United States Patent 7,691,997 (FUNCTIONAL AND HYPERFUNCTIONAL SIRNA) - sequence listing, part 35

SEQ ID NO: 1419810 - RNA, 19 nt, Homo sapiens
uuucuggucucaucuacga

SEQ ID NO: 1419811 - RNA, 19 nt, Homo sapiens
gaaugucugggcgagguaa

SEQ ID NO: 1419812 - RNA, 19 nt, Homo sapiens
gagcacgccaagcgcaaga

SEQ ID NO: 1419813 - RNA, 19 nt, Homo sapiens
caauauccaaggcauuaca

SEQ ID NO: 1419814 - RNA, 19 nt, Homo sapiens
uaggcgcugugauuucaga

SEQ ID NO: 1419815 - RNA, 19 nt, Homo sapiens
uccgugacgcggugacuua

SEQ ID NO: 1419816 - RNA, 19 nt, Homo sapiens
gcugugauuucagaauguc

SEQ ID NO: 1419817 - RNA, 19 nt, Homo sapiens
ucaacaaccugcauaauaa

SEQ ID NO: 1419818 - RNA, 19 nt, Homo sapiens
gcacaugacuuacacacaa

SEQ ID NO: 1419819 - RNA, 19 nt, Homo sapiens
gaaagaaaaucgugaauca

SEQ ID NO: 1419820 - RNA, 19 nt, Homo sapiens
caacauaguuccugcucuu

SEQ ID NO: 1419821 - RNA, 19 nt, Homo sapiens
agaaauagaccaugugaaa

SEQ ID NO: 1419822 - RNA, 19 nt, Homo sapiens
ccacguggcucacagaugu

SEQ ID NO: 1419823 - RNA, 19 nt, Homo sapiens
aagagaacaugcacagaua

SEQ ID NO: 1419824 - RNA, 19 nt, Homo sapiens
gaagagaacaugcacagau

SEQ ID NO: 1419825 - RNA, 19 nt, Homo sapiens
acaccuagaucaaggcuuu

SEQ ID NO: 1419826 - RNA, 19 nt, Homo sapiens
ggacagugguaugaaagaa

SEQ ID NO: 1419827 - RNA, 19 nt, Homo sapiens
gaacaccaucugccucuuu

SEQ ID NO: 1419828 - RNA, 19 nt, Homo sapiens
agaaguugcugcagaaguu

SEQ ID NO: 1419829 - RNA, 19 nt, Homo sapiens
cagcagaaguuuccguaga

SEQ ID NO: 1419830 - RNA, 19 nt, Homo sapiens
gaacucagcagaaauagac

SEQ ID NO: 1419831 - RNA, 19 nt, Homo sapiens
aaauugagccguuucauug

SEQ ID NO: 1419832 - RNA, 19 nt, Homo sapiens
caaauugagccguuucauu

SEQ ID NO: 1419833 - RNA, 19 nt, Homo sapiens
ugaaagagaggcauuccua

SEQ ID NO: 1419834 - RNA, 19 nt, Homo sapiens
gcacaacucaaaucucaga

SEQ ID NO: 1419835 - RNA, 19 nt, Homo sapiens
gcagaaauagaccauguga

SEQ ID NO: 1419836 - RNA, 19 nt, Homo sapiens
cagcagaaauagaccaugu

SEQ ID NO: 1419837 - RNA, 19 nt, Homo sapiens
ugagcuggcugcagaaguu

SEQ ID NO: 1419838 - RNA, 19 nt, Homo sapiens
gcagugcccauacuccaua

SEQ ID NO: 1419839 - RNA, 19 nt, Homo sapiens
gagaggcauuccuagagaa

SEQ ID NO: 1419840 - RNA, 19 nt, Homo sapiens
cgaagacauugaaagcauu

SEQ ID NO: 1419841 - RNA, 19 nt, Homo sapiens
gguggacagugguaugaaa

SEQ ID NO: 1419842 - RNA, 19 nt, Homo sapiens
caacaaccugcauaauaaa

SEQ ID NO: 1419843 - RNA, 19 nt, Homo sapiens
uugaaacucuaccuucuuu

SEQ ID NO: 1419844 - RNA, 19 nt, Homo sapiens
ucuguaagcccaucuguaa

SEQ ID NO: 1419845 - RNA, 19 nt, Homo sapiens
acacagagcuucauuuccu

SEQ ID NO: 1419846 - RNA, 19 nt, Homo sapiens
uaaaucaacaaccugcaua

SEQ ID NO: 1419847 - RNA, 19 nt, Homo sapiens
uaaaggcugucuccaaguc

SEQ ID NO: 1419848 - RNA, 19 nt, Homo sapiens
guauacugcacaugacuua

SEQ ID NO: 1419849 - RNA, 19 nt, Homo sapiens
guucauguuccucuuauuu

SEQ ID NO: 1419850 - RNA, 19 nt, Homo sapiens
gugauuggguuauucaaca

SEQ ID NO: 1419851 - RNA, 19 nt, Homo sapiens
gguagacaaugaacaacug

SEQ ID NO: 1419852 - RNA, 19 nt, Homo sapiens
aaacaccuuugugaaauug

SEQ ID NO: 1419853 - RNA, 19 nt, Homo sapiens
gugcauucauacucuguaa

SEQ ID NO: 1419854 - RNA, 19 nt, Homo sapiens
cugcagaaguugagaaauc

SEQ ID NO: 1419855 - RNA, 19 nt, Homo sapiens
gaucaacagccuccacaug

SEQ ID NO: 1419856 - RNA, 19 nt, Homo sapiens
ccuaaggguugaaacucua

SEQ ID NO: 1419857 - RNA, 19 nt, Homo sapiens
cuaaacaacaggaucacua

SEQ ID NO: 1419858 - RNA, 19 nt, Homo sapiens
aggcacaacucaaaucuca

SEQ ID NO: 1419859 - RNA, 19 nt, Homo sapiens
caacagcguaauucagauu

SEQ ID NO: 1419860 - RNA, 19 nt, Homo sapiens
gaagacauugaaagcauug

SEQ ID NO: 1419861 - RNA, 19 nt, Homo sapiens
caucuccuccugauaauga

SEQ ID NO: 1419862 - RNA, 19 nt, Homo sapiens
gacaaugaacaacugaauu

SEQ ID NO: 1419863 - RNA, 19 nt, Homo sapiens
cauaguuccugcucuuuua

SEQ ID NO: 1419864 - RNA, 19 nt, Homo sapiens
agagaggcauuccuagaga

SEQ ID NO: 1419865 - RNA, 19 nt, Homo sapiens
ggacgaagacauugaaagc

SEQ ID NO: 1419866 - RNA, 19 nt, Homo sapiens
gaaggaaagacuccaaagg

SEQ ID NO: 1419867 - RNA, 19 nt, Homo sapiens
ugugauggauuccuaagug

SEQ ID NO: 1419868 - RNA, 19 nt, Homo sapiens
agucucaacugccagcuuu

SEQ ID NO: 1419869 - RNA, 19 nt, Homo sapiens
ugacugugauuggguuauu

SEQ ID NO: 1419870 - RNA, 19 nt, Homo sapiens
aacucuaccuucuuucaua

SEQ ID NO: 1419871 - RNA, 19 nt, Homo sapiens
cuauccaauuuccuucuua

SEQ ID NO: 1419872 - RNA, 19 nt, Homo sapiens
gagcuucauuuccugucuu

SEQ ID NO: 1419873 - RNA, 19 nt, Homo sapiens
gcaauuuaccagacucuag

SEQ ID NO: 1419874 - RNA, 19 nt, Homo sapiens
cagcacugauucugagguu

SEQ ID NO: 1419875 - RNA, 19 nt, Homo sapiens
gguugaaacucuaccuucu

SEQ ID NO: 1419876 - RNA, 19 nt, Homo sapiens
ugacuucuccuuggaacua

SEQ ID NO: 1419877 - RNA, 19 nt, Homo sapiens
ccaccaaauugagccguuu

SEQ ID NO: 1419878 - RNA, 19 nt, Homo sapiens
acucuaccuucuuucauaa

SEQ ID NO: 1419879 - RNA, 19 nt, Homo sapiens
gcacacacacacacacaca

SEQ ID NO: 1419880 - RNA, 19 nt, Homo sapiens
caauuuaccagacucuaga

SEQ ID NO: 1419881 - RNA, 19 nt, Homo sapiens
gaauuuagaggacgaagac

SEQ ID NO: 1419882 - RNA, 19 nt, Homo sapiens
aaagagaggcauuccuaga

SEQ ID NO: 1419883 - RNA, 19 nt, Homo sapiens
ucagagacacuaaacaaca

SEQ ID NO: 1419884 - RNA, 19 nt, Homo sapiens
ccaauuuccuucuuaucgu

SEQ ID NO: 1419885 - RNA, 19 nt, Homo sapiens
augggaaggugauaucauu

SEQ ID NO: 1419886 - RNA, 19 nt, Homo sapiens
aucaacaaccugcauaaua

SEQ ID NO: 1419887 - RNA, 19 nt, Homo sapiens
ugucccagcugccauggaa

SEQ ID NO: 1419888 - RNA, 19 nt, Homo sapiens
aacuacauauggccaagua

SEQ ID NO: 1419889 - RNA, 19 nt, Homo sapiens
gacagugguaugaaagaaa

SEQ ID NO: 1419890 - RNA, 19 nt, Homo sapiens
ccaacucccuauguaaauc

SEQ ID NO: 1419891 - RNA, 19 nt, Homo sapiens
aaaacuccaugcuugguua

SEQ ID NO: 1419892 - RNA, 19 nt, Homo sapiens
ugugaugccucuaugaaag

SEQ ID NO: 1419893 - RNA, 19 nt, Homo sapiens
acacacagagcuucauuuc

SEQ ID NO: 1419894 - RNA, 19 nt, Homo sapiens
auucaucuccuccugauaa

SEQ ID NO: 1419895 - RNA, 19 nt, Homo sapiens
guuauucaacagcguaauu

SEQ ID NO: 1419896 - RNA, 19 nt, Homo sapiens
gcacugauucugagguucu

SEQ ID NO: 1419897 - RNA, 19 nt, Homo sapiens
gaaauagaccaugugaaaa

SEQ ID NO: 1419898 - RNA, 19 nt, Homo sapiens
ugacuuacacacaacauag

SEQ ID NO: 1419899 - RNA, 19 nt, Homo sapiens
uaucgugcauucauacucu

SEQ ID NO: 1419900 - RNA, 19 nt, Homo sapiens
uaaacaacaggaucacuag

SEQ ID NO: 1419901 - RNA, 19 nt, Homo sapiens
cagagacacuaaacaacag

SEQ ID NO: 1419902 - RNA, 19 nt, Homo sapiens
aggcauuccuagagaaaga

SEQ ID NO: 1419903 - RNA, 19 nt, Homo sapiens
acgaagacauugaaagcau

SEQ ID NO: 1419904 - RNA, 19 nt, Homo sapiens
cuagaucaaggcuuuaaga

SEQ ID NO: 1419905 - RNA, 19 nt, Homo sapiens
uuucucuucuuccuucuuu

SEQ ID NO: 1419906 - RNA, 19 nt, Homo sapiens
acacuaaacaacaggauca

SEQ ID NO: 1419907 - RNA, 19 nt, Homo sapiens
cucacucccuauccaauuu

SEQ ID NO: 1419908 - RNA, 19 nt, Homo sapiens
cugagguucugacacacua

SEQ ID NO: 1419909 - RNA, 19 nt, Homo sapiens
cuucauuuccugucuuaaa

SEQ ID NO: 1419910 - RNA, 19 nt, Homo sapiens
cagaaggaaagacuccaaa

SEQ ID NO: 1419911 - RNA, 19 nt, Homo sapiens
cuagaugacgagugggaua

SEQ ID NO: 1419912 - RNA, 19 nt, Homo sapiens
ucaacagccuccacauggu

SEQ ID NO: 1419913 - RNA, 19 nt, Homo sapiens
ggaacaccaucugccucuu

SEQ ID NO: 1419914 - RNA, 19 nt, Homo sapiens
guuuguauacugcacauga

SEQ ID NO: 1419915 - RNA, 19 nt, Homo sapiens
ucacuaggccugccaacca

SEQ ID NO: 1419916 - RNA, 19 nt, Homo sapiens
guggaaaauuguugaaaga

SEQ ID NO: 1419917 - RNA, 19 nt, Homo sapiens
cagcagagauggugaauaa

SEQ ID NO: 1419918 - RNA, 19 nt, Homo sapiens
gagaauaugugaaaggauu

SEQ ID NO: 1419919 - RNA, 19 nt, Homo sapiens
ggagaaagcugccacucuu

SEQ ID NO: 1419920 - RNA, 19 nt, Homo sapiens
gguaugagaugcuccuuaa

SEQ ID NO: 1419921 - RNA, 19 nt, Homo sapiens
gaaaugcuccgacuacaaa

SEQ ID NO: 1419922 - RNA, 19 nt, Homo sapiens
gcagcaagccauucuaaua

SEQ ID NO: 1419923 - RNA, 19 nt, Homo sapiens
ggaaacuacuccuagaauu

SEQ ID NO: 1419924 - RNA, 19 nt, Homo sapiens
caaccgacuugaccucuua

SEQ ID NO: 1419925 - RNA, 19 nt, Homo sapiens
ggacagauccucaaacuag

SEQ ID NO: 1419926 - RNA, 19 nt, Homo sapiens
gaauguaucugaagaagag

SEQ ID NO: 1419927 - RNA, 19 nt, Homo sapiens
auaaaugccuuccauagua

SEQ ID NO: 1419928 - RNA, 19 nt, Homo sapiens
caagauggauccgagauaa

SEQ ID NO: 1419929 - RNA, 19 nt, Homo sapiens
ugaaagagcuuaugucaac

SEQ ID NO: 1419930 - RNA, 19 nt, Homo sapiens
gaaccuaaaugcuccuaga

SEQ ID NO: 1419931 - RNA, 19 nt, Homo sapiens
ggaggcagcucauuaucaa

SEQ ID NO: 1419932 - RNA, 19 nt, Homo sapiens
ggacuggaaugaugcuaaa

SEQ ID NO: 1419933 - RNA, 19 nt, Homo sapiens
gaaaggauuugauaaugca

SEQ ID NO: 1419934 - RNA, 19 nt, Homo sapiens
gaagugacaauguguauga

SEQ ID NO: 1419935 - RNA, 19 nt, Homo sapiens
gaaagagucugcugugaac

SEQ ID NO: 1419936 - RNA, 19 nt, Homo sapiens
gcagcucauuaucaaauua

SEQ ID NO: 1419937 - RNA, 19 nt, Homo sapiens
cuacaggacuccaggcaua

SEQ ID NO: 1419938 - RNA, 19 nt, Homo sapiens
uaaaugccuuccauaguaa

SEQ ID NO: 1419939 - RNA, 19 nt, Homo sapiens
gaaacuacuccuagaauug

SEQ ID NO: 1419940 - RNA, 19 nt, Homo sapiens
ggaaaugcuucugacagua

SEQ ID NO: 1419941 - RNA, 19 nt, Homo sapiens
gaaggagacuaaugagcaa

SEQ ID NO: 1419942 - RNA, 19 nt, Homo sapiens
ggaaauugccuccugauuc

SEQ ID NO: 1419943 - RNA, 19 nt, Homo sapiens
gagacauccuucagaaauu

SEQ ID NO: 1419944 - RNA, 19 nt, Homo sapiens
ccucuuagaucagguauuu

SEQ ID NO: 1419945 - RNA, 19 nt, Homo sapiens
gcagcuuucuucaguauau

SEQ ID NO: 1419946 - RNA, 19 nt, Homo sapiens
gcacaagaacgcuaccuuu

SEQ ID NO: 1419947 - RNA, 19 nt, Homo sapiens
gaaauuggcaccauuccuu

SEQ ID NO: 1419948 - RNA, 19 nt, Homo sapiens
gaagaagaagacauuguaa

SEQ ID NO: 1419949 - RNA, 19 nt, Homo sapiens
gaaggaggcagcucauuau

SEQ ID NO: 1419950 - RNA, 19 nt, Homo sapiens
gugaggaacugaagcagaa

SEQ ID NO: 1419951 - RNA, 19 nt, Homo sapiens
gaaauugccuccugauucc

SEQ ID NO: 1419952 - RNA, 19 nt, Homo sapiens
gaaaaucugugggagcuua

SEQ ID NO: 1419953 - RNA, 19 nt, Homo sapiens
gaacaaaugaagggaguuu

SEQ ID NO: 1419954 - RNA, 19 nt, Homo sapiens
gauccgagauaaugaagug

SEQ ID NO: 1419955 - RNA, 19 nt, Homo sapiens
ggaaagcccucuggaacug

SEQ ID NO: 1419956 - RNA, 19 nt, Homo sapiens
gcagggaaaugaugcagau

SEQ ID NO: 1419957 - RNA, 19 nt, Homo sapiens
ugaaggaggcagcucauua

SEQ ID NO: 1419958 - RNA, 19 nt, Homo sapiens
guggauaugugguuuguug

SEQ ID NO: 1419959 - RNA, 19 nt, Homo sapiens
ggagacauccuucagaaau

SEQ ID NO: 1419960 - RNA, 19 nt, Homo sapiens
ucugaacccuugcuugaua

SEQ ID NO: 1419961 - RNA, 19 nt, Homo sapiens
gaagaaauucagaaacaga

SEQ ID NO: 1419962 - RNA, 19 nt, Homo sapiens
guggaggucucaggacuua

SEQ ID NO: 1419963 - RNA, 19 nt, Homo sapiens
agaaguaucuggaaacagu

SEQ ID NO: 1419964 - RNA, 19 nt, Homo sapiens
gugaaaggauuugauaaug

SEQ ID NO: 1419965 - RNA, 19 nt, Homo sapiens
uaaggacuaucuaaggaaa

SEQ ID NO: 1419966 - RNA, 19 nt, Homo sapiens
caccauuccuuaagaugua

SEQ ID NO: 1419967 - RNA, 19 nt, Homo sapiens
cauagugaauggagaaaga

SEQ ID NO: 1419968 - RNA, 19 nt, Homo sapiens
gacauucacucagagguuu

SEQ ID NO: 1419969 - RNA, 19 nt, Homo sapiens
gaacacuucagcacaagaa

SEQ ID NO: 1419970 - RNA, 19 nt, Homo sapiens
gagaaagcugccacucuua

SEQ ID NO: 1419971 - RNA, 19 nt, Homo sapiens
agaagaggcucagggagua

SEQ ID NO: 1419972 - RNA, 19 nt, Homo sapiens
aaauauaggcccauaaaug

SEQ ID NO: 1419973 - RNA, 19 nt, Homo sapiens
gacuugaccucuuagauca

SEQ ID NO: 1419974 - RNA, 19 nt, Homo sapiens
gcacauagugaauggagaa

SEQ ID NO: 1419975 - RNA, 19 nt, Homo sapiens
gcucagauacuucuauuca

SEQ ID NO: 1419976 - RNA, 19 nt, Homo sapiens
cauuacaccugcagaauuc

SEQ ID NO: 1419977 - RNA, 19 nt, Homo sapiens
ugaauaugauggugguaaa

SEQ ID NO: 1419978 - RNA, 19 nt, Homo sapiens
gcaagccauucuaauagug

SEQ ID NO: 1419979 - RNA, 19 nt, Homo sapiens
gguaucagaucucaucagu

SEQ ID NO: 1419980 - RNA, 19 nt, Homo sapiens
gauaaugaagugacaaugu

SEQ ID NO: 1419981 - RNA, 19 nt, Homo sapiens
aagaaaccaucgaugcuuu

SEQ ID NO: 1419982 - RNA, 19 nt, Homo sapiens
gagcuuaacuuugcagcau

SEQ ID NO: 1419983 - RNA, 19 nt, Homo sapiens
cagaaagcuugguguguga

SEQ ID NO: 1419984 - RNA, 19 nt, Homo sapiens
agaagaagaagacauugua

SEQ ID NO: 1419985 - RNA, 19 nt, Homo sapiens
gggagaagaagaagacauu

SEQ ID NO: 1419986 - RNA, 19 nt, Homo sapiens
gcaauggaccggguuaaug

SEQ ID NO: 1419987 - RNA, 19 nt, Homo sapiens
gagaaacgaaugcaagaau

SEQ ID NO: 1419988 - RNA, 19 nt, Homo sapiens
cagagucauucuaccgaua

SEQ ID NO: 1419989 - RNA, 19 nt, Homo sapiens
ggaaaugcuccgacuacaa

SEQ ID NO: 1419990 - RNA, 19 nt, Homo sapiens
gauaugugguuuguuggaa

SEQ ID NO: 1419991 - RNA, 19 nt, Homo sapiens
caaaauagccaaugaacuu

SEQ ID NO: 1419992 - RNA, 19 nt, Homo sapiens
gaaaugcuucugacaguag

SEQ ID NO: 1419993 - RNA, 19 nt, Homo sapiens
gaauucaccuucguccaau

SEQ ID NO: 1419994 - RNA, 19 nt, Homo sapiens
gagaauguaucugaagaag

SEQ ID NO: 1419995 - RNA, 19 nt, Homo sapiens
gcuagcacuuuauguugaa

SEQ ID NO: 1419996 - RNA, 19 nt, Homo sapiens
caaaucagugguugaagaa

SEQ ID NO: 1419997 - RNA, 19 nt, Homo sapiens
aaacaugacagaacguauu

SEQ ID NO: 1419998 - RNA, 19 nt, Homo sapiens
gggaaaugaugcagauaag

SEQ ID NO: 1419999 - RNA, 19 nt, Homo sapiens
gcuaugugguggaugaaau

SEQ ID NO: 1420000 - RNA, 19 nt, Homo sapiens
gguaggcucuaaauucaca

SEQ ID NO: 1420001 - RNA, 19 nt, Homo sapiens
guauggagaauaugugaaa

SEQ ID NO: 1420002 - RNA, 19 nt, Homo sapiens
ucagauacuucuauucaag

SEQ ID NO: 1420003 - RNA, 19 nt, Homo sapiens
gaaaugaugcagauaagac

SEQ ID NO: 1420004 - RNA, 19 nt, Homo sapiens
gugagaauguaucugaaga

SEQ ID NO: 1420005 - RNA, 19 nt, Homo sapiens
ggugguaaauugagcaaag

SEQ ID NO: 1420006 - RNA, 19 nt, Homo sapiens
gcauguggauaugugguuu

SEQ ID NO: 1420007 - RNA, 19 nt, Homo sapiens
ugaagaauauccacauacu

SEQ ID NO: 1420008 - RNA, 19 nt, Homo sapiens
caauaaaugccuuccauag

SEQ ID NO: 1420009 - RNA, 19 nt, Homo sapiens
gaauggagaaagagaugaa

SEQ ID NO: 1420010 - RNA, 19 nt, Homo sapiens
ccaguaagguaucagaucu

SEQ ID NO: 1420011 - RNA, 19 nt, Homo sapiens
ccaaggauggaggaaauua

SEQ ID NO: 1420012 - RNA, 19 nt, Homo sapiens
acuuacagcucaagacauu

SEQ ID NO: 1420013 - RNA, 19 nt, Homo sapiens
gugcagcuuucuucaguau

SEQ ID NO: 1420014 - RNA, 19 nt, Homo sapiens
gacaauguguaugaaaugu

SEQ ID NO: 1420015 - RNA, 19 nt, Homo sapiens
gugacaauguguaugaaau

SEQ ID NO: 1420016 - RNA, 19 nt, Homo sapiens
gaagaauauccacauacuu

SEQ ID NO: 1420017 - RNA, 19 nt, Homo sapiens
gaaaugagcuagcuuuaua

SEQ ID NO: 1420018 - RNA, 19 nt, Homo sapiens
ggaaggacauuguaaagua

SEQ ID NO: 1420019 - RNA, 19 nt, Homo sapiens
guaaagagcuauauacaug

SEQ ID NO: 1420020 - RNA, 19 nt, Homo sapiens
gauaagacaucgagccaua

SEQ ID NO: 1420021 - RNA, 19 nt, Homo sapiens
ggaaauauguguaacuugu

SEQ ID NO: 1420022 - RNA, 19 nt, Homo sapiens
gaaguaaucugcaaucucu

SEQ ID NO: 1420023 - RNA, 19 nt, Homo sapiens
gaaauguacuguagauguu

SEQ ID NO: 1420024 - RNA, 19 nt, Homo sapiens
ccagaggaauuguuaauaa

SEQ ID NO: 1420025 - RNA, 19 nt, Homo sapiens
acaaguaucuucaaacuga

SEQ ID NO: 1420026 - RNA, 19 nt, Homo sapiens
uaucaaagcuacccaaaga

SEQ ID NO: 1420027 - RNA, 19 nt, Homo sapiens
ugagagacuuuauucguua

SEQ ID NO: 1420028 - RNA, 19 nt, Homo sapiens
gaacauccuuccagaaagu

SEQ ID NO: 1420029 - RNA, 19 nt, Homo sapiens
gcaagaagccauaucgauu

SEQ ID NO: 1420030 - RNA, 19 nt, Homo sapiens
agacaaaccuuucaagugu

SEQ ID NO: 1420031 - RNA, 19 nt, Homo sapiens
gaaggacauuguaaaguau

SEQ ID NO: 1420032 - RNA, 19 nt, Homo sapiens
gggaggaccuauacccaua

SEQ ID NO: 1420033 - RNA, 19 nt, Homo sapiens
gacaauggguuuagggaaa

SEQ ID NO: 1420034 - RNA, 19 nt, Homo sapiens
gcauagagauaauagaaca

SEQ ID NO: 1420035 - RNA, 19 nt, Homo sapiens
ggaguacaguauguuaaua

SEQ ID NO: 1420036 - RNA, 19 nt, Homo sapiens
uagggaaaguugcacauua

SEQ ID NO: 1420037 - RNA, 19 nt, Homo sapiens
caaaagcacuguaaggaua

SEQ ID NO: 1420038 - RNA, 19 nt, Homo sapiens
ugagcuagcuuuauaacuu

SEQ ID NO: 1420039 - RNA, 19 nt, Homo sapiens
gcaccuucuuuaacaauaa

SEQ ID NO: 1420040 - RNA, 19 nt, Homo sapiens
ccucucagcucauauagaa

SEQ ID NO: 1420041 - RNA, 19 nt, Homo sapiens
guuaaagaguguugcagua

SEQ ID NO: 1420042 - RNA, 19 nt, Homo sapiens
gcuccuaccuucaaauaug

SEQ ID NO: 1420043 - RNA, 19 nt, Homo sapiens
agaccuugcuugaguauuu

SEQ ID NO: 1420044 - RNA, 19 nt, Homo sapiens
caagaagccauaucgauuu

SEQ ID NO: 1420045 - RNA, 19 nt, Homo sapiens
guaaggauauuugucuuga

SEQ ID NO: 1420046 - RNA, 19 nt, Homo sapiens
gagcuagcuuuauaacuug

SEQ ID NO: 1420047 - RNA, 19 nt, Homo sapiens
gaggacagcauaagcagua

SEQ ID NO: 1420048 - RNA, 19 nt, Homo sapiens
caacaugugcccuuacaaa

SEQ ID NO: 1420049 - RNA, 19 nt, Homo sapiens
gaacaaugccgcagaagag

SEQ ID NO: 1420050 - RNA, 19 nt, Homo sapiens
ccaaacauauacagaacaa

SEQ ID NO: 1420051 - RNA, 19 nt, Homo sapiens
ggaggaaauuaaagaacaa

SEQ ID NO: 1420052 - RNA, 19 nt, Homo sapiens
ggaaagguuguaaaguaua

SEQ ID NO: 1420053 - RNA, 19 nt, Homo sapiens
cuuaagcacuucaucaauu

SEQ ID NO: 1420054 - RNA, 19 nt, Homo sapiens
ggacuauguacuacuguua

SEQ ID NO: 1420055 - RNA, 19 nt, Homo sapiens
gauguagacagcacaauuu

SEQ ID NO: 1420056 - RNA, 19 nt, Homo sapiens
ucaaagcuacccaaagaua

SEQ ID NO: 1420057 - RNA, 19 nt, Homo sapiens
gaaugaaagugaacgacau

SEQ ID NO: 1420058 - RNA, 19 nt, Homo sapiens
ugacagugaucaagaaauc

SEQ ID NO: 1420059 - RNA, 19 nt, Homo sapiens
cauaagcaguacuauaaug

SEQ ID NO: 1420060 - RNA, 19 nt, Homo sapiens
caaagauacugccuugcuu

SEQ ID NO: 1420061 - RNA, 19 nt, Homo sapiens
agucaaaguugguuacaaa

SEQ ID NO: 1420062 - RNA, 19 nt, Homo sapiens
auggaaagguuguaaagua

SEQ ID NO: 1420063 - RNA, 19 nt, Homo sapiens
ggacaaggaagcacuacuu

SEQ ID NO: 1420064 - RNA, 19 nt, Homo sapiens
gagagacuuuauucguuaa

SEQ ID NO: 1420065 - RNA, 19 nt, Homo sapiens
cuagaggcaugaaaguuaa

SEQ ID NO: 1420066 - RNA, 19 nt, Homo sapiens
ggacuagggcuuucucaug

SEQ ID NO: 1420067 - RNA, 19 nt, Homo sapiens
cagcucauauagaaaguuu

SEQ ID NO: 1420068 - RNA, 19 nt, Homo sapiens
gugguuauaugcagugaaa

SEQ ID NO: 1420069 - RNA, 19 nt, Homo sapiens
agaagagguugaagaggua

SEQ ID NO: 1420070 - RNA, 19 nt, Homo sapiens
gauguugguuugauacugu

SEQ ID NO: 1420071 - RNA, 19 nt, Homo sapiens
cuggaaugguuguuuaaua

SEQ ID NO: 1420072 - RNA, 19 nt, Homo sapiens
uaaagaguguugcaguaug

SEQ ID NO: 1420073 - RNA, 19 nt, Homo sapiens
gcaguacuauaauggaugu

SEQ ID NO: 1420074 - RNA, 19 nt, Homo sapiens
gagacaaaccuuucaagug

SEQ ID NO: 1420075 - RNA, 19 nt, Homo sapiens
ucaaauaugacaccugaaa

SEQ ID NO: 1420076 - RNA, 19 nt, Homo sapiens
gaaaguugcacauuagagu

SEQ ID NO: 1420077 - RNA, 19 nt, Homo sapiens
gaacaaaaggaggaaauua

SEQ ID NO: 1420078 - RNA, 19 nt, Homo sapiens
guauauaacacuccaucua

SEQ ID NO: 1420079 - RNA, 19 nt, Homo sapiens
gagcacaguaaauaaguuu

SEQ ID NO: 1420080 - RNA, 19 nt, Homo sapiens
ucuagaggcaugaaaguua

SEQ ID NO: 1420081 - RNA, 19 nt, Homo sapiens
gaaagugaacgacaucagu

SEQ ID NO: 1420082 - RNA, 19 nt, Homo sapiens
ggggacaccugcagucuua

SEQ ID NO: 1420083 - RNA, 19 nt, Homo sapiens
ggauguagacagcacaauu

SEQ ID NO: 1420084 - RNA, 19 nt, Homo sapiens
uaaccucucagcucauaua

SEQ ID NO: 1420085 - RNA, 19 nt, Homo sapiens
uuaagcacuucaucaauug

SEQ ID NO: 1420086 - RNA, 19 nt, Homo sapiens
gaacaaaacacauugaaca

SEQ ID NO: 1420087 - RNA, 19 nt, Homo sapiens
cagcauaagcaguacuaua

SEQ ID NO: 1420088 - RNA, 19 nt, Homo sapiens
guacuauaauggauguaga

SEQ ID NO: 1420089 - RNA, 19 nt, Homo sapiens
gaagacauucugccugaug

SEQ ID NO: 1420090 - RNA, 19 nt, Homo sapiens
caaaagacgacgcucauua

SEQ ID NO: 1420091 - RNA, 19 nt, Homo sapiens
uggaaagguuguaaaguau

SEQ ID NO: 1420092 - RNA, 19 nt, Homo sapiens
gaucacauccguuccauac

SEQ ID NO: 1420093 - RNA, 19 nt, Homo sapiens
caaauguugcauagagaua

SEQ ID NO: 1420094 - RNA, 19 nt, Homo sapiens
acuaaucuguuaacgguuu

SEQ ID NO: 1420095 - RNA, 19 nt, Homo sapiens
acucuucgguggaauauau

SEQ ID NO: 1420096 - RNA, 19 nt, Homo sapiens
caucgagccauaugcuuua

SEQ ID NO: 1420097 - RNA, 19 nt, Homo sapiens
gccaaaggccaaagaagaa

SEQ ID NO: 1420098 - RNA, 19 nt, Homo sapiens
ucacauccguuccauacau

SEQ ID NO: 1420099 - RNA, 19 nt, Homo sapiens
gaaugguuguuuaauaagg

SEQ ID NO: 1420100 - RNA, 19 nt, Homo sapiens
agaauuauggcacucauuu

SEQ ID NO: 1420101 - RNA, 19 nt, Homo sapiens
guacuacuguuaauaucuc

SEQ ID NO: 1420102 - RNA, 19 nt, Homo sapiens
ggacucggaggacagcaua

SEQ ID NO: 1420103 - RNA, 19 nt, Homo sapiens
aaagaguguugcaguaugu

SEQ ID NO: 1420104 - RNA, 19 nt, Homo sapiens
caugugcccuuacaaauac

SEQ ID NO: 1420105 - RNA, 19 nt, Homo sapiens
gacacacaguggagacaaa

SEQ ID NO: 1420106 - RNA, 19 nt, Homo sapiens
gauuguagaccuugcuuga

SEQ ID NO: 1420107 - RNA, 19 nt, Homo sapiens
gaaguguuucagauacaua

SEQ ID NO: 1420108 - RNA, 19 nt, Homo sapiens
caaauagaaguguuucaga

SEQ ID NO: 1420109 - RNA, 19 nt, Homo sapiens
gcacugcuacuauaagaca

SEQ ID NO: 1420110 - RNA, 19 nt, Homo sapiens
gacaguguuuauugauuug

SEQ ID NO: 1420111 - RNA, 19 nt, Homo sapiens
guagaaauacuuagauguc

SEQ ID NO: 1420112 - RNA, 19 nt, Homo sapiens
gcacuucaucaauugcuuu

SEQ ID NO: 1420113 - RNA, 19 nt, Homo sapiens
agcauaagcaguacuauaa

SEQ ID NO: 1420114 - RNA, 19 nt, Homo sapiens
acaugugcccuuacaaaua

SEQ ID NO: 1420115 - RNA, 19 nt, Homo sapiens
uuucuucccuuuagugauu

SEQ ID NO: 1420116 - RNA, 19 nt, Homo sapiens
uuauggcacucauuucuga

SEQ ID NO: 1420117 - RNA, 19 nt, Homo sapiens
gaaauaaucuugccuuagu

SEQ ID NO: 1420118 - RNA, 19 nt, Homo sapiens
ucacagagcucccagcaua

SEQ ID NO: 1420119 - RNA, 19 nt, Homo sapiens
gcagaaauguguucauaga

SEQ ID NO: 1420120 - RNA, 19 nt, Homo sapiens
ucaagcagcuccuguauga

SEQ ID NO: 1420121 - RNA, 19 nt, Homo sapiens
gaugaaacauguaugauag

SEQ ID NO: 1420122 - RNA, 19 nt, Homo sapiens
gaaccaacauauccauuuc

SEQ ID NO: 1420123 - RNA, 19 nt, Homo sapiens
cagagucacugcucauuaa

SEQ ID NO: 1420124 - RNA, 19 nt, Homo sapiens
gauaagauacugcugauau

SEQ ID NO: 1420125 - RNA, 19 nt, Homo sapiens
ccacuguucuucuguugua

SEQ ID NO: 1420126 - RNA, 19 nt, Homo sapiens
ggaaauaaucuggcaaauu

SEQ ID NO: 1420127 - RNA, 19 nt, Homo sapiens
cagcgacacugugagauua

SEQ ID NO: 1420128 - RNA, 19 nt, Homo sapiens
gaccaauaaugaggaaaua

SEQ ID NO: 1420129 - RNA, 19 nt, Homo sapiens
uuacaaccaugccaaguuu

SEQ ID NO: 1420130 - RNA, 19 nt, Homo sapiens
acaacuguguggauauuua

SEQ ID NO: 1420131 - RNA, 19 nt, Homo sapiens
ggauaauucuccugaaauc

SEQ ID NO: 1420132 - RNA, 19 nt, Homo sapiens
ggaaccaacauauccauuu

SEQ ID NO: 1420133 - RNA, 19 nt, Homo sapiens
ccgaaccugugaaauguua

SEQ ID NO: 1420134 - RNA, 19 nt, Homo sapiens
guaaacaugcaucugauaa

SEQ ID NO: 1420135 - RNA, 19 nt, Homo sapiens
gugaggcugugaccaauaa

SEQ ID NO: 1420136 - RNA, 19 nt, Homo sapiens
gauggcaccugcauagaga

SEQ ID NO: 1420137 - RNA, 19 nt, Homo sapiens
agaaaugucugauguuaca

SEQ ID NO: 1420138 - RNA, 19 nt, Homo sapiens
caaugaggcuucuguuauc

SEQ ID NO: 1420139 - RNA, 19 nt, Homo sapiens
gacccuagauugugaagga

SEQ ID NO: 1420140 - RNA, 19 nt, Homo sapiens
aaacaugcaucugauaaga

SEQ ID NO: 1420141 - RNA, 19 nt, Homo sapiens
gauggauucuuucuguauu

SEQ ID NO: 1420142 - RNA, 19 nt, Homo sapiens
agaaauguguucauagaug

SEQ ID NO: 1420143 - RNA, 19 nt, Homo sapiens
ccagcaagccgacaaauga

SEQ ID NO: 1420144 - RNA, 19 nt, Homo sapiens
gguaaagaaugaagugauc

SEQ ID NO: 1420145 - RNA, 19 nt, Homo sapiens
cgacaacuguguggauauu

SEQ ID NO: 1420146 - RNA, 19 nt, Homo sapiens
caaccaugguagcaaauug

SEQ ID NO: 1420147 - RNA, 19 nt, Homo sapiens
uaccaacccugaagagauu

SEQ ID NO: 1420148 - RNA, 19 nt, Homo sapiens
gaacacagucacaggauca

SEQ ID NO: 1420149 - RNA, 19 nt, Homo sapiens
acaaagugcuguuauuuac

SEQ ID NO: 1420150 - RNA, 19 nt, Homo sapiens
cacaaagugcuguuauuua

SEQ ID NO: 1420151 - RNA, 19 nt, Homo sapiens
aacaagaacugccugaaga

SEQ ID NO: 1420152 - RNA, 19 nt, Homo sapiens
guaaagugccacaguauuc

SEQ ID NO: 1420153 - RNA, 19 nt, Homo sapiens
gggcagucuuguaguuuaa

SEQ ID NO: 1420154 - RNA, 19 nt, Homo sapiens
agagauugguuaugugaaa

SEQ ID NO: 1420155 - RNA, 19 nt, Homo sapiens
ccaaugaggcuucuguuau

SEQ ID NO: 1420156 - RNA, 19 nt, Homo sapiens
cugcguggauguuuccuua

SEQ ID NO: 1420157 - RNA, 19 nt, Homo sapiens
ccaaggagcugccucuacu

SEQ ID NO: 1420158 - RNA, 19 nt, Homo sapiens
ucacaaagugcuguuauuu

SEQ ID NO: 1420159 - RNA, 19 nt, Homo sapiens
ccugugaaauguuacguuu

SEQ ID NO: 1420160 - RNA, 19 nt, Homo sapiens
gcaaacgucaaccauggua

SEQ ID NO: 1420161 - RNA, 19 nt, Homo sapiens
acacaaacacagacaaauu

SEQ ID NO: 1420162 - RNA, 19 nt, Homo sapiens
uuagaguacugguaaagaa

SEQ ID NO: 1420163 - RNA, 19 nt, Homo sapiens
caaaagagauugguaaagu

SEQ ID NO: 1420164 - RNA, 19 nt, Homo sapiens
uaggauggauucuuucugu

SEQ ID NO: 1420165 - RNA, 19 nt, Homo sapiens
cagagaguaugacuauguu

SEQ ID NO: 1420166 - RNA, 19 nt, Homo sapiens
cgagcucccugaaccauug

SEQ ID NO: 1420167 - RNA, 19 nt, Homo sapiens
gccacaguauuccagauaa

SEQ ID NO: 1420168 - RNA, 19 nt, Homo sapiens
uugcagaaauguguucaua

SEQ ID NO: 1420169 - RNA, 19 nt, Homo sapiens
gcccgaaccugugaaaugu

SEQ ID NO: 1420170 - RNA, 19 nt, Homo sapiens
gaggugcacugccaauaag

SEQ ID NO: 1420171 - RNA, 19 nt, Homo sapiens
gaggaaauaaucuggcaaa

SEQ ID NO: 1420172 - RNA, 19 nt, Homo sapiens
gguagaaggaagaccauuu

SEQ ID NO: 1420173 - RNA, 19 nt, Homo sapiens
gaaaucaaacgggaacaga

SEQ ID NO: 1420174 - RNA, 19 nt, Homo sapiens
gcaucugggugauaucugu

SEQ ID NO: 1420175 - RNA, 19 nt, Homo sapiens
gccagacccuagauuguga

SEQ ID NO: 1420176 - RNA, 19 nt, Homo sapiens
gauucuuucuguauucuga

SEQ ID NO: 1420177 - RNA, 19 nt, Homo sapiens
gccaauaaguaucucuaau

SEQ ID NO: 1420178 - RNA, 19 nt, Homo sapiens
ccagagucacugcucauua

SEQ ID NO: 1420179 - RNA, 19 nt, Homo sapiens
ugaagaagaguccaagcua

SEQ ID NO: 1420180 - RNA, 19 nt, Homo sapiens
gaguacugguaaagaauga

SEQ ID NO: 1420181 - RNA, 19 nt, Homo sapiens
uuacguuugugcuucauuu

SEQ ID NO: 1420182 - RNA, 19 nt, Homo sapiens
ucuaaaagcuuaacaguuc

SEQ ID NO: 1420183 - RNA, 19 nt, Homo sapiens
aaacagggcagucuuguag

SEQ ID NO: 1420184 - RNA, 19 nt, Homo sapiens
uuccaaagguuccguggua

SEQ ID NO: 1420185 - RNA, 19 nt, Homo sapiens
gagcuucugucugcugcua

SEQ ID NO: 1420186 - RNA, 19 nt, Homo sapiens
ucagcugacuucccuguga

SEQ ID NO: 1420187 - RNA, 19 nt, Homo sapiens
cuagauacaugcaguaaaa

SEQ ID NO: 1420188 - RNA, 19 nt, Homo sapiens
cgucaaccaugguagcaaa

SEQ ID NO: 1420189 - RNA, 19 nt, Homo sapiens
cgaaggcuacuuucucaaa

SEQ ID NO: 1420190 - RNA, 19 nt, Homo sapiens
gcagcgacacugugagauu

SEQ ID NO: 1420191 - RNA, 19 nt, Homo sapiens
ugugaaauguuacguuugu

SEQ ID NO: 1420192 - RNA, 19 nt, Homo sapiens
cugcugauauucuaaacaa

SEQ ID NO: 1420193 - RNA, 19 nt, Homo sapiens
gaaggaagaccauuuuaug

SEQ ID NO: 1420194 - RNA, 19 nt, Homo sapiens
aaacuaggagaaugacuuu

SEQ ID NO: 1420195 - RNA, 19 nt, Homo sapiens
augauaggauggauucuuu

SEQ ID NO: 1420196 - RNA, 19 nt, Homo sapiens
cgucagagaauuuacuauu

SEQ ID NO: 1420197 - RNA, 19 nt, Homo sapiens
gguaaagugccacaguauu

SEQ ID NO: 1420198 - RNA, 19 nt, Homo sapiens
ggauggauucuuucuguau

SEQ ID NO: 1420199 - RNA, 19 nt, Homo sapiens
ccagagaguaugacuaugu

SEQ ID NO: 1420200 - RNA, 19 nt, Homo sapiens
caaagguuccgugguauga

SEQ ID NO: 1420201 - RNA, 19 nt, Homo sapiens
ugugaaauacuccaucuuu

SEQ ID NO: 1420202 - RNA, 19 nt, Homo sapiens
gcgcuuggauccucauuuu

SEQ ID NO: 1420203 - RNA, 19 nt, Homo sapiens
ugaaacauguaugauagga

SEQ ID NO: 1420204 - RNA, 19 nt, Homo sapiens
gaguaugacuauguuagau

SEQ ID NO: 1420205 - RNA, 19 nt, Homo sapiens
gcagcacgucagagaauuu

SEQ ID NO: 1420206 - RNA, 19 nt, Homo sapiens
cauagaugaugcugaaugg

SEQ ID NO: 1420207 - RNA, 19 nt, Homo sapiens
ccacauaacaugcauuugc

SEQ ID NO: 1420208 - RNA, 19 nt, Homo sapiens
agauacugcugauauucua

SEQ ID NO: 1420209 - RNA, 19 nt, Homo sapiens
gaaggcuacuuucucaaaa

SEQ ID NO: 1420210 - RNA, 19 nt, Homo sapiens
ugaggcuucuguuaucauu

SEQ ID NO: 1420211 - RNA, 19 nt, Homo sapiens
caagcucacagaaaucaaa

SEQ ID NO: 1420212 - RNA, 19 nt, Homo sapiens
guaccaacccugaagagau

SEQ ID NO: 1420213 - RNA, 19 nt, Homo sapiens
ggacguuggccaucagaau

SEQ ID NO: 1420214 - RNA, 19 nt, Homo sapiens
gagauugguuaugugaaau

SEQ ID NO: 1420215 - RNA, 19 nt, Homo sapiens
gaagaguccaagcuacaga

SEQ ID NO: 1420216 - RNA, 19 nt, Homo sapiens
gggcuaauuucaggauaau

SEQ ID NO: 1420217 - RNA, 19 nt, Homo sapiens
gaccaugacuuaccagaaa

SEQ ID NO: 1420218 - RNA, 19 nt, Homo sapiens
ggaagaagcuccgacuguu

SEQ ID NO: 1420219 - RNA, 19 nt, Homo sapiens
cagaggagccugucuauaa

SEQ ID NO: 1420220 - RNA, 19 nt, Homo sapiens
ggaggaagcugacuuacca

SEQ ID NO: 1420221 - RNA, 19 nt, Homo sapiens
ccagggcacucagaaauua

SEQ ID NO: 1420222 - RNA, 19 nt, Homo sapiens
gaagcugacuuaccaguuc

SEQ ID NO: 1420223 - RNA, 19 nt, Homo sapiens
ucaccaugauugcuaaaua

SEQ ID NO: 1420224 - RNA, 19 nt, Homo sapiens
gaucaagaauaucucaguu

SEQ ID NO: 1420225 - RNA, 19 nt, Homo sapiens
caagcugggucaagcauuu

SEQ ID NO: 1420226 - RNA, 19 nt, Homo sapiens
ggaaaucucuacaaguuuu

SEQ ID NO: 1420227 - RNA, 19 nt, Homo sapiens
ucggaaaucucuacaaguu

SEQ ID NO: 1420228 - RNA, 19 nt, Homo sapiens
gaucuucuauucacagugu

SEQ ID NO: 1420229 - RNA, 19 nt, Homo sapiens
gaagaagcuccgacuguuu

SEQ ID NO: 1420230 - RNA, 19 nt, Homo sapiens
gggaaauucugccaaugaa

SEQ ID NO: 1420231 - RNA, 19 nt, Homo sapiens
acaggaagaccaugacuua

SEQ ID NO: 1420232 - RNA, 19 nt, Homo sapiens
gaaauucugccaaugaaca

SEQ ID NO: 1420233 - RNA, 19 nt, Homo sapiens
ggaagaccaugacuuacca

SEQ ID NO: 1420234 - RNA, 19 nt, Homo sapiens
uaacagugcugcggacuuc

SEQ ID NO: 1420235 - RNA, 19 nt, Homo sapiens
ggagaacgguaauuaacag

SEQ ID NO: 1420236 - RNA, 19 nt, Homo sapiens
ccaauuaccaugagcuaaa

SEQ ID NO: 1420237 - RNA, 19 nt, Homo sapiens
caccaugauugcuaaauau

SEQ ID NO: 1420238 - RNA, 19 nt, Homo sapiens
ugacuuaccaguucaguga

SEQ ID NO: 1420239 - RNA, 19 nt, Homo sapiens
ugaaauaugacguguguug

SEQ ID NO: 1420240 - RNA, 19 nt, Homo sapiens
gaaauaugacguguguuga

SEQ ID NO: 1420241 - RNA, 19 nt, Homo sapiens
acucagaaauuacggaaga

SEQ ID NO: 1420242 - RNA, 19 nt, Homo sapiens
cagcugcuauggaguguug

SEQ ID NO: 1420243 - RNA, 19 nt, Homo sapiens
caucggaaaucucuacaag

SEQ ID NO: 1420244 - RNA, 19 nt, Homo sapiens
aaugaaauaugacgugugu

SEQ ID NO: 1420245 - RNA, 19 nt, Homo sapiens
gagccugucuauaauugga

SEQ ID NO: 1420246 - RNA, 19 nt, Homo sapiens
ucaaccugaucaagaauau

SEQ ID NO: 1420247 - RNA, 19 nt, Homo sapiens
agaggagccugucuauaau

SEQ ID NO: 1420248 - RNA, 19 nt, Homo sapiens
auacuaacuuguugggaaa

SEQ ID NO: 1420249 - RNA, 19 nt, Homo sapiens
caauuaccaugagcuaaau

SEQ ID NO: 1420250 - RNA, 19 nt, Homo sapiens
ggaagaaguggggaaauua

SEQ ID NO: 1420251 - RNA, 19 nt, Homo sapiens
caaagacucucuccauccu

SEQ ID NO: 1420252 - RNA, 19 nt, Homo sapiens
gugcugcggacuucuauuu

SEQ ID NO: 1420253 - RNA, 19 nt, Homo sapiens
cugcagaacauaacugaaa

SEQ ID NO: 1420254 - RNA, 19 nt, Homo sapiens
uguauucaguggguagaua

SEQ ID NO: 1420255 - RNA, 19 nt, Homo sapiens
cuucaguacucgccagauu

SEQ ID NO: 1420256 - RNA, 19 nt, Homo sapiens
gaggagccugucuauaauu

SEQ ID NO: 1420257 - RNA, 19 nt, Homo sapiens
ggaagcugacuuaccaguu

SEQ ID NO: 1420258 - RNA, 19 nt, Homo sapiens
ggaaauauucaucaaucuc

SEQ ID NO: 1420259 - RNA, 19 nt, Homo sapiens
agaaauuaccuggcuuuaa

SEQ ID NO: 1420260 - RNA, 19 nt, Homo sapiens
gcaaauacuaaagaggaaa

SEQ ID NO: 1420261 - RNA, 19 nt, Homo sapiens
ucacgaaucccuguauaau

SEQ ID NO: 1420262 - RNA, 19 nt, Homo sapiens
cuucacgaaucccuguaua

SEQ ID NO: 1420263 - RNA, 19 nt, Homo sapiens
uguucaaccugaucaagaa

SEQ ID NO: 1420264 - RNA, 19 nt, Homo sapiens
uuaccuggcuuuaaucaac

SEQ ID NO: 1420265 - RNA, 19 nt, Homo sapiens
cauauuucaugguuuacug

SEQ ID NO: 1420266 - RNA, 19 nt, Homo sapiens
gagaucuucuauucacagu

SEQ ID NO: 1420267 - RNA, 19 nt, Homo sapiens
guauucaguggguagauaa

SEQ ID NO: 1420268 - RNA, 19 nt, Homo sapiens
gaaauuccagcugcuaugg

SEQ ID NO: 1420269 - RNA, 19 nt, Homo sapiens
acauucaacuggagaucuu

SEQ ID NO: 1420270 - RNA, 19 nt, Homo sapiens
aagacucucuccauccuau

SEQ ID NO: 1420271 - RNA, 19 nt, Homo sapiens
guacucgccagauuacaga

SEQ ID NO: 1420272 - RNA, 19 nt, Homo sapiens
aaauaugacguguguugaa

SEQ ID NO: 1420273 - RNA, 19 nt, Homo sapiens
cuggagaucuucaguacuc

SEQ ID NO: 1420274 - RNA, 19 nt, Homo sapiens
ccaucguccucaugucaaa

SEQ ID NO: 1420275 - RNA, 19 nt, Homo sapiens
ugaagaugcuuuugagguu

SEQ ID NO: 1420276 - RNA, 19 nt, Homo sapiens
gccagggcacucagaaauu

SEQ ID NO: 1420277 - RNA, 19 nt, Homo sapiens
ggccagggcacucagaaau

SEQ ID NO: 1420278 - RNA, 19 nt, Homo sapiens
aagaagcuccgacuguuug

SEQ ID NO: 1420279 - RNA, 19 nt, Homo sapiens
uauaauuggagaacgguaa

SEQ ID NO: 1420280 - RNA, 19 nt, Homo sapiens
cagaaauuaccuggcuuua

SEQ ID NO: 1420281 - RNA, 19 nt, Homo sapiens
cauaugccaauuaccauga

SEQ ID NO: 1420282 - RNA, 19 nt, Homo sapiens
cgccagauuacagaaauua

SEQ ID NO: 1420283 - RNA, 19 nt, Homo sapiens
ccaguucagugaggccauu

SEQ ID NO: 1420284 - RNA, 19 nt, Homo sapiens
gagguucugaggcaacauu

SEQ ID NO: 1420285 - RNA, 19 nt, Homo sapiens
aggagccugucuauaauug

SEQ ID NO: 1420286 - RNA, 19 nt, Homo sapiens
ugggaaauucugccaauga

SEQ ID NO: 1420287 - RNA, 19 nt, Homo sapiens
acagaaauuaccuggcuuu

SEQ ID NO: 1420288 - RNA, 19 nt, Homo sapiens
uuccuccucugaagaaauu

SEQ ID NO: 1420289 - RNA, 19 nt, Homo sapiens
ugaggccauucuccaaaga

SEQ ID NO: 1420290 - RNA, 19 nt, Homo sapiens
gugaggccauucuccaaag

SEQ ID NO: 1420291 - RNA, 19 nt, Homo sapiens
agaaauuacggaagaagug

SEQ ID NO: 1420292 - RNA, 19 nt, Homo sapiens
guucugaggcaacauucaa

SEQ ID NO: 1420293 - RNA, 19 nt, Homo sapiens
acgaaucccuguauaaucc

SEQ ID NO: 1420294 - RNA, 19 nt, Homo sapiens
gacucucuccauccuauuu

SEQ ID NO: 1420295 - RNA, 19 nt, Homo sapiens
ggcaacaggaagaccauga

SEQ ID NO: 1420296 - RNA, 19 nt, Homo sapiens
caaucucugcagaacauaa

SEQ ID NO: 1420297 - RNA, 19 nt, Homo sapiens
aggcaucuuucaguuugua

SEQ ID NO: 1420298 - RNA, 19 nt, Homo sapiens
cggaaaucucuacaaguuu

SEQ ID NO: 1420299 - RNA, 19 nt, Homo sapiens
auacauaugccaauuacca

SEQ ID NO: 1420300 - RNA, 19 nt, Homo sapiens
caaccaucguccucauguc

SEQ ID NO: 1420301 - RNA, 19 nt, Homo sapiens
cggaagaaguggggaaauu

SEQ ID NO: 1420302 - RNA, 19 nt, Homo sapiens
ccucaugucaaaggaaauu

SEQ ID NO: 1420303 - RNA, 19 nt, Homo sapiens
agcaaauacuaaagaggaa

SEQ ID NO: 1420304 - RNA, 19 nt, Homo sapiens
guggggaaauuaccaaaau

SEQ ID NO: 1420305 - RNA, 19 nt, Homo sapiens
ccacucuucuccagcaaaa

SEQ ID NO: 1420306 - RNA, 19 nt, Homo sapiens
gcugcggacuucuauuuug

SEQ ID NO: 1420307 - RNA, 19 nt, Homo sapiens
cuaacuuguugggaaauuc

SEQ ID NO: 1420308 - RNA, 19 nt, Homo sapiens
uuacuggcaucggaaaucu

SEQ ID NO: 1420309 - RNA, 19 nt, Homo sapiens
caucuuucaguuuguauca

SEQ ID NO: 1420310 - RNA, 19 nt, Homo sapiens
aaucaaccaucguccucau

SEQ ID NO: 1420311 - RNA, 19 nt, Homo sapiens
ucgccagauuacagaaauu

SEQ ID NO: 1420312 - RNA, 19 nt, Homo sapiens
guguucaaccugaucaaga

SEQ ID NO: 1420313 - RNA, 19 nt, Homo sapiens
ucaaccaucguccucaugu

SEQ ID NO: 1420314 - RNA, 19 nt, Homo sapiens
guggguagauaaaaccaaa

SEQ ID NO: 1420315 - RNA, 19 nt, Homo sapiens
guaauguucuucuucuuug

SEQ ID NO: 1420316 - RNA, 19 nt, Homo sapiens
gaacaagauuuccuuuggu

SEQ ID NO: 1420317 - RNA, 19 nt, Homo sapiens
gagaaagacaguaauaguu

SEQ ID NO: 1420318 - RNA, 19 nt, Homo sapiens
gcagaaggucuccuacuuu

SEQ ID NO: 1420319 - RNA, 19 nt, Homo sapiens
ucucagggcuucucaucua

SEQ ID NO: 1420320 - RNA, 19 nt, Homo sapiens
ugacucaguucaaguaguu

SEQ ID NO: 1420321 - RNA, 19 nt, Homo sapiens
ggaacaggaaccaauaauu

SEQ ID NO: 1420322 - RNA, 19 nt, Homo sapiens
gaaagacaguaauaguucu

SEQ ID NO: 1420323 - RNA, 19 nt, Homo sapiens
cagaaggucuccuacuuuc

SEQ ID NO: 1420324 - RNA, 19 nt, Homo sapiens
ccagucaagugucuacauu

SEQ ID NO: 1420325 - RNA, 19 nt, Homo sapiens
ggagaaagacaguaauagu

SEQ ID NO: 1420326 - RNA, 19 nt, Homo sapiens
cagccuacaucuucaauag

SEQ ID NO: 1420327 - RNA, 19 nt, Homo sapiens
ucaggucccuuaauaugga

SEQ ID NO: 1420328 - RNA, 19 nt, Homo sapiens
agaacaagauuuccuuugg

SEQ ID NO: 1420329 - RNA, 19 nt, Homo sapiens
gagcaugugucucucuuuu

SEQ ID NO: 1420330 - RNA, 19 nt, Homo sapiens
gugucuacauuucugauuu

SEQ ID NO: 1420331 - RNA, 19 nt, Homo sapiens
ccuauucccugguggauuc

SEQ ID NO: 1420332 - RNA, 19 nt, Homo sapiens
aguuucaggucccuuaaua

SEQ ID NO: 1420333 - RNA, 19 nt, Homo sapiens
cuacauuucugauuuccau

SEQ ID NO: 1420334 - RNA, 19 nt, Homo sapiens
aaacuggucuucccaagcu

SEQ ID NO: 1420335 - RNA, 19 nt, Homo sapiens
cugcugaguugcugucauu

SEQ ID NO: 1420336 - RNA, 19 nt, Homo sapiens
cagcaguucuugcaacgau

SEQ ID NO: 1420337 - RNA, 19 nt, Homo sapiens
agaaagacaguaauaguuc

SEQ ID NO: 1420338 - RNA, 19 nt, Homo sapiens
ucaagugucuacauuucug

SEQ ID NO: 1420339 - RNA, 19 nt, Homo sapiens
gguaguuucaggucccuua

SEQ ID NO: 1420340 - RNA, 19 nt, Homo sapiens
aacaagauuuccuuugguu

SEQ ID NO: 1420341 - RNA, 19 nt, Homo sapiens
gauguggucugagccuuuc

SEQ ID NO: 1420342 - RNA, 19 nt, Homo sapiens
ccucaucggauacuuugua

SEQ ID NO: 1420343 - RNA, 19 nt, Homo sapiens
cguuaugccuggucuccua

SEQ ID NO: 1420344 - RNA, 19 nt, Homo sapiens
gcagccacuucuccauguu

SEQ ID NO: 1420345 - RNA, 19 nt, Homo sapiens
ucacgauggccuauuuaaa

SEQ ID NO: 1420346 - RNA, 19 nt, Homo sapiens
ugcagaaggucuccuacuu

SEQ ID NO: 1420347 - RNA, 19 nt, Homo sapiens
gccuacaucuucaauagca

SEQ ID NO: 1420348 - RNA, 19 nt, Homo sapiens
gugccaguauuuaacaaga

SEQ ID NO: 1420349 - RNA, 19 nt, Homo sapiens
ggauguggucugagccuuu

SEQ ID NO: 1420350 - RNA, 19 nt, Homo sapiens
agucaagugucuacauuuc

SEQ ID NO: 1420351 - RNA, 19 nt, Homo sapiens
aacgauagcuuuugcuuuu

SEQ ID NO: 1420352 - RNA, 19 nt, Homo sapiens
aaggagaaagacaguaaua

SEQ ID NO: 1420353 - RNA, 19 nt, Homo sapiens
cacgauggccuauuuaaag

SEQ ID NO: 1420354 - RNA, 19 nt, Homo sapiens
gggcaucggagacaucguu

SEQ ID NO: 1420355 - RNA, 19 nt, Homo sapiens
gcaacgucauggugaaggu

SEQ ID NO: 1420356 - RNA, 19 nt, Homo sapiens
gggagcaugugucucucuu

SEQ ID NO: 1420357 - RNA, 19 nt, Homo sapiens
auaaggagaaagacaguaa

SEQ ID NO: 1420358 - RNA, 19 nt, Homo sapiens
ggugccauuuacuuuauug

SEQ ID NO: 1420359 - RNA, 19 nt, Homo sapiens
gcaugcagaaggucuccua

SEQ ID NO: 1420360 - RNA, 19 nt, Homo sapiens
caucggagacaucguuaug

SEQ ID NO: 1420361 - RNA, 19 nt, Homo sapiens
ggcagccacuucuccaugu

SEQ ID NO: 1420362 - RNA, 19 nt, Homo sapiens
caaggucuccugccugcuu

SEQ ID NO: 1420363 - RNA, 19 nt, Homo sapiens
caagauaaggagaaagaca

SEQ ID NO: 1420364 - RNA, 19 nt, Homo sapiens
gcuuuguccuucgcuauga

SEQ ID NO: 1420365 - RNA, 19 nt, Homo sapiens
gauaaggagaaagacagua

SEQ ID NO: 1420366 - RNA, 19 nt, Homo sapiens
uuucacugcugcugaguug

SEQ ID NO: 1420367 - RNA, 19 nt, Homo sapiens
ccgaugugccaguauuuaa

SEQ ID NO: 1420368 - RNA, 19 nt, Homo sapiens
gcaugugucucucuuuuag

SEQ ID NO: 1420369 - RNA, 19 nt, Homo sapiens
cccuuaauauggacuuuga

SEQ ID NO: 1420370 - RNA, 19 nt, Homo sapiens
ccauucuucuuauagucua

SEQ ID NO: 1420371 - RNA, 19 nt, Homo sapiens
gaaggucuccuacuuucac

SEQ ID NO: 1420372 - RNA, 19 nt, Homo sapiens
cagaacaagauuuccuuug

SEQ ID NO: 1420373 - RNA, 19 nt, Homo sapiens
cugauuuccauucuucuua

SEQ ID NO: 1420374 - RNA, 19 nt, Homo sapiens
gccugucucugccuggaaa

SEQ ID NO: 1420375 - RNA, 19 nt, Homo sapiens
ggauuccagucaagugucu

SEQ ID NO: 1420376 - RNA, 19 nt, Homo sapiens
uuucugauuuccauucuuc

SEQ ID NO: 1420377 - RNA, 19 nt, Homo sapiens
ugucuacauuucugauuuc

SEQ ID NO: 1420378 - RNA, 19 nt, Homo sapiens
gcucaccucagaacaagau

SEQ ID NO: 1420379 - RNA, 19 nt, Homo sapiens
gaugugccaguauuuaaca

SEQ ID NO: 1420380 - RNA, 19 nt, Homo sapiens
gggaacaggaaccaauaau

SEQ ID NO: 1420381 - RNA, 19 nt, Homo sapiens
ucagaacaagauuuccuuu

SEQ ID NO: 1420382 - RNA, 19 nt, Homo sapiens
ggagcaugugucucucuuu

SEQ ID NO: 1420383 - RNA, 19 nt, Homo sapiens
gggcucgguuccuuccaau

SEQ ID NO: 1420384 - RNA, 19 nt, Homo sapiens
acugcacccucaucggaua

SEQ ID NO: 1420385 - RNA, 19 nt, Homo sapiens
uaugaugucuuuuggguau

SEQ ID NO: 1420386 - RNA, 19 nt, Homo sapiens
agacccugcucaccucaga

SEQ ID NO: 1420387 - RNA, 19 nt, Homo sapiens
uuucaggucccuuaauaug

SEQ ID NO: 1420388 - RNA, 19 nt, Homo sapiens
uggugaagguggccacuca

SEQ ID NO: 1420389 - RNA, 19 nt, Homo sapiens
guccucaucuggguucuca

SEQ ID NO: 1420390 - RNA, 19 nt, Homo sapiens
ggucuccuacuaugcuuug

SEQ ID NO: 1420391 - RNA, 19 nt, Homo sapiens
uuucucagccuacaucuuc

SEQ ID NO: 1420392 - RNA, 19 nt, Homo sapiens
gcaguucuugcaacgauag

SEQ ID NO: 1420393 - RNA, 19 nt, Homo sapiens
cuucuucuuugacucaguu

SEQ ID NO: 1420394 - RNA, 19 nt, Homo sapiens
gcucgguuccuuccaaugg

SEQ ID NO: 1420395 - RNA, 19 nt, Homo sapiens
ccucacgauggccuauuua

SEQ ID NO: 1420396 - RNA, 19 nt, Homo sapiens
uuggugccauuuacuuuau

SEQ ID NO: 1420397 - RNA, 19 nt, Homo sapiens
ucuauuuggugccauuuac

SEQ ID NO: 1420398 - RNA, 19 nt, Homo sapiens
guaguuucaggucccuuaa

SEQ ID NO: 1420399 - RNA, 19 nt, Homo sapiens
ccaaugggagcaugugucu

SEQ ID NO: 1420400 - RNA, 19 nt, Homo sapiens
ugccuggucuccuacuaug

SEQ ID NO: 1420401 - RNA, 19 nt, Homo sapiens
uccucacgauggccuauuu

SEQ ID NO: 1420402 - RNA, 19 nt, Homo sapiens
uuuggugccauuuacuuua

SEQ ID NO: 1420403 - RNA, 19 nt, Homo sapiens
guaggccugcucacugcua

SEQ ID NO: 1420404 - RNA, 19 nt, Homo sapiens
gcacccucaucggauacuu

SEQ ID NO: 1420405 - RNA, 19 nt, Homo sapiens
auagcaacgucauggugaa

SEQ ID NO: 1420406 - RNA, 19 nt, Homo sapiens
caagugucuacauuucuga

SEQ ID NO: 1420407 - RNA, 19 nt, Homo sapiens
cagucaagugucuacauuu

SEQ ID NO: 1420408 - RNA, 19 nt, Homo sapiens
ggcaucggagacaucguua

SEQ ID NO: 1420409 - RNA, 19 nt, Homo sapiens
gguucucacuggccauugg

SEQ ID NO: 1420410 - RNA, 19 nt, Homo sapiens
ucaccucagaacaagauuu

SEQ ID NO: 1420411 - RNA, 19 nt, Homo sapiens
agaaagcgguucccauuua

SEQ ID NO: 1420412 - RNA, 19 nt, Homo sapiens
ggauaaggaugauguaaca

SEQ ID NO: 1420413 - RNA, 19 nt, Homo sapiens
ccacagaaguccagcgaaa

SEQ ID NO: 1420414 - RNA, 19 nt, Homo sapiens
cgaagaaacugaggacuga

SEQ ID NO: 1420415 - RNA, 19 nt, Homo sapiens
gaaggcgucugcuacaaga

SEQ ID NO: 1420416 - RNA, 19 nt, Homo sapiens
caagaaagcgguucccauu

SEQ ID NO: 1420417 - RNA, 19 nt, Homo sapiens
gauguaacagggacaauaa

SEQ ID NO: 1420418 - RNA, 19 nt, Homo sapiens
gaaagcgguucccauuuac

SEQ ID NO: 1420419 - RNA, 19 nt, Homo sapiens
caggagagcaggaaagaaa

SEQ ID NO: 1420420 - RNA, 19 nt, Homo sapiens
guggagauugucagaauua

SEQ ID NO: 1420421 - RNA, 19 nt, Homo sapiens
uaacagggacaauaacaga

SEQ ID NO: 1420422 - RNA, 19 nt, Homo sapiens
ggaaugaccacccaaagag

SEQ ID NO: 1420423 - RNA, 19 nt, Homo sapiens
gaugaagagugacgaggau

SEQ ID NO: 1420424 - RNA, 19 nt, Homo sapiens
ugacugagacgcaugaaga

SEQ ID NO: 1420425 - RNA, 19 nt, Homo sapiens
gcugggcccucgaugaaga

SEQ ID NO: 1420426 - RNA, 19 nt, Homo sapiens
cguguucucugccuugauu

SEQ ID NO: 1420427 - RNA, 19 nt, Homo sapiens
ugucagaauuauccaaaug

SEQ ID NO: 1420428 - RNA, 19 nt, Homo sapiens
gaagaaguggagauuguca

SEQ ID NO: 1420429 - RNA, 19 nt, Homo sapiens
ggcccucgaugaagaguga

SEQ ID NO: 1420430 - RNA, 19 nt, Homo sapiens
ccauuuacauccacguguu

SEQ ID NO: 1420431 - RNA, 19 nt, Homo sapiens
gaaugaccacccaaagaga

SEQ ID NO: 1420432 - RNA, 19 nt, Homo sapiens
uaacagaagccgaagaaac

SEQ ID NO: 1420433 - RNA, 19 nt, Homo sapiens
gaaacugaggacugacuga

SEQ ID NO: 1420434 - RNA, 19 nt, Homo sapiens
ucugucagcugcagcaaug

SEQ ID NO: 1420435 - RNA, 19 nt, Homo sapiens
gaggauaaggaugauguaa

SEQ ID NO: 1420436 - RNA, 19 nt, Homo sapiens
uguaugacauuugugacua

SEQ ID NO: 1420437 - RNA, 19 nt, Homo sapiens
ugugugauguuccucugua

SEQ ID NO: 1420438 - RNA, 19 nt, Homo sapiens
gcaugaagaaguggagauu

SEQ ID NO: 1420439 - RNA, 19 nt, Homo sapiens
ugagacgcaugaagaagug

SEQ ID NO: 1420440 - RNA, 19 nt, Homo sapiens
uggaauacgugcuggaagu

SEQ ID NO: 1420441 - RNA, 19 nt, Homo sapiens
gugauguuccucuguauga

SEQ ID NO: 1420442 - RNA, 19 nt, Homo sapiens
ugaagagugacgaggauaa

SEQ ID NO: 1420443 - RNA, 19 nt, Homo sapiens
caucaucuacagagucauu

SEQ ID NO: 1420444 - RNA, 19 nt, Homo sapiens
gauggaaugaccacccaaa

SEQ ID NO: 1420445 - RNA, 19 nt, Homo sapiens
aaguggagauugucagaau

SEQ ID NO: 1420446 - RNA, 19 nt, Homo sapiens
aauaacagaagccgaagaa

SEQ ID NO: 1420447 - RNA, 19 nt, Homo sapiens
uuaacagugugauggaaug

SEQ ID NO: 1420448 - RNA, 19 nt, Homo sapiens
augaagaaguggagauugu

SEQ ID NO: 1420449 - RNA, 19 nt, Homo sapiens
gugcugggcccucgaugaa

SEQ ID NO: 1420450 - RNA, 19 nt, Homo sapiens
cagcugcagcaauggaaua

SEQ ID NO: 1420451 - RNA, 19 nt, Homo sapiens
gaauacgugcuggaaguga

SEQ ID NO: 1420452 - RNA, 19 nt, Homo sapiens
gaaguggagauugucagaa

SEQ ID NO: 1420453 - RNA, 19 nt, Homo sapiens
ugauguaacagggacaaua

SEQ ID NO: 1420454 - RNA, 19 nt, Homo sapiens
gaagagugacgaggauaag

SEQ ID NO: 1420455 - RNA, 19 nt, Homo sapiens
gagcucgggugcugcuucu

SEQ ID NO: 1420456 - RNA, 19 nt, Homo sapiens
gagauugucagaauuaucc

SEQ ID NO: 1420457 - RNA, 19 nt, Homo sapiens
gugacgaggauaaggauga

SEQ ID NO: 1420458 - RNA, 19 nt, Homo sapiens
aagaaagcgguucccauuu

SEQ ID NO: 1420459 - RNA, 19 nt, Homo sapiens
guaugacauuugugacuac

SEQ ID NO: 1420460 - RNA, 19 nt, Homo sapiens
uggaaugaccacccaaaga

SEQ ID NO: 1420461 - RNA, 19 nt, Homo sapiens
gucagaauuauccaaauga

SEQ ID NO: 1420462 - RNA, 19 nt, Homo sapiens
aauacgugcuggaagugaa

SEQ ID NO: 1420463 - RNA, 19 nt, Homo sapiens
ggagauugucagaauuauc

SEQ ID NO: 1420464 - RNA, 19 nt, Homo sapiens
guuccucuguaugacauuu

SEQ ID NO: 1420465 - RNA, 19 nt, Homo sapiens
ggaauacgugcuggaagug

SEQ ID NO: 1420466 - RNA, 19 nt, Homo sapiens
ugacgaggauaaggaugau

SEQ ID NO: 1420467 - RNA, 19 nt, Homo sapiens
ggcaccuccugaagcaauu

SEQ ID NO: 1420468 - RNA, 19 nt, Homo sapiens
gacugagacgcaugaagaa

SEQ ID NO: 1420469 - RNA, 19 nt, Homo sapiens
cagaagccgaagaaacuga

SEQ ID NO: 1420470 - RNA, 19 nt, Homo sapiens
aacagaagccgaagaaacu

SEQ ID NO: 1420471 - RNA, 19 nt, Homo sapiens
uaacagugugauggaauga

SEQ ID NO: 1420472 - RNA, 19 nt, Homo sapiens
cgaggauaaggaugaugua

SEQ ID NO: 1420473 - RNA, 19 nt, Homo sapiens
cgaaggcgucugcuacaag

SEQ ID NO: 1420474 - RNA, 19 nt, Homo sapiens
aguggagauugucagaauu

SEQ ID NO: 1420475 - RNA, 19 nt, Homo sapiens
gauguuccucuguaugaca

SEQ ID NO: 1420476 - RNA, 19 nt, Homo sapiens
caauaacagaagccgaaga

SEQ ID NO: 1420477 - RNA, 19 nt, Homo sapiens
ucaccaucaucuacagagu

SEQ ID NO: 1420478 - RNA, 19 nt, Homo sapiens
gaacuagacugcuuugaga

SEQ ID NO: 1420479 - RNA, 19 nt, Homo sapiens
gauauucccuugcaaguaa

SEQ ID NO: 1420480 - RNA, 19 nt, Homo sapiens
guacauggcuuagauaaau

SEQ ID NO: 1420481 - RNA, 19 nt, Homo sapiens
uaagccagcugaucuagua

SEQ ID NO: 1420482 - RNA, 19 nt, Homo sapiens
ucaagaagguucaccauga

SEQ ID NO: 1420483 - RNA, 19 nt, Homo sapiens
guuaacaucuuacaacuga

SEQ ID NO: 1420484 - RNA, 19 nt, Homo sapiens
gaaagauuccgccugcuua

SEQ ID NO: 1420485 - RNA, 19 nt, Homo sapiens
gaagauaaacaccucauug

SEQ ID NO: 1420486 - RNA, 19 nt, Homo sapiens
gaucgggucuggcuccuuu

SEQ ID NO: 1420487 - RNA, 19 nt, Homo sapiens
gcaaauuguucacauaaag

SEQ ID NO: 1420488 - RNA, 19 nt, Homo sapiens
caauaugacuacacauuug

SEQ ID NO: 1420489 - RNA, 19 nt, Homo sapiens
gagaaacccucgcaaacug

SEQ ID NO: 1420490 - RNA, 19 nt, Homo sapiens
caaagguuguaaaugcuua

SEQ ID NO: 1420491 - RNA, 19 nt, Homo sapiens
gcacugguauggucaggaa

SEQ ID NO: 1420492 - RNA, 19 nt, Homo sapiens
gagaugacauggaauccuu

SEQ ID NO: 1420493 - RNA, 19 nt, Homo sapiens
guaaacaccuauaugaucu

SEQ ID NO: 1420494 - RNA, 19 nt, Homo sapiens
uggcugagguggaggaaua

SEQ ID NO: 1420495 - RNA, 19 nt, Homo sapiens
guacugggcgucacuguaa

SEQ ID NO: 1420496 - RNA, 19 nt, Homo sapiens
gggcgucacuguaauaagu

SEQ ID NO: 1420497 - RNA, 19 nt, Homo sapiens
gagcguuggugaugcugua

SEQ ID NO: 1420498 - RNA, 19 nt, Homo sapiens
gagcccagccuccaucuuu

SEQ ID NO: 1420499 - RNA, 19 nt, Homo sapiens
uugaggaagucccagauua

SEQ ID NO: 1420500 - RNA, 19 nt, Homo sapiens
cagugaagcuggaaucuca

SEQ ID NO: 1420501 - RNA, 19 nt, Homo sapiens
ccaauaugacuacacauuu

SEQ ID NO: 1420502 - RNA, 19 nt, Homo sapiens
cagaugaucagcagaauug

SEQ ID NO: 1420503 - RNA, 19 nt, Homo sapiens
guauguacauggcuuagau

SEQ ID NO: 1420504 - RNA, 19 nt, Homo sapiens
caaaguguagccucuguaa

SEQ ID NO: 1420505 - RNA, 19 nt, Homo sapiens
ggaagucccagauuacaug

SEQ ID NO: 1420506 - RNA, 19 nt, Homo sapiens
gacuaaaggcuaugacaaa

SEQ ID NO: 1420507 - RNA, 19 nt, Homo sapiens
uugaauacgugcauacaaa

SEQ ID NO: 1420508 - RNA, 19 nt, Homo sapiens
gagcaaacucuacacgauu

SEQ ID NO: 1420509 - RNA, 19 nt, Homo sapiens
gcuuaccugugaagacaua

SEQ ID NO: 1420510 - RNA, 19 nt, Homo sapiens
ggacgauguuaaagcagaa

SEQ ID NO: 1420511 - RNA, 19 nt, Homo sapiens
gcuuugagauaucauuuca

SEQ ID NO: 1420512 - RNA, 19 nt, Homo sapiens
aaagauaacuaagcgugaa

SEQ ID NO: 1420513 - RNA, 19 nt, Homo sapiens
ccaccaauaugacuacaca

SEQ ID NO: 1420514 - RNA, 19 nt, Homo sapiens
ggacuaaaggcuaugacaa

SEQ ID NO: 1420515 - RNA, 19 nt, Homo sapiens
caaugcacaucuugguauu

SEQ ID NO: 1420516 - RNA, 19 nt, Homo sapiens
uaacugagguagugaaacg

SEQ ID NO: 1420517 - RNA, 19 nt, Homo sapiens
gaagaagcagagcagauga

SEQ ID NO: 1420518 - RNA, 19 nt, Homo sapiens
aauauuaacugagguagug

SEQ ID NO: 1420519 - RNA, 19 nt, Homo sapiens
ggcaaggacuaaaggcuau

SEQ ID NO: 1420520 - RNA, 19 nt, Homo sapiens
acacauaccguacagagaa

SEQ ID NO: 1420521 - RNA, 19 nt, Homo sapiens
caacuucgagccauuuguu

SEQ ID NO: 1420522 - RNA, 19 nt, Homo sapiens
uaaaaugguuggcuucuug

SEQ ID NO: 1420523 - RNA, 19 nt, Homo sapiens
aaugggagcuuuuauguuu

SEQ ID NO: 1420524 - RNA, 19 nt, Homo sapiens
gccagcugaucuaguagua

SEQ ID NO: 1420525 - RNA, 19 nt, Homo sapiens
cugcaaagguuguaaaugc

SEQ ID NO: 1420526 - RNA, 19 nt, Homo sapiens
cugcagaauucgccaugua

SEQ ID NO: 1420527 - RNA, 19 nt, Homo sapiens
uauaucauguucucgguau

SEQ ID NO: 1420528 - RNA, 19 nt, Homo sapiens
caugaaaacuguacuuaug

SEQ ID NO: 1420529 - RNA, 19 nt, Homo sapiens
caaguucacuaaaaucuga

SEQ ID NO: 1420530 - RNA, 19 nt, Homo sapiens
ccucuguaauugugaauau

SEQ ID NO: 1420531 - RNA, 19 nt, Homo sapiens
aaguguagccucuguaauu

SEQ ID NO: 1420532 - RNA, 19 nt, Homo sapiens
gcgaggaaguagcagugaa

SEQ ID NO: 1420533 - RNA, 19 nt, Homo sapiens
cugauucacuaggaaauaa

SEQ ID NO: 1420534 - RNA, 19 nt, Homo sapiens
gguuguaaaugcuuaugau

SEQ ID NO: 1420535 - RNA, 19 nt, Homo sapiens
gaugcuguaucccaaagug

SEQ ID NO: 1420536 - RNA, 19 nt, Homo sapiens
ugaaugaggaacagaagaa

SEQ ID NO: 1420537 - RNA, 19 nt, Homo sapiens
gaauacgugcauacaaaga

SEQ ID NO: 1420538 - RNA, 19 nt, Homo sapiens
aaccauauuugucacagaa

SEQ ID NO: 1420539 - RNA, 19 nt, Homo sapiens
ccacauuaacuauaucaug

SEQ ID NO: 1420540 - RNA, 19 nt, Homo sapiens
gcaaagguuguaaaugcuu

SEQ ID NO: 1420541 - RNA, 19 nt, Homo sapiens
cagcuauuccgcauucuuu

SEQ ID NO: 1420542 - RNA, 19 nt, Homo sapiens
ccgccgagaugacauggaa

SEQ ID NO: 1420543 - RNA, 19 nt, Homo sapiens
cauuggcacuguccgauau

SEQ ID NO: 1420544 - RNA, 19 nt, Homo sapiens
gaccagaugaucagcagaa

SEQ ID NO: 1420545 - RNA, 19 nt, Homo sapiens
uauguuagccgaccagaug

SEQ ID NO: 1420546 - RNA, 19 nt, Homo sapiens
ugagauaucauuucagaag

SEQ ID NO: 1420547 - RNA, 19 nt, Homo sapiens
guacagagaagauaaacac

SEQ ID NO: 1420548 - RNA, 19 nt, Homo sapiens
aaacaacagcggcuccaaa

SEQ ID NO: 1420549 - RNA, 19 nt, Homo sapiens
cgagccauuuguuacauga

SEQ ID NO: 1420550 - RNA, 19 nt, Homo sapiens
gaaaugggagcuuuuaugu

SEQ ID NO: 1420551 - RNA, 19 nt, Homo sapiens
ccuauaugaucugggauuu

SEQ ID NO: 1420552 - RNA, 19 nt, Homo sapiens
caaccauauuugucacaga

SEQ ID NO: 1420553 - RNA, 19 nt, Homo sapiens
guuggcuucuugucuguaa

SEQ ID NO: 1420554 - RNA, 19 nt, Homo sapiens
agccacagcugcaaagguu

SEQ ID NO: 1420555 - RNA, 19 nt, Homo sapiens
gauaacuaagcgugaauga

SEQ ID NO: 1420556 - RNA, 19 nt, Homo sapiens
acgaauugguggagacauu

SEQ ID NO: 1420557 - RNA, 19 nt, Homo sapiens
gcuaguggcugugaacaac

SEQ ID NO: 1420558 - RNA, 19 nt, Homo sapiens
agaauugaauacgugcaua

SEQ ID NO: 1420559 - RNA, 19 nt, Homo sapiens
cuagacugcuuugagauau

SEQ ID NO: 1420560 - RNA, 19 nt, Homo sapiens
gaauucgccauguacuuga

SEQ ID NO: 1420561 - RNA, 19 nt, Homo sapiens
cauuaaaccagauaacuuc

SEQ ID NO: 1420562 - RNA, 19 nt, Homo sapiens
gaugaucagcagaauugaa

SEQ ID NO: 1420563 - RNA, 19 nt, Homo sapiens
acaaugugcuagucaugga

SEQ ID NO: 1420564 - RNA, 19 nt, Homo sapiens
agccauuuguuacaugaua

SEQ ID NO: 1420565 - RNA, 19 nt, Homo sapiens
gcugauucacuaggaaaua

SEQ ID NO: 1420566 - RNA, 19 nt, Homo sapiens
cguaaacaccuauaugauc

SEQ ID NO: 1420567 - RNA, 19 nt, Homo sapiens
gauucgagcagcauuuguu

SEQ ID NO: 1420568 - RNA, 19 nt, Homo sapiens
gaugauucgagcagcauuu

SEQ ID NO: 1420569 - RNA, 19 nt, Homo sapiens
cagcugaucuaguaguaac

SEQ ID NO: 1420570 - RNA, 19 nt, Homo sapiens
caacaaugugcuagucaug

SEQ ID NO: 1420571 - RNA, 19 nt, Homo sapiens
ccauguacuugaacuacug

SEQ ID NO: 1420572 - RNA, 19 nt, Homo sapiens
ucaaugcacaucuugguau

SEQ ID NO: 1420573 - RNA, 19 nt, Homo sapiens
aaacuguacuuauguuagc

SEQ ID NO: 1420574 - RNA, 19 nt, Homo sapiens
agauaucauuucagaagga

SEQ ID NO: 1420575 - RNA, 19 nt, Homo sapiens
gaaccaccaauaugacuac

SEQ ID NO: 1420576 - RNA, 19 nt, Homo sapiens
ggacccugaaccaccaaua

SEQ ID NO: 1420577 - RNA, 19 nt, Homo sapiens
gccauuuguuacaugauau

SEQ ID NO: 1420578 - RNA, 19 nt, Homo sapiens
ggauagagauuccaaauau

SEQ ID NO: 1420579 - RNA, 19 nt, Homo sapiens
caaagaaacugaauuggaa

SEQ ID NO: 1420580 - RNA, 19 nt, Homo sapiens
gggauuaaauuccuuguuu

SEQ ID NO: 1420581 - RNA, 19 nt, Homo sapiens
gcacaaacaucagaggaaa

SEQ ID NO: 1420582 - RNA, 19 nt, Homo sapiens
ggacggcauuucuucauuu

SEQ ID NO: 1420583 - RNA, 19 nt, Homo sapiens
gaagagaacuguggugaca

SEQ ID NO: 1420584 - RNA, 19 nt, Homo sapiens
ggacuccucuucccugaaa

SEQ ID NO: 1420585 - RNA, 19 nt, Homo sapiens
ggaaauaccagacacaaug

SEQ ID NO: 1420586 - RNA, 19 nt, Homo sapiens
gcagaugugugcccaaaug

SEQ ID NO: 1420587 - RNA, 19 nt, Homo sapiens
ccucagaccuggaauauuc

SEQ ID NO: 1420588 - RNA, 19 nt, Homo sapiens
cgaagucucuguucugcua

SEQ ID NO: 1420589 - RNA, 19 nt, Homo sapiens
uaacuuggcuaauucuaga

SEQ ID NO: 1420590 - RNA, 19 nt, Homo sapiens
gcaaagaaacugaauugga

SEQ ID NO: 1420591 - RNA, 19 nt, Homo sapiens
cacaaugacuuccuggaua

SEQ ID NO: 1420592 - RNA, 19 nt, Homo sapiens
acacaggagugcuuucuaa

SEQ ID NO: 1420593 - RNA, 19 nt, Homo sapiens
ggaguauguuucccacuuu

SEQ ID NO: 1420594 - RNA, 19 nt, Homo sapiens
ccacagaaguaaggaauug

SEQ ID NO: 1420595 - RNA, 19 nt, Homo sapiens
gaguauguuucccacuuua

SEQ ID NO: 1420596 - RNA, 19 nt, Homo sapiens
caacacaacccaccaacaa

SEQ ID NO: 1420597 - RNA, 19 nt, Homo sapiens
gaggauacgucuaauaacu

SEQ ID NO: 1420598 - RNA, 19 nt, Homo sapiens
ggaaggcaauagaauaaag

SEQ ID NO: 1420599 - RNA, 19 nt, Homo sapiens
gaaauaccagacacaauga

SEQ ID NO: 1420600 - RNA, 19 nt, Homo sapiens
gaauuggaauguguaaaug

SEQ ID NO: 1420601 - RNA, 19 nt, Homo sapiens
caaaggguauucucuugga

SEQ ID NO: 1420602 - RNA, 19 nt, Homo sapiens
caacucaacuggguggauu

SEQ ID NO: 1420603 - RNA, 19 nt, Homo sapiens
uauaagaggauacgucuaa

SEQ ID NO: 1420604 - RNA, 19 nt, Homo sapiens
gaacuccugcugagguaua

SEQ ID NO: 1420605 - RNA, 19 nt, Homo sapiens
gaacuguggugacacuagu

SEQ ID NO: 1420606 - RNA, 19 nt, Homo sapiens
gcaaugcuuuucaucuuua

SEQ ID NO: 1420607 - RNA, 19 nt, Homo sapiens
ccaaaugccucaacucaac

SEQ ID NO: 1420608 - RNA, 19 nt, Homo sapiens
aaacugaauuggaaugugu

SEQ ID NO: 1420609 - RNA, 19 nt, Homo sapiens
uagaaacacucacaacauc

SEQ ID NO: 1420610 - RNA, 19 nt, Homo sapiens
caacaaaugaccacagguu

SEQ ID NO: 1420611 - RNA, 19 nt, Homo sapiens
ccaauccucuuauguaucu

SEQ ID NO: 1420612 - RNA, 19 nt, Homo sapiens
ggauacgucuaauaacuca

SEQ ID NO: 1420613 - RNA, 19 nt, Homo sapiens
cagcuaacuuggcuaauuc

SEQ ID NO: 1420614 - RNA, 19 nt, Homo sapiens
ucagcuaacuuggcuaauu

SEQ ID NO: 1420615 - RNA, 19 nt, Homo sapiens
ucucacaaauucuacguuu

SEQ ID NO: 1420616 - RNA, 19 nt, Homo sapiens
caggugaacuuacuacauc

SEQ ID NO: 1420617 - RNA, 19 nt, Homo sapiens
gugggaaucuuaccaagug

SEQ ID NO: 1420618 - RNA, 19 nt, Homo sapiens
gaaauagaaacacucacaa

SEQ ID NO: 1420619 - RNA, 19 nt, Homo sapiens
ccugauggguguuuacuug

SEQ ID NO: 1420620 - RNA, 19 nt, Homo sapiens
uuaaacaacuucagucucu

SEQ ID NO: 1420621 - RNA, 19 nt, Homo sapiens
cauccaauccucuuaugua

SEQ ID NO: 1420622 - RNA, 19 nt, Homo sapiens
gaccuggaauauucaaaga

SEQ ID NO: 1420623 - RNA, 19 nt, Homo sapiens
gaaacugaauuggaaugug

SEQ ID NO: 1420624 - RNA, 19 nt, Homo sapiens
aagaggauacgucuaauaa

SEQ ID NO: 1420625 - RNA, 19 nt, Homo sapiens
gaaaagcacaugugaauuc

SEQ ID NO: 1420626 - RNA, 19 nt, Homo sapiens
cagaauggcuccugucacu

SEQ ID NO: 1420627 - RNA, 19 nt, Homo sapiens
cuacugaccuacuugacuu

SEQ ID NO: 1420628 - RNA, 19 nt, Homo sapiens
gaaaggauagagauuccaa

SEQ ID NO: 1420629 - RNA, 19 nt, Homo sapiens
gaaccaguuugaaagucuu

SEQ ID NO: 1420630 - RNA, 19 nt, Homo sapiens
uaagaggauacgucuaaua

SEQ ID NO: 1420631 - RNA, 19 nt, Homo sapiens
ccacagucuuccagauaaa

SEQ ID NO: 1420632 - RNA, 19 nt, Homo sapiens
gaugauuucuaacaaugug

SEQ ID NO: 1420633 - RNA, 19 nt, Homo sapiens
acagaaaucuaacaacucu

SEQ ID NO: 1420634 - RNA, 19 nt, Homo sapiens
acaauguucuuucuacuuc

SEQ ID NO: 1420635 - RNA, 19 nt, Homo sapiens
cagaacuccugcugaggua

SEQ ID NO: 1420636 - RNA, 19 nt, Homo sapiens
agagguggcuguugcaaau

SEQ ID NO: 1420637 - RNA, 19 nt, Homo sapiens
aaauacaacucacgcuaug

SEQ ID NO: 1420638 - RNA, 19 nt, Homo sapiens
gaggacagcaccaaagguu

SEQ ID NO: 1420639 - RNA, 19 nt, Homo sapiens
cagaagauauuggaagcaa

SEQ ID NO: 1420640 - RNA, 19 nt, Homo sapiens
gguguuuacuuguucuuug

SEQ ID NO: 1420641 - RNA, 19 nt, Homo sapiens
cuaacaauauccucagaau

SEQ ID NO: 1420642 - RNA, 19 nt, Homo sapiens
ccaauccucuauacucuca

SEQ ID NO: 1420643 - RNA, 19 nt, Homo sapiens
gaagauauuggaagcaaag

SEQ ID NO: 1420644 - RNA, 19 nt, Homo sapiens
cacaagaaccaguuugaaa

SEQ ID NO: 1420645 - RNA, 19 nt, Homo sapiens
gcuguaaaccuaugauugu

SEQ ID NO: 1420646 - RNA, 19 nt, Homo sapiens
uaaagucugugccgaugau

SEQ ID NO: 1420647 - RNA, 19 nt, Homo sapiens
caugugaauucguguauag

SEQ ID NO: 1420648 - RNA, 19 nt, Homo sapiens
gcacaugugaauucgugua

SEQ ID NO: 1420649 - RNA, 19 nt, Homo sapiens
gaauauuugucuggguuau

SEQ ID NO: 1420650 - RNA, 19 nt, Homo sapiens
gaauauguaugcccuugac

SEQ ID NO: 1420651 - RNA, 19 nt, Homo sapiens
cuggaucugucuagcaaua

SEQ ID NO: 1420652 - RNA, 19 nt, Homo sapiens
cuagaugacaauccaauaa

SEQ ID NO: 1420653 - RNA, 19 nt, Homo sapiens
acaaugcugugacugcaaa

SEQ ID NO: 1420654 - RNA, 19 nt, Homo sapiens
ugaccaaacagaagauauu

SEQ ID NO: 1420655 - RNA, 19 nt, Homo sapiens
gguuauagcuuucauuacc

SEQ ID NO: 1420656 - RNA, 19 nt, Homo sapiens
ccaaauauaaacacacgaa

SEQ ID NO: 1420657 - RNA, 19 nt, Homo sapiens
uaacucaauugcuguaaac

SEQ ID NO: 1420658 - RNA, 19 nt, Homo sapiens
gcacuguccaugaaauaga

SEQ ID NO: 1420659 - RNA, 19 nt, Homo sapiens
ccgaugauuucuaacaaug

SEQ ID NO: 1420660 - RNA, 19 nt, Homo sapiens
caacaucugauuccagugu

SEQ ID NO: 1420661 - RNA, 19 nt, Homo sapiens
acaaugacuuccuggauag

SEQ ID NO: 1420662 - RNA, 19 nt, Homo sapiens
gauggguguuuacuuguuc

SEQ ID NO: 1420663 - RNA, 19 nt, Homo sapiens
gcgcuuguuuacgggauua

SEQ ID NO: 1420664 - RNA, 19 nt, Homo sapiens
agacacauauccaggaaag

SEQ ID NO: 1420665 - RNA, 19 nt, Homo sapiens
gcuaacagcguggccuuaa

SEQ ID NO: 1420666 - RNA, 19 nt, Homo sapiens
ggguugcacuguccaugaa

SEQ ID NO: 1420667 - RNA, 19 nt, Homo sapiens
uaacagugcuuugaaucca

SEQ ID NO: 1420668 - RNA, 19 nt, Homo sapiens
gcugagguauaagaggaua

SEQ ID NO: 1420669 - RNA, 19 nt, Homo sapiens
ccucuuggcuaacaauauc

SEQ ID NO: 1420670 - RNA, 19 nt, Homo sapiens
gacggcauuucuucauuug

SEQ ID NO: 1420671 - RNA, 19 nt, Homo sapiens
gaacuggaucugucuagca

SEQ ID NO: 1420672 - RNA, 19 nt, Homo sapiens
cucaauugcuguaaaccua

SEQ ID NO: 1420673 - RNA, 19 nt, Homo sapiens
aauggcagcuguacuaucu

SEQ ID NO: 1420674 - RNA, 19 nt, Homo sapiens
ucuauacucucacaaccaa

SEQ ID NO: 1420675 - RNA, 19 nt, Homo sapiens
cuggauuccuguauuugua

SEQ ID NO: 1420676 - RNA, 19 nt, Homo sapiens
gagaaguuccuggucauug

SEQ ID NO: 1420677 - RNA, 19 nt, Homo sapiens
gagggcaguaucagaagua

SEQ ID NO: 1420678 - RNA, 19 nt, Homo sapiens
ccacaaaucucaucucaau

SEQ ID NO: 1420679 - RNA, 19 nt, Homo sapiens
caaagaaacagaccacaua

SEQ ID NO: 1420680 - RNA, 19 nt, Homo sapiens
gaaaucacacucuaaagaa

SEQ ID NO: 1420681 - RNA, 19 nt, Homo sapiens
ggaaaucacacucuaaaga

SEQ ID NO: 1420682 - RNA, 19 nt, Homo sapiens
ccagauuucuuaaugcuuu

SEQ ID NO: 1420683 - RNA, 19 nt, Homo sapiens
ggacugcauucacgccuaa

SEQ ID NO: 1420684 - RNA, 19 nt, Homo sapiens
uaacaaggcacuaucaaau

SEQ ID NO: 1420685 - RNA, 19 nt, Homo sapiens
aaacagaccacauaccaaa

SEQ ID NO: 1420686 - RNA, 19 nt, Homo sapiens
uuccugagcuucaagauuu

SEQ ID NO: 1420687 - RNA, 19 nt, Homo sapiens
ggacauuccuagucauuuu

SEQ ID NO: 1420688 - RNA, 19 nt, Homo sapiens
cuacccagauuucuuaaug

SEQ ID NO: 1420689 - RNA, 19 nt, Homo sapiens
cuaccucacugucaacaaa

SEQ ID NO: 1420690 - RNA, 19 nt, Homo sapiens
acaaggcacuaucaaauca

SEQ ID NO: 1420691 - RNA, 19 nt, Homo sapiens
auugaucgcuuuauucgua

SEQ ID NO: 1420692 - RNA, 19 nt, Homo sapiens
ccaaagugacuacgacaaa

SEQ ID NO: 1420693 - RNA, 19 nt, Homo sapiens
gaaccaagagcacacaaag

SEQ ID NO: 1420694 - RNA, 19 nt, Homo sapiens
gacaaaaccuacccagauu

SEQ ID NO: 1420695 - RNA, 19 nt, Homo sapiens
gaaguuaacaaggcacuau

SEQ ID NO: 1420696 - RNA, 19 nt, Homo sapiens
gaacugccucccuuggaaa

SEQ ID NO: 1420697 - RNA, 19 nt, Homo sapiens
ugaguacacuuggaaauca

SEQ ID NO: 1420698 - RNA, 19 nt, Homo sapiens
gaaacagaccacauaccaa

SEQ ID NO: 1420699 - RNA, 19 nt, Homo sapiens
caguuuauuucccuuacua

SEQ ID NO: 1420700 - RNA, 19 nt, Homo sapiens
caaaagcucagaagauuaa

SEQ ID NO: 1420701 - RNA, 19 nt, Homo sapiens
gcacuaucaaaucaguuua

SEQ ID NO: 1420702 - RNA, 19 nt, Homo sapiens
caacugggauuccuaugcu

SEQ ID NO: 1420703 - RNA, 19 nt, Homo sapiens
cacaauauagugaugagua

SEQ ID NO: 1420704 - RNA, 19 nt, Homo sapiens
aaauauggaugcuacucaa

SEQ ID NO: 1420705 - RNA, 19 nt, Homo sapiens
aagaguaccuucagagucu

SEQ ID NO: 1420706 - RNA, 19 nt, Homo sapiens
gaaucaagagccacaaauc

SEQ ID NO: 1420707 - RNA, 19 nt, Homo sapiens
gaucaaaacugagacuuca

SEQ ID NO: 1420708 - RNA, 19 nt, Homo sapiens
gcuucaagauuucaguuuc

SEQ ID NO: 1420709 - RNA, 19 nt, Homo sapiens
ucacuugucucuggaaugg

SEQ ID NO: 1420710 - RNA, 19 nt, Homo sapiens
gacacugaauuccgaagga

SEQ ID NO: 1420711 - RNA, 19 nt, Homo sapiens
agaacugccucccuuggaa

SEQ ID NO: 1420712 - RNA, 19 nt, Homo sapiens
ggaaucaagagccacaaau

SEQ ID NO: 1420713 - RNA, 19 nt, Homo sapiens
ucagagucuuuccuacaaa

SEQ ID NO: 1420714 - RNA, 19 nt, Homo sapiens
gaaaaucccggcuucaaug

SEQ ID NO: 1420715 - RNA, 19 nt, Homo sapiens
ucaaucagacacaauauag

SEQ ID NO: 1420716 - RNA, 19 nt, Homo sapiens
ccacauaccaaagugacua

SEQ ID NO: 1420717 - RNA, 19 nt, Homo sapiens
ggaaccaagagcacacaaa

SEQ ID NO: 1420718 - RNA, 19 nt, Homo sapiens
gauccuauucucaaucaga

SEQ ID NO: 1420719 - RNA, 19 nt, Homo sapiens
gagagacuuuguggacaga

SEQ ID NO: 1420720 - RNA, 19 nt, Homo sapiens
caacaaacggggacacuaa

SEQ ID NO: 1420721 - RNA, 19 nt, Homo sapiens
caaagaguaccuucagagu

SEQ ID NO: 1420722 - RNA, 19 nt, Homo sapiens
uacucaagcuugccuguug

SEQ ID NO: 1420723 - RNA, 19 nt, Homo sapiens
caaauauggaugcuacuca

SEQ ID NO: 1420724 - RNA, 19 nt, Homo sapiens
uuaccaaauuccagcuaaa

SEQ ID NO: 1420725 - RNA, 19 nt, Homo sapiens
gggaaaauaguacaaauga

SEQ ID NO: 1420726 - RNA, 19 nt, Homo sapiens
ccaagagcacacaaagaaa

SEQ ID NO: 1420727 - RNA, 19 nt, Homo sapiens
ccaaaacgguaucagaaga

SEQ ID NO: 1420728 - RNA, 19 nt, Homo sapiens
aaccuacccagauuucuua

SEQ ID NO: 1420729 - RNA, 19 nt, Homo sapiens
gagcacacaaagaaacaga

SEQ ID NO: 1420730 - RNA, 19 nt, Homo sapiens
accaagagcacacaaagaa

SEQ ID NO: 1420731 - RNA, 19 nt, Homo sapiens
ggcacuaucaaaucaguuu

SEQ ID NO: 1420732 - RNA, 19 nt, Homo sapiens
gucaaagaguaccuucaga

SEQ ID NO: 1420733 - RNA, 19 nt, Homo sapiens
caaagugacuacgacaaaa

SEQ ID NO: 1420734 - RNA, 19 nt, Homo sapiens
aaacgguaucagaagauua

SEQ ID NO: 1420735 - RNA, 19 nt, Homo sapiens
uuaacaaggcacuaucaaa

SEQ ID NO: 1420736 - RNA, 19 nt, Homo sapiens
ucaagagccacaaaucuca

SEQ ID NO: 1420737 - RNA, 19 nt, Homo sapiens
gaugaguacacuuggaaau

SEQ ID NO: 1420738 - RNA, 19 nt, Homo sapiens
caagagcacacaaagaaac

SEQ ID NO: 1420739 - RNA, 19 nt, Homo sapiens
cuucaagauuucaguuuca

SEQ ID NO: 1420740 - RNA, 19 nt, Homo sapiens
aaaucacacucuaaagaag

SEQ ID NO: 1420741 - RNA, 19 nt, Homo sapiens
gaucaaaagcucagaagau

SEQ ID NO: 1420742 - RNA, 19 nt, Homo sapiens
gagacuuuguggacagauc

SEQ ID NO: 1420743 - RNA, 19 nt, Homo sapiens
cagacacaauauagugaug

SEQ ID NO: 1420744 - RNA, 19 nt, Homo sapiens
agaugcaaauagcuucaaa

SEQ ID NO: 1420745 - RNA, 19 nt, Homo sapiens
gaagaaaugaaaagggaaa

SEQ ID NO: 1420746 - RNA, 19 nt, Homo sapiens
aaaccuacccagauuucuu

SEQ ID NO: 1420747 - RNA, 19 nt, Homo sapiens
aaucagacacaauauagug

SEQ ID NO: 1420748 - RNA, 19 nt, Homo sapiens
gguaucagaagauuaggau

SEQ ID NO: 1420749 - RNA, 19 nt, Homo sapiens
gagcuucaagauuucaguu

SEQ ID NO: 1420750 - RNA, 19 nt, Homo sapiens
aagcucagaagauuaagaa

SEQ ID NO: 1420751 - RNA, 19 nt, Homo sapiens
acugagacuucaagaggaa

SEQ ID NO: 1420752 - RNA, 19 nt, Homo sapiens
acaauauagugaugaguac

SEQ ID NO: 1420753 - RNA, 19 nt, Homo sapiens
gacacaauauagugaugag

SEQ ID NO: 1420754 - RNA, 19 nt, Homo sapiens
agaaacagaccacauacca

SEQ ID NO: 1420755 - RNA, 19 nt, Homo sapiens
gcucagaagauuaagaaaa

SEQ ID NO: 1420756 - RNA, 19 nt, Homo sapiens
ucauuuacuuccucucaag

SEQ ID NO: 1420757 - RNA, 19 nt, Homo sapiens
uuagugauccuauucucaa

SEQ ID NO: 1420758 - RNA, 19 nt, Homo sapiens
gugaugaguacacuuggaa

SEQ ID NO: 1420759 - RNA, 19 nt, Homo sapiens
uucagagucuuuccuacaa

SEQ ID NO: 1420760 - RNA, 19 nt, Homo sapiens
cagaagauuaggauauaca

SEQ ID NO: 1420761 - RNA, 19 nt, Homo sapiens
ccacuaugaggacugcauu

SEQ ID NO: 1420762 - RNA, 19 nt, Homo sapiens
cgacaaaaccuacccagau

SEQ ID NO: 1420763 - RNA, 19 nt, Homo sapiens
cagaccacauaccaaagug

SEQ ID NO: 1420764 - RNA, 19 nt, Homo sapiens
uuacuaagagagacuuugu

SEQ ID NO: 1420765 - RNA, 19 nt, Homo sapiens
ggaaaaucccggcuucaau

SEQ ID NO: 1420766 - RNA, 19 nt, Homo sapiens
agccacaaaucucaucuca

SEQ ID NO: 1420767 - RNA, 19 nt, Homo sapiens
aaucacacucuaaagaaga

SEQ ID NO: 1420768 - RNA, 19 nt, Homo sapiens
gaaaagggaaaauaguaca

SEQ ID NO: 1420769 - RNA, 19 nt, Homo sapiens
cucaaucagacacaauaua

SEQ ID NO: 1420770 - RNA, 19 nt, Homo sapiens
uaaaauuccugagcuucaa

SEQ ID NO: 1420771 - RNA, 19 nt, Homo sapiens
acuugucucuggaauggaa

SEQ ID NO: 1420772 - RNA, 19 nt, Homo sapiens
ucaaaagcucagaagauua

SEQ ID NO: 1420773 - RNA, 19 nt, Homo sapiens
guuaacaaggcacuaucaa

SEQ ID NO: 1420774 - RNA, 19 nt, Homo sapiens
aaucaagagccacaaaucu

SEQ ID NO: 1420775 - RNA, 19 nt, Homo sapiens
uuggaaaucacacucuaaa

SEQ ID NO: 1420776 - RNA, 19 nt, Homo sapiens
acaaagaaacagaccacau

SEQ ID NO: 1420777 - RNA, 19 nt, Homo sapiens
gcuugccuguugcuucuca

SEQ ID NO: 1420778 - RNA, 19 nt, Homo sapiens
gaacugcucuguaccugaa

SEQ ID NO: 1420779 - RNA, 19 nt, Homo sapiens
gauaagcuccgaagaagua

SEQ ID NO: 1420780 - RNA, 19 nt, Homo sapiens
gaagaggaauuugaucauu

SEQ ID NO: 1420781 - RNA, 19 nt, Homo sapiens
gaucauggcucgucugcaa

SEQ ID NO: 1420782 - RNA, 19 nt, Homo sapiens
uaacaaugcuucuggaaau

SEQ ID NO: 1420783 - RNA, 19 nt, Homo sapiens
cuuaauaccugcaauguuu

SEQ ID NO: 1420784 - RNA, 19 nt, Homo sapiens
caacuagguucuauaaugu

SEQ ID NO: 1420785 - RNA, 19 nt, Homo sapiens
gagagaugguugcuacuaa

SEQ ID NO: 1420786 - RNA, 19 nt, Homo sapiens
gcauggagcuggaaaugga

SEQ ID NO: 1420787 - RNA, 19 nt, Homo sapiens
gcaaggagauaaccagaca

SEQ ID NO: 1420788 - RNA, 19 nt, Homo sapiens
gaaagucucaggcaagauu

SEQ ID NO: 1420789 - RNA, 19 nt, Homo sapiens
uaacaugccuuuaucaaac

SEQ ID NO: 1420790 - RNA, 19 nt, Homo sapiens
gcaguaacaugccuuuauc

SEQ ID NO: 1420791 - RNA, 19 nt, Homo sapiens
acaacuagguucuauaaug

SEQ ID NO: 1420792 - RNA, 19 nt, Homo sapiens
gagauaagcuccgaagaag

SEQ ID NO: 1420793 - RNA, 19 nt, Homo sapiens
uaaccagacagcagaauua

SEQ ID NO: 1420794 - RNA, 19 nt, Homo sapiens
gcaucuguaucaagacaua

SEQ ID NO: 1420795 - RNA, 19 nt, Homo sapiens
ucaagaauaugaccaauac

SEQ ID NO: 1420796 - RNA, 19 nt, Homo sapiens
ggaagugcaugucuguguu

SEQ ID NO: 1420797 - RNA, 19 nt, Homo sapiens
caccagagacuaauuauug

SEQ ID NO: 1420798 - RNA, 19 nt, Homo sapiens
cuaaacaucuuuccauuac

SEQ ID NO: 1420799 - RNA, 19 nt, Homo sapiens
gagcacaacauaauuugaa

SEQ ID NO: 1420800 - RNA, 19 nt, Homo sapiens
caaguugaccuacauagaa

SEQ ID NO: 1420801 - RNA, 19 nt, Homo sapiens
agacauaguuccagugugu

SEQ ID NO: 1420802 - RNA, 19 nt, Homo sapiens
caauaaugcuuugccauau

SEQ ID NO: 1420803 - RNA, 19 nt, Homo sapiens
ucaauaaugcuuugccaua

SEQ ID NO: 1420804 - RNA, 19 nt, Homo sapiens
gaccuucguuggcaauaaa

SEQ ID NO: 1420805 - RNA, 19 nt, Homo sapiens
ugacaacuagguucuauaa

SEQ ID NO: 1420806 - RNA, 19 nt, Homo sapiens
uaaccugccucgaagcaaa

SEQ ID NO: 1420807 - RNA, 19 nt, Homo sapiens
guagugaucaagaauauga

SEQ ID NO: 1420808 - RNA, 19 nt, Homo sapiens
aaacacaucaugcaauuug

SEQ ID NO: 1420809 - RNA, 19 nt, Homo sapiens
gauggaaauuggagagaug

SEQ ID NO: 1420810 - RNA, 19 nt, Homo sapiens
ccagacagcagaauuaaau

SEQ ID NO: 1420811 - RNA, 19 nt, Homo sapiens
gaagaaguaugccuaaccu

SEQ ID NO: 1420812 - RNA, 19 nt, Homo sapiens
ggacauguagugaucaaga

SEQ ID NO: 1420813 - RNA, 19 nt, Homo sapiens
ugaaugagcacaacauaau

SEQ ID NO: 1420814 - RNA, 19 nt, Homo sapiens
guaacaugccuuuaucaaa

SEQ ID NO: 1420815 - RNA, 19 nt, Homo sapiens
gccauuaguagcaacauua

SEQ ID NO: 1420816 - RNA, 19 nt, Homo sapiens
gagcucauugcacuuaaua

SEQ ID NO: 1420817 - RNA, 19 nt, Homo sapiens
ucaauuuacucacguguuc

SEQ ID NO: 1420818 - RNA, 19 nt, Homo sapiens
gaucagcaaccaaauagga

SEQ ID NO: 1420819 - RNA, 19 nt, Homo sapiens
gaaugagcacaacauaauu

SEQ ID NO: 1420820 - RNA, 19 nt, Homo sapiens
gaaccacuauggaacaacu

SEQ ID NO: 1420821 - RNA, 19 nt, Homo sapiens
ccagaucagcaaccaaaua

SEQ ID NO: 1420822 - RNA, 19 nt, Homo sapiens
gcacaaccuguuagaaguu

SEQ ID NO: 1420823 - RNA, 19 nt, Homo sapiens
gacauguagugaucaagaa

SEQ ID NO: 1420824 - RNA, 19 nt, Homo sapiens
ccaaguacaacugccauua

SEQ ID NO: 1420825 - RNA, 19 nt, Homo sapiens
agaggaauuugaucauuug

SEQ ID NO: 1420826 - RNA, 19 nt, Homo sapiens
acagugagcugaguacuuc

SEQ ID NO: 1420827 - RNA, 19 nt, Homo sapiens
acaccuaugugaaccacua

SEQ ID NO: 1420828 - RNA, 19 nt, Homo sapiens
ggagagaugguugcuacua

SEQ ID NO: 1420829 - RNA, 19 nt, Homo sapiens
gggaguaaccugccucgaa

SEQ ID NO: 1420830 - RNA, 19 nt, Homo sapiens
guacaacugccauuaguag

SEQ ID NO: 1420831 - RNA, 19 nt, Homo sapiens
aaagggacauguagugauc

SEQ ID NO: 1420832 - RNA, 19 nt, Homo sapiens
uacgaaggaugaaacugua

SEQ ID NO: 1420833 - RNA, 19 nt, Homo sapiens
guucagaaauaaagacucu

SEQ ID NO: 1420834 - RNA, 19 nt, Homo sapiens
ggaauguucagaaauaaag

SEQ ID NO: 1420835 - RNA, 19 nt, Homo sapiens
aaugaaugcuuucuuaugg

SEQ ID NO: 1420836 - RNA, 19 nt, Homo sapiens
gcacuuaauaccugcaaug

SEQ ID NO: 1420837 - RNA, 19 nt, Homo sapiens
cauugcauauugacaacua

SEQ ID NO: 1420838 - RNA, 19 nt, Homo sapiens
caacugccauuaguagcaa

SEQ ID NO: 1420839 - RNA, 19 nt, Homo sapiens
cuucagaauuggaggauga

SEQ ID NO: 1420840 - RNA, 19 nt, Homo sapiens
uacaggaccucacugaugu

SEQ ID NO: 1420841 - RNA, 19 nt, Homo sapiens
ugaccuacauagaagagaa

SEQ ID NO: 1420842 - RNA, 19 nt, Homo sapiens
auaaugcuuugccauauga

SEQ ID NO: 1420843 - RNA, 19 nt, Homo sapiens
caaagccucugucuucacu

SEQ ID NO: 1420844 - RNA, 19 nt, Homo sapiens
cuccaugggauauaaauua

SEQ ID NO: 1420845 - RNA, 19 nt, Homo sapiens
aauacagucuggaggauga

SEQ ID NO: 1420846 - RNA, 19 nt, Homo sapiens
cuagggauauaucagcaaa

SEQ ID NO: 1420847 - RNA, 19 nt, Homo sapiens
gcaguauugugacacuuag

SEQ ID NO: 1420848 - RNA, 19 nt, Homo sapiens
gagacuaauuauugcacuu

SEQ ID NO: 1420849 - RNA, 19 nt, Homo sapiens
agucaucuaucgacaguga

SEQ ID NO: 1420850 - RNA, 19 nt, Homo sapiens
gaucaagaauaugaccaau

SEQ ID NO: 1420851 - RNA, 19 nt, Homo sapiens
gaaggaugaaacuguaaug

SEQ ID NO: 1420852 - RNA, 19 nt, Homo sapiens
ggauggaaauuggagagau

SEQ ID NO: 1420853 - RNA, 19 nt, Homo sapiens
aagaaagucucaggcaaga

SEQ ID NO: 1420854 - RNA, 19 nt, Homo sapiens
caaugcuucuggaaaugaa

SEQ ID NO: 1420855 - RNA, 19 nt, Homo sapiens
auuaaaugguccugucuuu

SEQ ID NO: 1420856 - RNA, 19 nt, Homo sapiens
guacacugcuguuuuggaa

SEQ ID NO: 1420857 - RNA, 19 nt, Homo sapiens
aauaaugcuuugccauaug

SEQ ID NO: 1420858 - RNA, 19 nt, Homo sapiens
guucaaggcagcaguaaca

SEQ ID NO: 1420859 - RNA, 19 nt, Homo sapiens
gcagcaacaguauuauuca

SEQ ID NO: 1420860 - RNA, 19 nt, Homo sapiens
ggaugaagaggaauuugau

SEQ ID NO: 1420861 - RNA, 19 nt, Homo sapiens
ggaggaugaagaggaauuu

SEQ ID NO: 1420862 - RNA, 19 nt, Homo sapiens
gaacuggaagugcaugucu

SEQ ID NO: 1420863 - RNA, 19 nt, Homo sapiens
ccagucaucuaucgacagu

SEQ ID NO: 1420864 - RNA, 19 nt, Homo sapiens
cucuguaccugaauacuuu

SEQ ID NO: 1420865 - RNA, 19 nt, Homo sapiens
gaugguugcuacuaaugca

SEQ ID NO: 1420866 - RNA, 19 nt, Homo sapiens
cacaaccuguuagaaguuu

SEQ ID NO: 1420867 - RNA, 19 nt, Homo sapiens
cagcaucuguaucaagaca

SEQ ID NO: 1420868 - RNA, 19 nt, Homo sapiens
gcaagauuaugcuucuacu

SEQ ID NO: 1420869 - RNA, 19 nt, Homo sapiens
ccugagauacugcaacauu

SEQ ID NO: 1420870 - RNA, 19 nt, Homo sapiens
uuacaggaccucacugaug

SEQ ID NO: 1420871 - RNA, 19 nt, Homo sapiens
agagaugguugcuacuaau

SEQ ID NO: 1420872 - RNA, 19 nt, Homo sapiens
ggaaauuggagagaugguu

SEQ ID NO: 1420873 - RNA, 19 nt, Homo sapiens
cuacauagaagagaaggaa

SEQ ID NO: 1420874 - RNA, 19 nt, Homo sapiens
caagacauaguuccagugu

SEQ ID NO: 1420875 - RNA, 19 nt, Homo sapiens
acccaugguugcaguauug

SEQ ID NO: 1420876 - RNA, 19 nt, Homo sapiens
caaguacaacugccauuag

SEQ ID NO: 1420877 - RNA, 19 nt, Homo sapiens
cagcagcaacaguauuauu

SEQ ID NO: 1420878 - RNA, 19 nt, Homo sapiens
gaaauaccauucaguucaa

SEQ ID NO: 1420879 - RNA, 19 nt, Homo sapiens
caaagaacacucaguauga

SEQ ID NO: 1420880 - RNA, 19 nt, Homo sapiens
gaagaguguuuccaguaaa

SEQ ID NO: 1420881 - RNA, 19 nt, Homo sapiens
gaggauaugucugaauuau

SEQ ID NO: 1420882 - RNA, 19 nt, Homo sapiens
gagaagaguguuuccagua

SEQ ID NO: 1420883 - RNA, 19 nt, Homo sapiens
gaccaaauccuucaaaaua

SEQ ID NO: 1420884 - RNA, 19 nt, Homo sapiens
agaagaguguuuccaguaa

SEQ ID NO: 1420885 - RNA, 19 nt, Homo sapiens
aaagaacacucaguaugaa

SEQ ID NO: 1420886 - RNA, 19 nt, Homo sapiens
acaauucucuccuggcauu

SEQ ID NO: 1420887 - RNA, 19 nt, Homo sapiens
ucugaaccauuccacauaa

SEQ ID NO: 1420888 - RNA, 19 nt, Homo sapiens
ggaggauaugucugaauua

SEQ ID NO: 1420889 - RNA, 19 nt, Homo sapiens
ggagggagcauggcaguga

SEQ ID NO: 1420890 - RNA, 19 nt, Homo sapiens
gagaggagccugcuagaac

SEQ ID NO: 1420891 - RNA, 19 nt, Homo sapiens
ucaaagaacacucaguaug

SEQ ID NO: 1420892 - RNA, 19 nt, Homo sapiens
aaguacagcaucaacauua

SEQ ID NO: 1420893 - RNA, 19 nt, Homo sapiens
aggaggauaugucugaauu

SEQ ID NO: 1420894 - RNA, 19 nt, Homo sapiens
gagccaaggcagucaguga

SEQ ID NO: 1420895 - RNA, 19 nt, Homo sapiens
ggagaggagccugcuagaa

SEQ ID NO: 1420896 - RNA, 19 nt, Homo sapiens
caaguacagcaucaacauu

SEQ ID NO: 1420897 - RNA, 19 nt, Homo sapiens
ggaaaaucguuuauucaca

SEQ ID NO: 1420898 - RNA, 19 nt, Homo sapiens
agacgggacccucugcuuu

SEQ ID NO: 1420899 - RNA, 19 nt, Homo sapiens
aaacaacaccgagcgaaau

SEQ ID NO: 1420900 - RNA, 19 nt, Homo sapiens
gacgggacccucugcuuug

SEQ ID NO: 1420901 - RNA, 19 nt, Homo sapiens
gcugugcuguuggcaagaa

SEQ ID NO: 1420902 - RNA, 19 nt, Homo sapiens
guuacaugcugguauugau

SEQ ID NO: 1420903 - RNA, 19 nt, Homo sapiens
gcaucaacauuaucaacac

SEQ ID NO: 1420904 - RNA, 19 nt, Homo sapiens
gcuguuggcaagaaacuga

SEQ ID NO: 1420905 - RNA, 19 nt, Homo sapiens
cgagcgaaaugccaaguac

SEQ ID NO: 1420906 - RNA, 19 nt, Homo sapiens
auucaaagaacacucagua

SEQ ID NO: 1420907 - RNA, 19 nt, Homo sapiens
gcagugagaagaguguuuc

SEQ ID NO: 1420908 - RNA, 19 nt, Homo sapiens
aacauuaucaacaccguua

SEQ ID NO: 1420909 - RNA, 19 nt, Homo sapiens
gaaccauuccacauaaagg

SEQ ID NO: 1420910 - RNA, 19 nt, Homo sapiens
ccaaguacagcaucaacau

SEQ ID NO: 1420911 - RNA, 19 nt, Homo sapiens
gaugaagccaaugcuaaug

SEQ ID NO: 1420912 - RNA, 19 nt, Homo sapiens
cugaaccauuccacauaaa

SEQ ID NO: 1420913 - RNA, 19 nt, Homo sapiens
ccaaugcuaaugcaaaucu

SEQ ID NO: 1420914 - RNA, 19 nt, Homo sapiens
guacagcaucaacauuauc

SEQ ID NO: 1420915 - RNA, 19 nt, Homo sapiens
ugaagccaaugcuaaugca

SEQ ID NO: 1420916 - RNA, 19 nt, Homo sapiens
ugaugaagccaaugcuaau

SEQ ID NO: 1420917 - RNA, 19 nt, Homo sapiens
ucugagaauuaccaugaau

SEQ ID NO: 1420918 - RNA, 19 nt, Homo sapiens
gaguguuuccaguaaagaa

SEQ ID NO: 1420919 - RNA, 19 nt, Homo sapiens
aagaguguuuccaguaaag

SEQ ID NO: 1420920 - RNA, 19 nt, Homo sapiens
aguacagcaucaacauuau

SEQ ID NO: 1420921 - RNA, 19 nt, Homo sapiens
gagacgggacccucugcuu

SEQ ID NO: 1420922 - RNA, 19 nt, Homo sapiens
aacaggaggauaugucuga

SEQ ID NO: 1420923 - RNA, 19 nt, Homo sapiens
aaucguuuauucacaccaa

SEQ ID NO: 1420924 - RNA, 19 nt, Homo sapiens
uuaucaagcuggugguucu

SEQ ID NO: 1420925 - RNA, 19 nt, Homo sapiens
agaauucaaagaacacuca

SEQ ID NO: 1420926 - RNA, 19 nt, Homo sapiens
agccaaugcuaaugcaaau

SEQ ID NO: 1420927 - RNA, 19 nt, Homo sapiens
guucaaaacaggaggauau

SEQ ID NO: 1420928 - RNA, 19 nt, Homo sapiens
gaagccaaugcuaaugcaa

SEQ ID NO: 1420929 - RNA, 19 nt, Homo sapiens
ggaccaaauccuucaaaau

SEQ ID NO: 1420930 - RNA, 19 nt, Homo sapiens
aagccaaugcuaaugcaaa

SEQ ID NO: 1420931 - RNA, 19 nt, Homo sapiens
augcugguauugaugagaa

SEQ ID NO: 1420932 - RNA, 19 nt, Homo sapiens
gagcgaaaugccaaguaca

SEQ ID NO: 1420933 - RNA, 19 nt, Homo sapiens
gagcuaacguguaagcaaa

SEQ ID NO: 1420934 - RNA, 19 nt, Homo sapiens
gcacaccggucuccagguu

SEQ ID NO: 1420935 - RNA, 19 nt, Homo sapiens
uaccggcacuuuauauaua

SEQ ID NO: 1420936 - RNA, 19 nt, Homo sapiens
cccaggagcuaacguguaa

SEQ ID NO: 1420937 - RNA, 19 nt, Homo sapiens
ggccagggacugugauaua

SEQ ID NO: 1420938 - RNA, 19 nt, Homo sapiens
guacccgcuucaucuagua

SEQ ID NO: 1420939 - RNA, 19 nt, Homo sapiens
gcaguacccgcuucaucua

SEQ ID NO: 1420940 - RNA, 19 nt, Homo sapiens
guaccggcacuuuauauau

SEQ ID NO: 1420941 - RNA, 19 nt, Homo sapiens
uaugggaccugaagaggau

SEQ ID NO: 1420942 - RNA, 19 nt, Homo sapiens
ggagcuaacguguaagcaa

SEQ ID NO: 1420943 - RNA, 19 nt, Homo sapiens
cagaagcagugccgcaagu

SEQ ID NO: 1420944 - RNA, 19 nt, Homo sapiens
gaagaggauggcagacugu

SEQ ID NO: 1420945 - RNA, 19 nt, Homo sapiens
uaacguguaagcaaacaug

SEQ ID NO: 1420946 - RNA, 19 nt, Homo sapiens
gaaagugggauggcaguac

SEQ ID NO: 1420947 - RNA, 19 nt, Homo sapiens
cacccuaggcgcuggauuu

SEQ ID NO: 1420948 - RNA, 19 nt, Homo sapiens
gccagggacugugauauac

SEQ ID NO: 1420949 - RNA, 19 nt, Homo sapiens
ggaaagugggauggcagua

SEQ ID NO: 1420950 - RNA, 19 nt, Homo sapiens
gcguuguaccggcacuuua

SEQ ID NO: 1420951 - RNA, 19 nt, Homo sapiens
gcuaacguguaagcaaaca

SEQ ID NO: 1420952 - RNA, 19 nt, Homo sapiens
acaccggucuccagguugu

SEQ ID NO: 1420953 - RNA, 19 nt, Homo sapiens
ggcaguacccgcuucaucu

SEQ ID NO: 1420954 - RNA, 19 nt, Homo sapiens
ggagaucaagagagguaug

SEQ ID NO: 1420955 - RNA, 19 nt, Homo sapiens
guuguaccggcacuuuaua

SEQ ID NO: 1420956 - RNA, 19 nt, Homo sapiens
uguaccggcacuuuauaua

SEQ ID NO: 1420957 - RNA, 19 nt, Homo sapiens
agucgucguucgccuucua

SEQ ID NO: 1420958 - RNA, 19 nt, Homo sapiens
ggugaucgcggugcaggaa

SEQ ID NO: 1420959 - RNA, 19 nt, Homo sapiens
gcuugugcccugcuggaaa

SEQ ID NO: 1420960 - RNA, 19 nt, Homo sapiens
uguggcugcuggaggauau

SEQ ID NO: 1420961 - RNA, 19 nt, Homo sapiens
gaaauucacccgauacaua

SEQ ID NO: 1420962 - RNA, 19 nt, Homo sapiens
ucaaacagcucaucaaaga

SEQ ID NO: 1420963 - RNA, 19 nt, Homo sapiens
gaaagucucauccuaauuu

SEQ ID NO: 1420964 - RNA, 19 nt, Homo sapiens
gaagaaagucucauccuaa

SEQ ID NO: 1420965 - RNA, 19 nt, Homo sapiens
ggaggaagaugaugucaga

SEQ ID NO: 1420966 - RNA, 19 nt, Homo sapiens
ccacagaucacuuauuaua

SEQ ID NO: 1420967 - RNA, 19 nt, Homo sapiens
aaccacagaucacuuauua

SEQ ID NO: 1420968 - RNA, 19 nt, Homo sapiens
ugaaagaucugguauuauc

SEQ ID NO: 1420969 - RNA, 19 nt, Homo sapiens
gaguggcgcuuucaccuua

SEQ ID NO: 1420970 - RNA, 19 nt, Homo sapiens
ugaagaagauuaucgaaga

SEQ ID NO: 1420971 - RNA, 19 nt, Homo sapiens
gaaggcacauuccagauug

SEQ ID NO: 1420972 - RNA, 19 nt, Homo sapiens
cuaaagaauuggccaagua

SEQ ID NO: 1420973 - RNA, 19 nt, Homo sapiens
gaagaagauuaucgaagaa

SEQ ID NO: 1420974 - RNA, 19 nt, Homo sapiens
caaaagaccuguucaauca

SEQ ID NO: 1420975 - RNA, 19 nt, Homo sapiens
ggagugugauguuauuauu

SEQ ID NO: 1420976 - RNA, 19 nt, Homo sapiens
ugaaggaugucauuucuga

SEQ ID NO: 1420977 - RNA, 19 nt, Homo sapiens
gugcauagcucaugagaca

SEQ ID NO: 1420978 - RNA, 19 nt, Homo sapiens
cuugaaagaucugguauua

SEQ ID NO: 1420979 - RNA, 19 nt, Homo sapiens
uaacauguaggcugauuua

SEQ ID NO: 1420980 - RNA, 19 nt, Homo sapiens
gcagaauguuucccuuuga

SEQ ID NO: 1420981 - RNA, 19 nt, Homo sapiens
ggagauggcagagaagaua

SEQ ID NO: 1420982 - RNA, 19 nt, Homo sapiens
gaagcacagugaaacuuga

SEQ ID NO: 1420983 - RNA, 19 nt, Homo sapiens
gggcgagauuccugcauua

SEQ ID NO: 1420984 - RNA, 19 nt, Homo sapiens
gaauguuucccuuugauaa

SEQ ID NO: 1420985 - RNA, 19 nt, Homo sapiens
ggacuuaacgcaagauugu

SEQ ID NO: 1420986 - RNA, 19 nt, Homo sapiens
caacuagacgaucaauaua

SEQ ID NO: 1420987 - RNA, 19 nt, Homo sapiens
agaagaaagucucauccua

SEQ ID NO: 1420988 - RNA, 19 nt, Homo sapiens
gaagacauagucaagugua

SEQ ID NO: 1420989 - RNA, 19 nt, Homo sapiens
ccgaagacccuguugauuu

SEQ ID NO: 1420990 - RNA, 19 nt, Homo sapiens
ugaaggagcgugugauaaa

SEQ ID NO: 1420991 - RNA, 19 nt, Homo sapiens
gcagaaugcaggucaacua

SEQ ID NO: 1420992 - RNA, 19 nt, Homo sapiens
gaaaauacccagagaaaau

SEQ ID NO: 1420993 - RNA, 19 nt, Homo sapiens
gaaaagcgaaagcuauuua

SEQ ID NO: 1420994 - RNA, 19 nt, Homo sapiens
caagaacaauccugaagca

SEQ ID NO: 1420995 - RNA, 19 nt, Homo sapiens
gaaaagagaagaaagagaa

SEQ ID NO: 1420996 - RNA, 19 nt, Homo sapiens
uuauaaaccuguuggauuc

SEQ ID NO: 1420997 - RNA, 19 nt, Homo sapiens
ucaacuagacgaucaauau

SEQ ID NO: 1420998 - RNA, 19 nt, Homo sapiens
caguauugcuaaagaauug

SEQ ID NO: 1420999 - RNA, 19 nt, Homo sapiens
ggaaggagaagaagaaguc

SEQ ID NO: 1421000 - RNA, 19 nt, Homo sapiens
ugucauuucugaagccaua

SEQ ID NO: 1421001 - RNA, 19 nt, Homo sapiens
gaaggaggcauguuacaca

SEQ ID NO: 1421002 - RNA, 19 nt, Homo sapiens
gaagauuaucgaagaagaa

SEQ ID NO: 1421003 - RNA, 19 nt, Homo sapiens
gcauagcucaugagacaaa

SEQ ID NO: 1421004 - RNA, 19 nt, Homo sapiens
uaaagacauuugugcauag

SEQ ID NO: 1421005 - RNA, 19 nt, Homo sapiens
cagaaccacagaucacuua

SEQ ID NO: 1421006 - RNA, 19 nt, Homo sapiens
ccaaagaccuaugaucaag

SEQ ID NO: 1421007 - RNA, 19 nt, Homo sapiens
ggcagaauguuucccuuug

SEQ ID NO: 1421008 - RNA, 19 nt, Homo sapiens
ucgggaaguuucuaucuaa

SEQ ID NO: 1421009 - RNA, 19 nt, Homo sapiens
gaaugcaggucaacuagac

SEQ ID NO: 1421010 - RNA, 19 nt, Homo sapiens
uggaagcgcucuuugugaa

SEQ ID NO: 1421011 - RNA, 19 nt, Homo sapiens
gcuggagugugauguuauu

SEQ ID NO: 1421012 - RNA, 19 nt, Homo sapiens
gaaccacagaucacuuauu

SEQ ID NO: 1421013 - RNA, 19 nt, Homo sapiens
cgaagacccuguugauuuu

SEQ ID NO: 1421014 - RNA, 19 nt, Homo sapiens
uaugugaugccaacucuua

SEQ ID NO: 1421015 - RNA, 19 nt, Homo sapiens
gcggaaacaucgggaaguu

SEQ ID NO: 1421016 - RNA, 19 nt, Homo sapiens
caccauggcugaagaagag

SEQ ID NO: 1421017 - RNA, 19 nt, Homo sapiens
caaacugcaucacauccaa

SEQ ID NO: 1421018 - RNA, 19 nt, Homo sapiens
gcaaagcagaggauugaug

SEQ ID NO: 1421019 - RNA, 19 nt, Homo sapiens
uaaauauaccgcuucugua

SEQ ID NO: 1421020 - RNA, 19 nt, Homo sapiens
cagggaggcugcugaggaa

SEQ ID NO: 1421021 - RNA, 19 nt, Homo sapiens
ugaagaaauuacagaggaa

SEQ ID NO: 1421022 - RNA, 19 nt, Homo sapiens
aagaaagucucauccuaau

SEQ ID NO: 1421023 - RNA, 19 nt, Homo sapiens
gaagcuuccucaaccaaag

SEQ ID NO: 1421024 - RNA, 19 nt, Homo sapiens
aaacagcucaucaaagaga

SEQ ID NO: 1421025 - RNA, 19 nt, Homo sapiens
ugaagaugcucagaauaga

SEQ ID NO: 1421026 - RNA, 19 nt, Homo sapiens
cggaugaguuucugaagga

SEQ ID NO: 1421027 - RNA, 19 nt, Homo sapiens
gaaaauaagucagcuaugc

SEQ ID NO: 1421028 - RNA, 19 nt, Homo sapiens
cagugaaacuugaaagauc

SEQ ID NO: 1421029 - RNA, 19 nt, Homo sapiens
gccucgaaauuaugguuua

SEQ ID NO: 1421030 - RNA, 19 nt, Homo sapiens
gugauaaaccuuccugaga

SEQ ID NO: 1421031 - RNA, 19 nt, Homo sapiens
gaauggaagcgcucuuugu

SEQ ID NO: 1421032 - RNA, 19 nt, Homo sapiens
ccaaggacuuaacgcaaga

SEQ ID NO: 1421033 - RNA, 19 nt, Homo sapiens
cuaaauauaccgcuucugu

SEQ ID NO: 1421034 - RNA, 19 nt, Homo sapiens
gcaggaaucaagguuauau

SEQ ID NO: 1421035 - RNA, 19 nt, Homo sapiens
gaaaauccaguauugcuaa

SEQ ID NO: 1421036 - RNA, 19 nt, Homo sapiens
cccagaggguguuuauaaa

SEQ ID NO: 1421037 - RNA, 19 nt, Homo sapiens
ggcagaauaucucuucaag

SEQ ID NO: 1421038 - RNA, 19 nt, Homo sapiens
uaucaaacagcucaucaaa

SEQ ID NO: 1421039 - RNA, 19 nt, Homo sapiens
gaaggagcgugugauaaac

SEQ ID NO: 1421040 - RNA, 19 nt, Homo sapiens
gcaacuaccgggacaucaa

SEQ ID NO: 1421041 - RNA, 19 nt, Homo sapiens
ugucagaggcagaauguuu

SEQ ID NO: 1421042 - RNA, 19 nt, Homo sapiens
ggaggagaauguggaagau

SEQ ID NO: 1421043 - RNA, 19 nt, Homo sapiens
gagaagaagaagucgaaga

SEQ ID NO: 1421044 - RNA, 19 nt, Homo sapiens
gauaaagacauuugugcau

SEQ ID NO: 1421045 - RNA, 19 nt, Homo sapiens
ccugagaaacuauuuaaug

SEQ ID NO: 1421046 - RNA, 19 nt, Homo sapiens
uaucaacacuauccucaag

SEQ ID NO: 1421047 - RNA, 19 nt, Homo sapiens
auagucaaguguaucagua

SEQ ID NO: 1421048 - RNA, 19 nt, Homo sapiens
ccagaaaauuugcagcaua

SEQ ID NO: 1421049 - RNA, 19 nt, Homo sapiens
ugucgacggugaugacuug

SEQ ID NO: 1421050 - RNA, 19 nt, Homo sapiens
aaacuugaaagaucuggua

SEQ ID NO: 1421051 - RNA, 19 nt, Homo sapiens
ugaucuagcaggagugaua

SEQ ID NO: 1421052 - RNA, 19 nt, Homo sapiens
caacugaaggaugucauuu

SEQ ID NO: 1421053 - RNA, 19 nt, Homo sapiens
ccauuuacuggucaacuua

SEQ ID NO: 1421054 - RNA, 19 nt, Homo sapiens
uggaagacauagucaagug

SEQ ID NO: 1421055 - RNA, 19 nt, Homo sapiens
cgauggaacaaauguaauu

SEQ ID NO: 1421056 - RNA, 19 nt, Homo sapiens
gaauaaacgacuggaggaa

SEQ ID NO: 1421057 - RNA, 19 nt, Homo sapiens
gcucagaauagacuugcua

SEQ ID NO: 1421058 - RNA, 19 nt, Homo sapiens
ggcgauggaacaaauguaa

SEQ ID NO: 1421059 - RNA, 19 nt, Homo sapiens
agaagauuaucgaagaaga

SEQ ID NO: 1421060 - RNA, 19 nt, Homo sapiens
cagaauguuucccuuugau

SEQ ID NO: 1421061 - RNA, 19 nt, Homo sapiens
caaaccagauccugaauaa

SEQ ID NO: 1421062 - RNA, 19 nt, Homo sapiens
ucugugacaucuaaaguua

SEQ ID NO: 1421063 - RNA, 19 nt, Homo sapiens
acaguaaccuuuauccaaa

SEQ ID NO: 1421064 - RNA, 19 nt, Homo sapiens
gauccugaauaaagucaaa

SEQ ID NO: 1421065 - RNA, 19 nt, Homo sapiens
gcagggaguuggcucucuu

SEQ ID NO: 1421066 - RNA, 19 nt, Homo sapiens
gcgcuggcaccuccucuua

SEQ ID NO: 1421067 - RNA, 19 nt, Homo sapiens
gaugcugguuaucuucaaa

SEQ ID NO: 1421068 - RNA, 19 nt, Homo sapiens
ggaugacaaucuuccaaag

SEQ ID NO: 1421069 - RNA, 19 nt, Homo sapiens
ccaaaccagauccugaaua

SEQ ID NO: 1421070 - RNA, 19 nt, Homo sapiens
gcagcuggacucucuguga

SEQ ID NO: 1421071 - RNA, 19 nt, Homo sapiens
cagccaagaugaugucuac

SEQ ID NO: 1421072 - RNA, 19 nt, Homo sapiens
cagcugaacaccacacuga

SEQ ID NO: 1421073 - RNA, 19 nt, Homo sapiens
caccuccucuuacagcuuu

SEQ ID NO: 1421074 - RNA, 19 nt, Homo sapiens
ggccggagaaggugaaauu

SEQ ID NO: 1421075 - RNA, 19 nt, Homo sapiens
gcuggcaccuccucuuaca

SEQ ID NO: 1421076 - RNA, 19 nt, Homo sapiens
gacucucugugacaucuaa

SEQ ID NO: 1421077 - RNA, 19 nt, Homo sapiens
gggcuucaccucaguagga

SEQ ID NO: 1421078 - RNA, 19 nt, Homo sapiens
cacaguaaccuuuauccaa

SEQ ID NO: 1421079 - RNA, 19 nt, Homo sapiens
caagucuccuacucccaaa

SEQ ID NO: 1421080 - RNA, 19 nt, Homo sapiens
ugucagcucccgcacagua

SEQ ID NO: 1421081 - RNA, 19 nt, Homo sapiens
aaccagauccugaauaaag

SEQ ID NO: 1421082 - RNA, 19 nt, Homo sapiens
gcagucugguggcuauucu

SEQ ID NO: 1421083 - RNA, 19 nt, Homo sapiens
ggaaaaggccggagaaggu

SEQ ID NO: 1421084 - RNA, 19 nt, Homo sapiens
ugugacaucuaaaguuauc

SEQ ID NO: 1421085 - RNA, 19 nt, Homo sapiens
augacaaucuuccaaagga

SEQ ID NO: 1421086 - RNA, 19 nt, Homo sapiens
ggccaaccaugggaaagga

SEQ ID NO: 1421087 - RNA, 19 nt, Homo sapiens
gcacaguaaccuuuaucca

SEQ ID NO: 1421088 - RNA, 19 nt, Homo sapiens
gaugacaaucuuccaaagg

SEQ ID NO: 1421089 - RNA, 19 nt, Homo sapiens
cuccauagcagccaagaug

SEQ ID NO: 1421090 - RNA, 19 nt, Homo sapiens
gcaccuccucuuacagcuu

SEQ ID NO: 1421091 - RNA, 19 nt, Homo sapiens
cauagcagccaagaugaug

SEQ ID NO: 1421092 - RNA, 19 nt, Homo sapiens
aaucgccgcauccuccaua

SEQ ID NO: 1421093 - RNA, 19 nt, Homo sapiens
gcuggacucucugugacau

SEQ ID NO: 1421094 - RNA, 19 nt, Homo sapiens
gcagccaagaugaugucua

SEQ ID NO: 1421095 - RNA, 19 nt, Homo sapiens
agucaaaacucaaccaaca

SEQ ID NO: 1421096 - RNA, 19 nt, Homo sapiens
ucccaaaacuauuuaagga

SEQ ID NO: 1421097 - RNA, 19 nt, Homo sapiens
acacugaggcagggaguug

SEQ ID NO: 1421098 - RNA, 19 nt, Homo sapiens
uggcuauucugcagucagu

SEQ ID NO: 1421099 - RNA, 19 nt, Homo sapiens
ggcuucaccucaguaggaa

SEQ ID NO: 1421100 - RNA, 19 nt, Homo sapiens
gaacuucucaucucacuuc

SEQ ID NO: 1421101 - RNA, 19 nt, Homo sapiens
gcugaagccucuuuggaaa

SEQ ID NO: 1421102 - RNA, 19 nt, Homo sapiens
ccacguggcuucauacuac

SEQ ID NO: 1421103 - RNA, 19 nt, Homo sapiens
gcuuggcgcugucaucuau

SEQ ID NO: 1421104 - RNA, 19 nt, Homo sapiens
ccaacuggucggaggauua

SEQ ID NO: 1421105 - RNA, 19 nt, Homo sapiens
caucucacuucaaccguuu

SEQ ID NO: 1421106 - RNA, 19 nt, Homo sapiens
gaaucaggauagacaccaa

SEQ ID NO: 1421107 - RNA, 19 nt, Homo sapiens
gcccaccacugccuacuuc

SEQ ID NO: 1421108 - RNA, 19 nt, Homo sapiens
gcccaggaguucaucuaug

SEQ ID NO: 1421109 - RNA, 19 nt, Homo sapiens
aaaccuggccucagaacuu

SEQ ID NO: 1421110 - RNA, 19 nt, Homo sapiens
gcguccacguggcuucaua

SEQ ID NO: 1421111 - RNA, 19 nt, Homo sapiens
gagaugcugaagccucuuu

SEQ ID NO: 1421112 - RNA, 19 nt, Homo sapiens
cccaagaccuggagaagac

SEQ ID NO: 1421113 - RNA, 19 nt, Homo sapiens
gcgcugucaucuauaacug

SEQ ID NO: 1421114 - RNA, 19 nt, Homo sapiens
guggauggacggcacauau

SEQ ID NO: 1421115 - RNA, 19 nt, Homo sapiens
uggauggacggcacauaua

SEQ ID NO: 1421116 - RNA, 19 nt, Homo sapiens
ugcccgaggugcccaugua

SEQ ID NO: 1421117 - RNA, 19 nt, Homo sapiens
gcuggaaucaggauagaca

SEQ ID NO: 1421118 - RNA, 19 nt, Homo sapiens
caaauucuggguuguggau

SEQ ID NO: 1421119 - RNA, 19 nt, Homo sapiens
ggauggacggcacauauac

SEQ ID NO: 1421120 - RNA, 19 nt, Homo sapiens
gagggacuccugccagcuu

SEQ ID NO: 1421121 - RNA, 19 nt, Homo sapiens
gcccuuccacggccucuuu

SEQ ID NO: 1421122 - RNA, 19 nt, Homo sapiens
cccaggaguucaucuaugc

SEQ ID NO: 1421123 - RNA, 19 nt, Homo sapiens
uuggcgcugucaucuauaa

SEQ ID NO: 1421124 - RNA, 19 nt, Homo sapiens
cagcuuguccuuguggaaa

SEQ ID NO: 1421125 - RNA, 19 nt, Homo sapiens
cuucucaucucacuucaac

SEQ ID NO: 1421126 - RNA, 19 nt, Homo sapiens
gcccaagaccuggagaaga

SEQ ID NO: 1421127 - RNA, 19 nt, Homo sapiens
gauggacggcacauauaca

SEQ ID NO: 1421128 - RNA, 19 nt, Homo sapiens
ccugccagcuuguccuugu

SEQ ID NO: 1421129 - RNA, 19 nt, Homo sapiens
acagagaggcuggcacguu

SEQ ID NO: 1421130 - RNA, 19 nt, Homo sapiens
cccaaaaccuggccucaga

SEQ ID NO: 1421131 - RNA, 19 nt, Homo sapiens
gagcuuggcgcugucaucu

SEQ ID NO: 1421132 - RNA, 19 nt, Homo sapiens
gcgcccaggaguucaucua

SEQ ID NO: 1421133 - RNA, 19 nt, Homo sapiens
cggcuggaaucaggauaga

SEQ ID NO: 1421134 - RNA, 19 nt, Homo sapiens
caacuggucggaggauuac

SEQ ID NO: 1421135 - RNA, 19 nt, Homo sapiens
gcagggugaaccacagcaa

SEQ ID NO: 1421136 - RNA, 19 nt, Homo sapiens
gaacauaggugacguguau

SEQ ID NO: 1421137 - RNA, 19 nt, Homo sapiens
gaccuucuaugacacauua

SEQ ID NO: 1421138 - RNA, 19 nt, Homo sapiens
gcucagagaccuucuauga

SEQ ID NO: 1421139 - RNA, 19 nt, Homo sapiens
gagaugguguuuacuuuau

SEQ ID NO: 1421140 - RNA, 19 nt, Homo sapiens
gagcccaccuuguguuuga

SEQ ID NO: 1421141 - RNA, 19 nt, Homo sapiens
ucagagaccuucuaugaca

SEQ ID NO: 1421142 - RNA, 19 nt, Homo sapiens
uaauaaacaucuccaaugg

SEQ ID NO: 1421143 - RNA, 19 nt, Homo sapiens
guaauaaacaucuccaaug

SEQ ID NO: 1421144 - RNA, 19 nt, Homo sapiens
uaaagucggugucucauac

SEQ ID NO: 1421145 - RNA, 19 nt, Homo sapiens
gaaggucgaaguugaguau

SEQ ID NO: 1421146 - RNA, 19 nt, Homo sapiens
gagaagaggcucaucaucu

SEQ ID NO: 1421147 - RNA, 19 nt, Homo sapiens
ucuaagauaugcucacaug

SEQ ID NO: 1421148 - RNA, 19 nt, Homo sapiens
ugacagagcccaccuugug

SEQ ID NO: 1421149 - RNA, 19 nt, Homo sapiens
gaaagccagccuuguguau

SEQ ID NO: 1421150 - RNA, 19 nt, Homo sapiens
ggaaagccagccuugugua

SEQ ID NO: 1421151 - RNA, 19 nt, Homo sapiens
ggucgaaguugaguaugaa

SEQ ID NO: 1421152 - RNA, 19 nt, Homo sapiens
cgagaugguguuuacuuua

SEQ ID NO: 1421153 - RNA, 19 nt, Homo sapiens
ccgagaugguguuuacuuu

SEQ ID NO: 1421154 - RNA, 19 nt, Homo sapiens
gaagcaguguaauaaacau

SEQ ID NO: 1421155 - RNA, 19 nt, Homo sapiens
ccacuugccaggcuuguuu

SEQ ID NO: 1421156 - RNA, 19 nt, Homo sapiens
gguccgagaugguguuuac

SEQ ID NO: 1421157 - RNA, 19 nt, Homo sapiens
ggaccaaccuacucuucca

SEQ ID NO: 1421158 - RNA, 19 nt, Homo sapiens
aagccagccuuguguauau

SEQ ID NO: 1421159 - RNA, 19 nt, Homo sapiens
gguguuuacuuuauguaug

SEQ ID NO: 1421160 - RNA, 19 nt, Homo sapiens
gaugguguuuacuuuaugu

SEQ ID NO: 1421161 - RNA, 19 nt, Homo sapiens
gagcagaucaacgagauug

SEQ ID NO: 1421162 - RNA, 19 nt, Homo sapiens
gaacuacauccgcuuugug

SEQ ID NO: 1421163 - RNA, 19 nt, Homo sapiens
ugacgaagcuggacauccu

SEQ ID NO: 1421164 - RNA, 19 nt, Homo sapiens
gcgaccuccugucagauuu

SEQ ID NO: 1421165 - RNA, 19 nt, Homo sapiens
agaagaggcucaucaucuc

SEQ ID NO: 1421166 - RNA, 19 nt, Homo sapiens
ccugaugauucuaagauau

SEQ ID NO: 1421167 - RNA, 19 nt, Homo sapiens
cagccgaagcaguguaaua

SEQ ID NO: 1421168 - RNA, 19 nt, Homo sapiens
ggacguacugggugagguu

SEQ ID NO: 1421169 - RNA, 19 nt, Homo sapiens
gcacaagaggggaagaaua

SEQ ID NO: 1421170 - RNA, 19 nt, Homo sapiens
ccgaagcaguguaauaaac

SEQ ID NO: 1421171 - RNA, 19 nt, Homo sapiens
cgucuggacuuguguaaac

SEQ ID NO: 1421172 - RNA, 19 nt, Homo sapiens
uaagauaugcucacauggu

SEQ ID NO: 1421173 - RNA, 19 nt, Homo sapiens
gggagucgcagucaaaugg

SEQ ID NO: 1421174 - RNA, 19 nt, Homo sapiens
ccaccgagcagaucaacga

SEQ ID NO: 1421175 - RNA, 19 nt, Homo sapiens
gaagcagagaagaaugaaa

SEQ ID NO: 1421176 - RNA, 19 nt, Homo sapiens
accaggagaugcuucagaa

SEQ ID NO: 1421177 - RNA, 19 nt, Homo sapiens
gaccugaugauucuaagau

SEQ ID NO: 1421178 - RNA, 19 nt, Homo sapiens
ccagaacuacauccgcuuu

SEQ ID NO: 1421179 - RNA, 19 nt, Homo sapiens
gauaugcucacauggucaa

SEQ ID NO: 1421180 - RNA, 19 nt, Homo sapiens
ccgagcagaucaacgagau

SEQ ID NO: 1421181 - RNA, 19 nt, Homo sapiens
ggagaagaggcucaucauc

SEQ ID NO: 1421182 - RNA, 19 nt, Homo sapiens
cgaagcaguguaauaaaca

SEQ ID NO: 1421183 - RNA, 19 nt, Homo sapiens
aaagccagccuuguguaua

SEQ ID NO: 1421184 - RNA, 19 nt, Homo sapiens
caagagagucgaugaucca

SEQ ID NO: 1421185 - RNA, 19 nt, Homo sapiens
uucagaaggucgaaguuga

SEQ ID NO: 1421186 - RNA, 19 nt, Homo sapiens
gguuaaagucggugucuca

SEQ ID NO: 1421187 - RNA, 19 nt, Homo sapiens
ggaagcagagaagaaugaa

SEQ ID NO: 1421188 - RNA, 19 nt, Homo sapiens
gcagaucaacgagauugga

SEQ ID NO: 1421189 - RNA, 19 nt, Homo sapiens
acauuagugucacaugguu

SEQ ID NO: 1421190 - RNA, 19 nt, Homo sapiens
aaacagcagcagucacguu

SEQ ID NO: 1421191 - RNA, 19 nt, Homo sapiens
cugaaggacugggagaaga

SEQ ID NO: 1421192 - RNA, 19 nt, Homo sapiens
uuaaagucggugucucaua

SEQ ID NO: 1421193 - RNA, 19 nt, Homo sapiens
ggacauccuggacguacug

SEQ ID NO: 1421194 - RNA, 19 nt, Homo sapiens
cguacugggugagguuaaa

SEQ ID NO: 1421195 - RNA, 19 nt, Homo sapiens
caucugcgaccuccuguca

SEQ ID NO: 1421196 - RNA, 19 nt, Homo sapiens
aauauaggcaccaccaaga

SEQ ID NO: 1421197 - RNA, 19 nt, Homo sapiens
ggcagcgucuggacuugug

SEQ ID NO: 1421198 - RNA, 19 nt, Homo sapiens
agaacuacauccgcuuugu

SEQ ID NO: 1421199 - RNA, 19 nt, Homo sapiens
ucacauggucaacggauuc

SEQ ID NO: 1421200 - RNA, 19 nt, Homo sapiens
ugaggaagcagagaagaau

SEQ ID NO: 1421201 - RNA, 19 nt, Homo sapiens
cagagcccaccuuguguuu

SEQ ID NO: 1421202 - RNA, 19 nt, Homo sapiens
gcaguguaauaaacaucuc

SEQ ID NO: 1421203 - RNA, 19 nt, Homo sapiens
agccgaagcaguguaauaa

SEQ ID NO: 1421204 - RNA, 19 nt, Homo sapiens
gccgaagcaguguaauaaa

SEQ ID NO: 1421205 - RNA, 19 nt, Homo sapiens
ccacaggcccagaacuaca

SEQ ID NO: 1421206 - RNA, 19 nt, Homo sapiens
ccaaccuacucuuccaaag

SEQ ID NO: 1421207 - RNA, 19 nt, Homo sapiens
gacagagcccaccuugugu

SEQ ID NO: 1421208 - RNA, 19 nt, Homo sapiens
caaagcaggaaaaccauuu

SEQ ID NO: 1421209 - RNA, 19 nt, Homo sapiens
gcaagucaagagagucgau

SEQ ID NO: 1421210 - RNA, 19 nt, Homo sapiens
guuggcaagucaagagagu

SEQ ID NO: 1421211 - RNA, 19 nt, Homo sapiens
gaggaagcagagaagaaug

SEQ ID NO: 1421212 - RNA, 19 nt, Homo sapiens
aggucgaaguugaguauga

SEQ ID NO: 1421213 - RNA, 19 nt, Homo sapiens
ggugguggaugggaaagag

SEQ ID NO: 1421214 - RNA, 19 nt, Homo sapiens
gggagaagaggcucaucau

SEQ ID NO: 1421215 - RNA, 19 nt, Homo sapiens
cagagaagaaugaaaagaa

SEQ ID NO: 1421216 - RNA, 19 nt, Homo sapiens
ugggaaagaguacgacuuc

SEQ ID NO: 1421217 - RNA, 19 nt, Homo sapiens
gacauugaaggccaacuca

SEQ ID NO: 1421218 - RNA, 19 nt, Homo sapiens
cgugggagucgcagucaaa

SEQ ID NO: 1421219 - RNA, 19 nt, Homo sapiens
aggaagcagagaagaauga

SEQ ID NO: 1421220 - RNA, 19 nt, Homo sapiens
ggaaucggaccaaccuacu

SEQ ID NO: 1421221 - RNA, 19 nt, Homo sapiens
ggaagagccaagccagcau

SEQ ID NO: 1421222 - RNA, 19 nt, Homo sapiens
agaugguguuuacuuuaug

SEQ ID NO: 1421223 - RNA, 19 nt, Homo sapiens
accugaugauucuaagaua

SEQ ID NO: 1421224 - RNA, 19 nt, Homo sapiens
ggcucgaccugaugauucu

SEQ ID NO: 1421225 - RNA, 19 nt, Homo sapiens
cccuggaaauagacauuga

SEQ ID NO: 1421226 - RNA, 19 nt, Homo sapiens
ccacggacgccgacaucau

SEQ ID NO: 1421227 - RNA, 19 nt, Homo sapiens
gcaccaccaagaagggaau

SEQ ID NO: 1421228 - RNA, 19 nt, Homo sapiens
ccacagagcuuuaggacua

SEQ ID NO: 1421229 - RNA, 19 nt, Homo sapiens
ggacuagggucuuacuaaa

SEQ ID NO: 1421230 - RNA, 19 nt, Homo sapiens
gaaagcacaaugaagauaa

SEQ ID NO: 1421231 - RNA, 19 nt, Homo sapiens
cugaugagcugguuaguuu

SEQ ID NO: 1421232 - RNA, 19 nt, Homo sapiens
acgaagagaugcaauauga

SEQ ID NO: 1421233 - RNA, 19 nt, Homo sapiens
gugaacuccugauuauuua

SEQ ID NO: 1421234 - RNA, 19 nt, Homo sapiens
ggcauaagcugcugugaga

SEQ ID NO: 1421235 - RNA, 19 nt, Homo sapiens
ggaaacaguucggguaaug

SEQ ID NO: 1421236 - RNA, 19 nt, Homo sapiens
gcaaacggaucgugcaagu

SEQ ID NO: 1421237 - RNA, 19 nt, Homo sapiens
cagaagagauuacacuaca

SEQ ID NO: 1421238 - RNA, 19 nt, Homo sapiens
aauagaaacugaacaggaa

SEQ ID NO: 1421239 - RNA, 19 nt, Homo sapiens
uaucuacucuuuagcacua

SEQ ID NO: 1421240 - RNA, 19 nt, Homo sapiens
gacaaagaguguugcaaug

SEQ ID NO: 1421241 - RNA, 19 nt, Homo sapiens
gaagagaugcaauaugaca

SEQ ID NO: 1421242 - RNA, 19 nt, Homo sapiens
ucagaaagcacaaugaaga

SEQ ID NO: 1421243 - RNA, 19 nt, Homo sapiens
auagugaacuccugauuau

SEQ ID NO: 1421244 - RNA, 19 nt, Homo sapiens
gaacagaagagauuacacu

SEQ ID NO: 1421245 - RNA, 19 nt, Homo sapiens
ccauaguguuaccucauua

SEQ ID NO: 1421246 - RNA, 19 nt, Homo sapiens
uauagugaacuccugauua

SEQ ID NO: 1421247 - RNA, 19 nt, Homo sapiens
guacagaauccuggcauaa

SEQ ID NO: 1421248 - RNA, 19 nt, Homo sapiens
gaagagauuacacuacauc

SEQ ID NO: 1421249 - RNA, 19 nt, Homo sapiens
gaacaggaacagaagagau

SEQ ID NO: 1421250 - RNA, 19 nt, Homo sapiens
aaacugaacaggaacagaa

SEQ ID NO: 1421251 - RNA, 19 nt, Homo sapiens
ccaguucacuacaggcaaa

SEQ ID NO: 1421252 - RNA, 19 nt, Homo sapiens
aaacagaccauugagauau

SEQ ID NO: 1421253 - RNA, 19 nt, Homo sapiens
gcugcaaguuuguacagaa

SEQ ID NO: 1421254 - RNA, 19 nt, Homo sapiens
acagaccauugagauauua

SEQ ID NO: 1421255 - RNA, 19 nt, Homo sapiens
gcagaagcaucagaaagca

SEQ ID NO: 1421256 - RNA, 19 nt, Homo sapiens
guaaaucccacagagcuuu

SEQ ID NO: 1421257 - RNA, 19 nt, Homo sapiens
uagagaagauauugacagu

SEQ ID NO: 1421258 - RNA, 19 nt, Homo sapiens
gcaucugaauagaaacuga

SEQ ID NO: 1421259 - RNA, 19 nt, Homo sapiens
agugaacuccugauuauuu

SEQ ID NO: 1421260 - RNA, 19 nt, Homo sapiens
aguguuaccucauuagaga

SEQ ID NO: 1421261 - RNA, 19 nt, Homo sapiens
gagcaggcauggaauuuug

SEQ ID NO: 1421262 - RNA, 19 nt, Homo sapiens
ugacaaagaguguugcaau

SEQ ID NO: 1421263 - RNA, 19 nt, Homo sapiens
guaaugacaaagaguguug

SEQ ID NO: 1421264 - RNA, 19 nt, Homo sapiens
gaaacaguucggguaauga

SEQ ID NO: 1421265 - RNA, 19 nt, Homo sapiens
agaagaauuuacagacgaa

SEQ ID NO: 1421266 - RNA, 19 nt, Homo sapiens
gaccucuucuuguucauuc

SEQ ID NO: 1421267 - RNA, 19 nt, Homo sapiens
caaagaguguugcaaugac

SEQ ID NO: 1421268 - RNA, 19 nt, Homo sapiens
caucagaaagcacaaugaa

SEQ ID NO: 1421269 - RNA, 19 nt, Homo sapiens
aacccgauccuguuaguua

SEQ ID NO: 1421270 - RNA, 19 nt, Homo sapiens
ccaaggaugauaugucuuc

SEQ ID NO: 1421271 - RNA, 19 nt, Homo sapiens
acaaagaguguugcaauga

SEQ ID NO: 1421272 - RNA, 19 nt, Homo sapiens
guccaaggaugauaugucu

SEQ ID NO: 1421273 - RNA, 19 nt, Homo sapiens
gacaggucauucucugaug

SEQ ID NO: 1421274 - RNA, 19 nt, Homo sapiens
cagacgaagagaugcaaua

SEQ ID NO: 1421275 - RNA, 19 nt, Homo sapiens
guuuguggcucuaaguugu

SEQ ID NO: 1421276 - RNA, 19 nt, Homo sapiens
aaagaguguugcaaugaca

SEQ ID NO: 1421277 - RNA, 19 nt, Homo sapiens
uaaugaacccgauccuguu

SEQ ID NO: 1421278 - RNA, 19 nt, Homo sapiens
aacagaccauugagauauu

SEQ ID NO: 1421279 - RNA, 19 nt, Homo sapiens
gggaaacaguucggguaau

SEQ ID NO: 1421280 - RNA, 19 nt, Homo sapiens
agaaagcacaaugaagaua

SEQ ID NO: 1421281 - RNA, 19 nt, Homo sapiens
uguacagaauccuggcaua

SEQ ID NO: 1421282 - RNA, 19 nt, Homo sapiens
gacaugacagucuggagaa

SEQ ID NO: 1421283 - RNA, 19 nt, Homo sapiens
ucacuacaggcaaacaauu

SEQ ID NO: 1421284 - RNA, 19 nt, Homo sapiens
aaugaacccgauccuguua

SEQ ID NO: 1421285 - RNA, 19 nt, Homo sapiens
gaugagcugguuaguuugu

SEQ ID NO: 1421286 - RNA, 19 nt, Homo sapiens
gcaaguuuguacagaaucc

SEQ ID NO: 1421287 - RNA, 19 nt, Homo sapiens
gcaucagaaagcacaauga

SEQ ID NO: 1421288 - RNA, 19 nt, Homo sapiens
cuuuaggacuagggucuua

SEQ ID NO: 1421289 - RNA, 19 nt, Homo sapiens
gcauguccaaggaugauau

SEQ ID NO: 1421290 - RNA, 19 nt, Homo sapiens
gaaacugaacaggaacaga

SEQ ID NO: 1421291 - RNA, 19 nt, Homo sapiens
ucgugcaaguggagcaaua

SEQ ID NO: 1421292 - RNA, 19 nt, Homo sapiens
aaggaccucuucuuguuca

SEQ ID NO: 1421293 - RNA, 19 nt, Homo sapiens
ugccaauaccauaguguua

SEQ ID NO: 1421294 - RNA, 19 nt, Homo sapiens
ggaccucuucuuguucauu

SEQ ID NO: 1421295 - RNA, 19 nt, Homo sapiens
aacaggaacagaagagauu

SEQ ID NO: 1421296 - RNA, 19 nt, Homo sapiens
cugcaaguuuguacagaau

SEQ ID NO: 1421297 - RNA, 19 nt, Homo sapiens
guggagcaauaacuucauc

SEQ ID NO: 1421298 - RNA, 19 nt, Homo sapiens
gaauuuacagacgaagaga

SEQ ID NO: 1421299 - RNA, 19 nt, Homo sapiens
cagaaagcacaaugaagau

SEQ ID NO: 1421300 - RNA, 19 nt, Homo sapiens
accauaguguuaccucauu

SEQ ID NO: 1421301 - RNA, 19 nt, Homo sapiens
caguucggguaaugacaaa

SEQ ID NO: 1421302 - RNA, 19 nt, Homo sapiens
ugaacccgauccuguuagu

SEQ ID NO: 1421303 - RNA, 19 nt, Homo sapiens
uagagcaggcauggaauuu

SEQ ID NO: 1421304 - RNA, 19 nt, Homo sapiens
agacgaagagaugcaauau

SEQ ID NO: 1421305 - RNA, 19 nt, Homo sapiens
gauauugacagugcugaca

SEQ ID NO: 1421306 - RNA, 19 nt, Homo sapiens
acagaauccuggcauaagc

SEQ ID NO: 1421307 - RNA, 19 nt, Homo sapiens
gacgaagagaugcaauaug

SEQ ID NO: 1421308 - RNA, 19 nt, Homo sapiens
aggacuagggucuuacuaa

SEQ ID NO: 1421309 - RNA, 19 nt, Homo sapiens
cuagagcaggcauggaauu

SEQ ID NO: 1421310 - RNA, 19 nt, Homo sapiens
guucggguaaugacaaaga

SEQ ID NO: 1421311 - RNA, 19 nt, Homo sapiens
acccgauccuguuaguuaa

SEQ ID NO: 1421312 - RNA, 19 nt, Homo sapiens
acaggaacagaagagauua

SEQ ID NO: 1421313 - RNA, 19 nt, Homo sapiens
gccuagaacuggaaaauac

SEQ ID NO: 1421314 - RNA, 19 nt, Homo sapiens
gaacccgauccuguuaguu

SEQ ID NO: 1421315 - RNA, 19 nt, Homo sapiens
caucugaauagaaacugaa

SEQ ID NO: 1421316 - RNA, 19 nt, Homo sapiens
agaagagauuacacuacau

SEQ ID NO: 1421317 - RNA, 19 nt, Homo sapiens
ucuacucuuuagcacuaua

SEQ ID NO: 1421318 - RNA, 19 nt, Homo sapiens
gacuagggucuuacuaaag

SEQ ID NO: 1421319 - RNA, 19 nt, Homo sapiens
gauuacacuacaucugaga

SEQ ID NO: 1421320 - RNA, 19 nt, Homo sapiens
agagaugcaauaugacaug

SEQ ID NO: 1421321 - RNA, 19 nt, Homo sapiens
acaugacagucuggagaaa

SEQ ID NO: 1421322 - RNA, 19 nt, Homo sapiens
aauaccagccucagcaugu

SEQ ID NO: 1421323 - RNA, 19 nt, Homo sapiens
ccucauuagagaagauauu

SEQ ID NO: 1421324 - RNA, 19 nt, Homo sapiens
gcacugaaaugaacaacaa

SEQ ID NO: 1421325 - RNA, 19 nt, Homo sapiens
acaaggagcucuuugauga

SEQ ID NO: 1421326 - RNA, 19 nt, Homo sapiens
gaacauuuauggacucaug

SEQ ID NO: 1421327 - RNA, 19 nt, Homo sapiens
gggaagagaugacugacaa

SEQ ID NO: 1421328 - RNA, 19 nt, Homo sapiens
caaagacuguggcaucaug

SEQ ID NO: 1421329 - RNA, 19 nt, Homo sapiens
cagaugaaguccuggagaa

SEQ ID NO: 1421330 - RNA, 19 nt, Homo sapiens
ggacaucguguucagcaaa

SEQ ID NO: 1421331 - RNA, 19 nt, Homo sapiens
gaaaugaacaacaagaacu

SEQ ID NO: 1421332 - RNA, 19 nt, Homo sapiens
gauaagaagaccaaguaga

SEQ ID NO: 1421333 - RNA, 19 nt, Homo sapiens
ugacagacaccagcaagua

SEQ ID NO: 1421334 - RNA, 19 nt, Homo sapiens
agagaugacugacaacaca

SEQ ID NO: 1421335 - RNA, 19 nt, Homo sapiens
ucaaagaggcagugaagga

SEQ ID NO: 1421336 - RNA, 19 nt, Homo sapiens
gcaaagucaaggccaagaa

SEQ ID NO: 1421337 - RNA, 19 nt, Homo sapiens
ggacguggacaucguguuc

SEQ ID NO: 1421338 - RNA, 19 nt, Homo sapiens
ucuccaagcugugcaaaga

SEQ ID NO: 1421339 - RNA, 19 nt, Homo sapiens
gaagaguccagaugaaguc

SEQ ID NO: 1421340 - RNA, 19 nt, Homo sapiens
ggaagaguccagaugaagu

SEQ ID NO: 1421341 - RNA, 19 nt, Homo sapiens
caaagaggcagugaaggaa

SEQ ID NO: 1421342 - RNA, 19 nt, Homo sapiens
acaauaaacaucugugugu

SEQ ID NO: 1421343 - RNA, 19 nt, Homo sapiens
caggcuaugugagugguua

SEQ ID NO: 1421344 - RNA, 19 nt, Homo sapiens
gaagagaugacugacaaca

SEQ ID NO: 1421345 - RNA, 19 nt, Homo sapiens
gagaacauuuauggacuca

SEQ ID NO: 1421346 - RNA, 19 nt, Homo sapiens
gaaguccuggagaacauuu

SEQ ID NO: 1421347 - RNA, 19 nt, Homo sapiens
guagagaggagcuucaucu

SEQ ID NO: 1421348 - RNA, 19 nt, Homo sapiens
acgauaagaagaccaagua

SEQ ID NO: 1421349 - RNA, 19 nt, Homo sapiens
caucacguuucaacaguuc

SEQ ID NO: 1421350 - RNA, 19 nt, Homo sapiens
guucuggcaccuacgauaa

SEQ ID NO: 1421351 - RNA, 19 nt, Homo sapiens
cccugacccugcauguuua

SEQ ID NO: 1421352 - RNA, 19 nt, Homo sapiens
ccacaaggagcucuuugau

SEQ ID NO: 1421353 - RNA, 19 nt, Homo sapiens
ggaaaacaauaaacaucug

SEQ ID NO: 1421354 - RNA, 19 nt, Homo sapiens
aaggagcucuuugaugaga

SEQ ID NO: 1421355 - RNA, 19 nt, Homo sapiens
gaaccaucacguuucaaca

SEQ ID NO: 1421356 - RNA, 19 nt, Homo sapiens
uaagaagaccaaguagaga

SEQ ID NO: 1421357 - RNA, 19 nt, Homo sapiens
gaugaaguccuggagaaca

SEQ ID NO: 1421358 - RNA, 19 nt, Homo sapiens
ccaucacguuucaacaguu

SEQ ID NO: 1421359 - RNA, 19 nt, Homo sapiens
gacaucguguucagcaaag

SEQ ID NO: 1421360 - RNA, 19 nt, Homo sapiens
gacgggaagagaugacuga

SEQ ID NO: 1421361 - RNA, 19 nt, Homo sapiens
ccagggagcuuggaaaaca

SEQ ID NO: 1421362 - RNA, 19 nt, Homo sapiens
auaagaagaccaaguagag

SEQ ID NO: 1421363 - RNA, 19 nt, Homo sapiens
caccauccggguacucuaa

SEQ ID NO: 1421364 - RNA, 19 nt, Homo sapiens
ccaccacuggcgcuacuaa

SEQ ID NO: 1421365 - RNA, 19 nt, Homo sapiens
gcaccuacgauaagaagac

SEQ ID NO: 1421366 - RNA, 19 nt, Homo sapiens
gguucuggcaccuacgaua

SEQ ID NO: 1421367 - RNA, 19 nt, Homo sapiens
cacaaggagcucuuugaug

SEQ ID NO: 1421368 - RNA, 19 nt, Homo sapiens
gggaagaguccagaugaag

SEQ ID NO: 1421369 - RNA, 19 nt, Homo sapiens
agggaagaguccagaugaa

SEQ ID NO: 1421370 - RNA, 19 nt, Homo sapiens
ugcaaagacuguggcauca

SEQ ID NO: 1421371 - RNA, 19 nt, Homo sapiens
aagggaagaguccagauga

SEQ ID NO: 1421372 - RNA, 19 nt, Homo sapiens
aaagggaagaguccagaug

SEQ ID NO: 1421373 - RNA, 19 nt, Homo sapiens
ugggugcaguggaccguuu

SEQ ID NO: 1421374 - RNA, 19 nt, Homo sapiens
ccaucgguuugcugcguuu

SEQ ID NO: 1421375 - RNA, 19 nt, Homo sapiens
cccgaaccaucacguuuca

SEQ ID NO: 1421376 - RNA, 19 nt, Homo sapiens
gcccgaaccaucacguuuc

SEQ ID NO: 1421377 - RNA, 19 nt, Homo sapiens
cuacuaaagcaacaacagu

SEQ ID NO: 1421378 - RNA, 19 nt, Homo sapiens
guggaccguuugacagaca

SEQ ID NO: 1421379 - RNA, 19 nt, Homo sapiens
gcaaagacuguggcaucau

SEQ ID NO: 1421380 - RNA, 19 nt, Homo sapiens
gccaagaacgcccgaacca

SEQ ID NO: 1421381 - RNA, 19 nt, Homo sapiens
caaguagagaggagcuuca

SEQ ID NO: 1421382 - RNA, 19 nt, Homo sapiens
cuaugugagugguuacaag

SEQ ID NO: 1421383 - RNA, 19 nt, Homo sapiens
ugaaaugaacaacaagaac

SEQ ID NO: 1421384 - RNA, 19 nt, Homo sapiens
gacagacaccagcaaguac

SEQ ID NO: 1421385 - RNA, 19 nt, Homo sapiens
caguggaccguuugacaga

SEQ ID NO: 1421386 - RNA, 19 nt, Homo sapiens
cugaaaugaacaacaagaa

SEQ ID NO: 1421387 - RNA, 19 nt, Homo sapiens
caaagucaaggccaagaac

SEQ ID NO: 1421388 - RNA, 19 nt, Homo sapiens
gaacacaccuuacauagug

SEQ ID NO: 1421389 - RNA, 19 nt, Homo sapiens
gcaaagaccucaacaccuu

SEQ ID NO: 1421390 - RNA, 19 nt, Homo sapiens
caacauagccugcaagaau

SEQ ID NO: 1421391 - RNA, 19 nt, Homo sapiens
gacaucaucucagugguuu

SEQ ID NO: 1421392 - RNA, 19 nt, Homo sapiens
aacauagccugcaagaaua

SEQ ID NO: 1421393 - RNA, 19 nt, Homo sapiens
ugagcaucaucaauaagua

SEQ ID NO: 1421394 - RNA, 19 nt, Homo sapiens
gagcucaccucagggaagu

SEQ ID NO: 1421395 - RNA, 19 nt, Homo sapiens
caucaucucagugguuuaa

SEQ ID NO: 1421396 - RNA, 19 nt, Homo sapiens
ccugaacacaccuuacaua

SEQ ID NO: 1421397 - RNA, 19 nt, Homo sapiens
gagccaagcccaaggacau

SEQ ID NO: 1421398 - RNA, 19 nt, Homo sapiens
acaaagagaagcaccugaa

SEQ ID NO: 1421399 - RNA, 19 nt, Homo sapiens
acacagaacggugcaaaga

SEQ ID NO: 1421400 - RNA, 19 nt, Homo sapiens
caaacugcagguacaaaga

SEQ ID NO: 1421401 - RNA, 19 nt, Homo sapiens
guacacagaacggugcaaa

SEQ ID NO: 1421402 - RNA, 19 nt, Homo sapiens
ugacaucaucucagugguu

SEQ ID NO: 1421403 - RNA, 19 nt, Homo sapiens
cugcaagaauagcuguaaa

SEQ ID NO: 1421404 - RNA, 19 nt, Homo sapiens
caucaucaauaaguacaca

SEQ ID NO: 1421405 - RNA, 19 nt, Homo sapiens
ucagggaaguacccaaacu

SEQ ID NO: 1421406 - RNA, 19 nt, Homo sapiens
aaagagaagcaccugaaca

SEQ ID NO: 1421407 - RNA, 19 nt, Homo sapiens
gcagguacaaagagaagca

SEQ ID NO: 1421408 - RNA, 19 nt, Homo sapiens
gagcaucaucaauaaguac

SEQ ID NO: 1421409 - RNA, 19 nt, Homo sapiens
ugaacacaccuuacauagu

SEQ ID NO: 1421410 - RNA, 19 nt, Homo sapiens
ccucagggaaguacccaaa

SEQ ID NO: 1421411 - RNA, 19 nt, Homo sapiens
caucaauaaguacacagaa

SEQ ID NO: 1421412 - RNA, 19 nt, Homo sapiens
ccaaacugcagguacaaag

SEQ ID NO: 1421413 - RNA, 19 nt, Homo sapiens
ccugugcacuuggauaaag

SEQ ID NO: 1421414 - RNA, 19 nt, Homo sapiens
ccaggguacccacuuguuc

SEQ ID NO: 1421415 - RNA, 19 nt, Homo sapiens
caccugaacacaccuuaca

SEQ ID NO: 1421416 - RNA, 19 nt, Homo sapiens
caaagagaagcaccugaac

SEQ ID NO: 1421417 - RNA, 19 nt, Homo sapiens
ggaggaauguguauaguua

SEQ ID NO: 1421418 - RNA, 19 nt, Homo sapiens
gaaagccacuguucgguua

SEQ ID NO: 1421419 - RNA, 19 nt, Homo sapiens
gaagauuucuguauacuug

SEQ ID NO: 1421420 - RNA, 19 nt, Homo sapiens
guggauaucugucuaagua

SEQ ID NO: 1421421 - RNA, 19 nt, Homo sapiens
ucucuaggcuguuauguua

SEQ ID NO: 1421422 - RNA, 19 nt, Homo sapiens
ccucugauauguuaaagua

SEQ ID NO: 1421423 - RNA, 19 nt, Homo sapiens
gagcaauucuucaccaaau

SEQ ID NO: 1421424 - RNA, 19 nt, Homo sapiens
aagcaccuauuaucucuua

SEQ ID NO: 1421425 - RNA, 19 nt, Homo sapiens
guagauaauuuggguggua

SEQ ID NO: 1421426 - RNA, 19 nt, Homo sapiens
aagggaagauuucuguaua

SEQ ID NO: 1421427 - RNA, 19 nt, Homo sapiens
gauucugucugaacucuuu

SEQ ID NO: 1421428 - RNA, 19 nt, Homo sapiens
ggaaggaggaaguuucaaa

SEQ ID NO: 1421429 - RNA, 19 nt, Homo sapiens
gaacuacuaccaugaaucu

SEQ ID NO: 1421430 - RNA, 19 nt, Homo sapiens
gcuaugagcuaagggagaa

SEQ ID NO: 1421431 - RNA, 19 nt, Homo sapiens
gaauguguauaguuacuca

SEQ ID NO: 1421432 - RNA, 19 nt, Homo sapiens
gcucucauaucauuccauu

SEQ ID NO: 1421433 - RNA, 19 nt, Homo sapiens
ucaccaaauuuguagauga

SEQ ID NO: 1421434 - RNA, 19 nt, Homo sapiens
agaugaagcuacacuguga

SEQ ID NO: 1421435 - RNA, 19 nt, Homo sapiens
ggaagauucugucugaacu

SEQ ID NO: 1421436 - RNA, 19 nt, Homo sapiens
uguggaagauucugucuga

SEQ ID NO: 1421437 - RNA, 19 nt, Homo sapiens
ggucuuaguagauaauuug

SEQ ID NO: 1421438 - RNA, 19 nt, Homo sapiens
ggauaucugucuaaguaag

SEQ ID NO: 1421439 - RNA, 19 nt, Homo sapiens
gagcuaagggagaacauug

SEQ ID NO: 1421440 - RNA, 19 nt, Homo sapiens
guacugaagcaccuauuau

SEQ ID NO: 1421441 - RNA, 19 nt, Homo sapiens
gguacugaagcaccuauua

SEQ ID NO: 1421442 - RNA, 19 nt, Homo sapiens
gcaccuauuaucucuuauu

SEQ ID NO: 1421443 - RNA, 19 nt, Homo sapiens
uaauuugggugguacugaa

SEQ ID NO: 1421444 - RNA, 19 nt, Homo sapiens
uaaguaaggauuccauaug

SEQ ID NO: 1421445 - RNA, 19 nt, Homo sapiens
guuaauuccucugauaugu

SEQ ID NO: 1421446 - RNA, 19 nt, Homo sapiens
gaaggaggaaguuucaaag

SEQ ID NO: 1421447 - RNA, 19 nt, Homo sapiens
ugaagcaccuauuaucucu

SEQ ID NO: 1421448 - RNA, 19 nt, Homo sapiens
uaagggaagauuucuguau

SEQ ID NO: 1421449 - RNA, 19 nt, Homo sapiens
gagaggaggaauguguaua

SEQ ID NO: 1421450 - RNA, 19 nt, Homo sapiens
caaggaacuacuaccauga

SEQ ID NO: 1421451 - RNA, 19 nt, Homo sapiens
gaggaggaauguguauagu

SEQ ID NO: 1421452 - RNA, 19 nt, Homo sapiens
ggaagauuucuguauacuu

SEQ ID NO: 1421453 - RNA, 19 nt, Homo sapiens
ggagaggaggaauguguau

SEQ ID NO: 1421454 - RNA, 19 nt, Homo sapiens
ucuguucucuaggcuguua

SEQ ID NO: 1421455 - RNA, 19 nt, Homo sapiens
acuguggucuuaguagaua

SEQ ID NO: 1421456 - RNA, 19 nt, Homo sapiens
acacuguggucuuaguaga

SEQ ID NO: 1421457 - RNA, 19 nt, Homo sapiens
ucuaggcuguuauguuaau

SEQ ID NO: 1421458 - RNA, 19 nt, Homo sapiens
aaguaaggauuccauaugg

SEQ ID NO: 1421459 - RNA, 19 nt, Homo sapiens
gggaagauuucuguauacu

SEQ ID NO: 1421460 - RNA, 19 nt, Homo sapiens
cagacacggugcuaagaca

SEQ ID NO: 1421461 - RNA, 19 nt, Homo sapiens
caccaaauuuguagaugag

SEQ ID NO: 1421462 - RNA, 19 nt, Homo sapiens
guaagggaagauuucugua

SEQ ID NO: 1421463 - RNA, 19 nt, Homo sapiens
ccaacaggcaggcagauca

SEQ ID NO: 1421464 - RNA, 19 nt, Homo sapiens
ucaauaacagaucaguuug

SEQ ID NO: 1421465 - RNA, 19 nt, Homo sapiens
gggacccgcuaugagcuaa

SEQ ID NO: 1421466 - RNA, 19 nt, Homo sapiens
ggaacuacuaccaugaauc

SEQ ID NO: 1421467 - RNA, 19 nt, Homo sapiens
cuaaguaaggauuccauau

SEQ ID NO: 1421468 - RNA, 19 nt, Homo sapiens
ggagaagggaagccguuuc

SEQ ID NO: 1421469 - RNA, 19 nt, Homo sapiens
ccacuguucgguuaaagga

SEQ ID NO: 1421470 - RNA, 19 nt, Homo sapiens
uuagaugacuccaaaacuu

SEQ ID NO: 1421471 - RNA, 19 nt, Homo sapiens
gcucaucuccacccugaag

SEQ ID NO: 1421472 - RNA, 19 nt, Homo sapiens
cgagaugaagcuacacugu

SEQ ID NO: 1421473 - RNA, 19 nt, Homo sapiens
ucuuauuucuguucucuag

SEQ ID NO: 1421474 - RNA, 19 nt, Homo sapiens
gaacucuuucauucaagga

SEQ ID NO: 1421475 - RNA, 19 nt, Homo sapiens
guaaugggugagaccagaa

SEQ ID NO: 1421476 - RNA, 19 nt, Homo sapiens
gcgggaaggaggaaguuuc

SEQ ID NO: 1421477 - RNA, 19 nt, Homo sapiens
ucuccacccugaaggacaa

SEQ ID NO: 1421478 - RNA, 19 nt, Homo sapiens
agaggaggaauguguauag

SEQ ID NO: 1421479 - RNA, 19 nt, Homo sapiens
caauaacagaucaguuugg

SEQ ID NO: 1421480 - RNA, 19 nt, Homo sapiens
gggagaagggaagccguuu

SEQ ID NO: 1421481 - RNA, 19 nt, Homo sapiens
ucauaucauuccauuccau

SEQ ID NO: 1421482 - RNA, 19 nt, Homo sapiens
ggaguaagggaagauuucu

SEQ ID NO: 1421483 - RNA, 19 nt, Homo sapiens
cagcgucaaauuggaguaa

SEQ ID NO: 1421484 - RNA, 19 nt, Homo sapiens
uaaugggugagaccagaaa

SEQ ID NO: 1421485 - RNA, 19 nt, Homo sapiens
aaggaacuacuaccaugaa

SEQ ID NO: 1421486 - RNA, 19 nt, Homo sapiens
gaagauucugucugaacuc

SEQ ID NO: 1421487 - RNA, 19 nt, Homo sapiens
ugagcaauucuucaccaaa

SEQ ID NO: 1421488 - RNA, 19 nt, Homo sapiens
ucuaaguaaggauuccaua

SEQ ID NO: 1421489 - RNA, 19 nt, Homo sapiens
ggaaacaacuuacacauuu

SEQ ID NO: 1421490 - RNA, 19 nt, Homo sapiens
gaauaaaugucuucaguug

SEQ ID NO: 1421491 - RNA, 19 nt, Homo sapiens
gagcaaagaugacuuacuu

SEQ ID NO: 1421492 - RNA, 19 nt, Homo sapiens
aaacaucggucauggcaua

SEQ ID NO: 1421493 - RNA, 19 nt, Homo sapiens
guaaugagaugggauggua

SEQ ID NO: 1421494 - RNA, 19 nt, Homo sapiens
uacagugggucaaauauua

SEQ ID NO: 1421495 - RNA, 19 nt, Homo sapiens
ggaacacuguaucuuuaua

SEQ ID NO: 1421496 - RNA, 19 nt, Homo sapiens
ucuaauaccuucccuugua

SEQ ID NO: 1421497 - RNA, 19 nt, Homo sapiens
guguaaagcuucuauguau

SEQ ID NO: 1421498 - RNA, 19 nt, Homo sapiens
gaaauuuggaccuaugaua

SEQ ID NO: 1421499 - RNA, 19 nt, Homo sapiens
guaaagcagucauuagaau

SEQ ID NO: 1421500 - RNA, 19 nt, Homo sapiens
gauaguggguuguggagaa

SEQ ID NO: 1421501 - RNA, 19 nt, Homo sapiens
ggacuaagugcagauaaua

SEQ ID NO: 1421502 - RNA, 19 nt, Homo sapiens
gaacaagagaugaaaccua

SEQ ID NO: 1421503 - RNA, 19 nt, Homo sapiens
caaauuuccuuacaaacug

SEQ ID NO: 1421504 - RNA, 19 nt, Homo sapiens
gaaguauauuugccuaaug

SEQ ID NO: 1421505 - RNA, 19 nt, Homo sapiens
gagaugaaaccuacauuug

SEQ ID NO: 1421506 - RNA, 19 nt, Homo sapiens
gauaugaugacaaaggaua

SEQ ID NO: 1421507 - RNA, 19 nt, Homo sapiens
guaaagcuucuauguauug

SEQ ID NO: 1421508 - RNA, 19 nt, Homo sapiens
ggaugguaaucuaguaauu

SEQ ID NO: 1421509 - RNA, 19 nt, Homo sapiens
aaauaucaguggaucagua

SEQ ID NO: 1421510 - RNA, 19 nt, Homo sapiens
gugcaguucuuggaaauaa

SEQ ID NO: 1421511 - RNA, 19 nt, Homo sapiens
gaugaaauuuggaccuaug

SEQ ID NO: 1421512 - RNA, 19 nt, Homo sapiens
gcauuaccaucuauacaga

SEQ ID NO: 1421513 - RNA, 19 nt, Homo sapiens
cuaacguucuucuugaaua

SEQ ID NO: 1421514 - RNA, 19 nt, Homo sapiens
caaacuaggaugaaugauu

SEQ ID NO: 1421515 - RNA, 19 nt, Homo sapiens
uaacaccuauagcugauga

SEQ ID NO: 1421516 - RNA, 19 nt, Homo sapiens
ggauacagcaaucgacuuu

SEQ ID NO: 1421517 - RNA, 19 nt, Homo sapiens
caacuuacacauuuaccua

SEQ ID NO: 1421518 - RNA, 19 nt, Homo sapiens
cuggaaggauuacuauuaa

SEQ ID NO: 1421519 - RNA, 19 nt, Homo sapiens
gaugaaugauuugcacuau

SEQ ID NO: 1421520 - RNA, 19 nt, Homo sapiens
ccaaauugcaggcuuuauu

SEQ ID NO: 1421521 - RNA, 19 nt, Homo sapiens
gaaaaucaccgacuuugaa

SEQ ID NO: 1421522 - RNA, 19 nt, Homo sapiens
gcccuuccauugaauuauu

SEQ ID NO: 1421523 - RNA, 19 nt, Homo sapiens
ggaauaaaugucuucaguu

SEQ ID NO: 1421524 - RNA, 19 nt, Homo sapiens
uuucgacacuuaccuagua

SEQ ID NO: 1421525 - RNA, 19 nt, Homo sapiens
gaaauuaaagguggaguuc

SEQ ID NO: 1421526 - RNA, 19 nt, Homo sapiens
gacaaaggauacagcaauc

SEQ ID NO: 1421527 - RNA, 19 nt, Homo sapiens
uggaggauaugaugacaaa

SEQ ID NO: 1421528 - RNA, 19 nt, Homo sapiens
uacaggcuuugaaacauua

SEQ ID NO: 1421529 - RNA, 19 nt, Homo sapiens
acaaacugcagaacaaaua

SEQ ID NO: 1421530 - RNA, 19 nt, Homo sapiens
ucuggaaggauuacuauua

SEQ ID NO: 1421531 - RNA, 19 nt, Homo sapiens
ugaaugauuugcacuaucu

SEQ ID NO: 1421532 - RNA, 19 nt, Homo sapiens
ggacguguucugcaaacua

SEQ ID NO: 1421533 - RNA, 19 nt, Homo sapiens
gcaaguuaucucugaaauu

SEQ ID NO: 1421534 - RNA, 19 nt, Homo sapiens
uaauacagugggucaaaua

SEQ ID NO: 1421535 - RNA, 19 nt, Homo sapiens
auggaacacuguaucuuua

SEQ ID NO: 1421536 - RNA, 19 nt, Homo sapiens
gagaaugcaccucauggaa

SEQ ID NO: 1421537 - RNA, 19 nt, Homo sapiens
cucaagaacuucagaaauc

SEQ ID NO: 1421538 - RNA, 19 nt, Homo sapiens
gaaauuacucucaagaacu

SEQ ID NO: 1421539 - RNA, 19 nt, Homo sapiens
guggaucaguagcaauuaa

SEQ ID NO: 1421540 - RNA, 19 nt, Homo sapiens
gcgcauacgugugcaguuc

SEQ ID NO: 1421541 - RNA, 19 nt, Homo sapiens
acacaaagacacagacuug

SEQ ID NO: 1421542 - RNA, 19 nt, Homo sapiens
ccaccuacaccacgugaua

SEQ ID NO: 1421543 - RNA, 19 nt, Homo sapiens
auacagcaaucgacuuuau

SEQ ID NO: 1421544 - RNA, 19 nt, Homo sapiens
gaaauggaacacuguaucu

SEQ ID NO: 1421545 - RNA, 19 nt, Homo sapiens
ggagguuuauuuaucauac

SEQ ID NO: 1421546 - RNA, 19 nt, Homo sapiens
guacauaaaguggagguuu

SEQ ID NO: 1421547 - RNA, 19 nt, Homo sapiens
accuauagcugaugauaaa

SEQ ID NO: 1421548 - RNA, 19 nt, Homo sapiens
uggcauacuuuaacaccua

SEQ ID NO: 1421549 - RNA, 19 nt, Homo sapiens
caaagacacagacuugguu

SEQ ID NO: 1421550 - RNA, 19 nt, Homo sapiens
aaacuuuccugcuggguau

SEQ ID NO: 1421551 - RNA, 19 nt, Homo sapiens
ccaugcaaguuaucucuga

SEQ ID NO: 1421552 - RNA, 19 nt, Homo sapiens
gaaacauuaagaagcagua

SEQ ID NO: 1421553 - RNA, 19 nt, Homo sapiens
gugcuugcauuaauggaaa

SEQ ID NO: 1421554 - RNA, 19 nt, Homo sapiens
caauguguauucuuuacug

SEQ ID NO: 1421555 - RNA, 19 nt, Homo sapiens
agugaugguuggauucaua

SEQ ID NO: 1421556 - RNA, 19 nt, Homo sapiens
uuauagaaaucccucaguu

SEQ ID NO: 1421557 - RNA, 19 nt, Homo sapiens
aaacacagccuuauucacu

SEQ ID NO: 1421558 - RNA, 19 nt, Homo sapiens
gcaaucgacuuuauuuugu

SEQ ID NO: 1421559 - RNA, 19 nt, Homo sapiens
auacaggcuuugaaacauu

SEQ ID NO: 1421560 - RNA, 19 nt, Homo sapiens
uaucauacaggcuuugaaa

SEQ ID NO: 1421561 - RNA, 19 nt, Homo sapiens
auaaaugucuucaguuguc

SEQ ID NO: 1421562 - RNA, 19 nt, Homo sapiens
ucgaauagaggaauaaaug

SEQ ID NO: 1421563 - RNA, 19 nt, Homo sapiens
uaccuaacguucuucuuga

SEQ ID NO: 1421564 - RNA, 19 nt, Homo sapiens
gacuauaugccaugggaua

SEQ ID NO: 1421565 - RNA, 19 nt, Homo sapiens
gaauagaggaauaaauguc

SEQ ID NO: 1421566 - RNA, 19 nt, Homo sapiens
cauguuagaaagucagaua

SEQ ID NO: 1421567 - RNA, 19 nt, Homo sapiens
ggagaaagcccaaaacauc

SEQ ID NO: 1421568 - RNA, 19 nt, Homo sapiens
ggaugaaugauuugcacua

SEQ ID NO: 1421569 - RNA, 19 nt, Homo sapiens
gagacacagugaacuccaa

SEQ ID NO: 1421570 - RNA, 19 nt, Homo sapiens
ucaguugucucuccauuac

SEQ ID NO: 1421571 - RNA, 19 nt, Homo sapiens
cuacauauacacuuucaga

SEQ ID NO: 1421572 - RNA, 19 nt, Homo sapiens
cuggaaagauuacauacau

SEQ ID NO: 1421573 - RNA, 19 nt, Homo sapiens
cuuacaaacugcagaacaa

SEQ ID NO: 1421574 - RNA, 19 nt, Homo sapiens
gaagaacaaagaguccaaa

SEQ ID NO: 1421575 - RNA, 19 nt, Homo sapiens
gacuuggucuggaaggauu

SEQ ID NO: 1421576 - RNA, 19 nt, Homo sapiens
ugacaaaggauacagcaau

SEQ ID NO: 1421577 - RNA, 19 nt, Homo sapiens
aaaccuacauuugggagaa

SEQ ID NO: 1421578 - RNA, 19 nt, Homo sapiens
aaucaugcccuuccauuga

SEQ ID NO: 1421579 - RNA, 19 nt, Homo sapiens
uauagaaaucccucaguuu

SEQ ID NO: 1421580 - RNA, 19 nt, Homo sapiens
ugccuugacugcauuggua

SEQ ID NO: 1421581 - RNA, 19 nt, Homo sapiens
ugacuuacuugccuuggau

SEQ ID NO: 1421582 - RNA, 19 nt, Homo sapiens
gcauacgugugcaguucuu

SEQ ID NO: 1421583 - RNA, 19 nt, Homo sapiens
acucucagcuguucugugu

SEQ ID NO: 1421584 - RNA, 19 nt, Homo sapiens
uaccaucuauacagaaaug

SEQ ID NO: 1421585 - RNA, 19 nt, Homo sapiens
ccaccauucuacagaguug

SEQ ID NO: 1421586 - RNA, 19 nt, Homo sapiens
aggaauaaaugucuucagu

SEQ ID NO: 1421587 - RNA, 19 nt, Homo sapiens
agaaauuacucucaagaac

SEQ ID NO: 1421588 - RNA, 19 nt, Homo sapiens
ggagaaugcaccucaugga

SEQ ID NO: 1421589 - RNA, 19 nt, Homo sapiens
gaaaugcgcuuuacugauu

SEQ ID NO: 1421590 - RNA, 19 nt, Homo sapiens
gaaccaaaguugcagauau

SEQ ID NO: 1421591 - RNA, 19 nt, Homo sapiens
ccaaguaacagaugaauua

SEQ ID NO: 1421592 - RNA, 19 nt, Homo sapiens
ccagaaagcuccaggauuc

SEQ ID NO: 1421593 - RNA, 19 nt, Homo sapiens
ggaauaagcacuauggaaa

SEQ ID NO: 1421594 - RNA, 19 nt, Homo sapiens
cgugaaagauguuagauuu

SEQ ID NO: 1421595 - RNA, 19 nt, Homo sapiens
gcacaaugucuuucuauaa

SEQ ID NO: 1421596 - RNA, 19 nt, Homo sapiens
gcaaggguaucgaccaauu

SEQ ID NO: 1421597 - RNA, 19 nt, Homo sapiens
gcagcaagauacuauuauu

SEQ ID NO: 1421598 - RNA, 19 nt, Homo sapiens
ccaaagaccuccacugauc

SEQ ID NO: 1421599 - RNA, 19 nt, Homo sapiens
gcacauguucuuucuaauu

SEQ ID NO: 1421600 - RNA, 19 nt, Homo sapiens
cagaagacguaguguauga

SEQ ID NO: 1421601 - RNA, 19 nt, Homo sapiens
aaauagagauguugguuga

SEQ ID NO: 1421602 - RNA, 19 nt, Homo sapiens
ucucaacacugauuguaua

SEQ ID NO: 1421603 - RNA, 19 nt, Homo sapiens
caucagacuuuaccagaaa

SEQ ID NO: 1421604 - RNA, 19 nt, Homo sapiens
gcaaagaccggcuggaaga

SEQ ID NO: 1421605 - RNA, 19 nt, Homo sapiens
gagcagcaagauacuauua

SEQ ID NO: 1421606 - RNA, 19 nt, Homo sapiens
ggagugaauuuaucaaucu

SEQ ID NO: 1421607 - RNA, 19 nt, Homo sapiens
gagcuaauaugcaacaaag

SEQ ID NO: 1421608 - RNA, 19 nt, Homo sapiens
gcaaagccuucagaauauu

SEQ ID NO: 1421609 - RNA, 19 nt, Homo sapiens
caacacugauuguauaaca

SEQ ID NO: 1421610 - RNA, 19 nt, Homo sapiens
ggugaugcuuuauuuguuu

SEQ ID NO: 1421611 - RNA, 19 nt, Homo sapiens
ggacaaauguuggaaaauu

SEQ ID NO: 1421612 - RNA, 19 nt, Homo sapiens
gaaaacaaguucuucauuc

SEQ ID NO: 1421613 - RNA, 19 nt, Homo sapiens
aaucagaucuuugagguuu

SEQ ID NO: 1421614 - RNA, 19 nt, Homo sapiens
gugcugcuguuacaauaua

SEQ ID NO: 1421615 - RNA, 19 nt, Homo sapiens
ccagaccgauuacaucauu

SEQ ID NO: 1421616 - RNA, 19 nt, Homo sapiens
uugcaaagccuucagaaua

SEQ ID NO: 1421617 - RNA, 19 nt, Homo sapiens
gcagaugaaugaagagucu

SEQ ID NO: 1421618 - RNA, 19 nt, Homo sapiens
ggugagguuuguacucuaa

SEQ ID NO: 1421619 - RNA, 19 nt, Homo sapiens
guugauauauguagaguuc

SEQ ID NO: 1421620 - RNA, 19 nt, Homo sapiens
gcucagaguuacaccuuug

SEQ ID NO: 1421621 - RNA, 19 nt, Homo sapiens
cagaagcacauaagcaaua

SEQ ID NO: 1421622 - RNA, 19 nt, Homo sapiens
ugaugaaguuccagaguuu

SEQ ID NO: 1421623 - RNA, 19 nt, Homo sapiens
cccggaagcucauauacua

SEQ ID NO: 1421624 - RNA, 19 nt, Homo sapiens
aaagaucaguuugcacuaa

SEQ ID NO: 1421625 - RNA, 19 nt, Homo sapiens
cuaaggagcccagaucaua

SEQ ID NO: 1421626 - RNA, 19 nt, Homo sapiens
aaacguaguucacacuuca

SEQ ID NO: 1421627 - RNA, 19 nt, Homo sapiens
ugacgucgcuguucauuac

SEQ ID NO: 1421628 - RNA, 19 nt, Homo sapiens
ccgaagcucaucuuaaaua

SEQ ID NO: 1421629 - RNA, 19 nt, Homo sapiens
cacauguucuuucuaauug

SEQ ID NO: 1421630 - RNA, 19 nt, Homo sapiens
gcuaauaugcaacaaaguu

SEQ ID NO: 1421631 - RNA, 19 nt, Homo sapiens
guuuaaagcuuacuauguc

SEQ ID NO: 1421632 - RNA, 19 nt, Homo sapiens
gcuuggugaugcuuuauuu

SEQ ID NO: 1421633 - RNA, 19 nt, Homo sapiens
ggacucaguguuauacaaa

SEQ ID NO: 1421634 - RNA, 19 nt, Homo sapiens
gacagucaguugauauaug

SEQ ID NO: 1421635 - RNA, 19 nt, Homo sapiens
gcgcuuuacugauugcaaa

SEQ ID NO: 1421636 - RNA, 19 nt, Homo sapiens
aaccaaaguugcagauauu

SEQ ID NO: 1421637 - RNA, 19 nt, Homo sapiens
ugcaaagccuucagaauau

SEQ ID NO: 1421638 - RNA, 19 nt, Homo sapiens
gaagcacauuccaaacaug

SEQ ID NO: 1421639 - RNA, 19 nt, Homo sapiens
uauguagaguucagaauga

SEQ ID NO: 1421640 - RNA, 19 nt, Homo sapiens
uggaauuccuuaagauuga

SEQ ID NO: 1421641 - RNA, 19 nt, Homo sapiens
ucagugccauguccucuuu

SEQ ID NO: 1421642 - RNA, 19 nt, Homo sapiens
gaaggccucuauugcaaca

SEQ ID NO: 1421643 - RNA, 19 nt, Homo sapiens
ggacuuacaggacgaugaa

SEQ ID NO: 1421644 - RNA, 19 nt, Homo sapiens
gaaaauggcagauugauca

SEQ ID NO: 1421645 - RNA, 19 nt, Homo sapiens
cacaaugucuuucuauaag

SEQ ID NO: 1421646 - RNA, 19 nt, Homo sapiens
gaggaaagagggaagauuc

SEQ ID NO: 1421647 - RNA, 19 nt, Homo sapiens
gauauuggaauguauggaa

SEQ ID NO: 1421648 - RNA, 19 nt, Homo sapiens
gggagugaauuuaucaauc

SEQ ID NO: 1421649 - RNA, 19 nt, Homo sapiens
uggaacaauugcacuuuaa

SEQ ID NO: 1421650 - RNA, 19 nt, Homo sapiens
acauauuacuugugccaua

SEQ ID NO: 1421651 - RNA, 19 nt, Homo sapiens
gaagucagcccagacaugu

SEQ ID NO: 1421652 - RNA, 19 nt, Homo sapiens
cgaagcucaucuuaaauau

SEQ ID NO: 1421653 - RNA, 19 nt, Homo sapiens
uuccgaagcucaucuuaaa

SEQ ID NO: 1421654 - RNA, 19 nt, Homo sapiens
uugcacauguucuuucuaa

SEQ ID NO: 1421655 - RNA, 19 nt, Homo sapiens
gcuuaagccuggugagguu

SEQ ID NO: 1421656 - RNA, 19 nt, Homo sapiens
gaacuucauagcacaaugu

SEQ ID NO: 1421657 - RNA, 19 nt, Homo sapiens
gauuguguaugucuauaug

SEQ ID NO: 1421658 - RNA, 19 nt, Homo sapiens
gagaugauugcucuguaua

SEQ ID NO: 1421659 - RNA, 19 nt, Homo sapiens
gcauaagaggauuaaagua

SEQ ID NO: 1421660 - RNA, 19 nt, Homo sapiens
gcugggaaccugaggaauu

SEQ ID NO: 1421661 - RNA, 19 nt, Homo sapiens
gacagaagcacauaagcaa

SEQ ID NO: 1421662 - RNA, 19 nt, Homo sapiens
caacagccaccgccucuau

SEQ ID NO: 1421663 - RNA, 19 nt, Homo sapiens
caauuugggccuccuauga

SEQ ID NO: 1421664 - RNA, 19 nt, Homo sapiens
ggauuaaaguaugaaagga

SEQ ID NO: 1421665 - RNA, 19 nt, Homo sapiens
ggugcuuggugaugcuuua

SEQ ID NO: 1421666 - RNA, 19 nt, Homo sapiens
gaaagcuccaggauucauu

SEQ ID NO: 1421667 - RNA, 19 nt, Homo sapiens
cauaucuucuucacccuaa

SEQ ID NO: 1421668 - RNA, 19 nt, Homo sapiens
gaagcugaauggacacucu

SEQ ID NO: 1421669 - RNA, 19 nt, Homo sapiens
ugacagagcagcaagauac

SEQ ID NO: 1421670 - RNA, 19 nt, Homo sapiens
uaaggagcccagaucauaa

SEQ ID NO: 1421671 - RNA, 19 nt, Homo sapiens
ccaugauucucaacacuga

SEQ ID NO: 1421672 - RNA, 19 nt, Homo sapiens
gcagacagucaguugauau

SEQ ID NO: 1421673 - RNA, 19 nt, Homo sapiens
caaugcuaguuucugcuua

SEQ ID NO: 1421674 - RNA, 19 nt, Homo sapiens
agaagcacauaagcaauaa

SEQ ID NO: 1421675 - RNA, 19 nt, Homo sapiens
aguaauccaccauuucuua

SEQ ID NO: 1421676 - RNA, 19 nt, Homo sapiens
acagucaguugauauaugu

SEQ ID NO: 1421677 - RNA, 19 nt, Homo sapiens
aaugauaccugcagacagu

SEQ ID NO: 1421678 - RNA, 19 nt, Homo sapiens
gcccagacaugugcaucua

SEQ ID NO: 1421679 - RNA, 19 nt, Homo sapiens
ucucugaacaucaucauaa

SEQ ID NO: 1421680 - RNA, 19 nt, Homo sapiens
ucuuauggaugaugcuuaa

SEQ ID NO: 1421681 - RNA, 19 nt, Homo sapiens
guaucucagucucugcaua

SEQ ID NO: 1421682 - RNA, 19 nt, Homo sapiens
gaagacguaguguaugaga

SEQ ID NO: 1421683 - RNA, 19 nt, Homo sapiens
cauaagcaauaagcagaaa

SEQ ID NO: 1421684 - RNA, 19 nt, Homo sapiens
ggaaaugcgcuuuacugau

SEQ ID NO: 1421685 - RNA, 19 nt, Homo sapiens
cagaaggaaaugcgcuuua

SEQ ID NO: 1421686 - RNA, 19 nt, Homo sapiens
uuggaacaauugcacuuua

SEQ ID NO: 1421687 - RNA, 19 nt, Homo sapiens
ggaagucagcccagacaug

SEQ ID NO: 1421688 - RNA, 19 nt, Homo sapiens
gguacugcuuuauguuuau

SEQ ID NO: 1421689 - RNA, 19 nt, Homo sapiens
gcagaacaguuauuuguaa

SEQ ID NO: 1421690 - RNA, 19 nt, Homo sapiens
ggaaacaccuccuaaauac

SEQ ID NO: 1421691 - RNA, 19 nt, Homo sapiens
gaugacaaaugguuaauga

SEQ ID NO: 1421692 - RNA, 19 nt, Homo sapiens
cuacaugacuuacaccaua

SEQ ID NO: 1421693 - RNA, 19 nt, Homo sapiens
ccacaaauuuccacuggua

SEQ ID NO: 1421694 - RNA, 19 nt, Homo sapiens
gcacagcuguucauccauu

SEQ ID NO: 1421695 - RNA, 19 nt, Homo sapiens
gaacuguugcuucuacuua

SEQ ID NO: 1421696 - RNA, 19 nt, Homo sapiens
gaacaugggaaugauaaua

SEQ ID NO: 1421697 - RNA, 19 nt, Homo sapiens
ugauuaaucuggucaauga

SEQ ID NO: 1421698 - RNA, 19 nt, Homo sapiens
caagguagaugacaaaugg

SEQ ID NO: 1421699 - RNA, 19 nt, Homo sapiens
ucaggaagcuuaauacugu

SEQ ID NO: 1421700 - RNA, 19 nt, Homo sapiens
uagaaacucugagcuguua

SEQ ID NO: 1421701 - RNA, 19 nt, Homo sapiens
gagcagaagugccgacaga

SEQ ID NO: 1421702 - RNA, 19 nt, Homo sapiens
gaauaggucuuucucucaa

SEQ ID NO: 1421703 - RNA, 19 nt, Homo sapiens
ggauuccgaugaugaaauu

SEQ ID NO: 1421704 - RNA, 19 nt, Homo sapiens
gaacucauguuagauaagu

SEQ ID NO: 1421705 - RNA, 19 nt, Homo sapiens
ggaagacuauuuauucucu

SEQ ID NO: 1421706 - RNA, 19 nt, Homo sapiens
ucagugaacucauguuaga

SEQ ID NO: 1421707 - RNA, 19 nt, Homo sapiens
ccaauuccuucuucuauga

SEQ ID NO: 1421708 - RNA, 19 nt, Homo sapiens
gagcuaaaccaucuucaaa

SEQ ID NO: 1421709 - RNA, 19 nt, Homo sapiens
guuauacacucgagcuuaa

SEQ ID NO: 1421710 - RNA, 19 nt, Homo sapiens
cuucagggcuuccgucuaa

SEQ ID NO: 1421711 - RNA, 19 nt, Homo sapiens
gaaguuaucuuggucaaaa

SEQ ID NO: 1421712 - RNA, 19 nt, Homo sapiens
uguauuagcuuaugaacug

SEQ ID NO: 1421713 - RNA, 19 nt, Homo sapiens
agucaaacuugguguauuu

SEQ ID NO: 1421714 - RNA, 19 nt, Homo sapiens
caguaaagcugaauguugu

SEQ ID NO: 1421715 - RNA, 19 nt, Homo sapiens
gaucagauuuagccuuuag

SEQ ID NO: 1421716 - RNA, 19 nt, Homo sapiens
aaucacaacuuuagcuuug

SEQ ID NO: 1421717 - RNA, 19 nt, Homo sapiens
acacgcagauugauuaugu

SEQ ID NO: 1421718 - RNA, 19 nt, Homo sapiens
gaagauagugauauggauu

SEQ ID NO: 1421719 - RNA, 19 nt, Homo sapiens
guucagcccugugucauaa

SEQ ID NO: 1421720 - RNA, 19 nt, Homo sapiens
cguguagguuguauacuua

SEQ ID NO: 1421721 - RNA, 19 nt, Homo sapiens
uggaaacaccuccuaaaua

SEQ ID NO: 1421722 - RNA, 19 nt, Homo sapiens
cauauaugcagaacaguua

SEQ ID NO: 1421723 - RNA, 19 nt, Homo sapiens
acucugagcuguuacuuug

SEQ ID NO: 1421724 - RNA, 19 nt, Homo sapiens
gccgaucucuuaaacagaa

SEQ ID NO: 1421725 - RNA, 19 nt, Homo sapiens
gacaaaugguuaaugacuu

SEQ ID NO: 1421726 - RNA, 19 nt, Homo sapiens
uaaaaucucugcccuaaau

SEQ ID NO: 1421727 - RNA, 19 nt, Homo sapiens
acacacugcuccuauaaau

SEQ ID NO: 1421728 - RNA, 19 nt, Homo sapiens
caaugagaaucaaauggaa

SEQ ID NO: 1421729 - RNA, 19 nt, Homo sapiens
aaucuuauguccuuuccua

SEQ ID NO: 1421730 - RNA, 19 nt, Homo sapiens
gcagugguguccaaaauaa

SEQ ID NO: 1421731 - RNA, 19 nt, Homo sapiens
aaacagaaacugcaagaug

SEQ ID NO: 1421732 - RNA, 19 nt, Homo sapiens
gcagaagugccgacagaaa

SEQ ID NO: 1421733 - RNA, 19 nt, Homo sapiens
gaacaguacuggacaaaag

SEQ ID NO: 1421734 - RNA, 19 nt, Homo sapiens
gcacuuacucuucuacaau

SEQ ID NO: 1421735 - RNA, 19 nt, Homo sapiens
caaaggcagugguguccaa

SEQ ID NO: 1421736 - RNA, 19 nt, Homo sapiens
aucccuaucuucagaauua

SEQ ID NO: 1421737 - RNA, 19 nt, Homo sapiens
acaguggaaucacaacuuu

SEQ ID NO: 1421738 - RNA, 19 nt, Homo sapiens
gauccaggcacauuugaaa

SEQ ID NO: 1421739 - RNA, 19 nt, Homo sapiens
uuagauacauccagaaagu

SEQ ID NO: 1421740 - RNA, 19 nt, Homo sapiens
ucgaucagauuuagccuuu

SEQ ID NO: 1421741 - RNA, 19 nt, Homo sapiens
gaaaggaagcacagcuguu

SEQ ID NO: 1421742 - RNA, 19 nt, Homo sapiens
aagaguaccuaaguaguuu

SEQ ID NO: 1421743 - RNA, 19 nt, Homo sapiens
gaguuggacuuagaucauu

SEQ ID NO: 1421744 - RNA, 19 nt, Homo sapiens
gggaacaugggaaugauaa

SEQ ID NO: 1421745 - RNA, 19 nt, Homo sapiens
gaauugaacaguggaauca

SEQ ID NO: 1421746 - RNA, 19 nt, Homo sapiens
gugaacucauguuagauaa

SEQ ID NO: 1421747 - RNA, 19 nt, Homo sapiens
ccauugaguuggacuuaga

SEQ ID NO: 1421748 - RNA, 19 nt, Homo sapiens
uaacuuagucuguaaugug

SEQ ID NO: 1421749 - RNA, 19 nt, Homo sapiens
ccaaauaauuaucccuauc

SEQ ID NO: 1421750 - RNA, 19 nt, Homo sapiens
ucuauccacucccuuaauu

SEQ ID NO: 1421751 - RNA, 19 nt, Homo sapiens
gcgccuguauguucuuuga

SEQ ID NO: 1421752 - RNA, 19 nt, Homo sapiens
uuacugggcuccuagaaca

SEQ ID NO: 1421753 - RNA, 19 nt, Homo sapiens
acaggaagacuauuuauuc

SEQ ID NO: 1421754 - RNA, 19 nt, Homo sapiens
gcacaggaagacuauuuau

SEQ ID NO: 1421755 - RNA, 19 nt, Homo sapiens
guagaugacaaaugguuaa

SEQ ID NO: 1421756 - RNA, 19 nt, Homo sapiens
uaucagugaacucauguua

SEQ ID NO: 1421757 - RNA, 19 nt, Homo sapiens
gcaggauuacuaaauuuga

SEQ ID NO: 1421758 - RNA, 19 nt, Homo sapiens
gaaucacaacuuuagcuuu

SEQ ID NO: 1421759 - RNA, 19 nt, Homo sapiens
uaccagaccuccuucagau

SEQ ID NO: 1421760 - RNA, 19 nt, Homo sapiens
cgacacacugcuccuauaa

SEQ ID NO: 1421761 - RNA, 19 nt, Homo sapiens
ugacuuacaccauacagaa

SEQ ID NO: 1421762 - RNA, 19 nt, Homo sapiens
cagcacaggaagacuauuu

SEQ ID NO: 1421763 - RNA, 19 nt, Homo sapiens
acacugcuccuauaaauuc

SEQ ID NO: 1421764 - RNA, 19 nt, Homo sapiens
gcugagacagugaauggua

SEQ ID NO: 1421765 - RNA, 19 nt, Homo sapiens
ucuguaauguggcuucaaa

SEQ ID NO: 1421766 - RNA, 19 nt, Homo sapiens
aaacauggagcucaguauu

SEQ ID NO: 1421767 - RNA, 19 nt, Homo sapiens
aaagaguaccuaaguaguu

SEQ ID NO: 1421768 - RNA, 19 nt, Homo sapiens
ccaaagaguaccuaaguag

SEQ ID NO: 1421769 - RNA, 19 nt, Homo sapiens
gaugggaacaugggaauga

SEQ ID NO: 1421770 - RNA, 19 nt, Homo sapiens
ugacauuacugggcuccua

SEQ ID NO: 1421771 - RNA, 19 nt, Homo sapiens
ggggagugauggauaaaua

SEQ ID NO: 1421772 - RNA, 19 nt, Homo sapiens
aaaccgaagugucuuuaag

SEQ ID NO: 1421773 - RNA, 19 nt, Homo sapiens
gaggugcacuuacucuucu

SEQ ID NO: 1421774 - RNA, 19 nt, Homo sapiens
gguagaugacaaaugguua

SEQ ID NO: 1421775 - RNA, 19 nt, Homo sapiens
guaacaggaugggaacaug

SEQ ID NO: 1421776 - RNA, 19 nt, Homo sapiens
uauagucguucucuucaug

SEQ ID NO: 1421777 - RNA, 19 nt, Homo sapiens
gaaauucuaacacuuugca

SEQ ID NO: 1421778 - RNA, 19 nt, Homo sapiens
ucauaucagugaacucaug

SEQ ID NO: 1421779 - RNA, 19 nt, Homo sapiens
ggagcucaguauucaggaa

SEQ ID NO: 1421780 - RNA, 19 nt, Homo sapiens
caggauugaugcaccagaa

SEQ ID NO: 1421781 - RNA, 19 nt, Homo sapiens
guaacuguacaacuuauga

SEQ ID NO: 1421782 - RNA, 19 nt, Homo sapiens
gaaagugcccagaagaaac

SEQ ID NO: 1421783 - RNA, 19 nt, Homo sapiens
gaaauccugcaguuggaaa

SEQ ID NO: 1421784 - RNA, 19 nt, Homo sapiens
gguuauguguggaguggaa

SEQ ID NO: 1421785 - RNA, 19 nt, Homo sapiens
gacagugaaugguauagag

SEQ ID NO: 1421786 - RNA, 19 nt, Homo sapiens
ucaaugagaaucaaaugga

SEQ ID NO: 1421787 - RNA, 19 nt, Homo sapiens
caggaagacuauuuauucu

SEQ ID NO: 1421788 - RNA, 19 nt, Homo sapiens
gauuauguccacugucuug

SEQ ID NO: 1421789 - RNA, 19 nt, Homo sapiens
uuacuuuccuggccaagaa

SEQ ID NO: 1421790 - RNA, 19 nt, Homo sapiens
ugugagaccuggcagaaac

SEQ ID NO: 1421791 - RNA, 19 nt, Homo sapiens
ggagugugagaccaucuga

SEQ ID NO: 1421792 - RNA, 19 nt, Homo sapiens
gaaccugcgcaccuuugug

SEQ ID NO: 1421793 - RNA, 19 nt, Homo sapiens
guaccuacaacgagaccaa

SEQ ID NO: 1421794 - RNA, 19 nt, Homo sapiens
gcugugagaccuggcagaa

SEQ ID NO: 1421795 - RNA, 19 nt, Homo sapiens
gugggaaccugcgcaccuu

SEQ ID NO: 1421796 - RNA, 19 nt, Homo sapiens
gggaaccugcgcaccuuug

SEQ ID NO: 1421797 - RNA, 19 nt, Homo sapiens
uauugaagcccaucaucga

SEQ ID NO: 1421798 - RNA, 19 nt, Homo sapiens
gcugugccgugagggaguu

SEQ ID NO: 1421799 - RNA, 19 nt, Homo sapiens
ggaaccugcgcaccuuugu

SEQ ID NO: 1421800 - RNA, 19 nt, Homo sapiens
ccauggcccuccuccuucu

SEQ ID NO: 1421801 - RNA, 19 nt, Homo sapiens
ugagggaguuuacuuuccu

SEQ ID NO: 1421802 - RNA, 19 nt, Homo sapiens
gcccauugcuaucuuauua

SEQ ID NO: 1421803 - RNA, 19 nt, Homo sapiens
gaucguaucuggcuguauu

SEQ ID NO: 1421804 - RNA, 19 nt, Homo sapiens
ggucacggcucaacauauu

SEQ ID NO: 1421805 - RNA, 19 nt, Homo sapiens
cgucucagcugccuaauau

SEQ ID NO: 1421806 - RNA, 19 nt, Homo sapiens
ccuaauaucugcguagaaa

SEQ ID NO: 1421807 - RNA, 19 nt, Homo sapiens
caacauauuucuggcauuc

SEQ ID NO: 1421808 - RNA, 19 nt, Homo sapiens
gaaccacaccaauaucuug

SEQ ID NO: 1421809 - RNA, 19 nt, Homo sapiens
gaguugggccgaugugaua

SEQ ID NO: 1421810 - RNA, 19 nt, Homo sapiens
agucauagcugcucuccaa

SEQ ID NO: 1421811 - RNA, 19 nt, Homo sapiens
ccagacaucucucaauugg

SEQ ID NO: 1421812 - RNA, 19 nt, Homo sapiens
acgcugaucuggugaguug

SEQ ID NO: 1421813 - RNA, 19 nt, Homo sapiens
aaucaaaguuccagacauc

SEQ ID NO: 1421814 - RNA, 19 nt, Homo sapiens
gaaucaaaguuccagacau

SEQ ID NO: 1421815 - RNA, 19 nt, Homo sapiens
caagcuaccugucccuaca

SEQ ID NO: 1421816 - RNA, 19 nt, Homo sapiens
gagaaggccagcauugugu

SEQ ID NO: 1421817 - RNA, 19 nt, Homo sapiens
gcugaaagccugcggaucu

SEQ ID NO: 1421818 - RNA, 19 nt, Homo sapiens
ucuccaagauccuacgauu

SEQ ID NO: 1421819 - RNA, 19 nt, Homo sapiens
gagagcaucauuaaauaag

SEQ ID NO: 1421820 - RNA, 19 nt, Homo sapiens
cauagcugcucuccaagau

SEQ ID NO: 1421821 - RNA, 19 nt, Homo sapiens
uuccagacaucucucaauu

SEQ ID NO: 1421822 - RNA, 19 nt, Homo sapiens
guaucuggcuguauuugca

SEQ ID NO: 1421823 - RNA, 19 nt, Homo sapiens
ggcugaaacuacuguugaa

SEQ ID NO: 1421824 - RNA, 19 nt, Homo sapiens
uugagucccugcaguuuga

SEQ ID NO: 1421825 - RNA, 19 nt, Homo sapiens
ugaaacuacuguugaacca

SEQ ID NO: 1421826 - RNA, 19 nt, Homo sapiens
cuucuucugcaaacuauua

SEQ ID NO: 1421827 - RNA, 19 nt, Homo sapiens
ucaguaugaugaagauucu

SEQ ID NO: 1421828 - RNA, 19 nt, Homo sapiens
acauauuucuggcauucuu

SEQ ID NO: 1421829 - RNA, 19 nt, Homo sapiens
gcaaccuucuucugcaaac

SEQ ID NO: 1421830 - RNA, 19 nt, Homo sapiens
ugagaaggccagcauugug

SEQ ID NO: 1421831 - RNA, 19 nt, Homo sapiens
ggccaauaagggagucaua

SEQ ID NO: 1421832 - RNA, 19 nt, Homo sapiens
ggccucaguaucaguauga

SEQ ID NO: 1421833 - RNA, 19 nt, Homo sapiens
ucaacauauuucuggcauu

SEQ ID NO: 1421834 - RNA, 19 nt, Homo sapiens
gcugggaaucaaaugcuuu

SEQ ID NO: 1421835 - RNA, 19 nt, Homo sapiens
gauccuacgauucuucaag

SEQ ID NO: 1421836 - RNA, 19 nt, Homo sapiens
cagaagcugggaaucaaau

SEQ ID NO: 1421837 - RNA, 19 nt, Homo sapiens
caaaguuccagacaucucu

SEQ ID NO: 1421838 - RNA, 19 nt, Homo sapiens
ccuguuggcccauugcuau

SEQ ID NO: 1421839 - RNA, 19 nt, Homo sapiens
cagcauuguguacagcuuu

SEQ ID NO: 1421840 - RNA, 19 nt, Homo sapiens
ggacaugcuccaggaccuu

SEQ ID NO: 1421841 - RNA, 19 nt, Homo sapiens
ucacggcucaacauauuuc

SEQ ID NO: 1421842 - RNA, 19 nt, Homo sapiens
uaaggugggcaucauugga

SEQ ID NO: 1421843 - RNA, 19 nt, Homo sapiens
gaagcugggaaucaaaugc

SEQ ID NO: 1421844 - RNA, 19 nt, Homo sapiens
uccaagauccuacgauucu

SEQ ID NO: 1421845 - RNA, 19 nt, Homo sapiens
ucauagcugcucuccaaga

SEQ ID NO: 1421846 - RNA, 19 nt, Homo sapiens
uguugaaccacaccaauau

SEQ ID NO: 1421847 - RNA, 19 nt, Homo sapiens
cuguugaaccacaccaaua

SEQ ID NO: 1421848 - RNA, 19 nt, Homo sapiens
cauauuucuggcauucuuu

SEQ ID NO: 1421849 - RNA, 19 nt, Homo sapiens
aggcugaaacuacuguuga

SEQ ID NO: 1421850 - RNA, 19 nt, Homo sapiens
agaaggccagcauugugua

SEQ ID NO: 1421851 - RNA, 19 nt, Homo sapiens
ugauauuccucugcugcuu

SEQ ID NO: 1421852 - RNA, 19 nt, Homo sapiens
uaacgcugaucuggugagu

SEQ ID NO: 1421853 - RNA, 19 nt, Homo sapiens
gaacagauagccaccaguu

SEQ ID NO: 1421854 - RNA, 19 nt, Homo sapiens
gaagaggcuuggugguuga

SEQ ID NO: 1421855 - RNA, 19 nt, Homo sapiens
ggauggaacucagaaugaa

SEQ ID NO: 1421856 - RNA, 19 nt, Homo sapiens
cauccugggugauuccuua

SEQ ID NO: 1421857 - RNA, 19 nt, Homo sapiens
gcauuuccauccuuguaaa

SEQ ID NO: 1421858 - RNA, 19 nt, Homo sapiens
gcucuucucuggccucuuc

SEQ ID NO: 1421859 - RNA, 19 nt, Homo sapiens
gccaugaguugcaaccaaa

SEQ ID NO: 1421860 - RNA, 19 nt, Homo sapiens
ucaguaaacauugcucuua

SEQ ID NO: 1421861 - RNA, 19 nt, Homo sapiens
cauacucaccgaauguuua

SEQ ID NO: 1421862 - RNA, 19 nt, Homo sapiens
gcgcugagaccaaaguuga

SEQ ID NO: 1421863 - RNA, 19 nt, Homo sapiens
ccagauggcccuuccuuug

SEQ ID NO: 1421864 - RNA, 19 nt, Homo sapiens
ggaagaggagcgaaggaaa

SEQ ID NO: 1421865 - RNA, 19 nt, Homo sapiens
gcuaugguuuguuuguuau

SEQ ID NO: 1421866 - RNA, 19 nt, Homo sapiens
gcuuucaacugcacauguu

SEQ ID NO: 1421867 - RNA, 19 nt, Homo sapiens
gagcugaagacccagauug

SEQ ID NO: 1421868 - RNA, 19 nt, Homo sapiens
ucauucagauuccaagaga

SEQ ID NO: 1421869 - RNA, 19 nt, Homo sapiens
uguaaacccuucauaguac

SEQ ID NO: 1421870 - RNA, 19 nt, Homo sapiens
ugcuaugguuuguuuguua

SEQ ID NO: 1421871 - RNA, 19 nt, Homo sapiens
uuccuuagcuccaagaaga

SEQ ID NO: 1421872 - RNA, 19 nt, Homo sapiens
ggugguugauucuccaaga

SEQ ID NO: 1421873 - RNA, 19 nt, Homo sapiens
gaggauggaacucagaaug

SEQ ID NO: 1421874 - RNA, 19 nt, Homo sapiens
gaagagcgggcugaggaaa

SEQ ID NO: 1421875 - RNA, 19 nt, Homo sapiens
gaaaagccaugaguugcaa

SEQ ID NO: 1421876 - RNA, 19 nt, Homo sapiens
ggcagcagcucauccugau

SEQ ID NO: 1421877 - RNA, 19 nt, Homo sapiens
agaaggagcgcacggaguu

SEQ ID NO: 1421878 - RNA, 19 nt, Homo sapiens
gaaaagugacgaagagaga

SEQ ID NO: 1421879 - RNA, 19 nt, Homo sapiens
ggaggaagaggagaaggaa

SEQ ID NO: 1421880 - RNA, 19 nt, Homo sapiens
gagcugaaauacgcugaca

SEQ ID NO: 1421881 - RNA, 19 nt, Homo sapiens
uuguaaacccuucauagua

SEQ ID NO: 1421882 - RNA, 19 nt, Homo sapiens
guguguaacuccuaaguac

SEQ ID NO: 1421883 - RNA, 19 nt, Homo sapiens
gauggaacucagaaugaaa

SEQ ID NO: 1421884 - RNA, 19 nt, Homo sapiens
gaagaggagcgaaggaaaa

SEQ ID NO: 1421885 - RNA, 19 nt, Homo sapiens
gcugaaauacgcugacauc

SEQ ID NO: 1421886 - RNA, 19 nt, Homo sapiens
gguugauucuccaagauuc

SEQ ID NO: 1421887 - RNA, 19 nt, Homo sapiens
gaggcuuggugguugauuc

SEQ ID NO: 1421888 - RNA, 19 nt, Homo sapiens
ccuaaguacuguagucucu

SEQ ID NO: 1421889 - RNA, 19 nt, Homo sapiens
ggaagagcgggcugaggaa

SEQ ID NO: 1421890 - RNA, 19 nt, Homo sapiens
aaacgcggcugaggaugga

SEQ ID NO: 1421891 - RNA, 19 nt, Homo sapiens
ccaaggaaccuccgaacag

SEQ ID NO: 1421892 - RNA, 19 nt, Homo sapiens
gaaggagcgcacggaguuu

SEQ ID NO: 1421893 - RNA, 19 nt, Homo sapiens
gaggucauccugggugauu

SEQ ID NO: 1421894 - RNA, 19 nt, Homo sapiens
gugcauuuccauccuugua

SEQ ID NO: 1421895 - RNA, 19 nt, Homo sapiens
cacucgaugugauacagua

SEQ ID NO: 1421896 - RNA, 19 nt, Homo sapiens
ggugauuccuuagcuccaa

SEQ ID NO: 1421897 - RNA, 19 nt, Homo sapiens
gaccuacgucauucagauu

SEQ ID NO: 1421898 - RNA, 19 nt, Homo sapiens
caccgaauguuuacagacu

SEQ ID NO: 1421899 - RNA, 19 nt, Homo sapiens
guaaacccuucauaguacu

SEQ ID NO: 1421900 - RNA, 19 nt, Homo sapiens
caguauaaauaugcuaugg

SEQ ID NO: 1421901 - RNA, 19 nt, Homo sapiens
gaccaagcgcugagaccaa

SEQ ID NO: 1421902 - RNA, 19 nt, Homo sapiens
gaaggaaaagugacgaaga

SEQ ID NO: 1421903 - RNA, 19 nt, Homo sapiens
gaggugaaacugggcaaga

SEQ ID NO: 1421904 - RNA, 19 nt, Homo sapiens
guaucgcucaguaaacauu

SEQ ID NO: 1421905 - RNA, 19 nt, Homo sapiens
acagauagccaccaguuac

SEQ ID NO: 1421906 - RNA, 19 nt, Homo sapiens
accaagcgcugagaccaaa

SEQ ID NO: 1421907 - RNA, 19 nt, Homo sapiens
aagaagaggcuuggugguu

SEQ ID NO: 1421908 - RNA, 19 nt, Homo sapiens
aguccuguaucgcucagua

SEQ ID NO: 1421909 - RNA, 19 nt, Homo sapiens
gagcggcuggaacucauga

SEQ ID NO: 1421910 - RNA, 19 nt, Homo sapiens
ugagcuagaugaggaagag

SEQ ID NO: 1421911 - RNA, 19 nt, Homo sapiens
cauaguacucaguccugua

SEQ ID NO: 1421912 - RNA, 19 nt, Homo sapiens
gaagccgcgugaccuacgu

SEQ ID NO: 1421913 - RNA, 19 nt, Homo sapiens
gaggaagaggagaaggaaa

SEQ ID NO: 1421914 - RNA, 19 nt, Homo sapiens
gcacuuccuggaggugaaa

SEQ ID NO: 1421915 - RNA, 19 nt, Homo sapiens
cuguaucgcucaguaaaca

SEQ ID NO: 1421916 - RNA, 19 nt, Homo sapiens
gcccgaugccggaacaaga

SEQ ID NO: 1421917 - RNA, 19 nt, Homo sapiens
ccacuccuccugcuaugau

SEQ ID NO: 1421918 - RNA, 19 nt, Homo sapiens
gugguugauucuccaagau

SEQ ID NO: 1421919 - RNA, 19 nt, Homo sapiens
ucuauaaucacucgaugug

SEQ ID NO: 1421920 - RNA, 19 nt, Homo sapiens
aggauggaacucagaauga

SEQ ID NO: 1421921 - RNA, 19 nt, Homo sapiens
ggagguggaggaggaggaa

SEQ ID NO: 1421922 - RNA, 19 nt, Homo sapiens
cuguggaggagcugaaaua

SEQ ID NO: 1421923 - RNA, 19 nt, Homo sapiens
cgccuucacucucagucuu

SEQ ID NO: 1421924 - RNA, 19 nt, Homo sapiens
uaacuccuaaguacuguag

SEQ ID NO: 1421925 - RNA, 19 nt, Homo sapiens
cagauggcccuuccuuugg

SEQ ID NO: 1421926 - RNA, 19 nt, Homo sapiens
cugcucgccuucacucuca

SEQ ID NO: 1421927 - RNA, 19 nt, Homo sapiens
cguuguguguaacuccuaa

SEQ ID NO: 1421928 - RNA, 19 nt, Homo sapiens
caccagggcacccauccaa

SEQ ID NO: 1421929 - RNA, 19 nt, Homo sapiens
ggaauccgagcggcuggaa

SEQ ID NO: 1421930 - RNA, 19 nt, Homo sapiens
gaugccggaacaagaagaa

SEQ ID NO: 1421931 - RNA, 19 nt, Homo sapiens
guguaacuccuaaguacug

SEQ ID NO: 1421932 - RNA, 19 nt, Homo sapiens
gaagaugccuggaagcaaa

SEQ ID NO: 1421933 - RNA, 19 nt, Homo sapiens
gaacacagccaucaacuau

SEQ ID NO: 1421934 - RNA, 19 nt, Homo sapiens
gaaaacagcugucccuaaa

SEQ ID NO: 1421935 - RNA, 19 nt, Homo sapiens
gaccauaacuggagaagug

SEQ ID NO: 1421936 - RNA, 19 nt, Homo sapiens
ucagaugucuccuggauaa

SEQ ID NO: 1421937 - RNA, 19 nt, Homo sapiens
aaacagcugucccuaaauu

SEQ ID NO: 1421938 - RNA, 19 nt, Homo sapiens
acacagccaucaacuauaa

SEQ ID NO: 1421939 - RNA, 19 nt, Homo sapiens
cguuggaucuucaaaguua

SEQ ID NO: 1421940 - RNA, 19 nt, Homo sapiens
caugagagauucaagauca

SEQ ID NO: 1421941 - RNA, 19 nt, Homo sapiens
ccuaggagcugauauuugu

SEQ ID NO: 1421942 - RNA, 19 nt, Homo sapiens
guaaugcauuugucuguug

SEQ ID NO: 1421943 - RNA, 19 nt, Homo sapiens
uauaaggaaugcucucgua

SEQ ID NO: 1421944 - RNA, 19 nt, Homo sapiens
cagcuucccuucacagauu

SEQ ID NO: 1421945 - RNA, 19 nt, Homo sapiens
ccaauaacauggacaacau

SEQ ID NO: 1421946 - RNA, 19 nt, Homo sapiens
gcuaugaccugaggagaau

SEQ ID NO: 1421947 - RNA, 19 nt, Homo sapiens
aacagucucugaacgguua

SEQ ID NO: 1421948 - RNA, 19 nt, Homo sapiens
gaagcgggacguacagauu

SEQ ID NO: 1421949 - RNA, 19 nt, Homo sapiens
caucgagccuccuuacuuc

SEQ ID NO: 1421950 - RNA, 19 nt, Homo sapiens
ggaacacagccaucaacua

SEQ ID NO: 1421951 - RNA, 19 nt, Homo sapiens
gauucaagaucagauucua

SEQ ID NO: 1421952 - RNA, 19 nt, Homo sapiens
caacauaucccuggaguac

SEQ ID NO: 1421953 - RNA, 19 nt, Homo sapiens
acagauuacugaacaaaca

SEQ ID NO: 1421954 - RNA, 19 nt, Homo sapiens
gaagaagccguaugcuaca

SEQ ID NO: 1421955 - RNA, 19 nt, Homo sapiens
ugacaucuuugguauugga

SEQ ID NO: 1421956 - RNA, 19 nt, Homo sapiens
ggacugggcauuacaucga

SEQ ID NO: 1421957 - RNA, 19 nt, Homo sapiens
gcugauauuugucucucaa

SEQ ID NO: 1421958 - RNA, 19 nt, Homo sapiens
ucauugacaucuuugguau

SEQ ID NO: 1421959 - RNA, 19 nt, Homo sapiens
acauaucccuggaguacuu

SEQ ID NO: 1421960 - RNA, 19 nt, Homo sapiens
ucaguaacccuaugugaau

SEQ ID NO: 1421961 - RNA, 19 nt, Homo sapiens
uugaagaucuccccaauaa

SEQ ID NO: 1421962 - RNA, 19 nt, Homo sapiens
aaucagaugucuccuggau

SEQ ID NO: 1421963 - RNA, 19 nt, Homo sapiens
aagaucagauucuaguguu

SEQ ID NO: 1421964 - RNA, 19 nt, Homo sapiens
gaaugucucagccacaguu

SEQ ID NO: 1421965 - RNA, 19 nt, Homo sapiens
caauaacauggacaacaua

SEQ ID NO: 1421966 - RNA, 19 nt, Homo sapiens
gcauuugucuguuguugac

SEQ ID NO: 1421967 - RNA, 19 nt, Homo sapiens
ugaguuguaugcccaaaca

SEQ ID NO: 1421968 - RNA, 19 nt, Homo sapiens
aaggaaugcucucguagga

SEQ ID NO: 1421969 - RNA, 19 nt, Homo sapiens
ggacaucguggauauaagg

SEQ ID NO: 1421970 - RNA, 19 nt, Homo sapiens
gaaucaagguagcuuucuc

SEQ ID NO: 1421971 - RNA, 19 nt, Homo sapiens
gaagaucuccccaauaaca

SEQ ID NO: 1421972 - RNA, 19 nt, Homo sapiens
caucguggauauaaggaau

SEQ ID NO: 1421973 - RNA, 19 nt, Homo sapiens
ggagaaucaagguagcuuu

SEQ ID NO: 1421974 - RNA, 19 nt, Homo sapiens
gaacgagccggugcgcauu

SEQ ID NO: 1421975 - RNA, 19 nt, Homo sapiens
caagaucagauucuagugu

SEQ ID NO: 1421976 - RNA, 19 nt, Homo sapiens
cagcugucccuaaauugua

SEQ ID NO: 1421977 - RNA, 19 nt, Homo sapiens
gcucauuguuggucaggau

SEQ ID NO: 1421978 - RNA, 19 nt, Homo sapiens
cagcaugauuccaauagag

SEQ ID NO: 1421979 - RNA, 19 nt, Homo sapiens
ccagcaugauuccaauaga

SEQ ID NO: 1421980 - RNA, 19 nt, Homo sapiens
gagaaucaagguagcuuuc

SEQ ID NO: 1421981 - RNA, 19 nt, Homo sapiens
acaguagcauuccaccauu

SEQ ID NO: 1421982 - RNA, 19 nt, Homo sapiens
ggaagaugccuggaagcaa

SEQ ID NO: 1421983 - RNA, 19 nt, Homo sapiens
cagauucuaguguucagua

SEQ ID NO: 1421984 - RNA, 19 nt, Homo sapiens
ugacaugagagauucaaga

SEQ ID NO: 1421985 - RNA, 19 nt, Homo sapiens
cacguuggaucuucaaagu

SEQ ID NO: 1421986 - RNA, 19 nt, Homo sapiens
uauaagcacaguagcauuc

SEQ ID NO: 1421987 - RNA, 19 nt, Homo sapiens
ugauauuugucucucaaug

SEQ ID NO: 1421988 - RNA, 19 nt, Homo sapiens
ucuccuggauaacauuaaa

SEQ ID NO: 1421989 - RNA, 19 nt, Homo sapiens
agggaucauugacaucuuu

SEQ ID NO: 1421990 - RNA, 19 nt, Homo sapiens
gaucagauucuaguguuca

SEQ ID NO: 1421991 - RNA, 19 nt, Homo sapiens
gacaugagagauucaagau

SEQ ID NO: 1421992 - RNA, 19 nt, Homo sapiens
guggacaucguggauauaa

SEQ ID NO: 1421993 - RNA, 19 nt, Homo sapiens
caguagcauuccaccauug

SEQ ID NO: 1421994 - RNA, 19 nt, Homo sapiens
ucgaagaagccguaugcua

SEQ ID NO: 1421995 - RNA, 19 nt, Homo sapiens
gcaaauucuagccuucuuc

SEQ ID NO: 1421996 - RNA, 19 nt, Homo sapiens
auugacaucuuugguauug

SEQ ID NO: 1421997 - RNA, 19 nt, Homo sapiens
ggagaagugaguuguaugc

SEQ ID NO: 1421998 - RNA, 19 nt, Homo sapiens
gggcccauccugcucauug

SEQ ID NO: 1421999 - RNA, 19 nt, Homo sapiens
gauauuugucucucaaugg

SEQ ID NO: 1422000 - RNA, 19 nt, Homo sapiens
ucacagauuacugaacaaa

SEQ ID NO: 1422001 - RNA, 19 nt, Homo sapiens
uaacauggacaacauaucc

SEQ ID NO: 1422002 - RNA, 19 nt, Homo sapiens
gguuacaggcccauggaaa

SEQ ID NO: 1422003 - RNA, 19 nt, Homo sapiens
guucaguaacccuauguga

SEQ ID NO: 1422004 - RNA, 19 nt, Homo sapiens
gagauucaagaucagauuc

SEQ ID NO: 1422005 - RNA, 19 nt, Homo sapiens
gcaugauuccaauagagaa

SEQ ID NO: 1422006 - RNA, 19 nt, Homo sapiens
guuguugacaugagagauu

SEQ ID NO: 1422007 - RNA, 19 nt, Homo sapiens
uaaugcauuugucuguugu

SEQ ID NO: 1422008 - RNA, 19 nt, Homo sapiens
cuggagaagugaguuguau

SEQ ID NO: 1422009 - RNA, 19 nt, Homo sapiens
cagccacaguuuccaucaa

SEQ ID NO: 1422010 - RNA, 19 nt, Homo sapiens
guaaaaggcccaggcauug

SEQ ID NO: 1422011 - RNA, 19 nt, Homo sapiens
uaugcuacaugcuucaaca

SEQ ID NO: 1422012 - RNA, 19 nt, Homo sapiens
gguaaaaggcccaggcauu

SEQ ID NO: 1422013 - RNA, 19 nt, Homo sapiens
uguaaugcauuugucuguu

SEQ ID NO: 1422014 - RNA, 19 nt, Homo sapiens
ucucaggccucguggacau

SEQ ID NO: 1422015 - RNA, 19 nt, Homo sapiens
agauucuaguguucaguaa

SEQ ID NO: 1422016 - RNA, 19 nt, Homo sapiens
gaucauugacaucuuuggu

SEQ ID NO: 1422017 - RNA, 19 nt, Homo sapiens
ucguggacaucguggauau

SEQ ID NO: 1422018 - RNA, 19 nt, Homo sapiens
caucaacuauaagcacagu

SEQ ID NO: 1422019 - RNA, 19 nt, Homo sapiens
acaucgagccuccuuacuu

SEQ ID NO: 1422020 - RNA, 19 nt, Homo sapiens
caaauucuagccuucuucu

SEQ ID NO: 1422021 - RNA, 19 nt, Homo sapiens
ucaacuauaagcacaguag

SEQ ID NO: 1422022 - RNA, 19 nt, Homo sapiens
gccacaguuuccaucaaug

SEQ ID NO: 1422023 - RNA, 19 nt, Homo sapiens
gucccuaaauuguaaugca

SEQ ID NO: 1422024 - RNA, 19 nt, Homo sapiens
acaggcccauggaaaggaa

SEQ ID NO: 1422025 - RNA, 19 nt, Homo sapiens
ggcuaugaccugaggagaa

SEQ ID NO: 1422026 - RNA, 19 nt, Homo sapiens
ggacguacagauuccuuuu

SEQ ID NO: 1422027 - RNA, 19 nt, Homo sapiens
ggcccauccugcucauugu

SEQ ID NO: 1422028 - RNA, 19 nt, Homo sapiens
caagaaccccagcaugauu

SEQ ID NO: 1422029 - RNA, 19 nt, Homo sapiens
agccacaguuuccaucaau

SEQ ID NO: 1422030 - RNA, 19 nt, Homo sapiens
cagggaucauugacaucuu

SEQ ID NO: 1422031 - RNA, 19 nt, Homo sapiens
gggacguacagauuccuuu

SEQ ID NO: 1422032 - RNA, 19 nt, Homo sapiens
agaaauagcucuccgguuu

SEQ ID NO: 1422033 - RNA, 19 nt, Homo sapiens
uaacaaaccuguccuugau

SEQ ID NO: 1422034 - RNA, 19 nt, Homo sapiens
gcaacaaucucugauaaga

SEQ ID NO: 1422035 - RNA, 19 nt, Homo sapiens
gaguauaucuuucaucaug

SEQ ID NO: 1422036 - RNA, 19 nt, Homo sapiens
ggaaggaauugcagaaaug

SEQ ID NO: 1422037 - RNA, 19 nt, Homo sapiens
gaagacccauuacagguuu

SEQ ID NO: 1422038 - RNA, 19 nt, Homo sapiens
gaaaugguauacauagaug

SEQ ID NO: 1422039 - RNA, 19 nt, Homo sapiens
gcaagaaucuaugaggaaa

SEQ ID NO: 1422040 - RNA, 19 nt, Homo sapiens
ccaggcagcuuggaucuua

SEQ ID NO: 1422041 - RNA, 19 nt, Homo sapiens
gcacgcagaugcuggagaa

SEQ ID NO: 1422042 - RNA, 19 nt, Homo sapiens
caagagcgcuaacagaaau

SEQ ID NO: 1422043 - RNA, 19 nt, Homo sapiens
ggacacacaacauuuaauu

SEQ ID NO: 1422044 - RNA, 19 nt, Homo sapiens
gaaacucccuggaacuaau

SEQ ID NO: 1422045 - RNA, 19 nt, Homo sapiens
gaaaugaugcuggaugaaa

SEQ ID NO: 1422046 - RNA, 19 nt, Homo sapiens
ucugaaaucugccauuaaa

SEQ ID NO: 1422047 - RNA, 19 nt, Homo sapiens
ggugggaggauuauaaaua

SEQ ID NO: 1422048 - RNA, 19 nt, Homo sapiens
agacuuuccuuaagacuuu

SEQ ID NO: 1422049 - RNA, 19 nt, Homo sapiens
ggaggugggaggauuauaa

SEQ ID NO: 1422050 - RNA, 19 nt, Homo sapiens
ggaauaggagauacaaauu

SEQ ID NO: 1422051 - RNA, 19 nt, Homo sapiens
uaguuaaggugacacauaa

SEQ ID NO: 1422052 - RNA, 19 nt, Homo sapiens
gcaaccacuucuauucuga

SEQ ID NO: 1422053 - RNA, 19 nt, Homo sapiens
ggaacaggcuaucagaaca

SEQ ID NO: 1422054 - RNA, 19 nt, Homo sapiens
gcaagggcacuauuacaaa

SEQ ID NO: 1422055 - RNA, 19 nt, Homo sapiens
cagaaaugaugcuggauga

SEQ ID NO: 1422056 - RNA, 19 nt, Homo sapiens
acauguagcugugggaaua

SEQ ID NO: 1422057 - RNA, 19 nt, Homo sapiens
caucagcagcagaauauua

SEQ ID NO: 1422058 - RNA, 19 nt, Homo sapiens
gcaagagcgcuaacagaaa

SEQ ID NO: 1422059 - RNA, 19 nt, Homo sapiens
aaaccuguccuugauauua

SEQ ID NO: 1422060 - RNA, 19 nt, Homo sapiens
gaacgugcccuuucuuugg

SEQ ID NO: 1422061 - RNA, 19 nt, Homo sapiens
ggaaaugaacaauauguca

SEQ ID NO: 1422062 - RNA, 19 nt, Homo sapiens
agacaauacucauguggaa

SEQ ID NO: 1422063 - RNA, 19 nt, Homo sapiens
ggaaaguacagauuggaaa

SEQ ID NO: 1422064 - RNA, 19 nt, Homo sapiens
uaacaaaguauucccagaa

SEQ ID NO: 1422065 - RNA, 19 nt, Homo sapiens
caaacugcaucaucauuag

SEQ ID NO: 1422066 - RNA, 19 nt, Homo sapiens
acaaacugcaucaucauua

SEQ ID NO: 1422067 - RNA, 19 nt, Homo sapiens
gggaauaggagauacaaau

SEQ ID NO: 1422068 - RNA, 19 nt, Homo sapiens
ggaagacccauuacagguu

SEQ ID NO: 1422069 - RNA, 19 nt, Homo sapiens
ucaaacaaggcuuagauaa

SEQ ID NO: 1422070 - RNA, 19 nt, Homo sapiens
gggaauguaucgugaagca

SEQ ID NO: 1422071 - RNA, 19 nt, Homo sapiens
gugggaggauuauaaauag

SEQ ID NO: 1422072 - RNA, 19 nt, Homo sapiens
gugaauuuccucaauguuu

SEQ ID NO: 1422073 - RNA, 19 nt, Homo sapiens
ggaggauuauaaauagaga

SEQ ID NO: 1422074 - RNA, 19 nt, Homo sapiens
agucugaaaucugccauua

SEQ ID NO: 1422075 - RNA, 19 nt, Homo sapiens
uugcaacaaucucugauaa

SEQ ID NO: 1422076 - RNA, 19 nt, Homo sapiens
caagcuggaagacccauua

SEQ ID NO: 1422077 - RNA, 19 nt, Homo sapiens
gaaggaauugcagaaauga

SEQ ID NO: 1422078 - RNA, 19 nt, Homo sapiens
acaaaccuguccuugauau

SEQ ID NO: 1422079 - RNA, 19 nt, Homo sapiens
uaucuaggcugaauuuaac

SEQ ID NO: 1422080 - RNA, 19 nt, Homo sapiens
cagaaaugguauacauaga

SEQ ID NO: 1422081 - RNA, 19 nt, Homo sapiens
auagagacuuuccuuaaga

SEQ ID NO: 1422082 - RNA, 19 nt, Homo sapiens
cagaauguguaaugcaaau

SEQ ID NO: 1422083 - RNA, 19 nt, Homo sapiens
gauuggagaucugcagaga

SEQ ID NO: 1422084 - RNA, 19 nt, Homo sapiens
gaagccaucgcaugcauug

SEQ ID NO: 1422085 - RNA, 19 nt, Homo sapiens
gauauuaguuaaggugaca

SEQ ID NO: 1422086 - RNA, 19 nt, Homo sapiens
gaauugcaagaaucuauga

SEQ ID NO: 1422087 - RNA, 19 nt, Homo sapiens
aacaaaguauucccagaaa

SEQ ID NO: 1422088 - RNA, 19 nt, Homo sapiens
acauaagggugacacagaa

SEQ ID NO: 1422089 - RNA, 19 nt, Homo sapiens
gcacuaugucuguguaugu

SEQ ID NO: 1422090 - RNA, 19 nt, Homo sapiens
gaagucugaagcagcauuu

SEQ ID NO: 1422091 - RNA, 19 nt, Homo sapiens
auacaaauuuggcccauca

SEQ ID NO: 1422092 - RNA, 19 nt, Homo sapiens
gaaccgcauuuuaauuuug

SEQ ID NO: 1422093 - RNA, 19 nt, Homo sapiens
gaacaggcaagggcacuau

SEQ ID NO: 1422094 - RNA, 19 nt, Homo sapiens
gcugaugucugguacaacu

SEQ ID NO: 1422095 - RNA, 19 nt, Homo sapiens
gaggaaaugaacaauaugu

SEQ ID NO: 1422096 - RNA, 19 nt, Homo sapiens
gugacugcuuuaaaucuuu

SEQ ID NO: 1422097 - RNA, 19 nt, Homo sapiens
gaagcagcaggaaauggua

SEQ ID NO: 1422098 - RNA, 19 nt, Homo sapiens
gaggugggaggauuauaaa

SEQ ID NO: 1422099 - RNA, 19 nt, Homo sapiens
gaaacaagacaauacucau

SEQ ID NO: 1422100 - RNA, 19 nt, Homo sapiens
ggacuggugguggaaagua

SEQ ID NO: 1422101 - RNA, 19 nt, Homo sapiens
aaagcacuaugucugugua

SEQ ID NO: 1422102 - RNA, 19 nt, Homo sapiens
caagggcacuauuacaaac

SEQ ID NO: 1422103 - RNA, 19 nt, Homo sapiens
ggcaagggcacuauuacaa

SEQ ID NO: 1422104 - RNA, 19 nt, Homo sapiens
cagcagaauauuacaaaga

SEQ ID NO: 1422105 - RNA, 19 nt, Homo sapiens
uaaguuuccaggagaagua

SEQ ID NO: 1422106 - RNA, 19 nt, Homo sapiens
aauagagacuuuccuuaag

SEQ ID NO: 1422107 - RNA, 19 nt, Homo sapiens
gguagcaugugccuauagu

SEQ ID NO: 1422108 - RNA, 19 nt, Homo sapiens
cagcugaugucugguacaa

SEQ ID NO: 1422109 - RNA, 19 nt, Homo sapiens
gaaucuaugaggaaaugaa

SEQ ID NO: 1422110 - RNA, 19 nt, Homo sapiens
aagaaucuaugaggaaaug

SEQ ID NO: 1422111 - RNA, 19 nt, Homo sapiens
ggaauugcaagaaucuaug

SEQ ID NO: 1422112 - RNA, 19 nt, Homo sapiens
ggcugaauuuaacaaagua

SEQ ID NO: 1422113 - RNA, 19 nt, Homo sapiens
aacugucucucacauuaua

SEQ ID NO: 1422114 - RNA, 19 nt, Homo sapiens
gcccagcaguaugauauga

SEQ ID NO: 1422115 - RNA, 19 nt, Homo sapiens
aaacaagacaauacucaug

SEQ ID NO: 1422116 - RNA, 19 nt, Homo sapiens
ggaagggccacguugaaca

SEQ ID NO: 1422117 - RNA, 19 nt, Homo sapiens
uuaguuaaggugacacaua

SEQ ID NO: 1422118 - RNA, 19 nt, Homo sapiens
cacuaugucuguguaugua

SEQ ID NO: 1422119 - RNA, 19 nt, Homo sapiens
gcagaauauuacaaagaag

SEQ ID NO: 1422120 - RNA, 19 nt, Homo sapiens
gcagcagaauauuacaaag

SEQ ID NO: 1422121 - RNA, 19 nt, Homo sapiens
uagaccacauauguucuua

SEQ ID NO: 1422122 - RNA, 19 nt, Homo sapiens
acaggcaagggcacuauua

SEQ ID NO: 1422123 - RNA, 19 nt, Homo sapiens
gaaaguacagauuggaaaa

SEQ ID NO: 1422124 - RNA, 19 nt, Homo sapiens
cagcuccuccggaagauuu

SEQ ID NO: 1422125 - RNA, 19 nt, Homo sapiens
uuaacaaaccuguccuuga

SEQ ID NO: 1422126 - RNA, 19 nt, Homo sapiens
cugcagaugggcauuuaua

SEQ ID NO: 1422127 - RNA, 19 nt, Homo sapiens
aaauagcucuccgguuuua

SEQ ID NO: 1422128 - RNA, 19 nt, Homo sapiens
ugaaacaagacaauacuca

SEQ ID NO: 1422129 - RNA, 19 nt, Homo sapiens
gcuuacaaguccugaugga

SEQ ID NO: 1422130 - RNA, 19 nt, Homo sapiens
gguggaggugggaggauua

SEQ ID NO: 1422131 - RNA, 19 nt, Homo sapiens
gcagagaagcuauguugcu

SEQ ID NO: 1422132 - RNA, 19 nt, Homo sapiens
ggaaauggccucugaagua

SEQ ID NO: 1422133 - RNA, 19 nt, Homo sapiens
caacuaagauccuaaaugu

SEQ ID NO: 1422134 - RNA, 19 nt, Homo sapiens
ggaaauggauuacucuuug

SEQ ID NO: 1422135 - RNA, 19 nt, Homo sapiens
ggaaagagacaguaauaaa

SEQ ID NO: 1422136 - RNA, 19 nt, Homo sapiens
ggucuuggcuccacuguuu

SEQ ID NO: 1422137 - RNA, 19 nt, Homo sapiens
gaaauggccucugaaguau

SEQ ID NO: 1422138 - RNA, 19 nt, Homo sapiens
ggaaagcuaugacuucuca

SEQ ID NO: 1422139 - RNA, 19 nt, Homo sapiens
gaagauagagauuuccuuu

SEQ ID NO: 1422140 - RNA, 19 nt, Homo sapiens
gcacacaggaaauggauua

SEQ ID NO: 1422141 - RNA, 19 nt, Homo sapiens
uaaguuggcccucuaguua

SEQ ID NO: 1422142 - RNA, 19 nt, Homo sapiens
guuaggagcugguaguaaa

SEQ ID NO: 1422143 - RNA, 19 nt, Homo sapiens
ggauuacucuuuggauaua

SEQ ID NO: 1422144 - RNA, 19 nt, Homo sapiens
uaacgggcuuuauuguuua

SEQ ID NO: 1422145 - RNA, 19 nt, Homo sapiens
cgggagaguugauuuauaa

SEQ ID NO: 1422146 - RNA, 19 nt, Homo sapiens
uaagauaaaucaccugugu

SEQ ID NO: 1422147 - RNA, 19 nt, Homo sapiens
caaugaaccuacucugaaa

SEQ ID NO: 1422148 - RNA, 19 nt, Homo sapiens
gaaggauggugauauuuua

SEQ ID NO: 1422149 - RNA, 19 nt, Homo sapiens
uaucaagucucuguuagua

SEQ ID NO: 1422150 - RNA, 19 nt, Homo sapiens
ccaagacuguuaagaagaa

SEQ ID NO: 1422151 - RNA, 19 nt, Homo sapiens
guaaauagcagaauucagu

SEQ ID NO: 1422152 - RNA, 19 nt, Homo sapiens
ggaaagagauuuuaaagca

SEQ ID NO: 1422153 - RNA, 19 nt, Homo sapiens
uuacagugcucauuccuaa

SEQ ID NO: 1422154 - RNA, 19 nt, Homo sapiens
gaggacaaauauaugauga

SEQ ID NO: 1422155 - RNA, 19 nt, Homo sapiens
gcacggaccuagcuaugau

SEQ ID NO: 1422156 - RNA, 19 nt, Homo sapiens
gcuaauaaguagacuaagu

SEQ ID NO: 1422157 - RNA, 19 nt, Homo sapiens
agaggcagaugacauuaua

SEQ ID NO: 1422158 - RNA, 19 nt, Homo sapiens
guacuaaugcugguuauuu

SEQ ID NO: 1422159 - RNA, 19 nt, Homo sapiens
cauaagaacuguggccaaa

SEQ ID NO: 1422160 - RNA, 19 nt, Homo sapiens
aagcaugccuucuuuauuc

SEQ ID NO: 1422161 - RNA, 19 nt, Homo sapiens
gacaucacauuaucccuuu

SEQ ID NO: 1422162 - RNA, 19 nt, Homo sapiens
gaaaguuugugcccugugu

SEQ ID NO: 1422163 - RNA, 19 nt, Homo sapiens
ggaccuagcuaugaugugu

SEQ ID NO: 1422164 - RNA, 19 nt, Homo sapiens
gagauucuaugccaaaaua

SEQ ID NO: 1422165 - RNA, 19 nt, Homo sapiens
ugguuucucuguucuauua

SEQ ID NO: 1422166 - RNA, 19 nt, Homo sapiens
agagaaggauggugauauu

SEQ ID NO: 1422167 - RNA, 19 nt, Homo sapiens
ggaagaacuugaaggaucu

SEQ ID NO: 1422168 - RNA, 19 nt, Homo sapiens
uuagagcaguuguagguua

SEQ ID NO: 1422169 - RNA, 19 nt, Homo sapiens
ucauaaccauaccugauua

SEQ ID NO: 1422170 - RNA, 19 nt, Homo sapiens
caagagacacagacaguaa

SEQ ID NO: 1422171 - RNA, 19 nt, Homo sapiens
caucaacaccucugacuuu

SEQ ID NO: 1422172 - RNA, 19 nt, Homo sapiens
gggcuggagauuaauauua

SEQ ID NO: 1422173 - RNA, 19 nt, Homo sapiens
agaagaaacuagugggauu

SEQ ID NO: 1422174 - RNA, 19 nt, Homo sapiens
gaagguugagguuuaauug

SEQ ID NO: 1422175 - RNA, 19 nt, Homo sapiens
gaaaagacccuaaacugaa

SEQ ID NO: 1422176 - RNA, 19 nt, Homo sapiens
guucaugguuuacauuaga

SEQ ID NO: 1422177 - RNA, 19 nt, Homo sapiens
cauccaaaguucaugguuu

SEQ ID NO: 1422178 - RNA, 19 nt, Homo sapiens
gcuccuauguucuguguau

SEQ ID NO: 1422179 - RNA, 19 nt, Homo sapiens
gcacauuucaccugauuug

SEQ ID NO: 1422180 - RNA, 19 nt, Homo sapiens
guaugcauauugugagaaa

SEQ ID NO: 1422181 - RNA, 19 nt, Homo sapiens
ccagaagguugagguuuaa

SEQ ID NO: 1422182 - RNA, 19 nt, Homo sapiens
ugacuucuguuucuguaaa

SEQ ID NO: 1422183 - RNA, 19 nt, Homo sapiens
gaagaaacuagugggauuu

SEQ ID NO: 1422184 - RNA, 19 nt, Homo sapiens
gcuuucagaucaacacaaa

SEQ ID NO: 1422185 - RNA, 19 nt, Homo sapiens
guuauuuccuugaagcuuu

SEQ ID NO: 1422186 - RNA, 19 nt, Homo sapiens
gagaauaucaaccauagau

SEQ ID NO: 1422187 - RNA, 19 nt, Homo sapiens
gaagacaguaauaacauug

SEQ ID NO: 1422188 - RNA, 19 nt, Homo sapiens
ccaacgcuauugaauuuau

SEQ ID NO: 1422189 - RNA, 19 nt, Homo sapiens
guauaucaagucucuguua

SEQ ID NO: 1422190 - RNA, 19 nt, Homo sapiens
agaggcaaaucaacaaauu

SEQ ID NO: 1422191 - RNA, 19 nt, Homo sapiens
uaucagguggcacaaauua

SEQ ID NO: 1422192 - RNA, 19 nt, Homo sapiens
caacaccucugacuuugag

SEQ ID NO: 1422193 - RNA, 19 nt, Homo sapiens
gaaauggauuacucuuugg

SEQ ID NO: 1422194 - RNA, 19 nt, Homo sapiens
uuccaacgcuauugaauuu

SEQ ID NO: 1422195 - RNA, 19 nt, Homo sapiens
gagacugaaugugaaauug

SEQ ID NO: 1422196 - RNA, 19 nt, Homo sapiens
aggcauuucuugaccuuua

SEQ ID NO: 1422197 - RNA, 19 nt, Homo sapiens
gugagaauaucaaccauag

SEQ ID NO: 1422198 - RNA, 19 nt, Homo sapiens
gcuaagcaaaucuauguuu

SEQ ID NO: 1422199 - RNA, 19 nt, Homo sapiens
cuuguaagcuuucagauca

SEQ ID NO: 1422200 - RNA, 19 nt, Homo sapiens
ggagaaggaaaucauaaug

SEQ ID NO: 1422201 - RNA, 19 nt, Homo sapiens
gcuuucagguacagaagua

SEQ ID NO: 1422202 - RNA, 19 nt, Homo sapiens
accagaagguugagguuua

SEQ ID NO: 1422203 - RNA, 19 nt, Homo sapiens
gaagaggcaaaucaacaaa

SEQ ID NO: 1422204 - RNA, 19 nt, Homo sapiens
gagaagaggcaaaucaaca

SEQ ID NO: 1422205 - RNA, 19 nt, Homo sapiens
ucgaagcucuguaagaaga

SEQ ID NO: 1422206 - RNA, 19 nt, Homo sapiens
cagcacauuucaccugauu

SEQ ID NO: 1422207 - RNA, 19 nt, Homo sapiens
guggaaagagacaguaaua

SEQ ID NO: 1422208 - RNA, 19 nt, Homo sapiens
gauuuaaguuggcccucua

SEQ ID NO: 1422209 - RNA, 19 nt, Homo sapiens
acagaagccuggauacaau

SEQ ID NO: 1422210 - RNA, 19 nt, Homo sapiens
acaagaaacuccuucacau

SEQ ID NO: 1422211 - RNA, 19 nt, Homo sapiens
cuagggaaauggccucuga

SEQ ID NO: 1422212 - RNA, 19 nt, Homo sapiens
caaggagaaggaaaucaua

SEQ ID NO: 1422213 - RNA, 19 nt, Homo sapiens
uagagcaguuguagguuaa

SEQ ID NO: 1422214 - RNA, 19 nt, Homo sapiens
ggccagauuuggauaagug

SEQ ID NO: 1422215 - RNA, 19 nt, Homo sapiens
aacaguggauuuacuugua

SEQ ID NO: 1422216 - RNA, 19 nt, Homo sapiens
ucaaugaaccuacucugaa

SEQ ID NO: 1422217 - RNA, 19 nt, Homo sapiens
agucgaagcucuguaagaa

SEQ ID NO: 1422218 - RNA, 19 nt, Homo sapiens
gauauaacaccaccuucaa

SEQ ID NO: 1422219 - RNA, 19 nt, Homo sapiens
gacugaaugugaaauuguu

SEQ ID NO: 1422220 - RNA, 19 nt, Homo sapiens
aaacucaucucagcgauuc

SEQ ID NO: 1422221 - RNA, 19 nt, Homo sapiens
gggcuaagcaaaucuaugu

SEQ ID NO: 1422222 - RNA, 19 nt, Homo sapiens
gcuaugacuucucaguuuc

SEQ ID NO: 1422223 - RNA, 19 nt, Homo sapiens
caaaguucaugguuuacau

SEQ ID NO: 1422224 - RNA, 19 nt, Homo sapiens
ggucaguacucacauggau

SEQ ID NO: 1422225 - RNA, 19 nt, Homo sapiens
cccagaauauacauacuuu

SEQ ID NO: 1422226 - RNA, 19 nt, Homo sapiens
guaauggcaacagaauuua

SEQ ID NO: 1422227 - RNA, 19 nt, Homo sapiens
guuaucagguggcacaaau

SEQ ID NO: 1422228 - RNA, 19 nt, Homo sapiens
gaagcucuguaagaagaaa

SEQ ID NO: 1422229 - RNA, 19 nt, Homo sapiens
ccaaaccagugcauuucaa

SEQ ID NO: 1422230 - RNA, 19 nt, Homo sapiens
uggaucgguuugugauuua

SEQ ID NO: 1422231 - RNA, 19 nt, Homo sapiens
uguaauggcaacagaauuu

SEQ ID NO: 1422232 - RNA, 19 nt, Homo sapiens
gagaagagauugccugaaa

SEQ ID NO: 1422233 - RNA, 19 nt, Homo sapiens
gcacugagguguuugguuu

SEQ ID NO: 1422234 - RNA, 19 nt, Homo sapiens
gaauugaggucauuuguga

SEQ ID NO: 1422235 - RNA, 19 nt, Homo sapiens
gcaggcagcuucagaauug

SEQ ID NO: 1422236 - RNA, 19 nt, Homo sapiens
gaaguucccuguugcauga

SEQ ID NO: 1422237 - RNA, 19 nt, Homo sapiens
ggaccacucugucaccuua

SEQ ID NO: 1422238 - RNA, 19 nt, Homo sapiens
gcccagaggugguuccuua

SEQ ID NO: 1422239 - RNA, 19 nt, Homo sapiens
ccagacacauggagaaaua

SEQ ID NO: 1422240 - RNA, 19 nt, Homo sapiens
cagaagugcugguuaauga

SEQ ID NO: 1422241 - RNA, 19 nt, Homo sapiens
agacaucacuuuaaacuug

SEQ ID NO: 1422242 - RNA, 19 nt, Homo sapiens
gacuggagauuauaguuua

SEQ ID NO: 1422243 - RNA, 19 nt, Homo sapiens
gaaucaugaucaccaauaa

SEQ ID NO: 1422244 - RNA, 19 nt, Homo sapiens
gcacagauccugcgauuca

SEQ ID NO: 1422245 - RNA, 19 nt, Homo sapiens
gagcacacguauccuaauu

SEQ ID NO: 1422246 - RNA, 19 nt, Homo sapiens
gcacuguccuuguggguuu

SEQ ID NO: 1422247 - RNA, 19 nt, Homo sapiens
acaaacugcuuucugguua

SEQ ID NO: 1422248 - RNA, 19 nt, Homo sapiens
gggauucacaucaguauua

SEQ ID NO: 1422249 - RNA, 19 nt, Homo sapiens
gaaaggaucaugauacaca

SEQ ID NO: 1422250 - RNA, 19 nt, Homo sapiens
gaccaugguuguuaauuau

SEQ ID NO: 1422251 - RNA, 19 nt, Homo sapiens
gcaaaagucuauccgauuu

SEQ ID NO: 1422252 - RNA, 19 nt, Homo sapiens
agaccaugguuguuaauua

SEQ ID NO: 1422253 - RNA, 19 nt, Homo sapiens
ggucaagggucucuaguuc

SEQ ID NO: 1422254 - RNA, 19 nt, Homo sapiens
caccagacaucacuuuaaa

SEQ ID NO: 1422255 - RNA, 19 nt, Homo sapiens
guugaaaguuccaguuauu

SEQ ID NO: 1422256 - RNA, 19 nt, Homo sapiens
guaagagacuaacguggaa

SEQ ID NO: 1422257 - RNA, 19 nt, Homo sapiens
gauagaguuuaacgucuuu

SEQ ID NO: 1422258 - RNA, 19 nt, Homo sapiens
gcagaacccauuugagauu

SEQ ID NO: 1422259 - RNA, 19 nt, Homo sapiens
caucauauaggucaucaua

SEQ ID NO: 1422260 - RNA, 19 nt, Homo sapiens
ccagcaggaucaucauuaa

SEQ ID NO: 1422261 - RNA, 19 nt, Homo sapiens
gaaguacaaugugaagaug

SEQ ID NO: 1422262 - RNA, 19 nt, Homo sapiens
ggacacagacagccaagaa

SEQ ID NO: 1422263 - RNA, 19 nt, Homo sapiens
gaacuacccaugaugaugu

SEQ ID NO: 1422264 - RNA, 19 nt, Homo sapiens
ggcaagaccucaaccuguu

SEQ ID NO: 1422265 - RNA, 19 nt, Homo sapiens
ggaauguuguucucaagug

SEQ ID NO: 1422266 - RNA, 19 nt, Homo sapiens
gccaagaacugcacagauc

SEQ ID NO: 1422267 - RNA, 19 nt, Homo sapiens
gcacacguauccuaauuac

SEQ ID NO: 1422268 - RNA, 19 nt, Homo sapiens
ggaaaggugcuaacucaga

SEQ ID NO: 1422269 - RNA, 19 nt, Homo sapiens
ccaaagugcuucugucucu

SEQ ID NO: 1422270 - RNA, 19 nt, Homo sapiens
guggaaaggugcuaacuca

SEQ ID NO: 1422271 - RNA, 19 nt, Homo sapiens
agacacaaauccucuguau

SEQ ID NO: 1422272 - RNA, 19 nt, Homo sapiens
ugucagaagugcugguuaa

SEQ ID NO: 1422273 - RNA, 19 nt, Homo sapiens
cagcagaacccauuugaga

SEQ ID NO: 1422274 - RNA, 19 nt, Homo sapiens
aaacugcucugugauguau

SEQ ID NO: 1422275 - RNA, 19 nt, Homo sapiens
gcucaguggucuucaacuu

SEQ ID NO: 1422276 - RNA, 19 nt, Homo sapiens
gaagcaacguguuugacau

SEQ ID NO: 1422277 - RNA, 19 nt, Homo sapiens
ccuaauaucugucccuauc

SEQ ID NO: 1422278 - RNA, 19 nt, Homo sapiens
ucaagggucucuaguucaa

SEQ ID NO: 1422279 - RNA, 19 nt, Homo sapiens
ccaauggugugagcaguaa

SEQ ID NO: 1422280 - RNA, 19 nt, Homo sapiens
gaacccauuugagauucua

SEQ ID NO: 1422281 - RNA, 19 nt, Homo sapiens
ccuaagaaaucagcaaaga

SEQ ID NO: 1422282 - RNA, 19 nt, Homo sapiens
gguuaaugcucuaguuuca

SEQ ID NO: 1422283 - RNA, 19 nt, Homo sapiens
guaacccggucaacaguga

SEQ ID NO: 1422284 - RNA, 19 nt, Homo sapiens
caacauccugugcauaauu

SEQ ID NO: 1422285 - RNA, 19 nt, Homo sapiens
ccaccaggcuucuauuugg

SEQ ID NO: 1422286 - RNA, 19 nt, Homo sapiens
guaagaggaaagaacauuu

SEQ ID NO: 1422287 - RNA, 19 nt, Homo sapiens
uuccagaucuucuauguga

SEQ ID NO: 1422288 - RNA, 19 nt, Homo sapiens
gagagaaaaugagugaaua

SEQ ID NO: 1422289 - RNA, 19 nt, Homo sapiens
gaucuguucuccaauaagg

SEQ ID NO: 1422290 - RNA, 19 nt, Homo sapiens
ugaauacucuuagucucua

SEQ ID NO: 1422291 - RNA, 19 nt, Homo sapiens
uaucguagcuacaccaagu

SEQ ID NO: 1422292 - RNA, 19 nt, Homo sapiens
gaauguuguucucaagugu

SEQ ID NO: 1422293 - RNA, 19 nt, Homo sapiens
aaaccacccuguugaaagu

SEQ ID NO: 1422294 - RNA, 19 nt, Homo sapiens
cgaaucaugaucaccaaua

SEQ ID NO: 1422295 - RNA, 19 nt, Homo sapiens
ugaaggagaagccacagua

SEQ ID NO: 1422296 - RNA, 19 nt, Homo sapiens
gcuggaggcugguaaugau

SEQ ID NO: 1422297 - RNA, 19 nt, Homo sapiens
ucaggucauuuccuaauau

SEQ ID NO: 1422298 - RNA, 19 nt, Homo sapiens
ucuccaaacugcucuguga

SEQ ID NO: 1422299 - RNA, 19 nt, Homo sapiens
gaugcacuuugaauauuga

SEQ ID NO: 1422300 - RNA, 19 nt, Homo sapiens
cagaucuguucuccaauaa

SEQ ID NO: 1422301 - RNA, 19 nt, Homo sapiens
caugaucaccaauaaguuu

SEQ ID NO: 1422302 - RNA, 19 nt, Homo sapiens
gucaaaaccucaucaauau

SEQ ID NO: 1422303 - RNA, 19 nt, Homo sapiens
ggauuauucuccccacuua

SEQ ID NO: 1422304 - RNA, 19 nt, Homo sapiens
aauuauggaucaacaguga

SEQ ID NO: 1422305 - RNA, 19 nt, Homo sapiens
gcucaucguguucauauau

SEQ ID NO: 1422306 - RNA, 19 nt, Homo sapiens
gaguguggguaugacuuua

SEQ ID NO: 1422307 - RNA, 19 nt, Homo sapiens
cuuguggguuugucauuua

SEQ ID NO: 1422308 - RNA, 19 nt, Homo sapiens
ccugggagccucugacuuu

SEQ ID NO: 1422309 - RNA, 19 nt, Homo sapiens
caucucuccugcacacuuu

SEQ ID NO: 1422310 - RNA, 19 nt, Homo sapiens
gccagcaggaucaucauua

SEQ ID NO: 1422311 - RNA, 19 nt, Homo sapiens
ccaauguaacuuccuuuaa

SEQ ID NO: 1422312 - RNA, 19 nt, Homo sapiens
ucauauaggucaucauacu

SEQ ID NO: 1422313 - RNA, 19 nt, Homo sapiens
gugcuucuccauaaugaua

SEQ ID NO: 1422314 - RNA, 19 nt, Homo sapiens
ggaagcaacguguuugaca

SEQ ID NO: 1422315 - RNA, 19 nt, Homo sapiens
gaaggagaagccacaguau

SEQ ID NO: 1422316 - RNA, 19 nt, Homo sapiens
gccaauguaacuuccuuua

SEQ ID NO: 1422317 - RNA, 19 nt, Homo sapiens
aaucuucgaccacuugaua

SEQ ID NO: 1422318 - RNA, 19 nt, Homo sapiens
acucagagacuggagauua

SEQ ID NO: 1422319 - RNA, 19 nt, Homo sapiens
acacaaauccucuguaugc

SEQ ID NO: 1422320 - RNA, 19 nt, Homo sapiens
cgaagacccucagcagaau

SEQ ID NO: 1422321 - RNA, 19 nt, Homo sapiens
gcaaggcacaggccacaug

SEQ ID NO: 1422322 - RNA, 19 nt, Homo sapiens
ccaaacugcucugugaugu

SEQ ID NO: 1422323 - RNA, 19 nt, Homo sapiens
caaguucaggcuucucuuu

SEQ ID NO: 1422324 - RNA, 19 nt, Homo sapiens
ccgauuugaugcacuuuga

SEQ ID NO: 1422325 - RNA, 19 nt, Homo sapiens
ugaugcacuuugaauauug

SEQ ID NO: 1422326 - RNA, 19 nt, Homo sapiens
cagagaauaagcaaugaaa

SEQ ID NO: 1422327 - RNA, 19 nt, Homo sapiens
gaagagagaaaaugaguga

SEQ ID NO: 1422328 - RNA, 19 nt, Homo sapiens
caugauggcagacauucua

SEQ ID NO: 1422329 - RNA, 19 nt, Homo sapiens
ugauagaguuuaacgucuu

SEQ ID NO: 1422330 - RNA, 19 nt, Homo sapiens
gcauccaccuaaacaagug

SEQ ID NO: 1422331 - RNA, 19 nt, Homo sapiens
ggaucgcuguguucuccua

SEQ ID NO: 1422332 - RNA, 19 nt, Homo sapiens
ucacgaagcucagagauua

SEQ ID NO: 1422333 - RNA, 19 nt, Homo sapiens
ucagaaaccugggacauaa

SEQ ID NO: 1422334 - RNA, 19 nt, Homo sapiens
gcagagggcucagcagaga

SEQ ID NO: 1422335 - RNA, 19 nt, Homo sapiens
ggaaugugcucagugaaga

SEQ ID NO: 1422336 - RNA, 19 nt, Homo sapiens
gaacaccuccagccacaaa

SEQ ID NO: 1422337 - RNA, 19 nt, Homo sapiens
gaacuggauccucugcaua

SEQ ID NO: 1422338 - RNA, 19 nt, Homo sapiens
gcacagggguggcuaguug

SEQ ID NO: 1422339 - RNA, 19 nt, Homo sapiens
gaaacugucaagggaauaa

SEQ ID NO: 1422340 - RNA, 19 nt, Homo sapiens
cagaaacugucaagggaau

SEQ ID NO: 1422341 - RNA, 19 nt, Homo sapiens
guggaggucuggacaguuc

SEQ ID NO: 1422342 - RNA, 19 nt, Homo sapiens
cugaucagcuggguaguuu

SEQ ID NO: 1422343 - RNA, 19 nt, Homo sapiens
ucaagggaauaaaguguuc

SEQ ID NO: 1422344 - RNA, 19 nt, Homo sapiens
ccacaaagaagccaaaggu

SEQ ID NO: 1422345 - RNA, 19 nt, Homo sapiens
ccauggcgcuggacuucuu

SEQ ID NO: 1422346 - RNA, 19 nt, Homo sapiens
ucaaguccaucaucaagca

SEQ ID NO: 1422347 - RNA, 19 nt, Homo sapiens
gaagacgacacugggcuuu

SEQ ID NO: 1422348 - RNA, 19 nt, Homo sapiens
uguccuggcucucuaccua

SEQ ID NO: 1422349 - RNA, 19 nt, Homo sapiens
ccauggagcuggccaagac

SEQ ID NO: 1422350 - RNA, 19 nt, Homo sapiens
aaaccugggacauaaauug

SEQ ID NO: 1422351 - RNA, 19 nt, Homo sapiens
uggugucgcuguacagaaa

SEQ ID NO: 1422352 - RNA, 19 nt, Homo sapiens
ggacaguucaagugugaug

SEQ ID NO: 1422353 - RNA, 19 nt, Homo sapiens
ccucaguguucucaucuau

SEQ ID NO: 1422354 - RNA, 19 nt, Homo sapiens
ugaggccauugcaccguua

SEQ ID NO: 1422355 - RNA, 19 nt, Homo sapiens
gaaaccugggacauaaauu

SEQ ID NO: 1422356 - RNA, 19 nt, Homo sapiens
ucuacuuccucaccuauga

SEQ ID NO: 1422357 - RNA, 19 nt, Homo sapiens
gcucagcagagaacaguau

SEQ ID NO: 1422358 - RNA, 19 nt, Homo sapiens
cuggacaguucaaguguga

SEQ ID NO: 1422359 - RNA, 19 nt, Homo sapiens
ggucuggacaguucaagug

SEQ ID NO: 1422360 - RNA, 19 nt, Homo sapiens
ugaaauaaggacccucaug

SEQ ID NO: 1422361 - RNA, 19 nt, Homo sapiens
gcguggagaagccucagua

SEQ ID NO: 1422362 - RNA, 19 nt, Homo sapiens
gcugcgagcuguggagucu

SEQ ID NO: 1422363 - RNA, 19 nt, Homo sapiens
cagcuucggcgucuacuuc

SEQ ID NO: 1422364 - RNA, 19 nt, Homo sapiens
gggaaugugcucagugaag

SEQ ID NO: 1422365 - RNA, 19 nt, Homo sapiens
gauccuggccacgucauug

SEQ ID NO: 1422366 - RNA, 19 nt, Homo sapiens
gcaccguuauccuggaaac

SEQ ID NO: 1422367 - RNA, 19 nt, Homo sapiens
gcgggacguugcacugcuu

SEQ ID NO: 1422368 - RNA, 19 nt, Homo sapiens
ggacguugcacugcuucaa

SEQ ID NO: 1422369 - RNA, 19 nt, Homo sapiens
ccguuauccuggaaacuga

SEQ ID NO: 1422370 - RNA, 19 nt, Homo sapiens
cagaaaccugggacauaaa

SEQ ID NO: 1422371 - RNA, 19 nt, Homo sapiens
gcgucuacuuccucaccua

SEQ ID NO: 1422372 - RNA, 19 nt, Homo sapiens
caucaacgcgcugguguuc

SEQ ID NO: 1422373 - RNA, 19 nt, Homo sapiens
agaacuggauccucugcau

SEQ ID NO: 1422374 - RNA, 19 nt, Homo sapiens
ccagcugacggacaacuga

SEQ ID NO: 1422375 - RNA, 19 nt, Homo sapiens
ggaccucuaacuccacaca

SEQ ID NO: 1422376 - RNA, 19 nt, Homo sapiens
agaaaccugggacauaaau

SEQ ID NO: 1422377 - RNA, 19 nt, Homo sapiens
cucagaaaccugggacaua

SEQ ID NO: 1422378 - RNA, 19 nt, Homo sapiens
gcagcuguggcaaggagaa

SEQ ID NO: 1422379 - RNA, 19 nt, Homo sapiens
ggacuaggguggggagcaa

SEQ ID NO: 1422380 - RNA, 19 nt, Homo sapiens
ugcgagcuguggagucuau

SEQ ID NO: 1422381 - RNA, 19 nt, Homo sapiens
gucaagggaauaaaguguu

SEQ ID NO: 1422382 - RNA, 19 nt, Homo sapiens
gcacagaaaugauuaagaa

SEQ ID NO: 1422383 - RNA, 19 nt, Homo sapiens
ggaagaagaugaugauuga

SEQ ID NO: 1422384 - RNA, 19 nt, Homo sapiens
gcagauagguguucaaaga

SEQ ID NO: 1422385 - RNA, 19 nt, Homo sapiens
caaagaaacuuaccaguga

SEQ ID NO: 1422386 - RNA, 19 nt, Homo sapiens
gcaaugaaguguuugaugu

SEQ ID NO: 1422387 - RNA, 19 nt, Homo sapiens
gaagauaagcugcagaauu

SEQ ID NO: 1422388 - RNA, 19 nt, Homo sapiens
ggaacaggaucauaaauca

SEQ ID NO: 1422389 - RNA, 19 nt, Homo sapiens
gaucagcgaugaagaggaa

SEQ ID NO: 1422390 - RNA, 19 nt, Homo sapiens
gcucaaagauuacucaaag

SEQ ID NO: 1422391 - RNA, 19 nt, Homo sapiens
gaaagaagaagaacguuug

SEQ ID NO: 1422392 - RNA, 19 nt, Homo sapiens
aagauaagcugcagaauuc

SEQ ID NO: 1422393 - RNA, 19 nt, Homo sapiens
gaagaugaauuugaagaug

SEQ ID NO: 1422394 - RNA, 19 nt, Homo sapiens
guagaaauacccaaaguaa

SEQ ID NO: 1422395 - RNA, 19 nt, Homo sapiens
ucaaagacacagaagauua

SEQ ID NO: 1422396 - RNA, 19 nt, Homo sapiens
gauaaucacucugaaagau

SEQ ID NO: 1422397 - RNA, 19 nt, Homo sapiens
ggaagcaugucccugcauu

SEQ ID NO: 1422398 - RNA, 19 nt, Homo sapiens
gaagauaaagcucaaagau

SEQ ID NO: 1422399 - RNA, 19 nt, Homo sapiens
gaacacaggcauucagaug

SEQ ID NO: 1422400 - RNA, 19 nt, Homo sapiens
ggaacgagccagaaucuau

SEQ ID NO: 1422401 - RNA, 19 nt, Homo sapiens
ggaaacgacuuauauuuug

SEQ ID NO: 1422402 - RNA, 19 nt, Homo sapiens
ggccucagcuuuccgauga

SEQ ID NO: 1422403 - RNA, 19 nt, Homo sapiens
gaacgagccagaaucuauu

SEQ ID NO: 1422404 - RNA, 19 nt, Homo sapiens
gcacaaggaucugaugaag

SEQ ID NO: 1422405 - RNA, 19 nt, Homo sapiens
gacaauagaucagaagcuu

SEQ ID NO: 1422406 - RNA, 19 nt, Homo sapiens
gagggagcuucacaucaua

SEQ ID NO: 1422407 - RNA, 19 nt, Homo sapiens
gccgguagcuucugauaau

SEQ ID NO: 1422408 - RNA, 19 nt, Homo sapiens
aaccacagcugucugauga

SEQ ID NO: 1422409 - RNA, 19 nt, Homo sapiens
ugaaagaucagacaauaga

SEQ ID NO: 1422410 - RNA, 19 nt, Homo sapiens
caacgcacagaaaugauua

SEQ ID NO: 1422411 - RNA, 19 nt, Homo sapiens
gcagugauagugaagauga

SEQ ID NO: 1422412 - RNA, 19 nt, Homo sapiens
gcaaaauucugaugaugaa

SEQ ID NO: 1422413 - RNA, 19 nt, Homo sapiens
cgagggagcuucacaucau

SEQ ID NO: 1422414 - RNA, 19 nt, Homo sapiens
aagaaaugcuggaugaaga

SEQ ID NO: 1422415 - RNA, 19 nt, Homo sapiens
gaagaggaacaggaucaua

SEQ ID NO: 1422416 - RNA, 19 nt, Homo sapiens
ggacagugccacacauaga

SEQ ID NO: 1422417 - RNA, 19 nt, Homo sapiens
gcguaaagauucugauucu

SEQ ID NO: 1422418 - RNA, 19 nt, Homo sapiens
gggacaagcagucuuuaaa

SEQ ID NO: 1422419 - RNA, 19 nt, Homo sapiens
guggaaccauggauuuauu

SEQ ID NO: 1422420 - RNA, 19 nt, Homo sapiens
gagcgauaauggcggauau

SEQ ID NO: 1422421 - RNA, 19 nt, Homo sapiens
gaagcugagcguaaagauu

SEQ ID NO: 1422422 - RNA, 19 nt, Homo sapiens
aaacgaaacucaccuucag

SEQ ID NO: 1422423 - RNA, 19 nt, Homo sapiens
gaugagagacaacagcuau

SEQ ID NO: 1422424 - RNA, 19 nt, Homo sapiens
ucaggacaaccaaguaaua

SEQ ID NO: 1422425 - RNA, 19 nt, Homo sapiens
gaugaagaaggaaaugaaa

SEQ ID NO: 1422426 - RNA, 19 nt, Homo sapiens
cgaaugaaacgcaagaaug

SEQ ID NO: 1422427 - RNA, 19 nt, Homo sapiens
agcagaagaugaugauaaa

SEQ ID NO: 1422428 - RNA, 19 nt, Homo sapiens
caaagacacagaagauuag

SEQ ID NO: 1422429 - RNA, 19 nt, Homo sapiens
gaggauacgccgagaugaa

SEQ ID NO: 1422430 - RNA, 19 nt, Homo sapiens
gaagaaaugcuggaugaag

SEQ ID NO: 1422431 - RNA, 19 nt, Homo sapiens
agaagaagauaaagcucaa

SEQ ID NO: 1422432 - RNA, 19 nt, Homo sapiens
ggagaagacaaaccaccua

SEQ ID NO: 1422433 - RNA, 19 nt, Homo sapiens
gaaugaaacgcaagaaugc

SEQ ID NO: 1422434 - RNA, 19 nt, Homo sapiens
ggaaaaggcuaauucugau

SEQ ID NO: 1422435 - RNA, 19 nt, Homo sapiens
uaaucacucugaaagauca

SEQ ID NO: 1422436 - RNA, 19 nt, Homo sapiens
aagcagaagaugaugauaa

SEQ ID NO: 1422437 - RNA, 19 nt, Homo sapiens
gggaucagaagaagauaaa

SEQ ID NO: 1422438 - RNA, 19 nt, Homo sapiens
gaugagggaucagaagaag

SEQ ID NO: 1422439 - RNA, 19 nt, Homo sapiens
ugaaagugaucaggaugaa

SEQ ID NO: 1422440 - RNA, 19 nt, Homo sapiens
augaagaaaugcuggauga

SEQ ID NO: 1422441 - RNA, 19 nt, Homo sapiens
gcccaacuuucucagugua

SEQ ID NO: 1422442 - RNA, 19 nt, Homo sapiens
ccaaaguaaacacugauuu

SEQ ID NO: 1422443 - RNA, 19 nt, Homo sapiens
gaagacaaaccaccuacuc

SEQ ID NO: 1422444 - RNA, 19 nt, Homo sapiens
gcaagaggcagugauagug

SEQ ID NO: 1422445 - RNA, 19 nt, Homo sapiens
aagaggaacaggaucauaa

SEQ ID NO: 1422446 - RNA, 19 nt, Homo sapiens
uaaugaugaugaagacgaa

SEQ ID NO: 1422447 - RNA, 19 nt, Homo sapiens
gagcguaaagauucugauu

SEQ ID NO: 1422448 - RNA, 19 nt, Homo sapiens
aagcaugucccugcauuua

SEQ ID NO: 1422449 - RNA, 19 nt, Homo sapiens
ugauuuaggaaacgacuua

SEQ ID NO: 1422450 - RNA, 19 nt, Homo sapiens
gaaauacccaaaguaaaca

SEQ ID NO: 1422451 - RNA, 19 nt, Homo sapiens
gaauagaaguagaaauacc

SEQ ID NO: 1422452 - RNA, 19 nt, Homo sapiens
gaccagaauagaaguagaa

SEQ ID NO: 1422453 - RNA, 19 nt, Homo sapiens
gaugaaguuuuacgaauga

SEQ ID NO: 1422454 - RNA, 19 nt, Homo sapiens
caagaggcagugauaguga

SEQ ID NO: 1422455 - RNA, 19 nt, Homo sapiens
ccacaggccucagaugaag

SEQ ID NO: 1422456 - RNA, 19 nt, Homo sapiens
ggagagggcacaaggaucu

SEQ ID NO: 1422457 - RNA, 19 nt, Homo sapiens
gcaugucccugcauuuagg

SEQ ID NO: 1422458 - RNA, 19 nt, Homo sapiens
ggacaaccaaguaauaagg

SEQ ID NO: 1422459 - RNA, 19 nt, Homo sapiens
gaucagaagccccuaauga

SEQ ID NO: 1422460 - RNA, 19 nt, Homo sapiens
gaagcaugucccugcauuu

SEQ ID NO: 1422461 - RNA, 19 nt, Homo sapiens
aaccauggauuuauuugga

SEQ ID NO: 1422462 - RNA, 19 nt, Homo sapiens
acacaggcauucagaugau

SEQ ID NO: 1422463 - RNA, 19 nt, Homo sapiens
ggauauggaggaucucuuc

SEQ ID NO: 1422464 - RNA, 19 nt, Homo sapiens
gaaccuuccggaaagagaa

SEQ ID NO: 1422465 - RNA, 19 nt, Homo sapiens
guucaaagacacagaagau

SEQ ID NO: 1422466 - RNA, 19 nt, Homo sapiens
uuuaggcaaugaaguguuu

SEQ ID NO: 1422467 - RNA, 19 nt, Homo sapiens
gcaaugcucggauagucaa

SEQ ID NO: 1422468 - RNA, 19 nt, Homo sapiens
gcugucugaugaagagaaa

SEQ ID NO: 1422469 - RNA, 19 nt, Homo sapiens
agaagaugaugauaaagca

SEQ ID NO: 1422470 - RNA, 19 nt, Homo sapiens
gacagugccacacauagaa

SEQ ID NO: 1422471 - RNA, 19 nt, Homo sapiens
ggacaagcagucuuuaaaa

SEQ ID NO: 1422472 - RNA, 19 nt, Homo sapiens
agaaauacccaaaguaaac

SEQ ID NO: 1422473 - RNA, 19 nt, Homo sapiens
gaagacgaaggucauagau

SEQ ID NO: 1422474 - RNA, 19 nt, Homo sapiens
gaaagugaucaggaugaaa

SEQ ID NO: 1422475 - RNA, 19 nt, Homo sapiens
uaagaaagaagaagaacgu

SEQ ID NO: 1422476 - RNA, 19 nt, Homo sapiens
acuauaagauggaggauac

SEQ ID NO: 1422477 - RNA, 19 nt, Homo sapiens
caaguaauaaggaacuguu

SEQ ID NO: 1422478 - RNA, 19 nt, Homo sapiens
caggacaaccaaguaauaa

SEQ ID NO: 1422479 - RNA, 19 nt, Homo sapiens
agaaagaagaagaacguuu

SEQ ID NO: 1422480 - RNA, 19 nt, Homo sapiens
cggcggacgugagcgauaa

SEQ ID NO: 1422481 - RNA, 19 nt, Homo sapiens
gaaugccaacgcacagaaa

SEQ ID NO: 1422482 - RNA, 19 nt, Homo sapiens
ggaagaauauucaagauga

SEQ ID NO: 1422483 - RNA, 19 nt, Homo sapiens
uaacagagcugggaagaau

SEQ ID NO: 1422484 - RNA, 19 nt, Homo sapiens
ccacaacgguucuggaauu

SEQ ID NO: 1422485 - RNA, 19 nt, Homo sapiens
gugaagaggcuguuaaaua

SEQ ID NO: 1422486 - RNA, 19 nt, Homo sapiens
ugaagaggcuguuaaauag

SEQ ID NO: 1422487 - RNA, 19 nt, Homo sapiens
gaacauguuacucugauuu

SEQ ID NO: 1422488 - RNA, 19 nt, Homo sapiens
aaaccuggcuccaaacaaa

SEQ ID NO: 1422489 - RNA, 19 nt, Homo sapiens
ggauaagggugguaaaucu

SEQ ID NO: 1422490 - RNA, 19 nt, Homo sapiens
ggugguaaaucucgugaaa

SEQ ID NO: 1422491 - RNA, 19 nt, Homo sapiens
gcgccgagaugccuaagaa

SEQ ID NO: 1422492 - RNA, 19 nt, Homo sapiens
caaacagccuggaacaugu

SEQ ID NO: 1422493 - RNA, 19 nt, Homo sapiens
uaaaggaugcgucaccaua

SEQ ID NO: 1422494 - RNA, 19 nt, Homo sapiens
aagaugaccugauuuaaca

SEQ ID NO: 1422495 - RNA, 19 nt, Homo sapiens
gagaccacuuccucccuua

SEQ ID NO: 1422496 - RNA, 19 nt, Homo sapiens
ggccuuugauuuccuauau

SEQ ID NO: 1422497 - RNA, 19 nt, Homo sapiens
gaccugauuuaacaccuuu

SEQ ID NO: 1422498 - RNA, 19 nt, Homo sapiens
caugcaagcuggcaacuag

SEQ ID NO: 1422499 - RNA, 19 nt, Homo sapiens
gagacuuacucaagauugu

SEQ ID NO: 1422500 - RNA, 19 nt, Homo sapiens
ggaacauguuacucugauu

SEQ ID NO: 1422501 - RNA, 19 nt, Homo sapiens
caacgguucuggaauucug

SEQ ID NO: 1422502 - RNA, 19 nt, Homo sapiens
aagaggcuguuaaauagaa

SEQ ID NO: 1422503 - RNA, 19 nt, Homo sapiens
gaagaggcuguuaaauaga

SEQ ID NO: 1422504 - RNA, 19 nt, Homo sapiens
ccaaacagccuggaacaug

SEQ ID NO: 1422505 - RNA, 19 nt, Homo sapiens
gagcaaggaaccagagaga

SEQ ID NO: 1422506 - RNA, 19 nt, Homo sapiens
agcagaggcuguaaaugua

SEQ ID NO: 1422507 - RNA, 19 nt, Homo sapiens
gcuuuguagucuuaccuua

SEQ ID NO: 1422508 - RNA, 19 nt, Homo sapiens
ccauagccauccaugcaaa

SEQ ID NO: 1422509 - RNA, 19 nt, Homo sapiens
uaauccaguuuacaaguga

SEQ ID NO: 1422510 - RNA, 19 nt, Homo sapiens
gggcggagguugcaguaag

SEQ ID NO: 1422511 - RNA, 19 nt, Homo sapiens
gcaggagaaucacuugaac

SEQ ID NO: 1422512 - RNA, 19 nt, Homo sapiens
caggaagagugaugugguu

SEQ ID NO: 1422513 - RNA, 19 nt, Homo sapiens
uauucaagaugaccugauu

SEQ ID NO: 1422514 - RNA, 19 nt, Homo sapiens
caagaugaccugauuuaac

SEQ ID NO: 1422515 - RNA, 19 nt, Homo sapiens
gcugagcucugucgguauc

SEQ ID NO: 1422516 - RNA, 19 nt, Homo sapiens
gauuuaacaccuuucauuc

SEQ ID NO: 1422517 - RNA, 19 nt, Homo sapiens
gaagaauauucaagaugac

SEQ ID NO: 1422518 - RNA, 19 nt, Homo sapiens
gagcugggaagaauauuca

SEQ ID NO: 1422519 - RNA, 19 nt, Homo sapiens
cuaauccaguuuacaagug

SEQ ID NO: 1422520 - RNA, 19 nt, Homo sapiens
gaagagugaugugguuuug

SEQ ID NO: 1422521 - RNA, 19 nt, Homo sapiens
caucagagggagaggcuaa

SEQ ID NO: 1422522 - RNA, 19 nt, Homo sapiens
caaacaaaaugcuguaaca

SEQ ID NO: 1422523 - RNA, 19 nt, Homo sapiens
gggaagaauauucaagaug

SEQ ID NO: 1422524 - RNA, 19 nt, Homo sapiens
ggcuguaaauguagcuauu

SEQ ID NO: 1422525 - RNA, 19 nt, Homo sapiens
gaaccagagagaccacuuc

SEQ ID NO: 1422526 - RNA, 19 nt, Homo sapiens
gagaccagccugaccaaca

SEQ ID NO: 1422527 - RNA, 19 nt, Homo sapiens
gagagacuuacucaagauu

SEQ ID NO: 1422528 - RNA, 19 nt, Homo sapiens
augcugcuuuguagucuua

SEQ ID NO: 1422529 - RNA, 19 nt, Homo sapiens
uuuccuauauccagaaguu

SEQ ID NO: 1422530 - RNA, 19 nt, Homo sapiens
ucaagaugaccugauuuaa

SEQ ID NO: 1422531 - RNA, 19 nt, Homo sapiens
uauacuacaugcacagaag

SEQ ID NO: 1422532 - RNA, 19 nt, Homo sapiens
gucgguaucuuuccaaggu

SEQ ID NO: 1422533 - RNA, 19 nt, Homo sapiens
ccuguuaugcugcuuugua

SEQ ID NO: 1422534 - RNA, 19 nt, Homo sapiens
uuuaacaccuuucauucug

SEQ ID NO: 1422535 - RNA, 19 nt, Homo sapiens
gugcgacgaccaaggguaa

SEQ ID NO: 1422536 - RNA, 19 nt, Homo sapiens
ggcaggagaaucacuugaa

SEQ ID NO: 1422537 - RNA, 19 nt, Homo sapiens
ugauggcgcaugccuguaa

SEQ ID NO: 1422538 - RNA, 19 nt, Homo sapiens
guagucuuaccuuagauuu

SEQ ID NO: 1422539 - RNA, 19 nt, Homo sapiens
gcaacuagaacccaaaucc

SEQ ID NO: 1422540 - RNA, 19 nt, Homo sapiens
gagcucugucgguaucuuu

SEQ ID NO: 1422541 - RNA, 19 nt, Homo sapiens
uuuguagucuuaccuuaga

SEQ ID NO: 1422542 - RNA, 19 nt, Homo sapiens
uucaagaugaccugauuua

SEQ ID NO: 1422543 - RNA, 19 nt, Homo sapiens
agagaucuuggagaaauua

SEQ ID NO: 1422544 - RNA, 19 nt, Homo sapiens
gcagaggcuguaaauguag

SEQ ID NO: 1422545 - RNA, 19 nt, Homo sapiens
ccuguaaucccagcacuuu

SEQ ID NO: 1422546 - RNA, 19 nt, Homo sapiens
ucauggcguuguaaaauaa

SEQ ID NO: 1422547 - RNA, 19 nt, Homo sapiens
gaaaccccaucucuacgaa

SEQ ID NO: 1422548 - RNA, 19 nt, Homo sapiens
agaccagccugaccaacau

SEQ ID NO: 1422549 - RNA, 19 nt, Homo sapiens
ugaccugauuuaacaccuu

SEQ ID NO: 1422550 - RNA, 19 nt, Homo sapiens
gauggcgcaugccuguaau

SEQ ID NO: 1422551 - RNA, 19 nt, Homo sapiens
gugaugugguuuuggauaa

SEQ ID NO: 1422552 - RNA, 19 nt, Homo sapiens
cuucuaauccaguuuacaa

SEQ ID NO: 1422553 - RNA, 19 nt, Homo sapiens
caaauccuuggacuacuug

SEQ ID NO: 1422554 - RNA, 19 nt, Homo sapiens
acagagcugggaagaauau

SEQ ID NO: 1422555 - RNA, 19 nt, Homo sapiens
cugauuucauggcguugua

SEQ ID NO: 1422556 - RNA, 19 nt, Homo sapiens
uggaacauguuacucugau

SEQ ID NO: 1422557 - RNA, 19 nt, Homo sapiens
cuacaacuccagaagagau

SEQ ID NO: 1422558 - RNA, 19 nt, Homo sapiens
ucaagauuguaccaugcaa

SEQ ID NO: 1422559 - RNA, 19 nt, Homo sapiens
caccauagccauccaugca

SEQ ID NO: 1422560 - RNA, 19 nt, Homo sapiens
cacaacgguucuggaauuc

SEQ ID NO: 1422561 - RNA, 19 nt, Homo sapiens
ugggaagaauauucaagau

SEQ ID NO: 1422562 - RNA, 19 nt, Homo sapiens
uguggcaguugauccuaaa

SEQ ID NO: 1422563 - RNA, 19 nt, Homo sapiens
uuaacaccuuucauucugu

SEQ ID NO: 1422564 - RNA, 19 nt, Homo sapiens
aaagugcuauacauugcau

SEQ ID NO: 1422565 - RNA, 19 nt, Homo sapiens
auacauccuugagaaacuu

SEQ ID NO: 1422566 - RNA, 19 nt, Homo sapiens
gcuguaaauguagcuauug

SEQ ID NO: 1422567 - RNA, 19 nt, Homo sapiens
uacauugcaucagguucua

SEQ ID NO: 1422568 - RNA, 19 nt, Homo sapiens
gagaucuuggagaaauuaa

SEQ ID NO: 1422569 - RNA, 19 nt, Homo sapiens
gauaagggugguaaaucuc

SEQ ID NO: 1422570 - RNA, 19 nt, Homo sapiens
ggaaccagagagaccacuu

SEQ ID NO: 1422571 - RNA, 19 nt, Homo sapiens
gauuucauggcguuguaaa

SEQ ID NO: 1422572 - RNA, 19 nt, Homo sapiens
aaauuagccagaugugaug

SEQ ID NO: 1422573 - RNA, 19 nt, Homo sapiens
caguggcucaugccuguaa

SEQ ID NO: 1422574 - RNA, 19 nt, Homo sapiens
ggaagagugaugugguuuu

SEQ ID NO: 1422575 - RNA, 19 nt, Homo sapiens
aaaggaugcgucaccauag

SEQ ID NO: 1422576 - RNA, 19 nt, Homo sapiens
ugcaaaaccuggcuccaaa

SEQ ID NO: 1422577 - RNA, 19 nt, Homo sapiens
ggcuaaugcugagcucugu

SEQ ID NO: 1422578 - RNA, 19 nt, Homo sapiens
agacuuacucaagauugua

SEQ ID NO: 1422579 - RNA, 19 nt, Homo sapiens
gugaaaagguggugaagcu

SEQ ID NO: 1422580 - RNA, 19 nt, Homo sapiens
gcaaucagaugucucacua

SEQ ID NO: 1422581 - RNA, 19 nt, Homo sapiens
gaggaaagcuuaauacucu

SEQ ID NO: 1422582 - RNA, 19 nt, Homo sapiens
ggauguacgugauauguaa

SEQ ID NO: 1422583 - RNA, 19 nt, Homo sapiens
gaaaagcagugaucuguaa

SEQ ID NO: 1422584 - RNA, 19 nt, Homo sapiens
ggagcaauauguucuguga

SEQ ID NO: 1422585 - RNA, 19 nt, Homo sapiens
cagagaaacuggaggcuuu

SEQ ID NO: 1422586 - RNA, 19 nt, Homo sapiens
cagcagagauugccauguu

SEQ ID NO: 1422587 - RNA, 19 nt, Homo sapiens
cauggaacguuucacuuua

SEQ ID NO: 1422588 - RNA, 19 nt, Homo sapiens
gaccguagcugucgcuuuc

SEQ ID NO: 1422589 - RNA, 19 nt, Homo sapiens
gagggaagaugccuaguag

SEQ ID NO: 1422590 - RNA, 19 nt, Homo sapiens
caaagcagguagcagagaa

SEQ ID NO: 1422591 - RNA, 19 nt, Homo sapiens
ggaacccacuggaguuuau

SEQ ID NO: 1422592 - RNA, 19 nt, Homo sapiens
acacaggguuuacguaaga

SEQ ID NO: 1422593 - RNA, 19 nt, Homo sapiens
gagcagcccucgucaguac

SEQ ID NO: 1422594 - RNA, 19 nt, Homo sapiens
aaucagaugucucacuauu

SEQ ID NO: 1422595 - RNA, 19 nt, Homo sapiens
aauaucauccucugcauua

SEQ ID NO: 1422596 - RNA, 19 nt, Homo sapiens
cugcauacaucacaaagaa

SEQ ID NO: 1422597 - RNA, 19 nt, Homo sapiens
aaagggaugucgcaagguu

SEQ ID NO: 1422598 - RNA, 19 nt, Homo sapiens
gcucaaugaccauauuauu

SEQ ID NO: 1422599 - RNA, 19 nt, Homo sapiens
ucagaugucucacuauugg

SEQ ID NO: 1422600 - RNA, 19 nt, Homo sapiens
gaagucacccaguucauca

SEQ ID NO: 1422601 - RNA, 19 nt, Homo sapiens
ccuaguagaggaaagcuua

SEQ ID NO: 1422602 - RNA, 19 nt, Homo sapiens
gcauacaucacaaagaaga

SEQ ID NO: 1422603 - RNA, 19 nt, Homo sapiens
agcaauauguucugugaaa

SEQ ID NO: 1422604 - RNA, 19 nt, Homo sapiens
ggaggaacccacuggaguu

SEQ ID NO: 1422605 - RNA, 19 nt, Homo sapiens
ccauggaacguuucacuuu

SEQ ID NO: 1422606 - RNA, 19 nt, Homo sapiens
gaauaucauccucugcauu

SEQ ID NO: 1422607 - RNA, 19 nt, Homo sapiens
gcccugaagucacccaguu

SEQ ID NO: 1422608 - RNA, 19 nt, Homo sapiens
caaccaacuuauuugaaca

SEQ ID NO: 1422609 - RNA, 19 nt, Homo sapiens
gauucucccuguacuggaa

SEQ ID NO: 1422610 - RNA, 19 nt, Homo sapiens
acacacaggguuuacguaa

SEQ ID NO: 1422611 - RNA, 19 nt, Homo sapiens
gaaagccccugcccaacaa

SEQ ID NO: 1422612 - RNA, 19 nt, Homo sapiens
gaucacgucaguuucauca

SEQ ID NO: 1422613 - RNA, 19 nt, Homo sapiens
ugaguuacauggacagucu

SEQ ID NO: 1422614 - RNA, 19 nt, Homo sapiens
gcagguagcagagaaacug

SEQ ID NO: 1422615 - RNA, 19 nt, Homo sapiens
uggucuaccuccaagauaa

SEQ ID NO: 1422616 - RNA, 19 nt, Homo sapiens
ugagggaagaugccuagua

SEQ ID NO: 1422617 - RNA, 19 nt, Homo sapiens
gaggaacccacuggaguuu

SEQ ID NO: 1422618 - RNA, 19 nt, Homo sapiens
ccaacagucaguuucauga

SEQ ID NO: 1422619 - RNA, 19 nt, Homo sapiens
gggaagaugccuaguagag

SEQ ID NO: 1422620 - RNA, 19 nt, Homo sapiens
uuggauggcugcaaucuca

SEQ ID NO: 1422621 - RNA, 19 nt, Homo sapiens
ucacccaguucaucaagug

SEQ ID NO: 1422622 - RNA, 19 nt, Homo sapiens
ccuuacaaccaacuuauuu

SEQ ID NO: 1422623 - RNA, 19 nt, Homo sapiens
gggauguacgugauaugua

SEQ ID NO: 1422624 - RNA, 19 nt, Homo sapiens
gguuugcguuugaguacuu

SEQ ID NO: 1422625 - RNA, 19 nt, Homo sapiens
acaaccaacuuauuugaac

SEQ ID NO: 1422626 - RNA, 19 nt, Homo sapiens
auggaacguuucacuuuaa

SEQ ID NO: 1422627 - RNA, 19 nt, Homo sapiens
gcaaagcagguagcagaga

SEQ ID NO: 1422628 - RNA, 19 nt, Homo sapiens
uagcaacccagcagagauu

SEQ ID NO: 1422629 - RNA, 19 nt, Homo sapiens
aaaccuuacaaccaacuua

SEQ ID NO: 1422630 - RNA, 19 nt, Homo sapiens
uuucaugacugcucugauc

SEQ ID NO: 1422631 - RNA, 19 nt, Homo sapiens
uuguucagcuucuggaauu

SEQ ID NO: 1422632 - RNA, 19 nt, Homo sapiens
guagaggaaagcuuaauac

SEQ ID NO: 1422633 - RNA, 19 nt, Homo sapiens
ggucuaccuccaagauaaa

SEQ ID NO: 1422634 - RNA, 19 nt, Homo sapiens
uuauuggguuugcguuuga

SEQ ID NO: 1422635 - RNA, 19 nt, Homo sapiens
gcuuuagauucucccugua

SEQ ID NO: 1422636 - RNA, 19 nt, Homo sapiens
uauccacauuggcuuauuc

SEQ ID NO: 1422637 - RNA, 19 nt, Homo sapiens
gaacuucuuuaggcaacag

SEQ ID NO: 1422638 - RNA, 19 nt, Homo sapiens
gcaauauguucugugaaaa

SEQ ID NO: 1422639 - RNA, 19 nt, Homo sapiens
gaagaggggagaauggaaa

SEQ ID NO: 1422640 - RNA, 19 nt, Homo sapiens
gggacgaaaccucugaguu

SEQ ID NO: 1422641 - RNA, 19 nt, Homo sapiens
ggucucccuuauccacauu

SEQ ID NO: 1422642 - RNA, 19 nt, Homo sapiens
uuugaaggcuccucuuucu

SEQ ID NO: 1422643 - RNA, 19 nt, Homo sapiens
ggaaaagcagugaucugua

SEQ ID NO: 1422644 - RNA, 19 nt, Homo sapiens
agauugccauguuccuuga

SEQ ID NO: 1422645 - RNA, 19 nt, Homo sapiens
aguagaggaaagcuuaaua

SEQ ID NO: 1422646 - RNA, 19 nt, Homo sapiens
gaacccacuggaguuuauu

SEQ ID NO: 1422647 - RNA, 19 nt, Homo sapiens
ggccuugugucagaacuuc

SEQ ID NO: 1422648 - RNA, 19 nt, Homo sapiens
ugaguacuuugccaacagu

SEQ ID NO: 1422649 - RNA, 19 nt, Homo sapiens
gaccauauuauuggguuug

SEQ ID NO: 1422650 - RNA, 19 nt, Homo sapiens
ugaccauauuauuggguuu

SEQ ID NO: 1422651 - RNA, 19 nt, Homo sapiens
gcggcaaucagaugucuca

SEQ ID NO: 1422652 - RNA, 19 nt, Homo sapiens
gcuaugacugugggaugua

SEQ ID NO: 1422653 - RNA, 19 nt, Homo sapiens
caacaaaacagcuaugacu

SEQ ID NO: 1422654 - RNA, 19 nt, Homo sapiens
cuacugcggcaaucagaug

SEQ ID NO: 1422655 - RNA, 19 nt, Homo sapiens
ucaaugauaacuccaacca

SEQ ID NO: 1422656 - RNA, 19 nt, Homo sapiens
gccaacagucaguuucaug

SEQ ID NO: 1422657 - RNA, 19 nt, Homo sapiens
cccguagucuugaguuaca

SEQ ID NO: 1422658 - RNA, 19 nt, Homo sapiens
gagcaauauguucugugaa

SEQ ID NO: 1422659 - RNA, 19 nt, Homo sapiens
gcagcccucgucaguacaa

SEQ ID NO: 1422660 - RNA, 19 nt, Homo sapiens
uggcucaaugaccauauua

SEQ ID NO: 1422661 - RNA, 19 nt, Homo sapiens
ccuuauccacauuggcuua

SEQ ID NO: 1422662 - RNA, 19 nt, Homo sapiens
agaauaucauccucugcau

SEQ ID NO: 1422663 - RNA, 19 nt, Homo sapiens
cagcuucuggaauuucuga

SEQ ID NO: 1422664 - RNA, 19 nt, Homo sapiens
caaagaagauggcauuauu

SEQ ID NO: 1422665 - RNA, 19 nt, Homo sapiens
ggaauuaucuggacuuuca

SEQ ID NO: 1422666 - RNA, 19 nt, Homo sapiens
gaacaaacuucagaacaaa

SEQ ID NO: 1422667 - RNA, 19 nt, Homo sapiens
ggaacaaacuucagaacaa

SEQ ID NO: 1422668 - RNA, 19 nt, Homo sapiens
ccauuaaacuucuggauuu

SEQ ID NO: 1422669 - RNA, 19 nt, Homo sapiens
ccacaaacagucacaaaua

SEQ ID NO: 1422670 - RNA, 19 nt, Homo sapiens
caagagcacugcaaaggaa

SEQ ID NO: 1422671 - RNA, 19 nt, Homo sapiens
caacaaagaagaagcagaa

SEQ ID NO: 1422672 - RNA, 19 nt, Homo sapiens
gaaauauaauuccguugca

SEQ ID NO: 1422673 - RNA, 19 nt, Homo sapiens
gcgaauaccauuaaacuuc

SEQ ID NO: 1422674 - RNA, 19 nt, Homo sapiens
agaauaugauguuggagua

SEQ ID NO: 1422675 - RNA, 19 nt, Homo sapiens
ggaauuggaagcaguguug

SEQ ID NO: 1422676 - RNA, 19 nt, Homo sapiens
gcuacugacuucuacaaug

SEQ ID NO: 1422677 - RNA, 19 nt, Homo sapiens
caaacagucacaaauacua

SEQ ID NO: 1422678 - RNA, 19 nt, Homo sapiens
ugugggaucuggagaauau

SEQ ID NO: 1422679 - RNA, 19 nt, Homo sapiens
uaacagcuacugacuucua

SEQ ID NO: 1422680 - RNA, 19 nt, Homo sapiens
gaaagucugagcaauggaa

SEQ ID NO: 1422681 - RNA, 19 nt, Homo sapiens
ggaguaacaauuaugcaaa

SEQ ID NO: 1422682 - RNA, 19 nt, Homo sapiens
agucucagcuucccguaua

SEQ ID NO: 1422683 - RNA, 19 nt, Homo sapiens
gcccaauucucaaacaaga

SEQ ID NO: 1422684 - RNA, 19 nt, Homo sapiens
aaagugcuaugauuacaga

SEQ ID NO: 1422685 - RNA, 19 nt, Homo sapiens
gauguaggcccaauucuca

SEQ ID NO: 1422686 - RNA, 19 nt, Homo sapiens
gcaauaugcugugcagucu

SEQ ID NO: 1422687 - RNA, 19 nt, Homo sapiens
gguagaaguuaacaguuca

SEQ ID NO: 1422688 - RNA, 19 nt, Homo sapiens
gaaggcagcagccaaugga

SEQ ID NO: 1422689 - RNA, 19 nt, Homo sapiens
gaucaguaauauaccacaa

SEQ ID NO: 1422690 - RNA, 19 nt, Homo sapiens
ccaguugccucccgagaug

SEQ ID NO: 1422691 - RNA, 19 nt, Homo sapiens
caaagaagaagaguuaauc

SEQ ID NO: 1422692 - RNA, 19 nt, Homo sapiens
ccuaagauuucugcuggua

SEQ ID NO: 1422693 - RNA, 19 nt, Homo sapiens
ccaacaugcucauuucagu

SEQ ID NO: 1422694 - RNA, 19 nt, Homo sapiens
cuacugacuucuacaaugg

SEQ ID NO: 1422695 - RNA, 19 nt, Homo sapiens
acuaacagcuacugacuuc

SEQ ID NO: 1422696 - RNA, 19 nt, Homo sapiens
cacaaacagucacaaauac

SEQ ID NO: 1422697 - RNA, 19 nt, Homo sapiens
cgaauaccauuaaacuucu

SEQ ID NO: 1422698 - RNA, 19 nt, Homo sapiens
ccaaagugcuaugauuaca

SEQ ID NO: 1422699 - RNA, 19 nt, Homo sapiens
ccaagccaaugcagauuuc

SEQ ID NO: 1422700 - RNA, 19 nt, Homo sapiens
caaccaagccaaugcagau

SEQ ID NO: 1422701 - RNA, 19 nt, Homo sapiens
aaagauggauugccucacu

SEQ ID NO: 1422702 - RNA, 19 nt, Homo sapiens
uuaggaagaagauggauaa

SEQ ID NO: 1422703 - RNA, 19 nt, Homo sapiens
gaagcaguguugucaagac

SEQ ID NO: 1422704 - RNA, 19 nt, Homo sapiens
aagaagaguuaaucgacaa

SEQ ID NO: 1422705 - RNA, 19 nt, Homo sapiens
gaugugggaucuggagaau

SEQ ID NO: 1422706 - RNA, 19 nt, Homo sapiens
ucccaaagugcuaugauua

SEQ ID NO: 1422707 - RNA, 19 nt, Homo sapiens
cuucuacaauggauauuug

SEQ ID NO: 1422708 - RNA, 19 nt, Homo sapiens
gugccaacaugcucauuuc

SEQ ID NO: 1422709 - RNA, 19 nt, Homo sapiens
augaggcucuuauucuuaa

SEQ ID NO: 1422710 - RNA, 19 nt, Homo sapiens
uggagaauaugauguugga

SEQ ID NO: 1422711 - RNA, 19 nt, Homo sapiens
uugcaaggaugguuggauu

SEQ ID NO: 1422712 - RNA, 19 nt, Homo sapiens
caacaugcucauuucaguu

SEQ ID NO: 1422713 - RNA, 19 nt, Homo sapiens
ggaggaacaaacuucagaa

SEQ ID NO: 1422714 - RNA, 19 nt, Homo sapiens
cagugaugcucaagaaauc

SEQ ID NO: 1422715 - RNA, 19 nt, Homo sapiens
gggacaggcucuuauucca

SEQ ID NO: 1422716 - RNA, 19 nt, Homo sapiens
cauuaaacuucuggauuug

SEQ ID NO: 1422717 - RNA, 19 nt, Homo sapiens
aaugaggcucuuauucuua

SEQ ID NO: 1422718 - RNA, 19 nt, Homo sapiens
uugccucacuuuccacuuu

SEQ ID NO: 1422719 - RNA, 19 nt, Homo sapiens
gcucaagaaaucacuaaca

SEQ ID NO: 1422720 - RNA, 19 nt, Homo sapiens
ugguagaaguuaacaguuc

SEQ ID NO: 1422721 - RNA, 19 nt, Homo sapiens
gggaggaacaaacuucaga

SEQ ID NO: 1422722 - RNA, 19 nt, Homo sapiens
gcacugcaaaggaauugga

SEQ ID NO: 1422723 - RNA, 19 nt, Homo sapiens
ucaaagaagauggcauuau

SEQ ID NO: 1422724 - RNA, 19 nt, Homo sapiens
uaacgggacaggcucuuau

SEQ ID NO: 1422725 - RNA, 19 nt, Homo sapiens
gagaagauuauugccgaaa

SEQ ID NO: 1422726 - RNA, 19 nt, Homo sapiens
gaauaccauuaaacuucug

SEQ ID NO: 1422727 - RNA, 19 nt, Homo sapiens
ccaagagcacugcaaagga

SEQ ID NO: 1422728 - RNA, 19 nt, Homo sapiens
aauaugcugugcagucuca

SEQ ID NO: 1422729 - RNA, 19 nt, Homo sapiens
caccacacgcagcuaauuu

SEQ ID NO: 1422730 - RNA, 19 nt, Homo sapiens
cugaguagcugggauuaca

SEQ ID NO: 1422731 - RNA, 19 nt, Homo sapiens
ucagugaugcucaagaaau

SEQ ID NO: 1422732 - RNA, 19 nt, Homo sapiens
uggauuugguagaaguuaa

SEQ ID NO: 1422733 - RNA, 19 nt, Homo sapiens
cagaacaaauauucagacu

SEQ ID NO: 1422734 - RNA, 19 nt, Homo sapiens
ucucagacuuccaacaaag

SEQ ID NO: 1422735 - RNA, 19 nt, Homo sapiens
ucaguaauauaccacaaac

SEQ ID NO: 1422736 - RNA, 19 nt, Homo sapiens
ggaguaguggcuucguuug

SEQ ID NO: 1422737 - RNA, 19 nt, Homo sapiens
ugacuucuacaauggauau

SEQ ID NO: 1422738 - RNA, 19 nt, Homo sapiens
ggaugugggaucuggagaa

SEQ ID NO: 1422739 - RNA, 19 nt, Homo sapiens
guuaggaagaagauggaua

SEQ ID NO: 1422740 - RNA, 19 nt, Homo sapiens
ggugccaacaugcucauuu

SEQ ID NO: 1422741 - RNA, 19 nt, Homo sapiens
ggaagcaguguugucaaga

SEQ ID NO: 1422742 - RNA, 19 nt, Homo sapiens
gaagauuauugccgaaaag

SEQ ID NO: 1422743 - RNA, 19 nt, Homo sapiens
ggaaggcagcagccaaugg

SEQ ID NO: 1422744 - RNA, 19 nt, Homo sapiens
aaggaauuaucuggacuuu

SEQ ID NO: 1422745 - RNA, 19 nt, Homo sapiens
ggauugguguucgaucagu

SEQ ID NO: 1422746 - RNA, 19 nt, Homo sapiens
guaauauaccacaaacagu

SEQ ID NO: 1422747 - RNA, 19 nt, Homo sapiens
gccauuggaaauauaauuc

SEQ ID NO: 1422748 - RNA, 19 nt, Homo sapiens
cugaaagucugagcaaugg

SEQ ID NO: 1422749 - RNA, 19 nt, Homo sapiens
ccugaaagucugagcaaug

SEQ ID NO: 1422750 - RNA, 19 nt, Homo sapiens
aagacugggugccaacaug

SEQ ID NO: 1422751 - RNA, 19 nt, Homo sapiens
uggaagcaguguugucaag

SEQ ID NO: 1422752 - RNA, 19 nt, Homo sapiens
uuucaaagaagauggcauu

SEQ ID NO: 1422753 - RNA, 19 nt, Homo sapiens
caaggaauuaucuggacuu

SEQ ID NO: 1422754 - RNA, 19 nt, Homo sapiens
aacaugcucauuucaguuu

SEQ ID NO: 1422755 - RNA, 19 nt, Homo sapiens
gagcacugcaaaggaauug

SEQ ID NO: 1422756 - RNA, 19 nt, Homo sapiens
caccucagccucccaaagu

SEQ ID NO: 1422757 - RNA, 19 nt, Homo sapiens
gcaaggaugguuggauugg

SEQ ID NO: 1422758 - RNA, 19 nt, Homo sapiens
caggaucaguaauauacca

SEQ ID NO: 1422759 - RNA, 19 nt, Homo sapiens
uuaaacuucuggauuuggu

SEQ ID NO: 1422760 - RNA, 19 nt, Homo sapiens
cucccaaagugcuaugauu

SEQ ID NO: 1422761 - RNA, 19 nt, Homo sapiens
gaucuggagaauaugaugu

SEQ ID NO: 1422762 - RNA, 19 nt, Homo sapiens
ccaccacacgcagcuaauu

SEQ ID NO: 1422763 - RNA, 19 nt, Homo sapiens
aagaagagaagauuauugc

SEQ ID NO: 1422764 - RNA, 19 nt, Homo sapiens
gaagagaccugugaucauu

SEQ ID NO: 1422765 - RNA, 19 nt, Homo sapiens
gauauuugcuucuguguaa

SEQ ID NO: 1422766 - RNA, 19 nt, Homo sapiens
gaucacaguuguacacuaa

SEQ ID NO: 1422767 - RNA, 19 nt, Homo sapiens
ggaaaugccuauuagaugu

SEQ ID NO: 1422768 - RNA, 19 nt, Homo sapiens
gaggugcucucucccaaua

SEQ ID NO: 1422769 - RNA, 19 nt, Homo sapiens
gaggagccuucauuuauaa

SEQ ID NO: 1422770 - RNA, 19 nt, Homo sapiens
gcaggacgaugcucacauu

SEQ ID NO: 1422771 - RNA, 19 nt, Homo sapiens
gagaacauguuuaccuuug

SEQ ID NO: 1422772 - RNA, 19 nt, Homo sapiens
gguuaagaguugccauuua

SEQ ID NO: 1422773 - RNA, 19 nt, Homo sapiens
gcagauugaagaagaaaua

SEQ ID NO: 1422774 - RNA, 19 nt, Homo sapiens
aaagaugggcuucaaauaa

SEQ ID NO: 1422775 - RNA, 19 nt, Homo sapiens
gcacgaaguuuaauuuacu

SEQ ID NO: 1422776 - RNA, 19 nt, Homo sapiens
guacaggugcgguccauua

SEQ ID NO: 1422777 - RNA, 19 nt, Homo sapiens
ggagggaaaugccuauuag

SEQ ID NO: 1422778 - RNA, 19 nt, Homo sapiens
aagaugggcuucaaauaaa

SEQ ID NO: 1422779 - RNA, 19 nt, Homo sapiens
agaggagccuucauuuaua

SEQ ID NO: 1422780 - RNA, 19 nt, Homo sapiens
ccaacugccuauuagauuu

SEQ ID NO: 1422781 - RNA, 19 nt, Homo sapiens
cuucuaaacuggaaucauu

SEQ ID NO: 1422782 - RNA, 19 nt, Homo sapiens
ucacauauguuaguaagga

SEQ ID NO: 1422783 - RNA, 19 nt, Homo sapiens
gcagaggaucuauggaaua

SEQ ID NO: 1422784 - RNA, 19 nt, Homo sapiens
gaaaggagacgaugaacgu

SEQ ID NO: 1422785 - RNA, 19 nt, Homo sapiens
gauaagaagagaccuguga

SEQ ID NO: 1422786 - RNA, 19 nt, Homo sapiens
cagaggagccuucauuuau

SEQ ID NO: 1422787 - RNA, 19 nt, Homo sapiens
uaacuucugccauugauaa

SEQ ID NO: 1422788 - RNA, 19 nt, Homo sapiens
gaaugaggcugagaagcaa

SEQ ID NO: 1422789 - RNA, 19 nt, Homo sapiens
ugacaaaggaauucaguuu

SEQ ID NO: 1422790 - RNA, 19 nt, Homo sapiens
gaucauucaucgagccauu

SEQ ID NO: 1422791 - RNA, 19 nt, Homo sapiens
uugcaaagguccacaugua

SEQ ID NO: 1422792 - RNA, 19 nt, Homo sapiens
ggaaugaggcugagaagca

SEQ ID NO: 1422793 - RNA, 19 nt, Homo sapiens
ccagaggagccuucauuua

SEQ ID NO: 1422794 - RNA, 19 nt, Homo sapiens
gcacagcuggcucaguaua

SEQ ID NO: 1422795 - RNA, 19 nt, Homo sapiens
caacugccuauuagauuua

SEQ ID NO: 1422796 - RNA, 19 nt, Homo sapiens
uggcuucuccuuucaauua

SEQ ID NO: 1422797 - RNA, 19 nt, Homo sapiens
ccagggcacugucuaaugu

SEQ ID NO: 1422798 - RNA, 19 nt, Homo sapiens
gcgagaacauguuuaccuu

SEQ ID NO: 1422799 - RNA, 19 nt, Homo sapiens
caggugcgguccauuaauu

SEQ ID NO: 1422800 - RNA, 19 nt, Homo sapiens
gcaaagaaccgagaucaca

SEQ ID NO: 1422801 - RNA, 19 nt, Homo sapiens
cacuauagguuaagaguug

SEQ ID NO: 1422802 - RNA, 19 nt, Homo sapiens
ucagguauccagugaauuu

SEQ ID NO: 1422803 - RNA, 19 nt, Homo sapiens
cagaggaucuauggaauau

SEQ ID NO: 1422804 - RNA, 19 nt, Homo sapiens
ugacaugcacgaaguuuaa

SEQ ID NO: 1422805 - RNA, 19 nt, Homo sapiens
cccaggagauggagcauuu

SEQ ID NO: 1422806 - RNA, 19 nt, Homo sapiens
caauuaaaccugucaacaa

SEQ ID NO: 1422807 - RNA, 19 nt, Homo sapiens
gaacauguuuaccuuugag

SEQ ID NO: 1422808 - RNA, 19 nt, Homo sapiens
gagggcacgugggaaauuu

SEQ ID NO: 1422809 - RNA, 19 nt, Homo sapiens
ggagaaccguggaaaauga

SEQ ID NO: 1422810 - RNA, 19 nt, Homo sapiens
ccuauuagaugugcugauu

SEQ ID NO: 1422811 - RNA, 19 nt, Homo sapiens
uaggagagauugagaugug

SEQ ID NO: 1422812 - RNA, 19 nt, Homo sapiens
ggagcagauugaagaagaa

SEQ ID NO: 1422813 - RNA, 19 nt, Homo sapiens
gggaaaugccuauuagaug

SEQ ID NO: 1422814 - RNA, 19 nt, Homo sapiens
cccaauauguacaacagua

SEQ ID NO: 1422815 - RNA, 19 nt, Homo sapiens
gcacaguggagcagauuga

SEQ ID NO: 1422816 - RNA, 19 nt, Homo sapiens
gcuuacagauuucauacga

SEQ ID NO: 1422817 - RNA, 19 nt, Homo sapiens
ugacuuggaucacaguugu

SEQ ID NO: 1422818 - RNA, 19 nt, Homo sapiens
auaacaagaugaugagaga

SEQ ID NO: 1422819 - RNA, 19 nt, Homo sapiens
uuuaguaacuucugccauu

SEQ ID NO: 1422820 - RNA, 19 nt, Homo sapiens
augcacagcuggcucagua

SEQ ID NO: 1422821 - RNA, 19 nt, Homo sapiens
ggaucacaguuguacacua

SEQ ID NO: 1422822 - RNA, 19 nt, Homo sapiens
ccaucaaugugcuacaauu

SEQ ID NO: 1422823 - RNA, 19 nt, Homo sapiens
agauugagauguggaauga

SEQ ID NO: 1422824 - RNA, 19 nt, Homo sapiens
ggagggcaauccggaaaug

SEQ ID NO: 1422825 - RNA, 19 nt, Homo sapiens
ggaauucaguuuuguggaa

SEQ ID NO: 1422826 - RNA, 19 nt, Homo sapiens
gauagauaaugcuguaaac

SEQ ID NO: 1422827 - RNA, 19 nt, Homo sapiens
ucacaguuguacacuaaau

SEQ ID NO: 1422828 - RNA, 19 nt, Homo sapiens
ugauagccauucuuucaga

SEQ ID NO: 1422829 - RNA, 19 nt, Homo sapiens
ggagccuucauuuauaaua

SEQ ID NO: 1422830 - RNA, 19 nt, Homo sapiens
caaaauucauggagagauu

SEQ ID NO: 1422831 - RNA, 19 nt, Homo sapiens
caaagguccacauguaaga

SEQ ID NO: 1422832 - RNA, 19 nt, Homo sapiens
gcaaagguccacauguaag

SEQ ID NO: 1422833 - RNA, 19 nt, Homo sapiens
uggagcagauugaagaaga

SEQ ID NO: 1422834 - RNA, 19 nt, Homo sapiens
gagccuucauuuauaauac

SEQ ID NO: 1422835 - RNA, 19 nt, Homo sapiens
acacugaaacuuuaucuuc

SEQ ID NO: 1422836 - RNA, 19 nt, Homo sapiens
auaaaagucugcagaguuu

SEQ ID NO: 1422837 - RNA, 19 nt, Homo sapiens
ugagaaaggagacgaugaa

SEQ ID NO: 1422838 - RNA, 19 nt, Homo sapiens
gcgaacaagagacaacaaa

SEQ ID NO: 1422839 - RNA, 19 nt, Homo sapiens
gaacagcuugauggacuuu

SEQ ID NO: 1422840 - RNA, 19 nt, Homo sapiens
aauuaaaccugucaacaag

SEQ ID NO: 1422841 - RNA, 19 nt, Homo sapiens
cuacuaaaauucacacuga

SEQ ID NO: 1422842 - RNA, 19 nt, Homo sapiens
guuaguacuucuacgacuu

SEQ ID NO: 1422843 - RNA, 19 nt, Homo sapiens
ugaagaaucucaggaagac

SEQ ID NO: 1422844 - RNA, 19 nt, Homo sapiens
gagaagcaacugcagaaca

SEQ ID NO: 1422845 - RNA, 19 nt, Homo sapiens
caacaaggccggaaaacuu

SEQ ID NO: 1422846 - RNA, 19 nt, Homo sapiens
ggugcucucucccaauaug

SEQ ID NO: 1422847 - RNA, 19 nt, Homo sapiens
acauuuggcuucuccuuuc

SEQ ID NO: 1422848 - RNA, 19 nt, Homo sapiens
gaaaugccuauuagaugug

SEQ ID NO: 1422849 - RNA, 19 nt, Homo sapiens
gaucgggaaggaacaagaa

SEQ ID NO: 1422850 - RNA, 19 nt, Homo sapiens
gaacaagagacaacaaaau

SEQ ID NO: 1422851 - RNA, 19 nt, Homo sapiens
uagcugacaugcacgaagu

SEQ ID NO: 1422852 - RNA, 19 nt, Homo sapiens
ggaagacacggacacucaa

SEQ ID NO: 1422853 - RNA, 19 nt, Homo sapiens
gauaaacugaagaaucuca

SEQ ID NO: 1422854 - RNA, 19 nt, Homo sapiens
gcuguaaacgugcgaacaa

SEQ ID NO: 1422855 - RNA, 19 nt, Homo sapiens
ccaauauguacaacaguaa

SEQ ID NO: 1422856 - RNA, 19 nt, Homo sapiens
gcacuauagguuaagaguu

SEQ ID NO: 1422857 - RNA, 19 nt, Homo sapiens
aggagacgaugaacgugua

SEQ ID NO: 1422858 - RNA, 19 nt, Homo sapiens
guacuucuacgacuuugga

SEQ ID NO: 1422859 - RNA, 19 nt, Homo sapiens
gaagacacggacacucaau

SEQ ID NO: 1422860 - RNA, 19 nt, Homo sapiens
acaggaagaucgggaagga

SEQ ID NO: 1422861 - RNA, 19 nt, Homo sapiens
gcccuaaaauugacauaaa

SEQ ID NO: 1422862 - RNA, 19 nt, Homo sapiens
gaagaucgggaaggaacaa

SEQ ID NO: 1422863 - RNA, 19 nt, Homo sapiens
caugcacgaaguuuaauuu

SEQ ID NO: 1422864 - RNA, 19 nt, Homo sapiens
gcagaacucucuagaaaug

SEQ ID NO: 1422865 - RNA, 19 nt, Homo sapiens
gaacugaagacaacuguua

SEQ ID NO: 1422866 - RNA, 19 nt, Homo sapiens
cuagaaaugucaugauuga

SEQ ID NO: 1422867 - RNA, 19 nt, Homo sapiens
cugcagaacucucuagaaa

SEQ ID NO: 1422868 - RNA, 19 nt, Homo sapiens
auaggaaucugcaccauuu

SEQ ID NO: 1422869 - RNA, 19 nt, Homo sapiens
ggaacucccugacauccuu

SEQ ID NO: 1422870 - RNA, 19 nt, Homo sapiens
cagcgugccugaugggaua

SEQ ID NO: 1422871 - RNA, 19 nt, Homo sapiens
gauaaacacucaagaaccu

SEQ ID NO: 1422872 - RNA, 19 nt, Homo sapiens
gaugggauauauucaguca

SEQ ID NO: 1422873 - RNA, 19 nt, Homo sapiens
cagaaaaccuugcucagaa

SEQ ID NO: 1422874 - RNA, 19 nt, Homo sapiens
gaauauauccuuccccaaa

SEQ ID NO: 1422875 - RNA, 19 nt, Homo sapiens
uaccggaaauggaccaauu

SEQ ID NO: 1422876 - RNA, 19 nt, Homo sapiens
ugggauauauucagucaug

SEQ ID NO: 1422877 - RNA, 19 nt, Homo sapiens
uggaguuacugaaagauga

SEQ ID NO: 1422878 - RNA, 19 nt, Homo sapiens
gaacccugauaccggaaau

SEQ ID NO: 1422879 - RNA, 19 nt, Homo sapiens
cauuggaguuacugaaaga

SEQ ID NO: 1422880 - RNA, 19 nt, Homo sapiens
caaguuggaauauauccuu

SEQ ID NO: 1422881 - RNA, 19 nt, Homo sapiens
ucagaagcuuccaaaccuu

SEQ ID NO: 1422882 - RNA, 19 nt, Homo sapiens
gaccaauuuugacaagaua

SEQ ID NO: 1422883 - RNA, 19 nt, Homo sapiens
ggaccaauuuugacaagau

SEQ ID NO: 1422884 - RNA, 19 nt, Homo sapiens
cucuagaaaugucaugauu

SEQ ID NO: 1422885 - RNA, 19 nt, Homo sapiens
gaccugcugaguugauaaa

SEQ ID NO: 1422886 - RNA, 19 nt, Homo sapiens
aaaccuugcucagaagcuu

SEQ ID NO: 1422887 - RNA, 19 nt, Homo sapiens
ccauuggaguuacugaaag

SEQ ID NO: 1422888 - RNA, 19 nt, Homo sapiens
gaaaaggaacucccugaca

SEQ ID NO: 1422889 - RNA, 19 nt, Homo sapiens
caaaccuuguggaacugaa

SEQ ID NO: 1422890 - RNA, 19 nt, Homo sapiens
ugacauccuugccagaaaa

SEQ ID NO: 1422891 - RNA, 19 nt, Homo sapiens
aaaaggaacucccugacau

SEQ ID NO: 1422892 - RNA, 19 nt, Homo sapiens
gucauggcguccgaacuuu

SEQ ID NO: 1422893 - RNA, 19 nt, Homo sapiens
cagacgugguccugccaaa

SEQ ID NO: 1422894 - RNA, 19 nt, Homo sapiens
gcacugcagaacucucuag

SEQ ID NO: 1422895 - RNA, 19 nt, Homo sapiens
uauaggaaucugcaccauu

SEQ ID NO: 1422896 - RNA, 19 nt, Homo sapiens
agaacucucuagaaauguc

SEQ ID NO: 1422897 - RNA, 19 nt, Homo sapiens
aagaugagggacugcagua

SEQ ID NO: 1422898 - RNA, 19 nt, Homo sapiens
gaacucucuagaaauguca

SEQ ID NO: 1422899 - RNA, 19 nt, Homo sapiens
cauccuguccuguccaaug

SEQ ID NO: 1422900 - RNA, 19 nt, Homo sapiens
augagggacugcaguacuu

SEQ ID NO: 1422901 - RNA, 19 nt, Homo sapiens
ggacccgagaacccugaua

SEQ ID NO: 1422902 - RNA, 19 nt, Homo sapiens
gcucagaagcuuccaaacc

SEQ ID NO: 1422903 - RNA, 19 nt, Homo sapiens
cugacauccuugccagaaa

SEQ ID NO: 1422904 - RNA, 19 nt, Homo sapiens
gaacuuuguaagacgaucu

SEQ ID NO: 1422905 - RNA, 19 nt, Homo sapiens
gaugagggacugcaguacu

SEQ ID NO: 1422906 - RNA, 19 nt, Homo sapiens
agucauggcguccgaacuu

SEQ ID NO: 1422907 - RNA, 19 nt, Homo sapiens
ucuagaaaugucaugauug

SEQ ID NO: 1422908 - RNA, 19 nt, Homo sapiens
ccugcugaguugauaaaca

SEQ ID NO: 1422909 - RNA, 19 nt, Homo sapiens
cucagaagcuuccaaaccu

SEQ ID NO: 1422910 - RNA, 19 nt, Homo sapiens
ggaacugaagacaacuguu

SEQ ID NO: 1422911 - RNA, 19 nt, Homo sapiens
ggacgaagauuaccaaaga

SEQ ID NO: 1422912 - RNA, 19 nt, Homo sapiens
gaucaucucccaacaagua

SEQ ID NO: 1422913 - RNA, 19 nt, Homo sapiens
gcagggcacuauauuugua

SEQ ID NO: 1422914 - RNA, 19 nt, Homo sapiens
gaucugggauuacaucgaa

SEQ ID NO: 1422915 - RNA, 19 nt, Homo sapiens
gcucgcagcuccugucaaa

SEQ ID NO: 1422916 - RNA, 19 nt, Homo sapiens
gaagaaaccaagagcauug

SEQ ID NO: 1422917 - RNA, 19 nt, Homo sapiens
caucugagccuaugucauu

SEQ ID NO: 1422918 - RNA, 19 nt, Homo sapiens
ugucaaaucuggacgaaga

SEQ ID NO: 1422919 - RNA, 19 nt, Homo sapiens
ggaggaauuucugaaguug

SEQ ID NO: 1422920 - RNA, 19 nt, Homo sapiens
gaggacaaguucagaucuu

SEQ ID NO: 1422921 - RNA, 19 nt, Homo sapiens
gcacuauauuuguaugugu

SEQ ID NO: 1422922 - RNA, 19 nt, Homo sapiens
gcagcagggcacuauauuu

SEQ ID NO: 1422923 - RNA, 19 nt, Homo sapiens
cagcagggcacuauauuug

SEQ ID NO: 1422924 - RNA, 19 nt, Homo sapiens
auaaagggaucaaccuaga

SEQ ID NO: 1422925 - RNA, 19 nt, Homo sapiens
cagugaagcuggagaugga

SEQ ID NO: 1422926 - RNA, 19 nt, Homo sapiens
caggagggcuucacugucu

SEQ ID NO: 1422927 - RNA, 19 nt, Homo sapiens
gcagaucugucaggagcaa

SEQ ID NO: 1422928 - RNA, 19 nt, Homo sapiens
gacaugaacagcuacauca

SEQ ID NO: 1422929 - RNA, 19 nt, Homo sapiens
gagcagccguguggcaguu

SEQ ID NO: 1422930 - RNA, 19 nt, Homo sapiens
gcaagaagccacgaugaag

SEQ ID NO: 1422931 - RNA, 19 nt, Homo sapiens
gaagauuaccaaagagaag

SEQ ID NO: 1422932 - RNA, 19 nt, Homo sapiens
gaaggaggaauuucugaag

SEQ ID NO: 1422933 - RNA, 19 nt, Homo sapiens
ggacaaguucagaucuuug

SEQ ID NO: 1422934 - RNA, 19 nt, Homo sapiens
gugaagagggucauugaug

SEQ ID NO: 1422935 - RNA, 19 nt, Homo sapiens
guucagaucuuuggaaucc

SEQ ID NO: 1422936 - RNA, 19 nt, Homo sapiens
ccucggaccucuucucucu

SEQ ID NO: 1422937 - RNA, 19 nt, Homo sapiens
guagaacccacgcuuggaa

SEQ ID NO: 1422938 - RNA, 19 nt, Homo sapiens
aauccagccugccauagaa

SEQ ID NO: 1422939 - RNA, 19 nt, Homo sapiens
gcuacaucagucaguauua

SEQ ID NO: 1422940 - RNA, 19 nt, Homo sapiens
gccaucagccucaucauca

SEQ ID NO: 1422941 - RNA, 19 nt, Homo sapiens
ggguaagucuguucaacca

SEQ ID NO: 1422942 - RNA, 19 nt, Homo sapiens
gaacccacgcuuggaaaug

SEQ ID NO: 1422943 - RNA, 19 nt, Homo sapiens
gggauuacaucgaaaacaa

SEQ ID NO: 1422944 - RNA, 19 nt, Homo sapiens
ggaucagccuggucauucu

SEQ ID NO: 1422945 - RNA, 19 nt, Homo sapiens
ccaacaaguagacgaagaa

SEQ ID NO: 1422946 - RNA, 19 nt, Homo sapiens
aggaggaauuucugaaguu

SEQ ID NO: 1422947 - RNA, 19 nt, Homo sapiens
uaugucauuuguccucauu

SEQ ID NO: 1422948 - RNA, 19 nt, Homo sapiens
gggcuucacugucuuucag

SEQ ID NO: 1422949 - RNA, 19 nt, Homo sapiens
gagcuggaacacaggguaa

SEQ ID NO: 1422950 - RNA, 19 nt, Homo sapiens
gggcagcagggcacuauau

SEQ ID NO: 1422951 - RNA, 19 nt, Homo sapiens
cgaagaaaccaagagcauu

SEQ ID NO: 1422952 - RNA, 19 nt, Homo sapiens
caaccuuggcuuuaauaau

SEQ ID NO: 1422953 - RNA, 19 nt, Homo sapiens
caaguucagaucuuuggaa

SEQ ID NO: 1422954 - RNA, 19 nt, Homo sapiens
ggagggcuucacugucuuu

SEQ ID NO: 1422955 - RNA, 19 nt, Homo sapiens
acagcuacaucagucagua

SEQ ID NO: 1422956 - RNA, 19 nt, Homo sapiens
ggagcaaggguuugagauc

SEQ ID NO: 1422957 - RNA, 19 nt, Homo sapiens
uggagaggcugacgcagau

SEQ ID NO: 1422958 - RNA, 19 nt, Homo sapiens
caugagcguuucugagucu

SEQ ID NO: 1422959 - RNA, 19 nt, Homo sapiens
cuacaucagucaguauuac

SEQ ID NO: 1422960 - RNA, 19 nt, Homo sapiens
gaugaaggacgacaugaac

SEQ ID NO: 1422961 - RNA, 19 nt, Homo sapiens
caacaaguagacgaagaaa

SEQ ID NO: 1422962 - RNA, 19 nt, Homo sapiens
caauccagccugccauaga

SEQ ID NO: 1422963 - RNA, 19 nt, Homo sapiens
gcuccaucuuucaacauga

SEQ ID NO: 1422964 - RNA, 19 nt, Homo sapiens
gcgcagccgcuucaaagug

SEQ ID NO: 1422965 - RNA, 19 nt, Homo sapiens
gcugugaucauccuaucuu

SEQ ID NO: 1422966 - RNA, 19 nt, Homo sapiens
gggcugugaucauccuauc

SEQ ID NO: 1422967 - RNA, 19 nt, Homo sapiens
ggcuguggcuccaucuuuc

SEQ ID NO: 1422968 - RNA, 19 nt, Homo sapiens
gagcguuucugagucucuu

SEQ ID NO: 1422969 - RNA, 19 nt, Homo sapiens
agacagccaucucaaagcu

SEQ ID NO: 1422970 - RNA, 19 nt, Homo sapiens
ccacuaaacaccaagaaaa

SEQ ID NO: 1422971 - RNA, 19 nt, Homo sapiens
ccucuucucucuggacaug

SEQ ID NO: 1422972 - RNA, 19 nt, Homo sapiens
acaaugggcccagcaguga

SEQ ID NO: 1422973 - RNA, 19 nt, Homo sapiens
aggccaaggucauccaaga

SEQ ID NO: 1422974 - RNA, 19 nt, Homo sapiens
cgaagauuaccaaagagaa

SEQ ID NO: 1422975 - RNA, 19 nt, Homo sapiens
caccuucacaggauauaaa

SEQ ID NO: 1422976 - RNA, 19 nt, Homo sapiens
gggugaagagggucauuga

SEQ ID NO: 1422977 - RNA, 19 nt, Homo sapiens
gccaugggcugggugagau

SEQ ID NO: 1422978 - RNA, 19 nt, Homo sapiens
aggacaaguucagaucuuu

SEQ ID NO: 1422979 - RNA, 19 nt, Homo sapiens
gagacuguucuacggauug

SEQ ID NO: 1422980 - RNA, 19 nt, Homo sapiens
aaagagaagggucuaacug

SEQ ID NO: 1422981 - RNA, 19 nt, Homo sapiens
caagacgaaucuaguuuuc

SEQ ID NO: 1422982 - RNA, 19 nt, Homo sapiens
aaggaggaauuucugaagu

SEQ ID NO: 1422983 - RNA, 19 nt, Homo sapiens
aggacgacaugaacagcua

SEQ ID NO: 1422984 - RNA, 19 nt, Homo sapiens
cgaugaaggacgacaugaa

SEQ ID NO: 1422985 - RNA, 19 nt, Homo sapiens
cgcagccgcuucaaagugu

SEQ ID NO: 1422986 - RNA, 19 nt, Homo sapiens
ugccauagaaggaggaauu

SEQ ID NO: 1422987 - RNA, 19 nt, Homo sapiens
ggcacuauauuuguaugug

SEQ ID NO: 1422988 - RNA, 19 nt, Homo sapiens
gaggaauuucugaaguuga

SEQ ID NO: 1422989 - RNA, 19 nt, Homo sapiens
ucauuuguccucauucuca

SEQ ID NO: 1422990 - RNA, 19 nt, Homo sapiens
cgacaugaacagcuacauc

SEQ ID NO: 1422991 - RNA, 19 nt, Homo sapiens
gccaggaggccacaagcuu

SEQ ID NO: 1422992 - RNA, 19 nt, Homo sapiens
cugcagcccucgcaagaag

SEQ ID NO: 1422993 - RNA, 19 nt, Homo sapiens
agaugguuauccagcagua

SEQ ID NO: 1422994 - RNA, 19 nt, Homo sapiens
gugaucauccuaucuuugg

SEQ ID NO: 1422995 - RNA, 19 nt, Homo sapiens
cccaacaaguagacgaaga

SEQ ID NO: 1422996 - RNA, 19 nt, Homo sapiens
gcagccguguggcaguuuc

SEQ ID NO: 1422997 - RNA, 19 nt, Homo sapiens
caaagagaagggucuaacu

SEQ ID NO: 1422998 - RNA, 19 nt, Homo sapiens
ucgcagcuccugucaaauc

SEQ ID NO: 1422999 - RNA, 19 nt, Homo sapiens
ggcagcagggcacuauauu

SEQ ID NO: 1423000 - RNA, 19 nt, Homo sapiens
ggcuccaucuuucaacaug

SEQ ID NO: 1423001 - RNA, 19 nt, Homo sapiens
gaaccaggagggcuucacu

SEQ ID NO: 1423002 - RNA, 19 nt, Homo sapiens
uuguaugugucuuguagaa

SEQ ID NO: 1423003 - RNA, 19 nt, Homo sapiens
gaaggccaaggucauccaa

SEQ ID NO: 1423004 - RNA, 19 nt, Homo sapiens
gacgaagauuaccaaagag

SEQ ID NO: 1423005 - RNA, 19 nt, Homo sapiens
cugugcagcuggugaacuu

SEQ ID NO: 1423006 - RNA, 19 nt, Homo sapiens
gauauaaagggaucaaccu

SEQ ID NO: 1423007 - RNA, 19 nt, Homo sapiens
gccauagaaggaggaauuu

SEQ ID NO: 1423008 - RNA, 19 nt, Homo sapiens
ggaggacaaguucagaucu

SEQ ID NO: 1423009 - RNA, 19 nt, Homo sapiens
cgcaagaagccacgaugaa

SEQ ID NO: 1423010 - RNA, 19 nt, Homo sapiens
gcagccgcuucaaaguguu

SEQ ID NO: 1423011 - RNA, 19 nt, Homo sapiens
gaugggcucuuucugguua

SEQ ID NO: 1423012 - RNA, 19 nt, Homo sapiens
agaauugacuggauaguaa

SEQ ID NO: 1423013 - RNA, 19 nt, Homo sapiens
ccauuaaccuggaagcuuu

SEQ ID NO: 1423014 - RNA, 19 nt, Homo sapiens
gaaugugucuguaguugug

SEQ ID NO: 1423015 - RNA, 19 nt, Homo sapiens
gauuggaugugaaguagaa

SEQ ID NO: 1423016 - RNA, 19 nt, Homo sapiens
ucaaguaugucauccaaau

SEQ ID NO: 1423017 - RNA, 19 nt, Homo sapiens
uaagaggcauauacauuga

SEQ ID NO: 1423018 - RNA, 19 nt, Homo sapiens
gcauuaagcauguauaaca

SEQ ID NO: 1423019 - RNA, 19 nt, Homo sapiens
caugauagcagagauauuu

SEQ ID NO: 1423020 - RNA, 19 nt, Homo sapiens
gaucaugguguuagaauug

SEQ ID NO: 1423021 - RNA, 19 nt, Homo sapiens
ccuggaagcuuucaugaau

SEQ ID NO: 1423022 - RNA, 19 nt, Homo sapiens
gguuaguuguuacaugaua

SEQ ID NO: 1423023 - RNA, 19 nt, Homo sapiens
caaauaagaggcauauaca

SEQ ID NO: 1423024 - RNA, 19 nt, Homo sapiens
gcugaccaauccaguguuu

SEQ ID NO: 1423025 - RNA, 19 nt, Homo sapiens
gagagauuguugucuugaa

SEQ ID NO: 1423026 - RNA, 19 nt, Homo sapiens
uuauacagguguucaaaga

SEQ ID NO: 1423027 - RNA, 19 nt, Homo sapiens
aauaggagcuuggaugguu

SEQ ID NO: 1423028 - RNA, 19 nt, Homo sapiens
guucaaagaguucaauuuc

SEQ ID NO: 1423029 - RNA, 19 nt, Homo sapiens
acaaggcgcuggagugcuu

SEQ ID NO: 1423030 - RNA, 19 nt, Homo sapiens
uagauuacuuugggaauga

SEQ ID NO: 1423031 - RNA, 19 nt, Homo sapiens
ccaaauaagaggcauauac

SEQ ID NO: 1423032 - RNA, 19 nt, Homo sapiens
uggaagcuuucaugaauau

SEQ ID NO: 1423033 - RNA, 19 nt, Homo sapiens
caaguaugucauccaaaua

SEQ ID NO: 1423034 - RNA, 19 nt, Homo sapiens
aaugagagauuguugucuu

SEQ ID NO: 1423035 - RNA, 19 nt, Homo sapiens
gaagcuuucaugaauauuc

SEQ ID NO: 1423036 - RNA, 19 nt, Homo sapiens
gugaaugugucuguaguug

SEQ ID NO: 1423037 - RNA, 19 nt, Homo sapiens
gcuccuugcugggcaguuu

SEQ ID NO: 1423038 - RNA, 19 nt, Homo sapiens
gaaacuuccuggcuuacac

SEQ ID NO: 1423039 - RNA, 19 nt, Homo sapiens
gcuccgguacuuccuauuu

SEQ ID NO: 1423040 - RNA, 19 nt, Homo sapiens
cugguuaguuguuacauga

SEQ ID NO: 1423041 - RNA, 19 nt, Homo sapiens
caucuacuacgucguguuu

SEQ ID NO: 1423042 - RNA, 19 nt, Homo sapiens
cuccgguacuuccuauuua

SEQ ID NO: 1423043 - RNA, 19 nt, Homo sapiens
cuugaacucuggcacugua

SEQ ID NO: 1423044 - RNA, 19 nt, Homo sapiens
ggaaugagagauuguuguc

SEQ ID NO: 1423045 - RNA, 19 nt, Homo sapiens
uguuagaauugacuggaua

SEQ ID NO: 1423046 - RNA, 19 nt, Homo sapiens
gguccucgaucaugguguu

SEQ ID NO: 1423047 - RNA, 19 nt, Homo sapiens
gggauggccuguggauuca

SEQ ID NO: 1423048 - RNA, 19 nt, Homo sapiens
cuggaagcuuucaugaaua

SEQ ID NO: 1423049 - RNA, 19 nt, Homo sapiens
agacuagauugcaauagga

SEQ ID NO: 1423050 - RNA, 19 nt, Homo sapiens
cagacuagauugcaauagg

SEQ ID NO: 1423051 - RNA, 19 nt, Homo sapiens
auaagaggcauauacauug

SEQ ID NO: 1423052 - RNA, 19 nt, Homo sapiens
cagguggucugguggauag

SEQ ID NO: 1423053 - RNA, 19 nt, Homo sapiens
uuggaugguucgaggaaua

SEQ ID NO: 1423054 - RNA, 19 nt, Homo sapiens
guggugggcuggcacaauc

SEQ ID NO: 1423055 - RNA, 19 nt, Homo sapiens
gcagcaucaucguccaguu

SEQ ID NO: 1423056 - RNA, 19 nt, Homo sapiens
uagaauugacuggauagua

SEQ ID NO: 1423057 - RNA, 19 nt, Homo sapiens
cgaucaugguguuagaauu

SEQ ID NO: 1423058 - RNA, 19 nt, Homo sapiens
gugauuggaugugaaguag

SEQ ID NO: 1423059 - RNA, 19 nt, Homo sapiens
agaguucaauuucaaccuu

SEQ ID NO: 1423060 - RNA, 19 nt, Homo sapiens
aggcauauacauugaauug

SEQ ID NO: 1423061 - RNA, 19 nt, Homo sapiens
auacagguguucaaagagu

SEQ ID NO: 1423062 - RNA, 19 nt, Homo sapiens
uuacaugauagcagagaua

SEQ ID NO: 1423063 - RNA, 19 nt, Homo sapiens
gcuguuggccagauuggaa

SEQ ID NO: 1423064 - RNA, 19 nt, Homo sapiens
guacuuccuauuuaacaga

SEQ ID NO: 1423065 - RNA, 19 nt, Homo sapiens
uccgguacuuccuauuuaa

SEQ ID NO: 1423066 - RNA, 19 nt, Homo sapiens
gcgcuccgguacuuccuau

SEQ ID NO: 1423067 - RNA, 19 nt, Homo sapiens
uuagauuacuuugggaaug

SEQ ID NO: 1423068 - RNA, 19 nt, Homo sapiens
guaccguucggguccauuu

SEQ ID NO: 1423069 - RNA, 19 nt, Homo sapiens
caacaucauggucuacauc

SEQ ID NO: 1423070 - RNA, 19 nt, Homo sapiens
uguguuaguuugcauuaag

SEQ ID NO: 1423071 - RNA, 19 nt, Homo sapiens
aggaaaagcucaacaucuu

SEQ ID NO: 1423072 - RNA, 19 nt, Homo sapiens
uaaccuggaagcuuucaug

SEQ ID NO: 1423073 - RNA, 19 nt, Homo sapiens
aaacagacuagauugcaau

SEQ ID NO: 1423074 - RNA, 19 nt, Homo sapiens
agaggcauauacauugaau

SEQ ID NO: 1423075 - RNA, 19 nt, Homo sapiens
guaugucauccaaauaaga

SEQ ID NO: 1423076 - RNA, 19 nt, Homo sapiens
ugaccaauccaguguuugu

SEQ ID NO: 1423077 - RNA, 19 nt, Homo sapiens
gcuccgucgugcugauuau

SEQ ID NO: 1423078 - RNA, 19 nt, Homo sapiens
guaguuguguuaguuugca

SEQ ID NO: 1423079 - RNA, 19 nt, Homo sapiens
aggcugagcuggaggaaaa

SEQ ID NO: 1423080 - RNA, 19 nt, Homo sapiens
guuguguuaguuugcauua

SEQ ID NO: 1423081 - RNA, 19 nt, Homo sapiens
uaguuugcauuaagcaugu

SEQ ID NO: 1423082 - RNA, 19 nt, Homo sapiens
cgugauuggaugugaagua

SEQ ID NO: 1423083 - RNA, 19 nt, Homo sapiens
gggaaugagagauuguugu

SEQ ID NO: 1423084 - RNA, 19 nt, Homo sapiens
guuaguuguuacaugauag

SEQ ID NO: 1423085 - RNA, 19 nt, Homo sapiens
ccucgaucaugguguuaga

SEQ ID NO: 1423086 - RNA, 19 nt, Homo sapiens
ccaacaucauggucuacau

SEQ ID NO: 1423087 - RNA, 19 nt, Homo sapiens
auucaaguaugucauccaa

SEQ ID NO: 1423088 - RNA, 19 nt, Homo sapiens
agacgaaucucauuuucau

SEQ ID NO: 1423089 - RNA, 19 nt, Homo sapiens
ggccgugauuggaugugaa

SEQ ID NO: 1423090 - RNA, 19 nt, Homo sapiens
ggccucagccauccucuuc

SEQ ID NO: 1423091 - RNA, 19 nt, Homo sapiens
cagugaaugugucuguagu

SEQ ID NO: 1423092 - RNA, 19 nt, Homo sapiens
ggcaccaucucucucugau

SEQ ID NO: 1423093 - RNA, 19 nt, Homo sapiens
gaaaacagacuagauugca

SEQ ID NO: 1423094 - RNA, 19 nt, Homo sapiens
uacagguguucaaagaguu

SEQ ID NO: 1423095 - RNA, 19 nt, Homo sapiens
ucuacuacgucguguuuac

SEQ ID NO: 1423096 - RNA, 19 nt, Homo sapiens
cagcaucaucguccaguuc

SEQ ID NO: 1423097 - RNA, 19 nt, Homo sapiens
auaacaacccguccaguca

SEQ ID NO: 1423098 - RNA, 19 nt, Homo sapiens
gucuguaguuguguuaguu

SEQ ID NO: 1423099 - RNA, 19 nt, Homo sapiens
cuauuuaacagacauugug

SEQ ID NO: 1423100 - RNA, 19 nt, Homo sapiens
caguucagguacaucaaca

SEQ ID NO: 1423101 - RNA, 19 nt, Homo sapiens
gguacuuccuauuuaacag

SEQ ID NO: 1423102 - RNA, 19 nt, Homo sapiens
ggcucuuucugguuaguug

SEQ ID NO: 1423103 - RNA, 19 nt, Homo sapiens
gcuucgcgcuccgguacuu

SEQ ID NO: 1423104 - RNA, 19 nt, Homo sapiens
ggaaaagcucaacaucuug

SEQ ID NO: 1423105 - RNA, 19 nt, Homo sapiens
ggugguuucuggccgugau

SEQ ID NO: 1423106 - RNA, 19 nt, Homo sapiens
caacccguccagucagaga

SEQ ID NO: 1423107 - RNA, 19 nt, Homo sapiens
agagauuguugucuugaac

SEQ ID NO: 1423108 - RNA, 19 nt, Homo sapiens
gaaggaaaagcucaacauc

SEQ ID NO: 1423109 - RNA, 19 nt, Homo sapiens
guguuagaauugacuggau

SEQ ID NO: 1423110 - RNA, 19 nt, Homo sapiens
gaacugcaguccaaacuug

SEQ ID NO: 1423111 - RNA, 19 nt, Homo sapiens
gcuaagaacuuugaaacaa

SEQ ID NO: 1423112 - RNA, 19 nt, Homo sapiens
aagaggaacugaugcaaua

SEQ ID NO: 1423113 - RNA, 19 nt, Homo sapiens
gagaugauuugaacucuga

SEQ ID NO: 1423114 - RNA, 19 nt, Homo sapiens
gaaaauggcuucugacauc

SEQ ID NO: 1423115 - RNA, 19 nt, Homo sapiens
uagagaaguugccaaagua

SEQ ID NO: 1423116 - RNA, 19 nt, Homo sapiens
gcuauaauuuggaggauga

SEQ ID NO: 1423117 - RNA, 19 nt, Homo sapiens
ggagugaaccuguaccaaa

SEQ ID NO: 1423118 - RNA, 19 nt, Homo sapiens
ccaacagccaguuuaauua

SEQ ID NO: 1423119 - RNA, 19 nt, Homo sapiens
gcagacacacacaaauaua

SEQ ID NO: 1423120 - RNA, 19 nt, Homo sapiens
gaauaccauuugugucuga

SEQ ID NO: 1423121 - RNA, 19 nt, Homo sapiens
gcaagacaaugcuuccaau

SEQ ID NO: 1423122 - RNA, 19 nt, Homo sapiens
ccagccaggugauguuaua

SEQ ID NO: 1423123 - RNA, 19 nt, Homo sapiens
cagaugaaaugacaguuug

SEQ ID NO: 1423124 - RNA, 19 nt, Homo sapiens
gcagaugaaaugacaguuu

SEQ ID NO: 1423125 - RNA, 19 nt, Homo sapiens
ggacguagaugcaauuuuc

SEQ ID NO: 1423126 - RNA, 19 nt, Homo sapiens
gagagauucuucugaaagu

SEQ ID NO: 1423127 - RNA, 19 nt, Homo sapiens
caggagagauucuucugaa

SEQ ID NO: 1423128 - RNA, 19 nt, Homo sapiens
acacaaacauauacacaga

SEQ ID NO: 1423129 - RNA, 19 nt, Homo sapiens
acacaaacauauacacaga

SEQ ID NO: 1423130 - RNA, 19 nt, Homo sapiens
ggaggaugaugacuuggaa

SEQ ID NO: 1423131 - RNA, 19 nt, Homo sapiens
acacacaaauauacgcaua

SEQ ID NO: 1423132 - RNA, 19 nt, Homo sapiens
ggacaggccaugaaauaug

SEQ ID NO: 1423133 - RNA, 19 nt, Homo sapiens
gaaaugacaguuugcuaau

SEQ ID NO: 1423134 - RNA, 19 nt, Homo sapiens
gacaggcucuagcuaagaa

SEQ ID NO: 1423135 - RNA, 19 nt, Homo sapiens
ggaagcauucugucucuuu

SEQ ID NO: 1423136 - RNA, 19 nt, Homo sapiens
aaaguugucuucaguuuag

SEQ ID NO: 1423137 - RNA, 19 nt, Homo sapiens
cacgaucccuaucuuuaua

SEQ ID NO: 1423138 - RNA, 19 nt, Homo sapiens
acacagcccucaugacuca

SEQ ID NO: 1423139 - RNA, 19 nt, Homo sapiens
ggaugcagcccacccuaua

SEQ ID NO: 1423140 - RNA, 19 nt, Homo sapiens
ugaccgaccugaagaggaa

SEQ ID NO: 1423141 - RNA, 19 nt, Homo sapiens
ugaaaugacaguuugcuaa

SEQ ID NO: 1423142 - RNA, 19 nt, Homo sapiens
gacaggccaugaaauaugu

SEQ ID NO: 1423143 - RNA, 19 nt, Homo sapiens
guacacacaaacaucuuua

SEQ ID NO: 1423144 - RNA, 19 nt, Homo sapiens
aaugacaguuugcuaauga

SEQ ID NO: 1423145 - RNA, 19 nt, Homo sapiens
caacagccaguuuaauuau

SEQ ID NO: 1423146 - RNA, 19 nt, Homo sapiens
ggccaucccuuaccacuuc

SEQ ID NO: 1423147 - RNA, 19 nt, Homo sapiens
agacacauguagacacaaa

SEQ ID NO: 1423148 - RNA, 19 nt, Homo sapiens
agaaguugccaaaguaaua

SEQ ID NO: 1423149 - RNA, 19 nt, Homo sapiens
cuagagaaguugccaaagu

SEQ ID NO: 1423150 - RNA, 19 nt, Homo sapiens
aaacccaccuggauaagga

SEQ ID NO: 1423151 - RNA, 19 nt, Homo sapiens
aaacagacgugaacaagcu

SEQ ID NO: 1423152 - RNA, 19 nt, Homo sapiens
gugguggacuucaagauga

SEQ ID NO: 1423153 - RNA, 19 nt, Homo sapiens
gaagaggaacugaugcaau

SEQ ID NO: 1423154 - RNA, 19 nt, Homo sapiens
gacaucauuucagaccuua

SEQ ID NO: 1423155 - RNA, 19 nt, Homo sapiens
uaaagaauccccuugauaa

SEQ ID NO: 1423156 - RNA, 19 nt, Homo sapiens
gauaaggacaggccaugaa

SEQ ID NO: 1423157 - RNA, 19 nt, Homo sapiens
cagcagugguucuauuuca

SEQ ID NO: 1423158 - RNA, 19 nt, Homo sapiens
caaacuguccggcagauga

SEQ ID NO: 1423159 - RNA, 19 nt, Homo sapiens
acaaacauauacacagaug

SEQ ID NO: 1423160 - RNA, 19 nt, Homo sapiens
ggacauauagacaaacaca

SEQ ID NO: 1423161 - RNA, 19 nt, Homo sapiens
aaacaaagucaaagccaaa

SEQ ID NO: 1423162 - RNA, 19 nt, Homo sapiens
gauggucacuuccucucuu

SEQ ID NO: 1423163 - RNA, 19 nt, Homo sapiens
aaggacaggccaugaaaua

SEQ ID NO: 1423164 - RNA, 19 nt, Homo sapiens
ggucaacgcagaugugaau

SEQ ID NO: 1423165 - RNA, 19 nt, Homo sapiens
gcagugguucuauuucaaa

SEQ ID NO: 1423166 - RNA, 19 nt, Homo sapiens
gccaggugauguuauaaau

SEQ ID NO: 1423167 - RNA, 19 nt, Homo sapiens
ugacaucauuucagaccuu

SEQ ID NO: 1423168 - RNA, 19 nt, Homo sapiens
gggcuucugugccuaagug

SEQ ID NO: 1423169 - RNA, 19 nt, Homo sapiens
acaaacacauagacacaug

SEQ ID NO: 1423170 - RNA, 19 nt, Homo sapiens
guagaagauuugacuaagg

SEQ ID NO: 1423171 - RNA, 19 nt, Homo sapiens
gagauucuucugaaaguga

SEQ ID NO: 1423172 - RNA, 19 nt, Homo sapiens
gucuugagcucuccuauag

SEQ ID NO: 1423173 - RNA, 19 nt, Homo sapiens
aauaugaggugaugugucu

SEQ ID NO: 1423174 - RNA, 19 nt, Homo sapiens
gcacacacacgcagacaca

SEQ ID NO: 1423175 - RNA, 19 nt, Homo sapiens
ucugggaagugcuacuaua

SEQ ID NO: 1423176 - RNA, 19 nt, Homo sapiens
gucaggaaaucuucgcaaa

SEQ ID NO: 1423177 - RNA, 19 nt, Homo sapiens
gaaagugaaaucccugaca

SEQ ID NO: 1423178 - RNA, 19 nt, Homo sapiens
ggagagauucuucugaaag

SEQ ID NO: 1423179 - RNA, 19 nt, Homo sapiens
guugaccuguuacgaacua

SEQ ID NO: 1423180 - RNA, 19 nt, Homo sapiens
cugaagggcugaagaugug

SEQ ID NO: 1423181 - RNA, 19 nt, Homo sapiens
ggcaaacccaccuggauaa

SEQ ID NO: 1423182 - RNA, 19 nt, Homo sapiens
ggaaacagacgugaacaag

SEQ ID NO: 1423183 - RNA, 19 nt, Homo sapiens
gucaagguuuggaaagaaa

SEQ ID NO: 1423184 - RNA, 19 nt, Homo sapiens
gaugaugacuuggaaacag

SEQ ID NO: 1423185 - RNA, 19 nt, Homo sapiens
ccaggugauguuauaaaua

SEQ ID NO: 1423186 - RNA, 19 nt, Homo sapiens
gagugaaccuguaccaaaa

SEQ ID NO: 1423187 - RNA, 19 nt, Homo sapiens
acagacacguacacacaaa

SEQ ID NO: 1423188 - RNA, 19 nt, Homo sapiens
gccuagacguguauacaug

SEQ ID NO: 1423189 - RNA, 19 nt, Homo sapiens
gauaaccugaauaccauuu

SEQ ID NO: 1423190 - RNA, 19 nt, Homo sapiens
ggaggaucuucuuggcaaa

SEQ ID NO: 1423191 - RNA, 19 nt, Homo sapiens
uagaugagccuuggccuuu

SEQ ID NO: 1423192 - RNA, 19 nt, Homo sapiens
uaaccugaauaccauuugu

SEQ ID NO: 1423193 - RNA, 19 nt, Homo sapiens
gaagcauucugucucuuuu

SEQ ID NO: 1423194 - RNA, 19 nt, Homo sapiens
gcugucaccuucccacaca

SEQ ID NO: 1423195 - RNA, 19 nt, Homo sapiens
cccaacagccaguuuaauu

SEQ ID NO: 1423196 - RNA, 19 nt, Homo sapiens
gaugcaauaugaggugaug

SEQ ID NO: 1423197 - RNA, 19 nt, Homo sapiens
aaagugaaaucccugacau

SEQ ID NO: 1423198 - RNA, 19 nt, Homo sapiens
ggacaggcucuagcuaaga

SEQ ID NO: 1423199 - RNA, 19 nt, Homo sapiens
ggaaagaaagaaaguugag

SEQ ID NO: 1423200 - RNA, 19 nt, Homo sapiens
ucaacaucaucaacuguga

SEQ ID NO: 1423201 - RNA, 19 nt, Homo sapiens
ccacgaucccuaucuuuau

SEQ ID NO: 1423202 - RNA, 19 nt, Homo sapiens
gcaauuuucugcccaagga

SEQ ID NO: 1423203 - RNA, 19 nt, Homo sapiens
acgcagacacacacaaaua

SEQ ID NO: 1423204 - RNA, 19 nt, Homo sapiens
ggucacuuccucucuuaaa

SEQ ID NO: 1423205 - RNA, 19 nt, Homo sapiens
aggaacugaugcaauauga

SEQ ID NO: 1423206 - RNA, 19 nt, Homo sapiens
cauuaauguugcuuuguug

SEQ ID NO: 1423207 - RNA, 19 nt, Homo sapiens
auaaaggguuggagacugu

SEQ ID NO: 1423208 - RNA, 19 nt, Homo sapiens
gugguucuauuucaaagug

SEQ ID NO: 1423209 - RNA, 19 nt, Homo sapiens
caagacaaugcuuccaauu

SEQ ID NO: 1423210 - RNA, 19 nt, Homo sapiens
gaaagcauguucucccaaa

SEQ ID NO: 1423211 - RNA, 19 nt, Homo sapiens
gagccaagaucuccuguga

SEQ ID NO: 1423212 - RNA, 19 nt, Homo sapiens
gaaauucaguucacagaag

SEQ ID NO: 1423213 - RNA, 19 nt, Homo sapiens
gccaaagaguuuauuauug

SEQ ID NO: 1423214 - RNA, 19 nt, Homo sapiens
gaaccaaccuauacuuguc

SEQ ID NO: 1423215 - RNA, 19 nt, Homo sapiens
gaaacagaaccaaccuaua

SEQ ID NO: 1423216 - RNA, 19 nt, Homo sapiens
uaagcaagcaucacaguaa

SEQ ID NO: 1423217 - RNA, 19 nt, Homo sapiens
aaaugagacugacuuagaa

SEQ ID NO: 1423218 - RNA, 19 nt, Homo sapiens
gcagccauccuuucucuuu

SEQ ID NO: 1423219 - RNA, 19 nt, Homo sapiens
gcaaagcuacaaauccaaa

SEQ ID NO: 1423220 - RNA, 19 nt, Homo sapiens
ucagugacauuacgcuuga

SEQ ID NO: 1423221 - RNA, 19 nt, Homo sapiens
gaauaagcaccguuugaga

SEQ ID NO: 1423222 - RNA, 19 nt, Homo sapiens
gaaaacagcagaugggaaa

SEQ ID NO: 1423223 - RNA, 19 nt, Homo sapiens
aaacagaaccaaccuauac

SEQ ID NO: 1423224 - RNA, 19 nt, Homo sapiens
gcaaaucaaggaguuuauu

SEQ ID NO: 1423225 - RNA, 19 nt, Homo sapiens
gaaaagaccccaauauucu

SEQ ID NO: 1423226 - RNA, 19 nt, Homo sapiens
gugcaaagcuacaaaucca

SEQ ID NO: 1423227 - RNA, 19 nt, Homo sapiens
ggaaaagaccccaauauuc

SEQ ID NO: 1423228 - RNA, 19 nt, Homo sapiens
guguguggcuuaugcauau

SEQ ID NO: 1423229 - RNA, 19 nt, Homo sapiens
gggaauaagcaccguuuga

SEQ ID NO: 1423230 - RNA, 19 nt, Homo sapiens
aagagaaggugcuggaugu

SEQ ID NO: 1423231 - RNA, 19 nt, Homo sapiens
agaccaagccuccuacuga

SEQ ID NO: 1423232 - RNA, 19 nt, Homo sapiens
gaaggugcaucuggugauc

SEQ ID NO: 1423233 - RNA, 19 nt, Homo sapiens
cagcaacguucgcuaccuu

SEQ ID NO: 1423234 - RNA, 19 nt, Homo sapiens
gaccaaaguuuucccaaga

SEQ ID NO: 1423235 - RNA, 19 nt, Homo sapiens
ccaaacacccuauggucaa

SEQ ID NO: 1423236 - RNA, 19 nt, Homo sapiens
gggcaaggccucugggaau

SEQ ID NO: 1423237 - RNA, 19 nt, Homo sapiens
aaauucaguucacagaaga

SEQ ID NO: 1423238 - RNA, 19 nt, Homo sapiens
ggaauaagcaccguuugag

SEQ ID NO: 1423239 - RNA, 19 nt, Homo sapiens
gaguuuauuuggugcaaca

SEQ ID NO: 1423240 - RNA, 19 nt, Homo sapiens
cuggugaucugcaagaaga

SEQ ID NO: 1423241 - RNA, 19 nt, Homo sapiens
gagcagaguuaucauuccu

SEQ ID NO: 1423242 - RNA, 19 nt, Homo sapiens
guucacagaagaaacagaa

SEQ ID NO: 1423243 - RNA, 19 nt, Homo sapiens
gcauauggcuugaaaacag

SEQ ID NO: 1423244 - RNA, 19 nt, Homo sapiens
uuuauugucuucucgaugu

SEQ ID NO: 1423245 - RNA, 19 nt, Homo sapiens
gcaagcaucacaguaaugg

SEQ ID NO: 1423246 - RNA, 19 nt, Homo sapiens
uuaugcauauggcuugaaa

SEQ ID NO: 1423247 - RNA, 19 nt, Homo sapiens
aagcaagcaucacaguaau

SEQ ID NO: 1423248 - RNA, 19 nt, Homo sapiens
cccaaaugcuggagaccaa

SEQ ID NO: 1423249 - RNA, 19 nt, Homo sapiens
ccaaaggccaagcaggaaa

SEQ ID NO: 1423250 - RNA, 19 nt, Homo sapiens
gcagaugggaaaggugaaa

SEQ ID NO: 1423251 - RNA, 19 nt, Homo sapiens
ugacauuacgcuugaacaa

SEQ ID NO: 1423252 - RNA, 19 nt, Homo sapiens
gauccugccugaaguacac

SEQ ID NO: 1423253 - RNA, 19 nt, Homo sapiens
cagaaccaaccuauacuug

SEQ ID NO: 1423254 - RNA, 19 nt, Homo sapiens
agaaacagaaccaaccuau

SEQ ID NO: 1423255 - RNA, 19 nt, Homo sapiens
gaaaacaggccccaaaugc

SEQ ID NO: 1423256 - RNA, 19 nt, Homo sapiens
ggagugcaaagcuacaaau

SEQ ID NO: 1423257 - RNA, 19 nt, Homo sapiens
gguguguggcuuaugcaua

SEQ ID NO: 1423258 - RNA, 19 nt, Homo sapiens
gaaggugcuggauguggaa

SEQ ID NO: 1423259 - RNA, 19 nt, Homo sapiens
cagucugucuuuacucuuc

SEQ ID NO: 1423260 - RNA, 19 nt, Homo sapiens
ggauggguguguggcuuau

SEQ ID NO: 1423261 - RNA, 19 nt, Homo sapiens
ggcaaggccucugggaauc

SEQ ID NO: 1423262 - RNA, 19 nt, Homo sapiens
acagugagcagaguuauca

SEQ ID NO: 1423263 - RNA, 19 nt, Homo sapiens
ccagggcccuccuaguucu

SEQ ID NO: 1423264 - RNA, 19 nt, Homo sapiens
gguaagaagaguaagaacu

SEQ ID NO: 1423265 - RNA, 19 nt, Homo sapiens
cuuuggauguucuggguaa

SEQ ID NO: 1423266 - RNA, 19 nt, Homo sapiens
gagacugacuuagaaaaug

SEQ ID NO: 1423267 - RNA, 19 nt, Homo sapiens
aaaaugagacugacuuaga

SEQ ID NO: 1423268 - RNA, 19 nt, Homo sapiens
aauaagcaccguuugagau

SEQ ID NO: 1423269 - RNA, 19 nt, Homo sapiens
gaagaaacagaaccaaccu

SEQ ID NO: 1423270 - RNA, 19 nt, Homo sapiens
cagccauccuuucucuuuc

SEQ ID NO: 1423271 - RNA, 19 nt, Homo sapiens
guagaaccccugggaauaa

SEQ ID NO: 1423272 - RNA, 19 nt, Homo sapiens
gcuuuacuuucaaaugcuu

SEQ ID NO: 1423273 - RNA, 19 nt, Homo sapiens
ucaguucacagaagaaaca

SEQ ID NO: 1423274 - RNA, 19 nt, Homo sapiens
gugagcagaguuaucauuc

SEQ ID NO: 1423275 - RNA, 19 nt, Homo sapiens
gcuacaaauccaaauucaa

SEQ ID NO: 1423276 - RNA, 19 nt, Homo sapiens
ggucccuccugucugagaa

SEQ ID NO: 1423277 - RNA, 19 nt, Homo sapiens
gcauuggucccuccugucu

SEQ ID NO: 1423278 - RNA, 19 nt, Homo sapiens
cugcaaaucaaggaguuua

SEQ ID NO: 1423279 - RNA, 19 nt, Homo sapiens
uuaagcaagcaucacagua

SEQ ID NO: 1423280 - RNA, 19 nt, Homo sapiens
gguagaaccccugggaaua

SEQ ID NO: 1423281 - RNA, 19 nt, Homo sapiens
ucugagcggucgcgguaga

SEQ ID NO: 1423282 - RNA, 19 nt, Homo sapiens
ggaaaacaggccccaaaug

SEQ ID NO: 1423283 - RNA, 19 nt, Homo sapiens
gcgacugcuuggugugugu

SEQ ID NO: 1423284 - RNA, 19 nt, Homo sapiens
ucuuucuucucucucauuu

SEQ ID NO: 1423285 - RNA, 19 nt, Homo sapiens
caaacacccuauggucaac

SEQ ID NO: 1423286 - RNA, 19 nt, Homo sapiens
gcaucacaguaauggaucu

SEQ ID NO: 1423287 - RNA, 19 nt, Homo sapiens
gucagucugucuuuacucu

SEQ ID NO: 1423288 - RNA, 19 nt, Homo sapiens
guugauccugccugaagua

SEQ ID NO: 1423289 - RNA, 19 nt, Homo sapiens
gcuuaugcauauggcuuga

SEQ ID NO: 1423290 - RNA, 19 nt, Homo sapiens
cauccuuucucuuucuucu

SEQ ID NO: 1423291 - RNA, 19 nt, Homo sapiens
agaguuaucauuccugucu

SEQ ID NO: 1423292 - RNA, 19 nt, Homo sapiens
gggagugcaaagcuacaaa

SEQ ID NO: 1423293 - RNA, 19 nt, Homo sapiens
auuggucccuccugucuga

SEQ ID NO: 1423294 - RNA, 19 nt, Homo sapiens
aaucaaggaguuuauuugg

SEQ ID NO: 1423295 - RNA, 19 nt, Homo sapiens
ggccgaggaagauaccaaa

SEQ ID NO: 1423296 - RNA, 19 nt, Homo sapiens
agaaccaaccuauacuugu

SEQ ID NO: 1423297 - RNA, 19 nt, Homo sapiens
aagcuacaaauccaaauuc

SEQ ID NO: 1423298 - RNA, 19 nt, Homo sapiens
acagaaccaaccuauacuu

SEQ ID NO: 1423299 - RNA, 19 nt, Homo sapiens
caaagcuacaaauccaaau

SEQ ID NO: 1423300 - RNA, 19 nt, Homo sapiens
aaacuuuaagcaagcauca

SEQ ID NO: 1423301 - RNA, 19 nt, Homo sapiens
aagcaucacaguaauggau

SEQ ID NO: 1423302 - RNA, 19 nt, Homo sapiens
aggcuuuacuuucaaaugc

SEQ ID NO: 1423303 - RNA, 19 nt, Homo sapiens
gaagauggcuugugggaaa

SEQ ID NO: 1423304 - RNA, 19 nt, Homo sapiens
gcaggaggaccaaugauua

SEQ ID NO: 1423305 - RNA, 19 nt, Homo sapiens
cauauuagaucuaccuuga

SEQ ID NO: 1423306 - RNA, 19 nt, Homo sapiens
gcaccaagaugacaagcaa

SEQ ID NO: 1423307 - RNA, 19 nt, Homo sapiens
gaaauaaagcccuacucua

SEQ ID NO: 1423308 - RNA, 19 nt, Homo sapiens
gcauugcugucaacauuaa

SEQ ID NO: 1423309 - RNA, 19 nt, Homo sapiens
cuacaucuguugggucuua

SEQ ID NO: 1423310 - RNA, 19 nt, Homo sapiens
uagagaaucuuuccacuuc

SEQ ID NO: 1423311 - RNA, 19 nt, Homo sapiens
aaaccacuuuccaguaaua

SEQ ID NO: 1423312 - RNA, 19 nt, Homo sapiens
gcaagaagaugacauucac

SEQ ID NO: 1423313 - RNA, 19 nt, Homo sapiens
gaaagagccagacuucuca

SEQ ID NO: 1423314 - RNA, 19 nt, Homo sapiens
cauuaagacugcagagauu

SEQ ID NO: 1423315 - RNA, 19 nt, Homo sapiens
gaagaugacauucacuuag

SEQ ID NO: 1423316 - RNA, 19 nt, Homo sapiens
ggacaccauuuccacaugu

SEQ ID NO: 1423317 - RNA, 19 nt, Homo sapiens
ggaaagagccagacuucuc

SEQ ID NO: 1423318 - RNA, 19 nt, Homo sapiens
uggcauugcugucaacauu

SEQ ID NO: 1423319 - RNA, 19 nt, Homo sapiens
ggaaguacaccuuguugga

SEQ ID NO: 1423320 - RNA, 19 nt, Homo sapiens
ggaaauaaagcccuacucu

SEQ ID NO: 1423321 - RNA, 19 nt, Homo sapiens
cauuaugugugacagaauu

SEQ ID NO: 1423322 - RNA, 19 nt, Homo sapiens
gaggaaagagccagacuuc

SEQ ID NO: 1423323 - RNA, 19 nt, Homo sapiens
uauuagaucuaccuugaug

SEQ ID NO: 1423324 - RNA, 19 nt, Homo sapiens
gacagaacaacuucguaua

SEQ ID NO: 1423325 - RNA, 19 nt, Homo sapiens
ugacggaaccgacaccaaa

SEQ ID NO: 1423326 - RNA, 19 nt, Homo sapiens
cucagugucuuucaaauga

SEQ ID NO: 1423327 - RNA, 19 nt, Homo sapiens
aaauaaagcccuacucuac

SEQ ID NO: 1423328 - RNA, 19 nt, Homo sapiens
gcagagauuuacagagcau

SEQ ID NO: 1423329 - RNA, 19 nt, Homo sapiens
auaaagcccuacucuacaa

SEQ ID NO: 1423330 - RNA, 19 nt, Homo sapiens
uuacagagcauccuuucaa

SEQ ID NO: 1423331 - RNA, 19 nt, Homo sapiens
ccaguaauauauggcauug

SEQ ID NO: 1423332 - RNA, 19 nt, Homo sapiens
ccacuuuccaguaauauau

SEQ ID NO: 1423333 - RNA, 19 nt, Homo sapiens
gcagagacagaacaacuuc

SEQ ID NO: 1423334 - RNA, 19 nt, Homo sapiens
agaagaugacauucacuua

SEQ ID NO: 1423335 - RNA, 19 nt, Homo sapiens
guggaaggcuggaaguaca

SEQ ID NO: 1423336 - RNA, 19 nt, Homo sapiens
gaacauauuagaucuaccu

SEQ ID NO: 1423337 - RNA, 19 nt, Homo sapiens
acaagcaaauacuagagaa

SEQ ID NO: 1423338 - RNA, 19 nt, Homo sapiens
cucaucaacuucuuaguga

SEQ ID NO: 1423339 - RNA, 19 nt, Homo sapiens
gaucaugaacuccauaaaa

SEQ ID NO: 1423340 - RNA, 19 nt, Homo sapiens
agaacaacuucguauagga

SEQ ID NO: 1423341 - RNA, 19 nt, Homo sapiens
uuaagacugcagagauuua

SEQ ID NO: 1423342 - RNA, 19 nt, Homo sapiens
aagaugacauucacuuagu

SEQ ID NO: 1423343 - RNA, 19 nt, Homo sapiens
ccaccugcuugacacauug

SEQ ID NO: 1423344 - RNA, 19 nt, Homo sapiens
gccacuacuugucacauug

SEQ ID NO: 1423345 - RNA, 19 nt, Homo sapiens
gcaaauacuagagaaucuu

SEQ ID NO: 1423346 - RNA, 19 nt, Homo sapiens
caagaugacaagcaaauac

SEQ ID NO: 1423347 - RNA, 19 nt, Homo sapiens
ccaagaugacaagcaaaua

SEQ ID NO: 1423348 - RNA, 19 nt, Homo sapiens
caaagagagcuugcaguga

SEQ ID NO: 1423349 - RNA, 19 nt, Homo sapiens
gacaagcaaauacuagaga

SEQ ID NO: 1423350 - RNA, 19 nt, Homo sapiens
cagaacaacuucguauagg

SEQ ID NO: 1423351 - RNA, 19 nt, Homo sapiens
agacagaacaacuucguau

SEQ ID NO: 1423352 - RNA, 19 nt, Homo sapiens
gaggaccaaugauuagcau

SEQ ID NO: 1423353 - RNA, 19 nt, Homo sapiens
cagagcauccuuucaagau

SEQ ID NO: 1423354 - RNA, 19 nt, Homo sapiens
uuaaaugaccgggaagaaa

SEQ ID NO: 1423355 - RNA, 19 nt, Homo sapiens
gaauuugacaggcaagaag

SEQ ID NO: 1423356 - RNA, 19 nt, Homo sapiens
gagacagaacaacuucgua

SEQ ID NO: 1423357 - RNA, 19 nt, Homo sapiens
cccagggccuucuguaugu

SEQ ID NO: 1423358 - RNA, 19 nt, Homo sapiens
gaugacaagcaaauacuag

SEQ ID NO: 1423359 - RNA, 19 nt, Homo sapiens
ggaggaaagagccagacuu

SEQ ID NO: 1423360 - RNA, 19 nt, Homo sapiens
gcagugaccuccccaaagg

SEQ ID NO: 1423361 - RNA, 19 nt, Homo sapiens
ggcauugcugucaacauua

SEQ ID NO: 1423362 - RNA, 19 nt, Homo sapiens
uaaaugaccgggaagaaaa

SEQ ID NO: 1423363 - RNA, 19 nt, Homo sapiens
ggcaagaagaugacauuca

SEQ ID NO: 1423364 - RNA, 19 nt, Homo sapiens
gccaccugcuugacacauu

SEQ ID NO: 1423365 - RNA, 19 nt, Homo sapiens
acagaacaacuucguauag

SEQ ID NO: 1423366 - RNA, 19 nt, Homo sapiens
uauauggcauugcugucaa

SEQ ID NO: 1423367 - RNA, 19 nt, Homo sapiens
caucaacuucuuagugaau

SEQ ID NO: 1423368 - RNA, 19 nt, Homo sapiens
gaugaugccacuacuuguc

SEQ ID NO: 1423369 - RNA, 19 nt, Homo sapiens
aaaacucacucaucaacuu

SEQ ID NO: 1423370 - RNA, 19 nt, Homo sapiens
gagguccccuugaucauga

SEQ ID NO: 1423371 - RNA, 19 nt, Homo sapiens
gauuuacagagcauccuuu

SEQ ID NO: 1423372 - RNA, 19 nt, Homo sapiens
caggcaagaagaugacauu

SEQ ID NO: 1423373 - RNA, 19 nt, Homo sapiens
caacuucuuagugaauuug

SEQ ID NO: 1423374 - RNA, 19 nt, Homo sapiens
uuagaucuaccuugauguu

SEQ ID NO: 1423375 - RNA, 19 nt, Homo sapiens
ggaggaccaaugauuagca

SEQ ID NO: 1423376 - RNA, 19 nt, Homo sapiens
ugccacuacuugucacauu

SEQ ID NO: 1423377 - RNA, 19 nt, Homo sapiens
gcaccuucuuggccugaca

SEQ ID NO: 1423378 - RNA, 19 nt, Homo sapiens
cuagagaaucuuuccacuu

SEQ ID NO: 1423379 - RNA, 19 nt, Homo sapiens
guacuccuggacaccauuu

SEQ ID NO: 1423380 - RNA, 19 nt, Homo sapiens
aguaauauauggcauugcu

SEQ ID NO: 1423381 - RNA, 19 nt, Homo sapiens
gcuggaaguacaccuuguu

SEQ ID NO: 1423382 - RNA, 19 nt, Homo sapiens
ccacccgccuuuggaggaa

SEQ ID NO: 1423383 - RNA, 19 nt, Homo sapiens
cugaugaugccacuacuug

SEQ ID NO: 1423384 - RNA, 19 nt, Homo sapiens
gacaccauuuccacaugug

SEQ ID NO: 1423385 - RNA, 19 nt, Homo sapiens
aagaagaugacauucacuu

SEQ ID NO: 1423386 - RNA, 19 nt, Homo sapiens
ucaucaacuucuuagugaa

SEQ ID NO: 1423387 - RNA, 19 nt, Homo sapiens
ccucagugucuuucaaaug

SEQ ID NO: 1423388 - RNA, 19 nt, Homo sapiens
aauaaagcccuacucuaca

SEQ ID NO: 1423389 - RNA, 19 nt, Homo sapiens
caagcaaauacuagagaau

SEQ ID NO: 1423390 - RNA, 19 nt, Homo sapiens
caggaggaccaaugauuag

SEQ ID NO: 1423391 - RNA, 19 nt, Homo sapiens
uaaagcccuacucuacaaa

SEQ ID NO: 1423392 - RNA, 19 nt, Homo sapiens
cauuuaugaugcagagaca

SEQ ID NO: 1423393 - RNA, 19 nt, Homo sapiens
uacagagcauccuuucaag

SEQ ID NO: 1423394 - RNA, 19 nt, Homo sapiens
ccuccucagugucuuucaa

SEQ ID NO: 1423395 - RNA, 19 nt, Homo sapiens
agaucuaccuugauguuuu

SEQ ID NO: 1423396 - RNA, 19 nt, Homo sapiens
acauuaagacugcagagau

SEQ ID NO: 1423397 - RNA, 19 nt, Homo sapiens
ccagggccuucuguauguu

SEQ ID NO: 1423398 - RNA, 19 nt, Homo sapiens
aagcaaauacuagagaauc

SEQ ID NO: 1423399 - RNA, 19 nt, Homo sapiens
agagcauccuuucaagauc

SEQ ID NO: 1423400 - RNA, 19 nt, Homo sapiens
acucaucaacuucuuagug

SEQ ID NO: 1423401 - RNA, 19 nt, Homo sapiens
gaagaaagccaauggauga

SEQ ID NO: 1423402 - RNA, 19 nt, Homo sapiens
gaauugcaaucauguaaga

SEQ ID NO: 1423403 - RNA, 19 nt, Homo sapiens
guucacuucuuacagauua

SEQ ID NO: 1423404 - RNA, 19 nt, Homo sapiens
cuaauacgcuacuucgaua

SEQ ID NO: 1423405 - RNA, 19 nt, Homo sapiens
ccuaaacacugacaacauu

SEQ ID NO: 1423406 - RNA, 19 nt, Homo sapiens
ugaauuccguuguauugua

SEQ ID NO: 1423407 - RNA, 19 nt, Homo sapiens
ccacuaauguuuguagaaa

SEQ ID NO: 1423408 - RNA, 19 nt, Homo sapiens
gguaagagcuguaguuagc

SEQ ID NO: 1423409 - RNA, 19 nt, Homo sapiens
aaaguucgaugguauauuc

SEQ ID NO: 1423410 - RNA, 19 nt, Homo sapiens
guacuaacauugaagaucu

SEQ ID NO: 1423411 - RNA, 19 nt, Homo sapiens
gcaaucauguaagacuaua

SEQ ID NO: 1423412 - RNA, 19 nt, Homo sapiens
gaaaacaacugacuaugau

SEQ ID NO: 1423413 - RNA, 19 nt, Homo sapiens
ucaaagauggcauuguuua

SEQ ID NO: 1423414 - RNA, 19 nt, Homo sapiens
gcagaaguauugcaagagu

SEQ ID NO: 1423415 - RNA, 19 nt, Homo sapiens
gaauuccguuguauuguau

SEQ ID NO: 1423416 - RNA, 19 nt, Homo sapiens
gccaauggaugaccaccua

SEQ ID NO: 1423417 - RNA, 19 nt, Homo sapiens
ucaaugcccuagaugauga

SEQ ID NO: 1423418 - RNA, 19 nt, Homo sapiens
guaagacuauauucggaaa

SEQ ID NO: 1423419 - RNA, 19 nt, Homo sapiens
gaugaauuccguuguauug

SEQ ID NO: 1423420 - RNA, 19 nt, Homo sapiens
ccacugagcccagccauuu

SEQ ID NO: 1423421 - RNA, 19 nt, Homo sapiens
ucaucuagcuuauuggauu

SEQ ID NO: 1423422 - RNA, 19 nt, Homo sapiens
uaaagaaugugaaguaagc

SEQ ID NO: 1423423 - RNA, 19 nt, Homo sapiens
ccgaaacucuuaccaaaca

SEQ ID NO: 1423424 - RNA, 19 nt, Homo sapiens
ccaaagcgcugggauuaca

SEQ ID NO: 1423425 - RNA, 19 nt, Homo sapiens
gaucucggcucacugcaau

SEQ ID NO: 1423426 - RNA, 19 nt, Homo sapiens
auauauggaugcagaagua

SEQ ID NO: 1423427 - RNA, 19 nt, Homo sapiens
gcagaauugucacguguag

SEQ ID NO: 1423428 - RNA, 19 nt, Homo sapiens
gggaggcccugcugguaaa

SEQ ID NO: 1423429 - RNA, 19 nt, Homo sapiens
uuucaaagauggcauuguu

SEQ ID NO: 1423430 - RNA, 19 nt, Homo sapiens
gagacaggcuuugggagaa

SEQ ID NO: 1423431 - RNA, 19 nt, Homo sapiens
uaagaaaggaggaacagaa

SEQ ID NO: 1423432 - RNA, 19 nt, Homo sapiens
ggacagacaguuucucauc

SEQ ID NO: 1423433 - RNA, 19 nt, Homo sapiens
caaagauggcauuguuuaa

SEQ ID NO: 1423434 - RNA, 19 nt, Homo sapiens
aaagcuaacucuugucauc

SEQ ID NO: 1423435 - RNA, 19 nt, Homo sapiens
ucaauucugugcugcuuug

SEQ ID NO: 1423436 - RNA, 19 nt, Homo sapiens
cagacaaccuaguagaaga

SEQ ID NO: 1423437 - RNA, 19 nt, Homo sapiens
guagaggagaaguaaauuu

SEQ ID NO: 1423438 - RNA, 19 nt, Homo sapiens
gauccgagcugaaguuuuc

SEQ ID NO: 1423439 - RNA, 19 nt, Homo sapiens
gauagacagcuccugauug

SEQ ID NO: 1423440 - RNA, 19 nt, Homo sapiens
caucuagcuuauuggauuu

SEQ ID NO: 1423441 - RNA, 19 nt, Homo sapiens
aaacaacugacuaugauga

SEQ ID NO: 1423442 - RNA, 19 nt, Homo sapiens
gaaauaccagaaagggauu

SEQ ID NO: 1423443 - RNA, 19 nt, Homo sapiens
gaaugugaaguaagcauga

SEQ ID NO: 1423444 - RNA, 19 nt, Homo sapiens
gcccauuucuugcguggaa

SEQ ID NO: 1423445 - RNA, 19 nt, Homo sapiens
uaguuuaccucaggaauug

SEQ ID NO: 1423446 - RNA, 19 nt, Homo sapiens
uaagagcuguaguuagcaa

SEQ ID NO: 1423447 - RNA, 19 nt, Homo sapiens
acaacugacuaugaugaua

SEQ ID NO: 1423448 - RNA, 19 nt, Homo sapiens
gaauaaaagcuaacucuug

SEQ ID NO: 1423449 - RNA, 19 nt, Homo sapiens
gaacagaaaaguacuaaca

SEQ ID NO: 1423450 - RNA, 19 nt, Homo sapiens
ucgagaguauuuagaauuc

SEQ ID NO: 1423451 - RNA, 19 nt, Homo sapiens
uagaggagaaguaaauuug

SEQ ID NO: 1423452 - RNA, 19 nt, Homo sapiens
gucaacagauaaugcuuug

SEQ ID NO: 1423453 - RNA, 19 nt, Homo sapiens
gaaguuaagcagaauuguc

SEQ ID NO: 1423454 - RNA, 19 nt, Homo sapiens
gcaaugcuagucaguguuc

SEQ ID NO: 1423455 - RNA, 19 nt, Homo sapiens
uacgcuacuucgauauuua

SEQ ID NO: 1423456 - RNA, 19 nt, Homo sapiens
ugggguaucuuuugucuua

SEQ ID NO: 1423457 - RNA, 19 nt, Homo sapiens
gcaaggauccgagcugaag

SEQ ID NO: 1423458 - RNA, 19 nt, Homo sapiens
cugacaacauuuagcuuaa

SEQ ID NO: 1423459 - RNA, 19 nt, Homo sapiens
agauggaaguuaagcagaa

SEQ ID NO: 1423460 - RNA, 19 nt, Homo sapiens
auagacagcuccugauugg

SEQ ID NO: 1423461 - RNA, 19 nt, Homo sapiens
cuccgaaacucuuaccaaa

SEQ ID NO: 1423462 - RNA, 19 nt, Homo sapiens
gcaugaagagacaggcuuu

SEQ ID NO: 1423463 - RNA, 19 nt, Homo sapiens
gagaaguaaauuugcugua

SEQ ID NO: 1423464 - RNA, 19 nt, Homo sapiens
gauggaaguuaagcagaau

SEQ ID NO: 1423465 - RNA, 19 nt, Homo sapiens
aagauggcauuguuuaauc

SEQ ID NO: 1423466 - RNA, 19 nt, Homo sapiens
gaggagaaguaaauuugcu

SEQ ID NO: 1423467 - RNA, 19 nt, Homo sapiens
aaagguagaggagaaguaa

SEQ ID NO: 1423468 - RNA, 19 nt, Homo sapiens
uccaugaacuaaaugcauu

SEQ ID NO: 1423469 - RNA, 19 nt, Homo sapiens
acagauuagccaagaauuu

SEQ ID NO: 1423470 - RNA, 19 nt, Homo sapiens
uccacaggcucauuucauu

SEQ ID NO: 1423471 - RNA, 19 nt, Homo sapiens
ucacagaugagccagaaga

SEQ ID NO: 1423472 - RNA, 19 nt, Homo sapiens
aaucacagaugagccagaa

SEQ ID NO: 1423473 - RNA, 19 nt, Homo sapiens
gagcccagccauuuaggaa

SEQ ID NO: 1423474 - RNA, 19 nt, Homo sapiens
ccaaguagcugggaaaaca

SEQ ID NO: 1423475 - RNA, 19 nt, Homo sapiens
aaaauuggcauccucuuua

SEQ ID NO: 1423476 - RNA, 19 nt, Homo sapiens
gugguaagagcuguaguua

SEQ ID NO: 1423477 - RNA, 19 nt, Homo sapiens
cuugucaucuagcuuauug

SEQ ID NO: 1423478 - RNA, 19 nt, Homo sapiens
gcagacaaccuaguagaag

SEQ ID NO: 1423479 - RNA, 19 nt, Homo sapiens
gcccagccauuuaggaagu

SEQ ID NO: 1423480 - RNA, 19 nt, Homo sapiens
ccaccacaccggaguaguu

SEQ ID NO: 1423481 - RNA, 19 nt, Homo sapiens
aaaugcaccacuaauguuu

SEQ ID NO: 1423482 - RNA, 19 nt, Homo sapiens
gguauuagggcauuuaaaa

SEQ ID NO: 1423483 - RNA, 19 nt, Homo sapiens
gcaaaaguucgaugguaua

SEQ ID NO: 1423484 - RNA, 19 nt, Homo sapiens
guaugugcuaucucuaaua

SEQ ID NO: 1423485 - RNA, 19 nt, Homo sapiens
agaaucuggucaaccugua

SEQ ID NO: 1423486 - RNA, 19 nt, Homo sapiens
gauuuuagcccauuucuug

SEQ ID NO: 1423487 - RNA, 19 nt, Homo sapiens
guucgaugguauauucaga

SEQ ID NO: 1423488 - RNA, 19 nt, Homo sapiens
uaugugcuaucucuaauac

SEQ ID NO: 1423489 - RNA, 19 nt, Homo sapiens
aagaaaggaggaacagaaa

SEQ ID NO: 1423490 - RNA, 19 nt, Homo sapiens
aaauuggcauccucuuuag

SEQ ID NO: 1423491 - RNA, 19 nt, Homo sapiens
acugacaacauuuagcuua

SEQ ID NO: 1423492 - RNA, 19 nt, Homo sapiens
auacgcuacuucgauauuu

SEQ ID NO: 1423493 - RNA, 19 nt, Homo sapiens
agacaggcuuugggagaaa

SEQ ID NO: 1423494 - RNA, 19 nt, Homo sapiens
uggcaaugcuagucagugu

SEQ ID NO: 1423495 - RNA, 19 nt, Homo sapiens
guugaaggcuguuuuaaag

SEQ ID NO: 1423496 - RNA, 19 nt, Homo sapiens
uggcuuacuggaagauuua

SEQ ID NO: 1423497 - RNA, 19 nt, Homo sapiens
uuccuuagacuuuggcuua

SEQ ID NO: 1423498 - RNA, 19 nt, Homo sapiens
cgaccaucauugucucaug

SEQ ID NO: 1423499 - RNA, 19 nt, Homo sapiens
cucaggcagucaacagaua

SEQ ID NO: 1423500 - RNA, 19 nt, Homo sapiens
uggaugaccaccuaagaaa

SEQ ID NO: 1423501 - RNA, 19 nt, Homo sapiens
gcacccauguugucacuua

SEQ ID NO: 1423502 - RNA, 19 nt, Homo sapiens
guaaugugaugacuguuua

SEQ ID NO: 1423503 - RNA, 19 nt, Homo sapiens
gagaaccacuuaagcauug

SEQ ID NO: 1423504 - RNA, 19 nt, Homo sapiens
gcaaugaccuguguguuga

SEQ ID NO: 1423505 - RNA, 19 nt, Homo sapiens
gaacucugccaaacaaaua

SEQ ID NO: 1423506 - RNA, 19 nt, Homo sapiens
gaauaagccugccauuucu

SEQ ID NO: 1423507 - RNA, 19 nt, Homo sapiens
ggacuguuagguugaauua

SEQ ID NO: 1423508 - RNA, 19 nt, Homo sapiens
ggagcugccuucaauguau

SEQ ID NO: 1423509 - RNA, 19 nt, Homo sapiens
cuaaagagaacaugaguuu

SEQ ID NO: 1423510 - RNA, 19 nt, Homo sapiens
gagcugccuucaauguaua

SEQ ID NO: 1423511 - RNA, 19 nt, Homo sapiens
ccaaacaaauaucaaagug

SEQ ID NO: 1423512 - RNA, 19 nt, Homo sapiens
gggcaggucuguacugugu

SEQ ID NO: 1423513 - RNA, 19 nt, Homo sapiens
uaacagaagccaaacaaga

SEQ ID NO: 1423514 - RNA, 19 nt, Homo sapiens
ggaaauggagcgaaggaaa

SEQ ID NO: 1423515 - RNA, 19 nt, Homo sapiens
gcaaccaugugcaaauuca

SEQ ID NO: 1423516 - RNA, 19 nt, Homo sapiens
ccaacugacuugaaggaaa

SEQ ID NO: 1423517 - RNA, 19 nt, Homo sapiens
caaacaagaggauaaauuc

SEQ ID NO: 1423518 - RNA, 19 nt, Homo sapiens
gcagccaacugaggaauug

SEQ ID NO: 1423519 - RNA, 19 nt, Homo sapiens
gcucagcccuuuccucaca

SEQ ID NO: 1423520 - RNA, 19 nt, Homo sapiens
agagggagcugccuucaau

SEQ ID NO: 1423521 - RNA, 19 nt, Homo sapiens
guauggagcucugcuugaa

SEQ ID NO: 1423522 - RNA, 19 nt, Homo sapiens
gaacacauuguacugagaa

SEQ ID NO: 1423523 - RNA, 19 nt, Homo sapiens
guagugcuguuuacauaga

SEQ ID NO: 1423524 - RNA, 19 nt, Homo sapiens
gaucucaguuucgcauauu

SEQ ID NO: 1423525 - RNA, 19 nt, Homo sapiens
ugaugacuguuuagguuua

SEQ ID NO: 1423526 - RNA, 19 nt, Homo sapiens
ccaaacaagaggauaaauu

SEQ ID NO: 1423527 - RNA, 19 nt, Homo sapiens
agaauaagccugccauuuc

SEQ ID NO: 1423528 - RNA, 19 nt, Homo sapiens
gcucuuggcuuggaaguuc

SEQ ID NO: 1423529 - RNA, 19 nt, Homo sapiens
gcaacuacagugaagauga

SEQ ID NO: 1423530 - RNA, 19 nt, Homo sapiens
gaucugaauuuggaccauu

SEQ ID NO: 1423531 - RNA, 19 nt, Homo sapiens
aaggaucucuaccgguuua

SEQ ID NO: 1423532 - RNA, 19 nt, Homo sapiens
gguaaugugaugacuguuu

SEQ ID NO: 1423533 - RNA, 19 nt, Homo sapiens
ugauuucccucacuucuug

SEQ ID NO: 1423534 - RNA, 19 nt, Homo sapiens
ccuauugcauuucauguug

SEQ ID NO: 1423535 - RNA, 19 nt, Homo sapiens
guagacuucuuugauaguu

SEQ ID NO: 1423536 - RNA, 19 nt, Homo sapiens
uuaauucccaggcgauuua

SEQ ID NO: 1423537 - RNA, 19 nt, Homo sapiens
caacuacagugaagaugag

SEQ ID NO: 1423538 - RNA, 19 nt, Homo sapiens
ccugaacucugccaaacaa

SEQ ID NO: 1423539 - RNA, 19 nt, Homo sapiens
gcaccugucagucaaguga

SEQ ID NO: 1423540 - RNA, 19 nt, Homo sapiens
gauuugaauagcaguguua

SEQ ID NO: 1423541 - RNA, 19 nt, Homo sapiens
gcaaagauuggaagaacug

SEQ ID NO: 1423542 - RNA, 19 nt, Homo sapiens
gggccuaccugguuucagu

SEQ ID NO: 1423543 - RNA, 19 nt, Homo sapiens
ugugaugacuguuuagguu

SEQ ID NO: 1423544 - RNA, 19 nt, Homo sapiens
caacugacuugaaggaaaa

SEQ ID NO: 1423545 - RNA, 19 nt, Homo sapiens
ucagaaaacuguacuggaa

SEQ ID NO: 1423546 - RNA, 19 nt, Homo sapiens
aaaaguauguccucagaaa

SEQ ID NO: 1423547 - RNA, 19 nt, Homo sapiens
gcaggucuguacugugugu

SEQ ID NO: 1423548 - RNA, 19 nt, Homo sapiens
gccagggaaugccauaaug

SEQ ID NO: 1423549 - RNA, 19 nt, Homo sapiens
ucuuugaccuauugcauuu

SEQ ID NO: 1423550 - RNA, 19 nt, Homo sapiens
gccaagagcauuuguaguc

SEQ ID NO: 1423551 - RNA, 19 nt, Homo sapiens
uuuaggcacuuucuucauu

SEQ ID NO: 1423552 - RNA, 19 nt, Homo sapiens
uaaacuuccuaacagagaa

SEQ ID NO: 1423553 - RNA, 19 nt, Homo sapiens
gcucuaaaaugcuguauca

SEQ ID NO: 1423554 - RNA, 19 nt, Homo sapiens
cugaggaauuggaccauuu

SEQ ID NO: 1423555 - RNA, 19 nt, Homo sapiens
ggaccaauggcuaaacuuc

SEQ ID NO: 1423556 - RNA, 19 nt, Homo sapiens
caagccagguggagauauc

SEQ ID NO: 1423557 - RNA, 19 nt, Homo sapiens
guacugagaaccacuuaag

SEQ ID NO: 1423558 - RNA, 19 nt, Homo sapiens
uaagaacacauuguacuga

SEQ ID NO: 1423559 - RNA, 19 nt, Homo sapiens
uagaauaagccugccauuu

SEQ ID NO: 1423560 - RNA, 19 nt, Homo sapiens
uuaggcacuuucuucauuu

SEQ ID NO: 1423561 - RNA, 19 nt, Homo sapiens
ccccaggaguuauuuauua

SEQ ID NO: 1423562 - RNA, 19 nt, Homo sapiens
uaccgaagauccggauauu

SEQ ID NO: 1423563 - RNA, 19 nt, Homo sapiens
gaagggagaggugcacuca

SEQ ID NO: 1423564 - RNA, 19 nt, Homo sapiens
ggagggaguccaaguccaa

SEQ ID NO: 1423565 - RNA, 19 nt, Homo sapiens
acaagaggauaaauucaag

SEQ ID NO: 1423566 - RNA, 19 nt, Homo sapiens
gggaugggacuguuagguu

SEQ ID NO: 1423567 - RNA, 19 nt, Homo sapiens
ugaaagggcucuaaaaugc

SEQ ID NO: 1423568 - RNA, 19 nt, Homo sapiens
gaaauggagcgaaggaaaa

SEQ ID NO: 1423569 - RNA, 19 nt, Homo sapiens
gcgggaagaugcaauuuug

SEQ ID NO: 1423570 - RNA, 19 nt, Homo sapiens
gggagcugccuucaaugua

SEQ ID NO: 1423571 - RNA, 19 nt, Homo sapiens
cccaggaguuauuuauuau

SEQ ID NO: 1423572 - RNA, 19 nt, Homo sapiens
gaauaucaucagcuuacuu

SEQ ID NO: 1423573 - RNA, 19 nt, Homo sapiens
acgguucccuagccucuua

SEQ ID NO: 1423574 - RNA, 19 nt, Homo sapiens
guggagauauccucgucaa

SEQ ID NO: 1423575 - RNA, 19 nt, Homo sapiens
guucagcuuccaacacuuu

SEQ ID NO: 1423576 - RNA, 19 nt, Homo sapiens
cuaccugguuucaguuaga

SEQ ID NO: 1423577 - RNA, 19 nt, Homo sapiens
gaauuuggaccauuucacu

SEQ ID NO: 1423578 - RNA, 19 nt, Homo sapiens
cugauggcauguugaggua

SEQ ID NO: 1423579 - RNA, 19 nt, Homo sapiens
gauggcauguugagguaca

SEQ ID NO: 1423580 - RNA, 19 nt, Homo sapiens
ggcuaaacuuccuaacaga

SEQ ID NO: 1423581 - RNA, 19 nt, Homo sapiens
uggcuaaacuuccuaacag

SEQ ID NO: 1423582 - RNA, 19 nt, Homo sapiens
gaccauuucacuaaagaga

SEQ ID NO: 1423583 - RNA, 19 nt, Homo sapiens
gccagugugucaccaagug

SEQ ID NO: 1423584 - RNA, 19 nt, Homo sapiens
cuaaaaugcuguaucaugu

SEQ ID NO: 1423585 - RNA, 19 nt, Homo sapiens
agaacaauccuccgguauu

SEQ ID NO: 1423586 - RNA, 19 nt, Homo sapiens
ugagaaccacuuaagcauu

SEQ ID NO: 1423587 - RNA, 19 nt, Homo sapiens
cgguuuacauuucaguuug

SEQ ID NO: 1423588 - RNA, 19 nt, Homo sapiens
ccucacuucuugcucauuc

SEQ ID NO: 1423589 - RNA, 19 nt, Homo sapiens
ggaucucccagaauauuug

SEQ ID NO: 1423590 - RNA, 19 nt, Homo sapiens
ccggauauuuucuacuuua

SEQ ID NO: 1423591 - RNA, 19 nt, Homo sapiens
ccucuuaacagaagccaaa

SEQ ID NO: 1423592 - RNA, 19 nt, Homo sapiens
agacagcauugacggaauc

SEQ ID NO: 1423593 - RNA, 19 nt, Homo sapiens
gcaaauucaccaggaagga

SEQ ID NO: 1423594 - RNA, 19 nt, Homo sapiens
auggagcucugcuugaauu

SEQ ID NO: 1423595 - RNA, 19 nt, Homo sapiens
ccgaggagcagacuuagug

SEQ ID NO: 1423596 - RNA, 19 nt, Homo sapiens
uccacgcgcuggcuccaua

SEQ ID NO: 1423597 - RNA, 19 nt, Homo sapiens
aaagagaacaugaguuugc

SEQ ID NO: 1423598 - RNA, 19 nt, Homo sapiens
ccaagagcauuuguagucu

SEQ ID NO: 1423599 - RNA, 19 nt, Homo sapiens
ccgaagauccggauauuuu

SEQ ID NO: 1423600 - RNA, 19 nt, Homo sapiens
ucccuagccucuuaacaga

SEQ ID NO: 1423601 - RNA, 19 nt, Homo sapiens
ggaaagcgauucucucauu

SEQ ID NO: 1423602 - RNA, 19 nt, Homo sapiens
caacacauacuacaucgua

SEQ ID NO: 1423603 - RNA, 19 nt, Homo sapiens
gaaagacaguggcacaagu

SEQ ID NO: 1423604 - RNA, 19 nt, Homo sapiens
gcacugugaugaggaguaa

SEQ ID NO: 1423605 - RNA, 19 nt, Homo sapiens
agaacucccuuaucacuaa

SEQ ID NO: 1423606 - RNA, 19 nt, Homo sapiens
gaaagcgauucucucauuc

SEQ ID NO: 1423607 - RNA, 19 nt, Homo sapiens
ggccaggucuuccuccuau

SEQ ID NO: 1423608 - RNA, 19 nt, Homo sapiens
ggccugcacugggauguuu

SEQ ID NO: 1423609 - RNA, 19 nt, Homo sapiens
gacaguggcacaaguuuca

SEQ ID NO: 1423610 - RNA, 19 nt, Homo sapiens
cauccaaauggcucaauaa

SEQ ID NO: 1423611 - RNA, 19 nt, Homo sapiens
ggaaagacaguggcacaag

SEQ ID NO: 1423612 - RNA, 19 nt, Homo sapiens
guggaaagcgauucucuca

SEQ ID NO: 1423613 - RNA, 19 nt, Homo sapiens
aaagacaguggcacaaguu

SEQ ID NO: 1423614 - RNA, 19 nt, Homo sapiens
acggagaccuggaggagau

SEQ ID NO: 1423615 - RNA, 19 nt, Homo sapiens
gaacucccuuaucacuaac

SEQ ID NO: 1423616 - RNA, 19 nt, Homo sapiens
gccaggucuuccuccuaua

SEQ ID NO: 1423617 - RNA, 19 nt, Homo sapiens
ggguccgagucaacacaua

SEQ ID NO: 1423618 - RNA, 19 nt, Homo sapiens
uacaagugguaccugaaga

SEQ ID NO: 1423619 - RNA, 19 nt, Homo sapiens
ucuccuagcccuucucugu

SEQ ID NO: 1423620 - RNA, 19 nt, Homo sapiens
acaagugguaccugaagaa

SEQ ID NO: 1423621 - RNA, 19 nt, Homo sapiens
guugacagucgcucuccua

SEQ ID NO: 1423622 - RNA, 19 nt, Homo sapiens
uggaaguggugguggaaag

SEQ ID NO: 1423623 - RNA, 19 nt, Homo sapiens
aagaacucccuuaucacua

SEQ ID NO: 1423624 - RNA, 19 nt, Homo sapiens
gggaaagacaguggcacaa

SEQ ID NO: 1423625 - RNA, 19 nt, Homo sapiens
aagcgauucucucauucug

SEQ ID NO: 1423626 - RNA, 19 nt, Homo sapiens
ccaggucuuccuccuauag

SEQ ID NO: 1423627 - RNA, 19 nt, Homo sapiens
gaaccagggugaagaagaa

SEQ ID NO: 1423628 - RNA, 19 nt, Homo sapiens
gaacaaagacagaaaccau

SEQ ID NO: 1423629 - RNA, 19 nt, Homo sapiens
cuaagacuguuucaaagaa

SEQ ID NO: 1423630 - RNA, 19 nt, Homo sapiens
guacaacaguggcaucaca

SEQ ID NO: 1423631 - RNA, 19 nt, Homo sapiens
ucacggccaucgccaagua

SEQ ID NO: 1423632 - RNA, 19 nt, Homo sapiens
aaauacacgugaaaucuga

SEQ ID NO: 1423633 - RNA, 19 nt, Homo sapiens
gugaaucucuuacccugaa

SEQ ID NO: 1423634 - RNA, 19 nt, Homo sapiens
gagcauuuguagccuuauu

SEQ ID NO: 1423635 - RNA, 19 nt, Homo sapiens
gcucggcacccauaacuaa

SEQ ID NO: 1423636 - RNA, 19 nt, Homo sapiens
caaugacccuuccaagaau

SEQ ID NO: 1423637 - RNA, 19 nt, Homo sapiens
agacagcccuucuggauag

SEQ ID NO: 1423638 - RNA, 19 nt, Homo sapiens
guaucaggcuucaguacaa

SEQ ID NO: 1423639 - RNA, 19 nt, Homo sapiens
acaaugacccuuccaagaa

SEQ ID NO: 1423640 - RNA, 19 nt, Homo sapiens
ggccuggacuucugaguug

SEQ ID NO: 1423641 - RNA, 19 nt, Homo sapiens
guguucaccuaacgauuua

SEQ ID NO: 1423642 - RNA, 19 nt, Homo sapiens
caacugauuucuaccugau

SEQ ID NO: 1423643 - RNA, 19 nt, Homo sapiens
gaagacagaggguacaaca

SEQ ID NO: 1423644 - RNA, 19 nt, Homo sapiens
gagcaccaguucccucuuc

SEQ ID NO: 1423645 - RNA, 19 nt, Homo sapiens
uuaacgacguggccaaauu

SEQ ID NO: 1423646 - RNA, 19 nt, Homo sapiens
gacaaugacccuuccaaga

SEQ ID NO: 1423647 - RNA, 19 nt, Homo sapiens
ccaugcagcugaaugacaa

SEQ ID NO: 1423648 - RNA, 19 nt, Homo sapiens
guguuuggcuucuuugcua

SEQ ID NO: 1423649 - RNA, 19 nt, Homo sapiens
cuuauucucuugcguguga

SEQ ID NO: 1423650 - RNA, 19 nt, Homo sapiens
gaugagaccagccuucugu

SEQ ID NO: 1423651 - RNA, 19 nt, Homo sapiens
gcccucaucuacuuugcua

SEQ ID NO: 1423652 - RNA, 19 nt, Homo sapiens
caagacagaagaagagaau

SEQ ID NO: 1423653 - RNA, 19 nt, Homo sapiens
ccaguucccucuucauucu

SEQ ID NO: 1423654 - RNA, 19 nt, Homo sapiens
gaccacagcccacaagaca

SEQ ID NO: 1423655 - RNA, 19 nt, Homo sapiens
cgugaaaucugacuaccau

SEQ ID NO: 1423656 - RNA, 19 nt, Homo sapiens
ucaaagaagagcucauaga

SEQ ID NO: 1423657 - RNA, 19 nt, Homo sapiens
ucacuaacaggaacaaaga

SEQ ID NO: 1423658 - RNA, 19 nt, Homo sapiens
uggagcauuuguagccuua

SEQ ID NO: 1423659 - RNA, 19 nt, Homo sapiens
uaacaggaacaaagacaga

SEQ ID NO: 1423660 - RNA, 19 nt, Homo sapiens
gagaccagccuucuguguu

SEQ ID NO: 1423661 - RNA, 19 nt, Homo sapiens
caaagaagagcucauagac

SEQ ID NO: 1423662 - RNA, 19 nt, Homo sapiens
ccacagcccacaagacaga

SEQ ID NO: 1423663 - RNA, 19 nt, Homo sapiens
agaccagccuucuguguuc

SEQ ID NO: 1423664 - RNA, 19 nt, Homo sapiens
cgagucgggucucucauuc

SEQ ID NO: 1423665 - RNA, 19 nt, Homo sapiens
caaacccuccuucuuccua

SEQ ID NO: 1423666 - RNA, 19 nt, Homo sapiens
gauuucuaccugaucuuua

SEQ ID NO: 1423667 - RNA, 19 nt, Homo sapiens
aagccagacugaccacuug

SEQ ID NO: 1423668 - RNA, 19 nt, Homo sapiens
agggagaaauugaccuuug

SEQ ID NO: 1423669 - RNA, 19 nt, Homo sapiens
gcacgggcaggaaguuaga

SEQ ID NO: 1423670 - RNA, 19 nt, Homo sapiens
acaaagacagaaaccauga

SEQ ID NO: 1423671 - RNA, 19 nt, Homo sapiens
gaccggagacagcgaguau

SEQ ID NO: 1423672 - RNA, 19 nt, Homo sapiens
cgacucggacucugacuga

SEQ ID NO: 1423673 - RNA, 19 nt, Homo sapiens
uaucaggcuucaguacaaa

SEQ ID NO: 1423674 - RNA, 19 nt, Homo sapiens
guucaccuaacgauuuaua

SEQ ID NO: 1423675 - RNA, 19 nt, Homo sapiens
gggagaaauugaccuuugc

SEQ ID NO: 1423676 - RNA, 19 nt, Homo sapiens
gcagggagaaauugaccuu

SEQ ID NO: 1423677 - RNA, 19 nt, Homo sapiens
ccacaagacagaagaagag

SEQ ID NO: 1423678 - RNA, 19 nt, Homo sapiens
caaagccgcugggguguuu

SEQ ID NO: 1423679 - RNA, 19 nt, Homo sapiens
ggccuuguacuuccucuuu

SEQ ID NO: 1423680 - RNA, 19 nt, Homo sapiens
guaucugucuuugauggaa

SEQ ID NO: 1423681 - RNA, 19 nt, Homo sapiens
aaauugaccuuugccuugu

SEQ ID NO: 1423682 - RNA, 19 nt, Homo sapiens
ggccaaauuccucaaacaa

SEQ ID NO: 1423683 - RNA, 19 nt, Homo sapiens
uaacgacguggccaaauuc

SEQ ID NO: 1423684 - RNA, 19 nt, Homo sapiens
agacagaagaagagaauuc

SEQ ID NO: 1423685 - RNA, 19 nt, Homo sapiens
gguauuguaucaggcuuca

SEQ ID NO: 1423686 - RNA, 19 nt, Homo sapiens
uguguucaccuaacgauuu

SEQ ID NO: 1423687 - RNA, 19 nt, Homo sapiens
uaagacuguuucaaagaag

SEQ ID NO: 1423688 - RNA, 19 nt, Homo sapiens
ggagacagcgaguauagac

SEQ ID NO: 1423689 - RNA, 19 nt, Homo sapiens
aaccagagcaauacuguug

SEQ ID NO: 1423690 - RNA, 19 nt, Homo sapiens
agacagaggguacaacagu

SEQ ID NO: 1423691 - RNA, 19 nt, Homo sapiens
ucgggucucucauucauca

SEQ ID NO: 1423692 - RNA, 19 nt, Homo sapiens
uagacagcccuucuggaua

SEQ ID NO: 1423693 - RNA, 19 nt, Homo sapiens
gcgcacgggcaggaaguua

SEQ ID NO: 1423694 - RNA, 19 nt, Homo sapiens
cuaacgauuuauacugugu

SEQ ID NO: 1423695 - RNA, 19 nt, Homo sapiens
gcuuuccucugcucucuca

SEQ ID NO: 1423696 - RNA, 19 nt, Homo sapiens
ggucuucuguuucacuaac

SEQ ID NO: 1423697 - RNA, 19 nt, Homo sapiens
ggcuugugcuggcccauga

SEQ ID NO: 1423698 - RNA, 19 nt, Homo sapiens
uuucaaagaagagcucaua

SEQ ID NO: 1423699 - RNA, 19 nt, Homo sapiens
ugaagcagggagaaauuga

SEQ ID NO: 1423700 - RNA, 19 nt, Homo sapiens
guuugcaacugauuucuac

SEQ ID NO: 1423701 - RNA, 19 nt, Homo sapiens
acccauguuuggagcauuu

SEQ ID NO: 1423702 - RNA, 19 nt, Homo sapiens
caccaguucccucuucauu

SEQ ID NO: 1423703 - RNA, 19 nt, Homo sapiens
ccucagcucagcacuguug

SEQ ID NO: 1423704 - RNA, 19 nt, Homo sapiens
uguggauccugacagcuuu

SEQ ID NO: 1423705 - RNA, 19 nt, Homo sapiens
ucuaagacuguuucaaaga

SEQ ID NO: 1423706 - RNA, 19 nt, Homo sapiens
guucaaggagcaccaguuc

SEQ ID NO: 1423707 - RNA, 19 nt, Homo sapiens
ccacuuuggugacaaugac

SEQ ID NO: 1423708 - RNA, 19 nt, Homo sapiens
acuguuggguauuguauca

SEQ ID NO: 1423709 - RNA, 19 nt, Homo sapiens
ggacccauguuuggagcau

SEQ ID NO: 1423710 - RNA, 19 nt, Homo sapiens
cagccaaacccuccuucuu

SEQ ID NO: 1423711 - RNA, 19 nt, Homo sapiens
ggucucucauucaucacuu

SEQ ID NO: 1423712 - RNA, 19 nt, Homo sapiens
cgaaccagggugaagaaga

SEQ ID NO: 1423713 - RNA, 19 nt, Homo sapiens
cuucuuaacagauggcauu

SEQ ID NO: 1423714 - RNA, 19 nt, Homo sapiens
ccucagggcaggucuaugg

SEQ ID NO: 1423715 - RNA, 19 nt, Homo sapiens
ggguuugucugcacuuggu

SEQ ID NO: 1423716 - RNA, 19 nt, Homo sapiens
cuguguaucugucuuugau

SEQ ID NO: 1423717 - RNA, 19 nt, Homo sapiens
gaccagccuucuguguuca

SEQ ID NO: 1423718 - RNA, 19 nt, Homo sapiens
gagaugagaccagccuucu

SEQ ID NO: 1423719 - RNA, 19 nt, Homo sapiens
gcccacaccagccacuuug

SEQ ID NO: 1423720 - RNA, 19 nt, Homo sapiens
gagggcaucuuggguaucc

SEQ ID NO: 1423721 - RNA, 19 nt, Homo sapiens
gccuuguacuuccucuuug

SEQ ID NO: 1423722 - RNA, 19 nt, Homo sapiens
aagacuguuucaaagaaga

SEQ ID NO: 1423723 - RNA, 19 nt, Homo sapiens
gccaaauuccucaaacaag

SEQ ID NO: 1423724 - RNA, 19 nt, Homo sapiens
ccaucguguuugcaacuga

SEQ ID NO: 1423725 - RNA, 19 nt, Homo sapiens
cauguuuggagcauuugua

SEQ ID NO: 1423726 - RNA, 19 nt, Homo sapiens
cagccacuuuggugacaau

SEQ ID NO: 1423727 - RNA, 19 nt, Homo sapiens
gaaacaagcucccgagaag

SEQ ID NO: 1423728 - RNA, 19 nt, Homo sapiens
ugucuuagaucccauguua

SEQ ID NO: 1423729 - RNA, 19 nt, Homo sapiens
gaaauaagaagaaggaaga

SEQ ID NO: 1423730 - RNA, 19 nt, Homo sapiens
cagcauggcccucuaaaua

SEQ ID NO: 1423731 - RNA, 19 nt, Homo sapiens
gaaaguaagcaaucagaaa

SEQ ID NO: 1423732 - RNA, 19 nt, Homo sapiens
uaaagagccucauggagaa

SEQ ID NO: 1423733 - RNA, 19 nt, Homo sapiens
uagcaagacuccacaaugu

SEQ ID NO: 1423734 - RNA, 19 nt, Homo sapiens
ugacaguccuuaaacgaaa

SEQ ID NO: 1423735 - RNA, 19 nt, Homo sapiens
ggaaauacauguggaagac

SEQ ID NO: 1423736 - RNA, 19 nt, Homo sapiens
gaaagagauucaggaagga

SEQ ID NO: 1423737 - RNA, 19 nt, Homo sapiens
gaagacugcugaagauagg

SEQ ID NO: 1423738 - RNA, 19 nt, Homo sapiens
gaagaaggaagagaagaaa

SEQ ID NO: 1423739 - RNA, 19 nt, Homo sapiens
caaauggaccugaaggauu

SEQ ID NO: 1423740 - RNA, 19 nt, Homo sapiens
caacuuagugcaucccuuu

SEQ ID NO: 1423741 - RNA, 19 nt, Homo sapiens
ggaaacaccucagcauggu

SEQ ID NO: 1423742 - RNA, 19 nt, Homo sapiens
gaagaggacauagaugcua

SEQ ID NO: 1423743 - RNA, 19 nt, Homo sapiens
cagcaggccuuaggaaaga

SEQ ID NO: 1423744 - RNA, 19 nt, Homo sapiens
gcaccgaaccuaagaugga

SEQ ID NO: 1423745 - RNA, 19 nt, Homo sapiens
gggcaaccuucauaagaga

SEQ ID NO: 1423746 - RNA, 19 nt, Homo sapiens
gagggcaaccuucauaaga

SEQ ID NO: 1423747 - RNA, 19 nt, Homo sapiens
ccagagggcaaccuucaua

SEQ ID NO: 1423748 - RNA, 19 nt, Homo sapiens
gcaagacuccacaauguca

SEQ ID NO: 1423749 - RNA, 19 nt, Homo sapiens
ccacaaagaggaaauacau

SEQ ID NO: 1423750 - RNA, 19 nt, Homo sapiens
ggaagacugcugaagauag

SEQ ID NO: 1423751 - RNA, 19 nt, Homo sapiens
guggaagacugcugaagau

SEQ ID NO: 1423752 - RNA, 19 nt, Homo sapiens
ccaacaagaugccugacau

SEQ ID NO: 1423753 - RNA, 19 nt, Homo sapiens
aagaggacauagaugcuaa

SEQ ID NO: 1423754 - RNA, 19 nt, Homo sapiens
gauuuaaugcccacaaaga

SEQ ID NO: 1423755 - RNA, 19 nt, Homo sapiens
ugucugaccucaccugugu

SEQ ID NO: 1423756 - RNA, 19 nt, Homo sapiens
gaaaccaugaggauguuga

SEQ ID NO: 1423757 - RNA, 19 nt, Homo sapiens
gcagggacacggagacuuc

SEQ ID NO: 1423758 - RNA, 19 nt, Homo sapiens
ggaccugaaggauuuaaug

SEQ ID NO: 1423759 - RNA, 19 nt, Homo sapiens
ggucgaagaggacauagau

SEQ ID NO: 1423760 - RNA, 19 nt, Homo sapiens
uuacaggaggguaccuuua

SEQ ID NO: 1423761 - RNA, 19 nt, Homo sapiens
gcaaggaugcaggaaugaa

SEQ ID NO: 1423762 - RNA, 19 nt, Homo sapiens
auaagagacugguccaaca

SEQ ID NO: 1423763 - RNA, 19 nt, Homo sapiens
ggaagagaagaaaggcaaa

SEQ ID NO: 1423764 - RNA, 19 nt, Homo sapiens
acaaagaggaaauacaugu

SEQ ID NO: 1423765 - RNA, 19 nt, Homo sapiens
gcauggcccucuaaauagc

SEQ ID NO: 1423766 - RNA, 19 nt, Homo sapiens
uacaggaggguaccuuuaa

SEQ ID NO: 1423767 - RNA, 19 nt, Homo sapiens
agaagaaggaagagaagaa

SEQ ID NO: 1423768 - RNA, 19 nt, Homo sapiens
caacaagaugccugacaug

SEQ ID NO: 1423769 - RNA, 19 nt, Homo sapiens
gcaggaaugaauguggaua

SEQ ID NO: 1423770 - RNA, 19 nt, Homo sapiens
caaggaugcaggaaugaau

SEQ ID NO: 1423771 - RNA, 19 nt, Homo sapiens
caccgaaccuaagauggaa

SEQ ID NO: 1423772 - RNA, 19 nt, Homo sapiens
uaagagacugguccaacaa

SEQ ID NO: 1423773 - RNA, 19 nt, Homo sapiens
gacaguccuuaaacgaaau

SEQ ID NO: 1423774 - RNA, 19 nt, Homo sapiens
caaagaggaaauacaugug

SEQ ID NO: 1423775 - RNA, 19 nt, Homo sapiens
aagauaggcgcaugucuga

SEQ ID NO: 1423776 - RNA, 19 nt, Homo sapiens
auaagaagaaggaagagaa

SEQ ID NO: 1423777 - RNA, 19 nt, Homo sapiens
agaaacaagcucccgagaa

SEQ ID NO: 1423778 - RNA, 19 nt, Homo sapiens
gaaaagcaccgaaccuaag

SEQ ID NO: 1423779 - RNA, 19 nt, Homo sapiens
cagagggcaaccuucauaa

SEQ ID NO: 1423780 - RNA, 19 nt, Homo sapiens
gagaaaagcaccgaaccua

SEQ ID NO: 1423781 - RNA, 19 nt, Homo sapiens
agagacugguccaacaaga

SEQ ID NO: 1423782 - RNA, 19 nt, Homo sapiens
cuuagugcaucccuuuaga

SEQ ID NO: 1423783 - RNA, 19 nt, Homo sapiens
gugcugagcugccgauacc

SEQ ID NO: 1423784 - RNA, 19 nt, Homo sapiens
gaagagaagaaaggcaaag

SEQ ID NO: 1423785 - RNA, 19 nt, Homo sapiens
uagaaaguaagcaaucaga

SEQ ID NO: 1423786 - RNA, 19 nt, Homo sapiens
ugucagagcaacaaaugga

SEQ ID NO: 1423787 - RNA, 19 nt, Homo sapiens
gagacugguccaacaagau

SEQ ID NO: 1423788 - RNA, 19 nt, Homo sapiens
uaggaaagagauucaggaa

SEQ ID NO: 1423789 - RNA, 19 nt, Homo sapiens
gugacaguccuuaaacgaa

SEQ ID NO: 1423790 - RNA, 19 nt, Homo sapiens
ggugacaguccuuaaacga

SEQ ID NO: 1423791 - RNA, 19 nt, Homo sapiens
ucaggcuccuucugucaug

SEQ ID NO: 1423792 - RNA, 19 nt, Homo sapiens
uggaaaccaugaggauguu

SEQ ID NO: 1423793 - RNA, 19 nt, Homo sapiens
caaagcauugucuuagauc

SEQ ID NO: 1423794 - RNA, 19 nt, Homo sapiens
cuagcaagacuccacaaug

SEQ ID NO: 1423795 - RNA, 19 nt, Homo sapiens
uagugcaucccuuuagaaa

SEQ ID NO: 1423796 - RNA, 19 nt, Homo sapiens
aggauuuaaugcccacaaa

SEQ ID NO: 1423797 - RNA, 19 nt, Homo sapiens
uaagaagaaggaagagaag

SEQ ID NO: 1423798 - RNA, 19 nt, Homo sapiens
gcaacaaauggaccugaag

SEQ ID NO: 1423799 - RNA, 19 nt, Homo sapiens
gaaccuaagauggaaacca

SEQ ID NO: 1423800 - RNA, 19 nt, Homo sapiens
agacugguccaacaagaug

SEQ ID NO: 1423801 - RNA, 19 nt, Homo sapiens
ccaagccacuagcaagacu

SEQ ID NO: 1423802 - RNA, 19 nt, Homo sapiens
caggaaugaauguggauau

SEQ ID NO: 1423803 - RNA, 19 nt, Homo sapiens
uguggaagacugcugaaga

SEQ ID NO: 1423804 - RNA, 19 nt, Homo sapiens
ccagcaggccuuaggaaag

SEQ ID NO: 1423805 - RNA, 19 nt, Homo sapiens
agaaaguaagcaaucagaa

SEQ ID NO: 1423806 - RNA, 19 nt, Homo sapiens
cauggucgaagaggacaua

SEQ ID NO: 1423807 - RNA, 19 nt, Homo sapiens
ugccugacauggcuuacga

SEQ ID NO: 1423808 - RNA, 19 nt, Homo sapiens
aaaguggugacaguccuua

SEQ ID NO: 1423809 - RNA, 19 nt, Homo sapiens
uacgaacgcaagcuaaaga

SEQ ID NO: 1423810 - RNA, 19 nt, Homo sapiens
guuacaggaggguaccuuu

SEQ ID NO: 1423811 - RNA, 19 nt, Homo sapiens
cuacaagugguccuuccaa

SEQ ID NO: 1423812 - RNA, 19 nt, Homo sapiens
agcaacaaauggaccugaa

SEQ ID NO: 1423813 - RNA, 19 nt, Homo sapiens
ggauuuaaugcccacaaag

SEQ ID NO: 1423814 - RNA, 19 nt, Homo sapiens
caaaguggugacaguccuu

SEQ ID NO: 1423815 - RNA, 19 nt, Homo sapiens
acaaauggaccugaaggau

SEQ ID NO: 1423816 - RNA, 19 nt, Homo sapiens
caaugucagagcaacaaau

SEQ ID NO: 1423817 - RNA, 19 nt, Homo sapiens
ucuuagaucccauguuaca

SEQ ID NO: 1423818 - RNA, 19 nt, Homo sapiens
gaaaugaccugaccucaaa

SEQ ID NO: 1423819 - RNA, 19 nt, Homo sapiens
gcaggagccuuuccacauu

SEQ ID NO: 1423820 - RNA, 19 nt, Homo sapiens
caacaucagagcacauuaa

SEQ ID NO: 1423821 - RNA, 19 nt, Homo sapiens
caaggugcauccacuguga

SEQ ID NO: 1423822 - RNA, 19 nt, Homo sapiens
ggaaggaguucaccaccau

SEQ ID NO: 1423823 - RNA, 19 nt, Homo sapiens
ggaaaugaccugaccucaa

SEQ ID NO: 1423824 - RNA, 19 nt, Homo sapiens
guaccagccucagccuaua

SEQ ID NO: 1423825 - RNA, 19 nt, Homo sapiens
ggacuuauaccgggacuug

SEQ ID NO: 1423826 - RNA, 19 nt, Homo sapiens
caggagccuuuccacauuu

SEQ ID NO: 1423827 - RNA, 19 nt, Homo sapiens
gggacucucuguauaugga

SEQ ID NO: 1423828 - RNA, 19 nt, Homo sapiens
ggaggacgccagccuguau

SEQ ID NO: 1423829 - RNA, 19 nt, Homo sapiens
ugaagggugugcucucaga

SEQ ID NO: 1423830 - RNA, 19 nt, Homo sapiens
gagcagagugccaaacugu

SEQ ID NO: 1423831 - RNA, 19 nt, Homo sapiens
cagacgaccuccuccugaa

SEQ ID NO: 1423832 - RNA, 19 nt, Homo sapiens
gugcacagauggacacucu

SEQ ID NO: 1423833 - RNA, 19 nt, Homo sapiens
gaggugggacucucuguau

SEQ ID NO: 1423834 - RNA, 19 nt, Homo sapiens
ggaggugggacucucugua

SEQ ID NO: 1423835 - RNA, 19 nt, Homo sapiens
gcugaagggugugcucuca

SEQ ID NO: 1423836 - RNA, 19 nt, Homo sapiens
caucagagcacauuaaacg

SEQ ID NO: 1423837 - RNA, 19 nt, Homo sapiens
ggagcagagugccaaacug

SEQ ID NO: 1423838 - RNA, 19 nt, Homo sapiens
gauggacacucugcucuac

SEQ ID NO: 1423839 - RNA, 19 nt, Homo sapiens
gcuacagcgugcacagaug

SEQ ID NO: 1423840 - RNA, 19 nt, Homo sapiens
ggugggacucucuguauau

SEQ ID NO: 1423841 - RNA, 19 nt, Homo sapiens
gguaccagccucagccuau

SEQ ID NO: 1423842 - RNA, 19 nt, Homo sapiens
guacggggcucaggaguug

SEQ ID NO: 1423843 - RNA, 19 nt, Homo sapiens
gccagcagcccaccauaug

SEQ ID NO: 1423844 - RNA, 19 nt, Homo sapiens
cuugguggguccaguggua

SEQ ID NO: 1423845 - RNA, 19 nt, Homo sapiens
gagggacggucaacaucag

SEQ ID NO: 1423846 - RNA, 19 nt, Homo sapiens
ucaccaccaucaagaccuu

SEQ ID NO: 1423847 - RNA, 19 nt, Homo sapiens
uggacacucugcucuacaa

SEQ ID NO: 1423848 - RNA, 19 nt, Homo sapiens
ggaguucaccaccaucaag

SEQ ID NO: 1423849 - RNA, 19 nt, Homo sapiens
gcugcaugcugcccacugu

SEQ ID NO: 1423850 - RNA, 19 nt, Homo sapiens
gugggacucucuguauaug

SEQ ID NO: 1423851 - RNA, 19 nt, Homo sapiens
ccagaagaugggcuacgua

SEQ ID NO: 1423852 - RNA, 19 nt, Homo sapiens
gcccacagacaggaaauga

SEQ ID NO: 1423853 - RNA, 19 nt, Homo sapiens
aggugggacucucuguaua

SEQ ID NO: 1423854 - RNA, 19 nt, Homo sapiens
gacgaccuccuccugaaga

SEQ ID NO: 1423855 - RNA, 19 nt, Homo sapiens
gaguucaccaccaucaaga

SEQ ID NO: 1423856 - RNA, 19 nt, Homo sapiens
ggccagcagcccaccauau

SEQ ID NO: 1423857 - RNA, 19 nt, Homo sapiens
ucagagggacggucaacau

SEQ ID NO: 1423858 - RNA, 19 nt, Homo sapiens
cacauuaaacgcuggugaa

SEQ ID NO: 1423859 - RNA, 19 nt, Homo sapiens
acacucugcucuacaacag

SEQ ID NO: 1423860 - RNA, 19 nt, Homo sapiens
cugaaccugucccugagaa

SEQ ID NO: 1423861 - RNA, 19 nt, Homo sapiens
gaacgggcaguggcugaca

SEQ ID NO: 1423862 - RNA, 19 nt, Homo sapiens
aacaucagagcacauuaaa

SEQ ID NO: 1423863 - RNA, 19 nt, Homo sapiens
ucaacaucagagcacauua

SEQ ID NO: 1423864 - RNA, 19 nt, Homo sapiens
gaaggguccucgcccauuu

SEQ ID NO: 1423865 - RNA, 19 nt, Homo sapiens
ucaagaggcuccaaacguu

SEQ ID NO: 1423866 - RNA, 19 nt, Homo sapiens
ggaaagcucauucuucuuc

SEQ ID NO: 1423867 - RNA, 19 nt, Homo sapiens
gcaagaaagcugcaaagga

SEQ ID NO: 1423868 - RNA, 19 nt, Homo sapiens
gacgaucacuggcuucuuc

SEQ ID NO: 1423869 - RNA, 19 nt, Homo sapiens
gcugguggcugguggagaa

SEQ ID NO: 1423870 - RNA, 19 nt, Homo sapiens
uaaagcuuguucugcauga

SEQ ID NO: 1423871 - RNA, 19 nt, Homo sapiens
gcugguggcuaugcaggua

SEQ ID NO: 1423872 - RNA, 19 nt, Homo sapiens
gaaagcucauucuucuucu

SEQ ID NO: 1423873 - RNA, 19 nt, Homo sapiens
caagaggcuccaaacguuu

SEQ ID NO: 1423874 - RNA, 19 nt, Homo sapiens
gaauucaggcagcucaaga

SEQ ID NO: 1423875 - RNA, 19 nt, Homo sapiens
ccacaggcuugagguguug

SEQ ID NO: 1423876 - RNA, 19 nt, Homo sapiens
gagggugcguggacucugu

SEQ ID NO: 1423877 - RNA, 19 nt, Homo sapiens
cuggaaagcucauucuucu

SEQ ID NO: 1423878 - RNA, 19 nt, Homo sapiens
gcgcaggaguugggacgaa

SEQ ID NO: 1423879 - RNA, 19 nt, Homo sapiens
gguguugccaggauucuau

SEQ ID NO: 1423880 - RNA, 19 nt, Homo sapiens
gcaggaguugggacgaauu

SEQ ID NO: 1423881 - RNA, 19 nt, Homo sapiens
cccacaggcuugagguguu

SEQ ID NO: 1423882 - RNA, 19 nt, Homo sapiens
aaagcucauucuucuucuu

SEQ ID NO: 1423883 - RNA, 19 nt, Homo sapiens
gaaagcugcaaaggacuca

SEQ ID NO: 1423884 - RNA, 19 nt, Homo sapiens
ugaccgcguucucccaaag

SEQ ID NO: 1423885 - RNA, 19 nt, Homo sapiens
gccugcagcuguuggaaac

SEQ ID NO: 1423886 - RNA, 19 nt, Homo sapiens
gagcagugagcgcgaggau

SEQ ID NO: 1423887 - RNA, 19 nt, Homo sapiens
aaacguuugccuucucugu

SEQ ID NO: 1423888 - RNA, 19 nt, Homo sapiens
gaucaagaggcuccaaacg

SEQ ID NO: 1423889 - RNA, 19 nt, Homo sapiens
gcacccagcucauggcuua

SEQ ID NO: 1423890 - RNA, 19 nt, Homo sapiens
ucaagaaacugaaggauga

SEQ ID NO: 1423891 - RNA, 19 nt, Homo sapiens
gcaugaggcugaaaucuuc

SEQ ID NO: 1423892 - RNA, 19 nt, Homo sapiens
ccaaggagcuggucgacau

SEQ ID NO: 1423893 - RNA, 19 nt, Homo sapiens
gaucacaacccaccaccua

SEQ ID NO: 1423894 - RNA, 19 nt, Homo sapiens
uuucugagcuacaggagua

SEQ ID NO: 1423895 - RNA, 19 nt, Homo sapiens
gcuuggaccuggaaccauu

SEQ ID NO: 1423896 - RNA, 19 nt, Homo sapiens
gguggagaauguugugcua

SEQ ID NO: 1423897 - RNA, 19 nt, Homo sapiens
acaagaggcugguggaucu

SEQ ID NO: 1423898 - RNA, 19 nt, Homo sapiens
cacgauggcugaagagcaa

SEQ ID NO: 1423899 - RNA, 19 nt, Homo sapiens
ccaagagcuuagacacaaa

SEQ ID NO: 1423900 - RNA, 19 nt, Homo sapiens
gcagaggucccaccagauc

SEQ ID NO: 1423901 - RNA, 19 nt, Homo sapiens
cccaagagcuuagacacaa

SEQ ID NO: 1423902 - RNA, 19 nt, Homo sapiens
ccagaucuagcgcucaaua

SEQ ID NO: 1423903 - RNA, 19 nt, Homo sapiens
gcaugaagagcuacugguu

SEQ ID NO: 1423904 - RNA, 19 nt, Homo sapiens
gcccgcagcuaccacaaga

SEQ ID NO: 1423905 - RNA, 19 nt, Homo sapiens
gggcccagauccaccagaa

SEQ ID NO: 1423906 - RNA, 19 nt, Homo sapiens
ccgcaggcaugaagagcua

SEQ ID NO: 1423907 - RNA, 19 nt, Homo sapiens
caacccaccaccuacauga

SEQ ID NO: 1423908 - RNA, 19 nt, Homo sapiens
gcagguacaagcacgaaau

SEQ ID NO: 1423909 - RNA, 19 nt, Homo sapiens
ggagaauguugugcuacga

SEQ ID NO: 1423910 - RNA, 19 nt, Homo sapiens
caccagaucuagcgcucaa

SEQ ID NO: 1423911 - RNA, 19 nt, Homo sapiens
cugaagagcaacuuucuga

SEQ ID NO: 1423912 - RNA, 19 nt, Homo sapiens
gaaacugaaggaugaguac

SEQ ID NO: 1423913 - RNA, 19 nt, Homo sapiens
agagcaacuuucugagcua

SEQ ID NO: 1423914 - RNA, 19 nt, Homo sapiens
gcagcagcccaagagcuua

SEQ ID NO: 1423915 - RNA, 19 nt, Homo sapiens
gagcuggucgacauucaga

SEQ ID NO: 1423916 - RNA, 19 nt, Homo sapiens
gaucuagcgcucaauaagg

SEQ ID NO: 1423917 - RNA, 19 nt, Homo sapiens
gcugaagagugagauccuu

SEQ ID NO: 1423918 - RNA, 19 nt, Homo sapiens
gcacuggugacgcgugugu

SEQ ID NO: 1423919 - RNA, 19 nt, Homo sapiens
gcaacuuucugagcuacag

SEQ ID NO: 1423920 - RNA, 19 nt, Homo sapiens
cagaucuagcgcucaauaa

SEQ ID NO: 1423921 - RNA, 19 nt, Homo sapiens
ggcagcagcccaagagcuu

SEQ ID NO: 1423922 - RNA, 19 nt, Homo sapiens
uaaaacaugagucaggaua

SEQ ID NO: 1423923 - RNA, 19 nt, Homo sapiens
agaaacugaaggaugagua

SEQ ID NO: 1423924 - RNA, 19 nt, Homo sapiens
agugggcgcuggagcauca

SEQ ID NO: 1423925 - RNA, 19 nt, Homo sapiens
gagagggcagcaccagaga

SEQ ID NO: 1423926 - RNA, 19 nt, Homo sapiens
gugaggcucugcccugacu

SEQ ID NO: 1423927 - RNA, 19 nt, Homo sapiens
gaagugggcgcuggagcau

SEQ ID NO: 1423928 - RNA, 19 nt, Homo sapiens
caaggagcuggucgacauu

SEQ ID NO: 1423929 - RNA, 19 nt, Homo sapiens
ccaccuacaugagcagcau

SEQ ID NO: 1423930 - RNA, 19 nt, Homo sapiens
ggucgacauucagaucaca

SEQ ID NO: 1423931 - RNA, 19 nt, Homo sapiens
ucacaacccaccaccuaca

SEQ ID NO: 1423932 - RNA, 19 nt, Homo sapiens
ugggugugcuggauagcuu

SEQ ID NO: 1423933 - RNA, 19 nt, Homo sapiens
ccaugaaccccgagaauga

SEQ ID NO: 1423934 - RNA, 19 nt, Homo sapiens
gcccaagagcuuagacaca

SEQ ID NO: 1423935 - RNA, 19 nt, Homo sapiens
caagagcuuagacacaaag

SEQ ID NO: 1423936 - RNA, 19 nt, Homo sapiens
gcaaagauccauauucuaa

SEQ ID NO: 1423937 - RNA, 19 nt, Homo sapiens
caaacaagcuuuaaugcaa

SEQ ID NO: 1423938 - RNA, 19 nt, Homo sapiens
gugaagaucuuugugaaua

SEQ ID NO: 1423939 - RNA, 19 nt, Homo sapiens
ggaagcagcccucuacauu

SEQ ID NO: 1423940 - RNA, 19 nt, Homo sapiens
ccaagauucucccauuuaa

SEQ ID NO: 1423941 - RNA, 19 nt, Homo sapiens
ccacacgucuuaaguaaau

SEQ ID NO: 1423942 - RNA, 19 nt, Homo sapiens
uaaccaagauucucccauu

SEQ ID NO: 1423943 - RNA, 19 nt, Homo sapiens
gcaaguggcugaagaacag

SEQ ID NO: 1423944 - RNA, 19 nt, Homo sapiens
caagauaaaucggaaacaa

SEQ ID NO: 1423945 - RNA, 19 nt, Homo sapiens
gaaggcaaguggcugaaga

SEQ ID NO: 1423946 - RNA, 19 nt, Homo sapiens
gaauacagaagugcucuua

SEQ ID NO: 1423947 - RNA, 19 nt, Homo sapiens
ggaagauaaagguacauua

SEQ ID NO: 1423948 - RNA, 19 nt, Homo sapiens
auacagaagugcucuuauu

SEQ ID NO: 1423949 - RNA, 19 nt, Homo sapiens
caagcuaccacacgucuua

SEQ ID NO: 1423950 - RNA, 19 nt, Homo sapiens
ccaaauucauugccuguga

SEQ ID NO: 1423951 - RNA, 19 nt, Homo sapiens
gaugcucucucucuuguga

SEQ ID NO: 1423952 - RNA, 19 nt, Homo sapiens
ccagaaggauauaaaguca

SEQ ID NO: 1423953 - RNA, 19 nt, Homo sapiens
ggaccagucuucacuuucu

SEQ ID NO: 1423954 - RNA, 19 nt, Homo sapiens
agacagauguaacaaagga

SEQ ID NO: 1423955 - RNA, 19 nt, Homo sapiens
ccagacagauguaacaaag

SEQ ID NO: 1423956 - RNA, 19 nt, Homo sapiens
gaacucuagucccaaggaa

SEQ ID NO: 1423957 - RNA, 19 nt, Homo sapiens
uaccacacgucuuaaguaa

SEQ ID NO: 1423958 - RNA, 19 nt, Homo sapiens
caacaagaugagacacuua

SEQ ID NO: 1423959 - RNA, 19 nt, Homo sapiens
cuuaauauguucugugguu

SEQ ID NO: 1423960 - RNA, 19 nt, Homo sapiens
gaacaugugcaaauggaau

SEQ ID NO: 1423961 - RNA, 19 nt, Homo sapiens
gaaaggaccagucuucacu

SEQ ID NO: 1423962 - RNA, 19 nt, Homo sapiens
agacguaucuuugcccauu

SEQ ID NO: 1423963 - RNA, 19 nt, Homo sapiens
guucugugguuugcuguua

SEQ ID NO: 1423964 - RNA, 19 nt, Homo sapiens
uacagaagugcucuuauua

SEQ ID NO: 1423965 - RNA, 19 nt, Homo sapiens
gcaaacaagcuuuaaugca

SEQ ID NO: 1423966 - RNA, 19 nt, Homo sapiens
ggacagaugacuuggagau

SEQ ID NO: 1423967 - RNA, 19 nt, Homo sapiens
aagcagcccucuacauuca

SEQ ID NO: 1423968 - RNA, 19 nt, Homo sapiens
gaagcagcccucuacauuc

SEQ ID NO: 1423969 - RNA, 19 nt, Homo sapiens
cggaaacaaucaacccaaa

SEQ ID NO: 1423970 - RNA, 19 nt, Homo sapiens
gugacugacuacucucuuu

SEQ ID NO: 1423971 - RNA, 19 nt, Homo sapiens
cagaugacuuggagauguu

SEQ ID NO: 1423972 - RNA, 19 nt, Homo sapiens
guacauauugauugucuug

SEQ ID NO: 1423973 - RNA, 19 nt, Homo sapiens
ucuaagucccaaaguauua

SEQ ID NO: 1423974 - RNA, 19 nt, Homo sapiens
caaggaaaauguccaaaug

SEQ ID NO: 1423975 - RNA, 19 nt, Homo sapiens
ccaacaagaugagacacuu

SEQ ID NO: 1423976 - RNA, 19 nt, Homo sapiens
gaccacuccuuaacuuuua

SEQ ID NO: 1423977 - RNA, 19 nt, Homo sapiens
gggacagccuugugaagau

SEQ ID NO: 1423978 - RNA, 19 nt, Homo sapiens
caagauaggauucauugca

SEQ ID NO: 1423979 - RNA, 19 nt, Homo sapiens
guacaagauaggauucauu

SEQ ID NO: 1423980 - RNA, 19 nt, Homo sapiens
caaaugaugcucucucucu

SEQ ID NO: 1423981 - RNA, 19 nt, Homo sapiens
ggacagccuugugaagauc

SEQ ID NO: 1423982 - RNA, 19 nt, Homo sapiens
uccgaaagccuaguaguua

SEQ ID NO: 1423983 - RNA, 19 nt, Homo sapiens
ugacugacuacucucuuua

SEQ ID NO: 1423984 - RNA, 19 nt, Homo sapiens
aagauaggauucauugcaa

SEQ ID NO: 1423985 - RNA, 19 nt, Homo sapiens
gcugugauccugagauuca

SEQ ID NO: 1423986 - RNA, 19 nt, Homo sapiens
gcaaauccccagccacaua

SEQ ID NO: 1423987 - RNA, 19 nt, Homo sapiens
gaccuuauacuuaaugauc

SEQ ID NO: 1423988 - RNA, 19 nt, Homo sapiens
caaauucauugccugugau

SEQ ID NO: 1423989 - RNA, 19 nt, Homo sapiens
aaacauguucucccaaaga

SEQ ID NO: 1423990 - RNA, 19 nt, Homo sapiens
ggacagggacagccuugug

SEQ ID NO: 1423991 - RNA, 19 nt, Homo sapiens
uugcaaagauccauauucu

SEQ ID NO: 1423992 - RNA, 19 nt, Homo sapiens
cggaauggcuagccugcuu

SEQ ID NO: 1423993 - RNA, 19 nt, Homo sapiens
caacagacugggagggauu

SEQ ID NO: 1423994 - RNA, 19 nt, Homo sapiens
caaagccugugcagcaaca

SEQ ID NO: 1423995 - RNA, 19 nt, Homo sapiens
uccagagacuacaauaauu

SEQ ID NO: 1423996 - RNA, 19 nt, Homo sapiens
ugaagaacaggcuugauug

SEQ ID NO: 1423997 - RNA, 19 nt, Homo sapiens
gaagaacaggcuugauugg

SEQ ID NO: 1423998 - RNA, 19 nt, Homo sapiens
ccucaggaguauucuucua

SEQ ID NO: 1423999 - RNA, 19 nt, Homo sapiens
agucuucacuuucugcauu

SEQ ID NO: 1424000 - RNA, 19 nt, Homo sapiens
aaccaagauucucccauuu

SEQ ID NO: 1424001 - RNA, 19 nt, Homo sapiens
caucuuuccuguucugcuu

SEQ ID NO: 1424002 - RNA, 19 nt, Homo sapiens
ccagagacuacaauaauuc

SEQ ID NO: 1424003 - RNA, 19 nt, Homo sapiens
gaaagccuaguaguuaguu

SEQ ID NO: 1424004 - RNA, 19 nt, Homo sapiens
aaguuuaccuagugacuga

SEQ ID NO: 1424005 - RNA, 19 nt, Homo sapiens
caaauggaaucuuuucugu

SEQ ID NO: 1424006 - RNA, 19 nt, Homo sapiens
aaccauagcuaagacguau

SEQ ID NO: 1424007 - RNA, 19 nt, Homo sapiens
ggaggacgaugcaguaccu

SEQ ID NO: 1424008 - RNA, 19 nt, Homo sapiens
gcagcccucuacauucaau

SEQ ID NO: 1424009 - RNA, 19 nt, Homo sapiens
acagaugacuuggagaugu

SEQ ID NO: 1424010 - RNA, 19 nt, Homo sapiens
cuaccacacgucuuaagua

SEQ ID NO: 1424011 - RNA, 19 nt, Homo sapiens
caagauucucccauuuaaa

SEQ ID NO: 1424012 - RNA, 19 nt, Homo sapiens
gagaccacuccuuaacuuu

SEQ ID NO: 1424013 - RNA, 19 nt, Homo sapiens
acugacuacucucuuuaua

SEQ ID NO: 1424014 - RNA, 19 nt, Homo sapiens
gugcucuuauuaccaguuu

SEQ ID NO: 1424015 - RNA, 19 nt, Homo sapiens
aaggaccagucuucacuuu

SEQ ID NO: 1424016 - RNA, 19 nt, Homo sapiens
acacuuaaacccagacaga

SEQ ID NO: 1424017 - RNA, 19 nt, Homo sapiens
gcuccagagacuacaauaa

SEQ ID NO: 1424018 - RNA, 19 nt, Homo sapiens
ugacugagugguuauacaa

SEQ ID NO: 1424019 - RNA, 19 nt, Homo sapiens
ucaccgagccgucaagcaa

SEQ ID NO: 1424020 - RNA, 19 nt, Homo sapiens
ccgaaagccuaguaguuag

SEQ ID NO: 1424021 - RNA, 19 nt, Homo sapiens
cugaagaacaggcuugauu

SEQ ID NO: 1424022 - RNA, 19 nt, Homo sapiens
acucuagucccaaggaaua

SEQ ID NO: 1424023 - RNA, 19 nt, Homo sapiens
gacagggacagccuuguga

SEQ ID NO: 1424024 - RNA, 19 nt, Homo sapiens
ccucaaggcagauccgaaa

SEQ ID NO: 1424025 - RNA, 19 nt, Homo sapiens
ucauccagauuacuucuuc

SEQ ID NO: 1424026 - RNA, 19 nt, Homo sapiens
uaggauucauugcaaacaa

SEQ ID NO: 1424027 - RNA, 19 nt, Homo sapiens
uacaagauaggauucauug

SEQ ID NO: 1424028 - RNA, 19 nt, Homo sapiens
uggaacaugugcaaaugga

SEQ ID NO: 1424029 - RNA, 19 nt, Homo sapiens
ccaaagccagcaaguggaa

SEQ ID NO: 1424030 - RNA, 19 nt, Homo sapiens
gucuucacuuucugcauua

SEQ ID NO: 1424031 - RNA, 19 nt, Homo sapiens
uccaucaucuuaaccauag

SEQ ID NO: 1424032 - RNA, 19 nt, Homo sapiens
gauuacgguugcgccagua

SEQ ID NO: 1424033 - RNA, 19 nt, Homo sapiens
uaguugcacuggguuguuu

SEQ ID NO: 1424034 - RNA, 19 nt, Homo sapiens
accaagauucucccauuua

SEQ ID NO: 1424035 - RNA, 19 nt, Homo sapiens
gucccaaaguauuauauag

SEQ ID NO: 1424036 - RNA, 19 nt, Homo sapiens
gcaaaugacuuguuucuuc

SEQ ID NO: 1424037 - RNA, 19 nt, Homo sapiens
ugagacaacuggaaauaua

SEQ ID NO: 1424038 - RNA, 19 nt, Homo sapiens
gaaggcagcuccucucugu

SEQ ID NO: 1424039 - RNA, 19 nt, Homo sapiens
gggagaaguugcucuuuaa

SEQ ID NO: 1424040 - RNA, 19 nt, Homo sapiens
gaaacaggcgccuauuuaa

SEQ ID NO: 1424041 - RNA, 19 nt, Homo sapiens
acagagagaugccggauaa

SEQ ID NO: 1424042 - RNA, 19 nt, Homo sapiens
agaaguugcucuuuaauga

SEQ ID NO: 1424043 - RNA, 19 nt, Homo sapiens
ugaaacaggcgccuauuua

SEQ ID NO: 1424044 - RNA, 19 nt, Homo sapiens
gauaggagaguauuuaaug

SEQ ID NO: 1424045 - RNA, 19 nt, Homo sapiens
caaaugacuuguuucuuca

SEQ ID NO: 1424046 - RNA, 19 nt, Homo sapiens
gaagccaucucugcacaaa

SEQ ID NO: 1424047 - RNA, 19 nt, Homo sapiens
gaagucaacgcaggaauaa

SEQ ID NO: 1424048 - RNA, 19 nt, Homo sapiens
gagaguauuuaauggcaaa

SEQ ID NO: 1424049 - RNA, 19 nt, Homo sapiens
caucauagccaauccuaaa

SEQ ID NO: 1424050 - RNA, 19 nt, Homo sapiens
gcaagcuggugauuaacaa

SEQ ID NO: 1424051 - RNA, 19 nt, Homo sapiens
ccacgaaccuuugcgagaa

SEQ ID NO: 1424052 - RNA, 19 nt, Homo sapiens
gagaaucaacucugaaugu

SEQ ID NO: 1424053 - RNA, 19 nt, Homo sapiens
gagagaugccggauaaaga

SEQ ID NO: 1424054 - RNA, 19 nt, Homo sapiens
gaacgcaaagggcgauauu

SEQ ID NO: 1424055 - RNA, 19 nt, Homo sapiens
cauagccaauccuaaauga

SEQ ID NO: 1424056 - RNA, 19 nt, Homo sapiens
ggaguacaauggcacaauc

SEQ ID NO: 1424057 - RNA, 19 nt, Homo sapiens
gagacaacuggaaauauaa

SEQ ID NO: 1424058 - RNA, 19 nt, Homo sapiens
ugaauugcaucucaugaau

SEQ ID NO: 1424059 - RNA, 19 nt, Homo sapiens
caaacaguaugguauugug

SEQ ID NO: 1424060 - RNA, 19 nt, Homo sapiens
caccacacccagccaauua

SEQ ID NO: 1424061 - RNA, 19 nt, Homo sapiens
gaaguugcucuuuaaugaa

SEQ ID NO: 1424062 - RNA, 19 nt, Homo sapiens
gcaaagggcgauauuaaaa

SEQ ID NO: 1424063 - RNA, 19 nt, Homo sapiens
caacaaugccacacagaug

SEQ ID NO: 1424064 - RNA, 19 nt, Homo sapiens
ggagagaggaccauguuca

SEQ ID NO: 1424065 - RNA, 19 nt, Homo sapiens
uuucugcacucucuaauga

SEQ ID NO: 1424066 - RNA, 19 nt, Homo sapiens
caaauuccacuuuccauca

SEQ ID NO: 1424067 - RNA, 19 nt, Homo sapiens
caacaaacugcaagggaaa

SEQ ID NO: 1424068 - RNA, 19 nt, Homo sapiens
gagaaguugcucuuuaaug

SEQ ID NO: 1424069 - RNA, 19 nt, Homo sapiens
ggggagaaguugcucuuua

SEQ ID NO: 1424070 - RNA, 19 nt, Homo sapiens
acggcaagcuggugauuaa

SEQ ID NO: 1424071 - RNA, 19 nt, Homo sapiens
ccacacagaugcaaaugac

SEQ ID NO: 1424072 - RNA, 19 nt, Homo sapiens
aauuagggcugucuuacaa

SEQ ID NO: 1424073 - RNA, 19 nt, Homo sapiens
ccaaagugcugggauuaca

SEQ ID NO: 1424074 - RNA, 19 nt, Homo sapiens
ccaauuauggccacaaaug

SEQ ID NO: 1424075 - RNA, 19 nt, Homo sapiens
cagcugcccucaccaagau

SEQ ID NO: 1424076 - RNA, 19 nt, Homo sapiens
agaugcaaaugacuuguuu

SEQ ID NO: 1424077 - RNA, 19 nt, Homo sapiens
gaaucaacucugaauguga

SEQ ID NO: 1424078 - RNA, 19 nt, Homo sapiens
ccacugcccugcuccaucu

SEQ ID NO: 1424079 - RNA, 19 nt, Homo sapiens
guacaauggcacaaucuug

SEQ ID NO: 1424080 - RNA, 19 nt, Homo sapiens
gauccagccuaagcuagaa

SEQ ID NO: 1424081 - RNA, 19 nt, Homo sapiens
cuaaaugaaugccaaucug

SEQ ID NO: 1424082 - RNA, 19 nt, Homo sapiens
guaucaggcugugaccuuu

SEQ ID NO: 1424083 - RNA, 19 nt, Homo sapiens
agaagucaacgcaggaaua

SEQ ID NO: 1424084 - RNA, 19 nt, Homo sapiens
ggugggugauccagccuaa

SEQ ID NO: 1424085 - RNA, 19 nt, Homo sapiens
gacuggacacuuugagaua

SEQ ID NO: 1424086 - RNA, 19 nt, Homo sapiens
guacaugagacaacuggaa

SEQ ID NO: 1424087 - RNA, 19 nt, Homo sapiens
gagagaggaccauguucaa

SEQ ID NO: 1424088 - RNA, 19 nt, Homo sapiens
ccacaggaacgaugggaaa

SEQ ID NO: 1424089 - RNA, 19 nt, Homo sapiens
caugagacaacuggaaaua

SEQ ID NO: 1424090 - RNA, 19 nt, Homo sapiens
gggaaagccaggaagaaga

SEQ ID NO: 1424091 - RNA, 19 nt, Homo sapiens
ggugggaagcuuacucuga

SEQ ID NO: 1424092 - RNA, 19 nt, Homo sapiens
acgcaaagggcgauauuaa

SEQ ID NO: 1424093 - RNA, 19 nt, Homo sapiens
aaacaggcgccuauuuaau

SEQ ID NO: 1424094 - RNA, 19 nt, Homo sapiens
gggacucucucuuuuauug

SEQ ID NO: 1424095 - RNA, 19 nt, Homo sapiens
gaacacccaccaccagucu

SEQ ID NO: 1424096 - RNA, 19 nt, Homo sapiens
ggaugaaacaggcgccuau

SEQ ID NO: 1424097 - RNA, 19 nt, Homo sapiens
aaauaaaccacgugaagau

SEQ ID NO: 1424098 - RNA, 19 nt, Homo sapiens
caacucugaaugugaugua

SEQ ID NO: 1424099 - RNA, 19 nt, Homo sapiens
agaaucaacucugaaugug

SEQ ID NO: 1424100 - RNA, 19 nt, Homo sapiens
ccaaguggguccggcucua

SEQ ID NO: 1424101 - RNA, 19 nt, Homo sapiens
gaauugcaucucaugaaug

SEQ ID NO: 1424102 - RNA, 19 nt, Homo sapiens
ggaaagccaggaagaagag

SEQ ID NO: 1424103 - RNA, 19 nt, Homo sapiens
aauugcaucucaugaaugu

SEQ ID NO: 1424104 - RNA, 19 nt, Homo sapiens
ugcccaagcuggaguacaa

SEQ ID NO: 1424105 - RNA, 19 nt, Homo sapiens
uggacacuuugagauauua

SEQ ID NO: 1424106 - RNA, 19 nt, Homo sapiens
ggauaggagaguauuuaau

SEQ ID NO: 1424107 - RNA, 19 nt, Homo sapiens
agagaugccggauaaagaa

SEQ ID NO: 1424108 - RNA, 19 nt, Homo sapiens
gaugauaccacgagucaac

SEQ ID NO: 1424109 - RNA, 19 nt, Homo sapiens
gcaacggcagcuagucuga

SEQ ID NO: 1424110 - RNA, 19 nt, Homo sapiens
uagccaauccuaaaugaau

SEQ ID NO: 1424111 - RNA, 19 nt, Homo sapiens
gguauugugguuacgcuuu

SEQ ID NO: 1424112 - RNA, 19 nt, Homo sapiens
ggagaaguugcucuuuaau

SEQ ID NO: 1424113 - RNA, 19 nt, Homo sapiens
aaucuuggcucaccacaac

SEQ ID NO: 1424114 - RNA, 19 nt, Homo sapiens
gccaauuagggcugucuua

SEQ ID NO: 1424115 - RNA, 19 nt, Homo sapiens
guaaggaaccucgcuaugc

SEQ ID NO: 1424116 - RNA, 19 nt, Homo sapiens
gggagaaucaacucugaau

SEQ ID NO: 1424117 - RNA, 19 nt, Homo sapiens
cgcaaagggcgauauuaaa

SEQ ID NO: 1424118 - RNA, 19 nt, Homo sapiens
gaauggggacucucucuuu

SEQ ID NO: 1424119 - RNA, 19 nt, Homo sapiens
cugaguagcugggauuaca

SEQ ID NO: 1424120 - RNA, 19 nt, Homo sapiens
caggagagaggaccauguu

SEQ ID NO: 1424121 - RNA, 19 nt, Homo sapiens
ggagaaucaacucugaaug

SEQ ID NO: 1424122 - RNA, 19 nt, Homo sapiens
agucaacgcaggaauaaau

SEQ ID NO: 1424123 - RNA, 19 nt, Homo sapiens
acaauaagcaguaauucuc

SEQ ID NO: 1424124 - RNA, 19 nt, Homo sapiens
aagcgagucuccuccuuca

SEQ ID NO: 1424125 - RNA, 19 nt, Homo sapiens
ggacacuuugagauauuaa

SEQ ID NO: 1424126 - RNA, 19 nt, Homo sapiens
caacuggaaauauaacucu

SEQ ID NO: 1424127 - RNA, 19 nt, Homo sapiens
gcucuuuaaugaauugcau

SEQ ID NO: 1424128 - RNA, 19 nt, Homo sapiens
ccuauuuaaucgacagaga

SEQ ID NO: 1424129 - RNA, 19 nt, Homo sapiens
ccaagauacugaacuaccu

SEQ ID NO: 1424130 - RNA, 19 nt, Homo sapiens
auuccaagauacugaacua

SEQ ID NO: 1424131 - RNA, 19 nt, Homo sapiens
gguaaggaaccucgcuaug

SEQ ID NO: 1424132 - RNA, 19 nt, Homo sapiens
cgauggccaugcacagaug

SEQ ID NO: 1424133 - RNA, 19 nt, Homo sapiens
aagcaauuaccguucauuu

SEQ ID NO: 1424134 - RNA, 19 nt, Homo sapiens
ccucuccucacccaucuua

SEQ ID NO: 1424135 - RNA, 19 nt, Homo sapiens
cagaacacagguuuccaaa

SEQ ID NO: 1424136 - RNA, 19 nt, Homo sapiens
gaaucugaauccaccaaua

SEQ ID NO: 1424137 - RNA, 19 nt, Homo sapiens
gcaaggaccgcuauuucua

SEQ ID NO: 1424138 - RNA, 19 nt, Homo sapiens
gggcaucuauggccaguau

SEQ ID NO: 1424139 - RNA, 19 nt, Homo sapiens
caagagcauuggcuuugaa

SEQ ID NO: 1424140 - RNA, 19 nt, Homo sapiens
gagcugaggccaucugugu

SEQ ID NO: 1424141 - RNA, 19 nt, Homo sapiens
uagaggagccgaccacuga

SEQ ID NO: 1424142 - RNA, 19 nt, Homo sapiens
ggaccgcuauuucuauuuu

SEQ ID NO: 1424143 - RNA, 19 nt, Homo sapiens
cugaauccaccaauaaaua

SEQ ID NO: 1424144 - RNA, 19 nt, Homo sapiens
gaagcuugauggccagauc

SEQ ID NO: 1424145 - RNA, 19 nt, Homo sapiens
aaucugaauccaccaauaa

SEQ ID NO: 1424146 - RNA, 19 nt, Homo sapiens
caaggaccgcuauuucuau

SEQ ID NO: 1424147 - RNA, 19 nt, Homo sapiens
gcgaauacaucacaaaagu

SEQ ID NO: 1424148 - RNA, 19 nt, Homo sapiens
ggaggaggcaaguauuuca

SEQ ID NO: 1424149 - RNA, 19 nt, Homo sapiens
cagcaccacugaagacuac

SEQ ID NO: 1424150 - RNA, 19 nt, Homo sapiens
caguuaaucucacauacuc

SEQ ID NO: 1424151 - RNA, 19 nt, Homo sapiens
gaagacuacgaccaugaaa

SEQ ID NO: 1424152 - RNA, 19 nt, Homo sapiens
cagcaaggaccgcuauuuc

SEQ ID NO: 1424153 - RNA, 19 nt, Homo sapiens
cuacgaccaugaaaucaca

SEQ ID NO: 1424154 - RNA, 19 nt, Homo sapiens
aaggaccgcuauuucuauu

SEQ ID NO: 1424155 - RNA, 19 nt, Homo sapiens
gaaacugggagccuuaggu

SEQ ID NO: 1424156 - RNA, 19 nt, Homo sapiens
gcgggugucuguaggucuu

SEQ ID NO: 1424157 - RNA, 19 nt, Homo sapiens
caucaagagcauuggcuuu

SEQ ID NO: 1424158 - RNA, 19 nt, Homo sapiens
gggaauacccaggaaguca

SEQ ID NO: 1424159 - RNA, 19 nt, Homo sapiens
agacuacgaccaugaaauc

SEQ ID NO: 1424160 - RNA, 19 nt, Homo sapiens
ucgggacgcugaaucugaa

SEQ ID NO: 1424161 - RNA, 19 nt, Homo sapiens
gggcagggaagauguaugg

SEQ ID NO: 1424162 - RNA, 19 nt, Homo sapiens
ggugguggcugaugguacu

SEQ ID NO: 1424163 - RNA, 19 nt, Homo sapiens
ugaagacuacgaccaugaa

SEQ ID NO: 1424164 - RNA, 19 nt, Homo sapiens
gcaucuauggccaguauca

SEQ ID NO: 1424165 - RNA, 19 nt, Homo sapiens
ccagcaaggaccgcuauuu

SEQ ID NO: 1424166 - RNA, 19 nt, Homo sapiens
gcagccaggcgaauacauc

SEQ ID NO: 1424167 - RNA, 19 nt, Homo sapiens
caccaguuaaucucacaua

SEQ ID NO: 1424168 - RNA, 19 nt, Homo sapiens
uaucaacuccuuggcauca

SEQ ID NO: 1424169 - RNA, 19 nt, Homo sapiens
cgugaaacugggagccuua

SEQ ID NO: 1424170 - RNA, 19 nt, Homo sapiens
ugaaaaguguccaggugaa

SEQ ID NO: 1424171 - RNA, 19 nt, Homo sapiens
aaucucacauacucagcaa

SEQ ID NO: 1424172 - RNA, 19 nt, Homo sapiens
gagccaccaguuaaucuca

SEQ ID NO: 1424173 - RNA, 19 nt, Homo sapiens
ggcuuugaauggaauuauc

SEQ ID NO: 1424174 - RNA, 19 nt, Homo sapiens
ccaggcgaauacaucacaa

SEQ ID NO: 1424175 - RNA, 19 nt, Homo sapiens
gaaaaguguccaggugaaa

SEQ ID NO: 1424176 - RNA, 19 nt, Homo sapiens
cacauacucagcaaacuca

SEQ ID NO: 1424177 - RNA, 19 nt, Homo sapiens
ccaccaauaaauaaagcuu

SEQ ID NO: 1424178 - RNA, 19 nt, Homo sapiens
ggucuaggguguccucaaa

SEQ ID NO: 1424179 - RNA, 19 nt, Homo sapiens
gcccagagacuauggagua

SEQ ID NO: 1424180 - RNA, 19 nt, Homo sapiens
caaacaggcugaggagguu

SEQ ID NO: 1424181 - RNA, 19 nt, Homo sapiens
ggacuuggaggcagauuug

SEQ ID NO: 1424182 - RNA, 19 nt, Homo sapiens
ccuccaagcuccuauuuua

SEQ ID NO: 1424183 - RNA, 19 nt, Homo sapiens
gcuagggagugccggauga

SEQ ID NO: 1424184 - RNA, 19 nt, Homo sapiens
cgaggaggcucugaguuga

SEQ ID NO: 1424185 - RNA, 19 nt, Homo sapiens
cagaacacauggacuugga

SEQ ID NO: 1424186 - RNA, 19 nt, Homo sapiens
guaaggcauucaggacaaa

SEQ ID NO: 1424187 - RNA, 19 nt, Homo sapiens
cagcagccuccuagaguua

SEQ ID NO: 1424188 - RNA, 19 nt, Homo sapiens
gaguugaugucacuuaggu

SEQ ID NO: 1424189 - RNA, 19 nt, Homo sapiens
gaacugggcaacaucuaca

SEQ ID NO: 1424190 - RNA, 19 nt, Homo sapiens
ccacagucagggacaauaa

SEQ ID NO: 1424191 - RNA, 19 nt, Homo sapiens
gagaagaccaugggaguuc

SEQ ID NO: 1424192 - RNA, 19 nt, Homo sapiens
ggacaggaagggccauguu

SEQ ID NO: 1424193 - RNA, 19 nt, Homo sapiens
gcucugaguugaugucacu

SEQ ID NO: 1424194 - RNA, 19 nt, Homo sapiens
ugugucagcuggaaggaaa

SEQ ID NO: 1424195 - RNA, 19 nt, Homo sapiens
guucuucccuguggacuga

SEQ ID NO: 1424196 - RNA, 19 nt, Homo sapiens
gcuuccagcucaugagaug

SEQ ID NO: 1424197 - RNA, 19 nt, Homo sapiens
gcacuuggacagccuucaa

SEQ ID NO: 1424198 - RNA, 19 nt, Homo sapiens
ucuaucaccucuuuaugug

SEQ ID NO: 1424199 - RNA, 19 nt, Homo sapiens
gcguuaagacccuggauga

SEQ ID NO: 1424200 - RNA, 19 nt, Homo sapiens
cgggagagacacaggauaa

SEQ ID NO: 1424201 - RNA, 19 nt, Homo sapiens
gggcaacucccaccagauc

SEQ ID NO: 1424202 - RNA, 19 nt, Homo sapiens
ccaucuggcugcacuccaa

SEQ ID NO: 1424203 - RNA, 19 nt, Homo sapiens
ccgaggaggcucugaguug

SEQ ID NO: 1424204 - RNA, 19 nt, Homo sapiens
gggcucagguugggucuag

SEQ ID NO: 1424205 - RNA, 19 nt, Homo sapiens
cagagacuauggaguaagg

SEQ ID NO: 1424206 - RNA, 19 nt, Homo sapiens
ggaccucuuuacccucugu

SEQ ID NO: 1424207 - RNA, 19 nt, Homo sapiens
caccugcaguucaauaagu

SEQ ID NO: 1424208 - RNA, 19 nt, Homo sapiens
gacaggaagggccauguug

SEQ ID NO: 1424209 - RNA, 19 nt, Homo sapiens
uuaagacccuggaugacau

SEQ ID NO: 1424210 - RNA, 19 nt, Homo sapiens
gagcucagcggccucagau

SEQ ID NO: 1424211 - RNA, 19 nt, Homo sapiens
ccuguggacugaccucuuc

SEQ ID NO: 1424212 - RNA, 19 nt, Homo sapiens
gacacaggauaaaagguua

SEQ ID NO: 1424213 - RNA, 19 nt, Homo sapiens
ucccaagguucaaauacuu

SEQ ID NO: 1424214 - RNA, 19 nt, Homo sapiens
ggaccuggccgcuuugacu

SEQ ID NO: 1424215 - RNA, 19 nt, Homo sapiens
acagcagccuccuagaguu

SEQ ID NO: 1424216 - RNA, 19 nt, Homo sapiens
gaccuggccgcuuugacua

SEQ ID NO: 1424217 - RNA, 19 nt, Homo sapiens
cgugcucuaucaccucuuu

SEQ ID NO: 1424218 - RNA, 19 nt, Homo sapiens
gggagugggucuggguuca

SEQ ID NO: 1424219 - RNA, 19 nt, Homo sapiens
guuaagacccuggaugaca

SEQ ID NO: 1424220 - RNA, 19 nt, Homo sapiens
aguaaggcauucaggacaa

SEQ ID NO: 1424221 - RNA, 19 nt, Homo sapiens
ucuaggguguccucaaaca

SEQ ID NO: 1424222 - RNA, 19 nt, Homo sapiens
acaacgaacugggcaacau

SEQ ID NO: 1424223 - RNA, 19 nt, Homo sapiens
cccagagacuauggaguaa

SEQ ID NO: 1424224 - RNA, 19 nt, Homo sapiens
gggagagacacaggauaaa

SEQ ID NO: 1424225 - RNA, 19 nt, Homo sapiens
caacgaacugggcaacauc

SEQ ID NO: 1424226 - RNA, 19 nt, Homo sapiens
ggcguggacccgucuugua

SEQ ID NO: 1424227 - RNA, 19 nt, Homo sapiens
ucugaaagcagcacuugga

SEQ ID NO: 1424228 - RNA, 19 nt, Homo sapiens
caggcuccgugcucuauca

SEQ ID NO: 1424229 - RNA, 19 nt, Homo sapiens
uuccugaucuccaucuuuc

SEQ ID NO: 1424230 - RNA, 19 nt, Homo sapiens
ccucccaacucgucugcaa

SEQ ID NO: 1424231 - RNA, 19 nt, Homo sapiens
gacuauggaguaaggcauu

SEQ ID NO: 1424232 - RNA, 19 nt, Homo sapiens
ccacagcagccuccuagag

SEQ ID NO: 1424233 - RNA, 19 nt, Homo sapiens
gagccacagucagggacaa

SEQ ID NO: 1424234 - RNA, 19 nt, Homo sapiens
gggcugcagcugcuucuuc

SEQ ID NO: 1424235 - RNA, 19 nt, Homo sapiens
ggaggagagaguagugaca

SEQ ID NO: 1424236 - RNA, 19 nt, Homo sapiens
ggagagacacaggauaaaa

SEQ ID NO: 1424237 - RNA, 19 nt, Homo sapiens
gcucuaucaccucuuuaug

SEQ ID NO: 1424238 - RNA, 19 nt, Homo sapiens
ugccugcccuccaccuuga

SEQ ID NO: 1424239 - RNA, 19 nt, Homo sapiens
gcaccugcaguucaauaag

SEQ ID NO: 1424240 - RNA, 19 nt, Homo sapiens
ggauaaaagguuaaaagug

SEQ ID NO: 1424241 - RNA, 19 nt, Homo sapiens
cgccgcaccugcaguucaa

SEQ ID NO: 1424242 - RNA, 19 nt, Homo sapiens
gcaacucccaccagaucau

SEQ ID NO: 1424243 - RNA, 19 nt, Homo sapiens
cuuggaggcagauuugaaa

SEQ ID NO: 1424244 - RNA, 19 nt, Homo sapiens
ccgcaccugcaguucaaua

SEQ ID NO: 1424245 - RNA, 19 nt, Homo sapiens
aaacuuggugcacucugaa

SEQ ID NO: 1424246 - RNA, 19 nt, Homo sapiens
ucugaguugaugucacuua

SEQ ID NO: 1424247 - RNA, 19 nt, Homo sapiens
cacagcagccuccuagagu

SEQ ID NO: 1424248 - RNA, 19 nt, Homo sapiens
uuucagaacacauggacuu

SEQ ID NO: 1424249 - RNA, 19 nt, Homo sapiens
ggaaugaauuguagguuua

SEQ ID NO: 1424250 - RNA, 19 nt, Homo sapiens
gaaagaagacgguguuaaa

SEQ ID NO: 1424251 - RNA, 19 nt, Homo sapiens
aaacagagccguaucauaa

SEQ ID NO: 1424252 - RNA, 19 nt, Homo sapiens
ggaagaaggugaagugaag

SEQ ID NO: 1424253 - RNA, 19 nt, Homo sapiens
gcacgguucucauguaaau

SEQ ID NO: 1424254 - RNA, 19 nt, Homo sapiens
gggaggagcugcugaaaca

SEQ ID NO: 1424255 - RNA, 19 nt, Homo sapiens
gggaaugaauuguagguuu

SEQ ID NO: 1424256 - RNA, 19 nt, Homo sapiens
gaauaaggcggcugauaaa

SEQ ID NO: 1424257 - RNA, 19 nt, Homo sapiens
gaaacagagccguaucaua

SEQ ID NO: 1424258 - RNA, 19 nt, Homo sapiens
ggagagaagucagugaaga

SEQ ID NO: 1424259 - RNA, 19 nt, Homo sapiens
acacaguacucgagccuua

SEQ ID NO: 1424260 - RNA, 19 nt, Homo sapiens
ggacgaugauggagaaauc

SEQ ID NO: 1424261 - RNA, 19 nt, Homo sapiens
ugaauaaggcggcugauaa

SEQ ID NO: 1424262 - RNA, 19 nt, Homo sapiens
ccacauagaccuuccauca

SEQ ID NO: 1424263 - RNA, 19 nt, Homo sapiens
gaaagaggacgaugaugga

SEQ ID NO: 1424264 - RNA, 19 nt, Homo sapiens
gaagcgcuaugaaccauca

SEQ ID NO: 1424265 - RNA, 19 nt, Homo sapiens
uaaggcggcugauaaagga

SEQ ID NO: 1424266 - RNA, 19 nt, Homo sapiens
gccgguaguugaugaaauu

SEQ ID NO: 1424267 - RNA, 19 nt, Homo sapiens
cagcacgguucucauguaa

SEQ ID NO: 1424268 - RNA, 19 nt, Homo sapiens
acauagaccuuccaucaga

SEQ ID NO: 1424269 - RNA, 19 nt, Homo sapiens
ggaaauagacgaugaugac

SEQ ID NO: 1424270 - RNA, 19 nt, Homo sapiens
caagcgaccuuagggauga

SEQ ID NO: 1424271 - RNA, 19 nt, Homo sapiens
cuucugaucuggaggauga

SEQ ID NO: 1424272 - RNA, 19 nt, Homo sapiens
ccaagucucccaagaagaa

SEQ ID NO: 1424273 - RNA, 19 nt, Homo sapiens
ccagcacgguucucaugua

SEQ ID NO: 1424274 - RNA, 19 nt, Homo sapiens
ggugagggcuucugaucug

SEQ ID NO: 1424275 - RNA, 19 nt, Homo sapiens
gagagaagucagugaagaa

SEQ ID NO: 1424276 - RNA, 19 nt, Homo sapiens
acgcagacccuuauuauga

SEQ ID NO: 1424277 - RNA, 19 nt, Homo sapiens
acuaaagucucaucaggaa

SEQ ID NO: 1424278 - RNA, 19 nt, Homo sapiens
acagagccguaucauaauu

SEQ ID NO: 1424279 - RNA, 19 nt, Homo sapiens
gauccaagucucccaagaa

SEQ ID NO: 1424280 - RNA, 19 nt, Homo sapiens
cgaccggacuggacgcauu

SEQ ID NO: 1424281 - RNA, 19 nt, Homo sapiens
aguugacacuguugaauaa

SEQ ID NO: 1424282 - RNA, 19 nt, Homo sapiens
uaagaaagaagacgguguu

SEQ ID NO: 1424283 - RNA, 19 nt, Homo sapiens
gcggacaguaugagaauuu

SEQ ID NO: 1424284 - RNA, 19 nt, Homo sapiens
gagccaagcgggacgagaa

SEQ ID NO: 1424285 - RNA, 19 nt, Homo sapiens
ggaggacgaggcugagaaa

SEQ ID NO: 1424286 - RNA, 19 nt, Homo sapiens
uaaagucucaucaggaaau

SEQ ID NO: 1424287 - RNA, 19 nt, Homo sapiens
agaagacgguguuaaagag

SEQ ID NO: 1424288 - RNA, 19 nt, Homo sapiens
gaaagcaggagagaaguca

SEQ ID NO: 1424289 - RNA, 19 nt, Homo sapiens
agaggacgaugauggagaa

SEQ ID NO: 1424290 - RNA, 19 nt, Homo sapiens
gaaggcugguguucagagu

SEQ ID NO: 1424291 - RNA, 19 nt, Homo sapiens
gccaggaggaggaagauaa

SEQ ID NO: 1424292 - RNA, 19 nt, Homo sapiens
gcgcagccauuuuggauuu

SEQ ID NO: 1424293 - RNA, 19 nt, Homo sapiens
cagagccguaucauaauua

SEQ ID NO: 1424294 - RNA, 19 nt, Homo sapiens
ccacaaggagaucaaguug

SEQ ID NO: 1424295 - RNA, 19 nt, Homo sapiens
gcuaugaaccaucagacaa

SEQ ID NO: 1424296 - RNA, 19 nt, Homo sapiens
ccacacaaccacccaaauc

SEQ ID NO: 1424297 - RNA, 19 nt, Homo sapiens
gaagacgaacgggaauuug

SEQ ID NO: 1424298 - RNA, 19 nt, Homo sapiens
cgaagacgaacgggaauuu

SEQ ID NO: 1424299 - RNA, 19 nt, Homo sapiens
ggacagacagacacagaca

SEQ ID NO: 1424300 - RNA, 19 nt, Homo sapiens
cauagaccuuccaucagaa

SEQ ID NO: 1424301 - RNA, 19 nt, Homo sapiens
aagcugagccaccaaagaa

SEQ ID NO: 1424302 - RNA, 19 nt, Homo sapiens
agaaggagcgggagaagga

SEQ ID NO: 1424303 - RNA, 19 nt, Homo sapiens
agacgaugaugaccuggaa

SEQ ID NO: 1424304 - RNA, 19 nt, Homo sapiens
ccaggaaggagaaaggaaa

SEQ ID NO: 1424305 - RNA, 19 nt, Homo sapiens
aaagucucaucaggaaaua

SEQ ID NO: 1424306 - RNA, 19 nt, Homo sapiens
acgguucucauguaaauua

SEQ ID NO: 1424307 - RNA, 19 nt, Homo sapiens
acacagacagcgcuaguga

SEQ ID NO: 1424308 - RNA, 19 nt, Homo sapiens
gaagcaggaagcgcuauga

SEQ ID NO: 1424309 - RNA, 19 nt, Homo sapiens
aaagaagccacacaggaaa

SEQ ID NO: 1424310 - RNA, 19 nt, Homo sapiens
aaagaaagaggacgaugau

SEQ ID NO: 1424311 - RNA, 19 nt, Homo sapiens
agacuacgaugaggagguu

SEQ ID NO: 1424312 - RNA, 19 nt, Homo sapiens
gaccagcacgguucucaug

SEQ ID NO: 1424313 - RNA, 19 nt, Homo sapiens
aagaagacgguguuaaaga

SEQ ID NO: 1424314 - RNA, 19 nt, Homo sapiens
uuacgcagacccuuauuau

SEQ ID NO: 1424315 - RNA, 19 nt, Homo sapiens
ucuauauucucgacuaaag

SEQ ID NO: 1424316 - RNA, 19 nt, Homo sapiens
gagcagaugaguggaagga

SEQ ID NO: 1424317 - RNA, 19 nt, Homo sapiens
gaccauuggcgaagacgaa

SEQ ID NO: 1424318 - RNA, 19 nt, Homo sapiens
gguaguugaugaaauuuug

SEQ ID NO: 1424319 - RNA, 19 nt, Homo sapiens
ugaacgggauccucacucu

SEQ ID NO: 1424320 - RNA, 19 nt, Homo sapiens
gaagccacacaggaaauga

SEQ ID NO: 1424321 - RNA, 19 nt, Homo sapiens
gaccggacuggacgcauuu

SEQ ID NO: 1424322 - RNA, 19 nt, Homo sapiens
aaguugacacuguugaaua

SEQ ID NO: 1424323 - RNA, 19 nt, Homo sapiens
agaaagaagacgguguuaa

SEQ ID NO: 1424324 - RNA, 19 nt, Homo sapiens
ggaaagcaggagagaaguc

SEQ ID NO: 1424325 - RNA, 19 nt, Homo sapiens
gggaaauagacgaugauga

SEQ ID NO: 1424326 - RNA, 19 nt, Homo sapiens
gaccggacaagcgaccuua

SEQ ID NO: 1424327 - RNA, 19 nt, Homo sapiens
gaaaagcggaaaagggauu

SEQ ID NO: 1424328 - RNA, 19 nt, Homo sapiens
caggagagaagucagugaa

SEQ ID NO: 1424329 - RNA, 19 nt, Homo sapiens
gaccuuccaucagaaccaa

SEQ ID NO: 1424330 - RNA, 19 nt, Homo sapiens
caagcugagccaccaaaga

SEQ ID NO: 1424331 - RNA, 19 nt, Homo sapiens
cagaaacagagccguauca

SEQ ID NO: 1424332 - RNA, 19 nt, Homo sapiens
gguuuacggugaccauugg

SEQ ID NO: 1424333 - RNA, 19 nt, Homo sapiens
gcaggagagaagucaguga

SEQ ID NO: 1424334 - RNA, 19 nt, Homo sapiens
guaucauaauuaccgagaa

SEQ ID NO: 1424335 - RNA, 19 nt, Homo sapiens
gggcaagugagccuaaauc

SEQ ID NO: 1424336 - RNA, 19 nt, Homo sapiens
ggaagcaggaagcgcuaug

SEQ ID NO: 1424337 - RNA, 19 nt, Homo sapiens
agcaugagcuagacuacga

SEQ ID NO: 1424338 - RNA, 19 nt, Homo sapiens
gaugaugaccuggaagaag

SEQ ID NO: 1424339 - RNA, 19 nt, Homo sapiens
caaguugacacuguugaau

SEQ ID NO: 1424340 - RNA, 19 nt, Homo sapiens
gguccgaucaggauuugga

SEQ ID NO: 1424341 - RNA, 19 nt, Homo sapiens
ggacucggaggacauguac

SEQ ID NO: 1424342 - RNA, 19 nt, Homo sapiens
uggaugagcaugagcuaga

SEQ ID NO: 1424343 - RNA, 19 nt, Homo sapiens
cuaugaaauugagcgguuu

SEQ ID NO: 1424344 - RNA, 19 nt, Homo sapiens
aagacgaacgggaauuuga

SEQ ID NO: 1424345 - RNA, 19 nt, Homo sapiens
ggccgguaguugaugaaau

SEQ ID NO: 1424346 - RNA, 19 nt, Homo sapiens
aaaagaagccacacaggaa

SEQ ID NO: 1424347 - RNA, 19 nt, Homo sapiens
gguaagcgcagccauuuug

SEQ ID NO: 1424348 - RNA, 19 nt, Homo sapiens
gagaaaggaaaaucuaaga

SEQ ID NO: 1424349 - RNA, 19 nt, Homo sapiens
gaagaccacuuucacauuc

SEQ ID NO: 1424350 - RNA, 19 nt, Homo sapiens
ggagaaggacuacgucuuu

SEQ ID NO: 1424351 - RNA, 19 nt, Homo sapiens
gcaaaucugugugacuauu

SEQ ID NO: 1424352 - RNA, 19 nt, Homo sapiens
gugaggaguuuauugauga

SEQ ID NO: 1424353 - RNA, 19 nt, Homo sapiens
gugcggagcuuccugaaau

SEQ ID NO: 1424354 - RNA, 19 nt, Homo sapiens
caccugagaucaugaaaga

SEQ ID NO: 1424355 - RNA, 19 nt, Homo sapiens
gcagcggccuggauuauuc

SEQ ID NO: 1424356 - RNA, 19 nt, Homo sapiens
gagaggcacuuuggaaaug

SEQ ID NO: 1424357 - RNA, 19 nt, Homo sapiens
cgaccaaucuuagggaauu

SEQ ID NO: 1424358 - RNA, 19 nt, Homo sapiens
gucaaggugucucuuuaua

SEQ ID NO: 1424359 - RNA, 19 nt, Homo sapiens
ggaagaccacuuucacauu

SEQ ID NO: 1424360 - RNA, 19 nt, Homo sapiens
ugaaaucagugcuggaaga

SEQ ID NO: 1424361 - RNA, 19 nt, Homo sapiens
ccaaugagaugcuguucug

SEQ ID NO: 1424362 - RNA, 19 nt, Homo sapiens
ggauuugaaugaucauguu

SEQ ID NO: 1424363 - RNA, 19 nt, Homo sapiens
cauaaacggaagcgaauua

SEQ ID NO: 1424364 - RNA, 19 nt, Homo sapiens
ggaagaacaagaaaggaaa

SEQ ID NO: 1424365 - RNA, 19 nt, Homo sapiens
gaaggccuuuauccaguuu

SEQ ID NO: 1424366 - RNA, 19 nt, Homo sapiens
gcagugccgugguguuaga

SEQ ID NO: 1424367 - RNA, 19 nt, Homo sapiens
ggaguuuauugaugaauuc

SEQ ID NO: 1424368 - RNA, 19 nt, Homo sapiens
ccaauugagugauuugcaa

SEQ ID NO: 1424369 - RNA, 19 nt, Homo sapiens
ccaaggaguuugucaaggu

SEQ ID NO: 1424370 - RNA, 19 nt, Homo sapiens
gagaaggacuacgucuuug

SEQ ID NO: 1424371 - RNA, 19 nt, Homo sapiens
caaaucugugugacuauua

SEQ ID NO: 1424372 - RNA, 19 nt, Homo sapiens
ggauaacaaugcccugaca

SEQ ID NO: 1424373 - RNA, 19 nt, Homo sapiens
cagaggacgaccaaucuua

SEQ ID NO: 1424374 - RNA, 19 nt, Homo sapiens
ggacaaaauuuaugaaguc

SEQ ID NO: 1424375 - RNA, 19 nt, Homo sapiens
gaugagaggcacuuuggaa

SEQ ID NO: 1424376 - RNA, 19 nt, Homo sapiens
cccagugguuugcaaauaa

SEQ ID NO: 1424377 - RNA, 19 nt, Homo sapiens
uggaagacgugaacgagaa

SEQ ID NO: 1424378 - RNA, 19 nt, Homo sapiens
guauuuagaucggguguca

SEQ ID NO: 1424379 - RNA, 19 nt, Homo sapiens
ccagucagaccucggauaa

SEQ ID NO: 1424380 - RNA, 19 nt, Homo sapiens
ccacagaccuucagauccu

SEQ ID NO: 1424381 - RNA, 19 nt, Homo sapiens
uauuagggcuuggucuuaa

SEQ ID NO: 1424382 - RNA, 19 nt, Homo sapiens
ggaaaacgcagcauacuug

SEQ ID NO: 1424383 - RNA, 19 nt, Homo sapiens
ugaaagcaacugucgguuu

SEQ ID NO: 1424384 - RNA, 19 nt, Homo sapiens
acgcaaaucugugugacua

SEQ ID NO: 1424385 - RNA, 19 nt, Homo sapiens
ggagagcacucggauugca

SEQ ID NO: 1424386 - RNA, 19 nt, Homo sapiens
acacagugccucugacuug

SEQ ID NO: 1424387 - RNA, 19 nt, Homo sapiens
caaggugucucuuuauacg

SEQ ID NO: 1424388 - RNA, 19 nt, Homo sapiens
uuacgagguugaaaggauu

SEQ ID NO: 1424389 - RNA, 19 nt, Homo sapiens
gacaagaggaagaacaaga

SEQ ID NO: 1424390 - RNA, 19 nt, Homo sapiens
ccucugacuuggagacuug

SEQ ID NO: 1424391 - RNA, 19 nt, Homo sapiens
gaaaaugggaguaucuuau

SEQ ID NO: 1424392 - RNA, 19 nt, Homo sapiens
ucagcuaccugcaggacaa

SEQ ID NO: 1424393 - RNA, 19 nt, Homo sapiens
ugaaggccuuuauccaguu

SEQ ID NO: 1424394 - RNA, 19 nt, Homo sapiens
gugcacaccuggccucagu

SEQ ID NO: 1424395 - RNA, 19 nt, Homo sapiens
uugcugaaaugcaccauga

SEQ ID NO: 1424396 - RNA, 19 nt, Homo sapiens
gcuuggauuugaaugauca

SEQ ID NO: 1424397 - RNA, 19 nt, Homo sapiens
ggacaagaggaucaaguca

SEQ ID NO: 1424398 - RNA, 19 nt, Homo sapiens
aaacccaauugagugauuu

SEQ ID NO: 1424399 - RNA, 19 nt, Homo sapiens
gcuccuccuugguuugauu

SEQ ID NO: 1424400 - RNA, 19 nt, Homo sapiens
caagaggaagaacaagaaa

SEQ ID NO: 1424401 - RNA, 19 nt, Homo sapiens
ccagugguuugcaaauaau

SEQ ID NO: 1424402 - RNA, 19 nt, Homo sapiens
gaccaaucuuagggaauuu

SEQ ID NO: 1424403 - RNA, 19 nt, Homo sapiens
ggaaaaugggaguaucuua

SEQ ID NO: 1424404 - RNA, 19 nt, Homo sapiens
guaggguuguguccauuuc

SEQ ID NO: 1424405 - RNA, 19 nt, Homo sapiens
aaggagagcacucggauug

SEQ ID NO: 1424406 - RNA, 19 nt, Homo sapiens
agucagaccucggauaaca

SEQ ID NO: 1424407 - RNA, 19 nt, Homo sapiens
caaauaaugccccugaaaa

SEQ ID NO: 1424408 - RNA, 19 nt, Homo sapiens
acaagaggaagaacaagaa

SEQ ID NO: 1424409 - RNA, 19 nt, Homo sapiens
gggaagaccacuuucacau

SEQ ID NO: 1424410 - RNA, 19 nt, Homo sapiens
uaucuuauccgauggaaag

SEQ ID NO: 1424411 - RNA, 19 nt, Homo sapiens
ugugaggaguuuauugaug

SEQ ID NO: 1424412 - RNA, 19 nt, Homo sapiens
gcacugugaggaguuuauu

SEQ ID NO: 1424413 - RNA, 19 nt, Homo sapiens
aggugucucuuuauacgua

SEQ ID NO: 1424414 - RNA, 19 nt, Homo sapiens
ggaaaccagagcacagugu

SEQ ID NO: 1424415 - RNA, 19 nt, Homo sapiens
gauacaguguccgccagaa

SEQ ID NO: 1424416 - RNA, 19 nt, Homo sapiens
ucaauggguugcacauguc

SEQ ID NO: 1424417 - RNA, 19 nt, Homo sapiens
uugucaaggugucucuuua

SEQ ID NO: 1424418 - RNA, 19 nt, Homo sapiens
cgagaaggaaugccucaug

SEQ ID NO: 1424419 - RNA, 19 nt, Homo sapiens
caucagggacuuugugaag

SEQ ID NO: 1424420 - RNA, 19 nt, Homo sapiens
ucucagaacgggauggaaa

SEQ ID NO: 1424421 - RNA, 19 nt, Homo sapiens
gguugcacauguccaagga

SEQ ID NO: 1424422 - RNA, 19 nt, Homo sapiens
gcaaauaaugccccugaaa

SEQ ID NO: 1424423 - RNA, 19 nt, Homo sapiens
gcccgucgguugagaaacu

SEQ ID NO: 1424424 - RNA, 19 nt, Homo sapiens
ggaaggggaagaccacuuu

SEQ ID NO: 1424425 - RNA, 19 nt, Homo sapiens
ccugacaccugagaucaug

SEQ ID NO: 1424426 - RNA, 19 nt, Homo sapiens
gggugaaugugacguggau

SEQ ID NO: 1424427 - RNA, 19 nt, Homo sapiens
gaacaagaaaggaaaaugg

SEQ ID NO: 1424428 - RNA, 19 nt, Homo sapiens
ugaggaguuuauugaugaa

SEQ ID NO: 1424429 - RNA, 19 nt, Homo sapiens
aggaaugccucaugcucaa

SEQ ID NO: 1424430 - RNA, 19 nt, Homo sapiens
acgcuacacuggcggagaa

SEQ ID NO: 1424431 - RNA, 19 nt, Homo sapiens
cuauuagggcuuggucuua

SEQ ID NO: 1424432 - RNA, 19 nt, Homo sapiens
gccuuuauccaguuuaaga

SEQ ID NO: 1424433 - RNA, 19 nt, Homo sapiens
cagaagccaucagggacuu

SEQ ID NO: 1424434 - RNA, 19 nt, Homo sapiens
ucagggaagcaguccagua

SEQ ID NO: 1424435 - RNA, 19 nt, Homo sapiens
cauguuggagagcaagaua

SEQ ID NO: 1424436 - RNA, 19 nt, Homo sapiens
gaaggaugagaggcacuuu

SEQ ID NO: 1424437 - RNA, 19 nt, Homo sapiens
caauugagugauuugcaaa

SEQ ID NO: 1424438 - RNA, 19 nt, Homo sapiens
gggaagcaguccaguaccu

SEQ ID NO: 1424439 - RNA, 19 nt, Homo sapiens
caagauaugggugaaugug

SEQ ID NO: 1424440 - RNA, 19 nt, Homo sapiens
gcaagauaugggugaaugu

SEQ ID NO: 1424441 - RNA, 19 nt, Homo sapiens
ugagaggcacuuuggaaau

SEQ ID NO: 1424442 - RNA, 19 nt, Homo sapiens
aaaucugugugacuauuag

SEQ ID NO: 1424443 - RNA, 19 nt, Homo sapiens
gaagaacaagaaaggaaaa

SEQ ID NO: 1424444 - RNA, 19 nt, Homo sapiens
gguugcuccuccuugguuu

SEQ ID NO: 1424445 - RNA, 19 nt, Homo sapiens
cugcagugccgugguguua

SEQ ID NO: 1424446 - RNA, 19 nt, Homo sapiens
gaaggacuacgucuuugac

SEQ ID NO: 1424447 - RNA, 19 nt, Homo sapiens
uagacaagaggaagaacaa

SEQ ID NO: 1424448 - RNA, 19 nt, Homo sapiens
ccaagcaccgcuguccuuu

SEQ ID NO: 1424449 - RNA, 19 nt, Homo sapiens
gaacgaauuccaaaccaaa

SEQ ID NO: 1424450 - RNA, 19 nt, Homo sapiens
gagaagaacgaauuccaaa

SEQ ID NO: 1424451 - RNA, 19 nt, Homo sapiens
ggacuuugcauguuagugu

SEQ ID NO: 1424452 - RNA, 19 nt, Homo sapiens
gaacauggacgagcucaag

SEQ ID NO: 1424453 - RNA, 19 nt, Homo sapiens
caaaagagaagaacgaauu

SEQ ID NO: 1424454 - RNA, 19 nt, Homo sapiens
gcacauggagugguucaga

SEQ ID NO: 1424455 - RNA, 19 nt, Homo sapiens
gcuguuccuugcagagaaa

SEQ ID NO: 1424456 - RNA, 19 nt, Homo sapiens
cagcuggacuuugcauguu

SEQ ID NO: 1424457 - RNA, 19 nt, Homo sapiens
ccauggaggcagagagaua

SEQ ID NO: 1424458 - RNA, 19 nt, Homo sapiens
gaagaacgaauuccaaacc

SEQ ID NO: 1424459 - RNA, 19 nt, Homo sapiens
ggaaacuccaggacucuuc

SEQ ID NO: 1424460 - RNA, 19 nt, Homo sapiens
agaaaaggauugugggaaa

SEQ ID NO: 1424461 - RNA, 19 nt, Homo sapiens
gcagcuggacuuugcaugu

SEQ ID NO: 1424462 - RNA, 19 nt, Homo sapiens
ggccgugucuguguauuuc

SEQ ID NO: 1424463 - RNA, 19 nt, Homo sapiens
ccacgcagccuuccuucga

SEQ ID NO: 1424464 - RNA, 19 nt, Homo sapiens
agaacgaauuccaaaccaa

SEQ ID NO: 1424465 - RNA, 19 nt, Homo sapiens
cuacgugugucgcucuuca

SEQ ID NO: 1424466 - RNA, 19 nt, Homo sapiens
gcggacagaacuucagaga

SEQ ID NO: 1424467 - RNA, 19 nt, Homo sapiens
caacaggccaccucagaac

SEQ ID NO: 1424468 - RNA, 19 nt, Homo sapiens
ccaacaggccaccucagaa

SEQ ID NO: 1424469 - RNA, 19 nt, Homo sapiens
gcguggccgugucugugua

SEQ ID NO: 1424470 - RNA, 19 nt, Homo sapiens
cauggaggcagagagauaa

SEQ ID NO: 1424471 - RNA, 19 nt, Homo sapiens
gcuggacuuugcauguuag

SEQ ID NO: 1424472 - RNA, 19 nt, Homo sapiens
ccgugucuguguauuucua

SEQ ID NO: 1424473 - RNA, 19 nt, Homo sapiens
agcuggacuuugcauguua

SEQ ID NO: 1424474 - RNA, 19 nt, Homo sapiens
agagaagaacgaauuccaa

SEQ ID NO: 1424475 - RNA, 19 nt, Homo sapiens
cacgcagccuuccuucgaa

SEQ ID NO: 1424476 - RNA, 19 nt, Homo sapiens
cugacgcucucaccauguu

SEQ ID NO: 1424477 - RNA, 19 nt, Homo sapiens
ggucaugaucaaccaguuc

SEQ ID NO: 1424478 - RNA, 19 nt, Homo sapiens
aagaacgaauuccaaacca

SEQ ID NO: 1424479 - RNA, 19 nt, Homo sapiens
gcucaagcaccaggucaug

SEQ ID NO: 1424480 - RNA, 19 nt, Homo sapiens
ucaagcaccaggucaugau

SEQ ID NO: 1424481 - RNA, 19 nt, Homo sapiens
uaacaaaagagaagaacga

SEQ ID NO: 1424482 - RNA, 19 nt, Homo sapiens
gaaaaggauugugggaaac

SEQ ID NO: 1424483 - RNA, 19 nt, Homo sapiens
gagcaucuauuaaauguga

SEQ ID NO: 1424484 - RNA, 19 nt, Homo sapiens
ggacauaacccacaacauc

SEQ ID NO: 1424485 - RNA, 19 nt, Homo sapiens
gaacauggcgcacugugaa

SEQ ID NO: 1424486 - RNA, 19 nt, Homo sapiens
gaucaaggcuaugaagaug

SEQ ID NO: 1424487 - RNA, 19 nt, Homo sapiens
gggaccagaucaacaauga

SEQ ID NO: 1424488 - RNA, 19 nt, Homo sapiens
cagagcaucuauuaaaugu

SEQ ID NO: 1424489 - RNA, 19 nt, Homo sapiens
gaacuaccgcgucaucaga

SEQ ID NO: 1424490 - RNA, 19 nt, Homo sapiens
uaccagagcaucuauuaaa

SEQ ID NO: 1424491 - RNA, 19 nt, Homo sapiens
ggacaucaaugacaaaauc

SEQ ID NO: 1424492 - RNA, 19 nt, Homo sapiens
gcacugcugcguguacuuu

SEQ ID NO: 1424493 - RNA, 19 nt, Homo sapiens
ugaaggacauaacccacaa

SEQ ID NO: 1424494 - RNA, 19 nt, Homo sapiens
gaagaucaaggcuaugaag

SEQ ID NO: 1424495 - RNA, 19 nt, Homo sapiens
cagcggcucucaacacaca

SEQ ID NO: 1424496 - RNA, 19 nt, Homo sapiens
gcaaguccacgauggugaa

SEQ ID NO: 1424497 - RNA, 19 nt, Homo sapiens
cccacaacauccacuauga

SEQ ID NO: 1424498 - RNA, 19 nt, Homo sapiens
uaaaugugagccuugcuuu

SEQ ID NO: 1424499 - RNA, 19 nt, Homo sapiens
ccagagcaucuauuaaaug

SEQ ID NO: 1424500 - RNA, 19 nt, Homo sapiens
guaccagagcaucuauuaa

SEQ ID NO: 1424501 - RNA, 19 nt, Homo sapiens
uguaccagagcaucuauua

SEQ ID NO: 1424502 - RNA, 19 nt, Homo sapiens
ccaugacgauucugaugau

SEQ ID NO: 1424503 - RNA, 19 nt, Homo sapiens
caacauccacuaugagaac

SEQ ID NO: 1424504 - RNA, 19 nt, Homo sapiens
gaauguggugcccgugauu

SEQ ID NO: 1424505 - RNA, 19 nt, Homo sapiens
gaccagaucaacaaugaca

SEQ ID NO: 1424506 - RNA, 19 nt, Homo sapiens
agaagggugugaagcugaa

SEQ ID NO: 1424507 - RNA, 19 nt, Homo sapiens
ucauugaaguggagaacau

SEQ ID NO: 1424508 - RNA, 19 nt, Homo sapiens
gaccaagagcaccugauga

SEQ ID NO: 1424509 - RNA, 19 nt, Homo sapiens
ccaaaguguggaagucaaa

SEQ ID NO: 1424510 - RNA, 19 nt, Homo sapiens
ugacgauucugaugaugag

SEQ ID NO: 1424511 - RNA, 19 nt, Homo sapiens
uggaccagcugaagaucaa

SEQ ID NO: 1424512 - RNA, 19 nt, Homo sapiens
gcucucaacacacaccuau

SEQ ID NO: 1424513 - RNA, 19 nt, Homo sapiens
uccaagaccugaaggacau

SEQ ID NO: 1424514 - RNA, 19 nt, Homo sapiens
acgaggacaucaaugacaa

SEQ ID NO: 1424515 - RNA, 19 nt, Homo sapiens
gaagaugggguuugaguuc

SEQ ID NO: 1424516 - RNA, 19 nt, Homo sapiens
caaugaaagccaccuacug

SEQ ID NO: 1424517 - RNA, 19 nt, Homo sapiens
cacaacauccacuaugaga

SEQ ID NO: 1424518 - RNA, 19 nt, Homo sapiens
gcaaguuacgggaccgaau

SEQ ID NO: 1424519 - RNA, 19 nt, Homo sapiens
caaguuacgggaccgaauc

SEQ ID NO: 1424520 - RNA, 19 nt, Homo sapiens
ugcauucacugacccaugu

SEQ ID NO: 1424521 - RNA, 19 nt, Homo sapiens
ucucaacacacaccuaugu

SEQ ID NO: 1424522 - RNA, 19 nt, Homo sapiens
cgauucugaugaugaguuc

SEQ ID NO: 1424523 - RNA, 19 nt, Homo sapiens
cauggcgcacugugaauuu

SEQ ID NO: 1424524 - RNA, 19 nt, Homo sapiens
ugaccaagagcaccugaug

SEQ ID NO: 1424525 - RNA, 19 nt, Homo sapiens
gacaaggcagcuccuggaa

SEQ ID NO: 1424526 - RNA, 19 nt, Homo sapiens
accagagcaucuauuaaau

SEQ ID NO: 1424527 - RNA, 19 nt, Homo sapiens
uaacccacaacauccacua

SEQ ID NO: 1424528 - RNA, 19 nt, Homo sapiens
gacgaggacaucaaugaca

SEQ ID NO: 1424529 - RNA, 19 nt, Homo sapiens
ggcgcaggauccagcagaa

SEQ ID NO: 1424530 - RNA, 19 nt, Homo sapiens
ugaauguggugcccgugau

SEQ ID NO: 1424531 - RNA, 19 nt, Homo sapiens
accaagagcaccugaugaa

SEQ ID NO: 1424532 - RNA, 19 nt, Homo sapiens
gguaggggcugaccaagag

SEQ ID NO: 1424533 - RNA, 19 nt, Homo sapiens
aauccucaacagcaaguua

SEQ ID NO: 1424534 - RNA, 19 nt, Homo sapiens
ccgacagccugaccaugga

SEQ ID NO: 1424535 - RNA, 19 nt, Homo sapiens
aaagcgggcugggcaaguc

SEQ ID NO: 1424536 - RNA, 19 nt, Homo sapiens
gcuacaucaacgagcaaua

SEQ ID NO: 1424537 - RNA, 19 nt, Homo sapiens
gcccaugacgauucugaug

SEQ ID NO: 1424538 - RNA, 19 nt, Homo sapiens
cccagcggcucucaacaca

SEQ ID NO: 1424539 - RNA, 19 nt, Homo sapiens
gagaacuaccgcgucauca

SEQ ID NO: 1424540 - RNA, 19 nt, Homo sapiens
cugaagaucaaggcuauga

SEQ ID NO: 1424541 - RNA, 19 nt, Homo sapiens
ugagaacuaccgcgucauc

SEQ ID NO: 1424542 - RNA, 19 nt, Homo sapiens
acaaaauccucaacagcaa

SEQ ID NO: 1424543 - RNA, 19 nt, Homo sapiens
cgaggacaucaaugacaaa

SEQ ID NO: 1424544 - RNA, 19 nt, Homo sapiens
gaaaucaugucuuggcaua

SEQ ID NO: 1424545 - RNA, 19 nt, Homo sapiens
gaauaacccugcauccaaa

SEQ ID NO: 1424546 - RNA, 19 nt, Homo sapiens
gggcagaaaucaugucuug

SEQ ID NO: 1424547 - RNA, 19 nt, Homo sapiens
guaaguuucucaccacgua

SEQ ID NO: 1424548 - RNA, 19 nt, Homo sapiens
agacagagacagagaaaua

SEQ ID NO: 1424549 - RNA, 19 nt, Homo sapiens
gagcauuucccuauaauau

SEQ ID NO: 1424550 - RNA, 19 nt, Homo sapiens
caagcacccuggagacuuu

SEQ ID NO: 1424551 - RNA, 19 nt, Homo sapiens
uaugagcauuucccuauaa

SEQ ID NO: 1424552 - RNA, 19 nt, Homo sapiens
aaaccgaucacuguuauua

SEQ ID NO: 1424553 - RNA, 19 nt, Homo sapiens
agacuuugcucccugguuu

SEQ ID NO: 1424554 - RNA, 19 nt, Homo sapiens
ugaaaccgaucacuguuau

SEQ ID NO: 1424555 - RNA, 19 nt, Homo sapiens
aaagugacaugcucugaga

SEQ ID NO: 1424556 - RNA, 19 nt, Homo sapiens
gacagagaaauaagcauua

SEQ ID NO: 1424557 - RNA, 19 nt, Homo sapiens
gaaacuuccuauuacuauc

SEQ ID NO: 1424558 - RNA, 19 nt, Homo sapiens
aaucaugucuuggcauauu

SEQ ID NO: 1424559 - RNA, 19 nt, Homo sapiens
cgcgggagcuucagcagua

SEQ ID NO: 1424560 - RNA, 19 nt, Homo sapiens
gcacuuagacacacacagu

SEQ ID NO: 1424561 - RNA, 19 nt, Homo sapiens
gggcagacuugggcagaaa

SEQ ID NO: 1424562 - RNA, 19 nt, Homo sapiens
caaugaaaccgaucacugu

SEQ ID NO: 1424563 - RNA, 19 nt, Homo sapiens
uauccuaaauggaaacuca

SEQ ID NO: 1424564 - RNA, 19 nt, Homo sapiens
gacagagacagagaaauaa

SEQ ID NO: 1424565 - RNA, 19 nt, Homo sapiens
gaugugcaguaaacacuca

SEQ ID NO: 1424566 - RNA, 19 nt, Homo sapiens
agaauaacccugcauccaa

SEQ ID NO: 1424567 - RNA, 19 nt, Homo sapiens
gcacgucaaacugcucuuu

SEQ ID NO: 1424568 - RNA, 19 nt, Homo sapiens
uugguuagcucacccauca

SEQ ID NO: 1424569 - RNA, 19 nt, Homo sapiens
cagaaggacuggaaaaugu

SEQ ID NO: 1424570 - RNA, 19 nt, Homo sapiens
agacagagaaauaagcauu

SEQ ID NO: 1424571 - RNA, 19 nt, Homo sapiens
gcccuuagcucugcucucu

SEQ ID NO: 1424572 - RNA, 19 nt, Homo sapiens
gaaccagacccgagauguc

SEQ ID NO: 1424573 - RNA, 19 nt, Homo sapiens
agaaaagucucuaaguuug

SEQ ID NO: 1424574 - RNA, 19 nt, Homo sapiens
gagaaauaagcauuagaga

SEQ ID NO: 1424575 - RNA, 19 nt, Homo sapiens
uuaugagcauuucccuaua

SEQ ID NO: 1424576 - RNA, 19 nt, Homo sapiens
ucucuuugauuuacucaga

SEQ ID NO: 1424577 - RNA, 19 nt, Homo sapiens
agacuucucuuugauuuac

SEQ ID NO: 1424578 - RNA, 19 nt, Homo sapiens
ugaggccgcugguagacuu

SEQ ID NO: 1424579 - RNA, 19 nt, Homo sapiens
ccagccacgucuccaaaug

SEQ ID NO: 1424580 - RNA, 19 nt, Homo sapiens
gggccugguuucagcuuug

SEQ ID NO: 1424581 - RNA, 19 nt, Homo sapiens
aaagagagagagacagaga

SEQ ID NO: 1424582 - RNA, 19 nt, Homo sapiens
ucaccaagcugagacuucu

SEQ ID NO: 1424583 - RNA, 19 nt, Homo sapiens
uagcugccuucccagaauu

SEQ ID NO: 1424584 - RNA, 19 nt, Homo sapiens
ggccuggagagaugacuua

SEQ ID NO: 1424585 - RNA, 19 nt, Homo sapiens
ucuguaggaugugcaguaa

SEQ ID NO: 1424586 - RNA, 19 nt, Homo sapiens
cuugugagcuccuuaucug

SEQ ID NO: 1424587 - RNA, 19 nt, Homo sapiens
gauguccacgucaaaguga

SEQ ID NO: 1424588 - RNA, 19 nt, Homo sapiens
ggaaaauguuguccugcaa

SEQ ID NO: 1424589 - RNA, 19 nt, Homo sapiens
acagagaaauaagcauuag

SEQ ID NO: 1424590 - RNA, 19 nt, Homo sapiens
gagagacagagacagagaa

SEQ ID NO: 1424591 - RNA, 19 nt, Homo sapiens
agagagagacagagacaga

SEQ ID NO: 1424592 - RNA, 19 nt, Homo sapiens
ggcagcacacacagaauaa

SEQ ID NO: 1424593 - RNA, 19 nt, Homo sapiens
uguaggaugugcaguaaac

SEQ ID NO: 1424594 - RNA, 19 nt, Homo sapiens
gccugaagccgcaguaugu

SEQ ID NO: 1424595 - RNA, 19 nt, Homo sapiens
gcgcugaucaucccguguu

SEQ ID NO: 1424596 - RNA, 19 nt, Homo sapiens
cuauuacuauccuaaaugg

SEQ ID NO: 1424597 - RNA, 19 nt, Homo sapiens
ccuuagcucugcucucuag

SEQ ID NO: 1424598 - RNA, 19 nt, Homo sapiens
aggcagcacacacagaaua

SEQ ID NO: 1424599 - RNA, 19 nt, Homo sapiens
ccacguagcgcugaucauc

SEQ ID NO: 1424600 - RNA, 19 nt, Homo sapiens
gaaaccgaucacuguuauu

SEQ ID NO: 1424601 - RNA, 19 nt, Homo sapiens
gcuggaagcacgucaaacu

SEQ ID NO: 1424602 - RNA, 19 nt, Homo sapiens
gccacacccugauaucaag

SEQ ID NO: 1424603 - RNA, 19 nt, Homo sapiens
uaaauggaaacucagaauc

SEQ ID NO: 1424604 - RNA, 19 nt, Homo sapiens
ugugagcuccuuaucugua

SEQ ID NO: 1424605 - RNA, 19 nt, Homo sapiens
gucaccaacucgaguguuc

SEQ ID NO: 1424606 - RNA, 19 nt, Homo sapiens
cauuagagaccugcaauca

SEQ ID NO: 1424607 - RNA, 19 nt, Homo sapiens
gaccugcaaucaccaagcu

SEQ ID NO: 1424608 - RNA, 19 nt, Homo sapiens
cgccggagcugagaaccaa

SEQ ID NO: 1424609 - RNA, 19 nt, Homo sapiens
cuaaauggaaacucagaau

SEQ ID NO: 1424610 - RNA, 19 nt, Homo sapiens
ccuuugagcagucuccuuu

SEQ ID NO: 1424611 - RNA, 19 nt, Homo sapiens
ucuaguggcuguccccaua

SEQ ID NO: 1424612 - RNA, 19 nt, Homo sapiens
gacagggacagcaccagaa

SEQ ID NO: 1424613 - RNA, 19 nt, Homo sapiens
gaccugacgggcacuuaga

SEQ ID NO: 1424614 - RNA, 19 nt, Homo sapiens
gugagcuccuuaucuguag

SEQ ID NO: 1424615 - RNA, 19 nt, Homo sapiens
gaaaauguuguccugcaaa

SEQ ID NO: 1424616 - RNA, 19 nt, Homo sapiens
gcugguagacuuuuguuaa

SEQ ID NO: 1424617 - RNA, 19 nt, Homo sapiens
gagauguccacgucaaagu

SEQ ID NO: 1424618 - RNA, 19 nt, Homo sapiens
gugcguugcugcagaccau

SEQ ID NO: 1424619 - RNA, 19 nt, Homo sapiens
gcaaaaggagguaaguuuc

SEQ ID NO: 1424620 - RNA, 19 nt, Homo sapiens
uuagcugccuucccagaau

SEQ ID NO: 1424621 - RNA, 19 nt, Homo sapiens
gagaggcagcacacacaga

SEQ ID NO: 1424622 - RNA, 19 nt, Homo sapiens
cuggagagaugacuuaucc

SEQ ID NO: 1424623 - RNA, 19 nt, Homo sapiens
gauaucaagacccucagau

SEQ ID NO: 1424624 - RNA, 19 nt, Homo sapiens
ggaccugacgggcacuuag

SEQ ID NO: 1424625 - RNA, 19 nt, Homo sapiens
ccuauuacuauccuaaaug

SEQ ID NO: 1424626 - RNA, 19 nt, Homo sapiens
uaacccugcauccaaauuc

SEQ ID NO: 1424627 - RNA, 19 nt, Homo sapiens
gacuugggcagaaaucaug

SEQ ID NO: 1424628 - RNA, 19 nt, Homo sapiens
gaagccugaagccgcagua

SEQ ID NO: 1424629 - RNA, 19 nt, Homo sapiens
aaaauguuguccugcaaaa

SEQ ID NO: 1424630 - RNA, 19 nt, Homo sapiens
agagacagagacagagaaa

SEQ ID NO: 1424631 - RNA, 19 nt, Homo sapiens
agaggcagcacacacagaa

SEQ ID NO: 1424632 - RNA, 19 nt, Homo sapiens
ggccugguuucagcuuuga

SEQ ID NO: 1424633 - RNA, 19 nt, Homo sapiens
agagaaauaagcauuagag

SEQ ID NO: 1424634 - RNA, 19 nt, Homo sapiens
uaaaagagagagagacaga

SEQ ID NO: 1424635 - RNA, 19 nt, Homo sapiens
augaaaccgaucacuguua

SEQ ID NO: 1424636 - RNA, 19 nt, Homo sapiens
gcagucuccuuuuacuuau

SEQ ID NO: 1424637 - RNA, 19 nt, Homo sapiens
gcccagccacgucuccaaa

SEQ ID NO: 1424638 - RNA, 19 nt, Homo sapiens
ugagcauuucccuauaaua

SEQ ID NO: 1424639 - RNA, 19 nt, Homo sapiens
uuacucagaaggacuggaa

SEQ ID NO: 1424640 - RNA, 19 nt, Homo sapiens
accgaucacuguuauuaca

SEQ ID NO: 1424641 - RNA, 19 nt, Homo sapiens
gcucgaaggggccauauga

SEQ ID NO: 1424642 - RNA, 19 nt, Homo sapiens
auuaugagcauuucccuau

SEQ ID NO: 1424643 - RNA, 19 nt, Homo sapiens
ugacgccacacccugauau

SEQ ID NO: 1424644 - RNA, 19 nt, Homo sapiens
ggaagauacugguuuauuu

SEQ ID NO: 1424645 - RNA, 19 nt, Homo sapiens
gacaauaaaugccaaauag

SEQ ID NO: 1424646 - RNA, 19 nt, Homo sapiens
gaagaaaccguggaagaua

SEQ ID NO: 1424647 - RNA, 19 nt, Homo sapiens
caacuuggaugaacaggaa

SEQ ID NO: 1424648 - RNA, 19 nt, Homo sapiens
gcugagauguugaacuuaa

SEQ ID NO: 1424649 - RNA, 19 nt, Homo sapiens
ccucagacaucacaaauau

SEQ ID NO: 1424650 - RNA, 19 nt, Homo sapiens
ugugagaugucgcauauuu

SEQ ID NO: 1424651 - RNA, 19 nt, Homo sapiens
ucaugucccugcuggauua

SEQ ID NO: 1424652 - RNA, 19 nt, Homo sapiens
gaugugguaugguguauuc

SEQ ID NO: 1424653 - RNA, 19 nt, Homo sapiens
gaagauacugguuuauuuc

SEQ ID NO: 1424654 - RNA, 19 nt, Homo sapiens
agacuuauguggacuccua

SEQ ID NO: 1424655 - RNA, 19 nt, Homo sapiens
cguggaagauacugguuua

SEQ ID NO: 1424656 - RNA, 19 nt, Homo sapiens
caaaugagcagaguauguu

SEQ ID NO: 1424657 - RNA, 19 nt, Homo sapiens
gaagcaacuuggaugaaca

SEQ ID NO: 1424658 - RNA, 19 nt, Homo sapiens
gagcagaguauguuguauu

SEQ ID NO: 1424659 - RNA, 19 nt, Homo sapiens
aaacaagucuuuuggcuuu

SEQ ID NO: 1424660 - RNA, 19 nt, Homo sapiens
gcacuggugucuucucucu

SEQ ID NO: 1424661 - RNA, 19 nt, Homo sapiens
gaacaugaaggacaacaca

SEQ ID NO: 1424662 - RNA, 19 nt, Homo sapiens
agcagaguauguuguauua

SEQ ID NO: 1424663 - RNA, 19 nt, Homo sapiens
ggacuccuauuguucucaa

SEQ ID NO: 1424664 - RNA, 19 nt, Homo sapiens
ggaagcaacuuggaugaac

SEQ ID NO: 1424665 - RNA, 19 nt, Homo sapiens
ggaguguaguguuuucuua

SEQ ID NO: 1424666 - RNA, 19 nt, Homo sapiens
ggugucuucucucuucuuu

SEQ ID NO: 1424667 - RNA, 19 nt, Homo sapiens
gcucgucccucauuucucu

SEQ ID NO: 1424668 - RNA, 19 nt, Homo sapiens
ucugugagaugucgcauau

SEQ ID NO: 1424669 - RNA, 19 nt, Homo sapiens
caacacaucucagccuuuu

SEQ ID NO: 1424670 - RNA, 19 nt, Homo sapiens
ucuauagcauacauccuua

SEQ ID NO: 1424671 - RNA, 19 nt, Homo sapiens
uauguggacuccuauuguu

SEQ ID NO: 1424672 - RNA, 19 nt, Homo sapiens
ugucuucucucuucuuuca

SEQ ID NO: 1424673 - RNA, 19 nt, Homo sapiens
uccuagaauugaagacuua

SEQ ID NO: 1424674 - RNA, 19 nt, Homo sapiens
gauuuuagcuacucuauag

SEQ ID NO: 1424675 - RNA, 19 nt, Homo sapiens
caauaaaugccaaauaggu

SEQ ID NO: 1424676 - RNA, 19 nt, Homo sapiens
agacaucacaaauauggua

SEQ ID NO: 1424677 - RNA, 19 nt, Homo sapiens
caagccaagucaacagugu

SEQ ID NO: 1424678 - RNA, 19 nt, Homo sapiens
caaauaugguagguucaug

SEQ ID NO: 1424679 - RNA, 19 nt, Homo sapiens
acaggaacaugaaggacaa

SEQ ID NO: 1424680 - RNA, 19 nt, Homo sapiens
gguagguucaugucuguaa

SEQ ID NO: 1424681 - RNA, 19 nt, Homo sapiens
gagaugugguaugguguau

SEQ ID NO: 1424682 - RNA, 19 nt, Homo sapiens
ggaugaacaggaacaugaa

SEQ ID NO: 1424683 - RNA, 19 nt, Homo sapiens
augcugagauguugaacuu

SEQ ID NO: 1424684 - RNA, 19 nt, Homo sapiens
ucaaaugagcagaguaugu

SEQ ID NO: 1424685 - RNA, 19 nt, Homo sapiens
ugaagaaaccguggaagau

SEQ ID NO: 1424686 - RNA, 19 nt, Homo sapiens
auuauggaguguaguguuu

SEQ ID NO: 1424687 - RNA, 19 nt, Homo sapiens
ggaauccuccaaaagaaua

SEQ ID NO: 1424688 - RNA, 19 nt, Homo sapiens
gggcgcucgucccucauuu

SEQ ID NO: 1424689 - RNA, 19 nt, Homo sapiens
uggaugaacaggaacauga

SEQ ID NO: 1424690 - RNA, 19 nt, Homo sapiens
gagcagcagggaaggaaau

SEQ ID NO: 1424691 - RNA, 19 nt, Homo sapiens
ucagacaucacaaauaugg

SEQ ID NO: 1424692 - RNA, 19 nt, Homo sapiens
aagaaaccguggaagauac

SEQ ID NO: 1424693 - RNA, 19 nt, Homo sapiens
ugaagcuccuagaauugaa

SEQ ID NO: 1424694 - RNA, 19 nt, Homo sapiens
aauuacugcuggaaucuug

SEQ ID NO: 1424695 - RNA, 19 nt, Homo sapiens
gggcaucgugggaccaauu

SEQ ID NO: 1424696 - RNA, 19 nt, Homo sapiens
ugaaggacaacacaucuca

SEQ ID NO: 1424697 - RNA, 19 nt, Homo sapiens
ggcaucgugggaccaauua

SEQ ID NO: 1424698 - RNA, 19 nt, Homo sapiens
ggugaaauaaagcaggaaa

SEQ ID NO: 1424699 - RNA, 19 nt, Homo sapiens
cuacuucccucugcuccuu

SEQ ID NO: 1424700 - RNA, 19 nt, Homo sapiens
gcagaguauguuguauuaa

SEQ ID NO: 1424701 - RNA, 19 nt, Homo sapiens
ggcauccuuugcacugaaa

SEQ ID NO: 1424702 - RNA, 19 nt, Homo sapiens
caaagggaagcaacuugga

SEQ ID NO: 1424703 - RNA, 19 nt, Homo sapiens
uggaagauacugguuuauu

SEQ ID NO: 1424704 - RNA, 19 nt, Homo sapiens
ucauuucucuguggugaau

SEQ ID NO: 1424705 - RNA, 19 nt, Homo sapiens
gggcacuggugucuucucu

SEQ ID NO: 1424706 - RNA, 19 nt, Homo sapiens
ccaaaagaauacauuaugg

SEQ ID NO: 1424707 - RNA, 19 nt, Homo sapiens
cugagauguugaacuuaaa

SEQ ID NO: 1424708 - RNA, 19 nt, Homo sapiens
gcacuggacagacauuuug

SEQ ID NO: 1424709 - RNA, 19 nt, Homo sapiens
uuucuuaguucuucaaagg

SEQ ID NO: 1424710 - RNA, 19 nt, Homo sapiens
ucuguaagcauccuguuga

SEQ ID NO: 1424711 - RNA, 19 nt, Homo sapiens
cuacaucuuagugacaaua

SEQ ID NO: 1424712 - RNA, 19 nt, Homo sapiens
ucccagagaugugguaugg

SEQ ID NO: 1424713 - RNA, 19 nt, Homo sapiens
acuggugucuucucucuuc

SEQ ID NO: 1424714 - RNA, 19 nt, Homo sapiens
gggaagcaacuuggaugaa

SEQ ID NO: 1424715 - RNA, 19 nt, Homo sapiens
ugugggcacuggugucuuc

SEQ ID NO: 1424716 - RNA, 19 nt, Homo sapiens
ccuuugcacugaaauuuac

SEQ ID NO: 1424717 - RNA, 19 nt, Homo sapiens
gcagggaaggaaaugauac

SEQ ID NO: 1424718 - RNA, 19 nt, Homo sapiens
guagguucaugucuguaag

SEQ ID NO: 1424719 - RNA, 19 nt, Homo sapiens
caucacaaauaugguaggu

SEQ ID NO: 1424720 - RNA, 19 nt, Homo sapiens
uggcauccuuugcacugaa

SEQ ID NO: 1424721 - RNA, 19 nt, Homo sapiens
ugaacaggaacaugaagga

SEQ ID NO: 1424722 - RNA, 19 nt, Homo sapiens
cagcagggaaggaaaugau

SEQ ID NO: 1424723 - RNA, 19 nt, Homo sapiens
agagaugugguauggugua

SEQ ID NO: 1424724 - RNA, 19 nt, Homo sapiens
uugaagaaaccguggaaga

SEQ ID NO: 1424725 - RNA, 19 nt, Homo sapiens
uuucaaaugagcagaguau

SEQ ID NO: 1424726 - RNA, 19 nt, Homo sapiens
gcagcagggaaggaaauga

SEQ ID NO: 1424727 - RNA, 19 nt, Homo sapiens
gaccaauuacugcuggaau

SEQ ID NO: 1424728 - RNA, 19 nt, Homo sapiens
ggaccaauuacugcuggaa

SEQ ID NO: 1424729 - RNA, 19 nt, Homo sapiens
ucuucucucuucuuucaug

SEQ ID NO: 1424730 - RNA, 19 nt, Homo sapiens
ucacgaaucugcuguaaua

SEQ ID NO: 1424731 - RNA, 19 nt, Homo sapiens
cgaaucugcuguaauauaa

SEQ ID NO: 1424732 - RNA, 19 nt, Homo sapiens
gcaacggccuuuacaaaug

SEQ ID NO: 1424733 - RNA, 19 nt, Homo sapiens
uaagaaagcucagccgaaa

SEQ ID NO: 1424734 - RNA, 19 nt, Homo sapiens
gcacagaggguuuggcuuu

SEQ ID NO: 1424735 - RNA, 19 nt, Homo sapiens
uggcagaccucaccagaua

SEQ ID NO: 1424736 - RNA, 19 nt, Homo sapiens
gcucagauauggaggcaaa

SEQ ID NO: 1424737 - RNA, 19 nt, Homo sapiens
ggagaaagucugugagauu

SEQ ID NO: 1424738 - RNA, 19 nt, Homo sapiens
cggcauagcuggaccuuug

SEQ ID NO: 1424739 - RNA, 19 nt, Homo sapiens
gagaaagucugugagauuc

SEQ ID NO: 1424740 - RNA, 19 nt, Homo sapiens
gaaauuagagaauguaugg

SEQ ID NO: 1424741 - RNA, 19 nt, Homo sapiens
gcaaugcugauguuugaua

SEQ ID NO: 1424742 - RNA, 19 nt, Homo sapiens
guucaaagcuaaccauagu

SEQ ID NO: 1424743 - RNA, 19 nt, Homo sapiens
uggaagauguaaagcaaua

SEQ ID NO: 1424744 - RNA, 19 nt, Homo sapiens
gacaacagcuuuuaaaugu

SEQ ID NO: 1424745 - RNA, 19 nt, Homo sapiens
guauauaacccaugauuuc

SEQ ID NO: 1424746 - RNA, 19 nt, Homo sapiens
gaucgaggguugacuacau

SEQ ID NO: 1424747 - RNA, 19 nt, Homo sapiens
caaugcugauguuugauaa

SEQ ID NO: 1424748 - RNA, 19 nt, Homo sapiens
gagaauguauggucaugag

SEQ ID NO: 1424749 - RNA, 19 nt, Homo sapiens
gaaagucugugagauucau

SEQ ID NO: 1424750 - RNA, 19 nt, Homo sapiens
caacggccuuuacaaaugg

SEQ ID NO: 1424751 - RNA, 19 nt, Homo sapiens
ugagagaucccacuacgaa

SEQ ID NO: 1424752 - RNA, 19 nt, Homo sapiens
gaagaugcaaugcugaugu

SEQ ID NO: 1424753 - RNA, 19 nt, Homo sapiens
cagauagccuuagagacua

SEQ ID NO: 1424754 - RNA, 19 nt, Homo sapiens
ggagaaauuagagaaugua

SEQ ID NO: 1424755 - RNA, 19 nt, Homo sapiens
ccagauagccuuagagacu

SEQ ID NO: 1424756 - RNA, 19 nt, Homo sapiens
caacaggcacagaggguuu

SEQ ID NO: 1424757 - RNA, 19 nt, Homo sapiens
guagucacauagcuuuaau

SEQ ID NO: 1424758 - RNA, 19 nt, Homo sapiens
gcaaguguagauaaaguau

SEQ ID NO: 1424759 - RNA, 19 nt, Homo sapiens
cagcaaguguagauaaagu

SEQ ID NO: 1424760 - RNA, 19 nt, Homo sapiens
cugaguggcccuuuguuua

SEQ ID NO: 1424761 - RNA, 19 nt, Homo sapiens
gaacacaguaguggaagau

SEQ ID NO: 1424762 - RNA, 19 nt, Homo sapiens
aaccagagauggcucacuu

SEQ ID NO: 1424763 - RNA, 19 nt, Homo sapiens
cggauuugcuccaagcuau

SEQ ID NO: 1424764 - RNA, 19 nt, Homo sapiens
augcaaugcugauguuuga

SEQ ID NO: 1424765 - RNA, 19 nt, Homo sapiens
caaagcuaaccauaguaua

SEQ ID NO: 1424766 - RNA, 19 nt, Homo sapiens
gguuuggcuuugucacuuu

SEQ ID NO: 1424767 - RNA, 19 nt, Homo sapiens
ucaaagcuaaccauaguau

SEQ ID NO: 1424768 - RNA, 19 nt, Homo sapiens
ccaguagucacauagcuuu

SEQ ID NO: 1424769 - RNA, 19 nt, Homo sapiens
ugaaucacauuugguagug

SEQ ID NO: 1424770 - RNA, 19 nt, Homo sapiens
agaaagcucagccgaaaga

SEQ ID NO: 1424771 - RNA, 19 nt, Homo sapiens
gcaagacugggcgaaguuu

SEQ ID NO: 1424772 - RNA, 19 nt, Homo sapiens
caacagcuuuuaaaugugu

SEQ ID NO: 1424773 - RNA, 19 nt, Homo sapiens
acgaaucugcuguaauaua

SEQ ID NO: 1424774 - RNA, 19 nt, Homo sapiens
augaagauguuguggagaa

SEQ ID NO: 1424775 - RNA, 19 nt, Homo sapiens
acacaguaguggaagaugu

SEQ ID NO: 1424776 - RNA, 19 nt, Homo sapiens
aagaugcaaugcugauguu

SEQ ID NO: 1424777 - RNA, 19 nt, Homo sapiens
gaugcaaugcugauguuug

SEQ ID NO: 1424778 - RNA, 19 nt, Homo sapiens
caagguggaagaugcaaug

SEQ ID NO: 1424779 - RNA, 19 nt, Homo sapiens
cgaacacaguaguggaaga

SEQ ID NO: 1424780 - RNA, 19 nt, Homo sapiens
cccagcaaguguagauaaa

SEQ ID NO: 1424781 - RNA, 19 nt, Homo sapiens
gcuaaccauaguauaauug

SEQ ID NO: 1424782 - RNA, 19 nt, Homo sapiens
ugaagauguuguggagaaa

SEQ ID NO: 1424783 - RNA, 19 nt, Homo sapiens
gcaauauuucgagcaguuu

SEQ ID NO: 1424784 - RNA, 19 nt, Homo sapiens
aguggaagauguaaagcaa

SEQ ID NO: 1424785 - RNA, 19 nt, Homo sapiens
ggucacaagaacaaagaaa

SEQ ID NO: 1424786 - RNA, 19 nt, Homo sapiens
ccaagauggucacaagaac

SEQ ID NO: 1424787 - RNA, 19 nt, Homo sapiens
uggagaaauuagagaaugu

SEQ ID NO: 1424788 - RNA, 19 nt, Homo sapiens
gacuacaucucaucaucuc

SEQ ID NO: 1424789 - RNA, 19 nt, Homo sapiens
gccgaaagaagucauguuc

SEQ ID NO: 1424790 - RNA, 19 nt, Homo sapiens
ggguuuggcuuugucacuu

SEQ ID NO: 1424791 - RNA, 19 nt, Homo sapiens
uuaguccaguagucacaua

SEQ ID NO: 1424792 - RNA, 19 nt, Homo sapiens
caucucaucaucucacgaa

SEQ ID NO: 1424793 - RNA, 19 nt, Homo sapiens
gcacgaccccgguaaaaug

SEQ ID NO: 1424794 - RNA, 19 nt, Homo sapiens
gcuguaauauaagacaaca

SEQ ID NO: 1424795 - RNA, 19 nt, Homo sapiens
ucucacgaaucugcuguaa

SEQ ID NO: 1424796 - RNA, 19 nt, Homo sapiens
caagcuauggcuaucaguu

SEQ ID NO: 1424797 - RNA, 19 nt, Homo sapiens
gcuccaagcuauggcuauc

SEQ ID NO: 1424798 - RNA, 19 nt, Homo sapiens
ccaacuucguggcgaccua

SEQ ID NO: 1424799 - RNA, 19 nt, Homo sapiens
gagagaucccacuacgaaa

SEQ ID NO: 1424800 - RNA, 19 nt, Homo sapiens
cacaguaguggaagaugua

SEQ ID NO: 1424801 - RNA, 19 nt, Homo sapiens
uagagaauguauggucaug

SEQ ID NO: 1424802 - RNA, 19 nt, Homo sapiens
gaggguugacuacaucuca

SEQ ID NO: 1424803 - RNA, 19 nt, Homo sapiens
gcuggaccuuugauugcaa

SEQ ID NO: 1424804 - RNA, 19 nt, Homo sapiens
agcaauauuucgagcaguu

SEQ ID NO: 1424805 - RNA, 19 nt, Homo sapiens
caagauggucacaagaaca

SEQ ID NO: 1424806 - RNA, 19 nt, Homo sapiens
gagcgcaacccaagauggu

SEQ ID NO: 1424807 - RNA, 19 nt, Homo sapiens
guguauauaacccaugauu

SEQ ID NO: 1424808 - RNA, 19 nt, Homo sapiens
ugaguggcccuuuguuuag

SEQ ID NO: 1424809 - RNA, 19 nt, Homo sapiens
aauguauggucaugagaga

SEQ ID NO: 1424810 - RNA, 19 nt, Homo sapiens
uugcaacggccuuuacaaa

SEQ ID NO: 1424811 - RNA, 19 nt, Homo sapiens
cacagaggguuuggcuuug

SEQ ID NO: 1424812 - RNA, 19 nt, Homo sapiens
caccagauagccuuagaga

SEQ ID NO: 1424813 - RNA, 19 nt, Homo sapiens
ggaagaugcaaugcugaug

SEQ ID NO: 1424814 - RNA, 19 nt, Homo sapiens
gguagaauguaagaaagcu

SEQ ID NO: 1424815 - RNA, 19 nt, Homo sapiens
ucugugagauucauuucca

SEQ ID NO: 1424816 - RNA, 19 nt, Homo sapiens
guggagaaagucugugaga

SEQ ID NO: 1424817 - RNA, 19 nt, Homo sapiens
cggguuaucugcgaacaca

SEQ ID NO: 1424818 - RNA, 19 nt, Homo sapiens
cccaagauggucacaagaa

SEQ ID NO: 1424819 - RNA, 19 nt, Homo sapiens
ugauuucgguuuuguuuug

SEQ ID NO: 1424820 - RNA, 19 nt, Homo sapiens
gcagacccagcaaguguag

SEQ ID NO: 1424821 - RNA, 19 nt, Homo sapiens
cucaucaucucacgaaucu

SEQ ID NO: 1424822 - RNA, 19 nt, Homo sapiens
ggcaagacugggcgaaguu

SEQ ID NO: 1424823 - RNA, 19 nt, Homo sapiens
uuggagaaauuagagaaug

SEQ ID NO: 1424824 - RNA, 19 nt, Homo sapiens
acagaggguuuggcuuugu

SEQ ID NO: 1424825 - RNA, 19 nt, Homo sapiens
ggaagauguaaagcaauau

SEQ ID NO: 1424826 - RNA, 19 nt, Homo sapiens
ucucuucccauucuccuuu

SEQ ID NO: 1424827 - RNA, 19 nt, Homo sapiens
aagcucagccgaaagaagu

SEQ ID NO: 1424828 - RNA, 19 nt, Homo sapiens
gauguaaagcaauauuucg

SEQ ID NO: 1424829 - RNA, 19 nt, Homo sapiens
uagauuccaagacgauuga

SEQ ID NO: 1424830 - RNA, 19 nt, Homo sapiens
gagggaaacuucucacaaa

SEQ ID NO: 1424831 - RNA, 19 nt, Homo sapiens
uaagaaagcucagccgaaa

SEQ ID NO: 1424832 - RNA, 19 nt, Homo sapiens
gcacagaggguuuggcuuu

SEQ ID NO: 1424833 - RNA, 19 nt, Homo sapiens
uggcagaccucaccagaua

SEQ ID NO: 1424834 - RNA, 19 nt, Homo sapiens
ggaaacuucucacaaacuu

SEQ ID NO: 1424835 - RNA, 19 nt, Homo sapiens
ggagaaagucugugagauu

SEQ ID NO: 1424836 - RNA, 19 nt, Homo sapiens
gagaaagucugugagauuc

SEQ ID NO: 1424837 - RNA, 19 nt, Homo sapiens
gcucacuucuguuauguuu

SEQ ID NO: 1424838 - RNA, 19 nt, Homo sapiens
gaaauuagagaauguaugg

SEQ ID NO: 1424839 - RNA, 19 nt, Homo sapiens
gcaaugcugauguuugaua

SEQ ID NO: 1424840 - RNA, 19 nt, Homo sapiens
ggagcuauauaaacacuau

SEQ ID NO: 1424841 - RNA, 19 nt, Homo sapiens
ggaagaggagcuauauaaa

SEQ ID NO: 1424842 - RNA, 19 nt, Homo sapiens
uggaagauguaaagcaaua

SEQ ID NO: 1424843 - RNA, 19 nt, Homo sapiens
gacagacuauucucuaaga

SEQ ID NO: 1424844 - RNA, 19 nt, Homo sapiens
ggacagugauaaaggugaa

SEQ ID NO: 1424845 - RNA, 19 nt, Homo sapiens
ugacaucggugcucacuuc

SEQ ID NO: 1424846 - RNA, 19 nt, Homo sapiens
ucacugaaagucugucuua

SEQ ID NO: 1424847 - RNA, 19 nt, Homo sapiens
cauuaaagaugcuugaugu

SEQ ID NO: 1424848 - RNA, 19 nt, Homo sapiens
ugucuuagcugccuguuug

SEQ ID NO: 1424849 - RNA, 19 nt, Homo sapiens
gaaauacacccacucucuu

SEQ ID NO: 1424850 - RNA, 19 nt, Homo sapiens
aagaggagcuauauaaaca

SEQ ID NO: 1424851 - RNA, 19 nt, Homo sapiens
ccacuuugcuucuuguaug

SEQ ID NO: 1424852 - RNA, 19 nt, Homo sapiens
caguuuggcucaucucauu

SEQ ID NO: 1424853 - RNA, 19 nt, Homo sapiens
gcuaucaguucccagacua

SEQ ID NO: 1424854 - RNA, 19 nt, Homo sapiens
uggaagaggagcuauauaa

SEQ ID NO: 1424855 - RNA, 19 nt, Homo sapiens
ugauaaaggugaacacaca

SEQ ID NO: 1424856 - RNA, 19 nt, Homo sapiens
caaugcugauguuugauaa

SEQ ID NO: 1424857 - RNA, 19 nt, Homo sapiens
uggcucaucucauuaaaga

SEQ ID NO: 1424858 - RNA, 19 nt, Homo sapiens
gaagaggagcuauauaaac

SEQ ID NO: 1424859 - RNA, 19 nt, Homo sapiens
gagaauguauggucaugag

SEQ ID NO: 1424860 - RNA, 19 nt, Homo sapiens
gugagugaauccauacauu

SEQ ID NO: 1424861 - RNA, 19 nt, Homo sapiens
cacccacucucuuggaaua

SEQ ID NO: 1424862 - RNA, 19 nt, Homo sapiens
ucacaagccugucugucuu

SEQ ID NO: 1424863 - RNA, 19 nt, Homo sapiens
gcuaugaauugcuuugcuu

SEQ ID NO: 1424864 - RNA, 19 nt, Homo sapiens
ccucaagagucacugcuuu

SEQ ID NO: 1424865 - RNA, 19 nt, Homo sapiens
gaaagucugugagauucau

SEQ ID NO: 1424866 - RNA, 19 nt, Homo sapiens
ugagagaucccacuacgaa

SEQ ID NO: 1424867 - RNA, 19 nt, Homo sapiens
uggcuugacuuccuucauu

SEQ ID NO: 1424868 - RNA, 19 nt, Homo sapiens
gaagaugcaaugcugaugu

SEQ ID NO: 1424869 - RNA, 19 nt, Homo sapiens
gacccuacaugugcaguuu

SEQ ID NO: 1424870 - RNA, 19 nt, Homo sapiens
acacagagacagacuauuc

SEQ ID NO: 1424871 - RNA, 19 nt, Homo sapiens
cagauagccuuagagacua

SEQ ID NO: 1424872 - RNA, 19 nt, Homo sapiens
gugaauccauacauuugaa

SEQ ID NO: 1424873 - RNA, 19 nt, Homo sapiens
ggagaaauuagagaaugua

SEQ ID NO: 1424874 - RNA, 19 nt, Homo sapiens
ugaugugagugaauccaua

SEQ ID NO: 1424875 - RNA, 19 nt, Homo sapiens
caucggugcucacuucugu

SEQ ID NO: 1424876 - RNA, 19 nt, Homo sapiens
ccagauagccuuagagacu

SEQ ID NO: 1424877 - RNA, 19 nt, Homo sapiens
gagugaauccauacauuug

SEQ ID NO: 1424878 - RNA, 19 nt, Homo sapiens
gagcacccgugucuuacga

SEQ ID NO: 1424879 - RNA, 19 nt, Homo sapiens
caacaggcacagaggguuu

SEQ ID NO: 1424880 - RNA, 19 nt, Homo sapiens
gauggacagugauaaaggu

SEQ ID NO: 1424881 - RNA, 19 nt, Homo sapiens
gcaaguguagauaaaguau

SEQ ID NO: 1424882 - RNA, 19 nt, Homo sapiens
cagcaaguguagauaaagu

SEQ ID NO: 1424883 - RNA, 19 nt, Homo sapiens
guaagcaaccgagguagaa

SEQ ID NO: 1424884 - RNA, 19 nt, Homo sapiens
ugagugaauccauacauuu

SEQ ID NO: 1424885 - RNA, 19 nt, Homo sapiens
gcugguaguuugugagaag

SEQ ID NO: 1424886 - RNA, 19 nt, Homo sapiens
ggugcucacuucuguuaug

SEQ ID NO: 1424887 - RNA, 19 nt, Homo sapiens
cuucaucucuguaaauagu

SEQ ID NO: 1424888 - RNA, 19 nt, Homo sapiens
gaacacaguaguggaagau

SEQ ID NO: 1424889 - RNA, 19 nt, Homo sapiens
cggauuugcuccaagcuau

SEQ ID NO: 1424890 - RNA, 19 nt, Homo sapiens
augcaaugcugauguuuga

SEQ ID NO: 1424891 - RNA, 19 nt, Homo sapiens
ggcuugacuuccuucauuu

SEQ ID NO: 1424892 - RNA, 19 nt, Homo sapiens
gguuuggcuuugucacuuu

SEQ ID NO: 1424893 - RNA, 19 nt, Homo sapiens
guuggacccucaagaguca

SEQ ID NO: 1424894 - RNA, 19 nt, Homo sapiens
cuaggaagaagacaucaaa

SEQ ID NO: 1424895 - RNA, 19 nt, Homo sapiens
cuucuuguaugcauuguga

SEQ ID NO: 1424896 - RNA, 19 nt, Homo sapiens
agaaagcucagccgaaaga

SEQ ID NO: 1424897 - RNA, 19 nt, Homo sapiens
uaagagaggcauagcaaag

SEQ ID NO: 1424898 - RNA, 19 nt, Homo sapiens
ugucugugcugguaguuug

SEQ ID NO: 1424899 - RNA, 19 nt, Homo sapiens
ugaaauacacccacucucu

SEQ ID NO: 1424900 - RNA, 19 nt, Homo sapiens
augaagauguuguggagaa

SEQ ID NO: 1424901 - RNA, 19 nt, Homo sapiens
acacaguaguggaagaugu

SEQ ID NO: 1424902 - RNA, 19 nt, Homo sapiens
caaagaacaaaucuguaug

SEQ ID NO: 1424903 - RNA, 19 nt, Homo sapiens
gguaguuugugagaaguga

SEQ ID NO: 1424904 - RNA, 19 nt, Homo sapiens
gaggagcuauauaaacacu

SEQ ID NO: 1424905 - RNA, 19 nt, Homo sapiens
gcuaccauuucuagagaga

SEQ ID NO: 1424906 - RNA, 19 nt, Homo sapiens
aagaugcaaugcugauguu

SEQ ID NO: 1424907 - RNA, 19 nt, Homo sapiens
cuaguaugcuugccucaca

SEQ ID NO: 1424908 - RNA, 19 nt, Homo sapiens
gaugcaaugcugauguuug

SEQ ID NO: 1424909 - RNA, 19 nt, Homo sapiens
caagguggaagaugcaaug

SEQ ID NO: 1424910 - RNA, 19 nt, Homo sapiens
cgaacacaguaguggaaga

SEQ ID NO: 1424911 - RNA, 19 nt, Homo sapiens
cccagcaaguguagauaaa

SEQ ID NO: 1424912 - RNA, 19 nt, Homo sapiens
uaucaacuagcucuuaaga

SEQ ID NO: 1424913 - RNA, 19 nt, Homo sapiens
ugaagauguuguggagaaa

SEQ ID NO: 1424914 - RNA, 19 nt, Homo sapiens
gcaauauuucgagcaguuu

SEQ ID NO: 1424915 - RNA, 19 nt, Homo sapiens
aguggaagauguaaagcaa

SEQ ID NO: 1424916 - RNA, 19 nt, Homo sapiens
ggucacaagaacaaagaaa

SEQ ID NO: 1424917 - RNA, 19 nt, Homo sapiens
ccaagauggucacaagaac

SEQ ID NO: 1424918 - RNA, 19 nt, Homo sapiens
caaaauggccgaucugaca

SEQ ID NO: 1424919 - RNA, 19 nt, Homo sapiens
gcuuccauuugaugcauuu

SEQ ID NO: 1424920 - RNA, 19 nt, Homo sapiens
aagagucacugcuuugucu

SEQ ID NO: 1424921 - RNA, 19 nt, Homo sapiens
aacacuaucugacuaucuu

SEQ ID NO: 1424922 - RNA, 19 nt, Homo sapiens
ccacuuccucagaauguaa

SEQ ID NO: 1424923 - RNA, 19 nt, Homo sapiens
gaacuuguccuaguaugcu

SEQ ID NO: 1424924 - RNA, 19 nt, Homo sapiens
uggugaacuuguccuagua

SEQ ID NO: 1424925 - RNA, 19 nt, Homo sapiens
uggagaaauuagagaaugu

SEQ ID NO: 1424926 - RNA, 19 nt, Homo sapiens
ccacucucuuggaauaaug

SEQ ID NO: 1424927 - RNA, 19 nt, Homo sapiens
gcuguuggcauaaucacaa

SEQ ID NO: 1424928 - RNA, 19 nt, Homo sapiens
uuagcugccuguuugaaug

SEQ ID NO: 1424929 - RNA, 19 nt, Homo sapiens
agucaaugcucacugaaag

SEQ ID NO: 1424930 - RNA, 19 nt, Homo sapiens
ggucugggcucggagauua

SEQ ID NO: 1424931 - RNA, 19 nt, Homo sapiens
ccagaaaguuccagaagca

SEQ ID NO: 1424932 - RNA, 19 nt, Homo sapiens
gcaccugcaucgccuucua

SEQ ID NO: 1424933 - RNA, 19 nt, Homo sapiens
accaugagcuccauauuug

SEQ ID NO: 1424934 - RNA, 19 nt, Homo sapiens
gaagagaacaaaccuccau

SEQ ID NO: 1424935 - RNA, 19 nt, Homo sapiens
acaagguggugguagauga

SEQ ID NO: 1424936 - RNA, 19 nt, Homo sapiens
ccauggcccuccucuucua

SEQ ID NO: 1424937 - RNA, 19 nt, Homo sapiens
gcgcugaucuacaagaaaa

SEQ ID NO: 1424938 - RNA, 19 nt, Homo sapiens
cgugugggcuucaugaugu

SEQ ID NO: 1424939 - RNA, 19 nt, Homo sapiens
gaaaguuccagaagcagau

SEQ ID NO: 1424940 - RNA, 19 nt, Homo sapiens
ggaugagccgucagugaaa

SEQ ID NO: 1424941 - RNA, 19 nt, Homo sapiens
uaaaacaccugcggcauug

SEQ ID NO: 1424942 - RNA, 19 nt, Homo sapiens
ggaggaggcgggugaucuu

SEQ ID NO: 1424943 - RNA, 19 nt, Homo sapiens
acaagaaaauccacaagaa

SEQ ID NO: 1424944 - RNA, 19 nt, Homo sapiens
gagaggugccagaagagaa

SEQ ID NO: 1424945 - RNA, 19 nt, Homo sapiens
cgacucagaaagagagaaa

SEQ ID NO: 1424946 - RNA, 19 nt, Homo sapiens
agccgaagcugccgaagga

SEQ ID NO: 1424947 - RNA, 19 nt, Homo sapiens
aaccaugagcuccauauuu

SEQ ID NO: 1424948 - RNA, 19 nt, Homo sapiens
cagaaagagagaaacaaga

SEQ ID NO: 1424949 - RNA, 19 nt, Homo sapiens
uggaugagccgucagugaa

SEQ ID NO: 1424950 - RNA, 19 nt, Homo sapiens
gaagauccccagaaaguuc

SEQ ID NO: 1424951 - RNA, 19 nt, Homo sapiens
agaaagagagaaacaagag

SEQ ID NO: 1424952 - RNA, 19 nt, Homo sapiens
accgagaggugccagaaga

SEQ ID NO: 1424953 - RNA, 19 nt, Homo sapiens
caagguggugguagaugaa

SEQ ID NO: 1424954 - RNA, 19 nt, Homo sapiens
cccuagaccucucacuaug

SEQ ID NO: 1424955 - RNA, 19 nt, Homo sapiens
ggagaggccgaggguuuga

SEQ ID NO: 1424956 - RNA, 19 nt, Homo sapiens
cggcgcugaucuacaagaa

SEQ ID NO: 1424957 - RNA, 19 nt, Homo sapiens
uacccucucugugguguuu

SEQ ID NO: 1424958 - RNA, 19 nt, Homo sapiens
uaaagcacuuacccucucu

SEQ ID NO: 1424959 - RNA, 19 nt, Homo sapiens
auauuugcuuccucccuua

SEQ ID NO: 1424960 - RNA, 19 nt, Homo sapiens
gagaacaaaccuccaucca

SEQ ID NO: 1424961 - RNA, 19 nt, Homo sapiens
caucgugaacagcaucgua

SEQ ID NO: 1424962 - RNA, 19 nt, Homo sapiens
gggcgcugcucuuggucuu

SEQ ID NO: 1424963 - RNA, 19 nt, Homo sapiens
cccaggcagugcugucuga

SEQ ID NO: 1424964 - RNA, 19 nt, Homo sapiens
ucagaaagagagaaacaag

SEQ ID NO: 1424965 - RNA, 19 nt, Homo sapiens
acgacaagguggugguaga

SEQ ID NO: 1424966 - RNA, 19 nt, Homo sapiens
ccacgagccuccuguuccu

SEQ ID NO: 1424967 - RNA, 19 nt, Homo sapiens
caugguugguggcauccuu

SEQ ID NO: 1424968 - RNA, 19 nt, Homo sapiens
gcauguucuuggugaaguc

SEQ ID NO: 1424969 - RNA, 19 nt, Homo sapiens
gcgcugcucuuggucuucu

SEQ ID NO: 1424970 - RNA, 19 nt, Homo sapiens
ccuagaccucucacuauga

SEQ ID NO: 1424971 - RNA, 19 nt, Homo sapiens
gaugagccgucagugaaaa

SEQ ID NO: 1424972 - RNA, 19 nt, Homo sapiens
cuagaccucucacuaugac

SEQ ID NO: 1424973 - RNA, 19 nt, Homo sapiens
ggaggaggcacagcucgau

SEQ ID NO: 1424974 - RNA, 19 nt, Homo sapiens
ggccgaggguuugaugaag

SEQ ID NO: 1424975 - RNA, 19 nt, Homo sapiens
aaaccaugagcuccauauu

SEQ ID NO: 1424976 - RNA, 19 nt, Homo sapiens
ggagcaggcccagaucaag

SEQ ID NO: 1424977 - RNA, 19 nt, Homo sapiens
uuggagaggccgaggguuu

SEQ ID NO: 1424978 - RNA, 19 nt, Homo sapiens
cgggaaggcaggcaagaug

SEQ ID NO: 1424979 - RNA, 19 nt, Homo sapiens
caccugcggcauugucaaa

SEQ ID NO: 1424980 - RNA, 19 nt, Homo sapiens
ggcgggugaucuuccugaa

SEQ ID NO: 1424981 - RNA, 19 nt, Homo sapiens
ggaggcgggugaucuuccu

SEQ ID NO: 1424982 - RNA, 19 nt, Homo sapiens
caagcacggccucuucagu

SEQ ID NO: 1424983 - RNA, 19 nt, Homo sapiens
gcaguuuccuuucuuauaa

SEQ ID NO: 1424984 - RNA, 19 nt, Homo sapiens
gaacgaggccugucucuuc

SEQ ID NO: 1424985 - RNA, 19 nt, Homo sapiens
gccaauggauacaaagaua

SEQ ID NO: 1424986 - RNA, 19 nt, Homo sapiens
gaaaacaccugguucaguu

SEQ ID NO: 1424987 - RNA, 19 nt, Homo sapiens
cauccgaccucguuucuuu

SEQ ID NO: 1424988 - RNA, 19 nt, Homo sapiens
gaacuuccuuccucacuca

SEQ ID NO: 1424989 - RNA, 19 nt, Homo sapiens
ucacucagcuucccacguu

SEQ ID NO: 1424990 - RNA, 19 nt, Homo sapiens
ggaaggugauccugacguu

SEQ ID NO: 1424991 - RNA, 19 nt, Homo sapiens
gcacaucuguugguucuca

SEQ ID NO: 1424992 - RNA, 19 nt, Homo sapiens
gaagggacguuuccaucau

SEQ ID NO: 1424993 - RNA, 19 nt, Homo sapiens
cagaaauccucaugccuuu

SEQ ID NO: 1424994 - RNA, 19 nt, Homo sapiens
caccaaaucuuaucacaca

SEQ ID NO: 1424995 - RNA, 19 nt, Homo sapiens
gcaaagauacugcuagagu

SEQ ID NO: 1424996 - RNA, 19 nt, Homo sapiens
gaaugaaaguaagcaaaga

SEQ ID NO: 1424997 - RNA, 19 nt, Homo sapiens
gaaggcaucgaguucauuu

SEQ ID NO: 1424998 - RNA, 19 nt, Homo sapiens
ggagcuauccgaccugauu

SEQ ID NO: 1424999 - RNA, 19 nt, Homo sapiens
ggucugaacugcuuuccau

SEQ ID NO: 1425000 - RNA, 19 nt, Homo sapiens
cccuagagcuccuaccaua

SEQ ID NO: 1425001 - RNA, 19 nt, Homo sapiens
ggaagugaacgcugaaugu

SEQ ID NO: 1425002 - RNA, 19 nt, Homo sapiens
ucgcagaccuggacacaga

SEQ ID NO: 1425003 - RNA, 19 nt, Homo sapiens
gacuguggcugaauugaga

SEQ ID NO: 1425004 - RNA, 19 nt, Homo sapiens
ucuaggaacugucagaaau

SEQ ID NO: 1425005 - RNA, 19 nt, Homo sapiens
ccgaauggcuggcagugaa

SEQ ID NO: 1425006 - RNA, 19 nt, Homo sapiens
ggagugcacuuuuguuuug

SEQ ID NO: 1425007 - RNA, 19 nt, Homo sapiens
ggaauggaaugagucuaug

SEQ ID NO: 1425008 - RNA, 19 nt, Homo sapiens
agaacuggguguccaacua

SEQ ID NO: 1425009 - RNA, 19 nt, Homo sapiens
gaguaagaauggccacaga

SEQ ID NO: 1425010 - RNA, 19 nt, Homo sapiens
ggagaggcauggagcuauc

SEQ ID NO: 1425011 - RNA, 19 nt, Homo sapiens
agaccuugcugauguauuc

SEQ ID NO: 1425012 - RNA, 19 nt, Homo sapiens
gcaaggccaucaggacuca

SEQ ID NO: 1425013 - RNA, 19 nt, Homo sapiens
ugaagcaagucucacaugu

SEQ ID NO: 1425014 - RNA, 19 nt, Homo sapiens
gccacagaguagugaaaua

SEQ ID NO: 1425015 - RNA, 19 nt, Homo sapiens
uaagaauggccacagagua

SEQ ID NO: 1425016 - RNA, 19 nt, Homo sapiens
aaaguggaaucaccaaauc

SEQ ID NO: 1425017 - RNA, 19 nt, Homo sapiens
gaauugagaccuugcugau

SEQ ID NO: 1425018 - RNA, 19 nt, Homo sapiens
caucaggacucagcuuuua

SEQ ID NO: 1425019 - RNA, 19 nt, Homo sapiens
gcacgacccaggcugagaa

SEQ ID NO: 1425020 - RNA, 19 nt, Homo sapiens
gcagugcgggagauuguaa

SEQ ID NO: 1425021 - RNA, 19 nt, Homo sapiens
guucucaggccucagauaa

SEQ ID NO: 1425022 - RNA, 19 nt, Homo sapiens
gcaggcacaucuguugguu

SEQ ID NO: 1425023 - RNA, 19 nt, Homo sapiens
cuaacuggcugggucguuu

SEQ ID NO: 1425024 - RNA, 19 nt, Homo sapiens
ggauccaucuguuuuguaa

SEQ ID NO: 1425025 - RNA, 19 nt, Homo sapiens
gaagugaacgcugaaugug

SEQ ID NO: 1425026 - RNA, 19 nt, Homo sapiens
gcacuuuuguuuuguuuug

SEQ ID NO: 1425027 - RNA, 19 nt, Homo sapiens
ggacaagguggccguggaa

SEQ ID NO: 1425028 - RNA, 19 nt, Homo sapiens
aggcagugauuugcgauua

SEQ ID NO: 1425029 - RNA, 19 nt, Homo sapiens
ggauuugagacccagguua

SEQ ID NO: 1425030 - RNA, 19 nt, Homo sapiens
uaaaguggaaucaccaaau

SEQ ID NO: 1425031 - RNA, 19 nt, Homo sapiens
gaaggcagagugggauuug

SEQ ID NO: 1425032 - RNA, 19 nt, Homo sapiens
agacuucugugaaugacuu

SEQ ID NO: 1425033 - RNA, 19 nt, Homo sapiens
ccaauggauacaaagauaa

SEQ ID NO: 1425034 - RNA, 19 nt, Homo sapiens
ggaaucaccaaaucuuauc

SEQ ID NO: 1425035 - RNA, 19 nt, Homo sapiens
gcagauccuuggaaaagaa

SEQ ID NO: 1425036 - RNA, 19 nt, Homo sapiens
gaacugugccuggguugga

SEQ ID NO: 1425037 - RNA, 19 nt, Homo sapiens
caagaucggaagcgugaaa

SEQ ID NO: 1425038 - RNA, 19 nt, Homo sapiens
gguaucgaaucgcaguuau

SEQ ID NO: 1425039 - RNA, 19 nt, Homo sapiens
ucaagacuucugugaauga

SEQ ID NO: 1425040 - RNA, 19 nt, Homo sapiens
guggaaucaccaaaucuua

SEQ ID NO: 1425041 - RNA, 19 nt, Homo sapiens
uagagucgggaauucauua

SEQ ID NO: 1425042 - RNA, 19 nt, Homo sapiens
caagaggagugcacuuuug

SEQ ID NO: 1425043 - RNA, 19 nt, Homo sapiens
gugauguggugaacgagaa

SEQ ID NO: 1425044 - RNA, 19 nt, Homo sapiens
gaaacucuacuccguggau

SEQ ID NO: 1425045 - RNA, 19 nt, Homo sapiens
gugauuugcgauuacuuua

SEQ ID NO: 1425046 - RNA, 19 nt, Homo sapiens
cggcuucgcuggaguguac

SEQ ID NO: 1425047 - RNA, 19 nt, Homo sapiens
caacaccgacgaccagauc

SEQ ID NO: 1425048 - RNA, 19 nt, Homo sapiens
gaacuggguguccaacuac

SEQ ID NO: 1425049 - RNA, 19 nt, Homo sapiens
caggggagauggaguaauu

SEQ ID NO: 1425050 - RNA, 19 nt, Homo sapiens
gaaggaagugaacgcugaa

SEQ ID NO: 1425051 - RNA, 19 nt, Homo sapiens
ccucaugccuuucaagacu

SEQ ID NO: 1425052 - RNA, 19 nt, Homo sapiens
gaagcaagucucacauguc

SEQ ID NO: 1425053 - RNA, 19 nt, Homo sapiens
gaaucuagagucgggaauu

SEQ ID NO: 1425054 - RNA, 19 nt, Homo sapiens
gagaugcaaucaggaaggu

SEQ ID NO: 1425055 - RNA, 19 nt, Homo sapiens
gcucuucucuguggaaacu

SEQ ID NO: 1425056 - RNA, 19 nt, Homo sapiens
gagaacgcagugagcauga

SEQ ID NO: 1425057 - RNA, 19 nt, Homo sapiens
gcaucgaguucauuugacu

SEQ ID NO: 1425058 - RNA, 19 nt, Homo sapiens
gaucauuguggcccucaaa

SEQ ID NO: 1425059 - RNA, 19 nt, Homo sapiens
uaaacaauaaagcgucuga

SEQ ID NO: 1425060 - RNA, 19 nt, Homo sapiens
ggaggaagcgaaggaagug

SEQ ID NO: 1425061 - RNA, 19 nt, Homo sapiens
cuagagcuccuaccauaug

SEQ ID NO: 1425062 - RNA, 19 nt, Homo sapiens
gucaagggcccaagaggaa

SEQ ID NO: 1425063 - RNA, 19 nt, Homo sapiens
cgaaugaaaguaagcaaag

SEQ ID NO: 1425064 - RNA, 19 nt, Homo sapiens
ucgcauaggcagugauuug

SEQ ID NO: 1425065 - RNA, 19 nt, Homo sapiens
auugagaccuugcugaugu

SEQ ID NO: 1425066 - RNA, 19 nt, Homo sapiens
ucucaugguugucucuuuc

SEQ ID NO: 1425067 - RNA, 19 nt, Homo sapiens
ggacaggggagauggagua

SEQ ID NO: 1425068 - RNA, 19 nt, Homo sapiens
ccagaucgaaggcagcaaa

SEQ ID NO: 1425069 - RNA, 19 nt, Homo sapiens
uuucuucccuucucuguuc

SEQ ID NO: 1425070 - RNA, 19 nt, Homo sapiens
aagggacguuuccaucauu

SEQ ID NO: 1425071 - RNA, 19 nt, Homo sapiens
ccaaaucuuaucacacaga

SEQ ID NO: 1425072 - RNA, 19 nt, Homo sapiens
gaucggaagcgugaaauac

SEQ ID NO: 1425073 - RNA, 19 nt, Homo sapiens
cagagucgccuccuacauc

SEQ ID NO: 1425074 - RNA, 19 nt, Homo sapiens
cauaaugauuguguuccuu

SEQ ID NO: 1425075 - RNA, 19 nt, Homo sapiens
gcagugauuugcgauuacu

SEQ ID NO: 1425076 - RNA, 19 nt, Homo sapiens
ugacccgccuccuagauca

SEQ ID NO: 1425077 - RNA, 19 nt, Homo sapiens
gauuugagacccagguuag

SEQ ID NO: 1425078 - RNA, 19 nt, Homo sapiens
guaagaauggccacagagu

SEQ ID NO: 1425079 - RNA, 19 nt, Homo sapiens
ugcgggagauuguaaggaa

SEQ ID NO: 1425080 - RNA, 19 nt, Homo sapiens
cgcaucauauggccaguga

SEQ ID NO: 1425081 - RNA, 19 nt, Homo sapiens
cuucacgucuugccgaaug

SEQ ID NO: 1425082 - RNA, 19 nt, Homo sapiens
cggaauggaaugagucuau

SEQ ID NO: 1425083 - RNA, 19 nt, Homo sapiens
ccaaugggcugcaguauua

SEQ ID NO: 1425084 - RNA, 19 nt, Homo sapiens
uaagagagcucaccugugu

SEQ ID NO: 1425085 - RNA, 19 nt, Homo sapiens
gaaaguggauccucuaaac

SEQ ID NO: 1425086 - RNA, 19 nt, Homo sapiens
uaaaggacauguagacuug

SEQ ID NO: 1425087 - RNA, 19 nt, Homo sapiens
guaaguaugugguaugugu

SEQ ID NO: 1425088 - RNA, 19 nt, Homo sapiens
gcaaggugcuagaccaaug

SEQ ID NO: 1425089 - RNA, 19 nt, Homo sapiens
gggaugagcucgauuuagg

SEQ ID NO: 1425090 - RNA, 19 nt, Homo sapiens
ggccacgacucccuguuua

SEQ ID NO: 1425091 - RNA, 19 nt, Homo sapiens
agaccaagaugcagaagaa

SEQ ID NO: 1425092 - RNA, 19 nt, Homo sapiens
agacugaggucacagaugu

SEQ ID NO: 1425093 - RNA, 19 nt, Homo sapiens
ggaaagagagcccucaaag

SEQ ID NO: 1425094 - RNA, 19 nt, Homo sapiens
ccucuaaacugcagauugu

SEQ ID NO: 1425095 - RNA, 19 nt, Homo sapiens
gaaagucugucugcaccuu

SEQ ID NO: 1425096 - RNA, 19 nt, Homo sapiens
caaaaugaauugcaaguug

SEQ ID NO: 1425097 - RNA, 19 nt, Homo sapiens
ccagagacuugcucacuuc

SEQ ID NO: 1425098 - RNA, 19 nt, Homo sapiens
gcauguguccucugacgua

SEQ ID NO: 1425099 - RNA, 19 nt, Homo sapiens
gccagacucuucagccaaa

SEQ ID NO: 1425100 - RNA, 19 nt, Homo sapiens
ggaggacacagagcuauaa

SEQ ID NO: 1425101 - RNA, 19 nt, Homo sapiens
gcaggcucauugccacuuu

SEQ ID NO: 1425102 - RNA, 19 nt, Homo sapiens
gauggucccuguccuacug

SEQ ID NO: 1425103 - RNA, 19 nt, Homo sapiens
ggagaaaguggauccucua

SEQ ID NO: 1425104 - RNA, 19 nt, Homo sapiens
ggagauggucccuguccua

SEQ ID NO: 1425105 - RNA, 19 nt, Homo sapiens
guaaaggacauguagacuu

SEQ ID NO: 1425106 - RNA, 19 nt, Homo sapiens
gcauguguguguaaguaug

SEQ ID NO: 1425107 - RNA, 19 nt, Homo sapiens
gagaaaguggauccucuaa

SEQ ID NO: 1425108 - RNA, 19 nt, Homo sapiens
gguagggacugggcuguug

SEQ ID NO: 1425109 - RNA, 19 nt, Homo sapiens
gaaagagagcccucaaagg

SEQ ID NO: 1425110 - RNA, 19 nt, Homo sapiens
uggguaagcugaaggacaa

SEQ ID NO: 1425111 - RNA, 19 nt, Homo sapiens
ccucaugccucagcccuaa

SEQ ID NO: 1425112 - RNA, 19 nt, Homo sapiens
gcgcugggcuagagaaagg

SEQ ID NO: 1425113 - RNA, 19 nt, Homo sapiens
gccagagacuugcucacuu

SEQ ID NO: 1425114 - RNA, 19 nt, Homo sapiens
ucaaggaggccacccgaaa

SEQ ID NO: 1425115 - RNA, 19 nt, Homo sapiens
gcaagaccaagaugcagaa

SEQ ID NO: 1425116 - RNA, 19 nt, Homo sapiens
ggugguguuugguagguuu

SEQ ID NO: 1425117 - RNA, 19 nt, Homo sapiens
gugcaugcaugugugugua

SEQ ID NO: 1425118 - RNA, 19 nt, Homo sapiens
gagcagccguaaaggacau

SEQ ID NO: 1425119 - RNA, 19 nt, Homo sapiens
guguguguguucuugcaua

SEQ ID NO: 1425120 - RNA, 19 nt, Homo sapiens
gggaaagagagcccucaaa

SEQ ID NO: 1425121 - RNA, 19 nt, Homo sapiens
gaauguucucuaucaguau

SEQ ID NO: 1425122 - RNA, 19 nt, Homo sapiens
guugugaagggaagaguuu

SEQ ID NO: 1425123 - RNA, 19 nt, Homo sapiens
gcagcgacgugauguucgu

SEQ ID NO: 1425124 - RNA, 19 nt, Homo sapiens
augcauguguguguaagua

SEQ ID NO: 1425125 - RNA, 19 nt, Homo sapiens
ggugugugcuugggugugu

SEQ ID NO: 1425126 - RNA, 19 nt, Homo sapiens
uguggacacuggagaaagu

SEQ ID NO: 1425127 - RNA, 19 nt, Homo sapiens
gcucacuuccugcauuguu

SEQ ID NO: 1425128 - RNA, 19 nt, Homo sapiens
gauguggacacuggagaaa

SEQ ID NO: 1425129 - RNA, 19 nt, Homo sapiens
ugaagggccacauggaaug

SEQ ID NO: 1425130 - RNA, 19 nt, Homo sapiens
ucucugggcugccuaccau

SEQ ID NO: 1425131 - RNA, 19 nt, Homo sapiens
ccgccaaccuccucagucu

SEQ ID NO: 1425132 - RNA, 19 nt, Homo sapiens
caaggaggccacccgaaag

SEQ ID NO: 1425133 - RNA, 19 nt, Homo sapiens
gggcagcgacgugauguuc

SEQ ID NO: 1425134 - RNA, 19 nt, Homo sapiens
gugcucuccuccuuucuca

SEQ ID NO: 1425135 - RNA, 19 nt, Homo sapiens
ucaugccucagcccuaaua

SEQ ID NO: 1425136 - RNA, 19 nt, Homo sapiens
guguaaguaugugguaugu

SEQ ID NO: 1425137 - RNA, 19 nt, Homo sapiens
cugauggucuuguucucuu

SEQ ID NO: 1425138 - RNA, 19 nt, Homo sapiens
ggaggucagcaccaacuca

SEQ ID NO: 1425139 - RNA, 19 nt, Homo sapiens
acacaugugcccagaguag

SEQ ID NO: 1425140 - RNA, 19 nt, Homo sapiens
agaaaguggauccucuaaa

SEQ ID NO: 1425141 - RNA, 19 nt, Homo sapiens
ggguguguguguguucuug

SEQ ID NO: 1425142 - RNA, 19 nt, Homo sapiens
caacaucuggugccuagac

SEQ ID NO: 1425143 - RNA, 19 nt, Homo sapiens
agaccaaugggcugcagua

SEQ ID NO: 1425144 - RNA, 19 nt, Homo sapiens
ccaaaugccccaacuuuca

SEQ ID NO: 1425145 - RNA, 19 nt, Homo sapiens
gcucauugccacuuuugua

SEQ ID NO: 1425146 - RNA, 19 nt, Homo sapiens
gcaugcauguguguguaag

SEQ ID NO: 1425147 - RNA, 19 nt, Homo sapiens
ggguaaguccugcgaugug

SEQ ID NO: 1425148 - RNA, 19 nt, Homo sapiens
gcaucuggcagcuuccaau

SEQ ID NO: 1425149 - RNA, 19 nt, Homo sapiens
gcccugagccacccauucu

SEQ ID NO: 1425150 - RNA, 19 nt, Homo sapiens
uggaggacacagagcuaua

SEQ ID NO: 1425151 - RNA, 19 nt, Homo sapiens
cgaccucgaggcuuugaug

SEQ ID NO: 1425152 - RNA, 19 nt, Homo sapiens
ccugggaugagcucgauuu

SEQ ID NO: 1425153 - RNA, 19 nt, Homo sapiens
aauguucucuaucaguauc

SEQ ID NO: 1425154 - RNA, 19 nt, Homo sapiens
cacguugggugguguuugg

SEQ ID NO: 1425155 - RNA, 19 nt, Homo sapiens
ccugagccacccauucuga

SEQ ID NO: 1425156 - RNA, 19 nt, Homo sapiens
cuagcccgcuggagaccuu

SEQ ID NO: 1425157 - RNA, 19 nt, Homo sapiens
ccagggcaccuacgccaau

SEQ ID NO: 1425158 - RNA, 19 nt, Homo sapiens
cauguguccucugacguau

SEQ ID NO: 1425159 - RNA, 19 nt, Homo sapiens
acugggcuguugcgugauu

SEQ ID NO: 1425160 - RNA, 19 nt, Homo sapiens
cuugcucacuuccugcauu

SEQ ID NO: 1425161 - RNA, 19 nt, Homo sapiens
ugauggucuuguucucuug

SEQ ID NO: 1425162 - RNA, 19 nt, Homo sapiens
caggagcaaggaccaguug

SEQ ID NO: 1425163 - RNA, 19 nt, Homo sapiens
cuaaagacauggccacuua

SEQ ID NO: 1425164 - RNA, 19 nt, Homo sapiens
ggaccaaaguacagaaaga

SEQ ID NO: 1425165 - RNA, 19 nt, Homo sapiens
gaugggagaccuacauuaa

SEQ ID NO: 1425166 - RNA, 19 nt, Homo sapiens
gaaauggcacccucccuuu

SEQ ID NO: 1425167 - RNA, 19 nt, Homo sapiens
ggaacagccuaucuacaug

SEQ ID NO: 1425168 - RNA, 19 nt, Homo sapiens
gagaugacgcagauguuua

SEQ ID NO: 1425169 - RNA, 19 nt, Homo sapiens
gaacagccuaucuacauga

SEQ ID NO: 1425170 - RNA, 19 nt, Homo sapiens
gaacugaauuuaggucucu

SEQ ID NO: 1425171 - RNA, 19 nt, Homo sapiens
gcccuagacuuccaucauu

SEQ ID NO: 1425172 - RNA, 19 nt, Homo sapiens
gucaggagcuguagagaug

SEQ ID NO: 1425173 - RNA, 19 nt, Homo sapiens
gcaaacacaccacacaugu

SEQ ID NO: 1425174 - RNA, 19 nt, Homo sapiens
ggacucaagugaaagugau

SEQ ID NO: 1425175 - RNA, 19 nt, Homo sapiens
caugcaagauccucauuga

SEQ ID NO: 1425176 - RNA, 19 nt, Homo sapiens
gcaagauccucauugaaac

SEQ ID NO: 1425177 - RNA, 19 nt, Homo sapiens
uuaggucucuggccaauga

SEQ ID NO: 1425178 - RNA, 19 nt, Homo sapiens
gcacagagcaugggaccaa

SEQ ID NO: 1425179 - RNA, 19 nt, Homo sapiens
gccagcaccuguucucuug

SEQ ID NO: 1425180 - RNA, 19 nt, Homo sapiens
ccgaaccucugacuaaaga

SEQ ID NO: 1425181 - RNA, 19 nt, Homo sapiens
gggaacagccuaucuacau

SEQ ID NO: 1425182 - RNA, 19 nt, Homo sapiens
gaccugaccuugggacuca

SEQ ID NO: 1425183 - RNA, 19 nt, Homo sapiens
ggaugggagaccuacauua

SEQ ID NO: 1425184 - RNA, 19 nt, Homo sapiens
caacgugaugucauucuuu

SEQ ID NO: 1425185 - RNA, 19 nt, Homo sapiens
caucugggaucugcauuug

SEQ ID NO: 1425186 - RNA, 19 nt, Homo sapiens
gcgaugaggcccuugaaug

SEQ ID NO: 1425187 - RNA, 19 nt, Homo sapiens
caucaaggacaaucagaaa

SEQ ID NO: 1425188 - RNA, 19 nt, Homo sapiens
ccuugaauguggucacuuu

SEQ ID NO: 1425189 - RNA, 19 nt, Homo sapiens
ucacugccauccucugguu

SEQ ID NO: 1425190 - RNA, 19 nt, Homo sapiens
gggagcggcuuccacaaca

SEQ ID NO: 1425191 - RNA, 19 nt, Homo sapiens
ggcccuaccuccuggaaug

SEQ ID NO: 1425192 - RNA, 19 nt, Homo sapiens
caagaggaaccacuacaug

SEQ ID NO: 1425193 - RNA, 19 nt, Homo sapiens
ggugugggauugaaagaag

SEQ ID NO: 1425194 - RNA, 19 nt, Homo sapiens
ucaaggacaaucagaaaga

SEQ ID NO: 1425195 - RNA, 19 nt, Homo sapiens
ugcaagauccucauugaaa

SEQ ID NO: 1425196 - RNA, 19 nt, Homo sapiens
caaaguacagaaagagguu

SEQ ID NO: 1425197 - RNA, 19 nt, Homo sapiens
agacauggccacuuagaga

SEQ ID NO: 1425198 - RNA, 19 nt, Homo sapiens
ugaauguggucacuuugug

SEQ ID NO: 1425199 - RNA, 19 nt, Homo sapiens
ucaccuaccaacagcaaua

SEQ ID NO: 1425200 - RNA, 19 nt, Homo sapiens
gggaugaguuccugguucu

SEQ ID NO: 1425201 - RNA, 19 nt, Homo sapiens
ugggagaccuacauuaagu

SEQ ID NO: 1425202 - RNA, 19 nt, Homo sapiens
cgaugaggcccuugaaugu

SEQ ID NO: 1425203 - RNA, 19 nt, Homo sapiens
cgagaugacgcagauguuu

SEQ ID NO: 1425204 - RNA, 19 nt, Homo sapiens
gagcaugggaccaaaguac

SEQ ID NO: 1425205 - RNA, 19 nt, Homo sapiens
ggaauaacucgggcacaga

SEQ ID NO: 1425206 - RNA, 19 nt, Homo sapiens
gcaucugggaucugcauuu

SEQ ID NO: 1425207 - RNA, 19 nt, Homo sapiens
ucuccgaaccucugacuaa

SEQ ID NO: 1425208 - RNA, 19 nt, Homo sapiens
acagcaagcucaccuacca

SEQ ID NO: 1425209 - RNA, 19 nt, Homo sapiens
caccguuucuuccuguuga

SEQ ID NO: 1425210 - RNA, 19 nt, Homo sapiens
gaaccucugacuaaagaca

SEQ ID NO: 1425211 - RNA, 19 nt, Homo sapiens
gagaagagugaccgugugu

SEQ ID NO: 1425212 - RNA, 19 nt, Homo sapiens
caugggcgcuugucaacgu

SEQ ID NO: 1425213 - RNA, 19 nt, Homo sapiens
cgaaaaccaucgcaggaaa

SEQ ID NO: 1425214 - RNA, 19 nt, Homo sapiens
gagggugauucugggauga

SEQ ID NO: 1425215 - RNA, 19 nt, Homo sapiens
uagcaaaguuggguuuuaa

SEQ ID NO: 1425216 - RNA, 19 nt, Homo sapiens
ccugagaaccugauauauc

SEQ ID NO: 1425217 - RNA, 19 nt, Homo sapiens
cagaaagaccgcacguuca

SEQ ID NO: 1425218 - RNA, 19 nt, Homo sapiens
ucaacgugaugucauucuu

SEQ ID NO: 1425219 - RNA, 19 nt, Homo sapiens
caacucaacaccgucuuug

SEQ ID NO: 1425220 - RNA, 19 nt, Homo sapiens
cuacaugcuccugguauuu

SEQ ID NO: 1425221 - RNA, 19 nt, Homo sapiens
ccgucaaucucucuggaaa

SEQ ID NO: 1425222 - RNA, 19 nt, Homo sapiens
ucucugacuuugaacugaa

SEQ ID NO: 1425223 - RNA, 19 nt, Homo sapiens
ugucaggccucaagaacca

SEQ ID NO: 1425224 - RNA, 19 nt, Homo sapiens
cugagaaccugauauaucc

SEQ ID NO: 1425225 - RNA, 19 nt, Homo sapiens
gcacagcucagggacuuag

SEQ ID NO: 1425226 - RNA, 19 nt, Homo sapiens
aagugaaagugaucguuga

SEQ ID NO: 1425227 - RNA, 19 nt, Homo sapiens
ucaaugaauccgucaaucu

SEQ ID NO: 1425228 - RNA, 19 nt, Homo sapiens
caagcaaacacaccacaca

SEQ ID NO: 1425229 - RNA, 19 nt, Homo sapiens
gaccuucccaugugagaug

SEQ ID NO: 1425230 - RNA, 19 nt, Homo sapiens
ugccugagaaccugauaua

SEQ ID NO: 1425231 - RNA, 19 nt, Homo sapiens
agccagagcucgggcagaa

SEQ ID NO: 1425232 - RNA, 19 nt, Homo sapiens
cagccuaucuacaugaacu

SEQ ID NO: 1425233 - RNA, 19 nt, Homo sapiens
acagcaauauggcaguguu

SEQ ID NO: 1425234 - RNA, 19 nt, Homo sapiens
caggcgagaugacgcagau

SEQ ID NO: 1425235 - RNA, 19 nt, Homo sapiens
caaugaauccgucaaucuc

SEQ ID NO: 1425236 - RNA, 19 nt, Homo sapiens
gaacuuccagagugcaucu

SEQ ID NO: 1425237 - RNA, 19 nt, Homo sapiens
acgguucaaugccacuaua

SEQ ID NO: 1425238 - RNA, 19 nt, Homo sapiens
ccaacucaacaccgucuuu

SEQ ID NO: 1425239 - RNA, 19 nt, Homo sapiens
ucaaugccacuauaagcaa

SEQ ID NO: 1425240 - RNA, 19 nt, Homo sapiens
gcuaagauccccugaguca

SEQ ID NO: 1425241 - RNA, 19 nt, Homo sapiens
ugucagcaguggauaaagg

SEQ ID NO: 1425242 - RNA, 19 nt, Homo sapiens
guggucacuuugugcugua

SEQ ID NO: 1425243 - RNA, 19 nt, Homo sapiens
gaugaggcccuugaaugug

SEQ ID NO: 1425244 - RNA, 19 nt, Homo sapiens
ggucaggagcuguagagau

SEQ ID NO: 1425245 - RNA, 19 nt, Homo sapiens
uaagauccccugagucauu

SEQ ID NO: 1425246 - RNA, 19 nt, Homo sapiens
cugcacagcucagggacuu

SEQ ID NO: 1425247 - RNA, 19 nt, Homo sapiens
gugcccaucuugcucaucu

SEQ ID NO: 1425248 - RNA, 19 nt, Homo sapiens
ccacuacaugcuccuggua

SEQ ID NO: 1425249 - RNA, 19 nt, Homo sapiens
caauauggcaguguucauc

SEQ ID NO: 1425250 - RNA, 19 nt, Homo sapiens
caaggacaaucagaaagac

SEQ ID NO: 1425251 - RNA, 19 nt, Homo sapiens
guuucuuccuguugauauu

SEQ ID NO: 1425252 - RNA, 19 nt, Homo sapiens
aaacuuucucugacuuuga

SEQ ID NO: 1425253 - RNA, 19 nt, Homo sapiens
ucucugaucccacacacaa

SEQ ID NO: 1425254 - RNA, 19 nt, Homo sapiens
caaaguuggguuuuaauga

SEQ ID NO: 1425255 - RNA, 19 nt, Homo sapiens
caggagcuguagagaugga

SEQ ID NO: 1425256 - RNA, 19 nt, Homo sapiens
aaagacauggccacuuaga

SEQ ID NO: 1425257 - RNA, 19 nt, Homo sapiens
uuacuggugugggauugaa

SEQ ID NO: 1425258 - RNA, 19 nt, Homo sapiens
gcgagaugacgcagauguu

SEQ ID NO: 1425259 - RNA, 19 nt, Homo sapiens
ggucggagcaaggagagaa

SEQ ID NO: 1425260 - RNA, 19 nt, Homo sapiens
ggagggaaagccaaagcau

SEQ ID NO: 1425261 - RNA, 19 nt, Homo sapiens
aaacuguccuagggaagug

SEQ ID NO: 1425262 - RNA, 19 nt, Homo sapiens
ccaagcucccugccuauuc

SEQ ID NO: 1425263 - RNA, 19 nt, Homo sapiens
gcaaugacauggaguauga

SEQ ID NO: 1425264 - RNA, 19 nt, Homo sapiens
ggaaacagccgcacaguga

SEQ ID NO: 1425265 - RNA, 19 nt, Homo sapiens
ggaaggagcuacccucauc

SEQ ID NO: 1425266 - RNA, 19 nt, Homo sapiens
gaaaggagugcuacgcuaa

SEQ ID NO: 1425267 - RNA, 19 nt, Homo sapiens
ccaagaacauuaagacuag

SEQ ID NO: 1425268 - RNA, 19 nt, Homo sapiens
gaacgucuccuaccacauc

SEQ ID NO: 1425269 - RNA, 19 nt, Homo sapiens
ggagaaguccuaccuguuc

SEQ ID NO: 1425270 - RNA, 19 nt, Homo sapiens
gcuaagcucuuuaacuucu

SEQ ID NO: 1425271 - RNA, 19 nt, Homo sapiens
gcaacaaguacaucaacua

SEQ ID NO: 1425272 - RNA, 19 nt, Homo sapiens
uugcuaagcucuuuaacuu

SEQ ID NO: 1425273 - RNA, 19 nt, Homo sapiens
cagaagguguccaggguuu

SEQ ID NO: 1425274 - RNA, 19 nt, Homo sapiens
ggacaaggagaguggguuu

SEQ ID NO: 1425275 - RNA, 19 nt, Homo sapiens
caacaaguacaucaacuau

SEQ ID NO: 1425276 - RNA, 19 nt, Homo sapiens
uaaaguggaugagcagaug

SEQ ID NO: 1425277 - RNA, 19 nt, Homo sapiens
agacacaggugaugaccaa

SEQ ID NO: 1425278 - RNA, 19 nt, Homo sapiens
gccaagaacauuaagacua

SEQ ID NO: 1425279 - RNA, 19 nt, Homo sapiens
agacuagggugaagcagaa

SEQ ID NO: 1425280 - RNA, 19 nt, Homo sapiens
ugacuuugcuaagcucuuu

SEQ ID NO: 1425281 - RNA, 19 nt, Homo sapiens
cgacguggccuuugacuuc

SEQ ID NO: 1425282 - RNA, 19 nt, Homo sapiens
cgacaaggguagcaacaag

SEQ ID NO: 1425283 - RNA, 19 nt, Homo sapiens
gagguaggcagaucacuug

SEQ ID NO: 1425284 - RNA, 19 nt, Homo sapiens
cugggaagauuacauaaau

SEQ ID NO: 1425285 - RNA, 19 nt, Homo sapiens
cccaggagaugguguauca

SEQ ID NO: 1425286 - RNA, 19 nt, Homo sapiens
cuacaaugccacugucuuu

SEQ ID NO: 1425287 - RNA, 19 nt, Homo sapiens
gaacucaggccacaaaucc

SEQ ID NO: 1425288 - RNA, 19 nt, Homo sapiens
acaaguacaucaacuaucg

SEQ ID NO: 1425289 - RNA, 19 nt, Homo sapiens
acucacaccuguaaucuca

SEQ ID NO: 1425290 - RNA, 19 nt, Homo sapiens
gcacugggcaacugcauca

SEQ ID NO: 1425291 - RNA, 19 nt, Homo sapiens
uguccuaccuggagaucua

SEQ ID NO: 1425292 - RNA, 19 nt, Homo sapiens
ccucaucgcccauaaagug

SEQ ID NO: 1425293 - RNA, 19 nt, Homo sapiens
ggacagggugagcagguuu

SEQ ID NO: 1425294 - RNA, 19 nt, Homo sapiens
gaggagaccagcaaugaca

SEQ ID NO: 1425295 - RNA, 19 nt, Homo sapiens
cuggagaucuacaaugaga

SEQ ID NO: 1425296 - RNA, 19 nt, Homo sapiens
cgacucaagcgcaagauug

SEQ ID NO: 1425297 - RNA, 19 nt, Homo sapiens
gcagauggugguucucaug

SEQ ID NO: 1425298 - RNA, 19 nt, Homo sapiens
gagccuggcaucuauguuc

SEQ ID NO: 1425299 - RNA, 19 nt, Homo sapiens
gcugggaagauuacauaaa

SEQ ID NO: 1425300 - RNA, 19 nt, Homo sapiens
ccuguaaucucagcacguu

SEQ ID NO: 1425301 - RNA, 19 nt, Homo sapiens
acaaggguagcaacaagua

SEQ ID NO: 1425302 - RNA, 19 nt, Homo sapiens
gcacauaccaaggacucaa

SEQ ID NO: 1425303 - RNA, 19 nt, Homo sapiens
cgagaaggacucagacaca

SEQ ID NO: 1425304 - RNA, 19 nt, Homo sapiens
gcagccgggucaagaacau

SEQ ID NO: 1425305 - RNA, 19 nt, Homo sapiens
gagcagauggugguucuca

SEQ ID NO: 1425306 - RNA, 19 nt, Homo sapiens
acaaauccugugugacuuu

SEQ ID NO: 1425307 - RNA, 19 nt, Homo sapiens
gacaaggagaguggguuua

SEQ ID NO: 1425308 - RNA, 19 nt, Homo sapiens
gcuggaagcacgagaaguc

SEQ ID NO: 1425309 - RNA, 19 nt, Homo sapiens
cgaagucuccaccaucaau

SEQ ID NO: 1425310 - RNA, 19 nt, Homo sapiens
gggagaaguccuaccuguu

SEQ ID NO: 1425311 - RNA, 19 nt, Homo sapiens
gggaggagcagcgaaagga

SEQ ID NO: 1425312 - RNA, 19 nt, Homo sapiens
ccuaccacaucgcccagua

SEQ ID NO: 1425313 - RNA, 19 nt, Homo sapiens
gaaacagccgcacagugau

SEQ ID NO: 1425314 - RNA, 19 nt, Homo sapiens
accuggagaucuacaauga

SEQ ID NO: 1425315 - RNA, 19 nt, Homo sapiens
gaagucuccaccaucaaug

SEQ ID NO: 1425316 - RNA, 19 nt, Homo sapiens
ggcgaaaucccgucuuuac

SEQ ID NO: 1425317 - RNA, 19 nt, Homo sapiens
ggacucagacacaggugau

SEQ ID NO: 1425318 - RNA, 19 nt, Homo sapiens
caagauugaugagcagacu

SEQ ID NO: 1425319 - RNA, 19 nt, Homo sapiens
ccagcaaugacauggagua

SEQ ID NO: 1425320 - RNA, 19 nt, Homo sapiens
gggaagauuacauaaaugc

SEQ ID NO: 1425321 - RNA, 19 nt, Homo sapiens
ggaacucaggccacaaauc

SEQ ID NO: 1425322 - RNA, 19 nt, Homo sapiens
aguaugaggucuccauguc

SEQ ID NO: 1425323 - RNA, 19 nt, Homo sapiens
gacguggccuuugacuuca

SEQ ID NO: 1425324 - RNA, 19 nt, Homo sapiens
gggacagggugagcagguu

SEQ ID NO: 1425325 - RNA, 19 nt, Homo sapiens
agaagcaacugcgcaagca

SEQ ID NO: 1425326 - RNA, 19 nt, Homo sapiens
ugacauccgccacauccaa

SEQ ID NO: 1425327 - RNA, 19 nt, Homo sapiens
ucaccgaagucuccaccau

SEQ ID NO: 1425328 - RNA, 19 nt, Homo sapiens
ggagaccagcaaugacaug

SEQ ID NO: 1425329 - RNA, 19 nt, Homo sapiens
ccacugucuuugccuaugg

SEQ ID NO: 1425330 - RNA, 19 nt, Homo sapiens
caucgagggcgucaucuca

SEQ ID NO: 1425331 - RNA, 19 nt, Homo sapiens
cugcugcaaucaugaagga

SEQ ID NO: 1425332 - RNA, 19 nt, Homo sapiens
gguagcaacaaguacauca

SEQ ID NO: 1425333 - RNA, 19 nt, Homo sapiens
uaucaggccaccaccaaga

SEQ ID NO: 1425334 - RNA, 19 nt, Homo sapiens
ucgaggagaccagcaauga

SEQ ID NO: 1425335 - RNA, 19 nt, Homo sapiens
ugggaagauuacauaaaug

SEQ ID NO: 1425336 - RNA, 19 nt, Homo sapiens
aaacagccgcacagugaug

SEQ ID NO: 1425337 - RNA, 19 nt, Homo sapiens
ucaacuaucgcgacagcaa

SEQ ID NO: 1425338 - RNA, 19 nt, Homo sapiens
gcgccucgcagacacagaa

SEQ ID NO: 1425339 - RNA, 19 nt, Homo sapiens
ggaggaucccgacgacauc

SEQ ID NO: 1425340 - RNA, 19 nt, Homo sapiens
caaggaccagcaacucaug

SEQ ID NO: 1425341 - RNA, 19 nt, Homo sapiens
ggcgagauccagcgacuca

SEQ ID NO: 1425342 - RNA, 19 nt, Homo sapiens
cgucaucucaggcuacaau

SEQ ID NO: 1425343 - RNA, 19 nt, Homo sapiens
ugagguaggcagaucacuu

SEQ ID NO: 1425344 - RNA, 19 nt, Homo sapiens
uugcugggaagauuacaua

SEQ ID NO: 1425345 - RNA, 19 nt, Homo sapiens
cuacccucaucgcccauaa

SEQ ID NO: 1425346 - RNA, 19 nt, Homo sapiens
ggugaugaccaaccagaca

SEQ ID NO: 1425347 - RNA, 19 nt, Homo sapiens
ugaagcagaaccuccugaa

SEQ ID NO: 1425348 - RNA, 19 nt, Homo sapiens
ucaacgcccugagcgacaa

SEQ ID NO: 1425349 - RNA, 19 nt, Homo sapiens
aaucgugggcagcguauga

SEQ ID NO: 1425350 - RNA, 19 nt, Homo sapiens
gaagguguccaggguuugg

SEQ ID NO: 1425351 - RNA, 19 nt, Homo sapiens
guagcaacaaguacaucaa

SEQ ID NO: 1425352 - RNA, 19 nt, Homo sapiens
caaggagaguggguuuagg

SEQ ID NO: 1425353 - RNA, 19 nt, Homo sapiens
ggacuccaaggaccagcaa

SEQ ID NO: 1425354 - RNA, 19 nt, Homo sapiens
gaagcagaaccuccugaac

SEQ ID NO: 1425355 - RNA, 19 nt, Homo sapiens
ccaaggaccagcaacucau

SEQ ID NO: 1425356 - RNA, 19 nt, Homo sapiens
acaccaugcugggcacaga

SEQ ID NO: 1425357 - RNA, 19 nt, Homo sapiens
gugggcagcguaugaagga

SEQ ID NO: 1425358 - RNA, 19 nt, Homo sapiens
accgaagucuccaccauca

SEQ ID NO: 1425359 - RNA, 19 nt, Homo sapiens
ucagcacguugggaaguug

SEQ ID NO: 1425360 - RNA, 19 nt, Homo sapiens
ucacauuccccaccuguaa

SEQ ID NO: 1425361 - RNA, 19 nt, Homo sapiens
gcucuuuaacuucucuaug

SEQ ID NO: 1425362 - RNA, 19 nt, Homo sapiens
gacaaggguagcaacaagu

SEQ ID NO: 1425363 - RNA, 19 nt, Homo sapiens
gaaaggaagugcgucauua

SEQ ID NO: 1425364 - RNA, 19 nt, Homo sapiens
ggucaagacuuucugauaa

SEQ ID NO: 1425365 - RNA, 19 nt, Homo sapiens
ggaagaaccugaacaugga

SEQ ID NO: 1425366 - RNA, 19 nt, Homo sapiens
gaauuugacuaucucagua

SEQ ID NO: 1425367 - RNA, 19 nt, Homo sapiens
gagauagucuguccuaaau

SEQ ID NO: 1425368 - RNA, 19 nt, Homo sapiens
gauagucuguccuaaauau

SEQ ID NO: 1425369 - RNA, 19 nt, Homo sapiens
gcagagaucuuguucacau

SEQ ID NO: 1425370 - RNA, 19 nt, Homo sapiens
gaauuaaucuuugggaaug

SEQ ID NO: 1425371 - RNA, 19 nt, Homo sapiens
ccaccuagcugauccuaaa

SEQ ID NO: 1425372 - RNA, 19 nt, Homo sapiens
caagacguauuucgaguuu

SEQ ID NO: 1425373 - RNA, 19 nt, Homo sapiens
ggccagacuuggaguauuu

SEQ ID NO: 1425374 - RNA, 19 nt, Homo sapiens
ucacacaccugcaauacuu

SEQ ID NO: 1425375 - RNA, 19 nt, Homo sapiens
gauacaagaagaucaagua

SEQ ID NO: 1425376 - RNA, 19 nt, Homo sapiens
gcacacaguugcagcucaa

SEQ ID NO: 1425377 - RNA, 19 nt, Homo sapiens
ggaggaagaauuugacuau

SEQ ID NO: 1425378 - RNA, 19 nt, Homo sapiens
ggauuaccauuacuauguu

SEQ ID NO: 1425379 - RNA, 19 nt, Homo sapiens
caauucaggcuagauauua

SEQ ID NO: 1425380 - RNA, 19 nt, Homo sapiens
ugagaugucugcaggaaga

SEQ ID NO: 1425381 - RNA, 19 nt, Homo sapiens
gaugggauuuacaaagaaa

SEQ ID NO: 1425382 - RNA, 19 nt, Homo sapiens
gcaaaggaguaaccaagag

SEQ ID NO: 1425383 - RNA, 19 nt, Homo sapiens
aagaugggauuuacaaaga

SEQ ID NO: 1425384 - RNA, 19 nt, Homo sapiens
gcaggaagaugggauuuac

SEQ ID NO: 1425385 - RNA, 19 nt, Homo sapiens
ggaagaauuugacuaucuc

SEQ ID NO: 1425386 - RNA, 19 nt, Homo sapiens
ggaugaggaggaagaauuu

SEQ ID NO: 1425387 - RNA, 19 nt, Homo sapiens
gucaagacuuucugauaaa

SEQ ID NO: 1425388 - RNA, 19 nt, Homo sapiens
caggcuagauauuauacua

SEQ ID NO: 1425389 - RNA, 19 nt, Homo sapiens
gaagaugggauuuacaaag

SEQ ID NO: 1425390 - RNA, 19 nt, Homo sapiens
gcaauucaggcuagauauu

SEQ ID NO: 1425391 - RNA, 19 nt, Homo sapiens
uggcuuaucuuacuuguag

SEQ ID NO: 1425392 - RNA, 19 nt, Homo sapiens
ccuauucccugccuucauu

SEQ ID NO: 1425393 - RNA, 19 nt, Homo sapiens
ucacugcuauauucucauu

SEQ ID NO: 1425394 - RNA, 19 nt, Homo sapiens
ggaagugcgucauuauagg

SEQ ID NO: 1425395 - RNA, 19 nt, Homo sapiens
aggcagaacuguuugauag

SEQ ID NO: 1425396 - RNA, 19 nt, Homo sapiens
uaagguggauuaccauuac

SEQ ID NO: 1425397 - RNA, 19 nt, Homo sapiens
ggagcuacacguggaaaua

SEQ ID NO: 1425398 - RNA, 19 nt, Homo sapiens
uggcugcgcugcuagauug

SEQ ID NO: 1425399 - RNA, 19 nt, Homo sapiens
caagacaacuaccccauaa

SEQ ID NO: 1425400 - RNA, 19 nt, Homo sapiens
cguguagacucaagacgua

SEQ ID NO: 1425401 - RNA, 19 nt, Homo sapiens
gauaucagccacugguuug

SEQ ID NO: 1425402 - RNA, 19 nt, Homo sapiens
gaaguugcaggccaggaua

SEQ ID NO: 1425403 - RNA, 19 nt, Homo sapiens
gcucacugcuauauucuca

SEQ ID NO: 1425404 - RNA, 19 nt, Homo sapiens
gggaugaggaggaagaauu

SEQ ID NO: 1425405 - RNA, 19 nt, Homo sapiens
ggaaauaugaagggaagaa

SEQ ID NO: 1425406 - RNA, 19 nt, Homo sapiens
ggauaucagccacugguuu

SEQ ID NO: 1425407 - RNA, 19 nt, Homo sapiens
aguugcagcucaauaaauu

SEQ ID NO: 1425408 - RNA, 19 nt, Homo sapiens
cggcgcaacucaauuacuu

SEQ ID NO: 1425409 - RNA, 19 nt, Homo sapiens
uagcugauccuaaauguuc

SEQ ID NO: 1425410 - RNA, 19 nt, Homo sapiens
gggcagagaucuuguucac

SEQ ID NO: 1425411 - RNA, 19 nt, Homo sapiens
ucaguuagcaccaugcauu

SEQ ID NO: 1425412 - RNA, 19 nt, Homo sapiens
gagagauagucuguccuaa

SEQ ID NO: 1425413 - RNA, 19 nt, Homo sapiens
gggucaagacuuucugaua

SEQ ID NO: 1425414 - RNA, 19 nt, Homo sapiens
gaagaggauagucagaguu

SEQ ID NO: 1425415 - RNA, 19 nt, Homo sapiens
guacuucaaugaugaucuc

SEQ ID NO: 1425416 - RNA, 19 nt, Homo sapiens
caauacuucuguacuucaa

SEQ ID NO: 1425417 - RNA, 19 nt, Homo sapiens
ggaagaugggauuuacaaa

SEQ ID NO: 1425418 - RNA, 19 nt, Homo sapiens
gagcuacacguggaaauau

SEQ ID NO: 1425419 - RNA, 19 nt, Homo sapiens
gcugaaacccaucguggaa

SEQ ID NO: 1425420 - RNA, 19 nt, Homo sapiens
ugccucagccucccaaaua

SEQ ID NO: 1425421 - RNA, 19 nt, Homo sapiens
gaaacccaagggaaagaaa

SEQ ID NO: 1425422 - RNA, 19 nt, Homo sapiens
uuagggagauguagaagag

SEQ ID NO: 1425423 - RNA, 19 nt, Homo sapiens
acaagaagaucaaguaccu

SEQ ID NO: 1425424 - RNA, 19 nt, Homo sapiens
gugaacacgugcaguccaa

SEQ ID NO: 1425425 - RNA, 19 nt, Homo sapiens
gcaauacuucuguacuuca

SEQ ID NO: 1425426 - RNA, 19 nt, Homo sapiens
ggacugggccaacgauuuu

SEQ ID NO: 1425427 - RNA, 19 nt, Homo sapiens
uguacgaccuaacgucauu

SEQ ID NO: 1425428 - RNA, 19 nt, Homo sapiens
agagauagucuguccuaaa

SEQ ID NO: 1425429 - RNA, 19 nt, Homo sapiens
acagauaaguccuuucacu

SEQ ID NO: 1425430 - RNA, 19 nt, Homo sapiens
gcaaugauggaaaugagau

SEQ ID NO: 1425431 - RNA, 19 nt, Homo sapiens
ggagguggcccaacauaac

SEQ ID NO: 1425432 - RNA, 19 nt, Homo sapiens
uaaccaagagauccaguga

SEQ ID NO: 1425433 - RNA, 19 nt, Homo sapiens
caaaggaguaaccaagaga

SEQ ID NO: 1425434 - RNA, 19 nt, Homo sapiens
cacaguugcagcucaauaa

SEQ ID NO: 1425435 - RNA, 19 nt, Homo sapiens
cugcaauacuucuguacuu

SEQ ID NO: 1425436 - RNA, 19 nt, Homo sapiens
gaggaagaauuugacuauc

SEQ ID NO: 1425437 - RNA, 19 nt, Homo sapiens
ggacgcguguacgaccuaa

SEQ ID NO: 1425438 - RNA, 19 nt, Homo sapiens
augaugaucucacggaguu

SEQ ID NO: 1425439 - RNA, 19 nt, Homo sapiens
gacggaggucguaguagua

SEQ ID NO: 1425440 - RNA, 19 nt, Homo sapiens
ggagcauccgcaucauuaa

SEQ ID NO: 1425441 - RNA, 19 nt, Homo sapiens
ccagagacauccgcaagca

SEQ ID NO: 1425442 - RNA, 19 nt, Homo sapiens
ccauuacuauguuacagau

SEQ ID NO: 1425443 - RNA, 19 nt, Homo sapiens
acgccacaaugccuaauuu

SEQ ID NO: 1425444 - RNA, 19 nt, Homo sapiens
ggaaugauacaagaagauc

SEQ ID NO: 1425445 - RNA, 19 nt, Homo sapiens
guauuucgaguuuggcuuu

SEQ ID NO: 1425446 - RNA, 19 nt, Homo sapiens
agacguauuucgaguuugg

SEQ ID NO: 1425447 - RNA, 19 nt, Homo sapiens
aggaagaauuugacuaucu

SEQ ID NO: 1425448 - RNA, 19 nt, Homo sapiens
ugaaacccaucguggaagu

SEQ ID NO: 1425449 - RNA, 19 nt, Homo sapiens
uggauuaccauuacuaugu

SEQ ID NO: 1425450 - RNA, 19 nt, Homo sapiens
aaggaagugcgucauuaua

SEQ ID NO: 1425451 - RNA, 19 nt, Homo sapiens
gggccagacuuggaguauu

SEQ ID NO: 1425452 - RNA, 19 nt, Homo sapiens
ggucuuuucugauuucuug

SEQ ID NO: 1425453 - RNA, 19 nt, Homo sapiens
uuacagauaaguccuuuca

SEQ ID NO: 1425454 - RNA, 19 nt, Homo sapiens
agaagaggauagucagagu

SEQ ID NO: 1425455 - RNA, 19 nt, Homo sapiens
guagacucaagacguauuu

SEQ ID NO: 1425456 - RNA, 19 nt, Homo sapiens
ccaggccacugaauuaaaa

SEQ ID NO: 1425457 - RNA, 19 nt, Homo sapiens
gaagggaagaaccugaaca

SEQ ID NO: 1425458 - RNA, 19 nt, Homo sapiens
ggaaguugcaggccaggau

SEQ ID NO: 1425459 - RNA, 19 nt, Homo sapiens
auaagguggauuaccauua

SEQ ID NO: 1425460 - RNA, 19 nt, Homo sapiens
caagugauccucccaucuc

SEQ ID NO: 1425461 - RNA, 19 nt, Homo sapiens
aaaggaagugcgucauuau

SEQ ID NO: 1425462 - RNA, 19 nt, Homo sapiens
ggagauguagaagaggaua

SEQ ID NO: 1425463 - RNA, 19 nt, Homo sapiens
gauggugacugccacauaa

SEQ ID NO: 1425464 - RNA, 19 nt, Homo sapiens
ggagagcccuggauuagga

SEQ ID NO: 1425465 - RNA, 19 nt, Homo sapiens
agacaacuaucaauucuug

SEQ ID NO: 1425466 - RNA, 19 nt, Homo sapiens
agugaaagaucaagaaaug

SEQ ID NO: 1425467 - RNA, 19 nt, Homo sapiens
ggaccaguuugcagaguga

SEQ ID NO: 1425468 - RNA, 19 nt, Homo sapiens
agaaaugucucugcuccua

SEQ ID NO: 1425469 - RNA, 19 nt, Homo sapiens
cuugagacccaaauuauaa

SEQ ID NO: 1425470 - RNA, 19 nt, Homo sapiens
gcauuggguucaaggaauc

SEQ ID NO: 1425471 - RNA, 19 nt, Homo sapiens
ggugacugccacauaauaa

SEQ ID NO: 1425472 - RNA, 19 nt, Homo sapiens
gcuagcagcccuugugugu

SEQ ID NO: 1425473 - RNA, 19 nt, Homo sapiens
guuaagagacaacuaucaa

SEQ ID NO: 1425474 - RNA, 19 nt, Homo sapiens
ggcauuggguucaaggaau

SEQ ID NO: 1425475 - RNA, 19 nt, Homo sapiens
agagacaacuaucaauucu

SEQ ID NO: 1425476 - RNA, 19 nt, Homo sapiens
cagaaccaguuaagagaca

SEQ ID NO: 1425477 - RNA, 19 nt, Homo sapiens
aaacaugaauaugguugga

SEQ ID NO: 1425478 - RNA, 19 nt, Homo sapiens
aaaguggugauuuggauuu

SEQ ID NO: 1425479 - RNA, 19 nt, Homo sapiens
auaaaguggugauuuggau

SEQ ID NO: 1425480 - RNA, 19 nt, Homo sapiens
guuggagagcccuggauua

SEQ ID NO: 1425481 - RNA, 19 nt, Homo sapiens
gagcacaaggccuuaaugg

SEQ ID NO: 1425482 - RNA, 19 nt, Homo sapiens
gaaagaucaagaaaugucu

SEQ ID NO: 1425483 - RNA, 19 nt, Homo sapiens
gaaaacgcaaacaugaaua

SEQ ID NO: 1425484 - RNA, 19 nt, Homo sapiens
gcccugcccuguacugaag

SEQ ID NO: 1425485 - RNA, 19 nt, Homo sapiens
ugaaagaucaagaaauguc

SEQ ID NO: 1425486 - RNA, 19 nt, Homo sapiens
gcagagugaaagaucaaga

SEQ ID NO: 1425487 - RNA, 19 nt, Homo sapiens
ggauuaggagggugacaug

SEQ ID NO: 1425488 - RNA, 19 nt, Homo sapiens
acgcaaacaugaauauggu

SEQ ID NO: 1425489 - RNA, 19 nt, Homo sapiens
aaaugucucugcuccuaca

SEQ ID NO: 1425490 - RNA, 19 nt, Homo sapiens
ccaggacccuccacucacu

SEQ ID NO: 1425491 - RNA, 19 nt, Homo sapiens
cagagugaaagaucaagaa

SEQ ID NO: 1425492 - RNA, 19 nt, Homo sapiens
cgucaggccuaccucaagu

SEQ ID NO: 1425493 - RNA, 19 nt, Homo sapiens
cgauggugacugccacaua

SEQ ID NO: 1425494 - RNA, 19 nt, Homo sapiens
ucuugagacccaaauuaua

SEQ ID NO: 1425495 - RNA, 19 nt, Homo sapiens
ugacggccuucuugguuuc

SEQ ID NO: 1425496 - RNA, 19 nt, Homo sapiens
gagugaaagaucaagaaau

SEQ ID NO: 1425497 - RNA, 19 nt, Homo sapiens
uaaaguggugauuuggauu

SEQ ID NO: 1425498 - RNA, 19 nt, Homo sapiens
ggagcacaaggccuuaaug

SEQ ID NO: 1425499 - RNA, 19 nt, Homo sapiens
aagagacaacuaucaauuc

SEQ ID NO: 1425500 - RNA, 19 nt, Homo sapiens
gggcauuggguucaaggaa

SEQ ID NO: 1425501 - RNA, 19 nt, Homo sapiens
ccucgaggcuggugguuuu

SEQ ID NO: 1425502 - RNA, 19 nt, Homo sapiens
uugacggccuucuugguuu

SEQ ID NO: 1425503 - RNA, 19 nt, Homo sapiens
aggccuaccucaaguucuu

SEQ ID NO: 1425504 - RNA, 19 nt, Homo sapiens
gugacugccacauaauaaa

SEQ ID NO: 1425505 - RNA, 19 nt, Homo sapiens
gacauugacuugugaaaac

SEQ ID NO: 1425506 - RNA, 19 nt, Homo sapiens
cuuggugucugguuucugu

SEQ ID NO: 1425507 - RNA, 19 nt, Homo sapiens
ggacauugacuugugaaaa

SEQ ID NO: 1425508 - RNA, 19 nt, Homo sapiens
gaagaaaaggggagcacaa

SEQ ID NO: 1425509 - RNA, 19 nt, Homo sapiens
gagcaggaggccgacguuu

SEQ ID NO: 1425510 - RNA, 19 nt, Homo sapiens
auucuugagacccaaauua

SEQ ID NO: 1425511 - RNA, 19 nt, Homo sapiens
gagacaacuaucaauucuu

SEQ ID NO: 1425512 - RNA, 19 nt, Homo sapiens
gcaggaggccgacguuuuc

SEQ ID NO: 1425513 - RNA, 19 nt, Homo sapiens
agagugaaagaucaagaaa

SEQ ID NO: 1425514 - RNA, 19 nt, Homo sapiens
ugacugccacauaauaaag

SEQ ID NO: 1425515 - RNA, 19 nt, Homo sapiens
gguuggagagcccuggauu

SEQ ID NO: 1425516 - RNA, 19 nt, Homo sapiens
uggugacugccacauaaua

SEQ ID NO: 1425517 - RNA, 19 nt, Homo sapiens
cuacauccagcuccucuag

SEQ ID NO: 1425518 - RNA, 19 nt, Homo sapiens
caauauagaucuuccuuga

SEQ ID NO: 1425519 - RNA, 19 nt, Homo sapiens
gaagaugguugcagaggaa

SEQ ID NO: 1425520 - RNA, 19 nt, Homo sapiens
ggaaacccguugucuugua

SEQ ID NO: 1425521 - RNA, 19 nt, Homo sapiens
gaaacccguugucuuguaa

SEQ ID NO: 1425522 - RNA, 19 nt, Homo sapiens
gaucuugguugaacuguau

SEQ ID NO: 1425523 - RNA, 19 nt, Homo sapiens
gugaaaggcagaagcauua

SEQ ID NO: 1425524 - RNA, 19 nt, Homo sapiens
gggcuuauauccuguucua

SEQ ID NO: 1425525 - RNA, 19 nt, Homo sapiens
gcacugggcaugucacaaa

SEQ ID NO: 1425526 - RNA, 19 nt, Homo sapiens
gcaaggaaacucaaggaaa

SEQ ID NO: 1425527 - RNA, 19 nt, Homo sapiens
agaaugcaguuuccaagua

SEQ ID NO: 1425528 - RNA, 19 nt, Homo sapiens
uauaugggauucucugaaa

SEQ ID NO: 1425529 - RNA, 19 nt, Homo sapiens
gcagcaggcuagcagguuu

SEQ ID NO: 1425530 - RNA, 19 nt, Homo sapiens
gggccacccuuccugauaa

SEQ ID NO: 1425531 - RNA, 19 nt, Homo sapiens
gcaacaccuuugauccuuu

SEQ ID NO: 1425532 - RNA, 19 nt, Homo sapiens
caaggaaacucaaggaaaa

SEQ ID NO: 1425533 - RNA, 19 nt, Homo sapiens
gcagaagcauuagcaugaa

SEQ ID NO: 1425534 - RNA, 19 nt, Homo sapiens
gcacagcuguaccuuggau

SEQ ID NO: 1425535 - RNA, 19 nt, Homo sapiens
gaagaggaccugaauacca

SEQ ID NO: 1425536 - RNA, 19 nt, Homo sapiens
acaucaagcuucccagaaa

SEQ ID NO: 1425537 - RNA, 19 nt, Homo sapiens
gaaggcugcucgaggaaca

SEQ ID NO: 1425538 - RNA, 19 nt, Homo sapiens
gcaaggugcuaauccucuu

SEQ ID NO: 1425539 - RNA, 19 nt, Homo sapiens
gcacgacgcccuggaauuc

SEQ ID NO: 1425540 - RNA, 19 nt, Homo sapiens
aaacagagcaacaccuuug

SEQ ID NO: 1425541 - RNA, 19 nt, Homo sapiens
gaaugcaguuuccaaguac

SEQ ID NO: 1425542 - RNA, 19 nt, Homo sapiens
ggcagaagcauuagcauga

SEQ ID NO: 1425543 - RNA, 19 nt, Homo sapiens
agagggagauaauguguau

SEQ ID NO: 1425544 - RNA, 19 nt, Homo sapiens
caggaaacccguugucuug

SEQ ID NO: 1425545 - RNA, 19 nt, Homo sapiens
gauggagcgugucaguauu

SEQ ID NO: 1425546 - RNA, 19 nt, Homo sapiens
ucaaauaucacacucuuuc

SEQ ID NO: 1425547 - RNA, 19 nt, Homo sapiens
gcacugcgggugaggauga

SEQ ID NO: 1425548 - RNA, 19 nt, Homo sapiens
gagaacaggaggaaugaga

SEQ ID NO: 1425549 - RNA, 19 nt, Homo sapiens
gugcuaauccucuucugua

SEQ ID NO: 1425550 - RNA, 19 nt, Homo sapiens
gaaacagagcaacaccuuu

SEQ ID NO: 1425551 - RNA, 19 nt, Homo sapiens
caacaccuuugauccuuuc

SEQ ID NO: 1425552 - RNA, 19 nt, Homo sapiens
acccaggucugucgguuua

SEQ ID NO: 1425553 - RNA, 19 nt, Homo sapiens
guacggcucucaguuccaa

SEQ ID NO: 1425554 - RNA, 19 nt, Homo sapiens
gcuccucccugucugauca

SEQ ID NO: 1425555 - RNA, 19 nt, Homo sapiens
aaacucagaugguccaaac

SEQ ID NO: 1425556 - RNA, 19 nt, Homo sapiens
guguaugccuuucaaguuc

SEQ ID NO: 1425557 - RNA, 19 nt, Homo sapiens
ccaacagccucugcaauca

SEQ ID NO: 1425558 - RNA, 19 nt, Homo sapiens
agaaggccaugaacuggaa

SEQ ID NO: 1425559 - RNA, 19 nt, Homo sapiens
ucuccacgcuggugaaguu

SEQ ID NO: 1425560 - RNA, 19 nt, Homo sapiens
gauaauguguaugccuuuc

SEQ ID NO: 1425561 - RNA, 19 nt, Homo sapiens
gaugaagaggaccugaaua

SEQ ID NO: 1425562 - RNA, 19 nt, Homo sapiens
caaguacggcucucaguuc

SEQ ID NO: 1425563 - RNA, 19 nt, Homo sapiens
gaggugaucuugguugaac

SEQ ID NO: 1425564 - RNA, 19 nt, Homo sapiens
gagcgugucaguauugugu

SEQ ID NO: 1425565 - RNA, 19 nt, Homo sapiens
uaauguguaugccuuucaa

SEQ ID NO: 1425566 - RNA, 19 nt, Homo sapiens
cuuauauccuguucuauca

SEQ ID NO: 1425567 - RNA, 19 nt, Homo sapiens
gauggccagugguacaguu

SEQ ID NO: 1425568 - RNA, 19 nt, Homo sapiens
gcagagggagauaaugugu

SEQ ID NO: 1425569 - RNA, 19 nt, Homo sapiens
aagaggaccugaauaccau

SEQ ID NO: 1425570 - RNA, 19 nt, Homo sapiens
agacgagguucuugagugu

SEQ ID NO: 1425571 - RNA, 19 nt, Homo sapiens
uauauccuguucuaucaga

SEQ ID NO: 1425572 - RNA, 19 nt, Homo sapiens
cuaauccucuucuguaacu

SEQ ID NO: 1425573 - RNA, 19 nt, Homo sapiens
gaacugccugucaccauca

SEQ ID NO: 1425574 - RNA, 19 nt, Homo sapiens
agucaaauaucacacucuu

SEQ ID NO: 1425575 - RNA, 19 nt, Homo sapiens
ccucugcggugguccuuug

SEQ ID NO: 1425576 - RNA, 19 nt, Homo sapiens
guaccuuggaugaauguuu

SEQ ID NO: 1425577 - RNA, 19 nt, Homo sapiens
uggaauuccugcucugguu

SEQ ID NO: 1425578 - RNA, 19 nt, Homo sapiens
ccagcggucuuucuuugau

SEQ ID NO: 1425579 - RNA, 19 nt, Homo sapiens
ugauggagcgugucaguau

SEQ ID NO: 1425580 - RNA, 19 nt, Homo sapiens
gcuuauauccuguucuauc

SEQ ID NO: 1425581 - RNA, 19 nt, Homo sapiens
caagcacaauauagaucuu

SEQ ID NO: 1425582 - RNA, 19 nt, Homo sapiens
ccaaguacggcucucaguu

SEQ ID NO: 1425583 - RNA, 19 nt, Homo sapiens
ggagaagcuuccgccugaa

SEQ ID NO: 1425584 - RNA, 19 nt, Homo sapiens
gcuguaccuuggaugaaug

SEQ ID NO: 1425585 - RNA, 19 nt, Homo sapiens
gcaagguccgccaucuuau

SEQ ID NO: 1425586 - RNA, 19 nt, Homo sapiens
agcaagguccgccaucuua

SEQ ID NO: 1425587 - RNA, 19 nt, Homo sapiens
caucaagcuucccagaaag

SEQ ID NO: 1425588 - RNA, 19 nt, Homo sapiens
ggauggugaagcugaguuu

SEQ ID NO: 1425589 - RNA, 19 nt, Homo sapiens
gagaaugcaguuuccaagu

SEQ ID NO: 1425590 - RNA, 19 nt, Homo sapiens
ugaaacagagcaacaccuu

SEQ ID NO: 1425591 - RNA, 19 nt, Homo sapiens
gggagcaggcuucuuaugg

SEQ ID NO: 1425592 - RNA, 19 nt, Homo sapiens
gguggaaccgcuucgagaa

SEQ ID NO: 1425593 - RNA, 19 nt, Homo sapiens
ggccagugguacaguuaug

SEQ ID NO: 1425594 - RNA, 19 nt, Homo sapiens
ccaggaaacccguugucuu

SEQ ID NO: 1425595 - RNA, 19 nt, Homo sapiens
gugugacgcuggcauucuu

SEQ ID NO: 1425596 - RNA, 19 nt, Homo sapiens
gcgugucaguauuguguga

SEQ ID NO: 1425597 - RNA, 19 nt, Homo sapiens
gacaucaagcuucccagaa

SEQ ID NO: 1425598 - RNA, 19 nt, Homo sapiens
gagccaagcagggaccauu

SEQ ID NO: 1425599 - RNA, 19 nt, Homo sapiens
caagguccgccaucuuaug

SEQ ID NO: 1425600 - RNA, 19 nt, Homo sapiens
auauagaucuuccuugacu

SEQ ID NO: 1425601 - RNA, 19 nt, Homo sapiens
caagcuucccagaaaguuu

SEQ ID NO: 1425602 - RNA, 19 nt, Homo sapiens
aagcagggaccauucaaga

SEQ ID NO: 1425603 - RNA, 19 nt, Homo sapiens
gaaacucagaugguccaaa

SEQ ID NO: 1425604 - RNA, 19 nt, Homo sapiens
ccacuuucaagcacaauau

SEQ ID NO: 1425605 - RNA, 19 nt, Homo sapiens
ggaugacgccuggaagugu

SEQ ID NO: 1425606 - RNA, 19 nt, Homo sapiens
gccagaaggccaugaacug

SEQ ID NO: 1425607 - RNA, 19 nt, Homo sapiens
gguuggagcccaggcguuu

SEQ ID NO: 1425608 - RNA, 19 nt, Homo sapiens
gcaaggugggcauuacaca

SEQ ID NO: 1425609 - RNA, 19 nt, Homo sapiens
gguccgccaucuuaugaag

SEQ ID NO: 1425610 - RNA, 19 nt, Homo sapiens
ugcuaauccucuucuguaa

SEQ ID NO: 1425611 - RNA, 19 nt, Homo sapiens
ccacgagccaguccauugu

SEQ ID NO: 1425612 - RNA, 19 nt, Homo sapiens
caggggagcaggcuucuua

SEQ ID NO: 1425613 - RNA, 19 nt, Homo sapiens
gggacacucacccuucuga

SEQ ID NO: 1425614 - RNA, 19 nt, Homo sapiens
cagaagcauuagcaugaag

SEQ ID NO: 1425615 - RNA, 19 nt, Homo sapiens
cgugaaaggcagaagcauu

SEQ ID NO: 1425616 - RNA, 19 nt, Homo sapiens
guuccugacucucccaucu

SEQ ID NO: 1425617 - RNA, 19 nt, Homo sapiens
ugaucuugguugaacugua

SEQ ID NO: 1425618 - RNA, 19 nt, Homo sapiens
gaaagagaauccauuauug

SEQ ID NO: 1425619 - RNA, 19 nt, Homo sapiens
gaacuucgcucaaucuuac

SEQ ID NO: 1425620 - RNA, 19 nt, Homo sapiens
ggauggaccugcccaguuu

SEQ ID NO: 1425621 - RNA, 19 nt, Homo sapiens
gagcaccacugaaaucuug

SEQ ID NO: 1425622 - RNA, 19 nt, Homo sapiens
ugacagagcuaaucaccuu

SEQ ID NO: 1425623 - RNA, 19 nt, Homo sapiens
gacaagaacuucgcucaau

SEQ ID NO: 1425624 - RNA, 19 nt, Homo sapiens
ccagagaaaugacuagaca

SEQ ID NO: 1425625 - RNA, 19 nt, Homo sapiens
gaugcgagaugacuuaagu

SEQ ID NO: 1425626 - RNA, 19 nt, Homo sapiens
caagagggccaccaucaaa

SEQ ID NO: 1425627 - RNA, 19 nt, Homo sapiens
agagaaagagaauccauua

SEQ ID NO: 1425628 - RNA, 19 nt, Homo sapiens
ugacuagacagaaccaaua

SEQ ID NO: 1425629 - RNA, 19 nt, Homo sapiens
cagagacccugccagagaa

SEQ ID NO: 1425630 - RNA, 19 nt, Homo sapiens
cguggagucugaauucaaa

SEQ ID NO: 1425631 - RNA, 19 nt, Homo sapiens
gacaggugcccauggauuu

SEQ ID NO: 1425632 - RNA, 19 nt, Homo sapiens
ggugacaggugcccaugga

SEQ ID NO: 1425633 - RNA, 19 nt, Homo sapiens
gaagccagagcaccacuga

SEQ ID NO: 1425634 - RNA, 19 nt, Homo sapiens
gcuaaucaccuuugcaucu

SEQ ID NO: 1425635 - RNA, 19 nt, Homo sapiens
caacaugcagcucaacaau

SEQ ID NO: 1425636 - RNA, 19 nt, Homo sapiens
cagcugguaugcaagauag

SEQ ID NO: 1425637 - RNA, 19 nt, Homo sapiens
gagaaagagaauccauuau

SEQ ID NO: 1425638 - RNA, 19 nt, Homo sapiens
acaugcagcucaacaaugg

SEQ ID NO: 1425639 - RNA, 19 nt, Homo sapiens
gcagcugguaugcaagaua

SEQ ID NO: 1425640 - RNA, 19 nt, Homo sapiens
agagaugcgagaugacuua

SEQ ID NO: 1425641 - RNA, 19 nt, Homo sapiens
agaaaugacuagacagaac

SEQ ID NO: 1425642 - RNA, 19 nt, Homo sapiens
ggagucaggaagacaagaa

SEQ ID NO: 1425643 - RNA, 19 nt, Homo sapiens
uugcagagaugcgagauga

SEQ ID NO: 1425644 - RNA, 19 nt, Homo sapiens
gacuagacagaaccaauaa

SEQ ID NO: 1425645 - RNA, 19 nt, Homo sapiens
gagaaaugacuagacagaa

SEQ ID NO: 1425646 - RNA, 19 nt, Homo sapiens
ccacaaucccagagaaaug

SEQ ID NO: 1425647 - RNA, 19 nt, Homo sapiens
acaagaacuucgcucaauc

SEQ ID NO: 1425648 - RNA, 19 nt, Homo sapiens
cuaaucaccuuugcaucuu

SEQ ID NO: 1425649 - RNA, 19 nt, Homo sapiens
gagcuaaucaccuuugcau

SEQ ID NO: 1425650 - RNA, 19 nt, Homo sapiens
ggaccugcccaguuuggaa

SEQ ID NO: 1425651 - RNA, 19 nt, Homo sapiens
ucggacaggugccggcuuu

SEQ ID NO: 1425652 - RNA, 19 nt, Homo sapiens
ggagaggcagcauccauca

SEQ ID NO: 1425653 - RNA, 19 nt, Homo sapiens
gaccguggagucugaauuc

SEQ ID NO: 1425654 - RNA, 19 nt, Homo sapiens
ugacaggugcccauggauu

SEQ ID NO: 1425655 - RNA, 19 nt, Homo sapiens
cggcuuuacuggagucaga

SEQ ID NO: 1425656 - RNA, 19 nt, Homo sapiens
gcuggaggcagacaugcua

SEQ ID NO: 1425657 - RNA, 19 nt, Homo sapiens
ccagagcaccacugaaauc

SEQ ID NO: 1425658 - RNA, 19 nt, Homo sapiens
gaggagcgagagccagaaa

SEQ ID NO: 1425659 - RNA, 19 nt, Homo sapiens
caguggagguugcagagau

SEQ ID NO: 1425660 - RNA, 19 nt, Homo sapiens
gaacccaugcagcugguau

SEQ ID NO: 1425661 - RNA, 19 nt, Homo sapiens
caagaacuucgcucaaucu

SEQ ID NO: 1425662 - RNA, 19 nt, Homo sapiens
agagaaaugacuagacaga

SEQ ID NO: 1425663 - RNA, 19 nt, Homo sapiens
aaagagaauccauuauugg

SEQ ID NO: 1425664 - RNA, 19 nt, Homo sapiens
gaagcaaggaagacucagu

SEQ ID NO: 1425665 - RNA, 19 nt, Homo sapiens
agaacuucgcucaaucuua

SEQ ID NO: 1425666 - RNA, 19 nt, Homo sapiens
acacggaagccaacucgaa

SEQ ID NO: 1425667 - RNA, 19 nt, Homo sapiens
gaucccugaugcccacuca

SEQ ID NO: 1425668 - RNA, 19 nt, Homo sapiens
cacaaucccagagaaauga

SEQ ID NO: 1425669 - RNA, 19 nt, Homo sapiens
gggaagcaaggaagacuca

SEQ ID NO: 1425670 - RNA, 19 nt, Homo sapiens
gaucucccgccacccauug

SEQ ID NO: 1425671 - RNA, 19 nt, Homo sapiens
ggaguuucacggaggagaa

SEQ ID NO: 1425672 - RNA, 19 nt, Homo sapiens
caaagggucaguggagguu

SEQ ID NO: 1425673 - RNA, 19 nt, Homo sapiens
uaagucaacaccagauaca

SEQ ID NO: 1425674 - RNA, 19 nt, Homo sapiens
ucaagagggccaccaucaa

SEQ ID NO: 1425675 - RNA, 19 nt, Homo sapiens
agccagagcaccacugaaa

SEQ ID NO: 1425676 - RNA, 19 nt, Homo sapiens
gagaugcgagaugacuuaa

SEQ ID NO: 1425677 - RNA, 19 nt, Homo sapiens
gaccugacagagcuaauca

SEQ ID NO: 1425678 - RNA, 19 nt, Homo sapiens
cuagacagaaccaauaaag

SEQ ID NO: 1425679 - RNA, 19 nt, Homo sapiens
gucaacaccagauacaaga

SEQ ID NO: 1425680 - RNA, 19 nt, Homo sapiens
gcagagaugcgagaugacu

SEQ ID NO: 1425681 - RNA, 19 nt, Homo sapiens
ggacaggugccggcuuuac

SEQ ID NO: 1425682 - RNA, 19 nt, Homo sapiens
ggagcuggaggcagacaug

SEQ ID NO: 1425683 - RNA, 19 nt, Homo sapiens
uaaucaccuuugcaucuuc

SEQ ID NO: 1425684 - RNA, 19 nt, Homo sapiens
ggaggagaaccacgugucu

SEQ ID NO: 1425685 - RNA, 19 nt, Homo sapiens
gaaaagagaaagagaaucc

SEQ ID NO: 1425686 - RNA, 19 nt, Homo sapiens
uggaacacaugaugaaagc

SEQ ID NO: 1425687 - RNA, 19 nt, Homo sapiens
ccaucaacaugcagcucaa

SEQ ID NO: 1425688 - RNA, 19 nt, Homo sapiens
aagagaaagagaauccauu

SEQ ID NO: 1425689 - RNA, 19 nt, Homo sapiens
gaaaucuuggagucaggaa

SEQ ID NO: 1425690 - RNA, 19 nt, Homo sapiens
uuacuggagucagagcuau

SEQ ID NO: 1425691 - RNA, 19 nt, Homo sapiens
guuuggaacacaugaugaa

SEQ ID NO: 1425692 - RNA, 19 nt, Homo sapiens
caaucuuacuuugacuuca

SEQ ID NO: 1425693 - RNA, 19 nt, Homo sapiens
agacaagaacuucgcucaa

SEQ ID NO: 1425694 - RNA, 19 nt, Homo sapiens
ucaacaugcagcucaacaa

SEQ ID NO: 1425695 - RNA, 19 nt, Homo sapiens
ucagugcgcagaccuccaa

SEQ ID NO: 1425696 - RNA, 19 nt, Homo sapiens
gcagaagccccaacuccaa

SEQ ID NO: 1425697 - RNA, 19 nt, Homo sapiens
gcuauacccagcccucaag

SEQ ID NO: 1425698 - RNA, 19 nt, Homo sapiens
gaaauuaaauggccuuggu

SEQ ID NO: 1425699 - RNA, 19 nt, Homo sapiens
ggaggcagguggcagauga

SEQ ID NO: 1425700 - RNA, 19 nt, Homo sapiens
ugaaagauuuggaacagaa

SEQ ID NO: 1425701 - RNA, 19 nt, Homo sapiens
gaagagauguucgccaaag

SEQ ID NO: 1425702 - RNA, 19 nt, Homo sapiens
ggccugggcuggaacagua

SEQ ID NO: 1425703 - RNA, 19 nt, Homo sapiens
gagcugggcugagaaacaa

SEQ ID NO: 1425704 - RNA, 19 nt, Homo sapiens
gaauaagggugucacuagu

SEQ ID NO: 1425705 - RNA, 19 nt, Homo sapiens
ugugucaucuuacccuuua

SEQ ID NO: 1425706 - RNA, 19 nt, Homo sapiens
ggccugcauuugagaauaa

SEQ ID NO: 1425707 - RNA, 19 nt, Homo sapiens
ccaggcgucugcugaaaga

SEQ ID NO: 1425708 - RNA, 19 nt, Homo sapiens
gaaccagaccgccuguaau

SEQ ID NO: 1425709 - RNA, 19 nt, Homo sapiens
ccaccucaccguuuccaua

SEQ ID NO: 1425710 - RNA, 19 nt, Homo sapiens
ggcgucugcugaaagauuu

SEQ ID NO: 1425711 - RNA, 19 nt, Homo sapiens
gggccugcauuugagaaua

SEQ ID NO: 1425712 - RNA, 19 nt, Homo sapiens
agauggcgcuuugguguaa

SEQ ID NO: 1425713 - RNA, 19 nt, Homo sapiens
gagaauaagggugucacua

SEQ ID NO: 1425714 - RNA, 19 nt, Homo sapiens
ccaaggagaaggucccauu

SEQ ID NO: 1425715 - RNA, 19 nt, Homo sapiens
cgaaccagaccgccuguaa

SEQ ID NO: 1425716 - RNA, 19 nt, Homo sapiens
gcugaaagauuuggaacag

SEQ ID NO: 1425717 - RNA, 19 nt, Homo sapiens
gagauggcgcuuuggugua

SEQ ID NO: 1425718 - RNA, 19 nt, Homo sapiens
ccacccaguuccugaugaa

SEQ ID NO: 1425719 - RNA, 19 nt, Homo sapiens
ccucaccguuuccauaguu

SEQ ID NO: 1425720 - RNA, 19 nt, Homo sapiens
caaggagaaggucccauuu

SEQ ID NO: 1425721 - RNA, 19 nt, Homo sapiens
gcucuuuugugucaucuua

SEQ ID NO: 1425722 - RNA, 19 nt, Homo sapiens
cccaguuccugaugaauga

SEQ ID NO: 1425723 - RNA, 19 nt, Homo sapiens
ggauggagagccacucaga

SEQ ID NO: 1425724 - RNA, 19 nt, Homo sapiens
cgucaugacucuggugguu

SEQ ID NO: 1425725 - RNA, 19 nt, Homo sapiens
ggagagccacucagaggau

SEQ ID NO: 1425726 - RNA, 19 nt, Homo sapiens
auaagggugucacuaguuc

SEQ ID NO: 1425727 - RNA, 19 nt, Homo sapiens
agaauaagggugucacuag

SEQ ID NO: 1425728 - RNA, 19 nt, Homo sapiens
ccacucagaggaugaagau

SEQ ID NO: 1425729 - RNA, 19 nt, Homo sapiens
ggaggacaguacaggacau

SEQ ID NO: 1425730 - RNA, 19 nt, Homo sapiens
cuacaacaccacccaguuc

SEQ ID NO: 1425731 - RNA, 19 nt, Homo sapiens
ccgaggagcaggacagaga

SEQ ID NO: 1425732 - RNA, 19 nt, Homo sapiens
cagaggcuccggaccgaaa

SEQ ID NO: 1425733 - RNA, 19 nt, Homo sapiens
ggacaguacaggacaugag

SEQ ID NO: 1425734 - RNA, 19 nt, Homo sapiens
agaaacaacagcgggauga

SEQ ID NO: 1425735 - RNA, 19 nt, Homo sapiens
aaccagaccgccuguaaug

SEQ ID NO: 1425736 - RNA, 19 nt, Homo sapiens
gauuuggaacagaagauga

SEQ ID NO: 1425737 - RNA, 19 nt, Homo sapiens
aaacaacagcgggaugaga

SEQ ID NO: 1425738 - RNA, 19 nt, Homo sapiens
gcugagcugggcugagaaa

SEQ ID NO: 1425739 - RNA, 19 nt, Homo sapiens
gaaagauuuggaacagaag

SEQ ID NO: 1425740 - RNA, 19 nt, Homo sapiens
aauaagggugucacuaguu

SEQ ID NO: 1425741 - RNA, 19 nt, Homo sapiens
ccagaccgccuguaaugca

SEQ ID NO: 1425742 - RNA, 19 nt, Homo sapiens
acagcuaaaucgguucaga

SEQ ID NO: 1425743 - RNA, 19 nt, Homo sapiens
ggagaaggucccauuucgu

SEQ ID NO: 1425744 - RNA, 19 nt, Homo sapiens
gacaguacaggacaugagu

SEQ ID NO: 1425745 - RNA, 19 nt, Homo sapiens
gcccugagaacagcuaaau

SEQ ID NO: 1425746 - RNA, 19 nt, Homo sapiens
aggagaaggucccauuucg

SEQ ID NO: 1425747 - RNA, 19 nt, Homo sapiens
cucagaggaugaagaucuu

SEQ ID NO: 1425748 - RNA, 19 nt, Homo sapiens
gcagacaucuugcucauaa

SEQ ID NO: 1425749 - RNA, 19 nt, Homo sapiens
gcaaacgucucacuuuaaa

SEQ ID NO: 1425750 - RNA, 19 nt, Homo sapiens
cagcaaacgucucacuuua

SEQ ID NO: 1425751 - RNA, 19 nt, Homo sapiens
ggaagaaguuguuauuaca

SEQ ID NO: 1425752 - RNA, 19 nt, Homo sapiens
uaacaaagggucagcauuu

SEQ ID NO: 1425753 - RNA, 19 nt, Homo sapiens
gcagauagaauuuggcuuu

SEQ ID NO: 1425754 - RNA, 19 nt, Homo sapiens
acagucaccuuguuaauuu

SEQ ID NO: 1425755 - RNA, 19 nt, Homo sapiens
caucucagcuccucauuga

SEQ ID NO: 1425756 - RNA, 19 nt, Homo sapiens
gggaagggauccuauaugu

SEQ ID NO: 1425757 - RNA, 19 nt, Homo sapiens
acacuugccuucugaauga

SEQ ID NO: 1425758 - RNA, 19 nt, Homo sapiens
gauccuauauguccuguug

SEQ ID NO: 1425759 - RNA, 19 nt, Homo sapiens
gggcauggcuugaauuagu

SEQ ID NO: 1425760 - RNA, 19 nt, Homo sapiens
ggacagagaaggaggagaa

SEQ ID NO: 1425761 - RNA, 19 nt, Homo sapiens
guaacaagcugacugugau

SEQ ID NO: 1425762 - RNA, 19 nt, Homo sapiens
ucacagcccucuucuggaa

SEQ ID NO: 1425763 - RNA, 19 nt, Homo sapiens
gcucauaaacuuacaguau

SEQ ID NO: 1425764 - RNA, 19 nt, Homo sapiens
ugaccucucuuuaaaucua

SEQ ID NO: 1425765 - RNA, 19 nt, Homo sapiens
gcaaagcacggacagagaa

SEQ ID NO: 1425766 - RNA, 19 nt, Homo sapiens
gcagcaaacgucucacuuu

SEQ ID NO: 1425767 - RNA, 19 nt, Homo sapiens
ugacuuuccuuuccuaguu

SEQ ID NO: 1425768 - RNA, 19 nt, Homo sapiens
acucugaccucucuuuaaa

SEQ ID NO: 1425769 - RNA, 19 nt, Homo sapiens
gcccuuuacuucugacuuu

SEQ ID NO: 1425770 - RNA, 19 nt, Homo sapiens
gacuuuagcccaccaguuu

SEQ ID NO: 1425771 - RNA, 19 nt, Homo sapiens
gaggguuccugauggcuuu

SEQ ID NO: 1425772 - RNA, 19 nt, Homo sapiens
gacuguaaauggcaagaaa

SEQ ID NO: 1425773 - RNA, 19 nt, Homo sapiens
ccaaaaugcuggcuuuaaa

SEQ ID NO: 1425774 - RNA, 19 nt, Homo sapiens
ggagggaagggauccuaua

SEQ ID NO: 1425775 - RNA, 19 nt, Homo sapiens
guaccagucucacauuugg

SEQ ID NO: 1425776 - RNA, 19 nt, Homo sapiens
gauagaauuuggcuuugag

SEQ ID NO: 1425777 - RNA, 19 nt, Homo sapiens
gcacagggcauggcuugaa

SEQ ID NO: 1425778 - RNA, 19 nt, Homo sapiens
ggagugcacugagccaugu

SEQ ID NO: 1425779 - RNA, 19 nt, Homo sapiens
gagccagugugcagauaga

SEQ ID NO: 1425780 - RNA, 19 nt, Homo sapiens
cagaaaaccuggaaagaau

SEQ ID NO: 1425781 - RNA, 19 nt, Homo sapiens
uggaagaaguuguuauuac

SEQ ID NO: 1425782 - RNA, 19 nt, Homo sapiens
caguuugucugguugacua

SEQ ID NO: 1425783 - RNA, 19 nt, Homo sapiens
agacuucgguccaccaugu

SEQ ID NO: 1425784 - RNA, 19 nt, Homo sapiens
ggaaaacuguaaaggcaaa

SEQ ID NO: 1425785 - RNA, 19 nt, Homo sapiens
uagcuucacucaauguuag

SEQ ID NO: 1425786 - RNA, 19 nt, Homo sapiens
gagggaagggauccuauau

SEQ ID NO: 1425787 - RNA, 19 nt, Homo sapiens
gauucuugcugcgaacuuu

SEQ ID NO: 1425788 - RNA, 19 nt, Homo sapiens
ggcauggcuugaauuaguu

SEQ ID NO: 1425789 - RNA, 19 nt, Homo sapiens
gacuuuccuuuccuaguuu

SEQ ID NO: 1425790 - RNA, 19 nt, Homo sapiens
cauggaagaaguuguuauu

SEQ ID NO: 1425791 - RNA, 19 nt, Homo sapiens
gcccaaaccucaggauucu

SEQ ID NO: 1425792 - RNA, 19 nt, Homo sapiens
caucauagccaggccacua

SEQ ID NO: 1425793 - RNA, 19 nt, Homo sapiens
caucuugcucauaaacuua

SEQ ID NO: 1425794 - RNA, 19 nt, Homo sapiens
cagggcauggcuugaauua

SEQ ID NO: 1425795 - RNA, 19 nt, Homo sapiens
caaccaugcagacaucuug

SEQ ID NO: 1425796 - RNA, 19 nt, Homo sapiens
uuacuugacuaacagacuu

SEQ ID NO: 1425797 - RNA, 19 nt, Homo sapiens
gcgaggugguagccuuuga

SEQ ID NO: 1425798 - RNA, 19 nt, Homo sapiens
gggauaguuuucuuugaua

SEQ ID NO: 1425799 - RNA, 19 nt, Homo sapiens
cggcugcacucccaagaug

SEQ ID NO: 1425800 - RNA, 19 nt, Homo sapiens
gcagaaaaccuggaaagaa

SEQ ID NO: 1425801 - RNA, 19 nt, Homo sapiens
agagucagcugcccuuucu

SEQ ID NO: 1425802 - RNA, 19 nt, Homo sapiens
ccucaucccucugaaaaua

SEQ ID NO: 1425803 - RNA, 19 nt, Homo sapiens
caaaagauacugcaacguu

SEQ ID NO: 1425804 - RNA, 19 nt, Homo sapiens
gagccaggccuaugcaauc

SEQ ID NO: 1425805 - RNA, 19 nt, Homo sapiens
gaaaaccuggaaagaauuu

SEQ ID NO: 1425806 - RNA, 19 nt, Homo sapiens
gcccaaccaugcagacauc

SEQ ID NO: 1425807 - RNA, 19 nt, Homo sapiens
guguaccagucucacauuu

SEQ ID NO: 1425808 - RNA, 19 nt, Homo sapiens
cagauagaauuuggcuuug

SEQ ID NO: 1425809 - RNA, 19 nt, Homo sapiens
caagcugacugugauucuu

SEQ ID NO: 1425810 - RNA, 19 nt, Homo sapiens
aaacaaaacacccaacaaa

SEQ ID NO: 1425811 - RNA, 19 nt, Homo sapiens
uacaguauguuucagaagu

SEQ ID NO: 1425812 - RNA, 19 nt, Homo sapiens
aaacaucguagucauggaa

SEQ ID NO: 1425813 - RNA, 19 nt, Homo sapiens
caagaccauuaaagacugu

SEQ ID NO: 1425814 - RNA, 19 nt, Homo sapiens
ggacuuuagcccaccaguu

SEQ ID NO: 1425815 - RNA, 19 nt, Homo sapiens
ucugaccucucuuuaaauc

SEQ ID NO: 1425816 - RNA, 19 nt, Homo sapiens
ccagugugcagauagaauu

SEQ ID NO: 1425817 - RNA, 19 nt, Homo sapiens
gccacuaacuugacuuggu

SEQ ID NO: 1425818 - RNA, 19 nt, Homo sapiens
aagcugacugugauucuua

SEQ ID NO: 1425819 - RNA, 19 nt, Homo sapiens
aaucagugcuggugucucu

SEQ ID NO: 1425820 - RNA, 19 nt, Homo sapiens
uucaagcccugccuucaaa

SEQ ID NO: 1425821 - RNA, 19 nt, Homo sapiens
agauagaauuuggcuuuga

SEQ ID NO: 1425822 - RNA, 19 nt, Homo sapiens
gcacaucucagcuccucau

SEQ ID NO: 1425823 - RNA, 19 nt, Homo sapiens
uuccaaaucuuagacuuga

SEQ ID NO: 1425824 - RNA, 19 nt, Homo sapiens
uauguccuguuggcucuua

SEQ ID NO: 1425825 - RNA, 19 nt, Homo sapiens
gugcuggugucucucuaga

SEQ ID NO: 1425826 - RNA, 19 nt, Homo sapiens
gaccucucuuuaaaucuau

SEQ ID NO: 1425827 - RNA, 19 nt, Homo sapiens
uagagccagugugcagaua

SEQ ID NO: 1425828 - RNA, 19 nt, Homo sapiens
ccacucugcccuuuacuuc

SEQ ID NO: 1425829 - RNA, 19 nt, Homo sapiens
guaugccaccauccgaaua

SEQ ID NO: 1425830 - RNA, 19 nt, Homo sapiens
acaucuugcucauaaacuu

SEQ ID NO: 1425831 - RNA, 19 nt, Homo sapiens
gucuuuaacugugugugua

SEQ ID NO: 1425832 - RNA, 19 nt, Homo sapiens
uaacaagcugacugugauu

SEQ ID NO: 1425833 - RNA, 19 nt, Homo sapiens
cauuuacucugaccucucu

SEQ ID NO: 1425834 - RNA, 19 nt, Homo sapiens
auuaaugaccgaacagaaa

SEQ ID NO: 1425835 - RNA, 19 nt, Homo sapiens
uuacucugaccucucuuua

SEQ ID NO: 1425836 - RNA, 19 nt, Homo sapiens
gagagucagcugcccuuuc

SEQ ID NO: 1425837 - RNA, 19 nt, Homo sapiens
ggcccaaaccucaggauuc

SEQ ID NO: 1425838 - RNA, 19 nt, Homo sapiens
cacagggcauggcuugaau

SEQ ID NO: 1425839 - RNA, 19 nt, Homo sapiens
ggcuacacuugccuucuga

SEQ ID NO: 1425840 - RNA, 19 nt, Homo sapiens
ucuuagacuugaacaaaca

SEQ ID NO: 1425841 - RNA, 19 nt, Homo sapiens
ggaagggauccuauauguc

SEQ ID NO: 1425842 - RNA, 19 nt, Homo sapiens
ccauucacaagaccauuaa

SEQ ID NO: 1425843 - RNA, 19 nt, Homo sapiens
acaguauguuucagaagug

SEQ ID NO: 1425844 - RNA, 19 nt, Homo sapiens
caaaaugcuggcuuuaaaa

SEQ ID NO: 1425845 - RNA, 19 nt, Homo sapiens
cugccugucuuacuucaug

SEQ ID NO: 1425846 - RNA, 19 nt, Homo sapiens
aaaguaacaagcugacugu

SEQ ID NO: 1425847 - RNA, 19 nt, Homo sapiens
aacaaagggucagcauuuc

SEQ ID NO: 1425848 - RNA, 19 nt, Homo sapiens
gaagaagauucccuccuua

SEQ ID NO: 1425849 - RNA, 19 nt, Homo sapiens
gaagauucccuccuuaaua

SEQ ID NO: 1425850 - RNA, 19 nt, Homo sapiens
gaagaaacacuggaaauuu

SEQ ID NO: 1425851 - RNA, 19 nt, Homo sapiens
gagaacugguuguguauuu

SEQ ID NO: 1425852 - RNA, 19 nt, Homo sapiens
guauucagcuguaagugua

SEQ ID NO: 1425853 - RNA, 19 nt, Homo sapiens
gcacauugcuuuggaguca

SEQ ID NO: 1425854 - RNA, 19 nt, Homo sapiens
ggagacauguuaccucuuc

SEQ ID NO: 1425855 - RNA, 19 nt, Homo sapiens
ugaaggagcagaaacauaa

SEQ ID NO: 1425856 - RNA, 19 nt, Homo sapiens
cauaguaggugcucaacaa

SEQ ID NO: 1425857 - RNA, 19 nt, Homo sapiens
ggaagaaacacuggaaauu

SEQ ID NO: 1425858 - RNA, 19 nt, Homo sapiens
gcuaacaccaagauauuua

SEQ ID NO: 1425859 - RNA, 19 nt, Homo sapiens
gaacugguuguguauuuaa

SEQ ID NO: 1425860 - RNA, 19 nt, Homo sapiens
gaagcaggcacaaaucgua

SEQ ID NO: 1425861 - RNA, 19 nt, Homo sapiens
aagauucccuccuuaauau

SEQ ID NO: 1425862 - RNA, 19 nt, Homo sapiens
agaaauaauuccugguuug

SEQ ID NO: 1425863 - RNA, 19 nt, Homo sapiens
ggaccgagccguuuaugga

SEQ ID NO: 1425864 - RNA, 19 nt, Homo sapiens
gaggaaagguuugccaauc

SEQ ID NO: 1425865 - RNA, 19 nt, Homo sapiens
ggcagcagauugucuagaa

SEQ ID NO: 1425866 - RNA, 19 nt, Homo sapiens
gcagaaacauaaucaaucc

SEQ ID NO: 1425867 - RNA, 19 nt, Homo sapiens
uaaauaggauucagaaagc

SEQ ID NO: 1425868 - RNA, 19 nt, Homo sapiens
gagccuacaucuuggguau

SEQ ID NO: 1425869 - RNA, 19 nt, Homo sapiens
ggucagaaacucagaaugu

SEQ ID NO: 1425870 - RNA, 19 nt, Homo sapiens
guggaacgauggucagaaa

SEQ ID NO: 1425871 - RNA, 19 nt, Homo sapiens
cauguuaccucuucauaca

SEQ ID NO: 1425872 - RNA, 19 nt, Homo sapiens
caucuaggcugugucacua

SEQ ID NO: 1425873 - RNA, 19 nt, Homo sapiens
caauuucucugacaagaca

SEQ ID NO: 1425874 - RNA, 19 nt, Homo sapiens
ggauccagauuuuauguua

SEQ ID NO: 1425875 - RNA, 19 nt, Homo sapiens
gagcagaaacauaaucaau

SEQ ID NO: 1425876 - RNA, 19 nt, Homo sapiens
gaacuuaucaaagggagaa

SEQ ID NO: 1425877 - RNA, 19 nt, Homo sapiens
uggagaaacuggagaaauc

SEQ ID NO: 1425878 - RNA, 19 nt, Homo sapiens
gugcaaggauaucauuguu

SEQ ID NO: 1425879 - RNA, 19 nt, Homo sapiens
ucagaaagcuaacaguuuu

SEQ ID NO: 1425880 - RNA, 19 nt, Homo sapiens
ggauaaauaggauucagaa

SEQ ID NO: 1425881 - RNA, 19 nt, Homo sapiens
gagacaaacuagccaagca

SEQ ID NO: 1425882 - RNA, 19 nt, Homo sapiens
caaggauggugucagaaga

SEQ ID NO: 1425883 - RNA, 19 nt, Homo sapiens
ggagaaaucacccuuuuaa

SEQ ID NO: 1425884 - RNA, 19 nt, Homo sapiens
gagacucacuucgggauga

SEQ ID NO: 1425885 - RNA, 19 nt, Homo sapiens
aguaggugcucaacaaauu

SEQ ID NO: 1425886 - RNA, 19 nt, Homo sapiens
auagaaagcuaaugaagag

SEQ ID NO: 1425887 - RNA, 19 nt, Homo sapiens
agaacugguuguguauuua

SEQ ID NO: 1425888 - RNA, 19 nt, Homo sapiens
ugaagaggaugaagcagau

SEQ ID NO: 1425889 - RNA, 19 nt, Homo sapiens
uaucauuguuggcuagauu

SEQ ID NO: 1425890 - RNA, 19 nt, Homo sapiens
agggagaacugguugugua

SEQ ID NO: 1425891 - RNA, 19 nt, Homo sapiens
ggaaagguuugccaaucuc

SEQ ID NO: 1425892 - RNA, 19 nt, Homo sapiens
acuauugggugcaaggaua

SEQ ID NO: 1425893 - RNA, 19 nt, Homo sapiens
ccaguaugcugaugugaca

SEQ ID NO: 1425894 - RNA, 19 nt, Homo sapiens
gaacgauggucagaaacuc

SEQ ID NO: 1425895 - RNA, 19 nt, Homo sapiens
gcaugcacauugcuuugga

SEQ ID NO: 1425896 - RNA, 19 nt, Homo sapiens
gcagagggagagagacaaa

SEQ ID NO: 1425897 - RNA, 19 nt, Homo sapiens
acaaacuucuguuccgaaa

SEQ ID NO: 1425898 - RNA, 19 nt, Homo sapiens
guugaugacuguaccaaag

SEQ ID NO: 1425899 - RNA, 19 nt, Homo sapiens
ggaagaaggaacaggacaa

SEQ ID NO: 1425900 - RNA, 19 nt, Homo sapiens
gguuguguauuuaagagaa

SEQ ID NO: 1425901 - RNA, 19 nt, Homo sapiens
gagcgaaagcgauaaccuu

SEQ ID NO: 1425902 - RNA, 19 nt, Homo sapiens
gaaacaccaauguggaaga

SEQ ID NO: 1425903 - RNA, 19 nt, Homo sapiens
ggaugaagcagaugagaag

SEQ ID NO: 1425904 - RNA, 19 nt, Homo sapiens
gcacaaaucguaguaaagc

SEQ ID NO: 1425905 - RNA, 19 nt, Homo sapiens
agcagaagcucuccauuuc

SEQ ID NO: 1425906 - RNA, 19 nt, Homo sapiens
ucagaauguugucaccaaa

SEQ ID NO: 1425907 - RNA, 19 nt, Homo sapiens
gucagaaacucagaauguu

SEQ ID NO: 1425908 - RNA, 19 nt, Homo sapiens
gacauguuaccucuucaua

SEQ ID NO: 1425909 - RNA, 19 nt, Homo sapiens
uguggucugugaaaucuaa

SEQ ID NO: 1425910 - RNA, 19 nt, Homo sapiens
gacaagacaaaguagauau

SEQ ID NO: 1425911 - RNA, 19 nt, Homo sapiens
gaaauaauuccugguuugg

SEQ ID NO: 1425912 - RNA, 19 nt, Homo sapiens
uaacauggcagcaaaacua

SEQ ID NO: 1425913 - RNA, 19 nt, Homo sapiens
acaccaauguggaagaugu

SEQ ID NO: 1425914 - RNA, 19 nt, Homo sapiens
ugacaagacaaaguagaua

SEQ ID NO: 1425915 - RNA, 19 nt, Homo sapiens
cacuggaaauuucugcuaa

SEQ ID NO: 1425916 - RNA, 19 nt, Homo sapiens
uaccaaagaucuggaaugg

SEQ ID NO: 1425917 - RNA, 19 nt, Homo sapiens
cccaugaacuuaucaaagg

SEQ ID NO: 1425918 - RNA, 19 nt, Homo sapiens
gaagaggagaagcagagaa

SEQ ID NO: 1425919 - RNA, 19 nt, Homo sapiens
gcaggcacaaaucguagua

SEQ ID NO: 1425920 - RNA, 19 nt, Homo sapiens
gaauuuggcccagucuguu

SEQ ID NO: 1425921 - RNA, 19 nt, Homo sapiens
ccaagauauuuaagagugu

SEQ ID NO: 1425922 - RNA, 19 nt, Homo sapiens
acaccaagauauuuaagag

SEQ ID NO: 1425923 - RNA, 19 nt, Homo sapiens
uggcugaaauagaaagcua

SEQ ID NO: 1425924 - RNA, 19 nt, Homo sapiens
uuauggagccuacaucuug

SEQ ID NO: 1425925 - RNA, 19 nt, Homo sapiens
guacauaguaggugcucaa

SEQ ID NO: 1425926 - RNA, 19 nt, Homo sapiens
aaucauguauccucuugug

SEQ ID NO: 1425927 - RNA, 19 nt, Homo sapiens
gagucaguauucagcugua

SEQ ID NO: 1425928 - RNA, 19 nt, Homo sapiens
cagaugagaaggaugauuc

SEQ ID NO: 1425929 - RNA, 19 nt, Homo sapiens
ugacagaugaagaggauga

SEQ ID NO: 1425930 - RNA, 19 nt, Homo sapiens
guaggugcucaacaaauuu

SEQ ID NO: 1425931 - RNA, 19 nt, Homo sapiens
ggccauugccacccuaauu

SEQ ID NO: 1425932 - RNA, 19 nt, Homo sapiens
ggagaaacuggagaaauca

SEQ ID NO: 1425933 - RNA, 19 nt, Homo sapiens
ggaguggaccgagccguuu

SEQ ID NO: 1425934 - RNA, 19 nt, Homo sapiens
aggcacaaaucguaguaaa

SEQ ID NO: 1425935 - RNA, 19 nt, Homo sapiens
uuuacuaccuggccuguug

SEQ ID NO: 1425936 - RNA, 19 nt, Homo sapiens
auaaucauguauccucuug

SEQ ID NO: 1425937 - RNA, 19 nt, Homo sapiens
gcauuuccccuauuguuua

SEQ ID NO: 1425938 - RNA, 19 nt, Homo sapiens
gaguggaccgagccguuua

SEQ ID NO: 1425939 - RNA, 19 nt, Homo sapiens
gacagcaauuucucugaca

SEQ ID NO: 1425940 - RNA, 19 nt, Homo sapiens
cacaaaccacauuaaauug

SEQ ID NO: 1425941 - RNA, 19 nt, Homo sapiens
gugcucaacaaauuuauug

SEQ ID NO: 1425942 - RNA, 19 nt, Homo sapiens
uaaggaagaaacacuggaa

SEQ ID NO: 1425943 - RNA, 19 nt, Homo sapiens
ugaagaggccuaccuggau

SEQ ID NO: 1425944 - RNA, 19 nt, Homo sapiens
aaacaccaauguggaagau

SEQ ID NO: 1425945 - RNA, 19 nt, Homo sapiens
ugaagcagaugagaaggau

SEQ ID NO: 1425946 - RNA, 19 nt, Homo sapiens
ggaggaaagguuugccaau

SEQ ID NO: 1425947 - RNA, 19 nt, Homo sapiens
ucucugacaagacaaagua

SEQ ID NO: 1425948 - RNA, 19 nt, Homo sapiens
gaaaguaucugucacauga

SEQ ID NO: 1425949 - RNA, 19 nt, Homo sapiens
ccacauaccugcauucauu

SEQ ID NO: 1425950 - RNA, 19 nt, Homo sapiens
cauaaugucucaaacagua

SEQ ID NO: 1425951 - RNA, 19 nt, Homo sapiens
ggagacagauuaguuguuu

SEQ ID NO: 1425952 - RNA, 19 nt, Homo sapiens
ccaagaggcucgugaauau

SEQ ID NO: 1425953 - RNA, 19 nt, Homo sapiens
cuagaaagguuuaugguaa

SEQ ID NO: 1425954 - RNA, 19 nt, Homo sapiens
aaacaaggcuuccucaaca

SEQ ID NO: 1425955 - RNA, 19 nt, Homo sapiens
cuaaagaaguuucaacaga

SEQ ID NO: 1425956 - RNA, 19 nt, Homo sapiens
caacagaauuuccacauac

SEQ ID NO: 1425957 - RNA, 19 nt, Homo sapiens
gccaagagauaauaagaga

SEQ ID NO: 1425958 - RNA, 19 nt, Homo sapiens
gcaagugcuuucauccaaa

SEQ ID NO: 1425959 - RNA, 19 nt, Homo sapiens
ucaacagaauuuccacaua

SEQ ID NO: 1425960 - RNA, 19 nt, Homo sapiens
ccacagagacgauugaaga

SEQ ID NO: 1425961 - RNA, 19 nt, Homo sapiens
gcauugcaaucaguauuaa

SEQ ID NO: 1425962 - RNA, 19 nt, Homo sapiens
uccuugaacuuccgaauua

SEQ ID NO: 1425963 - RNA, 19 nt, Homo sapiens
acacaucaaucucaauuca

SEQ ID NO: 1425964 - RNA, 19 nt, Homo sapiens
aagaagaacugcuggaauc

SEQ ID NO: 1425965 - RNA, 19 nt, Homo sapiens
gaaauccuagaaagguuua

SEQ ID NO: 1425966 - RNA, 19 nt, Homo sapiens
caaacaccauuucauaucu

SEQ ID NO: 1425967 - RNA, 19 nt, Homo sapiens
ucaagcaucugaucacauc

SEQ ID NO: 1425968 - RNA, 19 nt, Homo sapiens
gagucggcauucaguauaa

SEQ ID NO: 1425969 - RNA, 19 nt, Homo sapiens
caagagauaauaagagaga

SEQ ID NO: 1425970 - RNA, 19 nt, Homo sapiens
gcucuaggcuaucuacaca

SEQ ID NO: 1425971 - RNA, 19 nt, Homo sapiens
gaaaacacaucaaucucaa

SEQ ID NO: 1425972 - RNA, 19 nt, Homo sapiens
gaacaucaggcauugcaau

SEQ ID NO: 1425973 - RNA, 19 nt, Homo sapiens
aaagcuagguggagacaga

SEQ ID NO: 1425974 - RNA, 19 nt, Homo sapiens
ccucaacagcuaucuauuu

SEQ ID NO: 1425975 - RNA, 19 nt, Homo sapiens
gcauugcugaguucucuua

SEQ ID NO: 1425976 - RNA, 19 nt, Homo sapiens
uaggcuaucuacacacuaa

SEQ ID NO: 1425977 - RNA, 19 nt, Homo sapiens
ggcauugcaaucaguauua

SEQ ID NO: 1425978 - RNA, 19 nt, Homo sapiens
ugaguucucuuaugcaauc

SEQ ID NO: 1425979 - RNA, 19 nt, Homo sapiens
gccaauuucaugcuuauuu

SEQ ID NO: 1425980 - RNA, 19 nt, Homo sapiens
gcaggaaguugagagagau

SEQ ID NO: 1425981 - RNA, 19 nt, Homo sapiens
gggcucaaauacagacuau

SEQ ID NO: 1425982 - RNA, 19 nt, Homo sapiens
gcugaguucucuuaugcaa

SEQ ID NO: 1425983 - RNA, 19 nt, Homo sapiens
ggagguagccuuuauuucc

SEQ ID NO: 1425984 - RNA, 19 nt, Homo sapiens
caacauuacagucuugaau

SEQ ID NO: 1425985 - RNA, 19 nt, Homo sapiens
guauaagaaccaagugaaa

SEQ ID NO: 1425986 - RNA, 19 nt, Homo sapiens
guaaagcuuagaugucauu

SEQ ID NO: 1425987 - RNA, 19 nt, Homo sapiens
gcuagguggagacagauua

SEQ ID NO: 1425988 - RNA, 19 nt, Homo sapiens
gcugaauccaccaaauaua

SEQ ID NO: 1425989 - RNA, 19 nt, Homo sapiens
aacuauagauggcauguug

SEQ ID NO: 1425990 - RNA, 19 nt, Homo sapiens
caacugugcaucucaaaca

SEQ ID NO: 1425991 - RNA, 19 nt, Homo sapiens
cugaauccaccaaauauaa

SEQ ID NO: 1425992 - RNA, 19 nt, Homo sapiens
cagcaacauuacagucuug

SEQ ID NO: 1425993 - RNA, 19 nt, Homo sapiens
uagaaauccuagaaagguu

SEQ ID NO: 1425994 - RNA, 19 nt, Homo sapiens
caaguuuacucuccgucuu

SEQ ID NO: 1425995 - RNA, 19 nt, Homo sapiens
guagaaauccuagaaaggu

SEQ ID NO: 1425996 - RNA, 19 nt, Homo sapiens
ggaaguugagagagauaaa

SEQ ID NO: 1425997 - RNA, 19 nt, Homo sapiens
ugcaugaacccauauauga

SEQ ID NO: 1425998 - RNA, 19 nt, Homo sapiens
aagaacugcuggaaucaga

SEQ ID NO: 1425999 - RNA, 19 nt, Homo sapiens
ggaaaguaucugucacaug

SEQ ID NO: 1426000 - RNA, 19 nt, Homo sapiens
ucaaacauauccucaucuc

SEQ ID NO: 1426001 - RNA, 19 nt, Homo sapiens
gcucaaauacagacuaucu

SEQ ID NO: 1426002 - RNA, 19 nt, Homo sapiens
ggaguugucgccacagaga

SEQ ID NO: 1426003 - RNA, 19 nt, Homo sapiens
ucaaacaccauuucauauc

SEQ ID NO: 1426004 - RNA, 19 nt, Homo sapiens
uugcagagcaucacuggua

SEQ ID NO: 1426005 - RNA, 19 nt, Homo sapiens
uaaagaagaacugcuggaa

SEQ ID NO: 1426006 - RNA, 19 nt, Homo sapiens
gaauuggagggcucugaaa

SEQ ID NO: 1426007 - RNA, 19 nt, Homo sapiens
gcagagucggcauucagua

SEQ ID NO: 1426008 - RNA, 19 nt, Homo sapiens
auucagaucuacacaaaca

SEQ ID NO: 1426009 - RNA, 19 nt, Homo sapiens
cauauccucaucucaguaa

SEQ ID NO: 1426010 - RNA, 19 nt, Homo sapiens
uaugccaauuucaugcuua

SEQ ID NO: 1426011 - RNA, 19 nt, Homo sapiens
gaggcugaauccaccaaau

SEQ ID NO: 1426012 - RNA, 19 nt, Homo sapiens
gggcuucaauugagaacuc

SEQ ID NO: 1426013 - RNA, 19 nt, Homo sapiens
ccuccaggcucuaggcuau

SEQ ID NO: 1426014 - RNA, 19 nt, Homo sapiens
ugaaacagcagcuugucaa

SEQ ID NO: 1426015 - RNA, 19 nt, Homo sapiens
acaauggugucuggagaaa

SEQ ID NO: 1426016 - RNA, 19 nt, Homo sapiens
ucucaaacauauccucauc

SEQ ID NO: 1426017 - RNA, 19 nt, Homo sapiens
caccauuucauaucucuaa

SEQ ID NO: 1426018 - RNA, 19 nt, Homo sapiens
auaccugcauucauuagaa

SEQ ID NO: 1426019 - RNA, 19 nt, Homo sapiens
agaggaacaucaggcauug

SEQ ID NO: 1426020 - RNA, 19 nt, Homo sapiens
ucuacacacuaaagaagaa

SEQ ID NO: 1426021 - RNA, 19 nt, Homo sapiens
cgucuugugucauguguuc

SEQ ID NO: 1426022 - RNA, 19 nt, Homo sapiens
ccuagaaagguuuauggua

SEQ ID NO: 1426023 - RNA, 19 nt, Homo sapiens
aauggugucuggagaaauc

SEQ ID NO: 1426024 - RNA, 19 nt, Homo sapiens
caaacaaggcuuccucaac

SEQ ID NO: 1426025 - RNA, 19 nt, Homo sapiens
agguaaagcuuagauguca

SEQ ID NO: 1426026 - RNA, 19 nt, Homo sapiens
caucucuguuccauuauuc

SEQ ID NO: 1426027 - RNA, 19 nt, Homo sapiens
cccaagaggcucgugaaua

SEQ ID NO: 1426028 - RNA, 19 nt, Homo sapiens
caugaacccauauaugaga

SEQ ID NO: 1426029 - RNA, 19 nt, Homo sapiens
gguggagacagauuaguug

SEQ ID NO: 1426030 - RNA, 19 nt, Homo sapiens
uggucuaucuucugcauga

SEQ ID NO: 1426031 - RNA, 19 nt, Homo sapiens
cuauagauggcauguugua

SEQ ID NO: 1426032 - RNA, 19 nt, Homo sapiens
gaaagggaaaggaguccau

SEQ ID NO: 1426033 - RNA, 19 nt, Homo sapiens
guuaagugcaggaaguuga

SEQ ID NO: 1426034 - RNA, 19 nt, Homo sapiens
ggugaccagguaaagcuua

SEQ ID NO: 1426035 - RNA, 19 nt, Homo sapiens
acucaugccucccucuguu

SEQ ID NO: 1426036 - RNA, 19 nt, Homo sapiens
guauguggauccagugaac

SEQ ID NO: 1426037 - RNA, 19 nt, Homo sapiens
acaauccagccaagagaua

SEQ ID NO: 1426038 - RNA, 19 nt, Homo sapiens
ccaagucucuuuugaacug

SEQ ID NO: 1426039 - RNA, 19 nt, Homo sapiens
aggcugaauccaccaaaua

SEQ ID NO: 1426040 - RNA, 19 nt, Homo sapiens
gacgacacacucauuggaa

SEQ ID NO: 1426041 - RNA, 19 nt, Homo sapiens
gagacgcuccuagagguuu

SEQ ID NO: 1426042 - RNA, 19 nt, Homo sapiens
gaacuuccgaauuaaucug

SEQ ID NO: 1426043 - RNA, 19 nt, Homo sapiens
gauugaagacgcccugcuu

SEQ ID NO: 1426044 - RNA, 19 nt, Homo sapiens
ucagcaacauuacagucuu

SEQ ID NO: 1426045 - RNA, 19 nt, Homo sapiens
ccacaauccagccaagaga

SEQ ID NO: 1426046 - RNA, 19 nt, Homo sapiens
ugcaggaaguugagagaga

SEQ ID NO: 1426047 - RNA, 19 nt, Homo sapiens
cagaauacaaaguacucua

SEQ ID NO: 1426048 - RNA, 19 nt, Homo sapiens
gagaaggagcccagcuuua

SEQ ID NO: 1426049 - RNA, 19 nt, Homo sapiens
ccaaggaggccacauguga

SEQ ID NO: 1426050 - RNA, 19 nt, Homo sapiens
gcaaagaccgcugugagaa

SEQ ID NO: 1426051 - RNA, 19 nt, Homo sapiens
gcaauggcaacaacuuuga

SEQ ID NO: 1426052 - RNA, 19 nt, Homo sapiens
gaaaaugggccucaaguuc

SEQ ID NO: 1426053 - RNA, 19 nt, Homo sapiens
ggccacaugugaccacuuc

SEQ ID NO: 1426054 - RNA, 19 nt, Homo sapiens
gggcaauggcaacaacuuu

SEQ ID NO: 1426055 - RNA, 19 nt, Homo sapiens
gcaggaugcugggaucuac

SEQ ID NO: 1426056 - RNA, 19 nt, Homo sapiens
cggacggccucaccuacua

SEQ ID NO: 1426057 - RNA, 19 nt, Homo sapiens
guuguaaccugccgcuauc

SEQ ID NO: 1426058 - RNA, 19 nt, Homo sapiens
gcaucacacuggccguugu

SEQ ID NO: 1426059 - RNA, 19 nt, Homo sapiens
agacggaccaggaguguga

SEQ ID NO: 1426060 - RNA, 19 nt, Homo sapiens
gugaggucaugcacaagaa

SEQ ID NO: 1426061 - RNA, 19 nt, Homo sapiens
cccagcuggucaucuauaa

SEQ ID NO: 1426062 - RNA, 19 nt, Homo sapiens
ugagaaggagcccagcuuu

SEQ ID NO: 1426063 - RNA, 19 nt, Homo sapiens
ggcaauggcaacaacuuug

SEQ ID NO: 1426064 - RNA, 19 nt, Homo sapiens
gaagcuucgugaggucaug

SEQ ID NO: 1426065 - RNA, 19 nt, Homo sapiens
caaagaccgcugugagaag

SEQ ID NO: 1426066 - RNA, 19 nt, Homo sapiens
caaccacuuugagaccuau

SEQ ID NO: 1426067 - RNA, 19 nt, Homo sapiens
gcccagcuggucaucuaua

SEQ ID NO: 1426068 - RNA, 19 nt, Homo sapiens
gcagcagggcucugagugu

SEQ ID NO: 1426069 - RNA, 19 nt, Homo sapiens
uugcccagcuggucaucua

SEQ ID NO: 1426070 - RNA, 19 nt, Homo sapiens
ggacggccucaccuacuau

SEQ ID NO: 1426071 - RNA, 19 nt, Homo sapiens
gacuguggaugagguccua

SEQ ID NO: 1426072 - RNA, 19 nt, Homo sapiens
gccaguccuuugucuaugg

SEQ ID NO: 1426073 - RNA, 19 nt, Homo sapiens
ccaggagugugagaccuau

SEQ ID NO: 1426074 - RNA, 19 nt, Homo sapiens
gugccaguccuuugucuau

SEQ ID NO: 1426075 - RNA, 19 nt, Homo sapiens
gaagugcugccccaacgua

SEQ ID NO: 1426076 - RNA, 19 nt, Homo sapiens
agaaggagcccagcuuuac

SEQ ID NO: 1426077 - RNA, 19 nt, Homo sapiens
gaggucaugcacaagaaga

SEQ ID NO: 1426078 - RNA, 19 nt, Homo sapiens
cgagggcaauggcaacaac

SEQ ID NO: 1426079 - RNA, 19 nt, Homo sapiens
ugaggacuguggcgaagag

SEQ ID NO: 1426080 - RNA, 19 nt, Homo sapiens
uggaggaucgggagaaugu

SEQ ID NO: 1426081 - RNA, 19 nt, Homo sapiens
caucacacuggccguugua

SEQ ID NO: 1426082 - RNA, 19 nt, Homo sapiens
cagugagcuuccucuguga

SEQ ID NO: 1426083 - RNA, 19 nt, Homo sapiens
uaaccugccgcuaucacuu

SEQ ID NO: 1426084 - RNA, 19 nt, Homo sapiens
ggaggucacucugcuucac

SEQ ID NO: 1426085 - RNA, 19 nt, Homo sapiens
ccuaaaggaugagaaaaug

SEQ ID NO: 1426086 - RNA, 19 nt, Homo sapiens
gagcuuccucugugaugug

SEQ ID NO: 1426087 - RNA, 19 nt, Homo sapiens
gacggccucaccuacuaua

SEQ ID NO: 1426088 - RNA, 19 nt, Homo sapiens
guuggaggaucgggagaau

SEQ ID NO: 1426089 - RNA, 19 nt, Homo sapiens
ggccagcccguguguaagu

SEQ ID NO: 1426090 - RNA, 19 nt, Homo sapiens
agugugagaccuaugagaa

SEQ ID NO: 1426091 - RNA, 19 nt, Homo sapiens
ggccagugccaguccuuug

SEQ ID NO: 1426092 - RNA, 19 nt, Homo sapiens
ugugagaccuaugagaagu

SEQ ID NO: 1426093 - RNA, 19 nt, Homo sapiens
accguaaccucaaccacuu

SEQ ID NO: 1426094 - RNA, 19 nt, Homo sapiens
gcccaaggaggccacaugu

SEQ ID NO: 1426095 - RNA, 19 nt, Homo sapiens
gugagaaggagcccagcuu

SEQ ID NO: 1426096 - RNA, 19 nt, Homo sapiens
gcagggagguuacaacuuu

SEQ ID NO: 1426097 - RNA, 19 nt, Homo sapiens
gaaauguguuccaguuuaa

SEQ ID NO: 1426098 - RNA, 19 nt, Homo sapiens
gagaagaccuacaauacau

SEQ ID NO: 1426099 - RNA, 19 nt, Homo sapiens
gagacaggcugaauuugaa

SEQ ID NO: 1426100 - RNA, 19 nt, Homo sapiens
caagaaccaucuccaaugu

SEQ ID NO: 1426101 - RNA, 19 nt, Homo sapiens
ggagacaggcugaauuuga

SEQ ID NO: 1426102 - RNA, 19 nt, Homo sapiens
acaaccacguggaguauua

SEQ ID NO: 1426103 - RNA, 19 nt, Homo sapiens
agaagcagcugaucauuuc

SEQ ID NO: 1426104 - RNA, 19 nt, Homo sapiens
gaggagacaggcugaauuu

SEQ ID NO: 1426105 - RNA, 19 nt, Homo sapiens
guaggaaccuggccauauc

SEQ ID NO: 1426106 - RNA, 19 nt, Homo sapiens
gauuauaggucaccagucu

SEQ ID NO: 1426107 - RNA, 19 nt, Homo sapiens
ggaguauucgagaguauua

SEQ ID NO: 1426108 - RNA, 19 nt, Homo sapiens
cgucagggcucgagauuuc

SEQ ID NO: 1426109 - RNA, 19 nt, Homo sapiens
ucagaauucuucauugaug

SEQ ID NO: 1426110 - RNA, 19 nt, Homo sapiens
gcagugugcugggaaaugu

SEQ ID NO: 1426111 - RNA, 19 nt, Homo sapiens
acaaagagcagggagguua

SEQ ID NO: 1426112 - RNA, 19 nt, Homo sapiens
gggcauaggagaaacacua

SEQ ID NO: 1426113 - RNA, 19 nt, Homo sapiens
gaagguagacauagugagu

SEQ ID NO: 1426114 - RNA, 19 nt, Homo sapiens
gcaccagaagguagacaua

SEQ ID NO: 1426115 - RNA, 19 nt, Homo sapiens
cagaagcagcugaucauuu

SEQ ID NO: 1426116 - RNA, 19 nt, Homo sapiens
gaacacccuugcugauguc

SEQ ID NO: 1426117 - RNA, 19 nt, Homo sapiens
cuagagaagaccuacaaua

SEQ ID NO: 1426118 - RNA, 19 nt, Homo sapiens
acucagaauucuucauuga

SEQ ID NO: 1426119 - RNA, 19 nt, Homo sapiens
cauccgccauccugucaua

SEQ ID NO: 1426120 - RNA, 19 nt, Homo sapiens
ugaacacccuugcugaugu

SEQ ID NO: 1426121 - RNA, 19 nt, Homo sapiens
caaaugugaagccaacaaa

SEQ ID NO: 1426122 - RNA, 19 nt, Homo sapiens
caagauauuggucauaauc

SEQ ID NO: 1426123 - RNA, 19 nt, Homo sapiens
ucuccaaugugccgcauaa

SEQ ID NO: 1426124 - RNA, 19 nt, Homo sapiens
ucaagaaccaucuccaaug

SEQ ID NO: 1426125 - RNA, 19 nt, Homo sapiens
ucacucagaauucuucauu

SEQ ID NO: 1426126 - RNA, 19 nt, Homo sapiens
ggcugaauuugaacacuuu

SEQ ID NO: 1426127 - RNA, 19 nt, Homo sapiens
gcccagaagugauuauagg

SEQ ID NO: 1426128 - RNA, 19 nt, Homo sapiens
gaucucugcuuggaacuca

SEQ ID NO: 1426129 - RNA, 19 nt, Homo sapiens
cucaagauauuggucauaa

SEQ ID NO: 1426130 - RNA, 19 nt, Homo sapiens
gcaaaugugaagccaacaa

SEQ ID NO: 1426131 - RNA, 19 nt, Homo sapiens
ggauuuauguucggaagca

SEQ ID NO: 1426132 - RNA, 19 nt, Homo sapiens
gguccucaguggccaaguu

SEQ ID NO: 1426133 - RNA, 19 nt, Homo sapiens
accggaagcuguugaaguu

SEQ ID NO: 1426134 - RNA, 19 nt, Homo sapiens
caacgaggagaccaagauu

SEQ ID NO: 1426135 - RNA, 19 nt, Homo sapiens
uaucucaggucaccaccaa

SEQ ID NO: 1426136 - RNA, 19 nt, Homo sapiens
guauuacacuaugcccuuu

SEQ ID NO: 1426137 - RNA, 19 nt, Homo sapiens
uagagaagaccuacaauac

SEQ ID NO: 1426138 - RNA, 19 nt, Homo sapiens
ccaguggcguggucaacuu

SEQ ID NO: 1426139 - RNA, 19 nt, Homo sapiens
ggacgaugauuuucucuuc

SEQ ID NO: 1426140 - RNA, 19 nt, Homo sapiens
gguaggaaccuggccauau

SEQ ID NO: 1426141 - RNA, 19 nt, Homo sapiens
ucccaggccuccaguuuga

SEQ ID NO: 1426142 - RNA, 19 nt, Homo sapiens
auaaaggugugagggcaua

SEQ ID NO: 1426143 - RNA, 19 nt, Homo sapiens
gaacuggcugcccuagaga

SEQ ID NO: 1426144 - RNA, 19 nt, Homo sapiens
agacuugaccguaauagug

SEQ ID NO: 1426145 - RNA, 19 nt, Homo sapiens
uacccagacuugaccguaa

SEQ ID NO: 1426146 - RNA, 19 nt, Homo sapiens
agaacuggcugcccuagag

SEQ ID NO: 1426147 - RNA, 19 nt, Homo sapiens
gaagaccuacaauacauac

SEQ ID NO: 1426148 - RNA, 19 nt, Homo sapiens
gggccugccuucacaagag

SEQ ID NO: 1426149 - RNA, 19 nt, Homo sapiens
ccauugcuaccaagacuuu

SEQ ID NO: 1426150 - RNA, 19 nt, Homo sapiens
ccagagaggaagcucagaa

SEQ ID NO: 1426151 - RNA, 19 nt, Homo sapiens
cagagaggaagcucagaaa

SEQ ID NO: 1426152 - RNA, 19 nt, Homo sapiens
cgaggagacaggcugaauu

SEQ ID NO: 1426153 - RNA, 19 nt, Homo sapiens
ggucaccaccaaauacguu

SEQ ID NO: 1426154 - RNA, 19 nt, Homo sapiens
caucccaggccuccaguuu

SEQ ID NO: 1426155 - RNA, 19 nt, Homo sapiens
ccaaugugccgcauaaagg

SEQ ID NO: 1426156 - RNA, 19 nt, Homo sapiens
gcccuccacuacuucaaga

SEQ ID NO: 1426157 - RNA, 19 nt, Homo sapiens
agaagaccuacaauacaua

SEQ ID NO: 1426158 - RNA, 19 nt, Homo sapiens
agagaagaccuacaauaca

SEQ ID NO: 1426159 - RNA, 19 nt, Homo sapiens
acgaggagaccaagauuga

SEQ ID NO: 1426160 - RNA, 19 nt, Homo sapiens
cagaagccccuggaaauua

SEQ ID NO: 1426161 - RNA, 19 nt, Homo sapiens
uggcauuguuggauuuaug

SEQ ID NO: 1426162 - RNA, 19 nt, Homo sapiens
guacuuggcauuguuggau

SEQ ID NO: 1426163 - RNA, 19 nt, Homo sapiens
ggucauaauccugguacuu

SEQ ID NO: 1426164 - RNA, 19 nt, Homo sapiens
ccugguacuuggcauuguu

SEQ ID NO: 1426165 - RNA, 19 nt, Homo sapiens
agaagccccuggaaauuaa

SEQ ID NO: 1426166 - RNA, 19 nt, Homo sapiens
gagaguauuacccagacuu

SEQ ID NO: 1426167 - RNA, 19 nt, Homo sapiens
cccacaagcucaugaucau

SEQ ID NO: 1426168 - RNA, 19 nt, Homo sapiens
gucauaauccugguacuug

SEQ ID NO: 1426169 - RNA, 19 nt, Homo sapiens
guggccaaguuuccaguga

SEQ ID NO: 1426170 - RNA, 19 nt, Homo sapiens
gaccggaagcuguugaagu

SEQ ID NO: 1426171 - RNA, 19 nt, Homo sapiens
ccagugaccggaagcuguu

SEQ ID NO: 1426172 - RNA, 19 nt, Homo sapiens
gagcagggagguuacaacu

SEQ ID NO: 1426173 - RNA, 19 nt, Homo sapiens
aaugugaagccaacaaaga

SEQ ID NO: 1426174 - RNA, 19 nt, Homo sapiens
caagcuggcccuccacuac

SEQ ID NO: 1426175 - RNA, 19 nt, Homo sapiens
cagaagguagacauaguga

SEQ ID NO: 1426176 - RNA, 19 nt, Homo sapiens
ccagaagguagacauagug

SEQ ID NO: 1426177 - RNA, 19 nt, Homo sapiens
gcggcagugugcugggaaa

SEQ ID NO: 1426178 - RNA, 19 nt, Homo sapiens
aagacaaccacguggagua

SEQ ID NO: 1426179 - RNA, 19 nt, Homo sapiens
cagcugaucauuucuacca

SEQ ID NO: 1426180 - RNA, 19 nt, Homo sapiens
ucaacgaggagaccaagau

SEQ ID NO: 1426181 - RNA, 19 nt, Homo sapiens
cguggaguauuacacuaug

SEQ ID NO: 1426182 - RNA, 19 nt, Homo sapiens
gaucaugcuccggaguauu

SEQ ID NO: 1426183 - RNA, 19 nt, Homo sapiens
ucacccggguccaguucaa

SEQ ID NO: 1426184 - RNA, 19 nt, Homo sapiens
ggaaccuggccauaucuca

SEQ ID NO: 1426185 - RNA, 19 nt, Homo sapiens
cacguggaguauuacacua

SEQ ID NO: 1426186 - RNA, 19 nt, Homo sapiens
agaggaagcucagaaaccu

SEQ ID NO: 1426187 - RNA, 19 nt, Homo sapiens
ggccagaagcagcugauca

SEQ ID NO: 1426188 - RNA, 19 nt, Homo sapiens
aggcugaauuugaacacuu

SEQ ID NO: 1426189 - RNA, 19 nt, Homo sapiens
caacuuucaggaugccuau

SEQ ID NO: 1426190 - RNA, 19 nt, Homo sapiens
ccguaauaguggcugauga

SEQ ID NO: 1426191 - RNA, 19 nt, Homo sapiens
gccagaagcagcugaucau

SEQ ID NO: 1426192 - RNA, 19 nt, Homo sapiens
ggucaugcccagaagugau

SEQ ID NO: 1426193 - RNA, 19 nt, Homo sapiens
gagaggaagcucagaaacc

SEQ ID NO: 1426194 - RNA, 19 nt, Homo sapiens
gaaccucuuuuccuacgau

SEQ ID NO: 1426195 - RNA, 19 nt, Homo sapiens
ucacaagaggaugggauuu

SEQ ID NO: 1426196 - RNA, 19 nt, Homo sapiens
gaaaagaccucacugaaug

SEQ ID NO: 1426197 - RNA, 19 nt, Homo sapiens
gaagacaagccagcgaaua

SEQ ID NO: 1426198 - RNA, 19 nt, Homo sapiens
gggucugccuugcuuauuu

SEQ ID NO: 1426199 - RNA, 19 nt, Homo sapiens
cagcugggaucauguuguu

SEQ ID NO: 1426200 - RNA, 19 nt, Homo sapiens
guacugcucagauuuguug

SEQ ID NO: 1426201 - RNA, 19 nt, Homo sapiens
gcucuacggucguugugaa

SEQ ID NO: 1426202 - RNA, 19 nt, Homo sapiens
ccaugaagauaacccaaga

SEQ ID NO: 1426203 - RNA, 19 nt, Homo sapiens
gcgaauaaaggaugguuga

SEQ ID NO: 1426204 - RNA, 19 nt, Homo sapiens
aagacaagccagcgaauaa

SEQ ID NO: 1426205 - RNA, 19 nt, Homo sapiens
ggauggcugugacuucuag

SEQ ID NO: 1426206 - RNA, 19 nt, Homo sapiens
ccagagugcuacaugacuu

SEQ ID NO: 1426207 - RNA, 19 nt, Homo sapiens
ugggaaaugugguuugguu

SEQ ID NO: 1426208 - RNA, 19 nt, Homo sapiens
gauguacugcucagauuug

SEQ ID NO: 1426209 - RNA, 19 nt, Homo sapiens
ggauguacugcucagauuu

SEQ ID NO: 1426210 - RNA, 19 nt, Homo sapiens
cggauguacugcucagauu

SEQ ID NO: 1426211 - RNA, 19 nt, Homo sapiens
ggucugccuugcuuauuuc

SEQ ID NO: 1426212 - RNA, 19 nt, Homo sapiens
guugugaacuggccagagu

SEQ ID NO: 1426213 - RNA, 19 nt, Homo sapiens
ggaaaagaccucacugaau

SEQ ID NO: 1426214 - RNA, 19 nt, Homo sapiens
ccagugaggccaagcucua

SEQ ID NO: 1426215 - RNA, 19 nt, Homo sapiens
gcacucaagcccuguuucu

SEQ ID NO: 1426216 - RNA, 19 nt, Homo sapiens
gaauaaaggaugguugaac

SEQ ID NO: 1426217 - RNA, 19 nt, Homo sapiens
gaccuaggcuugggaagac

SEQ ID NO: 1426218 - RNA, 19 nt, Homo sapiens
uaaaggaugguugaacguu

SEQ ID NO: 1426219 - RNA, 19 nt, Homo sapiens
gaaaugugguuugguuccu

SEQ ID NO: 1426220 - RNA, 19 nt, Homo sapiens
gccaagcucuacggucguu

SEQ ID NO: 1426221 - RNA, 19 nt, Homo sapiens
ggaagacaagccagcgaau

SEQ ID NO: 1426222 - RNA, 19 nt, Homo sapiens
gacugggucugccuugcuu

SEQ ID NO: 1426223 - RNA, 19 nt, Homo sapiens
ugaacuggccagagugcua

SEQ ID NO: 1426224 - RNA, 19 nt, Homo sapiens
caagccagcgaauaaagga

SEQ ID NO: 1426225 - RNA, 19 nt, Homo sapiens
agacaagccagcgaauaaa

SEQ ID NO: 1426226 - RNA, 19 nt, Homo sapiens
gacaagccagcgaauaaag

SEQ ID NO: 1426227 - RNA, 19 nt, Homo sapiens
gcugggaaaugugguuugg

SEQ ID NO: 1426228 - RNA, 19 nt, Homo sapiens
cagcugcuuuggacuacga

SEQ ID NO: 1426229 - RNA, 19 nt, Homo sapiens
guggauggcugugacuucu

SEQ ID NO: 1426230 - RNA, 19 nt, Homo sapiens
uggccagagugcuacauga

SEQ ID NO: 1426231 - RNA, 19 nt, Homo sapiens
acucaagcccuguuucuuc

SEQ ID NO: 1426232 - RNA, 19 nt, Homo sapiens
ggggacaucuugagcugaa

SEQ ID NO: 1426233 - RNA, 19 nt, Homo sapiens
gggaaaagaccucacugaa

SEQ ID NO: 1426234 - RNA, 19 nt, Homo sapiens
cugcucagauuuguugaau

SEQ ID NO: 1426235 - RNA, 19 nt, Homo sapiens
ugaccuaggcuugggaaga

SEQ ID NO: 1426236 - RNA, 19 nt, Homo sapiens
cuacggucguugugaacug

SEQ ID NO: 1426237 - RNA, 19 nt, Homo sapiens
accguuaucugugccauga

SEQ ID NO: 1426238 - RNA, 19 nt, Homo sapiens
acuucgggcuggacggaua

SEQ ID NO: 1426239 - RNA, 19 nt, Homo sapiens
cgaauaaaggaugguugaa

SEQ ID NO: 1426240 - RNA, 19 nt, Homo sapiens
aaucucaaggauaccguua

SEQ ID NO: 1426241 - RNA, 19 nt, Homo sapiens
gcugaugggagcaccaaca

SEQ ID NO: 1426242 - RNA, 19 nt, Homo sapiens
uuucaacgcagcugcuuug

SEQ ID NO: 1426243 - RNA, 19 nt, Homo sapiens
cugccuugcuuauuucaca

SEQ ID NO: 1426244 - RNA, 19 nt, Homo sapiens
gguuaaagcugaugggaua

SEQ ID NO: 1426245 - RNA, 19 nt, Homo sapiens
ggaauuagcuggucaugag

SEQ ID NO: 1426246 - RNA, 19 nt, Homo sapiens
gaucaaccaucccuuugua

SEQ ID NO: 1426247 - RNA, 19 nt, Homo sapiens
uaacaagguugggauauaa

SEQ ID NO: 1426248 - RNA, 19 nt, Homo sapiens
guaacaagguugggauaua

SEQ ID NO: 1426249 - RNA, 19 nt, Homo sapiens
ccagaaagcuguauuugca

SEQ ID NO: 1426250 - RNA, 19 nt, Homo sapiens
gaagaacucugggaacuac

SEQ ID NO: 1426251 - RNA, 19 nt, Homo sapiens
ggucagaucuggaagaacu

SEQ ID NO: 1426252 - RNA, 19 nt, Homo sapiens
cagcaaguguuuauguauu

SEQ ID NO: 1426253 - RNA, 19 nt, Homo sapiens
cuaccagaguuucccauua

SEQ ID NO: 1426254 - RNA, 19 nt, Homo sapiens
cugaauugcuguuugguuu

SEQ ID NO: 1426255 - RNA, 19 nt, Homo sapiens
gcucaagccuacacuaucu

SEQ ID NO: 1426256 - RNA, 19 nt, Homo sapiens
gcaacagagugagaucuug

SEQ ID NO: 1426257 - RNA, 19 nt, Homo sapiens
gcaaagaggagguuagcau

SEQ ID NO: 1426258 - RNA, 19 nt, Homo sapiens
gaacgaggccaucugaaac

SEQ ID NO: 1426259 - RNA, 19 nt, Homo sapiens
gaagguggugcccaaggua

SEQ ID NO: 1426260 - RNA, 19 nt, Homo sapiens
ggaagaacucugggaacua

SEQ ID NO: 1426261 - RNA, 19 nt, Homo sapiens
caagguugggauauaaaua

SEQ ID NO: 1426262 - RNA, 19 nt, Homo sapiens
gauacuagaccauuuagag

SEQ ID NO: 1426263 - RNA, 19 nt, Homo sapiens
ugaacgaggccaucugaaa

SEQ ID NO: 1426264 - RNA, 19 nt, Homo sapiens
uaccagaguuucccauuag

SEQ ID NO: 1426265 - RNA, 19 nt, Homo sapiens
gagcucaagccuacacuau

SEQ ID NO: 1426266 - RNA, 19 nt, Homo sapiens
gaugugaagauggagaaua

SEQ ID NO: 1426267 - RNA, 19 nt, Homo sapiens
guacugauacuagaccauu

SEQ ID NO: 1426268 - RNA, 19 nt, Homo sapiens
uguguuaucuccaugacuu

SEQ ID NO: 1426269 - RNA, 19 nt, Homo sapiens
ucucuuugcugccgaguug

SEQ ID NO: 1426270 - RNA, 19 nt, Homo sapiens
gaucuguacucccuuuggu

SEQ ID NO: 1426271 - RNA, 19 nt, Homo sapiens
aaacggcaccuuuucauua

SEQ ID NO: 1426272 - RNA, 19 nt, Homo sapiens
uaauugcuguggauacugu

SEQ ID NO: 1426273 - RNA, 19 nt, Homo sapiens
caagcaggguggcaacauc

SEQ ID NO: 1426274 - RNA, 19 nt, Homo sapiens
cuaaauauucagcugauug

SEQ ID NO: 1426275 - RNA, 19 nt, Homo sapiens
caggucagaucuggaagaa

SEQ ID NO: 1426276 - RNA, 19 nt, Homo sapiens
guucaucaaccucuuucua

SEQ ID NO: 1426277 - RNA, 19 nt, Homo sapiens
gagcccaauuuguggucua

SEQ ID NO: 1426278 - RNA, 19 nt, Homo sapiens
ccauuuagagcccaauuug

SEQ ID NO: 1426279 - RNA, 19 nt, Homo sapiens
caacagagugagaucuugu

SEQ ID NO: 1426280 - RNA, 19 nt, Homo sapiens
caucaggucagaucuggaa

SEQ ID NO: 1426281 - RNA, 19 nt, Homo sapiens
gaaacugacagacuuuggu

SEQ ID NO: 1426282 - RNA, 19 nt, Homo sapiens
uaaauaaggcaauguaucc

SEQ ID NO: 1426283 - RNA, 19 nt, Homo sapiens
gagagagguuaaagcugau

SEQ ID NO: 1426284 - RNA, 19 nt, Homo sapiens
cugaugggauacaggaauu

SEQ ID NO: 1426285 - RNA, 19 nt, Homo sapiens
gcaccaggaaucccuaaag

SEQ ID NO: 1426286 - RNA, 19 nt, Homo sapiens
gugaagauggagaauauuc

SEQ ID NO: 1426287 - RNA, 19 nt, Homo sapiens
ggaaccaucaggucagauc

SEQ ID NO: 1426288 - RNA, 19 nt, Homo sapiens
uaagaaugcgugggagaaa

SEQ ID NO: 1426289 - RNA, 19 nt, Homo sapiens
gagaugugaagauggagaa

SEQ ID NO: 1426290 - RNA, 19 nt, Homo sapiens
acagaucaaccaucccuuu

SEQ ID NO: 1426291 - RNA, 19 nt, Homo sapiens
augugaagauggagaauau

SEQ ID NO: 1426292 - RNA, 19 nt, Homo sapiens
aaagcuguauuugcaguga

SEQ ID NO: 1426293 - RNA, 19 nt, Homo sapiens
gaaugcgugggagaaauuu

SEQ ID NO: 1426294 - RNA, 19 nt, Homo sapiens
agaaugcgugggagaaauu

SEQ ID NO: 1426295 - RNA, 19 nt, Homo sapiens
gcacccagaaagcuguauu

SEQ ID NO: 1426296 - RNA, 19 nt, Homo sapiens
acugauacuagaccauuua

SEQ ID NO: 1426297 - RNA, 19 nt, Homo sapiens
gcauccagccugagcaaca

SEQ ID NO: 1426298 - RNA, 19 nt, Homo sapiens
ugaagguggugcccaaggu

SEQ ID NO: 1426299 - RNA, 19 nt, Homo sapiens
uucagcaaguguuuaugua

SEQ ID NO: 1426300 - RNA, 19 nt, Homo sapiens
gguacuguguuaucuccau

SEQ ID NO: 1426301 - RNA, 19 nt, Homo sapiens
cacuaaauauucagcugau

SEQ ID NO: 1426302 - RNA, 19 nt, Homo sapiens
cagaucaaccaucccuuug

SEQ ID NO: 1426303 - RNA, 19 nt, Homo sapiens
ggucuaccuucagcaagug

SEQ ID NO: 1426304 - RNA, 19 nt, Homo sapiens
uggaagaacucugggaacu

SEQ ID NO: 1426305 - RNA, 19 nt, Homo sapiens
ggagcucaagccuacacua

SEQ ID NO: 1426306 - RNA, 19 nt, Homo sapiens
gccagugccucaguucauc

SEQ ID NO: 1426307 - RNA, 19 nt, Homo sapiens
ucagcaaguguuuauguau

SEQ ID NO: 1426308 - RNA, 19 nt, Homo sapiens
ccuuaaggacacuaaauau

SEQ ID NO: 1426309 - RNA, 19 nt, Homo sapiens
aagaaugcgugggagaaau

SEQ ID NO: 1426310 - RNA, 19 nt, Homo sapiens
ggaggcagaggcugggaau

SEQ ID NO: 1426311 - RNA, 19 nt, Homo sapiens
ggugagagagguuaaagcu

SEQ ID NO: 1426312 - RNA, 19 nt, Homo sapiens
caccaggaaucccuaaagc

SEQ ID NO: 1426313 - RNA, 19 nt, Homo sapiens
gcugggaaugggagcagua

SEQ ID NO: 1426314 - RNA, 19 nt, Homo sapiens
gcugaugggauacaggaau

SEQ ID NO: 1426315 - RNA, 19 nt, Homo sapiens
guggcacucuucaguacau

SEQ ID NO: 1426316 - RNA, 19 nt, Homo sapiens
gauggagguugcggugagu

SEQ ID NO: 1426317 - RNA, 19 nt, Homo sapiens
ggucggcuguuggcugcuu

SEQ ID NO: 1426318 - RNA, 19 nt, Homo sapiens
aaccaucccuuuguacaca

SEQ ID NO: 1426319 - RNA, 19 nt, Homo sapiens
uacugauacuagaccauuu

SEQ ID NO: 1426320 - RNA, 19 nt, Homo sapiens
guuagcauccagcgacaga

SEQ ID NO: 1426321 - RNA, 19 nt, Homo sapiens
caagguaaagguccuacag

SEQ ID NO: 1426322 - RNA, 19 nt, Homo sapiens
ucaguucaucaaccucuuu

SEQ ID NO: 1426323 - RNA, 19 nt, Homo sapiens
gcuagucauguucuugguu

SEQ ID NO: 1426324 - RNA, 19 nt, Homo sapiens
ggguggcugucccucacaa

SEQ ID NO: 1426325 - RNA, 19 nt, Homo sapiens
accuuaaggacacuaaaua

SEQ ID NO: 1426326 - RNA, 19 nt, Homo sapiens
cuuuggaacuguccucaag

SEQ ID NO: 1426327 - RNA, 19 nt, Homo sapiens
cacccagaaagcuguauuu

SEQ ID NO: 1426328 - RNA, 19 nt, Homo sapiens
ccaagaauaucuccuuuga

SEQ ID NO: 1426329 - RNA, 19 nt, Homo sapiens
caaguagacuggacacaaa

SEQ ID NO: 1426330 - RNA, 19 nt, Homo sapiens
ggacagaacaucuuucaga

SEQ ID NO: 1426331 - RNA, 19 nt, Homo sapiens
gacagaacaucuuucagaa

SEQ ID NO: 1426332 - RNA, 19 nt, Homo sapiens
ccacucagcuugacaccaa

SEQ ID NO: 1426333 - RNA, 19 nt, Homo sapiens
cagaacaucuuucagaaca

SEQ ID NO: 1426334 - RNA, 19 nt, Homo sapiens
acacggagacugacucuaa

SEQ ID NO: 1426335 - RNA, 19 nt, Homo sapiens
guaugaagcuaagguguau

SEQ ID NO: 1426336 - RNA, 19 nt, Homo sapiens
agacggagauggugaaugg

SEQ ID NO: 1426337 - RNA, 19 nt, Homo sapiens
gagcugggcaaccgugaua

SEQ ID NO: 1426338 - RNA, 19 nt, Homo sapiens
gguaugaagcuaaggugua

SEQ ID NO: 1426339 - RNA, 19 nt, Homo sapiens
ccauggaacugaccaccaa

SEQ ID NO: 1426340 - RNA, 19 nt, Homo sapiens
ggucaaaggcugugagaca

SEQ ID NO: 1426341 - RNA, 19 nt, Homo sapiens
gcacaagggcaaggucaaa

SEQ ID NO: 1426342 - RNA, 19 nt, Homo sapiens
gcuagccucugugguugua

SEQ ID NO: 1426343 - RNA, 19 nt, Homo sapiens
ugccaucacugcagaagaa

SEQ ID NO: 1426344 - RNA, 19 nt, Homo sapiens
gaauggguaugaagcuaag

SEQ ID NO: 1426345 - RNA, 19 nt, Homo sapiens
caccaagaauaucuccuuu

SEQ ID NO: 1426346 - RNA, 19 nt, Homo sapiens
gaaccgcagcuuugucuuc

SEQ ID NO: 1426347 - RNA, 19 nt, Homo sapiens
uccaagaucugcccuagug

SEQ ID NO: 1426348 - RNA, 19 nt, Homo sapiens
aaagagggauggaagaaaa

SEQ ID NO: 1426349 - RNA, 19 nt, Homo sapiens
gcacuagacccaaguagac

SEQ ID NO: 1426350 - RNA, 19 nt, Homo sapiens
ccaccaagacacagaaguu

SEQ ID NO: 1426351 - RNA, 19 nt, Homo sapiens
gugaauggguaugaagcua

SEQ ID NO: 1426352 - RNA, 19 nt, Homo sapiens
gauggugaauggguaugaa

SEQ ID NO: 1426353 - RNA, 19 nt, Homo sapiens
caaagagggauggaagaaa

SEQ ID NO: 1426354 - RNA, 19 nt, Homo sapiens
cgagggaaccgcagcuuug

SEQ ID NO: 1426355 - RNA, 19 nt, Homo sapiens
gcugcuagccucugugguu

SEQ ID NO: 1426356 - RNA, 19 nt, Homo sapiens
ccacacuccugggcuuuga

SEQ ID NO: 1426357 - RNA, 19 nt, Homo sapiens
cacggagacugacucuaaa

SEQ ID NO: 1426358 - RNA, 19 nt, Homo sapiens
acgacgaccugcugcaauu

SEQ ID NO: 1426359 - RNA, 19 nt, Homo sapiens
gccagaaccugaggguaga

SEQ ID NO: 1426360 - RNA, 19 nt, Homo sapiens
gggaggcgcuaaccaacag

SEQ ID NO: 1426361 - RNA, 19 nt, Homo sapiens
ccaaguagacuggacacaa

SEQ ID NO: 1426362 - RNA, 19 nt, Homo sapiens
ccaagacacagaaguucaa

SEQ ID NO: 1426363 - RNA, 19 nt, Homo sapiens
gcugcaagguggacaucga

SEQ ID NO: 1426364 - RNA, 19 nt, Homo sapiens
ugaauggguaugaagcuaa

SEQ ID NO: 1426365 - RNA, 19 nt, Homo sapiens
gagcagcaaagaggcagua

SEQ ID NO: 1426366 - RNA, 19 nt, Homo sapiens
ggacuucuacguggagaug

SEQ ID NO: 1426367 - RNA, 19 nt, Homo sapiens
gcacacggacagaacaucu

SEQ ID NO: 1426368 - RNA, 19 nt, Homo sapiens
gauucugaggcacaaauaa

SEQ ID NO: 1426369 - RNA, 19 nt, Homo sapiens
ggaacugaccaccaagaca

SEQ ID NO: 1426370 - RNA, 19 nt, Homo sapiens
acacggacagaacaucuuu

SEQ ID NO: 1426371 - RNA, 19 nt, Homo sapiens
caucuaacguggagcucau

SEQ ID NO: 1426372 - RNA, 19 nt, Homo sapiens
gcgagggaaccgcagcuuu

SEQ ID NO: 1426373 - RNA, 19 nt, Homo sapiens
gaagaaaagaacaaagaga

SEQ ID NO: 1426374 - RNA, 19 nt, Homo sapiens
gcucagaagggacacaaag

SEQ ID NO: 1426375 - RNA, 19 nt, Homo sapiens
ccucauggccgucagcaau

SEQ ID NO: 1426376 - RNA, 19 nt, Homo sapiens
ggagauggugaauggguau

SEQ ID NO: 1426377 - RNA, 19 nt, Homo sapiens
ggacaucgagcagcuggau

SEQ ID NO: 1426378 - RNA, 19 nt, Homo sapiens
caagcgccguggucaugga

SEQ ID NO: 1426379 - RNA, 19 nt, Homo sapiens
cuaaaacccuucauccaau

SEQ ID NO: 1426380 - RNA, 19 nt, Homo sapiens
acaaagagggauggaagaa

SEQ ID NO: 1426381 - RNA, 19 nt, Homo sapiens
ggagaugaaaugggaguuc

SEQ ID NO: 1426382 - RNA, 19 nt, Homo sapiens
ccucaacggcugcgacgaa

SEQ ID NO: 1426383 - RNA, 19 nt, Homo sapiens
cuagugacaccuacaaagu

SEQ ID NO: 1426384 - RNA, 19 nt, Homo sapiens
gcuucccaguuaagauuga

SEQ ID NO: 1426385 - RNA, 19 nt, Homo sapiens
agacaccuuugcaguccuu

SEQ ID NO: 1426386 - RNA, 19 nt, Homo sapiens
gggaaccgcagcuuugucu

SEQ ID NO: 1426387 - RNA, 19 nt, Homo sapiens
cagcagggaguguguccaa

SEQ ID NO: 1426388 - RNA, 19 nt, Homo sapiens
gccgggugguguacacaga

SEQ ID NO: 1426389 - RNA, 19 nt, Homo sapiens
gggccaggagccagacaaa

SEQ ID NO: 1426390 - RNA, 19 nt, Homo sapiens
uggcuucccaguuaagauu

SEQ ID NO: 1426391 - RNA, 19 nt, Homo sapiens
caucacugcagaagaauac

SEQ ID NO: 1426392 - RNA, 19 nt, Homo sapiens
acaccaagaauaucuccuu

SEQ ID NO: 1426393 - RNA, 19 nt, Homo sapiens
gagggaaccgcagcuuugu

SEQ ID NO: 1426394 - RNA, 19 nt, Homo sapiens
uaaaacccuucauccaaug

SEQ ID NO: 1426395 - RNA, 19 nt, Homo sapiens
uaagcacuagacccaagua

SEQ ID NO: 1426396 - RNA, 19 nt, Homo sapiens
caaaaugggacccugauca

SEQ ID NO: 1426397 - RNA, 19 nt, Homo sapiens
cacaagcgccguggucaug

SEQ ID NO: 1426398 - RNA, 19 nt, Homo sapiens
gaccuaugguuggcugaag

SEQ ID NO: 1426399 - RNA, 19 nt, Homo sapiens
gcgccguggucauggagau

SEQ ID NO: 1426400 - RNA, 19 nt, Homo sapiens
aaccgcagcuuugucuuca

SEQ ID NO: 1426401 - RNA, 19 nt, Homo sapiens
ugauucugaggcacaaaua

SEQ ID NO: 1426402 - RNA, 19 nt, Homo sapiens
ucagaagggacacaaagag

SEQ ID NO: 1426403 - RNA, 19 nt, Homo sapiens
gaagacaguuggccucuac

SEQ ID NO: 1426404 - RNA, 19 nt, Homo sapiens
ggaagcaguucuacaagca

SEQ ID NO: 1426405 - RNA, 19 nt, Homo sapiens
ggagaaagacgccaaccaa

SEQ ID NO: 1426406 - RNA, 19 nt, Homo sapiens
ugaacaacauccucaaguu

SEQ ID NO: 1426407 - RNA, 19 nt, Homo sapiens
ggacaaaggcuugcacugu

SEQ ID NO: 1426408 - RNA, 19 nt, Homo sapiens
aggacgagaugcuaaauuu

SEQ ID NO: 1426409 - RNA, 19 nt, Homo sapiens
ccagaagugugucuugaga

SEQ ID NO: 1426410 - RNA, 19 nt, Homo sapiens
ggugcuaauuccuuuguaa

SEQ ID NO: 1426411 - RNA, 19 nt, Homo sapiens
gcaggaggaugacaaacuc

SEQ ID NO: 1426412 - RNA, 19 nt, Homo sapiens
gacaaacucuuccucaaaa

SEQ ID NO: 1426413 - RNA, 19 nt, Homo sapiens
cagagaaugucaccaaugg

SEQ ID NO: 1426414 - RNA, 19 nt, Homo sapiens
ugacaaacucuuccucaaa

SEQ ID NO: 1426415 - RNA, 19 nt, Homo sapiens
caaccugccucuccagauc

SEQ ID NO: 1426416 - RNA, 19 nt, Homo sapiens
guaccgagccagagaaugu

SEQ ID NO: 1426417 - RNA, 19 nt, Homo sapiens
ggaaucaagcucaucuaug

SEQ ID NO: 1426418 - RNA, 19 nt, Homo sapiens
caaccaaggcgagaagaaa

SEQ ID NO: 1426419 - RNA, 19 nt, Homo sapiens
uuuauugccuugaugauug

SEQ ID NO: 1426420 - RNA, 19 nt, Homo sapiens
gauucugccucuugccaaa

SEQ ID NO: 1426421 - RNA, 19 nt, Homo sapiens
ggugaguuguguuuggauu

SEQ ID NO: 1426422 - RNA, 19 nt, Homo sapiens
uuccucaacugcuucuuua

SEQ ID NO: 1426423 - RNA, 19 nt, Homo sapiens
gaccuucaccucauuaaca

SEQ ID NO: 1426424 - RNA, 19 nt, Homo sapiens
ggacgagaugcuaaauuug

SEQ ID NO: 1426425 - RNA, 19 nt, Homo sapiens
ucacagggaagcaguucua

SEQ ID NO: 1426426 - RNA, 19 nt, Homo sapiens
cagggaagcaguucuacaa

SEQ ID NO: 1426427 - RNA, 19 nt, Homo sapiens
guaucgucauggacaagua

SEQ ID NO: 1426428 - RNA, 19 nt, Homo sapiens
ugucggugcuaauuccuuu

SEQ ID NO: 1426429 - RNA, 19 nt, Homo sapiens
cauuaacacugcccaacau

SEQ ID NO: 1426430 - RNA, 19 nt, Homo sapiens
uaaauuuggccuucacugu

SEQ ID NO: 1426431 - RNA, 19 nt, Homo sapiens
ccaggaggccuucguguag

SEQ ID NO: 1426432 - RNA, 19 nt, Homo sapiens
guacggagcaaguaaacca

SEQ ID NO: 1426433 - RNA, 19 nt, Homo sapiens
ccacguuuauugccuugau

SEQ ID NO: 1426434 - RNA, 19 nt, Homo sapiens
gacgagaugcuaaauuugg

SEQ ID NO: 1426435 - RNA, 19 nt, Homo sapiens
gaggaggugagcuggauga

SEQ ID NO: 1426436 - RNA, 19 nt, Homo sapiens
caacauguucggcgaccuu

SEQ ID NO: 1426437 - RNA, 19 nt, Homo sapiens
gcucaagucagagggcuuu

SEQ ID NO: 1426438 - RNA, 19 nt, Homo sapiens
ucaucaugcucaagucaga

SEQ ID NO: 1426439 - RNA, 19 nt, Homo sapiens
uccagaagaucacuaaugc

SEQ ID NO: 1426440 - RNA, 19 nt, Homo sapiens
gccagagaaugucaccaau

SEQ ID NO: 1426441 - RNA, 19 nt, Homo sapiens
ggaggaugacaaacucuuc

SEQ ID NO: 1426442 - RNA, 19 nt, Homo sapiens
ggacuacucggugaagauc

SEQ ID NO: 1426443 - RNA, 19 nt, Homo sapiens
ucuaggaguuagcccuuau

SEQ ID NO: 1426444 - RNA, 19 nt, Homo sapiens
acaaaggcuugcacugucu

SEQ ID NO: 1426445 - RNA, 19 nt, Homo sapiens
ccagagaaugucaccaaug

SEQ ID NO: 1426446 - RNA, 19 nt, Homo sapiens
gaggcaggaggaugacaaa

SEQ ID NO: 1426447 - RNA, 19 nt, Homo sapiens
ggccggaggacauggacua

SEQ ID NO: 1426448 - RNA, 19 nt, Homo sapiens
ucaacugcuucuuuaacug

SEQ ID NO: 1426449 - RNA, 19 nt, Homo sapiens
cggaggacauggacuacuc

SEQ ID NO: 1426450 - RNA, 19 nt, Homo sapiens
guuggaggccgguggagaa

SEQ ID NO: 1426451 - RNA, 19 nt, Homo sapiens
ggggugaccugccucauuc

SEQ ID NO: 1426452 - RNA, 19 nt, Homo sapiens
ccucuacaccuccaucuuc

SEQ ID NO: 1426453 - RNA, 19 nt, Homo sapiens
gcccaggacgagaugcuaa

SEQ ID NO: 1426454 - RNA, 19 nt, Homo sapiens
ggggugggcucuaggaguu

SEQ ID NO: 1426455 - RNA, 19 nt, Homo sapiens
ccaccugaagggaauuuga

SEQ ID NO: 1426456 - RNA, 19 nt, Homo sapiens
agaagacaguuggccucua

SEQ ID NO: 1426457 - RNA, 19 nt, Homo sapiens
gcucaucaugcucaaguca

SEQ ID NO: 1426458 - RNA, 19 nt, Homo sapiens
gcuucugccucccgcucua

SEQ ID NO: 1426459 - RNA, 19 nt, Homo sapiens
cgaggagcccgaggagaaa

SEQ ID NO: 1426460 - RNA, 19 nt, Homo sapiens
ggaggcugaaggaguguga

SEQ ID NO: 1426461 - RNA, 19 nt, Homo sapiens
cgucauuggcuacaucaug

SEQ ID NO: 1426462 - RNA, 19 nt, Homo sapiens
gaucacagggaagcaguuc

SEQ ID NO: 1426463 - RNA, 19 nt, Homo sapiens
acaaguauggcccgaggaa

SEQ ID NO: 1426464 - RNA, 19 nt, Homo sapiens
ucggagcucugugguggaa

SEQ ID NO: 1426465 - RNA, 19 nt, Homo sapiens
ccaaccaaggcgagaagaa

SEQ ID NO: 1426466 - RNA, 19 nt, Homo sapiens
caggacgagaugcuaaauu

SEQ ID NO: 1426467 - RNA, 19 nt, Homo sapiens
gugaguuguguuuggauuu

SEQ ID NO: 1426468 - RNA, 19 nt, Homo sapiens
gugcuaauuccuuuguaau

SEQ ID NO: 1426469 - RNA, 19 nt, Homo sapiens
cgcucuaccugaucugcua

SEQ ID NO: 1426470 - RNA, 19 nt, Homo sapiens
guuuauugccuugaugauu

SEQ ID NO: 1426471 - RNA, 19 nt, Homo sapiens
ggauguguaugaccuucac

SEQ ID NO: 1426472 - RNA, 19 nt, Homo sapiens
gggcuuugaccacaagauc

SEQ ID NO: 1426473 - RNA, 19 nt, Homo sapiens
gcuucgcgguuuccugcuu

SEQ ID NO: 1426474 - RNA, 19 nt, Homo sapiens
caggaggccuucguguagu

SEQ ID NO: 1426475 - RNA, 19 nt, Homo sapiens
gcugggcuuugaccacaag

SEQ ID NO: 1426476 - RNA, 19 nt, Homo sapiens
acuacucggugaagaucaa

SEQ ID NO: 1426477 - RNA, 19 nt, Homo sapiens
ucaucgcccuggcucugaa

SEQ ID NO: 1426478 - RNA, 19 nt, Homo sapiens
gaaggacucuggcuauauu

SEQ ID NO: 1426479 - RNA, 19 nt, Homo sapiens
ggacaacccuccacacaga

SEQ ID NO: 1426480 - RNA, 19 nt, Homo sapiens
acaauuggcuuucauucua

SEQ ID NO: 1426481 - RNA, 19 nt, Homo sapiens
gauuacagcugggccaaua

SEQ ID NO: 1426482 - RNA, 19 nt, Homo sapiens
caaauaagaccaacucaau

SEQ ID NO: 1426483 - RNA, 19 nt, Homo sapiens
gccguagccucuucuguua

SEQ ID NO: 1426484 - RNA, 19 nt, Homo sapiens
ucacagcccucagauauca

SEQ ID NO: 1426485 - RNA, 19 nt, Homo sapiens
ccaacucaauuuccacuug

SEQ ID NO: 1426486 - RNA, 19 nt, Homo sapiens
uaucaacgggcacaaauaa

SEQ ID NO: 1426487 - RNA, 19 nt, Homo sapiens
gaagaauuauguguguguu

SEQ ID NO: 1426488 - RNA, 19 nt, Homo sapiens
ugagaagaauuaugugugu

SEQ ID NO: 1426489 - RNA, 19 nt, Homo sapiens
acgaggcaauaacaaauua

SEQ ID NO: 1426490 - RNA, 19 nt, Homo sapiens
aagcaggccucguggauga

SEQ ID NO: 1426491 - RNA, 19 nt, Homo sapiens
gcuauauucugcaaaugug

SEQ ID NO: 1426492 - RNA, 19 nt, Homo sapiens
gcacaaauaagaccaacuc

SEQ ID NO: 1426493 - RNA, 19 nt, Homo sapiens
ccaaaagccugcugaguug

SEQ ID NO: 1426494 - RNA, 19 nt, Homo sapiens
caauuggcuuucauucuau

SEQ ID NO: 1426495 - RNA, 19 nt, Homo sapiens
ggaaggacucuggcuauau

SEQ ID NO: 1426496 - RNA, 19 nt, Homo sapiens
guaauggcagcacggcuua

SEQ ID NO: 1426497 - RNA, 19 nt, Homo sapiens
ccacuugaauuuacaacca

SEQ ID NO: 1426498 - RNA, 19 nt, Homo sapiens
ccucacagcccucagauau

SEQ ID NO: 1426499 - RNA, 19 nt, Homo sapiens
gggccuauauagauguuga

SEQ ID NO: 1426500 - RNA, 19 nt, Homo sapiens
uggaaggacucuggcuaua

SEQ ID NO: 1426501 - RNA, 19 nt, Homo sapiens
cagcugggccaauacagua

SEQ ID NO: 1426502 - RNA, 19 nt, Homo sapiens
uuucaacacuauucccuuu

SEQ ID NO: 1426503 - RNA, 19 nt, Homo sapiens
guacgaggcaauaacaaau

SEQ ID NO: 1426504 - RNA, 19 nt, Homo sapiens
gauaucaacgggcacaaau

SEQ ID NO: 1426505 - RNA, 19 nt, Homo sapiens
gagcgggugggccuauaua

SEQ ID NO: 1426506 - RNA, 19 nt, Homo sapiens
ucaacgggcacaaauaaga

SEQ ID NO: 1426507 - RNA, 19 nt, Homo sapiens
gcugagaugcugacacuuc

SEQ ID NO: 1426508 - RNA, 19 nt, Homo sapiens
ggcaauaacaaauuagugu

SEQ ID NO: 1426509 - RNA, 19 nt, Homo sapiens
aguaggcccuugacacuug

SEQ ID NO: 1426510 - RNA, 19 nt, Homo sapiens
cguagccucuucuguuaau

SEQ ID NO: 1426511 - RNA, 19 nt, Homo sapiens
aacuacagcugcaagagaa

SEQ ID NO: 1426512 - RNA, 19 nt, Homo sapiens
cugaacaaagcaacaauuu

SEQ ID NO: 1426513 - RNA, 19 nt, Homo sapiens
aaacuacagcugcaagaga

SEQ ID NO: 1426514 - RNA, 19 nt, Homo sapiens
aaauuaguguggguugauu

SEQ ID NO: 1426515 - RNA, 19 nt, Homo sapiens
gcucggccgugucuacgau

SEQ ID NO: 1426516 - RNA, 19 nt, Homo sapiens
gcugacacuucacaauugg

SEQ ID NO: 1426517 - RNA, 19 nt, Homo sapiens
gggugggccuauauagaug

SEQ ID NO: 1426518 - RNA, 19 nt, Homo sapiens
gccaucacaugcuccuuuc

SEQ ID NO: 1426519 - RNA, 19 nt, Homo sapiens
cgagacgcauccagagcuu

SEQ ID NO: 1426520 - RNA, 19 nt, Homo sapiens
gcacugacccagguagaag

SEQ ID NO: 1426521 - RNA, 19 nt, Homo sapiens
acaaauuaguguggguuga

SEQ ID NO: 1426522 - RNA, 19 nt, Homo sapiens
ccgcugagaugcugacacu

SEQ ID NO: 1426523 - RNA, 19 nt, Homo sapiens
uagccucuucuguuaauaa

SEQ ID NO: 1426524 - RNA, 19 nt, Homo sapiens
gcaagagaagcagacauuc

SEQ ID NO: 1426525 - RNA, 19 nt, Homo sapiens
ugcugacacuucacaauug

SEQ ID NO: 1426526 - RNA, 19 nt, Homo sapiens
caaagcaacaauuuaaagc

SEQ ID NO: 1426527 - RNA, 19 nt, Homo sapiens
gcgggugggccuauauaga

SEQ ID NO: 1426528 - RNA, 19 nt, Homo sapiens
acaaauaagaccaacucaa

SEQ ID NO: 1426529 - RNA, 19 nt, Homo sapiens
ggucagcuuuucaacacua

SEQ ID NO: 1426530 - RNA, 19 nt, Homo sapiens
uguauaagccaggugcuaa

SEQ ID NO: 1426531 - RNA, 19 nt, Homo sapiens
ugcaagagaagcagacauu

SEQ ID NO: 1426532 - RNA, 19 nt, Homo sapiens
acacuucacaauuggcuuu

SEQ ID NO: 1426533 - RNA, 19 nt, Homo sapiens
caaauuaguguggguugau

SEQ ID NO: 1426534 - RNA, 19 nt, Homo sapiens
cgcgcuggcuuucgccuuu

SEQ ID NO: 1426535 - RNA, 19 nt, Homo sapiens
cagaagaguggagguguga

SEQ ID NO: 1426536 - RNA, 19 nt, Homo sapiens
caacaaacuacagcugcaa

SEQ ID NO: 1426537 - RNA, 19 nt, Homo sapiens
cugagaugcugacacuuca

SEQ ID NO: 1426538 - RNA, 19 nt, Homo sapiens
aaagccugcugaguugauu

SEQ ID NO: 1426539 - RNA, 19 nt, Homo sapiens
ggagcgggugggccuauau

SEQ ID NO: 1426540 - RNA, 19 nt, Homo sapiens
guagccucuucuguuaaua

SEQ ID NO: 1426541 - RNA, 19 nt, Homo sapiens
ucuaagccguagccucuuc

SEQ ID NO: 1426542 - RNA, 19 nt, Homo sapiens
ggacucuggcuauauucug

SEQ ID NO: 1426543 - RNA, 19 nt, Homo sapiens
gagaugcugacacuucaca

SEQ ID NO: 1426544 - RNA, 19 nt, Homo sapiens
gaugcugacacuucacaau

SEQ ID NO: 1426545 - RNA, 19 nt, Homo sapiens
ggaccuggaccacccaaac

SEQ ID NO: 1426546 - RNA, 19 nt, Homo sapiens
cgggugggccuauauagau

SEQ ID NO: 1426547 - RNA, 19 nt, Homo sapiens
ggcuauauucugcaaaugu

SEQ ID NO: 1426548 - RNA, 19 nt, Homo sapiens
aaacuuggcagaguacaca

SEQ ID NO: 1426549 - RNA, 19 nt, Homo sapiens
ucacaauuggcuuucauuc

SEQ ID NO: 1426550 - RNA, 19 nt, Homo sapiens
gaggcaauaacaaauuagu

SEQ ID NO: 1426551 - RNA, 19 nt, Homo sapiens
ugaagcaggccucguggau

SEQ ID NO: 1426552 - RNA, 19 nt, Homo sapiens
guggaggugugagcagaga

SEQ ID NO: 1426553 - RNA, 19 nt, Homo sapiens
agaugucucugaacaaagc

SEQ ID NO: 1426554 - RNA, 19 nt, Homo sapiens
uacgaggcaauaacaaauu

SEQ ID NO: 1426555 - RNA, 19 nt, Homo sapiens
cacuugaauuuacaaccaa

SEQ ID NO: 1426556 - RNA, 19 nt, Homo sapiens
agaagaauuaugugugugu

SEQ ID NO: 1426557 - RNA, 19 nt, Homo sapiens
caauuuaaagcaacgacau

SEQ ID NO: 1426558 - RNA, 19 nt, Homo sapiens
ggccgugucuacgaugugu

SEQ ID NO: 1426559 - RNA, 19 nt, Homo sapiens
cuggcuauauucugcaaau

SEQ ID NO: 1426560 - RNA, 19 nt, Homo sapiens
caacacuauucccuuugac

SEQ ID NO: 1426561 - RNA, 19 nt, Homo sapiens
guaggcccuugacacuugu

SEQ ID NO: 1426562 - RNA, 19 nt, Homo sapiens
ugaguaggcccuugacacu

SEQ ID NO: 1426563 - RNA, 19 nt, Homo sapiens
gggaagaccuuuaggguua

SEQ ID NO: 1426564 - RNA, 19 nt, Homo sapiens
gcacaggccucaaucuuaa

SEQ ID NO: 1426565 - RNA, 19 nt, Homo sapiens
gaagaaagauaccaugaau

SEQ ID NO: 1426566 - RNA, 19 nt, Homo sapiens
ggaaaggccuucauucaga

SEQ ID NO: 1426567 - RNA, 19 nt, Homo sapiens
ggaaagacauuuggaacua

SEQ ID NO: 1426568 - RNA, 19 nt, Homo sapiens
ggacaaacccuaugaaugu

SEQ ID NO: 1426569 - RNA, 19 nt, Homo sapiens
ggccagaacucagagauua

SEQ ID NO: 1426570 - RNA, 19 nt, Homo sapiens
gguaaagccuucagucaaa

SEQ ID NO: 1426571 - RNA, 19 nt, Homo sapiens
gaaagacauuuggaacuaa

SEQ ID NO: 1426572 - RNA, 19 nt, Homo sapiens
agagaaaccuuaugaaugu

SEQ ID NO: 1426573 - RNA, 19 nt, Homo sapiens
gcaagaaccuuuugggaua

SEQ ID NO: 1426574 - RNA, 19 nt, Homo sapiens
ggagagagacccuauaaau

SEQ ID NO: 1426575 - RNA, 19 nt, Homo sapiens
aagcauagcucaggccuua

SEQ ID NO: 1426576 - RNA, 19 nt, Homo sapiens
ggcaaagccuucaagcaua

SEQ ID NO: 1426577 - RNA, 19 nt, Homo sapiens
gaaacccuaugaaugcuuu

SEQ ID NO: 1426578 - RNA, 19 nt, Homo sapiens
ccacaugggucauuauuag

SEQ ID NO: 1426579 - RNA, 19 nt, Homo sapiens
ggagagagacuuuccauca

SEQ ID NO: 1426580 - RNA, 19 nt, Homo sapiens
gagagaaaccuuaugaaug

SEQ ID NO: 1426581 - RNA, 19 nt, Homo sapiens
gagaagcccuauguaugua

SEQ ID NO: 1426582 - RNA, 19 nt, Homo sapiens
agaaauacccuucagaauu

SEQ ID NO: 1426583 - RNA, 19 nt, Homo sapiens
uaaagaauguggaaagaca

SEQ ID NO: 1426584 - RNA, 19 nt, Homo sapiens
agaaagaccgggagaauaa

SEQ ID NO: 1426585 - RNA, 19 nt, Homo sapiens
caacuuaucauacaucaga

SEQ ID NO: 1426586 - RNA, 19 nt, Homo sapiens
gcaaagccuucaagcauag

SEQ ID NO: 1426587 - RNA, 19 nt, Homo sapiens
aaucagaacucacaucuca

SEQ ID NO: 1426588 - RNA, 19 nt, Homo sapiens
gagagaaacccuaugaaug

SEQ ID NO: 1426589 - RNA, 19 nt, Homo sapiens
uuaccaaggucaugaguuu

SEQ ID NO: 1426590 - RNA, 19 nt, Homo sapiens
ggagagaaaccuuaugaau

SEQ ID NO: 1426591 - RNA, 19 nt, Homo sapiens
gcucaggccuuauuagaca

SEQ ID NO: 1426592 - RNA, 19 nt, Homo sapiens
gagaaaccauaugaaugua

SEQ ID NO: 1426593 - RNA, 19 nt, Homo sapiens
ggagagaaaccauaugaau

SEQ ID NO: 1426594 - RNA, 19 nt, Homo sapiens
gcccaaaucugguuacaca

SEQ ID NO: 1426595 - RNA, 19 nt, Homo sapiens
gagaaagaccgggagaaua

SEQ ID NO: 1426596 - RNA, 19 nt, Homo sapiens
caaauacuaucaaggaaag

SEQ ID NO: 1426597 - RNA, 19 nt, Homo sapiens
ucaauucucuguccucuuc

SEQ ID NO: 1426598 - RNA, 19 nt, Homo sapiens
ggaguaaucugcaaaauag

SEQ ID NO: 1426599 - RNA, 19 nt, Homo sapiens
gcaaauacuaucaaggaaa

SEQ ID NO: 1426600 - RNA, 19 nt, Homo sapiens
gcaaauccuuaaccucaau

SEQ ID NO: 1426601 - RNA, 19 nt, Homo sapiens
gacaaacccuaugaaugua

SEQ ID NO: 1426602 - RNA, 19 nt, Homo sapiens
gagagagacccuauaaaug

SEQ ID NO: 1426603 - RNA, 19 nt, Homo sapiens
ggagagaaacccuaugaau

SEQ ID NO: 1426604 - RNA, 19 nt, Homo sapiens
gagcuuauccggcaucaga

SEQ ID NO: 1426605 - RNA, 19 nt, Homo sapiens
aaccauaucuguguaauga

SEQ ID NO: 1426606 - RNA, 19 nt, Homo sapiens
gagaauucaugcuggagaa

SEQ ID NO: 1426607 - RNA, 19 nt, Homo sapiens
ccucauacauguaaagaau

SEQ ID NO: 1426608 - RNA, 19 nt, Homo sapiens
gcacuuguaucuuauuagg

SEQ ID NO: 1426609 - RNA, 19 nt, Homo sapiens
gaacucagagauuauuaga

SEQ ID NO: 1426610 - RNA, 19 nt, Homo sapiens
gagagaaaccauaugaaug

SEQ ID NO: 1426611 - RNA, 19 nt, Homo sapiens
gaagaugaggcacuuguau

SEQ ID NO: 1426612 - RNA, 19 nt, Homo sapiens
aggcggaccucucaccuua

SEQ ID NO: 1426613 - RNA, 19 nt, Homo sapiens
gagagacccuauaaaugug

SEQ ID NO: 1426614 - RNA, 19 nt, Homo sapiens
gcggaccucucaccuuauu

SEQ ID NO: 1426615 - RNA, 19 nt, Homo sapiens
auucagaguucacaccuua

SEQ ID NO: 1426616 - RNA, 19 nt, Homo sapiens
caaaucugguuacacauca

SEQ ID NO: 1426617 - RNA, 19 nt, Homo sapiens
augaggcacuuguaucuua

SEQ ID NO: 1426618 - RNA, 19 nt, Homo sapiens
gaauguagcgagugugaga

SEQ ID NO: 1426619 - RNA, 19 nt, Homo sapiens
gagaaaccuuaugaaugua

SEQ ID NO: 1426620 - RNA, 19 nt, Homo sapiens
agagagacccuauaaaugu

SEQ ID NO: 1426621 - RNA, 19 nt, Homo sapiens
ucacaucucauccagcaua

SEQ ID NO: 1426622 - RNA, 19 nt, Homo sapiens
caggguugaugaucuuuaa

SEQ ID NO: 1426623 - RNA, 19 nt, Homo sapiens
acucagagauuauuagaca

SEQ ID NO: 1426624 - RNA, 19 nt, Homo sapiens
gagaaaagccucauacaug

SEQ ID NO: 1426625 - RNA, 19 nt, Homo sapiens
ggaguuagugcauuugcua

SEQ ID NO: 1426626 - RNA, 19 nt, Homo sapiens
ggagagaagccuuaugagu

SEQ ID NO: 1426627 - RNA, 19 nt, Homo sapiens
gaaugugggaagaccuuua

SEQ ID NO: 1426628 - RNA, 19 nt, Homo sapiens
ccagaaauacccuucagaa

SEQ ID NO: 1426629 - RNA, 19 nt, Homo sapiens
ccauaucuguguaaugaau

SEQ ID NO: 1426630 - RNA, 19 nt, Homo sapiens
agagggaguuagugcauuu

SEQ ID NO: 1426631 - RNA, 19 nt, Homo sapiens
ugaagaagaugaggcacuu

SEQ ID NO: 1426632 - RNA, 19 nt, Homo sapiens
gaacuucuuagacaugaga

SEQ ID NO: 1426633 - RNA, 19 nt, Homo sapiens
gcauagcucaggccuuauu

SEQ ID NO: 1426634 - RNA, 19 nt, Homo sapiens
cagcaucagagaauucaua

SEQ ID NO: 1426635 - RNA, 19 nt, Homo sapiens
gugcaaauacuaucaagga

SEQ ID NO: 1426636 - RNA, 19 nt, Homo sapiens
aggguuaguucacagcuua

SEQ ID NO: 1426637 - RNA, 19 nt, Homo sapiens
agagaaaccauaugaaugu

SEQ ID NO: 1426638 - RNA, 19 nt, Homo sapiens
cgacggcaccugagaauuc

SEQ ID NO: 1426639 - RNA, 19 nt, Homo sapiens
gagagagacuuuccaucag

SEQ ID NO: 1426640 - RNA, 19 nt, Homo sapiens
ugagaagcccuauguaugu

SEQ ID NO: 1426641 - RNA, 19 nt, Homo sapiens
ggugagaagcccuauguau

SEQ ID NO: 1426642 - RNA, 19 nt, Homo sapiens
aaagauaccaugaaugcaa

SEQ ID NO: 1426643 - RNA, 19 nt, Homo sapiens
caucauagaauucauacug

SEQ ID NO: 1426644 - RNA, 19 nt, Homo sapiens
aagaaugucagaagacuuu

SEQ ID NO: 1426645 - RNA, 19 nt, Homo sapiens
gugagaagcccuauguaug

SEQ ID NO: 1426646 - RNA, 19 nt, Homo sapiens
aaauucagcccuuauucua

SEQ ID NO: 1426647 - RNA, 19 nt, Homo sapiens
ggccugcgauugugagaug

SEQ ID NO: 1426648 - RNA, 19 nt, Homo sapiens
gggagaauaaugagaguga

SEQ ID NO: 1426649 - RNA, 19 nt, Homo sapiens
uaagaaaucacccucaagu

SEQ ID NO: 1426650 - RNA, 19 nt, Homo sapiens
guaaugaugauuugugcaa

SEQ ID NO: 1426651 - RNA, 19 nt, Homo sapiens
gggacaaacccuaugaaug

SEQ ID NO: 1426652 - RNA, 19 nt, Homo sapiens
gaaaauucauacuggagaa

SEQ ID NO: 1426653 - RNA, 19 nt, Homo sapiens
cgagagaguccauggaaga

SEQ ID NO: 1426654 - RNA, 19 nt, Homo sapiens
cauauacgcaaauccuuaa

SEQ ID NO: 1426655 - RNA, 19 nt, Homo sapiens
caucagagaauucauacug

SEQ ID NO: 1426656 - RNA, 19 nt, Homo sapiens
gaauguaaagaauguggaa

SEQ ID NO: 1426657 - RNA, 19 nt, Homo sapiens
aaggaaaggacaugaauug

SEQ ID NO: 1426658 - RNA, 19 nt, Homo sapiens
ugacugguaaugaugauuu

SEQ ID NO: 1426659 - RNA, 19 nt, Homo sapiens
gagaguucauaguggagaa

SEQ ID NO: 1426660 - RNA, 19 nt, Homo sapiens
ggccaaaacuuccuagaga

SEQ ID NO: 1426661 - RNA, 19 nt, Homo sapiens
caugggucauuauuagaaa

SEQ ID NO: 1426662 - RNA, 19 nt, Homo sapiens
ggauaauucugagcugcuu

SEQ ID NO: 1426663 - RNA, 19 nt, Homo sapiens
gaaccaagaucgcaccauu

SEQ ID NO: 1426664 - RNA, 19 nt, Homo sapiens
gauggaaucucuagcuauu

SEQ ID NO: 1426665 - RNA, 19 nt, Homo sapiens
gugagaaccugucuuuaaa

SEQ ID NO: 1426666 - RNA, 19 nt, Homo sapiens
gcagagagcuaggaucaca

SEQ ID NO: 1426667 - RNA, 19 nt, Homo sapiens
gaucucaucuguacuaaaa

SEQ ID NO: 1426668 - RNA, 19 nt, Homo sapiens
ugaggcagcuccagaauca

SEQ ID NO: 1426669 - RNA, 19 nt, Homo sapiens
cagaggcgcugguucuaaa

SEQ ID NO: 1426670 - RNA, 19 nt, Homo sapiens
cagaagagccuguggucua

SEQ ID NO: 1426671 - RNA, 19 nt, Homo sapiens
ccucacaccuguaaucuca

SEQ ID NO: 1426672 - RNA, 19 nt, Homo sapiens
gaaggccucuguccacuac

SEQ ID NO: 1426673 - RNA, 19 nt, Homo sapiens
ccuguaaucucagcacuuu

SEQ ID NO: 1426674 - RNA, 19 nt, Homo sapiens
ggaggacaguggaaagagu

SEQ ID NO: 1426675 - RNA, 19 nt, Homo sapiens
caagaucgcaccauugcaa

SEQ ID NO: 1426676 - RNA, 19 nt, Homo sapiens
gagcuaacaaucauucuuc

SEQ ID NO: 1426677 - RNA, 19 nt, Homo sapiens
ccucuggccuuuuaaguua

SEQ ID NO: 1426678 - RNA, 19 nt, Homo sapiens
gcaggagaaucacuugaac

SEQ ID NO: 1426679 - RNA, 19 nt, Homo sapiens
agugagaaccugucuuuaa

SEQ ID NO: 1426680 - RNA, 19 nt, Homo sapiens
caacaaagcaagaucucau

SEQ ID NO: 1426681 - RNA, 19 nt, Homo sapiens
gaguucagauccagcuuuc

SEQ ID NO: 1426682 - RNA, 19 nt, Homo sapiens
acacagagcacgcccaugu

SEQ ID NO: 1426683 - RNA, 19 nt, Homo sapiens
gaaaccccgucucuacuaa

SEQ ID NO: 1426684 - RNA, 19 nt, Homo sapiens
gagaccagcuugggcaaca

SEQ ID NO: 1426685 - RNA, 19 nt, Homo sapiens
gcagaaggcagaguuaucu

SEQ ID NO: 1426686 - RNA, 19 nt, Homo sapiens
agaagagccuguggucuau

SEQ ID NO: 1426687 - RNA, 19 nt, Homo sapiens
cggauggaaucucuagcua

SEQ ID NO: 1426688 - RNA, 19 nt, Homo sapiens
agagugagaaccugucuuu

SEQ ID NO: 1426689 - RNA, 19 nt, Homo sapiens
gcaucagggucagcaagaa

SEQ ID NO: 1426690 - RNA, 19 nt, Homo sapiens
cagaacugcuggcacuguu

SEQ ID NO: 1426691 - RNA, 19 nt, Homo sapiens
gauagcuccucaggcaauu

SEQ ID NO: 1426692 - RNA, 19 nt, Homo sapiens
ggacaccccuuaccuaucu

SEQ ID NO: 1426693 - RNA, 19 nt, Homo sapiens
gagaaccugucuuuaaaau

SEQ ID NO: 1426694 - RNA, 19 nt, Homo sapiens
ggucaaggcaggaagauac

SEQ ID NO: 1426695 - RNA, 19 nt, Homo sapiens
gagcaucccagcacuugug

SEQ ID NO: 1426696 - RNA, 19 nt, Homo sapiens
ucgcucaacugcuccuuug

SEQ ID NO: 1426697 - RNA, 19 nt, Homo sapiens
gggaugcucuacugagucu

SEQ ID NO: 1426698 - RNA, 19 nt, Homo sapiens
cagggcaggucgacaggaa

SEQ ID NO: 1426699 - RNA, 19 nt, Homo sapiens
cuaacaaucauucuucaga

SEQ ID NO: 1426700 - RNA, 19 nt, Homo sapiens
ggaggcaccaggacucuuc

SEQ ID NO: 1426701 - RNA, 19 nt, Homo sapiens
gagcagacacagcagcaau

SEQ ID NO: 1426702 - RNA, 19 nt, Homo sapiens
gcaagaaccaacagagcau

SEQ ID NO: 1426703 - RNA, 19 nt, Homo sapiens
ggaaccagcagagcagcua

SEQ ID NO: 1426704 - RNA, 19 nt, Homo sapiens
ggauggaaucucuagcuau

SEQ ID NO: 1426705 - RNA, 19 nt, Homo sapiens
ggcaggagaaucacuugaa

SEQ ID NO: 1426706 - RNA, 19 nt, Homo sapiens
gcaccuguaaucccagcua

SEQ ID NO: 1426707 - RNA, 19 nt, Homo sapiens
ggccaaggcagguggauca

SEQ ID NO: 1426708 - RNA, 19 nt, Homo sapiens
ccauggagcgggcagaaga

SEQ ID NO: 1426709 - RNA, 19 nt, Homo sapiens
ggccaagucuaccacuagu

SEQ ID NO: 1426710 - RNA, 19 nt, Homo sapiens
gcaaccugguggccaaguc

SEQ ID NO: 1426711 - RNA, 19 nt, Homo sapiens
cagacuggguacaaaauaa

SEQ ID NO: 1426712 - RNA, 19 nt, Homo sapiens
uggaaucucuagcuauuuu

SEQ ID NO: 1426713 - RNA, 19 nt, Homo sapiens
ccagagcuaacaaucauuc

SEQ ID NO: 1426714 - RNA, 19 nt, Homo sapiens
ccuguaaucccagcacuuu

SEQ ID NO: 1426715 - RNA, 19 nt, Homo sapiens
gagugagaaccugucuuua

SEQ ID NO: 1426716 - RNA, 19 nt, Homo sapiens
caucagaggcgcugguucu

SEQ ID NO: 1426717 - RNA, 19 nt, Homo sapiens
uaccuagacuugaguucug

SEQ ID NO: 1426718 - RNA, 19 nt, Homo sapiens
gcagagcccaggguacugu

SEQ ID NO: 1426719 - RNA, 19 nt, Homo sapiens
aagagccuguggucuauca

SEQ ID NO: 1426720 - RNA, 19 nt, Homo sapiens
gcuaagaaaaucaggguaa

SEQ ID NO: 1426721 - RNA, 19 nt, Homo sapiens
cccaaccucuggccuuuua

SEQ ID NO: 1426722 - RNA, 19 nt, Homo sapiens
ucagaggcgcugguucuaa

SEQ ID NO: 1426723 - RNA, 19 nt, Homo sapiens
cagcggcucugugcuccuu

SEQ ID NO: 1426724 - RNA, 19 nt, Homo sapiens
cccugcaggugccauguuu

SEQ ID NO: 1426725 - RNA, 19 nt, Homo sapiens
cauccagagcuaacaauca

SEQ ID NO: 1426726 - RNA, 19 nt, Homo sapiens
cagagcaucccagcacuug

SEQ ID NO: 1426727 - RNA, 19 nt, Homo sapiens
cgauagcuccucaggcaau

SEQ ID NO: 1426728 - RNA, 19 nt, Homo sapiens
gcccaggcccacuuuggaa

SEQ ID NO: 1426729 - RNA, 19 nt, Homo sapiens
aacaaucauucuucagauc

SEQ ID NO: 1426730 - RNA, 19 nt, Homo sapiens
ggaggaggaggagacauca

SEQ ID NO: 1426731 - RNA, 19 nt, Homo sapiens
ugaguucagauccagcuuu

SEQ ID NO: 1426732 - RNA, 19 nt, Homo sapiens
acaaucauucuucagauca

SEQ ID NO: 1426733 - RNA, 19 nt, Homo sapiens
aaaauuagcugggcauggu

SEQ ID NO: 1426734 - RNA, 19 nt, Homo sapiens
cugcagagagcuaggauca

SEQ ID NO: 1426735 - RNA, 19 nt, Homo sapiens
gguggagguugcagugaac

SEQ ID NO: 1426736 - RNA, 19 nt, Homo sapiens
gagccuguggucuaucaga

SEQ ID NO: 1426737 - RNA, 19 nt, Homo sapiens
ggcagaaggcagaguuauc

SEQ ID NO: 1426738 - RNA, 19 nt, Homo sapiens
gcacaccuguccccaagca

SEQ ID NO: 1426739 - RNA, 19 nt, Homo sapiens
ucaaggcugcagagagcua

SEQ ID NO: 1426740 - RNA, 19 nt, Homo sapiens
gcagacacagcagcaaugg

SEQ ID NO: 1426741 - RNA, 19 nt, Homo sapiens
auccagagcuaacaaucau

SEQ ID NO: 1426742 - RNA, 19 nt, Homo sapiens
cgcuugagcucaggaguuc

SEQ ID NO: 1426743 - RNA, 19 nt, Homo sapiens
gaaagaggcuucaaaucua

SEQ ID NO: 1426744 - RNA, 19 nt, Homo sapiens
ccacaaagcuugaagagua

SEQ ID NO: 1426745 - RNA, 19 nt, Homo sapiens
ggaauacucugucuaguuu

SEQ ID NO: 1426746 - RNA, 19 nt, Homo sapiens
ggacagaauuuaccucuaa

SEQ ID NO: 1426747 - RNA, 19 nt, Homo sapiens
ggaguuagaugacuuugua

SEQ ID NO: 1426748 - RNA, 19 nt, Homo sapiens
gagaaagaguuuacaagua

SEQ ID NO: 1426749 - RNA, 19 nt, Homo sapiens
ugucaacucugcuuaauua

SEQ ID NO: 1426750 - RNA, 19 nt, Homo sapiens
uaaagaagcugcuaacauc

SEQ ID NO: 1426751 - RNA, 19 nt, Homo sapiens
acagaaagauggaaacuaa

SEQ ID NO: 1426752 - RNA, 19 nt, Homo sapiens
gcacuuugaugauuuaaga

SEQ ID NO: 1426753 - RNA, 19 nt, Homo sapiens
gagcaugccuugaaauguu

SEQ ID NO: 1426754 - RNA, 19 nt, Homo sapiens
gcuggaaggugacaugaua

SEQ ID NO: 1426755 - RNA, 19 nt, Homo sapiens
gcauauaccuugaauuuac

SEQ ID NO: 1426756 - RNA, 19 nt, Homo sapiens
gaugauggcucuaauucuu

SEQ ID NO: 1426757 - RNA, 19 nt, Homo sapiens
ggaaagaggcuucaaaucu

SEQ ID NO: 1426758 - RNA, 19 nt, Homo sapiens
gaaauuacuucagacagaa

SEQ ID NO: 1426759 - RNA, 19 nt, Homo sapiens
gcuaacaucuugucacaug

SEQ ID NO: 1426760 - RNA, 19 nt, Homo sapiens
gauaacauggugaacauua

SEQ ID NO: 1426761 - RNA, 19 nt, Homo sapiens
ugaugaaggugacaaagua

SEQ ID NO: 1426762 - RNA, 19 nt, Homo sapiens
gaaaggagacggugagugu

SEQ ID NO: 1426763 - RNA, 19 nt, Homo sapiens
caggaugccuugaagauuu

SEQ ID NO: 1426764 - RNA, 19 nt, Homo sapiens
gaagccagcuguaagaaag

SEQ ID NO: 1426765 - RNA, 19 nt, Homo sapiens
ggagaaugaugaccuugaa

SEQ ID NO: 1426766 - RNA, 19 nt, Homo sapiens
gaagaaaaguccucugauu

SEQ ID NO: 1426767 - RNA, 19 nt, Homo sapiens
ugucuuagcugcugauuug

SEQ ID NO: 1426768 - RNA, 19 nt, Homo sapiens
caagaaccauauucaaaga

SEQ ID NO: 1426769 - RNA, 19 nt, Homo sapiens
gaacuuggaagacuuucua

SEQ ID NO: 1426770 - RNA, 19 nt, Homo sapiens
uaaaugcucucgccaagga

SEQ ID NO: 1426771 - RNA, 19 nt, Homo sapiens
uagguagucuuacuugaua

SEQ ID NO: 1426772 - RNA, 19 nt, Homo sapiens
ucauacagcuaaugcuaua

SEQ ID NO: 1426773 - RNA, 19 nt, Homo sapiens
gauaauggcaagauuggua

SEQ ID NO: 1426774 - RNA, 19 nt, Homo sapiens
ggaagaacuuggaagacuu

SEQ ID NO: 1426775 - RNA, 19 nt, Homo sapiens
gaugaagaauuccagaaga

SEQ ID NO: 1426776 - RNA, 19 nt, Homo sapiens
guccaaggcuacacagaua

SEQ ID NO: 1426777 - RNA, 19 nt, Homo sapiens
gacagaaaguuaucaagug

SEQ ID NO: 1426778 - RNA, 19 nt, Homo sapiens
guaugaggauguuucaauu

SEQ ID NO: 1426779 - RNA, 19 nt, Homo sapiens
uaacgucagugauaauaug

SEQ ID NO: 1426780 - RNA, 19 nt, Homo sapiens
aaagaggcuucaaaucuaa

SEQ ID NO: 1426781 - RNA, 19 nt, Homo sapiens
uaaagaagagguagagaaa

SEQ ID NO: 1426782 - RNA, 19 nt, Homo sapiens
ugacaaauccaguagaauu

SEQ ID NO: 1426783 - RNA, 19 nt, Homo sapiens
auacaggauucgauaguua

SEQ ID NO: 1426784 - RNA, 19 nt, Homo sapiens
ugaaugagcuacaggaaca

SEQ ID NO: 1426785 - RNA, 19 nt, Homo sapiens
auuaagaccugccaacuuu

SEQ ID NO: 1426786 - RNA, 19 nt, Homo sapiens
ugaaagaaaguccacauuu

SEQ ID NO: 1426787 - RNA, 19 nt, Homo sapiens
gggauuaagucaccuaaag

SEQ ID NO: 1426788 - RNA, 19 nt, Homo sapiens
gaagaacuuggaagacuuu

SEQ ID NO: 1426789 - RNA, 19 nt, Homo sapiens
gaagaauuccagaagauug

SEQ ID NO: 1426790 - RNA, 19 nt, Homo sapiens
gcauggguaucccuauaaa

SEQ ID NO: 1426791 - RNA, 19 nt, Homo sapiens
gcacuaaagacuguugaua

SEQ ID NO: 1426792 - RNA, 19 nt, Homo sapiens
gauggaaacuaaaguacau

SEQ ID NO: 1426793 - RNA, 19 nt, Homo sapiens
ucucugaccucaagacauu

SEQ ID NO: 1426794 - RNA, 19 nt, Homo sapiens
gacugaagcuggugaaaca

SEQ ID NO: 1426795 - RNA, 19 nt, Homo sapiens
gauaaaagguggucgaguu

SEQ ID NO: 1426796 - RNA, 19 nt, Homo sapiens
guuaagacauguaccugaa

SEQ ID NO: 1426797 - RNA, 19 nt, Homo sapiens
agaaugaucuaguugaugu

SEQ ID NO: 1426798 - RNA, 19 nt, Homo sapiens
gcaauuaguacucuggaaa

SEQ ID NO: 1426799 - RNA, 19 nt, Homo sapiens
gcaaaauuauggagaauga

SEQ ID NO: 1426800 - RNA, 19 nt, Homo sapiens
gaaguaacccauggauauu

SEQ ID NO: 1426801 - RNA, 19 nt, Homo sapiens
ugaaguaacccauggauau

SEQ ID NO: 1426802 - RNA, 19 nt, Homo sapiens
agaaagaguuuacaaguac

SEQ ID NO: 1426803 - RNA, 19 nt, Homo sapiens
acaguucuuuggauucuua

SEQ ID NO: 1426804 - RNA, 19 nt, Homo sapiens
guauacaguucuuuggauu

SEQ ID NO: 1426805 - RNA, 19 nt, Homo sapiens
cagauacucuuagcuacua

SEQ ID NO: 1426806 - RNA, 19 nt, Homo sapiens
uagcauggguaucccuaua

SEQ ID NO: 1426807 - RNA, 19 nt, Homo sapiens
gaaaugcgacaggcacuaa

SEQ ID NO: 1426808 - RNA, 19 nt, Homo sapiens
ugaaugaucuuccagugau

SEQ ID NO: 1426809 - RNA, 19 nt, Homo sapiens
ggagaaagaguuuacaagu

SEQ ID NO: 1426810 - RNA, 19 nt, Homo sapiens
gguucugguugcaguauua

SEQ ID NO: 1426811 - RNA, 19 nt, Homo sapiens
ucuaagaaauguugggauu

SEQ ID NO: 1426812 - RNA, 19 nt, Homo sapiens
guacaagccucaguaaguc

SEQ ID NO: 1426813 - RNA, 19 nt, Homo sapiens
augaugaccuugaaucuaa

SEQ ID NO: 1426814 - RNA, 19 nt, Homo sapiens
uugcuaagcuuaacccaaa

SEQ ID NO: 1426815 - RNA, 19 nt, Homo sapiens
gcagugguuuacauguuaa

SEQ ID NO: 1426816 - RNA, 19 nt, Homo sapiens
caaugaagcccuuaacugu

SEQ ID NO: 1426817 - RNA, 19 nt, Homo sapiens
gaagauaacauggugaaca

SEQ ID NO: 1426818 - RNA, 19 nt, Homo sapiens
gugguaagauuuaugugaa

SEQ ID NO: 1426819 - RNA, 19 nt, Homo sapiens
uaccaacccucccuagaaa

SEQ ID NO: 1426820 - RNA, 19 nt, Homo sapiens
gcgugaugcugccagguua

SEQ ID NO: 1426821 - RNA, 19 nt, Homo sapiens
caaagaauggcauaaacuu

SEQ ID NO: 1426822 - RNA, 19 nt, Homo sapiens
gaucaccuuugaaugaaau

SEQ ID NO: 1426823 - RNA, 19 nt, Homo sapiens
guacuauugcucauucaua

SEQ ID NO: 1426824 - RNA, 19 nt, Homo sapiens
gaagugguaagauuuaugu

SEQ ID NO: 1426825 - RNA, 19 nt, Homo sapiens
aguaacccauggauauuua

SEQ ID NO: 1426826 - RNA, 19 nt, Homo sapiens
gaacuauuaaccacaagaa

SEQ ID NO: 1426827 - RNA, 19 nt, Homo sapiens
gacagacacuaguagaaau

SEQ ID NO: 1426828 - RNA, 19 nt, Homo sapiens
ccuauaaaccgugaaauuu

SEQ ID NO: 1426829 - RNA, 19 nt, Homo sapiens
aaaaggaaaugcugucuaa

SEQ ID NO: 1426830 - RNA, 19 nt, Homo sapiens
gaaagaguuuacaaguaca

SEQ ID NO: 1426831 - RNA, 19 nt, Homo sapiens
uaagaaagcauuccagucu

SEQ ID NO: 1426832 - RNA, 19 nt, Homo sapiens
gaugacguguuugcuguuu

SEQ ID NO: 1426833 - RNA, 19 nt, Homo sapiens
ccauggauauuuacacuca

SEQ ID NO: 1426834 - RNA, 19 nt, Homo sapiens
caauagagaaggaaauuuc

SEQ ID NO: 1426835 - RNA, 19 nt, Homo sapiens
ucuguuauguucucaugua

SEQ ID NO: 1426836 - RNA, 19 nt, Homo sapiens
uuaaagcacagguaaguaa

SEQ ID NO: 1426837 - RNA, 19 nt, Homo sapiens
acacagauacucuuagcua

SEQ ID NO: 1426838 - RNA, 19 nt, Homo sapiens
ugauucauccagcaaauua

SEQ ID NO: 1426839 - RNA, 19 nt, Homo sapiens
ucaguaagucucuggauaa

SEQ ID NO: 1426840 - RNA, 19 nt, Homo sapiens
caugaaaguggcaagguua

SEQ ID NO: 1426841 - RNA, 19 nt, Homo sapiens
guuguaacgucagugauaa

SEQ ID NO: 1426842 - RNA, 19 nt, Homo sapiens
gagggacacccagaaauuu

SEQ ID NO: 1426843 - RNA, 19 nt, Homo sapiens
guaaugauauugucaggua

SEQ ID NO: 1426844 - RNA, 19 nt, Homo sapiens
gcgcaugcuugcccuauua

SEQ ID NO: 1426845 - RNA, 19 nt, Homo sapiens
gggcuucucugucaucuga

SEQ ID NO: 1426846 - RNA, 19 nt, Homo sapiens
gcagaggacaagcuucuua

SEQ ID NO: 1426847 - RNA, 19 nt, Homo sapiens
agaaggagcagagaaauua

SEQ ID NO: 1426848 - RNA, 19 nt, Homo sapiens
gaagaccgcguccugaauu

SEQ ID NO: 1426849 - RNA, 19 nt, Homo sapiens
ugacagcuguacccacuaa

SEQ ID NO: 1426850 - RNA, 19 nt, Homo sapiens
gagcaaagucucuccauuc

SEQ ID NO: 1426851 - RNA, 19 nt, Homo sapiens
uguccucccucuaaacuua

SEQ ID NO: 1426852 - RNA, 19 nt, Homo sapiens
uaaauacacucugcguuau

SEQ ID NO: 1426853 - RNA, 19 nt, Homo sapiens
auaaauacacucugcguua

SEQ ID NO: 1426854 - RNA, 19 nt, Homo sapiens
gaacagggacuugaaccaa

SEQ ID NO: 1426855 - RNA, 19 nt, Homo sapiens
cacuagagcuuccucauca

SEQ ID NO: 1426856 - RNA, 19 nt, Homo sapiens
gagaaggagcagagaaauu

SEQ ID NO: 1426857 - RNA, 19 nt, Homo sapiens
cuagguggcugcauugaug

SEQ ID NO: 1426858 - RNA, 19 nt, Homo sapiens
gaaggagcagagaaauuaa

SEQ ID NO: 1426859 - RNA, 19 nt, Homo sapiens
ugauggcugugacugaaua

SEQ ID NO: 1426860 - RNA, 19 nt, Homo sapiens
gcugauggcugugacugaa

SEQ ID NO: 1426861 - RNA, 19 nt, Homo sapiens
gagcaacgcgagaaggauu

SEQ ID NO: 1426862 - RNA, 19 nt, Homo sapiens
gaagccagauccugacacu

SEQ ID NO: 1426863 - RNA, 19 nt, Homo sapiens
gcugcuagguggcugcauu

SEQ ID NO: 1426864 - RNA, 19 nt, Homo sapiens
guuaguaaguggcagaaca

SEQ ID NO: 1426865 - RNA, 19 nt, Homo sapiens
gcugugcucuccucaaugg

SEQ ID NO: 1426866 - RNA, 19 nt, Homo sapiens
ccaggacaaccgaaugaua

SEQ ID NO: 1426867 - RNA, 19 nt, Homo sapiens
guacccauuucacagagaa

SEQ ID NO: 1426868 - RNA, 19 nt, Homo sapiens
gugaagagcccaaggucaa

SEQ ID NO: 1426869 - RNA, 19 nt, Homo sapiens
aaacacaagauccugauga

SEQ ID NO: 1426870 - RNA, 19 nt, Homo sapiens
cagagaaggagcagagaaa

SEQ ID NO: 1426871 - RNA, 19 nt, Homo sapiens
ggcagggcuuuaucaacua

SEQ ID NO: 1426872 - RNA, 19 nt, Homo sapiens
uguauuaguuccuuuacug

SEQ ID NO: 1426873 - RNA, 19 nt, Homo sapiens
gcucaaggucaugcaguua

SEQ ID NO: 1426874 - RNA, 19 nt, Homo sapiens
gcagagauccugaaaagau

SEQ ID NO: 1426875 - RNA, 19 nt, Homo sapiens
ggagauagcagcaguuuuc

SEQ ID NO: 1426876 - RNA, 19 nt, Homo sapiens
gagcuuccucaucagguua

SEQ ID NO: 1426877 - RNA, 19 nt, Homo sapiens
gagagcaacgcgagaagga

SEQ ID NO: 1426878 - RNA, 19 nt, Homo sapiens
gaccacauuguacccauuu

SEQ ID NO: 1426879 - RNA, 19 nt, Homo sapiens
gacaccagcugcggaaaca

SEQ ID NO: 1426880 - RNA, 19 nt, Homo sapiens
aaaauccucuuccccuaua

SEQ ID NO: 1426881 - RNA, 19 nt, Homo sapiens
gcaguugugcugagaaugg

SEQ ID NO: 1426882 - RNA, 19 nt, Homo sapiens
cagagauccugaaaagaua

SEQ ID NO: 1426883 - RNA, 19 nt, Homo sapiens
gcagaggauuccauuucag

SEQ ID NO: 1426884 - RNA, 19 nt, Homo sapiens
aacacaagauccugaugaa

SEQ ID NO: 1426885 - RNA, 19 nt, Homo sapiens
ggaaacacaagauccugau

SEQ ID NO: 1426886 - RNA, 19 nt, Homo sapiens
acucguagccagccuguuu

SEQ ID NO: 1426887 - RNA, 19 nt, Homo sapiens
cuauaccuguucccacaaa

SEQ ID NO: 1426888 - RNA, 19 nt, Homo sapiens
caaggcagagauccugaaa

SEQ ID NO: 1426889 - RNA, 19 nt, Homo sapiens
gaggauuccauuucagaug

SEQ ID NO: 1426890 - RNA, 19 nt, Homo sapiens
ggacauguggaagaacuug

SEQ ID NO: 1426891 - RNA, 19 nt, Homo sapiens
gcaggcagggcuuuaucaa

SEQ ID NO: 1426892 - RNA, 19 nt, Homo sapiens
acaagauccugaugaaggu

SEQ ID NO: 1426893 - RNA, 19 nt, Homo sapiens
gaaacacaagauccugaug

SEQ ID NO: 1426894 - RNA, 19 nt, Homo sapiens
caggacaaccgaaugauag

SEQ ID NO: 1426895 - RNA, 19 nt, Homo sapiens
gcagggcuuuaucaacuac

SEQ ID NO: 1426896 - RNA, 19 nt, Homo sapiens
aggcagggcuuuaucaacu

SEQ ID NO: 1426897 - RNA, 19 nt, Homo sapiens
cgagguguacgcugugaaa

SEQ ID NO: 1426898 - RNA, 19 nt, Homo sapiens
ggucaugcaguuaguaagu

SEQ ID NO: 1426899 - RNA, 19 nt, Homo sapiens
ugaccacauuguacccauu

SEQ ID NO: 1426900 - RNA, 19 nt, Homo sapiens
aagaccgcguccugaauuu

SEQ ID NO: 1426901 - RNA, 19 nt, Homo sapiens
cagaggauuccauuucaga

SEQ ID NO: 1426902 - RNA, 19 nt, Homo sapiens
uggcugugcucuccucaau

SEQ ID NO: 1426903 - RNA, 19 nt, Homo sapiens
gccagauccugacacuguu

SEQ ID NO: 1426904 - RNA, 19 nt, Homo sapiens
cuuaaggacugugccauuc

SEQ ID NO: 1426905 - RNA, 19 nt, Homo sapiens
gaggacaagcuucuuaugc

SEQ ID NO: 1426906 - RNA, 19 nt, Homo sapiens
caagcccucugcucugaag

SEQ ID NO: 1426907 - RNA, 19 nt, Homo sapiens
ggcugugacugaauauauc

SEQ ID NO: 1426908 - RNA, 19 nt, Homo sapiens
ugcagaggauuccauuuca

SEQ ID NO: 1426909 - RNA, 19 nt, Homo sapiens
aaugggacauguggaagaa

SEQ ID NO: 1426910 - RNA, 19 nt, Homo sapiens
acacuguuccggacucgua

SEQ ID NO: 1426911 - RNA, 19 nt, Homo sapiens
ccuccagacuguccgcuau

SEQ ID NO: 1426912 - RNA, 19 nt, Homo sapiens
gucaccggcuucguccuua

SEQ ID NO: 1426913 - RNA, 19 nt, Homo sapiens
caaugggacauguggaaga

SEQ ID NO: 1426914 - RNA, 19 nt, Homo sapiens
caaaaucugcugccccuuu

SEQ ID NO: 1426915 - RNA, 19 nt, Homo sapiens
gaaaauccucuuccccuau

SEQ ID NO: 1426916 - RNA, 19 nt, Homo sapiens
ucaaggucaugcaguuagu

SEQ ID NO: 1426917 - RNA, 19 nt, Homo sapiens
ccagcccugcgcauaaaua

SEQ ID NO: 1426918 - RNA, 19 nt, Homo sapiens
uagccagcccugcgcauaa

SEQ ID NO: 1426919 - RNA, 19 nt, Homo sapiens
ccacccuguuggaccagua

SEQ ID NO: 1426920 - RNA, 19 nt, Homo sapiens
aggauuccauuucagaugu

SEQ ID NO: 1426921 - RNA, 19 nt, Homo sapiens
ucagguauagggccacuug

SEQ ID NO: 1426922 - RNA, 19 nt, Homo sapiens
acaugcugcuggucaguga

SEQ ID NO: 1426923 - RNA, 19 nt, Homo sapiens
cucaucagguuacccagaa

SEQ ID NO: 1426924 - RNA, 19 nt, Homo sapiens
cagaggacaagcuucuuau

SEQ ID NO: 1426925 - RNA, 19 nt, Homo sapiens
caaggucaugcaguuagua

SEQ ID NO: 1426926 - RNA, 19 nt, Homo sapiens
gaggauuccaaguaccaaa

SEQ ID NO: 1426927 - RNA, 19 nt, Homo sapiens
caaggucaaggagauggua

SEQ ID NO: 1426928 - RNA, 19 nt, Homo sapiens
ccacauuguacccauuuca

SEQ ID NO: 1426929 - RNA, 19 nt, Homo sapiens
caacuugggacgugauagg

SEQ ID NO: 1426930 - RNA, 19 nt, Homo sapiens
ucagagagcaacgcgagaa

SEQ ID NO: 1426931 - RNA, 19 nt, Homo sapiens
agagcuuccucaucagguu

SEQ ID NO: 1426932 - RNA, 19 nt, Homo sapiens
gcagaacagggacuugaac

SEQ ID NO: 1426933 - RNA, 19 nt, Homo sapiens
cuuuacugcugaccacauu

SEQ ID NO: 1426934 - RNA, 19 nt, Homo sapiens
uggcugugacugaauauau

SEQ ID NO: 1426935 - RNA, 19 nt, Homo sapiens
agcaaagucucuccauucu

SEQ ID NO: 1426936 - RNA, 19 nt, Homo sapiens
ugaagaccgcguccugaau

SEQ ID NO: 1426937 - RNA, 19 nt, Homo sapiens
ggcagaacagggacuugaa

SEQ ID NO: 1426938 - RNA, 19 nt, Homo sapiens
guagcucaaccaagcaguu

SEQ ID NO: 1426939 - RNA, 19 nt, Homo sapiens
ggauuccauuucagauguc

SEQ ID NO: 1426940 - RNA, 19 nt, Homo sapiens
ugccuacccuccagacugu

SEQ ID NO: 1426941 - RNA, 19 nt, Homo sapiens
accaagcccucugcucuga

SEQ ID NO: 1426942 - RNA, 19 nt, Homo sapiens
gaugcagaggauuccauuu

SEQ ID NO: 1426943 - RNA, 19 nt, Homo sapiens
guaaugauauugucaggua

SEQ ID NO: 1426944 - RNA, 19 nt, Homo sapiens
gcgcaugcuugcccuauua

SEQ ID NO: 1426945 - RNA, 19 nt, Homo sapiens
gggcuucucugucaucuga

SEQ ID NO: 1426946 - RNA, 19 nt, Homo sapiens
gcagaggacaagcuucuua

SEQ ID NO: 1426947 - RNA, 19 nt, Homo sapiens
agaaggagcagagaaauua

SEQ ID NO: 1426948 - RNA, 19 nt, Homo sapiens
gaagaccgcguccugaauu

SEQ ID NO: 1426949 - RNA, 19 nt, Homo sapiens
ugacagcuguacccacuaa

SEQ ID NO: 1426950 - RNA, 19 nt, Homo sapiens
gagcaaagucucuccauuc

SEQ ID NO: 1426951 - RNA, 19 nt, Homo sapiens
uguccucccucuaaacuua

SEQ ID NO: 1426952 - RNA, 19 nt, Homo sapiens
uaaauacacucugcguuau

SEQ ID NO: 1426953 - RNA, 19 nt, Homo sapiens
ucaaguagcugggauuaca

SEQ ID NO: 1426954 - RNA, 19 nt, Homo sapiens
auaaauacacucugcguua

SEQ ID NO: 1426955 - RNA, 19 nt, Homo sapiens
gaacagggacuugaaccaa

SEQ ID NO: 1426956 - RNA, 19 nt, Homo sapiens
cacuagagcuuccucauca

SEQ ID NO: 1426957 - RNA, 19 nt, Homo sapiens
gagaaggagcagagaaauu

SEQ ID NO: 1426958 - RNA, 19 nt, Homo sapiens
cuagguggcugcauugaug

SEQ ID NO: 1426959 - RNA, 19 nt, Homo sapiens
gaaggagcagagaaauuaa

SEQ ID NO: 1426960 - RNA, 19 nt, Homo sapiens
ugauggcugugacugaaua

SEQ ID NO: 1426961 - RNA, 19 nt, Homo sapiens
gcugauggcugugacugaa

SEQ ID NO: 1426962 - RNA, 19 nt, Homo sapiens
gagcaacgcgagaaggauu

SEQ ID NO: 1426963 - RNA, 19 nt, Homo sapiens
gaagccagauccugacacu

SEQ ID NO: 1426964 - RNA, 19 nt, Homo sapiens
gcugcuagguggcugcauu

SEQ ID NO: 1426965 - RNA, 19 nt, Homo sapiens
guuaguaaguggcagaaca

SEQ ID NO: 1426966 - RNA, 19 nt, Homo sapiens
gcugugcucuccucaaugg

SEQ ID NO: 1426967 - RNA, 19 nt, Homo sapiens
ccaggacaaccgaaugaua

SEQ ID NO: 1426968 - RNA, 19 nt, Homo sapiens
guacccauuucacagagaa

SEQ ID NO: 1426969 - RNA, 19 nt, Homo sapiens
gugaagagcccaaggucaa

SEQ ID NO: 1426970 - RNA, 19 nt, Homo sapiens
aaacacaagauccugauga

SEQ ID NO: 1426971 - RNA, 19 nt, Homo sapiens
cagagaaggagcagagaaa

SEQ ID NO: 1426972 - RNA, 19 nt, Homo sapiens
ggcagggcuuuaucaacua

SEQ ID NO: 1426973 - RNA, 19 nt, Homo sapiens
uguauuaguuccuuuacug

SEQ ID NO: 1426974 - RNA, 19 nt, Homo sapiens
gcucaaggucaugcaguua

SEQ ID NO: 1426975 - RNA, 19 nt, Homo sapiens
gcagagauccugaaaagau

SEQ ID NO: 1426976 - RNA, 19 nt, Homo sapiens
ggagauagcagcaguuuuc

SEQ ID NO: 1426977 - RNA, 19 nt, Homo sapiens
gagcuuccucaucagguua

SEQ ID NO: 1426978 - RNA, 19 nt, Homo sapiens
gagagcaacgcgagaagga

SEQ ID NO: 1426979 - RNA, 19 nt, Homo sapiens
gaccacauuguacccauuu

SEQ ID NO: 1426980 - RNA, 19 nt, Homo sapiens
gacaccagcugcggaaaca

SEQ ID NO: 1426981 - RNA, 19 nt, Homo sapiens
aaaauccucuuccccuaua

SEQ ID NO: 1426982 - RNA, 19 nt, Homo sapiens
gcaguugugcugagaaugg

SEQ ID NO: 1426983 - RNA, 19 nt, Homo sapiens
cagagauccugaaaagaua

SEQ ID NO: 1426984 - RNA, 19 nt, Homo sapiens
gcagaggauuccauuucag

SEQ ID NO: 1426985 - RNA, 19 nt, Homo sapiens
aacacaagauccugaugaa

SEQ ID NO: 1426986 - RNA, 19 nt, Homo sapiens
ggaaacacaagauccugau

SEQ ID NO: 1426987 - RNA, 19 nt, Homo sapiens
acucguagccagccuguuu

SEQ ID NO: 1426988 - RNA, 19 nt, Homo sapiens
ugccucagccucucaagua

SEQ ID NO: 1426989 - RNA, 19 nt, Homo sapiens
cuauaccuguucccacaaa

SEQ ID NO: 1426990 - RNA, 19 nt, Homo sapiens
caaggcagagauccugaaa

SEQ ID NO: 1426991 - RNA, 19 nt, Homo sapiens
gaggauuccauuucagaug

SEQ ID NO: 1426992 - RNA, 19 nt, Homo sapiens
ggacauguggaagaacuug

SEQ ID NO: 1426993 - RNA, 19 nt, Homo sapiens
gcaggcagggcuuuaucaa

SEQ ID NO: 1426994 - RNA, 19 nt, Homo sapiens
acaagauccugaugaaggu

SEQ ID NO: 1426995 - RNA, 19 nt, Homo sapiens
gaaacacaagauccugaug

SEQ ID NO: 1426996 - RNA, 19 nt, Homo sapiens
caggacaaccgaaugauag

SEQ ID NO: 1426997 - RNA, 19 nt, Homo sapiens
gcagggcuuuaucaacuac

SEQ ID NO: 1426998 - RNA, 19 nt, Homo sapiens
aggcagggcuuuaucaacu

SEQ ID NO: 1426999 - RNA, 19 nt, Homo sapiens
cgagguguacgcugugaaa

SEQ ID NO: 1427000 - RNA, 19 nt, Homo sapiens
ggucaugcaguuaguaagu

SEQ ID NO: 1427001 - RNA, 19 nt, Homo sapiens
ugaccacauuguacccauu

SEQ ID NO: 1427002 - RNA, 19 nt, Homo sapiens
aagaccgcguccugaauuu

SEQ ID NO: 1427003 - RNA, 19 nt, Homo sapiens
cagaggauuccauuucaga

SEQ ID NO: 1427004 - RNA, 19 nt, Homo sapiens
uggcugugcucuccucaau

SEQ ID NO: 1427005 - RNA, 19 nt, Homo sapiens
gccagauccugacacuguu

SEQ ID NO: 1427006 - RNA, 19 nt, Homo sapiens
cuuaaggacugugccauuc

SEQ ID NO: 1427007 - RNA, 19 nt, Homo sapiens
gaggacaagcuucuuaugc

SEQ ID NO: 1427008 - RNA, 19 nt, Homo sapiens
ggcugugacugaauauauc

SEQ ID NO: 1427009 - RNA, 19 nt, Homo sapiens
caagcccucugcucugaag

SEQ ID NO: 1427010 - RNA, 19 nt, Homo sapiens
ugcagaggauuccauuuca

SEQ ID NO: 1427011 - RNA, 19 nt, Homo sapiens
aaugggacauguggaagaa

SEQ ID NO: 1427012 - RNA, 19 nt, Homo sapiens
acacuguuccggacucgua

SEQ ID NO: 1427013 - RNA, 19 nt, Homo sapiens
ccuccagacuguccgcuau

SEQ ID NO: 1427014 - RNA, 19 nt, Homo sapiens
gucaccggcuucguccuua

SEQ ID NO: 1427015 - RNA, 19 nt, Homo sapiens
caaugggacauguggaaga

SEQ ID NO: 1427016 - RNA, 19 nt, Homo sapiens
caaaaucugcugccccuuu

SEQ ID NO: 1427017 - RNA, 19 nt, Homo sapiens
gaaaauccucuuccccuau

SEQ ID NO: 1427018 - RNA, 19 nt, Homo sapiens
ucaaggucaugcaguuagu

SEQ ID NO: 1427019 - RNA, 19 nt, Homo sapiens
ccagcccugcgcauaaaua

SEQ ID NO: 1427020 - RNA, 19 nt, Homo sapiens
uagccagcccugcgcauaa

SEQ ID NO: 1427021 - RNA, 19 nt, Homo sapiens
ccacccuguuggaccagua

SEQ ID NO: 1427022 - RNA, 19 nt, Homo sapiens
aggauuccauuucagaugu

SEQ ID NO: 1427023 - RNA, 19 nt, Homo sapiens
ucagguauagggccacuug

SEQ ID NO: 1427024 - RNA, 19 nt, Homo sapiens
acaugcugcuggucaguga

SEQ ID NO: 1427025 - RNA, 19 nt, Homo sapiens
cucaucagguuacccagaa

SEQ ID NO: 1427026 - RNA, 19 nt, Homo sapiens
cagaggacaagcuucuuau

SEQ ID NO: 1427027 - RNA, 19 nt, Homo sapiens
caaggucaugcaguuagua

SEQ ID NO: 1427028 - RNA, 19 nt, Homo sapiens
caaggucaaggagauggua

SEQ ID NO: 1427029 - RNA, 19 nt, Homo sapiens
gaggauuccaaguaccaaa

SEQ ID NO: 1427030 - RNA, 19 nt, Homo sapiens
agagugcaguggcaugauc

SEQ ID NO: 1427031 - RNA, 19 nt, Homo sapiens
ccacauuguacccauuuca

SEQ ID NO: 1427032 - RNA, 19 nt, Homo sapiens
ggcaugaucucggcucacu

SEQ ID NO: 1427033 - RNA, 19 nt, Homo sapiens
caacuugggacgugauagg

SEQ ID NO: 1427034 - RNA, 19 nt, Homo sapiens
ucagagagcaacgcgagaa

SEQ ID NO: 1427035 - RNA, 19 nt, Homo sapiens
ucucaaguagcugggauua

SEQ ID NO: 1427036 - RNA, 19 nt, Homo sapiens
agagcuuccucaucagguu

SEQ ID NO: 1427037 - RNA, 19 nt, Homo sapiens
gcagaacagggacuugaac

SEQ ID NO: 1427038 - RNA, 19 nt, Homo sapiens
cuuuacugcugaccacauu

SEQ ID NO: 1427039 - RNA, 19 nt, Homo sapiens
agcaaagucucuccauucu

SEQ ID NO: 1427040 - RNA, 19 nt, Homo sapiens
uggcugugacugaauauau

SEQ ID NO: 1427041 - RNA, 19 nt, Homo sapiens
ugaagaccgcguccugaau

SEQ ID NO: 1427042 - RNA, 19 nt, Homo sapiens
ggcagaacagggacuugaa

SEQ ID NO: 1427043 - RNA, 19 nt, Homo sapiens
ggaaggagcuggagcagaa

SEQ ID NO: 1427044 - RNA, 19 nt, Homo sapiens
gaaacuggcuggcguacug

SEQ ID NO: 1427045 - RNA, 19 nt, Homo sapiens
cagaagauccuccuugaua

SEQ ID NO: 1427046 - RNA, 19 nt, Homo sapiens
caauaaauccuuuggaaga

SEQ ID NO: 1427047 - RNA, 19 nt, Homo sapiens
agagaaggguugagaagaa

SEQ ID NO: 1427048 - RNA, 19 nt, Homo sapiens
ggagauggcauacacaauc

SEQ ID NO: 1427049 - RNA, 19 nt, Homo sapiens
gcugacgucuuguuauguu

SEQ ID NO: 1427050 - RNA, 19 nt, Homo sapiens
gagaaggguugagaagaau

SEQ ID NO: 1427051 - RNA, 19 nt, Homo sapiens
ccagcaggaugcccacuuu

SEQ ID NO: 1427052 - RNA, 19 nt, Homo sapiens
ggcaacaucuaccagaaga

SEQ ID NO: 1427053 - RNA, 19 nt, Homo sapiens
gauguaaauaggaccaaua

SEQ ID NO: 1427054 - RNA, 19 nt, Homo sapiens
gaggaagcguugcuaccuu

SEQ ID NO: 1427055 - RNA, 19 nt, Homo sapiens
gcagucagaaggcaaagaa

SEQ ID NO: 1427056 - RNA, 19 nt, Homo sapiens
gacaagagcagccuucgau

SEQ ID NO: 1427057 - RNA, 19 nt, Homo sapiens
cagguggucuucucugaug

SEQ ID NO: 1427058 - RNA, 19 nt, Homo sapiens
aacagaagauccuccuuga

SEQ ID NO: 1427059 - RNA, 19 nt, Homo sapiens
gcaauagauguaaauagga

SEQ ID NO: 1427060 - RNA, 19 nt, Homo sapiens
gaagauccuccuugauaca

SEQ ID NO: 1427061 - RNA, 19 nt, Homo sapiens
ggacacagggcuccuagca

SEQ ID NO: 1427062 - RNA, 19 nt, Homo sapiens
caacuagggccugcaaaug

SEQ ID NO: 1427063 - RNA, 19 nt, Homo sapiens
cucagaagaucaucgugua

SEQ ID NO: 1427064 - RNA, 19 nt, Homo sapiens
gcaaagaacagaagauccu

SEQ ID NO: 1427065 - RNA, 19 nt, Homo sapiens
ccugcgaccucacauucua

SEQ ID NO: 1427066 - RNA, 19 nt, Homo sapiens
gaucaucguguaccucuca

SEQ ID NO: 1427067 - RNA, 19 nt, Homo sapiens
ggacagcugcguggugcua

SEQ ID NO: 1427068 - RNA, 19 nt, Homo sapiens
caagagcagccuucgauca

SEQ ID NO: 1427069 - RNA, 19 nt, Homo sapiens
ggaggagauucccauggau

SEQ ID NO: 1427070 - RNA, 19 nt, Homo sapiens
ugcaauagauguaaauagg

SEQ ID NO: 1427071 - RNA, 19 nt, Homo sapiens
gagagaaggguugagaaga

SEQ ID NO: 1427072 - RNA, 19 nt, Homo sapiens
ucuggccgcuguacaacua

SEQ ID NO: 1427073 - RNA, 19 nt, Homo sapiens
ugauacagccugcaagaug

SEQ ID NO: 1427074 - RNA, 19 nt, Homo sapiens
ucucacaauuugcaauaga

SEQ ID NO: 1427075 - RNA, 19 nt, Homo sapiens
gaaggguugagaagaauca

SEQ ID NO: 1427076 - RNA, 19 nt, Homo sapiens
ggacgggaaggaagaagga

SEQ ID NO: 1427077 - RNA, 19 nt, Homo sapiens
cuagcaagcaggaaguuaa

SEQ ID NO: 1427078 - RNA, 19 nt, Homo sapiens
gggcaagggugggaagaca

SEQ ID NO: 1427079 - RNA, 19 nt, Homo sapiens
ggaagccuggucugcagua

SEQ ID NO: 1427080 - RNA, 19 nt, Homo sapiens
acacggugcuguccaugga

SEQ ID NO: 1427081 - RNA, 19 nt, Homo sapiens
cacagguggucuucucuga

SEQ ID NO: 1427082 - RNA, 19 nt, Homo sapiens
gggagccuguccucaccua

SEQ ID NO: 1427083 - RNA, 19 nt, Homo sapiens
gaaggcaaagaacagaaga

SEQ ID NO: 1427084 - RNA, 19 nt, Homo sapiens
uggccuugcugcccacuaa

SEQ ID NO: 1427085 - RNA, 19 nt, Homo sapiens
ggaccauccugugugugaa

SEQ ID NO: 1427086 - RNA, 19 nt, Homo sapiens
cugcugacgucuuguuaug

SEQ ID NO: 1427087 - RNA, 19 nt, Homo sapiens
gggacauucugcagaucaa

SEQ ID NO: 1427088 - RNA, 19 nt, Homo sapiens
uggacgagcugcagaaggu

SEQ ID NO: 1427089 - RNA, 19 nt, Homo sapiens
agaagauccuccuugauac

SEQ ID NO: 1427090 - RNA, 19 nt, Homo sapiens
agccaggacuugaagcaaa

SEQ ID NO: 1427091 - RNA, 19 nt, Homo sapiens
gcccuucuccugccuguug

SEQ ID NO: 1427092 - RNA, 19 nt, Homo sapiens
cgacugaacagccguaagg

SEQ ID NO: 1427093 - RNA, 19 nt, Homo sapiens
gcaagcaggaaguuaagag

SEQ ID NO: 1427094 - RNA, 19 nt, Homo sapiens
ccacaccuuugaccuguac

SEQ ID NO: 1427095 - RNA, 19 nt, Homo sapiens
ucagcuaccuccuccacau

SEQ ID NO: 1427096 - RNA, 19 nt, Homo sapiens
ccaacuagggccugcaaau

SEQ ID NO: 1427097 - RNA, 19 nt, Homo sapiens
gcaagggugggaagacauc

SEQ ID NO: 1427098 - RNA, 19 nt, Homo sapiens
gccaggacuugaagcaaag

SEQ ID NO: 1427099 - RNA, 19 nt, Homo sapiens
ggacaagagcagccuucga

SEQ ID NO: 1427100 - RNA, 19 nt, Homo sapiens
gcugccuucucacaauuug

SEQ ID NO: 1427101 - RNA, 19 nt, Homo sapiens
ggucuucucucagcugcau

SEQ ID NO: 1427102 - RNA, 19 nt, Homo sapiens
gaccauccugugugugaaa

SEQ ID NO: 1427103 - RNA, 19 nt, Homo sapiens
ccuguugggugacaucauc

SEQ ID NO: 1427104 - RNA, 19 nt, Homo sapiens
gcaggaggaagcguugcua

SEQ ID NO: 1427105 - RNA, 19 nt, Homo sapiens
ccggcaacaucuaccagaa

SEQ ID NO: 1427106 - RNA, 19 nt, Homo sapiens
acuagggccugcaaaugga

SEQ ID NO: 1427107 - RNA, 19 nt, Homo sapiens
gaagcccacccaucacuac

SEQ ID NO: 1427108 - RNA, 19 nt, Homo sapiens
gcugaacccugggcuuguc

SEQ ID NO: 1427109 - RNA, 19 nt, Homo sapiens
acaccacacucauggacau

SEQ ID NO: 1427110 - RNA, 19 nt, Homo sapiens
ugcaugagcuucggcaaca

SEQ ID NO: 1427111 - RNA, 19 nt, Homo sapiens
aauaaauccuuuggaagag

SEQ ID NO: 1427112 - RNA, 19 nt, Homo sapiens
cuucucacaauuugcaaua

SEQ ID NO: 1427113 - RNA, 19 nt, Homo sapiens
gcuccacgacccugagaga

SEQ ID NO: 1427114 - RNA, 19 nt, Homo sapiens
ugagacagaggacuuccaa

SEQ ID NO: 1427115 - RNA, 19 nt, Homo sapiens
ggccgugguccaggaguua

SEQ ID NO: 1427116 - RNA, 19 nt, Homo sapiens
gcccacccaucacuacaag

SEQ ID NO: 1427117 - RNA, 19 nt, Homo sapiens
ugacagcagccaggacuug

SEQ ID NO: 1427118 - RNA, 19 nt, Homo sapiens
cugcugccuucucacaauu

SEQ ID NO: 1427119 - RNA, 19 nt, Homo sapiens
ccugcugccuucucacaau

SEQ ID NO: 1427120 - RNA, 19 nt, Homo sapiens
guugcuaccuucacuucuc

SEQ ID NO: 1427121 - RNA, 19 nt, Homo sapiens
caccguguccaacaagauu

SEQ ID NO: 1427122 - RNA, 19 nt, Homo sapiens
gcaccguguccaacaagau

SEQ ID NO: 1427123 - RNA, 19 nt, Homo sapiens
gacagcagccaggacuuga

SEQ ID NO: 1427124 - RNA, 19 nt, Homo sapiens
ugagagaaggguugagaag

SEQ ID NO: 1427125 - RNA, 19 nt, Homo sapiens
ggaaaaucauccccaacca

SEQ ID NO: 1427126 - RNA, 19 nt, Homo sapiens
caaucuacgugcccuucuc

SEQ ID NO: 1427127 - RNA, 19 nt, Homo sapiens
cggaccauccuguguguga

SEQ ID NO: 1427128 - RNA, 19 nt, Homo sapiens
accaguaccugcccuacau

SEQ ID NO: 1427129 - RNA, 19 nt, Homo sapiens
cgaccucacauucuagaca

SEQ ID NO: 1427130 - RNA, 19 nt, Homo sapiens
ucagaaggcaaagaacaga

SEQ ID NO: 1427131 - RNA, 19 nt, Homo sapiens
ggaugcccacuuucacuuc

SEQ ID NO: 1427132 - RNA, 19 nt, Homo sapiens
gacaucauccggaaaauca

SEQ ID NO: 1427133 - RNA, 19 nt, Homo sapiens
ggaggaagcguugcuaccu

SEQ ID NO: 1427134 - RNA, 19 nt, Homo sapiens
cagaaggcaaagaacagaa

SEQ ID NO: 1427135 - RNA, 19 nt, Homo sapiens
gcagccaggacuugaagca

SEQ ID NO: 1427136 - RNA, 19 nt, Homo sapiens
aagaggaguucgugugcaa

SEQ ID NO: 1427137 - RNA, 19 nt, Homo sapiens
ucuucgugcucuucuauuu

SEQ ID NO: 1427138 - RNA, 19 nt, Homo sapiens
gcuucuggcucuuccacau

SEQ ID NO: 1427139 - RNA, 19 nt, Homo sapiens
ggacgagcaagaggaguuc

SEQ ID NO: 1427140 - RNA, 19 nt, Homo sapiens
gaggaguucgugugcaaca

SEQ ID NO: 1427141 - RNA, 19 nt, Homo sapiens
gaaaguggaugaaguuauu

SEQ ID NO: 1427142 - RNA, 19 nt, Homo sapiens
gaaggcagcucaagcagaa

SEQ ID NO: 1427143 - RNA, 19 nt, Homo sapiens
ggaagguucuuucuuuaaa

SEQ ID NO: 1427144 - RNA, 19 nt, Homo sapiens
caacaaggauccagcuaga

SEQ ID NO: 1427145 - RNA, 19 nt, Homo sapiens
gaugaaggguguuuagaga

SEQ ID NO: 1427146 - RNA, 19 nt, Homo sapiens
gaagucaggcuuaucauga

SEQ ID NO: 1427147 - RNA, 19 nt, Homo sapiens
gagaagaucaugcaguauu

SEQ ID NO: 1427148 - RNA, 19 nt, Homo sapiens
uaucaaaccuccaucaaca

SEQ ID NO: 1427149 - RNA, 19 nt, Homo sapiens
aaagauaacccucgauuga

SEQ ID NO: 1427150 - RNA, 19 nt, Homo sapiens
guauuugacuugauuggaa

SEQ ID NO: 1427151 - RNA, 19 nt, Homo sapiens
gaaaagauccucaccagaa

SEQ ID NO: 1427152 - RNA, 19 nt, Homo sapiens
gauauagaagucaggcuua

SEQ ID NO: 1427153 - RNA, 19 nt, Homo sapiens
ucaaugagaucagggcaaa

SEQ ID NO: 1427154 - RNA, 19 nt, Homo sapiens
ccaaacaggcaaucuuaaa

SEQ ID NO: 1427155 - RNA, 19 nt, Homo sapiens
uaaaugggaguaucguuaa

SEQ ID NO: 1427156 - RNA, 19 nt, Homo sapiens
ugggaagguucuuucuuua

SEQ ID NO: 1427157 - RNA, 19 nt, Homo sapiens
gcucauggcacuauucaga

SEQ ID NO: 1427158 - RNA, 19 nt, Homo sapiens
uuaaaugggaguaucguua

SEQ ID NO: 1427159 - RNA, 19 nt, Homo sapiens
ggauccagcuagaagaaga

SEQ ID NO: 1427160 - RNA, 19 nt, Homo sapiens
gaucagggcaaacuaugaa

SEQ ID NO: 1427161 - RNA, 19 nt, Homo sapiens
gaacaagaaauagcaacuu

SEQ ID NO: 1427162 - RNA, 19 nt, Homo sapiens
gaaggguguuuagagacua

SEQ ID NO: 1427163 - RNA, 19 nt, Homo sapiens
gggaagguucuuucuuuaa

SEQ ID NO: 1427164 - RNA, 19 nt, Homo sapiens
gaggcuggaacaagaaaua

SEQ ID NO: 1427165 - RNA, 19 nt, Homo sapiens
gauuugaucuucauuuagc

SEQ ID NO: 1427166 - RNA, 19 nt, Homo sapiens
cagagaaaguggaugaagu

SEQ ID NO: 1427167 - RNA, 19 nt, Homo sapiens
ccagcuagaagaagacaua

SEQ ID NO: 1427168 - RNA, 19 nt, Homo sapiens
aaaccuccaucaacagcua

SEQ ID NO: 1427169 - RNA, 19 nt, Homo sapiens
gagaaaguggaugaaguua

SEQ ID NO: 1427170 - RNA, 19 nt, Homo sapiens
caagaaauagcaacuuauc

SEQ ID NO: 1427171 - RNA, 19 nt, Homo sapiens
gaagaagacauaagcaaaa

SEQ ID NO: 1427172 - RNA, 19 nt, Homo sapiens
ggaccaaggugggccauac

SEQ ID NO: 1427173 - RNA, 19 nt, Homo sapiens
caacagcuaauuaauccaa

SEQ ID NO: 1427174 - RNA, 19 nt, Homo sapiens
caaacaggcaaucuuaaau

SEQ ID NO: 1427175 - RNA, 19 nt, Homo sapiens
gcacuauucagacagagaa

SEQ ID NO: 1427176 - RNA, 19 nt, Homo sapiens
aaacaggcaaucuuaaaug

SEQ ID NO: 1427177 - RNA, 19 nt, Homo sapiens
cuacaaaagucccacaaaa

SEQ ID NO: 1427178 - RNA, 19 nt, Homo sapiens
agaugaggcuggaacaaga

SEQ ID NO: 1427179 - RNA, 19 nt, Homo sapiens
agacuaagcaggauaaucu

SEQ ID NO: 1427180 - RNA, 19 nt, Homo sapiens
gaacugucccagcuacuca

SEQ ID NO: 1427181 - RNA, 19 nt, Homo sapiens
ugucccagcuacucaauga

SEQ ID NO: 1427182 - RNA, 19 nt, Homo sapiens
augggaagguucuuucuuu

SEQ ID NO: 1427183 - RNA, 19 nt, Homo sapiens
aaccaaacaggcaaucuua

SEQ ID NO: 1427184 - RNA, 19 nt, Homo sapiens
uagaaacaguaaccaaaca

SEQ ID NO: 1427185 - RNA, 19 nt, Homo sapiens
caucaacagcuaauuaauc

SEQ ID NO: 1427186 - RNA, 19 nt, Homo sapiens
agaagaucaugcaguauuc

SEQ ID NO: 1427187 - RNA, 19 nt, Homo sapiens
agacagagaaaguggauga

SEQ ID NO: 1427188 - RNA, 19 nt, Homo sapiens
agaagaagacauaagcaaa

SEQ ID NO: 1427189 - RNA, 19 nt, Homo sapiens
gcaaguggaaauugaaucu

SEQ ID NO: 1427190 - RNA, 19 nt, Homo sapiens
gcaguauucccucuaucaa

SEQ ID NO: 1427191 - RNA, 19 nt, Homo sapiens
uaaagauaacccucgauug

SEQ ID NO: 1427192 - RNA, 19 nt, Homo sapiens
agacggugcucucaacaag

SEQ ID NO: 1427193 - RNA, 19 nt, Homo sapiens
agagaaaguggaugaaguu

SEQ ID NO: 1427194 - RNA, 19 nt, Homo sapiens
uaaccaaacaggcaaucuu

SEQ ID NO: 1427195 - RNA, 19 nt, Homo sapiens
gaagaugaggcuggaacaa

SEQ ID NO: 1427196 - RNA, 19 nt, Homo sapiens
ccuagagacugugauugaa

SEQ ID NO: 1427197 - RNA, 19 nt, Homo sapiens
uuaaagauaacccucgauu

SEQ ID NO: 1427198 - RNA, 19 nt, Homo sapiens
ccacaaguagaguugguuu

SEQ ID NO: 1427199 - RNA, 19 nt, Homo sapiens
ugcaagaccuagagacugu

SEQ ID NO: 1427200 - RNA, 19 nt, Homo sapiens
ggaaauugaaucucuccau

SEQ ID NO: 1427201 - RNA, 19 nt, Homo sapiens
gagaucagggcaaacuaug

SEQ ID NO: 1427202 - RNA, 19 nt, Homo sapiens
caaaagucccacaaaagua

SEQ ID NO: 1427203 - RNA, 19 nt, Homo sapiens
cgagcagcauuaccagaug

SEQ ID NO: 1427204 - RNA, 19 nt, Homo sapiens
caugcaguauucccucuau

SEQ ID NO: 1427205 - RNA, 19 nt, Homo sapiens
uguagaaacaguaaccaaa

SEQ ID NO: 1427206 - RNA, 19 nt, Homo sapiens
ugaaggguguuuagagacu

SEQ ID NO: 1427207 - RNA, 19 nt, Homo sapiens
uaccaucagccauuauaaa

SEQ ID NO: 1427208 - RNA, 19 nt, Homo sapiens
aaaagauccucaccagaaa

SEQ ID NO: 1427209 - RNA, 19 nt, Homo sapiens
caccagaaaucagauagag

SEQ ID NO: 1427210 - RNA, 19 nt, Homo sapiens
cuccaucaacagcuaauua

SEQ ID NO: 1427211 - RNA, 19 nt, Homo sapiens
uagaagaagacauaagcaa

SEQ ID NO: 1427212 - RNA, 19 nt, Homo sapiens
ucucuucgauuugaucuuc

SEQ ID NO: 1427213 - RNA, 19 nt, Homo sapiens
gucuguuucucuucgauuu

SEQ ID NO: 1427214 - RNA, 19 nt, Homo sapiens
guagaaacaguaaccaaac

SEQ ID NO: 1427215 - RNA, 19 nt, Homo sapiens
gaugaggcuggaacaagaa

SEQ ID NO: 1427216 - RNA, 19 nt, Homo sapiens
gcgagcagcauuaccagau

SEQ ID NO: 1427217 - RNA, 19 nt, Homo sapiens
guuauuacguauguaugga

SEQ ID NO: 1427218 - RNA, 19 nt, Homo sapiens
uagagacuaagcaggauaa

SEQ ID NO: 1427219 - RNA, 19 nt, Homo sapiens
gaagcucauggcacuauuc

SEQ ID NO: 1427220 - RNA, 19 nt, Homo sapiens
gacugugauugaaggacua

SEQ ID NO: 1427221 - RNA, 19 nt, Homo sapiens
gcuagaagaagacauaagc

SEQ ID NO: 1427222 - RNA, 19 nt, Homo sapiens
caguauucccucuaucaaa

SEQ ID NO: 1427223 - RNA, 19 nt, Homo sapiens
uaagcaggauaaucuacca

SEQ ID NO: 1427224 - RNA, 19 nt, Homo sapiens
ugaagcucauggcacuauu

SEQ ID NO: 1427225 - RNA, 19 nt, Homo sapiens
ggaacaagaaauagcaacu

SEQ ID NO: 1427226 - RNA, 19 nt, Homo sapiens
ugagaucagggcaaacuau

SEQ ID NO: 1427227 - RNA, 19 nt, Homo sapiens
caaggauccagcuagaaga

SEQ ID NO: 1427228 - RNA, 19 nt, Homo sapiens
uaucgccaccuccuagaaa

SEQ ID NO: 1427229 - RNA, 19 nt, Homo sapiens
aaagagcuacaggaaguaa

SEQ ID NO: 1427230 - RNA, 19 nt, Homo sapiens
gugauugaaggacuagaaa

SEQ ID NO: 1427231 - RNA, 19 nt, Homo sapiens
ccacugaugaaggguguuu

SEQ ID NO: 1427232 - RNA, 19 nt, Homo sapiens
ucauggcacuauucagaca

SEQ ID NO: 1427233 - RNA, 19 nt, Homo sapiens
uccaucaacagcuaauuaa

SEQ ID NO: 1427234 - RNA, 19 nt, Homo sapiens
auagaagucaggcuuauca

SEQ ID NO: 1427235 - RNA, 19 nt, Homo sapiens
acggugcucucaacaagga

SEQ ID NO: 1427236 - RNA, 19 nt, Homo sapiens
aacaggcaaucuuaaaugg

SEQ ID NO: 1427237 - RNA, 19 nt, Homo sapiens
ccacaaaaguaugagaaug

SEQ ID NO: 1427238 - RNA, 19 nt, Homo sapiens
caauaugugguucucuuca

SEQ ID NO: 1427239 - RNA, 19 nt, Homo sapiens
cagcuaauuaauccaaaga

SEQ ID NO: 1427240 - RNA, 19 nt, Homo sapiens
aguauucccucuaucaaac

SEQ ID NO: 1427241 - RNA, 19 nt, Homo sapiens
guaaauuccuccugaaaug

SEQ ID NO: 1427242 - RNA, 19 nt, Homo sapiens
gaaacaugcuugccuuaug

SEQ ID NO: 1427243 - RNA, 19 nt, Homo sapiens
gagguaggcucucuaggaa

SEQ ID NO: 1427244 - RNA, 19 nt, Homo sapiens
gagggcagcuguugagaug

SEQ ID NO: 1427245 - RNA, 19 nt, Homo sapiens
cauuggguaucauucauua

SEQ ID NO: 1427246 - RNA, 19 nt, Homo sapiens
gcaauccucccaccuugua

SEQ ID NO: 1427247 - RNA, 19 nt, Homo sapiens
ggagguaggcucucuagga

SEQ ID NO: 1427248 - RNA, 19 nt, Homo sapiens
gccacgagguugcaaauuc

SEQ ID NO: 1427249 - RNA, 19 nt, Homo sapiens
gguaggcucucuaggaauc

SEQ ID NO: 1427250 - RNA, 19 nt, Homo sapiens
caaaggcacaggccaaguu

SEQ ID NO: 1427251 - RNA, 19 nt, Homo sapiens
gcacauuggguaucauuca

SEQ ID NO: 1427252 - RNA, 19 nt, Homo sapiens
ggucuugggugucaauucu

SEQ ID NO: 1427253 - RNA, 19 nt, Homo sapiens
ggguaucauucauuacauu

SEQ ID NO: 1427254 - RNA, 19 nt, Homo sapiens
gcucauggaucacucuuuu

SEQ ID NO: 1427255 - RNA, 19 nt, Homo sapiens
ucuuuaagcuggaaauugu

SEQ ID NO: 1427256 - RNA, 19 nt, Homo sapiens
gauccaagagauauauuug

SEQ ID NO: 1427257 - RNA, 19 nt, Homo sapiens
ucacagcacaccuggcuaa

SEQ ID NO: 1427258 - RNA, 19 nt, Homo sapiens
gaagaaucagcaucauguu

SEQ ID NO: 1427259 - RNA, 19 nt, Homo sapiens
ugaagaaucagcaucaugu

SEQ ID NO: 1427260 - RNA, 19 nt, Homo sapiens
gcagauccaagagauauau

SEQ ID NO: 1427261 - RNA, 19 nt, Homo sapiens
gaaucagcaucauguuugg

SEQ ID NO: 1427262 - RNA, 19 nt, Homo sapiens
gggcaagagcaaauaaaga

SEQ ID NO: 1427263 - RNA, 19 nt, Homo sapiens
ccaagagaagguuauauuc

SEQ ID NO: 1427264 - RNA, 19 nt, Homo sapiens
agaaucagcaucauguuug

SEQ ID NO: 1427265 - RNA, 19 nt, Homo sapiens
cagcagauccaagagauau

SEQ ID NO: 1427266 - RNA, 19 nt, Homo sapiens
cccaagagaagguuauauu

SEQ ID NO: 1427267 - RNA, 19 nt, Homo sapiens
guugcaaauucgugaagaa

SEQ ID NO: 1427268 - RNA, 19 nt, Homo sapiens
ggaucacucuuuuguggua

SEQ ID NO: 1427269 - RNA, 19 nt, Homo sapiens
cagcacaccuggcuaaaau

SEQ ID NO: 1427270 - RNA, 19 nt, Homo sapiens
aaaggcacauuggguauca

SEQ ID NO: 1427271 - RNA, 19 nt, Homo sapiens
ggcaagagcaaauaaagag

SEQ ID NO: 1427272 - RNA, 19 nt, Homo sapiens
augcuugccuuauguauca

SEQ ID NO: 1427273 - RNA, 19 nt, Homo sapiens
caggccaaguuguagcuuu

SEQ ID NO: 1427274 - RNA, 19 nt, Homo sapiens
agacggauucucuauguug

SEQ ID NO: 1427275 - RNA, 19 nt, Homo sapiens
uagaaacaugcuugccuua

SEQ ID NO: 1427276 - RNA, 19 nt, Homo sapiens
gcacaccuggcuaaaauuu

SEQ ID NO: 1427277 - RNA, 19 nt, Homo sapiens
uaagcaauccucccaccuu

SEQ ID NO: 1427278 - RNA, 19 nt, Homo sapiens
gagauauauuuggcaacuu

SEQ ID NO: 1427279 - RNA, 19 nt, Homo sapiens
aagaaucagcaucauguuu

SEQ ID NO: 1427280 - RNA, 19 nt, Homo sapiens
ccacgagguugcaaauucg

SEQ ID NO: 1427281 - RNA, 19 nt, Homo sapiens
accaguagcugccaucagu

SEQ ID NO: 1427282 - RNA, 19 nt, Homo sapiens
gcucagcagauccaagaga

SEQ ID NO: 1427283 - RNA, 19 nt, Homo sapiens
caaguucuuuaagcuggaa

SEQ ID NO: 1427284 - RNA, 19 nt, Homo sapiens
aggcacaggccaaguugua

SEQ ID NO: 1427285 - RNA, 19 nt, Homo sapiens
caguagcugccaucaguuu

SEQ ID NO: 1427286 - RNA, 19 nt, Homo sapiens
agagauauauuuggcaacu

SEQ ID NO: 1427287 - RNA, 19 nt, Homo sapiens
gaaaaggcacauuggguau

SEQ ID NO: 1427288 - RNA, 19 nt, Homo sapiens
ggagggcagcuguugagau

SEQ ID NO: 1427289 - RNA, 19 nt, Homo sapiens
uaaauuccuccugaaaugu

SEQ ID NO: 1427290 - RNA, 19 nt, Homo sapiens
cuaggaaucugggaguagu

SEQ ID NO: 1427291 - RNA, 19 nt, Homo sapiens
caagagaagguuauauucc

SEQ ID NO: 1427292 - RNA, 19 nt, Homo sapiens
aggccaaguuguagcuuug

SEQ ID NO: 1427293 - RNA, 19 nt, Homo sapiens
gugaagaaucagcaucaug

SEQ ID NO: 1427294 - RNA, 19 nt, Homo sapiens
gguugcaaauucgugaaga

SEQ ID NO: 1427295 - RNA, 19 nt, Homo sapiens
uguaaauuccuccugaaau

SEQ ID NO: 1427296 - RNA, 19 nt, Homo sapiens
ucuugggugucaauucuug

SEQ ID NO: 1427297 - RNA, 19 nt, Homo sapiens
aaauuccuccugaaauguu

SEQ ID NO: 1427298 - RNA, 19 nt, Homo sapiens
cacauuggguaucauucau

SEQ ID NO: 1427299 - RNA, 19 nt, Homo sapiens
ucagcagauccaagagaua

SEQ ID NO: 1427300 - RNA, 19 nt, Homo sapiens
aaacuaacuggcaucaaca

SEQ ID NO: 1427301 - RNA, 19 nt, Homo sapiens
ccgggaagccugucuagag

SEQ ID NO: 1427302 - RNA, 19 nt, Homo sapiens
aaaacuaacuggcaucaac

SEQ ID NO: 1427303 - RNA, 19 nt, Homo sapiens
cagcaucucagcccaagag

SEQ ID NO: 1427304 - RNA, 19 nt, Homo sapiens
accaugaacuaauacuaca

SEQ ID NO: 1427305 - RNA, 19 nt, Homo sapiens
aaaggcacaggccaaguug

SEQ ID NO: 1427306 - RNA, 19 nt, Homo sapiens
agaaacaugcuugccuuau

SEQ ID NO: 1427307 - RNA, 19 nt, Homo sapiens
gcugauggcuguauucuga

SEQ ID NO: 1427308 - RNA, 19 nt, Homo sapiens
gaacugcucucagcugaug

SEQ ID NO: 1427309 - RNA, 19 nt, Homo sapiens
gaacaaaggaggguacauu

SEQ ID NO: 1427310 - RNA, 19 nt, Homo sapiens
gcugagagaaggugacuua

SEQ ID NO: 1427311 - RNA, 19 nt, Homo sapiens
gaagaugugaacaagaaua

SEQ ID NO: 1427312 - RNA, 19 nt, Homo sapiens
ucgaagaugugaacaagaa

SEQ ID NO: 1427313 - RNA, 19 nt, Homo sapiens
gagagaaggugacuuaacg

SEQ ID NO: 1427314 - RNA, 19 nt, Homo sapiens
ucacauuucugcugagaga

SEQ ID NO: 1427315 - RNA, 19 nt, Homo sapiens
ggaggagauugacgacauu

SEQ ID NO: 1427316 - RNA, 19 nt, Homo sapiens
gaggguacauuacuuaaac

SEQ ID NO: 1427317 - RNA, 19 nt, Homo sapiens
ugaagccuguuaagaggua

SEQ ID NO: 1427318 - RNA, 19 nt, Homo sapiens
gcuguauucugacuuugaa

SEQ ID NO: 1427319 - RNA, 19 nt, Homo sapiens
caaccaauccaccaacaga

SEQ ID NO: 1427320 - RNA, 19 nt, Homo sapiens
ccagagagcuugggucacu

SEQ ID NO: 1427321 - RNA, 19 nt, Homo sapiens
aaaggaggguacauuacuu

SEQ ID NO: 1427322 - RNA, 19 nt, Homo sapiens
ggaggguacauuacuuaaa

SEQ ID NO: 1427323 - RNA, 19 nt, Homo sapiens
ccucugguauccuuccuuu

SEQ ID NO: 1427324 - RNA, 19 nt, Homo sapiens
gaugguagguauggugugu

SEQ ID NO: 1427325 - RNA, 19 nt, Homo sapiens
gcaucucacuggagcuguu

SEQ ID NO: 1427326 - RNA, 19 nt, Homo sapiens
gacauuggcuaugcgcuau

SEQ ID NO: 1427327 - RNA, 19 nt, Homo sapiens
aacaaaggaggguacauua

SEQ ID NO: 1427328 - RNA, 19 nt, Homo sapiens
gaagcggcguagcgacgaa

SEQ ID NO: 1427329 - RNA, 19 nt, Homo sapiens
ggaguuagggccugcuugu

SEQ ID NO: 1427330 - RNA, 19 nt, Homo sapiens
caaaggaggguacauuacu

SEQ ID NO: 1427331 - RNA, 19 nt, Homo sapiens
agaagggccugcagaaacu

SEQ ID NO: 1427332 - RNA, 19 nt, Homo sapiens
gcugucuucugugcguuua

SEQ ID NO: 1427333 - RNA, 19 nt, Homo sapiens
gguaugguguguuuguucu

SEQ ID NO: 1427334 - RNA, 19 nt, Homo sapiens
ugguagguaugguguguuu

SEQ ID NO: 1427335 - RNA, 19 nt, Homo sapiens
ggcagaccauggcagaguu

SEQ ID NO: 1427336 - RNA, 19 nt, Homo sapiens
gggaggacaacguggauug

SEQ ID NO: 1427337 - RNA, 19 nt, Homo sapiens
aaggaggguacauuacuua

SEQ ID NO: 1427338 - RNA, 19 nt, Homo sapiens
gggaugaggaugacaccaa

SEQ ID NO: 1427339 - RNA, 19 nt, Homo sapiens
guuaaaggauggcauuuuc

SEQ ID NO: 1427340 - RNA, 19 nt, Homo sapiens
guagguaugguguguuugu

SEQ ID NO: 1427341 - RNA, 19 nt, Homo sapiens
aaggccagcuucacauuuc

SEQ ID NO: 1427342 - RNA, 19 nt, Homo sapiens
gcuauacaguggccuacag

SEQ ID NO: 1427343 - RNA, 19 nt, Homo sapiens
ggagcugcaggccuacuuu

SEQ ID NO: 1427344 - RNA, 19 nt, Homo sapiens
ccagaagggccugcagaaa

SEQ ID NO: 1427345 - RNA, 19 nt, Homo sapiens
cagaagggccugcagaaac

SEQ ID NO: 1427346 - RNA, 19 nt, Homo sapiens
gcccuuagccagccagugu

SEQ ID NO: 1427347 - RNA, 19 nt, Homo sapiens
ugacuuugaagccuguuaa

SEQ ID NO: 1427348 - RNA, 19 nt, Homo sapiens
gcuguuaaaggauggcauu

SEQ ID NO: 1427349 - RNA, 19 nt, Homo sapiens
gagagcagaggaccugauc

SEQ ID NO: 1427350 - RNA, 19 nt, Homo sapiens
ccaauccaccaacagaaug

SEQ ID NO: 1427351 - RNA, 19 nt, Homo sapiens
ggauuugaauagugguuuu

SEQ ID NO: 1427352 - RNA, 19 nt, Homo sapiens
ugacgaccgccuccucuug

SEQ ID NO: 1427353 - RNA, 19 nt, Homo sapiens
acgggugguugccauguuu

SEQ ID NO: 1427354 - RNA, 19 nt, Homo sapiens
aggaggagauugacgacau

SEQ ID NO: 1427355 - RNA, 19 nt, Homo sapiens
cuucgaagaugugaacaag

SEQ ID NO: 1427356 - RNA, 19 nt, Homo sapiens
gcucagcuucgaagaugug

SEQ ID NO: 1427357 - RNA, 19 nt, Homo sapiens
gauugacgacauuggcuau

SEQ ID NO: 1427358 - RNA, 19 nt, Homo sapiens
ucccggaacugcccuuugg

SEQ ID NO: 1427359 - RNA, 19 nt, Homo sapiens
gcauuuuccugcugucuuc

SEQ ID NO: 1427360 - RNA, 19 nt, Homo sapiens
gaggacaacguggauugga

SEQ ID NO: 1427361 - RNA, 19 nt, Homo sapiens
ggaugugcuugggcuaugg

SEQ ID NO: 1427362 - RNA, 19 nt, Homo sapiens
gggauuugaauagugguuu

SEQ ID NO: 1427363 - RNA, 19 nt, Homo sapiens
gagcugcaggccuacuuuc

SEQ ID NO: 1427364 - RNA, 19 nt, Homo sapiens
ggagagcagaggaccugau

SEQ ID NO: 1427365 - RNA, 19 nt, Homo sapiens
uaugguguguuuguucugu

SEQ ID NO: 1427366 - RNA, 19 nt, Homo sapiens
gcuggcugcuucugucaac

SEQ ID NO: 1427367 - RNA, 19 nt, Homo sapiens
gcugauggcuguauucuga

SEQ ID NO: 1427368 - RNA, 19 nt, Homo sapiens
gaacugcucucagcugaug

SEQ ID NO: 1427369 - RNA, 19 nt, Homo sapiens
gaacaaaggaggguacauu

SEQ ID NO: 1427370 - RNA, 19 nt, Homo sapiens
gcugagagaaggugacuua

SEQ ID NO: 1427371 - RNA, 19 nt, Homo sapiens
gaagaugugaacaagaaua

SEQ ID NO: 1427372 - RNA, 19 nt, Homo sapiens
ucgaagaugugaacaagaa

SEQ ID NO: 1427373 - RNA, 19 nt, Homo sapiens
gagagaaggugacuuaacg

SEQ ID NO: 1427374 - RNA, 19 nt, Homo sapiens
ucacauuucugcugagaga

SEQ ID NO: 1427375 - RNA, 19 nt, Homo sapiens
ggaggagauugacgacauu

SEQ ID NO: 1427376 - RNA, 19 nt, Homo sapiens
gaggguacauuacuuaaac

SEQ ID NO: 1427377 - RNA, 19 nt, Homo sapiens
ugaagccuguuaagaggua

SEQ ID NO: 1427378 - RNA, 19 nt, Homo sapiens
gcuguauucugacuuugaa

SEQ ID NO: 1427379 - RNA, 19 nt, Homo sapiens
caaccaauccaccaacaga

SEQ ID NO: 1427380 - RNA, 19 nt, Homo sapiens
ccagagagcuugggucacu

SEQ ID NO: 1427381 - RNA, 19 nt, Homo sapiens
aaaggaggguacauuacuu

SEQ ID NO: 1427382 - RNA, 19 nt, Homo sapiens
ggaggguacauuacuuaaa

SEQ ID NO: 1427383 - RNA, 19 nt, Homo sapiens
ccucugguauccuuccuuu

SEQ ID NO: 1427384 - RNA, 19 nt, Homo sapiens
gaugguagguauggugugu

SEQ ID NO: 1427385 - RNA, 19 nt, Homo sapiens
gcaucucacuggagcuguu

SEQ ID NO: 1427386 - RNA, 19 nt, Homo sapiens
gacauuggcuaugcgcuau

SEQ ID NO: 1427387 - RNA, 19 nt, Homo sapiens
gaagcggcguagcgacgaa

SEQ ID NO: 1427388 - RNA, 19 nt, Homo sapiens
aacaaaggaggguacauua

SEQ ID NO: 1427389 - RNA, 19 nt, Homo sapiens
caaaggaggguacauuacu

SEQ ID NO: 1427390 - RNA, 19 nt, Homo sapiens
agaagggccugcagaaacu

SEQ ID NO: 1427391 - RNA, 19 nt, Homo sapiens
gcugucuucugugcguuua

SEQ ID NO: 1427392 - RNA, 19 nt, Homo sapiens
gguaugguguguuuguucu

SEQ ID NO: 1427393 - RNA, 19 nt, Homo sapiens
ugguagguaugguguguuu

SEQ ID NO: 1427394 - RNA, 19 nt, Homo sapiens
gggcugagucccaauuuag

SEQ ID NO: 1427395 - RNA, 19 nt, Homo sapiens
ggcagaccauggcagaguu

SEQ ID NO: 1427396 - RNA, 19 nt, Homo sapiens
gggaggacaacguggauug

SEQ ID NO: 1427397 - RNA, 19 nt, Homo sapiens
gggaugaggaugacaccaa

SEQ ID NO: 1427398 - RNA, 19 nt, Homo sapiens
aaggaggguacauuacuua

SEQ ID NO: 1427399 - RNA, 19 nt, Homo sapiens
guuaaaggauggcauuuuc

SEQ ID NO: 1427400 - RNA, 19 nt, Homo sapiens
guagguaugguguguuugu

SEQ ID NO: 1427401 - RNA, 19 nt, Homo sapiens
aaggccagcuucacauuuc

SEQ ID NO: 1427402 - RNA, 19 nt, Homo sapiens
gcuauacaguggccuacag

SEQ ID NO: 1427403 - RNA, 19 nt, Homo sapiens
ggagcugcaggccuacuuu

SEQ ID NO: 1427404 - RNA, 19 nt, Homo sapiens
ccagaagggccugcagaaa

SEQ ID NO: 1427405 - RNA, 19 nt, Homo sapiens
gcccuuagccagccagugu

SEQ ID NO: 1427406 - RNA, 19 nt, Homo sapiens
cagaagggccugcagaaac

SEQ ID NO: 1427407 - RNA, 19 nt, Homo sapiens
ugacuuugaagccuguuaa

SEQ ID NO: 1427408 - RNA, 19 nt, Homo sapiens
gcuguuaaaggauggcauu

SEQ ID NO: 1427409 - RNA, 19 nt, Homo sapiens
gagagcagaggaccugauc

SEQ ID NO: 1427410 - RNA, 19 nt, Homo sapiens
ccaauccaccaacagaaug

SEQ ID NO: 1427411 - RNA, 19 nt, Homo sapiens
ggauuugaauagugguuuu

SEQ ID NO: 1427412 - RNA, 19 nt, Homo sapiens
ugacgaccgccuccucuug

SEQ ID NO: 1427413 - RNA, 19 nt, Homo sapiens
acgggugguugccauguuu

SEQ ID NO: 1427414 - RNA, 19 nt, Homo sapiens
aggaggagauugacgacau

SEQ ID NO: 1427415 - RNA, 19 nt, Homo sapiens
cuucgaagaugugaacaag

SEQ ID NO: 1427416 - RNA, 19 nt, Homo sapiens
ggggcugagucccaauuua

SEQ ID NO: 1427417 - RNA, 19 nt, Homo sapiens
gcucagcuucgaagaugug

SEQ ID NO: 1427418 - RNA, 19 nt, Homo sapiens
gauugacgacauuggcuau

SEQ ID NO: 1427419 - RNA, 19 nt, Homo sapiens
ucccggaacugcccuuugg

SEQ ID NO: 1427420 - RNA, 19 nt, Homo sapiens
gcauuuuccugcugucuuc

SEQ ID NO: 1427421 - RNA, 19 nt, Homo sapiens
gaggacaacguggauugga

SEQ ID NO: 1427422 - RNA, 19 nt, Homo sapiens
gagcugcaggccuacuuuc

SEQ ID NO: 1427423 - RNA, 19 nt, Homo sapiens
ggaugugcuugggcuaugg

SEQ ID NO: 1427424 - RNA, 19 nt, Homo sapiens
gggauuugaauagugguuu

SEQ ID NO: 1427425 - RNA, 19 nt, Homo sapiens
ggagagcagaggaccugau

SEQ ID NO: 1427426 - RNA, 19 nt, Homo sapiens
uaugguguguuuguucugu

SEQ ID NO: 1427427 - RNA, 19 nt, Homo sapiens
gcuggcugcuucugucaac

SEQ ID NO: 1427428 - RNA, 19 nt, Homo sapiens
gcagcacccucuucacuau

SEQ ID NO: 1427429 - RNA, 19 nt, Homo sapiens
ccaaguagcugggauuaca

SEQ ID NO: 1427430 - RNA, 19 nt, Homo sapiens
gcagcucggugcccaagaa

SEQ ID NO: 1427431 - RNA, 19 nt, Homo sapiens
gaugugcccuugggaacua

SEQ ID NO: 1427432 - RNA, 19 nt, Homo sapiens
gggcaacucuucaucuaca

SEQ ID NO: 1427433 - RNA, 19 nt, Homo sapiens
agauaucgcuggaccugua

SEQ ID NO: 1427434 - RNA, 19 nt, Homo sapiens
gcgggcaacucuucaucua

SEQ ID NO: 1427435 - RNA, 19 nt, Homo sapiens
ccucagagaucgucaccuu

SEQ ID NO: 1427436 - RNA, 19 nt, Homo sapiens
caccuuaccugaguacauu

SEQ ID NO: 1427437 - RNA, 19 nt, Homo sapiens
ccacagaguguccagauug

SEQ ID NO: 1427438 - RNA, 19 nt, Homo sapiens
ggaccgggaugaccuuugg

SEQ ID NO: 1427439 - RNA, 19 nt, Homo sapiens
caacagcgggcaacucuuc

SEQ ID NO: 1427440 - RNA, 19 nt, Homo sapiens
gcucuggccucuucauugg

SEQ ID NO: 1427441 - RNA, 19 nt, Homo sapiens
gcacugggauacccucaac

SEQ ID NO: 1427442 - RNA, 19 nt, Homo sapiens
caccaaagcagucagcauu

SEQ ID NO: 1427443 - RNA, 19 nt, Homo sapiens
gaggucggcugcuccaaca

SEQ ID NO: 1427444 - RNA, 19 nt, Homo sapiens
cacagaguguccagauuga

SEQ ID NO: 1427445 - RNA, 19 nt, Homo sapiens
ucgcugaccuccaucuuca

SEQ ID NO: 1427446 - RNA, 19 nt, Homo sapiens
gcagucagcauuggaagga

SEQ ID NO: 1427447 - RNA, 19 nt, Homo sapiens
guacagacgccaugcacau

SEQ ID NO: 1427448 - RNA, 19 nt, Homo sapiens
ccaucuacaucuccucaga

SEQ ID NO: 1427449 - RNA, 19 nt, Homo sapiens
ggauuacaguccucuuguc

SEQ ID NO: 1427450 - RNA, 19 nt, Homo sapiens
uuagauuucugacggacaa

SEQ ID NO: 1427451 - RNA, 19 nt, Homo sapiens
gcccgaaacaccaccauug

SEQ ID NO: 1427452 - RNA, 19 nt, Homo sapiens
gcuccauccuggccagcua

SEQ ID NO: 1427453 - RNA, 19 nt, Homo sapiens
ugugaggacuauuaauugu

SEQ ID NO: 1427454 - RNA, 19 nt, Homo sapiens
guaggaacacggugaaugg

SEQ ID NO: 1427455 - RNA, 19 nt, Homo sapiens
gaaaugggagaaaauaaug

SEQ ID NO: 1427456 - RNA, 19 nt, Homo sapiens
caaagcgggagcccugaaa

SEQ ID NO: 1427457 - RNA, 19 nt, Homo sapiens
gcaaagcgggagcccugaa

SEQ ID NO: 1427458 - RNA, 19 nt, Homo sapiens
cccaggugcucaugucuau

SEQ ID NO: 1427459 - RNA, 19 nt, Homo sapiens
cuccugaguucaagcaauu

SEQ ID NO: 1427460 - RNA, 19 nt, Homo sapiens
guccucagguccacccauu

SEQ ID NO: 1427461 - RNA, 19 nt, Homo sapiens
cgaggcugguccuggaauu

SEQ ID NO: 1427462 - RNA, 19 nt, Homo sapiens
agucuuggcucacugcaau

SEQ ID NO: 1427463 - RNA, 19 nt, Homo sapiens
ggaaaugggagaaaauaau

SEQ ID NO: 1427464 - RNA, 19 nt, Homo sapiens
ugccucagccucccaagua

SEQ ID NO: 1427465 - RNA, 19 nt, Homo sapiens
ggaacuaaagcaggugaug

SEQ ID NO: 1427466 - RNA, 19 nt, Homo sapiens
guccgucucucgaacagau

SEQ ID NO: 1427467 - RNA, 19 nt, Homo sapiens
ccagcuaccucaagaugcu

SEQ ID NO: 1427468 - RNA, 19 nt, Homo sapiens
caaagcagucagcauugga

SEQ ID NO: 1427469 - RNA, 19 nt, Homo sapiens
cagaguguccagauugaga

SEQ ID NO: 1427470 - RNA, 19 nt, Homo sapiens
agucagcauuggaaggaaa

SEQ ID NO: 1427471 - RNA, 19 nt, Homo sapiens
ggugggacgcacugggaua

SEQ ID NO: 1427472 - RNA, 19 nt, Homo sapiens
ugucgucgcugaccuccau

SEQ ID NO: 1427473 - RNA, 19 nt, Homo sapiens
uguacaccaucgcagcuuu

SEQ ID NO: 1427474 - RNA, 19 nt, Homo sapiens
gcucggugcccaagaacug

SEQ ID NO: 1427475 - RNA, 19 nt, Homo sapiens
gcaacucuucaucuacaug

SEQ ID NO: 1427476 - RNA, 19 nt, Homo sapiens
caaguguccgucucucgaa

SEQ ID NO: 1427477 - RNA, 19 nt, Homo sapiens
ggccagcuaccucaagaug

SEQ ID NO: 1427478 - RNA, 19 nt, Homo sapiens
gggauuacaguccucuugu

SEQ ID NO: 1427479 - RNA, 19 nt, Homo sapiens
ucagagaucgucaccuuac

SEQ ID NO: 1427480 - RNA, 19 nt, Homo sapiens
ucaaugccauccuccucau

SEQ ID NO: 1427481 - RNA, 19 nt, Homo sapiens
guccagauugagaaccuua

SEQ ID NO: 1427482 - RNA, 19 nt, Homo sapiens
cuguaugugaggacuauua

SEQ ID NO: 1427483 - RNA, 19 nt, Homo sapiens
uggcaggcuucgaguggaa

SEQ ID NO: 1427484 - RNA, 19 nt, Homo sapiens
cacggugaauggcuacuuc

SEQ ID NO: 1427485 - RNA, 19 nt, Homo sapiens
ucaucuacaugcagucagu

SEQ ID NO: 1427486 - RNA, 19 nt, Homo sapiens
uguaugugaggacuauuaa

SEQ ID NO: 1427487 - RNA, 19 nt, Homo sapiens
gcccgugucuguggcuuca

SEQ ID NO: 1427488 - RNA, 19 nt, Homo sapiens
gugaggacuauuaauuguu

SEQ ID NO: 1427489 - RNA, 19 nt, Homo sapiens
gggcugaugaucgcaguga

SEQ ID NO: 1427490 - RNA, 19 nt, Homo sapiens
gcaccaaagcagucagcau

SEQ ID NO: 1427491 - RNA, 19 nt, Homo sapiens
ugaccuccaucuucaacag

SEQ ID NO: 1427492 - RNA, 19 nt, Homo sapiens
gcugaugaucgcagugaug

SEQ ID NO: 1427493 - RNA, 19 nt, Homo sapiens
gggagaaaauaaugugaca

SEQ ID NO: 1427494 - RNA, 19 nt, Homo sapiens
ccucagguccacccauuuc

SEQ ID NO: 1427495 - RNA, 19 nt, Homo sapiens
cccacagaguguccagauu

SEQ ID NO: 1427496 - RNA, 19 nt, Homo sapiens
gcacccucuucacuaugga

SEQ ID NO: 1427497 - RNA, 19 nt, Homo sapiens
cagcagcacccucuucacu

SEQ ID NO: 1427498 - RNA, 19 nt, Homo sapiens
ccaagcuggucauggaacu

SEQ ID NO: 1427499 - RNA, 19 nt, Homo sapiens
gggcucuggccucuucauu

SEQ ID NO: 1427500 - RNA, 19 nt, Homo sapiens
guucccaggugcucauguc

SEQ ID NO: 1427501 - RNA, 19 nt, Homo sapiens
aaagcagucagcauuggaa

SEQ ID NO: 1427502 - RNA, 19 nt, Homo sapiens
cugccauccuggacagaaa

SEQ ID NO: 1427503 - RNA, 19 nt, Homo sapiens
acucaguggugcuguugug

SEQ ID NO: 1427504 - RNA, 19 nt, Homo sapiens
ccaguaggaacacggugaa

SEQ ID NO: 1427505 - RNA, 19 nt, Homo sapiens
ggguguucgugcccaucua

SEQ ID NO: 1427506 - RNA, 19 nt, Homo sapiens
gaauaaagauccagucaua

SEQ ID NO: 1427507 - RNA, 19 nt, Homo sapiens
caaaggagcuuaucacaga

SEQ ID NO: 1427508 - RNA, 19 nt, Homo sapiens
gaacccaguuuaagaauuu

SEQ ID NO: 1427509 - RNA, 19 nt, Homo sapiens
gcauaugccuuguuuaaga

SEQ ID NO: 1427510 - RNA, 19 nt, Homo sapiens
gcaguuaccuaccaguuaa

SEQ ID NO: 1427511 - RNA, 19 nt, Homo sapiens
gcagcugacuccuugaaua

SEQ ID NO: 1427512 - RNA, 19 nt, Homo sapiens
ggaagagccugauccuuug

SEQ ID NO: 1427513 - RNA, 19 nt, Homo sapiens
gaaaauuccugcacuuuaa

SEQ ID NO: 1427514 - RNA, 19 nt, Homo sapiens
gaagcaacauguuucauuc

SEQ ID NO: 1427515 - RNA, 19 nt, Homo sapiens
gaaacuaugggcaaagaua

SEQ ID NO: 1427516 - RNA, 19 nt, Homo sapiens
guaugaagcugaaaccuau

SEQ ID NO: 1427517 - RNA, 19 nt, Homo sapiens
gugaucaccucaaacauaa

SEQ ID NO: 1427518 - RNA, 19 nt, Homo sapiens
gaagacauuuagacaguau

SEQ ID NO: 1427519 - RNA, 19 nt, Homo sapiens
cagcaugccuggccaauug

SEQ ID NO: 1427520 - RNA, 19 nt, Homo sapiens
gaagaaaugaacccaguuu

SEQ ID NO: 1427521 - RNA, 19 nt, Homo sapiens
gaaccacacuugauuucug

SEQ ID NO: 1427522 - RNA, 19 nt, Homo sapiens
aaagauagacucacugaaa

SEQ ID NO: 1427523 - RNA, 19 nt, Homo sapiens
agauacaugugucugauua

SEQ ID NO: 1427524 - RNA, 19 nt, Homo sapiens
uaucaacgauucaagaaga

SEQ ID NO: 1427525 - RNA, 19 nt, Homo sapiens
caagacaaaucuauuaguc

SEQ ID NO: 1427526 - RNA, 19 nt, Homo sapiens
ggaagcaacauguuucauu

SEQ ID NO: 1427527 - RNA, 19 nt, Homo sapiens
cagcauaugccuuguuuaa

SEQ ID NO: 1427528 - RNA, 19 nt, Homo sapiens
gggcugcucugcugaguga

SEQ ID NO: 1427529 - RNA, 19 nt, Homo sapiens
gagugaaugucguuccuuu

SEQ ID NO: 1427530 - RNA, 19 nt, Homo sapiens
gaaaugaacccaguuuaag

SEQ ID NO: 1427531 - RNA, 19 nt, Homo sapiens
ucuaauaacuucugguguu

SEQ ID NO: 1427532 - RNA, 19 nt, Homo sapiens
acauaaugcuggucucuuu

SEQ ID NO: 1427533 - RNA, 19 nt, Homo sapiens
gagacaaacuagcaucauc

SEQ ID NO: 1427534 - RNA, 19 nt, Homo sapiens
gaagagacaaaggagcuua

SEQ ID NO: 1427535 - RNA, 19 nt, Homo sapiens
auacaaugcugaauccaaa

SEQ ID NO: 1427536 - RNA, 19 nt, Homo sapiens
gauccagucauauauguaa

SEQ ID NO: 1427537 - RNA, 19 nt, Homo sapiens
guuaaugucuuagaaguca

SEQ ID NO: 1427538 - RNA, 19 nt, Homo sapiens
ugaaguaucugcgcaguca

SEQ ID NO: 1427539 - RNA, 19 nt, Homo sapiens
gaaaggagugaaugucguu

SEQ ID NO: 1427540 - RNA, 19 nt, Homo sapiens
agaaaugaacccaguuuaa

SEQ ID NO: 1427541 - RNA, 19 nt, Homo sapiens
cuaauaacuucugguguuu

SEQ ID NO: 1427542 - RNA, 19 nt, Homo sapiens
caagggaagcaacauguuu

SEQ ID NO: 1427543 - RNA, 19 nt, Homo sapiens
gguguuuagucuuucuaua

SEQ ID NO: 1427544 - RNA, 19 nt, Homo sapiens
cacagcauaugccuuguuu

SEQ ID NO: 1427545 - RNA, 19 nt, Homo sapiens
aaacagaauagagcaguua

SEQ ID NO: 1427546 - RNA, 19 nt, Homo sapiens
caucaaaacugccuguaaa

SEQ ID NO: 1427547 - RNA, 19 nt, Homo sapiens
uugguuaguugccgaaaua

SEQ ID NO: 1427548 - RNA, 19 nt, Homo sapiens
caaaacugccuguaaauaa

SEQ ID NO: 1427549 - RNA, 19 nt, Homo sapiens
aagaagacauuuagacagu

SEQ ID NO: 1427550 - RNA, 19 nt, Homo sapiens
caaagauacaugugucuga

SEQ ID NO: 1427551 - RNA, 19 nt, Homo sapiens
gccaucaguagcaguauua

SEQ ID NO: 1427552 - RNA, 19 nt, Homo sapiens
gcugaaaccuaucaacacu

SEQ ID NO: 1427553 - RNA, 19 nt, Homo sapiens
ccugaagcuugucauaauu

SEQ ID NO: 1427554 - RNA, 19 nt, Homo sapiens
guacguaauuuggagacaa

SEQ ID NO: 1427555 - RNA, 19 nt, Homo sapiens
uauccagugugacccauaa

SEQ ID NO: 1427556 - RNA, 19 nt, Homo sapiens
ugaacccaguuuaagaauu

SEQ ID NO: 1427557 - RNA, 19 nt, Homo sapiens
ucugaggguuaaagaagua

SEQ ID NO: 1427558 - RNA, 19 nt, Homo sapiens
cuaguucucugaggguuaa

SEQ ID NO: 1427559 - RNA, 19 nt, Homo sapiens
gcacuuuaacccuuuggaa

SEQ ID NO: 1427560 - RNA, 19 nt, Homo sapiens
gaauguaccacggacugua

SEQ ID NO: 1427561 - RNA, 19 nt, Homo sapiens
uagacucacugaaaaguua

SEQ ID NO: 1427562 - RNA, 19 nt, Homo sapiens
gcaagggaagcaacauguu

SEQ ID NO: 1427563 - RNA, 19 nt, Homo sapiens
caaacuagcaucaucaaaa

SEQ ID NO: 1427564 - RNA, 19 nt, Homo sapiens
cauaugccuuguuuaagau

SEQ ID NO: 1427565 - RNA, 19 nt, Homo sapiens
gaguggaaaugcccucaca

SEQ ID NO: 1427566 - RNA, 19 nt, Homo sapiens
ccuugaauauccaguguga

SEQ ID NO: 1427567 - RNA, 19 nt, Homo sapiens
ugaaaccuaucaacacucu

SEQ ID NO: 1427568 - RNA, 19 nt, Homo sapiens
aaaugaacccaguuuaaga

SEQ ID NO: 1427569 - RNA, 19 nt, Homo sapiens
gcaagacaaaucuauuagu

SEQ ID NO: 1427570 - RNA, 19 nt, Homo sapiens
cagcugacuccuugaauau

SEQ ID NO: 1427571 - RNA, 19 nt, Homo sapiens
gaaugucguuccuuuucua

SEQ ID NO: 1427572 - RNA, 19 nt, Homo sapiens
agaagacauuuagacagua

SEQ ID NO: 1427573 - RNA, 19 nt, Homo sapiens
ucaagaagacauuuagaca

SEQ ID NO: 1427574 - RNA, 19 nt, Homo sapiens
ucagaaccacacuugauuu

SEQ ID NO: 1427575 - RNA, 19 nt, Homo sapiens
gaauuugccaucaguagca

SEQ ID NO: 1427576 - RNA, 19 nt, Homo sapiens
aaagauacaugugucugau

SEQ ID NO: 1427577 - RNA, 19 nt, Homo sapiens
ggaaaggaggccauuggau

SEQ ID NO: 1427578 - RNA, 19 nt, Homo sapiens
gagcaguuaccuaccaguu

SEQ ID NO: 1427579 - RNA, 19 nt, Homo sapiens
uuaagaauuugccaucagu

SEQ ID NO: 1427580 - RNA, 19 nt, Homo sapiens
ggaagaaaugaacccaguu

SEQ ID NO: 1427581 - RNA, 19 nt, Homo sapiens
cgaaauauacuaguucucu

SEQ ID NO: 1427582 - RNA, 19 nt, Homo sapiens
gcuccagcguccuaagaga

SEQ ID NO: 1427583 - RNA, 19 nt, Homo sapiens
gcucagggaacuccggaaa

SEQ ID NO: 1427584 - RNA, 19 nt, Homo sapiens
ccaguguguugcaaaggaa

SEQ ID NO: 1427585 - RNA, 19 nt, Homo sapiens
aagaaaugaacccaguuua

SEQ ID NO: 1427586 - RNA, 19 nt, Homo sapiens
gacaaaggagcuuaucaca

SEQ ID NO: 1427587 - RNA, 19 nt, Homo sapiens
ggauggaagagacaaagga

SEQ ID NO: 1427588 - RNA, 19 nt, Homo sapiens
uaacuucugguguuugguu

SEQ ID NO: 1427589 - RNA, 19 nt, Homo sapiens
aagauccagucauauaugu

SEQ ID NO: 1427590 - RNA, 19 nt, Homo sapiens
agcagugguuaaugucuua

SEQ ID NO: 1427591 - RNA, 19 nt, Homo sapiens
uggaaacuaugggcaaaga

SEQ ID NO: 1427592 - RNA, 19 nt, Homo sapiens
cagugcaucuaauaacuuc

SEQ ID NO: 1427593 - RNA, 19 nt, Homo sapiens
gauuccagugcaucuaaua

SEQ ID NO: 1427594 - RNA, 19 nt, Homo sapiens
ccuaucaacacucuucaaa

SEQ ID NO: 1427595 - RNA, 19 nt, Homo sapiens
gguuaguugccgaaauaua

SEQ ID NO: 1427596 - RNA, 19 nt, Homo sapiens
ugcaacaccugcucgguau

SEQ ID NO: 1427597 - RNA, 19 nt, Homo sapiens
ccacacuugauuucuguuu

SEQ ID NO: 1427598 - RNA, 19 nt, Homo sapiens
guuaguugccgaaauauac

SEQ ID NO: 1427599 - RNA, 19 nt, Homo sapiens
ggaagaaacaaaagauaga

SEQ ID NO: 1427600 - RNA, 19 nt, Homo sapiens
caaaggaaaggaggccauu

SEQ ID NO: 1427601 - RNA, 19 nt, Homo sapiens
aaagauccagucauauaug

SEQ ID NO: 1427602 - RNA, 19 nt, Homo sapiens
aaugaacccaguuuaagaa

SEQ ID NO: 1427603 - RNA, 19 nt, Homo sapiens
gagacaaaggagcuuauca

SEQ ID NO: 1427604 - RNA, 19 nt, Homo sapiens
ggacaggauggaagagaca

SEQ ID NO: 1427605 - RNA, 19 nt, Homo sapiens
gcaacaccugcucgguaua

SEQ ID NO: 1427606 - RNA, 19 nt, Homo sapiens
gaacuugucuggcauguca

SEQ ID NO: 1427607 - RNA, 19 nt, Homo sapiens
gcagguggcuggacaagaa

SEQ ID NO: 1427608 - RNA, 19 nt, Homo sapiens
gaaccuacagugauaauaa

SEQ ID NO: 1427609 - RNA, 19 nt, Homo sapiens
gaaccgauccaaagaguuu

SEQ ID NO: 1427610 - RNA, 19 nt, Homo sapiens
ccaaagaguuucucaugga

SEQ ID NO: 1427611 - RNA, 19 nt, Homo sapiens
gaacaacacggacacauuc

SEQ ID NO: 1427612 - RNA, 19 nt, Homo sapiens
gaacgacaccuucaucaug

SEQ ID NO: 1427613 - RNA, 19 nt, Homo sapiens
ggcaauguguacuucuuua

SEQ ID NO: 1427614 - RNA, 19 nt, Homo sapiens
gagaggauccuacugaaga

SEQ ID NO: 1427615 - RNA, 19 nt, Homo sapiens
gagcacaccucaggcuaaa

SEQ ID NO: 1427616 - RNA, 19 nt, Homo sapiens
caaagaguuucucauggaa

SEQ ID NO: 1427617 - RNA, 19 nt, Homo sapiens
ggaagaaccgauccaaaga

SEQ ID NO: 1427618 - RNA, 19 nt, Homo sapiens
ggacauugccucccucugu

SEQ ID NO: 1427619 - RNA, 19 nt, Homo sapiens
agaagacccugguguguga

SEQ ID NO: 1427620 - RNA, 19 nt, Homo sapiens
uauugaaccuacagugaua

SEQ ID NO: 1427621 - RNA, 19 nt, Homo sapiens
gggcagacauucucuuugg

SEQ ID NO: 1427622 - RNA, 19 nt, Homo sapiens
ggaacaacacggacacauu

SEQ ID NO: 1427623 - RNA, 19 nt, Homo sapiens
ccacagacacguuugaguu

SEQ ID NO: 1427624 - RNA, 19 nt, Homo sapiens
gcacaccucaggcuaaaug

SEQ ID NO: 1427625 - RNA, 19 nt, Homo sapiens
ccucuucccuucugucuga

SEQ ID NO: 1427626 - RNA, 19 nt, Homo sapiens
gcaauguguacuucuuuaa

SEQ ID NO: 1427627 - RNA, 19 nt, Homo sapiens
gcacgacaacaaagggaua

SEQ ID NO: 1427628 - RNA, 19 nt, Homo sapiens
acaacaagaucugugauga

SEQ ID NO: 1427629 - RNA, 19 nt, Homo sapiens
gcacugaugccaacguguu

SEQ ID NO: 1427630 - RNA, 19 nt, Homo sapiens
ugaaaugugugccguuauc

SEQ ID NO: 1427631 - RNA, 19 nt, Homo sapiens
cuucaaagccucuagcauu

SEQ ID NO: 1427632 - RNA, 19 nt, Homo sapiens
ugugaaaugugugccguua

SEQ ID NO: 1427633 - RNA, 19 nt, Homo sapiens
ggagcacaccucaggcuaa

SEQ ID NO: 1427634 - RNA, 19 nt, Homo sapiens
cgacaacaaagggauauuu

SEQ ID NO: 1427635 - RNA, 19 nt, Homo sapiens
cagacacguuugaguuuga

SEQ ID NO: 1427636 - RNA, 19 nt, Homo sapiens
gcagacgguccgcgacuuu

SEQ ID NO: 1427637 - RNA, 19 nt, Homo sapiens
gagggcagacauucucuuu

SEQ ID NO: 1427638 - RNA, 19 nt, Homo sapiens
gcacugaugccaacgucuu

SEQ ID NO: 1427639 - RNA, 19 nt, Homo sapiens
gaucugugaugagcuggaa

SEQ ID NO: 1427640 - RNA, 19 nt, Homo sapiens
gcacugacuccaacaucuu

SEQ ID NO: 1427641 - RNA, 19 nt, Homo sapiens
cuggagaccugaccauguu

SEQ ID NO: 1427642 - RNA, 19 nt, Homo sapiens
cgacgagaccuuccacuuc

SEQ ID NO: 1427643 - RNA, 19 nt, Homo sapiens
gcuggcaucugagcuaugu

SEQ ID NO: 1427644 - RNA, 19 nt, Homo sapiens
gagcagaacgacaccuuca

SEQ ID NO: 1427645 - RNA, 19 nt, Homo sapiens
gaagaaccgauccaaagag

SEQ ID NO: 1427646 - RNA, 19 nt, Homo sapiens
gcagaacgacaccuucauc

SEQ ID NO: 1427647 - RNA, 19 nt, Homo sapiens
caggcuggcugguggagaa

SEQ ID NO: 1427648 - RNA, 19 nt, Homo sapiens
gccaacguguucaucauca

SEQ ID NO: 1427649 - RNA, 19 nt, Homo sapiens
uucaaagccucuagcauug

SEQ ID NO: 1427650 - RNA, 19 nt, Homo sapiens
ccaacaacaagaucuguga

SEQ ID NO: 1427651 - RNA, 19 nt, Homo sapiens
ccucuguucucuaugaaau

SEQ ID NO: 1427652 - RNA, 19 nt, Homo sapiens
cagcacagaccgcuucuuc

SEQ ID NO: 1427653 - RNA, 19 nt, Homo sapiens
ugagcuaugucgaugugaa

SEQ ID NO: 1427654 - RNA, 19 nt, Homo sapiens
ggucuggcacgacaacaaa

SEQ ID NO: 1427655 - RNA, 19 nt, Homo sapiens
ggaccacagacacguuuga

SEQ ID NO: 1427656 - RNA, 19 nt, Homo sapiens
gacaacaaagggauauuuc

SEQ ID NO: 1427657 - RNA, 19 nt, Homo sapiens
ucaagaggaagaggaagua

SEQ ID NO: 1427658 - RNA, 19 nt, Homo sapiens
cacagacacguuugaguuu

SEQ ID NO: 1427659 - RNA, 19 nt, Homo sapiens
caagaagacccuggugugu

SEQ ID NO: 1427660 - RNA, 19 nt, Homo sapiens
ucauggagauccuagacau

SEQ ID NO: 1427661 - RNA, 19 nt, Homo sapiens
uuuccuggcuggcaucuga

SEQ ID NO: 1427662 - RNA, 19 nt, Homo sapiens
gcacagaccgcuucuuccu

SEQ ID NO: 1427663 - RNA, 19 nt, Homo sapiens
gagauggaguacggcaaug

SEQ ID NO: 1427664 - RNA, 19 nt, Homo sapiens
agaggauccuacugaagaa

SEQ ID NO: 1427665 - RNA, 19 nt, Homo sapiens
uggagaggauccuacugaa

SEQ ID NO: 1427666 - RNA, 19 nt, Homo sapiens
ggagaugcagcuggacaaa

SEQ ID NO: 1427667 - RNA, 19 nt, Homo sapiens
aagaaccgauccaaagagu

SEQ ID NO: 1427668 - RNA, 19 nt, Homo sapiens
cguuaucgaugaggaagaa

SEQ ID NO: 1427669 - RNA, 19 nt, Homo sapiens
gguuugagcgggagcagaa

SEQ ID NO: 1427670 - RNA, 19 nt, Homo sapiens
ucuguucucuaugaaauga

SEQ ID NO: 1427671 - RNA, 19 nt, Homo sapiens
agcgggagcugaagcagaa

SEQ ID NO: 1427672 - RNA, 19 nt, Homo sapiens
gucaagaccaucaccauca

SEQ ID NO: 1427673 - RNA, 19 nt, Homo sapiens
acagacacguuugaguuug

SEQ ID NO: 1427674 - RNA, 19 nt, Homo sapiens
ccuacaccgucgcaguuaa

SEQ ID NO: 1427675 - RNA, 19 nt, Homo sapiens
gcaggaagaaccgauccaa

SEQ ID NO: 1427676 - RNA, 19 nt, Homo sapiens
acauucaacuucccugaca

SEQ ID NO: 1427677 - RNA, 19 nt, Homo sapiens
ugugugccguuaucgauga

SEQ ID NO: 1427678 - RNA, 19 nt, Homo sapiens
caagacgacagagagcuuu

SEQ ID NO: 1427679 - RNA, 19 nt, Homo sapiens
gcagugcucccucuguucu

SEQ ID NO: 1427680 - RNA, 19 nt, Homo sapiens
ugaaggcacaccaggaaga

SEQ ID NO: 1427681 - RNA, 19 nt, Homo sapiens
gagaacuugucuggcaugu

SEQ ID NO: 1427682 - RNA, 19 nt, Homo sapiens
ggagacagagggcagacau

SEQ ID NO: 1427683 - RNA, 19 nt, Homo sapiens
uggaagagaccaccuacga

SEQ ID NO: 1427684 - RNA, 19 nt, Homo sapiens
caacaagaucugugaugag

SEQ ID NO: 1427685 - RNA, 19 nt, Homo sapiens
gcgacgagaccuuccacuu

SEQ ID NO: 1427686 - RNA, 19 nt, Homo sapiens
ggacacuggcccugaagca

SEQ ID NO: 1427687 - RNA, 19 nt, Homo sapiens
gugggacacuggcccugaa

SEQ ID NO: 1427688 - RNA, 19 nt, Homo sapiens
ggagaggauccuacugaag

SEQ ID NO: 1427689 - RNA, 19 nt, Homo sapiens
agaggaagaggaaguacuu

SEQ ID NO: 1427690 - RNA, 19 nt, Homo sapiens
ggcacugacuccaacaucu

SEQ ID NO: 1427691 - RNA, 19 nt, Homo sapiens
ccuagacauugcuccauuc

SEQ ID NO: 1427692 - RNA, 19 nt, Homo sapiens
ucacugagaugccccaauc

SEQ ID NO: 1427693 - RNA, 19 nt, Homo sapiens
gaaaaugcgcaaccucuuc

SEQ ID NO: 1427694 - RNA, 19 nt, Homo sapiens
uucaagguauucgagguua

SEQ ID NO: 1427695 - RNA, 19 nt, Homo sapiens
uaacugugacugccucauc

SEQ ID NO: 1427696 - RNA, 19 nt, Homo sapiens
ggcagacauucucuuugga

SEQ ID NO: 1427697 - RNA, 19 nt, Homo sapiens
caggaagaaccgauccaaa

SEQ ID NO: 1427698 - RNA, 19 nt, Homo sapiens
aggcagugcucccucuguu

SEQ ID NO: 1427699 - RNA, 19 nt, Homo sapiens
gagacagagggcagacauu

SEQ ID NO: 1427700 - RNA, 19 nt, Homo sapiens
caacaaagggauauuuccu

SEQ ID NO: 1427701 - RNA, 19 nt, Homo sapiens
ccuggugugugaaaugugu

SEQ ID NO: 1427702 - RNA, 19 nt, Homo sapiens
ucaagugaacaucauggaa

SEQ ID NO: 1427703 - RNA, 19 nt, Homo sapiens
ggucagcagcccuucaaag

SEQ ID NO: 1427704 - RNA, 19 nt, Homo sapiens
ccaagacgacagagagcuu

SEQ ID NO: 1427705 - RNA, 19 nt, Homo sapiens
acacggacacauucaacuu

SEQ ID NO: 1427706 - RNA, 19 nt, Homo sapiens
gaacuuggcugucuucuau

SEQ ID NO: 1427707 - RNA, 19 nt, Homo sapiens
gaaagagaauggagaguuu

SEQ ID NO: 1427708 - RNA, 19 nt, Homo sapiens
caguuaagcugacauauua

SEQ ID NO: 1427709 - RNA, 19 nt, Homo sapiens
gggcacagauugucuuuaa

SEQ ID NO: 1427710 - RNA, 19 nt, Homo sapiens
ugaagaggcuggaguaauu

SEQ ID NO: 1427711 - RNA, 19 nt, Homo sapiens
gcucugcucugguaucaua

SEQ ID NO: 1427712 - RNA, 19 nt, Homo sapiens
caacaugucugucuguaug

SEQ ID NO: 1427713 - RNA, 19 nt, Homo sapiens
ccuggaagauuuacaauaa

SEQ ID NO: 1427714 - RNA, 19 nt, Homo sapiens
ggaugaagcuaaggaaauu

SEQ ID NO: 1427715 - RNA, 19 nt, Homo sapiens
ugagguaccuguaaaauua

SEQ ID NO: 1427716 - RNA, 19 nt, Homo sapiens
ugauagagcucaauuucaa

SEQ ID NO: 1427717 - RNA, 19 nt, Homo sapiens
agaagaagcuaacugaaga

SEQ ID NO: 1427718 - RNA, 19 nt, Homo sapiens
ggaaagccuggaagauuua

SEQ ID NO: 1427719 - RNA, 19 nt, Homo sapiens
cagaaaggcugaguccuaa

SEQ ID NO: 1427720 - RNA, 19 nt, Homo sapiens
ggacacauuuucccaguua

SEQ ID NO: 1427721 - RNA, 19 nt, Homo sapiens
ccaaauucuucccucuuua

SEQ ID NO: 1427722 - RNA, 19 nt, Homo sapiens
gcagagcucuacuucuuca

SEQ ID NO: 1427723 - RNA, 19 nt, Homo sapiens
cgacuagagugucaaauca

SEQ ID NO: 1427724 - RNA, 19 nt, Homo sapiens
gagucaagcuugccaugaa

SEQ ID NO: 1427725 - RNA, 19 nt, Homo sapiens
gcuguuagcuuuggauaug

SEQ ID NO: 1427726 - RNA, 19 nt, Homo sapiens
caagaauugucagcuuaua

SEQ ID NO: 1427727 - RNA, 19 nt, Homo sapiens
acacacagccucuuuagaa

SEQ ID NO: 1427728 - RNA, 19 nt, Homo sapiens
guuggcaugugaugacuua

SEQ ID NO: 1427729 - RNA, 19 nt, Homo sapiens
ccaaagcgcucuguguguu

SEQ ID NO: 1427730 - RNA, 19 nt, Homo sapiens
aggaaagccuggaagauuu

SEQ ID NO: 1427731 - RNA, 19 nt, Homo sapiens
cagaagaugcuguucagua

SEQ ID NO: 1427732 - RNA, 19 nt, Homo sapiens
agagagaaauucaacaugu

SEQ ID NO: 1427733 - RNA, 19 nt, Homo sapiens
cauuagcucugcucuggua

SEQ ID NO: 1427734 - RNA, 19 nt, Homo sapiens
gaaaggcugaguccuaaga

SEQ ID NO: 1427735 - RNA, 19 nt, Homo sapiens
ugaccuugcucaaacguuu

SEQ ID NO: 1427736 - RNA, 19 nt, Homo sapiens
ugacucaucuguuguugga

SEQ ID NO: 1427737 - RNA, 19 nt, Homo sapiens
ggaugcauuugauuccuuu

SEQ ID NO: 1427738 - RNA, 19 nt, Homo sapiens
uaagugaccuugcucaaac

SEQ ID NO: 1427739 - RNA, 19 nt, Homo sapiens
gcugugcuuucauuuguaa

SEQ ID NO: 1427740 - RNA, 19 nt, Homo sapiens
gaacguugauguccgaaaa

SEQ ID NO: 1427741 - RNA, 19 nt, Homo sapiens
ggagccagcuuugucaguu

SEQ ID NO: 1427742 - RNA, 19 nt, Homo sapiens
aggcagagcucuacuucuu

SEQ ID NO: 1427743 - RNA, 19 nt, Homo sapiens
gcacagauugucuuuaaag

SEQ ID NO: 1427744 - RNA, 19 nt, Homo sapiens
cuacuugacugcaguuugu

SEQ ID NO: 1427745 - RNA, 19 nt, Homo sapiens
gagccagcuuugucaguuu

SEQ ID NO: 1427746 - RNA, 19 nt, Homo sapiens
ccuaagaaaucucaagcuu

SEQ ID NO: 1427747 - RNA, 19 nt, Homo sapiens
ggaugaugaugguaauaau

SEQ ID NO: 1427748 - RNA, 19 nt, Homo sapiens
gagagaaauucaacauguc

SEQ ID NO: 1427749 - RNA, 19 nt, Homo sapiens
gaauugugucgucagaaua

SEQ ID NO: 1427750 - RNA, 19 nt, Homo sapiens
gaugaauugugucgucaga

SEQ ID NO: 1427751 - RNA, 19 nt, Homo sapiens
gaacauccaacccaagauc

SEQ ID NO: 1427752 - RNA, 19 nt, Homo sapiens
ggaggaugaugaugguaau

SEQ ID NO: 1427753 - RNA, 19 nt, Homo sapiens
gcaguagaccagagagaaa

SEQ ID NO: 1427754 - RNA, 19 nt, Homo sapiens
ggacaucaaugcccuucag

SEQ ID NO: 1427755 - RNA, 19 nt, Homo sapiens
ugaauugugucgucagaau

SEQ ID NO: 1427756 - RNA, 19 nt, Homo sapiens
gcauuugauuccuuugaga

SEQ ID NO: 1427757 - RNA, 19 nt, Homo sapiens
gaugacauuugaggaagaa

SEQ ID NO: 1427758 - RNA, 19 nt, Homo sapiens
gcugacauauuaaagaucu

SEQ ID NO: 1427759 - RNA, 19 nt, Homo sapiens
ccaguuaagcugacauauu

SEQ ID NO: 1427760 - RNA, 19 nt, Homo sapiens
gguccgcacuuuaaaauaa

SEQ ID NO: 1427761 - RNA, 19 nt, Homo sapiens
acacaaaugucuaggaaac

SEQ ID NO: 1427762 - RNA, 19 nt, Homo sapiens
auacacaaaugucuaggaa

SEQ ID NO: 1427763 - RNA, 19 nt, Homo sapiens
acauguagcugaaaaguaa

SEQ ID NO: 1427764 - RNA, 19 nt, Homo sapiens
gaaagcucuuccaaacugu

SEQ ID NO: 1427765 - RNA, 19 nt, Homo sapiens
uggguaacaugaugaggua

SEQ ID NO: 1427766 - RNA, 19 nt, Homo sapiens
cuaggaaacucagaagaug

SEQ ID NO: 1427767 - RNA, 19 nt, Homo sapiens
ccacacugcuuuggaacuu

SEQ ID NO: 1427768 - RNA, 19 nt, Homo sapiens
caaauucuucccucuuuau

SEQ ID NO: 1427769 - RNA, 19 nt, Homo sapiens
uccaaauucuucccucuuu

SEQ ID NO: 1427770 - RNA, 19 nt, Homo sapiens
gaaaucauagcccacuaau

SEQ ID NO: 1427771 - RNA, 19 nt, Homo sapiens
ucuaaaaucuugcuccuaa

SEQ ID NO: 1427772 - RNA, 19 nt, Homo sapiens
ggacggauacaacgacuag

SEQ ID NO: 1427773 - RNA, 19 nt, Homo sapiens
uaggaaagccuggaagauu

SEQ ID NO: 1427774 - RNA, 19 nt, Homo sapiens
agaagaugcuguucaguac

SEQ ID NO: 1427775 - RNA, 19 nt, Homo sapiens
uucaggagcuguaucagaa

SEQ ID NO: 1427776 - RNA, 19 nt, Homo sapiens
acuuggcugucuucuauua

SEQ ID NO: 1427777 - RNA, 19 nt, Homo sapiens
caugauagagcucaauuuc

SEQ ID NO: 1427778 - RNA, 19 nt, Homo sapiens
ggauggcagugauaacaag

SEQ ID NO: 1427779 - RNA, 19 nt, Homo sapiens
cagaaacucuucaaaagga

SEQ ID NO: 1427780 - RNA, 19 nt, Homo sapiens
acagugccuugacaucuuu

SEQ ID NO: 1427781 - RNA, 19 nt, Homo sapiens
uaaaugcuaucuggacauc

SEQ ID NO: 1427782 - RNA, 19 nt, Homo sapiens
gaagaggcuggaguaauug

SEQ ID NO: 1427783 - RNA, 19 nt, Homo sapiens
gguggucccagugcuauua

SEQ ID NO: 1427784 - RNA, 19 nt, Homo sapiens
caauuucaaggaugcauuu

SEQ ID NO: 1427785 - RNA, 19 nt, Homo sapiens
acaccuaccuuaagcacau

SEQ ID NO: 1427786 - RNA, 19 nt, Homo sapiens
guuaugaacuuggcugucu

SEQ ID NO: 1427787 - RNA, 19 nt, Homo sapiens
gugcuauuaugccuacuug

SEQ ID NO: 1427788 - RNA, 19 nt, Homo sapiens
ugaaaucauagcccacuaa

SEQ ID NO: 1427789 - RNA, 19 nt, Homo sapiens
acucaucuguuguuggauu

SEQ ID NO: 1427790 - RNA, 19 nt, Homo sapiens
caaccaaagcgcucugugu

SEQ ID NO: 1427791 - RNA, 19 nt, Homo sapiens
agacugaaaggugcuguua

SEQ ID NO: 1427792 - RNA, 19 nt, Homo sapiens
aagaugcuguucaguacuu

SEQ ID NO: 1427793 - RNA, 19 nt, Homo sapiens
gggagccacuggugaugug

SEQ ID NO: 1427794 - RNA, 19 nt, Homo sapiens
gcaugauagagcucaauuu

SEQ ID NO: 1427795 - RNA, 19 nt, Homo sapiens
cagaagaagcuaacugaag

SEQ ID NO: 1427796 - RNA, 19 nt, Homo sapiens
uggcugugcuuucauuugu

SEQ ID NO: 1427797 - RNA, 19 nt, Homo sapiens
cugaauggguaacaugaug

SEQ ID NO: 1427798 - RNA, 19 nt, Homo sapiens
uuaagcacauaucugaaug

SEQ ID NO: 1427799 - RNA, 19 nt, Homo sapiens
cuacacacacagccucuuu

SEQ ID NO: 1427800 - RNA, 19 nt, Homo sapiens
gagaaaaggugagaaagag

SEQ ID NO: 1427801 - RNA, 19 nt, Homo sapiens
agacaaaccagagacugua

SEQ ID NO: 1427802 - RNA, 19 nt, Homo sapiens
guaugccuguuaugaacuu

SEQ ID NO: 1427803 - RNA, 19 nt, Homo sapiens
caacgacuagagugucaaa

SEQ ID NO: 1427804 - RNA, 19 nt, Homo sapiens
caggagcuguaucagaaga

SEQ ID NO: 1427805 - RNA, 19 nt, Homo sapiens
caugaugagguaccuguaa

SEQ ID NO: 1427806 - RNA, 19 nt, Homo sapiens
gaacaacgucuucuucucu

SEQ ID NO: 1427807 - RNA, 19 nt, Homo sapiens
cagcaaagccuguggugaa

SEQ ID NO: 1427808 - RNA, 19 nt, Homo sapiens
ggccuuacccuucucaauu

SEQ ID NO: 1427809 - RNA, 19 nt, Homo sapiens
ugaacaggcugggcugaaa

SEQ ID NO: 1427810 - RNA, 19 nt, Homo sapiens
gccuuacccuucucaauuc

SEQ ID NO: 1427811 - RNA, 19 nt, Homo sapiens
caaagccuguggugaaggu

SEQ ID NO: 1427812 - RNA, 19 nt, Homo sapiens
gcugcugaccgccuugaua

SEQ ID NO: 1427813 - RNA, 19 nt, Homo sapiens
gucucaaggucuccaguaa

SEQ ID NO: 1427814 - RNA, 19 nt, Homo sapiens
aagaaugcguggaagaaca

SEQ ID NO: 1427815 - RNA, 19 nt, Homo sapiens
ugaagaaugcguggaagaa

SEQ ID NO: 1427816 - RNA, 19 nt, Homo sapiens
acagguuccucacagcaaa

SEQ ID NO: 1427817 - RNA, 19 nt, Homo sapiens
gaacaggcugggcugaaag

SEQ ID NO: 1427818 - RNA, 19 nt, Homo sapiens
cuacuggacccgccaacaa

SEQ ID NO: 1427819 - RNA, 19 nt, Homo sapiens
ucucugggcucugugucua

SEQ ID NO: 1427820 - RNA, 19 nt, Homo sapiens
gcuacaccgugaagaaugc

SEQ ID NO: 1427821 - RNA, 19 nt, Homo sapiens
gaagaaugcguggaagaac

SEQ ID NO: 1427822 - RNA, 19 nt, Homo sapiens
cacgagcgccuuccucuuc

SEQ ID NO: 1427823 - RNA, 19 nt, Homo sapiens
gugaugggacugcggauuc

SEQ ID NO: 1427824 - RNA, 19 nt, Homo sapiens
gugaagaaugcguggaaga

SEQ ID NO: 1427825 - RNA, 19 nt, Homo sapiens
cuucuucucuugguccuau

SEQ ID NO: 1427826 - RNA, 19 nt, Homo sapiens
aacaacgucuucuucucuu

SEQ ID NO: 1427827 - RNA, 19 nt, Homo sapiens
cucaaggucuccaguaagg

SEQ ID NO: 1427828 - RNA, 19 nt, Homo sapiens
acaacgucuucuucucuug

SEQ ID NO: 1427829 - RNA, 19 nt, Homo sapiens
gacagguuccucacagcaa

SEQ ID NO: 1427830 - RNA, 19 nt, Homo sapiens
ccaacaagagggccacagu

SEQ ID NO: 1427831 - RNA, 19 nt, Homo sapiens
ccacggccaccaacuacug

SEQ ID NO: 1427832 - RNA, 19 nt, Homo sapiens
gcucagaccuucccagaua

SEQ ID NO: 1427833 - RNA, 19 nt, Homo sapiens
gcaagaagcuccauagaag

SEQ ID NO: 1427834 - RNA, 19 nt, Homo sapiens
ggauuuaggucacuucuuu

SEQ ID NO: 1427835 - RNA, 19 nt, Homo sapiens
gguaagggcuucagucgua

SEQ ID NO: 1427836 - RNA, 19 nt, Homo sapiens
ucaaagagaucacaucaga

SEQ ID NO: 1427837 - RNA, 19 nt, Homo sapiens
gggaaaggguuuggauuua

SEQ ID NO: 1427838 - RNA, 19 nt, Homo sapiens
gcagagagaaacauuauaa

SEQ ID NO: 1427839 - RNA, 19 nt, Homo sapiens
ggaaagugcuucaguuaca

SEQ ID NO: 1427840 - RNA, 19 nt, Homo sapiens
gaauuuacauggaagagaa

SEQ ID NO: 1427841 - RNA, 19 nt, Homo sapiens
guacacaccuucacauuca

SEQ ID NO: 1427842 - RNA, 19 nt, Homo sapiens
gagagaagcccuacaaaug

SEQ ID NO: 1427843 - RNA, 19 nt, Homo sapiens
gaucuuaucguucauugua

SEQ ID NO: 1427844 - RNA, 19 nt, Homo sapiens
gagccaagaucuuaucguu

SEQ ID NO: 1427845 - RNA, 19 nt, Homo sapiens
gcaagacucccuaugaauu

SEQ ID NO: 1427846 - RNA, 19 nt, Homo sapiens
gaggaaagccaacauaaug

SEQ ID NO: 1427847 - RNA, 19 nt, Homo sapiens
guaagucaggguucaauua

SEQ ID NO: 1427848 - RNA, 19 nt, Homo sapiens
gcauuucucuucagauuuc

SEQ ID NO: 1427849 - RNA, 19 nt, Homo sapiens
gagagaaaccauauaaaug

SEQ ID NO: 1427850 - RNA, 19 nt, Homo sapiens
ggucaaauuuccauuaaag

SEQ ID NO: 1427851 - RNA, 19 nt, Homo sapiens
gccaagaucuuaucguuca

SEQ ID NO: 1427852 - RNA, 19 nt, Homo sapiens
ccauagaaguggcauuuga

SEQ ID NO: 1427853 - RNA, 19 nt, Homo sapiens
gagaggcccuauaagugua

SEQ ID NO: 1427854 - RNA, 19 nt, Homo sapiens
ucacagcacucaccuagga

SEQ ID NO: 1427855 - RNA, 19 nt, Homo sapiens
ggucuagccuuuacaaaca

SEQ ID NO: 1427856 - RNA, 19 nt, Homo sapiens
gggaagggcuuugaucaga

SEQ ID NO: 1427857 - RNA, 19 nt, Homo sapiens
ggagagaggcccuauaagu

SEQ ID NO: 1427858 - RNA, 19 nt, Homo sapiens
ggaaaggguuuggauuuag

SEQ ID NO: 1427859 - RNA, 19 nt, Homo sapiens
guaguuaguggucaaauuu

SEQ ID NO: 1427860 - RNA, 19 nt, Homo sapiens
agacaaacccuacaaaugu

SEQ ID NO: 1427861 - RNA, 19 nt, Homo sapiens
gagacaaacccuacaaaug

SEQ ID NO: 1427862 - RNA, 19 nt, Homo sapiens
ccacagccuuucccaugua

SEQ ID NO: 1427863 - RNA, 19 nt, Homo sapiens
gagaaaccauauaaaugug

SEQ ID NO: 1427864 - RNA, 19 nt, Homo sapiens
gaagucuauuucccaguaa

SEQ ID NO: 1427865 - RNA, 19 nt, Homo sapiens
agaagucuauuucccagua

SEQ ID NO: 1427866 - RNA, 19 nt, Homo sapiens
uaagggaauuuacauggaa

SEQ ID NO: 1427867 - RNA, 19 nt, Homo sapiens
gagcagagagaaacauuau

SEQ ID NO: 1427868 - RNA, 19 nt, Homo sapiens
gagagaggcccuauaagug

SEQ ID NO: 1427869 - RNA, 19 nt, Homo sapiens
ucagagagaaaccauauaa

SEQ ID NO: 1427870 - RNA, 19 nt, Homo sapiens
gcguauagcucuguucuuc

SEQ ID NO: 1427871 - RNA, 19 nt, Homo sapiens
gaaaggauuuugcguauag

SEQ ID NO: 1427872 - RNA, 19 nt, Homo sapiens
gggaagauauaagggaauu

SEQ ID NO: 1427873 - RNA, 19 nt, Homo sapiens
uaaaggguguguccaggaa

SEQ ID NO: 1427874 - RNA, 19 nt, Homo sapiens
ucacuuacaucaaagagau

SEQ ID NO: 1427875 - RNA, 19 nt, Homo sapiens
ggagagaagcccuacaaau

SEQ ID NO: 1427876 - RNA, 19 nt, Homo sapiens
gaacguuaguacccagguu

SEQ ID NO: 1427877 - RNA, 19 nt, Homo sapiens
ggagaaaccauacaaaugc

SEQ ID NO: 1427878 - RNA, 19 nt, Homo sapiens
cagaggcagugcuguguuu

SEQ ID NO: 1427879 - RNA, 19 nt, Homo sapiens
guggucaaauuuccauuaa

SEQ ID NO: 1427880 - RNA, 19 nt, Homo sapiens
agucaggguucaauuagua

SEQ ID NO: 1427881 - RNA, 19 nt, Homo sapiens
gaaaggguuuggauuuagg

SEQ ID NO: 1427882 - RNA, 19 nt, Homo sapiens
ccuaugggcugcaaacaga

SEQ ID NO: 1427883 - RNA, 19 nt, Homo sapiens
gcaggcauuucucuucaga

SEQ ID NO: 1427884 - RNA, 19 nt, Homo sapiens
cagccaacgucuuuagauu

SEQ ID NO: 1427885 - RNA, 19 nt, Homo sapiens
gaugauagaggcuuacuca

SEQ ID NO: 1427886 - RNA, 19 nt, Homo sapiens
caggagagaggcccuauaa

SEQ ID NO: 1427887 - RNA, 19 nt, Homo sapiens
ggaauucagaucuuaaugu

SEQ ID NO: 1427888 - RNA, 19 nt, Homo sapiens
ggcaagugcuuuaguucaa

SEQ ID NO: 1427889 - RNA, 19 nt, Homo sapiens
gagaagcccuacaaaugca

SEQ ID NO: 1427890 - RNA, 19 nt, Homo sapiens
cuucaucuguguuggauuu

SEQ ID NO: 1427891 - RNA, 19 nt, Homo sapiens
gggagaaaccauacaaaug

SEQ ID NO: 1427892 - RNA, 19 nt, Homo sapiens
uuaggucacuucuuuguau

SEQ ID NO: 1427893 - RNA, 19 nt, Homo sapiens
cuacaaaugcgaugaaugu

SEQ ID NO: 1427894 - RNA, 19 nt, Homo sapiens
caucaugagucccaagaau

SEQ ID NO: 1427895 - RNA, 19 nt, Homo sapiens
gaugacagccucaguugga

SEQ ID NO: 1427896 - RNA, 19 nt, Homo sapiens
caaggacuguggauuucaa

SEQ ID NO: 1427897 - RNA, 19 nt, Homo sapiens
caucagagagugcauauag

SEQ ID NO: 1427898 - RNA, 19 nt, Homo sapiens
ggaggaaagccaacauaau

SEQ ID NO: 1427899 - RNA, 19 nt, Homo sapiens
guggaaagugcuucaguua

SEQ ID NO: 1427900 - RNA, 19 nt, Homo sapiens
ccagaacucucagggaaga

SEQ ID NO: 1427901 - RNA, 19 nt, Homo sapiens
gggcuucagucguaauuca

SEQ ID NO: 1427902 - RNA, 19 nt, Homo sapiens
gagaucacaucagagagaa

SEQ ID NO: 1427903 - RNA, 19 nt, Homo sapiens
aaagagaucacaucagaga

SEQ ID NO: 1427904 - RNA, 19 nt, Homo sapiens
gcucuguucuucacacuca

SEQ ID NO: 1427905 - RNA, 19 nt, Homo sapiens
cuauaaaugugaagagugu

SEQ ID NO: 1427906 - RNA, 19 nt, Homo sapiens
ggagacaaacccuacaaau

SEQ ID NO: 1427907 - RNA, 19 nt, Homo sapiens
ggacuguggauuucaagaa

SEQ ID NO: 1427908 - RNA, 19 nt, Homo sapiens
gggcaggcauuucucuuca

SEQ ID NO: 1427909 - RNA, 19 nt, Homo sapiens
gagaaaccauacaaaugca

SEQ ID NO: 1427910 - RNA, 19 nt, Homo sapiens
ggagaugcccuacaaaugc

SEQ ID NO: 1427911 - RNA, 19 nt, Homo sapiens
uggcaagacucccuaugaa

SEQ ID NO: 1427912 - RNA, 19 nt, Homo sapiens
aaacuuggguaugaaauca

SEQ ID NO: 1427913 - RNA, 19 nt, Homo sapiens
ggcaagaagcuccauagaa

SEQ ID NO: 1427914 - RNA, 19 nt, Homo sapiens
acacugccaucgauaaugu

SEQ ID NO: 1427915 - RNA, 19 nt, Homo sapiens
ccauacaaaugcaaugugu

SEQ ID NO: 1427916 - RNA, 19 nt, Homo sapiens
gguaaggucuucaguucag

SEQ ID NO: 1427917 - RNA, 19 nt, Homo sapiens
ccauauaaaugugaagugu

SEQ ID NO: 1427918 - RNA, 19 nt, Homo sapiens
agucagagccaagaucuua

SEQ ID NO: 1427919 - RNA, 19 nt, Homo sapiens
gaagaacauucaaaagugu

SEQ ID NO: 1427920 - RNA, 19 nt, Homo sapiens
gcucuucccuucacaacca

SEQ ID NO: 1427921 - RNA, 19 nt, Homo sapiens
gguagugguuguaguuagu

SEQ ID NO: 1427922 - RNA, 19 nt, Homo sapiens
guaagggcuucagucguaa

SEQ ID NO: 1427923 - RNA, 19 nt, Homo sapiens
caucagagagaaaccauau

SEQ ID NO: 1427924 - RNA, 19 nt, Homo sapiens
gaagagugggcaggcauuu

SEQ ID NO: 1427925 - RNA, 19 nt, Homo sapiens
gggagaugcccuacaaaug

SEQ ID NO: 1427926 - RNA, 19 nt, Homo sapiens
aggcauuucucuucagauu

SEQ ID NO: 1427927 - RNA, 19 nt, Homo sapiens
ggcaaggacuguggauuuc

SEQ ID NO: 1427928 - RNA, 19 nt, Homo sapiens
ccaauggagugugagcaaa

SEQ ID NO: 1427929 - RNA, 19 nt, Homo sapiens
ggacacugccaucgauaau

SEQ ID NO: 1427930 - RNA, 19 nt, Homo sapiens
caagacucccuaugaauuc

SEQ ID NO: 1427931 - RNA, 19 nt, Homo sapiens
cccaugcucuuacuaugaa

SEQ ID NO: 1427932 - RNA, 19 nt, Homo sapiens
ggaacgagcagaucaagaa

SEQ ID NO: 1427933 - RNA, 19 nt, Homo sapiens
gcucuggucuccacgugua

SEQ ID NO: 1427934 - RNA, 19 nt, Homo sapiens
gaggagaggcggauacaga

SEQ ID NO: 1427935 - RNA, 19 nt, Homo sapiens
uacagaaacuugugagaau

SEQ ID NO: 1427936 - RNA, 19 nt, Homo sapiens
guacaaugaugcgaucuca

SEQ ID NO: 1427937 - RNA, 19 nt, Homo sapiens
ccaaagugcugggauuaca

SEQ ID NO: 1427938 - RNA, 19 nt, Homo sapiens
gacugaagcgguccuauga

SEQ ID NO: 1427939 - RNA, 19 nt, Homo sapiens
ccagccagcuccugucugu

SEQ ID NO: 1427940 - RNA, 19 nt, Homo sapiens
ggaauggucggucacuaug

SEQ ID NO: 1427941 - RNA, 19 nt, Homo sapiens
gaccacaacccaagaaugg

SEQ ID NO: 1427942 - RNA, 19 nt, Homo sapiens
caugaacgccuccaacuuc

SEQ ID NO: 1427943 - RNA, 19 nt, Homo sapiens
ccugaucgccaguuucuaa

SEQ ID NO: 1427944 - RNA, 19 nt, Homo sapiens
cagagaagccgcucaacau

SEQ ID NO: 1427945 - RNA, 19 nt, Homo sapiens
ccgaguagcugggauuaca

SEQ ID NO: 1427946 - RNA, 19 nt, Homo sapiens
gggaauggucggucacuau

SEQ ID NO: 1427947 - RNA, 19 nt, Homo sapiens
gguacucccugagcuauca

SEQ ID NO: 1427948 - RNA, 19 nt, Homo sapiens
uaccaccgcugccucaaga

SEQ ID NO: 1427949 - RNA, 19 nt, Homo sapiens
caaaggacacacccuagau

SEQ ID NO: 1427950 - RNA, 19 nt, Homo sapiens
guagaugccucgcguugac

SEQ ID NO: 1427951 - RNA, 19 nt, Homo sapiens
gccagaaccagauccguaa

SEQ ID NO: 1427952 - RNA, 19 nt, Homo sapiens
caagccagaagcugacuuu

SEQ ID NO: 1427953 - RNA, 19 nt, Homo sapiens
gcaugaacgccuccaacuu

SEQ ID NO: 1427954 - RNA, 19 nt, Homo sapiens
ggagaggcggauacagaaa

SEQ ID NO: 1427955 - RNA, 19 nt, Homo sapiens
acagaaacuugugagaaug

SEQ ID NO: 1427956 - RNA, 19 nt, Homo sapiens
gguguggacucaacuacag

SEQ ID NO: 1427957 - RNA, 19 nt, Homo sapiens
gagcuaccuuggugaacuc

SEQ ID NO: 1427958 - RNA, 19 nt, Homo sapiens
gaaacuugugagaauguga

SEQ ID NO: 1427959 - RNA, 19 nt, Homo sapiens
ucuaacgcccucaccauuu

SEQ ID NO: 1427960 - RNA, 19 nt, Homo sapiens
ucaaaggacacacccuaga

SEQ ID NO: 1427961 - RNA, 19 nt, Homo sapiens
gcagaucaagaacgggauu

SEQ ID NO: 1427962 - RNA, 19 nt, Homo sapiens
ccagagaagccgcucaaca

SEQ ID NO: 1427963 - RNA, 19 nt, Homo sapiens
cuucguggauguuggaugu

SEQ ID NO: 1427964 - RNA, 19 nt, Homo sapiens
cccagagccuugacgaaug

SEQ ID NO: 1427965 - RNA, 19 nt, Homo sapiens
caccacgcccagcuuauuu

SEQ ID NO: 1427966 - RNA, 19 nt, Homo sapiens
ccaccacgcccagcuuauu

SEQ ID NO: 1427967 - RNA, 19 nt, Homo sapiens
cuaccuuggugaacucaug

SEQ ID NO: 1427968 - RNA, 19 nt, Homo sapiens
gaccagagaagccgcucaa

SEQ ID NO: 1427969 - RNA, 19 nt, Homo sapiens
ccagagccuugacgaaugc

SEQ ID NO: 1427970 - RNA, 19 nt, Homo sapiens
gauacagaaacuugugaga

SEQ ID NO: 1427971 - RNA, 19 nt, Homo sapiens
ugacugaagcgguccuaug

SEQ ID NO: 1427972 - RNA, 19 nt, Homo sapiens
gaugacgccaccucugaga

SEQ ID NO: 1427973 - RNA, 19 nt, Homo sapiens
gaugcgaucucagcucacu

SEQ ID NO: 1427974 - RNA, 19 nt, Homo sapiens
cuaacgcccucaccauuuu

SEQ ID NO: 1427975 - RNA, 19 nt, Homo sapiens
gccuucgaguuccuuguuu

SEQ ID NO: 1427976 - RNA, 19 nt, Homo sapiens
ccuaugaggcccuguucaa

SEQ ID NO: 1427977 - RNA, 19 nt, Homo sapiens
gugucuaagccacgaauaa

SEQ ID NO: 1427978 - RNA, 19 nt, Homo sapiens
uaacugcuaccagaacuuc

SEQ ID NO: 1427979 - RNA, 19 nt, Homo sapiens
cagaaacuugugagaaugu

SEQ ID NO: 1427980 - RNA, 19 nt, Homo sapiens
auacagaaacuugugagaa

SEQ ID NO: 1427981 - RNA, 19 nt, Homo sapiens
caccucagccucccaaagu

SEQ ID NO: 1427982 - RNA, 19 nt, Homo sapiens
uggucaggcuggucucaaa

SEQ ID NO: 1427983 - RNA, 19 nt, Homo sapiens
caccaccacgcccagcuua

SEQ ID NO: 1427984 - RNA, 19 nt, Homo sapiens
ccacgaauaaugguagaug

SEQ ID NO: 1427985 - RNA, 19 nt, Homo sapiens
aaaggacacacccuagaug

SEQ ID NO: 1427986 - RNA, 19 nt, Homo sapiens
gaacgagcagaucaagaac

SEQ ID NO: 1427987 - RNA, 19 nt, Homo sapiens
gccaccagccuucgaguuc

SEQ ID NO: 1427988 - RNA, 19 nt, Homo sapiens
gcagaggagaggcggauac

SEQ ID NO: 1427989 - RNA, 19 nt, Homo sapiens
ugccucagccucccgagua

SEQ ID NO: 1427990 - RNA, 19 nt, Homo sapiens
ggucuccacguguaugaug

SEQ ID NO: 1427991 - RNA, 19 nt, Homo sapiens
cgccaccucugagaucuug

SEQ ID NO: 1427992 - RNA, 19 nt, Homo sapiens
gguagaugccucgcguuga

SEQ ID NO: 1427993 - RNA, 19 nt, Homo sapiens
gagaggcggauacagaaac

SEQ ID NO: 1427994 - RNA, 19 nt, Homo sapiens
acagaauggagcuaaguug

SEQ ID NO: 1427995 - RNA, 19 nt, Homo sapiens
aaggacacacccuagauga

SEQ ID NO: 1427996 - RNA, 19 nt, Homo sapiens
cgacaaggacagggaaugg

SEQ ID NO: 1427997 - RNA, 19 nt, Homo sapiens
agaaccagauccguaacug

SEQ ID NO: 1427998 - RNA, 19 nt, Homo sapiens
gcccugcgaguacuauuuc

SEQ ID NO: 1427999 - RNA, 19 nt, Homo sapiens
ugaccacaacccaagaaug

SEQ ID NO: 1428000 - RNA, 19 nt, Homo sapiens
ucuaagccacgaauaaugg

SEQ ID NO: 1428001 - RNA, 19 nt, Homo sapiens
gaccagaucuuucuuauga

SEQ ID NO: 1428002 - RNA, 19 nt, Homo sapiens
ggaaugaacuuuagugauc

SEQ ID NO: 1428003 - RNA, 19 nt, Homo sapiens
gcacgaacauuacuucaau

SEQ ID NO: 1428004 - RNA, 19 nt, Homo sapiens
uaacaucacucaagaagga

SEQ ID NO: 1428005 - RNA, 19 nt, Homo sapiens
ggugagaucuggaaccauu

SEQ ID NO: 1428006 - RNA, 19 nt, Homo sapiens
agaagaaccugaauggaaa

SEQ ID NO: 1428007 - RNA, 19 nt, Homo sapiens
cagaagguauucauaaaga

SEQ ID NO: 1428008 - RNA, 19 nt, Homo sapiens
gauauaaggaugacuggua

SEQ ID NO: 1428009 - RNA, 19 nt, Homo sapiens
gaacuuaacaucacucaag

SEQ ID NO: 1428010 - RNA, 19 nt, Homo sapiens
ggaaaacucugguuauuca

SEQ ID NO: 1428011 - RNA, 19 nt, Homo sapiens
gaguacgacuggaacuuaa

SEQ ID NO: 1428012 - RNA, 19 nt, Homo sapiens
gaugaagaguaugcagaua

SEQ ID NO: 1428013 - RNA, 19 nt, Homo sapiens
gaugaagaauaccgacuau

SEQ ID NO: 1428014 - RNA, 19 nt, Homo sapiens
cagaagaaccugaauggaa

SEQ ID NO: 1428015 - RNA, 19 nt, Homo sapiens
ggucauaaagagaaagaua

SEQ ID NO: 1428016 - RNA, 19 nt, Homo sapiens
gaaaauugauggucaguca

SEQ ID NO: 1428017 - RNA, 19 nt, Homo sapiens
ucaaaccguucagcaauaa

SEQ ID NO: 1428018 - RNA, 19 nt, Homo sapiens
aguaugaccucucagaauu

SEQ ID NO: 1428019 - RNA, 19 nt, Homo sapiens
aaacucugguuauucagua

SEQ ID NO: 1428020 - RNA, 19 nt, Homo sapiens
cagaaggaaugaacuuuag

SEQ ID NO: 1428021 - RNA, 19 nt, Homo sapiens
ucacagaugaugaagagua

SEQ ID NO: 1428022 - RNA, 19 nt, Homo sapiens
ucacacaccuguacacucu

SEQ ID NO: 1428023 - RNA, 19 nt, Homo sapiens
gauggucagucaauugaau

SEQ ID NO: 1428024 - RNA, 19 nt, Homo sapiens
guuauucaguacacaguaa

SEQ ID NO: 1428025 - RNA, 19 nt, Homo sapiens
ugaagaguaugcagauaau

SEQ ID NO: 1428026 - RNA, 19 nt, Homo sapiens
ccagaucuuucuuaugaug

SEQ ID NO: 1428027 - RNA, 19 nt, Homo sapiens
acagaaggaaugaacuuua

SEQ ID NO: 1428028 - RNA, 19 nt, Homo sapiens
uuaacaggcacgaacauua

SEQ ID NO: 1428029 - RNA, 19 nt, Homo sapiens
gaaggaaugaacuuuagug

SEQ ID NO: 1428030 - RNA, 19 nt, Homo sapiens
gaaaccaaggguccagaaa

SEQ ID NO: 1428031 - RNA, 19 nt, Homo sapiens
auauaaggaugacugguaa

SEQ ID NO: 1428032 - RNA, 19 nt, Homo sapiens
gcaagcagagcgacuggaa

SEQ ID NO: 1428033 - RNA, 19 nt, Homo sapiens
ggaacagacuaaagacaac

SEQ ID NO: 1428034 - RNA, 19 nt, Homo sapiens
gggaacagacuaaagacaa

SEQ ID NO: 1428035 - RNA, 19 nt, Homo sapiens
acacaccuguacacucuaa

SEQ ID NO: 1428036 - RNA, 19 nt, Homo sapiens
ccaaggaggaaaugaagaa

SEQ ID NO: 1428037 - RNA, 19 nt, Homo sapiens
guucagcaauaaagggaaa

SEQ ID NO: 1428038 - RNA, 19 nt, Homo sapiens
cugcagacauugaccagaa

SEQ ID NO: 1428039 - RNA, 19 nt, Homo sapiens
ucucauugcuacuuuaauc

SEQ ID NO: 1428040 - RNA, 19 nt, Homo sapiens
gcauagaguacgacuggaa

SEQ ID NO: 1428041 - RNA, 19 nt, Homo sapiens
agaaacugaucagguguaa

SEQ ID NO: 1428042 - RNA, 19 nt, Homo sapiens
aaagauaaaggucugcaaa

SEQ ID NO: 1428043 - RNA, 19 nt, Homo sapiens
ccauuggccuggagcuuug

SEQ ID NO: 1428044 - RNA, 19 nt, Homo sapiens
ugagaacauuggugccauu

SEQ ID NO: 1428045 - RNA, 19 nt, Homo sapiens
ccuguacacucuaauuuua

SEQ ID NO: 1428046 - RNA, 19 nt, Homo sapiens
cacagaugaugaagaguau

SEQ ID NO: 1428047 - RNA, 19 nt, Homo sapiens
gcaguaugaccucucagaa

SEQ ID NO: 1428048 - RNA, 19 nt, Homo sapiens
caccguaagaugaagaaua

SEQ ID NO: 1428049 - RNA, 19 nt, Homo sapiens
uaagguugauggcuucaca

SEQ ID NO: 1428050 - RNA, 19 nt, Homo sapiens
uucaaaccguucagcaaua

SEQ ID NO: 1428051 - RNA, 19 nt, Homo sapiens
ccgacuauuugacgcagua

SEQ ID NO: 1428052 - RNA, 19 nt, Homo sapiens
aaaccagaagguauucaua

SEQ ID NO: 1428053 - RNA, 19 nt, Homo sapiens
accaaugacucccgauuug

SEQ ID NO: 1428054 - RNA, 19 nt, Homo sapiens
gacccgauauuuguggauu

SEQ ID NO: 1428055 - RNA, 19 nt, Homo sapiens
ucaaucaauuucacagaag

SEQ ID NO: 1428056 - RNA, 19 nt, Homo sapiens
guaugaccucucagaauuu

SEQ ID NO: 1428057 - RNA, 19 nt, Homo sapiens
accagaagguauucauaaa

SEQ ID NO: 1428058 - RNA, 19 nt, Homo sapiens
gaaagauaaaggucugcaa

SEQ ID NO: 1428059 - RNA, 19 nt, Homo sapiens
cgacuggaacuuaacauca

SEQ ID NO: 1428060 - RNA, 19 nt, Homo sapiens
uaacaggcacgaacauuac

SEQ ID NO: 1428061 - RNA, 19 nt, Homo sapiens
gaagaguaugcagauaauu

SEQ ID NO: 1428062 - RNA, 19 nt, Homo sapiens
gauaaaggucugcaaacca

SEQ ID NO: 1428063 - RNA, 19 nt, Homo sapiens
uaugaccucucagaauuug

SEQ ID NO: 1428064 - RNA, 19 nt, Homo sapiens
gaaaccagaagguauucau

SEQ ID NO: 1428065 - RNA, 19 nt, Homo sapiens
agaguacgacuggaacuua

SEQ ID NO: 1428066 - RNA, 19 nt, Homo sapiens
aaccagaagguauucauaa

SEQ ID NO: 1428067 - RNA, 19 nt, Homo sapiens
cagcgccgaugcuccagaa

SEQ ID NO: 1428068 - RNA, 19 nt, Homo sapiens
aaacugaucagguguaagg

SEQ ID NO: 1428069 - RNA, 19 nt, Homo sapiens
gaauaaguaucacgaaaac

SEQ ID NO: 1428070 - RNA, 19 nt, Homo sapiens
gggcuacauuaaggucuuu

SEQ ID NO: 1428071 - RNA, 19 nt, Homo sapiens
ucacagaaggaaugaacuu

SEQ ID NO: 1428072 - RNA, 19 nt, Homo sapiens
caauuucacagaaggaaug

SEQ ID NO: 1428073 - RNA, 19 nt, Homo sapiens
caccaaugacucccgauuu

SEQ ID NO: 1428074 - RNA, 19 nt, Homo sapiens
caagaauaaguaucacgaa

SEQ ID NO: 1428075 - RNA, 19 nt, Homo sapiens
gaacagacuaaagacaaca

SEQ ID NO: 1428076 - RNA, 19 nt, Homo sapiens
ggagagcauuggagaaacc

SEQ ID NO: 1428077 - RNA, 19 nt, Homo sapiens
ccugaaaccagaagguauu

SEQ ID NO: 1428078 - RNA, 19 nt, Homo sapiens
gaucuuucuuaugauguga

SEQ ID NO: 1428079 - RNA, 19 nt, Homo sapiens
caccuguacacucuaauuu

SEQ ID NO: 1428080 - RNA, 19 nt, Homo sapiens
cgauauuuguggauuugau

SEQ ID NO: 1428081 - RNA, 19 nt, Homo sapiens
aauugaauccggcagcaua

SEQ ID NO: 1428082 - RNA, 19 nt, Homo sapiens
gaccagaagaaccugaaug

SEQ ID NO: 1428083 - RNA, 19 nt, Homo sapiens
gggcuuugguccaguucug

SEQ ID NO: 1428084 - RNA, 19 nt, Homo sapiens
gcgaggaagaggaggaaga

SEQ ID NO: 1428085 - RNA, 19 nt, Homo sapiens
ccagaagguauucauaaag

SEQ ID NO: 1428086 - RNA, 19 nt, Homo sapiens
gaaccugaauggaaaaucg

SEQ ID NO: 1428087 - RNA, 19 nt, Homo sapiens
ggcgcuggcuaccgucuau

SEQ ID NO: 1428088 - RNA, 19 nt, Homo sapiens
aagagcugcugucgggaaa

SEQ ID NO: 1428089 - RNA, 19 nt, Homo sapiens
gacgcaguaugaccucuca

SEQ ID NO: 1428090 - RNA, 19 nt, Homo sapiens
cugcaaaccacucagaaug

SEQ ID NO: 1428091 - RNA, 19 nt, Homo sapiens
accguaagaugaagaauac

SEQ ID NO: 1428092 - RNA, 19 nt, Homo sapiens
ggccugaaaccagaaggua

SEQ ID NO: 1428093 - RNA, 19 nt, Homo sapiens
gguugcaguccaccaauga

SEQ ID NO: 1428094 - RNA, 19 nt, Homo sapiens
aaccaaggguccagaaagg

SEQ ID NO: 1428095 - RNA, 19 nt, Homo sapiens
augaagaguaugcagauaa

SEQ ID NO: 1428096 - RNA, 19 nt, Homo sapiens
caguaugaccucucagaau

SEQ ID NO: 1428097 - RNA, 19 nt, Homo sapiens
gaaaacaagaaacugauca

SEQ ID NO: 1428098 - RNA, 19 nt, Homo sapiens
ggaaaaucgcaauacuaua

SEQ ID NO: 1428099 - RNA, 19 nt, Homo sapiens
gagaacauuggugccauug

SEQ ID NO: 1428100 - RNA, 19 nt, Homo sapiens
agaugaagaauaccgacua

SEQ ID NO: 1428101 - RNA, 19 nt, Homo sapiens
gcagaggauucauuucuuc

SEQ ID NO: 1428102 - RNA, 19 nt, Homo sapiens
gaggauucauuucuucuau

SEQ ID NO: 1428103 - RNA, 19 nt, Homo sapiens
uacaacacguucuccaaua

SEQ ID NO: 1428104 - RNA, 19 nt, Homo sapiens
gagguggacuggugugaga

SEQ ID NO: 1428105 - RNA, 19 nt, Homo sapiens
ggcaguggcuauagcauau

SEQ ID NO: 1428106 - RNA, 19 nt, Homo sapiens
gcauugcccugcacauucu

SEQ ID NO: 1428107 - RNA, 19 nt, Homo sapiens
acaacacguucuccaauau

SEQ ID NO: 1428108 - RNA, 19 nt, Homo sapiens
ggauucauuucuucuaucu

SEQ ID NO: 1428109 - RNA, 19 nt, Homo sapiens
ggcagaggauucauuucuu

SEQ ID NO: 1428110 - RNA, 19 nt, Homo sapiens
gggcaguggcuauagcaua

SEQ ID NO: 1428111 - RNA, 19 nt, Homo sapiens
gagagcaacuuccaguacu

SEQ ID NO: 1428112 - RNA, 19 nt, Homo sapiens
ggaagaccagcaauaagga

SEQ ID NO: 1428113 - RNA, 19 nt, Homo sapiens
acaggaagaccagcaauaa

SEQ ID NO: 1428114 - RNA, 19 nt, Homo sapiens
cagcaucaccuucccuuau

SEQ ID NO: 1428115 - RNA, 19 nt, Homo sapiens
gagcuucggcaccugauug

SEQ ID NO: 1428116 - RNA, 19 nt, Homo sapiens
ggccuguucuccauguauu

SEQ ID NO: 1428117 - RNA, 19 nt, Homo sapiens
gcucugaccagcuggauca

SEQ ID NO: 1428118 - RNA, 19 nt, Homo sapiens
gaucagugaccgucugcuu

SEQ ID NO: 1428119 - RNA, 19 nt, Homo sapiens
ucauaggccuguucuccau

SEQ ID NO: 1428120 - RNA, 19 nt, Homo sapiens
ucagugaccgucugcuuug

SEQ ID NO: 1428121 - RNA, 19 nt, Homo sapiens
cagcauugcccugcacauu

SEQ ID NO: 1428122 - RNA, 19 nt, Homo sapiens
ucagcacccuucuguccuu

SEQ ID NO: 1428123 - RNA, 19 nt, Homo sapiens
gcacccguaugcccagaag

SEQ ID NO: 1428124 - RNA, 19 nt, Homo sapiens
uacaggaagaccagcaaua

SEQ ID NO: 1428125 - RNA, 19 nt, Homo sapiens
cuacaacacguucuccaau

SEQ ID NO: 1428126 - RNA, 19 nt, Homo sapiens
caacacguucuccaauauc

SEQ ID NO: 1428127 - RNA, 19 nt, Homo sapiens
gcaucaccuucccuuaugg

SEQ ID NO: 1428128 - RNA, 19 nt, Homo sapiens
gaccagcaauaaggagcuu

SEQ ID NO: 1428129 - RNA, 19 nt, Homo sapiens
uaugagaugccaggugaaa

SEQ ID NO: 1428130 - RNA, 19 nt, Homo sapiens
caggugaaacccucaaagu

SEQ ID NO: 1428131 - RNA, 19 nt, Homo sapiens
agcaucaccuucccuuaug

SEQ ID NO: 1428132 - RNA, 19 nt, Homo sapiens
gugagagcaacuuccagua

SEQ ID NO: 1428133 - RNA, 19 nt, Homo sapiens
ggaugccaacuaugagaug

SEQ ID NO: 1428134 - RNA, 19 nt, Homo sapiens
ugaugaugcuccugaugca

SEQ ID NO: 1428135 - RNA, 19 nt, Homo sapiens
uggguccucuucaugauca

SEQ ID NO: 1428136 - RNA, 19 nt, Homo sapiens
caucuggcaugugcucauc

SEQ ID NO: 1428137 - RNA, 19 nt, Homo sapiens
gauugaggucuccgugguu

SEQ ID NO: 1428138 - RNA, 19 nt, Homo sapiens
guacaggaagaccagcaau

SEQ ID NO: 1428139 - RNA, 19 nt, Homo sapiens
ugagagcaacuuccaguac

SEQ ID NO: 1428140 - RNA, 19 nt, Homo sapiens
uggcagaggauucauuucu

SEQ ID NO: 1428141 - RNA, 19 nt, Homo sapiens
gaagaaagccagggagaga

SEQ ID NO: 1428142 - RNA, 19 nt, Homo sapiens
gaggaacucuacagcuaug

SEQ ID NO: 1428143 - RNA, 19 nt, Homo sapiens
gaaacgagaaauccacaug

SEQ ID NO: 1428144 - RNA, 19 nt, Homo sapiens
ugacaaggaucaggucuca

SEQ ID NO: 1428145 - RNA, 19 nt, Homo sapiens
aggaggaacucuacagcua

SEQ ID NO: 1428146 - RNA, 19 nt, Homo sapiens
gcauuuggagagcgucuua

SEQ ID NO: 1428147 - RNA, 19 nt, Homo sapiens
guucaaguccacugcauuu

SEQ ID NO: 1428148 - RNA, 19 nt, Homo sapiens
cccaccaguucuuuaauaa

SEQ ID NO: 1428149 - RNA, 19 nt, Homo sapiens
aggcagaaaugcugacaug

SEQ ID NO: 1428150 - RNA, 19 nt, Homo sapiens
gagagcgucuuaaguaucc

SEQ ID NO: 1428151 - RNA, 19 nt, Homo sapiens
uuggagagcgucuuaagua

SEQ ID NO: 1428152 - RNA, 19 nt, Homo sapiens
ggaggccggugacaaggau

SEQ ID NO: 1428153 - RNA, 19 nt, Homo sapiens
ggaggaacucuacagcuau

SEQ ID NO: 1428154 - RNA, 19 nt, Homo sapiens
ggagagcgucuuaaguauc

SEQ ID NO: 1428155 - RNA, 19 nt, Homo sapiens
uggagagcgucuuaaguau

SEQ ID NO: 1428156 - RNA, 19 nt, Homo sapiens
ccaaggagaagguucaagu

SEQ ID NO: 1428157 - RNA, 19 nt, Homo sapiens
gggacgagcaccuggagaa

SEQ ID NO: 1428158 - RNA, 19 nt, Homo sapiens
aaccugcguucaccucuuu

SEQ ID NO: 1428159 - RNA, 19 nt, Homo sapiens
ccaggagggugaagaaagc

SEQ ID NO: 1428160 - RNA, 19 nt, Homo sapiens
uuacagaagaaacgagaaa

SEQ ID NO: 1428161 - RNA, 19 nt, Homo sapiens
ggugacuccugcagauauc

SEQ ID NO: 1428162 - RNA, 19 nt, Homo sapiens
acaaggaucaggucucauc

SEQ ID NO: 1428163 - RNA, 19 nt, Homo sapiens
ggucucauccugacaacca

SEQ ID NO: 1428164 - RNA, 19 nt, Homo sapiens
uuccuacucugaauuguca

SEQ ID NO: 1428165 - RNA, 19 nt, Homo sapiens
ggacggccagugaaucucu

SEQ ID NO: 1428166 - RNA, 19 nt, Homo sapiens
cgucuuaaguauccuugca

SEQ ID NO: 1428167 - RNA, 19 nt, Homo sapiens
acucugaauugucacacuu

SEQ ID NO: 1428168 - RNA, 19 nt, Homo sapiens
uggggaagcucaaaaggaa

SEQ ID NO: 1428169 - RNA, 19 nt, Homo sapiens
ggcuuucggucccuuucuu

SEQ ID NO: 1428170 - RNA, 19 nt, Homo sapiens
ccccaccaguucuuuaaua

SEQ ID NO: 1428171 - RNA, 19 nt, Homo sapiens
caaggagaagguucaaguc

SEQ ID NO: 1428172 - RNA, 19 nt, Homo sapiens
gagaagccgcagcaacucu

SEQ ID NO: 1428173 - RNA, 19 nt, Homo sapiens
ggccaggcaggcagaaaug

SEQ ID NO: 1428174 - RNA, 19 nt, Homo sapiens
cugcagauauccggagaca

SEQ ID NO: 1428175 - RNA, 19 nt, Homo sapiens
ucaaguccacugcauuugg

SEQ ID NO: 1428176 - RNA, 19 nt, Homo sapiens
acagaagaaacgagaaauc

SEQ ID NO: 1428177 - RNA, 19 nt, Homo sapiens
gauacucucuuccguaaau

SEQ ID NO: 1428178 - RNA, 19 nt, Homo sapiens
ccuccgagcuggcagaauu

SEQ ID NO: 1428179 - RNA, 19 nt, Homo sapiens
gaacuuuucugucuuacaa

SEQ ID NO: 1428180 - RNA, 19 nt, Homo sapiens
gaaaggaagacgcgauuag

SEQ ID NO: 1428181 - RNA, 19 nt, Homo sapiens
gcuuggagauuuggacuuu

SEQ ID NO: 1428182 - RNA, 19 nt, Homo sapiens
gauuagugguuaagacuuc

SEQ ID NO: 1428183 - RNA, 19 nt, Homo sapiens
ucgauacucucuuccguaa

SEQ ID NO: 1428184 - RNA, 19 nt, Homo sapiens
gaagacagaggguucgaau

SEQ ID NO: 1428185 - RNA, 19 nt, Homo sapiens
ccaaucagcgcucuguaaa

SEQ ID NO: 1428186 - RNA, 19 nt, Homo sapiens
caaccugaguggcggagaa

SEQ ID NO: 1428187 - RNA, 19 nt, Homo sapiens
ggaccaaucagcacucugu

SEQ ID NO: 1428188 - RNA, 19 nt, Homo sapiens
gcacugccgucuacucacu

SEQ ID NO: 1428189 - RNA, 19 nt, Homo sapiens
cgagcuggcagaauucuuu

SEQ ID NO: 1428190 - RNA, 19 nt, Homo sapiens
gagcucagccggcuacagu

SEQ ID NO: 1428191 - RNA, 19 nt, Homo sapiens
ccaccucgauacucucuuc

SEQ ID NO: 1428192 - RNA, 19 nt, Homo sapiens
uuucugauguugccucauu

SEQ ID NO: 1428193 - RNA, 19 nt, Homo sapiens
gaagacgcgauuagugguu

SEQ ID NO: 1428194 - RNA, 19 nt, Homo sapiens
aaucagcacucuguaagau

SEQ ID NO: 1428195 - RNA, 19 nt, Homo sapiens
gcggguaucugcccaccau

SEQ ID NO: 1428196 - RNA, 19 nt, Homo sapiens
aagacgcgauuagugguua

SEQ ID NO: 1428197 - RNA, 19 nt, Homo sapiens
ucuguaagauggaccaauc

SEQ ID NO: 1428198 - RNA, 19 nt, Homo sapiens
caacccgcuuggagauuug

SEQ ID NO: 1428199 - RNA, 19 nt, Homo sapiens
gaggaucugggucugguuu

SEQ ID NO: 1428200 - RNA, 19 nt, Homo sapiens
aaaucuugcugcugcuaaa

SEQ ID NO: 1428201 - RNA, 19 nt, Homo sapiens
gcaccuacagcugcuacua

SEQ ID NO: 1428202 - RNA, 19 nt, Homo sapiens
gcuuuguucucuugcucua

SEQ ID NO: 1428203 - RNA, 19 nt, Homo sapiens
ggaccaaucagcaggacau

SEQ ID NO: 1428204 - RNA, 19 nt, Homo sapiens
ucacuccgucugccguuua

SEQ ID NO: 1428205 - RNA, 19 nt, Homo sapiens
ugaaaggaagacgcgauua

SEQ ID NO: 1428206 - RNA, 19 nt, Homo sapiens
ccugugcuguagcuucuuu

SEQ ID NO: 1428207 - RNA, 19 nt, Homo sapiens
ggacaauaagggaauaaaa

SEQ ID NO: 1428208 - RNA, 19 nt, Homo sapiens
ggacuuccuggguugaaug

SEQ ID NO: 1428209 - RNA, 19 nt, Homo sapiens
uuucaagccuggagagauc

SEQ ID NO: 1428210 - RNA, 19 nt, Homo sapiens
gcucagccggcuacaguug

SEQ ID NO: 1428211 - RNA, 19 nt, Homo sapiens
ggaccaaucagcgcucugu

SEQ ID NO: 1428212 - RNA, 19 nt, Homo sapiens
ccaaucagcacucuguaag

SEQ ID NO: 1428213 - RNA, 19 nt, Homo sapiens
uaaaucuugcugcugcuaa

SEQ ID NO: 1428214 - RNA, 19 nt, Homo sapiens
cagaaagguaguagugaga

SEQ ID NO: 1428215 - RNA, 19 nt, Homo sapiens
gcugugcccugugcuguag

SEQ ID NO: 1428216 - RNA, 19 nt, Homo sapiens
ugggagcuuuguucucuug

SEQ ID NO: 1428217 - RNA, 19 nt, Homo sapiens
caagaggauuguaaaaugg

SEQ ID NO: 1428218 - RNA, 19 nt, Homo sapiens
gcgaggugcuggucaucag

SEQ ID NO: 1428219 - RNA, 19 nt, Homo sapiens
cgucugccguuuauucagu

SEQ ID NO: 1428220 - RNA, 19 nt, Homo sapiens
gcucuacacaauaaaucuu

SEQ ID NO: 1428221 - RNA, 19 nt, Homo sapiens
ugugggagcuuuguucucu

SEQ ID NO: 1428222 - RNA, 19 nt, Homo sapiens
caaucagcacucuguaaga

SEQ ID NO: 1428223 - RNA, 19 nt, Homo sapiens
cucuugcucuacacaauaa

SEQ ID NO: 1428224 - RNA, 19 nt, Homo sapiens
ucucuugcucuacacaaua

SEQ ID NO: 1428225 - RNA, 19 nt, Homo sapiens
cagcacugccgucuacuca

SEQ ID NO: 1428226 - RNA, 19 nt, Homo sapiens
gcccugugcuguagcuucu

SEQ ID NO: 1428227 - RNA, 19 nt, Homo sapiens
aaucagcgcucuguaaaau

SEQ ID NO: 1428228 - RNA, 19 nt, Homo sapiens
ccaaggaguagcugaaagg

SEQ ID NO: 1428229 - RNA, 19 nt, Homo sapiens
gaccaaucagcacucugua

SEQ ID NO: 1428230 - RNA, 19 nt, Homo sapiens
agacgcgauuagugguuaa

SEQ ID NO: 1428231 - RNA, 19 nt, Homo sapiens
uggagcugcuggugacaga

SEQ ID NO: 1428232 - RNA, 19 nt, Homo sapiens
ccauggcccuggugcugau

SEQ ID NO: 1428233 - RNA, 19 nt, Homo sapiens
gggacaauaagggaauaaa

SEQ ID NO: 1428234 - RNA, 19 nt, Homo sapiens
ccgcggaacgguccuuaga

SEQ ID NO: 1428235 - RNA, 19 nt, Homo sapiens
gcacugcagcccgagacuu

SEQ ID NO: 1428236 - RNA, 19 nt, Homo sapiens
gaccaaucagcgcucugua

SEQ ID NO: 1428237 - RNA, 19 nt, Homo sapiens
ucccagcacugccgucuac

SEQ ID NO: 1428238 - RNA, 19 nt, Homo sapiens
agacagaggguucgaaucc

SEQ ID NO: 1428239 - RNA, 19 nt, Homo sapiens
aaaggaagacgcgauuagu

SEQ ID NO: 1428240 - RNA, 19 nt, Homo sapiens
gguaguagugagacgugaa

SEQ ID NO: 1428241 - RNA, 19 nt, Homo sapiens
gcgauuagugguuaagacu

SEQ ID NO: 1428242 - RNA, 19 nt, Homo sapiens
caccuacagcugcuacuau

SEQ ID NO: 1428243 - RNA, 19 nt, Homo sapiens
acaugagcuucgugcugua

SEQ ID NO: 1428244 - RNA, 19 nt, Homo sapiens
gauacucucuuccguaaau

SEQ ID NO: 1428245 - RNA, 19 nt, Homo sapiens
ccuccgagcuggcagaauu

SEQ ID NO: 1428246 - RNA, 19 nt, Homo sapiens
gaacuuuucugucuuacaa

SEQ ID NO: 1428247 - RNA, 19 nt, Homo sapiens
gaaaggaagacgcgauuag

SEQ ID NO: 1428248 - RNA, 19 nt, Homo sapiens
gcuuggagauuuggacuuu

SEQ ID NO: 1428249 - RNA, 19 nt, Homo sapiens
gauuagugguuaagacuuc

SEQ ID NO: 1428250 - RNA, 19 nt, Homo sapiens
ucgauacucucuuccguaa

SEQ ID NO: 1428251 - RNA, 19 nt, Homo sapiens
gaagacagaggguucgaau

SEQ ID NO: 1428252 - RNA, 19 nt, Homo sapiens
ccaaucagcgcucuguaaa

SEQ ID NO: 1428253 - RNA, 19 nt, Homo sapiens
caaccugaguggcggagaa

SEQ ID NO: 1428254 - RNA, 19 nt, Homo sapiens
ggaccaaucagcacucugu

SEQ ID NO: 1428255 - RNA, 19 nt, Homo sapiens
gcacugccgucuacucacu

SEQ ID NO: 1428256 - RNA, 19 nt, Homo sapiens
cgagcuggcagaauucuuu

SEQ ID NO: 1428257 - RNA, 19 nt, Homo sapiens
gagcucagccggcuacagu

SEQ ID NO: 1428258 - RNA, 19 nt, Homo sapiens
ccaccucgauacucucuuc

SEQ ID NO: 1428259 - RNA, 19 nt, Homo sapiens
uuucugauguugccucauu

SEQ ID NO: 1428260 - RNA, 19 nt, Homo sapiens
gaagacgcgauuagugguu

SEQ ID NO: 1428261 - RNA, 19 nt, Homo sapiens
aaucagcacucuguaagau

SEQ ID NO: 1428262 - RNA, 19 nt, Homo sapiens
gcggguaucugcccaccau

SEQ ID NO: 1428263 - RNA, 19 nt, Homo sapiens
aagacgcgauuagugguua

SEQ ID NO: 1428264 - RNA, 19 nt, Homo sapiens
ucuguaagauggaccaauc

SEQ ID NO: 1428265 - RNA, 19 nt, Homo sapiens
caacccgcuuggagauuug

SEQ ID NO: 1428266 - RNA, 19 nt, Homo sapiens
gaggaucugggucugguuu

SEQ ID NO: 1428267 - RNA, 19 nt, Homo sapiens
aaaucuugcugcugcuaaa

SEQ ID NO: 1428268 - RNA, 19 nt, Homo sapiens
gcaccuacagcugcuacua

SEQ ID NO: 1428269 - RNA, 19 nt, Homo sapiens
gcuuuguucucuugcucua

SEQ ID NO: 1428270 - RNA, 19 nt, Homo sapiens
ggaccaaucagcaggacau

SEQ ID NO: 1428271 - RNA, 19 nt, Homo sapiens
ugaaaggaagacgcgauua

SEQ ID NO: 1428272 - RNA, 19 nt, Homo sapiens
ccugugcuguagcuucuuu

SEQ ID NO: 1428273 - RNA, 19 nt, Homo sapiens
ggacaauaagggaauaaaa

SEQ ID NO: 1428274 - RNA, 19 nt, Homo sapiens
ggacuuccuggguugaaug

SEQ ID NO: 1428275 - RNA, 19 nt, Homo sapiens
uuucaagccuggagagauc

SEQ ID NO: 1428276 - RNA, 19 nt, Homo sapiens
gcucagccggcuacaguug

SEQ ID NO: 1428277 - RNA, 19 nt, Homo sapiens
ggaccaaucagcgcucugu

SEQ ID NO: 1428278 - RNA, 19 nt, Homo sapiens
ccaaucagcacucuguaag

SEQ ID NO: 1428279 - RNA, 19 nt, Homo sapiens
uaaaucuugcugcugcuaa

SEQ ID NO: 1428280 - RNA, 19 nt, Homo sapiens
cagaaagguaguagugaga

SEQ ID NO: 1428281 - RNA, 19 nt, Homo sapiens
gcugugcccugugcuguag

SEQ ID NO: 1428282 - RNA, 19 nt, Homo sapiens
ugggagcuuuguucucuug

SEQ ID NO: 1428283 - RNA, 19 nt, Homo sapiens
caagaggauuguaaaaugg

SEQ ID NO: 1428284 - RNA, 19 nt, Homo sapiens
gcgaggugcuggucaucag

SEQ ID NO: 1428285 - RNA, 19 nt, Homo sapiens
gcucuacacaauaaaucuu

SEQ ID NO: 1428286 - RNA, 19 nt, Homo sapiens
ugugggagcuuuguucucu

SEQ ID NO: 1428287 - RNA, 19 nt, Homo sapiens
caaucagcacucuguaaga

SEQ ID NO: 1428288 - RNA, 19 nt, Homo sapiens
cucuugcucuacacaauaa

SEQ ID NO: 1428289 - RNA, 19 nt, Homo sapiens
ucucuugcucuacacaaua

SEQ ID NO: 1428290 - RNA, 19 nt, Homo sapiens
cagcacugccgucuacuca

SEQ ID NO: 1428291 - RNA, 19 nt, Homo sapiens
gcccugugcuguagcuucu

SEQ ID NO: 1428292 - RNA, 19 nt, Homo sapiens
aaucagcgcucuguaaaau

SEQ ID NO: 1428293 - RNA, 19 nt, Homo sapiens
ccaaggaguagcugaaagg

SEQ ID NO: 1428294 - RNA, 19 nt, Homo sapiens
gaccaaucagcacucugua

SEQ ID NO: 1428295 - RNA, 19 nt, Homo sapiens
agacgcgauuagugguuaa

SEQ ID NO: 1428296 - RNA, 19 nt, Homo sapiens
uggagcugcuggugacaga

SEQ ID NO: 1428297 - RNA, 19 nt, Homo sapiens
gggacaauaagggaauaaa

SEQ ID NO: 1428298 - RNA, 19 nt, Homo sapiens
ccauggcccuggugcugau

SEQ ID NO: 1428299 - RNA, 19 nt, Homo sapiens
ccgcggaacgguccuuaga

SEQ ID NO: 1428300 - RNA, 19 nt, Homo sapiens
gcacugcagcccgagacuu

SEQ ID NO: 1428301 - RNA, 19 nt, Homo sapiens
gaccaaucagcgcucugua

SEQ ID NO: 1428302 - RNA, 19 nt, Homo sapiens
ucccagcacugccgucuac

SEQ ID NO: 1428303 - RNA, 19 nt, Homo sapiens
agacagaggguucgaaucc

SEQ ID NO: 1428304 - RNA, 19 nt, Homo sapiens
aaaggaagacgcgauuagu

SEQ ID NO: 1428305 - RNA, 19 nt, Homo sapiens
gguaguagugagacgugaa

SEQ ID NO: 1428306 - RNA, 19 nt, Homo sapiens
gcgauuagugguuaagacu

SEQ ID NO: 1428307 - RNA, 19 nt, Homo sapiens
caccuacagcugcuacuau

SEQ ID NO: 1428308 - RNA, 19 nt, Homo sapiens
acaugagcuucgugcugua

SEQ ID NO: 1428309 - RNA, 19 nt, Homo sapiens
gauacucucuuccguaaau

SEQ ID NO: 1428310 - RNA, 19 nt, Homo sapiens
ccuccgagcuggcagaauu

SEQ ID NO: 1428311 - RNA, 19 nt, Homo sapiens
gaacuuuucugucuuacaa

SEQ ID NO: 1428312 - RNA, 19 nt, Homo sapiens
gaaaggaagacgcgauuag

SEQ ID NO: 1428313 - RNA, 19 nt, Homo sapiens
gcuuggagauuuggacuuu

SEQ ID NO: 1428314 - RNA, 19 nt, Homo sapiens
gauuagugguuaagacuuc

SEQ ID NO: 1428315 - RNA, 19 nt, Homo sapiens
ucgauacucucuuccguaa

SEQ ID NO: 1428316 - RNA, 19 nt, Homo sapiens
gaagacagaggguucgaau

SEQ ID NO: 1428317 - RNA, 19 nt, Homo sapiens
ccaaucagcgcucuguaaa

SEQ ID NO: 1428318 - RNA, 19 nt, Homo sapiens
caaccugaguggcggagaa

SEQ ID NO: 1428319 - RNA, 19 nt, Homo sapiens
ggaccaaucagcacucugu

SEQ ID NO: 1428320 - RNA, 19 nt, Homo sapiens
gcacugccgucuacucacu

SEQ ID NO: 1428321 - RNA, 19 nt, Homo sapiens
cgagcuggcagaauucuuu

SEQ ID NO: 1428322 - RNA, 19 nt, Homo sapiens
gagcucagccggcuacagu

SEQ ID NO: 1428323 - RNA, 19 nt, Homo sapiens
ccaccucgauacucucuuc

SEQ ID NO: 1428324 - RNA, 19 nt, Homo sapiens
uuucugauguugccucauu

SEQ ID NO: 1428325 - RNA, 19 nt, Homo sapiens
gaagacgcgauuagugguu

SEQ ID NO: 1428326 - RNA, 19 nt, Homo sapiens
aaucagcacucuguaagau

SEQ ID NO: 1428327 - RNA, 19 nt, Homo sapiens
gcggguaucugcccaccau

SEQ ID NO: 1428328 - RNA, 19 nt, Homo sapiens
aagacgcgauuagugguua

SEQ ID NO: 1428329 - RNA, 19 nt, Homo sapiens
ucuguaagauggaccaauc

SEQ ID NO: 1428330 - RNA, 19 nt, Homo sapiens
caacccgcuuggagauuug

SEQ ID NO: 1428331 - RNA, 19 nt, Homo sapiens
gaggaucugggucugguuu

SEQ ID NO: 1428332 - RNA, 19 nt, Homo sapiens
aaaucuugcugcugcuaaa

SEQ ID NO: 1428333 - RNA, 19 nt, Homo sapiens
gcaccuacagcugcuacua

SEQ ID NO: 1428334 - RNA, 19 nt, Homo sapiens
gcuuuguucucuugcucua

SEQ ID NO: 1428335 - RNA, 19 nt, Homo sapiens
ggaccaaucagcaggacau

SEQ ID NO: 1428336 - RNA, 19 nt, Homo sapiens
ugaaaggaagacgcgauua

SEQ ID NO: 1428337 - RNA, 19 nt, Homo sapiens
ccugugcuguagcuucuuu

SEQ ID NO: 1428338 - RNA, 19 nt, Homo sapiens
ggacaauaagggaauaaaa

SEQ ID NO: 1428339 - RNA, 19 nt, Homo sapiens
ggacuuccuggguugaaug

SEQ ID NO: 1428340 - RNA, 19 nt, Homo sapiens
uuucaagccuggagagauc

SEQ ID NO: 1428341 - RNA, 19 nt, Homo sapiens
gcucagccggcuacaguug

SEQ ID NO: 1428342 - RNA, 19 nt, Homo sapiens
ggaccaaucagcgcucugu

SEQ ID NO: 1428343 - RNA, 19 nt, Homo sapiens
ccaaucagcacucuguaag

SEQ ID NO: 1428344 - RNA, 19 nt, Homo sapiens
uaaaucuugcugcugcuaa

SEQ ID NO: 1428345 - RNA, 19 nt, Homo sapiens
cagaaagguaguagugaga

SEQ ID NO: 1428346 - RNA, 19 nt, Homo sapiens
gcugugcccugugcuguag

SEQ ID NO: 1428347 - RNA, 19 nt, Homo sapiens
ugggagcuuuguucucuug

SEQ ID NO: 1428348 - RNA, 19 nt, Homo sapiens
caagaggauuguaaaaugg

SEQ ID NO: 1428349 - RNA, 19 nt, Homo sapiens
gcgaggugcuggucaucag

SEQ ID NO: 1428350 - RNA, 19 nt, Homo sapiens
gcucuacacaauaaaucuu

SEQ ID NO: 1428351 - RNA, 19 nt, Homo sapiens
ugugggagcuuuguucucu

SEQ ID NO: 1428352 - RNA, 19 nt, Homo sapiens
caaucagcacucuguaaga

SEQ ID NO: 1428353 - RNA, 19 nt, Homo sapiens
cucuugcucuacacaauaa

SEQ ID NO: 1428354 - RNA, 19 nt, Homo sapiens
ucucuugcucuacacaaua

SEQ ID NO: 1428355 - RNA, 19 nt, Homo sapiens
cagcacugccgucuacuca

SEQ ID NO: 1428356 - RNA, 19 nt, Homo sapiens
gcccugugcuguagcuucu

SEQ ID NO: 1428357 - RNA, 19 nt, Homo sapiens
aaucagcgcucuguaaaau

SEQ ID NO: 1428358 - RNA, 19 nt, Homo sapiens
ccaaggaguagcugaaagg

SEQ ID NO: 1428359 - RNA, 19 nt, Homo sapiens
gaccaaucagcacucugua

SEQ ID NO: 1428360 - RNA, 19 nt, Homo sapiens
agacgcgauuagugguuaa

SEQ ID NO: 1428361 - RNA, 19 nt, Homo sapiens
uggagcugcuggugacaga

SEQ ID NO: 1428362 - RNA, 19 nt, Homo sapiens
gggacaauaagggaauaaa

SEQ ID NO: 1428363 - RNA, 19 nt, Homo sapiens
ccauggcccuggugcugau

SEQ ID NO: 1428364 - RNA, 19 nt, Homo sapiens
ccgcggaacgguccuuaga

SEQ ID NO: 1428365 - RNA, 19 nt, Homo sapiens
gcacugcagcccgagacuu

SEQ ID NO: 1428366 - RNA, 19 nt, Homo sapiens
gaccaaucagcgcucugua

SEQ ID NO: 1428367 - RNA, 19 nt, Homo sapiens
ucccagcacugccgucuac

SEQ ID NO: 1428368 - RNA, 19 nt, Homo sapiens
agacagaggguucgaaucc

SEQ ID NO: 1428369 - RNA, 19 nt, Homo sapiens
aaaggaagacgcgauuagu

SEQ ID NO: 1428370 - RNA, 19 nt, Homo sapiens
gguaguagugagacgugaa

SEQ ID NO: 1428371 - RNA, 19 nt, Homo sapiens
gcgauuagugguuaagacu

SEQ ID NO: 1428372 - RNA, 19 nt, Homo sapiens
caccuacagcugcuacuau

SEQ ID NO: 1428373 - RNA, 19 nt, Homo sapiens
acaugagcuucgugcugua

SEQ ID NO: 1428374 - RNA, 19 nt, Homo sapiens
gaaagaaacucuaugauug

SEQ ID NO: 1428375 - RNA, 19 nt, Homo sapiens
guacaaagaucucagaaga

SEQ ID NO: 1428376 - RNA, 19 nt, Homo sapiens
gagagagccugugaaauua

SEQ ID NO: 1428377 - RNA, 19 nt, Homo sapiens
gcacuuaccuucaaauaca

SEQ ID NO: 1428378 - RNA, 19 nt, Homo sapiens
gagaaacccuaucaaugua

SEQ ID NO: 1428379 - RNA, 19 nt, Homo sapiens
gagaaagccuuaaguacuu

SEQ ID NO: 1428380 - RNA, 19 nt, Homo sapiens
ggaaagaaacucuaugauu

SEQ ID NO: 1428381 - RNA, 19 nt, Homo sapiens
gaaauggaccucauaaaug

SEQ ID NO: 1428382 - RNA, 19 nt, Homo sapiens
ggagaaacccuauaaaugu

SEQ ID NO: 1428383 - RNA, 19 nt, Homo sapiens
gagaagccauauacacaua

SEQ ID NO: 1428384 - RNA, 19 nt, Homo sapiens
gagagaagccguauaaaug

SEQ ID NO: 1428385 - RNA, 19 nt, Homo sapiens
gguaaagccuucagucauu

SEQ ID NO: 1428386 - RNA, 19 nt, Homo sapiens
gaacaauccuaugaaugua

SEQ ID NO: 1428387 - RNA, 19 nt, Homo sapiens
gagaaacccuauaagugua

SEQ ID NO: 1428388 - RNA, 19 nt, Homo sapiens
ggaaagcauucucugauug

SEQ ID NO: 1428389 - RNA, 19 nt, Homo sapiens
gaaaauaccuggaguagau

SEQ ID NO: 1428390 - RNA, 19 nt, Homo sapiens
ggagagacccuauaaaugu

SEQ ID NO: 1428391 - RNA, 19 nt, Homo sapiens
gaaccacuaugaauguaaa

SEQ ID NO: 1428392 - RNA, 19 nt, Homo sapiens
gagagacccuauaaaugua

SEQ ID NO: 1428393 - RNA, 19 nt, Homo sapiens
gagaagccauauaaaugua

SEQ ID NO: 1428394 - RNA, 19 nt, Homo sapiens
ggaaauggaccucauaaau

SEQ ID NO: 1428395 - RNA, 19 nt, Homo sapiens
gaagacacaugauaacaca

SEQ ID NO: 1428396 - RNA, 19 nt, Homo sapiens
gcaaagacaugaaagaacu

SEQ ID NO: 1428397 - RNA, 19 nt, Homo sapiens
ucagaaaccuggacuguau

SEQ ID NO: 1428398 - RNA, 19 nt, Homo sapiens
ucaagucccugauauuaaa

SEQ ID NO: 1428399 - RNA, 19 nt, Homo sapiens
ugaaaugacucacuagaga

SEQ ID NO: 1428400 - RNA, 19 nt, Homo sapiens
gagaagccguauaaaugua

SEQ ID NO: 1428401 - RNA, 19 nt, Homo sapiens
gaagagaaaccauaugaau

SEQ ID NO: 1428402 - RNA, 19 nt, Homo sapiens
gagagaagccauauaaaug

SEQ ID NO: 1428403 - RNA, 19 nt, Homo sapiens
guucaucucuuaauugcua

SEQ ID NO: 1428404 - RNA, 19 nt, Homo sapiens
acaaagaucucagaagaaa

SEQ ID NO: 1428405 - RNA, 19 nt, Homo sapiens
ggagaaacccuauaagugu

SEQ ID NO: 1428406 - RNA, 19 nt, Homo sapiens
ggagaacaauccuaugaau

SEQ ID NO: 1428407 - RNA, 19 nt, Homo sapiens
gcuuauaguuccacucuaa

SEQ ID NO: 1428408 - RNA, 19 nt, Homo sapiens
gggaaagccuucaguuguu

SEQ ID NO: 1428409 - RNA, 19 nt, Homo sapiens
cuacagcguuuccugcuua

SEQ ID NO: 1428410 - RNA, 19 nt, Homo sapiens
ggagagacccuauaagugu

SEQ ID NO: 1428411 - RNA, 19 nt, Homo sapiens
ggagagaagccauauaaau

SEQ ID NO: 1428412 - RNA, 19 nt, Homo sapiens
gggaaagcauucucugauu

SEQ ID NO: 1428413 - RNA, 19 nt, Homo sapiens
ggagauggaccucguauau

SEQ ID NO: 1428414 - RNA, 19 nt, Homo sapiens
gagagacccuauaagugua

SEQ ID NO: 1428415 - RNA, 19 nt, Homo sapiens
gagaaacccuauaaaugug

SEQ ID NO: 1428416 - RNA, 19 nt, Homo sapiens
agagagagccugugaaauu

SEQ ID NO: 1428417 - RNA, 19 nt, Homo sapiens
ucuaagaugucauauggua

SEQ ID NO: 1428418 - RNA, 19 nt, Homo sapiens
gagaugggccucauaaaug

SEQ ID NO: 1428419 - RNA, 19 nt, Homo sapiens
gaaacccuaucaauguaaa

SEQ ID NO: 1428420 - RNA, 19 nt, Homo sapiens
uagaagaacucacacugaa

SEQ ID NO: 1428421 - RNA, 19 nt, Homo sapiens
uaucagcccugcuuucaaa

SEQ ID NO: 1428422 - RNA, 19 nt, Homo sapiens
caauggaccuuacuacugu

SEQ ID NO: 1428423 - RNA, 19 nt, Homo sapiens
ggagagaagccguauaaau

SEQ ID NO: 1428424 - RNA, 19 nt, Homo sapiens
gagagaaacccuaugaaug

SEQ ID NO: 1428425 - RNA, 19 nt, Homo sapiens
aaauggaccucauaaaugu

SEQ ID NO: 1428426 - RNA, 19 nt, Homo sapiens
ggauguggcuauaaacuuc

SEQ ID NO: 1428427 - RNA, 19 nt, Homo sapiens
ggagauggaccucauaaau

SEQ ID NO: 1428428 - RNA, 19 nt, Homo sapiens
ggagauggaccucauaaau

SEQ ID NO: 1428429 - RNA, 19 nt, Homo sapiens
gagagaaaccguaugaaug

SEQ ID NO: 1428430 - RNA, 19 nt, Homo sapiens
gagagaaacccuaucaaug

SEQ ID NO: 1428431 - RNA, 19 nt, Homo sapiens
gaagaacucacacugaaga

SEQ ID NO: 1428432 - RNA, 19 nt, Homo sapiens
cauaagagacucacacuga

SEQ ID NO: 1428433 - RNA, 19 nt, Homo sapiens
gaaaggacccacaguaugg

SEQ ID NO: 1428434 - RNA, 19 nt, Homo sapiens
ggaaaagccuucauuuguu

SEQ ID NO: 1428435 - RNA, 19 nt, Homo sapiens
gaucucagaagaaaucuaa

SEQ ID NO: 1428436 - RNA, 19 nt, Homo sapiens
gauaacacauacuggaaau

SEQ ID NO: 1428437 - RNA, 19 nt, Homo sapiens
gggaaaggcuucaggucuu

SEQ ID NO: 1428438 - RNA, 19 nt, Homo sapiens
ucgaagacaugaaagaauu

SEQ ID NO: 1428439 - RNA, 19 nt, Homo sapiens
gggagaaacccuauaaaug

SEQ ID NO: 1428440 - RNA, 19 nt, Homo sapiens
gaacucacacugaagagaa

SEQ ID NO: 1428441 - RNA, 19 nt, Homo sapiens
ggacagcuuucaguuauca

SEQ ID NO: 1428442 - RNA, 19 nt, Homo sapiens
gaacacaaaccauaugagu

SEQ ID NO: 1428443 - RNA, 19 nt, Homo sapiens
agaagaagaucaguacaaa

SEQ ID NO: 1428444 - RNA, 19 nt, Homo sapiens
ggagaugggccucauaaau

SEQ ID NO: 1428445 - RNA, 19 nt, Homo sapiens
gagagccugugaaauuaaa

SEQ ID NO: 1428446 - RNA, 19 nt, Homo sapiens
gaauguaaacaauguggua

SEQ ID NO: 1428447 - RNA, 19 nt, Homo sapiens
gagaaccacuaugaaugua

SEQ ID NO: 1428448 - RNA, 19 nt, Homo sapiens
gcagagaaccacuaugaau

SEQ ID NO: 1428449 - RNA, 19 nt, Homo sapiens
gagauggaccucauaaaug

SEQ ID NO: 1428450 - RNA, 19 nt, Homo sapiens
gagauggaccucauaaaug

SEQ ID NO: 1428451 - RNA, 19 nt, Homo sapiens
gggaagcauuucauuguau

SEQ ID NO: 1428452 - RNA, 19 nt, Homo sapiens
ggagagaaacccuaugaau

SEQ ID NO: 1428453 - RNA, 19 nt, Homo sapiens
gaaaagccuucauuuguug

SEQ ID NO: 1428454 - RNA, 19 nt, Homo sapiens
gagaaaccguaugaaugua

SEQ ID NO: 1428455 - RNA, 19 nt, Homo sapiens
ggagagaaaccguaugaau

SEQ ID NO: 1428456 - RNA, 19 nt, Homo sapiens
ggagagaaacccuaucaau

SEQ ID NO: 1428457 - RNA, 19 nt, Homo sapiens
gaaacucuaugauuguaag

SEQ ID NO: 1428458 - RNA, 19 nt, Homo sapiens
gaaaagcccuaugaaugua

SEQ ID NO: 1428459 - RNA, 19 nt, Homo sapiens
uaucugaucucucaagcuu

SEQ ID NO: 1428460 - RNA, 19 nt, Homo sapiens
ccucauaaaugcaagguau

SEQ ID NO: 1428461 - RNA, 19 nt, Homo sapiens
gcaguguucuacagcguuu

SEQ ID NO: 1428462 - RNA, 19 nt, Homo sapiens
ggucguucaucucuuaauu

SEQ ID NO: 1428463 - RNA, 19 nt, Homo sapiens
guagagagagccugugaaa

SEQ ID NO: 1428464 - RNA, 19 nt, Homo sapiens
cauauaaucuaggcacauu

SEQ ID NO: 1428465 - RNA, 19 nt, Homo sapiens
uaaacaaugugguaaagca

SEQ ID NO: 1428466 - RNA, 19 nt, Homo sapiens
ugaccaaacucauacuuca

SEQ ID NO: 1428467 - RNA, 19 nt, Homo sapiens
gaaaugacucacuagagaa

SEQ ID NO: 1428468 - RNA, 19 nt, Homo sapiens
ugaaagaccucagcaugga

SEQ ID NO: 1428469 - RNA, 19 nt, Homo sapiens
gauauucaagucccugaua

SEQ ID NO: 1428470 - RNA, 19 nt, Homo sapiens
uguaucaguuccuuucaua

SEQ ID NO: 1428471 - RNA, 19 nt, Homo sapiens
gggaaagcauuaucugauc

SEQ ID NO: 1428472 - RNA, 19 nt, Homo sapiens
uggccuaguuuauuucaua

SEQ ID NO: 1428473 - RNA, 19 nt, Homo sapiens
gagagaagccauauacaca

SEQ ID NO: 1428474 - RNA, 19 nt, Homo sapiens
gcaaagauuucuguacaua

SEQ ID NO: 1428475 - RNA, 19 nt, Homo sapiens
gaaagaacucacacuauua

SEQ ID NO: 1428476 - RNA, 19 nt, Homo sapiens
ugaaagaacucacacuauu

SEQ ID NO: 1428477 - RNA, 19 nt, Homo sapiens
gagaagccauauaaacaua

SEQ ID NO: 1428478 - RNA, 19 nt, Homo sapiens
gaaguuaaaucuugcuguu

SEQ ID NO: 1428479 - RNA, 19 nt, Homo sapiens
gagcaaagauuucuguaca

SEQ ID NO: 1428480 - RNA, 19 nt, Homo sapiens
caaguucuaucuacaguuu

SEQ ID NO: 1428481 - RNA, 19 nt, Homo sapiens
gagagaagccguacaaaug

SEQ ID NO: 1428482 - RNA, 19 nt, Homo sapiens
guagugaccuuguucuuga

SEQ ID NO: 1428483 - RNA, 19 nt, Homo sapiens
ccacauaagugucagaaau

SEQ ID NO: 1428484 - RNA, 19 nt, Homo sapiens
ucacgaaccucaucuguau

SEQ ID NO: 1428485 - RNA, 19 nt, Homo sapiens
agagaaaccuuaccaaugu

SEQ ID NO: 1428486 - RNA, 19 nt, Homo sapiens
ggagagaggccucauaaau

SEQ ID NO: 1428487 - RNA, 19 nt, Homo sapiens
gagaaacgauaugaaugua

SEQ ID NO: 1428488 - RNA, 19 nt, Homo sapiens
caggaaauguccaguguuu

SEQ ID NO: 1428489 - RNA, 19 nt, Homo sapiens
gggaaagccuucauucguu

SEQ ID NO: 1428490 - RNA, 19 nt, Homo sapiens
gagaaacccuaugaaugua

SEQ ID NO: 1428491 - RNA, 19 nt, Homo sapiens
gagagaaacccuacaaaug

SEQ ID NO: 1428492 - RNA, 19 nt, Homo sapiens
gggaaagccuucacuuguu

SEQ ID NO: 1428493 - RNA, 19 nt, Homo sapiens
gggaaagccuucacuuguu

SEQ ID NO: 1428494 - RNA, 19 nt, Homo sapiens
ggaaagccuucacuuguuc

SEQ ID NO: 1428495 - RNA, 19 nt, Homo sapiens
ggaaagccuucacuuguuc

SEQ ID NO: 1428496 - RNA, 19 nt, Homo sapiens
ggagauggaccuuauaaau

SEQ ID NO: 1428497 - RNA, 19 nt, Homo sapiens
gagagaggccucauaaaug

SEQ ID NO: 1428498 - RNA, 19 nt, Homo sapiens
guacauaccagagagauaa

SEQ ID NO: 1428499 - RNA, 19 nt, Homo sapiens
ccacuucguuucaauauca

SEQ ID NO: 1428500 - RNA, 19 nt, Homo sapiens
guuuauaccuuacccauga

SEQ ID NO: 1428501 - RNA, 19 nt, Homo sapiens
gagaaaccuuaccaaugua

SEQ ID NO: 1428502 - RNA, 19 nt, Homo sapiens
gagagaaaccuuaccaaug

SEQ ID NO: 1428503 - RNA, 19 nt, Homo sapiens
cuccaaaucucuugacuuu

SEQ ID NO: 1428504 - RNA, 19 nt, Homo sapiens
gagauggaccuuauaaaug

SEQ ID NO: 1428505 - RNA, 19 nt, Homo sapiens
gcaagcauucgaagauaua

SEQ ID NO: 1428506 - RNA, 19 nt, Homo sapiens
gagaaaucuucaugggaua

SEQ ID NO: 1428507 - RNA, 19 nt, Homo sapiens
ggagagaaacgauaugaau

SEQ ID NO: 1428508 - RNA, 19 nt, Homo sapiens
gaagacaugcugaacaaga

SEQ ID NO: 1428509 - RNA, 19 nt, Homo sapiens
ugucaaagaggauguaaua

SEQ ID NO: 1428510 - RNA, 19 nt, Homo sapiens
ugugucagcuccuuucaua

SEQ ID NO: 1428511 - RNA, 19 nt, Homo sapiens
uggccuaucuuacauauga

SEQ ID NO: 1428512 - RNA, 19 nt, Homo sapiens
gaauguaaacaauguggua

SEQ ID NO: 1428513 - RNA, 19 nt, Homo sapiens
ugaaaggccucacacuaga

SEQ ID NO: 1428514 - RNA, 19 nt, Homo sapiens
ggagagaaacccuacaaau

SEQ ID NO: 1428515 - RNA, 19 nt, Homo sapiens
gagaagccauaugaaugua

SEQ ID NO: 1428516 - RNA, 19 nt, Homo sapiens
gcaauaaaauguagagaug

SEQ ID NO: 1428517 - RNA, 19 nt, Homo sapiens
ugagaaacccuaugaaugu

SEQ ID NO: 1428518 - RNA, 19 nt, Homo sapiens
agagaggccucauaaaugu

SEQ ID NO: 1428519 - RNA, 19 nt, Homo sapiens
ggagaagccauaugaaugu

SEQ ID NO: 1428520 - RNA, 19 nt, Homo sapiens
ggaguaaaaucaugugaaa

SEQ ID NO: 1428521 - RNA, 19 nt, Homo sapiens
uaggaggugugauuuguuu

SEQ ID NO: 1428522 - RNA, 19 nt, Homo sapiens
ggaaggccuuagucacauu

SEQ ID NO: 1428523 - RNA, 19 nt, Homo sapiens
gagaaacccuacaaaugca

SEQ ID NO: 1428524 - RNA, 19 nt, Homo sapiens
agcauuaucucgccuuaua

SEQ ID NO: 1428525 - RNA, 19 nt, Homo sapiens
gggaaagccuucaauuguc

SEQ ID NO: 1428526 - RNA, 19 nt, Homo sapiens
ggagagaagccguacaaau

SEQ ID NO: 1428527 - RNA, 19 nt, Homo sapiens
ugucucaguuuauaccuua

SEQ ID NO: 1428528 - RNA, 19 nt, Homo sapiens
ggaaagccuuggauugucu

SEQ ID NO: 1428529 - RNA, 19 nt, Homo sapiens
agauggaccuuauaaaugu

SEQ ID NO: 1428530 - RNA, 19 nt, Homo sapiens
ccucaucuguauagaaauu

SEQ ID NO: 1428531 - RNA, 19 nt, Homo sapiens
gaccauaauuugucauucu

SEQ ID NO: 1428532 - RNA, 19 nt, Homo sapiens
ggauguggcugugaacuuc

SEQ ID NO: 1428533 - RNA, 19 nt, Homo sapiens
cggaagacaugcugaacaa

SEQ ID NO: 1428534 - RNA, 19 nt, Homo sapiens
ggagagaaaccuuaccaau

SEQ ID NO: 1428535 - RNA, 19 nt, Homo sapiens
gggaaagccuucagaucug

SEQ ID NO: 1428536 - RNA, 19 nt, Homo sapiens
aggaaagccuugagccaua

SEQ ID NO: 1428537 - RNA, 19 nt, Homo sapiens
cuacuaugcugccaucaga

SEQ ID NO: 1428538 - RNA, 19 nt, Homo sapiens
gguaggaggugugauuugu

SEQ ID NO: 1428539 - RNA, 19 nt, Homo sapiens
gacagggucucacuaucuu

SEQ ID NO: 1428540 - RNA, 19 nt, Homo sapiens
gggagaagccauaugaaug

SEQ ID NO: 1428541 - RNA, 19 nt, Homo sapiens
gaccugcuccggagucaua

SEQ ID NO: 1428542 - RNA, 19 nt, Homo sapiens
gaaccucaucuguauagaa

SEQ ID NO: 1428543 - RNA, 19 nt, Homo sapiens
cccagaagcuccacauuca

SEQ ID NO: 1428544 - RNA, 19 nt, Homo sapiens
ucaaaggcaugaaagaagu

SEQ ID NO: 1428545 - RNA, 19 nt, Homo sapiens
gaagacacaugagaaugca

SEQ ID NO: 1428546 - RNA, 19 nt, Homo sapiens
uggauugucucaguuuaua

SEQ ID NO: 1428547 - RNA, 19 nt, Homo sapiens
gauggaccuuauaaaugua

SEQ ID NO: 1428548 - RNA, 19 nt, Homo sapiens
ggugugauuuguuuacaug

SEQ ID NO: 1428549 - RNA, 19 nt, Homo sapiens
ccaaaucucuugacuuucc

SEQ ID NO: 1428550 - RNA, 19 nt, Homo sapiens
ucaagaguauccuccaaau

SEQ ID NO: 1428551 - RNA, 19 nt, Homo sapiens
gaggaaggccuuagucaca

SEQ ID NO: 1428552 - RNA, 19 nt, Homo sapiens
gagagaaacgauaugaaug

SEQ ID NO: 1428553 - RNA, 19 nt, Homo sapiens
aaccucaucuguauagaaa

SEQ ID NO: 1428554 - RNA, 19 nt, Homo sapiens
caauaaaggaaggcaauaa

SEQ ID NO: 1428555 - RNA, 19 nt, Homo sapiens
gaagccauaugaauguaag

SEQ ID NO: 1428556 - RNA, 19 nt, Homo sapiens
caugaaaggccucacacua

SEQ ID NO: 1428557 - RNA, 19 nt, Homo sapiens
ggaaagccuugagccauag

SEQ ID NO: 1428558 - RNA, 19 nt, Homo sapiens
aaacauaaacaacguagga

SEQ ID NO: 1428559 - RNA, 19 nt, Homo sapiens
gagagauaaugcagacugu

SEQ ID NO: 1428560 - RNA, 19 nt, Homo sapiens
ccaaguacauucgaauaca

SEQ ID NO: 1428561 - RNA, 19 nt, Homo sapiens
uguccaguguuuccuguua

SEQ ID NO: 1428562 - RNA, 19 nt, Homo sapiens
gaaacccuaugaauguaag

SEQ ID NO: 1428563 - RNA, 19 nt, Homo sapiens
ugugggaaaucauucaauu

SEQ ID NO: 1428564 - RNA, 19 nt, Homo sapiens
cauagccacugcuuucgaa

SEQ ID NO: 1428565 - RNA, 19 nt, Homo sapiens
gagauggaguuaggugaug

SEQ ID NO: 1428566 - RNA, 19 nt, Homo sapiens
caugaaagaacucacacua

SEQ ID NO: 1428567 - RNA, 19 nt, Homo sapiens
gugagaaacccuaugaaug

SEQ ID NO: 1428568 - RNA, 19 nt, Homo sapiens
gaacucacacuggagagaa

SEQ ID NO: 1428569 - RNA, 19 nt, Homo sapiens
uagagaagccauauaaaca

SEQ ID NO: 1428570 - RNA, 19 nt, Homo sapiens
ucacugguggccuaucuua

SEQ ID NO: 1428571 - RNA, 19 nt, Homo sapiens
gguagucaguguggagaaa

SEQ ID NO: 1428572 - RNA, 19 nt, Homo sapiens
cuucagaucugccaaguac

SEQ ID NO: 1428573 - RNA, 19 nt, Homo sapiens
cuuauaagcuuucgaagac

SEQ ID NO: 1428574 - RNA, 19 nt, Homo sapiens
gagaauugcuugaauauag

SEQ ID NO: 1428575 - RNA, 19 nt, Homo sapiens
gagaaacccuauaaaugua

SEQ ID NO: 1428576 - RNA, 19 nt, Homo sapiens
agaaagaccuuaugaaugu

SEQ ID NO: 1428577 - RNA, 19 nt, Homo sapiens
ggauggaccuuauaaaugu

SEQ ID NO: 1428578 - RNA, 19 nt, Homo sapiens
gaacaugaccucuuuagga

SEQ ID NO: 1428579 - RNA, 19 nt, Homo sapiens
ggagaaagacguuauaaau

SEQ ID NO: 1428580 - RNA, 19 nt, Homo sapiens
ggaaagaccagaacauuga

SEQ ID NO: 1428581 - RNA, 19 nt, Homo sapiens
gagagaagcccuauaaaug

SEQ ID NO: 1428582 - RNA, 19 nt, Homo sapiens
gaucagccuuauacuguua

SEQ ID NO: 1428583 - RNA, 19 nt, Homo sapiens
gagaagcucugugaaugua

SEQ ID NO: 1428584 - RNA, 19 nt, Homo sapiens
gagaaacccugugaaugua

SEQ ID NO: 1428585 - RNA, 19 nt, Homo sapiens
gguaaagccuucccucauu

SEQ ID NO: 1428586 - RNA, 19 nt, Homo sapiens
gaaaccaugugaauguaaa

SEQ ID NO: 1428587 - RNA, 19 nt, Homo sapiens
agagagaccuuauaaaugu

SEQ ID NO: 1428588 - RNA, 19 nt, Homo sapiens
gagaaaagccuuaugaaua

SEQ ID NO: 1428589 - RNA, 19 nt, Homo sapiens
gagagaaacccuauaaaug

SEQ ID NO: 1428590 - RNA, 19 nt, Homo sapiens
ccauuggugucauguauua

SEQ ID NO: 1428591 - RNA, 19 nt, Homo sapiens
gcaaagcuuucucuucuuc

SEQ ID NO: 1428592 - RNA, 19 nt, Homo sapiens
ggagaaagaccuuaugaau

SEQ ID NO: 1428593 - RNA, 19 nt, Homo sapiens
cuccagaccucaugauuua

SEQ ID NO: 1428594 - RNA, 19 nt, Homo sapiens
gcauucagcuugccuacuu

SEQ ID NO: 1428595 - RNA, 19 nt, Homo sapiens
gagaaacccuaugaaugua

SEQ ID NO: 1428596 - RNA, 19 nt, Homo sapiens
guagagagaccuuauaaau

SEQ ID NO: 1428597 - RNA, 19 nt, Homo sapiens
gggaaagccuucagauaug

SEQ ID NO: 1428598 - RNA, 19 nt, Homo sapiens
gagaaaccaugugaaugua

SEQ ID NO: 1428599 - RNA, 19 nt, Homo sapiens
gaaggaaacacuaugaaug

SEQ ID NO: 1428600 - RNA, 19 nt, Homo sapiens
ggagagaaacccuauaaau

SEQ ID NO: 1428601 - RNA, 19 nt, Homo sapiens
gaaaggacccacucuagga

SEQ ID NO: 1428602 - RNA, 19 nt, Homo sapiens
gaaacccuaugaauguaaa

SEQ ID NO: 1428603 - RNA, 19 nt, Homo sapiens
gagaaagacguuauaaaug

SEQ ID NO: 1428604 - RNA, 19 nt, Homo sapiens
ggagagaagcccuauaaau

SEQ ID NO: 1428605 - RNA, 19 nt, Homo sapiens
gagaaagaccuuaugaaug

SEQ ID NO: 1428606 - RNA, 19 nt, Homo sapiens
gaagacacaugguaaugca

SEQ ID NO: 1428607 - RNA, 19 nt, Homo sapiens
caucagaggugacauugga

SEQ ID NO: 1428608 - RNA, 19 nt, Homo sapiens
ucaggaacaugaccucuuu

SEQ ID NO: 1428609 - RNA, 19 nt, Homo sapiens
uaggagaauugcuugaaua

SEQ ID NO: 1428610 - RNA, 19 nt, Homo sapiens
gagagaaacccuaugaaug

SEQ ID NO: 1428611 - RNA, 19 nt, Homo sapiens
gagagaaaccguaugaaug

SEQ ID NO: 1428612 - RNA, 19 nt, Homo sapiens
caagcaacguucaguaguu

SEQ ID NO: 1428613 - RNA, 19 nt, Homo sapiens
gaaagaccuuaugaaugua

SEQ ID NO: 1428614 - RNA, 19 nt, Homo sapiens
gaaacccaaugcuuguaaa

SEQ ID NO: 1428615 - RNA, 19 nt, Homo sapiens
gagccgagguugcaccauu

SEQ ID NO: 1428616 - RNA, 19 nt, Homo sapiens
gaucucggcuuucuugcuu

SEQ ID NO: 1428617 - RNA, 19 nt, Homo sapiens
gagaaacccuaugagugua

SEQ ID NO: 1428618 - RNA, 19 nt, Homo sapiens
gagaaacccuaugagugua

SEQ ID NO: 1428619 - RNA, 19 nt, Homo sapiens
gaagagaaacccuaugagu

SEQ ID NO: 1428620 - RNA, 19 nt, Homo sapiens
gagaaacccuaugagugua

SEQ ID NO: 1428621 - RNA, 19 nt, Homo sapiens
cagcaaggguguaauauac

SEQ ID NO: 1428622 - RNA, 19 nt, Homo sapiens
ggaaagccuucagauaugu

SEQ ID NO: 1428623 - RNA, 19 nt, Homo sapiens
uauccucucuuacaaguuu

SEQ ID NO: 1428624 - RNA, 19 nt, Homo sapiens
ggagagaaacccuaugaau

SEQ ID NO: 1428625 - RNA, 19 nt, Homo sapiens
gagagaccuuauaaaugua

SEQ ID NO: 1428626 - RNA, 19 nt, Homo sapiens
ggacucacccugaagagaa

SEQ ID NO: 1428627 - RNA, 19 nt, Homo sapiens
gagaaaccguaugaaugua

SEQ ID NO: 1428628 - RNA, 19 nt, Homo sapiens
ggagagaaaccguaugaau

SEQ ID NO: 1428629 - RNA, 19 nt, Homo sapiens
ggagagaaaccaugugaau

SEQ ID NO: 1428630 - RNA, 19 nt, Homo sapiens
ggaucacacuggagagaaa

SEQ ID NO: 1428631 - RNA, 19 nt, Homo sapiens
cuagguaacucaucuuuua

SEQ ID NO: 1428632 - RNA, 19 nt, Homo sapiens
gggcuuugcuggauauuuc

SEQ ID NO: 1428633 - RNA, 19 nt, Homo sapiens
gacacacacuggagagaaa

SEQ ID NO: 1428634 - RNA, 19 nt, Homo sapiens
guaaagccuucccucauuc

SEQ ID NO: 1428635 - RNA, 19 nt, Homo sapiens
gaauguaaacaguguggua

SEQ ID NO: 1428636 - RNA, 19 nt, Homo sapiens
caagucacauuaguaagaa

SEQ ID NO: 1428637 - RNA, 19 nt, Homo sapiens
ggagagaagcccuaugaau

SEQ ID NO: 1428638 - RNA, 19 nt, Homo sapiens
ggagagaaacccugugaau

SEQ ID NO: 1428639 - RNA, 19 nt, Homo sapiens
gcauuauccucucuuacaa

SEQ ID NO: 1428640 - RNA, 19 nt, Homo sapiens
agagaaacccuauaaaugu

SEQ ID NO: 1428641 - RNA, 19 nt, Homo sapiens
gaaaaggcuuaucaaugua

SEQ ID NO: 1428642 - RNA, 19 nt, Homo sapiens
ggauguggcugugaacuuc

SEQ ID NO: 1428643 - RNA, 19 nt, Homo sapiens
gcccagaaccuucgaauuc

SEQ ID NO: 1428644 - RNA, 19 nt, Homo sapiens
ucaggagucucauagaaga

SEQ ID NO: 1428645 - RNA, 19 nt, Homo sapiens
uggcuaggcuggucucaaa

SEQ ID NO: 1428646 - RNA, 19 nt, Homo sapiens
ggacucacaugggagagaa

SEQ ID NO: 1428647 - RNA, 19 nt, Homo sapiens
gaaaagacuuacacuggaa

SEQ ID NO: 1428648 - RNA, 19 nt, Homo sapiens
gggaaagccuucagaucug

SEQ ID NO: 1428649 - RNA, 19 nt, Homo sapiens
gaaaggacacaaacacaca

SEQ ID NO: 1428650 - RNA, 19 nt, Homo sapiens
gaaaggacacaaacacaca

SEQ ID NO: 1428651 - RNA, 19 nt, Homo sapiens
gggaaagccuucagaucug

SEQ ID NO: 1428652 - RNA, 19 nt, Homo sapiens
ggagagaaacccaaugcuu

SEQ ID NO: 1428653 - RNA, 19 nt, Homo sapiens
acacgugucucuccaacaa

SEQ ID NO: 1428654 - RNA, 19 nt, Homo sapiens
ggaaggaaacacuaugaau

SEQ ID NO: 1428655 - RNA, 19 nt, Homo sapiens
cagcuugccuacuuccuuu

SEQ ID NO: 1428656 - RNA, 19 nt, Homo sapiens
agagaaacccuaugaaugu

SEQ ID NO: 1428657 - RNA, 19 nt, Homo sapiens
aaagcauuauccucucuua

SEQ ID NO: 1428658 - RNA, 19 nt, Homo sapiens
gggauggaccuuauaaaug

SEQ ID NO: 1428659 - RNA, 19 nt, Homo sapiens
acccaaugcuuguaaagua

SEQ ID NO: 1428660 - RNA, 19 nt, Homo sapiens
cauaugaguaucaggaaua

SEQ ID NO: 1428661 - RNA, 19 nt, Homo sapiens
gugaaacucugucuuaaaa

SEQ ID NO: 1428662 - RNA, 19 nt, Homo sapiens
caagauccuuugaauacau

SEQ ID NO: 1428663 - RNA, 19 nt, Homo sapiens
ggaaagccuucagaucugu

SEQ ID NO: 1428664 - RNA, 19 nt, Homo sapiens
agaauacacucuggagaaa

SEQ ID NO: 1428665 - RNA, 19 nt, Homo sapiens
ggagugggcuuugcuggau

SEQ ID NO: 1428666 - RNA, 19 nt, Homo sapiens
gaauguaagauauguggaa

SEQ ID NO: 1428667 - RNA, 19 nt, Homo sapiens
agaaaaggcuuaucaaugu

SEQ ID NO: 1428668 - RNA, 19 nt, Homo sapiens
gauggaccuuauaaaugua

SEQ ID NO: 1428669 - RNA, 19 nt, Homo sapiens
ucuguaaccugcacuguga

SEQ ID NO: 1428670 - RNA, 19 nt, Homo sapiens
gcuauaauaucccauuggu

SEQ ID NO: 1428671 - RNA, 19 nt, Homo sapiens
gaagcuauaauaucccauu

SEQ ID NO: 1428672 - RNA, 19 nt, Homo sapiens
ggagagaaacccuaugagu

SEQ ID NO: 1428673 - RNA, 19 nt, Homo sapiens
gccaagauccuuugaauac

SEQ ID NO: 1428674 - RNA, 19 nt, Homo sapiens
ccaaagaccuaaacaaugu

SEQ ID NO: 1428675 - RNA, 19 nt, Homo sapiens
gaacgacucuagacccaau

SEQ ID NO: 1428676 - RNA, 19 nt, Homo sapiens
gaacauucuugcacacaug

SEQ ID NO: 1428677 - RNA, 19 nt, Homo sapiens
gaaacccuguaucaacuaa

SEQ ID NO: 1428678 - RNA, 19 nt, Homo sapiens
agacacagcugcccacuuc

SEQ ID NO: 1428679 - RNA, 19 nt, Homo sapiens
ggacauaugcagauccaaa

SEQ ID NO: 1428680 - RNA, 19 nt, Homo sapiens
aaacagcgcugcuauuugc

SEQ ID NO: 1428681 - RNA, 19 nt, Homo sapiens
caucagauugccuuauuua

SEQ ID NO: 1428682 - RNA, 19 nt, Homo sapiens
gaagccgccugccucauug

SEQ ID NO: 1428683 - RNA, 19 nt, Homo sapiens
ggaagccgccugccucauu

SEQ ID NO: 1428684 - RNA, 19 nt, Homo sapiens
caacguuguuacuaagauu

SEQ ID NO: 1428685 - RNA, 19 nt, Homo sapiens
cagauugccuuauuuacug

SEQ ID NO: 1428686 - RNA, 19 nt, Homo sapiens
gcacucaacguuguuacua

SEQ ID NO: 1428687 - RNA, 19 nt, Homo sapiens
guuugagacuuccuucuuu

SEQ ID NO: 1428688 - RNA, 19 nt, Homo sapiens
gcacuuguacucccagcua

SEQ ID NO: 1428689 - RNA, 19 nt, Homo sapiens
ccgaucagauggagaaaug

SEQ ID NO: 1428690 - RNA, 19 nt, Homo sapiens
caccagaggucaggaguug

SEQ ID NO: 1428691 - RNA, 19 nt, Homo sapiens
gaugaaacccuguaucaac

SEQ ID NO: 1428692 - RNA, 19 nt, Homo sapiens
ucccauggcuggaauacuu

SEQ ID NO: 1428693 - RNA, 19 nt, Homo sapiens
gcagugagccgagauugug

SEQ ID NO: 1428694 - RNA, 19 nt, Homo sapiens
gcaggagaauugcuugaac

SEQ ID NO: 1428695 - RNA, 19 nt, Homo sapiens
gcacugcuccagcgguauu

SEQ ID NO: 1428696 - RNA, 19 nt, Homo sapiens
gagcuuuggugggugacua

SEQ ID NO: 1428697 - RNA, 19 nt, Homo sapiens
aagaguaccuagcggaaga

SEQ ID NO: 1428698 - RNA, 19 nt, Homo sapiens
cagcuacucaggaggcuua

SEQ ID NO: 1428699 - RNA, 19 nt, Homo sapiens
ccaaugcgacuccagaaga

SEQ ID NO: 1428700 - RNA, 19 nt, Homo sapiens
gaaaccccgucucuacuaa

SEQ ID NO: 1428701 - RNA, 19 nt, Homo sapiens
caaugcgacuccagaagau

SEQ ID NO: 1428702 - RNA, 19 nt, Homo sapiens
acuauacccugauuucuuc

SEQ ID NO: 1428703 - RNA, 19 nt, Homo sapiens
gacuauacccugauuucuu

SEQ ID NO: 1428704 - RNA, 19 nt, Homo sapiens
gugggugacuuuccgauca

SEQ ID NO: 1428705 - RNA, 19 nt, Homo sapiens
ccucauugccuuacuucua

SEQ ID NO: 1428706 - RNA, 19 nt, Homo sapiens
ucaucagauugccuuauuu

SEQ ID NO: 1428707 - RNA, 19 nt, Homo sapiens
gauccaaagaccuaaacaa

SEQ ID NO: 1428708 - RNA, 19 nt, Homo sapiens
cacucaacguuguuacuaa

SEQ ID NO: 1428709 - RNA, 19 nt, Homo sapiens
uugcacacaugcccuggua

SEQ ID NO: 1428710 - RNA, 19 nt, Homo sapiens
caaagaccuaaacaaugua

SEQ ID NO: 1428711 - RNA, 19 nt, Homo sapiens
gcagauccaaagaccuaaa

SEQ ID NO: 1428712 - RNA, 19 nt, Homo sapiens
gagaccagccugcccaaca

SEQ ID NO: 1428713 - RNA, 19 nt, Homo sapiens
ucagauggagaaaugauga

SEQ ID NO: 1428714 - RNA, 19 nt, Homo sapiens
cccaaucaauauguuguuu

SEQ ID NO: 1428715 - RNA, 19 nt, Homo sapiens
uucaucagauugccuuauu

SEQ ID NO: 1428716 - RNA, 19 nt, Homo sapiens
ugacaaagcgagacuccau

SEQ ID NO: 1428717 - RNA, 19 nt, Homo sapiens
gaugaagacgagacucugu

SEQ ID NO: 1428718 - RNA, 19 nt, Homo sapiens
ucaacguuguuacuaagau

SEQ ID NO: 1428719 - RNA, 19 nt, Homo sapiens
gacaggagaauugcuugaa

SEQ ID NO: 1428720 - RNA, 19 nt, Homo sapiens
cgaacauucuugcacacau

SEQ ID NO: 1428721 - RNA, 19 nt, Homo sapiens
ccuguaaucccagcacuuu

SEQ ID NO: 1428722 - RNA, 19 nt, Homo sapiens
ucgacggccuagaagagua

SEQ ID NO: 1428723 - RNA, 19 nt, Homo sapiens
ccaaggcccaguccucuuc

SEQ ID NO: 1428724 - RNA, 19 nt, Homo sapiens
ggaccggaacgacucuaga

SEQ ID NO: 1428725 - RNA, 19 nt, Homo sapiens
cagaguggugggugacuuu

SEQ ID NO: 1428726 - RNA, 19 nt, Homo sapiens
auaauuccaugggugacua

SEQ ID NO: 1428727 - RNA, 19 nt, Homo sapiens
gaggccagcccugagcuuu

SEQ ID NO: 1428728 - RNA, 19 nt, Homo sapiens
cucauugccuuacuucuag

SEQ ID NO: 1428729 - RNA, 19 nt, Homo sapiens
ucagauugccuuauuuacu

SEQ ID NO: 1428730 - RNA, 19 nt, Homo sapiens
ggcuuaggcaggagaauug

SEQ ID NO: 1428731 - RNA, 19 nt, Homo sapiens
ugaaacccuguaucaacua

SEQ ID NO: 1428732 - RNA, 19 nt, Homo sapiens
agaccagccugcccaacau

SEQ ID NO: 1428733 - RNA, 19 nt, Homo sapiens
ccagaggucaggaguugga

SEQ ID NO: 1428734 - RNA, 19 nt, Homo sapiens
uccaaagaccuaaacaaug

SEQ ID NO: 1428735 - RNA, 19 nt, Homo sapiens
ugagacaggagaauugcuu

SEQ ID NO: 1428736 - RNA, 19 nt, Homo sapiens
gugacuauacccugauuuc

SEQ ID NO: 1428737 - RNA, 19 nt, Homo sapiens
gaccuaaacaauguaaagu

SEQ ID NO: 1428738 - RNA, 19 nt, Homo sapiens
auacuuaccucagggacau

SEQ ID NO: 1428739 - RNA, 19 nt, Homo sapiens
gcucgacggccuagaagag

SEQ ID NO: 1428740 - RNA, 19 nt, Homo sapiens
gacauaugcagauccaaag

SEQ ID NO: 1428741 - RNA, 19 nt, Homo sapiens
gagauugugccacuacacu

SEQ ID NO: 1428742 - RNA, 19 nt, Homo sapiens
gcugcucgacggccuagaa

SEQ ID NO: 1428743 - RNA, 19 nt, Homo sapiens
cagccugggugaugaagac

SEQ ID NO: 1428744 - RNA, 19 nt, Homo sapiens
acucaacguuguuacuaag

SEQ ID NO: 1428745 - RNA, 19 nt, Homo sapiens
gaagcggagguugcaguga

SEQ ID NO: 1428746 - RNA, 19 nt, Homo sapiens
acaggagaauugcuugaac

SEQ ID NO: 1428747 - RNA, 19 nt, Homo sapiens
augcagauccaaagaccua

SEQ ID NO: 1428748 - RNA, 19 nt, Homo sapiens
ggcaggagaauugcuugaa

SEQ ID NO: 1428749 - RNA, 19 nt, Homo sapiens
augaaacccuguaucaacu

SEQ ID NO: 1428750 - RNA, 19 nt, Homo sapiens
ucagggacauaugcagauc

SEQ ID NO: 1428751 - RNA, 19 nt, Homo sapiens
ccaaggagguggaggagaa

SEQ ID NO: 1428752 - RNA, 19 nt, Homo sapiens
caacuaugaugucaaugug

SEQ ID NO: 1428753 - RNA, 19 nt, Homo sapiens
gcaacuaugaugucaaugu

SEQ ID NO: 1428754 - RNA, 19 nt, Homo sapiens
gaaaggccagcacuucaug

SEQ ID NO: 1428755 - RNA, 19 nt, Homo sapiens
gcugcugccucaauaaauc

SEQ ID NO: 1428756 - RNA, 19 nt, Homo sapiens
cggcaacuaugaugucaau

SEQ ID NO: 1428757 - RNA, 19 nt, Homo sapiens
ggaaaggccagcacuucau

SEQ ID NO: 1428758 - RNA, 19 nt, Homo sapiens
gggaaaggccagcacuuca

SEQ ID NO: 1428759 - RNA, 19 nt, Homo sapiens
gguggacggugucuacuac

SEQ ID NO: 1428760 - RNA, 19 nt, Homo sapiens
gcgaggugcugcugguagu

SEQ ID NO: 1428761 - RNA, 19 nt, Homo sapiens
ugccgcugcugccucaaua

SEQ ID NO: 1428762 - RNA, 19 nt, Homo sapiens
ccgaugagaucugcaagag

SEQ ID NO: 1428763 - RNA, 19 nt, Homo sapiens
acuaugaugucaaugugau

SEQ ID NO: 1428764 - RNA, 19 nt, Homo sapiens
gcaccggcaacuaugaugu

SEQ ID NO: 1428765 - RNA, 19 nt, Homo sapiens
ggaggcugccgaugagauc

SEQ ID NO: 1428766 - RNA, 19 nt, Homo sapiens
ccgcugcugccucaauaaa

SEQ ID NO: 1428767 - RNA, 19 nt, Homo sapiens
gaggugcugcugguaguga

SEQ ID NO: 1428768 - RNA, 19 nt, Homo sapiens
uggacggugucuacuacaa

SEQ ID NO: 1428769 - RNA, 19 nt, Homo sapiens
ggacggugucuacuacaac

SEQ ID NO: 1428770 - RNA, 19 nt, Homo sapiens
guaacucucugaaagauga

SEQ ID NO: 1428771 - RNA, 19 nt, Homo sapiens
gaaccaaacgcagcacuua

SEQ ID NO: 1428772 - RNA, 19 nt, Homo sapiens
caaaucaacuggaccuugu

SEQ ID NO: 1428773 - RNA, 19 nt, Homo sapiens
gaucaaggaauucaagaaa

SEQ ID NO: 1428774 - RNA, 19 nt, Homo sapiens
cgaaugugaucaaggaauu

SEQ ID NO: 1428775 - RNA, 19 nt, Homo sapiens
gggcgaaugugaucaagga

SEQ ID NO: 1428776 - RNA, 19 nt, Homo sapiens
gaagagguguuggacuguu

SEQ ID NO: 1428777 - RNA, 19 nt, Homo sapiens
ggaaaguggagacaaauca

SEQ ID NO: 1428778 - RNA, 19 nt, Homo sapiens
ucaaggaauucaagaaagu

SEQ ID NO: 1428779 - RNA, 19 nt, Homo sapiens
aaacuuugccgcuugcuaa

SEQ ID NO: 1428780 - RNA, 19 nt, Homo sapiens
ggucucggcuuguacauac

SEQ ID NO: 1428781 - RNA, 19 nt, Homo sapiens
gaaaguggagacaaaucaa

SEQ ID NO: 1428782 - RNA, 19 nt, Homo sapiens
gcaaauacccgaggaacca

SEQ ID NO: 1428783 - RNA, 19 nt, Homo sapiens
gcaguaggacggugguuug

SEQ ID NO: 1428784 - RNA, 19 nt, Homo sapiens
guguuggacuguuuacauu

SEQ ID NO: 1428785 - RNA, 19 nt, Homo sapiens
ggguaacucucugaaagau

SEQ ID NO: 1428786 - RNA, 19 nt, Homo sapiens
aagagguguuggacuguuu

SEQ ID NO: 1428787 - RNA, 19 nt, Homo sapiens
gcacuuaauggguaacucu

SEQ ID NO: 1428788 - RNA, 19 nt, Homo sapiens
ccaaacgcagcacuuaaug

SEQ ID NO: 1428789 - RNA, 19 nt, Homo sapiens
ccagauggacagcaaauac

SEQ ID NO: 1428790 - RNA, 19 nt, Homo sapiens
guaaggagaaaggaaaaua

SEQ ID NO: 1428791 - RNA, 19 nt, Homo sapiens
ucccaaguguauccacaaa

SEQ ID NO: 1428792 - RNA, 19 nt, Homo sapiens
caaggaauucaagaaaguu

SEQ ID NO: 1428793 - RNA, 19 nt, Homo sapiens
uggcguccuuugucaagaa

SEQ ID NO: 1428794 - RNA, 19 nt, Homo sapiens
gcuguugggcauccucauu

SEQ ID NO: 1428795 - RNA, 19 nt, Homo sapiens
uuacauugccagaggauca

SEQ ID NO: 1428796 - RNA, 19 nt, Homo sapiens
gguguuggacuguuuacau

SEQ ID NO: 1428797 - RNA, 19 nt, Homo sapiens
gaacguguuuguggggaaa

SEQ ID NO: 1428798 - RNA, 19 nt, Homo sapiens
cagaggaucacucccaagu

SEQ ID NO: 1428799 - RNA, 19 nt, Homo sapiens
gcgaaugugaucaaggaau

SEQ ID NO: 1428800 - RNA, 19 nt, Homo sapiens
acuacgcgcugaacguguu

SEQ ID NO: 1428801 - RNA, 19 nt, Homo sapiens
cgaggaaccaggcgcuguu

SEQ ID NO: 1428802 - RNA, 19 nt, Homo sapiens
gggaaaguggagacaaauc

SEQ ID NO: 1428803 - RNA, 19 nt, Homo sapiens
uaaaauuggugacaaaucc

SEQ ID NO: 1428804 - RNA, 19 nt, Homo sapiens
caaacgcagcacuuaaugg

SEQ ID NO: 1428805 - RNA, 19 nt, Homo sapiens
aaccaaacgcagcacuuaa

SEQ ID NO: 1428806 - RNA, 19 nt, Homo sapiens
guuggacuguuuacauugc

SEQ ID NO: 1428807 - RNA, 19 nt, Homo sapiens
agaugagccucugcuggaa

SEQ ID NO: 1428808 - RNA, 19 nt, Homo sapiens
auggguaacucucugaaag

SEQ ID NO: 1428809 - RNA, 19 nt, Homo sapiens
gaaauccgcugauggugaa

SEQ ID NO: 1428810 - RNA, 19 nt, Homo sapiens
gaacagcaacuauuacaug

SEQ ID NO: 1428811 - RNA, 19 nt, Homo sapiens
gagcagcaguuucagagaa

SEQ ID NO: 1428812 - RNA, 19 nt, Homo sapiens
gacaaauccuucacccuaa

SEQ ID NO: 1428813 - RNA, 19 nt, Homo sapiens
gcacugggauuggacauau

SEQ ID NO: 1428814 - RNA, 19 nt, Homo sapiens
ggccaugacucgcuuauuc

SEQ ID NO: 1428815 - RNA, 19 nt, Homo sapiens
aaaggcaucucucacguuu

SEQ ID NO: 1428816 - RNA, 19 nt, Homo sapiens
ccagcuggauccuuccuua

SEQ ID NO: 1428817 - RNA, 19 nt, Homo sapiens
gagggaggccugcaacuuu

SEQ ID NO: 1428818 - RNA, 19 nt, Homo sapiens
cagcaacuauuacaugaug

SEQ ID NO: 1428819 - RNA, 19 nt, Homo sapiens
uguuugacguccacaauua

SEQ ID NO: 1428820 - RNA, 19 nt, Homo sapiens
ccagaucccuguucagcaa

SEQ ID NO: 1428821 - RNA, 19 nt, Homo sapiens
caugaucgcugguuugaca

SEQ ID NO: 1428822 - RNA, 19 nt, Homo sapiens
uggagaagaucaaagaguu

SEQ ID NO: 1428823 - RNA, 19 nt, Homo sapiens
ggacacaugugggaguuca

SEQ ID NO: 1428824 - RNA, 19 nt, Homo sapiens
cgacuuugcugaugggaau

SEQ ID NO: 1428825 - RNA, 19 nt, Homo sapiens
ggacggggcugaaguggaa

SEQ ID NO: 1428826 - RNA, 19 nt, Homo sapiens
acaauuacccggacuaugu

SEQ ID NO: 1428827 - RNA, 19 nt, Homo sapiens
gaacaucuggcagcucuga

SEQ ID NO: 1428828 - RNA, 19 nt, Homo sapiens
ggaauaagggugaaauugc

SEQ ID NO: 1428829 - RNA, 19 nt, Homo sapiens
cagcuggccucuccaagga

SEQ ID NO: 1428830 - RNA, 19 nt, Homo sapiens
gcaccaggcucugcugaag

SEQ ID NO: 1428831 - RNA, 19 nt, Homo sapiens
uaccacggcuggcuucuug

SEQ ID NO: 1428832 - RNA, 19 nt, Homo sapiens
gugcggacaucccugaaga

SEQ ID NO: 1428833 - RNA, 19 nt, Homo sapiens
acccgaugcuguucaguua

SEQ ID NO: 1428834 - RNA, 19 nt, Homo sapiens
ggauguggccucccuguuc

SEQ ID NO: 1428835 - RNA, 19 nt, Homo sapiens
ccuggugggcguccaauua

SEQ ID NO: 1428836 - RNA, 19 nt, Homo sapiens
ccacauccaggccaauaaa

SEQ ID NO: 1428837 - RNA, 19 nt, Homo sapiens
gggauggcaugaucaccuu

SEQ ID NO: 1428838 - RNA, 19 nt, Homo sapiens
caacagacggccacugcaa

SEQ ID NO: 1428839 - RNA, 19 nt, Homo sapiens
ggagaagaucaaagaguug

SEQ ID NO: 1428840 - RNA, 19 nt, Homo sapiens
caugauggacuuccuguau

SEQ ID NO: 1428841 - RNA, 19 nt, Homo sapiens
uaccugcgcucccgaaauc

SEQ ID NO: 1428842 - RNA, 19 nt, Homo sapiens
gguuaugguguuucuuaua

SEQ ID NO: 1428843 - RNA, 19 nt, Homo sapiens
gcugccaccucucuucaga

SEQ ID NO: 1428844 - RNA, 19 nt, Homo sapiens
gggccaugaucgcugguuu

SEQ ID NO: 1428845 - RNA, 19 nt, Homo sapiens
aacagcaacuauuacauga

SEQ ID NO: 1428846 - RNA, 19 nt, Homo sapiens
guuccauucucccuauuug

SEQ ID NO: 1428847 - RNA, 19 nt, Homo sapiens
ugaggcugcuucuguccua

SEQ ID NO: 1428848 - RNA, 19 nt, Homo sapiens
ccuuaggacugauggagaa

SEQ ID NO: 1428849 - RNA, 19 nt, Homo sapiens
gacauccaccgacuucuga

SEQ ID NO: 1428850 - RNA, 19 nt, Homo sapiens
ugauggacuuccuguaugu

SEQ ID NO: 1428851 - RNA, 19 nt, Homo sapiens
acaaauccuucacccuaau

SEQ ID NO: 1428852 - RNA, 19 nt, Homo sapiens
acuauuacaugauggacuu

SEQ ID NO: 1428853 - RNA, 19 nt, Homo sapiens
gauucgggccugcugauga

SEQ ID NO: 1428854 - RNA, 19 nt, Homo sapiens
aauucugccugacuuauga

SEQ ID NO: 1428855 - RNA, 19 nt, Homo sapiens
gaucuugucugaaaauguc

SEQ ID NO: 1428856 - RNA, 19 nt, Homo sapiens
gcaacuauuacaugaugga

SEQ ID NO: 1428857 - RNA, 19 nt, Homo sapiens
ccagccagaucccuguuca

SEQ ID NO: 1428858 - RNA, 19 nt, Homo sapiens
cagcugggcuacucaacag

SEQ ID NO: 1428859 - RNA, 19 nt, Homo sapiens
caauuacccggacuauguu

SEQ ID NO: 1428860 - RNA, 19 nt, Homo sapiens
uggugaacagcaacuauua

SEQ ID NO: 1428861 - RNA, 19 nt, Homo sapiens
ucacguuucuggaaugacu

SEQ ID NO: 1428862 - RNA, 19 nt, Homo sapiens
caugaucaccuuccacauc

SEQ ID NO: 1428863 - RNA, 19 nt, Homo sapiens
aggcaucucucacguuucu

SEQ ID NO: 1428864 - RNA, 19 nt, Homo sapiens
gcucugcccaguacgagaa

SEQ ID NO: 1428865 - RNA, 19 nt, Homo sapiens
ggccugcgcuccuggaaaa

SEQ ID NO: 1428866 - RNA, 19 nt, Homo sapiens
gcccugaggcugcuucugu

SEQ ID NO: 1428867 - RNA, 19 nt, Homo sapiens
ggacaggggcaacugguuu

SEQ ID NO: 1428868 - RNA, 19 nt, Homo sapiens
gcuggccucuccaaggaau

SEQ ID NO: 1428869 - RNA, 19 nt, Homo sapiens
ccauggaggacaaagagaa

SEQ ID NO: 1428870 - RNA, 19 nt, Homo sapiens
agggaggccugcaacuuug

SEQ ID NO: 1428871 - RNA, 19 nt, Homo sapiens
ccagaucgccuugcaacug

SEQ ID NO: 1428872 - RNA, 19 nt, Homo sapiens
cuaaucgucuucucuaacg

SEQ ID NO: 1428873 - RNA, 19 nt, Homo sapiens
uaugcaagcgggagauuug

SEQ ID NO: 1428874 - RNA, 19 nt, Homo sapiens
uccaugcccuccuccugua

SEQ ID NO: 1428875 - RNA, 19 nt, Homo sapiens
gauggugaacagcaacuau

SEQ ID NO: 1428876 - RNA, 19 nt, Homo sapiens
ggugggaggaauuugugua

SEQ ID NO: 1428877 - RNA, 19 nt, Homo sapiens
ucagggccauggaggacaa

SEQ ID NO: 1428878 - RNA, 19 nt, Homo sapiens
caggacacaugugggaguu

SEQ ID NO: 1428879 - RNA, 19 nt, Homo sapiens
gugaacagcaacuauuaca

SEQ ID NO: 1428880 - RNA, 19 nt, Homo sapiens
gauccacuccuccaucucu

SEQ ID NO: 1428881 - RNA, 19 nt, Homo sapiens
gggaggaauuuguguaccu

SEQ ID NO: 1428882 - RNA, 19 nt, Homo sapiens
cugcugaugaccaugguua

SEQ ID NO: 1428883 - RNA, 19 nt, Homo sapiens
caauucugccugacuuaug

SEQ ID NO: 1428884 - RNA, 19 nt, Homo sapiens
gccaugaucgcugguuuga

SEQ ID NO: 1428885 - RNA, 19 nt, Homo sapiens
ggacuuccuguaugucaca

SEQ ID NO: 1428886 - RNA, 19 nt, Homo sapiens
ugacuggugggaggaauuu

SEQ ID NO: 1428887 - RNA, 19 nt, Homo sapiens
cauccaggccaauaaagau

SEQ ID NO: 1428888 - RNA, 19 nt, Homo sapiens
caaggaauaagggugaaau

SEQ ID NO: 1428889 - RNA, 19 nt, Homo sapiens
gagaagacggacccacagu

SEQ ID NO: 1428890 - RNA, 19 nt, Homo sapiens
ggugggcguccaauuaugu

SEQ ID NO: 1428891 - RNA, 19 nt, Homo sapiens
cuuaugcucugcccaguac

SEQ ID NO: 1428892 - RNA, 19 nt, Homo sapiens
uaggacugauggagaagau

SEQ ID NO: 1428893 - RNA, 19 nt, Homo sapiens
ucagcaaaugcaucuguuu

SEQ ID NO: 1428894 - RNA, 19 nt, Homo sapiens
gaguugaccgccaccuguu

SEQ ID NO: 1428895 - RNA, 19 nt, Homo sapiens
cgagggaggccugcaacuu

SEQ ID NO: 1428896 - RNA, 19 nt, Homo sapiens
ggagcagcaguuucagaga

SEQ ID NO: 1428897 - RNA, 19 nt, Homo sapiens
ucucucacguuucuggaau

SEQ ID NO: 1428898 - RNA, 19 nt, Homo sapiens
uccaaggccucaaugacau

SEQ ID NO: 1428899 - RNA, 19 nt, Homo sapiens
ucucacguuucuggaauga

SEQ ID NO: 1428900 - RNA, 19 nt, Homo sapiens
cccuaaucgucuucucuaa

SEQ ID NO: 1428901 - RNA, 19 nt, Homo sapiens
gcagcaguuucagagaauc

SEQ ID NO: 1428902 - RNA, 19 nt, Homo sapiens
ccgaucagcggacccuuga

SEQ ID NO: 1428903 - RNA, 19 nt, Homo sapiens
ggacaccgugcgcaaguac

SEQ ID NO: 1428904 - RNA, 19 nt, Homo sapiens
ggccaauaaagauguguga

SEQ ID NO: 1428905 - RNA, 19 nt, Homo sapiens
ggucagggaaggagaacuc

SEQ ID NO: 1428906 - RNA, 19 nt, Homo sapiens
augguuaugguguuucuua

SEQ ID NO: 1428907 - RNA, 19 nt, Homo sapiens
ccacaauuacccggacuau

SEQ ID NO: 1428908 - RNA, 19 nt, Homo sapiens
guucagcaaaugcaucugu

SEQ ID NO: 1428909 - RNA, 19 nt, Homo sapiens
ccaagaaccugaacuauga

SEQ ID NO: 1428910 - RNA, 19 nt, Homo sapiens
gagaugauguggaggauuu

SEQ ID NO: 1428911 - RNA, 19 nt, Homo sapiens
guuaaagccugaacacaga

SEQ ID NO: 1428912 - RNA, 19 nt, Homo sapiens
cagacgggcuguaugagua

SEQ ID NO: 1428913 - RNA, 19 nt, Homo sapiens
ggacauggccaccguguuc

SEQ ID NO: 1428914 - RNA, 19 nt, Homo sapiens
guuccugugucucccaaua

SEQ ID NO: 1428915 - RNA, 19 nt, Homo sapiens
ccugaacuaugacaccuuu

SEQ ID NO: 1428916 - RNA, 19 nt, Homo sapiens
gggaguaauuggccucauc

SEQ ID NO: 1428917 - RNA, 19 nt, Homo sapiens
gcaaggagaguggguguuc

SEQ ID NO: 1428918 - RNA, 19 nt, Homo sapiens
gcccaggguucccaguuug

SEQ ID NO: 1428919 - RNA, 19 nt, Homo sapiens
gcaacacuguggucauggu

SEQ ID NO: 1428920 - RNA, 19 nt, Homo sapiens
caugugguauuucggauca

SEQ ID NO: 1428921 - RNA, 19 nt, Homo sapiens
gagcgccaccuacugcauu

SEQ ID NO: 1428922 - RNA, 19 nt, Homo sapiens
cggcaacacuguggucaug

SEQ ID NO: 1428923 - RNA, 19 nt, Homo sapiens
caauaaacucucugaccaa

SEQ ID NO: 1428924 - RNA, 19 nt, Homo sapiens
uguccugccucuccaagaa

SEQ ID NO: 1428925 - RNA, 19 nt, Homo sapiens
uggccgaggugauccagaa

SEQ ID NO: 1428926 - RNA, 19 nt, Homo sapiens
ggagaccgggaccaucuga

SEQ ID NO: 1428927 - RNA, 19 nt, Homo sapiens
gugaaugggaagugguuaa

SEQ ID NO: 1428928 - RNA, 19 nt, Homo sapiens
caucacaggagagaacuug

SEQ ID NO: 1428929 - RNA, 19 nt, Homo sapiens
ugaaugggaagugguuaaa

SEQ ID NO: 1428930 - RNA, 19 nt, Homo sapiens
uccaagaaccugaacuaug

SEQ ID NO: 1428931 - RNA, 19 nt, Homo sapiens
uccaggccaugugguauuu

SEQ ID NO: 1428932 - RNA, 19 nt, Homo sapiens
ucuccaagaaccugaacua

SEQ ID NO: 1428933 - RNA, 19 nt, Homo sapiens
ccacauucuccuuccuuga

SEQ ID NO: 1428934 - RNA, 19 nt, Homo sapiens
uccugugucucccaauaaa

SEQ ID NO: 1428935 - RNA, 19 nt, Homo sapiens
gcugagcgcaagacgacuu

SEQ ID NO: 1428936 - RNA, 19 nt, Homo sapiens
uaaagccugaacacagaaa

SEQ ID NO: 1428937 - RNA, 19 nt, Homo sapiens
agcccaggguucccaguuu

SEQ ID NO: 1428938 - RNA, 19 nt, Homo sapiens
ggaggucugccaggacaug

SEQ ID NO: 1428939 - RNA, 19 nt, Homo sapiens
aaugggaagugguuaaagc

SEQ ID NO: 1428940 - RNA, 19 nt, Homo sapiens
cuucggaacgcccauucua

SEQ ID NO: 1428941 - RNA, 19 nt, Homo sapiens
ucccgggaauccugaaugu

SEQ ID NO: 1428942 - RNA, 19 nt, Homo sapiens
ccgaggugauccagaagca

SEQ ID NO: 1428943 - RNA, 19 nt, Homo sapiens
ccagacgggcuguaugagu

SEQ ID NO: 1428944 - RNA, 19 nt, Homo sapiens
gagcccaugggaguaauug

SEQ ID NO: 1428945 - RNA, 19 nt, Homo sapiens
gcaggacgcucucuucuug

SEQ ID NO: 1428946 - RNA, 19 nt, Homo sapiens
ccaauaaagucucaaaucu

SEQ ID NO: 1428947 - RNA, 19 nt, Homo sapiens
gcaauggcagccugacuuu

SEQ ID NO: 1428948 - RNA, 19 nt, Homo sapiens
ccacuacuccuggugcuua

SEQ ID NO: 1428949 - RNA, 19 nt, Homo sapiens
caaccacccuugccacuac

SEQ ID NO: 1428950 - RNA, 19 nt, Homo sapiens
gagcaccaacaaaguaauu

SEQ ID NO: 1428951 - RNA, 19 nt, Homo sapiens
guucaacucugagcuguuc

SEQ ID NO: 1428952 - RNA, 19 nt, Homo sapiens
ugucaaaacuacugcaaua

SEQ ID NO: 1428953 - RNA, 19 nt, Homo sapiens
gagcaggcgugcggaacuu

SEQ ID NO: 1428954 - RNA, 19 nt, Homo sapiens
caaaacuacugcaauaugu

SEQ ID NO: 1428955 - RNA, 19 nt, Homo sapiens
ggugcuggcucugcuguga

SEQ ID NO: 1428956 - RNA, 19 nt, Homo sapiens
gaccaugcccgugaccuuu

SEQ ID NO: 1428957 - RNA, 19 nt, Homo sapiens
gugcggaacuuuuagcaaa

SEQ ID NO: 1428958 - RNA, 19 nt, Homo sapiens
ggacaccaggguacacaug

SEQ ID NO: 1428959 - RNA, 19 nt, Homo sapiens
ccacugcggacccaugcua

SEQ ID NO: 1428960 - RNA, 19 nt, Homo sapiens
acaugagccuucggaggua

SEQ ID NO: 1428961 - RNA, 19 nt, Homo sapiens
gacccuagccagccuaucu

SEQ ID NO: 1428962 - RNA, 19 nt, Homo sapiens
gacaccaggguacacauga

SEQ ID NO: 1428963 - RNA, 19 nt, Homo sapiens
ucccagcauuuccuccuuu

SEQ ID NO: 1428964 - RNA, 19 nt, Homo sapiens
gcugccgguucaacucuga

SEQ ID NO: 1428965 - RNA, 19 nt, Homo sapiens
cugcagagagccaaucaga

SEQ ID NO: 1428966 - RNA, 19 nt, Homo sapiens
cccaauaaagucucaaauc

SEQ ID NO: 1428967 - RNA, 19 nt, Homo sapiens
ucgagcaccaacaaaguaa

SEQ ID NO: 1428968 - RNA, 19 nt, Homo sapiens
ucugucagcuugcgcuucu

SEQ ID NO: 1428969 - RNA, 19 nt, Homo sapiens
caccuuggcgccagggaaa

SEQ ID NO: 1428970 - RNA, 19 nt, Homo sapiens
gaagauacuuugcauugua

SEQ ID NO: 1428971 - RNA, 19 nt, Homo sapiens
gagaagcuccuguuuauua

SEQ ID NO: 1428972 - RNA, 19 nt, Homo sapiens
gaaagggacuuggaaauuc

SEQ ID NO: 1428973 - RNA, 19 nt, Homo sapiens
gaagggcuguggucuauga

SEQ ID NO: 1428974 - RNA, 19 nt, Homo sapiens
caaagguucuccuauguuu

SEQ ID NO: 1428975 - RNA, 19 nt, Homo sapiens
cagagaagcuccuguuuau

SEQ ID NO: 1428976 - RNA, 19 nt, Homo sapiens
gaaagugccucucuccaau

SEQ ID NO: 1428977 - RNA, 19 nt, Homo sapiens
gauguugggucguaucuuu

SEQ ID NO: 1428978 - RNA, 19 nt, Homo sapiens
caagagaacuggaagauac

SEQ ID NO: 1428979 - RNA, 19 nt, Homo sapiens
gaaacuaccuuugcugaau

SEQ ID NO: 1428980 - RNA, 19 nt, Homo sapiens
ggaguucucuuucagcaaa

SEQ ID NO: 1428981 - RNA, 19 nt, Homo sapiens
cuacacagcuuguugaaga

SEQ ID NO: 1428982 - RNA, 19 nt, Homo sapiens
gaaaccacaucgugcauug

SEQ ID NO: 1428983 - RNA, 19 nt, Homo sapiens
gaagugccuuucauugauu

SEQ ID NO: 1428984 - RNA, 19 nt, Homo sapiens
ggaagugccuuucauugau

SEQ ID NO: 1428985 - RNA, 19 nt, Homo sapiens
gcuccaagaugauggcaua

SEQ ID NO: 1428986 - RNA, 19 nt, Homo sapiens
gaacaugaaggcugaacua

SEQ ID NO: 1428987 - RNA, 19 nt, Homo sapiens
gagugaagcuacuguguga

SEQ ID NO: 1428988 - RNA, 19 nt, Homo sapiens
gagccgagaugaaagagaa

SEQ ID NO: 1428989 - RNA, 19 nt, Homo sapiens
ggucguaucuuugaaguug

SEQ ID NO: 1428990 - RNA, 19 nt, Homo sapiens
caaaugagaaucugcauga

SEQ ID NO: 1428991 - RNA, 19 nt, Homo sapiens
cacaagagaugaagauguu

SEQ ID NO: 1428992 - RNA, 19 nt, Homo sapiens
caaauggaguucucuuuca

SEQ ID NO: 1428993 - RNA, 19 nt, Homo sapiens
caaagaagacacugagauu

SEQ ID NO: 1428994 - RNA, 19 nt, Homo sapiens
cagcaaagguucuccuaug

SEQ ID NO: 1428995 - RNA, 19 nt, Homo sapiens
guaagagccuggucaaucu

SEQ ID NO: 1428996 - RNA, 19 nt, Homo sapiens
cagcaucucuucucuguuc

SEQ ID NO: 1428997 - RNA, 19 nt, Homo sapiens
caacacgucuugcuugaca

SEQ ID NO: 1428998 - RNA, 19 nt, Homo sapiens
acuccaagcuucuucauuu

SEQ ID NO: 1428999 - RNA, 19 nt, Homo sapiens
ccagagaagcuccuguuua

SEQ ID NO: 1429000 - RNA, 19 nt, Homo sapiens
cuaaagaccacguauauau

SEQ ID NO: 1429001 - RNA, 19 nt, Homo sapiens
gcuaaugcccucagccaua

SEQ ID NO: 1429002 - RNA, 19 nt, Homo sapiens
gaccuagccuuguuucuca

SEQ ID NO: 1429003 - RNA, 19 nt, Homo sapiens
gcucuacguuggucacaaa

SEQ ID NO: 1429004 - RNA, 19 nt, Homo sapiens
aaaaugaucuucaggauga

SEQ ID NO: 1429005 - RNA, 19 nt, Homo sapiens
uuaaucggcuccaagauga

SEQ ID NO: 1429006 - RNA, 19 nt, Homo sapiens
cuacguuggucacaaauga

SEQ ID NO: 1429007 - RNA, 19 nt, Homo sapiens
caugaaggcugaacuacug

SEQ ID NO: 1429008 - RNA, 19 nt, Homo sapiens
ggaagcagaccacagaaga

SEQ ID NO: 1429009 - RNA, 19 nt, Homo sapiens
ggaagauacuuugcauugu

SEQ ID NO: 1429010 - RNA, 19 nt, Homo sapiens
gcaagagaacuggaagaua

SEQ ID NO: 1429011 - RNA, 19 nt, Homo sapiens
cuuaaggccucauuaguga

SEQ ID NO: 1429012 - RNA, 19 nt, Homo sapiens
aaacuaccuuugcugaauu

SEQ ID NO: 1429013 - RNA, 19 nt, Homo sapiens
gcaaauggaguucucuuuc

SEQ ID NO: 1429014 - RNA, 19 nt, Homo sapiens
ggacgaacaugaggaacug

SEQ ID NO: 1429015 - RNA, 19 nt, Homo sapiens
cuaaugcccucagccauaa

SEQ ID NO: 1429016 - RNA, 19 nt, Homo sapiens
guggagagcuggcuaaugc

SEQ ID NO: 1429017 - RNA, 19 nt, Homo sapiens
gaugauggcauaaagcuau

SEQ ID NO: 1429018 - RNA, 19 nt, Homo sapiens
gauugugccugggauuuaa

SEQ ID NO: 1429019 - RNA, 19 nt, Homo sapiens
caucaaaggacgaacauga

SEQ ID NO: 1429020 - RNA, 19 nt, Homo sapiens
cagaugcucuccugcagaa

SEQ ID NO: 1429021 - RNA, 19 nt, Homo sapiens
gagacaagcaaguuugauu

SEQ ID NO: 1429022 - RNA, 19 nt, Homo sapiens
ccacaaagccacaagagau

SEQ ID NO: 1429023 - RNA, 19 nt, Homo sapiens
agaggaaccuagagaauuc

SEQ ID NO: 1429024 - RNA, 19 nt, Homo sapiens
gaagaaacagggaauguac

SEQ ID NO: 1429025 - RNA, 19 nt, Homo sapiens
aguaucagcuggaggaauu

SEQ ID NO: 1429026 - RNA, 19 nt, Homo sapiens
gugucaagaugcuauguaa

SEQ ID NO: 1429027 - RNA, 19 nt, Homo sapiens
gaacuucagcucuaacaag

SEQ ID NO: 1429028 - RNA, 19 nt, Homo sapiens
gcagucacauccuugaaag

SEQ ID NO: 1429029 - RNA, 19 nt, Homo sapiens
guauuacgaucuccaguca

SEQ ID NO: 1429030 - RNA, 19 nt, Homo sapiens
gcaaagguucuccuauguu

SEQ ID NO: 1429031 - RNA, 19 nt, Homo sapiens
uagacgagcuagaagaaga

SEQ ID NO: 1429032 - RNA, 19 nt, Homo sapiens
gaaaugcaaucugacaacu

SEQ ID NO: 1429033 - RNA, 19 nt, Homo sapiens
gcaagaacagccugagaga

SEQ ID NO: 1429034 - RNA, 19 nt, Homo sapiens
ccaagaugauggcauaaag

SEQ ID NO: 1429035 - RNA, 19 nt, Homo sapiens
uaccuuugcugaauugauu

SEQ ID NO: 1429036 - RNA, 19 nt, Homo sapiens
gcccucagccauaaucaua

SEQ ID NO: 1429037 - RNA, 19 nt, Homo sapiens
gagucaaguuccuguguga

SEQ ID NO: 1429038 - RNA, 19 nt, Homo sapiens
gagcuagaccugaguaaca

SEQ ID NO: 1429039 - RNA, 19 nt, Homo sapiens
ugaaagggacuuggaaauu

SEQ ID NO: 1429040 - RNA, 19 nt, Homo sapiens
aagaagauguugggucgua

SEQ ID NO: 1429041 - RNA, 19 nt, Homo sapiens
ggacuccagugguucuguu

SEQ ID NO: 1429042 - RNA, 19 nt, Homo sapiens
ccacguauauauccguaau

SEQ ID NO: 1429043 - RNA, 19 nt, Homo sapiens
caaugaaucugaccucacu

SEQ ID NO: 1429044 - RNA, 19 nt, Homo sapiens
uugaaucuguccuuucuuu

SEQ ID NO: 1429045 - RNA, 19 nt, Homo sapiens
aaacauagcaagagaacug

SEQ ID NO: 1429046 - RNA, 19 nt, Homo sapiens
agccgaaggugagguauua

SEQ ID NO: 1429047 - RNA, 19 nt, Homo sapiens
gcacugggcaaauggaguu

SEQ ID NO: 1429048 - RNA, 19 nt, Homo sapiens
gaagcagaccacagaagaa

SEQ ID NO: 1429049 - RNA, 19 nt, Homo sapiens
ccacagcagagguagauuu

SEQ ID NO: 1429050 - RNA, 19 nt, Homo sapiens
cuacggguauauuucauga

SEQ ID NO: 1429051 - RNA, 19 nt, Homo sapiens
gccagcaucucuucucugu

SEQ ID NO: 1429052 - RNA, 19 nt, Homo sapiens
uaagguacaugaaggaaac

SEQ ID NO: 1429053 - RNA, 19 nt, Homo sapiens
uaucucagcugccauaaaa

SEQ ID NO: 1429054 - RNA, 19 nt, Homo sapiens
ggagaagaguuagguaagg

SEQ ID NO: 1429055 - RNA, 19 nt, Homo sapiens
caagugaaguugagaaaau

SEQ ID NO: 1429056 - RNA, 19 nt, Homo sapiens
ucugagagcuuggaugaug

SEQ ID NO: 1429057 - RNA, 19 nt, Homo sapiens
ccaagaagaaccagagaug

SEQ ID NO: 1429058 - RNA, 19 nt, Homo sapiens
caagugugccuuagagaga

SEQ ID NO: 1429059 - RNA, 19 nt, Homo sapiens
ggaaacuaccuuugcugaa

SEQ ID NO: 1429060 - RNA, 19 nt, Homo sapiens
aagaagacacugagauuga

SEQ ID NO: 1429061 - RNA, 19 nt, Homo sapiens
aagcuccuguuuauuauug

SEQ ID NO: 1429062 - RNA, 19 nt, Homo sapiens
gccuaaagaccacguauau

SEQ ID NO: 1429063 - RNA, 19 nt, Homo sapiens
gagacacuuugaugacuca

SEQ ID NO: 1429064 - RNA, 19 nt, Homo sapiens
gggacgaccuacggguaua

SEQ ID NO: 1429065 - RNA, 19 nt, Homo sapiens
aucaagaccugguuuguga

SEQ ID NO: 1429066 - RNA, 19 nt, Homo sapiens
gaagaccaccuuggcaaug

SEQ ID NO: 1429067 - RNA, 19 nt, Homo sapiens
gccaagauccaaaccaaga

SEQ ID NO: 1429068 - RNA, 19 nt, Homo sapiens
gcccagggaugccaagauc

SEQ ID NO: 1429069 - RNA, 19 nt, Homo sapiens
gccaagauccaaaccaaga

SEQ ID NO: 1429070 - RNA, 19 nt, Homo sapiens
gcaauaaucuucaagguaa

SEQ ID NO: 1429071 - RNA, 19 nt, Homo sapiens
ggacugaucuuggcaauaa

SEQ ID NO: 1429072 - RNA, 19 nt, Homo sapiens
ggaaauggguguuagguaa

SEQ ID NO: 1429073 - RNA, 19 nt, Homo sapiens
gaacaucuuugccauuaug

SEQ ID NO: 1429074 - RNA, 19 nt, Homo sapiens
gccaagcccuaaaugauua

SEQ ID NO: 1429075 - RNA, 19 nt, Homo sapiens
aaaguugucuugagaauug

SEQ ID NO: 1429076 - RNA, 19 nt, Homo sapiens
gaagaacccugacuguaca

SEQ ID NO: 1429077 - RNA, 19 nt, Homo sapiens
caccagagcugagaacuuu

SEQ ID NO: 1429078 - RNA, 19 nt, Homo sapiens
gaagcggugucaauauuug

SEQ ID NO: 1429079 - RNA, 19 nt, Homo sapiens
gaaaugucccucucucgua

SEQ ID NO: 1429080 - RNA, 19 nt, Homo sapiens
ucuaaagacucucauacua

SEQ ID NO: 1429081 - RNA, 19 nt, Homo sapiens
caacaaagaaguucaagug

SEQ ID NO: 1429082 - RNA, 19 nt, Homo sapiens
ucaaguauuuccagaugua

SEQ ID NO: 1429083 - RNA, 19 nt, Homo sapiens
ggaaauacaacauguggaa

SEQ ID NO: 1429084 - RNA, 19 nt, Homo sapiens
caaagaaguucaagugucu

SEQ ID NO: 1429085 - RNA, 19 nt, Homo sapiens
ggucugcucuggucugaaa

SEQ ID NO: 1429086 - RNA, 19 nt, Homo sapiens
gcucacaucuacccucauu

SEQ ID NO: 1429087 - RNA, 19 nt, Homo sapiens
gaccucgugucaaagauua

SEQ ID NO: 1429088 - RNA, 19 nt, Homo sapiens
gagaggcugucgcagagua

SEQ ID NO: 1429089 - RNA, 19 nt, Homo sapiens
ucgaacaucuuugccauua

SEQ ID NO: 1429090 - RNA, 19 nt, Homo sapiens
uaucccagauuaauccuua

SEQ ID NO: 1429091 - RNA, 19 nt, Homo sapiens
gaagagagaagaggucauu

SEQ ID NO: 1429092 - RNA, 19 nt, Homo sapiens
ggaaggagaaucugguaaa

SEQ ID NO: 1429093 - RNA, 19 nt, Homo sapiens
gaacccugacuguacauua

SEQ ID NO: 1429094 - RNA, 19 nt, Homo sapiens
caagguaacgggcaucuaa

SEQ ID NO: 1429095 - RNA, 19 nt, Homo sapiens
uuaauagccugaaggauga

SEQ ID NO: 1429096 - RNA, 19 nt, Homo sapiens
gggcagaggugguucaucu

SEQ ID NO: 1429097 - RNA, 19 nt, Homo sapiens
gaaaacgccuugaaagaug

SEQ ID NO: 1429098 - RNA, 19 nt, Homo sapiens
gcacaggaaauggguguua

SEQ ID NO: 1429099 - RNA, 19 nt, Homo sapiens
ugucaaagauuauguccaa

SEQ ID NO: 1429100 - RNA, 19 nt, Homo sapiens
uaaagacucucauacuaag

SEQ ID NO: 1429101 - RNA, 19 nt, Homo sapiens
ucauaccucuguugcauaa

SEQ ID NO: 1429102 - RNA, 19 nt, Homo sapiens
ucauaaaguugucuugaga

SEQ ID NO: 1429103 - RNA, 19 nt, Homo sapiens
caaggugucuuucgguaau

SEQ ID NO: 1429104 - RNA, 19 nt, Homo sapiens
cuaaagacucucauacuaa

SEQ ID NO: 1429105 - RNA, 19 nt, Homo sapiens
gaaauggguguuagguaaa

SEQ ID NO: 1429106 - RNA, 19 nt, Homo sapiens
ggacuugaaugugggagaa

SEQ ID NO: 1429107 - RNA, 19 nt, Homo sapiens
uuuaauugcugucaggaua

SEQ ID NO: 1429108 - RNA, 19 nt, Homo sapiens
caccugagcuuggcagaaa

SEQ ID NO: 1429109 - RNA, 19 nt, Homo sapiens
gugaauagcaccauguuga

SEQ ID NO: 1429110 - RNA, 19 nt, Homo sapiens
ggaaacugcugaaagucau

SEQ ID NO: 1429111 - RNA, 19 nt, Homo sapiens
gguguuagguaaagaagau

SEQ ID NO: 1429112 - RNA, 19 nt, Homo sapiens
agaggaaacugcugaaagu

SEQ ID NO: 1429113 - RNA, 19 nt, Homo sapiens
aaaugucccucucucguaa

SEQ ID NO: 1429114 - RNA, 19 nt, Homo sapiens
ggaggaagccuuuguaagc

SEQ ID NO: 1429115 - RNA, 19 nt, Homo sapiens
agacuuaugcucuguguuu

SEQ ID NO: 1429116 - RNA, 19 nt, Homo sapiens
ugagaaacgugagccauga

SEQ ID NO: 1429117 - RNA, 19 nt, Homo sapiens
ggugguucaucucuugaua

SEQ ID NO: 1429118 - RNA, 19 nt, Homo sapiens
cugaagcggugucaauauu

SEQ ID NO: 1429119 - RNA, 19 nt, Homo sapiens
gaaagucauaccucuguug

SEQ ID NO: 1429120 - RNA, 19 nt, Homo sapiens
cgguauaaaucgaauguga

SEQ ID NO: 1429121 - RNA, 19 nt, Homo sapiens
uaugggacauuacgacuug

SEQ ID NO: 1429122 - RNA, 19 nt, Homo sapiens
ggcaauaaucuucaaggua

SEQ ID NO: 1429123 - RNA, 19 nt, Homo sapiens
ugagauacuuggaaauaca

SEQ ID NO: 1429124 - RNA, 19 nt, Homo sapiens
gagaauuggcaacaacaaa

SEQ ID NO: 1429125 - RNA, 19 nt, Homo sapiens
gagaauugcaggugaggaa

SEQ ID NO: 1429126 - RNA, 19 nt, Homo sapiens
aaucaaguauuuccagaug

SEQ ID NO: 1429127 - RNA, 19 nt, Homo sapiens
gagcaagaaugcgauugga

SEQ ID NO: 1429128 - RNA, 19 nt, Homo sapiens
gaucuuggcaauaaucuuc

SEQ ID NO: 1429129 - RNA, 19 nt, Homo sapiens
guacuuaccaugucugcuu

SEQ ID NO: 1429130 - RNA, 19 nt, Homo sapiens
gagaaacacaggugaaucu

SEQ ID NO: 1429131 - RNA, 19 nt, Homo sapiens
gaaugcgauuggagucuau

SEQ ID NO: 1429132 - RNA, 19 nt, Homo sapiens
gcaaggugucuuucgguaa

SEQ ID NO: 1429133 - RNA, 19 nt, Homo sapiens
gcugagaacuuuuccagaa

SEQ ID NO: 1429134 - RNA, 19 nt, Homo sapiens
acacagucauguccaaaug

SEQ ID NO: 1429135 - RNA, 19 nt, Homo sapiens
ucacaucuacccucauuga

SEQ ID NO: 1429136 - RNA, 19 nt, Homo sapiens
aggagaaucugguaaaaua

SEQ ID NO: 1429137 - RNA, 19 nt, Homo sapiens
gacugccuaucccagauua

SEQ ID NO: 1429138 - RNA, 19 nt, Homo sapiens
ggacucgaauaacuagcuu

SEQ ID NO: 1429139 - RNA, 19 nt, Homo sapiens
gcgauuggagucuauggua

SEQ ID NO: 1429140 - RNA, 19 nt, Homo sapiens
caacaacaaagaaguucaa

SEQ ID NO: 1429141 - RNA, 19 nt, Homo sapiens
gaauuggcaacaacaaaga

SEQ ID NO: 1429142 - RNA, 19 nt, Homo sapiens
gaaacugcugaaagucaua

SEQ ID NO: 1429143 - RNA, 19 nt, Homo sapiens
ccaccaagcacaacuggaa

SEQ ID NO: 1429144 - RNA, 19 nt, Homo sapiens
gaggaguacuuaccauguc

SEQ ID NO: 1429145 - RNA, 19 nt, Homo sapiens
gaaggagaaucugguaaaa

SEQ ID NO: 1429146 - RNA, 19 nt, Homo sapiens
acucacaguucucauauuc

SEQ ID NO: 1429147 - RNA, 19 nt, Homo sapiens
ggaaacaaucucacacagu

SEQ ID NO: 1429148 - RNA, 19 nt, Homo sapiens
gaggaaggagaaucuggua

SEQ ID NO: 1429149 - RNA, 19 nt, Homo sapiens
ugagacaucuggacuugag

SEQ ID NO: 1429150 - RNA, 19 nt, Homo sapiens
aaagcuaucucucucacau

SEQ ID NO: 1429151 - RNA, 19 nt, Homo sapiens
cuacugaucaugauaagau

SEQ ID NO: 1429152 - RNA, 19 nt, Homo sapiens
gaaaccagagggacuucuu

SEQ ID NO: 1429153 - RNA, 19 nt, Homo sapiens
uaaaucgaaugugauggaa

SEQ ID NO: 1429154 - RNA, 19 nt, Homo sapiens
guauaaaucgaaugugaug

SEQ ID NO: 1429155 - RNA, 19 nt, Homo sapiens
gaagaggucauuuucugua

SEQ ID NO: 1429156 - RNA, 19 nt, Homo sapiens
gcucuguguuugcaacgaa

SEQ ID NO: 1429157 - RNA, 19 nt, Homo sapiens
caagacuuaugcucugugu

SEQ ID NO: 1429158 - RNA, 19 nt, Homo sapiens
gcucuuggauggcuuugag

SEQ ID NO: 1429159 - RNA, 19 nt, Homo sapiens
cucaggaccucgugucaaa

SEQ ID NO: 1429160 - RNA, 19 nt, Homo sapiens
gaacugugauaaaaugugu

SEQ ID NO: 1429161 - RNA, 19 nt, Homo sapiens
ugaagaacccugacuguac

SEQ ID NO: 1429162 - RNA, 19 nt, Homo sapiens
uaacgggcaucuaaagacu

SEQ ID NO: 1429163 - RNA, 19 nt, Homo sapiens
ccaaaugccaccucugugu

SEQ ID NO: 1429164 - RNA, 19 nt, Homo sapiens
ccaagaccguggccauaca

SEQ ID NO: 1429165 - RNA, 19 nt, Homo sapiens
gauaaaauguguguuguag

SEQ ID NO: 1429166 - RNA, 19 nt, Homo sapiens
ucugagauacuuggaaaua

SEQ ID NO: 1429167 - RNA, 19 nt, Homo sapiens
gaaguucaagugucugcuu

SEQ ID NO: 1429168 - RNA, 19 nt, Homo sapiens
ucuuuacccucgugacuuu

SEQ ID NO: 1429169 - RNA, 19 nt, Homo sapiens
ggaccucgugucaaagauu

SEQ ID NO: 1429170 - RNA, 19 nt, Homo sapiens
gaacgaagguguaaaucua

SEQ ID NO: 1429171 - RNA, 19 nt, Homo sapiens
gcaguacccugugcaaaua

SEQ ID NO: 1429172 - RNA, 19 nt, Homo sapiens
gaaaggcuguuguucauca

SEQ ID NO: 1429173 - RNA, 19 nt, Homo sapiens
gaugaagcguuucuuguuu

SEQ ID NO: 1429174 - RNA, 19 nt, Homo sapiens
ggaaagaguuguccugaag

SEQ ID NO: 1429175 - RNA, 19 nt, Homo sapiens
caagaaauuucacaagcua

SEQ ID NO: 1429176 - RNA, 19 nt, Homo sapiens
cagagaagcucaagucaga

SEQ ID NO: 1429177 - RNA, 19 nt, Homo sapiens
acacaaagcucugcaaaga

SEQ ID NO: 1429178 - RNA, 19 nt, Homo sapiens
gaaaagacauucaccagaa

SEQ ID NO: 1429179 - RNA, 19 nt, Homo sapiens
gcauauagagggaauuaaa

SEQ ID NO: 1429180 - RNA, 19 nt, Homo sapiens
cgucauaucucagagcaua

SEQ ID NO: 1429181 - RNA, 19 nt, Homo sapiens
gaagaucucccaaauccuu

SEQ ID NO: 1429182 - RNA, 19 nt, Homo sapiens
gcacccaccugaaggaaga

SEQ ID NO: 1429183 - RNA, 19 nt, Homo sapiens
gagagucuguccuguguga

SEQ ID NO: 1429184 - RNA, 19 nt, Homo sapiens
gcucuguccucaacaauga

SEQ ID NO: 1429185 - RNA, 19 nt, Homo sapiens
auacagacccugauguuua

SEQ ID NO: 1429186 - RNA, 19 nt, Homo sapiens
gagcauauagagggaauua

SEQ ID NO: 1429187 - RNA, 19 nt, Homo sapiens
gacagaagaacaagaaauu

SEQ ID NO: 1429188 - RNA, 19 nt, Homo sapiens
uaacuucagucccaaagga

SEQ ID NO: 1429189 - RNA, 19 nt, Homo sapiens
gaauaggaagucaguguuu

SEQ ID NO: 1429190 - RNA, 19 nt, Homo sapiens
uaaaccuggugcagaauaa

SEQ ID NO: 1429191 - RNA, 19 nt, Homo sapiens
gggauaagacccucauuga

SEQ ID NO: 1429192 - RNA, 19 nt, Homo sapiens
gcacagagaagcucaaguc

SEQ ID NO: 1429193 - RNA, 19 nt, Homo sapiens
gcacggaaagucaggaauu

SEQ ID NO: 1429194 - RNA, 19 nt, Homo sapiens
gggaguuccuucucaaaga

SEQ ID NO: 1429195 - RNA, 19 nt, Homo sapiens
cagaaaggcuguuguucau

SEQ ID NO: 1429196 - RNA, 19 nt, Homo sapiens
gaucaugucccgaccagaa

SEQ ID NO: 1429197 - RNA, 19 nt, Homo sapiens
ggaagacaauggcgugaag

SEQ ID NO: 1429198 - RNA, 19 nt, Homo sapiens
gauggcgugugaagccuua

SEQ ID NO: 1429199 - RNA, 19 nt, Homo sapiens
caacaccucuggagaaucg

SEQ ID NO: 1429200 - RNA, 19 nt, Homo sapiens
ggaugaagcguuucuuguu

SEQ ID NO: 1429201 - RNA, 19 nt, Homo sapiens
gaacaagaaauuucacaag

SEQ ID NO: 1429202 - RNA, 19 nt, Homo sapiens
cauguggacugacuucuga

SEQ ID NO: 1429203 - RNA, 19 nt, Homo sapiens
gaguaacgccucucaguga

SEQ ID NO: 1429204 - RNA, 19 nt, Homo sapiens
guuuagaaaugcacagauu

SEQ ID NO: 1429205 - RNA, 19 nt, Homo sapiens
caggaaauuucacaagcua

SEQ ID NO: 1429206 - RNA, 19 nt, Homo sapiens
gguccuacuugcucuauau

SEQ ID NO: 1429207 - RNA, 19 nt, Homo sapiens
caaagauggagaaugauuu

SEQ ID NO: 1429208 - RNA, 19 nt, Homo sapiens
ccuaagaucccucaacuug

SEQ ID NO: 1429209 - RNA, 19 nt, Homo sapiens
gaacaggaaauuucacaag

SEQ ID NO: 1429210 - RNA, 19 nt, Homo sapiens
agacaaaucgcucaccuuu

SEQ ID NO: 1429211 - RNA, 19 nt, Homo sapiens
caagauggaaggagacaaa

SEQ ID NO: 1429212 - RNA, 19 nt, Homo sapiens
uaauugggcuguggaaaug

SEQ ID NO: 1429213 - RNA, 19 nt, Homo sapiens
gcaauggugucucuaugag

SEQ ID NO: 1429214 - RNA, 19 nt, Homo sapiens
ggacucaguaucugugaaa

SEQ ID NO: 1429215 - RNA, 19 nt, Homo sapiens
uagagaccuucaagucaua

SEQ ID NO: 1429216 - RNA, 19 nt, Homo sapiens
ggaguuccuucucaaagau

SEQ ID NO: 1429217 - RNA, 19 nt, Homo sapiens
ggaagcugcuggaggaagu

SEQ ID NO: 1429218 - RNA, 19 nt, Homo sapiens
gcaugaacccuguggaaga

SEQ ID NO: 1429219 - RNA, 19 nt, Homo sapiens
gaaggaagaggauguaagg

SEQ ID NO: 1429220 - RNA, 19 nt, Homo sapiens
gcacugggucucucuguug

SEQ ID NO: 1429221 - RNA, 19 nt, Homo sapiens
cuacaagagucacgugaug

SEQ ID NO: 1429222 - RNA, 19 nt, Homo sapiens
caccugagccuuagcauga

SEQ ID NO: 1429223 - RNA, 19 nt, Homo sapiens
ucacaaagcccucaauggu

SEQ ID NO: 1429224 - RNA, 19 nt, Homo sapiens
gaagcuguguucggccuuu

SEQ ID NO: 1429225 - RNA, 19 nt, Homo sapiens
aaguguggcuuccgauuaa

SEQ ID NO: 1429226 - RNA, 19 nt, Homo sapiens
gagggaguguggaauagga

SEQ ID NO: 1429227 - RNA, 19 nt, Homo sapiens
gcaaagacugggcugagaa

SEQ ID NO: 1429228 - RNA, 19 nt, Homo sapiens
gcuagacaaggaagaauuu

SEQ ID NO: 1429229 - RNA, 19 nt, Homo sapiens
gauugacccaugccuguua

SEQ ID NO: 1429230 - RNA, 19 nt, Homo sapiens
gaggagcagugggaagauu

SEQ ID NO: 1429231 - RNA, 19 nt, Homo sapiens
ggccggaaaugcaaacguu

SEQ ID NO: 1429232 - RNA, 19 nt, Homo sapiens
ugaaauguccgucauaucu

SEQ ID NO: 1429233 - RNA, 19 nt, Homo sapiens
gaaggcauguggacugacu

SEQ ID NO: 1429234 - RNA, 19 nt, Homo sapiens
ggaaauuucacaagcuaug

SEQ ID NO: 1429235 - RNA, 19 nt, Homo sapiens
aggaagaauuucagacauu

SEQ ID NO: 1429236 - RNA, 19 nt, Homo sapiens
ccaaaggaaugaugaagcu

SEQ ID NO: 1429237 - RNA, 19 nt, Homo sapiens
gcagcagcauccugacaga

SEQ ID NO: 1429238 - RNA, 19 nt, Homo sapiens
ggaauaggaagucaguguu

SEQ ID NO: 1429239 - RNA, 19 nt, Homo sapiens
ccagaaaggcuguuguuca

SEQ ID NO: 1429240 - RNA, 19 nt, Homo sapiens
cacaagcuauggaacaaga

SEQ ID NO: 1429241 - RNA, 19 nt, Homo sapiens
cacaagcuauggaacaaga

SEQ ID NO: 1429242 - RNA, 19 nt, Homo sapiens
cacaaagcccucaauggua

SEQ ID NO: 1429243 - RNA, 19 nt, Homo sapiens
gcacucuccuuggcccuuu

SEQ ID NO: 1429244 - RNA, 19 nt, Homo sapiens
gugagagucuguccugugu

SEQ ID NO: 1429245 - RNA, 19 nt, Homo sapiens
gauuucugauucucacaaa

SEQ ID NO: 1429246 - RNA, 19 nt, Homo sapiens
cacuugcgcuuauggguaa

SEQ ID NO: 1429247 - RNA, 19 nt, Homo sapiens
acaaagcucugcaaagacu

SEQ ID NO: 1429248 - RNA, 19 nt, Homo sapiens
ggcacgggaugacaugaaa

SEQ ID NO: 1429249 - RNA, 19 nt, Homo sapiens
cuagagaccuucaagucau

SEQ ID NO: 1429250 - RNA, 19 nt, Homo sapiens
cuacguugguuacuggauu

SEQ ID NO: 1429251 - RNA, 19 nt, Homo sapiens
ucaaagauggagaaugauu

SEQ ID NO: 1429252 - RNA, 19 nt, Homo sapiens
gacgguaguuggcauucuu

SEQ ID NO: 1429253 - RNA, 19 nt, Homo sapiens
guaaaucuacugugucgau

SEQ ID NO: 1429254 - RNA, 19 nt, Homo sapiens
ggccaaccguaaccuaaga

SEQ ID NO: 1429255 - RNA, 19 nt, Homo sapiens
gauacagacccugauguuu

SEQ ID NO: 1429256 - RNA, 19 nt, Homo sapiens
cagaagaacaagaaauuuc

SEQ ID NO: 1429257 - RNA, 19 nt, Homo sapiens
caaggaagaauuucagaca

SEQ ID NO: 1429258 - RNA, 19 nt, Homo sapiens
gcuagagaccuucaaguca

SEQ ID NO: 1429259 - RNA, 19 nt, Homo sapiens
gguagugauucuucugugu

SEQ ID NO: 1429260 - RNA, 19 nt, Homo sapiens
gucuaaaccuggugcagaa

SEQ ID NO: 1429261 - RNA, 19 nt, Homo sapiens
uuucgagacucaagacaaa

SEQ ID NO: 1429262 - RNA, 19 nt, Homo sapiens
ugagagaaccaucuuguca

SEQ ID NO: 1429263 - RNA, 19 nt, Homo sapiens
acaaaucgcucaccuuuuc

SEQ ID NO: 1429264 - RNA, 19 nt, Homo sapiens
aaacaggcaggcuuccaua

SEQ ID NO: 1429265 - RNA, 19 nt, Homo sapiens
gaauccacuugcuccuuga

SEQ ID NO: 1429266 - RNA, 19 nt, Homo sapiens
ggaacaaagaauccacuug

SEQ ID NO: 1429267 - RNA, 19 nt, Homo sapiens
gcaggaggacuugaacuug

SEQ ID NO: 1429268 - RNA, 19 nt, Homo sapiens
caaaagaacaggaaauuuc

SEQ ID NO: 1429269 - RNA, 19 nt, Homo sapiens
ccucagcccucgucagcaa

SEQ ID NO: 1429270 - RNA, 19 nt, Homo sapiens
gagaaaugauggaauguua

SEQ ID NO: 1429271 - RNA, 19 nt, Homo sapiens
gggaagaccuuuagacgua

SEQ ID NO: 1429272 - RNA, 19 nt, Homo sapiens
gagaaacccuauaaaugua

SEQ ID NO: 1429273 - RNA, 19 nt, Homo sapiens
gaacaugggcaguuucaua

SEQ ID NO: 1429274 - RNA, 19 nt, Homo sapiens
gggaauaccuggacccuaa

SEQ ID NO: 1429275 - RNA, 19 nt, Homo sapiens
gggaagaacuuucguagug

SEQ ID NO: 1429276 - RNA, 19 nt, Homo sapiens
gcucaaaccuuauucaaca

SEQ ID NO: 1429277 - RNA, 19 nt, Homo sapiens
caucaaagauuucauacug

SEQ ID NO: 1429278 - RNA, 19 nt, Homo sapiens
cguaguggcuaucaacuua

SEQ ID NO: 1429279 - RNA, 19 nt, Homo sapiens
gagaaacucuaugaaugua

SEQ ID NO: 1429280 - RNA, 19 nt, Homo sapiens
agacguaguucacaccuua

SEQ ID NO: 1429281 - RNA, 19 nt, Homo sapiens
gggaaggccuuuauauaug

SEQ ID NO: 1429282 - RNA, 19 nt, Homo sapiens
cagaagaaauuuaguagug

SEQ ID NO: 1429283 - RNA, 19 nt, Homo sapiens
caucagagauuucauacug

SEQ ID NO: 1429284 - RNA, 19 nt, Homo sapiens
gagaaacccuaugaaugua

SEQ ID NO: 1429285 - RNA, 19 nt, Homo sapiens
ggugagaaaugauggaaug

SEQ ID NO: 1429286 - RNA, 19 nt, Homo sapiens
gauaaucagcuacauagaa

SEQ ID NO: 1429287 - RNA, 19 nt, Homo sapiens
gcauggauaucuuaaucaa

SEQ ID NO: 1429288 - RNA, 19 nt, Homo sapiens
gggaagaccuauacuacug

SEQ ID NO: 1429289 - RNA, 19 nt, Homo sapiens
caucacagguuucauguca

SEQ ID NO: 1429290 - RNA, 19 nt, Homo sapiens
ggauuuggauuuacagugu

SEQ ID NO: 1429291 - RNA, 19 nt, Homo sapiens
ugacugcccuguagaauca

SEQ ID NO: 1429292 - RNA, 19 nt, Homo sapiens
gagaaacccuaugugugua

SEQ ID NO: 1429293 - RNA, 19 nt, Homo sapiens
gaauguggcaagaccuuua

SEQ ID NO: 1429294 - RNA, 19 nt, Homo sapiens
ugagaaacccuauaaaugu

SEQ ID NO: 1429295 - RNA, 19 nt, Homo sapiens
caacuuacucuacaucaaa

SEQ ID NO: 1429296 - RNA, 19 nt, Homo sapiens
gaugagaagccauacauau

SEQ ID NO: 1429297 - RNA, 19 nt, Homo sapiens
gaaacucuaugaauguaag

SEQ ID NO: 1429298 - RNA, 19 nt, Homo sapiens
gaauguaagguauguagaa

SEQ ID NO: 1429299 - RNA, 19 nt, Homo sapiens
ucacagguuucaugucauu

SEQ ID NO: 1429300 - RNA, 19 nt, Homo sapiens
uagaagaggucaccagcuu

SEQ ID NO: 1429301 - RNA, 19 nt, Homo sapiens
uguaagaaaugucagaaga

SEQ ID NO: 1429302 - RNA, 19 nt, Homo sapiens
ggauuuacagugugagaua

SEQ ID NO: 1429303 - RNA, 19 nt, Homo sapiens
aaacagauauauccucuac

SEQ ID NO: 1429304 - RNA, 19 nt, Homo sapiens
gaucuugccacauuagaaa

SEQ ID NO: 1429305 - RNA, 19 nt, Homo sapiens
gaacuuucguaguggcuau

SEQ ID NO: 1429306 - RNA, 19 nt, Homo sapiens
gagauaaucagcuacauag

SEQ ID NO: 1429307 - RNA, 19 nt, Homo sapiens
gugagaaacccuauaaaug

SEQ ID NO: 1429308 - RNA, 19 nt, Homo sapiens
aguacuggcucaaaccuua

SEQ ID NO: 1429309 - RNA, 19 nt, Homo sapiens
gcgagaaacccuaugaaug

SEQ ID NO: 1429310 - RNA, 19 nt, Homo sapiens
ggaaggccuuuauauaugc

SEQ ID NO: 1429311 - RNA, 19 nt, Homo sapiens
gagaaaaccuaugaaugua

SEQ ID NO: 1429312 - RNA, 19 nt, Homo sapiens
gaaugugggaagaacuuua

SEQ ID NO: 1429313 - RNA, 19 nt, Homo sapiens
gcuaucaacuuacucuaca

SEQ ID NO: 1429314 - RNA, 19 nt, Homo sapiens
gcaaagagugugggaagaa

SEQ ID NO: 1429315 - RNA, 19 nt, Homo sapiens
gauggaauguuagucuuau

SEQ ID NO: 1429316 - RNA, 19 nt, Homo sapiens
gggaaaaccuucagauaug

SEQ ID NO: 1429317 - RNA, 19 nt, Homo sapiens
uaugaaacccuaugaaugu

SEQ ID NO: 1429318 - RNA, 19 nt, Homo sapiens
gugggaaggccuuuauaua

SEQ ID NO: 1429319 - RNA, 19 nt, Homo sapiens
augcagaucuugccacauu

SEQ ID NO: 1429320 - RNA, 19 nt, Homo sapiens
caucagagaauucauagga

SEQ ID NO: 1429321 - RNA, 19 nt, Homo sapiens
gaaugugggaagaccuuua

SEQ ID NO: 1429322 - RNA, 19 nt, Homo sapiens
ugagaaaccuuuugaaugu

SEQ ID NO: 1429323 - RNA, 19 nt, Homo sapiens
ggugagaaacccuauaaau

SEQ ID NO: 1429324 - RNA, 19 nt, Homo sapiens
gggaaggccuauaguacug

SEQ ID NO: 1429325 - RNA, 19 nt, Homo sapiens
gaaacacuuugaauguaag

SEQ ID NO: 1429326 - RNA, 19 nt, Homo sapiens
gcaugaaacacuuugaaug

SEQ ID NO: 1429327 - RNA, 19 nt, Homo sapiens
ggaaaacccuaugaaugua

SEQ ID NO: 1429328 - RNA, 19 nt, Homo sapiens
aguaggcgcucaaaucuug

SEQ ID NO: 1429329 - RNA, 19 nt, Homo sapiens
gauuuacagugugagauaa

SEQ ID NO: 1429330 - RNA, 19 nt, Homo sapiens
ccacacuggugagaaauga

SEQ ID NO: 1429331 - RNA, 19 nt, Homo sapiens
ugagaaacccuaugugugu

SEQ ID NO: 1429332 - RNA, 19 nt, Homo sapiens
gcacaucagagcauucaug

SEQ ID NO: 1429333 - RNA, 19 nt, Homo sapiens
cuacaucagagaauucaua

SEQ ID NO: 1429334 - RNA, 19 nt, Homo sapiens
gcuauaccacugccucaua

SEQ ID NO: 1429335 - RNA, 19 nt, Homo sapiens
gggaugugauguuggagaa

SEQ ID NO: 1429336 - RNA, 19 nt, Homo sapiens
gaaaugauggaauguuagu

SEQ ID NO: 1429337 - RNA, 19 nt, Homo sapiens
uguaagaccguaaagagua

SEQ ID NO: 1429338 - RNA, 19 nt, Homo sapiens
gagaauucauaggagcaua

SEQ ID NO: 1429339 - RNA, 19 nt, Homo sapiens
guaugaaacccuaugaaug

SEQ ID NO: 1429340 - RNA, 19 nt, Homo sapiens
caucagagaauucauaaag

SEQ ID NO: 1429341 - RNA, 19 nt, Homo sapiens
gaaacccuaugaauguaca

SEQ ID NO: 1429342 - RNA, 19 nt, Homo sapiens
guaagaaaugucagaagaa

SEQ ID NO: 1429343 - RNA, 19 nt, Homo sapiens
cuacacaacuucagagcau

SEQ ID NO: 1429344 - RNA, 19 nt, Homo sapiens
caugaaacacuuugaaugu

SEQ ID NO: 1429345 - RNA, 19 nt, Homo sapiens
ucagagaauucauaaaggu

SEQ ID NO: 1429346 - RNA, 19 nt, Homo sapiens
gauauauccucuacacaac

SEQ ID NO: 1429347 - RNA, 19 nt, Homo sapiens
cuaaucagagggacuuaua

SEQ ID NO: 1429348 - RNA, 19 nt, Homo sapiens
gaauguuagucuuauaggu

SEQ ID NO: 1429349 - RNA, 19 nt, Homo sapiens
ucagggauguggccauaga

SEQ ID NO: 1429350 - RNA, 19 nt, Homo sapiens
gaaacccuaugaauguaag

SEQ ID NO: 1429351 - RNA, 19 nt, Homo sapiens
gcgcuugaguugguauaaa

SEQ ID NO: 1429352 - RNA, 19 nt, Homo sapiens
cgagaaacccuaugaaugc

SEQ ID NO: 1429353 - RNA, 19 nt, Homo sapiens
gggagggccuuuagucaag

SEQ ID NO: 1429354 - RNA, 19 nt, Homo sapiens
aguagugguuaucaacuua

SEQ ID NO: 1429355 - RNA, 19 nt, Homo sapiens
agguauggcuuuagcaauu

SEQ ID NO: 1429356 - RNA, 19 nt, Homo sapiens
gaauguaaggaguguaaga

SEQ ID NO: 1429357 - RNA, 19 nt, Homo sapiens
caucuuagaauucaucaga

SEQ ID NO: 1429358 - RNA, 19 nt, Homo sapiens
ugggaaggccuuuauauau

SEQ ID NO: 1429359 - RNA, 19 nt, Homo sapiens
caacuuauucuacaucaca

SEQ ID NO: 1429360 - RNA, 19 nt, Homo sapiens
ccucagacgugugugauga

SEQ ID NO: 1429361 - RNA, 19 nt, Homo sapiens
ugagauaaucagcuacaua

SEQ ID NO: 1429362 - RNA, 19 nt, Homo sapiens
gguauggcuuuagcaauug

SEQ ID NO: 1429363 - RNA, 19 nt, Homo sapiens
gaaaucuuacucuacauca

SEQ ID NO: 1429364 - RNA, 19 nt, Homo sapiens
gguaugaaacccuaugaau

SEQ ID NO: 1429365 - RNA, 19 nt, Homo sapiens
caagguggacaucuuagaa

SEQ ID NO: 1429366 - RNA, 19 nt, Homo sapiens
auauaugccucacacauug

SEQ ID NO: 1429367 - RNA, 19 nt, Homo sapiens
gaacuauagaaaccuggua

SEQ ID NO: 1429368 - RNA, 19 nt, Homo sapiens
caaugucaguccuguuuua

SEQ ID NO: 1429369 - RNA, 19 nt, Homo sapiens
uaaagcccaucagagaauu

SEQ ID NO: 1429370 - RNA, 19 nt, Homo sapiens
gcccaaagcuccuguugua

SEQ ID NO: 1429371 - RNA, 19 nt, Homo sapiens
ggaugagccugcugcauuu

SEQ ID NO: 1429372 - RNA, 19 nt, Homo sapiens
caucaaagaucaucacaca

SEQ ID NO: 1429373 - RNA, 19 nt, Homo sapiens
gaaauuccuuugguaauca

SEQ ID NO: 1429374 - RNA, 19 nt, Homo sapiens
gaucauggaaucugcauaa

SEQ ID NO: 1429375 - RNA, 19 nt, Homo sapiens
ugacaccucuucugaaaug

SEQ ID NO: 1429376 - RNA, 19 nt, Homo sapiens
gaaagaggccuaccugaag

SEQ ID NO: 1429377 - RNA, 19 nt, Homo sapiens
gaggguggcuucugucuca

SEQ ID NO: 1429378 - RNA, 19 nt, Homo sapiens
uguacaagcuccugggaua

SEQ ID NO: 1429379 - RNA, 19 nt, Homo sapiens
gcauuugacuugcucugaa

SEQ ID NO: 1429380 - RNA, 19 nt, Homo sapiens
gaugaaauuccuuugguaa

SEQ ID NO: 1429381 - RNA, 19 nt, Homo sapiens
gagaacaucaccaccguuu

SEQ ID NO: 1429382 - RNA, 19 nt, Homo sapiens
cauggaaucugcauaaugg

SEQ ID NO: 1429383 - RNA, 19 nt, Homo sapiens
ucuccaagaucccauuuaa

SEQ ID NO: 1429384 - RNA, 19 nt, Homo sapiens
cgacguggaucauggaauc

SEQ ID NO: 1429385 - RNA, 19 nt, Homo sapiens
caucgucuccuguaaguuu

SEQ ID NO: 1429386 - RNA, 19 nt, Homo sapiens
gccgugggcuuaaaguuga

SEQ ID NO: 1429387 - RNA, 19 nt, Homo sapiens
caagguccaucacgucaug

SEQ ID NO: 1429388 - RNA, 19 nt, Homo sapiens
caggcaagcugcuguggaa

SEQ ID NO: 1429389 - RNA, 19 nt, Homo sapiens
ugaugaaauuccuuuggua

SEQ ID NO: 1429390 - RNA, 19 nt, Homo sapiens
ccaaugcaaucucaaacug

SEQ ID NO: 1429391 - RNA, 19 nt, Homo sapiens
gcagauacuucaucgucau

SEQ ID NO: 1429392 - RNA, 19 nt, Homo sapiens
gauaggaccaugagacugu

SEQ ID NO: 1429393 - RNA, 19 nt, Homo sapiens
ugaaauuccuuugguaauc

SEQ ID NO: 1429394 - RNA, 19 nt, Homo sapiens
ccaaagcuccuguuguaga

SEQ ID NO: 1429395 - RNA, 19 nt, Homo sapiens
aucaagaucugggauguua

SEQ ID NO: 1429396 - RNA, 19 nt, Homo sapiens
ucucauuucuggaggguuu

SEQ ID NO: 1429397 - RNA, 19 nt, Homo sapiens
gguggacgguucugugguu

SEQ ID NO: 1429398 - RNA, 19 nt, Homo sapiens
ccaugagacuguggaauau

SEQ ID NO: 1429399 - RNA, 19 nt, Homo sapiens
ccaugaagguucugucagu

SEQ ID NO: 1429400 - RNA, 19 nt, Homo sapiens
agugacaccucuucugaaa

SEQ ID NO: 1429401 - RNA, 19 nt, Homo sapiens
ucaaagaucaucacacaag

SEQ ID NO: 1429402 - RNA, 19 nt, Homo sapiens
agaaagaggccuaccugaa

SEQ ID NO: 1429403 - RNA, 19 nt, Homo sapiens
ugacagggaaugcaaguug

SEQ ID NO: 1429404 - RNA, 19 nt, Homo sapiens
gaagcaaggaugacugaca

SEQ ID NO: 1429405 - RNA, 19 nt, Homo sapiens
gaaucaaucaacaugagaa

SEQ ID NO: 1429406 - RNA, 19 nt, Homo sapiens
agacagcucuuuucucauu

SEQ ID NO: 1429407 - RNA, 19 nt, Homo sapiens
caaagcuccuguuguagag

SEQ ID NO: 1429408 - RNA, 19 nt, Homo sapiens
gaagcugaagcaaggauga

SEQ ID NO: 1429409 - RNA, 19 nt, Homo sapiens
uggaaggucagguaugaua

SEQ ID NO: 1429410 - RNA, 19 nt, Homo sapiens
uguggaaggucagguauga

SEQ ID NO: 1429411 - RNA, 19 nt, Homo sapiens
ccgcaucuguugccugaga

SEQ ID NO: 1429412 - RNA, 19 nt, Homo sapiens
gaaccaccaccgcaucugu

SEQ ID NO: 1429413 - RNA, 19 nt, Homo sapiens
gacuugcucugaaucaauc

SEQ ID NO: 1429414 - RNA, 19 nt, Homo sapiens
guacaagcuccugggauaa

SEQ ID NO: 1429415 - RNA, 19 nt, Homo sapiens
ggacaggugcaucaagauc

SEQ ID NO: 1429416 - RNA, 19 nt, Homo sapiens
gaacaucaccaccguuucc

SEQ ID NO: 1429417 - RNA, 19 nt, Homo sapiens
gggaagcaaggaugacuga

SEQ ID NO: 1429418 - RNA, 19 nt, Homo sapiens
gcaacaacaagaaauggau

SEQ ID NO: 1429419 - RNA, 19 nt, Homo sapiens
gccauuagcaacaacaaga

SEQ ID NO: 1429420 - RNA, 19 nt, Homo sapiens
gcaagcugcuguggaaggu

SEQ ID NO: 1429421 - RNA, 19 nt, Homo sapiens
gcagggccaugaagguucu

SEQ ID NO: 1429422 - RNA, 19 nt, Homo sapiens
gguggcuucugucucauug

SEQ ID NO: 1429423 - RNA, 19 nt, Homo sapiens
cgacagcagcagagucauu

SEQ ID NO: 1429424 - RNA, 19 nt, Homo sapiens
guucugugguucgcgauuu

SEQ ID NO: 1429425 - RNA, 19 nt, Homo sapiens
accggaagcucucuuugaa

SEQ ID NO: 1429426 - RNA, 19 nt, Homo sapiens
uauuugggauguagcagaa

SEQ ID NO: 1429427 - RNA, 19 nt, Homo sapiens
gaccauggcgagggccuua

SEQ ID NO: 1429428 - RNA, 19 nt, Homo sapiens
ucacuaaggcacauuccaa

SEQ ID NO: 1429429 - RNA, 19 nt, Homo sapiens
gcaccugccacuucugugu

SEQ ID NO: 1429430 - RNA, 19 nt, Homo sapiens
accaugagacuguggaaua

SEQ ID NO: 1429431 - RNA, 19 nt, Homo sapiens
ugucaguuccugucacuuu

SEQ ID NO: 1429432 - RNA, 19 nt, Homo sapiens
caugaagguucugucaguu

SEQ ID NO: 1429433 - RNA, 19 nt, Homo sapiens
ggccgugggcuuaaaguug

SEQ ID NO: 1429434 - RNA, 19 nt, Homo sapiens
gcuccucaguggcuccuau

SEQ ID NO: 1429435 - RNA, 19 nt, Homo sapiens
caucacgucaugcugcuuu

SEQ ID NO: 1429436 - RNA, 19 nt, Homo sapiens
aggaugagccugcugcauu

SEQ ID NO: 1429437 - RNA, 19 nt, Homo sapiens
augagacuguggaauauug

SEQ ID NO: 1429438 - RNA, 19 nt, Homo sapiens
gacagcagcagagucauug

SEQ ID NO: 1429439 - RNA, 19 nt, Homo sapiens
guuguagagugcagcauca

SEQ ID NO: 1429440 - RNA, 19 nt, Homo sapiens
cauuugacuugcucugaau

SEQ ID NO: 1429441 - RNA, 19 nt, Homo sapiens
aaauggauccugucugcuu

SEQ ID NO: 1429442 - RNA, 19 nt, Homo sapiens
gucaguuccugucacuuug

SEQ ID NO: 1429443 - RNA, 19 nt, Homo sapiens
gagccugugugacucugau

SEQ ID NO: 1429444 - RNA, 19 nt, Homo sapiens
ggccauuuccuguguacaa

SEQ ID NO: 1429445 - RNA, 19 nt, Homo sapiens
caagaucugggauguuaca

SEQ ID NO: 1429446 - RNA, 19 nt, Homo sapiens
gagcaccugccacuucugu

SEQ ID NO: 1429447 - RNA, 19 nt, Homo sapiens
uuggacaggugcaucaaga

SEQ ID NO: 1429448 - RNA, 19 nt, Homo sapiens
uccuaugacugcacuguga

SEQ ID NO: 1429449 - RNA, 19 nt, Homo sapiens
gagugacaccucuucugaa

SEQ ID NO: 1429450 - RNA, 19 nt, Homo sapiens
caccucuucugaaauguuc

SEQ ID NO: 1429451 - RNA, 19 nt, Homo sapiens
caagaaauggauccugucu

SEQ ID NO: 1429452 - RNA, 19 nt, Homo sapiens
gugagcaccugccacuucu

SEQ ID NO: 1429453 - RNA, 19 nt, Homo sapiens
uaccuucaguggccauuuc

SEQ ID NO: 1429454 - RNA, 19 nt, Homo sapiens
gcauaauggacgccgagaa

SEQ ID NO: 1429455 - RNA, 19 nt, Homo sapiens
gauacuucaucgucaucau

SEQ ID NO: 1429456 - RNA, 19 nt, Homo sapiens
gacaggccuuucuccaucu

SEQ ID NO: 1429457 - RNA, 19 nt, Homo sapiens
aggccuaccugaagcugaa

SEQ ID NO: 1429458 - RNA, 19 nt, Homo sapiens
uaccggaagcucucuuuga

SEQ ID NO: 1429459 - RNA, 19 nt, Homo sapiens
ccguuuccgucaucaaaga

SEQ ID NO: 1429460 - RNA, 19 nt, Homo sapiens
gcucagcaggccugucaga

SEQ ID NO: 1429461 - RNA, 19 nt, Homo sapiens
gaaacuguggagccugugu

SEQ ID NO: 1429462 - RNA, 19 nt, Homo sapiens
ccaggugccggagaaauug

SEQ ID NO: 1429463 - RNA, 19 nt, Homo sapiens
ggcgacagcagcagaguca

SEQ ID NO: 1429464 - RNA, 19 nt, Homo sapiens
uggcuucugucucauugga

SEQ ID NO: 1429465 - RNA, 19 nt, Homo sapiens
caucacacaagguccauca

SEQ ID NO: 1429466 - RNA, 19 nt, Homo sapiens
ucauggaaucugcauaaug

SEQ ID NO: 1429467 - RNA, 19 nt, Homo sapiens
cugaaucaaucaacaugag

SEQ ID NO: 1429468 - RNA, 19 nt, Homo sapiens
gcuaccggaagcucucuuu

SEQ ID NO: 1429469 - RNA, 19 nt, Homo sapiens
uacaagcuccugggauaaa

SEQ ID NO: 1429470 - RNA, 19 nt, Homo sapiens
aauaaaggcuugugaagaa

SEQ ID NO: 1429471 - RNA, 19 nt, Homo sapiens
gaaaugcauucuacagcaa

SEQ ID NO: 1429472 - RNA, 19 nt, Homo sapiens
caacauaacaaggcucuuu

SEQ ID NO: 1429473 - RNA, 19 nt, Homo sapiens
caaagggacucagguaaca

SEQ ID NO: 1429474 - RNA, 19 nt, Homo sapiens
gaaaccggaucgcaagcuu

SEQ ID NO: 1429475 - RNA, 19 nt, Homo sapiens
gguaacagcccaggaaaug

SEQ ID NO: 1429476 - RNA, 19 nt, Homo sapiens
ggaucucgcucccacuuuc

SEQ ID NO: 1429477 - RNA, 19 nt, Homo sapiens
ggccagagcauuuauucaa

SEQ ID NO: 1429478 - RNA, 19 nt, Homo sapiens
gaucugggcccugcaagaa

SEQ ID NO: 1429479 - RNA, 19 nt, Homo sapiens
ccguagagauuccugaguu

SEQ ID NO: 1429480 - RNA, 19 nt, Homo sapiens
cagcaaagggacucaggua

SEQ ID NO: 1429481 - RNA, 19 nt, Homo sapiens
uaauaaaggcuugugaaga

SEQ ID NO: 1429482 - RNA, 19 nt, Homo sapiens
acccauagguacacacaaa

SEQ ID NO: 1429483 - RNA, 19 nt, Homo sapiens
gcaaagggacucagguaac

SEQ ID NO: 1429484 - RNA, 19 nt, Homo sapiens
caacaggaccccacccaua

SEQ ID NO: 1429485 - RNA, 19 nt, Homo sapiens
caaaaggguuccccaaagu

SEQ ID NO: 1429486 - RNA, 19 nt, Homo sapiens
caaagugggagaggaguga

SEQ ID NO: 1429487 - RNA, 19 nt, Homo sapiens
cguagagauuccugaguug

SEQ ID NO: 1429488 - RNA, 19 nt, Homo sapiens
gcugagggcaacauaacaa

SEQ ID NO: 1429489 - RNA, 19 nt, Homo sapiens
ggaggcugagggcaacaua

SEQ ID NO: 1429490 - RNA, 19 nt, Homo sapiens
auaaaggcuugugaagaaa

SEQ ID NO: 1429491 - RNA, 19 nt, Homo sapiens
uaacagcccaggaaaugca

SEQ ID NO: 1429492 - RNA, 19 nt, Homo sapiens
ucagguaacagcccaggaa

SEQ ID NO: 1429493 - RNA, 19 nt, Homo sapiens
cccaagaaccuaauaaagg

SEQ ID NO: 1429494 - RNA, 19 nt, Homo sapiens
cgaggcggguggaacacuu

SEQ ID NO: 1429495 - RNA, 19 nt, Homo sapiens
ccuguaaucccagcaguuu

SEQ ID NO: 1429496 - RNA, 19 nt, Homo sapiens
cguguuaaguggacaaagg

SEQ ID NO: 1429497 - RNA, 19 nt, Homo sapiens
ccaaaaggguuccccaaag

SEQ ID NO: 1429498 - RNA, 19 nt, Homo sapiens
ggucagggucucuccuaga

SEQ ID NO: 1429499 - RNA, 19 nt, Homo sapiens
cuacagcaacguccuauac

SEQ ID NO: 1429500 - RNA, 19 nt, Homo sapiens
ccuaauaaaggcuugugaa

SEQ ID NO: 1429501 - RNA, 19 nt, Homo sapiens
gccagagcauuuauucaac

SEQ ID NO: 1429502 - RNA, 19 nt, Homo sapiens
cccaggaaaugcauucuac

SEQ ID NO: 1429503 - RNA, 19 nt, Homo sapiens
ucgcaagcuucccaggauu

SEQ ID NO: 1429504 - RNA, 19 nt, Homo sapiens
gaggcugagggcaacauaa

SEQ ID NO: 1429505 - RNA, 19 nt, Homo sapiens
gcccaggaaaugcauucua

SEQ ID NO: 1429506 - RNA, 19 nt, Homo sapiens
cuaauaaaggcuugugaag

SEQ ID NO: 1429507 - RNA, 19 nt, Homo sapiens
gcauuuauucaaccuccuu

SEQ ID NO: 1429508 - RNA, 19 nt, Homo sapiens
gggagaggagugagagauc

SEQ ID NO: 1429509 - RNA, 19 nt, Homo sapiens
ccaagacacuucugacuua

SEQ ID NO: 1429510 - RNA, 19 nt, Homo sapiens
gaaccuaagugaugaaaga

SEQ ID NO: 1429511 - RNA, 19 nt, Homo sapiens
gaaaugaaccuaagugaug

SEQ ID NO: 1429512 - RNA, 19 nt, Homo sapiens
gaaauagaguugucaggaa

SEQ ID NO: 1429513 - RNA, 19 nt, Homo sapiens
ugagaggacuuugaaauuu

SEQ ID NO: 1429514 - RNA, 19 nt, Homo sapiens
uaacagaacccauagaaau

SEQ ID NO: 1429515 - RNA, 19 nt, Homo sapiens
gagaggacuuugaaauuuc

SEQ ID NO: 1429516 - RNA, 19 nt, Homo sapiens
gcagugcagugccguuauu

SEQ ID NO: 1429517 - RNA, 19 nt, Homo sapiens
cuucaugacuuucaccaua

SEQ ID NO: 1429518 - RNA, 19 nt, Homo sapiens
agacaagacuguugaaucu

SEQ ID NO: 1429519 - RNA, 19 nt, Homo sapiens
cgacugggcuguuggagau

SEQ ID NO: 1429520 - RNA, 19 nt, Homo sapiens
gccaauaacagaacccaua

SEQ ID NO: 1429521 - RNA, 19 nt, Homo sapiens
ucaaacaggucccaagaca

SEQ ID NO: 1429522 - RNA, 19 nt, Homo sapiens
ucaagucuaugugaaauug

SEQ ID NO: 1429523 - RNA, 19 nt, Homo sapiens
ggaagcacacuccgaaaug

SEQ ID NO: 1429524 - RNA, 19 nt, Homo sapiens
ugacauugguggcaaggaa

SEQ ID NO: 1429525 - RNA, 19 nt, Homo sapiens
cguauuauaugaucagugu

SEQ ID NO: 1429526 - RNA, 19 nt, Homo sapiens
aagaauccuucaugacuuu

SEQ ID NO: 1429527 - RNA, 19 nt, Homo sapiens
gaagcacacuccgaaaugg

SEQ ID NO: 1429528 - RNA, 19 nt, Homo sapiens
gcaaggaauagccaaguga

SEQ ID NO: 1429529 - RNA, 19 nt, Homo sapiens
gaacgccgcaggcuguuug

SEQ ID NO: 1429530 - RNA, 19 nt, Homo sapiens
gucaacaaauccuagugua

SEQ ID NO: 1429531 - RNA, 19 nt, Homo sapiens
aaauagaguugucaggaau

SEQ ID NO: 1429532 - RNA, 19 nt, Homo sapiens
caacaaauccuaguguaag

SEQ ID NO: 1429533 - RNA, 19 nt, Homo sapiens
aaaugaaccuaagugauga

SEQ ID NO: 1429534 - RNA, 19 nt, Homo sapiens
ugacuuagcacuuuguuag

SEQ ID NO: 1429535 - RNA, 19 nt, Homo sapiens
caaaagaugcugugagaaa

SEQ ID NO: 1429536 - RNA, 19 nt, Homo sapiens
gcaggagaaucacuugaac

SEQ ID NO: 1429537 - RNA, 19 nt, Homo sapiens
uagaaacgcugggacuaug

SEQ ID NO: 1429538 - RNA, 19 nt, Homo sapiens
ccauagaaaugaaccuaag

SEQ ID NO: 1429539 - RNA, 19 nt, Homo sapiens
gugcugggauuacuuuaca

SEQ ID NO: 1429540 - RNA, 19 nt, Homo sapiens
ggaauacggcaaugugcaa

SEQ ID NO: 1429541 - RNA, 19 nt, Homo sapiens
caugauuccggucagauua

SEQ ID NO: 1429542 - RNA, 19 nt, Homo sapiens
ucaacaaauccuaguguaa

SEQ ID NO: 1429543 - RNA, 19 nt, Homo sapiens
gaaauggaaacagacaaga

SEQ ID NO: 1429544 - RNA, 19 nt, Homo sapiens
ggaagggaauacggcaaug

SEQ ID NO: 1429545 - RNA, 19 nt, Homo sapiens
gccaaacucagaacuauuc

SEQ ID NO: 1429546 - RNA, 19 nt, Homo sapiens
guaccugaguuacuaggau

SEQ ID NO: 1429547 - RNA, 19 nt, Homo sapiens
ugucaggaauccaggugua

SEQ ID NO: 1429548 - RNA, 19 nt, Homo sapiens
ucagauuacuacgggauuu

SEQ ID NO: 1429549 - RNA, 19 nt, Homo sapiens
agaaaucucucuuguugcu

SEQ ID NO: 1429550 - RNA, 19 nt, Homo sapiens
cggcugugaugaugacauu

SEQ ID NO: 1429551 - RNA, 19 nt, Homo sapiens
gguguggaauaaacuuguu

SEQ ID NO: 1429552 - RNA, 19 nt, Homo sapiens
uuggguagguguggaauaa

SEQ ID NO: 1429553 - RNA, 19 nt, Homo sapiens
guagaaacgcugggacuau

SEQ ID NO: 1429554 - RNA, 19 nt, Homo sapiens
cagaacccauagaaaugaa

SEQ ID NO: 1429555 - RNA, 19 nt, Homo sapiens
aauaacagaacccauagaa

SEQ ID NO: 1429556 - RNA, 19 nt, Homo sapiens
ccaaagugcugggauuacu

SEQ ID NO: 1429557 - RNA, 19 nt, Homo sapiens
ggcaaggaauagccaagug

SEQ ID NO: 1429558 - RNA, 19 nt, Homo sapiens
ggaggcggagguugcagua

SEQ ID NO: 1429559 - RNA, 19 nt, Homo sapiens
ucaugacuuucaccauaaa

SEQ ID NO: 1429560 - RNA, 19 nt, Homo sapiens
gcacuuuguuagcaaugca

SEQ ID NO: 1429561 - RNA, 19 nt, Homo sapiens
ggaguuuuguuguuguuuu

SEQ ID NO: 1429562 - RNA, 19 nt, Homo sapiens
gcacuggcuuacgccugua

SEQ ID NO: 1429563 - RNA, 19 nt, Homo sapiens
aacaaauccuaguguaaga

SEQ ID NO: 1429564 - RNA, 19 nt, Homo sapiens
guggucaugucaacaaauc

SEQ ID NO: 1429565 - RNA, 19 nt, Homo sapiens
gcuauugagaggacuuuga

SEQ ID NO: 1429566 - RNA, 19 nt, Homo sapiens
uaccugaguuacuaggauu

SEQ ID NO: 1429567 - RNA, 19 nt, Homo sapiens
agacacuucugacuuagca

SEQ ID NO: 1429568 - RNA, 19 nt, Homo sapiens
ggcaggagaaucacuugaa

SEQ ID NO: 1429569 - RNA, 19 nt, Homo sapiens
uuucugagguacuuuagau

SEQ ID NO: 1429570 - RNA, 19 nt, Homo sapiens
uucaugacuuucaccauaa

SEQ ID NO: 1429571 - RNA, 19 nt, Homo sapiens
caagacacuucugacuuag

SEQ ID NO: 1429572 - RNA, 19 nt, Homo sapiens
ugagucggcugugaugaug

SEQ ID NO: 1429573 - RNA, 19 nt, Homo sapiens
uagaaaugaaccuaaguga

SEQ ID NO: 1429574 - RNA, 19 nt, Homo sapiens
gaagggaauacggcaaugu

SEQ ID NO: 1429575 - RNA, 19 nt, Homo sapiens
ggguagguguggaauaaac

SEQ ID NO: 1429576 - RNA, 19 nt, Homo sapiens
gagguacuuuagaugaaca

SEQ ID NO: 1429577 - RNA, 19 nt, Homo sapiens
cugagguacuuuagaugaa

SEQ ID NO: 1429578 - RNA, 19 nt, Homo sapiens
acagaacccauagaaauga

SEQ ID NO: 1429579 - RNA, 19 nt, Homo sapiens
cagcagugcagugccguua

SEQ ID NO: 1429580 - RNA, 19 nt, Homo sapiens
aaacaggucccaagacacu

SEQ ID NO: 1429581 - RNA, 19 nt, Homo sapiens
cagacaagacuguugaauc

SEQ ID NO: 1429582 - RNA, 19 nt, Homo sapiens
gcacacuccgaaauggaaa

SEQ ID NO: 1429583 - RNA, 19 nt, Homo sapiens
ggcugugccaguuuaguua

SEQ ID NO: 1429584 - RNA, 19 nt, Homo sapiens
ccuguaaucccagcacuuu

SEQ ID NO: 1429585 - RNA, 19 nt, Homo sapiens
uugagaggacuuugaaauu

SEQ ID NO: 1429586 - RNA, 19 nt, Homo sapiens
caaagaaauagaguuguca

SEQ ID NO: 1429587 - RNA, 19 nt, Homo sapiens
cgagggaagcagccuuuga

SEQ ID NO: 1429588 - RNA, 19 nt, Homo sapiens
gauuggaaggcuauugaga

SEQ ID NO: 1429589 - RNA, 19 nt, Homo sapiens
ggccgaaucuuguuuucaa

SEQ ID NO: 1429590 - RNA, 19 nt, Homo sapiens
gaggaagcacacuccgaaa

SEQ ID NO: 1429591 - RNA, 19 nt, Homo sapiens
ccuaagugaugaaagaaaa

SEQ ID NO: 1429592 - RNA, 19 nt, Homo sapiens
ccaauaacagaacccauag

SEQ ID NO: 1429593 - RNA, 19 nt, Homo sapiens
acuccgaaauggaaacaga

SEQ ID NO: 1429594 - RNA, 19 nt, Homo sapiens
cgaaauggaaacagacaag

SEQ ID NO: 1429595 - RNA, 19 nt, Homo sapiens
gcugugccaguuuaguuaa

SEQ ID NO: 1429596 - RNA, 19 nt, Homo sapiens
agaccacccuggccaacau

SEQ ID NO: 1429597 - RNA, 19 nt, Homo sapiens
aacagaacccauagaaaug

SEQ ID NO: 1429598 - RNA, 19 nt, Homo sapiens
ucagcagcucgcuuucuua

SEQ ID NO: 1429599 - RNA, 19 nt, Homo sapiens
gcuucggccucccaaagug

SEQ ID NO: 1429600 - RNA, 19 nt, Homo sapiens
uugccaaacucagaacuau

SEQ ID NO: 1429601 - RNA, 19 nt, Homo sapiens
cuucgcugcugucgcguuu

SEQ ID NO: 1429602 - RNA, 19 nt, Homo sapiens
ucugagguacuuuagauga

SEQ ID NO: 1429603 - RNA, 19 nt, Homo sapiens
gcauaugcaaauaaacauc

SEQ ID NO: 1429604 - RNA, 19 nt, Homo sapiens
cuguacgccuuucagguuu

SEQ ID NO: 1429605 - RNA, 19 nt, Homo sapiens
cagcagcucgcuuucuuag

SEQ ID NO: 1429606 - RNA, 19 nt, Homo sapiens
gagggaagcagccuuugac

SEQ ID NO: 1429607 - RNA, 19 nt, Homo sapiens
acuacgggauuucgaggaa

SEQ ID NO: 1429608 - RNA, 19 nt, Homo sapiens
cuauugagaggacuuugaa

SEQ ID NO: 1429609 - RNA, 19 nt, Homo sapiens
gaaauaggaucauuacaga

SEQ ID NO: 1429610 - RNA, 19 nt, Homo sapiens
agaagaagcuccugaguaa

SEQ ID NO: 1429611 - RNA, 19 nt, Homo sapiens
gcagugaggugcuggauga

SEQ ID NO: 1429612 - RNA, 19 nt, Homo sapiens
ggaauuaguucagaugauc

SEQ ID NO: 1429613 - RNA, 19 nt, Homo sapiens
gcaggaagauugcuugaac

SEQ ID NO: 1429614 - RNA, 19 nt, Homo sapiens
gcaaggaggcccagaagau

SEQ ID NO: 1429615 - RNA, 19 nt, Homo sapiens
ggaaauaggaucauuacag

SEQ ID NO: 1429616 - RNA, 19 nt, Homo sapiens
cagaagaagcuccugagua

SEQ ID NO: 1429617 - RNA, 19 nt, Homo sapiens
gaucauuacagauggaauu

SEQ ID NO: 1429618 - RNA, 19 nt, Homo sapiens
cccagaagaugcucaagaa

SEQ ID NO: 1429619 - RNA, 19 nt, Homo sapiens
ugaguaagauggcguccaa

SEQ ID NO: 1429620 - RNA, 19 nt, Homo sapiens
gaucaugucgccugggauu

SEQ ID NO: 1429621 - RNA, 19 nt, Homo sapiens
gaggcaggauaaucacuug

SEQ ID NO: 1429622 - RNA, 19 nt, Homo sapiens
uccauaaacucacguccua

SEQ ID NO: 1429623 - RNA, 19 nt, Homo sapiens
ugggugaccugucuccuuu

SEQ ID NO: 1429624 - RNA, 19 nt, Homo sapiens
gcagugagccgagauugug

SEQ ID NO: 1429625 - RNA, 19 nt, Homo sapiens
ggugaccugucuccuuuga

SEQ ID NO: 1429626 - RNA, 19 nt, Homo sapiens
gaccaccuuucacccguuu

SEQ ID NO: 1429627 - RNA, 19 nt, Homo sapiens
gcaggagaaucgcuugaac

SEQ ID NO: 1429628 - RNA, 19 nt, Homo sapiens
gaaaccccgucucuacuaa

SEQ ID NO: 1429629 - RNA, 19 nt, Homo sapiens
aagaagcuccugaguaaga

SEQ ID NO: 1429630 - RNA, 19 nt, Homo sapiens
cauuacagauggaauuagu

SEQ ID NO: 1429631 - RNA, 19 nt, Homo sapiens
guggcucacuacuguaauu

SEQ ID NO: 1429632 - RNA, 19 nt, Homo sapiens
gcagugagccgagauugca

SEQ ID NO: 1429633 - RNA, 19 nt, Homo sapiens
cagauggaauuaguucaga

SEQ ID NO: 1429634 - RNA, 19 nt, Homo sapiens
cugggucgcuugauguaaa

SEQ ID NO: 1429635 - RNA, 19 nt, Homo sapiens
uauaaucccagcuacuuga

SEQ ID NO: 1429636 - RNA, 19 nt, Homo sapiens
gaaaccccaucucuacuga

SEQ ID NO: 1429637 - RNA, 19 nt, Homo sapiens
caaggaggcccagaagaug

SEQ ID NO: 1429638 - RNA, 19 nt, Homo sapiens
cacuugagcccaggaguua

SEQ ID NO: 1429639 - RNA, 19 nt, Homo sapiens
gacgagggaagaucacuug

SEQ ID NO: 1429640 - RNA, 19 nt, Homo sapiens
ucgagaccauccuggcuaa

SEQ ID NO: 1429641 - RNA, 19 nt, Homo sapiens
aauaggaucauuacagaug

SEQ ID NO: 1429642 - RNA, 19 nt, Homo sapiens
ccagcuacuugagagauga

SEQ ID NO: 1429643 - RNA, 19 nt, Homo sapiens
ggccgaggcaggaagauug

SEQ ID NO: 1429644 - RNA, 19 nt, Homo sapiens
acacguauaaucccagcua

SEQ ID NO: 1429645 - RNA, 19 nt, Homo sapiens
gaucacaaggucaggagau

SEQ ID NO: 1429646 - RNA, 19 nt, Homo sapiens
uguaaucccagcacuuuga

SEQ ID NO: 1429647 - RNA, 19 nt, Homo sapiens
gauggaauuaguucagaug

SEQ ID NO: 1429648 - RNA, 19 nt, Homo sapiens
gugggacucugucuuaaaa

SEQ ID NO: 1429649 - RNA, 19 nt, Homo sapiens
gucaggagaucgagaccau

SEQ ID NO: 1429650 - RNA, 19 nt, Homo sapiens
ccuguaaucccagcacuuu

SEQ ID NO: 1429651 - RNA, 19 nt, Homo sapiens
aagauugcuugaacucaga

SEQ ID NO: 1429652 - RNA, 19 nt, Homo sapiens
gcucacuacuguaauucca

SEQ ID NO: 1429653 - RNA, 19 nt, Homo sapiens
ggaggcugaggcaggauaa

SEQ ID NO: 1429654 - RNA, 19 nt, Homo sapiens
ccuguaaucccagcacuuu

SEQ ID NO: 1429655 - RNA, 19 nt, Homo sapiens
gcccagaagaugcucaaga

SEQ ID NO: 1429656 - RNA, 19 nt, Homo sapiens
ggacguacggacucugcuu

SEQ ID NO: 1429657 - RNA, 19 nt, Homo sapiens
gcagaagaagcuccugagu

SEQ ID NO: 1429658 - RNA, 19 nt, Homo sapiens
gcagugaccgaugaucaug

SEQ ID NO: 1429659 - RNA, 19 nt, Homo sapiens
guauaaucccagcuacuug

SEQ ID NO: 1429660 - RNA, 19 nt, Homo sapiens
cccaggaccucagaagaug

SEQ ID NO: 1429661 - RNA, 19 nt, Homo sapiens
cguauaaucccagcuacuu

SEQ ID NO: 1429662 - RNA, 19 nt, Homo sapiens
agaagaugcucaagaaccu

SEQ ID NO: 1429663 - RNA, 19 nt, Homo sapiens
uggccgugcugguggauga

SEQ ID NO: 1429664 - RNA, 19 nt, Homo sapiens
ggaagauugcuugaacuca

SEQ ID NO: 1429665 - RNA, 19 nt, Homo sapiens
uuacagauggaauuaguuc

SEQ ID NO: 1429666 - RNA, 19 nt, Homo sapiens
aggcugcagugaccgauga

SEQ ID NO: 1429667 - RNA, 19 nt, Homo sapiens
ucacuugagcccaggaguu

SEQ ID NO: 1429668 - RNA, 19 nt, Homo sapiens
gggaggcugaggcaggaua

SEQ ID NO: 1429669 - RNA, 19 nt, Homo sapiens
uggaauuaguucagaugau

SEQ ID NO: 1429670 - RNA, 19 nt, Homo sapiens
gcacuucagccuggugaca

SEQ ID NO: 1429671 - RNA, 19 nt, Homo sapiens
gagaccauccuggcuaaca

SEQ ID NO: 1429672 - RNA, 19 nt, Homo sapiens
gagagaugacgagggaaga

SEQ ID NO: 1429673 - RNA, 19 nt, Homo sapiens
ccacguguucggccaccua

SEQ ID NO: 1429674 - RNA, 19 nt, Homo sapiens
aaaauuagcugggcauggu

SEQ ID NO: 1429675 - RNA, 19 nt, Homo sapiens
uuucacccguuuguacuuu

SEQ ID NO: 1429676 - RNA, 19 nt, Homo sapiens
gguguugcgugccuguagu

SEQ ID NO: 1429677 - RNA, 19 nt, Homo sapiens
gaggaggagguugcaguga

SEQ ID NO: 1429678 - RNA, 19 nt, Homo sapiens
ccgcaucaaccacguguuc

SEQ ID NO: 1429679 - RNA, 19 nt, Homo sapiens
caggaagauugcuugaacu

SEQ ID NO: 1429680 - RNA, 19 nt, Homo sapiens
gaagaagcuccugaguaag

SEQ ID NO: 1429681 - RNA, 19 nt, Homo sapiens
uaggaucauuacagaugga

SEQ ID NO: 1429682 - RNA, 19 nt, Homo sapiens
gucaauaccucauuuguaa

SEQ ID NO: 1429683 - RNA, 19 nt, Homo sapiens
gagagaagcccuauaaaug

SEQ ID NO: 1429684 - RNA, 19 nt, Homo sapiens
ggacagaaaucccacgaau

SEQ ID NO: 1429685 - RNA, 19 nt, Homo sapiens
ggagagaaaucuuacaagu

SEQ ID NO: 1429686 - RNA, 19 nt, Homo sapiens
gggacaaacucuauaaaug

SEQ ID NO: 1429687 - RNA, 19 nt, Homo sapiens
agagaaaccucacaaaugu

SEQ ID NO: 1429688 - RNA, 19 nt, Homo sapiens
ggacaaacucuauaaaugu

SEQ ID NO: 1429689 - RNA, 19 nt, Homo sapiens
gagagaaaccucacaaaug

SEQ ID NO: 1429690 - RNA, 19 nt, Homo sapiens
gagagaagcccuaugaaug

SEQ ID NO: 1429691 - RNA, 19 nt, Homo sapiens
gaugaugggacucaauuua

SEQ ID NO: 1429692 - RNA, 19 nt, Homo sapiens
gagagaaaucuuacaagua

SEQ ID NO: 1429693 - RNA, 19 nt, Homo sapiens
gagaagccauccaucaaau

SEQ ID NO: 1429694 - RNA, 19 nt, Homo sapiens
agagaaaccuuaugagugu

SEQ ID NO: 1429695 - RNA, 19 nt, Homo sapiens
ggagagaagcccuauaaau

SEQ ID NO: 1429696 - RNA, 19 nt, Homo sapiens
gaaccuggccucaguagau

SEQ ID NO: 1429697 - RNA, 19 nt, Homo sapiens
gacaaacucuauaaaugug

SEQ ID NO: 1429698 - RNA, 19 nt, Homo sapiens
gaacagacaauaccaaacu

SEQ ID NO: 1429699 - RNA, 19 nt, Homo sapiens
ggagagaaaccucacaaau

SEQ ID NO: 1429700 - RNA, 19 nt, Homo sapiens
gaugcacacuggagagaaa

SEQ ID NO: 1429701 - RNA, 19 nt, Homo sapiens
caucaaaugccagaucuua

SEQ ID NO: 1429702 - RNA, 19 nt, Homo sapiens
ggagaagccauccaucaaa

SEQ ID NO: 1429703 - RNA, 19 nt, Homo sapiens
gccaagucauucuuucuaa

SEQ ID NO: 1429704 - RNA, 19 nt, Homo sapiens
ccauaaaugugaacacugu

SEQ ID NO: 1429705 - RNA, 19 nt, Homo sapiens
gagaacaugugagaauuca

SEQ ID NO: 1429706 - RNA, 19 nt, Homo sapiens
gagaacaugugagaauuca

SEQ ID NO: 1429707 - RNA, 19 nt, Homo sapiens
gagaagcccuauaaauguc

SEQ ID NO: 1429708 - RNA, 19 nt, Homo sapiens
ggagagaagcccuaugaau

SEQ ID NO: 1429709 - RNA, 19 nt, Homo sapiens
gaaccgacacugaggagaa

SEQ ID NO: 1429710 - RNA, 19 nt, Homo sapiens
gcaucuuucuucucuuaaa

SEQ ID NO: 1429711 - RNA, 19 nt, Homo sapiens
guacacauaaugaagguaa

SEQ ID NO: 1429712 - RNA, 19 nt, Homo sapiens
ugaugggacucaauuuaaa

SEQ ID NO: 1429713 - RNA, 19 nt, Homo sapiens
ccaagucauucuuucuaaa

SEQ ID NO: 1429714 - RNA, 19 nt, Homo sapiens
gggagagccuucauuuauc

SEQ ID NO: 1429715 - RNA, 19 nt, Homo sapiens
gggaaggccuuuaccucuu

SEQ ID NO: 1429716 - RNA, 19 nt, Homo sapiens
ggagagaaaccuuaugagu

SEQ ID NO: 1429717 - RNA, 19 nt, Homo sapiens
ccauauaaaugucaggaau

SEQ ID NO: 1429718 - RNA, 19 nt, Homo sapiens
gggcaaacuuuccaacauc

SEQ ID NO: 1429719 - RNA, 19 nt, Homo sapiens
gagcacacacuaaagagaa

SEQ ID NO: 1429720 - RNA, 19 nt, Homo sapiens
gaaugucagucauacucaa

SEQ ID NO: 1429721 - RNA, 19 nt, Homo sapiens
agagaagccuuaugagugu

SEQ ID NO: 1429722 - RNA, 19 nt, Homo sapiens
agagaagccuuaugagugu

SEQ ID NO: 1429723 - RNA, 19 nt, Homo sapiens
acgcaucuuucuucucuua

SEQ ID NO: 1429724 - RNA, 19 nt, Homo sapiens
ggauguggcuguggacuuc

SEQ ID NO: 1429725 - RNA, 19 nt, Homo sapiens
guauaagugucaagcaugu

SEQ ID NO: 1429726 - RNA, 19 nt, Homo sapiens
ggagugggcuuugcuggau

SEQ ID NO: 1429727 - RNA, 19 nt, Homo sapiens
ggagagaagccuuaugagu

SEQ ID NO: 1429728 - RNA, 19 nt, Homo sapiens
ggagagaagccuuaugagu

SEQ ID NO: 1429729 - RNA, 19 nt, Homo sapiens
gggaaagccuucacuuggu

SEQ ID NO: 1429730 - RNA, 19 nt, Homo sapiens
aaagacaggccauauaaau

SEQ ID NO: 1429731 - RNA, 19 nt, Homo sapiens
ggagaagccguauaagugu

SEQ ID NO: 1429732 - RNA, 19 nt, Homo sapiens
acagaaaucccacgaaugu

SEQ ID NO: 1429733 - RNA, 19 nt, Homo sapiens
ccucacaaauguaaacaau

SEQ ID NO: 1429734 - RNA, 19 nt, Homo sapiens
cuauaaaugugaacacugu

SEQ ID NO: 1429735 - RNA, 19 nt, Homo sapiens
caaaagacaggccauauaa

SEQ ID NO: 1429736 - RNA, 19 nt, Homo sapiens
ucacgcaucuuucuucucu

SEQ ID NO: 1429737 - RNA, 19 nt, Homo sapiens
uagagaacaugugagaauu

SEQ ID NO: 1429738 - RNA, 19 nt, Homo sapiens
uagagaacaugugagaauu

SEQ ID NO: 1429739 - RNA, 19 nt, Homo sapiens
auaccaaacuucacaggaa

SEQ ID NO: 1429740 - RNA, 19 nt, Homo sapiens
gugggaaagccuucacuua

SEQ ID NO: 1429741 - RNA, 19 nt, Homo sapiens
aaagacacaugacaacaca

SEQ ID NO: 1429742 - RNA, 19 nt, Homo sapiens
gacgcacacuggagagaaa

SEQ ID NO: 1429743 - RNA, 19 nt, Homo sapiens
gaggagaagccguauaagu

SEQ ID NO: 1429744 - RNA, 19 nt, Homo sapiens
agaaaccucacaaauguaa

SEQ ID NO: 1429745 - RNA, 19 nt, Homo sapiens
gagaaaccucacaaaugua

SEQ ID NO: 1429746 - RNA, 19 nt, Homo sapiens
ugggagagccuucauuuau

SEQ ID NO: 1429747 - RNA, 19 nt, Homo sapiens
gguaaccucacauuaauuc

SEQ ID NO: 1429748 - RNA, 19 nt, Homo sapiens
gagaaaccuuaugagugua

SEQ ID NO: 1429749 - RNA, 19 nt, Homo sapiens
ucaguuagucugcaggaua

SEQ ID NO: 1429750 - RNA, 19 nt, Homo sapiens
caguuagucugcaggauau

SEQ ID NO: 1429751 - RNA, 19 nt, Homo sapiens
ucauuuaucccucgacauu

SEQ ID NO: 1429752 - RNA, 19 nt, Homo sapiens
uaccaaacuucacaggaaa

SEQ ID NO: 1429753 - RNA, 19 nt, Homo sapiens
agagaagcccuauaaaugu

SEQ ID NO: 1429754 - RNA, 19 nt, Homo sapiens
gcacugaagaccaccacaa

SEQ ID NO: 1429755 - RNA, 19 nt, Homo sapiens
caccaggagagaaaucuua

SEQ ID NO: 1429756 - RNA, 19 nt, Homo sapiens
gagaagccuuaugagugua

SEQ ID NO: 1429757 - RNA, 19 nt, Homo sapiens
gagaagccuuaugagugua

SEQ ID NO: 1429758 - RNA, 19 nt, Homo sapiens
gcagcucuauaaaugugaa

SEQ ID NO: 1429759 - RNA, 19 nt, Homo sapiens
gauauguacgggcaagaaa

SEQ ID NO: 1429760 - RNA, 19 nt, Homo sapiens
ggagagccuucauuuaucc

SEQ ID NO: 1429761 - RNA, 19 nt, Homo sapiens
agacaggccauauaaaugu

SEQ ID NO: 1429762 - RNA, 19 nt, Homo sapiens
ccucacaccuacacaguca

SEQ ID NO: 1429763 - RNA, 19 nt, Homo sapiens
ggacagucuucacgcaucu

SEQ ID NO: 1429764 - RNA, 19 nt, Homo sapiens
ugaaggcuauggcacugaa

SEQ ID NO: 1429765 - RNA, 19 nt, Homo sapiens
ugagagcacacacuaaaga

SEQ ID NO: 1429766 - RNA, 19 nt, Homo sapiens
ccacgaaugucagucauac

SEQ ID NO: 1429767 - RNA, 19 nt, Homo sapiens
gaaaccuuaugaguguaaa

SEQ ID NO: 1429768 - RNA, 19 nt, Homo sapiens
aaaggcacgucaagucuca

SEQ ID NO: 1429769 - RNA, 19 nt, Homo sapiens
gguccucaaccuuacauaa

SEQ ID NO: 1429770 - RNA, 19 nt, Homo sapiens
gaugcacacuggagagaag

SEQ ID NO: 1429771 - RNA, 19 nt, Homo sapiens
gagaagcccuaugaaugca

SEQ ID NO: 1429772 - RNA, 19 nt, Homo sapiens
acggagagcucgccuugga

SEQ ID NO: 1429773 - RNA, 19 nt, Homo sapiens
gagaaaucuuacaaguaug

SEQ ID NO: 1429774 - RNA, 19 nt, Homo sapiens
gacaauaccaaacuucaca

SEQ ID NO: 1429775 - RNA, 19 nt, Homo sapiens
ccaaacuucacaggaaaua

SEQ ID NO: 1429776 - RNA, 19 nt, Homo sapiens
gcagcuccauaaaugugaa

SEQ ID NO: 1429777 - RNA, 19 nt, Homo sapiens
caacacacacuggagagaa

SEQ ID NO: 1429778 - RNA, 19 nt, Homo sapiens
ugaagguaaucaauaugga

SEQ ID NO: 1429779 - RNA, 19 nt, Homo sapiens
guauaaugcuccagaaaau

SEQ ID NO: 1429780 - RNA, 19 nt, Homo sapiens
ccauaugaaugcaccaagu

SEQ ID NO: 1429781 - RNA, 19 nt, Homo sapiens
ugucaauaccucauuugua

SEQ ID NO: 1429782 - RNA, 19 nt, Homo sapiens
ccgcgacucuggcgaaaua

SEQ ID NO: 1429783 - RNA, 19 nt, Homo sapiens
ggagagaccuaagaaagag

SEQ ID NO: 1429784 - RNA, 19 nt, Homo sapiens
ggaaggaggagagaccuaa

SEQ ID NO: 1429785 - RNA, 19 nt, Homo sapiens
gaggagagaccuaagaaag

SEQ ID NO: 1429786 - RNA, 19 nt, Homo sapiens
ggagaccugucgcucaaca

SEQ ID NO: 1429787 - RNA, 19 nt, Homo sapiens
ggaggagagaccuaagaaa

SEQ ID NO: 1429788 - RNA, 19 nt, Homo sapiens
ggaaggagaggcugaaagc

SEQ ID NO: 1429789 - RNA, 19 nt, Homo sapiens
aggagagaccuaagaaaga

SEQ ID NO: 1429790 - RNA, 19 nt, Homo sapiens
acaccaggcccaagaagau

SEQ ID NO: 1429791 - RNA, 19 nt, Homo sapiens
gacaccaggcccaagaaga

SEQ ID NO: 1429792 - RNA, 19 nt, Homo sapiens
cugcagagaacgacgaaga

SEQ ID NO: 1429793 - RNA, 19 nt, Homo sapiens
ggacaccaggcccaagaag

SEQ ID NO: 1429794 - RNA, 19 nt, Homo sapiens
gaaggaggagagaccuaag

SEQ ID NO: 1429795 - RNA, 19 nt, Homo sapiens
gcgacucuggcgaaauaaa

SEQ ID NO: 1429796 - RNA, 19 nt, Homo sapiens
ggggagaccugucgcucaa

SEQ ID NO: 1429797 - RNA, 19 nt, Homo sapiens
cgacucuggcgaaauaaag

SEQ ID NO: 1429798 - RNA, 19 nt, Homo sapiens
ucaaagaacuccaugaaau

SEQ ID NO: 1429799 - RNA, 19 nt, Homo sapiens
ugaaauguaucuccuugua

SEQ ID NO: 1429800 - RNA, 19 nt, Homo sapiens
gacaagauuucaccauguu

SEQ ID NO: 1429801 - RNA, 19 nt, Homo sapiens
gcacuccguuucccaagaa

SEQ ID NO: 1429802 - RNA, 19 nt, Homo sapiens
ccaaagugcuggaaucaca

SEQ ID NO: 1429803 - RNA, 19 nt, Homo sapiens
ccacuuugcuuaugaucaa

SEQ ID NO: 1429804 - RNA, 19 nt, Homo sapiens
ccaaguagcugggauuaca

SEQ ID NO: 1429805 - RNA, 19 nt, Homo sapiens
gaauuggccuuucccagau

SEQ ID NO: 1429806 - RNA, 19 nt, Homo sapiens
acaagcacuucuacuauuu

SEQ ID NO: 1429807 - RNA, 19 nt, Homo sapiens
ggaacugcuugaugaaaug

SEQ ID NO: 1429808 - RNA, 19 nt, Homo sapiens
gcuucgagcugcacaagaa

SEQ ID NO: 1429809 - RNA, 19 nt, Homo sapiens
gagcaggcgucaccaagau

SEQ ID NO: 1429810 - RNA, 19 nt, Homo sapiens
cgugaacucuguaauucua

SEQ ID NO: 1429811 - RNA, 19 nt, Homo sapiens
gcuacaagcacuucuacua

SEQ ID NO: 1429812 - RNA, 19 nt, Homo sapiens
uacaagcacuucuacuauu

SEQ ID NO: 1429813 - RNA, 19 nt, Homo sapiens
gaaaucaggaacugcuuga

SEQ ID NO: 1429814 - RNA, 19 nt, Homo sapiens
ccaggaaauuauuguaguu

SEQ ID NO: 1429815 - RNA, 19 nt, Homo sapiens
ucggaacgauguccacuuu

SEQ ID NO: 1429816 - RNA, 19 nt, Homo sapiens
aaacgugaacucuguaauu

SEQ ID NO: 1429817 - RNA, 19 nt, Homo sapiens
caaagaacuccaugaaauc

SEQ ID NO: 1429818 - RNA, 19 nt, Homo sapiens
ggaacgauguccacuuugc

SEQ ID NO: 1429819 - RNA, 19 nt, Homo sapiens
gagcagggaccaucucugu

SEQ ID NO: 1429820 - RNA, 19 nt, Homo sapiens
ccaaagugcugggauuaca

SEQ ID NO: 1429821 - RNA, 19 nt, Homo sapiens
cagccgagcccucaaagaa

SEQ ID NO: 1429822 - RNA, 19 nt, Homo sapiens
uuaaaccacuuccacuuuc

SEQ ID NO: 1429823 - RNA, 19 nt, Homo sapiens
agacaagauuucaccaugu

SEQ ID NO: 1429824 - RNA, 19 nt, Homo sapiens
ggaggacgcucuggaacca

SEQ ID NO: 1429825 - RNA, 19 nt, Homo sapiens
ggaggaggacgcucuggaa

SEQ ID NO: 1429826 - RNA, 19 nt, Homo sapiens
ggaaaagcccacuguguuu

SEQ ID NO: 1429827 - RNA, 19 nt, Homo sapiens
ccagccagauacggaauaa

SEQ ID NO: 1429828 - RNA, 19 nt, Homo sapiens
gcuucugacucauuuccua

SEQ ID NO: 1429829 - RNA, 19 nt, Homo sapiens
cuacaagcacuucuacuau

SEQ ID NO: 1429830 - RNA, 19 nt, Homo sapiens
gauguccacuuugcuuaug

SEQ ID NO: 1429831 - RNA, 19 nt, Homo sapiens
ucaacaaggacaagacauu

SEQ ID NO: 1429832 - RNA, 19 nt, Homo sapiens
ucaaugcacucugcuucuu

SEQ ID NO: 1429833 - RNA, 19 nt, Homo sapiens
guacauggaccugcugaug

SEQ ID NO: 1429834 - RNA, 19 nt, Homo sapiens
caacaaggacaagacauuc

SEQ ID NO: 1429835 - RNA, 19 nt, Homo sapiens
ccucaaagaacuccaugaa

SEQ ID NO: 1429836 - RNA, 19 nt, Homo sapiens
gaacaagugcaauuaacac

SEQ ID NO: 1429837 - RNA, 19 nt, Homo sapiens
aaucgaacaagugcaauua

SEQ ID NO: 1429838 - RNA, 19 nt, Homo sapiens
ggaguccaguggcacaauc

SEQ ID NO: 1429839 - RNA, 19 nt, Homo sapiens
gaaacauucagcugacugu

SEQ ID NO: 1429840 - RNA, 19 nt, Homo sapiens
ccaccacgcccaggaaauu

SEQ ID NO: 1429841 - RNA, 19 nt, Homo sapiens
gaaaaucgaacaagugcaa

SEQ ID NO: 1429842 - RNA, 19 nt, Homo sapiens
gcugauuccugccuugucu

SEQ ID NO: 1429843 - RNA, 19 nt, Homo sapiens
acauggaccugcugaugga

SEQ ID NO: 1429844 - RNA, 19 nt, Homo sapiens
gcuggcaggaugagcauaa

SEQ ID NO: 1429845 - RNA, 19 nt, Homo sapiens
ucaagugauucuccugcuu

SEQ ID NO: 1429846 - RNA, 19 nt, Homo sapiens
ggagcuggagccacugaaa

SEQ ID NO: 1429847 - RNA, 19 nt, Homo sapiens
gaaauguaucuccuuguac

SEQ ID NO: 1429848 - RNA, 19 nt, Homo sapiens
gaaacucccaggacuuguc

SEQ ID NO: 1429849 - RNA, 19 nt, Homo sapiens
gaaccaucaucccgcuucu

SEQ ID NO: 1429850 - RNA, 19 nt, Homo sapiens
ucacgugguggacuucuuu

SEQ ID NO: 1429851 - RNA, 19 nt, Homo sapiens
acauucagcugacuguauc

SEQ ID NO: 1429852 - RNA, 19 nt, Homo sapiens
aacgugaacucuguaauuc

SEQ ID NO: 1429853 - RNA, 19 nt, Homo sapiens
aggaacugcuugaugaaau

SEQ ID NO: 1429854 - RNA, 19 nt, Homo sapiens
aaagaacuccaugaaauca

SEQ ID NO: 1429855 - RNA, 19 nt, Homo sapiens
cgaacaagugcaauuaaca

SEQ ID NO: 1429856 - RNA, 19 nt, Homo sapiens
cccagaugcugcaaacuuc

SEQ ID NO: 1429857 - RNA, 19 nt, Homo sapiens
gcaggaugagcauaaguuc

SEQ ID NO: 1429858 - RNA, 19 nt, Homo sapiens
gauggucaccgaagagaag

SEQ ID NO: 1429859 - RNA, 19 nt, Homo sapiens
gacaggguuucaccguguu

SEQ ID NO: 1429860 - RNA, 19 nt, Homo sapiens
cuacuccucaccagaauug

SEQ ID NO: 1429861 - RNA, 19 nt, Homo sapiens
caaaauccaugaguucugu

SEQ ID NO: 1429862 - RNA, 19 nt, Homo sapiens
uuuaaaccacuuccacuuu

SEQ ID NO: 1429863 - RNA, 19 nt, Homo sapiens
gaacucuguaauucuaugu

SEQ ID NO: 1429864 - RNA, 19 nt, Homo sapiens
ugaacucuguaauucuaug

SEQ ID NO: 1429865 - RNA, 19 nt, Homo sapiens
uggagccacugaaagaaau

SEQ ID NO: 1429866 - RNA, 19 nt, Homo sapiens
ggcaggaugagcauaaguu

SEQ ID NO: 1429867 - RNA, 19 nt, Homo sapiens
ggauuacaggcaugagcua

SEQ ID NO: 1429868 - RNA, 19 nt, Homo sapiens
caaaagugcugggauuaca

SEQ ID NO: 1429869 - RNA, 19 nt, Homo sapiens
ggagagcaggcgucaccaa

SEQ ID NO: 1429870 - RNA, 19 nt, Homo sapiens
gccgagcccucaaagaacu

SEQ ID NO: 1429871 - RNA, 19 nt, Homo sapiens
caccacgcccaggaaauua

SEQ ID NO: 1429872 - RNA, 19 nt, Homo sapiens
ucuacuauuucgucaagga

SEQ ID NO: 1429873 - RNA, 19 nt, Homo sapiens
gaacugcuugaugaaaugu

SEQ ID NO: 1429874 - RNA, 19 nt, Homo sapiens
gucuugaucuccugaccuu

SEQ ID NO: 1429875 - RNA, 19 nt, Homo sapiens
ggcacuccguuucccaaga

SEQ ID NO: 1429876 - RNA, 19 nt, Homo sapiens
ucgaacaagugcaauuaac

SEQ ID NO: 1429877 - RNA, 19 nt, Homo sapiens
gcaggcgucaccaagaugu

SEQ ID NO: 1429878 - RNA, 19 nt, Homo sapiens
uagccaggauggucuugau

SEQ ID NO: 1429879 - RNA, 19 nt, Homo sapiens
ggucucaaacuccugacuu

SEQ ID NO: 1429880 - RNA, 19 nt, Homo sapiens
cccaggaaauuauuguagu

SEQ ID NO: 1429881 - RNA, 19 nt, Homo sapiens
gcuucagccucccaaguag

SEQ ID NO: 1429882 - RNA, 19 nt, Homo sapiens
gagcuggagccacugaaag

SEQ ID NO: 1429883 - RNA, 19 nt, Homo sapiens
uuacaggcaugagcuacug

SEQ ID NO: 1429884 - RNA, 19 nt, Homo sapiens
gucucaaacuccugacuuc

SEQ ID NO: 1429885 - RNA, 19 nt, Homo sapiens
gaacgacuggguggcuguu

SEQ ID NO: 1429886 - RNA, 19 nt, Homo sapiens
aggcgcagaucaacaacga

SEQ ID NO: 1429887 - RNA, 19 nt, Homo sapiens
uguguacccuagaccuuug

SEQ ID NO: 1429888 - RNA, 19 nt, Homo sapiens
aagcuccgccucccagauu

SEQ ID NO: 1429889 - RNA, 19 nt, Homo sapiens
ggugggaucucggcucacu

SEQ ID NO: 1429890 - RNA, 19 nt, Homo sapiens
ccacgcccaggaaauuauu

SEQ ID NO: 1429891 - RNA, 19 nt, Homo sapiens
cuucuuccguucuucugaa

SEQ ID NO: 1429892 - RNA, 19 nt, Homo sapiens
ccgcuggugucucuucaca

SEQ ID NO: 1429893 - RNA, 19 nt, Homo sapiens
caggaacugcuugaugaaa

SEQ ID NO: 1429894 - RNA, 19 nt, Homo sapiens
gcccaggaaauuauuguag

SEQ ID NO: 1429895 - RNA, 19 nt, Homo sapiens
cuccuggguucaagugauu

SEQ ID NO: 1429896 - RNA, 19 nt, Homo sapiens
cuucuacuauuucgucaag

SEQ ID NO: 1429897 - RNA, 19 nt, Homo sapiens
caagcacuucuacuauuuc

SEQ ID NO: 1429898 - RNA, 19 nt, Homo sapiens
gaacaugaccuacuucuca

SEQ ID NO: 1429899 - RNA, 19 nt, Homo sapiens
ggaggaacaugaccuacuu

SEQ ID NO: 1429900 - RNA, 19 nt, Homo sapiens
auaaagagaugacggcaaa

SEQ ID NO: 1429901 - RNA, 19 nt, Homo sapiens
ccaccaggcucaucgugaa

SEQ ID NO: 1429902 - RNA, 19 nt, Homo sapiens
ucaccuaccugcugcucua

SEQ ID NO: 1429903 - RNA, 19 nt, Homo sapiens
ggaaguaggaaucccagaa

SEQ ID NO: 1429904 - RNA, 19 nt, Homo sapiens
ccaaugggcuggcagucau

SEQ ID NO: 1429905 - RNA, 19 nt, Homo sapiens
ccaugagcuucuuggauaa

SEQ ID NO: 1429906 - RNA, 19 nt, Homo sapiens
ucaugaagcccaucaacaa

SEQ ID NO: 1429907 - RNA, 19 nt, Homo sapiens
gcacucagguaugcguuca

SEQ ID NO: 1429908 - RNA, 19 nt, Homo sapiens
uggauaagguggccaaugg

SEQ ID NO: 1429909 - RNA, 19 nt, Homo sapiens
gaaguaggaaucccagaag

SEQ ID NO: 1429910 - RNA, 19 nt, Homo sapiens
ccauguaccucaccuacuc

SEQ ID NO: 1429911 - RNA, 19 nt, Homo sapiens
ugaagcccaucaacaagug

SEQ ID NO: 1429912 - RNA, 19 nt, Homo sapiens
ggcagcaaauaaagagaug

SEQ ID NO: 1429913 - RNA, 19 nt, Homo sapiens
ucccggagcucgucaccaa

SEQ ID NO: 1429914 - RNA, 19 nt, Homo sapiens
ggaacaggaaguaggaauc

SEQ ID NO: 1429915 - RNA, 19 nt, Homo sapiens
gcucacggcacucagguau

SEQ ID NO: 1429916 - RNA, 19 nt, Homo sapiens
caucgugaucuuccaguuu

SEQ ID NO: 1429917 - RNA, 19 nt, Homo sapiens
guaccucagcggcuucuug

SEQ ID NO: 1429918 - RNA, 19 nt, Homo sapiens
cagcggagcguucguguac

SEQ ID NO: 1429919 - RNA, 19 nt, Homo sapiens
acaagugcauugggaggaa

SEQ ID NO: 1429920 - RNA, 19 nt, Homo sapiens
ucacggcacucagguaugc

SEQ ID NO: 1429921 - RNA, 19 nt, Homo sapiens
gaaguucaucgcgaccauu

SEQ ID NO: 1429922 - RNA, 19 nt, Homo sapiens
gacuggguguggccgugua

SEQ ID NO: 1429923 - RNA, 19 nt, Homo sapiens
gccguguucucacugcuau

SEQ ID NO: 1429924 - RNA, 19 nt, Homo sapiens
gaacaggaaguaggaaucc

SEQ ID NO: 1429925 - RNA, 19 nt, Homo sapiens
ucaccucgcuggccaugac

SEQ ID NO: 1429926 - RNA, 19 nt, Homo sapiens
ccaacgaccaugagaaggu

SEQ ID NO: 1429927 - RNA, 19 nt, Homo sapiens
uggccaacaucaccgucua

SEQ ID NO: 1429928 - RNA, 19 nt, Homo sapiens
cggcagggaacaggaagua

SEQ ID NO: 1429929 - RNA, 19 nt, Homo sapiens
gcugcccugugucucugua

SEQ ID NO: 1429930 - RNA, 19 nt, Homo sapiens
gugggcauacuguacauga

SEQ ID NO: 1429931 - RNA, 19 nt, Homo sapiens
gggaacaggaaguaggaau

SEQ ID NO: 1429932 - RNA, 19 nt, Homo sapiens
ucaccaacgaccaugagaa

SEQ ID NO: 1429933 - RNA, 19 nt, Homo sapiens
ucaucgugaucuuccaguu

SEQ ID NO: 1429934 - RNA, 19 nt, Homo sapiens
caccaacgaccaugagaag

SEQ ID NO: 1429935 - RNA, 19 nt, Homo sapiens
gaccugugcgcguccaugu

SEQ ID NO: 1429936 - RNA, 19 nt, Homo sapiens
gcccguucaucgugaucuu

SEQ ID NO: 1429937 - RNA, 19 nt, Homo sapiens
aucgugaucuuccaguuug

SEQ ID NO: 1429938 - RNA, 19 nt, Homo sapiens
gaacccagcccuucucuag

SEQ ID NO: 1429939 - RNA, 19 nt, Homo sapiens
caagagggccuucgauaug

SEQ ID NO: 1429940 - RNA, 19 nt, Homo sapiens
ggaguuugcacgcuguuua

SEQ ID NO: 1429941 - RNA, 19 nt, Homo sapiens
gaacuucucccgccaugga

SEQ ID NO: 1429942 - RNA, 19 nt, Homo sapiens
ggaggcaucucggaagguu

SEQ ID NO: 1429943 - RNA, 19 nt, Homo sapiens
cagcaaauguccaguagag

SEQ ID NO: 1429944 - RNA, 19 nt, Homo sapiens
gaucugaggccaagcuaug

SEQ ID NO: 1429945 - RNA, 19 nt, Homo sapiens
ggaagcgcccagugaguuu

SEQ ID NO: 1429946 - RNA, 19 nt, Homo sapiens
gacaaguuccucucuagaa

SEQ ID NO: 1429947 - RNA, 19 nt, Homo sapiens
agaagucgguccagcaaau

SEQ ID NO: 1429948 - RNA, 19 nt, Homo sapiens
ccaagagggccuucgauau

SEQ ID NO: 1429949 - RNA, 19 nt, Homo sapiens
ggacaaguuccucucuaga

SEQ ID NO: 1429950 - RNA, 19 nt, Homo sapiens
aagagggccuucgauauga

SEQ ID NO: 1429951 - RNA, 19 nt, Homo sapiens
caucaacgaccacuccauu

SEQ ID NO: 1429952 - RNA, 19 nt, Homo sapiens
ggaaggcaguaucaucaac

SEQ ID NO: 1429953 - RNA, 19 nt, Homo sapiens
gaauccagcccagaucuga

SEQ ID NO: 1429954 - RNA, 19 nt, Homo sapiens
cuagaacccaauccaauuu

SEQ ID NO: 1429955 - RNA, 19 nt, Homo sapiens
ccagaucggaggacaaguu

SEQ ID NO: 1429956 - RNA, 19 nt, Homo sapiens
gauaugauuggccagagaa

SEQ ID NO: 1429957 - RNA, 19 nt, Homo sapiens
caaggaaggcaguaucauc

SEQ ID NO: 1429958 - RNA, 19 nt, Homo sapiens
cgauaugauuggccagaga

SEQ ID NO: 1429959 - RNA, 19 nt, Homo sapiens
cuggaggacuucaucuuug

SEQ ID NO: 1429960 - RNA, 19 nt, Homo sapiens
ggaaagcuacaugggcauu

SEQ ID NO: 1429961 - RNA, 19 nt, Homo sapiens
ucuagaacccaauccaauu

SEQ ID NO: 1429962 - RNA, 19 nt, Homo sapiens
agaggccuguggcuaguuu

SEQ ID NO: 1429963 - RNA, 19 nt, Homo sapiens
guugaugaccugcuggaaa

SEQ ID NO: 1429964 - RNA, 19 nt, Homo sapiens
caacgaccacuccauugug

SEQ ID NO: 1429965 - RNA, 19 nt, Homo sapiens
agaccaagcccagcauuga

SEQ ID NO: 1429966 - RNA, 19 nt, Homo sapiens
agauaggccuggaggacuu

SEQ ID NO: 1429967 - RNA, 19 nt, Homo sapiens
gagaccaagcccagcauug

SEQ ID NO: 1429968 - RNA, 19 nt, Homo sapiens
cccaagagggccuucgaua

SEQ ID NO: 1429969 - RNA, 19 nt, Homo sapiens
ccuggaggacuucaucuuu

SEQ ID NO: 1429970 - RNA, 19 nt, Homo sapiens
ggcuacgccuucaucaaga

SEQ ID NO: 1429971 - RNA, 19 nt, Homo sapiens
cgacgaguuugugguggaa

SEQ ID NO: 1429972 - RNA, 19 nt, Homo sapiens
uugaugaccugcuggaaag

SEQ ID NO: 1429973 - RNA, 19 nt, Homo sapiens
gaagucgguccagcaaaug

SEQ ID NO: 1429974 - RNA, 19 nt, Homo sapiens
gagguggaggucacuaaga

SEQ ID NO: 1429975 - RNA, 19 nt, Homo sapiens
agcccagcauugagaauaa

SEQ ID NO: 1429976 - RNA, 19 nt, Homo sapiens
gagaagucgguccagcaaa

SEQ ID NO: 1429977 - RNA, 19 nt, Homo sapiens
ucaacgaccacuccauugu

SEQ ID NO: 1429978 - RNA, 19 nt, Homo sapiens
acuacgagguggccaagau

SEQ ID NO: 1429979 - RNA, 19 nt, Homo sapiens
aaggaaggcaguaucauca

SEQ ID NO: 1429980 - RNA, 19 nt, Homo sapiens
gaaagcuacaugggcauuc

SEQ ID NO: 1429981 - RNA, 19 nt, Homo sapiens
ccaguagaggcgaaaguga

SEQ ID NO: 1429982 - RNA, 19 nt, Homo sapiens
gaggccaagcuaugugcua

SEQ ID NO: 1429983 - RNA, 19 nt, Homo sapiens
gcaucgaagccaucaacga

SEQ ID NO: 1429984 - RNA, 19 nt, Homo sapiens
gccaagcuaugugcuagag

SEQ ID NO: 1429985 - RNA, 19 nt, Homo sapiens
ccaccgagauuuuauucug

SEQ ID NO: 1429986 - RNA, 19 nt, Homo sapiens
ccucaacagccacaaagug

SEQ ID NO: 1429987 - RNA, 19 nt, Homo sapiens
gaagcgcccagugaguuug

SEQ ID NO: 1429988 - RNA, 19 nt, Homo sapiens
acaaaguggacaugcagaa

SEQ ID NO: 1429989 - RNA, 19 nt, Homo sapiens
gaaucaaggaaggcaguau

SEQ ID NO: 1429990 - RNA, 19 nt, Homo sapiens
ccagaacccagcccagauc

SEQ ID NO: 1429991 - RNA, 19 nt, Homo sapiens
gaggaagcgcccagugagu

SEQ ID NO: 1429992 - RNA, 19 nt, Homo sapiens
guccagcaaauguccagua

SEQ ID NO: 1429993 - RNA, 19 nt, Homo sapiens
caucaagagaaucaaggaa

SEQ ID NO: 1429994 - RNA, 19 nt, Homo sapiens
ggagguggaggucacuaag

SEQ ID NO: 1429995 - RNA, 19 nt, Homo sapiens
aagcccagcauugagaaua

SEQ ID NO: 1429996 - RNA, 19 nt, Homo sapiens
uagaacccaauccaauuug

SEQ ID NO: 1429997 - RNA, 19 nt, Homo sapiens
uggaggaagcgcccaguga

SEQ ID NO: 1429998 - RNA, 19 nt, Homo sapiens
gagggccuucgauaugauu

SEQ ID NO: 1429999 - RNA, 19 nt, Homo sapiens
gcuacgccuucaucaagag

SEQ ID NO: 1430000 - RNA, 19 nt, Homo sapiens
caaaguggacaugcagaag

SEQ ID NO: 1430001 - RNA, 19 nt, Homo sapiens
gaguuugcacgcuguuuag

SEQ ID NO: 1430002 - RNA, 19 nt, Homo sapiens
gcugggagguguuugcaaa

SEQ ID NO: 1430003 - RNA, 19 nt, Homo sapiens
uggcuaagguuggacaaua

SEQ ID NO: 1430004 - RNA, 19 nt, Homo sapiens
gagcacgcacgcacaacua

SEQ ID NO: 1430005 - RNA, 19 nt, Homo sapiens
cuacagcaccaccaguauu

SEQ ID NO: 1430006 - RNA, 19 nt, Homo sapiens
ugaaggaguggcuaagguu

SEQ ID NO: 1430007 - RNA, 19 nt, Homo sapiens
gccuacagcaccaccagua

SEQ ID NO: 1430008 - RNA, 19 nt, Homo sapiens
ggcuaagguuggacaauac

SEQ ID NO: 1430009 - RNA, 19 nt, Homo sapiens
ggagggcugggagguguuu

SEQ ID NO: 1430010 - RNA, 19 nt, Homo sapiens
cggccucccuggucaagau

SEQ ID NO: 1430011 - RNA, 19 nt, Homo sapiens
uacagcaccaccaguauug

SEQ ID NO: 1430012 - RNA, 19 nt, Homo sapiens
uuucgucaguacugggaua

SEQ ID NO: 1430013 - RNA, 19 nt, Homo sapiens
acgcacaacuacgggauug

SEQ ID NO: 1430014 - RNA, 19 nt, Homo sapiens
gaaagaaggagcaauggua

SEQ ID NO: 1430015 - RNA, 19 nt, Homo sapiens
acaaggagaugaagaccua

SEQ ID NO: 1430016 - RNA, 19 nt, Homo sapiens
gggaaaccauccagucuga

SEQ ID NO: 1430017 - RNA, 19 nt, Homo sapiens
gaugaggguuggcagguuu

SEQ ID NO: 1430018 - RNA, 19 nt, Homo sapiens
caaagaggguggcacagau

SEQ ID NO: 1430019 - RNA, 19 nt, Homo sapiens
caaacugcccugaaauaaa

SEQ ID NO: 1430020 - RNA, 19 nt, Homo sapiens
aaacugcccugaaauaaac

SEQ ID NO: 1430021 - RNA, 19 nt, Homo sapiens
caucugaucugcuggaaag

SEQ ID NO: 1430022 - RNA, 19 nt, Homo sapiens
cgacccagcuccagaagug

SEQ ID NO: 1430023 - RNA, 19 nt, Homo sapiens
acaaagcucucacaucgau

SEQ ID NO: 1430024 - RNA, 19 nt, Homo sapiens
gcacugaggcugcagaagu

SEQ ID NO: 1430025 - RNA, 19 nt, Homo sapiens
gcacgugguucccaucaag

SEQ ID NO: 1430026 - RNA, 19 nt, Homo sapiens
guaauuugcuuccgcuagu

SEQ ID NO: 1430027 - RNA, 19 nt, Homo sapiens
ccaaaugcccugggucuaa

SEQ ID NO: 1430028 - RNA, 19 nt, Homo sapiens
cagcucaucugccaacaau

SEQ ID NO: 1430029 - RNA, 19 nt, Homo sapiens
ccaaacugcccugaaauaa

SEQ ID NO: 1430030 - RNA, 19 nt, Homo sapiens
gcagaggagcggagaaaug

SEQ ID NO: 1430031 - RNA, 19 nt, Homo sapiens
ggagaaaagugacccaguu

SEQ ID NO: 1430032 - RNA, 19 nt, Homo sapiens
gaaaaccccugagcacaaa

SEQ ID NO: 1430033 - RNA, 19 nt, Homo sapiens
gcaguuacucggugucuga

SEQ ID NO: 1430034 - RNA, 19 nt, Homo sapiens
cgaggcaucucucagaauc

SEQ ID NO: 1430035 - RNA, 19 nt, Homo sapiens
ugaaauaaaccuggaguga

SEQ ID NO: 1430036 - RNA, 19 nt, Homo sapiens
gcacagaucgcagcaccuu

SEQ ID NO: 1430037 - RNA, 19 nt, Homo sapiens
gagacccgcuccuccacuu

SEQ ID NO: 1430038 - RNA, 19 nt, Homo sapiens
caacucagagguccuggaa

SEQ ID NO: 1430039 - RNA, 19 nt, Homo sapiens
gcucucacaucgauaggau

SEQ ID NO: 1430040 - RNA, 19 nt, Homo sapiens
ccguuucuaucuuccuuua

SEQ ID NO: 1430041 - RNA, 19 nt, Homo sapiens
agacacagcgugaggaaga

SEQ ID NO: 1430042 - RNA, 19 nt, Homo sapiens
ggaugaggguuggcagguu

SEQ ID NO: 1430043 - RNA, 19 nt, Homo sapiens
ggucuaagaaagaaagaga

SEQ ID NO: 1430044 - RNA, 19 nt, Homo sapiens
caaaugcccugggucuaag

SEQ ID NO: 1430045 - RNA, 19 nt, Homo sapiens
gagacaccagcuacacaua

SEQ ID NO: 1430046 - RNA, 19 nt, Homo sapiens
cccaaacugcccugaaaua

SEQ ID NO: 1430047 - RNA, 19 nt, Homo sapiens
ggccaaggcugcgacuuca

SEQ ID NO: 1430048 - RNA, 19 nt, Homo sapiens
aaagugacccaguuuagga

SEQ ID NO: 1430049 - RNA, 19 nt, Homo sapiens
ggagacacagcgugaggaa

SEQ ID NO: 1430050 - RNA, 19 nt, Homo sapiens
ggacauaguacaggagaca

SEQ ID NO: 1430051 - RNA, 19 nt, Homo sapiens
agagaaagaaggagcaaug

SEQ ID NO: 1430052 - RNA, 19 nt, Homo sapiens
caaagcaagaggcaucgaa

SEQ ID NO: 1430053 - RNA, 19 nt, Homo sapiens
ccauccaccuacacucaaa

SEQ ID NO: 1430054 - RNA, 19 nt, Homo sapiens
gacagcaguuccugagucu

SEQ ID NO: 1430055 - RNA, 19 nt, Homo sapiens
ggacacaaagcucucacau

SEQ ID NO: 1430056 - RNA, 19 nt, Homo sapiens
ugaccaagcugagccugau

SEQ ID NO: 1430057 - RNA, 19 nt, Homo sapiens
gaaaagugacccaguuuag

SEQ ID NO: 1430058 - RNA, 19 nt, Homo sapiens
ggagacaccagcuacacau

SEQ ID NO: 1430059 - RNA, 19 nt, Homo sapiens
agaagucccagucaucuga

SEQ ID NO: 1430060 - RNA, 19 nt, Homo sapiens
gcagaagucccagucaucu

SEQ ID NO: 1430061 - RNA, 19 nt, Homo sapiens
ccaaggagacgcccaucga

SEQ ID NO: 1430062 - RNA, 19 nt, Homo sapiens
gaagaccuaccgccuggau

SEQ ID NO: 1430063 - RNA, 19 nt, Homo sapiens
acagaucgcagcaccuuga

SEQ ID NO: 1430064 - RNA, 19 nt, Homo sapiens
ucaaagaggguggcacaga

SEQ ID NO: 1430065 - RNA, 19 nt, Homo sapiens
gggaggacaaggagaugaa

SEQ ID NO: 1430066 - RNA, 19 nt, Homo sapiens
ggaaaaccccugagcacaa

SEQ ID NO: 1430067 - RNA, 19 nt, Homo sapiens
cuaucuuccuuuagaaaug

SEQ ID NO: 1430068 - RNA, 19 nt, Homo sapiens
aggaugagccgcagacaug

SEQ ID NO: 1430069 - RNA, 19 nt, Homo sapiens
acagggagcagauugacuu

SEQ ID NO: 1430070 - RNA, 19 nt, Homo sapiens
gaggagaacgugguugaca

SEQ ID NO: 1430071 - RNA, 19 nt, Homo sapiens
aaagggagagggagagugu

SEQ ID NO: 1430072 - RNA, 19 nt, Homo sapiens
gagaaaagugacccaguuu

SEQ ID NO: 1430073 - RNA, 19 nt, Homo sapiens
ccacuuucagguguaauuu

SEQ ID NO: 1430074 - RNA, 19 nt, Homo sapiens
gcccugggucuaagaaaga

SEQ ID NO: 1430075 - RNA, 19 nt, Homo sapiens
gggcacauuugggacuguu

SEQ ID NO: 1430076 - RNA, 19 nt, Homo sapiens
gggccaguguccaaguugu

SEQ ID NO: 1430077 - RNA, 19 nt, Homo sapiens
cggacgguaucaacucaga

SEQ ID NO: 1430078 - RNA, 19 nt, Homo sapiens
gggagcagauugacuuccu

SEQ ID NO: 1430079 - RNA, 19 nt, Homo sapiens
gacacaaagcucucacauc

SEQ ID NO: 1430080 - RNA, 19 nt, Homo sapiens
ccaagaaccacagcucauc

SEQ ID NO: 1430081 - RNA, 19 nt, Homo sapiens
gagaaagaaggagcaaugg

SEQ ID NO: 1430082 - RNA, 19 nt, Homo sapiens
cacugaggcugcagaaguc

SEQ ID NO: 1430083 - RNA, 19 nt, Homo sapiens
gaggacaaggagaugaaga

SEQ ID NO: 1430084 - RNA, 19 nt, Homo sapiens
gcuccucccucugagaagu

SEQ ID NO: 1430085 - RNA, 19 nt, Homo sapiens
gcagagaaagaaggagcaa

SEQ ID NO: 1430086 - RNA, 19 nt, Homo sapiens
caccaaaggccacgauguc

SEQ ID NO: 1430087 - RNA, 19 nt, Homo sapiens
cggagaacagggaggauga

SEQ ID NO: 1430088 - RNA, 19 nt, Homo sapiens
gagaagucccaagcugaga

SEQ ID NO: 1430089 - RNA, 19 nt, Homo sapiens
cagcuccucccucugagaa

SEQ ID NO: 1430090 - RNA, 19 nt, Homo sapiens
caagaaccacagcucaucu

SEQ ID NO: 1430091 - RNA, 19 nt, Homo sapiens
cccgaggcaucucucagaa

SEQ ID NO: 1430092 - RNA, 19 nt, Homo sapiens
gucugagucucccuucuuc

SEQ ID NO: 1430093 - RNA, 19 nt, Homo sapiens
uggaccgcgugaccagaua

SEQ ID NO: 1430094 - RNA, 19 nt, Homo sapiens
cagcgugcaugccuacacu

SEQ ID NO: 1430095 - RNA, 19 nt, Homo sapiens
ucaaacccuucaccuuggu

SEQ ID NO: 1430096 - RNA, 19 nt, Homo sapiens
gauucuuucugcuucuaag

SEQ ID NO: 1430097 - RNA, 19 nt, Homo sapiens
ggaaagggagagggagagu

SEQ ID NO: 1430098 - RNA, 19 nt, Homo sapiens
gcccucagcucagauucca

SEQ ID NO: 1430099 - RNA, 19 nt, Homo sapiens
uuucagguguaauuugcuu

SEQ ID NO: 1430100 - RNA, 19 nt, Homo sapiens
uggaggagaacgugguuga

SEQ ID NO: 1430101 - RNA, 19 nt, Homo sapiens
gcucaucugccaacaaucc

SEQ ID NO: 1430102 - RNA, 19 nt, Homo sapiens
gcugcgacuucaccaaagg

SEQ ID NO: 1430103 - RNA, 19 nt, Homo sapiens
gcacugagccuaagauguc

SEQ ID NO: 1430104 - RNA, 19 nt, Homo sapiens
caucugagacucccaaauu

SEQ ID NO: 1430105 - RNA, 19 nt, Homo sapiens
gcaacgugauucuccuuga

SEQ ID NO: 1430106 - RNA, 19 nt, Homo sapiens
guacaggcagugcucaaua

SEQ ID NO: 1430107 - RNA, 19 nt, Homo sapiens
uacaggcagugcucaauaa

SEQ ID NO: 1430108 - RNA, 19 nt, Homo sapiens
aggcagugcucaauaaaug

SEQ ID NO: 1430109 - RNA, 19 nt, Homo sapiens
gacaaugacuuuuacauca

SEQ ID NO: 1430110 - RNA, 19 nt, Homo sapiens
ggagucagacagccuagaa

SEQ ID NO: 1430111 - RNA, 19 nt, Homo sapiens
gugcaaugcugcgaucuca

SEQ ID NO: 1430112 - RNA, 19 nt, Homo sapiens
ccgcggauguggacuggaa

SEQ ID NO: 1430113 - RNA, 19 nt, Homo sapiens
ggauuucugaguucuaaga

SEQ ID NO: 1430114 - RNA, 19 nt, Homo sapiens
caccaugccgagcuaauuu

SEQ ID NO: 1430115 - RNA, 19 nt, Homo sapiens
gagggucacugugccaauc

SEQ ID NO: 1430116 - RNA, 19 nt, Homo sapiens
ccaaaagguugcuugaaug

SEQ ID NO: 1430117 - RNA, 19 nt, Homo sapiens
ccaccucccaucccuguuu

SEQ ID NO: 1430118 - RNA, 19 nt, Homo sapiens
cgacuaugagaacauguuu

SEQ ID NO: 1430119 - RNA, 19 nt, Homo sapiens
cugaguagcugggauuaca

SEQ ID NO: 1430120 - RNA, 19 nt, Homo sapiens
guuguuguuuguuuguuug

SEQ ID NO: 1430121 - RNA, 19 nt, Homo sapiens
caauggaugaagaggagua

SEQ ID NO: 1430122 - RNA, 19 nt, Homo sapiens
gugcuggccuggagacucu

SEQ ID NO: 1430123 - RNA, 19 nt, Homo sapiens
gcaccagugggaugaacaa

SEQ ID NO: 1430124 - RNA, 19 nt, Homo sapiens
caacgugauucuccuugac

SEQ ID NO: 1430125 - RNA, 19 nt, Homo sapiens
ccaccaugccgagcuaauu

SEQ ID NO: 1430126 - RNA, 19 nt, Homo sapiens
gccgggagcugaacaaacc

SEQ ID NO: 1430127 - RNA, 19 nt, Homo sapiens
cccagccugucuacuguaa

SEQ ID NO: 1430128 - RNA, 19 nt, Homo sapiens
ccuccacucccgacuauga

SEQ ID NO: 1430129 - RNA, 19 nt, Homo sapiens
cagaggacaaugacuuuua

SEQ ID NO: 1430130 - RNA, 19 nt, Homo sapiens
gaacggccugcgagagcuu

SEQ ID NO: 1430131 - RNA, 19 nt, Homo sapiens
ggacaaugacuuuuacauc

SEQ ID NO: 1430132 - RNA, 19 nt, Homo sapiens
gaagccgggagcugaacaa

SEQ ID NO: 1430133 - RNA, 19 nt, Homo sapiens
ggggauuucugaguucuaa

SEQ ID NO: 1430134 - RNA, 19 nt, Homo sapiens
ccagaagccgggagcugaa

SEQ ID NO: 1430135 - RNA, 19 nt, Homo sapiens
cuccugaagugcugggauu

SEQ ID NO: 1430136 - RNA, 19 nt, Homo sapiens
cccaaaagguugcuugaau

SEQ ID NO: 1430137 - RNA, 19 nt, Homo sapiens
ugaagaggaguacgugauc

SEQ ID NO: 1430138 - RNA, 19 nt, Homo sapiens
cuccuggguucaagugauu

SEQ ID NO: 1430139 - RNA, 19 nt, Homo sapiens
cuucagaggacaaugacuu

SEQ ID NO: 1430140 - RNA, 19 nt, Homo sapiens
gagcaccagugggaugaac

SEQ ID NO: 1430141 - RNA, 19 nt, Homo sapiens
gugccacgugccugaauuu

SEQ ID NO: 1430142 - RNA, 19 nt, Homo sapiens
ucacccuccuguggaugua

SEQ ID NO: 1430143 - RNA, 19 nt, Homo sapiens
acuaugagaacauguuugu

SEQ ID NO: 1430144 - RNA, 19 nt, Homo sapiens
cugaagugcugggauuaca

SEQ ID NO: 1430145 - RNA, 19 nt, Homo sapiens
gaagaauggggacaggaaa

SEQ ID NO: 1430146 - RNA, 19 nt, Homo sapiens
caacuuaucuccuguguau

SEQ ID NO: 1430147 - RNA, 19 nt, Homo sapiens
gcagguaucucuuaacugu

SEQ ID NO: 1430148 - RNA, 19 nt, Homo sapiens
agaaagaccuuacaagugu

SEQ ID NO: 1430149 - RNA, 19 nt, Homo sapiens
ggaauuaggaguagucuga

SEQ ID NO: 1430150 - RNA, 19 nt, Homo sapiens
gggaaagccuucaaccaaa

SEQ ID NO: 1430151 - RNA, 19 nt, Homo sapiens
gagauaagcucugagaaca

SEQ ID NO: 1430152 - RNA, 19 nt, Homo sapiens
caaugaaugugggaaguua

SEQ ID NO: 1430153 - RNA, 19 nt, Homo sapiens
gcucugaccucaugaaaca

SEQ ID NO: 1430154 - RNA, 19 nt, Homo sapiens
gaccauaauuuguacagaa

SEQ ID NO: 1430155 - RNA, 19 nt, Homo sapiens
gggaaauucuuuaaccaaa

SEQ ID NO: 1430156 - RNA, 19 nt, Homo sapiens
cuaggaaaccguugauuua

SEQ ID NO: 1430157 - RNA, 19 nt, Homo sapiens
ccaaaggccuacccucauu

SEQ ID NO: 1430158 - RNA, 19 nt, Homo sapiens
ggacauuguuggucucaug

SEQ ID NO: 1430159 - RNA, 19 nt, Homo sapiens
gaaaggagcauggagaaug

SEQ ID NO: 1430160 - RNA, 19 nt, Homo sapiens
gaaauggaacucugcuaaa

SEQ ID NO: 1430161 - RNA, 19 nt, Homo sapiens
ggaaaccguugauuuacau

SEQ ID NO: 1430162 - RNA, 19 nt, Homo sapiens
gaaugugggaaguuauuua

SEQ ID NO: 1430163 - RNA, 19 nt, Homo sapiens
ggagaaagaccuuacaagu

SEQ ID NO: 1430164 - RNA, 19 nt, Homo sapiens
gagaaagaccuuacaagug

SEQ ID NO: 1430165 - RNA, 19 nt, Homo sapiens
guuaagaucuaccaaacug

SEQ ID NO: 1430166 - RNA, 19 nt, Homo sapiens
ggaaagccuucaaccaaag

SEQ ID NO: 1430167 - RNA, 19 nt, Homo sapiens
caacaucagauaguucaua

SEQ ID NO: 1430168 - RNA, 19 nt, Homo sapiens
gggaguaggcgagauuaua

SEQ ID NO: 1430169 - RNA, 19 nt, Homo sapiens
cauuguuggucucauguua

SEQ ID NO: 1430170 - RNA, 19 nt, Homo sapiens
caaguuacauucucuuacu

SEQ ID NO: 1430171 - RNA, 19 nt, Homo sapiens
gaauguggcugugcaggau

SEQ ID NO: 1430172 - RNA, 19 nt, Homo sapiens
gaaggggucuccagauuau

SEQ ID NO: 1430173 - RNA, 19 nt, Homo sapiens
gcagaccucuccucucucu

SEQ ID NO: 1430174 - RNA, 19 nt, Homo sapiens
gauuugaccucauuugcau

SEQ ID NO: 1430175 - RNA, 19 nt, Homo sapiens
gaaauucuucagccacauu

SEQ ID NO: 1430176 - RNA, 19 nt, Homo sapiens
gaaaauagggacugagaaa

SEQ ID NO: 1430177 - RNA, 19 nt, Homo sapiens
gcagagcaaauaaucuaaa

SEQ ID NO: 1430178 - RNA, 19 nt, Homo sapiens
gagaaaggagcauggagaa

SEQ ID NO: 1430179 - RNA, 19 nt, Homo sapiens
gaaccaauaccauaaucau

SEQ ID NO: 1430180 - RNA, 19 nt, Homo sapiens
aaauggaacucugcuaaau

SEQ ID NO: 1430181 - RNA, 19 nt, Homo sapiens
cagaaacacuggaugugau

SEQ ID NO: 1430182 - RNA, 19 nt, Homo sapiens
gcugggaccauaauuugua

SEQ ID NO: 1430183 - RNA, 19 nt, Homo sapiens
gaguuaagaucuaccaaac

SEQ ID NO: 1430184 - RNA, 19 nt, Homo sapiens
gacaaguuacauucucuua

SEQ ID NO: 1430185 - RNA, 19 nt, Homo sapiens
ccgaagcucugaccucaug

SEQ ID NO: 1430186 - RNA, 19 nt, Homo sapiens
uauagggacuguaguaucu

SEQ ID NO: 1430187 - RNA, 19 nt, Homo sapiens
gagcaaauaaucuaaaggu

SEQ ID NO: 1430188 - RNA, 19 nt, Homo sapiens
caaaccagcagaaauggaa

SEQ ID NO: 1430189 - RNA, 19 nt, Homo sapiens
guauugcccugguucaugu

SEQ ID NO: 1430190 - RNA, 19 nt, Homo sapiens
gaagcuuucuggagacaag

SEQ ID NO: 1430191 - RNA, 19 nt, Homo sapiens
gauaugugauugucaugca

SEQ ID NO: 1430192 - RNA, 19 nt, Homo sapiens
aaaagcagauccuauacua

SEQ ID NO: 1430193 - RNA, 19 nt, Homo sapiens
uagcaaaccagcagaaaug

SEQ ID NO: 1430194 - RNA, 19 nt, Homo sapiens
ggaguaggcgagauuauag

SEQ ID NO: 1430195 - RNA, 19 nt, Homo sapiens
guacagaaacacuggaugu

SEQ ID NO: 1430196 - RNA, 19 nt, Homo sapiens
agguaucucuuaacuguaa

SEQ ID NO: 1430197 - RNA, 19 nt, Homo sapiens
aaaggagcauggagaaugu

SEQ ID NO: 1430198 - RNA, 19 nt, Homo sapiens
agacaggccuuacgaaugc

SEQ ID NO: 1430199 - RNA, 19 nt, Homo sapiens
gaaacacuggaugugauua

SEQ ID NO: 1430200 - RNA, 19 nt, Homo sapiens
guaggaauuuauggguaua

SEQ ID NO: 1430201 - RNA, 19 nt, Homo sapiens
gagcagaguuaagaucuac

SEQ ID NO: 1430202 - RNA, 19 nt, Homo sapiens
ucagggaaccaauaccaua

SEQ ID NO: 1430203 - RNA, 19 nt, Homo sapiens
aauauaggguugccaaauc

SEQ ID NO: 1430204 - RNA, 19 nt, Homo sapiens
ugaaugcucccuugaaugu

SEQ ID NO: 1430205 - RNA, 19 nt, Homo sapiens
uaggcgagauuauagcaaa

SEQ ID NO: 1430206 - RNA, 19 nt, Homo sapiens
ucagaagauucacaucaga

SEQ ID NO: 1430207 - RNA, 19 nt, Homo sapiens
agaaauggaacucugcuaa

SEQ ID NO: 1430208 - RNA, 19 nt, Homo sapiens
ccacauugccagccucauu

SEQ ID NO: 1430209 - RNA, 19 nt, Homo sapiens
agaaacaacugucaaucca

SEQ ID NO: 1430210 - RNA, 19 nt, Homo sapiens
uaaagggaauuaggaguag

SEQ ID NO: 1430211 - RNA, 19 nt, Homo sapiens
ccuaggaaaccguugauuu

SEQ ID NO: 1430212 - RNA, 19 nt, Homo sapiens
gugcugugcuggcaggaaa

SEQ ID NO: 1430213 - RNA, 19 nt, Homo sapiens
gcaugaauugggucccuua

SEQ ID NO: 1430214 - RNA, 19 nt, Homo sapiens
caugaaacaucagcgaguu

SEQ ID NO: 1430215 - RNA, 19 nt, Homo sapiens
ucagggcgcugucaacuac

SEQ ID NO: 1430216 - RNA, 19 nt, Homo sapiens
gaagauucacaucagagaa

SEQ ID NO: 1430217 - RNA, 19 nt, Homo sapiens
ccaauaccauaaucaugau

SEQ ID NO: 1430218 - RNA, 19 nt, Homo sapiens
gggaaccaauaccauaauc

SEQ ID NO: 1430219 - RNA, 19 nt, Homo sapiens
gugcaacaguuucuuuuaa

SEQ ID NO: 1430220 - RNA, 19 nt, Homo sapiens
cgugaaugcucccuugaau

SEQ ID NO: 1430221 - RNA, 19 nt, Homo sapiens
ggaccauaauuuguacaga

SEQ ID NO: 1430222 - RNA, 19 nt, Homo sapiens
cagcugggaccauaauuug

SEQ ID NO: 1430223 - RNA, 19 nt, Homo sapiens
uuaggcagguaucucuuaa

SEQ ID NO: 1430224 - RNA, 19 nt, Homo sapiens
ccaauacuguaaagcagau

SEQ ID NO: 1430225 - RNA, 19 nt, Homo sapiens
gcagagaaacaacugucaa

SEQ ID NO: 1430226 - RNA, 19 nt, Homo sapiens
acaggaggauggcagagaa

SEQ ID NO: 1430227 - RNA, 19 nt, Homo sapiens
cacugcagcucuccaaaga

SEQ ID NO: 1430228 - RNA, 19 nt, Homo sapiens
caaagcuccagccucaaua

SEQ ID NO: 1430229 - RNA, 19 nt, Homo sapiens
ugaguaggaaguuggauuu

SEQ ID NO: 1430230 - RNA, 19 nt, Homo sapiens
cagagcaaauaaucuaaag

SEQ ID NO: 1430231 - RNA, 19 nt, Homo sapiens
uaagaucuaccaaacugaa

SEQ ID NO: 1430232 - RNA, 19 nt, Homo sapiens
caucagaagauucacauca

SEQ ID NO: 1430233 - RNA, 19 nt, Homo sapiens
uggcagagcaaauaaucua

SEQ ID NO: 1430234 - RNA, 19 nt, Homo sapiens
aaacacuggaugugauuaa

SEQ ID NO: 1430235 - RNA, 19 nt, Homo sapiens
caccaaggccuccuaggaa

SEQ ID NO: 1430236 - RNA, 19 nt, Homo sapiens
gcaaugaaugugggaaguu

SEQ ID NO: 1430237 - RNA, 19 nt, Homo sapiens
uaaaugugcauccgugaau

SEQ ID NO: 1430238 - RNA, 19 nt, Homo sapiens
acacuggaugugauuaaua

SEQ ID NO: 1430239 - RNA, 19 nt, Homo sapiens
gaggauggcagagaaacaa

SEQ ID NO: 1430240 - RNA, 19 nt, Homo sapiens
ccaaagcuccagccucaau

SEQ ID NO: 1430241 - RNA, 19 nt, Homo sapiens
cagggaaccaauaccauaa

SEQ ID NO: 1430242 - RNA, 19 nt, Homo sapiens
gauucaggguuugcagaaa

SEQ ID NO: 1430243 - RNA, 19 nt, Homo sapiens
ccagcugggaccauaauuu

SEQ ID NO: 1430244 - RNA, 19 nt, Homo sapiens
uguaggaauuuauggguau

SEQ ID NO: 1430245 - RNA, 19 nt, Homo sapiens
ccaccaaggccuccuagga

SEQ ID NO: 1430246 - RNA, 19 nt, Homo sapiens
acacugccuugauaacaua

SEQ ID NO: 1430247 - RNA, 19 nt, Homo sapiens
ccuggacacugccuugaua

SEQ ID NO: 1430248 - RNA, 19 nt, Homo sapiens
ggaggaaauugcugucaag

SEQ ID NO: 1430249 - RNA, 19 nt, Homo sapiens
uuccaucccuucccuauuu

SEQ ID NO: 1430250 - RNA, 19 nt, Homo sapiens
cuaagucccuuugucuuga

SEQ ID NO: 1430251 - RNA, 19 nt, Homo sapiens
ggcuuacucucccaauaaa

SEQ ID NO: 1430252 - RNA, 19 nt, Homo sapiens
ccucaggcucccucuauua

SEQ ID NO: 1430253 - RNA, 19 nt, Homo sapiens
caggcuuacucucccaaua

SEQ ID NO: 1430254 - RNA, 19 nt, Homo sapiens
gacacugccuugauaacau

SEQ ID NO: 1430255 - RNA, 19 nt, Homo sapiens
gacccacuuucuuggcaua

SEQ ID NO: 1430256 - RNA, 19 nt, Homo sapiens
acauagacccuuccacuga

SEQ ID NO: 1430257 - RNA, 19 nt, Homo sapiens
ggacacugccuugauaaca

SEQ ID NO: 1430258 - RNA, 19 nt, Homo sapiens
ccacuuucuuggcauauag

SEQ ID NO: 1430259 - RNA, 19 nt, Homo sapiens
ucugaguccucuacaaaga

SEQ ID NO: 1430260 - RNA, 19 nt, Homo sapiens
ccaccgacccacuuucuug

SEQ ID NO: 1430261 - RNA, 19 nt, Homo sapiens
ccaagucuucaaccagaua

SEQ ID NO: 1430262 - RNA, 19 nt, Homo sapiens
acaccaaacuguacagacu

SEQ ID NO: 1430263 - RNA, 19 nt, Homo sapiens
gaacacccaacaccaaacu

SEQ ID NO: 1430264 - RNA, 19 nt, Homo sapiens
gacaccaggccaacuagaa

SEQ ID NO: 1430265 - RNA, 19 nt, Homo sapiens
cggaggaaauugcugucaa

SEQ ID NO: 1430266 - RNA, 19 nt, Homo sapiens
caggcucccucuauuaaag

SEQ ID NO: 1430267 - RNA, 19 nt, Homo sapiens
ccuaagucccuuugucuug

SEQ ID NO: 1430268 - RNA, 19 nt, Homo sapiens
uagaacacccaacaccaaa

SEQ ID NO: 1430269 - RNA, 19 nt, Homo sapiens
gcacuucucgccggaggaa

SEQ ID NO: 1430270 - RNA, 19 nt, Homo sapiens
caaagacauccggguacua

SEQ ID NO: 1430271 - RNA, 19 nt, Homo sapiens
cuagaacacccaacaccaa

SEQ ID NO: 1430272 - RNA, 19 nt, Homo sapiens
gcauauagccccacuuaag

SEQ ID NO: 1430273 - RNA, 19 nt, Homo sapiens
aggcuuacucucccaauaa

SEQ ID NO: 1430274 - RNA, 19 nt, Homo sapiens
ggacaccaggccaacuaga

SEQ ID NO: 1430275 - RNA, 19 nt, Homo sapiens
ccaacuagaacacccaaca

SEQ ID NO: 1430276 - RNA, 19 nt, Homo sapiens
gacauccggguacuacauu

SEQ ID NO: 1430277 - RNA, 19 nt, Homo sapiens
cuucugaguccucuacaaa

SEQ ID NO: 1430278 - RNA, 19 nt, Homo sapiens
caccacucccuuagucuuu

SEQ ID NO: 1430279 - RNA, 19 nt, Homo sapiens
ugaguccucuacaaagaca

SEQ ID NO: 1430280 - RNA, 19 nt, Homo sapiens
uaagaccccuccucuacuu

SEQ ID NO: 1430281 - RNA, 19 nt, Homo sapiens
uauuaaagccgaucugacu

SEQ ID NO: 1430282 - RNA, 19 nt, Homo sapiens
cccaauaaaugugcuagag

SEQ ID NO: 1430283 - RNA, 19 nt, Homo sapiens
ccuaccagcacuacccuaa

SEQ ID NO: 1430284 - RNA, 19 nt, Homo sapiens
caacaccaaacuguacaga

SEQ ID NO: 1430285 - RNA, 19 nt, Homo sapiens
cucaggcucccucuauuaa

SEQ ID NO: 1430286 - RNA, 19 nt, Homo sapiens
cccacuuucuuggcauaua

SEQ ID NO: 1430287 - RNA, 19 nt, Homo sapiens
cuuacucucccaauaaaug

SEQ ID NO: 1430288 - RNA, 19 nt, Homo sapiens
ccaccacucccuuagucuu

SEQ ID NO: 1430289 - RNA, 19 nt, Homo sapiens
cacccaacaccaaacugua

SEQ ID NO: 1430290 - RNA, 19 nt, Homo sapiens
acaaagacauccggguacu

SEQ ID NO: 1430291 - RNA, 19 nt, Homo sapiens
acauccggguacuacauuu

SEQ ID NO: 1430292 - RNA, 19 nt, Homo sapiens
ucaggcucccucuauuaaa

SEQ ID NO: 1430293 - RNA, 19 nt, Homo sapiens
ggaggagcaggauggagau

SEQ ID NO: 1430294 - RNA, 19 nt, Homo sapiens
gcaagggucugcuuauuaa

SEQ ID NO: 1430295 - RNA, 19 nt, Homo sapiens
ugacaaagcugacaguaug

SEQ ID NO: 1430296 - RNA, 19 nt, Homo sapiens
gcaagaacaucgggcauga

SEQ ID NO: 1430297 - RNA, 19 nt, Homo sapiens
gaaauauaaccaagaguug

SEQ ID NO: 1430298 - RNA, 19 nt, Homo sapiens
ggaacuauccuccggugua

SEQ ID NO: 1430299 - RNA, 19 nt, Homo sapiens
gagcaacagcugcagauaa

SEQ ID NO: 1430300 - RNA, 19 nt, Homo sapiens
gaaggucccugacaaagcu

SEQ ID NO: 1430301 - RNA, 19 nt, Homo sapiens
gcgcaagggucugcuuauu

SEQ ID NO: 1430302 - RNA, 19 nt, Homo sapiens
ggagaaagaggagcugaaa

SEQ ID NO: 1430303 - RNA, 19 nt, Homo sapiens
caagcacccucuaggagaa

SEQ ID NO: 1430304 - RNA, 19 nt, Homo sapiens
cgaaauauaaccaagaguu

SEQ ID NO: 1430305 - RNA, 19 nt, Homo sapiens
gauuaaauaugacguuagg

SEQ ID NO: 1430306 - RNA, 19 nt, Homo sapiens
gagcugaaggaaagauuaa

SEQ ID NO: 1430307 - RNA, 19 nt, Homo sapiens
ggagcugaaggaaagauua

SEQ ID NO: 1430308 - RNA, 19 nt, Homo sapiens
gauaagcgaccgugugugu

SEQ ID NO: 1430309 - RNA, 19 nt, Homo sapiens
gcgcgcagcaccagauuaa

SEQ ID NO: 1430310 - RNA, 19 nt, Homo sapiens
gaacuauccuccgguguac

SEQ ID NO: 1430311 - RNA, 19 nt, Homo sapiens
ucacguaccuggaaaagaa

SEQ ID NO: 1430312 - RNA, 19 nt, Homo sapiens
aaucagagguccuacucaa

SEQ ID NO: 1430313 - RNA, 19 nt, Homo sapiens
gagacacucugaacuucug

SEQ ID NO: 1430314 - RNA, 19 nt, Homo sapiens
cgcaagggucugcuuauua

SEQ ID NO: 1430315 - RNA, 19 nt, Homo sapiens
ccacaucacguaccuggaa

SEQ ID NO: 1430316 - RNA, 19 nt, Homo sapiens
gcuacaggcccaagucuga

SEQ ID NO: 1430317 - RNA, 19 nt, Homo sapiens
ugguagaaauggcaaagaa

SEQ ID NO: 1430318 - RNA, 19 nt, Homo sapiens
ggccucaacugcaagaaca

SEQ ID NO: 1430319 - RNA, 19 nt, Homo sapiens
guacgaaauauaaccaaga

SEQ ID NO: 1430320 - RNA, 19 nt, Homo sapiens
aauaugacguuaggacuga

SEQ ID NO: 1430321 - RNA, 19 nt, Homo sapiens
ucagagguccuacucaaga

SEQ ID NO: 1430322 - RNA, 19 nt, Homo sapiens
gcguggagaugaucaaagg

SEQ ID NO: 1430323 - RNA, 19 nt, Homo sapiens
gguccucugucgaaaguuc

SEQ ID NO: 1430324 - RNA, 19 nt, Homo sapiens
caaggguccucugucgaaa

SEQ ID NO: 1430325 - RNA, 19 nt, Homo sapiens
ucaaggguccucugucgaa

SEQ ID NO: 1430326 - RNA, 19 nt, Homo sapiens
ggacaccuugguagaaaug

SEQ ID NO: 1430327 - RNA, 19 nt, Homo sapiens
ugagaaggucccugacaaa

SEQ ID NO: 1430328 - RNA, 19 nt, Homo sapiens
cugagaaggucccugacaa

SEQ ID NO: 1430329 - RNA, 19 nt, Homo sapiens
ggagcaacagcugcagaua

SEQ ID NO: 1430330 - RNA, 19 nt, Homo sapiens
gcugaaggaaagauuaaau

SEQ ID NO: 1430331 - RNA, 19 nt, Homo sapiens
gaaaauggagagagauaug

SEQ ID NO: 1430332 - RNA, 19 nt, Homo sapiens
ugaaaagcaugaagaggaa

SEQ ID NO: 1430333 - RNA, 19 nt, Homo sapiens
gagaaggucccugacaaag

SEQ ID NO: 1430334 - RNA, 19 nt, Homo sapiens
cagauaagcgaccgugugu

SEQ ID NO: 1430335 - RNA, 19 nt, Homo sapiens
gcacccucuaggagaauua

SEQ ID NO: 1430336 - RNA, 19 nt, Homo sapiens
gcgagaccuuggagcugaa

SEQ ID NO: 1430337 - RNA, 19 nt, Homo sapiens
agcaacagcugcagauaag

SEQ ID NO: 1430338 - RNA, 19 nt, Homo sapiens
ccgagacacucugaacuuc

SEQ ID NO: 1430339 - RNA, 19 nt, Homo sapiens
gccgagacacucugaacuu

SEQ ID NO: 1430340 - RNA, 19 nt, Homo sapiens
aagcugcagugccacauca

SEQ ID NO: 1430341 - RNA, 19 nt, Homo sapiens
uacgaaauauaaccaagag

SEQ ID NO: 1430342 - RNA, 19 nt, Homo sapiens
cacaucacguaccuggaaa

SEQ ID NO: 1430343 - RNA, 19 nt, Homo sapiens
gugcgcaagggucugcuua

SEQ ID NO: 1430344 - RNA, 19 nt, Homo sapiens
ugacgcacccucccuccaa

SEQ ID NO: 1430345 - RNA, 19 nt, Homo sapiens
gggagaaagaggagcugaa

SEQ ID NO: 1430346 - RNA, 19 nt, Homo sapiens
aggaaagaguugugugucu

SEQ ID NO: 1430347 - RNA, 19 nt, Homo sapiens
ccauguggcagcccaagga

SEQ ID NO: 1430348 - RNA, 19 nt, Homo sapiens
cgcagcgccugguuaagga

SEQ ID NO: 1430349 - RNA, 19 nt, Homo sapiens
gaggaccgcgcacauucug

SEQ ID NO: 1430350 - RNA, 19 nt, Homo sapiens
uccgguguacgaaauauaa

SEQ ID NO: 1430351 - RNA, 19 nt, Homo sapiens
gggagcaacagcugcagau

SEQ ID NO: 1430352 - RNA, 19 nt, Homo sapiens
ccguggaccucaugaacca

SEQ ID NO: 1430353 - RNA, 19 nt, Homo sapiens
cugacaguaugcuuacaug

SEQ ID NO: 1430354 - RNA, 19 nt, Homo sapiens
gcauguaccuuccaaauga

SEQ ID NO: 1430355 - RNA, 19 nt, Homo sapiens
gggaagaccuuggacuuua

SEQ ID NO: 1430356 - RNA, 19 nt, Homo sapiens
gcagacaccuucauguuug

SEQ ID NO: 1430357 - RNA, 19 nt, Homo sapiens
gagaagagauucaggaagu

SEQ ID NO: 1430358 - RNA, 19 nt, Homo sapiens
gaagaugagugauuauauc

SEQ ID NO: 1430359 - RNA, 19 nt, Homo sapiens
ggaugaagauggaaaggaa

SEQ ID NO: 1430360 - RNA, 19 nt, Homo sapiens
ccagagcgcugacauuaug

SEQ ID NO: 1430361 - RNA, 19 nt, Homo sapiens
aagagaagaugagugauua

SEQ ID NO: 1430362 - RNA, 19 nt, Homo sapiens
gagcauaucagccucauga

SEQ ID NO: 1430363 - RNA, 19 nt, Homo sapiens
gauuauaucuccgcuauca

SEQ ID NO: 1430364 - RNA, 19 nt, Homo sapiens
cagcugcccuuuacaacua

SEQ ID NO: 1430365 - RNA, 19 nt, Homo sapiens
ggaagaccuuggacuuuau

SEQ ID NO: 1430366 - RNA, 19 nt, Homo sapiens
gaagacggcguuccgcaua

SEQ ID NO: 1430367 - RNA, 19 nt, Homo sapiens
guucgaggcugcuugcuuu

SEQ ID NO: 1430368 - RNA, 19 nt, Homo sapiens
gcacuaacacugcuacguu

SEQ ID NO: 1430369 - RNA, 19 nt, Homo sapiens
gagaagaugagugauuaua

SEQ ID NO: 1430370 - RNA, 19 nt, Homo sapiens
gcucagcggucucccuuga

SEQ ID NO: 1430371 - RNA, 19 nt, Homo sapiens
ggacauaaacucagauuuu

SEQ ID NO: 1430372 - RNA, 19 nt, Homo sapiens
agaaaugugucuucagcua

SEQ ID NO: 1430373 - RNA, 19 nt, Homo sapiens
ccaaaggaaucaucugcuu

SEQ ID NO: 1430374 - RNA, 19 nt, Homo sapiens
gaaaugccgagaagagauu

SEQ ID NO: 1430375 - RNA, 19 nt, Homo sapiens
agcaaaggaugcagacuua

SEQ ID NO: 1430376 - RNA, 19 nt, Homo sapiens
caagagaagaugagugauu

SEQ ID NO: 1430377 - RNA, 19 nt, Homo sapiens
ucagcggucucccuugaua

SEQ ID NO: 1430378 - RNA, 19 nt, Homo sapiens
ugacucagcugcccuuuac

SEQ ID NO: 1430379 - RNA, 19 nt, Homo sapiens
gugauuauaucuccgcuau

SEQ ID NO: 1430380 - RNA, 19 nt, Homo sapiens
ucucgcaccuguccuguuu

SEQ ID NO: 1430381 - RNA, 19 nt, Homo sapiens
cuuggaugcuguucaauuu

SEQ ID NO: 1430382 - RNA, 19 nt, Homo sapiens
gcucuccacuggccuaugu

SEQ ID NO: 1430383 - RNA, 19 nt, Homo sapiens
gcaaggaagaagacaguga

SEQ ID NO: 1430384 - RNA, 19 nt, Homo sapiens
gccaagagaagaugaguga

SEQ ID NO: 1430385 - RNA, 19 nt, Homo sapiens
ggacagucuucagaaaugu

SEQ ID NO: 1430386 - RNA, 19 nt, Homo sapiens
ggaccugagugcaaguaau

SEQ ID NO: 1430387 - RNA, 19 nt, Homo sapiens
ggucucccuugauauguuu

SEQ ID NO: 1430388 - RNA, 19 nt, Homo sapiens
ugcaggagcuucuacauca

SEQ ID NO: 1430389 - RNA, 19 nt, Homo sapiens
ccauuuauccuaggacaua

SEQ ID NO: 1430390 - RNA, 19 nt, Homo sapiens
ggagaaaugccgagaagag

SEQ ID NO: 1430391 - RNA, 19 nt, Homo sapiens
gaccugagugcaaguaauu

SEQ ID NO: 1430392 - RNA, 19 nt, Homo sapiens
agaagaagguacuggacaa

SEQ ID NO: 1430393 - RNA, 19 nt, Homo sapiens
uagcucagccagauccuua

SEQ ID NO: 1430394 - RNA, 19 nt, Homo sapiens
ggccagggaugaagaugga

SEQ ID NO: 1430395 - RNA, 19 nt, Homo sapiens
cacuaacacugcuacguuu

SEQ ID NO: 1430396 - RNA, 19 nt, Homo sapiens
agaagacagugaacccaaa

SEQ ID NO: 1430397 - RNA, 19 nt, Homo sapiens
gagaaaugccgagaagaga

SEQ ID NO: 1430398 - RNA, 19 nt, Homo sapiens
cggaauaccaggagaaaug

SEQ ID NO: 1430399 - RNA, 19 nt, Homo sapiens
uaucuccgcuaucauugaa

SEQ ID NO: 1430400 - RNA, 19 nt, Homo sapiens
gaagguacuggacaacaug

SEQ ID NO: 1430401 - RNA, 19 nt, Homo sapiens
caaggaagaagacagugaa

SEQ ID NO: 1430402 - RNA, 19 nt, Homo sapiens
guacccaccugucacucuu

SEQ ID NO: 1430403 - RNA, 19 nt, Homo sapiens
ccagugggaucucuuggau

SEQ ID NO: 1430404 - RNA, 19 nt, Homo sapiens
gaagaccuuggacuuuauu

SEQ ID NO: 1430405 - RNA, 19 nt, Homo sapiens
aaccagagcgcugacauua

SEQ ID NO: 1430406 - RNA, 19 nt, Homo sapiens
gacauaaacucagauuuug

SEQ ID NO: 1430407 - RNA, 19 nt, Homo sapiens
caggagaaaugccgagaag

SEQ ID NO: 1430408 - RNA, 19 nt, Homo sapiens
aggaugaccucuucuaugg

SEQ ID NO: 1430409 - RNA, 19 nt, Homo sapiens
ccuaggacauaaacucaga

SEQ ID NO: 1430410 - RNA, 19 nt, Homo sapiens
agacggcguuccgcauaua

SEQ ID NO: 1430411 - RNA, 19 nt, Homo sapiens
ggagcuggcccuaaagcaa

SEQ ID NO: 1430412 - RNA, 19 nt, Homo sapiens
ccucuucuauggcuuccua

SEQ ID NO: 1430413 - RNA, 19 nt, Homo sapiens
gaccuaagacccaccuaug

SEQ ID NO: 1430414 - RNA, 19 nt, Homo sapiens
uggcaaaguauccggaaua

SEQ ID NO: 1430415 - RNA, 19 nt, Homo sapiens
uggacagucuucagaaaug

SEQ ID NO: 1430416 - RNA, 19 nt, Homo sapiens
ccaaggaugaccucuucua

SEQ ID NO: 1430417 - RNA, 19 nt, Homo sapiens
caacagcaacugccaagag

SEQ ID NO: 1430418 - RNA, 19 nt, Homo sapiens
caaggaugaccucuucuau

SEQ ID NO: 1430419 - RNA, 19 nt, Homo sapiens
uaaacucagacccuuguaa

SEQ ID NO: 1430420 - RNA, 19 nt, Homo sapiens
ggacaucaagcucccagau

SEQ ID NO: 1430421 - RNA, 19 nt, Homo sapiens
acaacuaugugcauuaagg

SEQ ID NO: 1430422 - RNA, 19 nt, Homo sapiens
gaagagauucaggaaguca

SEQ ID NO: 1430423 - RNA, 19 nt, Homo sapiens
ccugaagccuuacaugaag

SEQ ID NO: 1430424 - RNA, 19 nt, Homo sapiens
gacacccgccuuccacuuu

SEQ ID NO: 1430425 - RNA, 19 nt, Homo sapiens
caaagaucccgagggcaua

SEQ ID NO: 1430426 - RNA, 19 nt, Homo sapiens
caaccagagcgcugacauu

SEQ ID NO: 1430427 - RNA, 19 nt, Homo sapiens
gggcauguaccuuccaaau

SEQ ID NO: 1430428 - RNA, 19 nt, Homo sapiens
ggaccuaagacccaccuau

SEQ ID NO: 1430429 - RNA, 19 nt, Homo sapiens
gcacggaggacaucaagcu

SEQ ID NO: 1430430 - RNA, 19 nt, Homo sapiens
cagacaccuucauguuuga

SEQ ID NO: 1430431 - RNA, 19 nt, Homo sapiens
ccuggacagucuucagaaa

SEQ ID NO: 1430432 - RNA, 19 nt, Homo sapiens
ucucuuggaugcuguucaa

SEQ ID NO: 1430433 - RNA, 19 nt, Homo sapiens
gaagauggaaaggaacugu

SEQ ID NO: 1430434 - RNA, 19 nt, Homo sapiens
gaccuuggacuuuauugau

SEQ ID NO: 1430435 - RNA, 19 nt, Homo sapiens
gcaccacuaccucgacuuc

SEQ ID NO: 1430436 - RNA, 19 nt, Homo sapiens
ggugcacccugauuacauc

SEQ ID NO: 1430437 - RNA, 19 nt, Homo sapiens
uuauaucuccgcuaucauu

SEQ ID NO: 1430438 - RNA, 19 nt, Homo sapiens
aacagcaacugccaagaga

SEQ ID NO: 1430439 - RNA, 19 nt, Homo sapiens
aaaugugucuucagcuaca

SEQ ID NO: 1430440 - RNA, 19 nt, Homo sapiens
gcgcgugguuguggcacua

SEQ ID NO: 1430441 - RNA, 19 nt, Homo sapiens
guacaaccccuaccgcuuu

SEQ ID NO: 1430442 - RNA, 19 nt, Homo sapiens
aagcagacaccuucauguu

SEQ ID NO: 1430443 - RNA, 19 nt, Homo sapiens
ccacuaccucgacuucauu

SEQ ID NO: 1430444 - RNA, 19 nt, Homo sapiens
agaagguacuggacaacau

SEQ ID NO: 1430445 - RNA, 19 nt, Homo sapiens
gaccuguccugccgcuguu

SEQ ID NO: 1430446 - RNA, 19 nt, Homo sapiens
ucgcaccuguccuguuuga

SEQ ID NO: 1430447 - RNA, 19 nt, Homo sapiens
gaccaggcaccgcuguuga

SEQ ID NO: 1430448 - RNA, 19 nt, Homo sapiens
agguucagcuccuggauga

SEQ ID NO: 1430449 - RNA, 19 nt, Homo sapiens
gaccaggacucgccccaaa

SEQ ID NO: 1430450 - RNA, 19 nt, Homo sapiens
caacuaugugcauuaagga

SEQ ID NO: 1430451 - RNA, 19 nt, Homo sapiens
cauguacucuugguaugga

SEQ ID NO: 1430452 - RNA, 19 nt, Homo sapiens
gcggaagccggagcucaua

SEQ ID NO: 1430453 - RNA, 19 nt, Homo sapiens
ggaacugucagacgaggau

SEQ ID NO: 1430454 - RNA, 19 nt, Homo sapiens
uaaagaaccugcugauaaa

SEQ ID NO: 1430455 - RNA, 19 nt, Homo sapiens
gcagugagcugagauugua

SEQ ID NO: 1430456 - RNA, 19 nt, Homo sapiens
gagcugagauuguaccauu

SEQ ID NO: 1430457 - RNA, 19 nt, Homo sapiens
gauaacgggucauaaagaa

SEQ ID NO: 1430458 - RNA, 19 nt, Homo sapiens
gaaacccuaucucuacuaa

SEQ ID NO: 1430459 - RNA, 19 nt, Homo sapiens
ggagaaauguuugaauguu

SEQ ID NO: 1430460 - RNA, 19 nt, Homo sapiens
caccagacauccauugaua

SEQ ID NO: 1430461 - RNA, 19 nt, Homo sapiens
caagauaacgggucauaaa

SEQ ID NO: 1430462 - RNA, 19 nt, Homo sapiens
gagaggacuuuguuacaga

SEQ ID NO: 1430463 - RNA, 19 nt, Homo sapiens
gagaaauguuugaauguuc

SEQ ID NO: 1430464 - RNA, 19 nt, Homo sapiens
auaaagaaccugcugauaa

SEQ ID NO: 1430465 - RNA, 19 nt, Homo sapiens
agacauccauugauaguga

SEQ ID NO: 1430466 - RNA, 19 nt, Homo sapiens
gcucacgccuguaauccua

SEQ ID NO: 1430467 - RNA, 19 nt, Homo sapiens
guuaaagcauucuaaguca

SEQ ID NO: 1430468 - RNA, 19 nt, Homo sapiens
uaaaacagguugcaguaaa

SEQ ID NO: 1430469 - RNA, 19 nt, Homo sapiens
gcccgagccuucucacuga

SEQ ID NO: 1430470 - RNA, 19 nt, Homo sapiens
ccagcgccaugacaguuua

SEQ ID NO: 1430471 - RNA, 19 nt, Homo sapiens
gguguugugucccuacauu

SEQ ID NO: 1430472 - RNA, 19 nt, Homo sapiens
ccaugacaguuuacaaaug

SEQ ID NO: 1430473 - RNA, 19 nt, Homo sapiens
gcaggaggaucgcuugaac

SEQ ID NO: 1430474 - RNA, 19 nt, Homo sapiens
gcacggaggcagaacugaa

SEQ ID NO: 1430475 - RNA, 19 nt, Homo sapiens
ccagaugguuaaagcauuc

SEQ ID NO: 1430476 - RNA, 19 nt, Homo sapiens
ggaggucagcacaagauaa

SEQ ID NO: 1430477 - RNA, 19 nt, Homo sapiens
gagggcagaucaccuaagg

SEQ ID NO: 1430478 - RNA, 19 nt, Homo sapiens
gagagaggacuuuguuaca

SEQ ID NO: 1430479 - RNA, 19 nt, Homo sapiens
cauaaagaaccugcugaua

SEQ ID NO: 1430480 - RNA, 19 nt, Homo sapiens
gguuaaagcauucuaaguc

SEQ ID NO: 1430481 - RNA, 19 nt, Homo sapiens
guccggugcuucuguaaga

SEQ ID NO: 1430482 - RNA, 19 nt, Homo sapiens
ggagagguaguaaguagug

SEQ ID NO: 1430483 - RNA, 19 nt, Homo sapiens
gcugagagaggacuuuguu

SEQ ID NO: 1430484 - RNA, 19 nt, Homo sapiens
gacaagaagggaagcagaa

SEQ ID NO: 1430485 - RNA, 19 nt, Homo sapiens
caugacaguuuacaaaugc

SEQ ID NO: 1430486 - RNA, 19 nt, Homo sapiens
gacaggaguccagcucaua

SEQ ID NO: 1430487 - RNA, 19 nt, Homo sapiens
gguaggaggucagcacaag

SEQ ID NO: 1430488 - RNA, 19 nt, Homo sapiens
caacguggcgaaacccuau

SEQ ID NO: 1430489 - RNA, 19 nt, Homo sapiens
ggaggcguguauuguggaa

SEQ ID NO: 1430490 - RNA, 19 nt, Homo sapiens
gcaagggcacugcuaugga

SEQ ID NO: 1430491 - RNA, 19 nt, Homo sapiens
gaagggacuccgagcacuu

SEQ ID NO: 1430492 - RNA, 19 nt, Homo sapiens
gauaaaacagguugcagua

SEQ ID NO: 1430493 - RNA, 19 nt, Homo sapiens
ggaauaggagcuggguaaa

SEQ ID NO: 1430494 - RNA, 19 nt, Homo sapiens
ggaagaagcccagauugcu

SEQ ID NO: 1430495 - RNA, 19 nt, Homo sapiens
uggaauaggagcuggguaa

SEQ ID NO: 1430496 - RNA, 19 nt, Homo sapiens
gaaggugcuuuggaacagu

SEQ ID NO: 1430497 - RNA, 19 nt, Homo sapiens
gcgaaacccuaucucuacu

SEQ ID NO: 1430498 - RNA, 19 nt, Homo sapiens
gaugguuaaagcauucuaa

SEQ ID NO: 1430499 - RNA, 19 nt, Homo sapiens
gagagguaguaaguaguga

SEQ ID NO: 1430500 - RNA, 19 nt, Homo sapiens
gggagaaauguuugaaugu

SEQ ID NO: 1430501 - RNA, 19 nt, Homo sapiens
ggggagaaauguuugaaug

SEQ ID NO: 1430502 - RNA, 19 nt, Homo sapiens
ggacuuuguuacagauggu

SEQ ID NO: 1430503 - RNA, 19 nt, Homo sapiens
gagcaccagacauccauug

SEQ ID NO: 1430504 - RNA, 19 nt, Homo sapiens
caccaugggcggucaagaa

SEQ ID NO: 1430505 - RNA, 19 nt, Homo sapiens
gcaccagacauccauugau

SEQ ID NO: 1430506 - RNA, 19 nt, Homo sapiens
uaagucacgggaucaggua

SEQ ID NO: 1430507 - RNA, 19 nt, Homo sapiens
cuggagagguaguaaguag

SEQ ID NO: 1430508 - RNA, 19 nt, Homo sapiens
ggcgaaacccuaucucuac

SEQ ID NO: 1430509 - RNA, 19 nt, Homo sapiens
cacaagauaacgggucaua

SEQ ID NO: 1430510 - RNA, 19 nt, Homo sapiens
ggccagugguugcgguguu

SEQ ID NO: 1430511 - RNA, 19 nt, Homo sapiens
auaccaagauggcgacaag

SEQ ID NO: 1430512 - RNA, 19 nt, Homo sapiens
aaaaugaggcugaaaccua

SEQ ID NO: 1430513 - RNA, 19 nt, Homo sapiens
gagucugucucaaacaaac

SEQ ID NO: 1430514 - RNA, 19 nt, Homo sapiens
cgaaacccuaucucuacua

SEQ ID NO: 1430515 - RNA, 19 nt, Homo sapiens
uggcgaaacccuaucucua

SEQ ID NO: 1430516 - RNA, 19 nt, Homo sapiens
ccagacauccauugauagu

SEQ ID NO: 1430517 - RNA, 19 nt, Homo sapiens
cgccaugacaguuuacaaa

SEQ ID NO: 1430518 - RNA, 19 nt, Homo sapiens
ccuguaaucccagcuacua

SEQ ID NO: 1430519 - RNA, 19 nt, Homo sapiens
gccaugacaguuuacaaau

SEQ ID NO: 1430520 - RNA, 19 nt, Homo sapiens
agauaacgggucauaaaga

SEQ ID NO: 1430521 - RNA, 19 nt, Homo sapiens
cccagaugguuaaagcauu

SEQ ID NO: 1430522 - RNA, 19 nt, Homo sapiens
ggaacaguccggugcuucu

SEQ ID NO: 1430523 - RNA, 19 nt, Homo sapiens
gaggaugaggcaagcucua

SEQ ID NO: 1430524 - RNA, 19 nt, Homo sapiens
uuucauccgugccaucuuc

SEQ ID NO: 1430525 - RNA, 19 nt, Homo sapiens
gaggucagcacaagauaac

SEQ ID NO: 1430526 - RNA, 19 nt, Homo sapiens
aauaggagcuggguaaaau

SEQ ID NO: 1430527 - RNA, 19 nt, Homo sapiens
guaagaggcguuugaaccu

SEQ ID NO: 1430528 - RNA, 19 nt, Homo sapiens
cagaaggugcuuuggaaca

SEQ ID NO: 1430529 - RNA, 19 nt, Homo sapiens
ugguacugcuggagaggua

SEQ ID NO: 1430530 - RNA, 19 nt, Homo sapiens
gccagugguugcgguguug

SEQ ID NO: 1430531 - RNA, 19 nt, Homo sapiens
aacccuaucucuacuaaaa

SEQ ID NO: 1430532 - RNA, 19 nt, Homo sapiens
aaggagggcagaucaccua

SEQ ID NO: 1430533 - RNA, 19 nt, Homo sapiens
agagaggacuuuguuacag

SEQ ID NO: 1430534 - RNA, 19 nt, Homo sapiens
ugagagaggacuuuguuac

SEQ ID NO: 1430535 - RNA, 19 nt, Homo sapiens
ccaaggugcgucagaucuu

SEQ ID NO: 1430536 - RNA, 19 nt, Homo sapiens
gaacaguccggugcuucug

SEQ ID NO: 1430537 - RNA, 19 nt, Homo sapiens
gaaaccuacugggcugcau

SEQ ID NO: 1430538 - RNA, 19 nt, Homo sapiens
aagucuagcuucaccuauc

SEQ ID NO: 1430539 - RNA, 19 nt, Homo sapiens
aaaauuagcugggcauggu

SEQ ID NO: 1430540 - RNA, 19 nt, Homo sapiens
ggccaaggagggcagauca

SEQ ID NO: 1430541 - RNA, 19 nt, Homo sapiens
gccuguaauccuagcauuu

SEQ ID NO: 1430542 - RNA, 19 nt, Homo sapiens
ccucuggucguccucauug

SEQ ID NO: 1430543 - RNA, 19 nt, Homo sapiens
cugcauucccagaugguua

SEQ ID NO: 1430544 - RNA, 19 nt, Homo sapiens
ccgagcacuuggugagaau

SEQ ID NO: 1430545 - RNA, 19 nt, Homo sapiens
ccuaaggucaggaguucaa

SEQ ID NO: 1430546 - RNA, 19 nt, Homo sapiens
aaacagguugcaguaaaga

SEQ ID NO: 1430547 - RNA, 19 nt, Homo sapiens
cagauguccaggcagauga

SEQ ID NO: 1430548 - RNA, 19 nt, Homo sapiens
gaauaggagcuggguaaaa

SEQ ID NO: 1430549 - RNA, 19 nt, Homo sapiens
cgugggaggaggacaagaa

SEQ ID NO: 1430550 - RNA, 19 nt, Homo sapiens
guagugagcuccccaucgu

SEQ ID NO: 1430551 - RNA, 19 nt, Homo sapiens
agaggacuuuguuacagau

SEQ ID NO: 1430552 - RNA, 19 nt, Homo sapiens
ccaagauggcgacaagagu

SEQ ID NO: 1430553 - RNA, 19 nt, Homo sapiens
guaggaggucagcacaaga

SEQ ID NO: 1430554 - RNA, 19 nt, Homo sapiens
gaagagaaguugccacuaa

SEQ ID NO: 1430555 - RNA, 19 nt, Homo sapiens
gaaacuccaucucuacuaa

SEQ ID NO: 1430556 - RNA, 19 nt, Homo sapiens
ggaaagagguugcuagaag

SEQ ID NO: 1430557 - RNA, 19 nt, Homo sapiens
gcagaacaguaccgucuua

SEQ ID NO: 1430558 - RNA, 19 nt, Homo sapiens
uaaaucagccuuugacaua

SEQ ID NO: 1430559 - RNA, 19 nt, Homo sapiens
ugacauagcucuggagaaa

SEQ ID NO: 1430560 - RNA, 19 nt, Homo sapiens
ugagguagaugcuguagua

SEQ ID NO: 1430561 - RNA, 19 nt, Homo sapiens
gagcugauguccaugcuuu

SEQ ID NO: 1430562 - RNA, 19 nt, Homo sapiens
gagcugagaucgcaccauu

SEQ ID NO: 1430563 - RNA, 19 nt, Homo sapiens
ccaaauuucuuagcucaua

SEQ ID NO: 1430564 - RNA, 19 nt, Homo sapiens
gaaauuccguugacucauc

SEQ ID NO: 1430565 - RNA, 19 nt, Homo sapiens
uaacugacuuucucacaaa

SEQ ID NO: 1430566 - RNA, 19 nt, Homo sapiens
guaagaaacugaaauaagc

SEQ ID NO: 1430567 - RNA, 19 nt, Homo sapiens
gaacguugauggcaaaugg

SEQ ID NO: 1430568 - RNA, 19 nt, Homo sapiens
ccacaucacugagaagaaa

SEQ ID NO: 1430569 - RNA, 19 nt, Homo sapiens
ucaagaacauccuggcuaa

SEQ ID NO: 1430570 - RNA, 19 nt, Homo sapiens
gagcaagacuguaucucaa

SEQ ID NO: 1430571 - RNA, 19 nt, Homo sapiens
uggcaacuguuucaucuua

SEQ ID NO: 1430572 - RNA, 19 nt, Homo sapiens
gaauaaaggaccaaauuuc

SEQ ID NO: 1430573 - RNA, 19 nt, Homo sapiens
gacaccagcuccuaaagaa

SEQ ID NO: 1430574 - RNA, 19 nt, Homo sapiens
ggccagccauuuauuguaa

SEQ ID NO: 1430575 - RNA, 19 nt, Homo sapiens
agaaucaggugaauguuaa

SEQ ID NO: 1430576 - RNA, 19 nt, Homo sapiens
ccacagagccucacacuag

SEQ ID NO: 1430577 - RNA, 19 nt, Homo sapiens
gaagagaauuuucccuuuu

SEQ ID NO: 1430578 - RNA, 19 nt, Homo sapiens
cagaggagacuguaauuaa

SEQ ID NO: 1430579 - RNA, 19 nt, Homo sapiens
gaauauaguccauuuccaa

SEQ ID NO: 1430580 - RNA, 19 nt, Homo sapiens
ggaaauauacagaagacaa

SEQ ID NO: 1430581 - RNA, 19 nt, Homo sapiens
gcacuguguucauauuaau

SEQ ID NO: 1430582 - RNA, 19 nt, Homo sapiens
gcucauaucauugcuuuaa

SEQ ID NO: 1430583 - RNA, 19 nt, Homo sapiens
gcagaggagacuguaauua

SEQ ID NO: 1430584 - RNA, 19 nt, Homo sapiens
ccaaggacaugcugaagau

SEQ ID NO: 1430585 - RNA, 19 nt, Homo sapiens
gacuguaucucaaaggaaa

SEQ ID NO: 1430586 - RNA, 19 nt, Homo sapiens
agaggagacuguaauuaaa

SEQ ID NO: 1430587 - RNA, 19 nt, Homo sapiens
gcaggaacucccaaccuua

SEQ ID NO: 1430588 - RNA, 19 nt, Homo sapiens
ggaagaagaagagaaguug

SEQ ID NO: 1430589 - RNA, 19 nt, Homo sapiens
cagaaucaggugaauguua

SEQ ID NO: 1430590 - RNA, 19 nt, Homo sapiens
gaugacagcuuugcauugg

SEQ ID NO: 1430591 - RNA, 19 nt, Homo sapiens
ccaagaugaugaagugaga

SEQ ID NO: 1430592 - RNA, 19 nt, Homo sapiens
ggagugcgguggugcaauc

SEQ ID NO: 1430593 - RNA, 19 nt, Homo sapiens
gcaacuguuucaucuuaau

SEQ ID NO: 1430594 - RNA, 19 nt, Homo sapiens
caaggaaggcaaugaaaga

SEQ ID NO: 1430595 - RNA, 19 nt, Homo sapiens
gaauguuaauccagagaga

SEQ ID NO: 1430596 - RNA, 19 nt, Homo sapiens
uagcucauaucauugcuuu

SEQ ID NO: 1430597 - RNA, 19 nt, Homo sapiens
gguaauauccaaacuucaa

SEQ ID NO: 1430598 - RNA, 19 nt, Homo sapiens
gagccaacccugugacuga

SEQ ID NO: 1430599 - RNA, 19 nt, Homo sapiens
gaggucagaucaagaacau

SEQ ID NO: 1430600 - RNA, 19 nt, Homo sapiens
gcaagacuguaucucaaag

SEQ ID NO: 1430601 - RNA, 19 nt, Homo sapiens
agaaaccugugucuacaaa

SEQ ID NO: 1430602 - RNA, 19 nt, Homo sapiens
gguagaugcuguaguaguc

SEQ ID NO: 1430603 - RNA, 19 nt, Homo sapiens
ugacugacccugugaguau

SEQ ID NO: 1430604 - RNA, 19 nt, Homo sapiens
gaaggaaacgggacuaaac

SEQ ID NO: 1430605 - RNA, 19 nt, Homo sapiens
gaaagagcaggaagcagaa

SEQ ID NO: 1430606 - RNA, 19 nt, Homo sapiens
ucgcaagccuuauuucuuc

SEQ ID NO: 1430607 - RNA, 19 nt, Homo sapiens
ugagaacguugauggcaaa

SEQ ID NO: 1430608 - RNA, 19 nt, Homo sapiens
gugcaucaucuuucuguua

SEQ ID NO: 1430609 - RNA, 19 nt, Homo sapiens
gcaggaagcagaacaguac

SEQ ID NO: 1430610 - RNA, 19 nt, Homo sapiens
ugacagggagucuuaacua

SEQ ID NO: 1430611 - RNA, 19 nt, Homo sapiens
gagagaagacaaacagugu

SEQ ID NO: 1430612 - RNA, 19 nt, Homo sapiens
gucaagagauuaagaucau

SEQ ID NO: 1430613 - RNA, 19 nt, Homo sapiens
gaacaguaccgucuuaagc

SEQ ID NO: 1430614 - RNA, 19 nt, Homo sapiens
aaagaauacugcauguugu

SEQ ID NO: 1430615 - RNA, 19 nt, Homo sapiens
ccuguaaucccaacacuuu

SEQ ID NO: 1430616 - RNA, 19 nt, Homo sapiens
gaagaugacagcuuugcau

SEQ ID NO: 1430617 - RNA, 19 nt, Homo sapiens
gacagggagucuuaacuag

SEQ ID NO: 1430618 - RNA, 19 nt, Homo sapiens
gagccucacacuagaguuu

SEQ ID NO: 1430619 - RNA, 19 nt, Homo sapiens
gaaguugccacuaacaaag

SEQ ID NO: 1430620 - RNA, 19 nt, Homo sapiens
agaagugccucagcagaaa

SEQ ID NO: 1430621 - RNA, 19 nt, Homo sapiens
gcaggagaauugcuugaac

SEQ ID NO: 1430622 - RNA, 19 nt, Homo sapiens
gacaaacaguguggaggaa

SEQ ID NO: 1430623 - RNA, 19 nt, Homo sapiens
gccaauacagaggaaauua

SEQ ID NO: 1430624 - RNA, 19 nt, Homo sapiens
gcaccuaugguuccagcua

SEQ ID NO: 1430625 - RNA, 19 nt, Homo sapiens
cauuaugugucuauaguuc

SEQ ID NO: 1430626 - RNA, 19 nt, Homo sapiens
caggaacucccaaccuuaa

SEQ ID NO: 1430627 - RNA, 19 nt, Homo sapiens
acaaagaaaccaaggauag

SEQ ID NO: 1430628 - RNA, 19 nt, Homo sapiens
uaacaaagaaaccaaggau

SEQ ID NO: 1430629 - RNA, 19 nt, Homo sapiens
gcagggaugcccggacuaa

SEQ ID NO: 1430630 - RNA, 19 nt, Homo sapiens
ucacaaggucaagagauua

SEQ ID NO: 1430631 - RNA, 19 nt, Homo sapiens
gcaaggaaggcaaugaaag

SEQ ID NO: 1430632 - RNA, 19 nt, Homo sapiens
caaacaguguggaggaaag

SEQ ID NO: 1430633 - RNA, 19 nt, Homo sapiens
caagauggacagcaaguuc

SEQ ID NO: 1430634 - RNA, 19 nt, Homo sapiens
gcaggagaaucgcuugaac

SEQ ID NO: 1430635 - RNA, 19 nt, Homo sapiens
agucuuaacuagagaagga

SEQ ID NO: 1430636 - RNA, 19 nt, Homo sapiens
gaagagaaaaggaauauag

SEQ ID NO: 1430637 - RNA, 19 nt, Homo sapiens
ggauaggagagaagacaaa

SEQ ID NO: 1430638 - RNA, 19 nt, Homo sapiens
gcuuucagcaaauuugaua

SEQ ID NO: 1430639 - RNA, 19 nt, Homo sapiens
gcagaaaggcgaugaaccu

SEQ ID NO: 1430640 - RNA, 19 nt, Homo sapiens
ggcaacuguuucaucuuaa

SEQ ID NO: 1430641 - RNA, 19 nt, Homo sapiens
ggaaagcaaggaaggcaau

SEQ ID NO: 1430642 - RNA, 19 nt, Homo sapiens
guuaaccucgcaagccuua

SEQ ID NO: 1430643 - RNA, 19 nt, Homo sapiens
gcacaucguggaacugcuu

SEQ ID NO: 1430644 - RNA, 19 nt, Homo sapiens
cagaagugccucagcagaa

SEQ ID NO: 1430645 - RNA, 19 nt, Homo sapiens
gagaaggaaacgggacuaa

SEQ ID NO: 1430646 - RNA, 19 nt, Homo sapiens
gagaaguugccacuaacaa

SEQ ID NO: 1430647 - RNA, 19 nt, Homo sapiens
agaaugggagcaugaguuu

SEQ ID NO: 1430648 - RNA, 19 nt, Homo sapiens
aggaagcaaugcagaauca

SEQ ID NO: 1430649 - RNA, 19 nt, Homo sapiens
gaaaaggccaagaugauga

SEQ ID NO: 1430650 - RNA, 19 nt, Homo sapiens
uaguucagaugcuugugua

SEQ ID NO: 1430651 - RNA, 19 nt, Homo sapiens
gugcgguggugcaaucuug

SEQ ID NO: 1430652 - RNA, 19 nt, Homo sapiens
cauggcaacuguuucaucu

SEQ ID NO: 1430653 - RNA, 19 nt, Homo sapiens
gaauggugcagaugugaau

SEQ ID NO: 1430654 - RNA, 19 nt, Homo sapiens
gcacaaauccaacaagaaa

SEQ ID NO: 1430655 - RNA, 19 nt, Homo sapiens
ggacagggauuccagucua

SEQ ID NO: 1430656 - RNA, 19 nt, Homo sapiens
gaucagaguucucacuaug

SEQ ID NO: 1430657 - RNA, 19 nt, Homo sapiens
guucaaggcugcuacaaga

SEQ ID NO: 1430658 - RNA, 19 nt, Homo sapiens
ggccagagcuaucauuaug

SEQ ID NO: 1430659 - RNA, 19 nt, Homo sapiens
ggccagaguucccacuaua

SEQ ID NO: 1430660 - RNA, 19 nt, Homo sapiens
gaaccauccuucuauccaa

SEQ ID NO: 1430661 - RNA, 19 nt, Homo sapiens
gaccaaaguucucacuaug

SEQ ID NO: 1430662 - RNA, 19 nt, Homo sapiens
gcaacaacauaauagacaa

SEQ ID NO: 1430663 - RNA, 19 nt, Homo sapiens
gaccagaguuaucauuaug

SEQ ID NO: 1430664 - RNA, 19 nt, Homo sapiens
gcagaaauccuacccauac

SEQ ID NO: 1430665 - RNA, 19 nt, Homo sapiens
gcagaacggccaccaggua

SEQ ID NO: 1430666 - RNA, 19 nt, Homo sapiens
ggucagaguucccacuaug

SEQ ID NO: 1430667 - RNA, 19 nt, Homo sapiens
gcaaacccaugaagacaag

SEQ ID NO: 1430668 - RNA, 19 nt, Homo sapiens
ccaauucaauaccuuucua

SEQ ID NO: 1430669 - RNA, 19 nt, Homo sapiens
aaaccuauaugucgaguuc

SEQ ID NO: 1430670 - RNA, 19 nt, Homo sapiens
caucagcaacaacauaaua

SEQ ID NO: 1430671 - RNA, 19 nt, Homo sapiens
aaagagagguaucaaggau

SEQ ID NO: 1430672 - RNA, 19 nt, Homo sapiens
gaaagagagguaucaagga

SEQ ID NO: 1430673 - RNA, 19 nt, Homo sapiens
gagcagggccaucaaacuu

SEQ ID NO: 1430674 - RNA, 19 nt, Homo sapiens
gaagagcagggccaucaaa

SEQ ID NO: 1430675 - RNA, 19 nt, Homo sapiens
ccaagggacugaaggaaca

SEQ ID NO: 1430676 - RNA, 19 nt, Homo sapiens
ucaaggaucucagaaucaa

SEQ ID NO: 1430677 - RNA, 19 nt, Homo sapiens
uaucaaggaucucagaauc

SEQ ID NO: 1430678 - RNA, 19 nt, Homo sapiens
uacaagagccgagaacaua

SEQ ID NO: 1430679 - RNA, 19 nt, Homo sapiens
uagcacaaauccaacaaga

SEQ ID NO: 1430680 - RNA, 19 nt, Homo sapiens
cacaaacucuuagcacaaa

SEQ ID NO: 1430681 - RNA, 19 nt, Homo sapiens
ggacugaaggaacaagaaa

SEQ ID NO: 1430682 - RNA, 19 nt, Homo sapiens
gaaauacaagggcaaaaua

SEQ ID NO: 1430683 - RNA, 19 nt, Homo sapiens
agaccaaaguucucacuau

SEQ ID NO: 1430684 - RNA, 19 nt, Homo sapiens
gagcagaaccaucagagau

SEQ ID NO: 1430685 - RNA, 19 nt, Homo sapiens
ggccagaguuuccacuaug

SEQ ID NO: 1430686 - RNA, 19 nt, Homo sapiens
ggccaaaguucccacuaug

SEQ ID NO: 1430687 - RNA, 19 nt, Homo sapiens
gaaauccuacccauacuag

SEQ ID NO: 1430688 - RNA, 19 nt, Homo sapiens
gcaaacucaugaagaggau

SEQ ID NO: 1430689 - RNA, 19 nt, Homo sapiens
ucaccaacacaaacucuua

SEQ ID NO: 1430690 - RNA, 19 nt, Homo sapiens
ggacaggaaggguaccaaa

SEQ ID NO: 1430691 - RNA, 19 nt, Homo sapiens
ccaaaguucucacuauggu

SEQ ID NO: 1430692 - RNA, 19 nt, Homo sapiens
ggccagaguucccacuaug

SEQ ID NO: 1430693 - RNA, 19 nt, Homo sapiens
ggccagaguucccacuaug

SEQ ID NO: 1430694 - RNA, 19 nt, Homo sapiens
ggccagaguucccacuaug

SEQ ID NO: 1430695 - RNA, 19 nt, Homo sapiens
ggccagaguucccacuaug

SEQ ID NO: 1430696 - RNA, 19 nt, Homo sapiens
gaguucaccuuuaauucga

SEQ ID NO: 1430697 - RNA, 19 nt, Homo sapiens
gaucagggaggcuaaguca

SEQ ID NO: 1430698 - RNA, 19 nt, Homo sapiens
guacuagcauucacguaag

SEQ ID NO: 1430699 - RNA, 19 nt, Homo sapiens
gacaagaccagaguuauca

SEQ ID NO: 1430700 - RNA, 19 nt, Homo sapiens
caccagagguaaagcaaca

SEQ ID NO: 1430701 - RNA, 19 nt, Homo sapiens
gauagacacagccaugaga

SEQ ID NO: 1430702 - RNA, 19 nt, Homo sapiens
aaaggccaguguuaucauu

SEQ ID NO: 1430703 - RNA, 19 nt, Homo sapiens
agaaaagccucuuauguug

SEQ ID NO: 1430704 - RNA, 19 nt, Homo sapiens
ggacagacaaggccagagu

SEQ ID NO: 1430705 - RNA, 19 nt, Homo sapiens
uaugucgaguucaccuuua

SEQ ID NO: 1430706 - RNA, 19 nt, Homo sapiens
uaugugagcaccagaggua

SEQ ID NO: 1430707 - RNA, 19 nt, Homo sapiens
ggacaggcgaacccauaaa

SEQ ID NO: 1430708 - RNA, 19 nt, Homo sapiens
ccagaguucccacuauauu

SEQ ID NO: 1430709 - RNA, 19 nt, Homo sapiens
agaccagaguuaucauuau

SEQ ID NO: 1430710 - RNA, 19 nt, Homo sapiens
gggagagacuggcaaucau

SEQ ID NO: 1430711 - RNA, 19 nt, Homo sapiens
gugcagauuaugaauugua

SEQ ID NO: 1430712 - RNA, 19 nt, Homo sapiens
ucaauaccuuucuaguuuc

SEQ ID NO: 1430713 - RNA, 19 nt, Homo sapiens
uuucaagccucauagucua

SEQ ID NO: 1430714 - RNA, 19 nt, Homo sapiens
ggagagacuggcaaucaug

SEQ ID NO: 1430715 - RNA, 19 nt, Homo sapiens
ccagagcuaucauuauggu

SEQ ID NO: 1430716 - RNA, 19 nt, Homo sapiens
acagacaagaccagaguua

SEQ ID NO: 1430717 - RNA, 19 nt, Homo sapiens
ggccagaauucccacuaug

SEQ ID NO: 1430718 - RNA, 19 nt, Homo sapiens
acacugaaccauccuucua

SEQ ID NO: 1430719 - RNA, 19 nt, Homo sapiens
gagacaggcaaacucauga

SEQ ID NO: 1430720 - RNA, 19 nt, Homo sapiens
caggacaggcgaacccaua

SEQ ID NO: 1430721 - RNA, 19 nt, Homo sapiens
caacaucaccaacacaaac

SEQ ID NO: 1430722 - RNA, 19 nt, Homo sapiens
ugaagaggauagccaacau

SEQ ID NO: 1430723 - RNA, 19 nt, Homo sapiens
ggccagaguucccacuaca

SEQ ID NO: 1430724 - RNA, 19 nt, Homo sapiens
ggccagaguucccacuaca

SEQ ID NO: 1430725 - RNA, 19 nt, Homo sapiens
ggccagaguucccacuaca

SEQ ID NO: 1430726 - RNA, 19 nt, Homo sapiens
ggauaaaacaucaggaauu

SEQ ID NO: 1430727 - RNA, 19 nt, Homo sapiens
caggcaaacucaugaagag

SEQ ID NO: 1430728 - RNA, 19 nt, Homo sapiens
acaaauccaacaagaaaga

SEQ ID NO: 1430729 - RNA, 19 nt, Homo sapiens
ccacuacagucaaccaaac

SEQ ID NO: 1430730 - RNA, 19 nt, Homo sapiens
ugcaagagcagaaauccua

SEQ ID NO: 1430731 - RNA, 19 nt, Homo sapiens
gagacaggcaaacccauga

SEQ ID NO: 1430732 - RNA, 19 nt, Homo sapiens
gagacaggcaaacccauga

SEQ ID NO: 1430733 - RNA, 19 nt, Homo sapiens
ccaucaaacuugggauaga

SEQ ID NO: 1430734 - RNA, 19 nt, Homo sapiens
aagaccagaguuaucauua

SEQ ID NO: 1430735 - RNA, 19 nt, Homo sapiens
caagaccagaguuaucauu

SEQ ID NO: 1430736 - RNA, 19 nt, Homo sapiens
ccauaaagaugagcagaac

SEQ ID NO: 1430737 - RNA, 19 nt, Homo sapiens
ggaagaucagggaggcuaa

SEQ ID NO: 1430738 - RNA, 19 nt, Homo sapiens
ugaacaaucaggaagauca

SEQ ID NO: 1430739 - RNA, 19 nt, Homo sapiens
caagagccgagaacauaga

SEQ ID NO: 1430740 - RNA, 19 nt, Homo sapiens
gcauucacguaagggcuuu

SEQ ID NO: 1430741 - RNA, 19 nt, Homo sapiens
gacagggauuccagucuag

SEQ ID NO: 1430742 - RNA, 19 nt, Homo sapiens
gaaaagccucuuauguuga

SEQ ID NO: 1430743 - RNA, 19 nt, Homo sapiens
acagucagauggacagaca

SEQ ID NO: 1430744 - RNA, 19 nt, Homo sapiens
uaagauagacagacaagac

SEQ ID NO: 1430745 - RNA, 19 nt, Homo sapiens
gucauauguuugcaaauuc

SEQ ID NO: 1430746 - RNA, 19 nt, Homo sapiens
ggagaaagagagguaucaa

SEQ ID NO: 1430747 - RNA, 19 nt, Homo sapiens
gaagaggauagccaacauc

SEQ ID NO: 1430748 - RNA, 19 nt, Homo sapiens
gacccauuccaauucaaua

SEQ ID NO: 1430749 - RNA, 19 nt, Homo sapiens
agagagguaucaaggaucu

SEQ ID NO: 1430750 - RNA, 19 nt, Homo sapiens
gagaaagagagguaucaag

SEQ ID NO: 1430751 - RNA, 19 nt, Homo sapiens
ggcgaacccauaaagauga

SEQ ID NO: 1430752 - RNA, 19 nt, Homo sapiens
ggccaucaaacuugggaua

SEQ ID NO: 1430753 - RNA, 19 nt, Homo sapiens
gaucagacaaacagacaag

SEQ ID NO: 1430754 - RNA, 19 nt, Homo sapiens
ggagacauaugauaaacca

SEQ ID NO: 1430755 - RNA, 19 nt, Homo sapiens
ucaaaggcaucccugugua

SEQ ID NO: 1430756 - RNA, 19 nt, Homo sapiens
gcugauguucuguaucuua

SEQ ID NO: 1430757 - RNA, 19 nt, Homo sapiens
ucgaugagcuggccaagug

SEQ ID NO: 1430758 - RNA, 19 nt, Homo sapiens
cauggaaaguaaggaguua

SEQ ID NO: 1430759 - RNA, 19 nt, Homo sapiens
gagaagaccaguaagaucu

SEQ ID NO: 1430760 - RNA, 19 nt, Homo sapiens
gaccacaguuuguaaguac

SEQ ID NO: 1430761 - RNA, 19 nt, Homo sapiens
ggaguacuauucuuuccau

SEQ ID NO: 1430762 - RNA, 19 nt, Homo sapiens
ccagagagcauuaccuuca

SEQ ID NO: 1430763 - RNA, 19 nt, Homo sapiens
uaacaugaccacaguuugu

SEQ ID NO: 1430764 - RNA, 19 nt, Homo sapiens
aguaaggaguuaggcauua

SEQ ID NO: 1430765 - RNA, 19 nt, Homo sapiens
ugaccacaguuuguaagua

SEQ ID NO: 1430766 - RNA, 19 nt, Homo sapiens
guucuuggcugauguucug

SEQ ID NO: 1430767 - RNA, 19 nt, Homo sapiens
cccacucuauguuauguua

SEQ ID NO: 1430768 - RNA, 19 nt, Homo sapiens
uaaccaaucaugcaaacuu

SEQ ID NO: 1430769 - RNA, 19 nt, Homo sapiens
ggagaagcauggccuacag

SEQ ID NO: 1430770 - RNA, 19 nt, Homo sapiens
guacuauucuuuccaugag

SEQ ID NO: 1430771 - RNA, 19 nt, Homo sapiens
ggagaagaccaguaagauc

SEQ ID NO: 1430772 - RNA, 19 nt, Homo sapiens
cccggaagcugaggccuua

SEQ ID NO: 1430773 - RNA, 19 nt, Homo sapiens
ggagaggcuuagaccugaa

SEQ ID NO: 1430774 - RNA, 19 nt, Homo sapiens
gaccuuaucagcagcauca

SEQ ID NO: 1430775 - RNA, 19 nt, Homo sapiens
cugauguucuguaucuuaa

SEQ ID NO: 1430776 - RNA, 19 nt, Homo sapiens
aagcauggccuacagaaug

SEQ ID NO: 1430777 - RNA, 19 nt, Homo sapiens
ggaguugguucugguucuu

SEQ ID NO: 1430778 - RNA, 19 nt, Homo sapiens
caaggacccuggccaccau

SEQ ID NO: 1430779 - RNA, 19 nt, Homo sapiens
gccagcagcucaagucaac

SEQ ID NO: 1430780 - RNA, 19 nt, Homo sapiens
gagcauuaccuucaucucu

SEQ ID NO: 1430781 - RNA, 19 nt, Homo sapiens
gcagggcccacucuauguu

SEQ ID NO: 1430782 - RNA, 19 nt, Homo sapiens
ggccugaucauggaaagua

SEQ ID NO: 1430783 - RNA, 19 nt, Homo sapiens
caaaggcaucccuguguau

SEQ ID NO: 1430784 - RNA, 19 nt, Homo sapiens
uggcugauguucuguaucu

SEQ ID NO: 1430785 - RNA, 19 nt, Homo sapiens
gcuacaaaccaugcaauga

SEQ ID NO: 1430786 - RNA, 19 nt, Homo sapiens
ggaucuacaucuccuugca

SEQ ID NO: 1430787 - RNA, 19 nt, Homo sapiens
ccgaggaguacuauucuuu

SEQ ID NO: 1430788 - RNA, 19 nt, Homo sapiens
gaagcauggccuacagaau

SEQ ID NO: 1430789 - RNA, 19 nt, Homo sapiens
ggcaucauucgcauuagua

SEQ ID NO: 1430790 - RNA, 19 nt, Homo sapiens
ggccagagagcauuaccuu

SEQ ID NO: 1430791 - RNA, 19 nt, Homo sapiens
cuacaaaccaugcaaugag

SEQ ID NO: 1430792 - RNA, 19 nt, Homo sapiens
cagagagcauuaccuucau

SEQ ID NO: 1430793 - RNA, 19 nt, Homo sapiens
gagaagcauggccuacaga

SEQ ID NO: 1430794 - RNA, 19 nt, Homo sapiens
gcguacaccagaucgauga

SEQ ID NO: 1430795 - RNA, 19 nt, Homo sapiens
cagggcccacucuauguua

SEQ ID NO: 1430796 - RNA, 19 nt, Homo sapiens
gccugaucauggaaaguaa

SEQ ID NO: 1430797 - RNA, 19 nt, Homo sapiens
agcauggccuacagaauga

SEQ ID NO: 1430798 - RNA, 19 nt, Homo sapiens
cccagcaccuuugccagua

SEQ ID NO: 1430799 - RNA, 19 nt, Homo sapiens
gugccuggcugcuacaaac

SEQ ID NO: 1430800 - RNA, 19 nt, Homo sapiens
gagcugacagugcagaucu

SEQ ID NO: 1430801 - RNA, 19 nt, Homo sapiens
gccaugggaucuacaucuc

SEQ ID NO: 1430802 - RNA, 19 nt, Homo sapiens
gcuccaggguacccagcaa

SEQ ID NO: 1430803 - RNA, 19 nt, Homo sapiens
gaggaguacuauucuuucc

SEQ ID NO: 1430804 - RNA, 19 nt, Homo sapiens
cuuaacaugaccacaguuu

SEQ ID NO: 1430805 - RNA, 19 nt, Homo sapiens
cggcaucauucgcauuagu

SEQ ID NO: 1430806 - RNA, 19 nt, Homo sapiens
aaccaaucaugcaaacuuc

SEQ ID NO: 1430807 - RNA, 19 nt, Homo sapiens
gaagcugaggccuuaugga

SEQ ID NO: 1430808 - RNA, 19 nt, Homo sapiens
gagccgagaaauugaugug

SEQ ID NO: 1430809 - RNA, 19 nt, Homo sapiens
cgaggaguacuauucuuuc

SEQ ID NO: 1430810 - RNA, 19 nt, Homo sapiens
ugggguaauucaacaguua

SEQ ID NO: 1430811 - RNA, 19 nt, Homo sapiens
cgcggcaucauucgcauua

SEQ ID NO: 1430812 - RNA, 19 nt, Homo sapiens
ggcccacucuauguuaugu

SEQ ID NO: 1430813 - RNA, 19 nt, Homo sapiens
caugggccagagagcauua

SEQ ID NO: 1430814 - RNA, 19 nt, Homo sapiens
ccuaaccaaucaugcaaac

SEQ ID NO: 1430815 - RNA, 19 nt, Homo sapiens
ggaagcugaggccuuaugg

SEQ ID NO: 1430816 - RNA, 19 nt, Homo sapiens
gggccaaggagcacaaugg

SEQ ID NO: 1430817 - RNA, 19 nt, Homo sapiens
ggccaaggagcacaaugga

SEQ ID NO: 1430818 - RNA, 19 nt, Homo sapiens
ggagcggccaacagagcua

SEQ ID NO: 1430819 - RNA, 19 nt, Homo sapiens
ucuggagacauaugauaaa

SEQ ID NO: 1430820 - RNA, 19 nt, Homo sapiens
ccugguacgcggcaucauu

SEQ ID NO: 1430821 - RNA, 19 nt, Homo sapiens
caugucgagccgagaaauu

SEQ ID NO: 1430822 - RNA, 19 nt, Homo sapiens
ucauggaaaguaaggaguu

SEQ ID NO: 1430823 - RNA, 19 nt, Homo sapiens
gggagaagcauggccuaca

SEQ ID NO: 1430824 - RNA, 19 nt, Homo sapiens
gcagcaucacgcaggacua

SEQ ID NO: 1430825 - RNA, 19 nt, Homo sapiens
gccaagugcacaucagaca

SEQ ID NO: 1430826 - RNA, 19 nt, Homo sapiens
agagagcauuaccuucauc

SEQ ID NO: 1430827 - RNA, 19 nt, Homo sapiens
ccagcaccuuugccaguag

SEQ ID NO: 1430828 - RNA, 19 nt, Homo sapiens
ggacugcugaagccaacug

SEQ ID NO: 1430829 - RNA, 19 nt, Homo sapiens
guaaaugacugaaaggaaa

SEQ ID NO: 1430830 - RNA, 19 nt, Homo sapiens
gaagauaauucccuaaauc

SEQ ID NO: 1430831 - RNA, 19 nt, Homo sapiens
gcaaccaagugccuuauuu

SEQ ID NO: 1430832 - RNA, 19 nt, Homo sapiens
gcagacaguugaagccaua

SEQ ID NO: 1430833 - RNA, 19 nt, Homo sapiens
gagaagaacagaaagauga

SEQ ID NO: 1430834 - RNA, 19 nt, Homo sapiens
ccaagugccuuauuugcua

SEQ ID NO: 1430835 - RNA, 19 nt, Homo sapiens
gaaaccaacugauuaugca

SEQ ID NO: 1430836 - RNA, 19 nt, Homo sapiens
ucaaguacauuccaauaga

SEQ ID NO: 1430837 - RNA, 19 nt, Homo sapiens
ggcaagagcuuaaagaaac

SEQ ID NO: 1430838 - RNA, 19 nt, Homo sapiens
caacagaugcuuacaguuc

SEQ ID NO: 1430839 - RNA, 19 nt, Homo sapiens
caagagagacugacaaauc

SEQ ID NO: 1430840 - RNA, 19 nt, Homo sapiens
gaacaacaaaccagaacaa

SEQ ID NO: 1430841 - RNA, 19 nt, Homo sapiens
agauaaaccugaacaacaa

SEQ ID NO: 1430842 - RNA, 19 nt, Homo sapiens
guacaguaguaguaaaguu

SEQ ID NO: 1430843 - RNA, 19 nt, Homo sapiens
gaaacugguugcucaaagg

SEQ ID NO: 1430844 - RNA, 19 nt, Homo sapiens
caacaaaccagaacaagag

SEQ ID NO: 1430845 - RNA, 19 nt, Homo sapiens
caauauguguguacaguag

SEQ ID NO: 1430846 - RNA, 19 nt, Homo sapiens
cagaauacaugaggugcua

SEQ ID NO: 1430847 - RNA, 19 nt, Homo sapiens
gugaucaucuaggcaguua

SEQ ID NO: 1430848 - RNA, 19 nt, Homo sapiens
cuacugauuccauguauaa

SEQ ID NO: 1430849 - RNA, 19 nt, Homo sapiens
ccauagacauuugguuauu

SEQ ID NO: 1430850 - RNA, 19 nt, Homo sapiens
gcaagagcuuaaagaaaca

SEQ ID NO: 1430851 - RNA, 19 nt, Homo sapiens
ucagagaacccguggauga

SEQ ID NO: 1430852 - RNA, 19 nt, Homo sapiens
ggaaacugguugcucaaag

SEQ ID NO: 1430853 - RNA, 19 nt, Homo sapiens
gaacagaagacagguggaa

SEQ ID NO: 1430854 - RNA, 19 nt, Homo sapiens
gaacaagagagacugacaa

SEQ ID NO: 1430855 - RNA, 19 nt, Homo sapiens
gcucaaguacauuccaaua

SEQ ID NO: 1430856 - RNA, 19 nt, Homo sapiens
aagagagacugacaaauca

SEQ ID NO: 1430857 - RNA, 19 nt, Homo sapiens
gaagugcacacaacacaau

SEQ ID NO: 1430858 - RNA, 19 nt, Homo sapiens
gaucaucuaggcaguuauu

SEQ ID NO: 1430859 - RNA, 19 nt, Homo sapiens
gacaccaaaugccuuuaaa

SEQ ID NO: 1430860 - RNA, 19 nt, Homo sapiens
caucuaggcaguuauuauu

SEQ ID NO: 1430861 - RNA, 19 nt, Homo sapiens
gaagagcgaguacaugaag

SEQ ID NO: 1430862 - RNA, 19 nt, Homo sapiens
gugaagagcgaguacauga

SEQ ID NO: 1430863 - RNA, 19 nt, Homo sapiens
cugauuccauguauaauga

SEQ ID NO: 1430864 - RNA, 19 nt, Homo sapiens
gguagagccuauuaucauc

SEQ ID NO: 1430865 - RNA, 19 nt, Homo sapiens
ggcaacagaugcuuacagu

SEQ ID NO: 1430866 - RNA, 19 nt, Homo sapiens
gaugaauauuggucaccua

SEQ ID NO: 1430867 - RNA, 19 nt, Homo sapiens
agugaaagauguagaagau

SEQ ID NO: 1430868 - RNA, 19 nt, Homo sapiens
ccaaagaucaucgaguaaa

SEQ ID NO: 1430869 - RNA, 19 nt, Homo sapiens
gugaaagaauaucaaguca

SEQ ID NO: 1430870 - RNA, 19 nt, Homo sapiens
uaacuuuccagauuccaua

SEQ ID NO: 1430871 - RNA, 19 nt, Homo sapiens
ggucaaaaguccccaaaga

SEQ ID NO: 1430872 - RNA, 19 nt, Homo sapiens
ucagcagcaucuuuaugua

SEQ ID NO: 1430873 - RNA, 19 nt, Homo sapiens
caccaaaugccuuuaaaug

SEQ ID NO: 1430874 - RNA, 19 nt, Homo sapiens
uuaagauacugacaccaaa

SEQ ID NO: 1430875 - RNA, 19 nt, Homo sapiens
gagcuuaaagaaacacuug

SEQ ID NO: 1430876 - RNA, 19 nt, Homo sapiens
aaacagaccgauacaggaa

SEQ ID NO: 1430877 - RNA, 19 nt, Homo sapiens
uuccauagcuauaagauca

SEQ ID NO: 1430878 - RNA, 19 nt, Homo sapiens
caaccaagugccuuauuug

SEQ ID NO: 1430879 - RNA, 19 nt, Homo sapiens
ggagaagaacagaaagaug

SEQ ID NO: 1430880 - RNA, 19 nt, Homo sapiens
gaagauaaaccugaacaac

SEQ ID NO: 1430881 - RNA, 19 nt, Homo sapiens
gcaguagggcagacaguug

SEQ ID NO: 1430882 - RNA, 19 nt, Homo sapiens
caaagaucaucgaguaaaa

SEQ ID NO: 1430883 - RNA, 19 nt, Homo sapiens
gcuaguuccugaaaauuuu

SEQ ID NO: 1430884 - RNA, 19 nt, Homo sapiens
uguagaagauaaaccugaa

SEQ ID NO: 1430885 - RNA, 19 nt, Homo sapiens
gaauauuggucaccuaccu

SEQ ID NO: 1430886 - RNA, 19 nt, Homo sapiens
caacugauuaugcaagguu

SEQ ID NO: 1430887 - RNA, 19 nt, Homo sapiens
gcauccauuugcucuuuau

SEQ ID NO: 1430888 - RNA, 19 nt, Homo sapiens
acccguggaugacagaaua

SEQ ID NO: 1430889 - RNA, 19 nt, Homo sapiens
caguucagcagcaucuuua

SEQ ID NO: 1430890 - RNA, 19 nt, Homo sapiens
cccuaaaucuuugauauuc

SEQ ID NO: 1430891 - RNA, 19 nt, Homo sapiens
gaaaacaagcauccauuug

SEQ ID NO: 1430892 - RNA, 19 nt, Homo sapiens
ccagauuccauagcuauaa

SEQ ID NO: 1430893 - RNA, 19 nt, Homo sapiens
gacaaaucacccaccagua

SEQ ID NO: 1430894 - RNA, 19 nt, Homo sapiens
gccuuuaaauggcaacaga

SEQ ID NO: 1430895 - RNA, 19 nt, Homo sapiens
gauaaaccugaacaacaaa

SEQ ID NO: 1430896 - RNA, 19 nt, Homo sapiens
caaaccagaacaagagaga

SEQ ID NO: 1430897 - RNA, 19 nt, Homo sapiens
gcacuacuacugauuccau

SEQ ID NO: 1430898 - RNA, 19 nt, Homo sapiens
ugacaccaaaugccuuuaa

SEQ ID NO: 1430899 - RNA, 19 nt, Homo sapiens
ccauagcuauaagaucauu

SEQ ID NO: 1430900 - RNA, 19 nt, Homo sapiens
agccauagacauuugguua

SEQ ID NO: 1430901 - RNA, 19 nt, Homo sapiens
cggcaagagcuuaaagaaa

SEQ ID NO: 1430902 - RNA, 19 nt, Homo sapiens
gcuauucggcaagagcuua

SEQ ID NO: 1430903 - RNA, 19 nt, Homo sapiens
gaggugcuauucggcaaga

SEQ ID NO: 1430904 - RNA, 19 nt, Homo sapiens
guacauuccaauagacgaa

SEQ ID NO: 1430905 - RNA, 19 nt, Homo sapiens
caaguacauuccaauagac

SEQ ID NO: 1430906 - RNA, 19 nt, Homo sapiens
aagauaaaccugaacaaca

SEQ ID NO: 1430907 - RNA, 19 nt, Homo sapiens
gaagccagaagacucacaa

SEQ ID NO: 1430908 - RNA, 19 nt, Homo sapiens
ccccaaagaucaucgagua

SEQ ID NO: 1430909 - RNA, 19 nt, Homo sapiens
cuacuacugauuccaugua

SEQ ID NO: 1430910 - RNA, 19 nt, Homo sapiens
auaagaucauuccauccua

SEQ ID NO: 1430911 - RNA, 19 nt, Homo sapiens
acaaaucacccaccaguac

SEQ ID NO: 1430912 - RNA, 19 nt, Homo sapiens
gauacaggaagccagaaga

SEQ ID NO: 1430913 - RNA, 19 nt, Homo sapiens
acaacaaaccagaacaaga

SEQ ID NO: 1430914 - RNA, 19 nt, Homo sapiens
gcugggcgagggucucuuu

SEQ ID NO: 1430915 - RNA, 19 nt, Homo sapiens
cagauuccauagcuauaag

SEQ ID NO: 1430916 - RNA, 19 nt, Homo sapiens
auauguguguacaguagua

SEQ ID NO: 1430917 - RNA, 19 nt, Homo sapiens
uagagccuauuaucaucuu

SEQ ID NO: 1430918 - RNA, 19 nt, Homo sapiens
uugaagccauagacauuug

SEQ ID NO: 1430919 - RNA, 19 nt, Homo sapiens
guugaagccauagacauuu

SEQ ID NO: 1430920 - RNA, 19 nt, Homo sapiens
uagcucaaguacauuccaa

SEQ ID NO: 1430921 - RNA, 19 nt, Homo sapiens
uaauagcucaaguacauuc

SEQ ID NO: 1430922 - RNA, 19 nt, Homo sapiens
aacagaugcuuacaguuca

SEQ ID NO: 1430923 - RNA, 19 nt, Homo sapiens
ucaguucagcagcaucuuu

SEQ ID NO: 1430924 - RNA, 19 nt, Homo sapiens
gcaacagaugcuuacaguu

SEQ ID NO: 1430925 - RNA, 19 nt, Homo sapiens
aaauggcaacagaugcuua

SEQ ID NO: 1430926 - RNA, 19 nt, Homo sapiens
gccauagacauuugguuau

SEQ ID NO: 1430927 - RNA, 19 nt, Homo sapiens
guggaugacagaauacaug

SEQ ID NO: 1430928 - RNA, 19 nt, Homo sapiens
ccagaacaagagagacuga

SEQ ID NO: 1430929 - RNA, 19 nt, Homo sapiens
gagccagucuuuccuguau

SEQ ID NO: 1430930 - RNA, 19 nt, Homo sapiens
gugaugagcugccgguguu

SEQ ID NO: 1430931 - RNA, 19 nt, Homo sapiens
ggaugacccuggacacuca

SEQ ID NO: 1430932 - RNA, 19 nt, Homo sapiens
aagaagagaguaccaagua

SEQ ID NO: 1430933 - RNA, 19 nt, Homo sapiens
ucuggaaccuggaguuuga

SEQ ID NO: 1430934 - RNA, 19 nt, Homo sapiens
gaagagaguaccaaguagu

SEQ ID NO: 1430935 - RNA, 19 nt, Homo sapiens
guacgugggcaccgacuuu

SEQ ID NO: 1430936 - RNA, 19 nt, Homo sapiens
acacagccauguacaccaa

SEQ ID NO: 1430937 - RNA, 19 nt, Homo sapiens
gacacucaagccaaaguua

SEQ ID NO: 1430938 - RNA, 19 nt, Homo sapiens
ccuggacacucaagccaaa

SEQ ID NO: 1430939 - RNA, 19 nt, Homo sapiens
agacagguacggaggauga

SEQ ID NO: 1430940 - RNA, 19 nt, Homo sapiens
gccagucuuuccuguauag

SEQ ID NO: 1430941 - RNA, 19 nt, Homo sapiens
ggaagcugcgguucuggaa

SEQ ID NO: 1430942 - RNA, 19 nt, Homo sapiens
acuggaaacugcugucuag

SEQ ID NO: 1430943 - RNA, 19 nt, Homo sapiens
ggacacucaagccaaaguu

SEQ ID NO: 1430944 - RNA, 19 nt, Homo sapiens
gcuuauuccucaagucagu

SEQ ID NO: 1430945 - RNA, 19 nt, Homo sapiens
gagaguaccaaguagucuu

SEQ ID NO: 1430946 - RNA, 19 nt, Homo sapiens
agaagagaguaccaaguag

SEQ ID NO: 1430947 - RNA, 19 nt, Homo sapiens
gcccuaaccaggaauaaag

SEQ ID NO: 1430948 - RNA, 19 nt, Homo sapiens
cgcgcuaucuuguguacuu

SEQ ID NO: 1430949 - RNA, 19 nt, Homo sapiens
gcaggacacagccauguac

SEQ ID NO: 1430950 - RNA, 19 nt, Homo sapiens
caagaagagaguaccaagu

SEQ ID NO: 1430951 - RNA, 19 nt, Homo sapiens
cagacugccuggauauggu

SEQ ID NO: 1430952 - RNA, 19 nt, Homo sapiens
agaguaccaaguagucuuu

SEQ ID NO: 1430953 - RNA, 19 nt, Homo sapiens
ugccuggucuccacaguag

SEQ ID NO: 1430954 - RNA, 19 nt, Homo sapiens
gaugagcugccgguguuug

SEQ ID NO: 1430955 - RNA, 19 nt, Homo sapiens
guucgggagccacggauga

SEQ ID NO: 1430956 - RNA, 19 nt, Homo sapiens
ccggucagguucaccaucu

SEQ ID NO: 1430957 - RNA, 19 nt, Homo sapiens
uggaaacugcugucuagga

SEQ ID NO: 1430958 - RNA, 19 nt, Homo sapiens
guacaccaagaagagagua

SEQ ID NO: 1430959 - RNA, 19 nt, Homo sapiens
ggucaagccagggcaguca

SEQ ID NO: 1430960 - RNA, 19 nt, Homo sapiens
gaagagacuuuccuuucaa

SEQ ID NO: 1430961 - RNA, 19 nt, Homo sapiens
ggccggugcugcuuuauuu

SEQ ID NO: 1430962 - RNA, 19 nt, Homo sapiens
gaucuaacgugguuucaca

SEQ ID NO: 1430963 - RNA, 19 nt, Homo sapiens
gcacguggccuucgaguuc

SEQ ID NO: 1430964 - RNA, 19 nt, Homo sapiens
gaucuuccgugucucuuau

SEQ ID NO: 1430965 - RNA, 19 nt, Homo sapiens
acaagucacugaacccauu

SEQ ID NO: 1430966 - RNA, 19 nt, Homo sapiens
gaaagccccucguuuaaug

SEQ ID NO: 1430967 - RNA, 19 nt, Homo sapiens
uaacgugguuucacaucaa

SEQ ID NO: 1430968 - RNA, 19 nt, Homo sapiens
caacuuccgccuuaagaaa

SEQ ID NO: 1430969 - RNA, 19 nt, Homo sapiens
aaacuggccaucuaucuuu

SEQ ID NO: 1430970 - RNA, 19 nt, Homo sapiens
ucucagaucuaacgugguu

SEQ ID NO: 1430971 - RNA, 19 nt, Homo sapiens
aguguuugcuugcgacuua

SEQ ID NO: 1430972 - RNA, 19 nt, Homo sapiens
ucacguacuuuaacacauc

SEQ ID NO: 1430973 - RNA, 19 nt, Homo sapiens
aaauguaacucaguguuug

SEQ ID NO: 1430974 - RNA, 19 nt, Homo sapiens
ccagugacuucgugguaaa

SEQ ID NO: 1430975 - RNA, 19 nt, Homo sapiens
aaacgcaggagcacuuuaa

SEQ ID NO: 1430976 - RNA, 19 nt, Homo sapiens
gcccgucucucacguacuu

SEQ ID NO: 1430977 - RNA, 19 nt, Homo sapiens
ucacugaacccauuguuuc

SEQ ID NO: 1430978 - RNA, 19 nt, Homo sapiens
gcuccgaucuuccgugucu

SEQ ID NO: 1430979 - RNA, 19 nt, Homo sapiens
cugaacccauuguuucuuu

SEQ ID NO: 1430980 - RNA, 19 nt, Homo sapiens
ucacaucaauccgcuuuca

SEQ ID NO: 1430981 - RNA, 19 nt, Homo sapiens
guaaauguaacucaguguu

SEQ ID NO: 1430982 - RNA, 19 nt, Homo sapiens
gcacagcgaggacgugucu

SEQ ID NO: 1430983 - RNA, 19 nt, Homo sapiens
ugagagccaugccugacuu

SEQ ID NO: 1430984 - RNA, 19 nt, Homo sapiens
uggaggacaugcuggagaa

SEQ ID NO: 1430985 - RNA, 19 nt, Homo sapiens
ugacuucgugguaaaugua

SEQ ID NO: 1430986 - RNA, 19 nt, Homo sapiens
guaaguuugugucgaugag

SEQ ID NO: 1430987 - RNA, 19 nt, Homo sapiens
cuaacgugguuucacauca

SEQ ID NO: 1430988 - RNA, 19 nt, Homo sapiens
ugacuugucuuucuuuccu

SEQ ID NO: 1430989 - RNA, 19 nt, Homo sapiens
cugaagagacuuuccuuuc

SEQ ID NO: 1430990 - RNA, 19 nt, Homo sapiens
uuuggucucuguccaguga

SEQ ID NO: 1430991 - RNA, 19 nt, Homo sapiens
ggugcugcuuuauuucaga

SEQ ID NO: 1430992 - RNA, 19 nt, Homo sapiens
ccaaggugcuggccaugcu

SEQ ID NO: 1430993 - RNA, 19 nt, Homo sapiens
gcaacucugcgacuacuac

SEQ ID NO: 1430994 - RNA, 19 nt, Homo sapiens
uuuaacacauccuugaaag

SEQ ID NO: 1430995 - RNA, 19 nt, Homo sapiens
gaacccauuguuucuuucu

SEQ ID NO: 1430996 - RNA, 19 nt, Homo sapiens
gugacuucgugguaaaugu

SEQ ID NO: 1430997 - RNA, 19 nt, Homo sapiens
uccagugacuucgugguaa

SEQ ID NO: 1430998 - RNA, 19 nt, Homo sapiens
guccagugacuucguggua

SEQ ID NO: 1430999 - RNA, 19 nt, Homo sapiens
cuugaaagccccucguuua

SEQ ID NO: 1431000 - RNA, 19 nt, Homo sapiens
ucucucacguacuuuaaca

SEQ ID NO: 1431001 - RNA, 19 nt, Homo sapiens
ccaacuuccgccuuaagaa

SEQ ID NO: 1431002 - RNA, 19 nt, Homo sapiens
acccauuguuucuuucuga

SEQ ID NO: 1431003 - RNA, 19 nt, Homo sapiens
ccuggcaacucugcgacua

SEQ ID NO: 1431004 - RNA, 19 nt, Homo sapiens
cgaucuuccgugucucuua

SEQ ID NO: 1431005 - RNA, 19 nt, Homo sapiens
caggagcacuuuaaaacug

SEQ ID NO: 1431006 - RNA, 19 nt, Homo sapiens
ccaucuaucuuuucagugu

SEQ ID NO: 1431007 - RNA, 19 nt, Homo sapiens
aagagacuuuccuuucaag

SEQ ID NO: 1431008 - RNA, 19 nt, Homo sapiens
acaucaauccgcuuucaug

SEQ ID NO: 1431009 - RNA, 19 nt, Homo sapiens
ucucuuaucaguggcguuu

SEQ ID NO: 1431010 - RNA, 19 nt, Homo sapiens
gagccaugccugacuuguc

SEQ ID NO: 1431011 - RNA, 19 nt, Homo sapiens
gaagauggauacauugaua

SEQ ID NO: 1431012 - RNA, 19 nt, Homo sapiens
gaaaugagcuucugcuugu

SEQ ID NO: 1431013 - RNA, 19 nt, Homo sapiens
ggaaauaccucgcagaaga

SEQ ID NO: 1431014 - RNA, 19 nt, Homo sapiens
caacagagcugcaguaucu

SEQ ID NO: 1431015 - RNA, 19 nt, Homo sapiens
gaacaaccuuauaagcuua

SEQ ID NO: 1431016 - RNA, 19 nt, Homo sapiens
gaaauuccuuggacauuaa

SEQ ID NO: 1431017 - RNA, 19 nt, Homo sapiens
ggaauaugcugucaacuug

SEQ ID NO: 1431018 - RNA, 19 nt, Homo sapiens
gaagugauauacacagauu

SEQ ID NO: 1431019 - RNA, 19 nt, Homo sapiens
gaaagaagguguuaugacu

SEQ ID NO: 1431020 - RNA, 19 nt, Homo sapiens
gagcuucucugauccuaua

SEQ ID NO: 1431021 - RNA, 19 nt, Homo sapiens
ggaggaaaguauugaaauu

SEQ ID NO: 1431022 - RNA, 19 nt, Homo sapiens
cuacaaagcagauuacaua

SEQ ID NO: 1431023 - RNA, 19 nt, Homo sapiens
gagcaugggucauccagaa

SEQ ID NO: 1431024 - RNA, 19 nt, Homo sapiens
gaaacuggccgacuuaugu

SEQ ID NO: 1431025 - RNA, 19 nt, Homo sapiens
ccaaugagauggcaagugu

SEQ ID NO: 1431026 - RNA, 19 nt, Homo sapiens
gaaauagcccugcagcaaa

SEQ ID NO: 1431027 - RNA, 19 nt, Homo sapiens
gaacguggccauauggaaa

SEQ ID NO: 1431028 - RNA, 19 nt, Homo sapiens
ggaaugggcuccgucuuug

SEQ ID NO: 1431029 - RNA, 19 nt, Homo sapiens
gaaagaaauggaacuagaa

SEQ ID NO: 1431030 - RNA, 19 nt, Homo sapiens
agaaauuccuuggacauua

SEQ ID NO: 1431031 - RNA, 19 nt, Homo sapiens
gcaauauuauccaagagaa

SEQ ID NO: 1431032 - RNA, 19 nt, Homo sapiens
gaacuggcaugcugaacau

SEQ ID NO: 1431033 - RNA, 19 nt, Homo sapiens
ccagaaugcuuccagugua

SEQ ID NO: 1431034 - RNA, 19 nt, Homo sapiens
gagcugcaguaucugauuu

SEQ ID NO: 1431035 - RNA, 19 nt, Homo sapiens
gaacacugcauauauuaga

SEQ ID NO: 1431036 - RNA, 19 nt, Homo sapiens
ccgagaagauggauacauu

SEQ ID NO: 1431037 - RNA, 19 nt, Homo sapiens
ggacuucuucccucuauuu

SEQ ID NO: 1431038 - RNA, 19 nt, Homo sapiens
agaaagaaauggaacuaga

SEQ ID NO: 1431039 - RNA, 19 nt, Homo sapiens
uaaaccaccugucucuaaa

SEQ ID NO: 1431040 - RNA, 19 nt, Homo sapiens
cagaagaacaagaagaaua

SEQ ID NO: 1431041 - RNA, 19 nt, Homo sapiens
gcuggaggcuguaucaaug

SEQ ID NO: 1431042 - RNA, 19 nt, Homo sapiens
gauguuggcaugcaaguaa

SEQ ID NO: 1431043 - RNA, 19 nt, Homo sapiens
cagaaugcuuccaguguaa

SEQ ID NO: 1431044 - RNA, 19 nt, Homo sapiens
ugaacaaccuuauaagcuu

SEQ ID NO: 1431045 - RNA, 19 nt, Homo sapiens
caccaagacccaagaaaua

SEQ ID NO: 1431046 - RNA, 19 nt, Homo sapiens
gaaauaccucgcagaagaa

SEQ ID NO: 1431047 - RNA, 19 nt, Homo sapiens
gaacauauuccugaagaug

SEQ ID NO: 1431048 - RNA, 19 nt, Homo sapiens
acaaaugcaggcugaauua

SEQ ID NO: 1431049 - RNA, 19 nt, Homo sapiens
gaagacauggaaccaguaa

SEQ ID NO: 1431050 - RNA, 19 nt, Homo sapiens
caucaaacccuggaucuuu

SEQ ID NO: 1431051 - RNA, 19 nt, Homo sapiens
gagaucaccuuucuacaac

SEQ ID NO: 1431052 - RNA, 19 nt, Homo sapiens
cagaugaacaaccuuauaa

SEQ ID NO: 1431053 - RNA, 19 nt, Homo sapiens
gcugucaacuugucacaug

SEQ ID NO: 1431054 - RNA, 19 nt, Homo sapiens
gagccacacugaagccuau

SEQ ID NO: 1431055 - RNA, 19 nt, Homo sapiens
ggaauauccuggaaaugag

SEQ ID NO: 1431056 - RNA, 19 nt, Homo sapiens
aaagagaagucaagcaucu

SEQ ID NO: 1431057 - RNA, 19 nt, Homo sapiens
gaaccagcccagucucaaa

SEQ ID NO: 1431058 - RNA, 19 nt, Homo sapiens
gagaagauggauacauuga

SEQ ID NO: 1431059 - RNA, 19 nt, Homo sapiens
uuacagauauacacugguu

SEQ ID NO: 1431060 - RNA, 19 nt, Homo sapiens
uaaggcaggugauaguaga

SEQ ID NO: 1431061 - RNA, 19 nt, Homo sapiens
ggucauacauggaggugau

SEQ ID NO: 1431062 - RNA, 19 nt, Homo sapiens
gauauacacagauuggaaa

SEQ ID NO: 1431063 - RNA, 19 nt, Homo sapiens
aaacagagaaggcagaaga

SEQ ID NO: 1431064 - RNA, 19 nt, Homo sapiens
gaaucgaaguggaauaugc

SEQ ID NO: 1431065 - RNA, 19 nt, Homo sapiens
ccaacuaucuaugggcuaa

SEQ ID NO: 1431066 - RNA, 19 nt, Homo sapiens
ccgaauagaugaagauguc

SEQ ID NO: 1431067 - RNA, 19 nt, Homo sapiens
caagacccaagaaauauuu

SEQ ID NO: 1431068 - RNA, 19 nt, Homo sapiens
gaacaaaugcaggcugaau

SEQ ID NO: 1431069 - RNA, 19 nt, Homo sapiens
gaacacauuuauugaugac

SEQ ID NO: 1431070 - RNA, 19 nt, Homo sapiens
ucacagaugaacaaccuua

SEQ ID NO: 1431071 - RNA, 19 nt, Homo sapiens
cuucuucccucuauuuauu

SEQ ID NO: 1431072 - RNA, 19 nt, Homo sapiens
uaacuaugaucaccuacau

SEQ ID NO: 1431073 - RNA, 19 nt, Homo sapiens
cgacggaacuguccacacu

SEQ ID NO: 1431074 - RNA, 19 nt, Homo sapiens
gcgaagugauauacacaga

SEQ ID NO: 1431075 - RNA, 19 nt, Homo sapiens
agaggaaggcgaagugaua

SEQ ID NO: 1431076 - RNA, 19 nt, Homo sapiens
ggacauaagcacucagaca

SEQ ID NO: 1431077 - RNA, 19 nt, Homo sapiens
ccagaaauuuauccuuuag

SEQ ID NO: 1431078 - RNA, 19 nt, Homo sapiens
agccacagcugauuauuau

SEQ ID NO: 1431079 - RNA, 19 nt, Homo sapiens
gaacuguccacacuauuca

SEQ ID NO: 1431080 - RNA, 19 nt, Homo sapiens
agauaagccugaaugaaga

SEQ ID NO: 1431081 - RNA, 19 nt, Homo sapiens
gagaaucgaaguggaauau

SEQ ID NO: 1431082 - RNA, 19 nt, Homo sapiens
uccuauacauccucaguua

SEQ ID NO: 1431083 - RNA, 19 nt, Homo sapiens
aagaacauauuccugaaga

SEQ ID NO: 1431084 - RNA, 19 nt, Homo sapiens
gaacuagaaauggcaaaga

SEQ ID NO: 1431085 - RNA, 19 nt, Homo sapiens
ucagaaccauggcuccaaa

SEQ ID NO: 1431086 - RNA, 19 nt, Homo sapiens
gauauuagaccacagaaac

SEQ ID NO: 1431087 - RNA, 19 nt, Homo sapiens
ucugacacauuugagauua

SEQ ID NO: 1431088 - RNA, 19 nt, Homo sapiens
uaacaaugcauccauaagu

SEQ ID NO: 1431089 - RNA, 19 nt, Homo sapiens
gacauaagcacucagacaa

SEQ ID NO: 1431090 - RNA, 19 nt, Homo sapiens
uaaucaaagucacagagaa

SEQ ID NO: 1431091 - RNA, 19 nt, Homo sapiens
gaaauggaacuagaaaugg

SEQ ID NO: 1431092 - RNA, 19 nt, Homo sapiens
ggaacuguccacacuauuc

SEQ ID NO: 1431093 - RNA, 19 nt, Homo sapiens
gaaguggaauaugcuguca

SEQ ID NO: 1431094 - RNA, 19 nt, Homo sapiens
gaacccguaucauaaucug

SEQ ID NO: 1431095 - RNA, 19 nt, Homo sapiens
gaaggaggaaaguauugaa

SEQ ID NO: 1431096 - RNA, 19 nt, Homo sapiens
ugaaauagcccugcagcaa

SEQ ID NO: 1431097 - RNA, 19 nt, Homo sapiens
uaaaggacauaagcacuca

SEQ ID NO: 1431098 - RNA, 19 nt, Homo sapiens
gacauggaaccaguaaaua

SEQ ID NO: 1431099 - RNA, 19 nt, Homo sapiens
agaaauggaacuagaaaug

SEQ ID NO: 1431100 - RNA, 19 nt, Homo sapiens
gaucaccuuucuacaacga

SEQ ID NO: 1431101 - RNA, 19 nt, Homo sapiens
caagauaagccugaaugaa

SEQ ID NO: 1431102 - RNA, 19 nt, Homo sapiens
ggagaguaauaaagaagca

SEQ ID NO: 1431103 - RNA, 19 nt, Homo sapiens
auacccaccugaaagagua

SEQ ID NO: 1431104 - RNA, 19 nt, Homo sapiens
aaagagacacucaaacaau

SEQ ID NO: 1431105 - RNA, 19 nt, Homo sapiens
ucaagcaucuggaauacgu

SEQ ID NO: 1431106 - RNA, 19 nt, Homo sapiens
uagccacagcugauuauua

SEQ ID NO: 1431107 - RNA, 19 nt, Homo sapiens
aaagugggauggccaaucu

SEQ ID NO: 1431108 - RNA, 19 nt, Homo sapiens
caaccaagauaagccugaa

SEQ ID NO: 1431109 - RNA, 19 nt, Homo sapiens
ccuggaaaccucucacuaa

SEQ ID NO: 1431110 - RNA, 19 nt, Homo sapiens
cauuugagauuaacggaau

SEQ ID NO: 1431111 - RNA, 19 nt, Homo sapiens
gcaaugaucucuacaucua

SEQ ID NO: 1431112 - RNA, 19 nt, Homo sapiens
caacuuagcugaaccagaa

SEQ ID NO: 1431113 - RNA, 19 nt, Homo sapiens
ggaagcaucuacacauuaa

SEQ ID NO: 1431114 - RNA, 19 nt, Homo sapiens
gaaagaggauggagugaug

SEQ ID NO: 1431115 - RNA, 19 nt, Homo sapiens
gcaaaccuauaaagcguua

SEQ ID NO: 1431116 - RNA, 19 nt, Homo sapiens
gaagaggccuacaaaucaa

SEQ ID NO: 1431117 - RNA, 19 nt, Homo sapiens
ucacacaucuuguuuagga

SEQ ID NO: 1431118 - RNA, 19 nt, Homo sapiens
gguauuagcuccucacaca

SEQ ID NO: 1431119 - RNA, 19 nt, Homo sapiens
gcaccugccuuuggaauga

SEQ ID NO: 1431120 - RNA, 19 nt, Homo sapiens
ggaguacacagaauauuaa

SEQ ID NO: 1431121 - RNA, 19 nt, Homo sapiens
ugagcucucuacaguauua

SEQ ID NO: 1431122 - RNA, 19 nt, Homo sapiens
gcugagcucucuacaguau

SEQ ID NO: 1431123 - RNA, 19 nt, Homo sapiens
uaaaggaguacacagaaua

SEQ ID NO: 1431124 - RNA, 19 nt, Homo sapiens
gacaggaguuaaaggagua

SEQ ID NO: 1431125 - RNA, 19 nt, Homo sapiens
gcagauuucucaggcaauu

SEQ ID NO: 1431126 - RNA, 19 nt, Homo sapiens
caaaucaagugagcagaaa

SEQ ID NO: 1431127 - RNA, 19 nt, Homo sapiens
ggcuagagcuuuccauuca

SEQ ID NO: 1431128 - RNA, 19 nt, Homo sapiens
ugaagaggccuacaaauca

SEQ ID NO: 1431129 - RNA, 19 nt, Homo sapiens
gcacuuacauuuuccagaa

SEQ ID NO: 1431130 - RNA, 19 nt, Homo sapiens
caucagcuauugcucuuug

SEQ ID NO: 1431131 - RNA, 19 nt, Homo sapiens
gcaagaaggcugccacaca

SEQ ID NO: 1431132 - RNA, 19 nt, Homo sapiens
cuuuggagguugcaacuua

SEQ ID NO: 1431133 - RNA, 19 nt, Homo sapiens
gcauuggagucaugggaaa

SEQ ID NO: 1431134 - RNA, 19 nt, Homo sapiens
aguauuacccucccucuua

SEQ ID NO: 1431135 - RNA, 19 nt, Homo sapiens
guauuacccucccucuuau

SEQ ID NO: 1431136 - RNA, 19 nt, Homo sapiens
gagacaccaucugcaauga

SEQ ID NO: 1431137 - RNA, 19 nt, Homo sapiens
guacacagaauauuaagca

SEQ ID NO: 1431138 - RNA, 19 nt, Homo sapiens
ccugaagacuacagaaaga

SEQ ID NO: 1431139 - RNA, 19 nt, Homo sapiens
gaucucuacaucuaugaua

SEQ ID NO: 1431140 - RNA, 19 nt, Homo sapiens
gaaccuaccauguuuaagc

SEQ ID NO: 1431141 - RNA, 19 nt, Homo sapiens
gggaaccuaccauguuuaa

SEQ ID NO: 1431142 - RNA, 19 nt, Homo sapiens
gcuaucugcuucacuucaa

SEQ ID NO: 1431143 - RNA, 19 nt, Homo sapiens
gcccuuugcugugcuguuu

SEQ ID NO: 1431144 - RNA, 19 nt, Homo sapiens
ggaagaggcuaaaauugug

SEQ ID NO: 1431145 - RNA, 19 nt, Homo sapiens
cauccuggacuuuaucuaa

SEQ ID NO: 1431146 - RNA, 19 nt, Homo sapiens
agaaguagcugggcauugg

SEQ ID NO: 1431147 - RNA, 19 nt, Homo sapiens
caucgcaccugccuuugga

SEQ ID NO: 1431148 - RNA, 19 nt, Homo sapiens
aggaguacacagaauauua

SEQ ID NO: 1431149 - RNA, 19 nt, Homo sapiens
gacaccaucugcaaugauc

SEQ ID NO: 1431150 - RNA, 19 nt, Homo sapiens
ccucacacaucuuguuuag

SEQ ID NO: 1431151 - RNA, 19 nt, Homo sapiens
gcaagggcgguggcacuua

SEQ ID NO: 1431152 - RNA, 19 nt, Homo sapiens
ugaccgcacuggacacaga

SEQ ID NO: 1431153 - RNA, 19 nt, Homo sapiens
agagcuaucugcuucacuu

SEQ ID NO: 1431154 - RNA, 19 nt, Homo sapiens
cgugagagccagacuaaug

SEQ ID NO: 1431155 - RNA, 19 nt, Homo sapiens
ggaaugaucagcuuuaccu

SEQ ID NO: 1431156 - RNA, 19 nt, Homo sapiens
ggccaucgcaccugccuuu

SEQ ID NO: 1431157 - RNA, 19 nt, Homo sapiens
aggcacaucuccuccuuug

SEQ ID NO: 1431158 - RNA, 19 nt, Homo sapiens
uuaaaggaguacacagaau

SEQ ID NO: 1431159 - RNA, 19 nt, Homo sapiens
gcccugaauuucugcaugu

SEQ ID NO: 1431160 - RNA, 19 nt, Homo sapiens
uggaagcaucuacacauua

SEQ ID NO: 1431161 - RNA, 19 nt, Homo sapiens
cggcaucacucauguucug

SEQ ID NO: 1431162 - RNA, 19 nt, Homo sapiens
agauuucucaggcaauuua

SEQ ID NO: 1431163 - RNA, 19 nt, Homo sapiens
gcuacugccucaauaacca

SEQ ID NO: 1431164 - RNA, 19 nt, Homo sapiens
guuaaaggaguacacagaa

SEQ ID NO: 1431165 - RNA, 19 nt, Homo sapiens
caucugcaaugaucucuac

SEQ ID NO: 1431166 - RNA, 19 nt, Homo sapiens
cuagagcuuuccauucaug

SEQ ID NO: 1431167 - RNA, 19 nt, Homo sapiens
caagggcgguggcacuuac

SEQ ID NO: 1431168 - RNA, 19 nt, Homo sapiens
gagagaaagccgggacuug

SEQ ID NO: 1431169 - RNA, 19 nt, Homo sapiens
agagaaagccgggacuuga

SEQ ID NO: 1431170 - RNA, 19 nt, Homo sapiens
ccauccaggucaucagcua

SEQ ID NO: 1431171 - RNA, 19 nt, Homo sapiens
ggcgguggcacuuacauuu

SEQ ID NO: 1431172 - RNA, 19 nt, Homo sapiens
uaaauagugccaagacaca

SEQ ID NO: 1431173 - RNA, 19 nt, Homo sapiens
gaaccugaagacuacagaa

SEQ ID NO: 1431174 - RNA, 19 nt, Homo sapiens
aaugaucucuacaucuaug

SEQ ID NO: 1431175 - RNA, 19 nt, Homo sapiens
gacagccaguccacagguu

SEQ ID NO: 1431176 - RNA, 19 nt, Homo sapiens
ggagggcgguauccacacu

SEQ ID NO: 1431177 - RNA, 19 nt, Homo sapiens
cagcagcgauacggugguu

SEQ ID NO: 1431178 - RNA, 19 nt, Homo sapiens
aaaggaguacacagaauau

SEQ ID NO: 1431179 - RNA, 19 nt, Homo sapiens
acaaaucaagugagcagaa

SEQ ID NO: 1431180 - RNA, 19 nt, Homo sapiens
gcccgcaccuauugguaug

SEQ ID NO: 1431181 - RNA, 19 nt, Homo sapiens
agagagcccagcagcgaua

SEQ ID NO: 1431182 - RNA, 19 nt, Homo sapiens
gucaucagcuauugcucuu

SEQ ID NO: 1431183 - RNA, 19 nt, Homo sapiens
gagaaagccgggacuugag

SEQ ID NO: 1431184 - RNA, 19 nt, Homo sapiens
uugaagaggccuacaaauc

SEQ ID NO: 1431185 - RNA, 19 nt, Homo sapiens
cuagagacaccaucugcaa

SEQ ID NO: 1431186 - RNA, 19 nt, Homo sapiens
gggaagaggcuaaaauugu

SEQ ID NO: 1431187 - RNA, 19 nt, Homo sapiens
gcugggcauuggagucaug

SEQ ID NO: 1431188 - RNA, 19 nt, Homo sapiens
ugccaagacacaucacuaa

SEQ ID NO: 1431189 - RNA, 19 nt, Homo sapiens
ccaggucucuucggacagu

SEQ ID NO: 1431190 - RNA, 19 nt, Homo sapiens
gcuagagcuuuccauucau

SEQ ID NO: 1431191 - RNA, 19 nt, Homo sapiens
caucuccuccuuugugguu

SEQ ID NO: 1431192 - RNA, 19 nt, Homo sapiens
uuaguugacaggaguuaaa

SEQ ID NO: 1431193 - RNA, 19 nt, Homo sapiens
cugcaaugaucucuacauc

SEQ ID NO: 1431194 - RNA, 19 nt, Homo sapiens
ccacagcuacaagcaagaa

SEQ ID NO: 1431195 - RNA, 19 nt, Homo sapiens
gugcagaucgugggaugaa

SEQ ID NO: 1431196 - RNA, 19 nt, Homo sapiens
ggaguuaaaggaguacaca

SEQ ID NO: 1431197 - RNA, 19 nt, Homo sapiens
guugacaggaguuaaagga

SEQ ID NO: 1431198 - RNA, 19 nt, Homo sapiens
caaggaggaaccaccuguu

SEQ ID NO: 1431199 - RNA, 19 nt, Homo sapiens
ccaaaaccuuucacucuca

SEQ ID NO: 1431200 - RNA, 19 nt, Homo sapiens
ggagagaaagccgggacuu

SEQ ID NO: 1431201 - RNA, 19 nt, Homo sapiens
cuauugcucuuuggagguu

SEQ ID NO: 1431202 - RNA, 19 nt, Homo sapiens
gugccaagacacaucacua

SEQ ID NO: 1431203 - RNA, 19 nt, Homo sapiens
auggaagcaucuacacauu

SEQ ID NO: 1431204 - RNA, 19 nt, Homo sapiens
agagacaccaucugcaaug

SEQ ID NO: 1431205 - RNA, 19 nt, Homo sapiens
gaaguagcugggcauugga

SEQ ID NO: 1431206 - RNA, 19 nt, Homo sapiens
ucuaaauagugccaagaca

SEQ ID NO: 1431207 - RNA, 19 nt, Homo sapiens
acaggcacaucuccuccuu

SEQ ID NO: 1431208 - RNA, 19 nt, Homo sapiens
gcuccucacacaucuuguu

SEQ ID NO: 1431209 - RNA, 19 nt, Homo sapiens
ggagucaugggaaaauuaa

SEQ ID NO: 1431210 - RNA, 19 nt, Homo sapiens
gcagaucgugggaugaaac

SEQ ID NO: 1431211 - RNA, 19 nt, Homo sapiens
gagaaaggauggagaauga

SEQ ID NO: 1431212 - RNA, 19 nt, Homo sapiens
ggagaaacuuagugaauaa

SEQ ID NO: 1431213 - RNA, 19 nt, Homo sapiens
ggaaaagaaugccaaaaua

SEQ ID NO: 1431214 - RNA, 19 nt, Homo sapiens
gcaaaugcuugaccagauu

SEQ ID NO: 1431215 - RNA, 19 nt, Homo sapiens
gaacagaccauuuacaaca

SEQ ID NO: 1431216 - RNA, 19 nt, Homo sapiens
guacaggaguuucagguuu

SEQ ID NO: 1431217 - RNA, 19 nt, Homo sapiens
ccaaagacacuaacagaua

SEQ ID NO: 1431218 - RNA, 19 nt, Homo sapiens
gcuagaagacuuuaccuua

SEQ ID NO: 1431219 - RNA, 19 nt, Homo sapiens
gcacaaacuacuacauaua

SEQ ID NO: 1431220 - RNA, 19 nt, Homo sapiens
ggcagaagauccugaauga

SEQ ID NO: 1431221 - RNA, 19 nt, Homo sapiens
ccaaagugcuggaauuaga

SEQ ID NO: 1431222 - RNA, 19 nt, Homo sapiens
gaaaggauggagaaugaua

SEQ ID NO: 1431223 - RNA, 19 nt, Homo sapiens
caacgaagaugcacaaacu

SEQ ID NO: 1431224 - RNA, 19 nt, Homo sapiens
cuagaagacuuuaccuuaa

SEQ ID NO: 1431225 - RNA, 19 nt, Homo sapiens
gaaaucacacuuggauaua

SEQ ID NO: 1431226 - RNA, 19 nt, Homo sapiens
gauggagaaugauaugaaa

SEQ ID NO: 1431227 - RNA, 19 nt, Homo sapiens
ggcaggaguucuucaauga

SEQ ID NO: 1431228 - RNA, 19 nt, Homo sapiens
gaaggugauugaaagaaau

SEQ ID NO: 1431229 - RNA, 19 nt, Homo sapiens
gaagaugcacaaacuacua

SEQ ID NO: 1431230 - RNA, 19 nt, Homo sapiens
agaaggaacagaccauuua

SEQ ID NO: 1431231 - RNA, 19 nt, Homo sapiens
uggagaaacuuagugaaua

SEQ ID NO: 1431232 - RNA, 19 nt, Homo sapiens
ggaguguuaugaugacaaa

SEQ ID NO: 1431233 - RNA, 19 nt, Homo sapiens
gacaggaucucaccguguu

SEQ ID NO: 1431234 - RNA, 19 nt, Homo sapiens
ugaaggugauugaaagaaa

SEQ ID NO: 1431235 - RNA, 19 nt, Homo sapiens
gaugugaaauuaacaaagg

SEQ ID NO: 1431236 - RNA, 19 nt, Homo sapiens
caaagacacuaacagauac

SEQ ID NO: 1431237 - RNA, 19 nt, Homo sapiens
gacaguacauggaggaaau

SEQ ID NO: 1431238 - RNA, 19 nt, Homo sapiens
cagaagauccugaaugaga

SEQ ID NO: 1431239 - RNA, 19 nt, Homo sapiens
gcagaugauugauuucuac

SEQ ID NO: 1431240 - RNA, 19 nt, Homo sapiens
agagagggcugguguggaa

SEQ ID NO: 1431241 - RNA, 19 nt, Homo sapiens
acaaagacuugguaacuca

SEQ ID NO: 1431242 - RNA, 19 nt, Homo sapiens
gauuaguucucuugacuuc

SEQ ID NO: 1431243 - RNA, 19 nt, Homo sapiens
ccaaaauucuuccaaguuu

SEQ ID NO: 1431244 - RNA, 19 nt, Homo sapiens
cauauuggcuagaagacuu

SEQ ID NO: 1431245 - RNA, 19 nt, Homo sapiens
ugaaugaugugauggauac

SEQ ID NO: 1431246 - RNA, 19 nt, Homo sapiens
acacuacucuccucacaga

SEQ ID NO: 1431247 - RNA, 19 nt, Homo sapiens
aggaugggcuuaucaaaug

SEQ ID NO: 1431248 - RNA, 19 nt, Homo sapiens
ccacaaggauuuggcacaa

SEQ ID NO: 1431249 - RNA, 19 nt, Homo sapiens
acauuuggcccguucauua

SEQ ID NO: 1431250 - RNA, 19 nt, Homo sapiens
ugaaaucacacuuggauau

SEQ ID NO: 1431251 - RNA, 19 nt, Homo sapiens
uauauagugugugagguua

SEQ ID NO: 1431252 - RNA, 19 nt, Homo sapiens
gggauguucuacugucaaa

SEQ ID NO: 1431253 - RNA, 19 nt, Homo sapiens
cacuaagcauuucaucaua

SEQ ID NO: 1431254 - RNA, 19 nt, Homo sapiens
gagcucagccacauaugaa

SEQ ID NO: 1431255 - RNA, 19 nt, Homo sapiens
gaacugaccagggaacugu

SEQ ID NO: 1431256 - RNA, 19 nt, Homo sapiens
uugcagaaguugacacaaa

SEQ ID NO: 1431257 - RNA, 19 nt, Homo sapiens
ggauggagaaugauaugaa

SEQ ID NO: 1431258 - RNA, 19 nt, Homo sapiens
gcaccuggccuuggguuaa

SEQ ID NO: 1431259 - RNA, 19 nt, Homo sapiens
agaagauccugaaugagaa

SEQ ID NO: 1431260 - RNA, 19 nt, Homo sapiens
gaacaaauggaagagucua

SEQ ID NO: 1431261 - RNA, 19 nt, Homo sapiens
cugaagaccuugcacuguu

SEQ ID NO: 1431262 - RNA, 19 nt, Homo sapiens
caaacaaggacacugaaga

SEQ ID NO: 1431263 - RNA, 19 nt, Homo sapiens
ggcagaugauugauuucua

SEQ ID NO: 1431264 - RNA, 19 nt, Homo sapiens
gaagaaggaacagaccauu

SEQ ID NO: 1431265 - RNA, 19 nt, Homo sapiens
gaauauacaggaccaacga

SEQ ID NO: 1431266 - RNA, 19 nt, Homo sapiens
uuucagguuuggaguguua

SEQ ID NO: 1431267 - RNA, 19 nt, Homo sapiens
aaaccuuacugguauuguu

SEQ ID NO: 1431268 - RNA, 19 nt, Homo sapiens
uguuaaaccuuacugguau

SEQ ID NO: 1431269 - RNA, 19 nt, Homo sapiens
guacauggaggaaauuauc

SEQ ID NO: 1431270 - RNA, 19 nt, Homo sapiens
uaaacaagagguagaacaa

SEQ ID NO: 1431271 - RNA, 19 nt, Homo sapiens
ugaagaauggcaggaaaua

SEQ ID NO: 1431272 - RNA, 19 nt, Homo sapiens
acgauacucucaagauuau

SEQ ID NO: 1431273 - RNA, 19 nt, Homo sapiens
ugaagaccuugcacuguug

SEQ ID NO: 1431274 - RNA, 19 nt, Homo sapiens
gaagggauauuucuuuucu

SEQ ID NO: 1431275 - RNA, 19 nt, Homo sapiens
gaaguggcccagcugaaug

SEQ ID NO: 1431276 - RNA, 19 nt, Homo sapiens
ugugugagguuacuccaaa

SEQ ID NO: 1431277 - RNA, 19 nt, Homo sapiens
auacgauacucucaagauu

SEQ ID NO: 1431278 - RNA, 19 nt, Homo sapiens
gaagauccugaaugagaaa

SEQ ID NO: 1431279 - RNA, 19 nt, Homo sapiens
uguaacauaugccaaagga

SEQ ID NO: 1431280 - RNA, 19 nt, Homo sapiens
ugaaaugaaaucacacuug

SEQ ID NO: 1431281 - RNA, 19 nt, Homo sapiens
ugacuucuguucuuucaag

SEQ ID NO: 1431282 - RNA, 19 nt, Homo sapiens
aacaagagguagaacaaau

SEQ ID NO: 1431283 - RNA, 19 nt, Homo sapiens
ggaauaaauacacuaagca

SEQ ID NO: 1431284 - RNA, 19 nt, Homo sapiens
ggagcucagccacauauga

SEQ ID NO: 1431285 - RNA, 19 nt, Homo sapiens
uacgauacucucaagauua

SEQ ID NO: 1431286 - RNA, 19 nt, Homo sapiens
ucaaauggcaggaguucuu

SEQ ID NO: 1431287 - RNA, 19 nt, Homo sapiens
cauaugaauuggcccugaa

SEQ ID NO: 1431288 - RNA, 19 nt, Homo sapiens
ccagauugcucggcagaug

SEQ ID NO: 1431289 - RNA, 19 nt, Homo sapiens
gaccauuuacaacaugaua

SEQ ID NO: 1431290 - RNA, 19 nt, Homo sapiens
aaccuggaguuuccugaua

SEQ ID NO: 1431291 - RNA, 19 nt, Homo sapiens
uaucaaacaaggacacuga

SEQ ID NO: 1431292 - RNA, 19 nt, Homo sapiens
gaagacuuuaccuuaauga

SEQ ID NO: 1431293 - RNA, 19 nt, Homo sapiens
gaaaagaaugccaaaauag

SEQ ID NO: 1431294 - RNA, 19 nt, Homo sapiens
gcucuucccauccaugaaa

SEQ ID NO: 1431295 - RNA, 19 nt, Homo sapiens
gaugacaaauacacuacuc

SEQ ID NO: 1431296 - RNA, 19 nt, Homo sapiens
cuuccaaguuugauuaguu

SEQ ID NO: 1431297 - RNA, 19 nt, Homo sapiens
gaauaaauggggacaauga

SEQ ID NO: 1431298 - RNA, 19 nt, Homo sapiens
agagagagguaugugcaaa

SEQ ID NO: 1431299 - RNA, 19 nt, Homo sapiens
uacaggaguuucagguuug

SEQ ID NO: 1431300 - RNA, 19 nt, Homo sapiens
gacauuuuauccccuaaua

SEQ ID NO: 1431301 - RNA, 19 nt, Homo sapiens
gcucagccacauaugaauu

SEQ ID NO: 1431302 - RNA, 19 nt, Homo sapiens
aaagagaaaggauggagaa

SEQ ID NO: 1431303 - RNA, 19 nt, Homo sapiens
ggcacaagcucuuuuaaau

SEQ ID NO: 1431304 - RNA, 19 nt, Homo sapiens
ucucuugacuucuguucuu

SEQ ID NO: 1431305 - RNA, 19 nt, Homo sapiens
caggaaaacugggcagaua

SEQ ID NO: 1431306 - RNA, 19 nt, Homo sapiens
gcuggaauaaauacacuaa

SEQ ID NO: 1431307 - RNA, 19 nt, Homo sapiens
gacacuaacagauacuuug

SEQ ID NO: 1431308 - RNA, 19 nt, Homo sapiens
guagaagaauaucaugacu

SEQ ID NO: 1431309 - RNA, 19 nt, Homo sapiens
caagcauguuauugaagaa

SEQ ID NO: 1431310 - RNA, 19 nt, Homo sapiens
ugugauggauacuaugcua

SEQ ID NO: 1431311 - RNA, 19 nt, Homo sapiens
gcaagucucugguccauua

SEQ ID NO: 1431312 - RNA, 19 nt, Homo sapiens
gaucaaaggugugacauuu

SEQ ID NO: 1431313 - RNA, 19 nt, Homo sapiens
gaaagucguucaucauuug

SEQ ID NO: 1431314 - RNA, 19 nt, Homo sapiens
gaagauugccuacugaaua

SEQ ID NO: 1431315 - RNA, 19 nt, Homo sapiens
gagcagaacugaaggaaau

SEQ ID NO: 1431316 - RNA, 19 nt, Homo sapiens
gaacaucgacggagacauu

SEQ ID NO: 1431317 - RNA, 19 nt, Homo sapiens
gaaguagaguccacagaaa

SEQ ID NO: 1431318 - RNA, 19 nt, Homo sapiens
gaaaugaacgacagauaaa

SEQ ID NO: 1431319 - RNA, 19 nt, Homo sapiens
ggaaguugcuguucuacug

SEQ ID NO: 1431320 - RNA, 19 nt, Homo sapiens
cgacugaacuggacacugu

SEQ ID NO: 1431321 - RNA, 19 nt, Homo sapiens
gcagaugacagauggauuu

SEQ ID NO: 1431322 - RNA, 19 nt, Homo sapiens
cagcggaaauuacaucaaa

SEQ ID NO: 1431323 - RNA, 19 nt, Homo sapiens
ggaaacaucugcauaucag

SEQ ID NO: 1431324 - RNA, 19 nt, Homo sapiens
gaugauaaguguaagucaa

SEQ ID NO: 1431325 - RNA, 19 nt, Homo sapiens
agagggaaauuacguuuaa

SEQ ID NO: 1431326 - RNA, 19 nt, Homo sapiens
gcaagugcuucaaaggaaa

SEQ ID NO: 1431327 - RNA, 19 nt, Homo sapiens
caaccaagacauuagauuu

SEQ ID NO: 1431328 - RNA, 19 nt, Homo sapiens
uaaacacgcacaguuauua

SEQ ID NO: 1431329 - RNA, 19 nt, Homo sapiens
gaagagggaaauuacguuu

SEQ ID NO: 1431330 - RNA, 19 nt, Homo sapiens
aaacugugcuggcgccuuu

SEQ ID NO: 1431331 - RNA, 19 nt, Homo sapiens
aagauugccuacugaauaa

SEQ ID NO: 1431332 - RNA, 19 nt, Homo sapiens
ggcauuggaucaacacaaa

SEQ ID NO: 1431333 - RNA, 19 nt, Homo sapiens
ggagaaaggccacgaaugg

SEQ ID NO: 1431334 - RNA, 19 nt, Homo sapiens
ugaggaaacugcacaagug

SEQ ID NO: 1431335 - RNA, 19 nt, Homo sapiens
ccaaaugucuauaccaaag

SEQ ID NO: 1431336 - RNA, 19 nt, Homo sapiens
cagagcaccuggccuugua

SEQ ID NO: 1431337 - RNA, 19 nt, Homo sapiens
agaaagucguucaucauuu

SEQ ID NO: 1431338 - RNA, 19 nt, Homo sapiens
ccaggaaguugcuguucua

SEQ ID NO: 1431339 - RNA, 19 nt, Homo sapiens
gggaggcucuuggacauuu

SEQ ID NO: 1431340 - RNA, 19 nt, Homo sapiens
uggaacagcuggaugaaga

SEQ ID NO: 1431341 - RNA, 19 nt, Homo sapiens
gaacugaaggaaauagaga

SEQ ID NO: 1431342 - RNA, 19 nt, Homo sapiens
uagcagaaggcaagaaaua

SEQ ID NO: 1431343 - RNA, 19 nt, Homo sapiens
gaacacagcaaagagcaaa

SEQ ID NO: 1431344 - RNA, 19 nt, Homo sapiens
gcccaaaugucuauaccaa

SEQ ID NO: 1431345 - RNA, 19 nt, Homo sapiens
gcacaaccgaucaggaauu

SEQ ID NO: 1431346 - RNA, 19 nt, Homo sapiens
gaaggcaagaaauaacuaa

SEQ ID NO: 1431347 - RNA, 19 nt, Homo sapiens
gaugaaaguacaacucuug

SEQ ID NO: 1431348 - RNA, 19 nt, Homo sapiens
aauugcaccugaugaguua

SEQ ID NO: 1431349 - RNA, 19 nt, Homo sapiens
cacccuaacaucacaauua

SEQ ID NO: 1431350 - RNA, 19 nt, Homo sapiens
agaaaugaacgacagauaa

SEQ ID NO: 1431351 - RNA, 19 nt, Homo sapiens
ggaaugguuuugaugauaa

SEQ ID NO: 1431352 - RNA, 19 nt, Homo sapiens
gaaaggaucaacaaaauug

SEQ ID NO: 1431353 - RNA, 19 nt, Homo sapiens
caggaaagauccaaaauug

SEQ ID NO: 1431354 - RNA, 19 nt, Homo sapiens
agauaaacacgcacaguua

SEQ ID NO: 1431355 - RNA, 19 nt, Homo sapiens
ggaaggcauuggaucaaca

SEQ ID NO: 1431356 - RNA, 19 nt, Homo sapiens
ucaagucguuuggguuuaa

SEQ ID NO: 1431357 - RNA, 19 nt, Homo sapiens
ugaauaagguggacuugag

SEQ ID NO: 1431358 - RNA, 19 nt, Homo sapiens
caaccgaucaggaauucua

SEQ ID NO: 1431359 - RNA, 19 nt, Homo sapiens
ucggugagaucaaugguuu

SEQ ID NO: 1431360 - RNA, 19 nt, Homo sapiens
caggaaggaaucaguauuu

SEQ ID NO: 1431361 - RNA, 19 nt, Homo sapiens
cgagaaauauccccacuuu

SEQ ID NO: 1431362 - RNA, 19 nt, Homo sapiens
cacaggagcugggcacuga

SEQ ID NO: 1431363 - RNA, 19 nt, Homo sapiens
ggaaauuacguuuaaaggu

SEQ ID NO: 1431364 - RNA, 19 nt, Homo sapiens
ccagggaacaggccgguua

SEQ ID NO: 1431365 - RNA, 19 nt, Homo sapiens
cagaaagucguucaucauu

SEQ ID NO: 1431366 - RNA, 19 nt, Homo sapiens
ccacagcacugacgcaaaa

SEQ ID NO: 1431367 - RNA, 19 nt, Homo sapiens
ggcuuaaccuuguucuuug

SEQ ID NO: 1431368 - RNA, 19 nt, Homo sapiens
guggaacaguuuaugaaga

SEQ ID NO: 1431369 - RNA, 19 nt, Homo sapiens
ucugguaacugcaugaaga

SEQ ID NO: 1431370 - RNA, 19 nt, Homo sapiens
guacaacucuuggccugau

SEQ ID NO: 1431371 - RNA, 19 nt, Homo sapiens
caucaagucguuuggguuu

SEQ ID NO: 1431372 - RNA, 19 nt, Homo sapiens
ugaaggaaauagagacaca

SEQ ID NO: 1431373 - RNA, 19 nt, Homo sapiens
acccuaacaucacaauuaa

SEQ ID NO: 1431374 - RNA, 19 nt, Homo sapiens
gcagaaagucguucaucau

SEQ ID NO: 1431375 - RNA, 19 nt, Homo sapiens
gaagccaugaaauaccuua

SEQ ID NO: 1431376 - RNA, 19 nt, Homo sapiens
agucaaagaugaaaguaca

SEQ ID NO: 1431377 - RNA, 19 nt, Homo sapiens
caucaaaccagaaacacuu

SEQ ID NO: 1431378 - RNA, 19 nt, Homo sapiens
gaaguugcuguucuacuga

SEQ ID NO: 1431379 - RNA, 19 nt, Homo sapiens
ggaaggaaucaguauuuua

SEQ ID NO: 1431380 - RNA, 19 nt, Homo sapiens
ugaaguagaguccacagaa

SEQ ID NO: 1431381 - RNA, 19 nt, Homo sapiens
cagugaagguggagacaga

SEQ ID NO: 1431382 - RNA, 19 nt, Homo sapiens
cgaauggcagcggaaauua

SEQ ID NO: 1431383 - RNA, 19 nt, Homo sapiens
agaaauauccccacuuuaa

SEQ ID NO: 1431384 - RNA, 19 nt, Homo sapiens
ccaagguccuccuaguguu

SEQ ID NO: 1431385 - RNA, 19 nt, Homo sapiens
gagcagcacuggcgguacu

SEQ ID NO: 1431386 - RNA, 19 nt, Homo sapiens
gauuucaagcugugccuua

SEQ ID NO: 1431387 - RNA, 19 nt, Homo sapiens
ggaagagggaaauuacguu

SEQ ID NO: 1431388 - RNA, 19 nt, Homo sapiens
gcaaccaagacauuagauu

SEQ ID NO: 1431389 - RNA, 19 nt, Homo sapiens
ccacaaacaucagcaacca

SEQ ID NO: 1431390 - RNA, 19 nt, Homo sapiens
gagggaaauuacguuuaaa

SEQ ID NO: 1431391 - RNA, 19 nt, Homo sapiens
aagcaugaacuacugauuu

SEQ ID NO: 1431392 - RNA, 19 nt, Homo sapiens
gaugacagauggauuuuca

SEQ ID NO: 1431393 - RNA, 19 nt, Homo sapiens
gaacagcaaccucuuucag

SEQ ID NO: 1431394 - RNA, 19 nt, Homo sapiens
gaaauauccccacuuuaaa

SEQ ID NO: 1431395 - RNA, 19 nt, Homo sapiens
caucagcaaccaagacauu

SEQ ID NO: 1431396 - RNA, 19 nt, Homo sapiens
guaaacggcaggaaagauc

SEQ ID NO: 1431397 - RNA, 19 nt, Homo sapiens
guaacugcaugaagaaggu

SEQ ID NO: 1431398 - RNA, 19 nt, Homo sapiens
guuccugguugguugagua

SEQ ID NO: 1431399 - RNA, 19 nt, Homo sapiens
uggaggaggugcagaaagu

SEQ ID NO: 1431400 - RNA, 19 nt, Homo sapiens
uuagaagauugccuacuga

SEQ ID NO: 1431401 - RNA, 19 nt, Homo sapiens
accaagaagccaugaaaua

SEQ ID NO: 1431402 - RNA, 19 nt, Homo sapiens
acugaggacugaccaagaa

SEQ ID NO: 1431403 - RNA, 19 nt, Homo sapiens
gcuaucuacucacaagugu

SEQ ID NO: 1431404 - RNA, 19 nt, Homo sapiens
cagauaaacacgcacaguu

SEQ ID NO: 1431405 - RNA, 19 nt, Homo sapiens
aaccauagcccucucuuug

SEQ ID NO: 1431406 - RNA, 19 nt, Homo sapiens
aaguguaagucaaagauga

SEQ ID NO: 1431407 - RNA, 19 nt, Homo sapiens
gcauuucugcccuagcuaa

SEQ ID NO: 1431408 - RNA, 19 nt, Homo sapiens
cuuagaagauugccuacug

SEQ ID NO: 1431409 - RNA, 19 nt, Homo sapiens
ccaagaagccaugaaauac

SEQ ID NO: 1431410 - RNA, 19 nt, Homo sapiens
gcuagcagaaggcaagaaa

SEQ ID NO: 1431411 - RNA, 19 nt, Homo sapiens
ggaagcagcuggccaccaa

SEQ ID NO: 1431412 - RNA, 19 nt, Homo sapiens
caucacaguugacagguua

SEQ ID NO: 1431413 - RNA, 19 nt, Homo sapiens
agaaggagauucacuauuc

SEQ ID NO: 1431414 - RNA, 19 nt, Homo sapiens
ggaaguccaaggccucuua

SEQ ID NO: 1431415 - RNA, 19 nt, Homo sapiens
ggccggagguuccaucgua

SEQ ID NO: 1431416 - RNA, 19 nt, Homo sapiens
gaggugaucucuacagucu

SEQ ID NO: 1431417 - RNA, 19 nt, Homo sapiens
gccaagcgcgugaccauua

SEQ ID NO: 1431418 - RNA, 19 nt, Homo sapiens
guagaggucuuagauaaca

SEQ ID NO: 1431419 - RNA, 19 nt, Homo sapiens
gcagcgaucuaugagaauu

SEQ ID NO: 1431420 - RNA, 19 nt, Homo sapiens
cuuagaagcugcaugguau

SEQ ID NO: 1431421 - RNA, 19 nt, Homo sapiens
cuguagaggucuuagauaa

SEQ ID NO: 1431422 - RNA, 19 nt, Homo sapiens
gcacuuggaagaagcugua

SEQ ID NO: 1431423 - RNA, 19 nt, Homo sapiens
gcucuucgccuuaggaaau

SEQ ID NO: 1431424 - RNA, 19 nt, Homo sapiens
gaagcugcaugguaugucu

SEQ ID NO: 1431425 - RNA, 19 nt, Homo sapiens
guaguuccuuuacguuguu

SEQ ID NO: 1431426 - RNA, 19 nt, Homo sapiens
gagguuccaucguauccaa

SEQ ID NO: 1431427 - RNA, 19 nt, Homo sapiens
gaagacaguagaucagaca

SEQ ID NO: 1431428 - RNA, 19 nt, Homo sapiens
gcacucgguccucuuagaa

SEQ ID NO: 1431429 - RNA, 19 nt, Homo sapiens
guggagagcgggcuuaaga

SEQ ID NO: 1431430 - RNA, 19 nt, Homo sapiens
cugcagcgaucuaugagaa

SEQ ID NO: 1431431 - RNA, 19 nt, Homo sapiens
gggcuucgguuuucuguuu

SEQ ID NO: 1431432 - RNA, 19 nt, Homo sapiens
ccaagcgcgugaccauuau

SEQ ID NO: 1431433 - RNA, 19 nt, Homo sapiens
ucacugcagcgaucuauga

SEQ ID NO: 1431434 - RNA, 19 nt, Homo sapiens
ccuucucggucauuuauuu

SEQ ID NO: 1431435 - RNA, 19 nt, Homo sapiens
cgagaucgcgcaggacuuu

SEQ ID NO: 1431436 - RNA, 19 nt, Homo sapiens
ggugaucucuacagucucu

SEQ ID NO: 1431437 - RNA, 19 nt, Homo sapiens
agagcgggcuuaagaagug

SEQ ID NO: 1431438 - RNA, 19 nt, Homo sapiens
caucagcacuuggaagaag

SEQ ID NO: 1431439 - RNA, 19 nt, Homo sapiens
ggaaauggaauaaaacuuc

SEQ ID NO: 1431440 - RNA, 19 nt, Homo sapiens
acacacggccagauacaaa

SEQ ID NO: 1431441 - RNA, 19 nt, Homo sapiens
guucagauccuugggaaga

SEQ ID NO: 1431442 - RNA, 19 nt, Homo sapiens
gaaggagauucacuauucc

SEQ ID NO: 1431443 - RNA, 19 nt, Homo sapiens
gcuguagaggucuuagaua

SEQ ID NO: 1431444 - RNA, 19 nt, Homo sapiens
agacucaguaguuccuuua

SEQ ID NO: 1431445 - RNA, 19 nt, Homo sapiens
ggagagcgggcuuaagaag

SEQ ID NO: 1431446 - RNA, 19 nt, Homo sapiens
cagacucaguaguuccuuu

SEQ ID NO: 1431447 - RNA, 19 nt, Homo sapiens
ggcacucgguccucuuaga

SEQ ID NO: 1431448 - RNA, 19 nt, Homo sapiens
gaucagacaggaagaacgu

SEQ ID NO: 1431449 - RNA, 19 nt, Homo sapiens
cacagaaggagauucacua

SEQ ID NO: 1431450 - RNA, 19 nt, Homo sapiens
cgcuuaggcucccaacaaa

SEQ ID NO: 1431451 - RNA, 19 nt, Homo sapiens
cagcgaucuaugagaauua

SEQ ID NO: 1431452 - RNA, 19 nt, Homo sapiens
ccacccacaucagcacuug

SEQ ID NO: 1431453 - RNA, 19 nt, Homo sapiens
ccgcuuaggcucccaacaa

SEQ ID NO: 1431454 - RNA, 19 nt, Homo sapiens
gggaagacaguagaucaga

SEQ ID NO: 1431455 - RNA, 19 nt, Homo sapiens
cagaaggagauucacuauu

SEQ ID NO: 1431456 - RNA, 19 nt, Homo sapiens
gagaaggggaaauggaaua

SEQ ID NO: 1431457 - RNA, 19 nt, Homo sapiens
ggugccgucuugagcuuug

SEQ ID NO: 1431458 - RNA, 19 nt, Homo sapiens
ccucuuagugggaaaguga

SEQ ID NO: 1431459 - RNA, 19 nt, Homo sapiens
gcggugccgucuugagcuu

SEQ ID NO: 1431460 - RNA, 19 nt, Homo sapiens
cacaucagcacuuggaaga

SEQ ID NO: 1431461 - RNA, 19 nt, Homo sapiens
guagaucagacaggaagaa

SEQ ID NO: 1431462 - RNA, 19 nt, Homo sapiens
ugaccauuaugcccaagga

SEQ ID NO: 1431463 - RNA, 19 nt, Homo sapiens
gagagcgggcuuaagaagu

SEQ ID NO: 1431464 - RNA, 19 nt, Homo sapiens
aaggggaaauggaauaaaa

SEQ ID NO: 1431465 - RNA, 19 nt, Homo sapiens
cgaucuaugagaauuaaga

SEQ ID NO: 1431466 - RNA, 19 nt, Homo sapiens
uauuugcaccucagaagaa

SEQ ID NO: 1431467 - RNA, 19 nt, Homo sapiens
ucuuagaagcugcauggua

SEQ ID NO: 1431468 - RNA, 19 nt, Homo sapiens
gccggagguuccaucguau

SEQ ID NO: 1431469 - RNA, 19 nt, Homo sapiens
caccuucucggucauuuau

SEQ ID NO: 1431470 - RNA, 19 nt, Homo sapiens
ucaucacaguugacagguu

SEQ ID NO: 1431471 - RNA, 19 nt, Homo sapiens
ugcaugguaugucuggauu

SEQ ID NO: 1431472 - RNA, 19 nt, Homo sapiens
acagaaggagauucacuau

SEQ ID NO: 1431473 - RNA, 19 nt, Homo sapiens
agcgaucuaugagaauuaa

SEQ ID NO: 1431474 - RNA, 19 nt, Homo sapiens
guaagccuguguuuugguu

SEQ ID NO: 1431475 - RNA, 19 nt, Homo sapiens
aaagugaggcagggucuug

SEQ ID NO: 1431476 - RNA, 19 nt, Homo sapiens
gaaggcacucgguccucuu

SEQ ID NO: 1431477 - RNA, 19 nt, Homo sapiens
gccguucccuguccauguc

SEQ ID NO: 1431478 - RNA, 19 nt, Homo sapiens
gagaucgcgcaggacuuua

SEQ ID NO: 1431479 - RNA, 19 nt, Homo sapiens
uaacaccuucucggucauu

SEQ ID NO: 1431480 - RNA, 19 nt, Homo sapiens
caugguaugucuggauuuu

SEQ ID NO: 1431481 - RNA, 19 nt, Homo sapiens
gcuauggcccguacuaagc

SEQ ID NO: 1431482 - RNA, 19 nt, Homo sapiens
ggacaaacguggggagaac

SEQ ID NO: 1431483 - RNA, 19 nt, Homo sapiens
gaaagugaggcagggucuu

SEQ ID NO: 1431484 - RNA, 19 nt, Homo sapiens
gaaguccaaggccucuuag

SEQ ID NO: 1431485 - RNA, 19 nt, Homo sapiens
agacgcuggugcccgaguu

SEQ ID NO: 1431486 - RNA, 19 nt, Homo sapiens
gcaugguaugucuggauuu

SEQ ID NO: 1431487 - RNA, 19 nt, Homo sapiens
gaucuaugagaauuaagag

SEQ ID NO: 1431488 - RNA, 19 nt, Homo sapiens
agaucgcgcaggacuuuaa

SEQ ID NO: 1431489 - RNA, 19 nt, Homo sapiens
aguaguuccuuuacguugu

SEQ ID NO: 1431490 - RNA, 19 nt, Homo sapiens
aaggcacucgguccucuua

SEQ ID NO: 1431491 - RNA, 19 nt, Homo sapiens
guccauguccacagaagga

SEQ ID NO: 1431492 - RNA, 19 nt, Homo sapiens
ugagauagauacccauuua

SEQ ID NO: 1431493 - RNA, 19 nt, Homo sapiens
gggcagugguuacuuguua

SEQ ID NO: 1431494 - RNA, 19 nt, Homo sapiens
caagucauuucccuuauuu

SEQ ID NO: 1431495 - RNA, 19 nt, Homo sapiens
uauaggaaaugcacagaua

SEQ ID NO: 1431496 - RNA, 19 nt, Homo sapiens
gacaagcacucauuaagga

SEQ ID NO: 1431497 - RNA, 19 nt, Homo sapiens
gcaagucauuucccuuauu

SEQ ID NO: 1431498 - RNA, 19 nt, Homo sapiens
uaugguggcuguauuauga

SEQ ID NO: 1431499 - RNA, 19 nt, Homo sapiens
ggacugguuugguguuuau

SEQ ID NO: 1431500 - RNA, 19 nt, Homo sapiens
gcacagauacggcaugguu

SEQ ID NO: 1431501 - RNA, 19 nt, Homo sapiens
gcauagaauuggacacaga

SEQ ID NO: 1431502 - RNA, 19 nt, Homo sapiens
gggaagagauacaauccuu

SEQ ID NO: 1431503 - RNA, 19 nt, Homo sapiens
gaugagaccacuagagaaa

SEQ ID NO: 1431504 - RNA, 19 nt, Homo sapiens
acaaauaccugcuccaucu

SEQ ID NO: 1431505 - RNA, 19 nt, Homo sapiens
uaagagccauuuacagaau

SEQ ID NO: 1431506 - RNA, 19 nt, Homo sapiens
caacauguguggcaagaag

SEQ ID NO: 1431507 - RNA, 19 nt, Homo sapiens
guaagugcacaacuaauaa

SEQ ID NO: 1431508 - RNA, 19 nt, Homo sapiens
gcaggacaagcacucauua

SEQ ID NO: 1431509 - RNA, 19 nt, Homo sapiens
cgagaaucauugucaugua

SEQ ID NO: 1431510 - RNA, 19 nt, Homo sapiens
guacaaauuaggacagaaa

SEQ ID NO: 1431511 - RNA, 19 nt, Homo sapiens
gagaaucauugucauguac

SEQ ID NO: 1431512 - RNA, 19 nt, Homo sapiens
caucuggacuagugaauuc

SEQ ID NO: 1431513 - RNA, 19 nt, Homo sapiens
aaugauggaucgucagaaa

SEQ ID NO: 1431514 - RNA, 19 nt, Homo sapiens
gcggccaaguggaauauaa

SEQ ID NO: 1431515 - RNA, 19 nt, Homo sapiens
ucaaggaaccauugugaaa

SEQ ID NO: 1431516 - RNA, 19 nt, Homo sapiens
gcauuagccuugucuuugg

SEQ ID NO: 1431517 - RNA, 19 nt, Homo sapiens
cagaaugcauauacuacaa

SEQ ID NO: 1431518 - RNA, 19 nt, Homo sapiens
uguaagugcacaacuaaua

SEQ ID NO: 1431519 - RNA, 19 nt, Homo sapiens
gcaacaaauuaaacaaugc

SEQ ID NO: 1431520 - RNA, 19 nt, Homo sapiens
uaacugcuuuggagacuuc

SEQ ID NO: 1431521 - RNA, 19 nt, Homo sapiens
ggacaagcacucauuaagg

SEQ ID NO: 1431522 - RNA, 19 nt, Homo sapiens
gaauuucugaguuucguaa

SEQ ID NO: 1431523 - RNA, 19 nt, Homo sapiens
ggcagucccucuguuauug

SEQ ID NO: 1431524 - RNA, 19 nt, Homo sapiens
ccaacgaccucagcauaga

SEQ ID NO: 1431525 - RNA, 19 nt, Homo sapiens
ggcaggacaugacccuaaa

SEQ ID NO: 1431526 - RNA, 19 nt, Homo sapiens
uguaagaacugagguaagu

SEQ ID NO: 1431527 - RNA, 19 nt, Homo sapiens
ggccucaucuggacuagug

SEQ ID NO: 1431528 - RNA, 19 nt, Homo sapiens
gccaugauguuuaccuuca

SEQ ID NO: 1431529 - RNA, 19 nt, Homo sapiens
aagcaagucauuucccuua

SEQ ID NO: 1431530 - RNA, 19 nt, Homo sapiens
ugacagcuuuggcaacaug

SEQ ID NO: 1431531 - RNA, 19 nt, Homo sapiens
cucauugucuuugucauua

SEQ ID NO: 1431532 - RNA, 19 nt, Homo sapiens
ucuaagagccauuuacaga

SEQ ID NO: 1431533 - RNA, 19 nt, Homo sapiens
gaacuccaggccauuguga

SEQ ID NO: 1431534 - RNA, 19 nt, Homo sapiens
ggaaugaggagggaacaga

SEQ ID NO: 1431535 - RNA, 19 nt, Homo sapiens
uaacuacaaucgggcauuc

SEQ ID NO: 1431536 - RNA, 19 nt, Homo sapiens
caucaaggaaccauuguga

SEQ ID NO: 1431537 - RNA, 19 nt, Homo sapiens
gggcaggacaugacccuaa

SEQ ID NO: 1431538 - RNA, 19 nt, Homo sapiens
gguccuuccuguguguuua

SEQ ID NO: 1431539 - RNA, 19 nt, Homo sapiens
gaaugaggagggaacagaa

SEQ ID NO: 1431540 - RNA, 19 nt, Homo sapiens
gcauauacuacaacugcua

SEQ ID NO: 1431541 - RNA, 19 nt, Homo sapiens
ggaaucaugucgggaagag

SEQ ID NO: 1431542 - RNA, 19 nt, Homo sapiens
uaaccgaugugucccucaa

SEQ ID NO: 1431543 - RNA, 19 nt, Homo sapiens
ugagguaaguuuguaagug

SEQ ID NO: 1431544 - RNA, 19 nt, Homo sapiens
gggcagucccucuguuauu

SEQ ID NO: 1431545 - RNA, 19 nt, Homo sapiens
gugguuacuuguuauuuca

SEQ ID NO: 1431546 - RNA, 19 nt, Homo sapiens
ccgcauggcccucugugua

SEQ ID NO: 1431547 - RNA, 19 nt, Homo sapiens
cacguguucuuuaugaauu

SEQ ID NO: 1431548 - RNA, 19 nt, Homo sapiens
gaagaugagaccacuagag

SEQ ID NO: 1431549 - RNA, 19 nt, Homo sapiens
caaaugauggaucgucaga

SEQ ID NO: 1431550 - RNA, 19 nt, Homo sapiens
gaaugcauauacuacaacu

SEQ ID NO: 1431551 - RNA, 19 nt, Homo sapiens
aagagccauuuacagaaua

SEQ ID NO: 1431552 - RNA, 19 nt, Homo sapiens
caaccagaaugcauauacu

SEQ ID NO: 1431553 - RNA, 19 nt, Homo sapiens
uaugacagcuuuggcaaca

SEQ ID NO: 1431554 - RNA, 19 nt, Homo sapiens
guaacaauacuggaacuau

SEQ ID NO: 1431555 - RNA, 19 nt, Homo sapiens
gaucuggaaacaaaugaug

SEQ ID NO: 1431556 - RNA, 19 nt, Homo sapiens
gcuauuaaugggacagauu

SEQ ID NO: 1431557 - RNA, 19 nt, Homo sapiens
ggucguaccauuuaauugg

SEQ ID NO: 1431558 - RNA, 19 nt, Homo sapiens
gacauuugccauccucauu

SEQ ID NO: 1431559 - RNA, 19 nt, Homo sapiens
gugcugcucgucuugauuu

SEQ ID NO: 1431560 - RNA, 19 nt, Homo sapiens
gauguuuaccuucagauuc

SEQ ID NO: 1431561 - RNA, 19 nt, Homo sapiens
aaacauuuccuucuaagag

SEQ ID NO: 1431562 - RNA, 19 nt, Homo sapiens
uccaggccauugugagaua

SEQ ID NO: 1431563 - RNA, 19 nt, Homo sapiens
uuggaggacucauggcuuu

SEQ ID NO: 1431564 - RNA, 19 nt, Homo sapiens
gugguguguuucacuguuu

SEQ ID NO: 1431565 - RNA, 19 nt, Homo sapiens
uaccaacgaccucagcaua

SEQ ID NO: 1431566 - RNA, 19 nt, Homo sapiens
aagaugagaccacuagaga

SEQ ID NO: 1431567 - RNA, 19 nt, Homo sapiens
gauagauacccauuuaggu

SEQ ID NO: 1431568 - RNA, 19 nt, Homo sapiens
cuacaacugcuauuaaugg

SEQ ID NO: 1431569 - RNA, 19 nt, Homo sapiens
gcaaaacgcacugaaagaa

SEQ ID NO: 1431570 - RNA, 19 nt, Homo sapiens
gaaucauugucauguacau

SEQ ID NO: 1431571 - RNA, 19 nt, Homo sapiens
gcagugguuacuuguuauu

SEQ ID NO: 1431572 - RNA, 19 nt, Homo sapiens
gagguccaguucuuugcaa

SEQ ID NO: 1431573 - RNA, 19 nt, Homo sapiens
gggcacagcaggacaagca

SEQ ID NO: 1431574 - RNA, 19 nt, Homo sapiens
cuaagagccauuuacagaa

SEQ ID NO: 1431575 - RNA, 19 nt, Homo sapiens
gguuauuccuguucuuucu

SEQ ID NO: 1431576 - RNA, 19 nt, Homo sapiens
ccauuuaauuggccucauc

SEQ ID NO: 1431577 - RNA, 19 nt, Homo sapiens
ggcaacauguguggcaaga

SEQ ID NO: 1431578 - RNA, 19 nt, Homo sapiens
ggagcaacaaauuaaacaa

SEQ ID NO: 1431579 - RNA, 19 nt, Homo sapiens
uccaagaacucaagucacu

SEQ ID NO: 1431580 - RNA, 19 nt, Homo sapiens
caugauguuuaccuucaga

SEQ ID NO: 1431581 - RNA, 19 nt, Homo sapiens
caggacaagcacucauuaa

SEQ ID NO: 1431582 - RNA, 19 nt, Homo sapiens
gugggcagucccucuguua

SEQ ID NO: 1431583 - RNA, 19 nt, Homo sapiens
caacgaccucagcauagaa

SEQ ID NO: 1431584 - RNA, 19 nt, Homo sapiens
guggcuguauuaugacuau

SEQ ID NO: 1431585 - RNA, 19 nt, Homo sapiens
cuauuaaugggacagauuu

SEQ ID NO: 1431586 - RNA, 19 nt, Homo sapiens
ggcagugguuacuuguuau

SEQ ID NO: 1431587 - RNA, 19 nt, Homo sapiens
gagcugcccagguuaugga

SEQ ID NO: 1431588 - RNA, 19 nt, Homo sapiens
gaaagaacagcagcauggu

SEQ ID NO: 1431589 - RNA, 19 nt, Homo sapiens
gcacuuuuccuguguuuug

SEQ ID NO: 1431590 - RNA, 19 nt, Homo sapiens
cuuuggagacuucauaauu

SEQ ID NO: 1431591 - RNA, 19 nt, Homo sapiens
caguugagcuuuuccaaau

SEQ ID NO: 1431592 - RNA, 19 nt, Homo sapiens
gaaaugccauguagugaau

SEQ ID NO: 1431593 - RNA, 19 nt, Homo sapiens
gcucuacacugaagucaaa

SEQ ID NO: 1431594 - RNA, 19 nt, Homo sapiens
gaaggcagcccuccugaaa

SEQ ID NO: 1431595 - RNA, 19 nt, Homo sapiens
gcacugcccugcccaugau

SEQ ID NO: 1431596 - RNA, 19 nt, Homo sapiens
cagaagcacugcgaaagaa

SEQ ID NO: 1431597 - RNA, 19 nt, Homo sapiens
gggaaacccucuggcugua

SEQ ID NO: 1431598 - RNA, 19 nt, Homo sapiens
gagagaacaucgagaucau

SEQ ID NO: 1431599 - RNA, 19 nt, Homo sapiens
ccaagcagaccuacccaua

SEQ ID NO: 1431600 - RNA, 19 nt, Homo sapiens
ccaaggcccugccaaccaa

SEQ ID NO: 1431601 - RNA, 19 nt, Homo sapiens
ccaggaugcuauguguuua

SEQ ID NO: 1431602 - RNA, 19 nt, Homo sapiens
gcagagagaacaucgagau

SEQ ID NO: 1431603 - RNA, 19 nt, Homo sapiens
agagugaauuggaugauga

SEQ ID NO: 1431604 - RNA, 19 nt, Homo sapiens
gagagugaauuggaugaug

SEQ ID NO: 1431605 - RNA, 19 nt, Homo sapiens
ucucagaaaugccauguag

SEQ ID NO: 1431606 - RNA, 19 nt, Homo sapiens
aggaggagguggccaagaa

SEQ ID NO: 1431607 - RNA, 19 nt, Homo sapiens
gaggagaagugcucuacac

SEQ ID NO: 1431608 - RNA, 19 nt, Homo sapiens
ucagaaaugccauguagug

SEQ ID NO: 1431609 - RNA, 19 nt, Homo sapiens
gaagcacugcgaaagaaga

SEQ ID NO: 1431610 - RNA, 19 nt, Homo sapiens
gaucuguacccgccuguug

SEQ ID NO: 1431611 - RNA, 19 nt, Homo sapiens
uaauaaauccagagaccaa

SEQ ID NO: 1431612 - RNA, 19 nt, Homo sapiens
ccagaagcacugcgaaaga

SEQ ID NO: 1431613 - RNA, 19 nt, Homo sapiens
ccaccagccuccugagaag

SEQ ID NO: 1431614 - RNA, 19 nt, Homo sapiens
ucuacuugguuguguguaa

SEQ ID NO: 1431615 - RNA, 19 nt, Homo sapiens
gaaggccaacucccgcaaa

SEQ ID NO: 1431616 - RNA, 19 nt, Homo sapiens
gcagaccuacccauacugu

SEQ ID NO: 1431617 - RNA, 19 nt, Homo sapiens
cagcagcaccuucucuguu

SEQ ID NO: 1431618 - RNA, 19 nt, Homo sapiens
gcaagcugccgccuuccaa

SEQ ID NO: 1431619 - RNA, 19 nt, Homo sapiens
gcucagcacucagcuccau

SEQ ID NO: 1431620 - RNA, 19 nt, Homo sapiens
ggaaggagugcgaccucaa

SEQ ID NO: 1431621 - RNA, 19 nt, Homo sapiens
agaaaugccauguagugaa

SEQ ID NO: 1431622 - RNA, 19 nt, Homo sapiens
caaccaacugccucucuga

SEQ ID NO: 1431623 - RNA, 19 nt, Homo sapiens
ccugccagcucucagaaau

SEQ ID NO: 1431624 - RNA, 19 nt, Homo sapiens
gaagucaaaagcccauuaa

SEQ ID NO: 1431625 - RNA, 19 nt, Homo sapiens
cccaggaugcuauguguuu

SEQ ID NO: 1431626 - RNA, 19 nt, Homo sapiens
aagcagaccuacccauacu

SEQ ID NO: 1431627 - RNA, 19 nt, Homo sapiens
gccucaagcuuuccagaag

SEQ ID NO: 1431628 - RNA, 19 nt, Homo sapiens
gccagcaagucauccaaag

SEQ ID NO: 1431629 - RNA, 19 nt, Homo sapiens
ggaagauggcucggaagga

SEQ ID NO: 1431630 - RNA, 19 nt, Homo sapiens
cagaaaugccauguaguga

SEQ ID NO: 1431631 - RNA, 19 nt, Homo sapiens
gaaggagugcgaccucaac

SEQ ID NO: 1431632 - RNA, 19 nt, Homo sapiens
gaaccuccuggcagagaga

SEQ ID NO: 1431633 - RNA, 19 nt, Homo sapiens
aaagaagacauguccaucu

SEQ ID NO: 1431634 - RNA, 19 nt, Homo sapiens
ggugagcccaggaugcuau

SEQ ID NO: 1431635 - RNA, 19 nt, Homo sapiens
gcaagauccacucaguaca

SEQ ID NO: 1431636 - RNA, 19 nt, Homo sapiens
gcaccucagcacacacaug

SEQ ID NO: 1431637 - RNA, 19 nt, Homo sapiens
ccugcaagauccacucagu

SEQ ID NO: 1431638 - RNA, 19 nt, Homo sapiens
gccaccagccuccugagaa

SEQ ID NO: 1431639 - RNA, 19 nt, Homo sapiens
ccaugaugacuucuacuug

SEQ ID NO: 1431640 - RNA, 19 nt, Homo sapiens
caagcagaccuacccauac

SEQ ID NO: 1431641 - RNA, 19 nt, Homo sapiens
cugagaagacccagaagga

SEQ ID NO: 1431642 - RNA, 19 nt, Homo sapiens
gcacugcgaaagaagacau

SEQ ID NO: 1431643 - RNA, 19 nt, Homo sapiens
ugacccucauuaaagaaga

SEQ ID NO: 1431644 - RNA, 19 nt, Homo sapiens
agagagaacaucgagauca

SEQ ID NO: 1431645 - RNA, 19 nt, Homo sapiens
gagugaauuggaugaugaa

SEQ ID NO: 1431646 - RNA, 19 nt, Homo sapiens
agcagcaccuucucuguuc

SEQ ID NO: 1431647 - RNA, 19 nt, Homo sapiens
ggccagcaagucauccaaa

SEQ ID NO: 1431648 - RNA, 19 nt, Homo sapiens
caccucagcacacacaugu

SEQ ID NO: 1431649 - RNA, 19 nt, Homo sapiens
caaggacuccccuggaaaa

SEQ ID NO: 1431650 - RNA, 19 nt, Homo sapiens
gggcuuaaugggacaaugg

SEQ ID NO: 1431651 - RNA, 19 nt, Homo sapiens
ucucgaaagcggaaguuau

SEQ ID NO: 1431652 - RNA, 19 nt, Homo sapiens
caggcguucugcaccuuug

SEQ ID NO: 1431653 - RNA, 19 nt, Homo sapiens
caagauccacucaguacac

SEQ ID NO: 1431654 - RNA, 19 nt, Homo sapiens
gaucccaccggcagcugaa

SEQ ID NO: 1431655 - RNA, 19 nt, Homo sapiens
agaagacccagaaggacaa

SEQ ID NO: 1431656 - RNA, 19 nt, Homo sapiens
uuaaagaagacauguccau

SEQ ID NO: 1431657 - RNA, 19 nt, Homo sapiens
ggacaaggauuaagaaugu

SEQ ID NO: 1431658 - RNA, 19 nt, Homo sapiens
gagacaaacucaauguuaa

SEQ ID NO: 1431659 - RNA, 19 nt, Homo sapiens
ccacgaaguuucauaguuu

SEQ ID NO: 1431660 - RNA, 19 nt, Homo sapiens
gucaagugcuuacugauuu

SEQ ID NO: 1431661 - RNA, 19 nt, Homo sapiens
gcaggaguauuugcucuuu

SEQ ID NO: 1431662 - RNA, 19 nt, Homo sapiens
caagagugauuuguuaaug

SEQ ID NO: 1431663 - RNA, 19 nt, Homo sapiens
caauugaugucauguguca

SEQ ID NO: 1431664 - RNA, 19 nt, Homo sapiens
gaagagacaaacucaaugu

SEQ ID NO: 1431665 - RNA, 19 nt, Homo sapiens
gcagaugaguuaguucuuc

SEQ ID NO: 1431666 - RNA, 19 nt, Homo sapiens
gaacaggauauuaauagga

SEQ ID NO: 1431667 - RNA, 19 nt, Homo sapiens
caagaagaacaggauauua

SEQ ID NO: 1431668 - RNA, 19 nt, Homo sapiens
agagacaaacucaauguua

SEQ ID NO: 1431669 - RNA, 19 nt, Homo sapiens
aaaguggcaucaagaagaa

SEQ ID NO: 1431670 - RNA, 19 nt, Homo sapiens
gauuuaacauuccaacaca

SEQ ID NO: 1431671 - RNA, 19 nt, Homo sapiens
caacagcuccucccagauc

SEQ ID NO: 1431672 - RNA, 19 nt, Homo sapiens
ugguguacuuccugaauua

SEQ ID NO: 1431673 - RNA, 19 nt, Homo sapiens
ucagaagaguaauggugua

SEQ ID NO: 1431674 - RNA, 19 nt, Homo sapiens
gcauagcgccucucugauc

SEQ ID NO: 1431675 - RNA, 19 nt, Homo sapiens
ggauuaagaauguggauca

SEQ ID NO: 1431676 - RNA, 19 nt, Homo sapiens
ugaguuaguucuucauucu

SEQ ID NO: 1431677 - RNA, 19 nt, Homo sapiens
ggagugaccacgaaguuuc

SEQ ID NO: 1431678 - RNA, 19 nt, Homo sapiens
cagaagagacaaacucaau

SEQ ID NO: 1431679 - RNA, 19 nt, Homo sapiens
uuccaaauguuuaccauga

SEQ ID NO: 1431680 - RNA, 19 nt, Homo sapiens
gaaguuauggauucuuaca

SEQ ID NO: 1431681 - RNA, 19 nt, Homo sapiens
cagaugaguuaguucuuca

SEQ ID NO: 1431682 - RNA, 19 nt, Homo sapiens
cugcauggcucaggugauu

SEQ ID NO: 1431683 - RNA, 19 nt, Homo sapiens
uguaugguuugacagauuu

SEQ ID NO: 1431684 - RNA, 19 nt, Homo sapiens
gauauuaauaggaggauuc

SEQ ID NO: 1431685 - RNA, 19 nt, Homo sapiens
ucaagugcuuacugauuug

SEQ ID NO: 1431686 - RNA, 19 nt, Homo sapiens
gcuccucccagaucauaua

SEQ ID NO: 1431687 - RNA, 19 nt, Homo sapiens
ucaagcagguuuuaaauca

SEQ ID NO: 1431688 - RNA, 19 nt, Homo sapiens
gcauauagaaaucaucaag

SEQ ID NO: 1431689 - RNA, 19 nt, Homo sapiens
uuauuucagugucauggua

SEQ ID NO: 1431690 - RNA, 19 nt, Homo sapiens
ucaagaagaacaggauauu

SEQ ID NO: 1431691 - RNA, 19 nt, Homo sapiens
uaaguguaaugucuuugug

SEQ ID NO: 1431692 - RNA, 19 nt, Homo sapiens
augaaugaaucaagaguga

SEQ ID NO: 1431693 - RNA, 19 nt, Homo sapiens
gauuaagaauguggaucaa

SEQ ID NO: 1431694 - RNA, 19 nt, Homo sapiens
agauguggcaggaguauuu

SEQ ID NO: 1431695 - RNA, 19 nt, Homo sapiens
aaucuccaauguaugguuu

SEQ ID NO: 1431696 - RNA, 19 nt, Homo sapiens
guaaguguaaugucuuugu

SEQ ID NO: 1431697 - RNA, 19 nt, Homo sapiens
caauguaugguuugacaga

SEQ ID NO: 1431698 - RNA, 19 nt, Homo sapiens
ugucaugugucaagugcuu

SEQ ID NO: 1431699 - RNA, 19 nt, Homo sapiens
ggauauuaauaggaggauu

SEQ ID NO: 1431700 - RNA, 19 nt, Homo sapiens
caucaagaagaacaggaua

SEQ ID NO: 1431701 - RNA, 19 nt, Homo sapiens
cugauuugauugaugaaga

SEQ ID NO: 1431702 - RNA, 19 nt, Homo sapiens
ugugucaagugcuuacuga

SEQ ID NO: 1431703 - RNA, 19 nt, Homo sapiens
gcccagaacaccuugaauc

SEQ ID NO: 1431704 - RNA, 19 nt, Homo sapiens
gcagaagagacaaacucaa

SEQ ID NO: 1431705 - RNA, 19 nt, Homo sapiens
guuauggauucuuacaaag

SEQ ID NO: 1431706 - RNA, 19 nt, Homo sapiens
cauagcgccucucugaucu

SEQ ID NO: 1431707 - RNA, 19 nt, Homo sapiens
ugucaagugcuuacugauu

SEQ ID NO: 1431708 - RNA, 19 nt, Homo sapiens
aguguaaugucuuugugaa

SEQ ID NO: 1431709 - RNA, 19 nt, Homo sapiens
ugaguuagacauauugaag

SEQ ID NO: 1431710 - RNA, 19 nt, Homo sapiens
aguuaguucuucauucuug

SEQ ID NO: 1431711 - RNA, 19 nt, Homo sapiens
guauuugcucuuucuaguu

SEQ ID NO: 1431712 - RNA, 19 nt, Homo sapiens
gaaucuccaauguaugguu

SEQ ID NO: 1431713 - RNA, 19 nt, Homo sapiens
cagcuccucccagaucaua

SEQ ID NO: 1431714 - RNA, 19 nt, Homo sapiens
accacgaaguuucauaguu

SEQ ID NO: 1431715 - RNA, 19 nt, Homo sapiens
gcaucaagaagaacaggau

SEQ ID NO: 1431716 - RNA, 19 nt, Homo sapiens
ggaucaagcagguuuuaaa

SEQ ID NO: 1431717 - RNA, 19 nt, Homo sapiens
uccaauguaugguuugaca

SEQ ID NO: 1431718 - RNA, 19 nt, Homo sapiens
gggcagaagagacaaacuc

SEQ ID NO: 1431719 - RNA, 19 nt, Homo sapiens
caagauguggcaggaguau

SEQ ID NO: 1431720 - RNA, 19 nt, Homo sapiens
uuaauaggaggauucucua

SEQ ID NO: 1431721 - RNA, 19 nt, Homo sapiens
acaaagcugccaggagaaa

SEQ ID NO: 1431722 - RNA, 19 nt, Homo sapiens
gaguuagacauauugaagu

SEQ ID NO: 1431723 - RNA, 19 nt, Homo sapiens
gacaaggauuaagaaugug

SEQ ID NO: 1431724 - RNA, 19 nt, Homo sapiens
aguauuugcucuuucuagu

SEQ ID NO: 1431725 - RNA, 19 nt, Homo sapiens
ggcagaagagacaaacuca

SEQ ID NO: 1431726 - RNA, 19 nt, Homo sapiens
guacugcagaugaguuagu

SEQ ID NO: 1431727 - RNA, 19 nt, Homo sapiens
ggaguauuugcucuuucua

SEQ ID NO: 1431728 - RNA, 19 nt, Homo sapiens
agaacaggauauuaauagg

SEQ ID NO: 1431729 - RNA, 19 nt, Homo sapiens
cccagaacaccuugaauca

SEQ ID NO: 1431730 - RNA, 19 nt, Homo sapiens
uaggagugaccacgaaguu

SEQ ID NO: 1431731 - RNA, 19 nt, Homo sapiens
ccucccagaucauauacuc

SEQ ID NO: 1431732 - RNA, 19 nt, Homo sapiens
gaguauuugcucuuucuag

SEQ ID NO: 1431733 - RNA, 19 nt, Homo sapiens
uagcgccucucugaucuuc

SEQ ID NO: 1431734 - RNA, 19 nt, Homo sapiens
gaucaagcagguuuuaaau

SEQ ID NO: 1431735 - RNA, 19 nt, Homo sapiens
aaagcugccaggagaaaug

SEQ ID NO: 1431736 - RNA, 19 nt, Homo sapiens
gagugaccacgaaguuuca

SEQ ID NO: 1431737 - RNA, 19 nt, Homo sapiens
agaagagacaaacucaaug

SEQ ID NO: 1431738 - RNA, 19 nt, Homo sapiens
ccagaucauauacuccuau

SEQ ID NO: 1431739 - RNA, 19 nt, Homo sapiens
guacuuccugaauuauuuc

SEQ ID NO: 1431740 - RNA, 19 nt, Homo sapiens
ugacugcccagaacaccuu

SEQ ID NO: 1431741 - RNA, 19 nt, Homo sapiens
caggaguauuugcucuuuc

SEQ ID NO: 1431742 - RNA, 19 nt, Homo sapiens
ucaagauguggcaggagua

SEQ ID NO: 1431743 - RNA, 19 nt, Homo sapiens
agugcuuacugauuugauu

SEQ ID NO: 1431744 - RNA, 19 nt, Homo sapiens
gcauggcucaggugauucu

SEQ ID NO: 1431745 - RNA, 19 nt, Homo sapiens
uauggauucuuacaaagcu

SEQ ID NO: 1431746 - RNA, 19 nt, Homo sapiens
ugaccacgaaguuucauag

SEQ ID NO: 1431747 - RNA, 19 nt, Homo sapiens
ugauucuggacaaggauua

SEQ ID NO: 1431748 - RNA, 19 nt, Homo sapiens
gaauuauuucagugucaug

SEQ ID NO: 1431749 - RNA, 19 nt, Homo sapiens
ucuccaauguaugguuuga

SEQ ID NO: 1431750 - RNA, 19 nt, Homo sapiens
aaaaguggcaucaagaaga

SEQ ID NO: 1431751 - RNA, 19 nt, Homo sapiens
gcagagagauaaagaguuu

SEQ ID NO: 1431752 - RNA, 19 nt, Homo sapiens
gauaaagaguuucgacuaa

SEQ ID NO: 1431753 - RNA, 19 nt, Homo sapiens
gagcuaagauuggcagaaa

SEQ ID NO: 1431754 - RNA, 19 nt, Homo sapiens
auaaugggcucucagaaua

SEQ ID NO: 1431755 - RNA, 19 nt, Homo sapiens
cuacagagccaccaacuaa

SEQ ID NO: 1431756 - RNA, 19 nt, Homo sapiens
gaacaaacacuagggaaga

SEQ ID NO: 1431757 - RNA, 19 nt, Homo sapiens
gaaauugaccaguacagaa

SEQ ID NO: 1431758 - RNA, 19 nt, Homo sapiens
gggaagauacaagaacuua

SEQ ID NO: 1431759 - RNA, 19 nt, Homo sapiens
gauaaugggcucucagaau

SEQ ID NO: 1431760 - RNA, 19 nt, Homo sapiens
auacaucggcacugaauua

SEQ ID NO: 1431761 - RNA, 19 nt, Homo sapiens
ucucucagaugaaauagaa

SEQ ID NO: 1431762 - RNA, 19 nt, Homo sapiens
ggaagcaaugguagaaauu

SEQ ID NO: 1431763 - RNA, 19 nt, Homo sapiens
caucggcacugaauuaaac

SEQ ID NO: 1431764 - RNA, 19 nt, Homo sapiens
ggacacuacaauaaguaua

SEQ ID NO: 1431765 - RNA, 19 nt, Homo sapiens
ggaagauacaagaacuuaa

SEQ ID NO: 1431766 - RNA, 19 nt, Homo sapiens
ccucauuuauaccuccuua

SEQ ID NO: 1431767 - RNA, 19 nt, Homo sapiens
ggaggaagcaaugguagaa

SEQ ID NO: 1431768 - RNA, 19 nt, Homo sapiens
caaggaggaagcaauggua

SEQ ID NO: 1431769 - RNA, 19 nt, Homo sapiens
cagaugaaauagaagaaca

SEQ ID NO: 1431770 - RNA, 19 nt, Homo sapiens
gguagaaauugaccaguac

SEQ ID NO: 1431771 - RNA, 19 nt, Homo sapiens
gaaugcagagagauaaaga

SEQ ID NO: 1431772 - RNA, 19 nt, Homo sapiens
gaagcaagccaaggaggaa

SEQ ID NO: 1431773 - RNA, 19 nt, Homo sapiens
gauacaagaacuuaaugga

SEQ ID NO: 1431774 - RNA, 19 nt, Homo sapiens
cuccuuaucucauacagaa

SEQ ID NO: 1431775 - RNA, 19 nt, Homo sapiens
gaacuuaauggacacuaca

SEQ ID NO: 1431776 - RNA, 19 nt, Homo sapiens
uauaccuccuuaucucaua

SEQ ID NO: 1431777 - RNA, 19 nt, Homo sapiens
gcuaagauuggcagaaaug

SEQ ID NO: 1431778 - RNA, 19 nt, Homo sapiens
ggagcagacuaccaugaca

SEQ ID NO: 1431779 - RNA, 19 nt, Homo sapiens
gaugcaacaccucauuuau

SEQ ID NO: 1431780 - RNA, 19 nt, Homo sapiens
ugcaacaccucauuuauac

SEQ ID NO: 1431781 - RNA, 19 nt, Homo sapiens
cagaaauccaugugaacua

SEQ ID NO: 1431782 - RNA, 19 nt, Homo sapiens
aaccagaaauccaugugaa

SEQ ID NO: 1431783 - RNA, 19 nt, Homo sapiens
cuuaauggacacuacaaua

SEQ ID NO: 1431784 - RNA, 19 nt, Homo sapiens
guagaugcaacaccucauu

SEQ ID NO: 1431785 - RNA, 19 nt, Homo sapiens
aagauuggcagaaaugauu

SEQ ID NO: 1431786 - RNA, 19 nt, Homo sapiens
caacuaaauguacaucaca

SEQ ID NO: 1431787 - RNA, 19 nt, Homo sapiens
augcaacaccucauuuaua

SEQ ID NO: 1431788 - RNA, 19 nt, Homo sapiens
agauaaagaguuucgacua

SEQ ID NO: 1431789 - RNA, 19 nt, Homo sapiens
acucauacaucggcacuga

SEQ ID NO: 1431790 - RNA, 19 nt, Homo sapiens
auacagaagagcuaagauu

SEQ ID NO: 1431791 - RNA, 19 nt, Homo sapiens
uaaugggcucucagaauaa

SEQ ID NO: 1431792 - RNA, 19 nt, Homo sapiens
agaugcaacaccucauuua

SEQ ID NO: 1431793 - RNA, 19 nt, Homo sapiens
gagccaccaacuaaaugua

SEQ ID NO: 1431794 - RNA, 19 nt, Homo sapiens
gaaaccagaaauccaugug

SEQ ID NO: 1431795 - RNA, 19 nt, Homo sapiens
gauugaagcaagccaagga

SEQ ID NO: 1431796 - RNA, 19 nt, Homo sapiens
gagcagacuaccaugacaa

SEQ ID NO: 1431797 - RNA, 19 nt, Homo sapiens
gugaugaaccagcucuuga

SEQ ID NO: 1431798 - RNA, 19 nt, Homo sapiens
aggaagcaaugguagaaau

SEQ ID NO: 1431799 - RNA, 19 nt, Homo sapiens
gaggaagccaagaagagaa

SEQ ID NO: 1431800 - RNA, 19 nt, Homo sapiens
ugacaugaaaccagaaauc

SEQ ID NO: 1431801 - RNA, 19 nt, Homo sapiens
uacagaagagcuaagauug

SEQ ID NO: 1431802 - RNA, 19 nt, Homo sapiens
agugccaccugguugcuua

SEQ ID NO: 1431803 - RNA, 19 nt, Homo sapiens
cuaaauguacaucacaguu

SEQ ID NO: 1431804 - RNA, 19 nt, Homo sapiens
agaaauccaugugaacuac

SEQ ID NO: 1431805 - RNA, 19 nt, Homo sapiens
uacagaaugcagagagaua

SEQ ID NO: 1431806 - RNA, 19 nt, Homo sapiens
ccaacuaaauguacaucac

SEQ ID NO: 1431807 - RNA, 19 nt, Homo sapiens
aauggacacuacaauaagu

SEQ ID NO: 1431808 - RNA, 19 nt, Homo sapiens
aaauugaccaguacagaau

SEQ ID NO: 1431809 - RNA, 19 nt, Homo sapiens
gcacugaauuaaacaaaac

SEQ ID NO: 1431810 - RNA, 19 nt, Homo sapiens
caaggacaagcuagaggaa

SEQ ID NO: 1431811 - RNA, 19 nt, Homo sapiens
uagaugcaacaccucauuu

SEQ ID NO: 1431812 - RNA, 19 nt, Homo sapiens
acagagccaccaacuaaau

SEQ ID NO: 1431813 - RNA, 19 nt, Homo sapiens
cagaaugcagagagauaaa

SEQ ID NO: 1431814 - RNA, 19 nt, Homo sapiens
acagaaugcagagagauaa

SEQ ID NO: 1431815 - RNA, 19 nt, Homo sapiens
gaggaagcaaugguagaaa

SEQ ID NO: 1431816 - RNA, 19 nt, Homo sapiens
caugaaaccagaaauccau

SEQ ID NO: 1431817 - RNA, 19 nt, Homo sapiens
uaauggacacuacaauaag

SEQ ID NO: 1431818 - RNA, 19 nt, Homo sapiens
aaaccagaaauccauguga

SEQ ID NO: 1431819 - RNA, 19 nt, Homo sapiens
uggaaagugugaugaacca

SEQ ID NO: 1431820 - RNA, 19 nt, Homo sapiens
guauauggaaagugugaug

SEQ ID NO: 1431821 - RNA, 19 nt, Homo sapiens
uagggaagauacaagaacu

SEQ ID NO: 1431822 - RNA, 19 nt, Homo sapiens
gaaauagaagaacaaacac

SEQ ID NO: 1431823 - RNA, 19 nt, Homo sapiens
caacaccucauuuauaccu

SEQ ID NO: 1431824 - RNA, 19 nt, Homo sapiens
cagagccaccaacuaaaug

SEQ ID NO: 1431825 - RNA, 19 nt, Homo sapiens
gaaauccaugugaacuaca

SEQ ID NO: 1431826 - RNA, 19 nt, Homo sapiens
ucauuuauaccuccuuauc

SEQ ID NO: 1431827 - RNA, 19 nt, Homo sapiens
uaagauuggcagaaaugau

SEQ ID NO: 1431828 - RNA, 19 nt, Homo sapiens
agaggaagccaagaagaga

SEQ ID NO: 1431829 - RNA, 19 nt, Homo sapiens
acaaacacuagggaagaua

SEQ ID NO: 1431830 - RNA, 19 nt, Homo sapiens
aaugggcucucagaauaau

SEQ ID NO: 1431831 - RNA, 19 nt, Homo sapiens
cgacuaaaacaaucuaaga

SEQ ID NO: 1431832 - RNA, 19 nt, Homo sapiens
ucauacaucggcacugaau

SEQ ID NO: 1431833 - RNA, 19 nt, Homo sapiens
gccaccaacuaaauguaca

SEQ ID NO: 1431834 - RNA, 19 nt, Homo sapiens
gggccaaggacaagcuaga

SEQ ID NO: 1431835 - RNA, 19 nt, Homo sapiens
agaaauugaccaguacaga

SEQ ID NO: 1431836 - RNA, 19 nt, Homo sapiens
gcuagaggaagccaagaag

SEQ ID NO: 1431837 - RNA, 19 nt, Homo sapiens
ucuugagcauggucuguga

SEQ ID NO: 1431838 - RNA, 19 nt, Homo sapiens
aaggaaagcgauugaagca

SEQ ID NO: 1431839 - RNA, 19 nt, Homo sapiens
ucucagaugaaauagaaga

SEQ ID NO: 1431840 - RNA, 19 nt, Homo sapiens
cuaagauaaugggcucuca

SEQ ID NO: 1431841 - RNA, 19 nt, Homo sapiens
guacagaaugcagagagau

SEQ ID NO: 1431842 - RNA, 19 nt, Homo sapiens
gaaaaggaaagcgauugaa

SEQ ID NO: 1431843 - RNA, 19 nt, Homo sapiens
uagaggaagccaagaagag

SEQ ID NO: 1431844 - RNA, 19 nt, Homo sapiens
caaacacuagggaagauac

SEQ ID NO: 1431845 - RNA, 19 nt, Homo sapiens
aacaaacacuagggaagau

SEQ ID NO: 1431846 - RNA, 19 nt, Homo sapiens
aagauaaugggcucucaga

SEQ ID NO: 1431847 - RNA, 19 nt, Homo sapiens
gcagagagauaaagaguuu

SEQ ID NO: 1431848 - RNA, 19 nt, Homo sapiens
gauaaagaguuucgacuaa

SEQ ID NO: 1431849 - RNA, 19 nt, Homo sapiens
gagcuaagauuggcagaaa

SEQ ID NO: 1431850 - RNA, 19 nt, Homo sapiens
auaaugggcucucagaaua

SEQ ID NO: 1431851 - RNA, 19 nt, Homo sapiens
cuacagagccaccaacuaa

SEQ ID NO: 1431852 - RNA, 19 nt, Homo sapiens
gaacaaacacuagggaaga

SEQ ID NO: 1431853 - RNA, 19 nt, Homo sapiens
gaaauugaccaguacagaa

SEQ ID NO: 1431854 - RNA, 19 nt, Homo sapiens
gggaagauacaagaacuua

SEQ ID NO: 1431855 - RNA, 19 nt, Homo sapiens
gauaaugggcucucagaau

SEQ ID NO: 1431856 - RNA, 19 nt, Homo sapiens
auacaucggcacugaauua

SEQ ID NO: 1431857 - RNA, 19 nt, Homo sapiens
ucucucagaugaaauagaa

SEQ ID NO: 1431858 - RNA, 19 nt, Homo sapiens
ggaagcaaugguagaaauu

SEQ ID NO: 1431859 - RNA, 19 nt, Homo sapiens
caucggcacugaauuaaac

SEQ ID NO: 1431860 - RNA, 19 nt, Homo sapiens
ggacacuacaauaaguaua

SEQ ID NO: 1431861 - RNA, 19 nt, Homo sapiens
ggaagauacaagaacuuaa

SEQ ID NO: 1431862 - RNA, 19 nt, Homo sapiens
ccucauuuauaccuccuua

SEQ ID NO: 1431863 - RNA, 19 nt, Homo sapiens
ggaggaagcaaugguagaa

SEQ ID NO: 1431864 - RNA, 19 nt, Homo sapiens
caaggaggaagcaauggua

SEQ ID NO: 1431865 - RNA, 19 nt, Homo sapiens
cagaugaaauagaagaaca

SEQ ID NO: 1431866 - RNA, 19 nt, Homo sapiens
gguagaaauugaccaguac

SEQ ID NO: 1431867 - RNA, 19 nt, Homo sapiens
gaaugcagagagauaaaga

SEQ ID NO: 1431868 - RNA, 19 nt, Homo sapiens
gaagcaagccaaggaggaa

SEQ ID NO: 1431869 - RNA, 19 nt, Homo sapiens
gauacaagaacuuaaugga

SEQ ID NO: 1431870 - RNA, 19 nt, Homo sapiens
cuccuuaucucauacagaa

SEQ ID NO: 1431871 - RNA, 19 nt, Homo sapiens
gaacuuaauggacacuaca

SEQ ID NO: 1431872 - RNA, 19 nt, Homo sapiens
uauaccuccuuaucucaua

SEQ ID NO: 1431873 - RNA, 19 nt, Homo sapiens
gcuaagauuggcagaaaug

SEQ ID NO: 1431874 - RNA, 19 nt, Homo sapiens
gaagagacugggacugcuu

SEQ ID NO: 1431875 - RNA, 19 nt, Homo sapiens
ggagcagacuaccaugaca

SEQ ID NO: 1431876 - RNA, 19 nt, Homo sapiens
gaugcaacaccucauuuau

SEQ ID NO: 1431877 - RNA, 19 nt, Homo sapiens
ugcaacaccucauuuauac

SEQ ID NO: 1431878 - RNA, 19 nt, Homo sapiens
cagaaauccaugugaacua

SEQ ID NO: 1431879 - RNA, 19 nt, Homo sapiens
aaccagaaauccaugugaa

SEQ ID NO: 1431880 - RNA, 19 nt, Homo sapiens
cuuaauggacacuacaaua

SEQ ID NO: 1431881 - RNA, 19 nt, Homo sapiens
guagaugcaacaccucauu

SEQ ID NO: 1431882 - RNA, 19 nt, Homo sapiens
aagauuggcagaaaugauu

SEQ ID NO: 1431883 - RNA, 19 nt, Homo sapiens
caacuaaauguacaucaca

SEQ ID NO: 1431884 - RNA, 19 nt, Homo sapiens
augcaacaccucauuuaua

SEQ ID NO: 1431885 - RNA, 19 nt, Homo sapiens
agauaaagaguuucgacua

SEQ ID NO: 1431886 - RNA, 19 nt, Homo sapiens
acucauacaucggcacuga

SEQ ID NO: 1431887 - RNA, 19 nt, Homo sapiens
auacagaagagcuaagauu

SEQ ID NO: 1431888 - RNA, 19 nt, Homo sapiens
uaaugggcucucagaauaa

SEQ ID NO: 1431889 - RNA, 19 nt, Homo sapiens
agaugcaacaccucauuua

SEQ ID NO: 1431890 - RNA, 19 nt, Homo sapiens
gagccaccaacuaaaugua

SEQ ID NO: 1431891 - RNA, 19 nt, Homo sapiens
gaaaccagaaauccaugug

SEQ ID NO: 1431892 - RNA, 19 nt, Homo sapiens
gauugaagcaagccaagga

SEQ ID NO: 1431893 - RNA, 19 nt, Homo sapiens
gagcagacuaccaugacaa

SEQ ID NO: 1431894 - RNA, 19 nt, Homo sapiens
gugaugaaccagcucuuga

SEQ ID NO: 1431895 - RNA, 19 nt, Homo sapiens
aggaagcaaugguagaaau

SEQ ID NO: 1431896 - RNA, 19 nt, Homo sapiens
uacagaagagcuaagauug

SEQ ID NO: 1431897 - RNA, 19 nt, Homo sapiens
ugacaugaaaccagaaauc

SEQ ID NO: 1431898 - RNA, 19 nt, Homo sapiens
gaggaagccaagaagauuc

SEQ ID NO: 1431899 - RNA, 19 nt, Homo sapiens
agugccaccugguugcuua

SEQ ID NO: 1431900 - RNA, 19 nt, Homo sapiens
cuaaauguacaucacaguu

SEQ ID NO: 1431901 - RNA, 19 nt, Homo sapiens
agaaauccaugugaacuac

SEQ ID NO: 1431902 - RNA, 19 nt, Homo sapiens
uacagaaugcagagagaua

SEQ ID NO: 1431903 - RNA, 19 nt, Homo sapiens
ccaacuaaauguacaucac

SEQ ID NO: 1431904 - RNA, 19 nt, Homo sapiens
aauggacacuacaauaagu

SEQ ID NO: 1431905 - RNA, 19 nt, Homo sapiens
aaauugaccaguacagaau

SEQ ID NO: 1431906 - RNA, 19 nt, Homo sapiens
agaggaagccaagaagauu

SEQ ID NO: 1431907 - RNA, 19 nt, Homo sapiens
gcacugaauuaaacaaaac

SEQ ID NO: 1431908 - RNA, 19 nt, Homo sapiens
ggaaaaggaaagcgauuga

SEQ ID NO: 1431909 - RNA, 19 nt, Homo sapiens
caaggacaagcuagaggaa

SEQ ID NO: 1431910 - RNA, 19 nt, Homo sapiens
acagagccaccaacuaaau

SEQ ID NO: 1431911 - RNA, 19 nt, Homo sapiens
uagaugcaacaccucauuu

SEQ ID NO: 1431912 - RNA, 19 nt, Homo sapiens
cagaaugcagagagauaaa

SEQ ID NO: 1431913 - RNA, 19 nt, Homo sapiens
acagaaugcagagagauaa

SEQ ID NO: 1431914 - RNA, 19 nt, Homo sapiens
gaggaagcaaugguagaaa

SEQ ID NO: 1431915 - RNA, 19 nt, Homo sapiens
uagaggaagccaagaagau

SEQ ID NO: 1431916 - RNA, 19 nt, Homo sapiens
caugaaaccagaaauccau

SEQ ID NO: 1431917 - RNA, 19 nt, Homo sapiens
uaauggacacuacaauaag

SEQ ID NO: 1431918 - RNA, 19 nt, Homo sapiens
aaaccagaaauccauguga

SEQ ID NO: 1431919 - RNA, 19 nt, Homo sapiens
uggaaagugugaugaacca

SEQ ID NO: 1431920 - RNA, 19 nt, Homo sapiens
guauauggaaagugugaug

SEQ ID NO: 1431921 - RNA, 19 nt, Homo sapiens
uagggaagauacaagaacu

SEQ ID NO: 1431922 - RNA, 19 nt, Homo sapiens
gaaauagaagaacaaacac

SEQ ID NO: 1431923 - RNA, 19 nt, Homo sapiens
caacaccucauuuauaccu

SEQ ID NO: 1431924 - RNA, 19 nt, Homo sapiens
cagagccaccaacuaaaug

SEQ ID NO: 1431925 - RNA, 19 nt, Homo sapiens
gaaauccaugugaacuaca

SEQ ID NO: 1431926 - RNA, 19 nt, Homo sapiens
ucauuuauaccuccuuauc

SEQ ID NO: 1431927 - RNA, 19 nt, Homo sapiens
uaagauuggcagaaaugau

SEQ ID NO: 1431928 - RNA, 19 nt, Homo sapiens
acaaacacuagggaagaua

SEQ ID NO: 1431929 - RNA, 19 nt, Homo sapiens
aaugggcucucagaauaau

SEQ ID NO: 1431930 - RNA, 19 nt, Homo sapiens
cgacuaaaacaaucuaaga

SEQ ID NO: 1431931 - RNA, 19 nt, Homo sapiens
ucauacaucggcacugaau

SEQ ID NO: 1431932 - RNA, 19 nt, Homo sapiens
gccaccaacuaaauguaca

SEQ ID NO: 1431933 - RNA, 19 nt, Homo sapiens
gggccaaggacaagcuaga

SEQ ID NO: 1431934 - RNA, 19 nt, Homo sapiens
agaaauugaccaguacaga

SEQ ID NO: 1431935 - RNA, 19 nt, Homo sapiens
ucuugagcauggucuguga

SEQ ID NO: 1431936 - RNA, 19 nt, Homo sapiens
ucucagaugaaauagaaga

SEQ ID NO: 1431937 - RNA, 19 nt, Homo sapiens
cuaagauaaugggcucuca

SEQ ID NO: 1431938 - RNA, 19 nt, Homo sapiens
guacagaaugcagagagau

SEQ ID NO: 1431939 - RNA, 19 nt, Homo sapiens
gcuagaggaagccaagaag

SEQ ID NO: 1431940 - RNA, 19 nt, Homo sapiens
aaggaaagcgauugaagca

SEQ ID NO: 1431941 - RNA, 19 nt, Homo sapiens
gaaaaggaaagcgauugaa

SEQ ID NO: 1431942 - RNA, 19 nt, Homo sapiens
caaacacuagggaagauac

SEQ ID NO: 1431943 - RNA, 19 nt, Homo sapiens
aacaaacacuagggaagau

SEQ ID NO: 1431944 - RNA, 19 nt, Homo sapiens
aagauaaugggcucucaga

SEQ ID NO: 1431945 - RNA, 19 nt, Homo sapiens
caucaggaaucaacuauua

SEQ ID NO: 1431946 - RNA, 19 nt, Homo sapiens
uaacaaugcuuaccaaugu

SEQ ID NO: 1431947 - RNA, 19 nt, Homo sapiens
gcacugauauggagaacuu

SEQ ID NO: 1431948 - RNA, 19 nt, Homo sapiens
ggaaucaacuauuaaccaa

SEQ ID NO: 1431949 - RNA, 19 nt, Homo sapiens
gcucccagauggaauauuu

SEQ ID NO: 1431950 - RNA, 19 nt, Homo sapiens
ggaagacauccaauuauuu

SEQ ID NO: 1431951 - RNA, 19 nt, Homo sapiens
gaagacauccaauuauuuc

SEQ ID NO: 1431952 - RNA, 19 nt, Homo sapiens
auauguaacuggaggauua

SEQ ID NO: 1431953 - RNA, 19 nt, Homo sapiens
gaguaaagccugccacauu

SEQ ID NO: 1431954 - RNA, 19 nt, Homo sapiens
gaagcaauauauucugcaa

SEQ ID NO: 1431955 - RNA, 19 nt, Homo sapiens
auacaaagauccaugugaa

SEQ ID NO: 1431956 - RNA, 19 nt, Homo sapiens
cagauuacauugcauuugu

SEQ ID NO: 1431957 - RNA, 19 nt, Homo sapiens
uuacaucuuugcagacuaa

SEQ ID NO: 1431958 - RNA, 19 nt, Homo sapiens
cuacagugcugcuauaagu

SEQ ID NO: 1431959 - RNA, 19 nt, Homo sapiens
uuaggaagacauccaauua

SEQ ID NO: 1431960 - RNA, 19 nt, Homo sapiens
uaaagacacagcugaguuu

SEQ ID NO: 1431961 - RNA, 19 nt, Homo sapiens
aggaagacauccaauuauu

SEQ ID NO: 1431962 - RNA, 19 nt, Homo sapiens
uuaaagggcacuucuguuu

SEQ ID NO: 1431963 - RNA, 19 nt, Homo sapiens
gaaccaaggauuuacagau

SEQ ID NO: 1431964 - RNA, 19 nt, Homo sapiens
gaggauuacaguaugcuua

SEQ ID NO: 1431965 - RNA, 19 nt, Homo sapiens
uuacauuccuucaacaaga

SEQ ID NO: 1431966 - RNA, 19 nt, Homo sapiens
ugaauuggcugacauccau

SEQ ID NO: 1431967 - RNA, 19 nt, Homo sapiens
agauccaugugaacuauua

SEQ ID NO: 1431968 - RNA, 19 nt, Homo sapiens
gaacuuucacaccaguaua

SEQ ID NO: 1431969 - RNA, 19 nt, Homo sapiens
acaguaugcuuaccucuga

SEQ ID NO: 1431970 - RNA, 19 nt, Homo sapiens
aaagggcacuucuguuugu

SEQ ID NO: 1431971 - RNA, 19 nt, Homo sapiens
caaagauccaugugaacua

SEQ ID NO: 1431972 - RNA, 19 nt, Homo sapiens
aguaaagccugccacauug

SEQ ID NO: 1431973 - RNA, 19 nt, Homo sapiens
ucaacaagauacaaagauc

SEQ ID NO: 1431974 - RNA, 19 nt, Homo sapiens
ucaaggaaauaaagacaca

SEQ ID NO: 1431975 - RNA, 19 nt, Homo sapiens
acugcaauauggaaucuua

SEQ ID NO: 1431976 - RNA, 19 nt, Homo sapiens
aaagauccaugugaacuau

SEQ ID NO: 1431977 - RNA, 19 nt, Homo sapiens
gagaguaagaguaaugguu

SEQ ID NO: 1431978 - RNA, 19 nt, Homo sapiens
guucaagacagaaguugua

SEQ ID NO: 1431979 - RNA, 19 nt, Homo sapiens
acgcacuacucacagauua

SEQ ID NO: 1431980 - RNA, 19 nt, Homo sapiens
gaguaagaguaaugguuga

SEQ ID NO: 1431981 - RNA, 19 nt, Homo sapiens
gauacaaagauccauguga

SEQ ID NO: 1431982 - RNA, 19 nt, Homo sapiens
gcaauauggaaucuuagaa

SEQ ID NO: 1431983 - RNA, 19 nt, Homo sapiens
acaauucuguacuggguuu

SEQ ID NO: 1431984 - RNA, 19 nt, Homo sapiens
ugagguauguggacuugga

SEQ ID NO: 1431985 - RNA, 19 nt, Homo sapiens
auguauggcuuagaaguua

SEQ ID NO: 1431986 - RNA, 19 nt, Homo sapiens
uuauguagcucagacaaga

SEQ ID NO: 1431987 - RNA, 19 nt, Homo sapiens
caucacaccucucuuuuau

SEQ ID NO: 1431988 - RNA, 19 nt, Homo sapiens
gauggaauauuuucacuuc

SEQ ID NO: 1431989 - RNA, 19 nt, Homo sapiens
uggcugacauccaugaaga

SEQ ID NO: 1431990 - RNA, 19 nt, Homo sapiens
aaugguugaucgugaauug

SEQ ID NO: 1431991 - RNA, 19 nt, Homo sapiens
uaaagggcacuucuguuug

SEQ ID NO: 1431992 - RNA, 19 nt, Homo sapiens
agacacagcugaguuuagg

SEQ ID NO: 1431993 - RNA, 19 nt, Homo sapiens
gaucgugaauuggcugaca

SEQ ID NO: 1431994 - RNA, 19 nt, Homo sapiens
ucacagauuacauugcauu

SEQ ID NO: 1431995 - RNA, 19 nt, Homo sapiens
aaccaaggauuuacagauc

SEQ ID NO: 1431996 - RNA, 19 nt, Homo sapiens
guuacgaaccaaggauuua

SEQ ID NO: 1431997 - RNA, 19 nt, Homo sapiens
gcaauauauucugcaaucu

SEQ ID NO: 1431998 - RNA, 19 nt, Homo sapiens
ucuaauuccugcucgucua

SEQ ID NO: 1431999 - RNA, 19 nt, Homo sapiens
guuguaaccuggcacugau

SEQ ID NO: 1432000 - RNA, 19 nt, Homo sapiens
agacuauguucaagacaga

SEQ ID NO: 1432001 - RNA, 19 nt, Homo sapiens
gcaaucuccuugacaaaau

SEQ ID NO: 1432002 - RNA, 19 nt, Homo sapiens
ucacaccucucuuuuaugu

SEQ ID NO: 1432003 - RNA, 19 nt, Homo sapiens
accaauguauggcuuagaa

SEQ ID NO: 1432004 - RNA, 19 nt, Homo sapiens
aaauacuacugcaauaugg

SEQ ID NO: 1432005 - RNA, 19 nt, Homo sapiens
uuacauugcauuuguggaa

SEQ ID NO: 1432006 - RNA, 19 nt, Homo sapiens
uuucuacagugcugcuaua

SEQ ID NO: 1432007 - RNA, 19 nt, Homo sapiens
acagugcugcuauaaguaa

SEQ ID NO: 1432008 - RNA, 19 nt, Homo sapiens
gacuaaccaucaggaauca

SEQ ID NO: 1432009 - RNA, 19 nt, Homo sapiens
uggcaucacaccucucuuu

SEQ ID NO: 1432010 - RNA, 19 nt, Homo sapiens
agcaauauauucugcaauc

SEQ ID NO: 1432011 - RNA, 19 nt, Homo sapiens
gcacuacucacagauuaca

SEQ ID NO: 1432012 - RNA, 19 nt, Homo sapiens
uaggaagacauccaauuau

SEQ ID NO: 1432013 - RNA, 19 nt, Homo sapiens
aaagacacagcugaguuua

SEQ ID NO: 1432014 - RNA, 19 nt, Homo sapiens
aguaaugguugaucgugaa

SEQ ID NO: 1432015 - RNA, 19 nt, Homo sapiens
acucacagauuacauugca

SEQ ID NO: 1432016 - RNA, 19 nt, Homo sapiens
agacuaaccaucaggaauc

SEQ ID NO: 1432017 - RNA, 19 nt, Homo sapiens
gaacuauuacaucuuugca

SEQ ID NO: 1432018 - RNA, 19 nt, Homo sapiens
gauuacauuccuucaacaa

SEQ ID NO: 1432019 - RNA, 19 nt, Homo sapiens
uguccaagcccauuaagug

SEQ ID NO: 1432020 - RNA, 19 nt, Homo sapiens
aacaaugcuuaccaaugua

SEQ ID NO: 1432021 - RNA, 19 nt, Homo sapiens
auacgucaguguccuaagu

SEQ ID NO: 1432022 - RNA, 19 nt, Homo sapiens
gcagacuaaccaucaggaa

SEQ ID NO: 1432023 - RNA, 19 nt, Homo sapiens
agagugcuuucugucauuu

SEQ ID NO: 1432024 - RNA, 19 nt, Homo sapiens
cauguuugguacuauguuc

SEQ ID NO: 1432025 - RNA, 19 nt, Homo sapiens
gcaucacaccucucuuuua

SEQ ID NO: 1432026 - RNA, 19 nt, Homo sapiens
ucugcaaucuccuugacaa

SEQ ID NO: 1432027 - RNA, 19 nt, Homo sapiens
gacaaaagacuauguucaa

SEQ ID NO: 1432028 - RNA, 19 nt, Homo sapiens
uauguggacuuggaugguu

SEQ ID NO: 1432029 - RNA, 19 nt, Homo sapiens
uguccaagaagcaauauau

SEQ ID NO: 1432030 - RNA, 19 nt, Homo sapiens
cccauuaaguggcaucaca

SEQ ID NO: 1432031 - RNA, 19 nt, Homo sapiens
acagcugaguuuaggaaga

SEQ ID NO: 1432032 - RNA, 19 nt, Homo sapiens
gaagacaaaagacuauguu

SEQ ID NO: 1432033 - RNA, 19 nt, Homo sapiens
aagguaauccugacuuugu

SEQ ID NO: 1432034 - RNA, 19 nt, Homo sapiens
uguauggcuuagaaguuaa

SEQ ID NO: 1432035 - RNA, 19 nt, Homo sapiens
uuaacaaugcuuaccaaug

SEQ ID NO: 1432036 - RNA, 19 nt, Homo sapiens
ccuuaacaaugcuuaccaa

SEQ ID NO: 1432037 - RNA, 19 nt, Homo sapiens
guaaagccugccacauugu

SEQ ID NO: 1432038 - RNA, 19 nt, Homo sapiens
gcuuaccucugauuuuauu

SEQ ID NO: 1432039 - RNA, 19 nt, Homo sapiens
ccaugaagaugccaaaaca

SEQ ID NO: 1432040 - RNA, 19 nt, Homo sapiens
gaaaagguaauccugacuu

SEQ ID NO: 1432041 - RNA, 19 nt, Homo sapiens
acacagcugaguuuaggaa

SEQ ID NO: 1432042 - RNA, 19 nt, Homo sapiens
auaaagacacagcugaguu

SEQ ID NO: 1432043 - RNA, 19 nt, Homo sapiens
gaagaugccaaaacauguu

SEQ ID NO: 1432044 - RNA, 19 nt, Homo sapiens
ggauaccguuuugaaguaa

SEQ ID NO: 1432045 - RNA, 19 nt, Homo sapiens
gaacuuggauguugucuug

SEQ ID NO: 1432046 - RNA, 19 nt, Homo sapiens
ggaaagaggagaagaauaa

SEQ ID NO: 1432047 - RNA, 19 nt, Homo sapiens
gaaauaguguucuggacuu

SEQ ID NO: 1432048 - RNA, 19 nt, Homo sapiens
guaaauacagggaucaaua

SEQ ID NO: 1432049 - RNA, 19 nt, Homo sapiens
ucaaagcgcuggaucauca

SEQ ID NO: 1432050 - RNA, 19 nt, Homo sapiens
gaaaucagauaaagagucu

SEQ ID NO: 1432051 - RNA, 19 nt, Homo sapiens
gauaaagagucuaccaaau

SEQ ID NO: 1432052 - RNA, 19 nt, Homo sapiens
gauuguaaauucaggagua

SEQ ID NO: 1432053 - RNA, 19 nt, Homo sapiens
guucuggacuugauuguaa

SEQ ID NO: 1432054 - RNA, 19 nt, Homo sapiens
gaacuggcaucuuccugaa

SEQ ID NO: 1432055 - RNA, 19 nt, Homo sapiens
cagaagagcuaaccaguca

SEQ ID NO: 1432056 - RNA, 19 nt, Homo sapiens
uauagaaccuuuacugaga

SEQ ID NO: 1432057 - RNA, 19 nt, Homo sapiens
ugucgcaucuuuagaauuu

SEQ ID NO: 1432058 - RNA, 19 nt, Homo sapiens
ggaaauacuccucuacuau

SEQ ID NO: 1432059 - RNA, 19 nt, Homo sapiens
ggacuugauuguaaauuca

SEQ ID NO: 1432060 - RNA, 19 nt, Homo sapiens
uuuaggaacuuacccaaua

SEQ ID NO: 1432061 - RNA, 19 nt, Homo sapiens
caauggguuugcaaaguua

SEQ ID NO: 1432062 - RNA, 19 nt, Homo sapiens
caacaagucugcagucaac

SEQ ID NO: 1432063 - RNA, 19 nt, Homo sapiens
gaguaugcaucuucucaaa

SEQ ID NO: 1432064 - RNA, 19 nt, Homo sapiens
gaagaauggagucacuaua

SEQ ID NO: 1432065 - RNA, 19 nt, Homo sapiens
uaauugaucucagcaggua

SEQ ID NO: 1432066 - RNA, 19 nt, Homo sapiens
uaaagagucuaccaaauac

SEQ ID NO: 1432067 - RNA, 19 nt, Homo sapiens
gugcagagauuugagugua

SEQ ID NO: 1432068 - RNA, 19 nt, Homo sapiens
gcauguaaccaucgacuuu

SEQ ID NO: 1432069 - RNA, 19 nt, Homo sapiens
aaacuacucuaucuucaug

SEQ ID NO: 1432070 - RNA, 19 nt, Homo sapiens
gcuaaccagucaugaagaa

SEQ ID NO: 1432071 - RNA, 19 nt, Homo sapiens
gaaauugugguggguuaua

SEQ ID NO: 1432072 - RNA, 19 nt, Homo sapiens
ggcaggauauuaaagaaga

SEQ ID NO: 1432073 - RNA, 19 nt, Homo sapiens
ccaaugaagauaaaggaua

SEQ ID NO: 1432074 - RNA, 19 nt, Homo sapiens
gaauaaguguggaaauacu

SEQ ID NO: 1432075 - RNA, 19 nt, Homo sapiens
gauguugucuuguuucucu

SEQ ID NO: 1432076 - RNA, 19 nt, Homo sapiens
gacagacagugcagagauu

SEQ ID NO: 1432077 - RNA, 19 nt, Homo sapiens
guaugcaucuucucaaaca

SEQ ID NO: 1432078 - RNA, 19 nt, Homo sapiens
guacuugccucacuuuaac

SEQ ID NO: 1432079 - RNA, 19 nt, Homo sapiens
gaaccuuuacugagaauau

SEQ ID NO: 1432080 - RNA, 19 nt, Homo sapiens
gaaagcaguguaaccaaug

SEQ ID NO: 1432081 - RNA, 19 nt, Homo sapiens
gaggcaggauauuaaagaa

SEQ ID NO: 1432082 - RNA, 19 nt, Homo sapiens
agaaauggcagcacuuaaa

SEQ ID NO: 1432083 - RNA, 19 nt, Homo sapiens
acaauggguuugcaaaguu

SEQ ID NO: 1432084 - RNA, 19 nt, Homo sapiens
uggaaauacuccucuacua

SEQ ID NO: 1432085 - RNA, 19 nt, Homo sapiens
gaauggagucacuauaaug

SEQ ID NO: 1432086 - RNA, 19 nt, Homo sapiens
gacaauggguuugcaaagu

SEQ ID NO: 1432087 - RNA, 19 nt, Homo sapiens
gaggugggauuucaacaag

SEQ ID NO: 1432088 - RNA, 19 nt, Homo sapiens
ccacuugucuccaauucau

SEQ ID NO: 1432089 - RNA, 19 nt, Homo sapiens
aagaauggagucacuauaa

SEQ ID NO: 1432090 - RNA, 19 nt, Homo sapiens
gacccgauguuucauggaa

SEQ ID NO: 1432091 - RNA, 19 nt, Homo sapiens
gaaauggcagcacuuaaag

SEQ ID NO: 1432092 - RNA, 19 nt, Homo sapiens
gaagagcuaaccagucaug

SEQ ID NO: 1432093 - RNA, 19 nt, Homo sapiens
ggauauagacauguucuug

SEQ ID NO: 1432094 - RNA, 19 nt, Homo sapiens
gauauucauccacuucaaa

SEQ ID NO: 1432095 - RNA, 19 nt, Homo sapiens
gguacuugccucacuuuaa

SEQ ID NO: 1432096 - RNA, 19 nt, Homo sapiens
gcaggauauuaaagaagaa

SEQ ID NO: 1432097 - RNA, 19 nt, Homo sapiens
uauguuugauuguccagua

SEQ ID NO: 1432098 - RNA, 19 nt, Homo sapiens
caaacuugaucuccaugga

SEQ ID NO: 1432099 - RNA, 19 nt, Homo sapiens
uggagucacuauaaugaaa

SEQ ID NO: 1432100 - RNA, 19 nt, Homo sapiens
agaaagcaguguaaccaau

SEQ ID NO: 1432101 - RNA, 19 nt, Homo sapiens
agaauggagucacuauaau

SEQ ID NO: 1432102 - RNA, 19 nt, Homo sapiens
uggcagcacuuaaagacuu

SEQ ID NO: 1432103 - RNA, 19 nt, Homo sapiens
auucagaacuggcaucuuc

SEQ ID NO: 1432104 - RNA, 19 nt, Homo sapiens
cgauuugucugacuguguu

SEQ ID NO: 1432105 - RNA, 19 nt, Homo sapiens
ucaauagcuugcaguuguu

SEQ ID NO: 1432106 - RNA, 19 nt, Homo sapiens
auacagggaucaauaaagg

SEQ ID NO: 1432107 - RNA, 19 nt, Homo sapiens
ggacagaaaagaacuuauu

SEQ ID NO: 1432108 - RNA, 19 nt, Homo sapiens
gaagaauaaguguggaaau

SEQ ID NO: 1432109 - RNA, 19 nt, Homo sapiens
ugaagcauagugagguuua

SEQ ID NO: 1432110 - RNA, 19 nt, Homo sapiens
gaaagauucaaagcaugua

SEQ ID NO: 1432111 - RNA, 19 nt, Homo sapiens
uucaauagcuugcaguugu

SEQ ID NO: 1432112 - RNA, 19 nt, Homo sapiens
caaagcauguaaccaucga

SEQ ID NO: 1432113 - RNA, 19 nt, Homo sapiens
ucauugcccucacuauguu

SEQ ID NO: 1432114 - RNA, 19 nt, Homo sapiens
gagcuaaccagucaugaag

SEQ ID NO: 1432115 - RNA, 19 nt, Homo sapiens
gaggauaaaugaguuuuga

SEQ ID NO: 1432116 - RNA, 19 nt, Homo sapiens
gaucucagcagguaagagu

SEQ ID NO: 1432117 - RNA, 19 nt, Homo sapiens
aaagcaguguaaccaauga

SEQ ID NO: 1432118 - RNA, 19 nt, Homo sapiens
caauaaaggcugaaaacua

SEQ ID NO: 1432119 - RNA, 19 nt, Homo sapiens
gauauagacauguucuugu

SEQ ID NO: 1432120 - RNA, 19 nt, Homo sapiens
cuaguucucucagguaaau

SEQ ID NO: 1432121 - RNA, 19 nt, Homo sapiens
aaacugaggauaaaugagu

SEQ ID NO: 1432122 - RNA, 19 nt, Homo sapiens
cuggagaacuuggauguug

SEQ ID NO: 1432123 - RNA, 19 nt, Homo sapiens
gccuaguucucucagguaa

SEQ ID NO: 1432124 - RNA, 19 nt, Homo sapiens
acagaaauggcagcacuua

SEQ ID NO: 1432125 - RNA, 19 nt, Homo sapiens
gagaagaauaaguguggaa

SEQ ID NO: 1432126 - RNA, 19 nt, Homo sapiens
ggugggauuucaacaaguc

SEQ ID NO: 1432127 - RNA, 19 nt, Homo sapiens
uuaggaacuuacccaauau

SEQ ID NO: 1432128 - RNA, 19 nt, Homo sapiens
ggaauggauugaagaaccu

SEQ ID NO: 1432129 - RNA, 19 nt, Homo sapiens
accaugaucuggagaacuu

SEQ ID NO: 1432130 - RNA, 19 nt, Homo sapiens
gcaguuguuggacaugaaa

SEQ ID NO: 1432131 - RNA, 19 nt, Homo sapiens
ggccuucauuuaaagucua

SEQ ID NO: 1432132 - RNA, 19 nt, Homo sapiens
aaacauaagagaaggucaa

SEQ ID NO: 1432133 - RNA, 19 nt, Homo sapiens
gagaauauuuuggacagaa

SEQ ID NO: 1432134 - RNA, 19 nt, Homo sapiens
gcaguguaaccaaugaaga

SEQ ID NO: 1432135 - RNA, 19 nt, Homo sapiens
guagaaagcaguguaacca

SEQ ID NO: 1432136 - RNA, 19 nt, Homo sapiens
aauauuggacagcaaauga

SEQ ID NO: 1432137 - RNA, 19 nt, Homo sapiens
uaaccagucaugaagaaug

SEQ ID NO: 1432138 - RNA, 19 nt, Homo sapiens
ccauggaaaucagauaaag

SEQ ID NO: 1432139 - RNA, 19 nt, Homo sapiens
ugaggcaggauauuaaaga

SEQ ID NO: 1432140 - RNA, 19 nt, Homo sapiens
cuggauaacugggacagaa

SEQ ID NO: 1432141 - RNA, 19 nt, Homo sapiens
gcagagauuugaguguacu

SEQ ID NO: 1432142 - RNA, 19 nt, Homo sapiens
caagucugcagucaacauu

SEQ ID NO: 1432143 - RNA, 19 nt, Homo sapiens
gucaugaggugggauuuca

SEQ ID NO: 1432144 - RNA, 19 nt, Homo sapiens
gcauagugagguuuaggaa

SEQ ID NO: 1432145 - RNA, 19 nt, Homo sapiens
cagcaaagguggugauaaa

SEQ ID NO: 1432146 - RNA, 19 nt, Homo sapiens
gcucaagucugaagcugua

SEQ ID NO: 1432147 - RNA, 19 nt, Homo sapiens
ggacaaacauggccauuuu

SEQ ID NO: 1432148 - RNA, 19 nt, Homo sapiens
caaggccucugauuucuuu

SEQ ID NO: 1432149 - RNA, 19 nt, Homo sapiens
gaaugucccugaccgaaau

SEQ ID NO: 1432150 - RNA, 19 nt, Homo sapiens
ccaaggcucuuuacugaug

SEQ ID NO: 1432151 - RNA, 19 nt, Homo sapiens
auaaagugcuccugcauuu

SEQ ID NO: 1432152 - RNA, 19 nt, Homo sapiens
aaauaaaccugucucuguu

SEQ ID NO: 1432153 - RNA, 19 nt, Homo sapiens
uaaaugcccuuagucugua

SEQ ID NO: 1432154 - RNA, 19 nt, Homo sapiens
gaccacugcuaccuguuua

SEQ ID NO: 1432155 - RNA, 19 nt, Homo sapiens
caaagguggugauaaagug

SEQ ID NO: 1432156 - RNA, 19 nt, Homo sapiens
ccauugcaguggccauuua

SEQ ID NO: 1432157 - RNA, 19 nt, Homo sapiens
caagcaaggccucugauuu

SEQ ID NO: 1432158 - RNA, 19 nt, Homo sapiens
ccuaauggcucaugucagu

SEQ ID NO: 1432159 - RNA, 19 nt, Homo sapiens
gaugucagaaucauuguuu

SEQ ID NO: 1432160 - RNA, 19 nt, Homo sapiens
gauaaagugcuccugcauu

SEQ ID NO: 1432161 - RNA, 19 nt, Homo sapiens
gcaggagcauugccaucuu

SEQ ID NO: 1432162 - RNA, 19 nt, Homo sapiens
gcagagaugggcuugauuc

SEQ ID NO: 1432163 - RNA, 19 nt, Homo sapiens
gcaaagguggugauaaagu

SEQ ID NO: 1432164 - RNA, 19 nt, Homo sapiens
aguaugagcagaaacauuu

SEQ ID NO: 1432165 - RNA, 19 nt, Homo sapiens
gggcagagaugggcuugau

SEQ ID NO: 1432166 - RNA, 19 nt, Homo sapiens
gcauugccaucuuggacaa

SEQ ID NO: 1432167 - RNA, 19 nt, Homo sapiens
uuuaaguucuccgugauua

SEQ ID NO: 1432168 - RNA, 19 nt, Homo sapiens
aaacucuccuucacacaga

SEQ ID NO: 1432169 - RNA, 19 nt, Homo sapiens
aaaccugucucuguuggaa

SEQ ID NO: 1432170 - RNA, 19 nt, Homo sapiens
uaaguucuccgugauuaaa

SEQ ID NO: 1432171 - RNA, 19 nt, Homo sapiens
acaaggagcuaggcuucaa

SEQ ID NO: 1432172 - RNA, 19 nt, Homo sapiens
gcaggacacaguugauugu

SEQ ID NO: 1432173 - RNA, 19 nt, Homo sapiens
agucacaggugucaucuuc

SEQ ID NO: 1432174 - RNA, 19 nt, Homo sapiens
uuaaaugcccuuagucugu

SEQ ID NO: 1432175 - RNA, 19 nt, Homo sapiens
caggagcauugccaucuug

SEQ ID NO: 1432176 - RNA, 19 nt, Homo sapiens
aagcaaggccucugauuuc

SEQ ID NO: 1432177 - RNA, 19 nt, Homo sapiens
gcagcaacgagccauuaaa

SEQ ID NO: 1432178 - RNA, 19 nt, Homo sapiens
ucaguuacaccaagcuaaa

SEQ ID NO: 1432179 - RNA, 19 nt, Homo sapiens
gaagacaaugcaccuugga

SEQ ID NO: 1432180 - RNA, 19 nt, Homo sapiens
aaacaugccaauccugaga

SEQ ID NO: 1432181 - RNA, 19 nt, Homo sapiens
guagauacuggaagacaau

SEQ ID NO: 1432182 - RNA, 19 nt, Homo sapiens
gcgcgugcauccugaagca

SEQ ID NO: 1432183 - RNA, 19 nt, Homo sapiens
ggaagcccgugcgugaugu

SEQ ID NO: 1432184 - RNA, 19 nt, Homo sapiens
gcaaggccucugauuucuu

SEQ ID NO: 1432185 - RNA, 19 nt, Homo sapiens
gcucuccgcaucugaaugu

SEQ ID NO: 1432186 - RNA, 19 nt, Homo sapiens
gguggacccuggagacucu

SEQ ID NO: 1432187 - RNA, 19 nt, Homo sapiens
cuggagaccuugggccuuu

SEQ ID NO: 1432188 - RNA, 19 nt, Homo sapiens
ccagaaacaugccaauccu

SEQ ID NO: 1432189 - RNA, 19 nt, Homo sapiens
gggcaggacacaguugauu

SEQ ID NO: 1432190 - RNA, 19 nt, Homo sapiens
ggccucugauuucuuugaa

SEQ ID NO: 1432191 - RNA, 19 nt, Homo sapiens
augccaauccugagaauaa

SEQ ID NO: 1432192 - RNA, 19 nt, Homo sapiens
acauuucaaccaugagaua

SEQ ID NO: 1432193 - RNA, 19 nt, Homo sapiens
uaauggcucaugucaguau

SEQ ID NO: 1432194 - RNA, 19 nt, Homo sapiens
ccccaaggcucuuuacuga

SEQ ID NO: 1432195 - RNA, 19 nt, Homo sapiens
gcaggguggcugugaguca

SEQ ID NO: 1432196 - RNA, 19 nt, Homo sapiens
cggcagcaacgagccauua

SEQ ID NO: 1432197 - RNA, 19 nt, Homo sapiens
gcaauaaaacucuccuuca

SEQ ID NO: 1432198 - RNA, 19 nt, Homo sapiens
aaacauuucaaccaugaga

SEQ ID NO: 1432199 - RNA, 19 nt, Homo sapiens
uguagauacuggaagacaa

SEQ ID NO: 1432200 - RNA, 19 nt, Homo sapiens
acaccaagcuaaaauuuca

SEQ ID NO: 1432201 - RNA, 19 nt, Homo sapiens
ccgggagggucuuagucua

SEQ ID NO: 1432202 - RNA, 19 nt, Homo sapiens
aaaauaaaccugucucugu

SEQ ID NO: 1432203 - RNA, 19 nt, Homo sapiens
gauauuccaacucugcaau

SEQ ID NO: 1432204 - RNA, 19 nt, Homo sapiens
guuugcaccugcuggguau

SEQ ID NO: 1432205 - RNA, 19 nt, Homo sapiens
ugccgaaccucuccugauc

SEQ ID NO: 1432206 - RNA, 19 nt, Homo sapiens
ggcaggacacaguugauug

SEQ ID NO: 1432207 - RNA, 19 nt, Homo sapiens
gaagcuguagauacuggaa

SEQ ID NO: 1432208 - RNA, 19 nt, Homo sapiens
agacaagcaaggccucuga

SEQ ID NO: 1432209 - RNA, 19 nt, Homo sapiens
ucucagguuuauucccaaa

SEQ ID NO: 1432210 - RNA, 19 nt, Homo sapiens
ugugacagcaggagcauug

SEQ ID NO: 1432211 - RNA, 19 nt, Homo sapiens
ggcagcaacgagccauuaa

SEQ ID NO: 1432212 - RNA, 19 nt, Homo sapiens
gcacuggacacugcucauc

SEQ ID NO: 1432213 - RNA, 19 nt, Homo sapiens
gucugaagcuguagauacu

SEQ ID NO: 1432214 - RNA, 19 nt, Homo sapiens
agaccacugcuaccuguuu

SEQ ID NO: 1432215 - RNA, 19 nt, Homo sapiens
cuaggagaccugacuggaa

SEQ ID NO: 1432216 - RNA, 19 nt, Homo sapiens
cacaguugauugucucuac

SEQ ID NO: 1432217 - RNA, 19 nt, Homo sapiens
caaaacaucagccuaaugg

SEQ ID NO: 1432218 - RNA, 19 nt, Homo sapiens
aaacauggccauuuuaagu

SEQ ID NO: 1432219 - RNA, 19 nt, Homo sapiens
caaggcucuuuacugaugu

SEQ ID NO: 1432220 - RNA, 19 nt, Homo sapiens
agaaugucccugaccgaaa

SEQ ID NO: 1432221 - RNA, 19 nt, Homo sapiens
aaaugcccuuagucuguaa

SEQ ID NO: 1432222 - RNA, 19 nt, Homo sapiens
ucacaggugucaucuuccu

SEQ ID NO: 1432223 - RNA, 19 nt, Homo sapiens
gcccaaaacaucagccuaa

SEQ ID NO: 1432224 - RNA, 19 nt, Homo sapiens
gacaaacauggccauuuua

SEQ ID NO: 1432225 - RNA, 19 nt, Homo sapiens
cagcaacgagccauuaaaa

SEQ ID NO: 1432226 - RNA, 19 nt, Homo sapiens
acaagcaaggccucugauu

SEQ ID NO: 1432227 - RNA, 19 nt, Homo sapiens
gcaacgagccauuaaaacu

SEQ ID NO: 1432228 - RNA, 19 nt, Homo sapiens
uuccaacucugcaauaaaa

SEQ ID NO: 1432229 - RNA, 19 nt, Homo sapiens
caauaaaacucuccuucac

SEQ ID NO: 1432230 - RNA, 19 nt, Homo sapiens
gauacuggaagacaaugca

SEQ ID NO: 1432231 - RNA, 19 nt, Homo sapiens
ccucuggcuuucaguuaca

SEQ ID NO: 1432232 - RNA, 19 nt, Homo sapiens
gaacaagucuaucugauuc

SEQ ID NO: 1432233 - RNA, 19 nt, Homo sapiens
caaauacacucuggaaaua

SEQ ID NO: 1432234 - RNA, 19 nt, Homo sapiens
guacaaagaugaugaagug

SEQ ID NO: 1432235 - RNA, 19 nt, Homo sapiens
gcaaacaacuccaggacaa

SEQ ID NO: 1432236 - RNA, 19 nt, Homo sapiens
gaaacccggucucuacuaa

SEQ ID NO: 1432237 - RNA, 19 nt, Homo sapiens
ggagaguggugaucggaua

SEQ ID NO: 1432238 - RNA, 19 nt, Homo sapiens
uaacaguacuggcaucuga

SEQ ID NO: 1432239 - RNA, 19 nt, Homo sapiens
gaugagaucuggcuucaca

SEQ ID NO: 1432240 - RNA, 19 nt, Homo sapiens
gagaugacauuuaacugaa

SEQ ID NO: 1432241 - RNA, 19 nt, Homo sapiens
guacugagcugggcauuuc

SEQ ID NO: 1432242 - RNA, 19 nt, Homo sapiens
gcaaauacacucuggaaau

SEQ ID NO: 1432243 - RNA, 19 nt, Homo sapiens
gagccaagauugagccaaa

SEQ ID NO: 1432244 - RNA, 19 nt, Homo sapiens
uaaagcagguccaaggaaa

SEQ ID NO: 1432245 - RNA, 19 nt, Homo sapiens
gaacgggacuucucugcau

SEQ ID NO: 1432246 - RNA, 19 nt, Homo sapiens
uggaggagaugacauuuaa

SEQ ID NO: 1432247 - RNA, 19 nt, Homo sapiens
ggaaaacccuggaaauuau

SEQ ID NO: 1432248 - RNA, 19 nt, Homo sapiens
ggagaugacauuuaacuga

SEQ ID NO: 1432249 - RNA, 19 nt, Homo sapiens
gaagaaucgugccaaagug

SEQ ID NO: 1432250 - RNA, 19 nt, Homo sapiens
ccaaggagcugaagagcau

SEQ ID NO: 1432251 - RNA, 19 nt, Homo sapiens
gaacguacaaagaugauga

SEQ ID NO: 1432252 - RNA, 19 nt, Homo sapiens
aaacagaccugggcgcaaa

SEQ ID NO: 1432253 - RNA, 19 nt, Homo sapiens
ucagcaaggucaaguacua

SEQ ID NO: 1432254 - RNA, 19 nt, Homo sapiens
cagcaucccucauccuuga

SEQ ID NO: 1432255 - RNA, 19 nt, Homo sapiens
ggacagaggucaccaucac

SEQ ID NO: 1432256 - RNA, 19 nt, Homo sapiens
gauaggacccugugcuuga

SEQ ID NO: 1432257 - RNA, 19 nt, Homo sapiens
aaacucagagcaucuauuu

SEQ ID NO: 1432258 - RNA, 19 nt, Homo sapiens
gcaccaaaguggagaagca

SEQ ID NO: 1432259 - RNA, 19 nt, Homo sapiens
gaagcauauucauucagua

SEQ ID NO: 1432260 - RNA, 19 nt, Homo sapiens
acacaaaggcagcugauaa

SEQ ID NO: 1432261 - RNA, 19 nt, Homo sapiens
ggacaaggcaggacaugau

SEQ ID NO: 1432262 - RNA, 19 nt, Homo sapiens
cgagaagaaucgugccaaa

SEQ ID NO: 1432263 - RNA, 19 nt, Homo sapiens
gcaccacccuggaugagau

SEQ ID NO: 1432264 - RNA, 19 nt, Homo sapiens
caacguggaguacaugaaa

SEQ ID NO: 1432265 - RNA, 19 nt, Homo sapiens
ggauggagcugggaacaca

SEQ ID NO: 1432266 - RNA, 19 nt, Homo sapiens
gaugccagauggucaguau

SEQ ID NO: 1432267 - RNA, 19 nt, Homo sapiens
gaaggagacucgcuuucag

SEQ ID NO: 1432268 - RNA, 19 nt, Homo sapiens
ggacaagggaauuuacaga

SEQ ID NO: 1432269 - RNA, 19 nt, Homo sapiens
ggaggacgacaccauauug

SEQ ID NO: 1432270 - RNA, 19 nt, Homo sapiens
ggcaggacaugauaaagau

SEQ ID NO: 1432271 - RNA, 19 nt, Homo sapiens
caggacaugauaaagauua

SEQ ID NO: 1432272 - RNA, 19 nt, Homo sapiens
ugagaggucugccggaugu

SEQ ID NO: 1432273 - RNA, 19 nt, Homo sapiens
ugaagcacauggacauuuc

SEQ ID NO: 1432274 - RNA, 19 nt, Homo sapiens
gcccugccauaaacugaua

SEQ ID NO: 1432275 - RNA, 19 nt, Homo sapiens
ccaccugguuccacaaaga

SEQ ID NO: 1432276 - RNA, 19 nt, Homo sapiens
ccagaagcauauucauuca

SEQ ID NO: 1432277 - RNA, 19 nt, Homo sapiens
gcacucuucagccuguuua

SEQ ID NO: 1432278 - RNA, 19 nt, Homo sapiens
gacaaggcaggacaugaua

SEQ ID NO: 1432279 - RNA, 19 nt, Homo sapiens
ucaccuuccuugaccgaua

SEQ ID NO: 1432280 - RNA, 19 nt, Homo sapiens
gccaugagcccugccauaa

SEQ ID NO: 1432281 - RNA, 19 nt, Homo sapiens
ggaaaaccauuagcaagaa

SEQ ID NO: 1432282 - RNA, 19 nt, Homo sapiens
gauagaacccaggauguga

SEQ ID NO: 1432283 - RNA, 19 nt, Homo sapiens
ugaaaucucuuggcugaag

SEQ ID NO: 1432284 - RNA, 19 nt, Homo sapiens
gcauauucauucaguaaac

SEQ ID NO: 1432285 - RNA, 19 nt, Homo sapiens
caaggcaggacaugauaaa

SEQ ID NO: 1432286 - RNA, 19 nt, Homo sapiens
cauguaaguucaacagaca

SEQ ID NO: 1432287 - RNA, 19 nt, Homo sapiens
ggcaggacauugaugaauc

SEQ ID NO: 1432288 - RNA, 19 nt, Homo sapiens
guucaaggcaggaccauug

SEQ ID NO: 1432289 - RNA, 19 nt, Homo sapiens
ugaacaagucuaucugauu

SEQ ID NO: 1432290 - RNA, 19 nt, Homo sapiens
cggcagcucucaacagauc

SEQ ID NO: 1432291 - RNA, 19 nt, Homo sapiens
gaacacaaaggcagcugau

SEQ ID NO: 1432292 - RNA, 19 nt, Homo sapiens
caccugaagucuagcaugu

SEQ ID NO: 1432293 - RNA, 19 nt, Homo sapiens
caugagcccugccauaaac

SEQ ID NO: 1432294 - RNA, 19 nt, Homo sapiens
gggcaaauacacucuggaa

SEQ ID NO: 1432295 - RNA, 19 nt, Homo sapiens
caagaaggagacucgcuuu

SEQ ID NO: 1432296 - RNA, 19 nt, Homo sapiens
gcaggacauugaugaaucg

SEQ ID NO: 1432297 - RNA, 19 nt, Homo sapiens
agaagcauauucauucagu

SEQ ID NO: 1432298 - RNA, 19 nt, Homo sapiens
gaaaacagcaucccucauc

SEQ ID NO: 1432299 - RNA, 19 nt, Homo sapiens
ggauguggccacuaucaug

SEQ ID NO: 1432300 - RNA, 19 nt, Homo sapiens
cggcuggccucacuugaug

SEQ ID NO: 1432301 - RNA, 19 nt, Homo sapiens
gaggucaccaucaccauug

SEQ ID NO: 1432302 - RNA, 19 nt, Homo sapiens
gcugaacaccagagacuga

SEQ ID NO: 1432303 - RNA, 19 nt, Homo sapiens
ggucagguacgcugcuaaa

SEQ ID NO: 1432304 - RNA, 19 nt, Homo sapiens
gaugguuucugacgaucga

SEQ ID NO: 1432305 - RNA, 19 nt, Homo sapiens
cugcagcucccaccacaua

SEQ ID NO: 1432306 - RNA, 19 nt, Homo sapiens
gagaguggugaucggauaa

SEQ ID NO: 1432307 - RNA, 19 nt, Homo sapiens
acauuuaacugaagcacau

SEQ ID NO: 1432308 - RNA, 19 nt, Homo sapiens
ccuggaaauuauagagaaa

SEQ ID NO: 1432309 - RNA, 19 nt, Homo sapiens
gacgaaacccggucucuac

SEQ ID NO: 1432310 - RNA, 19 nt, Homo sapiens
caaaggcagcugauaagca

SEQ ID NO: 1432311 - RNA, 19 nt, Homo sapiens
ucuucagccuguuuagaua

SEQ ID NO: 1432312 - RNA, 19 nt, Homo sapiens
gggaggacgacaccauauu

SEQ ID NO: 1432313 - RNA, 19 nt, Homo sapiens
gaaaacccuggaaauuaua

SEQ ID NO: 1432314 - RNA, 19 nt, Homo sapiens
gaucccauaguuucaauuc

SEQ ID NO: 1432315 - RNA, 19 nt, Homo sapiens
gaggucagguacgcugcua

SEQ ID NO: 1432316 - RNA, 19 nt, Homo sapiens
guacuggcaucugauaggu

SEQ ID NO: 1432317 - RNA, 19 nt, Homo sapiens
gagcggaugcaccaaagug

SEQ ID NO: 1432318 - RNA, 19 nt, Homo sapiens
aagucuaucugauuccaaa

SEQ ID NO: 1432319 - RNA, 19 nt, Homo sapiens
agaagaaucgugccaaagu

SEQ ID NO: 1432320 - RNA, 19 nt, Homo sapiens
gaggagaugacauuuaacu

SEQ ID NO: 1432321 - RNA, 19 nt, Homo sapiens
gcucucaacagaucucuca

SEQ ID NO: 1432322 - RNA, 19 nt, Homo sapiens
caaggcaggaccauuggaa

SEQ ID NO: 1432323 - RNA, 19 nt, Homo sapiens
cgaaacccggucucuacua

SEQ ID NO: 1432324 - RNA, 19 nt, Homo sapiens
ccuguaaucccaguaguuu

SEQ ID NO: 1432325 - RNA, 19 nt, Homo sapiens
ggccaugagcccugccaua

SEQ ID NO: 1432326 - RNA, 19 nt, Homo sapiens
gcaaggucaaguacuacaa

SEQ ID NO: 1432327 - RNA, 19 nt, Homo sapiens
cccagaagcauauucauuc

SEQ ID NO: 1432328 - RNA, 19 nt, Homo sapiens
uggaaaacccuggaaauua

SEQ ID NO: 1432329 - RNA, 19 nt, Homo sapiens
gauaccggcuggccucacu

SEQ ID NO: 1432330 - RNA, 19 nt, Homo sapiens
ggugggagaauccguugaa

SEQ ID NO: 1432331 - RNA, 19 nt, Homo sapiens
ccaugagcccugccauaaa

SEQ ID NO: 1432332 - RNA, 19 nt, Homo sapiens
uagaaggcgucaugaauua

SEQ ID NO: 1432333 - RNA, 19 nt, Homo sapiens
cagcuacccugaacaguaa

SEQ ID NO: 1432334 - RNA, 19 nt, Homo sapiens
caucaguucuugagcuaua

SEQ ID NO: 1432335 - RNA, 19 nt, Homo sapiens
ccaacaaccuggugcacua

SEQ ID NO: 1432336 - RNA, 19 nt, Homo sapiens
gcuagucacuggaauggaa

SEQ ID NO: 1432337 - RNA, 19 nt, Homo sapiens
gaccaggaaugaagguuga

SEQ ID NO: 1432338 - RNA, 19 nt, Homo sapiens
gcuaacaugugaaacuaau

SEQ ID NO: 1432339 - RNA, 19 nt, Homo sapiens
gguguuggcuguguuggua

SEQ ID NO: 1432340 - RNA, 19 nt, Homo sapiens
gcagugagccgagaucaug

SEQ ID NO: 1432341 - RNA, 19 nt, Homo sapiens
gcacuacucguccuucgaa

SEQ ID NO: 1432342 - RNA, 19 nt, Homo sapiens
aauagcaccuccucccuuu

SEQ ID NO: 1432343 - RNA, 19 nt, Homo sapiens
gaauuacuuucucuucucu

SEQ ID NO: 1432344 - RNA, 19 nt, Homo sapiens
ucagcaaacucccuuucaa

SEQ ID NO: 1432345 - RNA, 19 nt, Homo sapiens
uguggaaugugagauauaa

SEQ ID NO: 1432346 - RNA, 19 nt, Homo sapiens
gugcaggugugguucaaga

SEQ ID NO: 1432347 - RNA, 19 nt, Homo sapiens
cuagaaggcgucaugaauu

SEQ ID NO: 1432348 - RNA, 19 nt, Homo sapiens
gcagucagccagugaguca

SEQ ID NO: 1432349 - RNA, 19 nt, Homo sapiens
gagcuucaccugagucugu

SEQ ID NO: 1432350 - RNA, 19 nt, Homo sapiens
auacccagcuggacacuga

SEQ ID NO: 1432351 - RNA, 19 nt, Homo sapiens
cagcaaacucccuuucaaa

SEQ ID NO: 1432352 - RNA, 19 nt, Homo sapiens
gcauauagcagcacauagg

SEQ ID NO: 1432353 - RNA, 19 nt, Homo sapiens
gugagaggcuggccaugug

SEQ ID NO: 1432354 - RNA, 19 nt, Homo sapiens
ggguacggcugaccaggaa

SEQ ID NO: 1432355 - RNA, 19 nt, Homo sapiens
ucucuucucucuucucaau

SEQ ID NO: 1432356 - RNA, 19 nt, Homo sapiens
uggcuaacaugugaaacua

SEQ ID NO: 1432357 - RNA, 19 nt, Homo sapiens
gcaguagaauggccagcau

SEQ ID NO: 1432358 - RNA, 19 nt, Homo sapiens
ccacucccaucucuucuuc

SEQ ID NO: 1432359 - RNA, 19 nt, Homo sapiens
ucuucucucuucucaauuu

SEQ ID NO: 1432360 - RNA, 19 nt, Homo sapiens
ggcccuagcuggagacucu

SEQ ID NO: 1432361 - RNA, 19 nt, Homo sapiens
aggaacagcuccagaagca

SEQ ID NO: 1432362 - RNA, 19 nt, Homo sapiens
gaaggaacagcuccagaag

SEQ ID NO: 1432363 - RNA, 19 nt, Homo sapiens
ggaaacccagcucagcaaa

SEQ ID NO: 1432364 - RNA, 19 nt, Homo sapiens
gguccucauucccaagauu

SEQ ID NO: 1432365 - RNA, 19 nt, Homo sapiens
ccagccaucccuucuguuu

SEQ ID NO: 1432366 - RNA, 19 nt, Homo sapiens
gggccaaguuccggaagaa

SEQ ID NO: 1432367 - RNA, 19 nt, Homo sapiens
gggcuucccuccagcuagu

SEQ ID NO: 1432368 - RNA, 19 nt, Homo sapiens
ugaauuacuuucucuucuc

SEQ ID NO: 1432369 - RNA, 19 nt, Homo sapiens
ucgauacgcugcccaacug

SEQ ID NO: 1432370 - RNA, 19 nt, Homo sapiens
ccuccuagcccugugguua

SEQ ID NO: 1432371 - RNA, 19 nt, Homo sapiens
agaaggaacagcuccagaa

SEQ ID NO: 1432372 - RNA, 19 nt, Homo sapiens
gaauagggaggaggugaga

SEQ ID NO: 1432373 - RNA, 19 nt, Homo sapiens
ccacaagcaucgagaaccu

SEQ ID NO: 1432374 - RNA, 19 nt, Homo sapiens
aaacccagcucagcaaacu

SEQ ID NO: 1432375 - RNA, 19 nt, Homo sapiens
aagcauauagcagcacaua

SEQ ID NO: 1432376 - RNA, 19 nt, Homo sapiens
cagcauuccugccuguaag

SEQ ID NO: 1432377 - RNA, 19 nt, Homo sapiens
gcaauuccgccagcacaug

SEQ ID NO: 1432378 - RNA, 19 nt, Homo sapiens
ccuguaaucccagcacuuu

SEQ ID NO: 1432379 - RNA, 19 nt, Homo sapiens
ggaaugaagguugaacucu

SEQ ID NO: 1432380 - RNA, 19 nt, Homo sapiens
ugaggaggcaguaguuaau

SEQ ID NO: 1432381 - RNA, 19 nt, Homo sapiens
gauugaggaggcaguaguu

SEQ ID NO: 1432382 - RNA, 19 nt, Homo sapiens
caagauugaggaggcagua

SEQ ID NO: 1432383 - RNA, 19 nt, Homo sapiens
cgucaugaauuacuuucuc

SEQ ID NO: 1432384 - RNA, 19 nt, Homo sapiens
gcaucuagaaggcgucaug

SEQ ID NO: 1432385 - RNA, 19 nt, Homo sapiens
gagccaauuauggaaguaa

SEQ ID NO: 1432386 - RNA, 19 nt, Homo sapiens
ucuagaaggcgucaugaau

SEQ ID NO: 1432387 - RNA, 19 nt, Homo sapiens
ccguugcucuccuucuauu

SEQ ID NO: 1432388 - RNA, 19 nt, Homo sapiens
ggcuguacauuucaagaca

SEQ ID NO: 1432389 - RNA, 19 nt, Homo sapiens
cagagccaauuauggaagu

SEQ ID NO: 1432390 - RNA, 19 nt, Homo sapiens
ccagcauuccugccuguaa

SEQ ID NO: 1432391 - RNA, 19 nt, Homo sapiens
gaagcuguuccuuucuaug

SEQ ID NO: 1432392 - RNA, 19 nt, Homo sapiens
ucccguugcucuccuucua

SEQ ID NO: 1432393 - RNA, 19 nt, Homo sapiens
ccuccacguucagcagaua

SEQ ID NO: 1432394 - RNA, 19 nt, Homo sapiens
uacuuucucuucucucuuc

SEQ ID NO: 1432395 - RNA, 19 nt, Homo sapiens
gaagacucacuacccagau

SEQ ID NO: 1432396 - RNA, 19 nt, Homo sapiens
gaaggcgucaugaauuacu

SEQ ID NO: 1432397 - RNA, 19 nt, Homo sapiens
guguugguaucaucaguuc

SEQ ID NO: 1432398 - RNA, 19 nt, Homo sapiens
cuacccagauguggugaug

SEQ ID NO: 1432399 - RNA, 19 nt, Homo sapiens
guacggcugaccaggaaug

SEQ ID NO: 1432400 - RNA, 19 nt, Homo sapiens
cggcccagccucuguauuc

SEQ ID NO: 1432401 - RNA, 19 nt, Homo sapiens
gagucugucugagcaguca

SEQ ID NO: 1432402 - RNA, 19 nt, Homo sapiens
guugguaucaucaguucuu

SEQ ID NO: 1432403 - RNA, 19 nt, Homo sapiens
ucuccacccuugaucuuuc

SEQ ID NO: 1432404 - RNA, 19 nt, Homo sapiens
gcuguacauuucaagacau

SEQ ID NO: 1432405 - RNA, 19 nt, Homo sapiens
aggccuggcuccugcauca

SEQ ID NO: 1432406 - RNA, 19 nt, Homo sapiens
cuggcuggcuguacauuuc

SEQ ID NO: 1432407 - RNA, 19 nt, Homo sapiens
ucccagagccaauuaugga

SEQ ID NO: 1432408 - RNA, 19 nt, Homo sapiens
caugaauuacuuucucuuc

SEQ ID NO: 1432409 - RNA, 19 nt, Homo sapiens
aagacucacuacccagaug

SEQ ID NO: 1432410 - RNA, 19 nt, Homo sapiens
ucacucagcgccauguaca

SEQ ID NO: 1432411 - RNA, 19 nt, Homo sapiens
cuacuugggaggcugaguu

SEQ ID NO: 1432412 - RNA, 19 nt, Homo sapiens
gcucagcaaacucccuuuc

SEQ ID NO: 1432413 - RNA, 19 nt, Homo sapiens
cauaggcucaggcuucugu

SEQ ID NO: 1432414 - RNA, 19 nt, Homo sapiens
cuaccggccuucagugcau

SEQ ID NO: 1432415 - RNA, 19 nt, Homo sapiens
ccugcggccucucuaggaa

SEQ ID NO: 1432416 - RNA, 19 nt, Homo sapiens
gauguggugaugcgugaga

SEQ ID NO: 1432417 - RNA, 19 nt, Homo sapiens
gguaucaucaguucuugag

SEQ ID NO: 1432418 - RNA, 19 nt, Homo sapiens
cguguggaaugugagauau

SEQ ID NO: 1432419 - RNA, 19 nt, Homo sapiens
gaaaaguguguuccuguuc

SEQ ID NO: 1432420 - RNA, 19 nt, Homo sapiens
caagcugagccuccacguu

SEQ ID NO: 1432421 - RNA, 19 nt, Homo sapiens
ggaggcaguaguuaaucug

SEQ ID NO: 1432422 - RNA, 19 nt, Homo sapiens
caucuuggaggcccguuau

SEQ ID NO: 1432423 - RNA, 19 nt, Homo sapiens
agccaucccuucuguuucu

SEQ ID NO: 1432424 - RNA, 19 nt, Homo sapiens
ccaagcuucccucggagaa

SEQ ID NO: 1432425 - RNA, 19 nt, Homo sapiens
gaaacccagcucagcaaac

SEQ ID NO: 1432426 - RNA, 19 nt, Homo sapiens
cacauaggcucaggcuucu

SEQ ID NO: 1432427 - RNA, 19 nt, Homo sapiens
guacauuucaagacaucau

SEQ ID NO: 1432428 - RNA, 19 nt, Homo sapiens
uugaggaggcaguaguuaa

SEQ ID NO: 1432429 - RNA, 19 nt, Homo sapiens
gucaugaauuacuuucucu

SEQ ID NO: 1432430 - RNA, 19 nt, Homo sapiens
ucucucuccuuccuucuuc

SEQ ID NO: 1432431 - RNA, 19 nt, Homo sapiens
guguggaaugugagauaua

SEQ ID NO: 1432432 - RNA, 19 nt, Homo sapiens
uagaaggcgucaugaauua

SEQ ID NO: 1432433 - RNA, 19 nt, Homo sapiens
cagcuacccugaacaguaa

SEQ ID NO: 1432434 - RNA, 19 nt, Homo sapiens
caucaguucuugagcuaua

SEQ ID NO: 1432435 - RNA, 19 nt, Homo sapiens
ccaacaaccuggugcacua

SEQ ID NO: 1432436 - RNA, 19 nt, Homo sapiens
gcuagucacuggaauggaa

SEQ ID NO: 1432437 - RNA, 19 nt, Homo sapiens
gaccaggaaugaagguuga

SEQ ID NO: 1432438 - RNA, 19 nt, Homo sapiens
gcuaacaugugaaacuaau

SEQ ID NO: 1432439 - RNA, 19 nt, Homo sapiens
gguguuggcuguguuggua

SEQ ID NO: 1432440 - RNA, 19 nt, Homo sapiens
gcagugagccgagaucaug

SEQ ID NO: 1432441 - RNA, 19 nt, Homo sapiens
gcacuacucguccuucgaa

SEQ ID NO: 1432442 - RNA, 19 nt, Homo sapiens
aauagcaccuccucccuuu

SEQ ID NO: 1432443 - RNA, 19 nt, Homo sapiens
gaauuacuuucucuucucu

SEQ ID NO: 1432444 - RNA, 19 nt, Homo sapiens
ucagcaaacucccuuucaa

SEQ ID NO: 1432445 - RNA, 19 nt, Homo sapiens
uguggaaugugagauauaa

SEQ ID NO: 1432446 - RNA, 19 nt, Homo sapiens
gugcaggugugguucaaga

SEQ ID NO: 1432447 - RNA, 19 nt, Homo sapiens
cuagaaggcgucaugaauu

SEQ ID NO: 1432448 - RNA, 19 nt, Homo sapiens
gcagucagccagugaguca

SEQ ID NO: 1432449 - RNA, 19 nt, Homo sapiens
gagcuucaccugagucugu

SEQ ID NO: 1432450 - RNA, 19 nt, Homo sapiens
auacccagcuggacacuga

SEQ ID NO: 1432451 - RNA, 19 nt, Homo sapiens
gcgccuggcugacaucauc

SEQ ID NO: 1432452 - RNA, 19 nt, Homo sapiens
cagcaaacucccuuucaaa

SEQ ID NO: 1432453 - RNA, 19 nt, Homo sapiens
gcauauagcagcacauagg

SEQ ID NO: 1432454 - RNA, 19 nt, Homo sapiens
gugagaggcuggccaugug

SEQ ID NO: 1432455 - RNA, 19 nt, Homo sapiens
ggguacggcugaccaggaa

SEQ ID NO: 1432456 - RNA, 19 nt, Homo sapiens
ucucuucucucuucucaau

SEQ ID NO: 1432457 - RNA, 19 nt, Homo sapiens
uggcuaacaugugaaacua

SEQ ID NO: 1432458 - RNA, 19 nt, Homo sapiens
gcaguagaauggccagcau

SEQ ID NO: 1432459 - RNA, 19 nt, Homo sapiens
ccacucccaucucuucuuc

SEQ ID NO: 1432460 - RNA, 19 nt, Homo sapiens
ucuucucucuucucaauuu

SEQ ID NO: 1432461 - RNA, 19 nt, Homo sapiens
ggcccuagcuggagacucu

SEQ ID NO: 1432462 - RNA, 19 nt, Homo sapiens
aggaacagcuccagaagca

SEQ ID NO: 1432463 - RNA, 19 nt, Homo sapiens
gaaggaacagcuccagaag

SEQ ID NO: 1432464 - RNA, 19 nt, Homo sapiens
ggaaacccagcucagcaaa

SEQ ID NO: 1432465 - RNA, 19 nt, Homo sapiens
gguccucauucccaagauu

SEQ ID NO: 1432466 - RNA, 19 nt, Homo sapiens
ccagccaucccuucuguuu

SEQ ID NO: 1432467 - RNA, 19 nt, Homo sapiens
gggccaaguuccggaagaa

SEQ ID NO: 1432468 - RNA, 19 nt, Homo sapiens
gggcuucccuccagcuagu

SEQ ID NO: 1432469 - RNA, 19 nt, Homo sapiens
ugaauuacuuucucuucuc

SEQ ID NO: 1432470 - RNA, 19 nt, Homo sapiens
ucgauacgcugcccaacug

SEQ ID NO: 1432471 - RNA, 19 nt, Homo sapiens
ccuccuagcccugugguua

SEQ ID NO: 1432472 - RNA, 19 nt, Homo sapiens
agaaggaacagcuccagaa

SEQ ID NO: 1432473 - RNA, 19 nt, Homo sapiens
gaauagggaggaggugaga

SEQ ID NO: 1432474 - RNA, 19 nt, Homo sapiens
uggcugacaucaucuugga

SEQ ID NO: 1432475 - RNA, 19 nt, Homo sapiens
ccacaagcaucgagaaccu

SEQ ID NO: 1432476 - RNA, 19 nt, Homo sapiens
aaacccagcucagcaaacu

SEQ ID NO: 1432477 - RNA, 19 nt, Homo sapiens
aagcauauagcagcacaua

SEQ ID NO: 1432478 - RNA, 19 nt, Homo sapiens
cagcauuccugccuguaag

SEQ ID NO: 1432479 - RNA, 19 nt, Homo sapiens
gcaauuccgccagcacaug

SEQ ID NO: 1432480 - RNA, 19 nt, Homo sapiens
ccuguaaucccagcacuuu

SEQ ID NO: 1432481 - RNA, 19 nt, Homo sapiens
ggaaugaagguugaacucu

SEQ ID NO: 1432482 - RNA, 19 nt, Homo sapiens
ugaggaggcaguaguuaau

SEQ ID NO: 1432483 - RNA, 19 nt, Homo sapiens
gauugaggaggcaguaguu

SEQ ID NO: 1432484 - RNA, 19 nt, Homo sapiens
caagauugaggaggcagua

SEQ ID NO: 1432485 - RNA, 19 nt, Homo sapiens
cgucaugaauuacuuucuc

SEQ ID NO: 1432486 - RNA, 19 nt, Homo sapiens
gcaucuagaaggcgucaug

SEQ ID NO: 1432487 - RNA, 19 nt, Homo sapiens
gagccaauuauggaaguaa

SEQ ID NO: 1432488 - RNA, 19 nt, Homo sapiens
ucuagaaggcgucaugaau

SEQ ID NO: 1432489 - RNA, 19 nt, Homo sapiens
ccguugcucuccuucuauu

SEQ ID NO: 1432490 - RNA, 19 nt, Homo sapiens
cagagccaauuauggaagu

SEQ ID NO: 1432491 - RNA, 19 nt, Homo sapiens
ccagcauuccugccuguaa

SEQ ID NO: 1432492 - RNA, 19 nt, Homo sapiens
gaagcuguuccuuucuaug

SEQ ID NO: 1432493 - RNA, 19 nt, Homo sapiens
ucccguugcucuccuucua

SEQ ID NO: 1432494 - RNA, 19 nt, Homo sapiens
gaagacucacuacccagau

SEQ ID NO: 1432495 - RNA, 19 nt, Homo sapiens
ccuccacguucagcagaua

SEQ ID NO: 1432496 - RNA, 19 nt, Homo sapiens
uacuuucucuucucucuuc

SEQ ID NO: 1432497 - RNA, 19 nt, Homo sapiens
cuacccagauguggugaug

SEQ ID NO: 1432498 - RNA, 19 nt, Homo sapiens
gaaggcgucaugaauuacu

SEQ ID NO: 1432499 - RNA, 19 nt, Homo sapiens
guguugguaucaucaguuc

SEQ ID NO: 1432500 - RNA, 19 nt, Homo sapiens
guacggcugaccaggaaug

SEQ ID NO: 1432501 - RNA, 19 nt, Homo sapiens
cggcccagccucuguauuc

SEQ ID NO: 1432502 - RNA, 19 nt, Homo sapiens
gagucugucugagcaguca

SEQ ID NO: 1432503 - RNA, 19 nt, Homo sapiens
guugguaucaucaguucuu

SEQ ID NO: 1432504 - RNA, 19 nt, Homo sapiens
ucuccacccuugaucuuuc

SEQ ID NO: 1432505 - RNA, 19 nt, Homo sapiens
aggccuggcuccugcauca

SEQ ID NO: 1432506 - RNA, 19 nt, Homo sapiens
ucccagagccaauuaugga

SEQ ID NO: 1432507 - RNA, 19 nt, Homo sapiens
aagacucacuacccagaug

SEQ ID NO: 1432508 - RNA, 19 nt, Homo sapiens
caugaauuacuuucucuuc

SEQ ID NO: 1432509 - RNA, 19 nt, Homo sapiens
ucacucagcgccauguaca

SEQ ID NO: 1432510 - RNA, 19 nt, Homo sapiens
cuacuugggaggcugaguu

SEQ ID NO: 1432511 - RNA, 19 nt, Homo sapiens
gcucagcaaacucccuuuc

SEQ ID NO: 1432512 - RNA, 19 nt, Homo sapiens
cauaggcucaggcuucugu

SEQ ID NO: 1432513 - RNA, 19 nt, Homo sapiens
cuaccggccuucagugcau

SEQ ID NO: 1432514 - RNA, 19 nt, Homo sapiens
gauguggugaugcgugaga

SEQ ID NO: 1432515 - RNA, 19 nt, Homo sapiens
ccugcggccucucuaggaa

SEQ ID NO: 1432516 - RNA, 19 nt, Homo sapiens
gguaucaucaguucuugag

SEQ ID NO: 1432517 - RNA, 19 nt, Homo sapiens
cguguggaaugugagauau

SEQ ID NO: 1432518 - RNA, 19 nt, Homo sapiens
gaaaaguguguuccuguuc

SEQ ID NO: 1432519 - RNA, 19 nt, Homo sapiens
caagcugagccuccacguu

SEQ ID NO: 1432520 - RNA, 19 nt, Homo sapiens
ggaggcaguaguuaaucug

SEQ ID NO: 1432521 - RNA, 19 nt, Homo sapiens
agccaucccuucuguuucu

SEQ ID NO: 1432522 - RNA, 19 nt, Homo sapiens
ccaagcuucccucggagaa

SEQ ID NO: 1432523 - RNA, 19 nt, Homo sapiens
caucuuggaggcccguuau

SEQ ID NO: 1432524 - RNA, 19 nt, Homo sapiens
gaaacccagcucagcaaac

SEQ ID NO: 1432525 - RNA, 19 nt, Homo sapiens
cacauaggcucaggcuucu

SEQ ID NO: 1432526 - RNA, 19 nt, Homo sapiens
uugaggaggcaguaguuaa

SEQ ID NO: 1432527 - RNA, 19 nt, Homo sapiens
gucaugaauuacuuucucu

SEQ ID NO: 1432528 - RNA, 19 nt, Homo sapiens
ucucucuccuuccuucuuc

SEQ ID NO: 1432529 - RNA, 19 nt, Homo sapiens
guguggaaugugagauaua

SEQ ID NO: 1432530 - RNA, 19 nt, Homo sapiens
gucuacguguggaauguga

SEQ ID NO: 1432531 - RNA, 19 nt, Homo sapiens
guaagucuacguguggaau

SEQ ID NO: 1432532 - RNA, 19 nt, Homo sapiens
gcacuuguauucuguauua

SEQ ID NO: 1432533 - RNA, 19 nt, Homo sapiens
gcauaaagcuuggaaagua

SEQ ID NO: 1432534 - RNA, 19 nt, Homo sapiens
ggugagaagucuacaauuu

SEQ ID NO: 1432535 - RNA, 19 nt, Homo sapiens
gcaaagccuucaucaagaa

SEQ ID NO: 1432536 - RNA, 19 nt, Homo sapiens
gaaaggcacuuguauucug

SEQ ID NO: 1432537 - RNA, 19 nt, Homo sapiens
gagaaacccuaccagugua

SEQ ID NO: 1432538 - RNA, 19 nt, Homo sapiens
gagagaaaccuuacaguug

SEQ ID NO: 1432539 - RNA, 19 nt, Homo sapiens
gagagaagcccuaugaaug

SEQ ID NO: 1432540 - RNA, 19 nt, Homo sapiens
gggaaggcguuuaugcaua

SEQ ID NO: 1432541 - RNA, 19 nt, Homo sapiens
gagaaaggcacuuguauuc

SEQ ID NO: 1432542 - RNA, 19 nt, Homo sapiens
gaaucugagucuccuuuaa

SEQ ID NO: 1432543 - RNA, 19 nt, Homo sapiens
ucccagaagucaaaucuua

SEQ ID NO: 1432544 - RNA, 19 nt, Homo sapiens
gagaagcccuaugaaugua

SEQ ID NO: 1432545 - RNA, 19 nt, Homo sapiens
cauaaagcuuggaaaguaa

SEQ ID NO: 1432546 - RNA, 19 nt, Homo sapiens
guucaucccuuuauaaaca

SEQ ID NO: 1432547 - RNA, 19 nt, Homo sapiens
aagaguagauucccauaaa

SEQ ID NO: 1432548 - RNA, 19 nt, Homo sapiens
gugagaagucuacaauuua

SEQ ID NO: 1432549 - RNA, 19 nt, Homo sapiens
ggagagaaaccuuacaguu

SEQ ID NO: 1432550 - RNA, 19 nt, Homo sapiens
ggagagagacccuuugugu

SEQ ID NO: 1432551 - RNA, 19 nt, Homo sapiens
ggagagaaaggcacuugua

SEQ ID NO: 1432552 - RNA, 19 nt, Homo sapiens
ggcaaagccuucaucaaga

SEQ ID NO: 1432553 - RNA, 19 nt, Homo sapiens
gagaaguguuugccaccua

SEQ ID NO: 1432554 - RNA, 19 nt, Homo sapiens
ugagaaggccuuauuaaau

SEQ ID NO: 1432555 - RNA, 19 nt, Homo sapiens
agagaaaccuuacaguugu

SEQ ID NO: 1432556 - RNA, 19 nt, Homo sapiens
gaagaguagauucccauaa

SEQ ID NO: 1432557 - RNA, 19 nt, Homo sapiens
ggagagaagcccuaugaau

SEQ ID NO: 1432558 - RNA, 19 nt, Homo sapiens
cgugaaaucucauacacuu

SEQ ID NO: 1432559 - RNA, 19 nt, Homo sapiens
acuuggaacuccucauuua

SEQ ID NO: 1432560 - RNA, 19 nt, Homo sapiens
uaacagaugugggaaagca

SEQ ID NO: 1432561 - RNA, 19 nt, Homo sapiens
guaugccuauuaacaguuu

SEQ ID NO: 1432562 - RNA, 19 nt, Homo sapiens
gaacuccucauuuaaucaa

SEQ ID NO: 1432563 - RNA, 19 nt, Homo sapiens
ggagagaagccuuaugagu

SEQ ID NO: 1432564 - RNA, 19 nt, Homo sapiens
gagagaaaggcacuuguau

SEQ ID NO: 1432565 - RNA, 19 nt, Homo sapiens
gcaugacaguguuucugaa

SEQ ID NO: 1432566 - RNA, 19 nt, Homo sapiens
ugaaaucucauacacuuga

SEQ ID NO: 1432567 - RNA, 19 nt, Homo sapiens
ccaaucauguucuggaagu

SEQ ID NO: 1432568 - RNA, 19 nt, Homo sapiens
agacaucagauaacucaua

SEQ ID NO: 1432569 - RNA, 19 nt, Homo sapiens
aaucaaagaaccagugaaa

SEQ ID NO: 1432570 - RNA, 19 nt, Homo sapiens
caggagagaagcccuauga

SEQ ID NO: 1432571 - RNA, 19 nt, Homo sapiens
caacacgugaaaucucaua

SEQ ID NO: 1432572 - RNA, 19 nt, Homo sapiens
ggaaaacauucacuuggaa

SEQ ID NO: 1432573 - RNA, 19 nt, Homo sapiens
gacaucagauaacucauac

SEQ ID NO: 1432574 - RNA, 19 nt, Homo sapiens
uacaguaaguauucaguug

SEQ ID NO: 1432575 - RNA, 19 nt, Homo sapiens
ugacaguguuucugaaucu

SEQ ID NO: 1432576 - RNA, 19 nt, Homo sapiens
agaaguguuugccaccuaa

SEQ ID NO: 1432577 - RNA, 19 nt, Homo sapiens
gagcauaaagcuuggaaag

SEQ ID NO: 1432578 - RNA, 19 nt, Homo sapiens
gcuuaugaaugcagugaau

SEQ ID NO: 1432579 - RNA, 19 nt, Homo sapiens
guucuggaagugauaauaa

SEQ ID NO: 1432580 - RNA, 19 nt, Homo sapiens
uaugagaaggccuuauuaa

SEQ ID NO: 1432581 - RNA, 19 nt, Homo sapiens
uaucauauguggcaaagcu

SEQ ID NO: 1432582 - RNA, 19 nt, Homo sapiens
gaauuuggaagaguagauu

SEQ ID NO: 1432583 - RNA, 19 nt, Homo sapiens
ccagaagucaaaucuuauu

SEQ ID NO: 1432584 - RNA, 19 nt, Homo sapiens
auuaacaguuucugcagua

SEQ ID NO: 1432585 - RNA, 19 nt, Homo sapiens
agagaaacccuaccagugu

SEQ ID NO: 1432586 - RNA, 19 nt, Homo sapiens
cuugagaagucauuugaau

SEQ ID NO: 1432587 - RNA, 19 nt, Homo sapiens
ccuugcaacucaucagaaa

SEQ ID NO: 1432588 - RNA, 19 nt, Homo sapiens
agagaagcccuaugaaugu

SEQ ID NO: 1432589 - RNA, 19 nt, Homo sapiens
aggcacaccuugcaacuca

SEQ ID NO: 1432590 - RNA, 19 nt, Homo sapiens
uggcaaagccuucaucaag

SEQ ID NO: 1432591 - RNA, 19 nt, Homo sapiens
acacaccaaagaauucaua

SEQ ID NO: 1432592 - RNA, 19 nt, Homo sapiens
ucacuuggaacuccucauu

SEQ ID NO: 1432593 - RNA, 19 nt, Homo sapiens
agagaaaggcacuuguauu

SEQ ID NO: 1432594 - RNA, 19 nt, Homo sapiens
gguauaguucaucccuuua

SEQ ID NO: 1432595 - RNA, 19 nt, Homo sapiens
agguauaguucaucccuuu

SEQ ID NO: 1432596 - RNA, 19 nt, Homo sapiens
gggaaaacauucacuugga

SEQ ID NO: 1432597 - RNA, 19 nt, Homo sapiens
aaaggcacuuguauucugu

SEQ ID NO: 1432598 - RNA, 19 nt, Homo sapiens
ucagacaucagauaacuca

SEQ ID NO: 1432599 - RNA, 19 nt, Homo sapiens
agaaaacgcuuaugaaugc

SEQ ID NO: 1432600 - RNA, 19 nt, Homo sapiens
auacaggagagaaaccuua

SEQ ID NO: 1432601 - RNA, 19 nt, Homo sapiens
cauccgugcuuguuacaca

SEQ ID NO: 1432602 - RNA, 19 nt, Homo sapiens
guguuugccaccuaauuua

SEQ ID NO: 1432603 - RNA, 19 nt, Homo sapiens
uaaugggcaugacaguguu

SEQ ID NO: 1432604 - RNA, 19 nt, Homo sapiens
aaacaagacacuaauugag

SEQ ID NO: 1432605 - RNA, 19 nt, Homo sapiens
ggcaugacaguguuucuga

SEQ ID NO: 1432606 - RNA, 19 nt, Homo sapiens
uaacaguuucugcaguaaa

SEQ ID NO: 1432607 - RNA, 19 nt, Homo sapiens
acacauccgugcuuguuac

SEQ ID NO: 1432608 - RNA, 19 nt, Homo sapiens
cuaccaguguaucauaugu

SEQ ID NO: 1432609 - RNA, 19 nt, Homo sapiens
ggaacuccucauuuaauca

SEQ ID NO: 1432610 - RNA, 19 nt, Homo sapiens
aacaguuucugcaguaaau

SEQ ID NO: 1432611 - RNA, 19 nt, Homo sapiens
cuaugaauguaacagaugu

SEQ ID NO: 1432612 - RNA, 19 nt, Homo sapiens
uggaacuccucauuuaauc

SEQ ID NO: 1432613 - RNA, 19 nt, Homo sapiens
acacuggagagaagccuua

SEQ ID NO: 1432614 - RNA, 19 nt, Homo sapiens
gaggagagaaaggcacuug

SEQ ID NO: 1432615 - RNA, 19 nt, Homo sapiens
gacacuaauugaggagaga

SEQ ID NO: 1432616 - RNA, 19 nt, Homo sapiens
ugaaucugagucuccuuua

SEQ ID NO: 1432617 - RNA, 19 nt, Homo sapiens
uuaugcaagugugaguuua

SEQ ID NO: 1432618 - RNA, 19 nt, Homo sapiens
ccucagacaucagauaacu

SEQ ID NO: 1432619 - RNA, 19 nt, Homo sapiens
cuggagagaagccuuauga

SEQ ID NO: 1432620 - RNA, 19 nt, Homo sapiens
guauaguucaucccuuuau

SEQ ID NO: 1432621 - RNA, 19 nt, Homo sapiens
uaauggagagagacccuuu

SEQ ID NO: 1432622 - RNA, 19 nt, Homo sapiens
uaaguauucaguugaggaa

SEQ ID NO: 1432623 - RNA, 19 nt, Homo sapiens
cugagucuccuuuaauuau

SEQ ID NO: 1432624 - RNA, 19 nt, Homo sapiens
ucugagucuccuuuaauua

SEQ ID NO: 1432625 - RNA, 19 nt, Homo sapiens
uuaaugggcaugacagugu

SEQ ID NO: 1432626 - RNA, 19 nt, Homo sapiens
gaauucauggugagaaguc

SEQ ID NO: 1432627 - RNA, 19 nt, Homo sapiens
gaagcccuaugaauguaac

SEQ ID NO: 1432628 - RNA, 19 nt, Homo sapiens
gagucuccuuuaauuauac

SEQ ID NO: 1432629 - RNA, 19 nt, Homo sapiens
caagugagaaaauguguuu

SEQ ID NO: 1432630 - RNA, 19 nt, Homo sapiens
augagaaggccuuauuaaa

SEQ ID NO: 1432631 - RNA, 19 nt, Homo sapiens
guagaaaacgcuuaugaau

SEQ ID NO: 1432632 - RNA, 19 nt, Homo sapiens
guagcaagcuucauguuua

SEQ ID NO: 1432633 - RNA, 19 nt, Homo sapiens
gaagagaguugugguugua

SEQ ID NO: 1432634 - RNA, 19 nt, Homo sapiens
ggaagcgucuguuuaguuu

SEQ ID NO: 1432635 - RNA, 19 nt, Homo sapiens
gaaggaagcuugcagacau

SEQ ID NO: 1432636 - RNA, 19 nt, Homo sapiens
ggacgggacuaacauuauu

SEQ ID NO: 1432637 - RNA, 19 nt, Homo sapiens
gaacaaggauuugaggaau

SEQ ID NO: 1432638 - RNA, 19 nt, Homo sapiens
gaaagcaggcuguguuauu

SEQ ID NO: 1432639 - RNA, 19 nt, Homo sapiens
ccagagaaguuuacacuga

SEQ ID NO: 1432640 - RNA, 19 nt, Homo sapiens
gaauagcccucagaagaaa

SEQ ID NO: 1432641 - RNA, 19 nt, Homo sapiens
gaauuuccaugaacgcuaa

SEQ ID NO: 1432642 - RNA, 19 nt, Homo sapiens
gugaaagggugauggauuu

SEQ ID NO: 1432643 - RNA, 19 nt, Homo sapiens
gaggaaagguuuacaagca

SEQ ID NO: 1432644 - RNA, 19 nt, Homo sapiens
gcagguaacugaaacucaa

SEQ ID NO: 1432645 - RNA, 19 nt, Homo sapiens
gagaguagcuggagaugag

SEQ ID NO: 1432646 - RNA, 19 nt, Homo sapiens
gaaagauucuggaggaaag

SEQ ID NO: 1432647 - RNA, 19 nt, Homo sapiens
ucacuuaucugaacguuuc

SEQ ID NO: 1432648 - RNA, 19 nt, Homo sapiens
gaacagagccugggacaag

SEQ ID NO: 1432649 - RNA, 19 nt, Homo sapiens
gaauguaagcuucaugaaa

SEQ ID NO: 1432650 - RNA, 19 nt, Homo sapiens
uaacaugucuucuuuccau

SEQ ID NO: 1432651 - RNA, 19 nt, Homo sapiens
cagaugaaguuacuacuau

SEQ ID NO: 1432652 - RNA, 19 nt, Homo sapiens
gggcaggaguaauuaauug

SEQ ID NO: 1432653 - RNA, 19 nt, Homo sapiens
gcccuggucuucacauuaa

SEQ ID NO: 1432654 - RNA, 19 nt, Homo sapiens
gaaacaucaccuucaauuu

SEQ ID NO: 1432655 - RNA, 19 nt, Homo sapiens
cagaauagcccucagaaga

SEQ ID NO: 1432656 - RNA, 19 nt, Homo sapiens
ucagaagccuuggaauuaa

SEQ ID NO: 1432657 - RNA, 19 nt, Homo sapiens
aaagcaggcuguguuauuu

SEQ ID NO: 1432658 - RNA, 19 nt, Homo sapiens
gagaugugcuuuggagauu

SEQ ID NO: 1432659 - RNA, 19 nt, Homo sapiens
gcucagaaagguauaguaa

SEQ ID NO: 1432660 - RNA, 19 nt, Homo sapiens
aaaggaagaugaguugaaa

SEQ ID NO: 1432661 - RNA, 19 nt, Homo sapiens
guagaagacucaaggaagu

SEQ ID NO: 1432662 - RNA, 19 nt, Homo sapiens
gcaguaagccaagauugua

SEQ ID NO: 1432663 - RNA, 19 nt, Homo sapiens
ggugauaguuggaaaguag

SEQ ID NO: 1432664 - RNA, 19 nt, Homo sapiens
gaaucuuguugaagccuua

SEQ ID NO: 1432665 - RNA, 19 nt, Homo sapiens
gaaacccugucuguacuaa

SEQ ID NO: 1432666 - RNA, 19 nt, Homo sapiens
gcacguuuguaaucugaaa

SEQ ID NO: 1432667 - RNA, 19 nt, Homo sapiens
cagaugauauuuccuagau

SEQ ID NO: 1432668 - RNA, 19 nt, Homo sapiens
gaggcucacugaacagaaa

SEQ ID NO: 1432669 - RNA, 19 nt, Homo sapiens
gagcacguuuguaaucuga

SEQ ID NO: 1432670 - RNA, 19 nt, Homo sapiens
guacaguuggugaaauuua

SEQ ID NO: 1432671 - RNA, 19 nt, Homo sapiens
uagcaagcuucauguuuaa

SEQ ID NO: 1432672 - RNA, 19 nt, Homo sapiens
ggaccaggaucagguuuga

SEQ ID NO: 1432673 - RNA, 19 nt, Homo sapiens
gaacgcuaauggagcuauu

SEQ ID NO: 1432674 - RNA, 19 nt, Homo sapiens
ugaagggucuugagcauca

SEQ ID NO: 1432675 - RNA, 19 nt, Homo sapiens
aaacaucaccuucaauuuc

SEQ ID NO: 1432676 - RNA, 19 nt, Homo sapiens
auaguaagcugggaacuuu

SEQ ID NO: 1432677 - RNA, 19 nt, Homo sapiens
ggaggaagcgucuguuuag

SEQ ID NO: 1432678 - RNA, 19 nt, Homo sapiens
ggagauggaggcugcagua

SEQ ID NO: 1432679 - RNA, 19 nt, Homo sapiens
gggaggaagcgucuguuua

SEQ ID NO: 1432680 - RNA, 19 nt, Homo sapiens
ggguacaguuggugaaauu

SEQ ID NO: 1432681 - RNA, 19 nt, Homo sapiens
gagcaguaguuacaaaugg

SEQ ID NO: 1432682 - RNA, 19 nt, Homo sapiens
cagaagccuuggaauuaaa

SEQ ID NO: 1432683 - RNA, 19 nt, Homo sapiens
uuaaagggcaggaguaauu

SEQ ID NO: 1432684 - RNA, 19 nt, Homo sapiens
gaaaauacccaguuaaaca

SEQ ID NO: 1432685 - RNA, 19 nt, Homo sapiens
ucucucacccguuguauua

SEQ ID NO: 1432686 - RNA, 19 nt, Homo sapiens
ggaacaaggauuugaggaa

SEQ ID NO: 1432687 - RNA, 19 nt, Homo sapiens
agacaggccugcaggaaug

SEQ ID NO: 1432688 - RNA, 19 nt, Homo sapiens
aaagauggaucaccuacug

SEQ ID NO: 1432689 - RNA, 19 nt, Homo sapiens
caagaugcguaaacacuca

SEQ ID NO: 1432690 - RNA, 19 nt, Homo sapiens
gagcuauucugagcauuug

SEQ ID NO: 1432691 - RNA, 19 nt, Homo sapiens
gauagugaaugacagaucu

SEQ ID NO: 1432692 - RNA, 19 nt, Homo sapiens
guugaagccuuacaagaau

SEQ ID NO: 1432693 - RNA, 19 nt, Homo sapiens
agacaucccucccaaucuu

SEQ ID NO: 1432694 - RNA, 19 nt, Homo sapiens
gcuaauggagcuauucuga

SEQ ID NO: 1432695 - RNA, 19 nt, Homo sapiens
gaacccagaguaaguugaa

SEQ ID NO: 1432696 - RNA, 19 nt, Homo sapiens
aauguaagcuucaugaaag

SEQ ID NO: 1432697 - RNA, 19 nt, Homo sapiens
ucagaaagguauaguaacu

SEQ ID NO: 1432698 - RNA, 19 nt, Homo sapiens
gaugugcuuuggagauuug

SEQ ID NO: 1432699 - RNA, 19 nt, Homo sapiens
guagaaugauugcagagau

SEQ ID NO: 1432700 - RNA, 19 nt, Homo sapiens
ucccagagcucacuuaucu

SEQ ID NO: 1432701 - RNA, 19 nt, Homo sapiens
uaaagggcaggaguaauua

SEQ ID NO: 1432702 - RNA, 19 nt, Homo sapiens
auaccuguguucagucuua

SEQ ID NO: 1432703 - RNA, 19 nt, Homo sapiens
gcugaugacauuccaguuu

SEQ ID NO: 1432704 - RNA, 19 nt, Homo sapiens
acagaaacaucaccuucaa

SEQ ID NO: 1432705 - RNA, 19 nt, Homo sapiens
ggagcuauucugagcauuu

SEQ ID NO: 1432706 - RNA, 19 nt, Homo sapiens
ggugaaggcguuagacuga

SEQ ID NO: 1432707 - RNA, 19 nt, Homo sapiens
gcaagcacgucaagguagu

SEQ ID NO: 1432708 - RNA, 19 nt, Homo sapiens
gauggaggcugcaguaagc

SEQ ID NO: 1432709 - RNA, 19 nt, Homo sapiens
gcagacaucccucccaauc

SEQ ID NO: 1432710 - RNA, 19 nt, Homo sapiens
caagcuucauguuuaaaga

SEQ ID NO: 1432711 - RNA, 19 nt, Homo sapiens
gguuguggauguacaguau

SEQ ID NO: 1432712 - RNA, 19 nt, Homo sapiens
ucuguucuguucccuguua

SEQ ID NO: 1432713 - RNA, 19 nt, Homo sapiens
gauuucaucuacucucaug

SEQ ID NO: 1432714 - RNA, 19 nt, Homo sapiens
caaggacaccucuaaacuu

SEQ ID NO: 1432715 - RNA, 19 nt, Homo sapiens
guuggaaaguagaaugauu

SEQ ID NO: 1432716 - RNA, 19 nt, Homo sapiens
agcaggaacuggucacuuu

SEQ ID NO: 1432717 - RNA, 19 nt, Homo sapiens
agaaacaucaccuucaauu

SEQ ID NO: 1432718 - RNA, 19 nt, Homo sapiens
gacuggagcacguuuguaa

SEQ ID NO: 1432719 - RNA, 19 nt, Homo sapiens
gguaacugaaacucaauua

SEQ ID NO: 1432720 - RNA, 19 nt, Homo sapiens
ugaaggcguuagacugauu

SEQ ID NO: 1432721 - RNA, 19 nt, Homo sapiens
ccucccaacuauucuuuaa

SEQ ID NO: 1432722 - RNA, 19 nt, Homo sapiens
gcagauagugaaugacaga

SEQ ID NO: 1432723 - RNA, 19 nt, Homo sapiens
ccucaggguuuauuugaau

SEQ ID NO: 1432724 - RNA, 19 nt, Homo sapiens
ugaacaagaugcguaaaca

SEQ ID NO: 1432725 - RNA, 19 nt, Homo sapiens
gaaguggagauaucuggaa

SEQ ID NO: 1432726 - RNA, 19 nt, Homo sapiens
caagcuaggucuccauaac

SEQ ID NO: 1432727 - RNA, 19 nt, Homo sapiens
ucacugaacagaaacauca

SEQ ID NO: 1432728 - RNA, 19 nt, Homo sapiens
gaagaugaguugaaaagca

SEQ ID NO: 1432729 - RNA, 19 nt, Homo sapiens
aaggacaccucuaaacuuc

SEQ ID NO: 1432730 - RNA, 19 nt, Homo sapiens
cucagaagccuuggaauua

SEQ ID NO: 1432731 - RNA, 19 nt, Homo sapiens
gcccacacacugagaagua

SEQ ID NO: 1432732 - RNA, 19 nt, Homo sapiens
ggacuuugcugccaacuau

SEQ ID NO: 1432733 - RNA, 19 nt, Homo sapiens
ggaaucagcucacagagau

SEQ ID NO: 1432734 - RNA, 19 nt, Homo sapiens
ggacauugaaggcaacuua

SEQ ID NO: 1432735 - RNA, 19 nt, Homo sapiens
gaaacaagauagugacaag

SEQ ID NO: 1432736 - RNA, 19 nt, Homo sapiens
ggagacaccuuuguucuuc

SEQ ID NO: 1432737 - RNA, 19 nt, Homo sapiens
acaacaagcuggagaagau

SEQ ID NO: 1432738 - RNA, 19 nt, Homo sapiens
caaacgcccugaucagugu

SEQ ID NO: 1432739 - RNA, 19 nt, Homo sapiens
gcaccuaggagacaccuuu

SEQ ID NO: 1432740 - RNA, 19 nt, Homo sapiens
ggaggaagaggaaacaaga

SEQ ID NO: 1432741 - RNA, 19 nt, Homo sapiens
ggagaagacacaaggguau

SEQ ID NO: 1432742 - RNA, 19 nt, Homo sapiens
gaugugaccuaggaugaug

SEQ ID NO: 1432743 - RNA, 19 nt, Homo sapiens
guauugaccugcgugaguu

SEQ ID NO: 1432744 - RNA, 19 nt, Homo sapiens
gggcugacacagucucaua

SEQ ID NO: 1432745 - RNA, 19 nt, Homo sapiens
cugcagaacaacaagauua

SEQ ID NO: 1432746 - RNA, 19 nt, Homo sapiens
caccugggcugccucgaaa

SEQ ID NO: 1432747 - RNA, 19 nt, Homo sapiens
acacccagcugcacacaug

SEQ ID NO: 1432748 - RNA, 19 nt, Homo sapiens
ggaucuuucucagguuuaa

SEQ ID NO: 1432749 - RNA, 19 nt, Homo sapiens
gaaauguccaugugcugaa

SEQ ID NO: 1432750 - RNA, 19 nt, Homo sapiens
caaccucaauuaccuguac

SEQ ID NO: 1432751 - RNA, 19 nt, Homo sapiens
gcacacacaggcacccauu

SEQ ID NO: 1432752 - RNA, 19 nt, Homo sapiens
acacacaacuacccuccaa

SEQ ID NO: 1432753 - RNA, 19 nt, Homo sapiens
gaagaggaaacaagauagu

SEQ ID NO: 1432754 - RNA, 19 nt, Homo sapiens
ccagacacaugcacacaca

SEQ ID NO: 1432755 - RNA, 19 nt, Homo sapiens
gaaguuccgggugccuuua

SEQ ID NO: 1432756 - RNA, 19 nt, Homo sapiens
acacacacaugcacaaguc

SEQ ID NO: 1432757 - RNA, 19 nt, Homo sapiens
ggaagaggaaacaagauag

SEQ ID NO: 1432758 - RNA, 19 nt, Homo sapiens
gugacaaggugaugcagau

SEQ ID NO: 1432759 - RNA, 19 nt, Homo sapiens
gcacaccaaccaccuaucu

SEQ ID NO: 1432760 - RNA, 19 nt, Homo sapiens
ggaggaggaggaagaggaa

SEQ ID NO: 1432761 - RNA, 19 nt, Homo sapiens
gggaaucagcucacagaga

SEQ ID NO: 1432762 - RNA, 19 nt, Homo sapiens
ggccagaagccaaacuuga

SEQ ID NO: 1432763 - RNA, 19 nt, Homo sapiens
gcucagccacacacaacua

SEQ ID NO: 1432764 - RNA, 19 nt, Homo sapiens
uguacaagcugcaccucaa

SEQ ID NO: 1432765 - RNA, 19 nt, Homo sapiens
ucuaugggcucaccuuugg

SEQ ID NO: 1432766 - RNA, 19 nt, Homo sapiens
gaucuaugggcucaccuuu

SEQ ID NO: 1432767 - RNA, 19 nt, Homo sapiens
caucugaccaaccucaauu

SEQ ID NO: 1432768 - RNA, 19 nt, Homo sapiens
gagacaccuuuguucuuca

SEQ ID NO: 1432769 - RNA, 19 nt, Homo sapiens
ggaaacaagauagugacaa

SEQ ID NO: 1432770 - RNA, 19 nt, Homo sapiens
aggaagaggaaacaagaua

SEQ ID NO: 1432771 - RNA, 19 nt, Homo sapiens
ccugaucaguguggacuuu

SEQ ID NO: 1432772 - RNA, 19 nt, Homo sapiens
ugaccaaccucaauuaccu

SEQ ID NO: 1432773 - RNA, 19 nt, Homo sapiens
cagaacaaccagcuggaaa

SEQ ID NO: 1432774 - RNA, 19 nt, Homo sapiens
gcgaacagcccuccaaagc

SEQ ID NO: 1432775 - RNA, 19 nt, Homo sapiens
gagcacaccaaccaccuau

SEQ ID NO: 1432776 - RNA, 19 nt, Homo sapiens
cugcaggucuuggacauug

SEQ ID NO: 1432777 - RNA, 19 nt, Homo sapiens
gaacaacaagcuggagaag

SEQ ID NO: 1432778 - RNA, 19 nt, Homo sapiens
gcagaacaaccagcuggaa

SEQ ID NO: 1432779 - RNA, 19 nt, Homo sapiens
acaacgagaccuucuggaa

SEQ ID NO: 1432780 - RNA, 19 nt, Homo sapiens
ccaauaacaagcugaccuu

SEQ ID NO: 1432781 - RNA, 19 nt, Homo sapiens
uaccuguacuuggccaaua

SEQ ID NO: 1432782 - RNA, 19 nt, Homo sapiens
augcagaugugaccuagga

SEQ ID NO: 1432783 - RNA, 19 nt, Homo sapiens
acaaggugaugcagaugug

SEQ ID NO: 1432784 - RNA, 19 nt, Homo sapiens
cagaacaacaagauuagug

SEQ ID NO: 1432785 - RNA, 19 nt, Homo sapiens
gcagaacaacuaccugacu

SEQ ID NO: 1432786 - RNA, 19 nt, Homo sapiens
gagcuauaccugcagaaca

SEQ ID NO: 1432787 - RNA, 19 nt, Homo sapiens
ccaccuaucucugcagaac

SEQ ID NO: 1432788 - RNA, 19 nt, Homo sapiens
gguauugaccugcgugagu

SEQ ID NO: 1432789 - RNA, 19 nt, Homo sapiens
cagaugugaccuaggauga

SEQ ID NO: 1432790 - RNA, 19 nt, Homo sapiens
agaggaaacaagauaguga

SEQ ID NO: 1432791 - RNA, 19 nt, Homo sapiens
caaacuugaggucugugua

SEQ ID NO: 1432792 - RNA, 19 nt, Homo sapiens
agaaggcguuugagcaucu

SEQ ID NO: 1432793 - RNA, 19 nt, Homo sapiens
cuuagaguuuggugacauu

SEQ ID NO: 1432794 - RNA, 19 nt, Homo sapiens
ugacauguguaugcguaug

SEQ ID NO: 1432795 - RNA, 19 nt, Homo sapiens
agcuauaccugcagaacaa

SEQ ID NO: 1432796 - RNA, 19 nt, Homo sapiens
gagugaagcagaggugaug

SEQ ID NO: 1432797 - RNA, 19 nt, Homo sapiens
gacaaggugaugcagaugu

SEQ ID NO: 1432798 - RNA, 19 nt, Homo sapiens
cggugcaccuguacaacaa

SEQ ID NO: 1432799 - RNA, 19 nt, Homo sapiens
ccuaggagacaccuuuguu

SEQ ID NO: 1432800 - RNA, 19 nt, Homo sapiens
ccagccagaaucagccaua

SEQ ID NO: 1432801 - RNA, 19 nt, Homo sapiens
gcaggucuuggacauugaa

SEQ ID NO: 1432802 - RNA, 19 nt, Homo sapiens
caaaacaaccgccugacuu

SEQ ID NO: 1432803 - RNA, 19 nt, Homo sapiens
cgucugcccuguccaucug

SEQ ID NO: 1432804 - RNA, 19 nt, Homo sapiens
gcucaccuuuggccagaag

SEQ ID NO: 1432805 - RNA, 19 nt, Homo sapiens
gccagaaucagccauagca

SEQ ID NO: 1432806 - RNA, 19 nt, Homo sapiens
ccaaagccuaugccacaga

SEQ ID NO: 1432807 - RNA, 19 nt, Homo sapiens
ggaggaggaagaggaaaca

SEQ ID NO: 1432808 - RNA, 19 nt, Homo sapiens
guuccgggugccuuuauuu

SEQ ID NO: 1432809 - RNA, 19 nt, Homo sapiens
ggagugaagcagaggugau

SEQ ID NO: 1432810 - RNA, 19 nt, Homo sapiens
acacaaggguauccaugcu

SEQ ID NO: 1432811 - RNA, 19 nt, Homo sapiens
gaaggucaagcgcaaugag

SEQ ID NO: 1432812 - RNA, 19 nt, Homo sapiens
ucccagagaaggcguuuga

SEQ ID NO: 1432813 - RNA, 19 nt, Homo sapiens
gccagaagccaaacuugag

SEQ ID NO: 1432814 - RNA, 19 nt, Homo sapiens
gaggaagaggaaacaagau

SEQ ID NO: 1432815 - RNA, 19 nt, Homo sapiens
gggaucuuucucagguuua

SEQ ID NO: 1432816 - RNA, 19 nt, Homo sapiens
gcagaacaacaagauuagu

SEQ ID NO: 1432817 - RNA, 19 nt, Homo sapiens
cguggacuguggcgguauu

SEQ ID NO: 1432818 - RNA, 19 nt, Homo sapiens
gagaagacacaaggguauc

SEQ ID NO: 1432819 - RNA, 19 nt, Homo sapiens
ugaggcaucccacaugaca

SEQ ID NO: 1432820 - RNA, 19 nt, Homo sapiens
acaaccagcuggaaaagau

SEQ ID NO: 1432821 - RNA, 19 nt, Homo sapiens
cugcugcacuuggagaaga

SEQ ID NO: 1432822 - RNA, 19 nt, Homo sapiens
gccaaacgcccugaucagu

SEQ ID NO: 1432823 - RNA, 19 nt, Homo sapiens
gaaggcguuugagcaucug

SEQ ID NO: 1432824 - RNA, 19 nt, Homo sapiens
ccaaaccaccacagucucu

SEQ ID NO: 1432825 - RNA, 19 nt, Homo sapiens
acacacaucacacccucaa

SEQ ID NO: 1432826 - RNA, 19 nt, Homo sapiens
ugacacgggcugacacagu

SEQ ID NO: 1432827 - RNA, 19 nt, Homo sapiens
ggggaucuuucucagguuu

SEQ ID NO: 1432828 - RNA, 19 nt, Homo sapiens
accuguacuuggccaauaa

SEQ ID NO: 1432829 - RNA, 19 nt, Homo sapiens
acgagggccuggacaacga

SEQ ID NO: 1432830 - RNA, 19 nt, Homo sapiens
gcaucugaccaaccucaau

SEQ ID NO: 1432831 - RNA, 19 nt, Homo sapiens
cuaggagacaccuuuguuc

SEQ ID NO: 1432832 - RNA, 19 nt, Homo sapiens
gaaaugguaucuaugauuc

SEQ ID NO: 1432833 - RNA, 19 nt, Homo sapiens
caacaaacuugaacaacuu

SEQ ID NO: 1432834 - RNA, 19 nt, Homo sapiens
ccacugaaauugaaaguau

SEQ ID NO: 1432835 - RNA, 19 nt, Homo sapiens
gcaacgaaaugaaauaaca

SEQ ID NO: 1432836 - RNA, 19 nt, Homo sapiens
ggagaaaucaugacagaaa

SEQ ID NO: 1432837 - RNA, 19 nt, Homo sapiens
gaagaaauggcaaaucuga

SEQ ID NO: 1432838 - RNA, 19 nt, Homo sapiens
gaacaugccugcccuugag

SEQ ID NO: 1432839 - RNA, 19 nt, Homo sapiens
ggugaauucucuaauguuu

SEQ ID NO: 1432840 - RNA, 19 nt, Homo sapiens
gaagaacgaguaagcuuaa

SEQ ID NO: 1432841 - RNA, 19 nt, Homo sapiens
gcaaucuacucuuaacuga

SEQ ID NO: 1432842 - RNA, 19 nt, Homo sapiens
ggaagaacgaguaagcuua

SEQ ID NO: 1432843 - RNA, 19 nt, Homo sapiens
ccaaggaacuaaguaauug

SEQ ID NO: 1432844 - RNA, 19 nt, Homo sapiens
caaacaaucagcaauauga

SEQ ID NO: 1432845 - RNA, 19 nt, Homo sapiens
gcaacaaacuugaacaacu

SEQ ID NO: 1432846 - RNA, 19 nt, Homo sapiens
gaaggaauuucaacacaag

SEQ ID NO: 1432847 - RNA, 19 nt, Homo sapiens
gagaaggaauuucaacaca

SEQ ID NO: 1432848 - RNA, 19 nt, Homo sapiens
caagaugcccuucuaaaga

SEQ ID NO: 1432849 - RNA, 19 nt, Homo sapiens
gagaagagcagaucaccaa

SEQ ID NO: 1432850 - RNA, 19 nt, Homo sapiens
gaagauggaagagucauuu

SEQ ID NO: 1432851 - RNA, 19 nt, Homo sapiens
gaaaagcuauuaccaaagu

SEQ ID NO: 1432852 - RNA, 19 nt, Homo sapiens
gaacaacuuccugauacua

SEQ ID NO: 1432853 - RNA, 19 nt, Homo sapiens
ggauuggacugcuuacuag

SEQ ID NO: 1432854 - RNA, 19 nt, Homo sapiens
uaaugaaguuggugacuau

SEQ ID NO: 1432855 - RNA, 19 nt, Homo sapiens
gagacaacccacugaaauu

SEQ ID NO: 1432856 - RNA, 19 nt, Homo sapiens
gaaacugaaucaacuacag

SEQ ID NO: 1432857 - RNA, 19 nt, Homo sapiens
gauagucgcuaacuuuggu

SEQ ID NO: 1432858 - RNA, 19 nt, Homo sapiens
ggacaugggaagcaacaaa

SEQ ID NO: 1432859 - RNA, 19 nt, Homo sapiens
ggauuacuuuggugaauuc

SEQ ID NO: 1432860 - RNA, 19 nt, Homo sapiens
ugaaucaacuacaggaaug

SEQ ID NO: 1432861 - RNA, 19 nt, Homo sapiens
guggagaaaucaugacaga

SEQ ID NO: 1432862 - RNA, 19 nt, Homo sapiens
gaauggcaacuucauagaa

SEQ ID NO: 1432863 - RNA, 19 nt, Homo sapiens
cacaagagcucagcaaucu

SEQ ID NO: 1432864 - RNA, 19 nt, Homo sapiens
ugucaaugcuguaaaggaa

SEQ ID NO: 1432865 - RNA, 19 nt, Homo sapiens
caagucaacgguucaacua

SEQ ID NO: 1432866 - RNA, 19 nt, Homo sapiens
gggauuggacugcuuacua

SEQ ID NO: 1432867 - RNA, 19 nt, Homo sapiens
cuacaggaauggcaacuuc

SEQ ID NO: 1432868 - RNA, 19 nt, Homo sapiens
gaucugggaagaacgagua

SEQ ID NO: 1432869 - RNA, 19 nt, Homo sapiens
ggaauuauuuggccuucag

SEQ ID NO: 1432870 - RNA, 19 nt, Homo sapiens
gaagaggaacgggaauuau

SEQ ID NO: 1432871 - RNA, 19 nt, Homo sapiens
ccucaaacaaucagcaaua

SEQ ID NO: 1432872 - RNA, 19 nt, Homo sapiens
acaacuuccugauacuaua

SEQ ID NO: 1432873 - RNA, 19 nt, Homo sapiens
gaagcgagagaaggaauuu

SEQ ID NO: 1432874 - RNA, 19 nt, Homo sapiens
cuaaugaaguuggugacua

SEQ ID NO: 1432875 - RNA, 19 nt, Homo sapiens
ugaauucucuaauguuugg

SEQ ID NO: 1432876 - RNA, 19 nt, Homo sapiens
cauaaauacggauggauaa

SEQ ID NO: 1432877 - RNA, 19 nt, Homo sapiens
gagcagaucaccaagucaa

SEQ ID NO: 1432878 - RNA, 19 nt, Homo sapiens
uggaagaaauggcaaaucu

SEQ ID NO: 1432879 - RNA, 19 nt, Homo sapiens
gaucugaguaugaacgauu

SEQ ID NO: 1432880 - RNA, 19 nt, Homo sapiens
gaggauuacuuuggugaau

SEQ ID NO: 1432881 - RNA, 19 nt, Homo sapiens
caacgguucaacuacuuua

SEQ ID NO: 1432882 - RNA, 19 nt, Homo sapiens
aaacuagaacuggcuguua

SEQ ID NO: 1432883 - RNA, 19 nt, Homo sapiens
gaaccucauuguguuagau

SEQ ID NO: 1432884 - RNA, 19 nt, Homo sapiens
gaacugguuugcugaaaau

SEQ ID NO: 1432885 - RNA, 19 nt, Homo sapiens
guaaaggaaguuugggaaa

SEQ ID NO: 1432886 - RNA, 19 nt, Homo sapiens
gguuaugugugucuauuca

SEQ ID NO: 1432887 - RNA, 19 nt, Homo sapiens
uuauuuggccuucaguuua

SEQ ID NO: 1432888 - RNA, 19 nt, Homo sapiens
aacuagaacuggcuguuaa

SEQ ID NO: 1432889 - RNA, 19 nt, Homo sapiens
agaaggaauuucaacacaa

SEQ ID NO: 1432890 - RNA, 19 nt, Homo sapiens
ggaauggcaacuucauaga

SEQ ID NO: 1432891 - RNA, 19 nt, Homo sapiens
ccagaaccucauuguguua

SEQ ID NO: 1432892 - RNA, 19 nt, Homo sapiens
auacaagagucacggagaa

SEQ ID NO: 1432893 - RNA, 19 nt, Homo sapiens
cagcaacaauaaacugcaa

SEQ ID NO: 1432894 - RNA, 19 nt, Homo sapiens
ucaacuacuuuaccaaucu

SEQ ID NO: 1432895 - RNA, 19 nt, Homo sapiens
gcacacauacauacaagag

SEQ ID NO: 1432896 - RNA, 19 nt, Homo sapiens
uauuuggccuucaguuuau

SEQ ID NO: 1432897 - RNA, 19 nt, Homo sapiens
agaggaacgggaauuauuu

SEQ ID NO: 1432898 - RNA, 19 nt, Homo sapiens
agaagaggaacgggaauua

SEQ ID NO: 1432899 - RNA, 19 nt, Homo sapiens
gcaagauauuccaguaugc

SEQ ID NO: 1432900 - RNA, 19 nt, Homo sapiens
auaacaugcuugccucaaa

SEQ ID NO: 1432901 - RNA, 19 nt, Homo sapiens
gagaaaucaugacagaaaa

SEQ ID NO: 1432902 - RNA, 19 nt, Homo sapiens
gaggaacgggaauuauuug

SEQ ID NO: 1432903 - RNA, 19 nt, Homo sapiens
ugaaggcacagaugaagaa

SEQ ID NO: 1432904 - RNA, 19 nt, Homo sapiens
uaacaugcuugccucaaac

SEQ ID NO: 1432905 - RNA, 19 nt, Homo sapiens
gaaacuagaacuggcuguu

SEQ ID NO: 1432906 - RNA, 19 nt, Homo sapiens
gaagagucauuuugaagau

SEQ ID NO: 1432907 - RNA, 19 nt, Homo sapiens
gaagagcagaucaccaagu

SEQ ID NO: 1432908 - RNA, 19 nt, Homo sapiens
ggaauuucaacacaagcua

SEQ ID NO: 1432909 - RNA, 19 nt, Homo sapiens
acaacccacugaaauugaa

SEQ ID NO: 1432910 - RNA, 19 nt, Homo sapiens
gacaacccacugaaauuga

SEQ ID NO: 1432911 - RNA, 19 nt, Homo sapiens
gcaacaauaaacugcaaga

SEQ ID NO: 1432912 - RNA, 19 nt, Homo sapiens
gagagaaggaauuucaaca

SEQ ID NO: 1432913 - RNA, 19 nt, Homo sapiens
ccucauuguguuagauuua

SEQ ID NO: 1432914 - RNA, 19 nt, Homo sapiens
ggaagauggaagagucauu

SEQ ID NO: 1432915 - RNA, 19 nt, Homo sapiens
uaaccaagcuaagagaaaa

SEQ ID NO: 1432916 - RNA, 19 nt, Homo sapiens
gaacgaguaagcuuaacca

SEQ ID NO: 1432917 - RNA, 19 nt, Homo sapiens
uaaaggaaguuugggaaaa

SEQ ID NO: 1432918 - RNA, 19 nt, Homo sapiens
aagaggaacgggaauuauu

SEQ ID NO: 1432919 - RNA, 19 nt, Homo sapiens
caguaugcauggaagaaau

SEQ ID NO: 1432920 - RNA, 19 nt, Homo sapiens
ugcaagauauuccaguaug

SEQ ID NO: 1432921 - RNA, 19 nt, Homo sapiens
uccagaaccucauuguguu

SEQ ID NO: 1432922 - RNA, 19 nt, Homo sapiens
gggaagaacgaguaagcuu

SEQ ID NO: 1432923 - RNA, 19 nt, Homo sapiens
aagaugcccuucuaaagag

SEQ ID NO: 1432924 - RNA, 19 nt, Homo sapiens
ucaagaugcccuucuaaag

SEQ ID NO: 1432925 - RNA, 19 nt, Homo sapiens
ucugaaaugguaucuauga

SEQ ID NO: 1432926 - RNA, 19 nt, Homo sapiens
ccagggauuggacugcuua

SEQ ID NO: 1432927 - RNA, 19 nt, Homo sapiens
ccagugaaggcacagauga

SEQ ID NO: 1432928 - RNA, 19 nt, Homo sapiens
agacaacccacugaaauug

SEQ ID NO: 1432929 - RNA, 19 nt, Homo sapiens
gcugcaacgaaaugaaaua

SEQ ID NO: 1432930 - RNA, 19 nt, Homo sapiens
uuacuagacuucaggaacu

SEQ ID NO: 1432931 - RNA, 19 nt, Homo sapiens
agagauaccaccagggauu

SEQ ID NO: 1432932 - RNA, 19 nt, Homo sapiens
ggagggagguugauagcua

SEQ ID NO: 1432933 - RNA, 19 nt, Homo sapiens
gaugcuggcuuccucuaua

SEQ ID NO: 1432934 - RNA, 19 nt, Homo sapiens
gaugggaacucuguccuaa

SEQ ID NO: 1432935 - RNA, 19 nt, Homo sapiens
cuacaaggauuaugacaug

SEQ ID NO: 1432936 - RNA, 19 nt, Homo sapiens
ggaacucuguccuaaugaa

SEQ ID NO: 1432937 - RNA, 19 nt, Homo sapiens
ugaguggcgugaacaagua

SEQ ID NO: 1432938 - RNA, 19 nt, Homo sapiens
guauaugucaaaccucuua

SEQ ID NO: 1432939 - RNA, 19 nt, Homo sapiens
gcagguagcacccagguau

SEQ ID NO: 1432940 - RNA, 19 nt, Homo sapiens
gcaagcaccaccugaaaca

SEQ ID NO: 1432941 - RNA, 19 nt, Homo sapiens
ugggaacucuguccuaaug

SEQ ID NO: 1432942 - RNA, 19 nt, Homo sapiens
ggacacagccagcaugaac

SEQ ID NO: 1432943 - RNA, 19 nt, Homo sapiens
gggaaugccuacccgauac

SEQ ID NO: 1432944 - RNA, 19 nt, Homo sapiens
ggucuucaccuacuucaug

SEQ ID NO: 1432945 - RNA, 19 nt, Homo sapiens
gcgcaagcaccaccugaaa

SEQ ID NO: 1432946 - RNA, 19 nt, Homo sapiens
gcagguggguauccauaac

SEQ ID NO: 1432947 - RNA, 19 nt, Homo sapiens
agaaggacuuugucugcaa

SEQ ID NO: 1432948 - RNA, 19 nt, Homo sapiens
ggcaacaguauaugucaaa

SEQ ID NO: 1432949 - RNA, 19 nt, Homo sapiens
gauacgugcccaccauaug

SEQ ID NO: 1432950 - RNA, 19 nt, Homo sapiens
ggacugugguggacguacu

SEQ ID NO: 1432951 - RNA, 19 nt, Homo sapiens
ggaugggaacucuguccua

SEQ ID NO: 1432952 - RNA, 19 nt, Homo sapiens
cagcaugaacugggcauuu

SEQ ID NO: 1432953 - RNA, 19 nt, Homo sapiens
gaacucuguccuaaugaag

SEQ ID NO: 1432954 - RNA, 19 nt, Homo sapiens
gcaagaggugcauggagau

SEQ ID NO: 1432955 - RNA, 19 nt, Homo sapiens
gagcagaaggacuuugucu

SEQ ID NO: 1432956 - RNA, 19 nt, Homo sapiens
acgacaaccugagcaagaa

SEQ ID NO: 1432957 - RNA, 19 nt, Homo sapiens
uccauaaccugcgagauca

SEQ ID NO: 1432958 - RNA, 19 nt, Homo sapiens
agaggugcauggagaucuu

SEQ ID NO: 1432959 - RNA, 19 nt, Homo sapiens
gcaacaguauaugucaaac

SEQ ID NO: 1432960 - RNA, 19 nt, Homo sapiens
cgagaucagcagauaagau

SEQ ID NO: 1432961 - RNA, 19 nt, Homo sapiens
cagguagcacccagguaua

SEQ ID NO: 1432962 - RNA, 19 nt, Homo sapiens
caugaggccacccaggaaa

SEQ ID NO: 1432963 - RNA, 19 nt, Homo sapiens
caccgccucuacaaggauu

SEQ ID NO: 1432964 - RNA, 19 nt, Homo sapiens
ugucugugguguucaucuu

SEQ ID NO: 1432965 - RNA, 19 nt, Homo sapiens
uggcaacaguauaugucaa

SEQ ID NO: 1432966 - RNA, 19 nt, Homo sapiens
cagcagauaagaucaacag

SEQ ID NO: 1432967 - RNA, 19 nt, Homo sapiens
ccacagcugccaucugcau

SEQ ID NO: 1432968 - RNA, 19 nt, Homo sapiens
uacgacaaccugagcaaga

SEQ ID NO: 1432969 - RNA, 19 nt, Homo sapiens
gauagcuacuggggauuuu

SEQ ID NO: 1432970 - RNA, 19 nt, Homo sapiens
caggacacagccagcauga

SEQ ID NO: 1432971 - RNA, 19 nt, Homo sapiens
ggaugcuggcuuccucuau

SEQ ID NO: 1432972 - RNA, 19 nt, Homo sapiens
agcaugaacugggcauuuc

SEQ ID NO: 1432973 - RNA, 19 nt, Homo sapiens
acgaugagcagaaggacuu

SEQ ID NO: 1432974 - RNA, 19 nt, Homo sapiens
gggacgaugagcagaagga

SEQ ID NO: 1432975 - RNA, 19 nt, Homo sapiens
guacagcacuuucuagauu

SEQ ID NO: 1432976 - RNA, 19 nt, Homo sapiens
gaaaagaaauccagcuaaa

SEQ ID NO: 1432977 - RNA, 19 nt, Homo sapiens
aggcaaaugucucuucuua

SEQ ID NO: 1432978 - RNA, 19 nt, Homo sapiens
cgacagaccuggagaagca

SEQ ID NO: 1432979 - RNA, 19 nt, Homo sapiens
gcugauggauccaguuuga

SEQ ID NO: 1432980 - RNA, 19 nt, Homo sapiens
gcaaaugucucuucuuacg

SEQ ID NO: 1432981 - RNA, 19 nt, Homo sapiens
gaagcacccuuaugagcaa

SEQ ID NO: 1432982 - RNA, 19 nt, Homo sapiens
gaagaaguaccgaauguca

SEQ ID NO: 1432983 - RNA, 19 nt, Homo sapiens
guaccuacguuggcuuuaa

SEQ ID NO: 1432984 - RNA, 19 nt, Homo sapiens
guaaugccaggaagaagua

SEQ ID NO: 1432985 - RNA, 19 nt, Homo sapiens
aaaugucucuucuuacguu

SEQ ID NO: 1432986 - RNA, 19 nt, Homo sapiens
ucgaggaacuugaacucua

SEQ ID NO: 1432987 - RNA, 19 nt, Homo sapiens
gaacucuaccguaaacaau

SEQ ID NO: 1432988 - RNA, 19 nt, Homo sapiens
gggaagauguggucaacag

SEQ ID NO: 1432989 - RNA, 19 nt, Homo sapiens
ucuagaaaguguucggaaa

SEQ ID NO: 1432990 - RNA, 19 nt, Homo sapiens
gagcugauggauccaguuu

SEQ ID NO: 1432991 - RNA, 19 nt, Homo sapiens
uggagaagcacccuuauga

SEQ ID NO: 1432992 - RNA, 19 nt, Homo sapiens
aaauccagcuaaagccuaa

SEQ ID NO: 1432993 - RNA, 19 nt, Homo sapiens
guacuucgaggaacuugaa

SEQ ID NO: 1432994 - RNA, 19 nt, Homo sapiens
ccugagagcuaaguacuuc

SEQ ID NO: 1432995 - RNA, 19 nt, Homo sapiens
ugaauuauguuggcaagag

SEQ ID NO: 1432996 - RNA, 19 nt, Homo sapiens
uaccuacguuggcuuuaaa

SEQ ID NO: 1432997 - RNA, 19 nt, Homo sapiens
aaggugaacuuacgaacau

SEQ ID NO: 1432998 - RNA, 19 nt, Homo sapiens
aacuugaacucuaccguaa

SEQ ID NO: 1432999 - RNA, 19 nt, Homo sapiens
gcagccaaguaccuacguu

SEQ ID NO: 1433000 - RNA, 19 nt, Homo sapiens
aggaagaaguaccgaaugu

SEQ ID NO: 1433001 - RNA, 19 nt, Homo sapiens
cgaggaacuugaacucuac

SEQ ID NO: 1433002 - RNA, 19 nt, Homo sapiens
ccacuaugcucagcugaag

SEQ ID NO: 1433003 - RNA, 19 nt, Homo sapiens
uacguuggcuuuaaagagu

SEQ ID NO: 1433004 - RNA, 19 nt, Homo sapiens
ugauggauccaguuugaaa

SEQ ID NO: 1433005 - RNA, 19 nt, Homo sapiens
uaaggcaaaugucucuucu

SEQ ID NO: 1433006 - RNA, 19 nt, Homo sapiens
uaccgaaugucagcuagaa

SEQ ID NO: 1433007 - RNA, 19 nt, Homo sapiens
ggaaaagaaauccagcuaa

SEQ ID NO: 1433008 - RNA, 19 nt, Homo sapiens
caucauccuuccuacucuu

SEQ ID NO: 1433009 - RNA, 19 nt, Homo sapiens
uacagcacuuucuagauug

SEQ ID NO: 1433010 - RNA, 19 nt, Homo sapiens
caggaagaaaugaugaauu

SEQ ID NO: 1433011 - RNA, 19 nt, Homo sapiens
gaacaugggaaaagaaauc

SEQ ID NO: 1433012 - RNA, 19 nt, Homo sapiens
gcacccuuaugagcaaaga

SEQ ID NO: 1433013 - RNA, 19 nt, Homo sapiens
ggagaagcacccuuaugag

SEQ ID NO: 1433014 - RNA, 19 nt, Homo sapiens
aaaauucgcugcaaguaca

SEQ ID NO: 1433015 - RNA, 19 nt, Homo sapiens
aaagaaauccagcuaaagc

SEQ ID NO: 1433016 - RNA, 19 nt, Homo sapiens
ccagacggccuccaucauc

SEQ ID NO: 1433017 - RNA, 19 nt, Homo sapiens
cuaaguacuucgaggaacu

SEQ ID NO: 1433018 - RNA, 19 nt, Homo sapiens
ccaggaagaaguaccgaau

SEQ ID NO: 1433019 - RNA, 19 nt, Homo sapiens
gcugaauuacagaaacaaa

SEQ ID NO: 1433020 - RNA, 19 nt, Homo sapiens
ugaaaaggccaaauaugaa

SEQ ID NO: 1433021 - RNA, 19 nt, Homo sapiens
ugaacucuaccguaaacaa

SEQ ID NO: 1433022 - RNA, 19 nt, Homo sapiens
gaaaaggccaaauaugaag

SEQ ID NO: 1433023 - RNA, 19 nt, Homo sapiens
ggaagaaguaccgaauguc

SEQ ID NO: 1433024 - RNA, 19 nt, Homo sapiens
uaccguaaacaauguaaug

SEQ ID NO: 1433025 - RNA, 19 nt, Homo sapiens
acagaaacaaauucaagga

SEQ ID NO: 1433026 - RNA, 19 nt, Homo sapiens
caauguaaugccaggaaga

SEQ ID NO: 1433027 - RNA, 19 nt, Homo sapiens
acucuaccguaaacaaugu

SEQ ID NO: 1433028 - RNA, 19 nt, Homo sapiens
caaagcccgauaccaggaa

SEQ ID NO: 1433029 - RNA, 19 nt, Homo sapiens
cagggaagauguggucaac

SEQ ID NO: 1433030 - RNA, 19 nt, Homo sapiens
aaaggugaacuuacgaaca

SEQ ID NO: 1433031 - RNA, 19 nt, Homo sapiens
uggccaaacucgacaaagc

SEQ ID NO: 1433032 - RNA, 19 nt, Homo sapiens
gcaugaaaaggccaaauau

SEQ ID NO: 1433033 - RNA, 19 nt, Homo sapiens
cuaaggcaaaugucucuuc

SEQ ID NO: 1433034 - RNA, 19 nt, Homo sapiens
cuugaacucuaccguaaac

SEQ ID NO: 1433035 - RNA, 19 nt, Homo sapiens
gauggaagcuguaaucaca

SEQ ID NO: 1433036 - RNA, 19 nt, Homo sapiens
ugaaagagaucucagacuu

SEQ ID NO: 1433037 - RNA, 19 nt, Homo sapiens
gacagagaaugcaacaaua

SEQ ID NO: 1433038 - RNA, 19 nt, Homo sapiens
ggaggcggcuguggaguua

SEQ ID NO: 1433039 - RNA, 19 nt, Homo sapiens
gaaaaggagugaaaauuga

SEQ ID NO: 1433040 - RNA, 19 nt, Homo sapiens
gcagugaccuagagaguuc

SEQ ID NO: 1433041 - RNA, 19 nt, Homo sapiens
ggguagagauuuauguauu

SEQ ID NO: 1433042 - RNA, 19 nt, Homo sapiens
ggacugcgguuaugcuguu

SEQ ID NO: 1433043 - RNA, 19 nt, Homo sapiens
cacaauuucuuaccagaua

SEQ ID NO: 1433044 - RNA, 19 nt, Homo sapiens
ggacagagaaugcaacaau

SEQ ID NO: 1433045 - RNA, 19 nt, Homo sapiens
gcccgaagcuaacuuguga

SEQ ID NO: 1433046 - RNA, 19 nt, Homo sapiens
gugcauacauuaucaagau

SEQ ID NO: 1433047 - RNA, 19 nt, Homo sapiens
acagauggacuuaguguua

SEQ ID NO: 1433048 - RNA, 19 nt, Homo sapiens
gaaagagaucucagacuug

SEQ ID NO: 1433049 - RNA, 19 nt, Homo sapiens
ggagagcccucaagaaucc

SEQ ID NO: 1433050 - RNA, 19 nt, Homo sapiens
gggaaaauauagcagguua

SEQ ID NO: 1433051 - RNA, 19 nt, Homo sapiens
gaauucuguuggcuuugua

SEQ ID NO: 1433052 - RNA, 19 nt, Homo sapiens
ucauuggcauuccuguuua

SEQ ID NO: 1433053 - RNA, 19 nt, Homo sapiens
ggcagagaaugaagaagaa

SEQ ID NO: 1433054 - RNA, 19 nt, Homo sapiens
gcagauauggcauccaaau

SEQ ID NO: 1433055 - RNA, 19 nt, Homo sapiens
ucaaagaguguacauaugu

SEQ ID NO: 1433056 - RNA, 19 nt, Homo sapiens
gaaugcuccuguucugaga

SEQ ID NO: 1433057 - RNA, 19 nt, Homo sapiens
cagcaaaccuugggacauc

SEQ ID NO: 1433058 - RNA, 19 nt, Homo sapiens
caacagagggcccagacuu

SEQ ID NO: 1433059 - RNA, 19 nt, Homo sapiens
gauauggcccgucaacaga

SEQ ID NO: 1433060 - RNA, 19 nt, Homo sapiens
ggaaaaggagugaaaauug

SEQ ID NO: 1433061 - RNA, 19 nt, Homo sapiens
ccaaaucagacaugcgaua

SEQ ID NO: 1433062 - RNA, 19 nt, Homo sapiens
gcccagacuuuacgaguuc

SEQ ID NO: 1433063 - RNA, 19 nt, Homo sapiens
guauugagcacuaguggaa

SEQ ID NO: 1433064 - RNA, 19 nt, Homo sapiens
gcaguuaguguugguauug

SEQ ID NO: 1433065 - RNA, 19 nt, Homo sapiens
aagcagauauggcauccaa

SEQ ID NO: 1433066 - RNA, 19 nt, Homo sapiens
guguguauauugaaugcua

SEQ ID NO: 1433067 - RNA, 19 nt, Homo sapiens
ccaaacacaagaggaauuu

SEQ ID NO: 1433068 - RNA, 19 nt, Homo sapiens
gagggaagguugccagacu

SEQ ID NO: 1433069 - RNA, 19 nt, Homo sapiens
ccauggagccguaagaaga

SEQ ID NO: 1433070 - RNA, 19 nt, Homo sapiens
cugagaagcacacuuguaa

SEQ ID NO: 1433071 - RNA, 19 nt, Homo sapiens
uggagaagccagaguauga

SEQ ID NO: 1433072 - RNA, 19 nt, Homo sapiens
ccucaagaaucccagcauu

SEQ ID NO: 1433073 - RNA, 19 nt, Homo sapiens
gucaaagaguguacauaug

SEQ ID NO: 1433074 - RNA, 19 nt, Homo sapiens
ggaaugaaugcuccuguuc

SEQ ID NO: 1433075 - RNA, 19 nt, Homo sapiens
cagauggacuuaguguuau

SEQ ID NO: 1433076 - RNA, 19 nt, Homo sapiens
gccagaguaugaaguggaa

SEQ ID NO: 1433077 - RNA, 19 nt, Homo sapiens
gagcccaagugcccauaug

SEQ ID NO: 1433078 - RNA, 19 nt, Homo sapiens
gaaugcaacaauauggaaa

SEQ ID NO: 1433079 - RNA, 19 nt, Homo sapiens
acagagggcccagacuuua

SEQ ID NO: 1433080 - RNA, 19 nt, Homo sapiens
ugucaaagaguguacauau

SEQ ID NO: 1433081 - RNA, 19 nt, Homo sapiens
gaagccagaguaugaagug

SEQ ID NO: 1433082 - RNA, 19 nt, Homo sapiens
cauaaucaguuccuacaac

SEQ ID NO: 1433083 - RNA, 19 nt, Homo sapiens
uggcauuccuguuuauguu

SEQ ID NO: 1433084 - RNA, 19 nt, Homo sapiens
ugugaauucuguuggcuuu

SEQ ID NO: 1433085 - RNA, 19 nt, Homo sapiens
acacuucaggucucaguua

SEQ ID NO: 1433086 - RNA, 19 nt, Homo sapiens
gagaagcacacuuguaacu

SEQ ID NO: 1433087 - RNA, 19 nt, Homo sapiens
aaauauagcagguuagaag

SEQ ID NO: 1433088 - RNA, 19 nt, Homo sapiens
ugaagaugaugguccaauc

SEQ ID NO: 1433089 - RNA, 19 nt, Homo sapiens
gaaugaagaagaagguagu

SEQ ID NO: 1433090 - RNA, 19 nt, Homo sapiens
gagaaugcaacaauaugga

SEQ ID NO: 1433091 - RNA, 19 nt, Homo sapiens
ggcccagacuuuacgaguu

SEQ ID NO: 1433092 - RNA, 19 nt, Homo sapiens
cagcgaaacggccagcuuu

SEQ ID NO: 1433093 - RNA, 19 nt, Homo sapiens
gcauacauuaucaagauga

SEQ ID NO: 1433094 - RNA, 19 nt, Homo sapiens
gauauggcauccaaaucag

SEQ ID NO: 1433095 - RNA, 19 nt, Homo sapiens
aguaugaaguggaaugaau

SEQ ID NO: 1433096 - RNA, 19 nt, Homo sapiens
ggagaagccagaguaugaa

SEQ ID NO: 1433097 - RNA, 19 nt, Homo sapiens
gaagccagaagguggagaa

SEQ ID NO: 1433098 - RNA, 19 nt, Homo sapiens
uauagcagguuagaaguuc

SEQ ID NO: 1433099 - RNA, 19 nt, Homo sapiens
gucauuggcauuccuguuu

SEQ ID NO: 1433100 - RNA, 19 nt, Homo sapiens
caaaucagacaugcgauau

SEQ ID NO: 1433101 - RNA, 19 nt, Homo sapiens
caagaggaauuuggcuauc

SEQ ID NO: 1433102 - RNA, 19 nt, Homo sapiens
ggaagauucacagcaggua

SEQ ID NO: 1433103 - RNA, 19 nt, Homo sapiens
cagcugggcacguugauug

SEQ ID NO: 1433104 - RNA, 19 nt, Homo sapiens
aaacacacuucaggucuca

SEQ ID NO: 1433105 - RNA, 19 nt, Homo sapiens
gaagauucacagcagguau

SEQ ID NO: 1433106 - RNA, 19 nt, Homo sapiens
aaucagacaugcgauaugg

SEQ ID NO: 1433107 - RNA, 19 nt, Homo sapiens
ugccagacaucaccucaga

SEQ ID NO: 1433108 - RNA, 19 nt, Homo sapiens
gaagguugccagacugagu

SEQ ID NO: 1433109 - RNA, 19 nt, Homo sapiens
ugaauucuguuggcuuugu

SEQ ID NO: 1433110 - RNA, 19 nt, Homo sapiens
caugaggugugucaaagag

SEQ ID NO: 1433111 - RNA, 19 nt, Homo sapiens
caugaaaaguuugccguua

SEQ ID NO: 1433112 - RNA, 19 nt, Homo sapiens
gaaugaaugcuccuguucu

SEQ ID NO: 1433113 - RNA, 19 nt, Homo sapiens
agauauggcauccaaauca

SEQ ID NO: 1433114 - RNA, 19 nt, Homo sapiens
gaaggccugacuaguguau

SEQ ID NO: 1433115 - RNA, 19 nt, Homo sapiens
uugaaggccugacuagugu

SEQ ID NO: 1433116 - RNA, 19 nt, Homo sapiens
uggaaugaaugcuccuguu

SEQ ID NO: 1433117 - RNA, 19 nt, Homo sapiens
gcagacaccaaagcuguga

SEQ ID NO: 1433118 - RNA, 19 nt, Homo sapiens
gagaaugaagaagaaggua

SEQ ID NO: 1433119 - RNA, 19 nt, Homo sapiens
gauggcagagaaugaagaa

SEQ ID NO: 1433120 - RNA, 19 nt, Homo sapiens
acagagaaugcaacaauau

SEQ ID NO: 1433121 - RNA, 19 nt, Homo sapiens
gaaaauauagcagguuaga

SEQ ID NO: 1433122 - RNA, 19 nt, Homo sapiens
ccaguuauugcugcaguua

SEQ ID NO: 1433123 - RNA, 19 nt, Homo sapiens
ucuguuggcuuuguaugaa

SEQ ID NO: 1433124 - RNA, 19 nt, Homo sapiens
uggcagagaaugaagaaga

SEQ ID NO: 1433125 - RNA, 19 nt, Homo sapiens
ggacauugaagccaaacca

SEQ ID NO: 1433126 - RNA, 19 nt, Homo sapiens
guugugcccauuucucuuu

SEQ ID NO: 1433127 - RNA, 19 nt, Homo sapiens
gaaggaaaaccuccaaaca

SEQ ID NO: 1433128 - RNA, 19 nt, Homo sapiens
ccaaaccaagccacuauca

SEQ ID NO: 1433129 - RNA, 19 nt, Homo sapiens
cagagaaugcaacaauaug

SEQ ID NO: 1433130 - RNA, 19 nt, Homo sapiens
uggaagcuguaaucacaug

SEQ ID NO: 1433131 - RNA, 19 nt, Homo sapiens
guaugaaguggaaugaaug

SEQ ID NO: 1433132 - RNA, 19 nt, Homo sapiens
uggaagcccuacagaugga

SEQ ID NO: 1433133 - RNA, 19 nt, Homo sapiens
cuggagagcccucaagaau

SEQ ID NO: 1433134 - RNA, 19 nt, Homo sapiens
aagaggaauuuggcuauca

SEQ ID NO: 1433135 - RNA, 19 nt, Homo sapiens
gcaaggaacagguauaaua

SEQ ID NO: 1433136 - RNA, 19 nt, Homo sapiens
gagcagcauucauaaauuu

SEQ ID NO: 1433137 - RNA, 19 nt, Homo sapiens
ggucaucccucgacauuug

SEQ ID NO: 1433138 - RNA, 19 nt, Homo sapiens
gaucgggucucauuauguu

SEQ ID NO: 1433139 - RNA, 19 nt, Homo sapiens
ggaauuugaugcugaugaa

SEQ ID NO: 1433140 - RNA, 19 nt, Homo sapiens
caauggagaugcaauccua

SEQ ID NO: 1433141 - RNA, 19 nt, Homo sapiens
caaggaacagguauaauaa

SEQ ID NO: 1433142 - RNA, 19 nt, Homo sapiens
ggaagcaguucuccacguu

SEQ ID NO: 1433143 - RNA, 19 nt, Homo sapiens
gaagugaugucggcugcua

SEQ ID NO: 1433144 - RNA, 19 nt, Homo sapiens
gcacauccguucacacaca

SEQ ID NO: 1433145 - RNA, 19 nt, Homo sapiens
gagaugcaauccuauuaug

SEQ ID NO: 1433146 - RNA, 19 nt, Homo sapiens
ucaaggaucugaugucaca

SEQ ID NO: 1433147 - RNA, 19 nt, Homo sapiens
gaagaugggucugcugauc

SEQ ID NO: 1433148 - RNA, 19 nt, Homo sapiens
gaaguacgaacaucugauu

SEQ ID NO: 1433149 - RNA, 19 nt, Homo sapiens
gacaaugacuggccaaucu

SEQ ID NO: 1433150 - RNA, 19 nt, Homo sapiens
gaaaggcccuauccauguc

SEQ ID NO: 1433151 - RNA, 19 nt, Homo sapiens
gcugcuagcuuccuucaga

SEQ ID NO: 1433152 - RNA, 19 nt, Homo sapiens
ccaaagugcuggcauuaca

SEQ ID NO: 1433153 - RNA, 19 nt, Homo sapiens
gaagcugaacaacaucuua

SEQ ID NO: 1433154 - RNA, 19 nt, Homo sapiens
gaagaacaagcacagauug

SEQ ID NO: 1433155 - RNA, 19 nt, Homo sapiens
ggagaggacucaggugaug

SEQ ID NO: 1433156 - RNA, 19 nt, Homo sapiens
gaacaagcacagauugaug

SEQ ID NO: 1433157 - RNA, 19 nt, Homo sapiens
ggagaacauucacgaguca

SEQ ID NO: 1433158 - RNA, 19 nt, Homo sapiens
ugaaugacguggugaacuu

SEQ ID NO: 1433159 - RNA, 19 nt, Homo sapiens
gauccuauguggagauugu

SEQ ID NO: 1433160 - RNA, 19 nt, Homo sapiens
gccgaaagauggagaagga

SEQ ID NO: 1433161 - RNA, 19 nt, Homo sapiens
gagcaaggaacagguauaa

SEQ ID NO: 1433162 - RNA, 19 nt, Homo sapiens
gaaugugauugaagugaug

SEQ ID NO: 1433163 - RNA, 19 nt, Homo sapiens
caaggaaagaguccauuaa

SEQ ID NO: 1433164 - RNA, 19 nt, Homo sapiens
ccaaggaaagaguccauua

SEQ ID NO: 1433165 - RNA, 19 nt, Homo sapiens
guggugaacuucugcaaga

SEQ ID NO: 1433166 - RNA, 19 nt, Homo sapiens
ccagcuaccugcagaugaa

SEQ ID NO: 1433167 - RNA, 19 nt, Homo sapiens
gggagaaugugauugaagu

SEQ ID NO: 1433168 - RNA, 19 nt, Homo sapiens
gagauaaggauuccagaug

SEQ ID NO: 1433169 - RNA, 19 nt, Homo sapiens
ggucaaggaucugauguca

SEQ ID NO: 1433170 - RNA, 19 nt, Homo sapiens
ccaucaagcuccacaagug

SEQ ID NO: 1433171 - RNA, 19 nt, Homo sapiens
ggaacccgcuggaagagau

SEQ ID NO: 1433172 - RNA, 19 nt, Homo sapiens
gagugaagaugagaauaga

SEQ ID NO: 1433173 - RNA, 19 nt, Homo sapiens
ggagcugaaugaacagaga

SEQ ID NO: 1433174 - RNA, 19 nt, Homo sapiens
guacgaacaucugauucuu

SEQ ID NO: 1433175 - RNA, 19 nt, Homo sapiens
ggaguacaguggcaugauc

SEQ ID NO: 1433176 - RNA, 19 nt, Homo sapiens
acagauugaugcugaaaug

SEQ ID NO: 1433177 - RNA, 19 nt, Homo sapiens
ccagaagaauacucaacaa

SEQ ID NO: 1433178 - RNA, 19 nt, Homo sapiens
gcgcaggcaagauguauuu

SEQ ID NO: 1433179 - RNA, 19 nt, Homo sapiens
gagcagcgcaggcaagaug

SEQ ID NO: 1433180 - RNA, 19 nt, Homo sapiens
ggagaaaggcccuauccau

SEQ ID NO: 1433181 - RNA, 19 nt, Homo sapiens
uggaagagauacagguuug

SEQ ID NO: 1433182 - RNA, 19 nt, Homo sapiens
ggagaugcaauccuauuau

SEQ ID NO: 1433183 - RNA, 19 nt, Homo sapiens
ugacugcaguauucuaguu

SEQ ID NO: 1433184 - RNA, 19 nt, Homo sapiens
gagguucacucgacaagag

SEQ ID NO: 1433185 - RNA, 19 nt, Homo sapiens
gaucuccucucaucagucu

SEQ ID NO: 1433186 - RNA, 19 nt, Homo sapiens
agauaaagaugccaauucu

SEQ ID NO: 1433187 - RNA, 19 nt, Homo sapiens
uaucuuggacuucguauau

SEQ ID NO: 1433188 - RNA, 19 nt, Homo sapiens
cagcuacauuucaggcuuu

SEQ ID NO: 1433189 - RNA, 19 nt, Homo sapiens
caagagcagcauucauaaa

SEQ ID NO: 1433190 - RNA, 19 nt, Homo sapiens
cgaugaugaugaugauuug

SEQ ID NO: 1433191 - RNA, 19 nt, Homo sapiens
uaaugagugucuugcagaa

SEQ ID NO: 1433192 - RNA, 19 nt, Homo sapiens
caauucaccaggcauguaa

SEQ ID NO: 1433193 - RNA, 19 nt, Homo sapiens
ucauaaauuuccagaaugg

SEQ ID NO: 1433194 - RNA, 19 nt, Homo sapiens
agagcagcauucauaaauu

SEQ ID NO: 1433195 - RNA, 19 nt, Homo sapiens
gacuuagaaucuucccuuu

SEQ ID NO: 1433196 - RNA, 19 nt, Homo sapiens
agacauacauuaggucauc

SEQ ID NO: 1433197 - RNA, 19 nt, Homo sapiens
ugagugucuugcagaauuu

SEQ ID NO: 1433198 - RNA, 19 nt, Homo sapiens
guaaacucaucugcagaaa

SEQ ID NO: 1433199 - RNA, 19 nt, Homo sapiens
gauaaagaugccaauucua

SEQ ID NO: 1433200 - RNA, 19 nt, Homo sapiens
agacaauccuccaaacaca

SEQ ID NO: 1433201 - RNA, 19 nt, Homo sapiens
ggcaaacugucucuuacug

SEQ ID NO: 1433202 - RNA, 19 nt, Homo sapiens
cuucguauauucuggcaaa

SEQ ID NO: 1433203 - RNA, 19 nt, Homo sapiens
gaccaucacuuuucuagga

SEQ ID NO: 1433204 - RNA, 19 nt, Homo sapiens
gauuccagauggcacuuga

SEQ ID NO: 1433205 - RNA, 19 nt, Homo sapiens
aaacucaucugcagaaaau

SEQ ID NO: 1433206 - RNA, 19 nt, Homo sapiens
caccaggcauguaaacuca

SEQ ID NO: 1433207 - RNA, 19 nt, Homo sapiens
ugaagaacaagcacagauu

SEQ ID NO: 1433208 - RNA, 19 nt, Homo sapiens
uucaagagcagcauucaua

SEQ ID NO: 1433209 - RNA, 19 nt, Homo sapiens
gcaacuaccacgugaagca

SEQ ID NO: 1433210 - RNA, 19 nt, Homo sapiens
gagaaguacgaacaucuga

SEQ ID NO: 1433211 - RNA, 19 nt, Homo sapiens
cauccagccucccagaaga

SEQ ID NO: 1433212 - RNA, 19 nt, Homo sapiens
guguagaacguuccucuuu

SEQ ID NO: 1433213 - RNA, 19 nt, Homo sapiens
ucaagagcagcauucauaa

SEQ ID NO: 1433214 - RNA, 19 nt, Homo sapiens
gaaaagagcgacacagaca

SEQ ID NO: 1433215 - RNA, 19 nt, Homo sapiens
accagaaggugcaggagua

SEQ ID NO: 1433216 - RNA, 19 nt, Homo sapiens
cuuggaagcugaacaacau

SEQ ID NO: 1433217 - RNA, 19 nt, Homo sapiens
aaauguaaacgucauguga

SEQ ID NO: 1433218 - RNA, 19 nt, Homo sapiens
cuaaagcgccaccuucguu

SEQ ID NO: 1433219 - RNA, 19 nt, Homo sapiens
agacauuagugagaaagaa

SEQ ID NO: 1433220 - RNA, 19 nt, Homo sapiens
ggagguggacguuggugaa

SEQ ID NO: 1433221 - RNA, 19 nt, Homo sapiens
gaacugguggugagagaca

SEQ ID NO: 1433222 - RNA, 19 nt, Homo sapiens
gagaaugugauugaaguga

SEQ ID NO: 1433223 - RNA, 19 nt, Homo sapiens
agaaaggcccuauccaugu

SEQ ID NO: 1433224 - RNA, 19 nt, Homo sapiens
caaacgagaaguacgaaca

SEQ ID NO: 1433225 - RNA, 19 nt, Homo sapiens
aaggaaagaguccauuaaa

SEQ ID NO: 1433226 - RNA, 19 nt, Homo sapiens
cagauaaagaugccaauuc

SEQ ID NO: 1433227 - RNA, 19 nt, Homo sapiens
gacauuagugagaaagaaa

SEQ ID NO: 1433228 - RNA, 19 nt, Homo sapiens
cagacuguuugacuuagaa

SEQ ID NO: 1433229 - RNA, 19 nt, Homo sapiens
ggaaggaagaccagaaggu

SEQ ID NO: 1433230 - RNA, 19 nt, Homo sapiens
gcacagauugaugcugaaa

SEQ ID NO: 1433231 - RNA, 19 nt, Homo sapiens
ggaacagguauaauaagug

SEQ ID NO: 1433232 - RNA, 19 nt, Homo sapiens
aaagaugccaauucuaaug

SEQ ID NO: 1433233 - RNA, 19 nt, Homo sapiens
cuucaaagcacaucgaaau

SEQ ID NO: 1433234 - RNA, 19 nt, Homo sapiens
gcuggaacccgcuggaaga

SEQ ID NO: 1433235 - RNA, 19 nt, Homo sapiens
ugacagcacuggcuacaua

SEQ ID NO: 1433236 - RNA, 19 nt, Homo sapiens
gacaauaucuacaucacua

SEQ ID NO: 1433237 - RNA, 19 nt, Homo sapiens
cuggagaccuucaaccuua

SEQ ID NO: 1433238 - RNA, 19 nt, Homo sapiens
caaggcaacaucaguauuu

SEQ ID NO: 1433239 - RNA, 19 nt, Homo sapiens
aaucauggauggugugaaa

SEQ ID NO: 1433240 - RNA, 19 nt, Homo sapiens
gcaggagccucucaaugga

SEQ ID NO: 1433241 - RNA, 19 nt, Homo sapiens
gggcaacccuuaccugaag

SEQ ID NO: 1433242 - RNA, 19 nt, Homo sapiens
cuacaucacuagccgauuc

SEQ ID NO: 1433243 - RNA, 19 nt, Homo sapiens
ggagacaggcagacauuug

SEQ ID NO: 1433244 - RNA, 19 nt, Homo sapiens
gaaccagaccgccgaagug

SEQ ID NO: 1433245 - RNA, 19 nt, Homo sapiens
ccaaagucaugaaggaugu

SEQ ID NO: 1433246 - RNA, 19 nt, Homo sapiens
ggccuaugcuucuucauca

SEQ ID NO: 1433247 - RNA, 19 nt, Homo sapiens
cagcagcccuuaccugaag

SEQ ID NO: 1433248 - RNA, 19 nt, Homo sapiens
gagcaggcaugguuauugc

SEQ ID NO: 1433249 - RNA, 19 nt, Homo sapiens
ucuccuaccuguacaaugu

SEQ ID NO: 1433250 - RNA, 19 nt, Homo sapiens
cagcaaggcaacaucagua

SEQ ID NO: 1433251 - RNA, 19 nt, Homo sapiens
ggaccauuaugacaauauc

SEQ ID NO: 1433252 - RNA, 19 nt, Homo sapiens
gaacugggaccauuaugac

SEQ ID NO: 1433253 - RNA, 19 nt, Homo sapiens
gcaaggcaacaucaguauu

SEQ ID NO: 1433254 - RNA, 19 nt, Homo sapiens
cagcagccaugcccaaagu

SEQ ID NO: 1433255 - RNA, 19 nt, Homo sapiens
ccacagaccaccugagaca

SEQ ID NO: 1433256 - RNA, 19 nt, Homo sapiens
gcucaugcccuucaaacug

SEQ ID NO: 1433257 - RNA, 19 nt, Homo sapiens
ggcaggagccucucaaugg

SEQ ID NO: 1433258 - RNA, 19 nt, Homo sapiens
gccaaggauuuauaugcaa

SEQ ID NO: 1433259 - RNA, 19 nt, Homo sapiens
gcuacgcugggaauauuua

SEQ ID NO: 1433260 - RNA, 19 nt, Homo sapiens
uggcuacgcugggaauauu

SEQ ID NO: 1433261 - RNA, 19 nt, Homo sapiens
cgucaucccuaaguacauu

SEQ ID NO: 1433262 - RNA, 19 nt, Homo sapiens
ccagaccgccgaagugcua

SEQ ID NO: 1433263 - RNA, 19 nt, Homo sapiens
gaccagggccacagaagug

SEQ ID NO: 1433264 - RNA, 19 nt, Homo sapiens
gcagcaacagcuccaagaa

SEQ ID NO: 1433265 - RNA, 19 nt, Homo sapiens
gaccuggugucagcauuug

SEQ ID NO: 1433266 - RNA, 19 nt, Homo sapiens
aagccuaccaccuguguua

SEQ ID NO: 1433267 - RNA, 19 nt, Homo sapiens
gaaauuccaggagcacaga

SEQ ID NO: 1433268 - RNA, 19 nt, Homo sapiens
ccagggcucuccggaaugu

SEQ ID NO: 1433269 - RNA, 19 nt, Homo sapiens
ccaccgggcuccaucuucu

SEQ ID NO: 1433270 - RNA, 19 nt, Homo sapiens
ccacgccucugcugcuugu

SEQ ID NO: 1433271 - RNA, 19 nt, Homo sapiens
guacauucaacccuucuug

SEQ ID NO: 1433272 - RNA, 19 nt, Homo sapiens
cauagucauuggcgucaug

SEQ ID NO: 1433273 - RNA, 19 nt, Homo sapiens
ugaacugggaccauuauga

SEQ ID NO: 1433274 - RNA, 19 nt, Homo sapiens
ccaucagccugucagcauu

SEQ ID NO: 1433275 - RNA, 19 nt, Homo sapiens
uaccugaacugggaccauu

SEQ ID NO: 1433276 - RNA, 19 nt, Homo sapiens
gccaaggacagcugcauga

SEQ ID NO: 1433277 - RNA, 19 nt, Homo sapiens
gcaaguucuuucggucaau

SEQ ID NO: 1433278 - RNA, 19 nt, Homo sapiens
agacauccuccgccacuaa

SEQ ID NO: 1433279 - RNA, 19 nt, Homo sapiens
gagacauccuccgccacua

SEQ ID NO: 1433280 - RNA, 19 nt, Homo sapiens
gcccugcaccgaucaguga

SEQ ID NO: 1433281 - RNA, 19 nt, Homo sapiens
caaggacagcugcaugaug

SEQ ID NO: 1433282 - RNA, 19 nt, Homo sapiens
gcagcagcccuuaccugaa

SEQ ID NO: 1433283 - RNA, 19 nt, Homo sapiens
agcaacagcuccaagaagu

SEQ ID NO: 1433284 - RNA, 19 nt, Homo sapiens
cgucauguauggccuaugc

SEQ ID NO: 1433285 - RNA, 19 nt, Homo sapiens
ggucucuacugccucacuu

SEQ ID NO: 1433286 - RNA, 19 nt, Homo sapiens
ugcagcagcucccuagugu

SEQ ID NO: 1433287 - RNA, 19 nt, Homo sapiens
ccaacacucuacgcaacuu

SEQ ID NO: 1433288 - RNA, 19 nt, Homo sapiens
gacauccuccgccacuaaa

SEQ ID NO: 1433289 - RNA, 19 nt, Homo sapiens
gagacaggcagacauuugg

SEQ ID NO: 1433290 - RNA, 19 nt, Homo sapiens
gcaacagcuccaagaagug

SEQ ID NO: 1433291 - RNA, 19 nt, Homo sapiens
gcagcaaggcaacaucagu

SEQ ID NO: 1433292 - RNA, 19 nt, Homo sapiens
ugccaaggauuuauaugca

SEQ ID NO: 1433293 - RNA, 19 nt, Homo sapiens
caaguucuuucggucaauc

SEQ ID NO: 1433294 - RNA, 19 nt, Homo sapiens
acccugggcuugucuuuag

SEQ ID NO: 1433295 - RNA, 19 nt, Homo sapiens
cacuuuggcugccuuccuu

SEQ ID NO: 1433296 - RNA, 19 nt, Homo sapiens
ucauuggcgucauguaugg

SEQ ID NO: 1433297 - RNA, 19 nt, Homo sapiens
gcagccaugcccaaaguca

SEQ ID NO: 1433298 - RNA, 19 nt, Homo sapiens
cggcugccaaggauuuaua

SEQ ID NO: 1433299 - RNA, 19 nt, Homo sapiens
cuaccuccaagcccuauuu

SEQ ID NO: 1433300 - RNA, 19 nt, Homo sapiens
ucucucaccucccucucuu

SEQ ID NO: 1433301 - RNA, 19 nt, Homo sapiens
ucuacugccucacuugcuu

SEQ ID NO: 1433302 - RNA, 19 nt, Homo sapiens
ugacagccacccaccacuu

SEQ ID NO: 1433303 - RNA, 19 nt, Homo sapiens
gcccugaacaagauuaaag

SEQ ID NO: 1433304 - RNA, 19 nt, Homo sapiens
gacagccacccaccacuuc

SEQ ID NO: 1433305 - RNA, 19 nt, Homo sapiens
cgucaggaguuugaguuca

SEQ ID NO: 1433306 - RNA, 19 nt, Homo sapiens
gugcacggguuuucgauga

SEQ ID NO: 1433307 - RNA, 19 nt, Homo sapiens
ggugucagcauuugauguc

SEQ ID NO: 1433308 - RNA, 19 nt, Homo sapiens
ugcccaaagucaugaagga

SEQ ID NO: 1433309 - RNA, 19 nt, Homo sapiens
cagcaacagcuccaagaag

SEQ ID NO: 1433310 - RNA, 19 nt, Homo sapiens
ugagcaggcaugguuauug

SEQ ID NO: 1433311 - RNA, 19 nt, Homo sapiens
caucugugccuccuacuac

SEQ ID NO: 1433312 - RNA, 19 nt, Homo sapiens
ucucuaaccguggaaggua

SEQ ID NO: 1433313 - RNA, 19 nt, Homo sapiens
gaacugggcaacccuuacc

SEQ ID NO: 1433314 - RNA, 19 nt, Homo sapiens
cgcaaguucuuucggucaa

SEQ ID NO: 1433315 - RNA, 19 nt, Homo sapiens
ugaccuggaugaggagaag

SEQ ID NO: 1433316 - RNA, 19 nt, Homo sapiens
ccgccgaaccaaucuguug

SEQ ID NO: 1433317 - RNA, 19 nt, Homo sapiens
uggagaccuucaaccuuau

SEQ ID NO: 1433318 - RNA, 19 nt, Homo sapiens
gggaccauuaugacaauau

SEQ ID NO: 1433319 - RNA, 19 nt, Homo sapiens
ccacccaccacuucucugu

SEQ ID NO: 1433320 - RNA, 19 nt, Homo sapiens
ccgggugcgucaggaguuu

SEQ ID NO: 1433321 - RNA, 19 nt, Homo sapiens
cuacgggcuucuggagcua

SEQ ID NO: 1433322 - RNA, 19 nt, Homo sapiens
cugaacaagauuaaagcua

SEQ ID NO: 1433323 - RNA, 19 nt, Homo sapiens
caaagaagcuccauauuau

SEQ ID NO: 1433324 - RNA, 19 nt, Homo sapiens
gaacagagucuagcaguua

SEQ ID NO: 1433325 - RNA, 19 nt, Homo sapiens
ccaaagaagcuccauauua

SEQ ID NO: 1433326 - RNA, 19 nt, Homo sapiens
ggagagggauugagaaaga

SEQ ID NO: 1433327 - RNA, 19 nt, Homo sapiens
ggaaauagcaugauagaau

SEQ ID NO: 1433328 - RNA, 19 nt, Homo sapiens
ggguggagcugcacguuua

SEQ ID NO: 1433329 - RNA, 19 nt, Homo sapiens
gaauaaagacuucucacaa

SEQ ID NO: 1433330 - RNA, 19 nt, Homo sapiens
gaaaguucauuggccauuu

SEQ ID NO: 1433331 - RNA, 19 nt, Homo sapiens
ccagaacucuuacugauuc

SEQ ID NO: 1433332 - RNA, 19 nt, Homo sapiens
guacuucccugacuucuca

SEQ ID NO: 1433333 - RNA, 19 nt, Homo sapiens
gaauuggcuucauuucaaa

SEQ ID NO: 1433334 - RNA, 19 nt, Homo sapiens
agaauuggcuucauuucaa

SEQ ID NO: 1433335 - RNA, 19 nt, Homo sapiens
ggaccaggcucuccuccuu

SEQ ID NO: 1433336 - RNA, 19 nt, Homo sapiens
gugguacucugucuugaua

SEQ ID NO: 1433337 - RNA, 19 nt, Homo sapiens
guauagaauucaacugcua

SEQ ID NO: 1433338 - RNA, 19 nt, Homo sapiens
ggaucaugguuauguuuaa

SEQ ID NO: 1433339 - RNA, 19 nt, Homo sapiens
gggaagagaaugcaacaaa

SEQ ID NO: 1433340 - RNA, 19 nt, Homo sapiens
ggauggugcuuaugaggaa

SEQ ID NO: 1433341 - RNA, 19 nt, Homo sapiens
ugacaucagugacaucaug

SEQ ID NO: 1433342 - RNA, 19 nt, Homo sapiens
ccgaguagcugcaauuaca

SEQ ID NO: 1433343 - RNA, 19 nt, Homo sapiens
ggaagcaagugccaucaag

SEQ ID NO: 1433344 - RNA, 19 nt, Homo sapiens
caaagguuguguccuguau

SEQ ID NO: 1433345 - RNA, 19 nt, Homo sapiens
caauuuagcagauaccauu

SEQ ID NO: 1433346 - RNA, 19 nt, Homo sapiens
gcaggcaggcuuuauucua

SEQ ID NO: 1433347 - RNA, 19 nt, Homo sapiens
gugacuggcucccucuuaa

SEQ ID NO: 1433348 - RNA, 19 nt, Homo sapiens
gaggauuacugaagauagu

SEQ ID NO: 1433349 - RNA, 19 nt, Homo sapiens
ggaagagaaugcaacaaaa

SEQ ID NO: 1433350 - RNA, 19 nt, Homo sapiens
caggcaggcuuuauucuau

SEQ ID NO: 1433351 - RNA, 19 nt, Homo sapiens
gauggagaccuuucugauu

SEQ ID NO: 1433352 - RNA, 19 nt, Homo sapiens
cugauggugucacauguua

SEQ ID NO: 1433353 - RNA, 19 nt, Homo sapiens
gcaguuaugcugucauuag

SEQ ID NO: 1433354 - RNA, 19 nt, Homo sapiens
aagagacgcugaugggauu

SEQ ID NO: 1433355 - RNA, 19 nt, Homo sapiens
gaagcugacugggcccaaa

SEQ ID NO: 1433356 - RNA, 19 nt, Homo sapiens
caaguuaccaaauuuccua

SEQ ID NO: 1433357 - RNA, 19 nt, Homo sapiens
ggaauaagcaaagguguuc

SEQ ID NO: 1433358 - RNA, 19 nt, Homo sapiens
ggaauaaagacuucucaca

SEQ ID NO: 1433359 - RNA, 19 nt, Homo sapiens
ccgcagcuuucaagaauug

SEQ ID NO: 1433360 - RNA, 19 nt, Homo sapiens
ccaaauuuccuauguauac

SEQ ID NO: 1433361 - RNA, 19 nt, Homo sapiens
gaagggaggagaacagagu

SEQ ID NO: 1433362 - RNA, 19 nt, Homo sapiens
gggaaucuauggcuucucu

SEQ ID NO: 1433363 - RNA, 19 nt, Homo sapiens
ugucacauguuaaagauuc

SEQ ID NO: 1433364 - RNA, 19 nt, Homo sapiens
gauggugucacauguuaaa

SEQ ID NO: 1433365 - RNA, 19 nt, Homo sapiens
caagugccaucaagguuca

SEQ ID NO: 1433366 - RNA, 19 nt, Homo sapiens
gcacaucguccaccucauc

SEQ ID NO: 1433367 - RNA, 19 nt, Homo sapiens
ggugucacauguuaaagau

SEQ ID NO: 1433368 - RNA, 19 nt, Homo sapiens
ggcagcaccucaccauguu

SEQ ID NO: 1433369 - RNA, 19 nt, Homo sapiens
uauggaggauuacugaaga

SEQ ID NO: 1433370 - RNA, 19 nt, Homo sapiens
uaaaguacaggcuccuaaa

SEQ ID NO: 1433371 - RNA, 19 nt, Homo sapiens
ucuacaggcugaaauuaug

SEQ ID NO: 1433372 - RNA, 19 nt, Homo sapiens
ggucuuugcaaauuucuuu

SEQ ID NO: 1433373 - RNA, 19 nt, Homo sapiens
ucaagaauuggcuucauuu

SEQ ID NO: 1433374 - RNA, 19 nt, Homo sapiens
aaagacuucucacaacuca

SEQ ID NO: 1433375 - RNA, 19 nt, Homo sapiens
acacaggccucuauuccau

SEQ ID NO: 1433376 - RNA, 19 nt, Homo sapiens
gcccaaagaagcuccauau

SEQ ID NO: 1433377 - RNA, 19 nt, Homo sapiens
guuaccaaauuuccuaugu

SEQ ID NO: 1433378 - RNA, 19 nt, Homo sapiens
uggcuucauuucaaacuuu

SEQ ID NO: 1433379 - RNA, 19 nt, Homo sapiens
aauaaagacuucucacaac

SEQ ID NO: 1433380 - RNA, 19 nt, Homo sapiens
caggugacccacuuucuuu

SEQ ID NO: 1433381 - RNA, 19 nt, Homo sapiens
auccuacagucacauauua

SEQ ID NO: 1433382 - RNA, 19 nt, Homo sapiens
caaacuggacccauucaau

SEQ ID NO: 1433383 - RNA, 19 nt, Homo sapiens
ccaagggcaugauacucaa

SEQ ID NO: 1433384 - RNA, 19 nt, Homo sapiens
guuguguccuguauccuuu

SEQ ID NO: 1433385 - RNA, 19 nt, Homo sapiens
ggcuucauuucaaacuuua

SEQ ID NO: 1433386 - RNA, 19 nt, Homo sapiens
gaaauuaugcucgcuuugc

SEQ ID NO: 1433387 - RNA, 19 nt, Homo sapiens
ggcucccucuuaacauuua

SEQ ID NO: 1433388 - RNA, 19 nt, Homo sapiens
ucauacaggugacccacuu

SEQ ID NO: 1433389 - RNA, 19 nt, Homo sapiens
gaaguggagcagucagaga

SEQ ID NO: 1433390 - RNA, 19 nt, Homo sapiens
aggcaggcuuuauucuaua

SEQ ID NO: 1433391 - RNA, 19 nt, Homo sapiens
gaugcaggcaggcuuuauu

SEQ ID NO: 1433392 - RNA, 19 nt, Homo sapiens
ccugacuucucauuucauu

SEQ ID NO: 1433393 - RNA, 19 nt, Homo sapiens
aaacuggacccauucaauc

SEQ ID NO: 1433394 - RNA, 19 nt, Homo sapiens
agacuucucacaacucaaa

SEQ ID NO: 1433395 - RNA, 19 nt, Homo sapiens
ggaaaguucauuggccauu

SEQ ID NO: 1433396 - RNA, 19 nt, Homo sapiens
gcucuccuccuuccaaaga

SEQ ID NO: 1433397 - RNA, 19 nt, Homo sapiens
gcaaaucacagccagucau

SEQ ID NO: 1433398 - RNA, 19 nt, Homo sapiens
cccauucaaucucaucuug

SEQ ID NO: 1433399 - RNA, 19 nt, Homo sapiens
auggagaccuuucugauuc

SEQ ID NO: 1433400 - RNA, 19 nt, Homo sapiens
ggcaugauacucaaagguu

SEQ ID NO: 1433401 - RNA, 19 nt, Homo sapiens
gaaucuauggcuucucuuc

SEQ ID NO: 1433402 - RNA, 19 nt, Homo sapiens
cagcuauggaucaugguua

SEQ ID NO: 1433403 - RNA, 19 nt, Homo sapiens
cugaaauuaugcucgcuuu

SEQ ID NO: 1433404 - RNA, 19 nt, Homo sapiens
agaacagagucuagcaguu

SEQ ID NO: 1433405 - RNA, 19 nt, Homo sapiens
cuaaaguacaggcuccuaa

SEQ ID NO: 1433406 - RNA, 19 nt, Homo sapiens
ggcuauuucuuuucucuua

SEQ ID NO: 1433407 - RNA, 19 nt, Homo sapiens
uucaagaauuggcuucauu

SEQ ID NO: 1433408 - RNA, 19 nt, Homo sapiens
acaaguugcuacaggaagu

SEQ ID NO: 1433409 - RNA, 19 nt, Homo sapiens
aaucugcuuuguuaguuug

SEQ ID NO: 1433410 - RNA, 19 nt, Homo sapiens
cuccgcagcuuucaagaau

SEQ ID NO: 1433411 - RNA, 19 nt, Homo sapiens
gucccugagccucuaauua

SEQ ID NO: 1433412 - RNA, 19 nt, Homo sapiens
gauagcgggauggugcuua

SEQ ID NO: 1433413 - RNA, 19 nt, Homo sapiens
cuccagaacucuuacugau

SEQ ID NO: 1433414 - RNA, 19 nt, Homo sapiens
cacaugcaauuuagcagau

SEQ ID NO: 1433415 - RNA, 19 nt, Homo sapiens
ggaggauuacugaagauag

SEQ ID NO: 1433416 - RNA, 19 nt, Homo sapiens
uuuauucucugcucaucuu

SEQ ID NO: 1433417 - RNA, 19 nt, Homo sapiens
uuauacugcugcugaaauc

SEQ ID NO: 1433418 - RNA, 19 nt, Homo sapiens
guggaaauagcaugauaga

SEQ ID NO: 1433419 - RNA, 19 nt, Homo sapiens
auaaagacuucucacaacu

SEQ ID NO: 1433420 - RNA, 19 nt, Homo sapiens
uggaucaugguuauguuua

SEQ ID NO: 1433421 - RNA, 19 nt, Homo sapiens
ggucuccaagggcaugaua

SEQ ID NO: 1433422 - RNA, 19 nt, Homo sapiens
cauccuacagucacauauu

SEQ ID NO: 1433423 - RNA, 19 nt, Homo sapiens
caacaaaggugaagaagug

SEQ ID NO: 1433424 - RNA, 19 nt, Homo sapiens
gaccauggcuuucaaauau

SEQ ID NO: 1433425 - RNA, 19 nt, Homo sapiens
gaaaguuuauggaggaauu

SEQ ID NO: 1433426 - RNA, 19 nt, Homo sapiens
gcacacacauacacauauu

SEQ ID NO: 1433427 - RNA, 19 nt, Homo sapiens
ggacaaaguucagaauaau

SEQ ID NO: 1433428 - RNA, 19 nt, Homo sapiens
cagaagaguuauccuauga

SEQ ID NO: 1433429 - RNA, 19 nt, Homo sapiens
gaggagcacucacucuuga

SEQ ID NO: 1433430 - RNA, 19 nt, Homo sapiens
gcaaaguucugaaugacau

SEQ ID NO: 1433431 - RNA, 19 nt, Homo sapiens
caagagcucuacuccaaga

SEQ ID NO: 1433432 - RNA, 19 nt, Homo sapiens
gaagaguuauccuaugaag

SEQ ID NO: 1433433 - RNA, 19 nt, Homo sapiens
cuaaagaagagcugaauuu

SEQ ID NO: 1433434 - RNA, 19 nt, Homo sapiens
gaguauccauguuucuaaa

SEQ ID NO: 1433435 - RNA, 19 nt, Homo sapiens
caaagaacuuagccucaug

SEQ ID NO: 1433436 - RNA, 19 nt, Homo sapiens
caacaacaaaggugaagaa

SEQ ID NO: 1433437 - RNA, 19 nt, Homo sapiens
gugaagccauuacgucuau

SEQ ID NO: 1433438 - RNA, 19 nt, Homo sapiens
gaagugaagaggauagaau

SEQ ID NO: 1433439 - RNA, 19 nt, Homo sapiens
aggacaaaguucagaauaa

SEQ ID NO: 1433440 - RNA, 19 nt, Homo sapiens
agaaugaugcugcuaguuu

SEQ ID NO: 1433441 - RNA, 19 nt, Homo sapiens
gaaguuaucaacauacaag

SEQ ID NO: 1433442 - RNA, 19 nt, Homo sapiens
ugggagggauggagauuaa

SEQ ID NO: 1433443 - RNA, 19 nt, Homo sapiens
gugaagaagugaagaggau

SEQ ID NO: 1433444 - RNA, 19 nt, Homo sapiens
ccauuacgucuauuucuua

SEQ ID NO: 1433445 - RNA, 19 nt, Homo sapiens
agaguuauccuaugaaguu

SEQ ID NO: 1433446 - RNA, 19 nt, Homo sapiens
ccagaagaguuauccuaug

SEQ ID NO: 1433447 - RNA, 19 nt, Homo sapiens
uaauaacggucgcuuugug

SEQ ID NO: 1433448 - RNA, 19 nt, Homo sapiens
gcauggauaagcucuauga

SEQ ID NO: 1433449 - RNA, 19 nt, Homo sapiens
gccauuacgucuauuucuu

SEQ ID NO: 1433450 - RNA, 19 nt, Homo sapiens
gaaugaugcugcuaguuuu

SEQ ID NO: 1433451 - RNA, 19 nt, Homo sapiens
gaguuauccuaugaaguua

SEQ ID NO: 1433452 - RNA, 19 nt, Homo sapiens
gaauaauaacggucgcuuu

SEQ ID NO: 1433453 - RNA, 19 nt, Homo sapiens
gcagcugacagaaauauau

SEQ ID NO: 1433454 - RNA, 19 nt, Homo sapiens
caugauggaugaguuauag

SEQ ID NO: 1433455 - RNA, 19 nt, Homo sapiens
gaagccauuacgucuauuu

SEQ ID NO: 1433456 - RNA, 19 nt, Homo sapiens
ggauggagauuaagaaacc

SEQ ID NO: 1433457 - RNA, 19 nt, Homo sapiens
caagcaugguggaaacuau

SEQ ID NO: 1433458 - RNA, 19 nt, Homo sapiens
ggacucaucagaauguuca

SEQ ID NO: 1433459 - RNA, 19 nt, Homo sapiens
cucaagagcucuacuccaa

SEQ ID NO: 1433460 - RNA, 19 nt, Homo sapiens
ccaccauguucaauagaaa

SEQ ID NO: 1433461 - RNA, 19 nt, Homo sapiens
ccuaugaaguuaucaacau

SEQ ID NO: 1433462 - RNA, 19 nt, Homo sapiens
gcuccaaacccucuugcua

SEQ ID NO: 1433463 - RNA, 19 nt, Homo sapiens
ucaaagaacuuagccucau

SEQ ID NO: 1433464 - RNA, 19 nt, Homo sapiens
ugaccauggcuuucaaaua

SEQ ID NO: 1433465 - RNA, 19 nt, Homo sapiens
cagcauggauaagcucuau

SEQ ID NO: 1433466 - RNA, 19 nt, Homo sapiens
ucaugugucuggaucauca

SEQ ID NO: 1433467 - RNA, 19 nt, Homo sapiens
ggagggauggagauuaaga

SEQ ID NO: 1433468 - RNA, 19 nt, Homo sapiens
uaaagaagagcugaauuuc

SEQ ID NO: 1433469 - RNA, 19 nt, Homo sapiens
uccaaacccucuugcuaaa

SEQ ID NO: 1433470 - RNA, 19 nt, Homo sapiens
gaaacugggaacuaacaug

SEQ ID NO: 1433471 - RNA, 19 nt, Homo sapiens
gaaguuccaggacucauca

SEQ ID NO: 1433472 - RNA, 19 nt, Homo sapiens
ggcagacacuccucaucuu

SEQ ID NO: 1433473 - RNA, 19 nt, Homo sapiens
gaacaagcagcgcuaacca

SEQ ID NO: 1433474 - RNA, 19 nt, Homo sapiens
uaagcucuaugaccugaug

SEQ ID NO: 1433475 - RNA, 19 nt, Homo sapiens
gaggauagaauucaagcau

SEQ ID NO: 1433476 - RNA, 19 nt, Homo sapiens
gaagaagugaagaggauag

SEQ ID NO: 1433477 - RNA, 19 nt, Homo sapiens
aauaauaacggucgcuuug

SEQ ID NO: 1433478 - RNA, 19 nt, Homo sapiens
gcagacacuccucaucuuc

SEQ ID NO: 1433479 - RNA, 19 nt, Homo sapiens
caaccauccugcagcaagu

SEQ ID NO: 1433480 - RNA, 19 nt, Homo sapiens
ccauggcuuucaaauauca

SEQ ID NO: 1433481 - RNA, 19 nt, Homo sapiens
uaaaggacaaaguucagaa

SEQ ID NO: 1433482 - RNA, 19 nt, Homo sapiens
cgaguauccauguuucuaa

SEQ ID NO: 1433483 - RNA, 19 nt, Homo sapiens
aaccaggccagaagaguua

SEQ ID NO: 1433484 - RNA, 19 nt, Homo sapiens
uaaccaggccagaagaguu

SEQ ID NO: 1433485 - RNA, 19 nt, Homo sapiens
uaacauguacagcgugaau

SEQ ID NO: 1433486 - RNA, 19 nt, Homo sapiens
gaagaggauagaauucaag

SEQ ID NO: 1433487 - RNA, 19 nt, Homo sapiens
ucuaugaccugaugaccau

SEQ ID NO: 1433488 - RNA, 19 nt, Homo sapiens
ggccagaagaguuauccua

SEQ ID NO: 1433489 - RNA, 19 nt, Homo sapiens
ccagaaugaugcugcuagu

SEQ ID NO: 1433490 - RNA, 19 nt, Homo sapiens
caucaucuccaccauguuc

SEQ ID NO: 1433491 - RNA, 19 nt, Homo sapiens
ugaagaagaggaacaagca

SEQ ID NO: 1433492 - RNA, 19 nt, Homo sapiens
gcuaaagaagagcugaauu

SEQ ID NO: 1433493 - RNA, 19 nt, Homo sapiens
cuaugucccugcacccaaa

SEQ ID NO: 1433494 - RNA, 19 nt, Homo sapiens
gccagaagaguuauccuau

SEQ ID NO: 1433495 - RNA, 19 nt, Homo sapiens
cuccaaacccucuugcuaa

SEQ ID NO: 1433496 - RNA, 19 nt, Homo sapiens
uguggaaacucaugugucu

SEQ ID NO: 1433497 - RNA, 19 nt, Homo sapiens
gaaucagccuguggaaacu

SEQ ID NO: 1433498 - RNA, 19 nt, Homo sapiens
aaacugggaacuaacaugu

SEQ ID NO: 1433499 - RNA, 19 nt, Homo sapiens
agacacuccucaucuucuu

SEQ ID NO: 1433500 - RNA, 19 nt, Homo sapiens
gaaggcacacacauacaca

SEQ ID NO: 1433501 - RNA, 19 nt, Homo sapiens
ccaggacucaucagaaugu

SEQ ID NO: 1433502 - RNA, 19 nt, Homo sapiens
cauccgaguauccauguuu

SEQ ID NO: 1433503 - RNA, 19 nt, Homo sapiens
gaccugcacauccgaguau

SEQ ID NO: 1433504 - RNA, 19 nt, Homo sapiens
uggauaccaucaagggauu

SEQ ID NO: 1433505 - RNA, 19 nt, Homo sapiens
cccgcaaaguucugaauga

SEQ ID NO: 1433506 - RNA, 19 nt, Homo sapiens
guuauccuaugaaguuauc

SEQ ID NO: 1433507 - RNA, 19 nt, Homo sapiens
gugucuggaucaucaaaga

SEQ ID NO: 1433508 - RNA, 19 nt, Homo sapiens
ugaaucagccuguggaaac

SEQ ID NO: 1433509 - RNA, 19 nt, Homo sapiens
uaacggucgcuuuguguug

SEQ ID NO: 1433510 - RNA, 19 nt, Homo sapiens
gagggauggagauuaagaa

SEQ ID NO: 1433511 - RNA, 19 nt, Homo sapiens
ccuccauuaugaaacuuaa

SEQ ID NO: 1433512 - RNA, 19 nt, Homo sapiens
aaggacaaaguucagaaua

SEQ ID NO: 1433513 - RNA, 19 nt, Homo sapiens
cuacugagugaagccauua

SEQ ID NO: 1433514 - RNA, 19 nt, Homo sapiens
agaaggcccugaggacugu

SEQ ID NO: 1433515 - RNA, 19 nt, Homo sapiens
uggaugaguuauagcuguu

SEQ ID NO: 1433516 - RNA, 19 nt, Homo sapiens
ccugaggacugucuaugag

SEQ ID NO: 1433517 - RNA, 19 nt, Homo sapiens
ucaaucacuuggauaccau

SEQ ID NO: 1433518 - RNA, 19 nt, Homo sapiens
uuccaggacucaucagaau

SEQ ID NO: 1433519 - RNA, 19 nt, Homo sapiens
guauccauguuucuaaagg

SEQ ID NO: 1433520 - RNA, 19 nt, Homo sapiens
uaccgcugcucuucuugaa

SEQ ID NO: 1433521 - RNA, 19 nt, Homo sapiens
ugaugaccauggcuuucaa

SEQ ID NO: 1433522 - RNA, 19 nt, Homo sapiens
gcgcuaaccaggccagaag

SEQ ID NO: 1433523 - RNA, 19 nt, Homo sapiens
ggacccaccuccuggauua

SEQ ID NO: 1433524 - RNA, 19 nt, Homo sapiens
gauguuggcuuuacuugua

SEQ ID NO: 1433525 - RNA, 19 nt, Homo sapiens
gagcaggugugugcaaaua

SEQ ID NO: 1433526 - RNA, 19 nt, Homo sapiens
ggagagaaccaacgacuaa

SEQ ID NO: 1433527 - RNA, 19 nt, Homo sapiens
gaauugguuugguucauuu

SEQ ID NO: 1433528 - RNA, 19 nt, Homo sapiens
uaauuuaucugcagaccua

SEQ ID NO: 1433529 - RNA, 19 nt, Homo sapiens
ggaagguggugacuaauca

SEQ ID NO: 1433530 - RNA, 19 nt, Homo sapiens
ggaaagggaaccaggagua

SEQ ID NO: 1433531 - RNA, 19 nt, Homo sapiens
gcaaguaacagacaagaug

SEQ ID NO: 1433532 - RNA, 19 nt, Homo sapiens
cauuuaagcuucugaugaa

SEQ ID NO: 1433533 - RNA, 19 nt, Homo sapiens
acacacagcuaauuuaucu

SEQ ID NO: 1433534 - RNA, 19 nt, Homo sapiens
gcaguucccugagcauuga

SEQ ID NO: 1433535 - RNA, 19 nt, Homo sapiens
ggugggcccugaagacuuu

SEQ ID NO: 1433536 - RNA, 19 nt, Homo sapiens
gccggaagguggugacuaa

SEQ ID NO: 1433537 - RNA, 19 nt, Homo sapiens
gcaaaccguguucauuuaa

SEQ ID NO: 1433538 - RNA, 19 nt, Homo sapiens
caggaaagaugauaacagu

SEQ ID NO: 1433539 - RNA, 19 nt, Homo sapiens
gaagaugugugugucuaug

SEQ ID NO: 1433540 - RNA, 19 nt, Homo sapiens
gcuagcaugcugucauuua

SEQ ID NO: 1433541 - RNA, 19 nt, Homo sapiens
guuaggagcauguguguuu

SEQ ID NO: 1433542 - RNA, 19 nt, Homo sapiens
gggaagccauugaggaguu

SEQ ID NO: 1433543 - RNA, 19 nt, Homo sapiens
ugcaaaccguguucauuua

SEQ ID NO: 1433544 - RNA, 19 nt, Homo sapiens
gggcuagcaugcugucauu

SEQ ID NO: 1433545 - RNA, 19 nt, Homo sapiens
caaaccaucucuccauugg

SEQ ID NO: 1433546 - RNA, 19 nt, Homo sapiens
gaacugguaucaggaaagg

SEQ ID NO: 1433547 - RNA, 19 nt, Homo sapiens
auaauuugcuggcaugauu

SEQ ID NO: 1433548 - RNA, 19 nt, Homo sapiens
ggaacccugugaagaauag

SEQ ID NO: 1433549 - RNA, 19 nt, Homo sapiens
gcaggugugugcaaauaca

SEQ ID NO: 1433550 - RNA, 19 nt, Homo sapiens
gcgcaugagugaggaugua

SEQ ID NO: 1433551 - RNA, 19 nt, Homo sapiens
gagcuuaagugugcugugu

SEQ ID NO: 1433552 - RNA, 19 nt, Homo sapiens
acaaagagcaggagaagga

SEQ ID NO: 1433553 - RNA, 19 nt, Homo sapiens
gacagcaacuccaacuuca

SEQ ID NO: 1433554 - RNA, 19 nt, Homo sapiens
caaggaugcuaacgagaau

SEQ ID NO: 1433555 - RNA, 19 nt, Homo sapiens
gaccaacccaagaugaaua

SEQ ID NO: 1433556 - RNA, 19 nt, Homo sapiens
aaauaucgcuucccugucu

SEQ ID NO: 1433557 - RNA, 19 nt, Homo sapiens
guacacacagcuaauuuau

SEQ ID NO: 1433558 - RNA, 19 nt, Homo sapiens
cauguaggcuggugugugu

SEQ ID NO: 1433559 - RNA, 19 nt, Homo sapiens
ggugaacaguggcauggaa

SEQ ID NO: 1433560 - RNA, 19 nt, Homo sapiens
ucauuuaucugaagguugu

SEQ ID NO: 1433561 - RNA, 19 nt, Homo sapiens
gugcauguguagacaggua

SEQ ID NO: 1433562 - RNA, 19 nt, Homo sapiens
ggaagccauugaggaguuu

SEQ ID NO: 1433563 - RNA, 19 nt, Homo sapiens
gucuguagcucuugcauau

SEQ ID NO: 1433564 - RNA, 19 nt, Homo sapiens
gagaacugguaucaggaaa

SEQ ID NO: 1433565 - RNA, 19 nt, Homo sapiens
gcaugggagguguauguua

SEQ ID NO: 1433566 - RNA, 19 nt, Homo sapiens
cagaagaugugugugucua

SEQ ID NO: 1433567 - RNA, 19 nt, Homo sapiens
gguuguggcugacccauuc

SEQ ID NO: 1433568 - RNA, 19 nt, Homo sapiens
ccaaggaugcuaacgagaa

SEQ ID NO: 1433569 - RNA, 19 nt, Homo sapiens
caugggagguguauguuag

SEQ ID NO: 1433570 - RNA, 19 nt, Homo sapiens
gcagcgaggcuaacugaug

SEQ ID NO: 1433571 - RNA, 19 nt, Homo sapiens
gcacuaguaaguacauaau

SEQ ID NO: 1433572 - RNA, 19 nt, Homo sapiens
ggaguagugaugaagauga

SEQ ID NO: 1433573 - RNA, 19 nt, Homo sapiens
ugaggaagcccuugugugu

SEQ ID NO: 1433574 - RNA, 19 nt, Homo sapiens
gaaccaggaguagugauga

SEQ ID NO: 1433575 - RNA, 19 nt, Homo sapiens
ggagaacugguaucaggaa

SEQ ID NO: 1433576 - RNA, 19 nt, Homo sapiens
cuguagcucuugcauauug

SEQ ID NO: 1433577 - RNA, 19 nt, Homo sapiens
gcucucugcuuuguucuug

SEQ ID NO: 1433578 - RNA, 19 nt, Homo sapiens
gcucuugcauauugagugu

SEQ ID NO: 1433579 - RNA, 19 nt, Homo sapiens
agcauuggauguugaauug

SEQ ID NO: 1433580 - RNA, 19 nt, Homo sapiens
gaguagugaugaagaugau

SEQ ID NO: 1433581 - RNA, 19 nt, Homo sapiens
cuagcaugcugucauuuau

SEQ ID NO: 1433582 - RNA, 19 nt, Homo sapiens
uagcagcauuggauguuga

SEQ ID NO: 1433583 - RNA, 19 nt, Homo sapiens
gaaaaggagcuguugcaaa

SEQ ID NO: 1433584 - RNA, 19 nt, Homo sapiens
ccaccucuccuuucccuuu

SEQ ID NO: 1433585 - RNA, 19 nt, Homo sapiens
gagcuucgacaccauccua

SEQ ID NO: 1433586 - RNA, 19 nt, Homo sapiens
uugcaaaccguguucauuu

SEQ ID NO: 1433587 - RNA, 19 nt, Homo sapiens
aaacaaaccaucucuccau

SEQ ID NO: 1433588 - RNA, 19 nt, Homo sapiens
guauaaaugagcuuaagug

SEQ ID NO: 1433589 - RNA, 19 nt, Homo sapiens
ggugagcagugguaugaag

SEQ ID NO: 1433590 - RNA, 19 nt, Homo sapiens
gaaagggaaccaggaguag

SEQ ID NO: 1433591 - RNA, 19 nt, Homo sapiens
caaaccguguucauuuaag

SEQ ID NO: 1433592 - RNA, 19 nt, Homo sapiens
ggaaccaggaguagugaug

SEQ ID NO: 1433593 - RNA, 19 nt, Homo sapiens
ggacacuggugggugaaca

SEQ ID NO: 1433594 - RNA, 19 nt, Homo sapiens
uaaaauaccaguucccaaa

SEQ ID NO: 1433595 - RNA, 19 nt, Homo sapiens
gcuauugucccugauguug

SEQ ID NO: 1433596 - RNA, 19 nt, Homo sapiens
gcaugagugaggauguaua

SEQ ID NO: 1433597 - RNA, 19 nt, Homo sapiens
gaacucgguaugugcaugu

SEQ ID NO: 1433598 - RNA, 19 nt, Homo sapiens
gcauguauaaaugagcuua

SEQ ID NO: 1433599 - RNA, 19 nt, Homo sapiens
guguaggcaugugugaaua

SEQ ID NO: 1433600 - RNA, 19 nt, Homo sapiens
aaacuggggcagaaaauua

SEQ ID NO: 1433601 - RNA, 19 nt, Homo sapiens
gggcucuuccuaucucuaa

SEQ ID NO: 1433602 - RNA, 19 nt, Homo sapiens
ugcuuaggaugcugaauuu

SEQ ID NO: 1433603 - RNA, 19 nt, Homo sapiens
aaaaggagcuguugcaaac

SEQ ID NO: 1433604 - RNA, 19 nt, Homo sapiens
aacaaaccaucucuccauu

SEQ ID NO: 1433605 - RNA, 19 nt, Homo sapiens
gagagcaccggaccuggaa

SEQ ID NO: 1433606 - RNA, 19 nt, Homo sapiens
ugugugaggcgcacuagua

SEQ ID NO: 1433607 - RNA, 19 nt, Homo sapiens
gcuuagcucucugcuuugu

SEQ ID NO: 1433608 - RNA, 19 nt, Homo sapiens
caagugccaaggaugcuaa

SEQ ID NO: 1433609 - RNA, 19 nt, Homo sapiens
ggacaggaaagaugauaac

SEQ ID NO: 1433610 - RNA, 19 nt, Homo sapiens
cagcaacuccaacuucaug

SEQ ID NO: 1433611 - RNA, 19 nt, Homo sapiens
uguacacacagcuaauuua

SEQ ID NO: 1433612 - RNA, 19 nt, Homo sapiens
ggaccaacccaagaugaau

SEQ ID NO: 1433613 - RNA, 19 nt, Homo sapiens
gccaagagaaugcaagauc

SEQ ID NO: 1433614 - RNA, 19 nt, Homo sapiens
cagcauuggauguugaauu

SEQ ID NO: 1433615 - RNA, 19 nt, Homo sapiens
guuuauaagcuugcaagua

SEQ ID NO: 1433616 - RNA, 19 nt, Homo sapiens
aaauaccaguucccaaaca

SEQ ID NO: 1433617 - RNA, 19 nt, Homo sapiens
guggaacccugugaagaau

SEQ ID NO: 1433618 - RNA, 19 nt, Homo sapiens
ggauguauaggcagaagau

SEQ ID NO: 1433619 - RNA, 19 nt, Homo sapiens
gaaugaggaacucgguaug

SEQ ID NO: 1433620 - RNA, 19 nt, Homo sapiens
gcgcacuaguaaguacaua

SEQ ID NO: 1433621 - RNA, 19 nt, Homo sapiens
gagccaagagaaugcaaga

SEQ ID NO: 1433622 - RNA, 19 nt, Homo sapiens
uuagcucucugcuuuguuc

SEQ ID NO: 1433623 - RNA, 19 nt, Homo sapiens
ccaaggagcugcggaguuu

SEQ ID NO: 1433624 - RNA, 19 nt, Homo sapiens
ggaccaauuucuuccauau

SEQ ID NO: 1433625 - RNA, 19 nt, Homo sapiens
gaggagaauuucauacaga

SEQ ID NO: 1433626 - RNA, 19 nt, Homo sapiens
ugaacucgguggagcguua

SEQ ID NO: 1433627 - RNA, 19 nt, Homo sapiens
ggagagccuucugcagaua

SEQ ID NO: 1433628 - RNA, 19 nt, Homo sapiens
ucugcagucucuucaauua

SEQ ID NO: 1433629 - RNA, 19 nt, Homo sapiens
ccacguaccggacgccuua

SEQ ID NO: 1433630 - RNA, 19 nt, Homo sapiens
ggacagcagcccugacuga

SEQ ID NO: 1433631 - RNA, 19 nt, Homo sapiens
cuacguggcucccuugcaa

SEQ ID NO: 1433632 - RNA, 19 nt, Homo sapiens
gaaccuggaggcccugaaa

SEQ ID NO: 1433633 - RNA, 19 nt, Homo sapiens
gcagaaggcauucaugucu

SEQ ID NO: 1433634 - RNA, 19 nt, Homo sapiens
ggaggagaauuucauacag

SEQ ID NO: 1433635 - RNA, 19 nt, Homo sapiens
ccaggaauguggccaucaa

SEQ ID NO: 1433636 - RNA, 19 nt, Homo sapiens
gggaccaauuucuuccaua

SEQ ID NO: 1433637 - RNA, 19 nt, Homo sapiens
caucugcagucucuucaau

SEQ ID NO: 1433638 - RNA, 19 nt, Homo sapiens
guacgacuacuauguggaa

SEQ ID NO: 1433639 - RNA, 19 nt, Homo sapiens
cagaaggcauucaugucuu

SEQ ID NO: 1433640 - RNA, 19 nt, Homo sapiens
caagguguacgacuacuau

SEQ ID NO: 1433641 - RNA, 19 nt, Homo sapiens
gcaagguguacgacuacua

SEQ ID NO: 1433642 - RNA, 19 nt, Homo sapiens
ucucuucaauuaucucuuc

SEQ ID NO: 1433643 - RNA, 19 nt, Homo sapiens
gaauggaggagaauuucau

SEQ ID NO: 1433644 - RNA, 19 nt, Homo sapiens
gcccuugcuucaacucuga

SEQ ID NO: 1433645 - RNA, 19 nt, Homo sapiens
gccuggaucugggcaauug

SEQ ID NO: 1433646 - RNA, 19 nt, Homo sapiens
ccaagccggugacacaaag

SEQ ID NO: 1433647 - RNA, 19 nt, Homo sapiens
cgacuacuauguggaaucu

SEQ ID NO: 1433648 - RNA, 19 nt, Homo sapiens
caaggcagcagugacauga

SEQ ID NO: 1433649 - RNA, 19 nt, Homo sapiens
gaugaccgcccuugcuuca

SEQ ID NO: 1433650 - RNA, 19 nt, Homo sapiens
ggucaacggcuuucucuac

SEQ ID NO: 1433651 - RNA, 19 nt, Homo sapiens
ggaauguggccaucaagag

SEQ ID NO: 1433652 - RNA, 19 nt, Homo sapiens
gaucugggcaauugcuaug

SEQ ID NO: 1433653 - RNA, 19 nt, Homo sapiens
aggagaauuucauacagaa

SEQ ID NO: 1433654 - RNA, 19 nt, Homo sapiens
gcaaggcagcagugacaug

SEQ ID NO: 1433655 - RNA, 19 nt, Homo sapiens
uggacaaccucaucuacug

SEQ ID NO: 1433656 - RNA, 19 nt, Homo sapiens
gcagucucuucaauuaucu

SEQ ID NO: 1433657 - RNA, 19 nt, Homo sapiens
gggaugaccgcccuugcuu

SEQ ID NO: 1433658 - RNA, 19 nt, Homo sapiens
agaugagucuuacccuuca

SEQ ID NO: 1433659 - RNA, 19 nt, Homo sapiens
ggccauuucuaggcaauca

SEQ ID NO: 1433660 - RNA, 19 nt, Homo sapiens
ccagguuugugcccaagga

SEQ ID NO: 1433661 - RNA, 19 nt, Homo sapiens
gaggugaauuccgguccuu

SEQ ID NO: 1433662 - RNA, 19 nt, Homo sapiens
ugcagucucuucaauuauc

SEQ ID NO: 1433663 - RNA, 19 nt, Homo sapiens
cuccauggcaggacaguaa

SEQ ID NO: 1433664 - RNA, 19 nt, Homo sapiens
gguguacgacuacuaugug

SEQ ID NO: 1433665 - RNA, 19 nt, Homo sapiens
ugaccgcccuugcuucaac

SEQ ID NO: 1433666 - RNA, 19 nt, Homo sapiens
aaagggugcagccgaaaga

SEQ ID NO: 1433667 - RNA, 19 nt, Homo sapiens
agggcaagguguacgacua

SEQ ID NO: 1433668 - RNA, 19 nt, Homo sapiens
gccaagccggugacacaaa

SEQ ID NO: 1433669 - RNA, 19 nt, Homo sapiens
gggagagagggaucuuaga

SEQ ID NO: 1433670 - RNA, 19 nt, Homo sapiens
ggugaauuccgguccuuuc

SEQ ID NO: 1433671 - RNA, 19 nt, Homo sapiens
ggcuuucucuaccgcuuug

SEQ ID NO: 1433672 - RNA, 19 nt, Homo sapiens
ccagccgcgucuucugcua

SEQ ID NO: 1433673 - RNA, 19 nt, Homo sapiens
aggagagccuucugcagau

SEQ ID NO: 1433674 - RNA, 19 nt, Homo sapiens
aauggaggagaauuucaua

SEQ ID NO: 1433675 - RNA, 19 nt, Homo sapiens
gccaucaagaggugaauuc

SEQ ID NO: 1433676 - RNA, 19 nt, Homo sapiens
acuacuauguggaaucuac

SEQ ID NO: 1433677 - RNA, 19 nt, Homo sapiens
uauaccuucucauccauag

SEQ ID NO: 1433678 - RNA, 19 nt, Homo sapiens
ggaucugggcaauugcuau

SEQ ID NO: 1433679 - RNA, 19 nt, Homo sapiens
cgaauggaggagaauuuca

SEQ ID NO: 1433680 - RNA, 19 nt, Homo sapiens
gaggagcucuucagaauca

SEQ ID NO: 1433681 - RNA, 19 nt, Homo sapiens
ucaauaugcucugcuauaa

SEQ ID NO: 1433682 - RNA, 19 nt, Homo sapiens
caaauacucuuucuuccau

SEQ ID NO: 1433683 - RNA, 19 nt, Homo sapiens
gcaacaucauuagcaaaua

SEQ ID NO: 1433684 - RNA, 19 nt, Homo sapiens
gaaucaaaguguucucuca

SEQ ID NO: 1433685 - RNA, 19 nt, Homo sapiens
gggcaccucuucuggcuuu

SEQ ID NO: 1433686 - RNA, 19 nt, Homo sapiens
gcaaggcccuggucaaagg

SEQ ID NO: 1433687 - RNA, 19 nt, Homo sapiens
gaaaugguccuagaaagug

SEQ ID NO: 1433688 - RNA, 19 nt, Homo sapiens
ccaaccagaucaccaauca

SEQ ID NO: 1433689 - RNA, 19 nt, Homo sapiens
ggaaaugguccuagaaagu

SEQ ID NO: 1433690 - RNA, 19 nt, Homo sapiens
caacaucauuagcaaauac

SEQ ID NO: 1433691 - RNA, 19 nt, Homo sapiens
ugagagagcggacuucuga

SEQ ID NO: 1433692 - RNA, 19 nt, Homo sapiens
gagccaagcugaacuucca

SEQ ID NO: 1433693 - RNA, 19 nt, Homo sapiens
gcuggaagguggagacugu

SEQ ID NO: 1433694 - RNA, 19 nt, Homo sapiens
cuacaaauacucuuucuuc

SEQ ID NO: 1433695 - RNA, 19 nt, Homo sapiens
gcaagccacugaucaaagc

SEQ ID NO: 1433696 - RNA, 19 nt, Homo sapiens
gauccuggcuaaaucucaa

SEQ ID NO: 1433697 - RNA, 19 nt, Homo sapiens
ggcuaaaucucaacaaguc

SEQ ID NO: 1433698 - RNA, 19 nt, Homo sapiens
gaaagugcucacagacauu

SEQ ID NO: 1433699 - RNA, 19 nt, Homo sapiens
ccuagaaagugcucacaga

SEQ ID NO: 1433700 - RNA, 19 nt, Homo sapiens
cuacauaccucuggugucu

SEQ ID NO: 1433701 - RNA, 19 nt, Homo sapiens
guccagcgguggcagauug

SEQ ID NO: 1433702 - RNA, 19 nt, Homo sapiens
ccagagcuucgacuacaua

SEQ ID NO: 1433703 - RNA, 19 nt, Homo sapiens
gagcaagccacugaucaaa

SEQ ID NO: 1433704 - RNA, 19 nt, Homo sapiens
agaaagugcucacagacau

SEQ ID NO: 1433705 - RNA, 19 nt, Homo sapiens
gcaccaaccagaucaccaa

SEQ ID NO: 1433706 - RNA, 19 nt, Homo sapiens
ggaaccagagcuucgacua

SEQ ID NO: 1433707 - RNA, 19 nt, Homo sapiens
caugaaggccucagagaau

SEQ ID NO: 1433708 - RNA, 19 nt, Homo sapiens
aagcugaacuuccagucuu

SEQ ID NO: 1433709 - RNA, 19 nt, Homo sapiens
caugccagcugccaagaga

SEQ ID NO: 1433710 - RNA, 19 nt, Homo sapiens
cagcaaggccugcaacauc

SEQ ID NO: 1433711 - RNA, 19 nt, Homo sapiens
gcaggaugccgaccuaugg

SEQ ID NO: 1433712 - RNA, 19 nt, Homo sapiens
gguggcagauugauuugca

SEQ ID NO: 1433713 - RNA, 19 nt, Homo sapiens
ccaccaagcacgaucugaa

SEQ ID NO: 1433714 - RNA, 19 nt, Homo sapiens
gaaucucgaguucaauaug

SEQ ID NO: 1433715 - RNA, 19 nt, Homo sapiens
gaagauucggcaccaggaa

SEQ ID NO: 1433716 - RNA, 19 nt, Homo sapiens
gacgaugcuuggagaagau

SEQ ID NO: 1433717 - RNA, 19 nt, Homo sapiens
agacgaugcuuggagaaga

SEQ ID NO: 1433718 - RNA, 19 nt, Homo sapiens
gaaccagagcuucgacuac

SEQ ID NO: 1433719 - RNA, 19 nt, Homo sapiens
gguggagacugugccaaga

SEQ ID NO: 1433720 - RNA, 19 nt, Homo sapiens
cacagacauugauggguuu

SEQ ID NO: 1433721 - RNA, 19 nt, Homo sapiens
uggcagcucugucuucuac

SEQ ID NO: 1433722 - RNA, 19 nt, Homo sapiens
ccaugaaggccucagagaa

SEQ ID NO: 1433723 - RNA, 19 nt, Homo sapiens
gcaaauacacagccuucgu

SEQ ID NO: 1433724 - RNA, 19 nt, Homo sapiens
ccaagggcuuccugagcaa

SEQ ID NO: 1433725 - RNA, 19 nt, Homo sapiens
caacuucuuggucccauug

SEQ ID NO: 1433726 - RNA, 19 nt, Homo sapiens
gcagcucugucuucuacca

SEQ ID NO: 1433727 - RNA, 19 nt, Homo sapiens
ccgaagcccuggagaucug

SEQ ID NO: 1433728 - RNA, 19 nt, Homo sapiens
aaccagagcuucgacuaca

SEQ ID NO: 1433729 - RNA, 19 nt, Homo sapiens
ucaaaguguucucucaacu

SEQ ID NO: 1433730 - RNA, 19 nt, Homo sapiens
gcacgcagggcacacucaa

SEQ ID NO: 1433731 - RNA, 19 nt, Homo sapiens
aauacucuuucuuccauga

SEQ ID NO: 1433732 - RNA, 19 nt, Homo sapiens
caacaaguccaggcuacug

SEQ ID NO: 1433733 - RNA, 19 nt, Homo sapiens
agcaaggccugcaacauca

SEQ ID NO: 1433734 - RNA, 19 nt, Homo sapiens
uucaauaugcucugcuaua

SEQ ID NO: 1433735 - RNA, 19 nt, Homo sapiens
cuaggcacccguccuguga

SEQ ID NO: 1433736 - RNA, 19 nt, Homo sapiens
gagauacccacugcggaaa

SEQ ID NO: 1433737 - RNA, 19 nt, Homo sapiens
ccagaucaccaaucacaag

SEQ ID NO: 1433738 - RNA, 19 nt, Homo sapiens
ccugcaacaucauuagcaa

SEQ ID NO: 1433739 - RNA, 19 nt, Homo sapiens
ccauggagaagcucaagug

SEQ ID NO: 1433740 - RNA, 19 nt, Homo sapiens
aguguucucucaacuucuu

SEQ ID NO: 1433741 - RNA, 19 nt, Homo sapiens
agacauugauggguuuuaa

SEQ ID NO: 1433742 - RNA, 19 nt, Homo sapiens
gagcuucgacuacauaccu

SEQ ID NO: 1433743 - RNA, 19 nt, Homo sapiens
ugagcaagccacugaucaa

SEQ ID NO: 1433744 - RNA, 19 nt, Homo sapiens
ggagcucuucagaaucaaa

SEQ ID NO: 1433745 - RNA, 19 nt, Homo sapiens
aauaugcucugcuauaacc

SEQ ID NO: 1433746 - RNA, 19 nt, Homo sapiens
ugccagcugccaagagaua

SEQ ID NO: 1433747 - RNA, 19 nt, Homo sapiens
gggcauacagcaccaacca

SEQ ID NO: 1433748 - RNA, 19 nt, Homo sapiens
gcggagacucuaccaccaa

SEQ ID NO: 1433749 - RNA, 19 nt, Homo sapiens
uagaaagugcucacagaca

SEQ ID NO: 1433750 - RNA, 19 nt, Homo sapiens
gcagacgaugcuuggagaa

SEQ ID NO: 1433751 - RNA, 19 nt, Homo sapiens
gagcugcccugcguaugcu

SEQ ID NO: 1433752 - RNA, 19 nt, Homo sapiens
caaggccugcaacaucauu

SEQ ID NO: 1433753 - RNA, 19 nt, Homo sapiens
acauaccucuggugucucu

SEQ ID NO: 1433754 - RNA, 19 nt, Homo sapiens
gcaagucccacugcucucu

SEQ ID NO: 1433755 - RNA, 19 nt, Homo sapiens
aaagugcucacagacauug

SEQ ID NO: 1433756 - RNA, 19 nt, Homo sapiens
aaucccagaucugacaaga

SEQ ID NO: 1433757 - RNA, 19 nt, Homo sapiens
acaguucggccuccuacuu

SEQ ID NO: 1433758 - RNA, 19 nt, Homo sapiens
gagacucuaccaccaagca

SEQ ID NO: 1433759 - RNA, 19 nt, Homo sapiens
ucaacuucuuggucccauu

SEQ ID NO: 1433760 - RNA, 19 nt, Homo sapiens
ugcaggaccucaccaacca

SEQ ID NO: 1433761 - RNA, 19 nt, Homo sapiens
acaaauacucuuucuucca

SEQ ID NO: 1433762 - RNA, 19 nt, Homo sapiens
guggagacugugccaagaa

SEQ ID NO: 1433763 - RNA, 19 nt, Homo sapiens
aaucaaaguguucucucaa

SEQ ID NO: 1433764 - RNA, 19 nt, Homo sapiens
gaauaaagcuagacucaaa

SEQ ID NO: 1433765 - RNA, 19 nt, Homo sapiens
gagcauggauuacccagua

SEQ ID NO: 1433766 - RNA, 19 nt, Homo sapiens
cagccaaacucacuaaaua

SEQ ID NO: 1433767 - RNA, 19 nt, Homo sapiens
gaagacaagugaagaagau

SEQ ID NO: 1433768 - RNA, 19 nt, Homo sapiens
ggugugcgcucaucauaua

SEQ ID NO: 1433769 - RNA, 19 nt, Homo sapiens
gaacugugauucucucgaa

SEQ ID NO: 1433770 - RNA, 19 nt, Homo sapiens
gaaaguaaguugcuuccau

SEQ ID NO: 1433771 - RNA, 19 nt, Homo sapiens
gaucaugacuucuccuuuc

SEQ ID NO: 1433772 - RNA, 19 nt, Homo sapiens
caaaucauccuucagagua

SEQ ID NO: 1433773 - RNA, 19 nt, Homo sapiens
ccucuucucucaauaagua

SEQ ID NO: 1433774 - RNA, 19 nt, Homo sapiens
ugacucaucugaucccuuu

SEQ ID NO: 1433775 - RNA, 19 nt, Homo sapiens
caaccuccuuggcuuauuu

SEQ ID NO: 1433776 - RNA, 19 nt, Homo sapiens
gaacaccggcuugccuuua

SEQ ID NO: 1433777 - RNA, 19 nt, Homo sapiens
gagaagcaauggccacaga

SEQ ID NO: 1433778 - RNA, 19 nt, Homo sapiens
ggaagagccucccauaaaa

SEQ ID NO: 1433779 - RNA, 19 nt, Homo sapiens
gugcugauguggacaguuu

SEQ ID NO: 1433780 - RNA, 19 nt, Homo sapiens
ggaaguagcccuuuaccau

SEQ ID NO: 1433781 - RNA, 19 nt, Homo sapiens
uccuaaagcuugaaaguaa

SEQ ID NO: 1433782 - RNA, 19 nt, Homo sapiens
guaaauaaccacaguguag

SEQ ID NO: 1433783 - RNA, 19 nt, Homo sapiens
uguauuugaugcaggauua

SEQ ID NO: 1433784 - RNA, 19 nt, Homo sapiens
gagcaagcuugaaggaguu

SEQ ID NO: 1433785 - RNA, 19 nt, Homo sapiens
gcaguugacagccucauuu

SEQ ID NO: 1433786 - RNA, 19 nt, Homo sapiens
gaccgagucugcagaaauc

SEQ ID NO: 1433787 - RNA, 19 nt, Homo sapiens
gaccacagcagacagaauu

SEQ ID NO: 1433788 - RNA, 19 nt, Homo sapiens
gccaacagaugauuugcaa

SEQ ID NO: 1433789 - RNA, 19 nt, Homo sapiens
gaaggcauaagcauagaaa

SEQ ID NO: 1433790 - RNA, 19 nt, Homo sapiens
ugugugagguggcaucuaa

SEQ ID NO: 1433791 - RNA, 19 nt, Homo sapiens
ggucuuguguuuccaacuu

SEQ ID NO: 1433792 - RNA, 19 nt, Homo sapiens
ugacuagguuuacaacuuc

SEQ ID NO: 1433793 - RNA, 19 nt, Homo sapiens
ccagggagcuucugaugag

SEQ ID NO: 1433794 - RNA, 19 nt, Homo sapiens
cggcuugccuuuacaguga

SEQ ID NO: 1433795 - RNA, 19 nt, Homo sapiens
ggccaccucuucccguuaa

SEQ ID NO: 1433796 - RNA, 19 nt, Homo sapiens
gaaacagcagugaucauga

SEQ ID NO: 1433797 - RNA, 19 nt, Homo sapiens
caauaaguauccaguccuu

SEQ ID NO: 1433798 - RNA, 19 nt, Homo sapiens
aagcuagacucaaaccaaa

SEQ ID NO: 1433799 - RNA, 19 nt, Homo sapiens
gaugcaggauuaaacacuu

SEQ ID NO: 1433800 - RNA, 19 nt, Homo sapiens
cagcagugaucaugacuuc

SEQ ID NO: 1433801 - RNA, 19 nt, Homo sapiens
ggucagccauuccuuugau

SEQ ID NO: 1433802 - RNA, 19 nt, Homo sapiens
gugccuuggucucguguua

SEQ ID NO: 1433803 - RNA, 19 nt, Homo sapiens
aauagagacugacuagguu

SEQ ID NO: 1433804 - RNA, 19 nt, Homo sapiens
ggcauaagcauagaaauau

SEQ ID NO: 1433805 - RNA, 19 nt, Homo sapiens
ugucaguaauggaaucuuu

SEQ ID NO: 1433806 - RNA, 19 nt, Homo sapiens
ggaaccaucggaccaagaa

SEQ ID NO: 1433807 - RNA, 19 nt, Homo sapiens
gcaguauccgggcucuuua

SEQ ID NO: 1433808 - RNA, 19 nt, Homo sapiens
caaacucacuaaauaugca

SEQ ID NO: 1433809 - RNA, 19 nt, Homo sapiens
gcuggugagcuuagaauuu

SEQ ID NO: 1433810 - RNA, 19 nt, Homo sapiens
gaggugugcgcucaucaua

SEQ ID NO: 1433811 - RNA, 19 nt, Homo sapiens
aaacaggaaagcuuuagaa

SEQ ID NO: 1433812 - RNA, 19 nt, Homo sapiens
caaacaugguguguccuuu

SEQ ID NO: 1433813 - RNA, 19 nt, Homo sapiens
ugacaaccuccuuggcuua

SEQ ID NO: 1433814 - RNA, 19 nt, Homo sapiens
uuuggguccuucugaauua

SEQ ID NO: 1433815 - RNA, 19 nt, Homo sapiens
aggcauaagcauagaaaua

SEQ ID NO: 1433816 - RNA, 19 nt, Homo sapiens
ucucgcacguugaggcuua

SEQ ID NO: 1433817 - RNA, 19 nt, Homo sapiens
cuaacuggcauuuguguuu

SEQ ID NO: 1433818 - RNA, 19 nt, Homo sapiens
ggccaaaucauccuucaga

SEQ ID NO: 1433819 - RNA, 19 nt, Homo sapiens
guggacaguuugccaaugu

SEQ ID NO: 1433820 - RNA, 19 nt, Homo sapiens
ccaaugcuuuccugucugu

SEQ ID NO: 1433821 - RNA, 19 nt, Homo sapiens
uaccgacacugcagcauug

SEQ ID NO: 1433822 - RNA, 19 nt, Homo sapiens
ugaaauggagcaagcuuga

SEQ ID NO: 1433823 - RNA, 19 nt, Homo sapiens
ucagauaagcugcaugguu

SEQ ID NO: 1433824 - RNA, 19 nt, Homo sapiens
aaagcauggucaucacaaa

SEQ ID NO: 1433825 - RNA, 19 nt, Homo sapiens
ucugugggcugaauucuuc

SEQ ID NO: 1433826 - RNA, 19 nt, Homo sapiens
uaauagagacugacuaggu

SEQ ID NO: 1433827 - RNA, 19 nt, Homo sapiens
ggauuuacuauuuguguga

SEQ ID NO: 1433828 - RNA, 19 nt, Homo sapiens
ugaagaaacaggccguuga

SEQ ID NO: 1433829 - RNA, 19 nt, Homo sapiens
uuucugaccucaccaaauc

SEQ ID NO: 1433830 - RNA, 19 nt, Homo sapiens
caacagaugauuugcaaac

SEQ ID NO: 1433831 - RNA, 19 nt, Homo sapiens
uauccgggcucuuuaccaa

SEQ ID NO: 1433832 - RNA, 19 nt, Homo sapiens
gaaggcuggucugguccua

SEQ ID NO: 1433833 - RNA, 19 nt, Homo sapiens
ccagaagcauauacaugug

SEQ ID NO: 1433834 - RNA, 19 nt, Homo sapiens
uaacuggcauuuguguuuc

SEQ ID NO: 1433835 - RNA, 19 nt, Homo sapiens
gauucuagucugguaaaua

SEQ ID NO: 1433836 - RNA, 19 nt, Homo sapiens
gcugcuugcuguuagauca

SEQ ID NO: 1433837 - RNA, 19 nt, Homo sapiens
uaggauaugugaauaaagc

SEQ ID NO: 1433838 - RNA, 19 nt, Homo sapiens
caggaaagcuuuagaaaac

SEQ ID NO: 1433839 - RNA, 19 nt, Homo sapiens
cugacuagguuuacaacuu

SEQ ID NO: 1433840 - RNA, 19 nt, Homo sapiens
uguaggaacuaucuaacug

SEQ ID NO: 1433841 - RNA, 19 nt, Homo sapiens
cgacacugcagcauugaaa

SEQ ID NO: 1433842 - RNA, 19 nt, Homo sapiens
gggagaccaggguuguuua

SEQ ID NO: 1433843 - RNA, 19 nt, Homo sapiens
caccuacucugugguaaga

SEQ ID NO: 1433844 - RNA, 19 nt, Homo sapiens
ccacugccauuugcucaga

SEQ ID NO: 1433845 - RNA, 19 nt, Homo sapiens
aaauaguccuaaagcuuga

SEQ ID NO: 1433846 - RNA, 19 nt, Homo sapiens
cuaucuaacuggcauuugu

SEQ ID NO: 1433847 - RNA, 19 nt, Homo sapiens
gguaaauaaccacagugua

SEQ ID NO: 1433848 - RNA, 19 nt, Homo sapiens
auuaaacacuucccagaga

SEQ ID NO: 1433849 - RNA, 19 nt, Homo sapiens
gaaauggagcaagcuugaa

SEQ ID NO: 1433850 - RNA, 19 nt, Homo sapiens
ucacuaaauaugcacauga

SEQ ID NO: 1433851 - RNA, 19 nt, Homo sapiens
gcagccaaacucacuaaau

SEQ ID NO: 1433852 - RNA, 19 nt, Homo sapiens
gccaaacucacuaaauaug

SEQ ID NO: 1433853 - RNA, 19 nt, Homo sapiens
gugaauaaagcuagacuca

SEQ ID NO: 1433854 - RNA, 19 nt, Homo sapiens
ggaaagcuuuagaaaacuu

SEQ ID NO: 1433855 - RNA, 19 nt, Homo sapiens
agaggauucuagucuggua

SEQ ID NO: 1433856 - RNA, 19 nt, Homo sapiens
aaacagcagugaucaugac

SEQ ID NO: 1433857 - RNA, 19 nt, Homo sapiens
ugaaacagcagugaucaug

SEQ ID NO: 1433858 - RNA, 19 nt, Homo sapiens
gcaccaugaagacaaguga

SEQ ID NO: 1433859 - RNA, 19 nt, Homo sapiens
gagacgggcaccaugaaga

SEQ ID NO: 1433860 - RNA, 19 nt, Homo sapiens
ucucuucuauugcaaguuc

SEQ ID NO: 1433861 - RNA, 19 nt, Homo sapiens
agugcagucugauuucuuu

SEQ ID NO: 1433862 - RNA, 19 nt, Homo sapiens
caaaacaucagcauuucua

SEQ ID NO: 1433863 - RNA, 19 nt, Homo sapiens
ggaggaggaggcuguggaa

SEQ ID NO: 1433864 - RNA, 19 nt, Homo sapiens
gaacaaggcugaggaaugu

SEQ ID NO: 1433865 - RNA, 19 nt, Homo sapiens
gcaagaacccagcuacuua

SEQ ID NO: 1433866 - RNA, 19 nt, Homo sapiens
ugaagucccucuacaguua

SEQ ID NO: 1433867 - RNA, 19 nt, Homo sapiens
ggacuuaguuucuggcuau

SEQ ID NO: 1433868 - RNA, 19 nt, Homo sapiens
gaacccagcuacuuagaau

SEQ ID NO: 1433869 - RNA, 19 nt, Homo sapiens
aaacauugcuuaaccauca

SEQ ID NO: 1433870 - RNA, 19 nt, Homo sapiens
gaacucaagucacguccuu

SEQ ID NO: 1433871 - RNA, 19 nt, Homo sapiens
uaaaggagcuaugauaaca

SEQ ID NO: 1433872 - RNA, 19 nt, Homo sapiens
cauaagcaguucaaaguga

SEQ ID NO: 1433873 - RNA, 19 nt, Homo sapiens
uaacuucacugaucagcaa

SEQ ID NO: 1433874 - RNA, 19 nt, Homo sapiens
aagcauggauuauaucuga

SEQ ID NO: 1433875 - RNA, 19 nt, Homo sapiens
caacauagacaaucucaau

SEQ ID NO: 1433876 - RNA, 19 nt, Homo sapiens
cugcaaagauccucugaaa

SEQ ID NO: 1433877 - RNA, 19 nt, Homo sapiens
agaaaccaaugacugauaa

SEQ ID NO: 1433878 - RNA, 19 nt, Homo sapiens
cuccugaaauggugaauua

SEQ ID NO: 1433879 - RNA, 19 nt, Homo sapiens
uagaaaagcuucagaaaga

SEQ ID NO: 1433880 - RNA, 19 nt, Homo sapiens
cagaugaugugaaagagaa

SEQ ID NO: 1433881 - RNA, 19 nt, Homo sapiens
ugaaaggaaucaugucuuc

SEQ ID NO: 1433882 - RNA, 19 nt, Homo sapiens
caacuacaaucucauuuac

SEQ ID NO: 1433883 - RNA, 19 nt, Homo sapiens
gcacuaaggacaaccaaug

SEQ ID NO: 1433884 - RNA, 19 nt, Homo sapiens
gcaaaccacugauaaucca

SEQ ID NO: 1433885 - RNA, 19 nt, Homo sapiens
gaucagaggaaaccuaguu

SEQ ID NO: 1433886 - RNA, 19 nt, Homo sapiens
gcacugcgguacuuaaagg

SEQ ID NO: 1433887 - RNA, 19 nt, Homo sapiens
caacaaaugaagacgcuuu

SEQ ID NO: 1433888 - RNA, 19 nt, Homo sapiens
gaacaaccagaaaucagaa

SEQ ID NO: 1433889 - RNA, 19 nt, Homo sapiens
agaaagcucuccugcugaa

SEQ ID NO: 1433890 - RNA, 19 nt, Homo sapiens
ggaggccgaugcagcuauu

SEQ ID NO: 1433891 - RNA, 19 nt, Homo sapiens
gcaaagauccucugaaacc

SEQ ID NO: 1433892 - RNA, 19 nt, Homo sapiens
gcuuaaccaucaagauuug

SEQ ID NO: 1433893 - RNA, 19 nt, Homo sapiens
cugaaauggugaauuauga

SEQ ID NO: 1433894 - RNA, 19 nt, Homo sapiens
aaacagaaacccaaacaau

SEQ ID NO: 1433895 - RNA, 19 nt, Homo sapiens
ucugaaaccuuuaaagauc

SEQ ID NO: 1433896 - RNA, 19 nt, Homo sapiens
ugaccaaccugaggauauu

SEQ ID NO: 1433897 - RNA, 19 nt, Homo sapiens
uaauccagaugaugugaaa

SEQ ID NO: 1433898 - RNA, 19 nt, Homo sapiens
gaagaacaaggcugaggaa

SEQ ID NO: 1433899 - RNA, 19 nt, Homo sapiens
caagugggacaacaaauga

SEQ ID NO: 1433900 - RNA, 19 nt, Homo sapiens
cuacaguuaccaacaguua

SEQ ID NO: 1433901 - RNA, 19 nt, Homo sapiens
gacccaaucucuucaggau

SEQ ID NO: 1433902 - RNA, 19 nt, Homo sapiens
gauaaugcaaggcagauga

SEQ ID NO: 1433903 - RNA, 19 nt, Homo sapiens
gaccaggccuugcgcagau

SEQ ID NO: 1433904 - RNA, 19 nt, Homo sapiens
agaaagagcugaagauccu

SEQ ID NO: 1433905 - RNA, 19 nt, Homo sapiens
gaccaguccuuauccuaug

SEQ ID NO: 1433906 - RNA, 19 nt, Homo sapiens
guacuuaaaggagcuauga

SEQ ID NO: 1433907 - RNA, 19 nt, Homo sapiens
gagaaaauaugcucuugga

SEQ ID NO: 1433908 - RNA, 19 nt, Homo sapiens
ccacugauaauccagauga

SEQ ID NO: 1433909 - RNA, 19 nt, Homo sapiens
caaggcagaugagcagaga

SEQ ID NO: 1433910 - RNA, 19 nt, Homo sapiens
gaagggauuuugaaaggaa

SEQ ID NO: 1433911 - RNA, 19 nt, Homo sapiens
cagaaaccaaugacugaua

SEQ ID NO: 1433912 - RNA, 19 nt, Homo sapiens
ggagaaugacagcuugaaa

SEQ ID NO: 1433913 - RNA, 19 nt, Homo sapiens
ccagacgccucauucacaa

SEQ ID NO: 1433914 - RNA, 19 nt, Homo sapiens
ucaaagugaucagaggaaa

SEQ ID NO: 1433915 - RNA, 19 nt, Homo sapiens
cgaugcagcuauuguagau

SEQ ID NO: 1433916 - RNA, 19 nt, Homo sapiens
aagauccucugaaaccuuu

SEQ ID NO: 1433917 - RNA, 19 nt, Homo sapiens
cagaagagaacucaaguca

SEQ ID NO: 1433918 - RNA, 19 nt, Homo sapiens
ugggaagcauggauuauau

SEQ ID NO: 1433919 - RNA, 19 nt, Homo sapiens
caagucacguccuuugagu

SEQ ID NO: 1433920 - RNA, 19 nt, Homo sapiens
agccaaagaucaaggagaa

SEQ ID NO: 1433921 - RNA, 19 nt, Homo sapiens
ggauagacagguucaggaa

SEQ ID NO: 1433922 - RNA, 19 nt, Homo sapiens
cuucugauuuguuaucuga

SEQ ID NO: 1433923 - RNA, 19 nt, Homo sapiens
cccauuaacuucacugauc

SEQ ID NO: 1433924 - RNA, 19 nt, Homo sapiens
ugucagagauuuucuaaga

SEQ ID NO: 1433925 - RNA, 19 nt, Homo sapiens
ccauuaacuucacugauca

SEQ ID NO: 1433926 - RNA, 19 nt, Homo sapiens
caaagaucaaggagaauga

SEQ ID NO: 1433927 - RNA, 19 nt, Homo sapiens
ucacaacuacaaucucauu

SEQ ID NO: 1433928 - RNA, 19 nt, Homo sapiens
uucaauaccucguggagaa

SEQ ID NO: 1433929 - RNA, 19 nt, Homo sapiens
ccaagugggacaacaaaug

SEQ ID NO: 1433930 - RNA, 19 nt, Homo sapiens
agacguggauagacagguu

SEQ ID NO: 1433931 - RNA, 19 nt, Homo sapiens
ccucugaaaccuuuaaaga

SEQ ID NO: 1433932 - RNA, 19 nt, Homo sapiens
guaaacacuuucaauaccu

SEQ ID NO: 1433933 - RNA, 19 nt, Homo sapiens
gugggaagcauggauuaua

SEQ ID NO: 1433934 - RNA, 19 nt, Homo sapiens
ggcaaacaguagcagauuc

SEQ ID NO: 1433935 - RNA, 19 nt, Homo sapiens
aaacaaccagaaacuacua

SEQ ID NO: 1433936 - RNA, 19 nt, Homo sapiens
cuuaaaggagcuaugauaa

SEQ ID NO: 1433937 - RNA, 19 nt, Homo sapiens
gaauccagcugugaagaac

SEQ ID NO: 1433938 - RNA, 19 nt, Homo sapiens
aagcaaaacugaacauaug

SEQ ID NO: 1433939 - RNA, 19 nt, Homo sapiens
gagcuucuucugauuuguu

SEQ ID NO: 1433940 - RNA, 19 nt, Homo sapiens
cauagacaaucucaaucug

SEQ ID NO: 1433941 - RNA, 19 nt, Homo sapiens
caauggcagacucaacaua

SEQ ID NO: 1433942 - RNA, 19 nt, Homo sapiens
ugaagauccuggacccaau

SEQ ID NO: 1433943 - RNA, 19 nt, Homo sapiens
ccagagaacaaccagaaau

SEQ ID NO: 1433944 - RNA, 19 nt, Homo sapiens
ccaaacaaugcaccagaaa

SEQ ID NO: 1433945 - RNA, 19 nt, Homo sapiens
caagaacccagcuacuuag

SEQ ID NO: 1433946 - RNA, 19 nt, Homo sapiens
cagcuauuguagaugcuuu

SEQ ID NO: 1433947 - RNA, 19 nt, Homo sapiens
gcggaggcauugucagagu

SEQ ID NO: 1433948 - RNA, 19 nt, Homo sapiens
cccaaacaaugcaccagaa

SEQ ID NO: 1433949 - RNA, 19 nt, Homo sapiens
ucaaggagaaugacagcuu

SEQ ID NO: 1433950 - RNA, 19 nt, Homo sapiens
uaaaauccuuugucagaga

SEQ ID NO: 1433951 - RNA, 19 nt, Homo sapiens
gagaccaguccuuauccua

SEQ ID NO: 1433952 - RNA, 19 nt, Homo sapiens
ccaaagaucaaggagaaug

SEQ ID NO: 1433953 - RNA, 19 nt, Homo sapiens
gggcaaacaguagcagauu

SEQ ID NO: 1433954 - RNA, 19 nt, Homo sapiens
cagaugcaaugccugagau

SEQ ID NO: 1433955 - RNA, 19 nt, Homo sapiens
ggcaagaacccagcuacuu

SEQ ID NO: 1433956 - RNA, 19 nt, Homo sapiens
ugagccugcuggaaacauu

SEQ ID NO: 1433957 - RNA, 19 nt, Homo sapiens
gaaaggaaucaugucuuca

SEQ ID NO: 1433958 - RNA, 19 nt, Homo sapiens
gagaaugacagcuugaaaa

SEQ ID NO: 1433959 - RNA, 19 nt, Homo sapiens
gaaaacaaccagaaacuac

SEQ ID NO: 1433960 - RNA, 19 nt, Homo sapiens
cagcaaaccacugauaauc

SEQ ID NO: 1433961 - RNA, 19 nt, Homo sapiens
ugccugagaucauggugaa

SEQ ID NO: 1433962 - RNA, 19 nt, Homo sapiens
cugaaaccuuuaaagauca

SEQ ID NO: 1433963 - RNA, 19 nt, Homo sapiens
ggaagcauggauuauaucu

SEQ ID NO: 1433964 - RNA, 19 nt, Homo sapiens
agaaggagcugauugagaa

SEQ ID NO: 1433965 - RNA, 19 nt, Homo sapiens
gaacgagcuccacaaccua

SEQ ID NO: 1433966 - RNA, 19 nt, Homo sapiens
gagaaggagcugauugaga

SEQ ID NO: 1433967 - RNA, 19 nt, Homo sapiens
ccaaagggaaugugacuau

SEQ ID NO: 1433968 - RNA, 19 nt, Homo sapiens
ucaaggcccuauucuggaa

SEQ ID NO: 1433969 - RNA, 19 nt, Homo sapiens
cgagagaucugcugcuacu

SEQ ID NO: 1433970 - RNA, 19 nt, Homo sapiens
uacaguggcuuauucaaca

SEQ ID NO: 1433971 - RNA, 19 nt, Homo sapiens
cgaccaugaucgcuuuguu

SEQ ID NO: 1433972 - RNA, 19 nt, Homo sapiens
caccguggguuucaacaug

SEQ ID NO: 1433973 - RNA, 19 nt, Homo sapiens
gaugagaaggagcugauug

SEQ ID NO: 1433974 - RNA, 19 nt, Homo sapiens
gagcauuggaugagaagga

SEQ ID NO: 1433975 - RNA, 19 nt, Homo sapiens
caaagggaaugugacuauc

SEQ ID NO: 1433976 - RNA, 19 nt, Homo sapiens
gagguuugaacuccuguuu

SEQ ID NO: 1433977 - RNA, 19 nt, Homo sapiens
ggaccgucaucaucuaaac

SEQ ID NO: 1433978 - RNA, 19 nt, Homo sapiens
cagggaccgucaucaucua

SEQ ID NO: 1433979 - RNA, 19 nt, Homo sapiens
caugaucgcuuuguucaac

SEQ ID NO: 1433980 - RNA, 19 nt, Homo sapiens
acaagcugcuggacugguu

SEQ ID NO: 1433981 - RNA, 19 nt, Homo sapiens
gcuacuccaucucuugcaa

SEQ ID NO: 1433982 - RNA, 19 nt, Homo sapiens
gcagggcaucccggucuua

SEQ ID NO: 1433983 - RNA, 19 nt, Homo sapiens
gcaagaccaccuucgucaa

SEQ ID NO: 1433984 - RNA, 19 nt, Homo sapiens
gaaggagcugauugagaaa

SEQ ID NO: 1433985 - RNA, 19 nt, Homo sapiens
agauugaggccucuaagaa

SEQ ID NO: 1433986 - RNA, 19 nt, Homo sapiens
agaacgagcuccacaaccu

SEQ ID NO: 1433987 - RNA, 19 nt, Homo sapiens
aagggaaugugacuaucaa

SEQ ID NO: 1433988 - RNA, 19 nt, Homo sapiens
gucaucaucuaaaccugaa

SEQ ID NO: 1433989 - RNA, 19 nt, Homo sapiens
ggaaugugacuaucaagcu

SEQ ID NO: 1433990 - RNA, 19 nt, Homo sapiens
caaagaaaaggacaacauu

SEQ ID NO: 1433991 - RNA, 19 nt, Homo sapiens
gaagauugaggccucuaag

SEQ ID NO: 1433992 - RNA, 19 nt, Homo sapiens
gaccaugaucgcuuuguuc

SEQ ID NO: 1433993 - RNA, 19 nt, Homo sapiens
gggcaucccggucuuaguc

SEQ ID NO: 1433994 - RNA, 19 nt, Homo sapiens
guccuguucugcugagguu

SEQ ID NO: 1433995 - RNA, 19 nt, Homo sapiens
gaaaaggacaacauugaca

SEQ ID NO: 1433996 - RNA, 19 nt, Homo sapiens
aaagggaaugugacuauca

SEQ ID NO: 1433997 - RNA, 19 nt, Homo sapiens
gaucgcgucaggacaguuc

SEQ ID NO: 1433998 - RNA, 19 nt, Homo sapiens
cgggagcauuggaugagaa

SEQ ID NO: 1433999 - RNA, 19 nt, Homo sapiens
gauugaggccucuaagaac

SEQ ID NO: 1434000 - RNA, 19 nt, Homo sapiens
caagaccaccuucgucaac

SEQ ID NO: 1434001 - RNA, 19 nt, Homo sapiens
gcaaagaaaaggacaacau

SEQ ID NO: 1434002 - RNA, 19 nt, Homo sapiens
gaccagggaccgucaucau

SEQ ID NO: 1434003 - RNA, 19 nt, Homo sapiens
guucaacgaggacaugauc

SEQ ID NO: 1434004 - RNA, 19 nt, Homo sapiens
ccagggaccgucaucaucu

SEQ ID NO: 1434005 - RNA, 19 nt, Homo sapiens
acauugacaucacccuaca

SEQ ID NO: 1434006 - RNA, 19 nt, Homo sapiens
uaagaacgagcuccacaac

SEQ ID NO: 1434007 - RNA, 19 nt, Homo sapiens
gagugagcgccaucgugua

SEQ ID NO: 1434008 - RNA, 19 nt, Homo sapiens
acccuacaguggcuuauuc

SEQ ID NO: 1434009 - RNA, 19 nt, Homo sapiens
gcugcuacuccaucucuug

SEQ ID NO: 1434010 - RNA, 19 nt, Homo sapiens
accgagagaucugcugcua

SEQ ID NO: 1434011 - RNA, 19 nt, Homo sapiens
cuaagaacgagcuccacaa

SEQ ID NO: 1434012 - RNA, 19 nt, Homo sapiens
cgucaggacaguucaacga

SEQ ID NO: 1434013 - RNA, 19 nt, Homo sapiens
ccacaaccuacuggacaaa

SEQ ID NO: 1434014 - RNA, 19 nt, Homo sapiens
agaagauugaggccucuaa

SEQ ID NO: 1434015 - RNA, 19 nt, Homo sapiens
caaaaucaccaaagggaau

SEQ ID NO: 1434016 - RNA, 19 nt, Homo sapiens
ggaaugaaacugaaacaua

SEQ ID NO: 1434017 - RNA, 19 nt, Homo sapiens
gaaauguucucaggaauga

SEQ ID NO: 1434018 - RNA, 19 nt, Homo sapiens
gaaugaaacugaaacauac

SEQ ID NO: 1434019 - RNA, 19 nt, Homo sapiens
gcaaacaguucugcuacua

SEQ ID NO: 1434020 - RNA, 19 nt, Homo sapiens
gaauguaccucagcuguug

SEQ ID NO: 1434021 - RNA, 19 nt, Homo sapiens
gcaaucaggauguaaagua

SEQ ID NO: 1434022 - RNA, 19 nt, Homo sapiens
gaaacaucgugacuuugua

SEQ ID NO: 1434023 - RNA, 19 nt, Homo sapiens
gaucacauauuugccagua

SEQ ID NO: 1434024 - RNA, 19 nt, Homo sapiens
acagaaacaucgugacuuu

SEQ ID NO: 1434025 - RNA, 19 nt, Homo sapiens
gaaggucuuuguugaguau

SEQ ID NO: 1434026 - RNA, 19 nt, Homo sapiens
ugaaugugcuggaugauga

SEQ ID NO: 1434027 - RNA, 19 nt, Homo sapiens
ucacauauuugccaguaaa

SEQ ID NO: 1434028 - RNA, 19 nt, Homo sapiens
aaacaguucugcuacuauu

SEQ ID NO: 1434029 - RNA, 19 nt, Homo sapiens
gcagagugauacagaaugu

SEQ ID NO: 1434030 - RNA, 19 nt, Homo sapiens
caaaccacguaacauauug

SEQ ID NO: 1434031 - RNA, 19 nt, Homo sapiens
gaaugaagaggaauaugaa

SEQ ID NO: 1434032 - RNA, 19 nt, Homo sapiens
gauccaagcagaagaauuc

SEQ ID NO: 1434033 - RNA, 19 nt, Homo sapiens
gaagaauuccugcugaaau

SEQ ID NO: 1434034 - RNA, 19 nt, Homo sapiens
gugcagagaaugaauguuu

SEQ ID NO: 1434035 - RNA, 19 nt, Homo sapiens
ccucaaaccacguaacaua

SEQ ID NO: 1434036 - RNA, 19 nt, Homo sapiens
guaaagcaguggugaaugc

SEQ ID NO: 1434037 - RNA, 19 nt, Homo sapiens
ccaaagcugcgcagaaauu

SEQ ID NO: 1434038 - RNA, 19 nt, Homo sapiens
caaucaggauguaaaguau

SEQ ID NO: 1434039 - RNA, 19 nt, Homo sapiens
gauguuugaugggaaguuu

SEQ ID NO: 1434040 - RNA, 19 nt, Homo sapiens
caaagcugcgcagaaauua

SEQ ID NO: 1434041 - RNA, 19 nt, Homo sapiens
ggaaauguucucaggaaug

SEQ ID NO: 1434042 - RNA, 19 nt, Homo sapiens
gaugaugauuaucuugaga

SEQ ID NO: 1434043 - RNA, 19 nt, Homo sapiens
aagaauuccugcugaaaug

SEQ ID NO: 1434044 - RNA, 19 nt, Homo sapiens
cagaagaauuccugcugaa

SEQ ID NO: 1434045 - RNA, 19 nt, Homo sapiens
gacuuuguauggaguguuu

SEQ ID NO: 1434046 - RNA, 19 nt, Homo sapiens
gaauaugaaggucuuuguu

SEQ ID NO: 1434047 - RNA, 19 nt, Homo sapiens
ugucauggcugcuugaagu

SEQ ID NO: 1434048 - RNA, 19 nt, Homo sapiens
aaaccuugcuuuaaucagu

SEQ ID NO: 1434049 - RNA, 19 nt, Homo sapiens
agaaugaagaggaauauga

SEQ ID NO: 1434050 - RNA, 19 nt, Homo sapiens
gaauggaaggcaaacaguu

SEQ ID NO: 1434051 - RNA, 19 nt, Homo sapiens
caaagaaggcaaucaggau

SEQ ID NO: 1434052 - RNA, 19 nt, Homo sapiens
cgaguaugguuuccgcaaa

SEQ ID NO: 1434053 - RNA, 19 nt, Homo sapiens
uuucggaauugcucuuaua

SEQ ID NO: 1434054 - RNA, 19 nt, Homo sapiens
gcuuuaaucaguaaccuaa

SEQ ID NO: 1434055 - RNA, 19 nt, Homo sapiens
ugaaggucuuuguugagua

SEQ ID NO: 1434056 - RNA, 19 nt, Homo sapiens
ucaaaccacguaacauauu

SEQ ID NO: 1434057 - RNA, 19 nt, Homo sapiens
cucauugacuuuggacuua

SEQ ID NO: 1434058 - RNA, 19 nt, Homo sapiens
auaugaaggucuuuguuga

SEQ ID NO: 1434059 - RNA, 19 nt, Homo sapiens
gaugauccaagcagaagaa

SEQ ID NO: 1434060 - RNA, 19 nt, Homo sapiens
guaucaaaccuugcuuuaa

SEQ ID NO: 1434061 - RNA, 19 nt, Homo sapiens
ggaauaugaaggucuuugu

SEQ ID NO: 1434062 - RNA, 19 nt, Homo sapiens
gugcuaagacugcugaaug

SEQ ID NO: 1434063 - RNA, 19 nt, Homo sapiens
ggaaucauuuuacuggaaa

SEQ ID NO: 1434064 - RNA, 19 nt, Homo sapiens
agaaggcaaucaggaugua

SEQ ID NO: 1434065 - RNA, 19 nt, Homo sapiens
uuccaaagcugcgcagaaa

SEQ ID NO: 1434066 - RNA, 19 nt, Homo sapiens
gaguaugguuuccgcaaag

SEQ ID NO: 1434067 - RNA, 19 nt, Homo sapiens
cuggaaauguucucaggaa

SEQ ID NO: 1434068 - RNA, 19 nt, Homo sapiens
uaaacucauugacuuugga

SEQ ID NO: 1434069 - RNA, 19 nt, Homo sapiens
gcuggaugaugauuaucuu

SEQ ID NO: 1434070 - RNA, 19 nt, Homo sapiens
caucgugacuuuguaugga

SEQ ID NO: 1434071 - RNA, 19 nt, Homo sapiens
ggaugaugauuaucuugag

SEQ ID NO: 1434072 - RNA, 19 nt, Homo sapiens
uguaucaaaccuugcuuua

SEQ ID NO: 1434073 - RNA, 19 nt, Homo sapiens
guaucgggcuccagaagca

SEQ ID NO: 1434074 - RNA, 19 nt, Homo sapiens
gcauugugcccgagauguu

SEQ ID NO: 1434075 - RNA, 19 nt, Homo sapiens
caccaggguuguuccaugu

SEQ ID NO: 1434076 - RNA, 19 nt, Homo sapiens
agaggaauaugaaggucuu

SEQ ID NO: 1434077 - RNA, 19 nt, Homo sapiens
agucagaucucaggaaugg

SEQ ID NO: 1434078 - RNA, 19 nt, Homo sapiens
acagucagaucucaggaau

SEQ ID NO: 1434079 - RNA, 19 nt, Homo sapiens
gcagagaaugaauguuuua

SEQ ID NO: 1434080 - RNA, 19 nt, Homo sapiens
agaaacaucgugacuuugu

SEQ ID NO: 1434081 - RNA, 19 nt, Homo sapiens
ucagaucucaggaauggaa

SEQ ID NO: 1434082 - RNA, 19 nt, Homo sapiens
gaaggcaaucaggauguaa

SEQ ID NO: 1434083 - RNA, 19 nt, Homo sapiens
caaacaguucugcuacuau

SEQ ID NO: 1434084 - RNA, 19 nt, Homo sapiens
uaccucagcuguugaucug

SEQ ID NO: 1434085 - RNA, 19 nt, Homo sapiens
ggagugcagagaaugaaug

SEQ ID NO: 1434086 - RNA, 19 nt, Homo sapiens
aaccuugcuuuaaucagua

SEQ ID NO: 1434087 - RNA, 19 nt, Homo sapiens
caaaugcuggugauuccaa

SEQ ID NO: 1434088 - RNA, 19 nt, Homo sapiens
ggaauggaaggcaaacagu

SEQ ID NO: 1434089 - RNA, 19 nt, Homo sapiens
gaaacauacagucagaucu

SEQ ID NO: 1434090 - RNA, 19 nt, Homo sapiens
aaacaucgugacuuuguau

SEQ ID NO: 1434091 - RNA, 19 nt, Homo sapiens
gaaguuuguuguggcuaca

SEQ ID NO: 1434092 - RNA, 19 nt, Homo sapiens
ugacuggaaggauguuuga

SEQ ID NO: 1434093 - RNA, 19 nt, Homo sapiens
aauaugaaggucuuuguug

SEQ ID NO: 1434094 - RNA, 19 nt, Homo sapiens
uauugaagaucuggucaug

SEQ ID NO: 1434095 - RNA, 19 nt, Homo sapiens
gagccuaggaaucauuuua

SEQ ID NO: 1434096 - RNA, 19 nt, Homo sapiens
cagaaauuacugacuggaa

SEQ ID NO: 1434097 - RNA, 19 nt, Homo sapiens
ugugcuggaugaugauuau

SEQ ID NO: 1434098 - RNA, 19 nt, Homo sapiens
cagccuaucaccuaagaga

SEQ ID NO: 1434099 - RNA, 19 nt, Homo sapiens
gaccucaaaccacguaaca

SEQ ID NO: 1434100 - RNA, 19 nt, Homo sapiens
ugucaguguuucggaauug

SEQ ID NO: 1434101 - RNA, 19 nt, Homo sapiens
acaguucugcuacuauuga

SEQ ID NO: 1434102 - RNA, 19 nt, Homo sapiens
guaugcaaaugcuggugau

SEQ ID NO: 1434103 - RNA, 19 nt, Homo sapiens
ugcuaagacugcugaaugu

SEQ ID NO: 1434104 - RNA, 19 nt, Homo sapiens
guucugcuacuauugauca

SEQ ID NO: 1434105 - RNA, 19 nt, Homo sapiens
gaucuguggagccuaggaa

SEQ ID NO: 1434106 - RNA, 19 nt, Homo sapiens
aaaugcuggugauuccaaa

SEQ ID NO: 1434107 - RNA, 19 nt, Homo sapiens
cacgcugucuguugcuuga

SEQ ID NO: 1434108 - RNA, 19 nt, Homo sapiens
aaacauacagucagaucuc

SEQ ID NO: 1434109 - RNA, 19 nt, Homo sapiens
ugaaacauacagucagauc

SEQ ID NO: 1434110 - RNA, 19 nt, Homo sapiens
ugaagaggaauaugaaggu

SEQ ID NO: 1434111 - RNA, 19 nt, Homo sapiens
uugaagaucuggucaugcu

SEQ ID NO: 1434112 - RNA, 19 nt, Homo sapiens
ucaaaccuugcuuuaauca

SEQ ID NO: 1434113 - RNA, 19 nt, Homo sapiens
ggcaaacaguucugcuacu

SEQ ID NO: 1434114 - RNA, 19 nt, Homo sapiens
gccaucacgcugucuguug

SEQ ID NO: 1434115 - RNA, 19 nt, Homo sapiens
agaagaauuccugcugaaa

SEQ ID NO: 1434116 - RNA, 19 nt, Homo sapiens
gcaaacaguucugcuauua

SEQ ID NO: 1434117 - RNA, 19 nt, Homo sapiens
ggaaugaaacugaaacaua

SEQ ID NO: 1434118 - RNA, 19 nt, Homo sapiens
gaagcaaggaugaauaaua

SEQ ID NO: 1434119 - RNA, 19 nt, Homo sapiens
gaaauguucucaggaauga

SEQ ID NO: 1434120 - RNA, 19 nt, Homo sapiens
gaaugaaacugaaacauac

SEQ ID NO: 1434121 - RNA, 19 nt, Homo sapiens
agaauuagauguacaguga

SEQ ID NO: 1434122 - RNA, 19 nt, Homo sapiens
ggaguuaaauugagacuuc

SEQ ID NO: 1434123 - RNA, 19 nt, Homo sapiens
gacaagaccucucagcuau

SEQ ID NO: 1434124 - RNA, 19 nt, Homo sapiens
caugguagguugucuuuaa

SEQ ID NO: 1434125 - RNA, 19 nt, Homo sapiens
gaauguaccucagcuguug

SEQ ID NO: 1434126 - RNA, 19 nt, Homo sapiens
gcaaucaggauguaaagua

SEQ ID NO: 1434127 - RNA, 19 nt, Homo sapiens
ggacacaaguugauuacau

SEQ ID NO: 1434128 - RNA, 19 nt, Homo sapiens
gaaacaucgugacuuugua

SEQ ID NO: 1434129 - RNA, 19 nt, Homo sapiens
ggacaagaccucucagcua

SEQ ID NO: 1434130 - RNA, 19 nt, Homo sapiens
gaucacauauuugccagua

SEQ ID NO: 1434131 - RNA, 19 nt, Homo sapiens
acagaaacaucgugacuuu

SEQ ID NO: 1434132 - RNA, 19 nt, Homo sapiens
gcagugagccuaucuaagu

SEQ ID NO: 1434133 - RNA, 19 nt, Homo sapiens
cauaaugugucccugagua

SEQ ID NO: 1434134 - RNA, 19 nt, Homo sapiens
ugaaugugcuggaugauga

SEQ ID NO: 1434135 - RNA, 19 nt, Homo sapiens
ucacauauuugccaguaaa

SEQ ID NO: 1434136 - RNA, 19 nt, Homo sapiens
gcagagugauacagaaugu

SEQ ID NO: 1434137 - RNA, 19 nt, Homo sapiens
caaaccacguaacauauug

SEQ ID NO: 1434138 - RNA, 19 nt, Homo sapiens
gaaugaagaggaauaugaa

SEQ ID NO: 1434139 - RNA, 19 nt, Homo sapiens
gauccaagcagaagaauuc

SEQ ID NO: 1434140 - RNA, 19 nt, Homo sapiens
gaguaugaaugauuagaga

SEQ ID NO: 1434141 - RNA, 19 nt, Homo sapiens
gaagaggaauaugaagaug

SEQ ID NO: 1434142 - RNA, 19 nt, Homo sapiens
gaagaauuccugcugaaau

SEQ ID NO: 1434143 - RNA, 19 nt, Homo sapiens
gugcagagaaugaauguuu

SEQ ID NO: 1434144 - RNA, 19 nt, Homo sapiens
ggaauaugaagauguugua

SEQ ID NO: 1434145 - RNA, 19 nt, Homo sapiens
ccucaaaccacguaacaua

SEQ ID NO: 1434146 - RNA, 19 nt, Homo sapiens
ccucucagcuauacauuga

SEQ ID NO: 1434147 - RNA, 19 nt, Homo sapiens
ugacugcguugcauacauu

SEQ ID NO: 1434148 - RNA, 19 nt, Homo sapiens
guaaagcaguggugaaugc

SEQ ID NO: 1434149 - RNA, 19 nt, Homo sapiens
gacacaaguugauuacaug

SEQ ID NO: 1434150 - RNA, 19 nt, Homo sapiens
gauguacagugaagggaaa

SEQ ID NO: 1434151 - RNA, 19 nt, Homo sapiens
gcaaggaugaauaauauca

SEQ ID NO: 1434152 - RNA, 19 nt, Homo sapiens
ccaaagcugcgcagaaauu

SEQ ID NO: 1434153 - RNA, 19 nt, Homo sapiens
caaucaggauguaaaguau

SEQ ID NO: 1434154 - RNA, 19 nt, Homo sapiens
gaugcucucaguaauguua

SEQ ID NO: 1434155 - RNA, 19 nt, Homo sapiens
guccagugguucuuccuua

SEQ ID NO: 1434156 - RNA, 19 nt, Homo sapiens
gauguuugaugggaaguuu

SEQ ID NO: 1434157 - RNA, 19 nt, Homo sapiens
ccagugguaucucuacuug

SEQ ID NO: 1434158 - RNA, 19 nt, Homo sapiens
gaaagguguagauauaaug

SEQ ID NO: 1434159 - RNA, 19 nt, Homo sapiens
agaacaaacuggagucuag

SEQ ID NO: 1434160 - RNA, 19 nt, Homo sapiens
gagguagucugucugauac

SEQ ID NO: 1434161 - RNA, 19 nt, Homo sapiens
ugaauccugugagcuaaua

SEQ ID NO: 1434162 - RNA, 19 nt, Homo sapiens
caaagcugcgcagaaauua

SEQ ID NO: 1434163 - RNA, 19 nt, Homo sapiens
ggaaauguucucaggaaug

SEQ ID NO: 1434164 - RNA, 19 nt, Homo sapiens
caaguugauuacaugguuu

SEQ ID NO: 1434165 - RNA, 19 nt, Homo sapiens
gaagagaggguggaaaaua

SEQ ID NO: 1434166 - RNA, 19 nt, Homo sapiens
agaggaauaugaagauguu

SEQ ID NO: 1434167 - RNA, 19 nt, Homo sapiens
ggcaaacaguucugcuauu

SEQ ID NO: 1434168 - RNA, 19 nt, Homo sapiens
guguagauauaaugaggua

SEQ ID NO: 1434169 - RNA, 19 nt, Homo sapiens
gcaagguaguuaagaaagg

SEQ ID NO: 1434170 - RNA, 19 nt, Homo sapiens
gcuaauacagucuauacuu

SEQ ID NO: 1434171 - RNA, 19 nt, Homo sapiens
gacuuuguauggaguguuu

SEQ ID NO: 1434172 - RNA, 19 nt, Homo sapiens
gaugaugauuaucuugaga

SEQ ID NO: 1434173 - RNA, 19 nt, Homo sapiens
aagaauuccugcugaaaug

SEQ ID NO: 1434174 - RNA, 19 nt, Homo sapiens
cagaagaauuccugcugaa

SEQ ID NO: 1434175 - RNA, 19 nt, Homo sapiens
ggauucuucuuauuucaug

SEQ ID NO: 1434176 - RNA, 19 nt, Homo sapiens
aaauuaggaugccuuuaug

SEQ ID NO: 1434177 - RNA, 19 nt, Homo sapiens
guucugcuauuauugauca

SEQ ID NO: 1434178 - RNA, 19 nt, Homo sapiens
acaaguugauuacaugguu

SEQ ID NO: 1434179 - RNA, 19 nt, Homo sapiens
caaccccucuuuuaguuua

SEQ ID NO: 1434180 - RNA, 19 nt, Homo sapiens
gaacugcagugagccuauc

SEQ ID NO: 1434181 - RNA, 19 nt, Homo sapiens
aaaccuugcuuuaaucagu

SEQ ID NO: 1434182 - RNA, 19 nt, Homo sapiens
agaaugaagaggaauauga

SEQ ID NO: 1434183 - RNA, 19 nt, Homo sapiens
auccuuagcugaagacaaa

SEQ ID NO: 1434184 - RNA, 19 nt, Homo sapiens
uaagguuucucaagaugug

SEQ ID NO: 1434185 - RNA, 19 nt, Homo sapiens
caagaccucucagcuauac

SEQ ID NO: 1434186 - RNA, 19 nt, Homo sapiens
gaauggaaggcaaacaguu

SEQ ID NO: 1434187 - RNA, 19 nt, Homo sapiens
caaagaaggcaaucaggau

SEQ ID NO: 1434188 - RNA, 19 nt, Homo sapiens
agagguagucugucugaua

SEQ ID NO: 1434189 - RNA, 19 nt, Homo sapiens
ucaguguacuuuauagugu

SEQ ID NO: 1434190 - RNA, 19 nt, Homo sapiens
cgaguaugguuuccgcaaa

SEQ ID NO: 1434191 - RNA, 19 nt, Homo sapiens
uuucggaauugcucuuaua

SEQ ID NO: 1434192 - RNA, 19 nt, Homo sapiens
guagauauaaugagguaga

SEQ ID NO: 1434193 - RNA, 19 nt, Homo sapiens
guuaagaaagguguagaua

SEQ ID NO: 1434194 - RNA, 19 nt, Homo sapiens
agucuagccuggaguuaaa

SEQ ID NO: 1434195 - RNA, 19 nt, Homo sapiens
gcuuuaaucaguaaccuaa

SEQ ID NO: 1434196 - RNA, 19 nt, Homo sapiens
ucaaaccacguaacauauu

SEQ ID NO: 1434197 - RNA, 19 nt, Homo sapiens
auaaugagguagaaguaga

SEQ ID NO: 1434198 - RNA, 19 nt, Homo sapiens
gagcuaauacagucuauac

SEQ ID NO: 1434199 - RNA, 19 nt, Homo sapiens
uauguaugcuugagugaau

SEQ ID NO: 1434200 - RNA, 19 nt, Homo sapiens
cucauugacuuuggacuua

SEQ ID NO: 1434201 - RNA, 19 nt, Homo sapiens
cagugguucuuccuuauug

SEQ ID NO: 1434202 - RNA, 19 nt, Homo sapiens
acauaugaaugcaggacua

SEQ ID NO: 1434203 - RNA, 19 nt, Homo sapiens
uggcagaggacaagucuuu

SEQ ID NO: 1434204 - RNA, 19 nt, Homo sapiens
agugguaucucuacuuguu

SEQ ID NO: 1434205 - RNA, 19 nt, Homo sapiens
gaugauccaagcagaagaa

SEQ ID NO: 1434206 - RNA, 19 nt, Homo sapiens
gauauaaugagguagaagu

SEQ ID NO: 1434207 - RNA, 19 nt, Homo sapiens
gguagucugucugauacaa

SEQ ID NO: 1434208 - RNA, 19 nt, Homo sapiens
uuucacauccguaagauuu

SEQ ID NO: 1434209 - RNA, 19 nt, Homo sapiens
guaucaaaccuugcuuuaa

SEQ ID NO: 1434210 - RNA, 19 nt, Homo sapiens
ugaagauguuguagaagau

SEQ ID NO: 1434211 - RNA, 19 nt, Homo sapiens
augaagauguuguagaaga

SEQ ID NO: 1434212 - RNA, 19 nt, Homo sapiens
gugcuaagacugcugaaug

SEQ ID NO: 1434213 - RNA, 19 nt, Homo sapiens
ggaaucauuuuacuggaaa

SEQ ID NO: 1434214 - RNA, 19 nt, Homo sapiens
agaaggcaaucaggaugua

SEQ ID NO: 1434215 - RNA, 19 nt, Homo sapiens
cauggacacaaguugauua

SEQ ID NO: 1434216 - RNA, 19 nt, Homo sapiens
guagaaaccuguuauuuac

SEQ ID NO: 1434217 - RNA, 19 nt, Homo sapiens
ucuacaagcuucacuacua

SEQ ID NO: 1434218 - RNA, 19 nt, Homo sapiens
uaacugagcacuugagaau

SEQ ID NO: 1434219 - RNA, 19 nt, Homo sapiens
ggucaaaguguaauuauuc

SEQ ID NO: 1434220 - RNA, 19 nt, Homo sapiens
gaggguuucucuuagacua

SEQ ID NO: 1434221 - RNA, 19 nt, Homo sapiens
gaaguagaaaccuguuauu

SEQ ID NO: 1434222 - RNA, 19 nt, Homo sapiens
ucacagaauucagcaagaa

SEQ ID NO: 1434223 - RNA, 19 nt, Homo sapiens
ugagguaacugagcacuug

SEQ ID NO: 1434224 - RNA, 19 nt, Homo sapiens
cagauaagccuagccagua

SEQ ID NO: 1434225 - RNA, 19 nt, Homo sapiens
guaauaggccgcuuuccuu

SEQ ID NO: 1434226 - RNA, 19 nt, Homo sapiens
ccgcaagcauucucuuuga

SEQ ID NO: 1434227 - RNA, 19 nt, Homo sapiens
acugagcacuugagaauau

SEQ ID NO: 1434228 - RNA, 19 nt, Homo sapiens
uguaguggcugacgauuuc

SEQ ID NO: 1434229 - RNA, 19 nt, Homo sapiens
gaaaugcagcugcucaaag

SEQ ID NO: 1434230 - RNA, 19 nt, Homo sapiens
gggucaaaguguaauuauu

SEQ ID NO: 1434231 - RNA, 19 nt, Homo sapiens
gauuuaacuuuggauguga

SEQ ID NO: 1434232 - RNA, 19 nt, Homo sapiens
acccuuagcccuucagaua

SEQ ID NO: 1434233 - RNA, 19 nt, Homo sapiens
gaauucagcaagaaguaga

SEQ ID NO: 1434234 - RNA, 19 nt, Homo sapiens
aaaugcagcugcucaaagg

SEQ ID NO: 1434235 - RNA, 19 nt, Homo sapiens
aaauaaauccuggguucua

SEQ ID NO: 1434236 - RNA, 19 nt, Homo sapiens
ugauuuaacuuuggaugug

SEQ ID NO: 1434237 - RNA, 19 nt, Homo sapiens
gggugguccuggaauuaaa

SEQ ID NO: 1434238 - RNA, 19 nt, Homo sapiens
cuuggaggcuggucccuuu

SEQ ID NO: 1434239 - RNA, 19 nt, Homo sapiens
ccagaucggucccguuggu

SEQ ID NO: 1434240 - RNA, 19 nt, Homo sapiens
ccucuuccuuucaagcuuu

SEQ ID NO: 1434241 - RNA, 19 nt, Homo sapiens
aauaaauccuggguucuau

SEQ ID NO: 1434242 - RNA, 19 nt, Homo sapiens
cagaauucagcaagaagua

SEQ ID NO: 1434243 - RNA, 19 nt, Homo sapiens
ucacgcgaauuucuuucaa

SEQ ID NO: 1434244 - RNA, 19 nt, Homo sapiens
ccuguuauuuacuacauug

SEQ ID NO: 1434245 - RNA, 19 nt, Homo sapiens
cuacaagcuucacuacuac

SEQ ID NO: 1434246 - RNA, 19 nt, Homo sapiens
gaaaccuguuauuuacuac

SEQ ID NO: 1434247 - RNA, 19 nt, Homo sapiens
gggcggaaguucaaauagc

SEQ ID NO: 1434248 - RNA, 19 nt, Homo sapiens
caaccucacacagcaguuu

SEQ ID NO: 1434249 - RNA, 19 nt, Homo sapiens
gagaaaugcagcugcucaa

SEQ ID NO: 1434250 - RNA, 19 nt, Homo sapiens
uuaaguacauugagguaac

SEQ ID NO: 1434251 - RNA, 19 nt, Homo sapiens
ugaauuuagucacccuuag

SEQ ID NO: 1434252 - RNA, 19 nt, Homo sapiens
gaacccgagcugaguguca

SEQ ID NO: 1434253 - RNA, 19 nt, Homo sapiens
uccuauuacugaugaguuu

SEQ ID NO: 1434254 - RNA, 19 nt, Homo sapiens
cacgcgaauuucuuucaaa

SEQ ID NO: 1434255 - RNA, 19 nt, Homo sapiens
ggagcgcccacgaagugua

SEQ ID NO: 1434256 - RNA, 19 nt, Homo sapiens
gacgcugucuccucuccuu

SEQ ID NO: 1434257 - RNA, 19 nt, Homo sapiens
aagacguucaguccuauua

SEQ ID NO: 1434258 - RNA, 19 nt, Homo sapiens
aagccuagccaguacauau

SEQ ID NO: 1434259 - RNA, 19 nt, Homo sapiens
cgcaagcauucucuuugaa

SEQ ID NO: 1434260 - RNA, 19 nt, Homo sapiens
agaaguagaaaccuguuau

SEQ ID NO: 1434261 - RNA, 19 nt, Homo sapiens
gccgggugguccuggaauu

SEQ ID NO: 1434262 - RNA, 19 nt, Homo sapiens
cgcagcgucuccuauucua

SEQ ID NO: 1434263 - RNA, 19 nt, Homo sapiens
uagggucaaaguguaauua

SEQ ID NO: 1434264 - RNA, 19 nt, Homo sapiens
gccuagccaguacauauuu

SEQ ID NO: 1434265 - RNA, 19 nt, Homo sapiens
ggguuucucuuagacuaug

SEQ ID NO: 1434266 - RNA, 19 nt, Homo sapiens
ccuggucccucuuccuuuc

SEQ ID NO: 1434267 - RNA, 19 nt, Homo sapiens
gcugccacuuggaggguuu

SEQ ID NO: 1434268 - RNA, 19 nt, Homo sapiens
acuuggaggguuucucuua

SEQ ID NO: 1434269 - RNA, 19 nt, Homo sapiens
gacguucaguccuauuacu

SEQ ID NO: 1434270 - RNA, 19 nt, Homo sapiens
caagaaguagaaaccuguu

SEQ ID NO: 1434271 - RNA, 19 nt, Homo sapiens
ggcggaaguucaaauagcu

SEQ ID NO: 1434272 - RNA, 19 nt, Homo sapiens
guaacugagcacuugagaa

SEQ ID NO: 1434273 - RNA, 19 nt, Homo sapiens
aaggagcgcccacgaagug

SEQ ID NO: 1434274 - RNA, 19 nt, Homo sapiens
uuaaaggagcgcccacgaa

SEQ ID NO: 1434275 - RNA, 19 nt, Homo sapiens
gguaauaggccgcuuuccu

SEQ ID NO: 1434276 - RNA, 19 nt, Homo sapiens
agauaagccuagccaguac

SEQ ID NO: 1434277 - RNA, 19 nt, Homo sapiens
aagaaguagaaaccuguua

SEQ ID NO: 1434278 - RNA, 19 nt, Homo sapiens
cgacgcccuuggaacaauc

SEQ ID NO: 1434279 - RNA, 19 nt, Homo sapiens
ccacuuggaggguuucucu

SEQ ID NO: 1434280 - RNA, 19 nt, Homo sapiens
gcgcagcgucuccuauucu

SEQ ID NO: 1434281 - RNA, 19 nt, Homo sapiens
guguaguggcugacgauuu

SEQ ID NO: 1434282 - RNA, 19 nt, Homo sapiens
uuggaggguuucucuuaga

SEQ ID NO: 1434283 - RNA, 19 nt, Homo sapiens
gagaauauuuuagggucaa

SEQ ID NO: 1434284 - RNA, 19 nt, Homo sapiens
gguaacugagcacuugaga

SEQ ID NO: 1434285 - RNA, 19 nt, Homo sapiens
uaaguacauugagguaacu

SEQ ID NO: 1434286 - RNA, 19 nt, Homo sapiens
caaauagcugccacuugga

SEQ ID NO: 1434287 - RNA, 19 nt, Homo sapiens
gaaacccgacguggaccuu

SEQ ID NO: 1434288 - RNA, 19 nt, Homo sapiens
ggcgcagcgucuccuauuc

SEQ ID NO: 1434289 - RNA, 19 nt, Homo sapiens
gaauuuagucacccuuagc

SEQ ID NO: 1434290 - RNA, 19 nt, Homo sapiens
ccgggugguccuggaauua

SEQ ID NO: 1434291 - RNA, 19 nt, Homo sapiens
ccuagccaguacauauuuc

SEQ ID NO: 1434292 - RNA, 19 nt, Homo sapiens
gagcgcccacgaaguguag

SEQ ID NO: 1434293 - RNA, 19 nt, Homo sapiens
agaaaugcagcugcucaaa

SEQ ID NO: 1434294 - RNA, 19 nt, Homo sapiens
gauagcagcuggaaccuua

SEQ ID NO: 1434295 - RNA, 19 nt, Homo sapiens
gaacauggcuauuccuuuc

SEQ ID NO: 1434296 - RNA, 19 nt, Homo sapiens
gaugauaccugcucuuuau

SEQ ID NO: 1434297 - RNA, 19 nt, Homo sapiens
ggaacaggauuucaaguuu

SEQ ID NO: 1434298 - RNA, 19 nt, Homo sapiens
gaacugcauugauuuacua

SEQ ID NO: 1434299 - RNA, 19 nt, Homo sapiens
gaaaucaacagcauuagua

SEQ ID NO: 1434300 - RNA, 19 nt, Homo sapiens
ugacaucgcuguauacuga

SEQ ID NO: 1434301 - RNA, 19 nt, Homo sapiens
gaagggaggucauguucaa

SEQ ID NO: 1434302 - RNA, 19 nt, Homo sapiens
gaaagcaaguucacagaga

SEQ ID NO: 1434303 - RNA, 19 nt, Homo sapiens
gaagacuacugaaagauau

SEQ ID NO: 1434304 - RNA, 19 nt, Homo sapiens
gcaagcagccagaaguuua

SEQ ID NO: 1434305 - RNA, 19 nt, Homo sapiens
cgagugaacugcauugauu

SEQ ID NO: 1434306 - RNA, 19 nt, Homo sapiens
ggaagacuacugaaagaua

SEQ ID NO: 1434307 - RNA, 19 nt, Homo sapiens
aaauaaaucuggcuucuuc

SEQ ID NO: 1434308 - RNA, 19 nt, Homo sapiens
gugaucaucuuauggaauu

SEQ ID NO: 1434309 - RNA, 19 nt, Homo sapiens
caaaugaaaucaacagcau

SEQ ID NO: 1434310 - RNA, 19 nt, Homo sapiens
gcgaaggcucuuugaauua

SEQ ID NO: 1434311 - RNA, 19 nt, Homo sapiens
cauguuauccuuugcaaua

SEQ ID NO: 1434312 - RNA, 19 nt, Homo sapiens
gguuaaaggugaacaaaca

SEQ ID NO: 1434313 - RNA, 19 nt, Homo sapiens
gcucauucuuuggaaauua

SEQ ID NO: 1434314 - RNA, 19 nt, Homo sapiens
gaacaggauuucaaguuuu

SEQ ID NO: 1434315 - RNA, 19 nt, Homo sapiens
gacaagagauuucauuuug

SEQ ID NO: 1434316 - RNA, 19 nt, Homo sapiens
cgaaggcucuuugaauuau

SEQ ID NO: 1434317 - RNA, 19 nt, Homo sapiens
gaagaagggaggucauguu

SEQ ID NO: 1434318 - RNA, 19 nt, Homo sapiens
ggacauuauuguggauauu

SEQ ID NO: 1434319 - RNA, 19 nt, Homo sapiens
uaaauggugugaucaucuu

SEQ ID NO: 1434320 - RNA, 19 nt, Homo sapiens
ccacgaagaagaaguuuga

SEQ ID NO: 1434321 - RNA, 19 nt, Homo sapiens
caaaaggacucuucagaug

SEQ ID NO: 1434322 - RNA, 19 nt, Homo sapiens
gaaagcaacagccaaugga

SEQ ID NO: 1434323 - RNA, 19 nt, Homo sapiens
cuugugauguuacugaaua

SEQ ID NO: 1434324 - RNA, 19 nt, Homo sapiens
gcaagcaaagcauacauga

SEQ ID NO: 1434325 - RNA, 19 nt, Homo sapiens
gauaccugcucuuuauuuc

SEQ ID NO: 1434326 - RNA, 19 nt, Homo sapiens
agaaauggcugcugcacau

SEQ ID NO: 1434327 - RNA, 19 nt, Homo sapiens
ggacagcgaaggcucuuug

SEQ ID NO: 1434328 - RNA, 19 nt, Homo sapiens
ucucugacaucgcuguaua

SEQ ID NO: 1434329 - RNA, 19 nt, Homo sapiens
caaacugacacauaagaaa

SEQ ID NO: 1434330 - RNA, 19 nt, Homo sapiens
ggaugauaccugcucuuua

SEQ ID NO: 1434331 - RNA, 19 nt, Homo sapiens
ucgaagauaucccuuggaa

SEQ ID NO: 1434332 - RNA, 19 nt, Homo sapiens
caccauggauuuauuacga

SEQ ID NO: 1434333 - RNA, 19 nt, Homo sapiens
gaugucgaguugauaguug

SEQ ID NO: 1434334 - RNA, 19 nt, Homo sapiens
caucugagaaugucuacua

SEQ ID NO: 1434335 - RNA, 19 nt, Homo sapiens
ggagggaagacuacugaaa

SEQ ID NO: 1434336 - RNA, 19 nt, Homo sapiens
aaagauugcuuagggaguu

SEQ ID NO: 1434337 - RNA, 19 nt, Homo sapiens
aaacagagaggcagggauu

SEQ ID NO: 1434338 - RNA, 19 nt, Homo sapiens
ggagcugccugauguugug

SEQ ID NO: 1434339 - RNA, 19 nt, Homo sapiens
ggauacuacuggcuggaaa

SEQ ID NO: 1434340 - RNA, 19 nt, Homo sapiens
guaccgaccugaagauugc

SEQ ID NO: 1434341 - RNA, 19 nt, Homo sapiens
gcaaacugacacauaagaa

SEQ ID NO: 1434342 - RNA, 19 nt, Homo sapiens
cagauggcauuacaggaaa

SEQ ID NO: 1434343 - RNA, 19 nt, Homo sapiens
aaagcaaguucacagagaa

SEQ ID NO: 1434344 - RNA, 19 nt, Homo sapiens
ugacauacuguuccucuuu

SEQ ID NO: 1434345 - RNA, 19 nt, Homo sapiens
gaacaaacagauguaaugg

SEQ ID NO: 1434346 - RNA, 19 nt, Homo sapiens
cuggugaccuuaacucuga

SEQ ID NO: 1434347 - RNA, 19 nt, Homo sapiens
gcaccacgaagaagaaguu

SEQ ID NO: 1434348 - RNA, 19 nt, Homo sapiens
caagucaugcuauguguug

SEQ ID NO: 1434349 - RNA, 19 nt, Homo sapiens
gcuguauacugauucaugu

SEQ ID NO: 1434350 - RNA, 19 nt, Homo sapiens
ugaacaaacagauguaaug

SEQ ID NO: 1434351 - RNA, 19 nt, Homo sapiens
gacauacuguuccucuuuc

SEQ ID NO: 1434352 - RNA, 19 nt, Homo sapiens
ugucagaacaugugcagua

SEQ ID NO: 1434353 - RNA, 19 nt, Homo sapiens
uaggcgguguuucuuauuu

SEQ ID NO: 1434354 - RNA, 19 nt, Homo sapiens
gcucuuuauuucaggauga

SEQ ID NO: 1434355 - RNA, 19 nt, Homo sapiens
gaaauggcugcugcacaua

SEQ ID NO: 1434356 - RNA, 19 nt, Homo sapiens
gucagaacaugugcaguaa

SEQ ID NO: 1434357 - RNA, 19 nt, Homo sapiens
gguuaucaauguuuagcuu

SEQ ID NO: 1434358 - RNA, 19 nt, Homo sapiens
ucagauggcauuacaggaa

SEQ ID NO: 1434359 - RNA, 19 nt, Homo sapiens
cuccuaagauucgaagaua

SEQ ID NO: 1434360 - RNA, 19 nt, Homo sapiens
gggaagcaagcaaagcaua

SEQ ID NO: 1434361 - RNA, 19 nt, Homo sapiens
caugcuauguguuguacaa

SEQ ID NO: 1434362 - RNA, 19 nt, Homo sapiens
gcuauuccuuucccagaug

SEQ ID NO: 1434363 - RNA, 19 nt, Homo sapiens
gagcgcaacgggacuauca

SEQ ID NO: 1434364 - RNA, 19 nt, Homo sapiens
agcgaaggcucuuugaauu

SEQ ID NO: 1434365 - RNA, 19 nt, Homo sapiens
ucugggagcugccugaugu

SEQ ID NO: 1434366 - RNA, 19 nt, Homo sapiens
caacgggacuaucaaaaug

SEQ ID NO: 1434367 - RNA, 19 nt, Homo sapiens
ggaaagcaacagccaaugg

SEQ ID NO: 1434368 - RNA, 19 nt, Homo sapiens
ggagaucaagucaggauuc

SEQ ID NO: 1434369 - RNA, 19 nt, Homo sapiens
cagaacaugugcaguaaaa

SEQ ID NO: 1434370 - RNA, 19 nt, Homo sapiens
ggaguucuggugaccuuaa

SEQ ID NO: 1434371 - RNA, 19 nt, Homo sapiens
gcucuggcaugcccucaau

SEQ ID NO: 1434372 - RNA, 19 nt, Homo sapiens
gagggaagacuacugaaag

SEQ ID NO: 1434373 - RNA, 19 nt, Homo sapiens
gcauugauuuacuacaagu

SEQ ID NO: 1434374 - RNA, 19 nt, Homo sapiens
aggcgguguuucuuauuua

SEQ ID NO: 1434375 - RNA, 19 nt, Homo sapiens
ggagaaaccaccagacacu

SEQ ID NO: 1434376 - RNA, 19 nt, Homo sapiens
cugaauaucccauagaaau

SEQ ID NO: 1434377 - RNA, 19 nt, Homo sapiens
cagcgaaggcucuuugaau

SEQ ID NO: 1434378 - RNA, 19 nt, Homo sapiens
gauaugcuaccuuucacaa

SEQ ID NO: 1434379 - RNA, 19 nt, Homo sapiens
aagcaaagcauacaugaca

SEQ ID NO: 1434380 - RNA, 19 nt, Homo sapiens
cugcauugauuuacuacaa

SEQ ID NO: 1434381 - RNA, 19 nt, Homo sapiens
gagaaaccaccagacacua

SEQ ID NO: 1434382 - RNA, 19 nt, Homo sapiens
ucggcucucugccuauaua

SEQ ID NO: 1434383 - RNA, 19 nt, Homo sapiens
cagacaagagauuucauuu

SEQ ID NO: 1434384 - RNA, 19 nt, Homo sapiens
gcagcuggaaccuuaaaug

SEQ ID NO: 1434385 - RNA, 19 nt, Homo sapiens
gcagcaagcagccagaagu

SEQ ID NO: 1434386 - RNA, 19 nt, Homo sapiens
ccuuaacucugaauaccaa

SEQ ID NO: 1434387 - RNA, 19 nt, Homo sapiens
gacauguuauccuuugcaa

SEQ ID NO: 1434388 - RNA, 19 nt, Homo sapiens
caagucaggauuccauaug

SEQ ID NO: 1434389 - RNA, 19 nt, Homo sapiens
gaaaccaccagacacuauc

SEQ ID NO: 1434390 - RNA, 19 nt, Homo sapiens
ugauaccugcucuuuauuu

SEQ ID NO: 1434391 - RNA, 19 nt, Homo sapiens
uggaagguuucgugacuga

SEQ ID NO: 1434392 - RNA, 19 nt, Homo sapiens
caaggccuuugaaguggaa

SEQ ID NO: 1434393 - RNA, 19 nt, Homo sapiens
ugaauuaucacagacaaga

SEQ ID NO: 1434394 - RNA, 19 nt, Homo sapiens
gaaguaacauuucuaguug

SEQ ID NO: 1434395 - RNA, 19 nt, Homo sapiens
gaacauuccuugcagaaga

SEQ ID NO: 1434396 - RNA, 19 nt, Homo sapiens
gcugagaacugaacaaaga

SEQ ID NO: 1434397 - RNA, 19 nt, Homo sapiens
gaacagaagaagaucauaa

SEQ ID NO: 1434398 - RNA, 19 nt, Homo sapiens
cuagauagaucguucuuaa

SEQ ID NO: 1434399 - RNA, 19 nt, Homo sapiens
gaacaggaacgugccauua

SEQ ID NO: 1434400 - RNA, 19 nt, Homo sapiens
gaaguccgcucccaguauu

SEQ ID NO: 1434401 - RNA, 19 nt, Homo sapiens
guaccuuucucuuacuuua

SEQ ID NO: 1434402 - RNA, 19 nt, Homo sapiens
ggaaggcaguagcauguuu

SEQ ID NO: 1434403 - RNA, 19 nt, Homo sapiens
aaggugagcugggaaauua

SEQ ID NO: 1434404 - RNA, 19 nt, Homo sapiens
ugacauaccacguaagaua

SEQ ID NO: 1434405 - RNA, 19 nt, Homo sapiens
aauaagggauguugacuuu

SEQ ID NO: 1434406 - RNA, 19 nt, Homo sapiens
ucaaacaacugccugagaa

SEQ ID NO: 1434407 - RNA, 19 nt, Homo sapiens
gaagugcaccgguuuggua

SEQ ID NO: 1434408 - RNA, 19 nt, Homo sapiens
gaacaauagggaacaagua

SEQ ID NO: 1434409 - RNA, 19 nt, Homo sapiens
uugguaagcuugacuauuu

SEQ ID NO: 1434410 - RNA, 19 nt, Homo sapiens
gaggacaggugagugauuu

SEQ ID NO: 1434411 - RNA, 19 nt, Homo sapiens
caucggagcugagaacuga

SEQ ID NO: 1434412 - RNA, 19 nt, Homo sapiens
ggagagagauguggauaca

SEQ ID NO: 1434413 - RNA, 19 nt, Homo sapiens
gaaagaaccaagaaucuag

SEQ ID NO: 1434414 - RNA, 19 nt, Homo sapiens
ccugagaacugaauuagga

SEQ ID NO: 1434415 - RNA, 19 nt, Homo sapiens
ucaaggaacuuagagaaga

SEQ ID NO: 1434416 - RNA, 19 nt, Homo sapiens
ccagaaccuuuacgacuuu

SEQ ID NO: 1434417 - RNA, 19 nt, Homo sapiens
guagagaggcugaaagaga

SEQ ID NO: 1434418 - RNA, 19 nt, Homo sapiens
uaagggauguugacuuugu

SEQ ID NO: 1434419 - RNA, 19 nt, Homo sapiens
ccaccgaucuguaucuguu

SEQ ID NO: 1434420 - RNA, 19 nt, Homo sapiens
gaaccaagaaucuaguaau

SEQ ID NO: 1434421 - RNA, 19 nt, Homo sapiens
agauagagcaccguaauua

SEQ ID NO: 1434422 - RNA, 19 nt, Homo sapiens
ggaacaaguagaaguggua

SEQ ID NO: 1434423 - RNA, 19 nt, Homo sapiens
aaacagaacagaagaagau

SEQ ID NO: 1434424 - RNA, 19 nt, Homo sapiens
gaucauaacaagaacacaa

SEQ ID NO: 1434425 - RNA, 19 nt, Homo sapiens
uacagaaggugaaacagaa

SEQ ID NO: 1434426 - RNA, 19 nt, Homo sapiens
guacagaaggugaaacaga

SEQ ID NO: 1434427 - RNA, 19 nt, Homo sapiens
uuaguaaacugcccaagau

SEQ ID NO: 1434428 - RNA, 19 nt, Homo sapiens
gguuugguaucacggguua

SEQ ID NO: 1434429 - RNA, 19 nt, Homo sapiens
uauaguaccuuucucuuac

SEQ ID NO: 1434430 - RNA, 19 nt, Homo sapiens
uguauagccugcucuuuga

SEQ ID NO: 1434431 - RNA, 19 nt, Homo sapiens
cuaccugguucucucauaa

SEQ ID NO: 1434432 - RNA, 19 nt, Homo sapiens
cagaagaagaucauaaaga

SEQ ID NO: 1434433 - RNA, 19 nt, Homo sapiens
cagcaugaaugugaaguga

SEQ ID NO: 1434434 - RNA, 19 nt, Homo sapiens
gcuguaaucacacuaaaga

SEQ ID NO: 1434435 - RNA, 19 nt, Homo sapiens
gaaggugagcugggaaauu

SEQ ID NO: 1434436 - RNA, 19 nt, Homo sapiens
uugaggagcuucauuguag

SEQ ID NO: 1434437 - RNA, 19 nt, Homo sapiens
ugucuuagguauuggugua

SEQ ID NO: 1434438 - RNA, 19 nt, Homo sapiens
gauagagcaccguaauuau

SEQ ID NO: 1434439 - RNA, 19 nt, Homo sapiens
gguagaauuucacagcaau

SEQ ID NO: 1434440 - RNA, 19 nt, Homo sapiens
gcaugaaugugaagugaac

SEQ ID NO: 1434441 - RNA, 19 nt, Homo sapiens
ugaaagagagcauugugaa

SEQ ID NO: 1434442 - RNA, 19 nt, Homo sapiens
gcaugugggugucuuaggu

SEQ ID NO: 1434443 - RNA, 19 nt, Homo sapiens
gaguuacuguuucagaaug

SEQ ID NO: 1434444 - RNA, 19 nt, Homo sapiens
gauguugacuuuguugcuu

SEQ ID NO: 1434445 - RNA, 19 nt, Homo sapiens
gaauaagggauguugacuu

SEQ ID NO: 1434446 - RNA, 19 nt, Homo sapiens
gagcugagaacugaacaaa

SEQ ID NO: 1434447 - RNA, 19 nt, Homo sapiens
gaauguaugugguguugcu

SEQ ID NO: 1434448 - RNA, 19 nt, Homo sapiens
cacaagaauuuaaccuaga

SEQ ID NO: 1434449 - RNA, 19 nt, Homo sapiens
aaguagaagugguagaauu

SEQ ID NO: 1434450 - RNA, 19 nt, Homo sapiens
caauagggaacaaguagaa

SEQ ID NO: 1434451 - RNA, 19 nt, Homo sapiens
guuccucccucuucccuaa

SEQ ID NO: 1434452 - RNA, 19 nt, Homo sapiens
ugaaagaaccaagaaucua

SEQ ID NO: 1434453 - RNA, 19 nt, Homo sapiens
gaaacagaacagaagaaga

SEQ ID NO: 1434454 - RNA, 19 nt, Homo sapiens
gcaguuugcauuuccaaga

SEQ ID NO: 1434455 - RNA, 19 nt, Homo sapiens
ggaugaaccuacugaugag

SEQ ID NO: 1434456 - RNA, 19 nt, Homo sapiens
gagacuggcccaagaaaca

SEQ ID NO: 1434457 - RNA, 19 nt, Homo sapiens
gcauuucacagacugcuuu

SEQ ID NO: 1434458 - RNA, 19 nt, Homo sapiens
uuagagcgcuucacugucu

SEQ ID NO: 1434459 - RNA, 19 nt, Homo sapiens
ugguaagcuugacuauuua

SEQ ID NO: 1434460 - RNA, 19 nt, Homo sapiens
gaaagagcugguagcagaa

SEQ ID NO: 1434461 - RNA, 19 nt, Homo sapiens
gugggugucuuagguauug

SEQ ID NO: 1434462 - RNA, 19 nt, Homo sapiens
uaagauagagcaccguaau

SEQ ID NO: 1434463 - RNA, 19 nt, Homo sapiens
uggaugaaccuacugauga

SEQ ID NO: 1434464 - RNA, 19 nt, Homo sapiens
acaggaacgugccauuaug

SEQ ID NO: 1434465 - RNA, 19 nt, Homo sapiens
gaaagagagcauugugaag

SEQ ID NO: 1434466 - RNA, 19 nt, Homo sapiens
uagagcaccguaauuauga

SEQ ID NO: 1434467 - RNA, 19 nt, Homo sapiens
guaaacugcccaagaucaa

SEQ ID NO: 1434468 - RNA, 19 nt, Homo sapiens
cauguucacugguauuugg

SEQ ID NO: 1434469 - RNA, 19 nt, Homo sapiens
ucacuccuguuucauguuc

SEQ ID NO: 1434470 - RNA, 19 nt, Homo sapiens
ugacuuuguugcuuuauac

SEQ ID NO: 1434471 - RNA, 19 nt, Homo sapiens
caguuugcauuuccaagaa

SEQ ID NO: 1434472 - RNA, 19 nt, Homo sapiens
gcuucacugucucucauuu

SEQ ID NO: 1434473 - RNA, 19 nt, Homo sapiens
guggauacacaagaauuua

SEQ ID NO: 1434474 - RNA, 19 nt, Homo sapiens
uagaagugguagaauuuca

SEQ ID NO: 1434475 - RNA, 19 nt, Homo sapiens
cagcuguaaucacacuaaa

SEQ ID NO: 1434476 - RNA, 19 nt, Homo sapiens
caaggaacuuagagaagag

SEQ ID NO: 1434477 - RNA, 19 nt, Homo sapiens
caagaagagagaugugaug

SEQ ID NO: 1434478 - RNA, 19 nt, Homo sapiens
guucuuaacacgcauuuca

SEQ ID NO: 1434479 - RNA, 19 nt, Homo sapiens
gggaacaacugagucaacu

SEQ ID NO: 1434480 - RNA, 19 nt, Homo sapiens
gagaaggugagcugggaaa

SEQ ID NO: 1434481 - RNA, 19 nt, Homo sapiens
uuaggaaguuucuccaauc

SEQ ID NO: 1434482 - RNA, 19 nt, Homo sapiens
gucaaaguaggauuuagua

SEQ ID NO: 1434483 - RNA, 19 nt, Homo sapiens
ggaggacaggugagugauu

SEQ ID NO: 1434484 - RNA, 19 nt, Homo sapiens
ggaacaggaacgugccauu

SEQ ID NO: 1434485 - RNA, 19 nt, Homo sapiens
cgccagaucauaacaagaa

SEQ ID NO: 1434486 - RNA, 19 nt, Homo sapiens
uccagaaccuuuacgacuu

SEQ ID NO: 1434487 - RNA, 19 nt, Homo sapiens
acaacugccugagaacuga

SEQ ID NO: 1434488 - RNA, 19 nt, Homo sapiens
gaacacaaagcaggcuaau

SEQ ID NO: 1434489 - RNA, 19 nt, Homo sapiens
acugguauuuggugcauuu

SEQ ID NO: 1434490 - RNA, 19 nt, Homo sapiens
ggauuggacagguuggaaa

SEQ ID NO: 1434491 - RNA, 19 nt, Homo sapiens
agacugcaguggccugguu

SEQ ID NO: 1434492 - RNA, 19 nt, Homo sapiens
gcagaagaaaccagugcaa

SEQ ID NO: 1434493 - RNA, 19 nt, Homo sapiens
aagagagcauugugaagga

SEQ ID NO: 1434494 - RNA, 19 nt, Homo sapiens
gcaaaucaauguuggaguu

SEQ ID NO: 1434495 - RNA, 19 nt, Homo sapiens
gcuaaugaauucuguguuu

SEQ ID NO: 1434496 - RNA, 19 nt, Homo sapiens
gaggagugcugcaaagauu

SEQ ID NO: 1434497 - RNA, 19 nt, Homo sapiens
caacagcccuccuuauguc

SEQ ID NO: 1434498 - RNA, 19 nt, Homo sapiens
acaccuagauuccuauuug

SEQ ID NO: 1434499 - RNA, 19 nt, Homo sapiens
gaagcugacaacccaaaua

SEQ ID NO: 1434500 - RNA, 19 nt, Homo sapiens
gauuaacuguguagccauu

SEQ ID NO: 1434501 - RNA, 19 nt, Homo sapiens
gcucuuaaacuuccagauu

SEQ ID NO: 1434502 - RNA, 19 nt, Homo sapiens
gcaaggagcugcgcuucca

SEQ ID NO: 1434503 - RNA, 19 nt, Homo sapiens
caacaagggcaaaucaaug

SEQ ID NO: 1434504 - RNA, 19 nt, Homo sapiens
cucuuaaacuuccagauua

SEQ ID NO: 1434505 - RNA, 19 nt, Homo sapiens
cuagauuccuauuugcuaa

SEQ ID NO: 1434506 - RNA, 19 nt, Homo sapiens
gcaauaugcauucuuccaa

SEQ ID NO: 1434507 - RNA, 19 nt, Homo sapiens
gauauucgccaccaaaugg

SEQ ID NO: 1434508 - RNA, 19 nt, Homo sapiens
ggugcugacuuaaagaaug

SEQ ID NO: 1434509 - RNA, 19 nt, Homo sapiens
ucaguccacuuuacaacaa

SEQ ID NO: 1434510 - RNA, 19 nt, Homo sapiens
gaauggggcucuagugguu

SEQ ID NO: 1434511 - RNA, 19 nt, Homo sapiens
uggaggcacuucaggaauu

SEQ ID NO: 1434512 - RNA, 19 nt, Homo sapiens
gaugauauucgccaccaaa

SEQ ID NO: 1434513 - RNA, 19 nt, Homo sapiens
ggcccuggaugaugauauu

SEQ ID NO: 1434514 - RNA, 19 nt, Homo sapiens
caacccaaauacagggauu

SEQ ID NO: 1434515 - RNA, 19 nt, Homo sapiens
agauugcgcuaaugaauuc

SEQ ID NO: 1434516 - RNA, 19 nt, Homo sapiens
acaaggagaagaaagauau

SEQ ID NO: 1434517 - RNA, 19 nt, Homo sapiens
gguguuggcucauuauucg

SEQ ID NO: 1434518 - RNA, 19 nt, Homo sapiens
cugaggcccuggcaucuuu

SEQ ID NO: 1434519 - RNA, 19 nt, Homo sapiens
gggcucuagugguuuauga

SEQ ID NO: 1434520 - RNA, 19 nt, Homo sapiens
ggaggcacuucaggaauuc

SEQ ID NO: 1434521 - RNA, 19 nt, Homo sapiens
gcugggcaguugggcaaua

SEQ ID NO: 1434522 - RNA, 19 nt, Homo sapiens
ugucuuugcagcuuuguua

SEQ ID NO: 1434523 - RNA, 19 nt, Homo sapiens
ccuuaugucugcuauguca

SEQ ID NO: 1434524 - RNA, 19 nt, Homo sapiens
caguagcacuaaaagauua

SEQ ID NO: 1434525 - RNA, 19 nt, Homo sapiens
gcuaagagaucccuuuucu

SEQ ID NO: 1434526 - RNA, 19 nt, Homo sapiens
caaagauugcgcuaaugaa

SEQ ID NO: 1434527 - RNA, 19 nt, Homo sapiens
caucuucaguccacuuuac

SEQ ID NO: 1434528 - RNA, 19 nt, Homo sapiens
caagggcaaaucaauguug

SEQ ID NO: 1434529 - RNA, 19 nt, Homo sapiens
ccaacagcccuccuuaugu

SEQ ID NO: 1434530 - RNA, 19 nt, Homo sapiens
aggagguguuggcucauua

SEQ ID NO: 1434531 - RNA, 19 nt, Homo sapiens
ccaacaagggcaaaucaau

SEQ ID NO: 1434532 - RNA, 19 nt, Homo sapiens
aaagauugcgcuaaugaau

SEQ ID NO: 1434533 - RNA, 19 nt, Homo sapiens
ggaggagugcugcaaagau

SEQ ID NO: 1434534 - RNA, 19 nt, Homo sapiens
ucuagugguuuaugagaug

SEQ ID NO: 1434535 - RNA, 19 nt, Homo sapiens
gucccguggugcugacuua

SEQ ID NO: 1434536 - RNA, 19 nt, Homo sapiens
caggagguguuggcucauu

SEQ ID NO: 1434537 - RNA, 19 nt, Homo sapiens
caacugcuacacuggaaug

SEQ ID NO: 1434538 - RNA, 19 nt, Homo sapiens
ccauuucaguagcacuaaa

SEQ ID NO: 1434539 - RNA, 19 nt, Homo sapiens
ugucuccuuucuaagauuu

SEQ ID NO: 1434540 - RNA, 19 nt, Homo sapiens
caggagcuaaugacaguuu

SEQ ID NO: 1434541 - RNA, 19 nt, Homo sapiens
gugcugacuuaaagaaugg

SEQ ID NO: 1434542 - RNA, 19 nt, Homo sapiens
cuaggcauccacccacaua

SEQ ID NO: 1434543 - RNA, 19 nt, Homo sapiens
caaggagaagaaagauauu

SEQ ID NO: 1434544 - RNA, 19 nt, Homo sapiens
gguggaggcacuucaggaa

SEQ ID NO: 1434545 - RNA, 19 nt, Homo sapiens
uccaggagcuaaugacagu

SEQ ID NO: 1434546 - RNA, 19 nt, Homo sapiens
ggauuggugccuuccgauu

SEQ ID NO: 1434547 - RNA, 19 nt, Homo sapiens
gcucuagugguuuaugaga

SEQ ID NO: 1434548 - RNA, 19 nt, Homo sapiens
cacaaggagaagaaagaua

SEQ ID NO: 1434549 - RNA, 19 nt, Homo sapiens
ggagguguuggcucauuau

SEQ ID NO: 1434550 - RNA, 19 nt, Homo sapiens
gauuggugccuuccgauuc

SEQ ID NO: 1434551 - RNA, 19 nt, Homo sapiens
aagauugcgcuaaugaauu

SEQ ID NO: 1434552 - RNA, 19 nt, Homo sapiens
gagaucccuuuucuuacua

SEQ ID NO: 1434553 - RNA, 19 nt, Homo sapiens
ccuagauuccuauuugcua

SEQ ID NO: 1434554 - RNA, 19 nt, Homo sapiens
uuaugucuccuuucuaaga

SEQ ID NO: 1434555 - RNA, 19 nt, Homo sapiens
gcugacaacccaaauacag

SEQ ID NO: 1434556 - RNA, 19 nt, Homo sapiens
gcuauggccgagugaaugu

SEQ ID NO: 1434557 - RNA, 19 nt, Homo sapiens
gcuugucuuugcagcuuug

SEQ ID NO: 1434558 - RNA, 19 nt, Homo sapiens
ugggcaauaugcauucuuc

SEQ ID NO: 1434559 - RNA, 19 nt, Homo sapiens
gcaguugggcaauaugcau

SEQ ID NO: 1434560 - RNA, 19 nt, Homo sapiens
uccaacagcccuccuuaug

SEQ ID NO: 1434561 - RNA, 19 nt, Homo sapiens
uaugucuccuuucuaagau

SEQ ID NO: 1434562 - RNA, 19 nt, Homo sapiens
ggaguuccaggagcuaaug

SEQ ID NO: 1434563 - RNA, 19 nt, Homo sapiens
ggaagcugacaacccaaau

SEQ ID NO: 1434564 - RNA, 19 nt, Homo sapiens
cuuugggaguuuccaguuu

SEQ ID NO: 1434565 - RNA, 19 nt, Homo sapiens
gcgcuaaugaauucugugu

SEQ ID NO: 1434566 - RNA, 19 nt, Homo sapiens
cuguguagccauuucagua

SEQ ID NO: 1434567 - RNA, 19 nt, Homo sapiens
uuaacuguguagccauuuc

SEQ ID NO: 1434568 - RNA, 19 nt, Homo sapiens
ccuccaacagcccuccuua

SEQ ID NO: 1434569 - RNA, 19 nt, Homo sapiens
caguccacuuuacaacaaa

SEQ ID NO: 1434570 - RNA, 19 nt, Homo sapiens
gagguguuggcucauuauu

SEQ ID NO: 1434571 - RNA, 19 nt, Homo sapiens
gagaugguucccuccaaca

SEQ ID NO: 1434572 - RNA, 19 nt, Homo sapiens
aacaagggcaaaucaaugu

SEQ ID NO: 1434573 - RNA, 19 nt, Homo sapiens
uaacuguguagccauuuca

SEQ ID NO: 1434574 - RNA, 19 nt, Homo sapiens
ccguggugcugacuuaaag

SEQ ID NO: 1434575 - RNA, 19 nt, Homo sapiens
gggcuauggccgagugaau

SEQ ID NO: 1434576 - RNA, 19 nt, Homo sapiens
ccacaaggagaagaaagau

SEQ ID NO: 1434577 - RNA, 19 nt, Homo sapiens
aaacuuccagauuaacugu

SEQ ID NO: 1434578 - RNA, 19 nt, Homo sapiens
uaaacuuccagauuaacug

SEQ ID NO: 1434579 - RNA, 19 nt, Homo sapiens
aaacaucuucaguccacuu

SEQ ID NO: 1434580 - RNA, 19 nt, Homo sapiens
caaaucaauguuggaguuc

SEQ ID NO: 1434581 - RNA, 19 nt, Homo sapiens
ggaaguaccucuuuaauua

SEQ ID NO: 1434582 - RNA, 19 nt, Homo sapiens
gaaauucuaccaccuauua

SEQ ID NO: 1434583 - RNA, 19 nt, Homo sapiens
gaagaaggcuaaccucgaa

SEQ ID NO: 1434584 - RNA, 19 nt, Homo sapiens
gaacaauuccgaagugaaa

SEQ ID NO: 1434585 - RNA, 19 nt, Homo sapiens
ggaaauauacuugcuauga

SEQ ID NO: 1434586 - RNA, 19 nt, Homo sapiens
ggaaggcacuggaggaguu

SEQ ID NO: 1434587 - RNA, 19 nt, Homo sapiens
gcauauaucaggcauuuaa

SEQ ID NO: 1434588 - RNA, 19 nt, Homo sapiens
gagaggagcucagaagaga

SEQ ID NO: 1434589 - RNA, 19 nt, Homo sapiens
uaacaguucugaaaggaaa

SEQ ID NO: 1434590 - RNA, 19 nt, Homo sapiens
gggcauauaucaggcauuu

SEQ ID NO: 1434591 - RNA, 19 nt, Homo sapiens
gagaagagaagaaggcuaa

SEQ ID NO: 1434592 - RNA, 19 nt, Homo sapiens
gaccuaaaguuaagcagaa

SEQ ID NO: 1434593 - RNA, 19 nt, Homo sapiens
ggagaaugaugcagcaguu

SEQ ID NO: 1434594 - RNA, 19 nt, Homo sapiens
gaugaugaaucucuacaau

SEQ ID NO: 1434595 - RNA, 19 nt, Homo sapiens
gcuauaggguucggaagua

SEQ ID NO: 1434596 - RNA, 19 nt, Homo sapiens
agauaucaccgaaguauua

SEQ ID NO: 1434597 - RNA, 19 nt, Homo sapiens
caccgaagaccuaaaguua

SEQ ID NO: 1434598 - RNA, 19 nt, Homo sapiens
guucggaaguaccucuuua

SEQ ID NO: 1434599 - RNA, 19 nt, Homo sapiens
gaagccaucugcauuuuaa

SEQ ID NO: 1434600 - RNA, 19 nt, Homo sapiens
ccaccagccuuacugauug

SEQ ID NO: 1434601 - RNA, 19 nt, Homo sapiens
ggaggaguuugcagaaaug

SEQ ID NO: 1434602 - RNA, 19 nt, Homo sapiens
ucaacuaacugugcaggua

SEQ ID NO: 1434603 - RNA, 19 nt, Homo sapiens
caugggagcugcaauuaca

SEQ ID NO: 1434604 - RNA, 19 nt, Homo sapiens
aaagaacaauuccgaagug

SEQ ID NO: 1434605 - RNA, 19 nt, Homo sapiens
gaaagaaagagaagagaag

SEQ ID NO: 1434606 - RNA, 19 nt, Homo sapiens
gcaaguaugguccuauuuc

SEQ ID NO: 1434607 - RNA, 19 nt, Homo sapiens
ggaguuugcagaaaugaaa

SEQ ID NO: 1434608 - RNA, 19 nt, Homo sapiens
guauaaaggcgucagaaga

SEQ ID NO: 1434609 - RNA, 19 nt, Homo sapiens
uauaaaggcgucagaagaa

SEQ ID NO: 1434610 - RNA, 19 nt, Homo sapiens
gaaugaugcagcaguuaaa

SEQ ID NO: 1434611 - RNA, 19 nt, Homo sapiens
ggauuuccagacuguauua

SEQ ID NO: 1434612 - RNA, 19 nt, Homo sapiens
gaaccaaucgaugaguuaa

SEQ ID NO: 1434613 - RNA, 19 nt, Homo sapiens
gaaaugaaagaaagagaag

SEQ ID NO: 1434614 - RNA, 19 nt, Homo sapiens
gcagguagcauauuauacu

SEQ ID NO: 1434615 - RNA, 19 nt, Homo sapiens
uaacugugcagguagcaua

SEQ ID NO: 1434616 - RNA, 19 nt, Homo sapiens
ugacaaggauuuccagacu

SEQ ID NO: 1434617 - RNA, 19 nt, Homo sapiens
aguaugguccuauuucuua

SEQ ID NO: 1434618 - RNA, 19 nt, Homo sapiens
gcagaaagcaauaucaacu

SEQ ID NO: 1434619 - RNA, 19 nt, Homo sapiens
gaugucaaguucgggcaua

SEQ ID NO: 1434620 - RNA, 19 nt, Homo sapiens
ccgaagaccuaaaguuaag

SEQ ID NO: 1434621 - RNA, 19 nt, Homo sapiens
ugcaauggcugucaggauu

SEQ ID NO: 1434622 - RNA, 19 nt, Homo sapiens
gcauuuaucaagcaaguau

SEQ ID NO: 1434623 - RNA, 19 nt, Homo sapiens
acaauucacccuucagaaa

SEQ ID NO: 1434624 - RNA, 19 nt, Homo sapiens
ugaugaaucucuacaaugc

SEQ ID NO: 1434625 - RNA, 19 nt, Homo sapiens
cagaaccaaucgaugaguu

SEQ ID NO: 1434626 - RNA, 19 nt, Homo sapiens
cagguagcauauuauacua

SEQ ID NO: 1434627 - RNA, 19 nt, Homo sapiens
gagcucuucucaaaguaug

SEQ ID NO: 1434628 - RNA, 19 nt, Homo sapiens
agaaauggaucugugacaa

SEQ ID NO: 1434629 - RNA, 19 nt, Homo sapiens
caaguaugguccuauuucu

SEQ ID NO: 1434630 - RNA, 19 nt, Homo sapiens
aagcaaguaugguccuauu

SEQ ID NO: 1434631 - RNA, 19 nt, Homo sapiens
gagaaugaugcagcaguua

SEQ ID NO: 1434632 - RNA, 19 nt, Homo sapiens
caaguucgggcauauauca

SEQ ID NO: 1434633 - RNA, 19 nt, Homo sapiens
gaaaggaaaacacagauga

SEQ ID NO: 1434634 - RNA, 19 nt, Homo sapiens
gagauuaccaagcccgaaa

SEQ ID NO: 1434635 - RNA, 19 nt, Homo sapiens
agagaccaaugaugcaauu

SEQ ID NO: 1434636 - RNA, 19 nt, Homo sapiens
gugcagguagcauauuaua

SEQ ID NO: 1434637 - RNA, 19 nt, Homo sapiens
cagaaagcaauaucaacua

SEQ ID NO: 1434638 - RNA, 19 nt, Homo sapiens
acaaggauuuccagacugu

SEQ ID NO: 1434639 - RNA, 19 nt, Homo sapiens
gaaauggaucugugacaag

SEQ ID NO: 1434640 - RNA, 19 nt, Homo sapiens
agagaggaauggcugcaaa

SEQ ID NO: 1434641 - RNA, 19 nt, Homo sapiens
ccaaugaugcaauuaggaa

SEQ ID NO: 1434642 - RNA, 19 nt, Homo sapiens
cggaaguaccucuuuaauu

SEQ ID NO: 1434643 - RNA, 19 nt, Homo sapiens
caaagaacaauuccgaagu

SEQ ID NO: 1434644 - RNA, 19 nt, Homo sapiens
gaccaaugaugcaauuagg

SEQ ID NO: 1434645 - RNA, 19 nt, Homo sapiens
gaaagaguaccugaaaguc

SEQ ID NO: 1434646 - RNA, 19 nt, Homo sapiens
aaacacagaugaagauccu

SEQ ID NO: 1434647 - RNA, 19 nt, Homo sapiens
uguuguagauccauuuaga

SEQ ID NO: 1434648 - RNA, 19 nt, Homo sapiens
ucaaugcauuuaucaagca

SEQ ID NO: 1434649 - RNA, 19 nt, Homo sapiens
cgagauaucaccgaaguau

SEQ ID NO: 1434650 - RNA, 19 nt, Homo sapiens
caaagcugguuucgaggau

SEQ ID NO: 1434651 - RNA, 19 nt, Homo sapiens
cgaaagggaagagaagaaa

SEQ ID NO: 1434652 - RNA, 19 nt, Homo sapiens
ugaaagaguaccugaaagu

SEQ ID NO: 1434653 - RNA, 19 nt, Homo sapiens
cugugcagguagcauauua

SEQ ID NO: 1434654 - RNA, 19 nt, Homo sapiens
gguccuauuucuuacaaag

SEQ ID NO: 1434655 - RNA, 19 nt, Homo sapiens
ugaaagaaagagaagagaa

SEQ ID NO: 1434656 - RNA, 19 nt, Homo sapiens
uggaggaguuugcagaaau

SEQ ID NO: 1434657 - RNA, 19 nt, Homo sapiens
gaagugaaaauccuaagaa

SEQ ID NO: 1434658 - RNA, 19 nt, Homo sapiens
uggcagaaccaaucgauga

SEQ ID NO: 1434659 - RNA, 19 nt, Homo sapiens
uuaccaagcccgaaagaug

SEQ ID NO: 1434660 - RNA, 19 nt, Homo sapiens
gcauuuaaacaggauugua

SEQ ID NO: 1434661 - RNA, 19 nt, Homo sapiens
guaggaaauauacuugcua

SEQ ID NO: 1434662 - RNA, 19 nt, Homo sapiens
cuggacagauuguauaaag

SEQ ID NO: 1434663 - RNA, 19 nt, Homo sapiens
gugaaaauccuaagaaaug

SEQ ID NO: 1434664 - RNA, 19 nt, Homo sapiens
guacaucccaucaaugcau

SEQ ID NO: 1434665 - RNA, 19 nt, Homo sapiens
ucaccgaaguauuagaaca

SEQ ID NO: 1434666 - RNA, 19 nt, Homo sapiens
agaaugaugcagcaguuaa

SEQ ID NO: 1434667 - RNA, 19 nt, Homo sapiens
uugcagaaaugaaagaaag

SEQ ID NO: 1434668 - RNA, 19 nt, Homo sapiens
aaaaguacaucccaucaau

SEQ ID NO: 1434669 - RNA, 19 nt, Homo sapiens
uaacacaccgaagaccuaa

SEQ ID NO: 1434670 - RNA, 19 nt, Homo sapiens
gaagagaagaaaagagauu

SEQ ID NO: 1434671 - RNA, 19 nt, Homo sapiens
agaaccaaucgaugaguua

SEQ ID NO: 1434672 - RNA, 19 nt, Homo sapiens
gagauaucaccgaaguauu

SEQ ID NO: 1434673 - RNA, 19 nt, Homo sapiens
ggaaaacacagaugaagau

SEQ ID NO: 1434674 - RNA, 19 nt, Homo sapiens
uaucaccgaaguauuagaa

SEQ ID NO: 1434675 - RNA, 19 nt, Homo sapiens
gaagaaaagagauuaccaa

SEQ ID NO: 1434676 - RNA, 19 nt, Homo sapiens
cuaagaaauggaucuguga

SEQ ID NO: 1434677 - RNA, 19 nt, Homo sapiens
caucaaugcauuuaucaag

SEQ ID NO: 1434678 - RNA, 19 nt, Homo sapiens
caaucgaugaguuaaaguu

SEQ ID NO: 1434679 - RNA, 19 nt, Homo sapiens
uaaaggcgucagaagaaga

SEQ ID NO: 1434680 - RNA, 19 nt, Homo sapiens
aagcuggacagauuguaua

SEQ ID NO: 1434681 - RNA, 19 nt, Homo sapiens
gaagugagcucguggaaga

SEQ ID NO: 1434682 - RNA, 19 nt, Homo sapiens
gaaggaaugugaaucuguu

SEQ ID NO: 1434683 - RNA, 19 nt, Homo sapiens
ggacaacuccugcaaagaa

SEQ ID NO: 1434684 - RNA, 19 nt, Homo sapiens
guacaaguccuucaucaaa

SEQ ID NO: 1434685 - RNA, 19 nt, Homo sapiens
gaaaguaugaccuggaauu

SEQ ID NO: 1434686 - RNA, 19 nt, Homo sapiens
ggugguggaucucuguuua

SEQ ID NO: 1434687 - RNA, 19 nt, Homo sapiens
gcucaaugaucaggacuua

SEQ ID NO: 1434688 - RNA, 19 nt, Homo sapiens
agacauacccacagcauua

SEQ ID NO: 1434689 - RNA, 19 nt, Homo sapiens
gcgcgcagaucauauggua

SEQ ID NO: 1434690 - RNA, 19 nt, Homo sapiens
ggagaaauaugggaaagau

SEQ ID NO: 1434691 - RNA, 19 nt, Homo sapiens
gaaugugaaucuguuguuu

SEQ ID NO: 1434692 - RNA, 19 nt, Homo sapiens
ccaacauccuggagaauaa

SEQ ID NO: 1434693 - RNA, 19 nt, Homo sapiens
ugaagaaugucaucaagga

SEQ ID NO: 1434694 - RNA, 19 nt, Homo sapiens
gagaagauugacaaacuua

SEQ ID NO: 1434695 - RNA, 19 nt, Homo sapiens
gaauuccacuguugagguu

SEQ ID NO: 1434696 - RNA, 19 nt, Homo sapiens
aaagcuggcuacacugaua

SEQ ID NO: 1434697 - RNA, 19 nt, Homo sapiens
gaaaacagcuacaaggaau

SEQ ID NO: 1434698 - RNA, 19 nt, Homo sapiens
ccacgaaauucagauauga

SEQ ID NO: 1434699 - RNA, 19 nt, Homo sapiens
acaaauaucccauucaaga

SEQ ID NO: 1434700 - RNA, 19 nt, Homo sapiens
agacaaauaucccauucaa

SEQ ID NO: 1434701 - RNA, 19 nt, Homo sapiens
gaacugcccacgaaauuca

SEQ ID NO: 1434702 - RNA, 19 nt, Homo sapiens
gauguccuaugacgaauug

SEQ ID NO: 1434703 - RNA, 19 nt, Homo sapiens
gacaacuccugcaaagaaa

SEQ ID NO: 1434704 - RNA, 19 nt, Homo sapiens
ggaaagcuggcuacacuga

SEQ ID NO: 1434705 - RNA, 19 nt, Homo sapiens
gcgcagaucauaugguaaa

SEQ ID NO: 1434706 - RNA, 19 nt, Homo sapiens
agagauggauggaacagaa

SEQ ID NO: 1434707 - RNA, 19 nt, Homo sapiens
ggaacucccuaaagcugaa

SEQ ID NO: 1434708 - RNA, 19 nt, Homo sapiens
gaagauugacaaacuuaug

SEQ ID NO: 1434709 - RNA, 19 nt, Homo sapiens
ugauaagacucgcuauaug

SEQ ID NO: 1434710 - RNA, 19 nt, Homo sapiens
gaaauucaccaugucuauu

SEQ ID NO: 1434711 - RNA, 19 nt, Homo sapiens
cgaaggaggagaagaagaa

SEQ ID NO: 1434712 - RNA, 19 nt, Homo sapiens
gaaacugaacgucacagaa

SEQ ID NO: 1434713 - RNA, 19 nt, Homo sapiens
cccuaaagcugaagaaugu

SEQ ID NO: 1434714 - RNA, 19 nt, Homo sapiens
cacagacccuagcacuuua

SEQ ID NO: 1434715 - RNA, 19 nt, Homo sapiens
gcaacugccuccugcucaa

SEQ ID NO: 1434716 - RNA, 19 nt, Homo sapiens
uaaaggaaccaguggaaga

SEQ ID NO: 1434717 - RNA, 19 nt, Homo sapiens
gcaaagcuagugcuguuga

SEQ ID NO: 1434718 - RNA, 19 nt, Homo sapiens
cagaucauaugguaaagga

SEQ ID NO: 1434719 - RNA, 19 nt, Homo sapiens
cuucaggucuggaaaguau

SEQ ID NO: 1434720 - RNA, 19 nt, Homo sapiens
gaacgucacagaacaagag

SEQ ID NO: 1434721 - RNA, 19 nt, Homo sapiens
uuaaauagguccugagacu

SEQ ID NO: 1434722 - RNA, 19 nt, Homo sapiens
ccuagcacuuuauccuuua

SEQ ID NO: 1434723 - RNA, 19 nt, Homo sapiens
acacagacccuagcacuuu

SEQ ID NO: 1434724 - RNA, 19 nt, Homo sapiens
gauaagacucgcuauaugg

SEQ ID NO: 1434725 - RNA, 19 nt, Homo sapiens
acaaccagcuccucagaau

SEQ ID NO: 1434726 - RNA, 19 nt, Homo sapiens
guacaucucaccugacugu

SEQ ID NO: 1434727 - RNA, 19 nt, Homo sapiens
ucaccaagcuggccaugca

SEQ ID NO: 1434728 - RNA, 19 nt, Homo sapiens
cugcaaagcuagugcuguu

SEQ ID NO: 1434729 - RNA, 19 nt, Homo sapiens
aagagaagauugacaaacu

SEQ ID NO: 1434730 - RNA, 19 nt, Homo sapiens
ucgcaccucuuccuuagaa

SEQ ID NO: 1434731 - RNA, 19 nt, Homo sapiens
gaccuggaauucaaguuuc

SEQ ID NO: 1434732 - RNA, 19 nt, Homo sapiens
gguguucaaugucaucaau

SEQ ID NO: 1434733 - RNA, 19 nt, Homo sapiens
ccacaucgccgacuugucu

SEQ ID NO: 1434734 - RNA, 19 nt, Homo sapiens
gaacaagagaagauugaca

SEQ ID NO: 1434735 - RNA, 19 nt, Homo sapiens
aguaugaccuggaauucaa

SEQ ID NO: 1434736 - RNA, 19 nt, Homo sapiens
ucagacaaauaucccauuc

SEQ ID NO: 1434737 - RNA, 19 nt, Homo sapiens
gagacccaguggcuagaaa

SEQ ID NO: 1434738 - RNA, 19 nt, Homo sapiens
caugccacguugaagauaa

SEQ ID NO: 1434739 - RNA, 19 nt, Homo sapiens
ggaaugugaaucuguuguu

SEQ ID NO: 1434740 - RNA, 19 nt, Homo sapiens
caagaaggaaugugaaucu

SEQ ID NO: 1434741 - RNA, 19 nt, Homo sapiens
gcugaagaaugugauacaa

SEQ ID NO: 1434742 - RNA, 19 nt, Homo sapiens
guggaucucuguuuauuuu

SEQ ID NO: 1434743 - RNA, 19 nt, Homo sapiens
gguaaaggaaccaguggaa

SEQ ID NO: 1434744 - RNA, 19 nt, Homo sapiens
gcucaaagugaaccagauu

SEQ ID NO: 1434745 - RNA, 19 nt, Homo sapiens
uggaaaguaugaccuggaa

SEQ ID NO: 1434746 - RNA, 19 nt, Homo sapiens
gcuagaaauucaccauguc

SEQ ID NO: 1434747 - RNA, 19 nt, Homo sapiens
ggcuagaaauucaccaugu

SEQ ID NO: 1434748 - RNA, 19 nt, Homo sapiens
gggccaaaguccuacaauc

SEQ ID NO: 1434749 - RNA, 19 nt, Homo sapiens
uggcugaccuguacaaguc

SEQ ID NO: 1434750 - RNA, 19 nt, Homo sapiens
gggaagccaugcccauugg

SEQ ID NO: 1434751 - RNA, 19 nt, Homo sapiens
agagaagauugacaaacuu

SEQ ID NO: 1434752 - RNA, 19 nt, Homo sapiens
ucacagaacaagagaagau

SEQ ID NO: 1434753 - RNA, 19 nt, Homo sapiens
uauaagaguuuaggacaag

SEQ ID NO: 1434754 - RNA, 19 nt, Homo sapiens
gugacuugcucaaugauca

SEQ ID NO: 1434755 - RNA, 19 nt, Homo sapiens
gaggaugaucucagaguga

SEQ ID NO: 1434756 - RNA, 19 nt, Homo sapiens
gaagacugcgauugggaaa

SEQ ID NO: 1434757 - RNA, 19 nt, Homo sapiens
aaccacaggucaagaagga

SEQ ID NO: 1434758 - RNA, 19 nt, Homo sapiens
guucgcaccucuuccuuag

SEQ ID NO: 1434759 - RNA, 19 nt, Homo sapiens
ugaaugagaagaagugcaa

SEQ ID NO: 1434760 - RNA, 19 nt, Homo sapiens
ccaugucuauucucaagau

SEQ ID NO: 1434761 - RNA, 19 nt, Homo sapiens
cagcuacaaggaaugcuua

SEQ ID NO: 1434762 - RNA, 19 nt, Homo sapiens
guugauagccccagacaua

SEQ ID NO: 1434763 - RNA, 19 nt, Homo sapiens
aaaauuauccucucucuga

SEQ ID NO: 1434764 - RNA, 19 nt, Homo sapiens
guacaaccagcuccucaga

SEQ ID NO: 1434765 - RNA, 19 nt, Homo sapiens
ugaccuggaauucaaguuu

SEQ ID NO: 1434766 - RNA, 19 nt, Homo sapiens
ugggaaagcuggcuacacu

SEQ ID NO: 1434767 - RNA, 19 nt, Homo sapiens
cccuagcacuuuauccuuu

SEQ ID NO: 1434768 - RNA, 19 nt, Homo sapiens
cagaacaagagaagauuga

SEQ ID NO: 1434769 - RNA, 19 nt, Homo sapiens
caaauaucccauucaagau

SEQ ID NO: 1434770 - RNA, 19 nt, Homo sapiens
ccccaaagcuggcaguuuu

SEQ ID NO: 1434771 - RNA, 19 nt, Homo sapiens
agaaugucaucaaggagaa

SEQ ID NO: 1434772 - RNA, 19 nt, Homo sapiens
uaccacagccugaagaaug

SEQ ID NO: 1434773 - RNA, 19 nt, Homo sapiens
caccaugucuauucucaag

SEQ ID NO: 1434774 - RNA, 19 nt, Homo sapiens
cccacagcauuauauguaa

SEQ ID NO: 1434775 - RNA, 19 nt, Homo sapiens
gaaacaaccacaggucaag

SEQ ID NO: 1434776 - RNA, 19 nt, Homo sapiens
cuacugaagaucccuuuga

SEQ ID NO: 1434777 - RNA, 19 nt, Homo sapiens
aaccagcuccucagaauug

SEQ ID NO: 1434778 - RNA, 19 nt, Homo sapiens
cauggugccucaucauucu

SEQ ID NO: 1434779 - RNA, 19 nt, Homo sapiens
auacggaacucccuaaagc

SEQ ID NO: 1434780 - RNA, 19 nt, Homo sapiens
caacuccaaagucaucuug

SEQ ID NO: 1434781 - RNA, 19 nt, Homo sapiens
gaaggaaugugaaucuguu

SEQ ID NO: 1434782 - RNA, 19 nt, Homo sapiens
ccaagaggaucauauggua

SEQ ID NO: 1434783 - RNA, 19 nt, Homo sapiens
ggacaacuccugcaaagaa

SEQ ID NO: 1434784 - RNA, 19 nt, Homo sapiens
guacaaguccuucaucaaa

SEQ ID NO: 1434785 - RNA, 19 nt, Homo sapiens
gaaaguaugaccuggaauu

SEQ ID NO: 1434786 - RNA, 19 nt, Homo sapiens
ggugguggaucucuguuua

SEQ ID NO: 1434787 - RNA, 19 nt, Homo sapiens
gcucaaugaucaggacuua

SEQ ID NO: 1434788 - RNA, 19 nt, Homo sapiens
agacauacccacagcauua

SEQ ID NO: 1434789 - RNA, 19 nt, Homo sapiens
ggagaaauaugggaaagau

SEQ ID NO: 1434790 - RNA, 19 nt, Homo sapiens
gaaugugaaucuguuguuu

SEQ ID NO: 1434791 - RNA, 19 nt, Homo sapiens
ccaacauccuggagaauaa

SEQ ID NO: 1434792 - RNA, 19 nt, Homo sapiens
ugaagaaugucaucaagga

SEQ ID NO: 1434793 - RNA, 19 nt, Homo sapiens
gagaagauugacaaacuua

SEQ ID NO: 1434794 - RNA, 19 nt, Homo sapiens
ggcaaacuccagagaauua

SEQ ID NO: 1434795 - RNA, 19 nt, Homo sapiens
gaauuccacuguugagguu

SEQ ID NO: 1434796 - RNA, 19 nt, Homo sapiens
aaagcuggcuacacugaua

SEQ ID NO: 1434797 - RNA, 19 nt, Homo sapiens
gaaaacagcuacaaggaau

SEQ ID NO: 1434798 - RNA, 19 nt, Homo sapiens
ccacgaaauucagauauga

SEQ ID NO: 1434799 - RNA, 19 nt, Homo sapiens
acaaauaucccauucaaga

SEQ ID NO: 1434800 - RNA, 19 nt, Homo sapiens
agacaaauaucccauucaa

SEQ ID NO: 1434801 - RNA, 19 nt, Homo sapiens
gaacugcccacgaaauuca

SEQ ID NO: 1434802 - RNA, 19 nt, Homo sapiens
gauguccuaugacgaauug

SEQ ID NO: 1434803 - RNA, 19 nt, Homo sapiens
gacaacuccugcaaagaaa

SEQ ID NO: 1434804 - RNA, 19 nt, Homo sapiens
ggaaagcuggcuacacuga

SEQ ID NO: 1434805 - RNA, 19 nt, Homo sapiens
caggacgacuaaacagaua

SEQ ID NO: 1434806 - RNA, 19 nt, Homo sapiens
agagauggauggaacagaa

SEQ ID NO: 1434807 - RNA, 19 nt, Homo sapiens
ggaacucccuaaagcugaa

SEQ ID NO: 1434808 - RNA, 19 nt, Homo sapiens
gaagauugacaaacuuaug

SEQ ID NO: 1434809 - RNA, 19 nt, Homo sapiens
ugauaagacucgcuauaug

SEQ ID NO: 1434810 - RNA, 19 nt, Homo sapiens
gaaauucaccaugucuauu

SEQ ID NO: 1434811 - RNA, 19 nt, Homo sapiens
gaaacugaacgucacagaa

SEQ ID NO: 1434812 - RNA, 19 nt, Homo sapiens
cccuaaagcugaagaaugu

SEQ ID NO: 1434813 - RNA, 19 nt, Homo sapiens
cacagacccuagcacuuua

SEQ ID NO: 1434814 - RNA, 19 nt, Homo sapiens
gcaacugccuccugcucaa

SEQ ID NO: 1434815 - RNA, 19 nt, Homo sapiens
gcaaagcuagugcuguuga

SEQ ID NO: 1434816 - RNA, 19 nt, Homo sapiens
uaaaggaaccaguggaaga

SEQ ID NO: 1434817 - RNA, 19 nt, Homo sapiens
cuucaggucuggaaaguau

SEQ ID NO: 1434818 - RNA, 19 nt, Homo sapiens
gaacgucacagaacaagag

SEQ ID NO: 1434819 - RNA, 19 nt, Homo sapiens
uuaaauagguccugagacu

SEQ ID NO: 1434820 - RNA, 19 nt, Homo sapiens
ccuagcacuuuauccuuua

SEQ ID NO: 1434821 - RNA, 19 nt, Homo sapiens
acacagacccuagcacuuu

SEQ ID NO: 1434822 - RNA, 19 nt, Homo sapiens
gauaagacucgcuauaugg

SEQ ID NO: 1434823 - RNA, 19 nt, Homo sapiens
acaaccagcuccucagaau

SEQ ID NO: 1434824 - RNA, 19 nt, Homo sapiens
guacaucucaccugacugu

SEQ ID NO: 1434825 - RNA, 19 nt, Homo sapiens
ucaccaagcuggccaugca

SEQ ID NO: 1434826 - RNA, 19 nt, Homo sapiens
cugcaaagcuagugcuguu

SEQ ID NO: 1434827 - RNA, 19 nt, Homo sapiens
aagagaagauugacaaacu

SEQ ID NO: 1434828 - RNA, 19 nt, Homo sapiens
ucgcaccucuuccuuagaa

SEQ ID NO: 1434829 - RNA, 19 nt, Homo sapiens
gaccuggaauucaaguuuc

SEQ ID NO: 1434830 - RNA, 19 nt, Homo sapiens
gguguucaaugucaucaau

SEQ ID NO: 1434831 - RNA, 19 nt, Homo sapiens
ccacaucgccgacuugucu

SEQ ID NO: 1434832 - RNA, 19 nt, Homo sapiens
gaacaagagaagauugaca

SEQ ID NO: 1434833 - RNA, 19 nt, Homo sapiens
aguaugaccuggaauucaa

SEQ ID NO: 1434834 - RNA, 19 nt, Homo sapiens
gcaaacuccagagaauuaa

SEQ ID NO: 1434835 - RNA, 19 nt, Homo sapiens
gagacccaguggcuagaaa

SEQ ID NO: 1434836 - RNA, 19 nt, Homo sapiens
caugccacguugaagauaa

SEQ ID NO: 1434837 - RNA, 19 nt, Homo sapiens
ggaaugugaaucuguuguu

SEQ ID NO: 1434838 - RNA, 19 nt, Homo sapiens
caagaaggaaugugaaucu

SEQ ID NO: 1434839 - RNA, 19 nt, Homo sapiens
gcugaagaaugugauacaa

SEQ ID NO: 1434840 - RNA, 19 nt, Homo sapiens
ucagacaaauaucccauuc

SEQ ID NO: 1434841 - RNA, 19 nt, Homo sapiens
guggaucucuguuuauuuu

SEQ ID NO: 1434842 - RNA, 19 nt, Homo sapiens
gaauuaagaagccaaacuc

SEQ ID NO: 1434843 - RNA, 19 nt, Homo sapiens
gcucaaagugaaccagauu

SEQ ID NO: 1434844 - RNA, 19 nt, Homo sapiens
uggaaaguaugaccuggaa

SEQ ID NO: 1434845 - RNA, 19 nt, Homo sapiens
gguaaaggaaccaguggaa

SEQ ID NO: 1434846 - RNA, 19 nt, Homo sapiens
gcuagaaauucaccauguc

SEQ ID NO: 1434847 - RNA, 19 nt, Homo sapiens
ggcuagaaauucaccaugu

SEQ ID NO: 1434848 - RNA, 19 nt, Homo sapiens
gggccaaaguccuacaauc

SEQ ID NO: 1434849 - RNA, 19 nt, Homo sapiens
uggcugaccuguacaaguc

SEQ ID NO: 1434850 - RNA, 19 nt, Homo sapiens
gggaagccaugcccauugg

SEQ ID NO: 1434851 - RNA, 19 nt, Homo sapiens
agagaagauugacaaacuu

SEQ ID NO: 1434852 - RNA, 19 nt, Homo sapiens
ucacagaacaagagaagau

SEQ ID NO: 1434853 - RNA, 19 nt, Homo sapiens
uauaagaguuuaggacaag

SEQ ID NO: 1434854 - RNA, 19 nt, Homo sapiens
gugacuugcucaaugauca

SEQ ID NO: 1434855 - RNA, 19 nt, Homo sapiens
gaggaugaucucagaguga

SEQ ID NO: 1434856 - RNA, 19 nt, Homo sapiens
gaagacugcgauugggaaa

SEQ ID NO: 1434857 - RNA, 19 nt, Homo sapiens
aaccacaggucaagaagga

SEQ ID NO: 1434858 - RNA, 19 nt, Homo sapiens
caagaggaucauaugguaa

SEQ ID NO: 1434859 - RNA, 19 nt, Homo sapiens
guucgcaccucuuccuuag

SEQ ID NO: 1434860 - RNA, 19 nt, Homo sapiens
ugaaugagaagaagugcaa

SEQ ID NO: 1434861 - RNA, 19 nt, Homo sapiens
ccaugucuauucucaagau

SEQ ID NO: 1434862 - RNA, 19 nt, Homo sapiens
cagcuacaaggaaugcuua

SEQ ID NO: 1434863 - RNA, 19 nt, Homo sapiens
guugauagccccagacaua

SEQ ID NO: 1434864 - RNA, 19 nt, Homo sapiens
aaaauuauccucucucuga

SEQ ID NO: 1434865 - RNA, 19 nt, Homo sapiens
caaauaucccauucaagau

SEQ ID NO: 1434866 - RNA, 19 nt, Homo sapiens
guacaaccagcuccucaga

SEQ ID NO: 1434867 - RNA, 19 nt, Homo sapiens
cccuagcacuuuauccuuu

SEQ ID NO: 1434868 - RNA, 19 nt, Homo sapiens
ugaccuggaauucaaguuu

SEQ ID NO: 1434869 - RNA, 19 nt, Homo sapiens
ugggaaagcuggcuacacu

SEQ ID NO: 1434870 - RNA, 19 nt, Homo sapiens
cagaacaagagaagauuga

SEQ ID NO: 1434871 - RNA, 19 nt, Homo sapiens
ccccaaagcuggcaguuuu

SEQ ID NO: 1434872 - RNA, 19 nt, Homo sapiens
agaaugucaucaaggagaa

SEQ ID NO: 1434873 - RNA, 19 nt, Homo sapiens
uaccacagccugaagaaug

SEQ ID NO: 1434874 - RNA, 19 nt, Homo sapiens
caccaugucuauucucaag

SEQ ID NO: 1434875 - RNA, 19 nt, Homo sapiens
cccacagcauuauauguaa

SEQ ID NO: 1434876 - RNA, 19 nt, Homo sapiens
gaaacaaccacaggucaag

SEQ ID NO: 1434877 - RNA, 19 nt, Homo sapiens
cuacugaagaucccuuuga

SEQ ID NO: 1434878 - RNA, 19 nt, Homo sapiens
aaccagcuccucagaauug

SEQ ID NO: 1434879 - RNA, 19 nt, Homo sapiens
cauggugccucaucauucu

SEQ ID NO: 1434880 - RNA, 19 nt, Homo sapiens
caacuccaaagucaucuug

SEQ ID NO: 1434881 - RNA, 19 nt, Homo sapiens
gagauaagguuaaguguuu

SEQ ID NO: 1434882 - RNA, 19 nt, Homo sapiens
gcagaaagaucauagacaa

SEQ ID NO: 1434883 - RNA, 19 nt, Homo sapiens
gaaaggauguuacuagaag

SEQ ID NO: 1434884 - RNA, 19 nt, Homo sapiens
gaacaugucuucaucuucu

SEQ ID NO: 1434885 - RNA, 19 nt, Homo sapiens
gggcagaaguggcucauuu

SEQ ID NO: 1434886 - RNA, 19 nt, Homo sapiens
guaggaaagugauaguuaa

SEQ ID NO: 1434887 - RNA, 19 nt, Homo sapiens
gagaaaggauguuacuaga

SEQ ID NO: 1434888 - RNA, 19 nt, Homo sapiens
caacauggagauuagauua

SEQ ID NO: 1434889 - RNA, 19 nt, Homo sapiens
ggaguuaacuaaaggaugu

SEQ ID NO: 1434890 - RNA, 19 nt, Homo sapiens
gauucaagauggagagaua

SEQ ID NO: 1434891 - RNA, 19 nt, Homo sapiens
gaaauuuacuugucacucu

SEQ ID NO: 1434892 - RNA, 19 nt, Homo sapiens
cauccaagcuccuauguga

SEQ ID NO: 1434893 - RNA, 19 nt, Homo sapiens
gaagggacauagcaguauu

SEQ ID NO: 1434894 - RNA, 19 nt, Homo sapiens
gcuaugaggugucuugaga

SEQ ID NO: 1434895 - RNA, 19 nt, Homo sapiens
gacaguaccuucugacgaa

SEQ ID NO: 1434896 - RNA, 19 nt, Homo sapiens
gaacucagcgcccaucuug

SEQ ID NO: 1434897 - RNA, 19 nt, Homo sapiens
ugaggugucuugagaaauu

SEQ ID NO: 1434898 - RNA, 19 nt, Homo sapiens
gagcucagaucucaccauu

SEQ ID NO: 1434899 - RNA, 19 nt, Homo sapiens
caaaccagauggcuuguug

SEQ ID NO: 1434900 - RNA, 19 nt, Homo sapiens
ggaugaacuugauucguuu

SEQ ID NO: 1434901 - RNA, 19 nt, Homo sapiens
gagaggcagucuucaaguu

SEQ ID NO: 1434902 - RNA, 19 nt, Homo sapiens
gaagaagaauggaugaacu

SEQ ID NO: 1434903 - RNA, 19 nt, Homo sapiens
guuccugacuuguguuaua

SEQ ID NO: 1434904 - RNA, 19 nt, Homo sapiens
ggaaagugauaguuaacug

SEQ ID NO: 1434905 - RNA, 19 nt, Homo sapiens
gcucagaucucaccauugc

SEQ ID NO: 1434906 - RNA, 19 nt, Homo sapiens
ggagaaaggauguuacuag

SEQ ID NO: 1434907 - RNA, 19 nt, Homo sapiens
ggacauagcaguauuucag

SEQ ID NO: 1434908 - RNA, 19 nt, Homo sapiens
gaaaguuguucauggucuu

SEQ ID NO: 1434909 - RNA, 19 nt, Homo sapiens
uggaugaacuugauucguu

SEQ ID NO: 1434910 - RNA, 19 nt, Homo sapiens
uaaaugcacucauguuagg

SEQ ID NO: 1434911 - RNA, 19 nt, Homo sapiens
gagcauggaguuaacuaaa

SEQ ID NO: 1434912 - RNA, 19 nt, Homo sapiens
ggagagauaagguuaagug

SEQ ID NO: 1434913 - RNA, 19 nt, Homo sapiens
gaagaauggaugaacuuga

SEQ ID NO: 1434914 - RNA, 19 nt, Homo sapiens
gaaagaucauagacaacau

SEQ ID NO: 1434915 - RNA, 19 nt, Homo sapiens
guccuuaggugaaugaaga

SEQ ID NO: 1434916 - RNA, 19 nt, Homo sapiens
ucacauuucuuggacauau

SEQ ID NO: 1434917 - RNA, 19 nt, Homo sapiens
ccacuggaaucccaauaau

SEQ ID NO: 1434918 - RNA, 19 nt, Homo sapiens
cggaaaagcuuauaccaaa

SEQ ID NO: 1434919 - RNA, 19 nt, Homo sapiens
uaugaggugucuugagaaa

SEQ ID NO: 1434920 - RNA, 19 nt, Homo sapiens
gagcuuagacgacauaugc

SEQ ID NO: 1434921 - RNA, 19 nt, Homo sapiens
gcaagaugcccaugaccuu

SEQ ID NO: 1434922 - RNA, 19 nt, Homo sapiens
uaacacagaagaagaaugg

SEQ ID NO: 1434923 - RNA, 19 nt, Homo sapiens
gauuagagcaaggauguaa

SEQ ID NO: 1434924 - RNA, 19 nt, Homo sapiens
cgacugagcgagacucuau

SEQ ID NO: 1434925 - RNA, 19 nt, Homo sapiens
gcagaaguggcucauuuau

SEQ ID NO: 1434926 - RNA, 19 nt, Homo sapiens
ggcagaaguggcucauuua

SEQ ID NO: 1434927 - RNA, 19 nt, Homo sapiens
ucucaggacucucuuguca

SEQ ID NO: 1434928 - RNA, 19 nt, Homo sapiens
aagaauggaugaacuugau

SEQ ID NO: 1434929 - RNA, 19 nt, Homo sapiens
gcgcccaucuugaacaugu

SEQ ID NO: 1434930 - RNA, 19 nt, Homo sapiens
ggccagggauggucucugu

SEQ ID NO: 1434931 - RNA, 19 nt, Homo sapiens
caguaaggauucagaagug

SEQ ID NO: 1434932 - RNA, 19 nt, Homo sapiens
gcacucauguuaggaaggu

SEQ ID NO: 1434933 - RNA, 19 nt, Homo sapiens
uaaaggggauggugcgaua

SEQ ID NO: 1434934 - RNA, 19 nt, Homo sapiens
cgacugugccuuccacuga

SEQ ID NO: 1434935 - RNA, 19 nt, Homo sapiens
gcauggaguuaacuaaagg

SEQ ID NO: 1434936 - RNA, 19 nt, Homo sapiens
cgaggcaggcggaucauuu

SEQ ID NO: 1434937 - RNA, 19 nt, Homo sapiens
ggugagaggccauauucuu

SEQ ID NO: 1434938 - RNA, 19 nt, Homo sapiens
ggaacccuccagugccuua

SEQ ID NO: 1434939 - RNA, 19 nt, Homo sapiens
aaauuagccuggcauaugg

SEQ ID NO: 1434940 - RNA, 19 nt, Homo sapiens
ggacaguaaggauucagaa

SEQ ID NO: 1434941 - RNA, 19 nt, Homo sapiens
gaugagcuuagacgacaua

SEQ ID NO: 1434942 - RNA, 19 nt, Homo sapiens
gagaaguaggaaagugaua

SEQ ID NO: 1434943 - RNA, 19 nt, Homo sapiens
gggagaaguaggaaaguga

SEQ ID NO: 1434944 - RNA, 19 nt, Homo sapiens
ggaagggacauagcaguau

SEQ ID NO: 1434945 - RNA, 19 nt, Homo sapiens
gaggugucuugagaaauuu

SEQ ID NO: 1434946 - RNA, 19 nt, Homo sapiens
gcaacauggagauuagauu

SEQ ID NO: 1434947 - RNA, 19 nt, Homo sapiens
cuacuucacugccuuuguc

SEQ ID NO: 1434948 - RNA, 19 nt, Homo sapiens
acuauggcauggacaguaa

SEQ ID NO: 1434949 - RNA, 19 nt, Homo sapiens
ucaggacucucuugucagu

SEQ ID NO: 1434950 - RNA, 19 nt, Homo sapiens
cagcaagagaugacgauuu

SEQ ID NO: 1434951 - RNA, 19 nt, Homo sapiens
aguaggaaagugauaguua

SEQ ID NO: 1434952 - RNA, 19 nt, Homo sapiens
gcugcaacauggagauuag

SEQ ID NO: 1434953 - RNA, 19 nt, Homo sapiens
gcgauagauucaagaugga

SEQ ID NO: 1434954 - RNA, 19 nt, Homo sapiens
gaggagaggcagucuucaa

SEQ ID NO: 1434955 - RNA, 19 nt, Homo sapiens
ccauauaaaugugaucagu

SEQ ID NO: 1434956 - RNA, 19 nt, Homo sapiens
uaaguaacacagaagaaga

SEQ ID NO: 1434957 - RNA, 19 nt, Homo sapiens
ggagaggaccagagugauc

SEQ ID NO: 1434958 - RNA, 19 nt, Homo sapiens
gcccagugcugccaagaag

SEQ ID NO: 1434959 - RNA, 19 nt, Homo sapiens
cacauuucuuggacauaua

SEQ ID NO: 1434960 - RNA, 19 nt, Homo sapiens
gugagaggccauauucuug

SEQ ID NO: 1434961 - RNA, 19 nt, Homo sapiens
cagcugagucccagucauu

SEQ ID NO: 1434962 - RNA, 19 nt, Homo sapiens
acauggagauuagauuaga

SEQ ID NO: 1434963 - RNA, 19 nt, Homo sapiens
gaaaccccaucucuacaaa

SEQ ID NO: 1434964 - RNA, 19 nt, Homo sapiens
cauuugagguuagagauuc

SEQ ID NO: 1434965 - RNA, 19 nt, Homo sapiens
gcagagcagaaagaucaua

SEQ ID NO: 1434966 - RNA, 19 nt, Homo sapiens
ggagcauggaguuaacuaa

SEQ ID NO: 1434967 - RNA, 19 nt, Homo sapiens
guaggagagcccaauauuc

SEQ ID NO: 1434968 - RNA, 19 nt, Homo sapiens
gauggagagauaagguuaa

SEQ ID NO: 1434969 - RNA, 19 nt, Homo sapiens
aaagaccuguggacucuag

SEQ ID NO: 1434970 - RNA, 19 nt, Homo sapiens
gcaccucacauuucuugga

SEQ ID NO: 1434971 - RNA, 19 nt, Homo sapiens
ggagagcccaauauuccaa

SEQ ID NO: 1434972 - RNA, 19 nt, Homo sapiens
gaaguaggaaagugauagu

SEQ ID NO: 1434973 - RNA, 19 nt, Homo sapiens
ucacugccuuugucugugu

SEQ ID NO: 1434974 - RNA, 19 nt, Homo sapiens
gugaggagcauggaguuaa

SEQ ID NO: 1434975 - RNA, 19 nt, Homo sapiens
uuaggugaaugaagaagga

SEQ ID NO: 1434976 - RNA, 19 nt, Homo sapiens
gaacuccaggccucaggaa

SEQ ID NO: 1434977 - RNA, 19 nt, Homo sapiens
gaugauuuacugucagaga

SEQ ID NO: 1434978 - RNA, 19 nt, Homo sapiens
gaucauuugagguuagaga

SEQ ID NO: 1434979 - RNA, 19 nt, Homo sapiens
gaggcaggcggaucauuug

SEQ ID NO: 1434980 - RNA, 19 nt, Homo sapiens
gagaggaccagagugauca

SEQ ID NO: 1434981 - RNA, 19 nt, Homo sapiens
ugaguaggauccugaauga

SEQ ID NO: 1434982 - RNA, 19 nt, Homo sapiens
gaacguugaguacacauga

SEQ ID NO: 1434983 - RNA, 19 nt, Homo sapiens
gaauaugggcucugcaaug

SEQ ID NO: 1434984 - RNA, 19 nt, Homo sapiens
gcagaaacgccucaugaug

SEQ ID NO: 1434985 - RNA, 19 nt, Homo sapiens
ggucagcucuucuguggau

SEQ ID NO: 1434986 - RNA, 19 nt, Homo sapiens
gauccugaaugaggcuuua

SEQ ID NO: 1434987 - RNA, 19 nt, Homo sapiens
aauaugggcucugcaauga

SEQ ID NO: 1434988 - RNA, 19 nt, Homo sapiens
gagaccacauccagcauug

SEQ ID NO: 1434989 - RNA, 19 nt, Homo sapiens
gcgcagaaacgccucauga

SEQ ID NO: 1434990 - RNA, 19 nt, Homo sapiens
caucaaggauuuccauagg

SEQ ID NO: 1434991 - RNA, 19 nt, Homo sapiens
gaacuuccucucuguaucu

SEQ ID NO: 1434992 - RNA, 19 nt, Homo sapiens
ccacaucaugggaagguua

SEQ ID NO: 1434993 - RNA, 19 nt, Homo sapiens
gaggugagggugaccauau

SEQ ID NO: 1434994 - RNA, 19 nt, Homo sapiens
ccaauccuguccuguaaca

SEQ ID NO: 1434995 - RNA, 19 nt, Homo sapiens
gagugcaugugaacguuga

SEQ ID NO: 1434996 - RNA, 19 nt, Homo sapiens
uaugggcucugcaaugaga

SEQ ID NO: 1434997 - RNA, 19 nt, Homo sapiens
ugaaugaggcuuuaucucu

SEQ ID NO: 1434998 - RNA, 19 nt, Homo sapiens
acuagcagcuggaggaguu

SEQ ID NO: 1434999 - RNA, 19 nt, Homo sapiens
cauccaauccuguccugua

SEQ ID NO: 1435000 - RNA, 19 nt, Homo sapiens
uaucaugguuguguuaauc

SEQ ID NO: 1435001 - RNA, 19 nt, Homo sapiens
guugggaguucauggcuau

SEQ ID NO: 1435002 - RNA, 19 nt, Homo sapiens
cagcaucucaggacaguug

SEQ ID NO: 1435003 - RNA, 19 nt, Homo sapiens
ggcagcaucuucagcaucu

SEQ ID NO: 1435004 - RNA, 19 nt, Homo sapiens
uugcauggcgugugauuaa

SEQ ID NO: 1435005 - RNA, 19 nt, Homo sapiens
uggauugcauggcguguga

SEQ ID NO: 1435006 - RNA, 19 nt, Homo sapiens
gcucuucuguggauugcau

SEQ ID NO: 1435007 - RNA, 19 nt, Homo sapiens
caccagugccugcucauug

SEQ ID NO: 1435008 - RNA, 19 nt, Homo sapiens
ggaugggaccagcgacuga

SEQ ID NO: 1435009 - RNA, 19 nt, Homo sapiens
gugaguaggauccugaaug

SEQ ID NO: 1435010 - RNA, 19 nt, Homo sapiens
ccagagccguccuucuucu

SEQ ID NO: 1435011 - RNA, 19 nt, Homo sapiens
cagcugaggccaugugagu

SEQ ID NO: 1435012 - RNA, 19 nt, Homo sapiens
uggccaggcagaaagaaua

SEQ ID NO: 1435013 - RNA, 19 nt, Homo sapiens
accagugccugcucauuga

SEQ ID NO: 1435014 - RNA, 19 nt, Homo sapiens
ggccauggcagcaucuuca

SEQ ID NO: 1435015 - RNA, 19 nt, Homo sapiens
auccaauccuguccuguaa

SEQ ID NO: 1435016 - RNA, 19 nt, Homo sapiens
gugagugcaugugaacguu

SEQ ID NO: 1435017 - RNA, 19 nt, Homo sapiens
gcugaggccaugugaguag

SEQ ID NO: 1435018 - RNA, 19 nt, Homo sapiens
gcucggcugugcaggacau

SEQ ID NO: 1435019 - RNA, 19 nt, Homo sapiens
caagaccccucacauccaa

SEQ ID NO: 1435020 - RNA, 19 nt, Homo sapiens
gggugugagugcaugugaa

SEQ ID NO: 1435021 - RNA, 19 nt, Homo sapiens
cgagaccacauccagcauu

SEQ ID NO: 1435022 - RNA, 19 nt, Homo sapiens
gcuaucaugguuguguuaa

SEQ ID NO: 1435023 - RNA, 19 nt, Homo sapiens
ggcuuuaucucuggcuguu

SEQ ID NO: 1435024 - RNA, 19 nt, Homo sapiens
ggcuaucaugguuguguua

SEQ ID NO: 1435025 - RNA, 19 nt, Homo sapiens
gcaugugaacguugaguac

SEQ ID NO: 1435026 - RNA, 19 nt, Homo sapiens
gggaguucauggcuaucau

SEQ ID NO: 1435027 - RNA, 19 nt, Homo sapiens
ggccaggcagaaagaauau

SEQ ID NO: 1435028 - RNA, 19 nt, Homo sapiens
accauauccuggacuguga

SEQ ID NO: 1435029 - RNA, 19 nt, Homo sapiens
gauugcauggcgugugauu

SEQ ID NO: 1435030 - RNA, 19 nt, Homo sapiens
gaccaagccaugucugaac

SEQ ID NO: 1435031 - RNA, 19 nt, Homo sapiens
aagaauaugggcucugcaa

SEQ ID NO: 1435032 - RNA, 19 nt, Homo sapiens
caugggaagguuaaugugu

SEQ ID NO: 1435033 - RNA, 19 nt, Homo sapiens
ggguguugguguccaugga

SEQ ID NO: 1435034 - RNA, 19 nt, Homo sapiens
caucaugggaagguuaaug

SEQ ID NO: 1435035 - RNA, 19 nt, Homo sapiens
agccagagccguccuucuu

SEQ ID NO: 1435036 - RNA, 19 nt, Homo sapiens
cagcauugccagccucauc

SEQ ID NO: 1435037 - RNA, 19 nt, Homo sapiens
cagcagccgcucaggugaa

SEQ ID NO: 1435038 - RNA, 19 nt, Homo sapiens
gcguggcacugcugucaac

SEQ ID NO: 1435039 - RNA, 19 nt, Homo sapiens
ugaccaagccaugucugaa

SEQ ID NO: 1435040 - RNA, 19 nt, Homo sapiens
ggagacaacuuaggaaauu

SEQ ID NO: 1435041 - RNA, 19 nt, Homo sapiens
guaaaugaauuguggaaca

SEQ ID NO: 1435042 - RNA, 19 nt, Homo sapiens
gagacaacuuaggaaauua

SEQ ID NO: 1435043 - RNA, 19 nt, Homo sapiens
ccuaauccauuguuaaauc

SEQ ID NO: 1435044 - RNA, 19 nt, Homo sapiens
agggaacgauuacaucuaa

SEQ ID NO: 1435045 - RNA, 19 nt, Homo sapiens
gcaaaccuccagcuucaga

SEQ ID NO: 1435046 - RNA, 19 nt, Homo sapiens
uggaauguauguaugcaaa

SEQ ID NO: 1435047 - RNA, 19 nt, Homo sapiens
ccagcuauauuaaucuuca

SEQ ID NO: 1435048 - RNA, 19 nt, Homo sapiens
uaaaucaccugccccaauu

SEQ ID NO: 1435049 - RNA, 19 nt, Homo sapiens
ggaacgauuacaucuaaga

SEQ ID NO: 1435050 - RNA, 19 nt, Homo sapiens
ugacagagcgagacuuugu

SEQ ID NO: 1435051 - RNA, 19 nt, Homo sapiens
ggacacggagggaacgauu

SEQ ID NO: 1435052 - RNA, 19 nt, Homo sapiens
ggugacagagcgagacuuu

SEQ ID NO: 1435053 - RNA, 19 nt, Homo sapiens
gaacauccagacaacaaag

SEQ ID NO: 1435054 - RNA, 19 nt, Homo sapiens
aggcagagguugcagugaa

SEQ ID NO: 1435055 - RNA, 19 nt, Homo sapiens
uaagaucagugagauugga

SEQ ID NO: 1435056 - RNA, 19 nt, Homo sapiens
cuagucauccuaacagaaa

SEQ ID NO: 1435057 - RNA, 19 nt, Homo sapiens
gagggaacgauuacaucua

SEQ ID NO: 1435058 - RNA, 19 nt, Homo sapiens
gaucacaagcccaaggaau

SEQ ID NO: 1435059 - RNA, 19 nt, Homo sapiens
gagaucugcuggagacaac

SEQ ID NO: 1435060 - RNA, 19 nt, Homo sapiens
ggugaccagucgagaaauc

SEQ ID NO: 1435061 - RNA, 19 nt, Homo sapiens
caaagcugcccucgguuga

SEQ ID NO: 1435062 - RNA, 19 nt, Homo sapiens
cagaaaaguuccagccaaa

SEQ ID NO: 1435063 - RNA, 19 nt, Homo sapiens
gaaaaguuccagccaaaga

SEQ ID NO: 1435064 - RNA, 19 nt, Homo sapiens
ccaacugguuagugggaaa

SEQ ID NO: 1435065 - RNA, 19 nt, Homo sapiens
agacccagcucgcccaaca

SEQ ID NO: 1435066 - RNA, 19 nt, Homo sapiens
aauaagggaucuuccaaaa

SEQ ID NO: 1435067 - RNA, 19 nt, Homo sapiens
augcaaaccuccagcuuca

SEQ ID NO: 1435068 - RNA, 19 nt, Homo sapiens
ccaaagaggaagcuaaugc

SEQ ID NO: 1435069 - RNA, 19 nt, Homo sapiens
ggagggaacgauuacaucu

SEQ ID NO: 1435070 - RNA, 19 nt, Homo sapiens
gacacggagggaacgauua

SEQ ID NO: 1435071 - RNA, 19 nt, Homo sapiens
uaagggaucuuccaaaagg

SEQ ID NO: 1435072 - RNA, 19 nt, Homo sapiens
gcacacuagucauccuaac

SEQ ID NO: 1435073 - RNA, 19 nt, Homo sapiens
aaauaagggaucuuccaaa

SEQ ID NO: 1435074 - RNA, 19 nt, Homo sapiens
gagcggcacacuagucauc

SEQ ID NO: 1435075 - RNA, 19 nt, Homo sapiens
ucuaagaucagugagauug

SEQ ID NO: 1435076 - RNA, 19 nt, Homo sapiens
gaauguauguaugcaaacc

SEQ ID NO: 1435077 - RNA, 19 nt, Homo sapiens
ggacuccuggaauguaugu

SEQ ID NO: 1435078 - RNA, 19 nt, Homo sapiens
gcccaaggaaugccuagga

SEQ ID NO: 1435079 - RNA, 19 nt, Homo sapiens
ccuuaucuccuaauccauu

SEQ ID NO: 1435080 - RNA, 19 nt, Homo sapiens
cagccaaagaggaagcuaa

SEQ ID NO: 1435081 - RNA, 19 nt, Homo sapiens
aaaggugaccagucgagaa

SEQ ID NO: 1435082 - RNA, 19 nt, Homo sapiens
cugaugcuaugauucuuuc

SEQ ID NO: 1435083 - RNA, 19 nt, Homo sapiens
gauuggaacaggcugagau

SEQ ID NO: 1435084 - RNA, 19 nt, Homo sapiens
aaggugaccagucgagaaa

SEQ ID NO: 1435085 - RNA, 19 nt, Homo sapiens
cagauggagcggcacacua

SEQ ID NO: 1435086 - RNA, 19 nt, Homo sapiens
cuccuaauccauuguuaaa

SEQ ID NO: 1435087 - RNA, 19 nt, Homo sapiens
gaucagugagauuggaaca

SEQ ID NO: 1435088 - RNA, 19 nt, Homo sapiens
agagaucgcgccacugcaa

SEQ ID NO: 1435089 - RNA, 19 nt, Homo sapiens
ugaacauccagacaacaaa

SEQ ID NO: 1435090 - RNA, 19 nt, Homo sapiens
gaucugcuggagacaacuu

SEQ ID NO: 1435091 - RNA, 19 nt, Homo sapiens
caaagaggaagcuaaugcu

SEQ ID NO: 1435092 - RNA, 19 nt, Homo sapiens
gaacauuuacaggcaucug

SEQ ID NO: 1435093 - RNA, 19 nt, Homo sapiens
ggcagagguugcagugaac

SEQ ID NO: 1435094 - RNA, 19 nt, Homo sapiens
cugaacauccagacaacaa

SEQ ID NO: 1435095 - RNA, 19 nt, Homo sapiens
cauggauuguugaucaucu

SEQ ID NO: 1435096 - RNA, 19 nt, Homo sapiens
gagcuccucuggcaauaaa

SEQ ID NO: 1435097 - RNA, 19 nt, Homo sapiens
cgagcacgguggugaagua

SEQ ID NO: 1435098 - RNA, 19 nt, Homo sapiens
gacgauugaugaacuguau

SEQ ID NO: 1435099 - RNA, 19 nt, Homo sapiens
gcagagcccaugacgauug

SEQ ID NO: 1435100 - RNA, 19 nt, Homo sapiens
gaaaauggacuguuagaug

SEQ ID NO: 1435101 - RNA, 19 nt, Homo sapiens
gaagguggguggguauucu

SEQ ID NO: 1435102 - RNA, 19 nt, Homo sapiens
agagguugcuaugguauuu

SEQ ID NO: 1435103 - RNA, 19 nt, Homo sapiens
gggauugggugccaucucu

SEQ ID NO: 1435104 - RNA, 19 nt, Homo sapiens
gcuacgagccaaccaucua

SEQ ID NO: 1435105 - RNA, 19 nt, Homo sapiens
acacaaagggcaagagguu

SEQ ID NO: 1435106 - RNA, 19 nt, Homo sapiens
caggagcuauuuaacgaau

SEQ ID NO: 1435107 - RNA, 19 nt, Homo sapiens
cagagcccaugacgauuga

SEQ ID NO: 1435108 - RNA, 19 nt, Homo sapiens
guauuuggaacacaugaaa

SEQ ID NO: 1435109 - RNA, 19 nt, Homo sapiens
gggagcuccucuggcaaua

SEQ ID NO: 1435110 - RNA, 19 nt, Homo sapiens
acaugaaaauggacuguua

SEQ ID NO: 1435111 - RNA, 19 nt, Homo sapiens
ccgcagagcccaugacgau

SEQ ID NO: 1435112 - RNA, 19 nt, Homo sapiens
gcacgguggugaaguaccu

SEQ ID NO: 1435113 - RNA, 19 nt, Homo sapiens
uuaccggucgcuaccauua

SEQ ID NO: 1435114 - RNA, 19 nt, Homo sapiens
ggacucacugugcccauug

SEQ ID NO: 1435115 - RNA, 19 nt, Homo sapiens
gggacucacugugcccauu

SEQ ID NO: 1435116 - RNA, 19 nt, Homo sapiens
cagccagacuugcucaucu

SEQ ID NO: 1435117 - RNA, 19 nt, Homo sapiens
accaggagcuauuuaacga

SEQ ID NO: 1435118 - RNA, 19 nt, Homo sapiens
cagcguggaccaacuuaug

SEQ ID NO: 1435119 - RNA, 19 nt, Homo sapiens
ccaugacgauugaugaacu

SEQ ID NO: 1435120 - RNA, 19 nt, Homo sapiens
ggaccaacuuauggaacug

SEQ ID NO: 1435121 - RNA, 19 nt, Homo sapiens
cacccuacccugacacuga

SEQ ID NO: 1435122 - RNA, 19 nt, Homo sapiens
cgauugaugaacuguauga

SEQ ID NO: 1435123 - RNA, 19 nt, Homo sapiens
gcucgacaccucaaacucu

SEQ ID NO: 1435124 - RNA, 19 nt, Homo sapiens
caauaaaagucagugaaug

SEQ ID NO: 1435125 - RNA, 19 nt, Homo sapiens
gcaauaaaagucagugaau

SEQ ID NO: 1435126 - RNA, 19 nt, Homo sapiens
acgagccaaccaucuauua

SEQ ID NO: 1435127 - RNA, 19 nt, Homo sapiens
caagagguugcuaugguau

SEQ ID NO: 1435128 - RNA, 19 nt, Homo sapiens
ggagcuccucuggcaauaa

SEQ ID NO: 1435129 - RNA, 19 nt, Homo sapiens
ggaagguggguggguauuc

SEQ ID NO: 1435130 - RNA, 19 nt, Homo sapiens
ggagggauccagccagacu

SEQ ID NO: 1435131 - RNA, 19 nt, Homo sapiens
cuacuguccuggucaucug

SEQ ID NO: 1435132 - RNA, 19 nt, Homo sapiens
ggaccaggagcuauuuaac

SEQ ID NO: 1435133 - RNA, 19 nt, Homo sapiens
gcccaugacgauugaugaa

SEQ ID NO: 1435134 - RNA, 19 nt, Homo sapiens
uaugguauuuggaacacau

SEQ ID NO: 1435135 - RNA, 19 nt, Homo sapiens
gugaaugguggaagucaga

SEQ ID NO: 1435136 - RNA, 19 nt, Homo sapiens
gaauaauggaggagauggu

SEQ ID NO: 1435137 - RNA, 19 nt, Homo sapiens
cauccugaguguccugaag

SEQ ID NO: 1435138 - RNA, 19 nt, Homo sapiens
caugacgauugaugaacug

SEQ ID NO: 1435139 - RNA, 19 nt, Homo sapiens
gucagugaaugguggaagu

SEQ ID NO: 1435140 - RNA, 19 nt, Homo sapiens
ggacguggagaagggaaau

SEQ ID NO: 1435141 - RNA, 19 nt, Homo sapiens
caggaugggacguggagaa

SEQ ID NO: 1435142 - RNA, 19 nt, Homo sapiens
gaccaggagcuauuuaacg

SEQ ID NO: 1435143 - RNA, 19 nt, Homo sapiens
gaaugguggaagucagaga

SEQ ID NO: 1435144 - RNA, 19 nt, Homo sapiens
gggaauaauggaggagaug

SEQ ID NO: 1435145 - RNA, 19 nt, Homo sapiens
cuacgagccaaccaucuau

SEQ ID NO: 1435146 - RNA, 19 nt, Homo sapiens
gagcccaugacgauugaug

SEQ ID NO: 1435147 - RNA, 19 nt, Homo sapiens
cauaacaggugaucacuga

SEQ ID NO: 1435148 - RNA, 19 nt, Homo sapiens
gaagggaaagcaucuggaa

SEQ ID NO: 1435149 - RNA, 19 nt, Homo sapiens
aaacuccuaucaugccuuu

SEQ ID NO: 1435150 - RNA, 19 nt, Homo sapiens
gagucuaccugcccuaugu

SEQ ID NO: 1435151 - RNA, 19 nt, Homo sapiens
ccuagagccucgccaggua

SEQ ID NO: 1435152 - RNA, 19 nt, Homo sapiens
ggacaagcaguggcuguuu

SEQ ID NO: 1435153 - RNA, 19 nt, Homo sapiens
ggcccacgcugucuuccua

SEQ ID NO: 1435154 - RNA, 19 nt, Homo sapiens
ggccaaggguaguuucuuc

SEQ ID NO: 1435155 - RNA, 19 nt, Homo sapiens
cagucucgauuccuccuua

SEQ ID NO: 1435156 - RNA, 19 nt, Homo sapiens
gagaauaagcgagucacaa

SEQ ID NO: 1435157 - RNA, 19 nt, Homo sapiens
gugcugggaccuauaugua

SEQ ID NO: 1435158 - RNA, 19 nt, Homo sapiens
ggaacguucuggugcugau

SEQ ID NO: 1435159 - RNA, 19 nt, Homo sapiens
ugacccggcugcacucuuc

SEQ ID NO: 1435160 - RNA, 19 nt, Homo sapiens
aaugcaggcucgaagugua

SEQ ID NO: 1435161 - RNA, 19 nt, Homo sapiens
ggaaugcaggcucgaagug

SEQ ID NO: 1435162 - RNA, 19 nt, Homo sapiens
ggccugcagugucuccauu

SEQ ID NO: 1435163 - RNA, 19 nt, Homo sapiens
ggguugcuauggccauuau

SEQ ID NO: 1435164 - RNA, 19 nt, Homo sapiens
uuaacuccguccucuauca

SEQ ID NO: 1435165 - RNA, 19 nt, Homo sapiens
gacaagcaguggcuguuuu

SEQ ID NO: 1435166 - RNA, 19 nt, Homo sapiens
gaauaagcgagucacaagu

SEQ ID NO: 1435167 - RNA, 19 nt, Homo sapiens
ugcugugucuugucuguaa

SEQ ID NO: 1435168 - RNA, 19 nt, Homo sapiens
gaaugcaggcucgaagugu

SEQ ID NO: 1435169 - RNA, 19 nt, Homo sapiens
gcaagaugcggguguacca

SEQ ID NO: 1435170 - RNA, 19 nt, Homo sapiens
ccaggaggcucagauacag

SEQ ID NO: 1435171 - RNA, 19 nt, Homo sapiens
gcucgaaguguagagauga

SEQ ID NO: 1435172 - RNA, 19 nt, Homo sapiens
acugauaccuggcaaagac

SEQ ID NO: 1435173 - RNA, 19 nt, Homo sapiens
ucacaagugccaccagcaa

SEQ ID NO: 1435174 - RNA, 19 nt, Homo sapiens
agaauaagcgagucacaag

SEQ ID NO: 1435175 - RNA, 19 nt, Homo sapiens
gucuguaaauaaacuccua

SEQ ID NO: 1435176 - RNA, 19 nt, Homo sapiens
gcugugucuugucuguaaa

SEQ ID NO: 1435177 - RNA, 19 nt, Homo sapiens
gcuggcacuucgcuucugu

SEQ ID NO: 1435178 - RNA, 19 nt, Homo sapiens
agggaaagcaucuggaaug

SEQ ID NO: 1435179 - RNA, 19 nt, Homo sapiens
gcugguugcugugucuugu

SEQ ID NO: 1435180 - RNA, 19 nt, Homo sapiens
guaguuucuuccucugaca

SEQ ID NO: 1435181 - RNA, 19 nt, Homo sapiens
aauaagcgagucacaagug

SEQ ID NO: 1435182 - RNA, 19 nt, Homo sapiens
ggcccucuccuuucuaugu

SEQ ID NO: 1435183 - RNA, 19 nt, Homo sapiens
ugcaggaggccaaguuuga

SEQ ID NO: 1435184 - RNA, 19 nt, Homo sapiens
gauggugcugggaccuaua

SEQ ID NO: 1435185 - RNA, 19 nt, Homo sapiens
ucuguggccuuggcauuga

SEQ ID NO: 1435186 - RNA, 19 nt, Homo sapiens
ggagaauaagcgagucaca

SEQ ID NO: 1435187 - RNA, 19 nt, Homo sapiens
ccaaacugcccgaggucaa

SEQ ID NO: 1435188 - RNA, 19 nt, Homo sapiens
gcugcaggaggccaaguuu

SEQ ID NO: 1435189 - RNA, 19 nt, Homo sapiens
ccugaggacuuggcugcaa

SEQ ID NO: 1435190 - RNA, 19 nt, Homo sapiens
ccuuaacuccguccucuau

SEQ ID NO: 1435191 - RNA, 19 nt, Homo sapiens
ggcucgaaguguagagaug

SEQ ID NO: 1435192 - RNA, 19 nt, Homo sapiens
guugcugugucuugucugu

SEQ ID NO: 1435193 - RNA, 19 nt, Homo sapiens
gaccauaacaggugaucac

SEQ ID NO: 1435194 - RNA, 19 nt, Homo sapiens
cacaagugccaccagcaaa

SEQ ID NO: 1435195 - RNA, 19 nt, Homo sapiens
ucaaggccaaggguaguuu

SEQ ID NO: 1435196 - RNA, 19 nt, Homo sapiens
gaaccauucugcagacuuu

SEQ ID NO: 1435197 - RNA, 19 nt, Homo sapiens
ggcaauggcuccacaugua

SEQ ID NO: 1435198 - RNA, 19 nt, Homo sapiens
gcaaucacuuggcugagaa

SEQ ID NO: 1435199 - RNA, 19 nt, Homo sapiens
gggaaucacuuaccuaugc

SEQ ID NO: 1435200 - RNA, 19 nt, Homo sapiens
gcaauggcuccacauguaa

SEQ ID NO: 1435201 - RNA, 19 nt, Homo sapiens
cagcacaacuuucaaacuc

SEQ ID NO: 1435202 - RNA, 19 nt, Homo sapiens
uaacucagcuuuuccaaug

SEQ ID NO: 1435203 - RNA, 19 nt, Homo sapiens
caaugaggcuugaauccau

SEQ ID NO: 1435204 - RNA, 19 nt, Homo sapiens
caaaugaacaaucuaccaa

SEQ ID NO: 1435205 - RNA, 19 nt, Homo sapiens
ggaggagucaaccaaauga

SEQ ID NO: 1435206 - RNA, 19 nt, Homo sapiens
cauugucuaugcucaaauu

SEQ ID NO: 1435207 - RNA, 19 nt, Homo sapiens
cagccaagcuuucauccau

SEQ ID NO: 1435208 - RNA, 19 nt, Homo sapiens
gaugugaucuggcaaugcu

SEQ ID NO: 1435209 - RNA, 19 nt, Homo sapiens
gccuuuaucuuccucauca

SEQ ID NO: 1435210 - RNA, 19 nt, Homo sapiens
cauguaaacccgacacuga

SEQ ID NO: 1435211 - RNA, 19 nt, Homo sapiens
acacaucacuuucacuuuu

SEQ ID NO: 1435212 - RNA, 19 nt, Homo sapiens
ucauaaagagcuacagaaa

SEQ ID NO: 1435213 - RNA, 19 nt, Homo sapiens
gaccaccaccugugugaaa

SEQ ID NO: 1435214 - RNA, 19 nt, Homo sapiens
uaucuucacacaucacuuu

SEQ ID NO: 1435215 - RNA, 19 nt, Homo sapiens
ucaaccaaaugaacaaucu

SEQ ID NO: 1435216 - RNA, 19 nt, Homo sapiens
ggagucaaccaaaugaaca

SEQ ID NO: 1435217 - RNA, 19 nt, Homo sapiens
gaaagacaaggcacucucu

SEQ ID NO: 1435218 - RNA, 19 nt, Homo sapiens
ucacacaucacuuucacuu

SEQ ID NO: 1435219 - RNA, 19 nt, Homo sapiens
caucucagcccuaucuuca

SEQ ID NO: 1435220 - RNA, 19 nt, Homo sapiens
agucggaguuguuuagaug

SEQ ID NO: 1435221 - RNA, 19 nt, Homo sapiens
gaauccauuuccucucauc

SEQ ID NO: 1435222 - RNA, 19 nt, Homo sapiens
ucacuuggcugagaaccau

SEQ ID NO: 1435223 - RNA, 19 nt, Homo sapiens
gggaggagucaaccaaaug

SEQ ID NO: 1435224 - RNA, 19 nt, Homo sapiens
ugauggcccucccacuuga

SEQ ID NO: 1435225 - RNA, 19 nt, Homo sapiens
caaacuaacucagcuuuuc

SEQ ID NO: 1435226 - RNA, 19 nt, Homo sapiens
ugagaugggucccucuucu

SEQ ID NO: 1435227 - RNA, 19 nt, Homo sapiens
caucauaaagagcuacaga

SEQ ID NO: 1435228 - RNA, 19 nt, Homo sapiens
ggaguuguuuagaugugau

SEQ ID NO: 1435229 - RNA, 19 nt, Homo sapiens
uugaauccauuuccucuca

SEQ ID NO: 1435230 - RNA, 19 nt, Homo sapiens
ucucagcccuaucuucaca

SEQ ID NO: 1435231 - RNA, 19 nt, Homo sapiens
cacccagcaucaugaauca

SEQ ID NO: 1435232 - RNA, 19 nt, Homo sapiens
gggcucagugcacagagua

SEQ ID NO: 1435233 - RNA, 19 nt, Homo sapiens
uucaaacucucagaagaaa

SEQ ID NO: 1435234 - RNA, 19 nt, Homo sapiens
gagaugggucccucuucuu

SEQ ID NO: 1435235 - RNA, 19 nt, Homo sapiens
caauggcuccacauguaaa

SEQ ID NO: 1435236 - RNA, 19 nt, Homo sapiens
caaccaaaugaacaaucua

SEQ ID NO: 1435237 - RNA, 19 nt, Homo sapiens
uaacaaacuaacucagcuu

SEQ ID NO: 1435238 - RNA, 19 nt, Homo sapiens
agaugggucccucuucuuu

SEQ ID NO: 1435239 - RNA, 19 nt, Homo sapiens
ggagaggcuucccauuucc

SEQ ID NO: 1435240 - RNA, 19 nt, Homo sapiens
ccucucaucucagcccuau

SEQ ID NO: 1435241 - RNA, 19 nt, Homo sapiens
gauccuccagccaagcuuu

SEQ ID NO: 1435242 - RNA, 19 nt, Homo sapiens
ugacacugcugcugauagc

SEQ ID NO: 1435243 - RNA, 19 nt, Homo sapiens
uaaacccgacacugaaaga

SEQ ID NO: 1435244 - RNA, 19 nt, Homo sapiens
ugggaggagucaaccaaau

SEQ ID NO: 1435245 - RNA, 19 nt, Homo sapiens
cuuucaaacucucagaaga

SEQ ID NO: 1435246 - RNA, 19 nt, Homo sapiens
ucucuaaccaccacaacaa

SEQ ID NO: 1435247 - RNA, 19 nt, Homo sapiens
ccaaaugaacaaucuacca

SEQ ID NO: 1435248 - RNA, 19 nt, Homo sapiens
gcucagugcacagaguauu

SEQ ID NO: 1435249 - RNA, 19 nt, Homo sapiens
uuucaaacucucagaagaa

SEQ ID NO: 1435250 - RNA, 19 nt, Homo sapiens
caacuugggaggagucaac

SEQ ID NO: 1435251 - RNA, 19 nt, Homo sapiens
cccauugucuaugcucaaa

SEQ ID NO: 1435252 - RNA, 19 nt, Homo sapiens
gaggagucaaccaaaugaa

SEQ ID NO: 1435253 - RNA, 19 nt, Homo sapiens
ucacccagcaucaugaauc

SEQ ID NO: 1435254 - RNA, 19 nt, Homo sapiens
guauucacccagcaucaug

SEQ ID NO: 1435255 - RNA, 19 nt, Homo sapiens
ccuaugccagcacaacuuu

SEQ ID NO: 1435256 - RNA, 19 nt, Homo sapiens
uguaaacccgacacugaaa

SEQ ID NO: 1435257 - RNA, 19 nt, Homo sapiens
acauuuaauccuugccuuu

SEQ ID NO: 1435258 - RNA, 19 nt, Homo sapiens
cggaguuguuuagauguga

SEQ ID NO: 1435259 - RNA, 19 nt, Homo sapiens
gaugggucccucuucuuuc

SEQ ID NO: 1435260 - RNA, 19 nt, Homo sapiens
gagucaaccaaaugaacaa

SEQ ID NO: 1435261 - RNA, 19 nt, Homo sapiens
uccauuuccucucaucuca

SEQ ID NO: 1435262 - RNA, 19 nt, Homo sapiens
ccugcacccugucucucua

SEQ ID NO: 1435263 - RNA, 19 nt, Homo sapiens
ccaggcccauugcugagau

SEQ ID NO: 1435264 - RNA, 19 nt, Homo sapiens
gcagucggaguuguuuaga

SEQ ID NO: 1435265 - RNA, 19 nt, Homo sapiens
gcccuaucuucacacauca

SEQ ID NO: 1435266 - RNA, 19 nt, Homo sapiens
agcaaucacuuggcugaga

SEQ ID NO: 1435267 - RNA, 19 nt, Homo sapiens
caacuuucaaacucucaga

SEQ ID NO: 1435268 - RNA, 19 nt, Homo sapiens
cauaaagagcuacagaaaa

SEQ ID NO: 1435269 - RNA, 19 nt, Homo sapiens
guaaacccgacacugaaag

SEQ ID NO: 1435270 - RNA, 19 nt, Homo sapiens
gaggcaauggcuccacaug

SEQ ID NO: 1435271 - RNA, 19 nt, Homo sapiens
acccgacacugaaagacaa

SEQ ID NO: 1435272 - RNA, 19 nt, Homo sapiens
ccaaugaggcuugaaucca

SEQ ID NO: 1435273 - RNA, 19 nt, Homo sapiens
ggaagucgguggccucuua

SEQ ID NO: 1435274 - RNA, 19 nt, Homo sapiens
caagagaguuuguaauuuc

SEQ ID NO: 1435275 - RNA, 19 nt, Homo sapiens
ggacagcuuugauuucauu

SEQ ID NO: 1435276 - RNA, 19 nt, Homo sapiens
gaagaggacagcuuugauu

SEQ ID NO: 1435277 - RNA, 19 nt, Homo sapiens
gaggacagcuuugauuuca

SEQ ID NO: 1435278 - RNA, 19 nt, Homo sapiens
ggaggaagaggacagcuuu

SEQ ID NO: 1435279 - RNA, 19 nt, Homo sapiens
gucaagagaguuuguaauu

SEQ ID NO: 1435280 - RNA, 19 nt, Homo sapiens
gcaggcaguacucuuguaa

SEQ ID NO: 1435281 - RNA, 19 nt, Homo sapiens
gaaaagccauccagucucu

SEQ ID NO: 1435282 - RNA, 19 nt, Homo sapiens
guaaauaaacaggaacaug

SEQ ID NO: 1435283 - RNA, 19 nt, Homo sapiens
guugguaaauaaacaggaa

SEQ ID NO: 1435284 - RNA, 19 nt, Homo sapiens
ugauuucauugguggauuu

SEQ ID NO: 1435285 - RNA, 19 nt, Homo sapiens
gagaguuuguaauuuccuu

SEQ ID NO: 1435286 - RNA, 19 nt, Homo sapiens
caccugcccuggguucuaa

SEQ ID NO: 1435287 - RNA, 19 nt, Homo sapiens
cauccagucucuuguccaa

SEQ ID NO: 1435288 - RNA, 19 nt, Homo sapiens
gguaucaucaaguugguaa

SEQ ID NO: 1435289 - RNA, 19 nt, Homo sapiens
ccaaacucgugccagaaga

SEQ ID NO: 1435290 - RNA, 19 nt, Homo sapiens
ggaagaggacagcuuugau

SEQ ID NO: 1435291 - RNA, 19 nt, Homo sapiens
gaagucgguggccucuuaa

SEQ ID NO: 1435292 - RNA, 19 nt, Homo sapiens
agaggcagguguuugacuu

SEQ ID NO: 1435293 - RNA, 19 nt, Homo sapiens
ucucuaccaugucaaugaa

SEQ ID NO: 1435294 - RNA, 19 nt, Homo sapiens
gaccgaccagugacaauga

SEQ ID NO: 1435295 - RNA, 19 nt, Homo sapiens
aagaggacagcuuugauuu

SEQ ID NO: 1435296 - RNA, 19 nt, Homo sapiens
acagcgagcuacugaccuu

SEQ ID NO: 1435297 - RNA, 19 nt, Homo sapiens
caaacucgugccagaagaa

SEQ ID NO: 1435298 - RNA, 19 nt, Homo sapiens
gcaccugcccuggguucua

SEQ ID NO: 1435299 - RNA, 19 nt, Homo sapiens
uggaggcccuacacaguug

SEQ ID NO: 1435300 - RNA, 19 nt, Homo sapiens
ggccaacuuuguccacauc

SEQ ID NO: 1435301 - RNA, 19 nt, Homo sapiens
cagcuuugauuucauuggu

SEQ ID NO: 1435302 - RNA, 19 nt, Homo sapiens
ucgguggccucuuaaagga

SEQ ID NO: 1435303 - RNA, 19 nt, Homo sapiens
aggcaguacucuuguaaag

SEQ ID NO: 1435304 - RNA, 19 nt, Homo sapiens
cgagcaggcaguacucuug

SEQ ID NO: 1435305 - RNA, 19 nt, Homo sapiens
caccuccucuggcaacaug

SEQ ID NO: 1435306 - RNA, 19 nt, Homo sapiens
uggaacgucuucaucaucu

SEQ ID NO: 1435307 - RNA, 19 nt, Homo sapiens
gcauagggcagggcacaug

SEQ ID NO: 1435308 - RNA, 19 nt, Homo sapiens
gagcaggcaguacucuugu

SEQ ID NO: 1435309 - RNA, 19 nt, Homo sapiens
cauuuccucucuaccaugu

SEQ ID NO: 1435310 - RNA, 19 nt, Homo sapiens
caacuuuguccacaucauc

SEQ ID NO: 1435311 - RNA, 19 nt, Homo sapiens
gaucgcgcuucugggcuuu

SEQ ID NO: 1435312 - RNA, 19 nt, Homo sapiens
gggcaaacagucccaaagg

SEQ ID NO: 1435313 - RNA, 19 nt, Homo sapiens
guggaggcccuacacaguu

SEQ ID NO: 1435314 - RNA, 19 nt, Homo sapiens
uggagaggcagguguuuga

SEQ ID NO: 1435315 - RNA, 19 nt, Homo sapiens
ccagguggucagcguguuu

SEQ ID NO: 1435316 - RNA, 19 nt, Homo sapiens
ggaacgucuucaucaucug

SEQ ID NO: 1435317 - RNA, 19 nt, Homo sapiens
cggcugcgcuaugucaugu

SEQ ID NO: 1435318 - RNA, 19 nt, Homo sapiens
gcgucaagagaguuuguaa

SEQ ID NO: 1435319 - RNA, 19 nt, Homo sapiens
uuucauugguggauuugau

SEQ ID NO: 1435320 - RNA, 19 nt, Homo sapiens
uguccaagcagguguacuu

SEQ ID NO: 1435321 - RNA, 19 nt, Homo sapiens
gcccauccuggccaacuuu

SEQ ID NO: 1435322 - RNA, 19 nt, Homo sapiens
aaagccauccagucucuug

SEQ ID NO: 1435323 - RNA, 19 nt, Homo sapiens
gcugcgcuaugucauguac

SEQ ID NO: 1435324 - RNA, 19 nt, Homo sapiens
ccuggaacgucuucaucau

SEQ ID NO: 1435325 - RNA, 19 nt, Homo sapiens
cugcguaagugaggaaaca

SEQ ID NO: 1435326 - RNA, 19 nt, Homo sapiens
gaggaagaggacagcuuug

SEQ ID NO: 1435327 - RNA, 19 nt, Homo sapiens
cagguggucagcguguuua

SEQ ID NO: 1435328 - RNA, 19 nt, Homo sapiens
aaggacagcgagcuacuga

SEQ ID NO: 1435329 - RNA, 19 nt, Homo sapiens
gcagcaacaucucccacaa

SEQ ID NO: 1435330 - RNA, 19 nt, Homo sapiens
aauauggacuugaaucuuc

SEQ ID NO: 1435331 - RNA, 19 nt, Homo sapiens
gaaggaggcaaccaaaaua

SEQ ID NO: 1435332 - RNA, 19 nt, Homo sapiens
gaauauggacuugaaucuu

SEQ ID NO: 1435333 - RNA, 19 nt, Homo sapiens
ggguugcccuguauacaug

SEQ ID NO: 1435334 - RNA, 19 nt, Homo sapiens
gagauccaguggugguaug

SEQ ID NO: 1435335 - RNA, 19 nt, Homo sapiens
cagccaaccugaauaaagc

SEQ ID NO: 1435336 - RNA, 19 nt, Homo sapiens
ugccacagcucagugauga

SEQ ID NO: 1435337 - RNA, 19 nt, Homo sapiens
aaauaaguguggucaaggu

SEQ ID NO: 1435338 - RNA, 19 nt, Homo sapiens
caccaugucggcccucuuu

SEQ ID NO: 1435339 - RNA, 19 nt, Homo sapiens
caaaauaaguguggucaag

SEQ ID NO: 1435340 - RNA, 19 nt, Homo sapiens
ccugcagccucuagacuga

SEQ ID NO: 1435341 - RNA, 19 nt, Homo sapiens
ggaaggaggcaaccaaaau

SEQ ID NO: 1435342 - RNA, 19 nt, Homo sapiens
uaccagccaaccugaauaa

SEQ ID NO: 1435343 - RNA, 19 nt, Homo sapiens
uacaugauccagucuguga

SEQ ID NO: 1435344 - RNA, 19 nt, Homo sapiens
aggauucucugcccuguca

SEQ ID NO: 1435345 - RNA, 19 nt, Homo sapiens
uauacaugauccagucugu

SEQ ID NO: 1435346 - RNA, 19 nt, Homo sapiens
ggcgaguccuuccuguuca

SEQ ID NO: 1435347 - RNA, 19 nt, Homo sapiens
ccagccaaccugaauaaag

SEQ ID NO: 1435348 - RNA, 19 nt, Homo sapiens
cuaccagccaaccugaaua

SEQ ID NO: 1435349 - RNA, 19 nt, Homo sapiens
aagcaucucagcaggaaga

SEQ ID NO: 1435350 - RNA, 19 nt, Homo sapiens
ggagauccaguggugguau

SEQ ID NO: 1435351 - RNA, 19 nt, Homo sapiens
ucaguucccucacgauucc

SEQ ID NO: 1435352 - RNA, 19 nt, Homo sapiens
cccugaauauggacuugaa

SEQ ID NO: 1435353 - RNA, 19 nt, Homo sapiens
ucacagagacaccccauga

SEQ ID NO: 1435354 - RNA, 19 nt, Homo sapiens
aaaagcaucucagcaggaa

SEQ ID NO: 1435355 - RNA, 19 nt, Homo sapiens
ugaauauggacuugaaucu

SEQ ID NO: 1435356 - RNA, 19 nt, Homo sapiens
gauccaguggugguaugua

SEQ ID NO: 1435357 - RNA, 19 nt, Homo sapiens
ucaagguggugggcagcaa

SEQ ID NO: 1435358 - RNA, 19 nt, Homo sapiens
gaaauaguguguuugcuua

SEQ ID NO: 1435359 - RNA, 19 nt, Homo sapiens
gcuaagcccuuuccuguug

SEQ ID NO: 1435360 - RNA, 19 nt, Homo sapiens
cuagagaccucgcgacuuu

SEQ ID NO: 1435361 - RNA, 19 nt, Homo sapiens
gggaaagguugcuguguuu

SEQ ID NO: 1435362 - RNA, 19 nt, Homo sapiens
gagcuugacuuucuguaau

SEQ ID NO: 1435363 - RNA, 19 nt, Homo sapiens
ccaguuggcugagguuuaa

SEQ ID NO: 1435364 - RNA, 19 nt, Homo sapiens
gaaccaggcuguguguguu

SEQ ID NO: 1435365 - RNA, 19 nt, Homo sapiens
gaccaagagugacgaguga

SEQ ID NO: 1435366 - RNA, 19 nt, Homo sapiens
caugaugucuggcuacuug

SEQ ID NO: 1435367 - RNA, 19 nt, Homo sapiens
gcucacucauggcaucuua

SEQ ID NO: 1435368 - RNA, 19 nt, Homo sapiens
ggaaauaguguguuugcuu

SEQ ID NO: 1435369 - RNA, 19 nt, Homo sapiens
gcacaacauuauucgacuu

SEQ ID NO: 1435370 - RNA, 19 nt, Homo sapiens
cauggcaucuuaucuguug

SEQ ID NO: 1435371 - RNA, 19 nt, Homo sapiens
ugggaugaaugaacaauuu

SEQ ID NO: 1435372 - RNA, 19 nt, Homo sapiens
ccaagaauuuguuccuguu

SEQ ID NO: 1435373 - RNA, 19 nt, Homo sapiens
ugacagcucucccuuggau

SEQ ID NO: 1435374 - RNA, 19 nt, Homo sapiens
cugauuaacuacacauuga

SEQ ID NO: 1435375 - RNA, 19 nt, Homo sapiens
ggauagcgcucagguccuu

SEQ ID NO: 1435376 - RNA, 19 nt, Homo sapiens
guacuaagccccuuccaua

SEQ ID NO: 1435377 - RNA, 19 nt, Homo sapiens
ggacuugggauccagaguu

SEQ ID NO: 1435378 - RNA, 19 nt, Homo sapiens
gggaugaaugaacaauuua

SEQ ID NO: 1435379 - RNA, 19 nt, Homo sapiens
caagcugggugcucacuca

SEQ ID NO: 1435380 - RNA, 19 nt, Homo sapiens
ggucuucugugacuuucuu

SEQ ID NO: 1435381 - RNA, 19 nt, Homo sapiens
ggggagaucuugcacguuu

SEQ ID NO: 1435382 - RNA, 19 nt, Homo sapiens
cgggaaagguugcuguguu

SEQ ID NO: 1435383 - RNA, 19 nt, Homo sapiens
uggcuaaguucuuucauuc

SEQ ID NO: 1435384 - RNA, 19 nt, Homo sapiens
ggucaugaauucagagaac

SEQ ID NO: 1435385 - RNA, 19 nt, Homo sapiens
uggcugagguuuaaaugga

SEQ ID NO: 1435386 - RNA, 19 nt, Homo sapiens
gacuugggauccagaguug

SEQ ID NO: 1435387 - RNA, 19 nt, Homo sapiens
gagccucucaggacaauga

SEQ ID NO: 1435388 - RNA, 19 nt, Homo sapiens
gcuaaguucuuucauucuc

SEQ ID NO: 1435389 - RNA, 19 nt, Homo sapiens
guacugcauuaaguggaua

SEQ ID NO: 1435390 - RNA, 19 nt, Homo sapiens
ggaugucccuggguaagug

SEQ ID NO: 1435391 - RNA, 19 nt, Homo sapiens
gccaggaccuuguacuaag

SEQ ID NO: 1435392 - RNA, 19 nt, Homo sapiens
gcuuaggaguguuuacugu

SEQ ID NO: 1435393 - RNA, 19 nt, Homo sapiens
ggaaccaggcugugugugu

SEQ ID NO: 1435394 - RNA, 19 nt, Homo sapiens
gcagaggcaugggaguugu

SEQ ID NO: 1435395 - RNA, 19 nt, Homo sapiens
ucugguaacuacugugcua

SEQ ID NO: 1435396 - RNA, 19 nt, Homo sapiens
gcagaggaaaugcgggaaa

SEQ ID NO: 1435397 - RNA, 19 nt, Homo sapiens
caaagugucggucauugug

SEQ ID NO: 1435398 - RNA, 19 nt, Homo sapiens
ccucucacccacucaauaa

SEQ ID NO: 1435399 - RNA, 19 nt, Homo sapiens
gaacaugcuagaccucagu

SEQ ID NO: 1435400 - RNA, 19 nt, Homo sapiens
aagaauuuguuccuguuga

SEQ ID NO: 1435401 - RNA, 19 nt, Homo sapiens
gcgaauuccagacuccuuu

SEQ ID NO: 1435402 - RNA, 19 nt, Homo sapiens
gaaagguugcuguguuugg

SEQ ID NO: 1435403 - RNA, 19 nt, Homo sapiens
ugcgaaagcucuguaagug

SEQ ID NO: 1435404 - RNA, 19 nt, Homo sapiens
caaggccggugcuguguac

SEQ ID NO: 1435405 - RNA, 19 nt, Homo sapiens
cuacugugcuaagcccuuu

SEQ ID NO: 1435406 - RNA, 19 nt, Homo sapiens
augaggaaauaguguguuu

SEQ ID NO: 1435407 - RNA, 19 nt, Homo sapiens
gcugauuaacuacacauug

SEQ ID NO: 1435408 - RNA, 19 nt, Homo sapiens
ugaucuccuuucaaucuuu

SEQ ID NO: 1435409 - RNA, 19 nt, Homo sapiens
aaagguugcuguguuugga

SEQ ID NO: 1435410 - RNA, 19 nt, Homo sapiens
cuccugagcuugacuuucu

SEQ ID NO: 1435411 - RNA, 19 nt, Homo sapiens
aaaaguagcuguaaaaccu

SEQ ID NO: 1435412 - RNA, 19 nt, Homo sapiens
ggaaacuguuagaggaaac

SEQ ID NO: 1435413 - RNA, 19 nt, Homo sapiens
caauauuugugggaugaau

SEQ ID NO: 1435414 - RNA, 19 nt, Homo sapiens
ugaauucagagaacuguau

SEQ ID NO: 1435415 - RNA, 19 nt, Homo sapiens
ucuccucaauaaccuuuaa

SEQ ID NO: 1435416 - RNA, 19 nt, Homo sapiens
gaacucauuuucuccucaa

SEQ ID NO: 1435417 - RNA, 19 nt, Homo sapiens
uacaaagugucggucauug

SEQ ID NO: 1435418 - RNA, 19 nt, Homo sapiens
uggaaacuguuagaggaaa

SEQ ID NO: 1435419 - RNA, 19 nt, Homo sapiens
uguguguguugcuuaaauu

SEQ ID NO: 1435420 - RNA, 19 nt, Homo sapiens
ggcuguguguguugcuuaa

SEQ ID NO: 1435421 - RNA, 19 nt, Homo sapiens
gaauucagagaacuguaug

SEQ ID NO: 1435422 - RNA, 19 nt, Homo sapiens
cggcuauccuggagacaga

SEQ ID NO: 1435423 - RNA, 19 nt, Homo sapiens
ugucucagcacaacauuau

SEQ ID NO: 1435424 - RNA, 19 nt, Homo sapiens
gaucuccgacuccugacuu

SEQ ID NO: 1435425 - RNA, 19 nt, Homo sapiens
aaauuggucuucugugacu

SEQ ID NO: 1435426 - RNA, 19 nt, Homo sapiens
cuggcuaaguucuuucauu

SEQ ID NO: 1435427 - RNA, 19 nt, Homo sapiens
gguaaguggugcuggucau

SEQ ID NO: 1435428 - RNA, 19 nt, Homo sapiens
cuacaaagugucggucauu

SEQ ID NO: 1435429 - RNA, 19 nt, Homo sapiens
gaggaaauaguguguuugc

SEQ ID NO: 1435430 - RNA, 19 nt, Homo sapiens
uaucaugauuagagcuuuc

SEQ ID NO: 1435431 - RNA, 19 nt, Homo sapiens
caagaauuuguuccuguug

SEQ ID NO: 1435432 - RNA, 19 nt, Homo sapiens
caacauuauucgacuuuuc

SEQ ID NO: 1435433 - RNA, 19 nt, Homo sapiens
cacaacauuauucgacuuu

SEQ ID NO: 1435434 - RNA, 19 nt, Homo sapiens
ggccuccucaugauuguuu

SEQ ID NO: 1435435 - RNA, 19 nt, Homo sapiens
uuggaaccgugaacucauu

SEQ ID NO: 1435436 - RNA, 19 nt, Homo sapiens
ugccguguguguuauauca

SEQ ID NO: 1435437 - RNA, 19 nt, Homo sapiens
gggcugccguguguguuau

SEQ ID NO: 1435438 - RNA, 19 nt, Homo sapiens
cuacacuccuccuucucaa

SEQ ID NO: 1435439 - RNA, 19 nt, Homo sapiens
ggaaagguugcuguguuug

SEQ ID NO: 1435440 - RNA, 19 nt, Homo sapiens
cagaggaaaugcgggaaag

SEQ ID NO: 1435441 - RNA, 19 nt, Homo sapiens
gaucuuuguacugcauuaa

SEQ ID NO: 1435442 - RNA, 19 nt, Homo sapiens
ugagaucuuuguacugcau

SEQ ID NO: 1435443 - RNA, 19 nt, Homo sapiens
aaacugcgaaagcucugua

SEQ ID NO: 1435444 - RNA, 19 nt, Homo sapiens
ugagcuugacuuucuguaa

SEQ ID NO: 1435445 - RNA, 19 nt, Homo sapiens
gcuuggcgcuuuggcaauc

SEQ ID NO: 1435446 - RNA, 19 nt, Homo sapiens
gaucuccuuucaaucuuuu

SEQ ID NO: 1435447 - RNA, 19 nt, Homo sapiens
ccuuugggcuuggcgcuuu

SEQ ID NO: 1435448 - RNA, 19 nt, Homo sapiens
gaguguuuacugucuggua

SEQ ID NO: 1435449 - RNA, 19 nt, Homo sapiens
guaccuccuccacgacaaa

SEQ ID NO: 1435450 - RNA, 19 nt, Homo sapiens
agaucuuuguacugcauua

SEQ ID NO: 1435451 - RNA, 19 nt, Homo sapiens
cucaauauuugugggauga

SEQ ID NO: 1435452 - RNA, 19 nt, Homo sapiens
uuggauggcuuugcugguu

SEQ ID NO: 1435453 - RNA, 19 nt, Homo sapiens
caagagugacgagugaugu

SEQ ID NO: 1435454 - RNA, 19 nt, Homo sapiens
ccaagagugacgagugaug

SEQ ID NO: 1435455 - RNA, 19 nt, Homo sapiens
ccuugggucuggaaacugu

SEQ ID NO: 1435456 - RNA, 19 nt, Homo sapiens
uaacuacacauugaucagu

SEQ ID NO: 1435457 - RNA, 19 nt, Homo sapiens
gaggaaaugcgggaaaggu

SEQ ID NO: 1435458 - RNA, 19 nt, Homo sapiens
gaauauggaagaagcaaua

SEQ ID NO: 1435459 - RNA, 19 nt, Homo sapiens
uaaagaggguauagagaaa

SEQ ID NO: 1435460 - RNA, 19 nt, Homo sapiens
aaacaaggaugaagaugug

SEQ ID NO: 1435461 - RNA, 19 nt, Homo sapiens
ugaaaccagugcccuuaua

SEQ ID NO: 1435462 - RNA, 19 nt, Homo sapiens
gaaaccagugcccuuauaa

SEQ ID NO: 1435463 - RNA, 19 nt, Homo sapiens
gaaacaaggaugaagaugu

SEQ ID NO: 1435464 - RNA, 19 nt, Homo sapiens
ccagugcccuuauaagaga

SEQ ID NO: 1435465 - RNA, 19 nt, Homo sapiens
gaaaggaaguguuguuacc

SEQ ID NO: 1435466 - RNA, 19 nt, Homo sapiens
agaaggcacugucagagaa

SEQ ID NO: 1435467 - RNA, 19 nt, Homo sapiens
gggaaaggaaguguuguua

SEQ ID NO: 1435468 - RNA, 19 nt, Homo sapiens
ggaagaaggaggaaacaag

SEQ ID NO: 1435469 - RNA, 19 nt, Homo sapiens
gaaaugaugcuggguccuu

SEQ ID NO: 1435470 - RNA, 19 nt, Homo sapiens
uuaaagaggguauagagaa

SEQ ID NO: 1435471 - RNA, 19 nt, Homo sapiens
gaggaaacaaggaugaaga

SEQ ID NO: 1435472 - RNA, 19 nt, Homo sapiens
gaaggaacuggaagaagga

SEQ ID NO: 1435473 - RNA, 19 nt, Homo sapiens
uaccagguguccucagaaa

SEQ ID NO: 1435474 - RNA, 19 nt, Homo sapiens
ccagguguccucagaaaug

SEQ ID NO: 1435475 - RNA, 19 nt, Homo sapiens
ggacuucccagccucuaga

SEQ ID NO: 1435476 - RNA, 19 nt, Homo sapiens
caacguacgcugcuucaag

SEQ ID NO: 1435477 - RNA, 19 nt, Homo sapiens
gcuagaaggcacugucaga

SEQ ID NO: 1435478 - RNA, 19 nt, Homo sapiens
cauggugucucucguucuu

SEQ ID NO: 1435479 - RNA, 19 nt, Homo sapiens
gaugcuggguccuuucuac

SEQ ID NO: 1435480 - RNA, 19 nt, Homo sapiens
ggaaaggaaguguuguuac

SEQ ID NO: 1435481 - RNA, 19 nt, Homo sapiens
uugcccagcugacaacgua

SEQ ID NO: 1435482 - RNA, 19 nt, Homo sapiens
aaaugaugcuggguccuuu

SEQ ID NO: 1435483 - RNA, 19 nt, Homo sapiens
cagguguccucagaaauga

SEQ ID NO: 1435484 - RNA, 19 nt, Homo sapiens
ccugagacuuggaauaugg

SEQ ID NO: 1435485 - RNA, 19 nt, Homo sapiens
cucuagaacuguaagaaau

SEQ ID NO: 1435486 - RNA, 19 nt, Homo sapiens
aaugaaaccagugcccuua

SEQ ID NO: 1435487 - RNA, 19 nt, Homo sapiens
ccucuagaacuguaagaaa

SEQ ID NO: 1435488 - RNA, 19 nt, Homo sapiens
gguccugagacuuggaaua

SEQ ID NO: 1435489 - RNA, 19 nt, Homo sapiens
uguccaggcuccuccucua

SEQ ID NO: 1435490 - RNA, 19 nt, Homo sapiens
agacuuggaauauggaaga

SEQ ID NO: 1435491 - RNA, 19 nt, Homo sapiens
ggaaacaaggaugaagaug

SEQ ID NO: 1435492 - RNA, 19 nt, Homo sapiens
aaccagugcccuuauaaga

SEQ ID NO: 1435493 - RNA, 19 nt, Homo sapiens
aaagaaaaccugagcuuga

SEQ ID NO: 1435494 - RNA, 19 nt, Homo sapiens
guccugagacuuggaauau

SEQ ID NO: 1435495 - RNA, 19 nt, Homo sapiens
guuaaagaggguauagaga

SEQ ID NO: 1435496 - RNA, 19 nt, Homo sapiens
uagaaggcacugucagaga

SEQ ID NO: 1435497 - RNA, 19 nt, Homo sapiens
gagcugccuugcccuucug

SEQ ID NO: 1435498 - RNA, 19 nt, Homo sapiens
gaauggaccccucaugaau

SEQ ID NO: 1435499 - RNA, 19 nt, Homo sapiens
gacgguacuuucccucucu

SEQ ID NO: 1435500 - RNA, 19 nt, Homo sapiens
gaacuggaagaaggaggaa

SEQ ID NO: 1435501 - RNA, 19 nt, Homo sapiens
ggaguuaaagaggguauag

SEQ ID NO: 1435502 - RNA, 19 nt, Homo sapiens
ucuaccagguguccucaga

SEQ ID NO: 1435503 - RNA, 19 nt, Homo sapiens
ccugguggcuguggaagga

SEQ ID NO: 1435504 - RNA, 19 nt, Homo sapiens
caaggaugaagauguguca

SEQ ID NO: 1435505 - RNA, 19 nt, Homo sapiens
ggaauauggaagaagcaau

SEQ ID NO: 1435506 - RNA, 19 nt, Homo sapiens
aacguacgcugcuucaagu

SEQ ID NO: 1435507 - RNA, 19 nt, Homo sapiens
aagaaaaccugagcuugaa

SEQ ID NO: 1435508 - RNA, 19 nt, Homo sapiens
gcacugucagagaagagaa

SEQ ID NO: 1435509 - RNA, 19 nt, Homo sapiens
cccuaaugcucaugaaugg

SEQ ID NO: 1435510 - RNA, 19 nt, Homo sapiens
gugccuugaucuuggacuu

SEQ ID NO: 1435511 - RNA, 19 nt, Homo sapiens
gaaggcacugucagagaag

SEQ ID NO: 1435512 - RNA, 19 nt, Homo sapiens
gacuuggaauauggaagaa

SEQ ID NO: 1435513 - RNA, 19 nt, Homo sapiens
ggaggaaacaaggaugaag

SEQ ID NO: 1435514 - RNA, 19 nt, Homo sapiens
cccagccucuagaacugua

SEQ ID NO: 1435515 - RNA, 19 nt, Homo sapiens
cugaggguccugagacuug

SEQ ID NO: 1435516 - RNA, 19 nt, Homo sapiens
gacaauggcuacuccagaa

SEQ ID NO: 1435517 - RNA, 19 nt, Homo sapiens
gaugaaauagcaccagaua

SEQ ID NO: 1435518 - RNA, 19 nt, Homo sapiens
guagauggaugaaauagca

SEQ ID NO: 1435519 - RNA, 19 nt, Homo sapiens
ugaaauagcaccagauaug

SEQ ID NO: 1435520 - RNA, 19 nt, Homo sapiens
gggaagccauguccuacuu

SEQ ID NO: 1435521 - RNA, 19 nt, Homo sapiens
gcuuguagauggaugaaau

SEQ ID NO: 1435522 - RNA, 19 nt, Homo sapiens
gaaauagcaccagauaugu

SEQ ID NO: 1435523 - RNA, 19 nt, Homo sapiens
aaauagcaccagauaugua

SEQ ID NO: 1435524 - RNA, 19 nt, Homo sapiens
gaagaugccccuagugaga

SEQ ID NO: 1435525 - RNA, 19 nt, Homo sapiens
gaucacuauucccucacaa

SEQ ID NO: 1435526 - RNA, 19 nt, Homo sapiens
gaaggaauacagccgaaac

SEQ ID NO: 1435527 - RNA, 19 nt, Homo sapiens
gggagacacuacggaagga

SEQ ID NO: 1435528 - RNA, 19 nt, Homo sapiens
ccgaaacugccacaaauuc

SEQ ID NO: 1435529 - RNA, 19 nt, Homo sapiens
cuucaggacuccacaaacu

SEQ ID NO: 1435530 - RNA, 19 nt, Homo sapiens
agacacuacggaaggaaua

SEQ ID NO: 1435531 - RNA, 19 nt, Homo sapiens
gggaagaggaccugaucug

SEQ ID NO: 1435532 - RNA, 19 nt, Homo sapiens
agccgaaacugccacaaau

SEQ ID NO: 1435533 - RNA, 19 nt, Homo sapiens
cagccgaaacugccacaaa

SEQ ID NO: 1435534 - RNA, 19 nt, Homo sapiens
ggaaggaauacagccgaaa

SEQ ID NO: 1435535 - RNA, 19 nt, Homo sapiens
cgcucaagcuuucaugaug

SEQ ID NO: 1435536 - RNA, 19 nt, Homo sapiens
ccuccuggcuccugcuugu

SEQ ID NO: 1435537 - RNA, 19 nt, Homo sapiens
gccgaaacugccacaaauu

SEQ ID NO: 1435538 - RNA, 19 nt, Homo sapiens
gguggccucugguggaaca

SEQ ID NO: 1435539 - RNA, 19 nt, Homo sapiens
gccacaaauucccgcaugu

SEQ ID NO: 1435540 - RNA, 19 nt, Homo sapiens
gagcuugggcugggacaau

SEQ ID NO: 1435541 - RNA, 19 nt, Homo sapiens
gcuccugcuuguagaugga

SEQ ID NO: 1435542 - RNA, 19 nt, Homo sapiens
gggaagaugccccuaguga

SEQ ID NO: 1435543 - RNA, 19 nt, Homo sapiens
gcucccagccugauaucug

SEQ ID NO: 1435544 - RNA, 19 nt, Homo sapiens
gugguggccucugguggaa

SEQ ID NO: 1435545 - RNA, 19 nt, Homo sapiens
gaugcugugugggcuguca

SEQ ID NO: 1435546 - RNA, 19 nt, Homo sapiens
ucaggacuccacaaacuca

SEQ ID NO: 1435547 - RNA, 19 nt, Homo sapiens
gagacacuacggaaggaau

SEQ ID NO: 1435548 - RNA, 19 nt, Homo sapiens
gcaaauaccugcugucuga

SEQ ID NO: 1435549 - RNA, 19 nt, Homo sapiens
ggaagcagcugguauuaga

SEQ ID NO: 1435550 - RNA, 19 nt, Homo sapiens
gaaagaagaggaggaaaua

SEQ ID NO: 1435551 - RNA, 19 nt, Homo sapiens
gcucagaggucuccagaaa

SEQ ID NO: 1435552 - RNA, 19 nt, Homo sapiens
gcacacaauugcauggaua

SEQ ID NO: 1435553 - RNA, 19 nt, Homo sapiens
uaacagacguggaugaaga

SEQ ID NO: 1435554 - RNA, 19 nt, Homo sapiens
caagagaucucccggguau

SEQ ID NO: 1435555 - RNA, 19 nt, Homo sapiens
gaacagcgaucagcccauu

SEQ ID NO: 1435556 - RNA, 19 nt, Homo sapiens
gcaccaaaguggaaaguga

SEQ ID NO: 1435557 - RNA, 19 nt, Homo sapiens
ggacacagacucuaaauuc

SEQ ID NO: 1435558 - RNA, 19 nt, Homo sapiens
gaaagagucagaagacaaa

SEQ ID NO: 1435559 - RNA, 19 nt, Homo sapiens
gaagucauuuguccaauca

SEQ ID NO: 1435560 - RNA, 19 nt, Homo sapiens
gaacaccauucacaguuug

SEQ ID NO: 1435561 - RNA, 19 nt, Homo sapiens
aggagaagcugaugaaaga

SEQ ID NO: 1435562 - RNA, 19 nt, Homo sapiens
gaaggagugugggaaagaa

SEQ ID NO: 1435563 - RNA, 19 nt, Homo sapiens
ggccuaaucucaccaacaa

SEQ ID NO: 1435564 - RNA, 19 nt, Homo sapiens
gcaagucccagaucuuaaa

SEQ ID NO: 1435565 - RNA, 19 nt, Homo sapiens
gaacgagucucugcugagu

SEQ ID NO: 1435566 - RNA, 19 nt, Homo sapiens
ggacagcgguucaguagcu

SEQ ID NO: 1435567 - RNA, 19 nt, Homo sapiens
cgaacaccauucacaguuu

SEQ ID NO: 1435568 - RNA, 19 nt, Homo sapiens
gaaagaaaguccccacgaa

SEQ ID NO: 1435569 - RNA, 19 nt, Homo sapiens
cgacagagcagcaagaugu

SEQ ID NO: 1435570 - RNA, 19 nt, Homo sapiens
ccaagacgcucuguccaaa

SEQ ID NO: 1435571 - RNA, 19 nt, Homo sapiens
gaggaugucuccagugaag

SEQ ID NO: 1435572 - RNA, 19 nt, Homo sapiens
uaccagaacucuccaggaa

SEQ ID NO: 1435573 - RNA, 19 nt, Homo sapiens
agacguggaugaagaauag

SEQ ID NO: 1435574 - RNA, 19 nt, Homo sapiens
ucagaggucuccagaaaca

SEQ ID NO: 1435575 - RNA, 19 nt, Homo sapiens
gaggaagacuuggaagaug

SEQ ID NO: 1435576 - RNA, 19 nt, Homo sapiens
ucgauucccuccaagauuu

SEQ ID NO: 1435577 - RNA, 19 nt, Homo sapiens
ggacaaagaggaugcucaa

SEQ ID NO: 1435578 - RNA, 19 nt, Homo sapiens
gaaugaaacgggccacuau

SEQ ID NO: 1435579 - RNA, 19 nt, Homo sapiens
ggaagucauuuguccaauc

SEQ ID NO: 1435580 - RNA, 19 nt, Homo sapiens
guaugcaaaucucuaaguu

SEQ ID NO: 1435581 - RNA, 19 nt, Homo sapiens
aggaacagcugaaagaaga

SEQ ID NO: 1435582 - RNA, 19 nt, Homo sapiens
gacacagacucuaaauuca

SEQ ID NO: 1435583 - RNA, 19 nt, Homo sapiens
acacucaagucaagaaaga

SEQ ID NO: 1435584 - RNA, 19 nt, Homo sapiens
ggacgaaugccuuaguuuc

SEQ ID NO: 1435585 - RNA, 19 nt, Homo sapiens
ucaccuggguuuccaaaug

SEQ ID NO: 1435586 - RNA, 19 nt, Homo sapiens
ccacacaccuggccccuua

SEQ ID NO: 1435587 - RNA, 19 nt, Homo sapiens
gauuugagcguccacauga

SEQ ID NO: 1435588 - RNA, 19 nt, Homo sapiens
ccagaacucuccaggaagu

SEQ ID NO: 1435589 - RNA, 19 nt, Homo sapiens
aaagcaagguggagcaaga

SEQ ID NO: 1435590 - RNA, 19 nt, Homo sapiens
gagccagucccaaccauuu

SEQ ID NO: 1435591 - RNA, 19 nt, Homo sapiens
gcagagaugccucagacaa

SEQ ID NO: 1435592 - RNA, 19 nt, Homo sapiens
cuaugaagauccucuacaa

SEQ ID NO: 1435593 - RNA, 19 nt, Homo sapiens
gagcaaacaugcgguaaaa

SEQ ID NO: 1435594 - RNA, 19 nt, Homo sapiens
aacaauagcugccgaagag

SEQ ID NO: 1435595 - RNA, 19 nt, Homo sapiens
caagcacaauuuccauguu

SEQ ID NO: 1435596 - RNA, 19 nt, Homo sapiens
uaacucagcaucagauugu

SEQ ID NO: 1435597 - RNA, 19 nt, Homo sapiens
caaacgaagcacacaauug

SEQ ID NO: 1435598 - RNA, 19 nt, Homo sapiens
caccuggguuuccaaauga

SEQ ID NO: 1435599 - RNA, 19 nt, Homo sapiens
gggcgauucuuuccgcaaa

SEQ ID NO: 1435600 - RNA, 19 nt, Homo sapiens
ccauugaccugaccaaguc

SEQ ID NO: 1435601 - RNA, 19 nt, Homo sapiens
gauggucacaggucacuuu

SEQ ID NO: 1435602 - RNA, 19 nt, Homo sapiens
ggaggacagcgguucagua

SEQ ID NO: 1435603 - RNA, 19 nt, Homo sapiens
guacagccucuacaacuga

SEQ ID NO: 1435604 - RNA, 19 nt, Homo sapiens
caacuggaauccucagcau

SEQ ID NO: 1435605 - RNA, 19 nt, Homo sapiens
aagaagaggaggaaauaaa

SEQ ID NO: 1435606 - RNA, 19 nt, Homo sapiens
gaaacgggccacuaucaag

SEQ ID NO: 1435607 - RNA, 19 nt, Homo sapiens
ucagcucggugcaguugua

SEQ ID NO: 1435608 - RNA, 19 nt, Homo sapiens
gacucuaaauucaagugua

SEQ ID NO: 1435609 - RNA, 19 nt, Homo sapiens
ucaaguaccagcuuaggaa

SEQ ID NO: 1435610 - RNA, 19 nt, Homo sapiens
gcaaaucucuaaguuuacg

SEQ ID NO: 1435611 - RNA, 19 nt, Homo sapiens
cacaagagcguaugcaaau

SEQ ID NO: 1435612 - RNA, 19 nt, Homo sapiens
ccacaagagcguaugcaaa

SEQ ID NO: 1435613 - RNA, 19 nt, Homo sapiens
caauuuccauguuccacaa

SEQ ID NO: 1435614 - RNA, 19 nt, Homo sapiens
gaacaaucacuugggcaaa

SEQ ID NO: 1435615 - RNA, 19 nt, Homo sapiens
gaaagggaagcagcuggua

SEQ ID NO: 1435616 - RNA, 19 nt, Homo sapiens
ggucacaggucacuuucuc

SEQ ID NO: 1435617 - RNA, 19 nt, Homo sapiens
ugacugugcacaugaauga

SEQ ID NO: 1435618 - RNA, 19 nt, Homo sapiens
gaggacagcgguucaguag

SEQ ID NO: 1435619 - RNA, 19 nt, Homo sapiens
ggaggaagacuuggaagau

SEQ ID NO: 1435620 - RNA, 19 nt, Homo sapiens
caaccgcuauggcuaccaa

SEQ ID NO: 1435621 - RNA, 19 nt, Homo sapiens
ggcgcuaccuguuugagaa

SEQ ID NO: 1435622 - RNA, 19 nt, Homo sapiens
ccacagccaucaacaaagc

SEQ ID NO: 1435623 - RNA, 19 nt, Homo sapiens
cgaaacggcagcaacaaga

SEQ ID NO: 1435624 - RNA, 19 nt, Homo sapiens
gaaagagggcagcgagaag

SEQ ID NO: 1435625 - RNA, 19 nt, Homo sapiens
caggacgaaugccuuaguu

SEQ ID NO: 1435626 - RNA, 19 nt, Homo sapiens
gagcguaugcaaaucucua

SEQ ID NO: 1435627 - RNA, 19 nt, Homo sapiens
gaggagaagcugaugaaag

SEQ ID NO: 1435628 - RNA, 19 nt, Homo sapiens
caagaaagagucagaagac

SEQ ID NO: 1435629 - RNA, 19 nt, Homo sapiens
caccacagccaucaacaaa

SEQ ID NO: 1435630 - RNA, 19 nt, Homo sapiens
gaaaagcgaggacuaugaa

SEQ ID NO: 1435631 - RNA, 19 nt, Homo sapiens
cagcaaggaugagaaaguc

SEQ ID NO: 1435632 - RNA, 19 nt, Homo sapiens
caaagaggaugcucaaaag

SEQ ID NO: 1435633 - RNA, 19 nt, Homo sapiens
ugaaagaagaggaggaaau

SEQ ID NO: 1435634 - RNA, 19 nt, Homo sapiens
ccaaguucaagcacaauuu

SEQ ID NO: 1435635 - RNA, 19 nt, Homo sapiens
acgagucucugcugaguga

SEQ ID NO: 1435636 - RNA, 19 nt, Homo sapiens
aaagaaaggccagaggaaa

SEQ ID NO: 1435637 - RNA, 19 nt, Homo sapiens
agagaugccucagacaaga

SEQ ID NO: 1435638 - RNA, 19 nt, Homo sapiens
uagaaucucaccuggguuu

SEQ ID NO: 1435639 - RNA, 19 nt, Homo sapiens
acagugagggcgauucuuu

SEQ ID NO: 1435640 - RNA, 19 nt, Homo sapiens
ggacuaugaagauccucua

SEQ ID NO: 1435641 - RNA, 19 nt, Homo sapiens
gagcugacugugcacauga

SEQ ID NO: 1435642 - RNA, 19 nt, Homo sapiens
caacaagagugauuuugau

SEQ ID NO: 1435643 - RNA, 19 nt, Homo sapiens
ggaggaacagcugaaagaa

SEQ ID NO: 1435644 - RNA, 19 nt, Homo sapiens
aaacgaagcacacaauugc

SEQ ID NO: 1435645 - RNA, 19 nt, Homo sapiens
uugaggaugucuccaguga

SEQ ID NO: 1435646 - RNA, 19 nt, Homo sapiens
ggacggacgaggagcuaga

SEQ ID NO: 1435647 - RNA, 19 nt, Homo sapiens
aagcacaauuuccauguuc

SEQ ID NO: 1435648 - RNA, 19 nt, Homo sapiens
gacagaagcuccagcauuu

SEQ ID NO: 1435649 - RNA, 19 nt, Homo sapiens
gagaagggcuccaggaaga

SEQ ID NO: 1435650 - RNA, 19 nt, Homo sapiens
caacacagcugccaugcuu

SEQ ID NO: 1435651 - RNA, 19 nt, Homo sapiens
gaggaacgcugcacagaga

SEQ ID NO: 1435652 - RNA, 19 nt, Homo sapiens
ccaaugacgucuccauaaa

SEQ ID NO: 1435653 - RNA, 19 nt, Homo sapiens
caacaccaagcauauauua

SEQ ID NO: 1435654 - RNA, 19 nt, Homo sapiens
ucaucuggcuguuuacuua

SEQ ID NO: 1435655 - RNA, 19 nt, Homo sapiens
caaagacucuccagaccuu

SEQ ID NO: 1435656 - RNA, 19 nt, Homo sapiens
ggacagaagcuccagcauu

SEQ ID NO: 1435657 - RNA, 19 nt, Homo sapiens
ggacaacaccaagcauaua

SEQ ID NO: 1435658 - RNA, 19 nt, Homo sapiens
caacaucccugguagaaaa

SEQ ID NO: 1435659 - RNA, 19 nt, Homo sapiens
ggcccaagcuccucaaugu

SEQ ID NO: 1435660 - RNA, 19 nt, Homo sapiens
gcucaacaccagacuuuaa

SEQ ID NO: 1435661 - RNA, 19 nt, Homo sapiens
gaacaagaggcaucacuca

SEQ ID NO: 1435662 - RNA, 19 nt, Homo sapiens
ggacggcagccucuacuuu

SEQ ID NO: 1435663 - RNA, 19 nt, Homo sapiens
gagcaaggacuaccaacaa

SEQ ID NO: 1435664 - RNA, 19 nt, Homo sapiens
cugaagagcugaacaugug

SEQ ID NO: 1435665 - RNA, 19 nt, Homo sapiens
gaaaugucguuggaaacuu

SEQ ID NO: 1435666 - RNA, 19 nt, Homo sapiens
gcgguuauaugacuucuuc

SEQ ID NO: 1435667 - RNA, 19 nt, Homo sapiens
aaagaaaguggcagagaua

SEQ ID NO: 1435668 - RNA, 19 nt, Homo sapiens
gcgagaggcuggcaacauc

SEQ ID NO: 1435669 - RNA, 19 nt, Homo sapiens
gcacagagaggccaagaag

SEQ ID NO: 1435670 - RNA, 19 nt, Homo sapiens
ggaagaaccuacggcagau

SEQ ID NO: 1435671 - RNA, 19 nt, Homo sapiens
ugacccaccuccuauauca

SEQ ID NO: 1435672 - RNA, 19 nt, Homo sapiens
ccagaucccucaggacuug

SEQ ID NO: 1435673 - RNA, 19 nt, Homo sapiens
gcccucagcuggcucauca

SEQ ID NO: 1435674 - RNA, 19 nt, Homo sapiens
cagcuucccugccucagaa

SEQ ID NO: 1435675 - RNA, 19 nt, Homo sapiens
ggacuugcccuaugagaca

SEQ ID NO: 1435676 - RNA, 19 nt, Homo sapiens
gaacacgggagcuucugaa

SEQ ID NO: 1435677 - RNA, 19 nt, Homo sapiens
caaaagauguccugaccaa

SEQ ID NO: 1435678 - RNA, 19 nt, Homo sapiens
ugauguggcugcccuuaga

SEQ ID NO: 1435679 - RNA, 19 nt, Homo sapiens
gagagaagggcuccaggaa

SEQ ID NO: 1435680 - RNA, 19 nt, Homo sapiens
caaccgcuuugugaaauug

SEQ ID NO: 1435681 - RNA, 19 nt, Homo sapiens
gaccaaccgcuuugugaaa

SEQ ID NO: 1435682 - RNA, 19 nt, Homo sapiens
gacaacaccaagcauauau

SEQ ID NO: 1435683 - RNA, 19 nt, Homo sapiens
aaaugucguuggaaacuug

SEQ ID NO: 1435684 - RNA, 19 nt, Homo sapiens
ggaccaaccgcuuugugaa

SEQ ID NO: 1435685 - RNA, 19 nt, Homo sapiens
ggacugugacugugacaug

SEQ ID NO: 1435686 - RNA, 19 nt, Homo sapiens
ggagaaggcagacuuuaac

SEQ ID NO: 1435687 - RNA, 19 nt, Homo sapiens
aacgagaacuuguccaugu

SEQ ID NO: 1435688 - RNA, 19 nt, Homo sapiens
ccauuucacuugcucaaca

SEQ ID NO: 1435689 - RNA, 19 nt, Homo sapiens
gcuccugacugaugagauc

SEQ ID NO: 1435690 - RNA, 19 nt, Homo sapiens
gagggcuccugacugauga

SEQ ID NO: 1435691 - RNA, 19 nt, Homo sapiens
ccucaggacuugcccuaug

SEQ ID NO: 1435692 - RNA, 19 nt, Homo sapiens
gaccucacccuguguguau

SEQ ID NO: 1435693 - RNA, 19 nt, Homo sapiens
gacaggccuugcuggguuu

SEQ ID NO: 1435694 - RNA, 19 nt, Homo sapiens
gcucauaagacccucauuc

SEQ ID NO: 1435695 - RNA, 19 nt, Homo sapiens
cagcagagcaggagaccuu

SEQ ID NO: 1435696 - RNA, 19 nt, Homo sapiens
cagccgugauuguguugua

SEQ ID NO: 1435697 - RNA, 19 nt, Homo sapiens
gggcuaccaugacauugug

SEQ ID NO: 1435698 - RNA, 19 nt, Homo sapiens
aggaagaacugauugacau

SEQ ID NO: 1435699 - RNA, 19 nt, Homo sapiens
ccaaccgcuuugugaaauu

SEQ ID NO: 1435700 - RNA, 19 nt, Homo sapiens
acccucagcugcacuacua

SEQ ID NO: 1435701 - RNA, 19 nt, Homo sapiens
ccaaugacccaccuccuau

SEQ ID NO: 1435702 - RNA, 19 nt, Homo sapiens
cggagaaggcagacuuuaa

SEQ ID NO: 1435703 - RNA, 19 nt, Homo sapiens
guuggaaacuugcaaagac

SEQ ID NO: 1435704 - RNA, 19 nt, Homo sapiens
ggcagccucuacuuucaaa

SEQ ID NO: 1435705 - RNA, 19 nt, Homo sapiens
gccaaugacccaccuccua

SEQ ID NO: 1435706 - RNA, 19 nt, Homo sapiens
gguuuagaccuuaugcuuu

SEQ ID NO: 1435707 - RNA, 19 nt, Homo sapiens
ggaaaugucguuggaaacu

SEQ ID NO: 1435708 - RNA, 19 nt, Homo sapiens
gguuggaaaugucguugga

SEQ ID NO: 1435709 - RNA, 19 nt, Homo sapiens
caaugacccaccuccuaua

SEQ ID NO: 1435710 - RNA, 19 nt, Homo sapiens
agccaugccuauccaauga

SEQ ID NO: 1435711 - RNA, 19 nt, Homo sapiens
guuuagaccuuaugcuuuu

SEQ ID NO: 1435712 - RNA, 19 nt, Homo sapiens
caacaauggacaacaccaa

SEQ ID NO: 1435713 - RNA, 19 nt, Homo sapiens
uuggaaaugucguuggaaa

SEQ ID NO: 1435714 - RNA, 19 nt, Homo sapiens
ucacuaccuuggcgucguu

SEQ ID NO: 1435715 - RNA, 19 nt, Homo sapiens
acgcauggcuaucagugaa

SEQ ID NO: 1435716 - RNA, 19 nt, Homo sapiens
caaggacuaccaacaagug

SEQ ID NO: 1435717 - RNA, 19 nt, Homo sapiens
gcggagaaggcagacuuua

SEQ ID NO: 1435718 - RNA, 19 nt, Homo sapiens
gaagaucgaacaaaagaug

SEQ ID NO: 1435719 - RNA, 19 nt, Homo sapiens
ugagguagggaccaucuuu

SEQ ID NO: 1435720 - RNA, 19 nt, Homo sapiens
caugcagagugcugaggua

SEQ ID NO: 1435721 - RNA, 19 nt, Homo sapiens
uaccagggcuaccaugaca

SEQ ID NO: 1435722 - RNA, 19 nt, Homo sapiens
ggaacgagaacuuguccau

SEQ ID NO: 1435723 - RNA, 19 nt, Homo sapiens
ggaacacgggagcuucuga

SEQ ID NO: 1435724 - RNA, 19 nt, Homo sapiens
auccagagcuccaugacuu

SEQ ID NO: 1435725 - RNA, 19 nt, Homo sapiens
caacaccagacuuuaaucu

SEQ ID NO: 1435726 - RNA, 19 nt, Homo sapiens
uuaaggcacccacucacua

SEQ ID NO: 1435727 - RNA, 19 nt, Homo sapiens
agaccuuccucuuacauca

SEQ ID NO: 1435728 - RNA, 19 nt, Homo sapiens
gaaagccagagaagaccuu

SEQ ID NO: 1435729 - RNA, 19 nt, Homo sapiens
gccaaggaccaaccgcuuu

SEQ ID NO: 1435730 - RNA, 19 nt, Homo sapiens
gagauacaccaggcucuga

SEQ ID NO: 1435731 - RNA, 19 nt, Homo sapiens
gcaacaucccugguagaaa

SEQ ID NO: 1435732 - RNA, 19 nt, Homo sapiens
gcaaggacuaccaacaagu

SEQ ID NO: 1435733 - RNA, 19 nt, Homo sapiens
aaacggaaucucugucugu

SEQ ID NO: 1435734 - RNA, 19 nt, Homo sapiens
gaaaguggcagagauacac

SEQ ID NO: 1435735 - RNA, 19 nt, Homo sapiens
ccaaggaccaaccgcuuug

SEQ ID NO: 1435736 - RNA, 19 nt, Homo sapiens
acccacugaugccgauuua

SEQ ID NO: 1435737 - RNA, 19 nt, Homo sapiens
ggcaacaucccugguagaa

SEQ ID NO: 1435738 - RNA, 19 nt, Homo sapiens
gcuggcaacaucccuggua

SEQ ID NO: 1435739 - RNA, 19 nt, Homo sapiens
caucauccuccucaucuug

SEQ ID NO: 1435740 - RNA, 19 nt, Homo sapiens
acagagaggccaagaagca

SEQ ID NO: 1435741 - RNA, 19 nt, Homo sapiens
ggcauguccugucugacuu

SEQ ID NO: 1435742 - RNA, 19 nt, Homo sapiens
caccaagcauauauuaaac

SEQ ID NO: 1435743 - RNA, 19 nt, Homo sapiens
ccagggcuaccaugacauu

SEQ ID NO: 1435744 - RNA, 19 nt, Homo sapiens
ccaagcuccucaaugucaa

SEQ ID NO: 1435745 - RNA, 19 nt, Homo sapiens
gcaacccucagcugcacua

SEQ ID NO: 1435746 - RNA, 19 nt, Homo sapiens
ccaguuucaucucaacaca

SEQ ID NO: 1435747 - RNA, 19 nt, Homo sapiens
ggguuuagaccuuaugcuu

SEQ ID NO: 1435748 - RNA, 19 nt, Homo sapiens
gcaaauggguacagucuca

SEQ ID NO: 1435749 - RNA, 19 nt, Homo sapiens
ucaguguccuucaaauaua

SEQ ID NO: 1435750 - RNA, 19 nt, Homo sapiens
caacucaguguccuucaaa

SEQ ID NO: 1435751 - RNA, 19 nt, Homo sapiens
gacaauccaggcagucuuu

SEQ ID NO: 1435752 - RNA, 19 nt, Homo sapiens
ccacagcgcaaacuucuca

SEQ ID NO: 1435753 - RNA, 19 nt, Homo sapiens
gcucuacuccugcaaaugg

SEQ ID NO: 1435754 - RNA, 19 nt, Homo sapiens
gcacuaggacugacaaucc

SEQ ID NO: 1435755 - RNA, 19 nt, Homo sapiens
ucagcuuccucaccuuuga

SEQ ID NO: 1435756 - RNA, 19 nt, Homo sapiens
ggucagcuuccucaccuuu

SEQ ID NO: 1435757 - RNA, 19 nt, Homo sapiens
acaaugaccacccuucuuc

SEQ ID NO: 1435758 - RNA, 19 nt, Homo sapiens
ccuuugaccugcuccauag

SEQ ID NO: 1435759 - RNA, 19 nt, Homo sapiens
gaggaggugaggaggguuu

SEQ ID NO: 1435760 - RNA, 19 nt, Homo sapiens
ccuacucucacccuuauaa

SEQ ID NO: 1435761 - RNA, 19 nt, Homo sapiens
acucugagcucacccuucu

SEQ ID NO: 1435762 - RNA, 19 nt, Homo sapiens
acucaguguccuucaaaua

SEQ ID NO: 1435763 - RNA, 19 nt, Homo sapiens
ugaccacccuucuucaaaa

SEQ ID NO: 1435764 - RNA, 19 nt, Homo sapiens
acaacucaguguccuucaa

SEQ ID NO: 1435765 - RNA, 19 nt, Homo sapiens
ccagugcguccaccuguau

SEQ ID NO: 1435766 - RNA, 19 nt, Homo sapiens
cucaguguccuucaaauau

SEQ ID NO: 1435767 - RNA, 19 nt, Homo sapiens
gaggcucuacuccugcaaa

SEQ ID NO: 1435768 - RNA, 19 nt, Homo sapiens
caguguccuucaaauauac

SEQ ID NO: 1435769 - RNA, 19 nt, Homo sapiens
caugacccggcucugcuua

SEQ ID NO: 1435770 - RNA, 19 nt, Homo sapiens
gguacagucucaggacaac

SEQ ID NO: 1435771 - RNA, 19 nt, Homo sapiens
gaaacgguccucuuuauug

SEQ ID NO: 1435772 - RNA, 19 nt, Homo sapiens
cagaagagguggacuguau

SEQ ID NO: 1435773 - RNA, 19 nt, Homo sapiens
cagaaacgguccucuuuau

SEQ ID NO: 1435774 - RNA, 19 nt, Homo sapiens
ugaaaccacggaugaauua

SEQ ID NO: 1435775 - RNA, 19 nt, Homo sapiens
ccauugccauugacagaua

SEQ ID NO: 1435776 - RNA, 19 nt, Homo sapiens
aaacgguccucuuuauugu

SEQ ID NO: 1435777 - RNA, 19 nt, Homo sapiens
caacagaaacgguccucuu

SEQ ID NO: 1435778 - RNA, 19 nt, Homo sapiens
ccuccucccucuccuuuaa

SEQ ID NO: 1435779 - RNA, 19 nt, Homo sapiens
gaacaacaccaugaaguac

SEQ ID NO: 1435780 - RNA, 19 nt, Homo sapiens
gaagagguggacuguauca

SEQ ID NO: 1435781 - RNA, 19 nt, Homo sapiens
agaacaacaccaugaagua

SEQ ID NO: 1435782 - RNA, 19 nt, Homo sapiens
ucaguuauggugauuauga

SEQ ID NO: 1435783 - RNA, 19 nt, Homo sapiens
acagaaacgguccucuuua

SEQ ID NO: 1435784 - RNA, 19 nt, Homo sapiens
cagcagcucuacuacaagu

SEQ ID NO: 1435785 - RNA, 19 nt, Homo sapiens
gauggacuacuacguggua

SEQ ID NO: 1435786 - RNA, 19 nt, Homo sapiens
gaugaggacaugaccaaga

SEQ ID NO: 1435787 - RNA, 19 nt, Homo sapiens
ggaugaggaugaggacaug

SEQ ID NO: 1435788 - RNA, 19 nt, Homo sapiens
gggcacccuucuacgguuu

SEQ ID NO: 1435789 - RNA, 19 nt, Homo sapiens
caucuuuggugucgaguuc

SEQ ID NO: 1435790 - RNA, 19 nt, Homo sapiens
ccacuguguucgugaagga

SEQ ID NO: 1435791 - RNA, 19 nt, Homo sapiens
caccaucguucgugacuuc

SEQ ID NO: 1435792 - RNA, 19 nt, Homo sapiens
gugcucaugugcauucuca

SEQ ID NO: 1435793 - RNA, 19 nt, Homo sapiens
ccacggaugaauuaucaaa

SEQ ID NO: 1435794 - RNA, 19 nt, Homo sapiens
aaccacggaugaauuauca

SEQ ID NO: 1435795 - RNA, 19 nt, Homo sapiens
cggcuuacuuugcaacaga

SEQ ID NO: 1435796 - RNA, 19 nt, Homo sapiens
acagauaucucgccaucgu

SEQ ID NO: 1435797 - RNA, 19 nt, Homo sapiens
gauuaugaccucccuaugg

SEQ ID NO: 1435798 - RNA, 19 nt, Homo sapiens
ccuucgagauggacuacua

SEQ ID NO: 1435799 - RNA, 19 nt, Homo sapiens
acaacaccaugaaguacuu

SEQ ID NO: 1435800 - RNA, 19 nt, Homo sapiens
caagaucgucauuggcauu

SEQ ID NO: 1435801 - RNA, 19 nt, Homo sapiens
ucaagaacaacaccaugaa

SEQ ID NO: 1435802 - RNA, 19 nt, Homo sapiens
gcaacagcaugaucaacac

SEQ ID NO: 1435803 - RNA, 19 nt, Homo sapiens
gaucgucauuggcauugca

SEQ ID NO: 1435804 - RNA, 19 nt, Homo sapiens
caaguccagugcugaccuu

SEQ ID NO: 1435805 - RNA, 19 nt, Homo sapiens
cuacuuccucuucaucuuu

SEQ ID NO: 1435806 - RNA, 19 nt, Homo sapiens
gcccucacccgcuauaaga

SEQ ID NO: 1435807 - RNA, 19 nt, Homo sapiens
gaucagcagcucuacuaca

SEQ ID NO: 1435808 - RNA, 19 nt, Homo sapiens
ucgguaacuuugucuuuau

SEQ ID NO: 1435809 - RNA, 19 nt, Homo sapiens
gucaagaacaacaccauga

SEQ ID NO: 1435810 - RNA, 19 nt, Homo sapiens
caucguucgugacuucuuc

SEQ ID NO: 1435811 - RNA, 19 nt, Homo sapiens
cuucaguuauggugauuau

SEQ ID NO: 1435812 - RNA, 19 nt, Homo sapiens
caucgguaacuuugucuuu

SEQ ID NO: 1435813 - RNA, 19 nt, Homo sapiens
cuaccucacugccuucuac

SEQ ID NO: 1435814 - RNA, 19 nt, Homo sapiens
uggaucagcagcucuacua

SEQ ID NO: 1435815 - RNA, 19 nt, Homo sapiens
agaaacgguccucuuuauu

SEQ ID NO: 1435816 - RNA, 19 nt, Homo sapiens
aacagaaacgguccucuuu

SEQ ID NO: 1435817 - RNA, 19 nt, Homo sapiens
caucccaucggcuuacuuu

SEQ ID NO: 1435818 - RNA, 19 nt, Homo sapiens
auuaugaccucccuaugga

SEQ ID NO: 1435819 - RNA, 19 nt, Homo sapiens
aucgguaacuuugucuuua

SEQ ID NO: 1435820 - RNA, 19 nt, Homo sapiens
caagaacaacaccaugaag

SEQ ID NO: 1435821 - RNA, 19 nt, Homo sapiens
ucaagagccaggagaagau

SEQ ID NO: 1435822 - RNA, 19 nt, Homo sapiens
cagaauggaaacaccaguu

SEQ ID NO: 1435823 - RNA, 19 nt, Homo sapiens
ggccauugccauugacaga

SEQ ID NO: 1435824 - RNA, 19 nt, Homo sapiens
ccucaccaaucugcucauu

SEQ ID NO: 1435825 - RNA, 19 nt, Homo sapiens
cggcaucgguaacuuuguc

SEQ ID NO: 1435826 - RNA, 19 nt, Homo sapiens
aucagcagcucuacuacaa

SEQ ID NO: 1435827 - RNA, 19 nt, Homo sapiens
gaaaccacggaugaauuau

SEQ ID NO: 1435828 - RNA, 19 nt, Homo sapiens
gaccuugaccucagaacca

SEQ ID NO: 1435829 - RNA, 19 nt, Homo sapiens
gucaagagccaggagaaga

SEQ ID NO: 1435830 - RNA, 19 nt, Homo sapiens
guuucacacccaacuuuaa

SEQ ID NO: 1435831 - RNA, 19 nt, Homo sapiens
gugauuaugaccucccuau

SEQ ID NO: 1435832 - RNA, 19 nt, Homo sapiens
ccuacuuccucuucaucuu

SEQ ID NO: 1435833 - RNA, 19 nt, Homo sapiens
gcacccuucuacgguuuca

SEQ ID NO: 1435834 - RNA, 19 nt, Homo sapiens
uugaaaccacggaugaauu

SEQ ID NO: 1435835 - RNA, 19 nt, Homo sapiens
aagaacaacaccaugaagu

SEQ ID NO: 1435836 - RNA, 19 nt, Homo sapiens
cccgggagcucugguucaa

SEQ ID NO: 1435837 - RNA, 19 nt, Homo sapiens
acgguccucuuuauuguca

SEQ ID NO: 1435838 - RNA, 19 nt, Homo sapiens
ggcuuacuuugcaacagaa

SEQ ID NO: 1435839 - RNA, 19 nt, Homo sapiens
cccaucggcuuacuuugca

SEQ ID NO: 1435840 - RNA, 19 nt, Homo sapiens
aaaccacggaugaauuauc

SEQ ID NO: 1435841 - RNA, 19 nt, Homo sapiens
gaacgugucuguaaaggaa

SEQ ID NO: 1435842 - RNA, 19 nt, Homo sapiens
gcaagaagcugagaaagag

SEQ ID NO: 1435843 - RNA, 19 nt, Homo sapiens
gcaagaagaacaugaauuc

SEQ ID NO: 1435844 - RNA, 19 nt, Homo sapiens
caacgacaccuacuuauau

SEQ ID NO: 1435845 - RNA, 19 nt, Homo sapiens
gcaacgacaccuacuuaua

SEQ ID NO: 1435846 - RNA, 19 nt, Homo sapiens
gggaacaggugguggcuuu

SEQ ID NO: 1435847 - RNA, 19 nt, Homo sapiens
cgacgggaguggaguauau

SEQ ID NO: 1435848 - RNA, 19 nt, Homo sapiens
gagaaagaguuuaauuugc

SEQ ID NO: 1435849 - RNA, 19 nt, Homo sapiens
acacucaacuucuucauuc

SEQ ID NO: 1435850 - RNA, 19 nt, Homo sapiens
cagcaacgacaccuacuua

SEQ ID NO: 1435851 - RNA, 19 nt, Homo sapiens
gggcagaaaccucagauga

SEQ ID NO: 1435852 - RNA, 19 nt, Homo sapiens
gcaaggagaacgugucugu

SEQ ID NO: 1435853 - RNA, 19 nt, Homo sapiens
ggaguggaguauauaguca

SEQ ID NO: 1435854 - RNA, 19 nt, Homo sapiens
gaauucaacacucaacuuc

SEQ ID NO: 1435855 - RNA, 19 nt, Homo sapiens
gcaguugggaagaaaguuu

SEQ ID NO: 1435856 - RNA, 19 nt, Homo sapiens
gcugagaaagaguuuaauu

SEQ ID NO: 1435857 - RNA, 19 nt, Homo sapiens
gggaucggaugcuggagaa

SEQ ID NO: 1435858 - RNA, 19 nt, Homo sapiens
caagcugggucacuuccaa

SEQ ID NO: 1435859 - RNA, 19 nt, Homo sapiens
agaagaacaugaauucaac

SEQ ID NO: 1435860 - RNA, 19 nt, Homo sapiens
aaggagaacgugucuguaa

SEQ ID NO: 1435861 - RNA, 19 nt, Homo sapiens
ugcacuggcuguuauuaaa

SEQ ID NO: 1435862 - RNA, 19 nt, Homo sapiens
guugugcacuggcuguuau

SEQ ID NO: 1435863 - RNA, 19 nt, Homo sapiens
guccagaggcuaauucgaa

SEQ ID NO: 1435864 - RNA, 19 nt, Homo sapiens
ggagaacgugucuguaaag

SEQ ID NO: 1435865 - RNA, 19 nt, Homo sapiens
caggaaagccuauguuggu

SEQ ID NO: 1435866 - RNA, 19 nt, Homo sapiens
ccaaaugcaagaggaauga

SEQ ID NO: 1435867 - RNA, 19 nt, Homo sapiens
gaacaggugguggcuuugu

SEQ ID NO: 1435868 - RNA, 19 nt, Homo sapiens
gaguuuaauuugcgagucu

SEQ ID NO: 1435869 - RNA, 19 nt, Homo sapiens
aggagaacgugucuguaaa

SEQ ID NO: 1435870 - RNA, 19 nt, Homo sapiens
aaagcaagaagcugagaaa

SEQ ID NO: 1435871 - RNA, 19 nt, Homo sapiens
aagcugagaaagaguuuaa

SEQ ID NO: 1435872 - RNA, 19 nt, Homo sapiens
ggaccaaaugcaagaggaa

SEQ ID NO: 1435873 - RNA, 19 nt, Homo sapiens
gggagggcuuccagcagaa

SEQ ID NO: 1435874 - RNA, 19 nt, Homo sapiens
ugcccuggauaaacuauuu

SEQ ID NO: 1435875 - RNA, 19 nt, Homo sapiens
gagaacgugucuguaaagg

SEQ ID NO: 1435876 - RNA, 19 nt, Homo sapiens
gugcacuggcuguuauuaa

SEQ ID NO: 1435877 - RNA, 19 nt, Homo sapiens
uggaguauauagucacugu

SEQ ID NO: 1435878 - RNA, 19 nt, Homo sapiens
auucaacacucaacuucuu

SEQ ID NO: 1435879 - RNA, 19 nt, Homo sapiens
gaagaacaugaauucaaca

SEQ ID NO: 1435880 - RNA, 19 nt, Homo sapiens
gagcaagaagaacaugaau

SEQ ID NO: 1435881 - RNA, 19 nt, Homo sapiens
uggcuguuauuaaacugua

SEQ ID NO: 1435882 - RNA, 19 nt, Homo sapiens
gaagcugagaaagaguuua

SEQ ID NO: 1435883 - RNA, 19 nt, Homo sapiens
aacaugaauucaacacuca

SEQ ID NO: 1435884 - RNA, 19 nt, Homo sapiens
ggugguggcuuuguaagac

SEQ ID NO: 1435885 - RNA, 19 nt, Homo sapiens
caaagcaagaagcugagaa

SEQ ID NO: 1435886 - RNA, 19 nt, Homo sapiens
aacaggugguggcuuugua

SEQ ID NO: 1435887 - RNA, 19 nt, Homo sapiens
gcaaagcaagaagcugaga

SEQ ID NO: 1435888 - RNA, 19 nt, Homo sapiens
uaucgaguccagaggcuaa

SEQ ID NO: 1435889 - RNA, 19 nt, Homo sapiens
gggaguggaguauauaguc

SEQ ID NO: 1435890 - RNA, 19 nt, Homo sapiens
gacgggaguggaguauaua

SEQ ID NO: 1435891 - RNA, 19 nt, Homo sapiens
ugaauucaacacucaacuu

SEQ ID NO: 1435892 - RNA, 19 nt, Homo sapiens
caagaagaacaugaauuca

SEQ ID NO: 1435893 - RNA, 19 nt, Homo sapiens
ugagcaagaagaacaugaa

SEQ ID NO: 1435894 - RNA, 19 nt, Homo sapiens
gaaggugcaguugggaaga

SEQ ID NO: 1435895 - RNA, 19 nt, Homo sapiens
gcacuggcuguuauuaaac

SEQ ID NO: 1435896 - RNA, 19 nt, Homo sapiens
caaggagaacgugucugua

SEQ ID NO: 1435897 - RNA, 19 nt, Homo sapiens
gaugggagaaugagugaac

SEQ ID NO: 1435898 - RNA, 19 nt, Homo sapiens
ugacgacgggaguggagua

SEQ ID NO: 1435899 - RNA, 19 nt, Homo sapiens
gagcaaggagaacgugucu

SEQ ID NO: 1435900 - RNA, 19 nt, Homo sapiens
ccgagcaugugggcagaaa

SEQ ID NO: 1435901 - RNA, 19 nt, Homo sapiens
uuaauuugcgagucuuuga

SEQ ID NO: 1435902 - RNA, 19 nt, Homo sapiens
cgacaccuacuuauaucga

SEQ ID NO: 1435903 - RNA, 19 nt, Homo sapiens
cauucaauccuacaacaau

SEQ ID NO: 1435904 - RNA, 19 nt, Homo sapiens
gguuaugaugggagaauga

SEQ ID NO: 1435905 - RNA, 19 nt, Homo sapiens
agcaagaagcugagaaaga

SEQ ID NO: 1435906 - RNA, 19 nt, Homo sapiens
gcaccaccacacccuggaa

SEQ ID NO: 1435907 - RNA, 19 nt, Homo sapiens
gcgagucuuugauauacac

SEQ ID NO: 1435908 - RNA, 19 nt, Homo sapiens
aauuugcgagucuuugaua

SEQ ID NO: 1435909 - RNA, 19 nt, Homo sapiens
aaaggaagcacagggaaca

SEQ ID NO: 1435910 - RNA, 19 nt, Homo sapiens
acaggugguggcuuuguaa

SEQ ID NO: 1435911 - RNA, 19 nt, Homo sapiens
aacgacaccuacuuauauc

SEQ ID NO: 1435912 - RNA, 19 nt, Homo sapiens
auucaauccuacaacaaug

SEQ ID NO: 1435913 - RNA, 19 nt, Homo sapiens
ucaacuucuucauucaauc

SEQ ID NO: 1435914 - RNA, 19 nt, Homo sapiens
gcacagagcugaacaauac

SEQ ID NO: 1435915 - RNA, 19 nt, Homo sapiens
gcagaaggauggcagauga

SEQ ID NO: 1435916 - RNA, 19 nt, Homo sapiens
ccacacaucuugagccuaa

SEQ ID NO: 1435917 - RNA, 19 nt, Homo sapiens
gcuuuggacuuguuuguua

SEQ ID NO: 1435918 - RNA, 19 nt, Homo sapiens
caacugccauuuccaagaa

SEQ ID NO: 1435919 - RNA, 19 nt, Homo sapiens
ggacuuguuuguuauccua

SEQ ID NO: 1435920 - RNA, 19 nt, Homo sapiens
ggacuacuaugccuacaga

SEQ ID NO: 1435921 - RNA, 19 nt, Homo sapiens
gcaaagggacugugaugaa

SEQ ID NO: 1435922 - RNA, 19 nt, Homo sapiens
gaaauuugaagacgacauu

SEQ ID NO: 1435923 - RNA, 19 nt, Homo sapiens
cauguaguguagaucauua

SEQ ID NO: 1435924 - RNA, 19 nt, Homo sapiens
ggaguuugcuguccacaca

SEQ ID NO: 1435925 - RNA, 19 nt, Homo sapiens
gagcagcuuuggacuuguu

SEQ ID NO: 1435926 - RNA, 19 nt, Homo sapiens
gaacuaggugugggaaauu

SEQ ID NO: 1435927 - RNA, 19 nt, Homo sapiens
guccaagacuguauucuca

SEQ ID NO: 1435928 - RNA, 19 nt, Homo sapiens
acaaugucauggcucguua

SEQ ID NO: 1435929 - RNA, 19 nt, Homo sapiens
ggucugugcucaauuaacu

SEQ ID NO: 1435930 - RNA, 19 nt, Homo sapiens
cugggucugugcucaauua

SEQ ID NO: 1435931 - RNA, 19 nt, Homo sapiens
ccagagcugccucccuuua

SEQ ID NO: 1435932 - RNA, 19 nt, Homo sapiens
ccaagacuguauucucaau

SEQ ID NO: 1435933 - RNA, 19 nt, Homo sapiens
gagcaaagggacugugaug

SEQ ID NO: 1435934 - RNA, 19 nt, Homo sapiens
caaagggacugugaugaac

SEQ ID NO: 1435935 - RNA, 19 nt, Homo sapiens
cuaaucauguaguguagau

SEQ ID NO: 1435936 - RNA, 19 nt, Homo sapiens
gggcacaucuugaauuccu

SEQ ID NO: 1435937 - RNA, 19 nt, Homo sapiens
cugagcagcuuuggacuug

SEQ ID NO: 1435938 - RNA, 19 nt, Homo sapiens
agaacuaggugugggaaau

SEQ ID NO: 1435939 - RNA, 19 nt, Homo sapiens
ggcccuggaugacucaguu

SEQ ID NO: 1435940 - RNA, 19 nt, Homo sapiens
gaaaauccacacaucuuga

SEQ ID NO: 1435941 - RNA, 19 nt, Homo sapiens
ucagaucaguguuuuagaa

SEQ ID NO: 1435942 - RNA, 19 nt, Homo sapiens
ugacaacugccauuuccaa

SEQ ID NO: 1435943 - RNA, 19 nt, Homo sapiens
cagagcugccucccuuuaa

SEQ ID NO: 1435944 - RNA, 19 nt, Homo sapiens
gaaagcacagagcugaaca

SEQ ID NO: 1435945 - RNA, 19 nt, Homo sapiens
acaauacuuucaccugcuu

SEQ ID NO: 1435946 - RNA, 19 nt, Homo sapiens
aaggauggcagaugaguga

SEQ ID NO: 1435947 - RNA, 19 nt, Homo sapiens
agagcugccucccuuuaau

SEQ ID NO: 1435948 - RNA, 19 nt, Homo sapiens
ucuugagccuaaucaugua

SEQ ID NO: 1435949 - RNA, 19 nt, Homo sapiens
caucuugagccuaaucaug

SEQ ID NO: 1435950 - RNA, 19 nt, Homo sapiens
aagacgacauugacaacug

SEQ ID NO: 1435951 - RNA, 19 nt, Homo sapiens
gagcugccucccuuuaauc

SEQ ID NO: 1435952 - RNA, 19 nt, Homo sapiens
gcucccagauccugcugau

SEQ ID NO: 1435953 - RNA, 19 nt, Homo sapiens
guguagaucauuaaacauc

SEQ ID NO: 1435954 - RNA, 19 nt, Homo sapiens
gacauugacaacugccauu

SEQ ID NO: 1435955 - RNA, 19 nt, Homo sapiens
guagaucauuaaacaucag

SEQ ID NO: 1435956 - RNA, 19 nt, Homo sapiens
aagacuguauucucaaugg

SEQ ID NO: 1435957 - RNA, 19 nt, Homo sapiens
agucagcggugccuacagu

SEQ ID NO: 1435958 - RNA, 19 nt, Homo sapiens
cagagcugaacaauacuuu

SEQ ID NO: 1435959 - RNA, 19 nt, Homo sapiens
aacuaggugugggaaauuu

SEQ ID NO: 1435960 - RNA, 19 nt, Homo sapiens
caacagagcaaggacuacu

SEQ ID NO: 1435961 - RNA, 19 nt, Homo sapiens
gagugccuguugccagugu

SEQ ID NO: 1435962 - RNA, 19 nt, Homo sapiens
gcugggaagagcaaaguca

SEQ ID NO: 1435963 - RNA, 19 nt, Homo sapiens
aaucauguaguguagauca

SEQ ID NO: 1435964 - RNA, 19 nt, Homo sapiens
gaagacgacauugacaacu

SEQ ID NO: 1435965 - RNA, 19 nt, Homo sapiens
agacuguauucucaaugga

SEQ ID NO: 1435966 - RNA, 19 nt, Homo sapiens
acagagcaaggacuacuau

SEQ ID NO: 1435967 - RNA, 19 nt, Homo sapiens
gaucauuaaacaucagcau

SEQ ID NO: 1435968 - RNA, 19 nt, Homo sapiens
gccuaaucauguaguguag

SEQ ID NO: 1435969 - RNA, 19 nt, Homo sapiens
agaccugcuuggagggauu

SEQ ID NO: 1435970 - RNA, 19 nt, Homo sapiens
gauuaagggcugggucugu

SEQ ID NO: 1435971 - RNA, 19 nt, Homo sapiens
ucucuuaggcucccagauc

SEQ ID NO: 1435972 - RNA, 19 nt, Homo sapiens
gagaacuaggugugggaaa

SEQ ID NO: 1435973 - RNA, 19 nt, Homo sapiens
acaacugccauuuccaaga

SEQ ID NO: 1435974 - RNA, 19 nt, Homo sapiens
ggugugggaaauuugaaga

SEQ ID NO: 1435975 - RNA, 19 nt, Homo sapiens
cuaggugugggaaauuuga

SEQ ID NO: 1435976 - RNA, 19 nt, Homo sapiens
caagacuguauucucaaug

SEQ ID NO: 1435977 - RNA, 19 nt, Homo sapiens
gcugcugcugcuucucuua

SEQ ID NO: 1435978 - RNA, 19 nt, Homo sapiens
gaaauaagaucacacacau

SEQ ID NO: 1435979 - RNA, 19 nt, Homo sapiens
caaagaauguaucaacuuc

SEQ ID NO: 1435980 - RNA, 19 nt, Homo sapiens
ucacacacaucaucucuau

SEQ ID NO: 1435981 - RNA, 19 nt, Homo sapiens
gaucagcugggccgaaaua

SEQ ID NO: 1435982 - RNA, 19 nt, Homo sapiens
ggcagcagcuugaagaguu

SEQ ID NO: 1435983 - RNA, 19 nt, Homo sapiens
gcaauggcaugaccaaggu

SEQ ID NO: 1435984 - RNA, 19 nt, Homo sapiens
gcagcagcuugaagaguuu

SEQ ID NO: 1435985 - RNA, 19 nt, Homo sapiens
gagggagaguggaggguuu

SEQ ID NO: 1435986 - RNA, 19 nt, Homo sapiens
cagcguaugugaugacugu

SEQ ID NO: 1435987 - RNA, 19 nt, Homo sapiens
uuaaagagacacagaagaa

SEQ ID NO: 1435988 - RNA, 19 nt, Homo sapiens
aaacuucauugaugccaaa

SEQ ID NO: 1435989 - RNA, 19 nt, Homo sapiens
cagcugggccgaaauaaga

SEQ ID NO: 1435990 - RNA, 19 nt, Homo sapiens
ugacgggccuggaggguau

SEQ ID NO: 1435991 - RNA, 19 nt, Homo sapiens
cgaaauaagaucacacaca

SEQ ID NO: 1435992 - RNA, 19 nt, Homo sapiens
aauaagaucacacacauca

SEQ ID NO: 1435993 - RNA, 19 nt, Homo sapiens
uaagaucacacacaucauc

SEQ ID NO: 1435994 - RNA, 19 nt, Homo sapiens
gcacuucaaagaauguauc

SEQ ID NO: 1435995 - RNA, 19 nt, Homo sapiens
guauuaaagagacacagaa

SEQ ID NO: 1435996 - RNA, 19 nt, Homo sapiens
gguauuaaagagacacaga

SEQ ID NO: 1435997 - RNA, 19 nt, Homo sapiens
cucggaaacuucauugaug

SEQ ID NO: 1435998 - RNA, 19 nt, Homo sapiens
uggaucagcugggccgaaa

SEQ ID NO: 1435999 - RNA, 19 nt, Homo sapiens
gaucacacacaucaucucu

SEQ ID NO: 1436000 - RNA, 19 nt, Homo sapiens
gguacuuccuggacucuac

SEQ ID NO: 1436001 - RNA, 19 nt, Homo sapiens
gacucuaccucggaaacuu

SEQ ID NO: 1436002 - RNA, 19 nt, Homo sapiens
gggccuggaggguauuaaa

SEQ ID NO: 1436003 - RNA, 19 nt, Homo sapiens
ggaggguauuaaagagaca

SEQ ID NO: 1436004 - RNA, 19 nt, Homo sapiens
ccacugcugccgccuuaau

SEQ ID NO: 1436005 - RNA, 19 nt, Homo sapiens
gcuuuaggcagcagcuuga

SEQ ID NO: 1436006 - RNA, 19 nt, Homo sapiens
gccuggaggguauuaaaga

SEQ ID NO: 1436007 - RNA, 19 nt, Homo sapiens
ugugacagcguaugugaug

SEQ ID NO: 1436008 - RNA, 19 nt, Homo sapiens
ucucgcagcaccacgauug

SEQ ID NO: 1436009 - RNA, 19 nt, Homo sapiens
uuaggcagcagcuugaaga

SEQ ID NO: 1436010 - RNA, 19 nt, Homo sapiens
gcguaugugaugacuguga

SEQ ID NO: 1436011 - RNA, 19 nt, Homo sapiens
gcaucccggucgcugauac

SEQ ID NO: 1436012 - RNA, 19 nt, Homo sapiens
uaaagagacacagaagaag

SEQ ID NO: 1436013 - RNA, 19 nt, Homo sapiens
auccacugcugccgccuua

SEQ ID NO: 1436014 - RNA, 19 nt, Homo sapiens
ccucggaaacuucauugau

SEQ ID NO: 1436015 - RNA, 19 nt, Homo sapiens
aaaagcacuucaaagaaug

SEQ ID NO: 1436016 - RNA, 19 nt, Homo sapiens
gggccgaaauaagaucaca

SEQ ID NO: 1436017 - RNA, 19 nt, Homo sapiens
gccgaaauaagaucacaca

SEQ ID NO: 1436018 - RNA, 19 nt, Homo sapiens
ggaauuaacuggcuucauc

SEQ ID NO: 1436019 - RNA, 19 nt, Homo sapiens
ucaagggcaucaccaauuu

SEQ ID NO: 1436020 - RNA, 19 nt, Homo sapiens
ugaaguggcuguagcuuau

SEQ ID NO: 1436021 - RNA, 19 nt, Homo sapiens
cgacccagaucaagauaaa

SEQ ID NO: 1436022 - RNA, 19 nt, Homo sapiens
cagaaguccuuucauguga

SEQ ID NO: 1436023 - RNA, 19 nt, Homo sapiens
ucaaauauguucugauguc

SEQ ID NO: 1436024 - RNA, 19 nt, Homo sapiens
cgucaaauauguucugaug

SEQ ID NO: 1436025 - RNA, 19 nt, Homo sapiens
ccaagauggucaacaaguu

SEQ ID NO: 1436026 - RNA, 19 nt, Homo sapiens
gacccuggcucgcuucauu

SEQ ID NO: 1436027 - RNA, 19 nt, Homo sapiens
gcagauggccacuucuuug

SEQ ID NO: 1436028 - RNA, 19 nt, Homo sapiens
uaaagaagccucccaaggu

SEQ ID NO: 1436029 - RNA, 19 nt, Homo sapiens
ggacagcacccugcacaaa

SEQ ID NO: 1436030 - RNA, 19 nt, Homo sapiens
agacuaaccugccuagcaa

SEQ ID NO: 1436031 - RNA, 19 nt, Homo sapiens
ccacuucuuuggacagauu

SEQ ID NO: 1436032 - RNA, 19 nt, Homo sapiens
gcagaaguccuuucaugug

SEQ ID NO: 1436033 - RNA, 19 nt, Homo sapiens
ucaaugaugugcuucaagu

SEQ ID NO: 1436034 - RNA, 19 nt, Homo sapiens
uagcuuaucccaagucaaa

SEQ ID NO: 1436035 - RNA, 19 nt, Homo sapiens
gaugggcaccgucaaauau

SEQ ID NO: 1436036 - RNA, 19 nt, Homo sapiens
caccagcuaucucgaagaa

SEQ ID NO: 1436037 - RNA, 19 nt, Homo sapiens
cggaaguccucaucgauug

SEQ ID NO: 1436038 - RNA, 19 nt, Homo sapiens
uaaccugccuagcaacaug

SEQ ID NO: 1436039 - RNA, 19 nt, Homo sapiens
uggcugagcuggacauagu

SEQ ID NO: 1436040 - RNA, 19 nt, Homo sapiens
gaaacagccagggaugaaa

SEQ ID NO: 1436041 - RNA, 19 nt, Homo sapiens
cugcagaaguccuuucaug

SEQ ID NO: 1436042 - RNA, 19 nt, Homo sapiens
gagggaacauggagaucau

SEQ ID NO: 1436043 - RNA, 19 nt, Homo sapiens
gcuccaaugucccucuuuc

SEQ ID NO: 1436044 - RNA, 19 nt, Homo sapiens
ggagugggcaucuuccaau

SEQ ID NO: 1436045 - RNA, 19 nt, Homo sapiens
ggccaugaauuacaaucug

SEQ ID NO: 1436046 - RNA, 19 nt, Homo sapiens
gaauuaacuggcuucauca

SEQ ID NO: 1436047 - RNA, 19 nt, Homo sapiens
ccucaucgauuggcaacuu

SEQ ID NO: 1436048 - RNA, 19 nt, Homo sapiens
cugcagagcuugcccuucu

SEQ ID NO: 1436049 - RNA, 19 nt, Homo sapiens
gaaguggaccaaccucagu

SEQ ID NO: 1436050 - RNA, 19 nt, Homo sapiens
gagugggcaucuuccaaug

SEQ ID NO: 1436051 - RNA, 19 nt, Homo sapiens
agagucauauccuggagaa

SEQ ID NO: 1436052 - RNA, 19 nt, Homo sapiens
caaggucacuaugaagaca

SEQ ID NO: 1436053 - RNA, 19 nt, Homo sapiens
caagauggucaacaaguuc

SEQ ID NO: 1436054 - RNA, 19 nt, Homo sapiens
ggagggaacauggagauca

SEQ ID NO: 1436055 - RNA, 19 nt, Homo sapiens
ccagaugggcaccgucaaa

SEQ ID NO: 1436056 - RNA, 19 nt, Homo sapiens
cuacaucccaguugucaau

SEQ ID NO: 1436057 - RNA, 19 nt, Homo sapiens
gugggcaucuuccaaugug

SEQ ID NO: 1436058 - RNA, 19 nt, Homo sapiens
ucaucacacugaacuuugu

SEQ ID NO: 1436059 - RNA, 19 nt, Homo sapiens
ccacagcacccuggagaug

SEQ ID NO: 1436060 - RNA, 19 nt, Homo sapiens
uggucaaugugaagacuaa

SEQ ID NO: 1436061 - RNA, 19 nt, Homo sapiens
gggcaucaccaauuugaag

SEQ ID NO: 1436062 - RNA, 19 nt, Homo sapiens
acagcacccuggagauguu

SEQ ID NO: 1436063 - RNA, 19 nt, Homo sapiens
ucgaugcaguccuggugua

SEQ ID NO: 1436064 - RNA, 19 nt, Homo sapiens
gcaacaugcuccccaagau

SEQ ID NO: 1436065 - RNA, 19 nt, Homo sapiens
gagcuggacauaguagaga

SEQ ID NO: 1436066 - RNA, 19 nt, Homo sapiens
cugaaguggcuguagcuua

SEQ ID NO: 1436067 - RNA, 19 nt, Homo sapiens
gcaguccugguguauguga

SEQ ID NO: 1436068 - RNA, 19 nt, Homo sapiens
cgucaucacacugaacuuu

SEQ ID NO: 1436069 - RNA, 19 nt, Homo sapiens
gucauauccuggagaagau

SEQ ID NO: 1436070 - RNA, 19 nt, Homo sapiens
ucaaugagagggaauuaac

SEQ ID NO: 1436071 - RNA, 19 nt, Homo sapiens
agaugggcaccgucaaaua

SEQ ID NO: 1436072 - RNA, 19 nt, Homo sapiens
acagcacccugcacaaagu

SEQ ID NO: 1436073 - RNA, 19 nt, Homo sapiens
ccaauuugaaggugaagga

SEQ ID NO: 1436074 - RNA, 19 nt, Homo sapiens
agccagggaugaaaccuau

SEQ ID NO: 1436075 - RNA, 19 nt, Homo sapiens
caucccaguugucaaugau

SEQ ID NO: 1436076 - RNA, 19 nt, Homo sapiens
ugacgacccagaucaagau

SEQ ID NO: 1436077 - RNA, 19 nt, Homo sapiens
agaaacagccagggaugaa

SEQ ID NO: 1436078 - RNA, 19 nt, Homo sapiens
gaggucauccuggucaaug

SEQ ID NO: 1436079 - RNA, 19 nt, Homo sapiens
ccggaaguccucaucgauu

SEQ ID NO: 1436080 - RNA, 19 nt, Homo sapiens
ugguguaugugaacaggaa

SEQ ID NO: 1436081 - RNA, 19 nt, Homo sapiens
gacagcacccugcacaaag

SEQ ID NO: 1436082 - RNA, 19 nt, Homo sapiens
gaagccuacaucccaguug

SEQ ID NO: 1436083 - RNA, 19 nt, Homo sapiens
caucaccagcuaucucgaa

SEQ ID NO: 1436084 - RNA, 19 nt, Homo sapiens
cucccaaggucacuaugaa

SEQ ID NO: 1436085 - RNA, 19 nt, Homo sapiens
caaaagggcaaaaccauca

SEQ ID NO: 1436086 - RNA, 19 nt, Homo sapiens
aguagagaaugcccugaug

SEQ ID NO: 1436087 - RNA, 19 nt, Homo sapiens
ccagggaugaaaccuauca

SEQ ID NO: 1436088 - RNA, 19 nt, Homo sapiens
agucauauccuggagaaga

SEQ ID NO: 1436089 - RNA, 19 nt, Homo sapiens
cggacuuucuggccaugaa

SEQ ID NO: 1436090 - RNA, 19 nt, Homo sapiens
ggccacuucuuuggacaga

SEQ ID NO: 1436091 - RNA, 19 nt, Homo sapiens
caagggcaucaccaauuug

SEQ ID NO: 1436092 - RNA, 19 nt, Homo sapiens
augcaguccugguguaugu

SEQ ID NO: 1436093 - RNA, 19 nt, Homo sapiens
caucacacugaacuuugua

SEQ ID NO: 1436094 - RNA, 19 nt, Homo sapiens
aagccuacaucccaguugu

SEQ ID NO: 1436095 - RNA, 19 nt, Homo sapiens
acaucccaguugucaauga

SEQ ID NO: 1436096 - RNA, 19 nt, Homo sapiens
ucaaucugaagguccagua

SEQ ID NO: 1436097 - RNA, 19 nt, Homo sapiens
caccacagccagcuacauc

SEQ ID NO: 1436098 - RNA, 19 nt, Homo sapiens
ugucaaugaugugcuucaa

SEQ ID NO: 1436099 - RNA, 19 nt, Homo sapiens
gacgacccagaucaagaua

SEQ ID NO: 1436100 - RNA, 19 nt, Homo sapiens
gggcaccgucaaauauguu

SEQ ID NO: 1436101 - RNA, 19 nt, Homo sapiens
ggaaguccucaucgauugg

SEQ ID NO: 1436102 - RNA, 19 nt, Homo sapiens
uaucaagggcaucaccaau

SEQ ID NO: 1436103 - RNA, 19 nt, Homo sapiens
cccaaggucacuaugaaga

SEQ ID NO: 1436104 - RNA, 19 nt, Homo sapiens
caucguggcccugaacauc

SEQ ID NO: 1436105 - RNA, 19 nt, Homo sapiens
gacaaggccugguggaaau

SEQ ID NO: 1436106 - RNA, 19 nt, Homo sapiens
ggacaaggccugguggaaa

SEQ ID NO: 1436107 - RNA, 19 nt, Homo sapiens
gcccugccaugggaaacua

SEQ ID NO: 1436108 - RNA, 19 nt, Homo sapiens
ggaccaaagcacccaagca

SEQ ID NO: 1436109 - RNA, 19 nt, Homo sapiens
ccaccucacucggaagaag

SEQ ID NO: 1436110 - RNA, 19 nt, Homo sapiens
cuaccaggaucgugcugau

SEQ ID NO: 1436111 - RNA, 19 nt, Homo sapiens
ccaggaucgugcugauucu

SEQ ID NO: 1436112 - RNA, 19 nt, Homo sapiens
gaaaugaccugaaauguag

SEQ ID NO: 1436113 - RNA, 19 nt, Homo sapiens
gaagagauguuaagcaaga

SEQ ID NO: 1436114 - RNA, 19 nt, Homo sapiens
cgauaaaguugaugaguua

SEQ ID NO: 1436115 - RNA, 19 nt, Homo sapiens
ggaagugccugcuguuuau

SEQ ID NO: 1436116 - RNA, 19 nt, Homo sapiens
gcccuuagcuguaauaaug

SEQ ID NO: 1436117 - RNA, 19 nt, Homo sapiens
gcagaucgacggcacauua

SEQ ID NO: 1436118 - RNA, 19 nt, Homo sapiens
caagugagauuguuagaau

SEQ ID NO: 1436119 - RNA, 19 nt, Homo sapiens
ggaauuagaagaacuagaa

SEQ ID NO: 1436120 - RNA, 19 nt, Homo sapiens
ggacaucgauaaaguugau

SEQ ID NO: 1436121 - RNA, 19 nt, Homo sapiens
ggaaacgugcauacauuua

SEQ ID NO: 1436122 - RNA, 19 nt, Homo sapiens
ugaaaugaccugaaaugua

SEQ ID NO: 1436123 - RNA, 19 nt, Homo sapiens
gacaagaauuugcuggaaa

SEQ ID NO: 1436124 - RNA, 19 nt, Homo sapiens
gguuugcacugucuauuaa

SEQ ID NO: 1436125 - RNA, 19 nt, Homo sapiens
cagaugaaauuaugguuug

SEQ ID NO: 1436126 - RNA, 19 nt, Homo sapiens
gggaagugccugcuguuua

SEQ ID NO: 1436127 - RNA, 19 nt, Homo sapiens
caacauggacaucgauaaa

SEQ ID NO: 1436128 - RNA, 19 nt, Homo sapiens
gcacugaagcguaagaaga

SEQ ID NO: 1436129 - RNA, 19 nt, Homo sapiens
acauugagcuucuggacua

SEQ ID NO: 1436130 - RNA, 19 nt, Homo sapiens
cggaagagauguuaagcaa

SEQ ID NO: 1436131 - RNA, 19 nt, Homo sapiens
gcucauggcggaauuagaa

SEQ ID NO: 1436132 - RNA, 19 nt, Homo sapiens
ggacacggaagagauguua

SEQ ID NO: 1436133 - RNA, 19 nt, Homo sapiens
gaaacgugcauacauuuau

SEQ ID NO: 1436134 - RNA, 19 nt, Homo sapiens
gaggagauuucaacagcaa

SEQ ID NO: 1436135 - RNA, 19 nt, Homo sapiens
guaagaagagguaugagaa

SEQ ID NO: 1436136 - RNA, 19 nt, Homo sapiens
gcugaauccucaauggaaa

SEQ ID NO: 1436137 - RNA, 19 nt, Homo sapiens
uaccaaauguucccucuau

SEQ ID NO: 1436138 - RNA, 19 nt, Homo sapiens
gaaacagucccucuaccaa

SEQ ID NO: 1436139 - RNA, 19 nt, Homo sapiens
gcugcucacucucugcaua

SEQ ID NO: 1436140 - RNA, 19 nt, Homo sapiens
gaaaucaguggacccgaaa

SEQ ID NO: 1436141 - RNA, 19 nt, Homo sapiens
caguugaaaugaccugaaa

SEQ ID NO: 1436142 - RNA, 19 nt, Homo sapiens
acugauagauaacucauug

SEQ ID NO: 1436143 - RNA, 19 nt, Homo sapiens
ucgauaaaguugaugaguu

SEQ ID NO: 1436144 - RNA, 19 nt, Homo sapiens
gagagcaagugagauuguu

SEQ ID NO: 1436145 - RNA, 19 nt, Homo sapiens
ggaacuagacaagaauuug

SEQ ID NO: 1436146 - RNA, 19 nt, Homo sapiens
caacagcaauuucgaaacc

SEQ ID NO: 1436147 - RNA, 19 nt, Homo sapiens
ugaaauggaugguguucuc

SEQ ID NO: 1436148 - RNA, 19 nt, Homo sapiens
agaagcagcuggcgcagau

SEQ ID NO: 1436149 - RNA, 19 nt, Homo sapiens
ugaaggaauuggagaacug

SEQ ID NO: 1436150 - RNA, 19 nt, Homo sapiens
cuauagcccuaccaucaaa

SEQ ID NO: 1436151 - RNA, 19 nt, Homo sapiens
aggaggaacuagacaagaa

SEQ ID NO: 1436152 - RNA, 19 nt, Homo sapiens
gaucgacggcacauuauca

SEQ ID NO: 1436153 - RNA, 19 nt, Homo sapiens
guccaucaccuguguauug

SEQ ID NO: 1436154 - RNA, 19 nt, Homo sapiens
uggaaagggucgacugguu

SEQ ID NO: 1436155 - RNA, 19 nt, Homo sapiens
agacaagaauuugcuggaa

SEQ ID NO: 1436156 - RNA, 19 nt, Homo sapiens
ggagauuucaacagcaauu

SEQ ID NO: 1436157 - RNA, 19 nt, Homo sapiens
gaacuugcagaggagauuu

SEQ ID NO: 1436158 - RNA, 19 nt, Homo sapiens
cagcaaccaugucgguguu

SEQ ID NO: 1436159 - RNA, 19 nt, Homo sapiens
aaacagucccucuaccaaa

SEQ ID NO: 1436160 - RNA, 19 nt, Homo sapiens
caagaagcacggcaccaaa

SEQ ID NO: 1436161 - RNA, 19 nt, Homo sapiens
uuggaaacgugcauacauu

SEQ ID NO: 1436162 - RNA, 19 nt, Homo sapiens
gcaagugagauuguuagaa

SEQ ID NO: 1436163 - RNA, 19 nt, Homo sapiens
uguagccucuguccuugua

SEQ ID NO: 1436164 - RNA, 19 nt, Homo sapiens
ccaaauguucccucuauag

SEQ ID NO: 1436165 - RNA, 19 nt, Homo sapiens
gaacaggaggaacuagaca

SEQ ID NO: 1436166 - RNA, 19 nt, Homo sapiens
gauaacugauagauaacuc

SEQ ID NO: 1436167 - RNA, 19 nt, Homo sapiens
gcuguaauaaugcaucuga

SEQ ID NO: 1436168 - RNA, 19 nt, Homo sapiens
gaacuagacaagaauuugc

SEQ ID NO: 1436169 - RNA, 19 nt, Homo sapiens
gauagauaacucauuggaa

SEQ ID NO: 1436170 - RNA, 19 nt, Homo sapiens
aaauguagccucuguccuu

SEQ ID NO: 1436171 - RNA, 19 nt, Homo sapiens
gaagugccugcuguuuaua

SEQ ID NO: 1436172 - RNA, 19 nt, Homo sapiens
uguauuggcccuguguuua

SEQ ID NO: 1436173 - RNA, 19 nt, Homo sapiens
gaguuugugacauugauuu

SEQ ID NO: 1436174 - RNA, 19 nt, Homo sapiens
ggaggacgacgacaugaag

SEQ ID NO: 1436175 - RNA, 19 nt, Homo sapiens
uccaggcacugaagcguaa

SEQ ID NO: 1436176 - RNA, 19 nt, Homo sapiens
acauggacaucgauaaagu

SEQ ID NO: 1436177 - RNA, 19 nt, Homo sapiens
ccucuguccuuguaaguca

SEQ ID NO: 1436178 - RNA, 19 nt, Homo sapiens
guugaaaugaccugaaaug

SEQ ID NO: 1436179 - RNA, 19 nt, Homo sapiens
gaggaacuagacaagaauu

SEQ ID NO: 1436180 - RNA, 19 nt, Homo sapiens
gacaacauggacaucgaua

SEQ ID NO: 1436181 - RNA, 19 nt, Homo sapiens
ccugaaauguagccucugu

SEQ ID NO: 1436182 - RNA, 19 nt, Homo sapiens
uuucgacucucacuccaaa

SEQ ID NO: 1436183 - RNA, 19 nt, Homo sapiens
ggacgacgacaugaaggaa

SEQ ID NO: 1436184 - RNA, 19 nt, Homo sapiens
ggaggaacuagacaagaau

SEQ ID NO: 1436185 - RNA, 19 nt, Homo sapiens
gagauuucaacagcaauuu

SEQ ID NO: 1436186 - RNA, 19 nt, Homo sapiens
ucaagaacaugggcuaugc

SEQ ID NO: 1436187 - RNA, 19 nt, Homo sapiens
gagcaagugagauuguuag

SEQ ID NO: 1436188 - RNA, 19 nt, Homo sapiens
gagaaugccaacaccaaca

SEQ ID NO: 1436189 - RNA, 19 nt, Homo sapiens
acgacgacaugaaggaauu

SEQ ID NO: 1436190 - RNA, 19 nt, Homo sapiens
caucaaaacccgccaagaa

SEQ ID NO: 1436191 - RNA, 19 nt, Homo sapiens
aacagucccucuaccaaau

SEQ ID NO: 1436192 - RNA, 19 nt, Homo sapiens
ccaagaagcacggcaccaa

SEQ ID NO: 1436193 - RNA, 19 nt, Homo sapiens
aauggaugguguucucuug

SEQ ID NO: 1436194 - RNA, 19 nt, Homo sapiens
gagcuguguuucuguccau

SEQ ID NO: 1436195 - RNA, 19 nt, Homo sapiens
gcaguugaaaugaccugaa

SEQ ID NO: 1436196 - RNA, 19 nt, Homo sapiens
ccgaggugcucaagaacau

SEQ ID NO: 1436197 - RNA, 19 nt, Homo sapiens
cguaagaagagguaugaga

SEQ ID NO: 1436198 - RNA, 19 nt, Homo sapiens
uggaaacgugcauacauuu

SEQ ID NO: 1436199 - RNA, 19 nt, Homo sapiens
ugguuugcacugucuauua

SEQ ID NO: 1436200 - RNA, 19 nt, Homo sapiens
ugccugcuguuuauaaugu

SEQ ID NO: 1436201 - RNA, 19 nt, Homo sapiens
agagcaagugagauuguua

SEQ ID NO: 1436202 - RNA, 19 nt, Homo sapiens
gacggcacauuaucaacca

SEQ ID NO: 1436203 - RNA, 19 nt, Homo sapiens
uaucaaccaucgaguucca

SEQ ID NO: 1436204 - RNA, 19 nt, Homo sapiens
ugacuccacugcugaaucc

SEQ ID NO: 1436205 - RNA, 19 nt, Homo sapiens
gggcuggauccauguaaug

SEQ ID NO: 1436206 - RNA, 19 nt, Homo sapiens
gguccuuguugcuguuugu

SEQ ID NO: 1436207 - RNA, 19 nt, Homo sapiens
accaaauguucccucuaua

SEQ ID NO: 1436208 - RNA, 19 nt, Homo sapiens
cgaaacagucccucuacca

SEQ ID NO: 1436209 - RNA, 19 nt, Homo sapiens
agaagaguuugacgaggau

SEQ ID NO: 1436210 - RNA, 19 nt, Homo sapiens
ggaguuugugacauugauu

SEQ ID NO: 1436211 - RNA, 19 nt, Homo sapiens
uuccaucgcuuucgacucu

SEQ ID NO: 1436212 - RNA, 19 nt, Homo sapiens
gagcagggcuuguuagauu

SEQ ID NO: 1436213 - RNA, 19 nt, Homo sapiens
gauuguggcuacuuaauaa

SEQ ID NO: 1436214 - RNA, 19 nt, Homo sapiens
gcucaucucugauuacuuc

SEQ ID NO: 1436215 - RNA, 19 nt, Homo sapiens
gaaaguggcccuguucuau

SEQ ID NO: 1436216 - RNA, 19 nt, Homo sapiens
gaagugccaacucuaauuu

SEQ ID NO: 1436217 - RNA, 19 nt, Homo sapiens
ccucauugcuuucuucauu

SEQ ID NO: 1436218 - RNA, 19 nt, Homo sapiens
gcacuucagccucuucuuu

SEQ ID NO: 1436219 - RNA, 19 nt, Homo sapiens
gucuauggcuuuauacuuu

SEQ ID NO: 1436220 - RNA, 19 nt, Homo sapiens
cgacauaccagucucugua

SEQ ID NO: 1436221 - RNA, 19 nt, Homo sapiens
guuagauuguggcuacuua

SEQ ID NO: 1436222 - RNA, 19 nt, Homo sapiens
gcagaaacuccuccuagaa

SEQ ID NO: 1436223 - RNA, 19 nt, Homo sapiens
ggaagugccaacucuaauu

SEQ ID NO: 1436224 - RNA, 19 nt, Homo sapiens
acaagucucugguaccaaa

SEQ ID NO: 1436225 - RNA, 19 nt, Homo sapiens
guacauaccugugaaaaug

SEQ ID NO: 1436226 - RNA, 19 nt, Homo sapiens
ggacguggcgcucuacaug

SEQ ID NO: 1436227 - RNA, 19 nt, Homo sapiens
guacuucuuugcagagaug

SEQ ID NO: 1436228 - RNA, 19 nt, Homo sapiens
gggaguaugccaugaugua

SEQ ID NO: 1436229 - RNA, 19 nt, Homo sapiens
acaacacccucauugcuuu

SEQ ID NO: 1436230 - RNA, 19 nt, Homo sapiens
acacauggccucuacuuga

SEQ ID NO: 1436231 - RNA, 19 nt, Homo sapiens
ucacugcuauugcccugua

SEQ ID NO: 1436232 - RNA, 19 nt, Homo sapiens
ugccaacucuaauuucuuu

SEQ ID NO: 1436233 - RNA, 19 nt, Homo sapiens
gcaaagccuucuggaucuu

SEQ ID NO: 1436234 - RNA, 19 nt, Homo sapiens
guauguguguuucagauca

SEQ ID NO: 1436235 - RNA, 19 nt, Homo sapiens
cgcagucuauggcuuuaua

SEQ ID NO: 1436236 - RNA, 19 nt, Homo sapiens
cuucucagcucuugggauu

SEQ ID NO: 1436237 - RNA, 19 nt, Homo sapiens
ccucuuucauuuccuaauu

SEQ ID NO: 1436238 - RNA, 19 nt, Homo sapiens
gcugucaucgccaucuuua

SEQ ID NO: 1436239 - RNA, 19 nt, Homo sapiens
caucucugauuacuucuau

SEQ ID NO: 1436240 - RNA, 19 nt, Homo sapiens
gcaauccaggacuucaaua

SEQ ID NO: 1436241 - RNA, 19 nt, Homo sapiens
uguggcaccucuggauuua

SEQ ID NO: 1436242 - RNA, 19 nt, Homo sapiens
guggaaccaucucuacaga

SEQ ID NO: 1436243 - RNA, 19 nt, Homo sapiens
gaucaacgucuucuucuac

SEQ ID NO: 1436244 - RNA, 19 nt, Homo sapiens
gaucucacuccaaacauug

SEQ ID NO: 1436245 - RNA, 19 nt, Homo sapiens
uuccagaucucacuccaaa

SEQ ID NO: 1436246 - RNA, 19 nt, Homo sapiens
caauccaggacuucaauaa

SEQ ID NO: 1436247 - RNA, 19 nt, Homo sapiens
gcccuguucuaucucuuaa

SEQ ID NO: 1436248 - RNA, 19 nt, Homo sapiens
caggaagugccaacucuaa

SEQ ID NO: 1436249 - RNA, 19 nt, Homo sapiens
ccuguucuaucucuuaaau

SEQ ID NO: 1436250 - RNA, 19 nt, Homo sapiens
gcaggaagugccaacucua

SEQ ID NO: 1436251 - RNA, 19 nt, Homo sapiens
cccaucuucuucauguuua

SEQ ID NO: 1436252 - RNA, 19 nt, Homo sapiens
gauaacugaugcacucacu

SEQ ID NO: 1436253 - RNA, 19 nt, Homo sapiens
ucacaagucucugguacca

SEQ ID NO: 1436254 - RNA, 19 nt, Homo sapiens
uggcaccucuggauuuaug

SEQ ID NO: 1436255 - RNA, 19 nt, Homo sapiens
guccucaccugcaucauca

SEQ ID NO: 1436256 - RNA, 19 nt, Homo sapiens
agaucucacuccaaacauu

SEQ ID NO: 1436257 - RNA, 19 nt, Homo sapiens
caacaacacccucauugcu

SEQ ID NO: 1436258 - RNA, 19 nt, Homo sapiens
ugaaaguggcccuguucua

SEQ ID NO: 1436259 - RNA, 19 nt, Homo sapiens
ccagaucucacuccaaaca

SEQ ID NO: 1436260 - RNA, 19 nt, Homo sapiens
ucauuugccucuccuucuu

SEQ ID NO: 1436261 - RNA, 19 nt, Homo sapiens
ggcaguacauaccugugaa

SEQ ID NO: 1436262 - RNA, 19 nt, Homo sapiens
cuaauugacuaugcugaau

SEQ ID NO: 1436263 - RNA, 19 nt, Homo sapiens
gugggaagccuagugguaa

SEQ ID NO: 1436264 - RNA, 19 nt, Homo sapiens
gcaguacauaccugugaaa

SEQ ID NO: 1436265 - RNA, 19 nt, Homo sapiens
agauuguggcuacuuaaua

SEQ ID NO: 1436266 - RNA, 19 nt, Homo sapiens
ucucagcucuugggauuuc

SEQ ID NO: 1436267 - RNA, 19 nt, Homo sapiens
cugaugcacucacugcuau

SEQ ID NO: 1436268 - RNA, 19 nt, Homo sapiens
agaucaacgucuucuucua

SEQ ID NO: 1436269 - RNA, 19 nt, Homo sapiens
gcugaauugguguuuauga

SEQ ID NO: 1436270 - RNA, 19 nt, Homo sapiens
aguaugccaugauguaugu

SEQ ID NO: 1436271 - RNA, 19 nt, Homo sapiens
ggaguaugccaugauguau

SEQ ID NO: 1436272 - RNA, 19 nt, Homo sapiens
caucaacaacacccucauu

SEQ ID NO: 1436273 - RNA, 19 nt, Homo sapiens
gaaacuccuccuagaacug

SEQ ID NO: 1436274 - RNA, 19 nt, Homo sapiens
ucagaucaacgucuucuuc

SEQ ID NO: 1436275 - RNA, 19 nt, Homo sapiens
uaugcugaauugguguuua

SEQ ID NO: 1436276 - RNA, 19 nt, Homo sapiens
ccaucacacugaccuucaa

SEQ ID NO: 1436277 - RNA, 19 nt, Homo sapiens
gcaucaucaucgucuguuc

SEQ ID NO: 1436278 - RNA, 19 nt, Homo sapiens
ccaugcucgugcucaagua

SEQ ID NO: 1436279 - RNA, 19 nt, Homo sapiens
ccucacacauggccucuac

SEQ ID NO: 1436280 - RNA, 19 nt, Homo sapiens
cagagauguuugagcacuu

SEQ ID NO: 1436281 - RNA, 19 nt, Homo sapiens
gaguaugccaugauguaug

SEQ ID NO: 1436282 - RNA, 19 nt, Homo sapiens
cugaauugguguuuaugau

SEQ ID NO: 1436283 - RNA, 19 nt, Homo sapiens
cucauugcuuucuucauuu

SEQ ID NO: 1436284 - RNA, 19 nt, Homo sapiens
agcagaaacuccuccuaga

SEQ ID NO: 1436285 - RNA, 19 nt, Homo sapiens
ggcgagugcuugggcagaa

SEQ ID NO: 1436286 - RNA, 19 nt, Homo sapiens
ucacacauggccucuacuu

SEQ ID NO: 1436287 - RNA, 19 nt, Homo sapiens
gccuagugguaaucauuug

SEQ ID NO: 1436288 - RNA, 19 nt, Homo sapiens
gccuuucacuguuggacuu

SEQ ID NO: 1436289 - RNA, 19 nt, Homo sapiens
ggcccuguucuaucucuua

SEQ ID NO: 1436290 - RNA, 19 nt, Homo sapiens
cagaaacuccuccuagaac

SEQ ID NO: 1436291 - RNA, 19 nt, Homo sapiens
cuggagcaguauuucauga

SEQ ID NO: 1436292 - RNA, 19 nt, Homo sapiens
aggcagugcuuuccucagu

SEQ ID NO: 1436293 - RNA, 19 nt, Homo sapiens
aauccaggacuucaauaaa

SEQ ID NO: 1436294 - RNA, 19 nt, Homo sapiens
guggcuacuuaauaaaugu

SEQ ID NO: 1436295 - RNA, 19 nt, Homo sapiens
uguggcuacuuaauaaaug

SEQ ID NO: 1436296 - RNA, 19 nt, Homo sapiens
ggaguacuaccucacacau

SEQ ID NO: 1436297 - RNA, 19 nt, Homo sapiens
guauucuggagcaguauuu

SEQ ID NO: 1436298 - RNA, 19 nt, Homo sapiens
auaccucuuucauuuccua

SEQ ID NO: 1436299 - RNA, 19 nt, Homo sapiens
augcugaauugguguuuau

SEQ ID NO: 1436300 - RNA, 19 nt, Homo sapiens
ugcguuacaucccuuugaa

SEQ ID NO: 1436301 - RNA, 19 nt, Homo sapiens
auccaggacuucaauaaag

SEQ ID NO: 1436302 - RNA, 19 nt, Homo sapiens
ucuacagauuccugagaaa

SEQ ID NO: 1436303 - RNA, 19 nt, Homo sapiens
ggaagccuagugguaauca

SEQ ID NO: 1436304 - RNA, 19 nt, Homo sapiens
gaucuuuucuugggaguau

SEQ ID NO: 1436305 - RNA, 19 nt, Homo sapiens
guacccacucaccuuguuu

SEQ ID NO: 1436306 - RNA, 19 nt, Homo sapiens
gaugcacucacugcuauug

SEQ ID NO: 1436307 - RNA, 19 nt, Homo sapiens
gcuauugcccuguauuuug

SEQ ID NO: 1436308 - RNA, 19 nt, Homo sapiens
ucuauggcuuuauacuuuc

SEQ ID NO: 1436309 - RNA, 19 nt, Homo sapiens
gaagccuagugguaaucau

SEQ ID NO: 1436310 - RNA, 19 nt, Homo sapiens
agaaacuccuccuagaacu

SEQ ID NO: 1436311 - RNA, 19 nt, Homo sapiens
gugcuuuccucagugcuau

SEQ ID NO: 1436312 - RNA, 19 nt, Homo sapiens
ggcauagacuguuauauau

SEQ ID NO: 1436313 - RNA, 19 nt, Homo sapiens
gcucacaccuguaaucuca

SEQ ID NO: 1436314 - RNA, 19 nt, Homo sapiens
caacucagaugaaacucaa

SEQ ID NO: 1436315 - RNA, 19 nt, Homo sapiens
acacagggcuauacaugaa

SEQ ID NO: 1436316 - RNA, 19 nt, Homo sapiens
uggcauagacuguuauaua

SEQ ID NO: 1436317 - RNA, 19 nt, Homo sapiens
guagcaggauuccauuuau

SEQ ID NO: 1436318 - RNA, 19 nt, Homo sapiens
uaucuggcauagacuguua

SEQ ID NO: 1436319 - RNA, 19 nt, Homo sapiens
gcugugcuguaguguauaa

SEQ ID NO: 1436320 - RNA, 19 nt, Homo sapiens
ggcuauacaugaaguuaaa

SEQ ID NO: 1436321 - RNA, 19 nt, Homo sapiens
ggauaaaaccccauauuaa

SEQ ID NO: 1436322 - RNA, 19 nt, Homo sapiens
aagaaucacuugaggauag

SEQ ID NO: 1436323 - RNA, 19 nt, Homo sapiens
guaccaaugucaauuucug

SEQ ID NO: 1436324 - RNA, 19 nt, Homo sapiens
ggaaauucuucagagcaaa

SEQ ID NO: 1436325 - RNA, 19 nt, Homo sapiens
agaugaaacucaaggaaau

SEQ ID NO: 1436326 - RNA, 19 nt, Homo sapiens
gaagaaucacuugaggaua

SEQ ID NO: 1436327 - RNA, 19 nt, Homo sapiens
ggaguccugugguguugaa

SEQ ID NO: 1436328 - RNA, 19 nt, Homo sapiens
gcaggauuccauuuaugua

SEQ ID NO: 1436329 - RNA, 19 nt, Homo sapiens
gaaacugaguauguucugu

SEQ ID NO: 1436330 - RNA, 19 nt, Homo sapiens
uagacaaccuccuaugcaa

SEQ ID NO: 1436331 - RNA, 19 nt, Homo sapiens
uauaagguguuaacauugg

SEQ ID NO: 1436332 - RNA, 19 nt, Homo sapiens
aaacugaguauguucugua

SEQ ID NO: 1436333 - RNA, 19 nt, Homo sapiens
acacaaaggaguacagaug

SEQ ID NO: 1436334 - RNA, 19 nt, Homo sapiens
cagaugaaacucaaggaaa

SEQ ID NO: 1436335 - RNA, 19 nt, Homo sapiens
uagcaggauuccauuuaug

SEQ ID NO: 1436336 - RNA, 19 nt, Homo sapiens
gaaacucaaggaaauucuu

SEQ ID NO: 1436337 - RNA, 19 nt, Homo sapiens
cacagcaacucagaugaaa

SEQ ID NO: 1436338 - RNA, 19 nt, Homo sapiens
caauauguauccguacugu

SEQ ID NO: 1436339 - RNA, 19 nt, Homo sapiens
guacacacagcaacucaga

SEQ ID NO: 1436340 - RNA, 19 nt, Homo sapiens
uaugcaaccuccugugaau

SEQ ID NO: 1436341 - RNA, 19 nt, Homo sapiens
ggauuccauuuauguaaca

SEQ ID NO: 1436342 - RNA, 19 nt, Homo sapiens
uguagcaggauuccauuua

SEQ ID NO: 1436343 - RNA, 19 nt, Homo sapiens
uguaguguauaagguguua

SEQ ID NO: 1436344 - RNA, 19 nt, Homo sapiens
caggauuccauuuauguaa

SEQ ID NO: 1436345 - RNA, 19 nt, Homo sapiens
gaugaaacucaaggaaauu

SEQ ID NO: 1436346 - RNA, 19 nt, Homo sapiens
uaugugauauagugccauu

SEQ ID NO: 1436347 - RNA, 19 nt, Homo sapiens
gcaaccuccugugaaucua

SEQ ID NO: 1436348 - RNA, 19 nt, Homo sapiens
ccuguaaucucagcuacuu

SEQ ID NO: 1436349 - RNA, 19 nt, Homo sapiens
guauaagguguuaacauug

SEQ ID NO: 1436350 - RNA, 19 nt, Homo sapiens
ucuguagacuguaccaaug

SEQ ID NO: 1436351 - RNA, 19 nt, Homo sapiens
agaguuagguacacaaagg

SEQ ID NO: 1436352 - RNA, 19 nt, Homo sapiens
gggcuauacaugaaguuaa

SEQ ID NO: 1436353 - RNA, 19 nt, Homo sapiens
gcaacucagaugaaacuca

SEQ ID NO: 1436354 - RNA, 19 nt, Homo sapiens
acacagcaacucagaugaa

SEQ ID NO: 1436355 - RNA, 19 nt, Homo sapiens
guagaguuagguacacaaa

SEQ ID NO: 1436356 - RNA, 19 nt, Homo sapiens
gaccccaucucuaaauaaa

SEQ ID NO: 1436357 - RNA, 19 nt, Homo sapiens
acacacagcaacucagaug

SEQ ID NO: 1436358 - RNA, 19 nt, Homo sapiens
cccaggaccucccuagaca

SEQ ID NO: 1436359 - RNA, 19 nt, Homo sapiens
gagggaguccugugguguu

SEQ ID NO: 1436360 - RNA, 19 nt, Homo sapiens
aggaaauucuucagagcaa

SEQ ID NO: 1436361 - RNA, 19 nt, Homo sapiens
agaagaaucacuugaggau

SEQ ID NO: 1436362 - RNA, 19 nt, Homo sapiens
uuacacagggcuauacaug

SEQ ID NO: 1436363 - RNA, 19 nt, Homo sapiens
uggauaaaaccccauauua

SEQ ID NO: 1436364 - RNA, 19 nt, Homo sapiens
ggaccucccuagacaaccu

SEQ ID NO: 1436365 - RNA, 19 nt, Homo sapiens
ggaaaacagauuaaagguu

SEQ ID NO: 1436366 - RNA, 19 nt, Homo sapiens
uacuguaugugauauagug

SEQ ID NO: 1436367 - RNA, 19 nt, Homo sapiens
aaccuccugugaaucuaua

SEQ ID NO: 1436368 - RNA, 19 nt, Homo sapiens
augcugugcuguaguguau

SEQ ID NO: 1436369 - RNA, 19 nt, Homo sapiens
gaugcugugcuguagugua

SEQ ID NO: 1436370 - RNA, 19 nt, Homo sapiens
ggaaacugaguauguucug

SEQ ID NO: 1436371 - RNA, 19 nt, Homo sapiens
uuagguacacaaaggagua

SEQ ID NO: 1436372 - RNA, 19 nt, Homo sapiens
ucagaugaaacucaaggaa

SEQ ID NO: 1436373 - RNA, 19 nt, Homo sapiens
auauguauccguacuguau

SEQ ID NO: 1436374 - RNA, 19 nt, Homo sapiens
caauuucugcguccugaug

SEQ ID NO: 1436375 - RNA, 19 nt, Homo sapiens
aguauguucuguagacugu

SEQ ID NO: 1436376 - RNA, 19 nt, Homo sapiens
gaaauucuucagagcaaaa

SEQ ID NO: 1436377 - RNA, 19 nt, Homo sapiens
cagcaacucagaugaaacu

SEQ ID NO: 1436378 - RNA, 19 nt, Homo sapiens
auuauuaucuggcauagac

SEQ ID NO: 1436379 - RNA, 19 nt, Homo sapiens
cacaaaggaguacagaugu

SEQ ID NO: 1436380 - RNA, 19 nt, Homo sapiens
aguaacugcuguacacaca

SEQ ID NO: 1436381 - RNA, 19 nt, Homo sapiens
gagcaagaccccaucucua

SEQ ID NO: 1436382 - RNA, 19 nt, Homo sapiens
caaccuccugugaaucuau

SEQ ID NO: 1436383 - RNA, 19 nt, Homo sapiens
ccuaugcaaccuccuguga

SEQ ID NO: 1436384 - RNA, 19 nt, Homo sapiens
cugaugcugugcuguagug

SEQ ID NO: 1436385 - RNA, 19 nt, Homo sapiens
guccugaugcugugcugua

SEQ ID NO: 1436386 - RNA, 19 nt, Homo sapiens
cagccugacuggugguuac

SEQ ID NO: 1436387 - RNA, 19 nt, Homo sapiens
ggaggcugaggcagaagaa

SEQ ID NO: 1436388 - RNA, 19 nt, Homo sapiens
gugcuguaguguauaaggu

SEQ ID NO: 1436389 - RNA, 19 nt, Homo sapiens
cugaguauguucuguagac

SEQ ID NO: 1436390 - RNA, 19 nt, Homo sapiens
ggcacuuccuacaccacua

SEQ ID NO: 1436391 - RNA, 19 nt, Homo sapiens
aaacucaaggaaauucuuc

SEQ ID NO: 1436392 - RNA, 19 nt, Homo sapiens
gcaagaccccaucucuaaa

SEQ ID NO: 1436393 - RNA, 19 nt, Homo sapiens
cguacuguaugugauauag

SEQ ID NO: 1436394 - RNA, 19 nt, Homo sapiens
cuagacaaccuccuaugca

SEQ ID NO: 1436395 - RNA, 19 nt, Homo sapiens
cagccaaucuugaaaacau

SEQ ID NO: 1436396 - RNA, 19 nt, Homo sapiens
gcacuuccuacaccacuac

SEQ ID NO: 1436397 - RNA, 19 nt, Homo sapiens
uacacagggcuauacauga

SEQ ID NO: 1436398 - RNA, 19 nt, Homo sapiens
ggaguaggcuuguauuuaa

SEQ ID NO: 1436399 - RNA, 19 nt, Homo sapiens
uaacagaagugcagacuca

SEQ ID NO: 1436400 - RNA, 19 nt, Homo sapiens
caacagggaugaauucuac

SEQ ID NO: 1436401 - RNA, 19 nt, Homo sapiens
gaggcaaacuucauaggaa

SEQ ID NO: 1436402 - RNA, 19 nt, Homo sapiens
gaaugugagcuccugauaa

SEQ ID NO: 1436403 - RNA, 19 nt, Homo sapiens
gcagacucauugcuagauu

SEQ ID NO: 1436404 - RNA, 19 nt, Homo sapiens
gaguaggcuuguauuuaaa

SEQ ID NO: 1436405 - RNA, 19 nt, Homo sapiens
uggcagcacucaccaacua

SEQ ID NO: 1436406 - RNA, 19 nt, Homo sapiens
aaugugagcuccugauaau

SEQ ID NO: 1436407 - RNA, 19 nt, Homo sapiens
uggaugugcucaacaauga

SEQ ID NO: 1436408 - RNA, 19 nt, Homo sapiens
cagccgacccuccaaguua

SEQ ID NO: 1436409 - RNA, 19 nt, Homo sapiens
gggcgacucucaccucuca

SEQ ID NO: 1436410 - RNA, 19 nt, Homo sapiens
ggagacagccacauuugga

SEQ ID NO: 1436411 - RNA, 19 nt, Homo sapiens
gaaaccuuccuuugccaua

SEQ ID NO: 1436412 - RNA, 19 nt, Homo sapiens
gcacauggcugggcaucag

SEQ ID NO: 1436413 - RNA, 19 nt, Homo sapiens
gaacacaggcgugcuugga

SEQ ID NO: 1436414 - RNA, 19 nt, Homo sapiens
uaacauggcacacacauac

SEQ ID NO: 1436415 - RNA, 19 nt, Homo sapiens
ugugagcuccugauaauaa

SEQ ID NO: 1436416 - RNA, 19 nt, Homo sapiens
gcucucagaaucccgcuua

SEQ ID NO: 1436417 - RNA, 19 nt, Homo sapiens
ccaaagugcugggauuaca

SEQ ID NO: 1436418 - RNA, 19 nt, Homo sapiens
acacacaggugcacacaca

SEQ ID NO: 1436419 - RNA, 19 nt, Homo sapiens
gcacagacacacacacaca

SEQ ID NO: 1436420 - RNA, 19 nt, Homo sapiens
ucagugggcuggacaugga

SEQ ID NO: 1436421 - RNA, 19 nt, Homo sapiens
guacacaggcacuaacaug

SEQ ID NO: 1436422 - RNA, 19 nt, Homo sapiens
gcaccgagaagaccugaga

SEQ ID NO: 1436423 - RNA, 19 nt, Homo sapiens
gaggagacagccacauuug

SEQ ID NO: 1436424 - RNA, 19 nt, Homo sapiens
cgacaggaguaggcuugua

SEQ ID NO: 1436425 - RNA, 19 nt, Homo sapiens
auaggaaucuguaccugaa

SEQ ID NO: 1436426 - RNA, 19 nt, Homo sapiens
caccaugcccagcuaauuu

SEQ ID NO: 1436427 - RNA, 19 nt, Homo sapiens
gcaccagaaccaacacuau

SEQ ID NO: 1436428 - RNA, 19 nt, Homo sapiens
gugagcuccugauaauaaa

SEQ ID NO: 1436429 - RNA, 19 nt, Homo sapiens
gccaguaggucuuuguucu

SEQ ID NO: 1436430 - RNA, 19 nt, Homo sapiens
cagaagugcagacucauug

SEQ ID NO: 1436431 - RNA, 19 nt, Homo sapiens
aggaguaggcuuguauuua

SEQ ID NO: 1436432 - RNA, 19 nt, Homo sapiens
guagcaugauggacaagga

SEQ ID NO: 1436433 - RNA, 19 nt, Homo sapiens
ugaaugugagcuccugaua

SEQ ID NO: 1436434 - RNA, 19 nt, Homo sapiens
cagaggagacagccacauu

SEQ ID NO: 1436435 - RNA, 19 nt, Homo sapiens
cggccgagguauaccauga

SEQ ID NO: 1436436 - RNA, 19 nt, Homo sapiens
cugauuagcugggauuaca

SEQ ID NO: 1436437 - RNA, 19 nt, Homo sapiens
gaauugggcaccgagaaga

SEQ ID NO: 1436438 - RNA, 19 nt, Homo sapiens
gcaucaucuucuuuaaguu

SEQ ID NO: 1436439 - RNA, 19 nt, Homo sapiens
ugcaucaucuucuuuaagu

SEQ ID NO: 1436440 - RNA, 19 nt, Homo sapiens
gacaggaguaggcuuguau

SEQ ID NO: 1436441 - RNA, 19 nt, Homo sapiens
ggaauugggcaccgagaag

SEQ ID NO: 1436442 - RNA, 19 nt, Homo sapiens
gagacagccacauuuggaa

SEQ ID NO: 1436443 - RNA, 19 nt, Homo sapiens
ggaggaaggcaaggaagga

SEQ ID NO: 1436444 - RNA, 19 nt, Homo sapiens
caacaacgagauccucagu

SEQ ID NO: 1436445 - RNA, 19 nt, Homo sapiens
ccaacagggaugaauucua

SEQ ID NO: 1436446 - RNA, 19 nt, Homo sapiens
gacagccacauuuggaauu

SEQ ID NO: 1436447 - RNA, 19 nt, Homo sapiens
ccaugugcaucaucuucuu

SEQ ID NO: 1436448 - RNA, 19 nt, Homo sapiens
ucucaccucucaugugcuu

SEQ ID NO: 1436449 - RNA, 19 nt, Homo sapiens
guucagggucugccuuuau

SEQ ID NO: 1436450 - RNA, 19 nt, Homo sapiens
cacacacgaugccgaacaa

SEQ ID NO: 1436451 - RNA, 19 nt, Homo sapiens
gcacaagcacacacaugca

SEQ ID NO: 1436452 - RNA, 19 nt, Homo sapiens
gcccugcucucucccucuu

SEQ ID NO: 1436453 - RNA, 19 nt, Homo sapiens
agaggagacagccacauuu

SEQ ID NO: 1436454 - RNA, 19 nt, Homo sapiens
cgagguauaccaugaacau

SEQ ID NO: 1436455 - RNA, 19 nt, Homo sapiens
cccugugguuugcguguua

SEQ ID NO: 1436456 - RNA, 19 nt, Homo sapiens
aggcaaacuucauaggaau

SEQ ID NO: 1436457 - RNA, 19 nt, Homo sapiens
cagacucauugcuagauuc

SEQ ID NO: 1436458 - RNA, 19 nt, Homo sapiens
ccaccaugcccagcuaauu

SEQ ID NO: 1436459 - RNA, 19 nt, Homo sapiens
gaaccaacacuaucauccu

SEQ ID NO: 1436460 - RNA, 19 nt, Homo sapiens
caggaguaggcuuguauuu

SEQ ID NO: 1436461 - RNA, 19 nt, Homo sapiens
gcaccuacgggcugagcaa

SEQ ID NO: 1436462 - RNA, 19 nt, Homo sapiens
uuacccagcuggagaccau

SEQ ID NO: 1436463 - RNA, 19 nt, Homo sapiens
aacccacucucauaacaga

SEQ ID NO: 1436464 - RNA, 19 nt, Homo sapiens
acacuaucauccugguaga

SEQ ID NO: 1436465 - RNA, 19 nt, Homo sapiens
aaucuguaccugaauguga

SEQ ID NO: 1436466 - RNA, 19 nt, Homo sapiens
ggaaucuguaccugaaugu

SEQ ID NO: 1436467 - RNA, 19 nt, Homo sapiens
acucauugcuagauucagu

SEQ ID NO: 1436468 - RNA, 19 nt, Homo sapiens
gugccaccaugcccagcua

SEQ ID NO: 1436469 - RNA, 19 nt, Homo sapiens
acagccacauuuggaauug

SEQ ID NO: 1436470 - RNA, 19 nt, Homo sapiens
gcacaguugcacagacaca

SEQ ID NO: 1436471 - RNA, 19 nt, Homo sapiens
gcccacucuugcacaugua

SEQ ID NO: 1436472 - RNA, 19 nt, Homo sapiens
gggagaccagaaccuauga

SEQ ID NO: 1436473 - RNA, 19 nt, Homo sapiens
ucacugagcguagcaugau

SEQ ID NO: 1436474 - RNA, 19 nt, Homo sapiens
aggaaucuguaccugaaug

SEQ ID NO: 1436475 - RNA, 19 nt, Homo sapiens
gcaaacuucauaggaaucu

SEQ ID NO: 1436476 - RNA, 19 nt, Homo sapiens
ugaggcaaacuucauagga

SEQ ID NO: 1436477 - RNA, 19 nt, Homo sapiens
gugaggagcagcagagucu

SEQ ID NO: 1436478 - RNA, 19 nt, Homo sapiens
caacacuaucauccuggua

SEQ ID NO: 1436479 - RNA, 19 nt, Homo sapiens
ccucuguguuugagacaau

SEQ ID NO: 1436480 - RNA, 19 nt, Homo sapiens
ggcagaagggcgacucuca

SEQ ID NO: 1436481 - RNA, 19 nt, Homo sapiens
cagccaacagggaugaauu

SEQ ID NO: 1436482 - RNA, 19 nt, Homo sapiens
gcaaggaaggaggcacaug

SEQ ID NO: 1436483 - RNA, 19 nt, Homo sapiens
acagaagugcagacucauu

SEQ ID NO: 1436484 - RNA, 19 nt, Homo sapiens
cuaacauggcacacacaua

SEQ ID NO: 1436485 - RNA, 19 nt, Homo sapiens
ugugcaucaucuucuuuaa

SEQ ID NO: 1436486 - RNA, 19 nt, Homo sapiens
uagauucagugcccuugag

SEQ ID NO: 1436487 - RNA, 19 nt, Homo sapiens
gagaccagaaccuaugagu

SEQ ID NO: 1436488 - RNA, 19 nt, Homo sapiens
caccagaaccaacacuauc

SEQ ID NO: 1436489 - RNA, 19 nt, Homo sapiens
gaacuccugacguggugau

SEQ ID NO: 1436490 - RNA, 19 nt, Homo sapiens
ggucuuuguucugguccaa

SEQ ID NO: 1436491 - RNA, 19 nt, Homo sapiens
cacaagcacacacaugcaa

SEQ ID NO: 1436492 - RNA, 19 nt, Homo sapiens
aaacuucauaggaaucugu

SEQ ID NO: 1436493 - RNA, 19 nt, Homo sapiens
uugagacaauccugugugu

SEQ ID NO: 1436494 - RNA, 19 nt, Homo sapiens
uggucaggcuggucuugaa

SEQ ID NO: 1436495 - RNA, 19 nt, Homo sapiens
gcgacucucaccucucaug

SEQ ID NO: 1436496 - RNA, 19 nt, Homo sapiens
uucagggucugccuuuaug

SEQ ID NO: 1436497 - RNA, 19 nt, Homo sapiens
caaggaccaucaaacauuu

SEQ ID NO: 1436498 - RNA, 19 nt, Homo sapiens
gaauuugcuuugucuguuu

SEQ ID NO: 1436499 - RNA, 19 nt, Homo sapiens
caaaucaugugaccucuau

SEQ ID NO: 1436500 - RNA, 19 nt, Homo sapiens
gauauaaacagcagagauu

SEQ ID NO: 1436501 - RNA, 19 nt, Homo sapiens
ucagauaugucuucuacaa

SEQ ID NO: 1436502 - RNA, 19 nt, Homo sapiens
ggaggaggaugaugaagau

SEQ ID NO: 1436503 - RNA, 19 nt, Homo sapiens
acauagagaugcugaaguu

SEQ ID NO: 1436504 - RNA, 19 nt, Homo sapiens
gaagcaucauuuggaauuu

SEQ ID NO: 1436505 - RNA, 19 nt, Homo sapiens
ggucuuugcugauguggaa

SEQ ID NO: 1436506 - RNA, 19 nt, Homo sapiens
gcaauaccauacaugaauc

SEQ ID NO: 1436507 - RNA, 19 nt, Homo sapiens
caaguuguuucucccaauu

SEQ ID NO: 1436508 - RNA, 19 nt, Homo sapiens
gcuaugaacacuagagauu

SEQ ID NO: 1436509 - RNA, 19 nt, Homo sapiens
ccaaggaccaucaaacauu

SEQ ID NO: 1436510 - RNA, 19 nt, Homo sapiens
gaccuuugaucccaagaaa

SEQ ID NO: 1436511 - RNA, 19 nt, Homo sapiens
ggaggguccuucaguguuc

SEQ ID NO: 1436512 - RNA, 19 nt, Homo sapiens
aaaguggaaucaccaaaga

SEQ ID NO: 1436513 - RNA, 19 nt, Homo sapiens
ucauaagccuggcgaaaug

SEQ ID NO: 1436514 - RNA, 19 nt, Homo sapiens
ugaaucacaugaagcauca

SEQ ID NO: 1436515 - RNA, 19 nt, Homo sapiens
caucaaaccauguucagaa

SEQ ID NO: 1436516 - RNA, 19 nt, Homo sapiens
cagccaggaucaaguggua

SEQ ID NO: 1436517 - RNA, 19 nt, Homo sapiens
cagcuacagugucacauug

SEQ ID NO: 1436518 - RNA, 19 nt, Homo sapiens
gaaaguggaaucaccaaag

SEQ ID NO: 1436519 - RNA, 19 nt, Homo sapiens
ggaggaggcagaaaugaga

SEQ ID NO: 1436520 - RNA, 19 nt, Homo sapiens
gcacaaauacacccucaca

SEQ ID NO: 1436521 - RNA, 19 nt, Homo sapiens
gcuguggucccuucagaua

SEQ ID NO: 1436522 - RNA, 19 nt, Homo sapiens
ugguauggcuuccguuauu

SEQ ID NO: 1436523 - RNA, 19 nt, Homo sapiens
ugaagcaucauuuggaauu

SEQ ID NO: 1436524 - RNA, 19 nt, Homo sapiens
cgacuuuccacuucagaua

SEQ ID NO: 1436525 - RNA, 19 nt, Homo sapiens
gggacucagugucuaguug

SEQ ID NO: 1436526 - RNA, 19 nt, Homo sapiens
gaagacggcuaugaacacu

SEQ ID NO: 1436527 - RNA, 19 nt, Homo sapiens
cagaucagguccucuuaca

SEQ ID NO: 1436528 - RNA, 19 nt, Homo sapiens
gagagaauccaaacaaagg

SEQ ID NO: 1436529 - RNA, 19 nt, Homo sapiens
gguggagcauguacauaga

SEQ ID NO: 1436530 - RNA, 19 nt, Homo sapiens
gaucagguccucuuacaac

SEQ ID NO: 1436531 - RNA, 19 nt, Homo sapiens
aaaggcacauuucaaucuu

SEQ ID NO: 1436532 - RNA, 19 nt, Homo sapiens
aaaaugagcucaccacaag

SEQ ID NO: 1436533 - RNA, 19 nt, Homo sapiens
gaaaggccacuuccgucaa

SEQ ID NO: 1436534 - RNA, 19 nt, Homo sapiens
gguauggcuuccguuauug

SEQ ID NO: 1436535 - RNA, 19 nt, Homo sapiens
uuuagaacgugccaugaaa

SEQ ID NO: 1436536 - RNA, 19 nt, Homo sapiens
gaggggcgaucgacagaua

SEQ ID NO: 1436537 - RNA, 19 nt, Homo sapiens
gcaaaucaugugaccucua

SEQ ID NO: 1436538 - RNA, 19 nt, Homo sapiens
gagcauguacauagagaug

SEQ ID NO: 1436539 - RNA, 19 nt, Homo sapiens
gggaggaggaugaugaaga

SEQ ID NO: 1436540 - RNA, 19 nt, Homo sapiens
uuacagaucgucggucuuu

SEQ ID NO: 1436541 - RNA, 19 nt, Homo sapiens
aaagggaggaggaugauga

SEQ ID NO: 1436542 - RNA, 19 nt, Homo sapiens
caacucaucaaaccauguu

SEQ ID NO: 1436543 - RNA, 19 nt, Homo sapiens
gaagaaagaaaggccacuu

SEQ ID NO: 1436544 - RNA, 19 nt, Homo sapiens
aaacagaucagguccucuu

SEQ ID NO: 1436545 - RNA, 19 nt, Homo sapiens
cuucagauaugucuucuac

SEQ ID NO: 1436546 - RNA, 19 nt, Homo sapiens
gcucaaagucaagaagaaa

SEQ ID NO: 1436547 - RNA, 19 nt, Homo sapiens
agacggcuaugaacacuag

SEQ ID NO: 1436548 - RNA, 19 nt, Homo sapiens
ucugugaauugucauuuga

SEQ ID NO: 1436549 - RNA, 19 nt, Homo sapiens
agacucacaccaccuuuaa

SEQ ID NO: 1436550 - RNA, 19 nt, Homo sapiens
cguguuacuuagcaacuuu

SEQ ID NO: 1436551 - RNA, 19 nt, Homo sapiens
agaguucuccugauucaaa

SEQ ID NO: 1436552 - RNA, 19 nt, Homo sapiens
aaaggccacuuccgucaau

SEQ ID NO: 1436553 - RNA, 19 nt, Homo sapiens
ccucagucuucuccuguaa

SEQ ID NO: 1436554 - RNA, 19 nt, Homo sapiens
caagugccggcuacaguuu

SEQ ID NO: 1436555 - RNA, 19 nt, Homo sapiens
aaacugcaauaccauacau

SEQ ID NO: 1436556 - RNA, 19 nt, Homo sapiens
agaauuugcuuugucuguu

SEQ ID NO: 1436557 - RNA, 19 nt, Homo sapiens
aaggcacauuucaaucuua

SEQ ID NO: 1436558 - RNA, 19 nt, Homo sapiens
gcccucugcugucuguaaa

SEQ ID NO: 1436559 - RNA, 19 nt, Homo sapiens
ccagagagagcaaaugagu

SEQ ID NO: 1436560 - RNA, 19 nt, Homo sapiens
aaacagcagagauuccaaa

SEQ ID NO: 1436561 - RNA, 19 nt, Homo sapiens
aaucccaucguguuacuua

SEQ ID NO: 1436562 - RNA, 19 nt, Homo sapiens
uugagagaauccaaacaaa

SEQ ID NO: 1436563 - RNA, 19 nt, Homo sapiens
gagaugggcagccggaaca

SEQ ID NO: 1436564 - RNA, 19 nt, Homo sapiens
cuacagugucacauugaua

SEQ ID NO: 1436565 - RNA, 19 nt, Homo sapiens
gcuacagugucacauugau

SEQ ID NO: 1436566 - RNA, 19 nt, Homo sapiens
gaagacucacaccaccuuu

SEQ ID NO: 1436567 - RNA, 19 nt, Homo sapiens
ucaagucuagcaagucaaa

SEQ ID NO: 1436568 - RNA, 19 nt, Homo sapiens
ggccugaugcuaauggaaa

SEQ ID NO: 1436569 - RNA, 19 nt, Homo sapiens
ggcucaaagucaagaagaa

SEQ ID NO: 1436570 - RNA, 19 nt, Homo sapiens
uggaaucaccaaagaagaa

SEQ ID NO: 1436571 - RNA, 19 nt, Homo sapiens
ccaagugccggcuacaguu

SEQ ID NO: 1436572 - RNA, 19 nt, Homo sapiens
uuucaagucuagcaaguca

SEQ ID NO: 1436573 - RNA, 19 nt, Homo sapiens
ucuuacagauccagagaga

SEQ ID NO: 1436574 - RNA, 19 nt, Homo sapiens
uagcuguggucccuucaga

SEQ ID NO: 1436575 - RNA, 19 nt, Homo sapiens
aagcaucauuuggaauuug

SEQ ID NO: 1436576 - RNA, 19 nt, Homo sapiens
uguggucccuucagauaug

SEQ ID NO: 1436577 - RNA, 19 nt, Homo sapiens
cagcagagauuccaaaagg

SEQ ID NO: 1436578 - RNA, 19 nt, Homo sapiens
ucaaagucaagaagaaaga

SEQ ID NO: 1436579 - RNA, 19 nt, Homo sapiens
acuuuccacuucagauaua

SEQ ID NO: 1436580 - RNA, 19 nt, Homo sapiens
ggaggaaauagagcacaaa

SEQ ID NO: 1436581 - RNA, 19 nt, Homo sapiens
agaagaauuugagagaauc

SEQ ID NO: 1436582 - RNA, 19 nt, Homo sapiens
ugugccagguuugccauua

SEQ ID NO: 1436583 - RNA, 19 nt, Homo sapiens
caucauaagccuggcgaaa

SEQ ID NO: 1436584 - RNA, 19 nt, Homo sapiens
ucacaccaccuuuaaaugc

SEQ ID NO: 1436585 - RNA, 19 nt, Homo sapiens
ggaaucaccaaagaagaau

SEQ ID NO: 1436586 - RNA, 19 nt, Homo sapiens
cagguccucuuacaacaca

SEQ ID NO: 1436587 - RNA, 19 nt, Homo sapiens
guuuaugaaucacaugaag

SEQ ID NO: 1436588 - RNA, 19 nt, Homo sapiens
ggguggagcauguacauag

SEQ ID NO: 1436589 - RNA, 19 nt, Homo sapiens
acaauaagcacaaauacac

SEQ ID NO: 1436590 - RNA, 19 nt, Homo sapiens
guacauagagaugcugaag

SEQ ID NO: 1436591 - RNA, 19 nt, Homo sapiens
gcacauuucaaucuuacag

SEQ ID NO: 1436592 - RNA, 19 nt, Homo sapiens
caaagucaagaagaaagaa

SEQ ID NO: 1436593 - RNA, 19 nt, Homo sapiens
gacguugaaggaggaaaua

SEQ ID NO: 1436594 - RNA, 19 nt, Homo sapiens
gaaucaccaaagaagaauu

SEQ ID NO: 1436595 - RNA, 19 nt, Homo sapiens
gagucuggccuggcaauga

SEQ ID NO: 1436596 - RNA, 19 nt, Homo sapiens
gaucugcaacucaucaaac

SEQ ID NO: 1436597 - RNA, 19 nt, Homo sapiens
gaugugugcuggccaauaa

SEQ ID NO: 1436598 - RNA, 19 nt, Homo sapiens
cgucucaucugcugucuga

SEQ ID NO: 1436599 - RNA, 19 nt, Homo sapiens
gcccguccauauuuauuaa

SEQ ID NO: 1436600 - RNA, 19 nt, Homo sapiens
guacaaggcuucgucucau

SEQ ID NO: 1436601 - RNA, 19 nt, Homo sapiens
gggagcagcuacagaacug

SEQ ID NO: 1436602 - RNA, 19 nt, Homo sapiens
gaacuggugcuccuaugug

SEQ ID NO: 1436603 - RNA, 19 nt, Homo sapiens
gggagacccuggugagaag

SEQ ID NO: 1436604 - RNA, 19 nt, Homo sapiens
ugggaguccuggucacaua

SEQ ID NO: 1436605 - RNA, 19 nt, Homo sapiens
ugacagagcggcugaaggu

SEQ ID NO: 1436606 - RNA, 19 nt, Homo sapiens
caaggugauguacaagaua

SEQ ID NO: 1436607 - RNA, 19 nt, Homo sapiens
ucaaggagggauagaggua

SEQ ID NO: 1436608 - RNA, 19 nt, Homo sapiens
acaaggugauguacaagau

SEQ ID NO: 1436609 - RNA, 19 nt, Homo sapiens
uccaacaccuucacugaga

SEQ ID NO: 1436610 - RNA, 19 nt, Homo sapiens
gguacaaggcuucgucuca

SEQ ID NO: 1436611 - RNA, 19 nt, Homo sapiens
acgcgaggcuuugaagauu

SEQ ID NO: 1436612 - RNA, 19 nt, Homo sapiens
ccacuggacccaaaggaau

SEQ ID NO: 1436613 - RNA, 19 nt, Homo sapiens
ggccucaguuucccucugu

SEQ ID NO: 1436614 - RNA, 19 nt, Homo sapiens
ucacugagaccaacaacca

SEQ ID NO: 1436615 - RNA, 19 nt, Homo sapiens
caacugcagcaaaguguca

SEQ ID NO: 1436616 - RNA, 19 nt, Homo sapiens
ggaacuggugcuccuaugu

SEQ ID NO: 1436617 - RNA, 19 nt, Homo sapiens
ugagaggguuuuaaucuug

SEQ ID NO: 1436618 - RNA, 19 nt, Homo sapiens
cgcgaggcuuugaagauuu

SEQ ID NO: 1436619 - RNA, 19 nt, Homo sapiens
ggugagacccacauacaag

SEQ ID NO: 1436620 - RNA, 19 nt, Homo sapiens
ugucucaacugcagcaaag

SEQ ID NO: 1436621 - RNA, 19 nt, Homo sapiens
gcggacaugcaaccaacua

SEQ ID NO: 1436622 - RNA, 19 nt, Homo sapiens
gagcagccaguaccuccaa

SEQ ID NO: 1436623 - RNA, 19 nt, Homo sapiens
gcgaggcuuugaagauuuu

SEQ ID NO: 1436624 - RNA, 19 nt, Homo sapiens
gcagaauggcaccuaccuu

SEQ ID NO: 1436625 - RNA, 19 nt, Homo sapiens
aaggugauguacaagauag

SEQ ID NO: 1436626 - RNA, 19 nt, Homo sapiens
ugucauagagcagccagua

SEQ ID NO: 1436627 - RNA, 19 nt, Homo sapiens
gaggucaggcugcccaauc

SEQ ID NO: 1436628 - RNA, 19 nt, Homo sapiens
gaauggcaccuaccuucag

SEQ ID NO: 1436629 - RNA, 19 nt, Homo sapiens
uaaaggccccuaccugauu

SEQ ID NO: 1436630 - RNA, 19 nt, Homo sapiens
ccguccauauuuauuaaug

SEQ ID NO: 1436631 - RNA, 19 nt, Homo sapiens
gagcauccaggcccaaagg

SEQ ID NO: 1436632 - RNA, 19 nt, Homo sapiens
ggucccuucugccaucuag

SEQ ID NO: 1436633 - RNA, 19 nt, Homo sapiens
gagacccauugcuguccaa

SEQ ID NO: 1436634 - RNA, 19 nt, Homo sapiens
guaccuccaacaccagcua

SEQ ID NO: 1436635 - RNA, 19 nt, Homo sapiens
cccacagccuucucagguu

SEQ ID NO: 1436636 - RNA, 19 nt, Homo sapiens
cgcccguccauauuuauua

SEQ ID NO: 1436637 - RNA, 19 nt, Homo sapiens
agaugaccaugcugacugu

SEQ ID NO: 1436638 - RNA, 19 nt, Homo sapiens
uacaaggcuucgucucauc

SEQ ID NO: 1436639 - RNA, 19 nt, Homo sapiens
gcucggcacaugcagagau

SEQ ID NO: 1436640 - RNA, 19 nt, Homo sapiens
uguccaacaccuucacuga

SEQ ID NO: 1436641 - RNA, 19 nt, Homo sapiens
gagaagagguagcaagaga

SEQ ID NO: 1436642 - RNA, 19 nt, Homo sapiens
ccgcacagcucuacacuuu

SEQ ID NO: 1436643 - RNA, 19 nt, Homo sapiens
gcagugaguuucucugguu

SEQ ID NO: 1436644 - RNA, 19 nt, Homo sapiens
ccaaagagcagguggauga

SEQ ID NO: 1436645 - RNA, 19 nt, Homo sapiens
guaaugaaguuaaggaucu

SEQ ID NO: 1436646 - RNA, 19 nt, Homo sapiens
ugaagcagaucauccauau

SEQ ID NO: 1436647 - RNA, 19 nt, Homo sapiens
gagcugcgcugcaagauac

SEQ ID NO: 1436648 - RNA, 19 nt, Homo sapiens
gcacagcucuacacuuugc

SEQ ID NO: 1436649 - RNA, 19 nt, Homo sapiens
gcagauguaaugaaguuaa

SEQ ID NO: 1436650 - RNA, 19 nt, Homo sapiens
ccaaugauguggaaacagu

SEQ ID NO: 1436651 - RNA, 19 nt, Homo sapiens
guaguggccucccaagaug

SEQ ID NO: 1436652 - RNA, 19 nt, Homo sapiens
gggaauaaauuuguguugu

SEQ ID NO: 1436653 - RNA, 19 nt, Homo sapiens
caauggcaaugaccagauu

SEQ ID NO: 1436654 - RNA, 19 nt, Homo sapiens
gcagaugaccaguaccaaa

SEQ ID NO: 1436655 - RNA, 19 nt, Homo sapiens
gcagguggaugaagugacu

SEQ ID NO: 1436656 - RNA, 19 nt, Homo sapiens
gagauacugcagugaguuu

SEQ ID NO: 1436657 - RNA, 19 nt, Homo sapiens
ccaagaugcccauguccua

SEQ ID NO: 1436658 - RNA, 19 nt, Homo sapiens
caaccacguuccugucauc

SEQ ID NO: 1436659 - RNA, 19 nt, Homo sapiens
uugcagauguaaugaaguu

SEQ ID NO: 1436660 - RNA, 19 nt, Homo sapiens
ccaagucaaagcugaauau

SEQ ID NO: 1436661 - RNA, 19 nt, Homo sapiens
gaacucuaagggaauaaau

SEQ ID NO: 1436662 - RNA, 19 nt, Homo sapiens
caagaugcccauguccuaa

SEQ ID NO: 1436663 - RNA, 19 nt, Homo sapiens
ggacuuggagcugcacuug

SEQ ID NO: 1436664 - RNA, 19 nt, Homo sapiens
gauccuaaccagcgagaug

SEQ ID NO: 1436665 - RNA, 19 nt, Homo sapiens
caaugccaaugauguggaa

SEQ ID NO: 1436666 - RNA, 19 nt, Homo sapiens
gggcuuugcagauguaaug

SEQ ID NO: 1436667 - RNA, 19 nt, Homo sapiens
gucagcaggugugggcuua

SEQ ID NO: 1436668 - RNA, 19 nt, Homo sapiens
cuaagggaauaaauuugug

SEQ ID NO: 1436669 - RNA, 19 nt, Homo sapiens
agacacgucaccagacuuu

SEQ ID NO: 1436670 - RNA, 19 nt, Homo sapiens
agaggagguuggaggugua

SEQ ID NO: 1436671 - RNA, 19 nt, Homo sapiens
gugaagcagaucauccaua

SEQ ID NO: 1436672 - RNA, 19 nt, Homo sapiens
agucaaagcugaauauccu

SEQ ID NO: 1436673 - RNA, 19 nt, Homo sapiens
ggacucggccaaugccaau

SEQ ID NO: 1436674 - RNA, 19 nt, Homo sapiens
gauguaaugaaguuaagga

SEQ ID NO: 1436675 - RNA, 19 nt, Homo sapiens
cagugaggcuaauuuuaua

SEQ ID NO: 1436676 - RNA, 19 nt, Homo sapiens
gcaauggcaaugaccagau

SEQ ID NO: 1436677 - RNA, 19 nt, Homo sapiens
gaagauuaucccagcuugu

SEQ ID NO: 1436678 - RNA, 19 nt, Homo sapiens
cagauguaaugaaguuaag

SEQ ID NO: 1436679 - RNA, 19 nt, Homo sapiens
aagagcagguggaugaagu

SEQ ID NO: 1436680 - RNA, 19 nt, Homo sapiens
gaggugcacgcucugaaga

SEQ ID NO: 1436681 - RNA, 19 nt, Homo sapiens
gugagucccagaccuuaaa

SEQ ID NO: 1436682 - RNA, 19 nt, Homo sapiens
ggagauacugcagugaguu

SEQ ID NO: 1436683 - RNA, 19 nt, Homo sapiens
gaugaccaguaccaaagag

SEQ ID NO: 1436684 - RNA, 19 nt, Homo sapiens
cgagcugcgcugcaagaua

SEQ ID NO: 1436685 - RNA, 19 nt, Homo sapiens
gauuaucccagcuuguuca

SEQ ID NO: 1436686 - RNA, 19 nt, Homo sapiens
cagaugaccaguaccaaag

SEQ ID NO: 1436687 - RNA, 19 nt, Homo sapiens
uauaccggaggguguaaua

SEQ ID NO: 1436688 - RNA, 19 nt, Homo sapiens
ggugagucccagaccuuaa

SEQ ID NO: 1436689 - RNA, 19 nt, Homo sapiens
aagcagaucauccauaugc

SEQ ID NO: 1436690 - RNA, 19 nt, Homo sapiens
aaaugcauccucccacaga

SEQ ID NO: 1436691 - RNA, 19 nt, Homo sapiens
gggcagcucaagccacaga

SEQ ID NO: 1436692 - RNA, 19 nt, Homo sapiens
aagauuaucccagcuuguu

SEQ ID NO: 1436693 - RNA, 19 nt, Homo sapiens
ccacucccagccacaguuu

SEQ ID NO: 1436694 - RNA, 19 nt, Homo sapiens
gcucuacacuuugccucau

SEQ ID NO: 1436695 - RNA, 19 nt, Homo sapiens
uccauaugcugagggagua

SEQ ID NO: 1436696 - RNA, 19 nt, Homo sapiens
aaggaucuuucgccaggaa

SEQ ID NO: 1436697 - RNA, 19 nt, Homo sapiens
ggaggugcacgcucugaag

SEQ ID NO: 1436698 - RNA, 19 nt, Homo sapiens
gcagcgagaacgccuggau

SEQ ID NO: 1436699 - RNA, 19 nt, Homo sapiens
gaagcagaucauccauaug

SEQ ID NO: 1436700 - RNA, 19 nt, Homo sapiens
ugucaucaccacacugcua

SEQ ID NO: 1436701 - RNA, 19 nt, Homo sapiens
ccggaggguguaauaguuu

SEQ ID NO: 1436702 - RNA, 19 nt, Homo sapiens
uggagaagagguagcaaga

SEQ ID NO: 1436703 - RNA, 19 nt, Homo sapiens
gacgagcugcgcugcaaga

SEQ ID NO: 1436704 - RNA, 19 nt, Homo sapiens
acacgucaccagacuuuca

SEQ ID NO: 1436705 - RNA, 19 nt, Homo sapiens
gagcagguggaugaaguga

SEQ ID NO: 1436706 - RNA, 19 nt, Homo sapiens
caaagagcagguggaugaa

SEQ ID NO: 1436707 - RNA, 19 nt, Homo sapiens
caacaugagcagcgagaac

SEQ ID NO: 1436708 - RNA, 19 nt, Homo sapiens
ucagugaggcuaauuuuau

SEQ ID NO: 1436709 - RNA, 19 nt, Homo sapiens
accggaggguguaauaguu

SEQ ID NO: 1436710 - RNA, 19 nt, Homo sapiens
cagcuucaccucccucagu

SEQ ID NO: 1436711 - RNA, 19 nt, Homo sapiens
gcaccuggccaagucaaag

SEQ ID NO: 1436712 - RNA, 19 nt, Homo sapiens
gugaguuucucugguugga

SEQ ID NO: 1436713 - RNA, 19 nt, Homo sapiens
acagacacgucaccagacu

SEQ ID NO: 1436714 - RNA, 19 nt, Homo sapiens
ucaccagcacuuagacaga

SEQ ID NO: 1436715 - RNA, 19 nt, Homo sapiens
gccaagucaaagcugaaua

SEQ ID NO: 1436716 - RNA, 19 nt, Homo sapiens
acuuggagcugcacuuguc

SEQ ID NO: 1436717 - RNA, 19 nt, Homo sapiens
ggccaaugccaaugaugug

SEQ ID NO: 1436718 - RNA, 19 nt, Homo sapiens
gaacaagagucgauaguuu

SEQ ID NO: 1436719 - RNA, 19 nt, Homo sapiens
gaacagaggauucaaauuu

SEQ ID NO: 1436720 - RNA, 19 nt, Homo sapiens
gaaacggccuugaaauauu

SEQ ID NO: 1436721 - RNA, 19 nt, Homo sapiens
gcagauaagcugaagaaua

SEQ ID NO: 1436722 - RNA, 19 nt, Homo sapiens
ggagacaacugugaaauug

SEQ ID NO: 1436723 - RNA, 19 nt, Homo sapiens
cgacaaggcuaaacuagaa

SEQ ID NO: 1436724 - RNA, 19 nt, Homo sapiens
gaggaucaguuaaguauga

SEQ ID NO: 1436725 - RNA, 19 nt, Homo sapiens
ucaggaagcuaaaguauug

SEQ ID NO: 1436726 - RNA, 19 nt, Homo sapiens
gaaugugaauccucucuuu

SEQ ID NO: 1436727 - RNA, 19 nt, Homo sapiens
cagauaagcugaagaauac

SEQ ID NO: 1436728 - RNA, 19 nt, Homo sapiens
uugagaagcugcagacuua

SEQ ID NO: 1436729 - RNA, 19 nt, Homo sapiens
ggaaucucgugaagacuua

SEQ ID NO: 1436730 - RNA, 19 nt, Homo sapiens
gauaacaacuaaugacugu

SEQ ID NO: 1436731 - RNA, 19 nt, Homo sapiens
ggaaguucaugucaauaaa

SEQ ID NO: 1436732 - RNA, 19 nt, Homo sapiens
gagaagagauugacacacu

SEQ ID NO: 1436733 - RNA, 19 nt, Homo sapiens
gacauuaucuaaacagaga

SEQ ID NO: 1436734 - RNA, 19 nt, Homo sapiens
aaacggccuugaaauauuu

SEQ ID NO: 1436735 - RNA, 19 nt, Homo sapiens
gauguuggaagcacaauua

SEQ ID NO: 1436736 - RNA, 19 nt, Homo sapiens
ggaagaaugucaauuacag

SEQ ID NO: 1436737 - RNA, 19 nt, Homo sapiens
ugaacuagcucuaagugaa

SEQ ID NO: 1436738 - RNA, 19 nt, Homo sapiens
ggaaacggccuugaaauau

SEQ ID NO: 1436739 - RNA, 19 nt, Homo sapiens
acacuuaaccuccuacaua

SEQ ID NO: 1436740 - RNA, 19 nt, Homo sapiens
gcaaggauaguggaacuua

SEQ ID NO: 1436741 - RNA, 19 nt, Homo sapiens
gcaacaauuuggacuacuu

SEQ ID NO: 1436742 - RNA, 19 nt, Homo sapiens
cacuaaagauguccaguaa

SEQ ID NO: 1436743 - RNA, 19 nt, Homo sapiens
gaacgacaaggcuaaacua

SEQ ID NO: 1436744 - RNA, 19 nt, Homo sapiens
gaagauagaagagaaugaa

SEQ ID NO: 1436745 - RNA, 19 nt, Homo sapiens
gacacuauaucuccauuga

SEQ ID NO: 1436746 - RNA, 19 nt, Homo sapiens
gagaaugaacgguugcaua

SEQ ID NO: 1436747 - RNA, 19 nt, Homo sapiens
uaaaggaaguucaugucaa

SEQ ID NO: 1436748 - RNA, 19 nt, Homo sapiens
gaagagauugacacacuaa

SEQ ID NO: 1436749 - RNA, 19 nt, Homo sapiens
ugacggcucuucuaaacuu

SEQ ID NO: 1436750 - RNA, 19 nt, Homo sapiens
gauauuguagguuuccuua

SEQ ID NO: 1436751 - RNA, 19 nt, Homo sapiens
ugacagcuguguuugagaa

SEQ ID NO: 1436752 - RNA, 19 nt, Homo sapiens
gcagcgaguggauucauua

SEQ ID NO: 1436753 - RNA, 19 nt, Homo sapiens
agacaacugugaaauugaa

SEQ ID NO: 1436754 - RNA, 19 nt, Homo sapiens
aaaugaaacuugccaguca

SEQ ID NO: 1436755 - RNA, 19 nt, Homo sapiens
aaaucaagcuagagaaaga

SEQ ID NO: 1436756 - RNA, 19 nt, Homo sapiens
ucacugagcuauggaccua

SEQ ID NO: 1436757 - RNA, 19 nt, Homo sapiens
aaaggaaguucaugucaau

SEQ ID NO: 1436758 - RNA, 19 nt, Homo sapiens
gaaugcaugcuacaguaua

SEQ ID NO: 1436759 - RNA, 19 nt, Homo sapiens
ucauggauauuguagguuu

SEQ ID NO: 1436760 - RNA, 19 nt, Homo sapiens
gagauugacacacuaaaga

SEQ ID NO: 1436761 - RNA, 19 nt, Homo sapiens
gguaaucgauuugguaucu

SEQ ID NO: 1436762 - RNA, 19 nt, Homo sapiens
cuaaagauguccaguaagg

SEQ ID NO: 1436763 - RNA, 19 nt, Homo sapiens
ggaaaaugcugcuguguca

SEQ ID NO: 1436764 - RNA, 19 nt, Homo sapiens
uggaaacggccuugaaaua

SEQ ID NO: 1436765 - RNA, 19 nt, Homo sapiens
gcgaguggauucauuaguc

SEQ ID NO: 1436766 - RNA, 19 nt, Homo sapiens
gaagauuugucagguagau

SEQ ID NO: 1436767 - RNA, 19 nt, Homo sapiens
auacguaugucauggauau

SEQ ID NO: 1436768 - RNA, 19 nt, Homo sapiens
caagaggaguuacgaggau

SEQ ID NO: 1436769 - RNA, 19 nt, Homo sapiens
caugaagauuugucaggua

SEQ ID NO: 1436770 - RNA, 19 nt, Homo sapiens
ggaaauggacaguuugaca

SEQ ID NO: 1436771 - RNA, 19 nt, Homo sapiens
gcacagcaaguucaacaga

SEQ ID NO: 1436772 - RNA, 19 nt, Homo sapiens
ucacaauaccuucaugaaa

SEQ ID NO: 1436773 - RNA, 19 nt, Homo sapiens
gaaguucucacaauaccuu

SEQ ID NO: 1436774 - RNA, 19 nt, Homo sapiens
uagaacuacuucaagauga

SEQ ID NO: 1436775 - RNA, 19 nt, Homo sapiens
aguaauagcuaaaggaagu

SEQ ID NO: 1436776 - RNA, 19 nt, Homo sapiens
gaguuacgaggaucaguua

SEQ ID NO: 1436777 - RNA, 19 nt, Homo sapiens
cacagaagcugauaacaac

SEQ ID NO: 1436778 - RNA, 19 nt, Homo sapiens
cacuauaucuccauugaau

SEQ ID NO: 1436779 - RNA, 19 nt, Homo sapiens
gaaugaacgguugcauaua

SEQ ID NO: 1436780 - RNA, 19 nt, Homo sapiens
aacaggaaauggacaguuu

SEQ ID NO: 1436781 - RNA, 19 nt, Homo sapiens
gaccaccugugcagcauga

SEQ ID NO: 1436782 - RNA, 19 nt, Homo sapiens
caacagaguuuggaaaaga

SEQ ID NO: 1436783 - RNA, 19 nt, Homo sapiens
caauuuggacuacuucauu

SEQ ID NO: 1436784 - RNA, 19 nt, Homo sapiens
cacaauaccuucaugaaaa

SEQ ID NO: 1436785 - RNA, 19 nt, Homo sapiens
gaagcuggcucaggaguac

SEQ ID NO: 1436786 - RNA, 19 nt, Homo sapiens
caagaugaacuagcucuaa

SEQ ID NO: 1436787 - RNA, 19 nt, Homo sapiens
gaaauggacaguuugacau

SEQ ID NO: 1436788 - RNA, 19 nt, Homo sapiens
caaauucugcagcuuuaaa

SEQ ID NO: 1436789 - RNA, 19 nt, Homo sapiens
ucagcagacuucaggauga

SEQ ID NO: 1436790 - RNA, 19 nt, Homo sapiens
gacaguaagucagugcauu

SEQ ID NO: 1436791 - RNA, 19 nt, Homo sapiens
gugcugcucugcauggauu

SEQ ID NO: 1436792 - RNA, 19 nt, Homo sapiens
ugaaggcauucuccagauu

SEQ ID NO: 1436793 - RNA, 19 nt, Homo sapiens
gagacauuaucuaaacaga

SEQ ID NO: 1436794 - RNA, 19 nt, Homo sapiens
cugaaugcaugcuacagua

SEQ ID NO: 1436795 - RNA, 19 nt, Homo sapiens
gaacggaagaaugucaauu

SEQ ID NO: 1436796 - RNA, 19 nt, Homo sapiens
uauuguagguuuccuuaug

SEQ ID NO: 1436797 - RNA, 19 nt, Homo sapiens
acacagaagcugauaacaa

SEQ ID NO: 1436798 - RNA, 19 nt, Homo sapiens
cacuuaaccuccuacauau

SEQ ID NO: 1436799 - RNA, 19 nt, Homo sapiens
gccaaggaaugucgacuuc

SEQ ID NO: 1436800 - RNA, 19 nt, Homo sapiens
ggaagcacaauuagccaaa

SEQ ID NO: 1436801 - RNA, 19 nt, Homo sapiens
aaauggagcaggaaagauu

SEQ ID NO: 1436802 - RNA, 19 nt, Homo sapiens
ggagacaccagcugaagau

SEQ ID NO: 1436803 - RNA, 19 nt, Homo sapiens
gucaaacugucauuacuuc

SEQ ID NO: 1436804 - RNA, 19 nt, Homo sapiens
cugccuauaugaagucuuu

SEQ ID NO: 1436805 - RNA, 19 nt, Homo sapiens
gaacguuccacuccacaau

SEQ ID NO: 1436806 - RNA, 19 nt, Homo sapiens
agaaugaacgguugcauau

SEQ ID NO: 1436807 - RNA, 19 nt, Homo sapiens
ggaguuacgaggaucaguu

SEQ ID NO: 1436808 - RNA, 19 nt, Homo sapiens
aggaugagcugacaacuac

SEQ ID NO: 1436809 - RNA, 19 nt, Homo sapiens
agcaaauucugcagcuuua

SEQ ID NO: 1436810 - RNA, 19 nt, Homo sapiens
uggagucugugccuuauga

SEQ ID NO: 1436811 - RNA, 19 nt, Homo sapiens
uaacaaauggagcaggaaa

SEQ ID NO: 1436812 - RNA, 19 nt, Homo sapiens
cagcugaagaugcgagaua

SEQ ID NO: 1436813 - RNA, 19 nt, Homo sapiens
aacggaagaaugucaauua

SEQ ID NO: 1436814 - RNA, 19 nt, Homo sapiens
cuucagauccuguggguuu

SEQ ID NO: 1436815 - RNA, 19 nt, Homo sapiens
gcaaauacagaaguugaug

SEQ ID NO: 1436816 - RNA, 19 nt, Homo sapiens
agaagagauugacacacua

SEQ ID NO: 1436817 - RNA, 19 nt, Homo sapiens
gagcugacaacuaccaaga

SEQ ID NO: 1436818 - RNA, 19 nt, Homo sapiens
gcagaaacaucucaaggua

SEQ ID NO: 1436819 - RNA, 19 nt, Homo sapiens
gagcaucgcuaugaucuaa

SEQ ID NO: 1436820 - RNA, 19 nt, Homo sapiens
gaucugggcuuccucacuu

SEQ ID NO: 1436821 - RNA, 19 nt, Homo sapiens
ggaccuggcuguggccuau

SEQ ID NO: 1436822 - RNA, 19 nt, Homo sapiens
caggacagcugaugguugu

SEQ ID NO: 1436823 - RNA, 19 nt, Homo sapiens
gaagugugcuggcugucau

SEQ ID NO: 1436824 - RNA, 19 nt, Homo sapiens
agucggcacucuuggguua

SEQ ID NO: 1436825 - RNA, 19 nt, Homo sapiens
gagcugcacugggauucuu

SEQ ID NO: 1436826 - RNA, 19 nt, Homo sapiens
ccacguggguauuuuagua

SEQ ID NO: 1436827 - RNA, 19 nt, Homo sapiens
guggagaacugguccuaca

SEQ ID NO: 1436828 - RNA, 19 nt, Homo sapiens
gcaaauaacacagcagaac

SEQ ID NO: 1436829 - RNA, 19 nt, Homo sapiens
ggucaccuguccucacuca

SEQ ID NO: 1436830 - RNA, 19 nt, Homo sapiens
ccauaucuucuuuccauuu

SEQ ID NO: 1436831 - RNA, 19 nt, Homo sapiens
ucaguggagucuucuuugu

SEQ ID NO: 1436832 - RNA, 19 nt, Homo sapiens
gugaugaaccaccauguau

SEQ ID NO: 1436833 - RNA, 19 nt, Homo sapiens
gaaccacguggguauuuua

SEQ ID NO: 1436834 - RNA, 19 nt, Homo sapiens
gggugugugucaucgauau

SEQ ID NO: 1436835 - RNA, 19 nt, Homo sapiens
gguccucaguggagucuuc

SEQ ID NO: 1436836 - RNA, 19 nt, Homo sapiens
gcugaugguuguggcagaa

SEQ ID NO: 1436837 - RNA, 19 nt, Homo sapiens
ccaggucucugcacuacgu

SEQ ID NO: 1436838 - RNA, 19 nt, Homo sapiens
gcagaaccacguggguauu

SEQ ID NO: 1436839 - RNA, 19 nt, Homo sapiens
gcugucaucgccuuuauca

SEQ ID NO: 1436840 - RNA, 19 nt, Homo sapiens
gcugcacccuggacgaugu

SEQ ID NO: 1436841 - RNA, 19 nt, Homo sapiens
cagaaccacguggguauuu

SEQ ID NO: 1436842 - RNA, 19 nt, Homo sapiens
gcaucgcuaugaucuaagg

SEQ ID NO: 1436843 - RNA, 19 nt, Homo sapiens
gagagcaucgcuaugaucu

SEQ ID NO: 1436844 - RNA, 19 nt, Homo sapiens
gaugaaccaccauguaugc

SEQ ID NO: 1436845 - RNA, 19 nt, Homo sapiens
gcaacuuucagguggauca

SEQ ID NO: 1436846 - RNA, 19 nt, Homo sapiens
ucacuuccuuuagggcaaa

SEQ ID NO: 1436847 - RNA, 19 nt, Homo sapiens
caccuucagcuacgaguuu

SEQ ID NO: 1436848 - RNA, 19 nt, Homo sapiens
uaacaccacggcacucauc

SEQ ID NO: 1436849 - RNA, 19 nt, Homo sapiens
ccucaguggagucuucuuu

SEQ ID NO: 1436850 - RNA, 19 nt, Homo sapiens
ggcagaaacaucucaaggu

SEQ ID NO: 1436851 - RNA, 19 nt, Homo sapiens
ugugaugaaccaccaugua

SEQ ID NO: 1436852 - RNA, 19 nt, Homo sapiens
ccgagagcaucgcuaugau

SEQ ID NO: 1436853 - RNA, 19 nt, Homo sapiens
cccgagagcaucgcuauga

SEQ ID NO: 1436854 - RNA, 19 nt, Homo sapiens
ggagaacugguccuacaac

SEQ ID NO: 1436855 - RNA, 19 nt, Homo sapiens
cgccuuagccuacggaaag

SEQ ID NO: 1436856 - RNA, 19 nt, Homo sapiens
gagucuucuuuguccauga

SEQ ID NO: 1436857 - RNA, 19 nt, Homo sapiens
uggccuaucugcgaagugu

SEQ ID NO: 1436858 - RNA, 19 nt, Homo sapiens
ucacuggcauauggacugu

SEQ ID NO: 1436859 - RNA, 19 nt, Homo sapiens
guggagugggcacgccuua

SEQ ID NO: 1436860 - RNA, 19 nt, Homo sapiens
gugggugugugucaucgau

SEQ ID NO: 1436861 - RNA, 19 nt, Homo sapiens
uggcugucaucgccuuuau

SEQ ID NO: 1436862 - RNA, 19 nt, Homo sapiens
ugaugaaccaccauguaug

SEQ ID NO: 1436863 - RNA, 19 nt, Homo sapiens
ccauggcugugaugaacca

SEQ ID NO: 1436864 - RNA, 19 nt, Homo sapiens
gaaaugagaucaccuuuac

SEQ ID NO: 1436865 - RNA, 19 nt, Homo sapiens
ugacagaugugcuuuauca

SEQ ID NO: 1436866 - RNA, 19 nt, Homo sapiens
ggaaagcagugacagaugu

SEQ ID NO: 1436867 - RNA, 19 nt, Homo sapiens
gaaggagguugcuacacua

SEQ ID NO: 1436868 - RNA, 19 nt, Homo sapiens
gaaauuggaugcauauucg

SEQ ID NO: 1436869 - RNA, 19 nt, Homo sapiens
ggaaaugagaucaccuuua

SEQ ID NO: 1436870 - RNA, 19 nt, Homo sapiens
ggacuuggaucaacaccuu

SEQ ID NO: 1436871 - RNA, 19 nt, Homo sapiens
gaagacagccaaacauuuc

SEQ ID NO: 1436872 - RNA, 19 nt, Homo sapiens
ggaaguacuccuaggauuu

SEQ ID NO: 1436873 - RNA, 19 nt, Homo sapiens
ccacaaccucgaucaauua

SEQ ID NO: 1436874 - RNA, 19 nt, Homo sapiens
gaucaacaccuuuaacuuc

SEQ ID NO: 1436875 - RNA, 19 nt, Homo sapiens
caaccucgaucaauuagug

SEQ ID NO: 1436876 - RNA, 19 nt, Homo sapiens
guuaggaucugaaccaaug

SEQ ID NO: 1436877 - RNA, 19 nt, Homo sapiens
gcaauggaguacauguuug

SEQ ID NO: 1436878 - RNA, 19 nt, Homo sapiens
gggaauaucuuaaaacaug

SEQ ID NO: 1436879 - RNA, 19 nt, Homo sapiens
ggaaauuggaugcauauuc

SEQ ID NO: 1436880 - RNA, 19 nt, Homo sapiens
gagaucaccuuuacuugca

SEQ ID NO: 1436881 - RNA, 19 nt, Homo sapiens
gagauucuuugacuucaga

SEQ ID NO: 1436882 - RNA, 19 nt, Homo sapiens
ccaaagcaauggaguacau

SEQ ID NO: 1436883 - RNA, 19 nt, Homo sapiens
ggaaagccuuaagcaaaga

SEQ ID NO: 1436884 - RNA, 19 nt, Homo sapiens
cagaagaucaccucgauga

SEQ ID NO: 1436885 - RNA, 19 nt, Homo sapiens
gguaguagaacaccaagaa

SEQ ID NO: 1436886 - RNA, 19 nt, Homo sapiens
acaggaaauuggaugcaua

SEQ ID NO: 1436887 - RNA, 19 nt, Homo sapiens
caugagaccucuugcuaca

SEQ ID NO: 1436888 - RNA, 19 nt, Homo sapiens
gcauauucguuaucaaucu

SEQ ID NO: 1436889 - RNA, 19 nt, Homo sapiens
uacaaagccucuacuagug

SEQ ID NO: 1436890 - RNA, 19 nt, Homo sapiens
gaaguacuccuaggauuuc

SEQ ID NO: 1436891 - RNA, 19 nt, Homo sapiens
ccuaggauuucuaccauga

SEQ ID NO: 1436892 - RNA, 19 nt, Homo sapiens
ggaugcauauucguuauca

SEQ ID NO: 1436893 - RNA, 19 nt, Homo sapiens
auuuguagcucgcacuuua

SEQ ID NO: 1436894 - RNA, 19 nt, Homo sapiens
aagcaaagaugggaggauu

SEQ ID NO: 1436895 - RNA, 19 nt, Homo sapiens
cagccaaacauuucaguaa

SEQ ID NO: 1436896 - RNA, 19 nt, Homo sapiens
ggagguugcuacacuaaaa

SEQ ID NO: 1436897 - RNA, 19 nt, Homo sapiens
gcauacaaagccucuacua

SEQ ID NO: 1436898 - RNA, 19 nt, Homo sapiens
ugacaaaaguguuauggaa

SEQ ID NO: 1436899 - RNA, 19 nt, Homo sapiens
cggaaagccuuaagcaaag

SEQ ID NO: 1436900 - RNA, 19 nt, Homo sapiens
ccaguuagaaguauauaug

SEQ ID NO: 1436901 - RNA, 19 nt, Homo sapiens
ugaaagucuuguauccaaa

SEQ ID NO: 1436902 - RNA, 19 nt, Homo sapiens
ucggaaagccuuaagcaaa

SEQ ID NO: 1436903 - RNA, 19 nt, Homo sapiens
caaggagauucuuugacuu

SEQ ID NO: 1436904 - RNA, 19 nt, Homo sapiens
guauuuggguuuccucaag

SEQ ID NO: 1436905 - RNA, 19 nt, Homo sapiens
ggaacagggcaaaguaugu

SEQ ID NO: 1436906 - RNA, 19 nt, Homo sapiens
agaaggagguugcuacacu

SEQ ID NO: 1436907 - RNA, 19 nt, Homo sapiens
ccacgaaagacgacauuau

SEQ ID NO: 1436908 - RNA, 19 nt, Homo sapiens
agaagacagccaaacauuu

SEQ ID NO: 1436909 - RNA, 19 nt, Homo sapiens
uaccagcucauaaagauaa

SEQ ID NO: 1436910 - RNA, 19 nt, Homo sapiens
uguaccagcucauaaagau

SEQ ID NO: 1436911 - RNA, 19 nt, Homo sapiens
gaaaacucagcauugauua

SEQ ID NO: 1436912 - RNA, 19 nt, Homo sapiens
cauuaaggauacaaccuau

SEQ ID NO: 1436913 - RNA, 19 nt, Homo sapiens
caaagccucuacuagugau

SEQ ID NO: 1436914 - RNA, 19 nt, Homo sapiens
uggaaguacuccuaggauu

SEQ ID NO: 1436915 - RNA, 19 nt, Homo sapiens
uccacaaccucgaucaauu

SEQ ID NO: 1436916 - RNA, 19 nt, Homo sapiens
auacaaagccucuacuagu

SEQ ID NO: 1436917 - RNA, 19 nt, Homo sapiens
caacacaaccuggaaguac

SEQ ID NO: 1436918 - RNA, 19 nt, Homo sapiens
gcaucugcuuccuacauau

SEQ ID NO: 1436919 - RNA, 19 nt, Homo sapiens
ucaagaagacagccaaaca

SEQ ID NO: 1436920 - RNA, 19 nt, Homo sapiens
guuuguauauguccuguca

SEQ ID NO: 1436921 - RNA, 19 nt, Homo sapiens
gaaagucuuguauccaaag

SEQ ID NO: 1436922 - RNA, 19 nt, Homo sapiens
caaccuggaaguacuccua

SEQ ID NO: 1436923 - RNA, 19 nt, Homo sapiens
guaaaaccauguauugaca

SEQ ID NO: 1436924 - RNA, 19 nt, Homo sapiens
gggcaaaguauguuuaguc

SEQ ID NO: 1436925 - RNA, 19 nt, Homo sapiens
caagaagacagccaaacau

SEQ ID NO: 1436926 - RNA, 19 nt, Homo sapiens
caacaccuuuaacuucaag

SEQ ID NO: 1436927 - RNA, 19 nt, Homo sapiens
ggaucaacaccuuuaacuu

SEQ ID NO: 1436928 - RNA, 19 nt, Homo sapiens
gaagaucaccucgaugacu

SEQ ID NO: 1436929 - RNA, 19 nt, Homo sapiens
caucaugauugguguaaaa

SEQ ID NO: 1436930 - RNA, 19 nt, Homo sapiens
caugugaugucuaauacag

SEQ ID NO: 1436931 - RNA, 19 nt, Homo sapiens
augaaagucuuguauccaa

SEQ ID NO: 1436932 - RNA, 19 nt, Homo sapiens
acucuugggugacuguauu

SEQ ID NO: 1436933 - RNA, 19 nt, Homo sapiens
aagaagacagccaaacauu

SEQ ID NO: 1436934 - RNA, 19 nt, Homo sapiens
ucauuaaggauacaaccua

SEQ ID NO: 1436935 - RNA, 19 nt, Homo sapiens
uaggauuucuaccaugaga

SEQ ID NO: 1436936 - RNA, 19 nt, Homo sapiens
gaaagcagugacagaugug

SEQ ID NO: 1436937 - RNA, 19 nt, Homo sapiens
guaccagcucauaaagaua

SEQ ID NO: 1436938 - RNA, 19 nt, Homo sapiens
gcacagaaaacucagcauu

SEQ ID NO: 1436939 - RNA, 19 nt, Homo sapiens
acaaagccucuacuaguga

SEQ ID NO: 1436940 - RNA, 19 nt, Homo sapiens
aaugagaucaccuuuacuu

SEQ ID NO: 1436941 - RNA, 19 nt, Homo sapiens
ucuaccgacacaaauauua

SEQ ID NO: 1436942 - RNA, 19 nt, Homo sapiens
acagaaaacucagcauuga

SEQ ID NO: 1436943 - RNA, 19 nt, Homo sapiens
gcaaagaugggaggauuuu

SEQ ID NO: 1436944 - RNA, 19 nt, Homo sapiens
gcuccaccaguuagaagua

SEQ ID NO: 1436945 - RNA, 19 nt, Homo sapiens
ggaagguacugguuuuaag

SEQ ID NO: 1436946 - RNA, 19 nt, Homo sapiens
ucaacaccuuuaacuucaa

SEQ ID NO: 1436947 - RNA, 19 nt, Homo sapiens
ggaguaauggaaaugagau

SEQ ID NO: 1436948 - RNA, 19 nt, Homo sapiens
ccaguuguaccagcucaua

SEQ ID NO: 1436949 - RNA, 19 nt, Homo sapiens
caagaaggagguugcuaca

SEQ ID NO: 1436950 - RNA, 19 nt, Homo sapiens
cacgaaagacgacauuauc

SEQ ID NO: 1436951 - RNA, 19 nt, Homo sapiens
agccaaacauuucaguaau

SEQ ID NO: 1436952 - RNA, 19 nt, Homo sapiens
guaggaguaauggaaauga

SEQ ID NO: 1436953 - RNA, 19 nt, Homo sapiens
ucaguaggaguaauggaaa

SEQ ID NO: 1436954 - RNA, 19 nt, Homo sapiens
gaucugaaccaaugaugcu

SEQ ID NO: 1436955 - RNA, 19 nt, Homo sapiens
ccaacacaaccuggaagua

SEQ ID NO: 1436956 - RNA, 19 nt, Homo sapiens
uaguggcccuucaguagga

SEQ ID NO: 1436957 - RNA, 19 nt, Homo sapiens
acagggcaaaguauguuua

SEQ ID NO: 1436958 - RNA, 19 nt, Homo sapiens
gaaaauuaauugggaaggu

SEQ ID NO: 1436959 - RNA, 19 nt, Homo sapiens
acucagcauugauuauugu

SEQ ID NO: 1436960 - RNA, 19 nt, Homo sapiens
aaaagaugcuugagauaca

SEQ ID NO: 1436961 - RNA, 19 nt, Homo sapiens
gaguuaaugcccaguucuu

SEQ ID NO: 1436962 - RNA, 19 nt, Homo sapiens
ccaaagccaggaguuaaug

SEQ ID NO: 1436963 - RNA, 19 nt, Homo sapiens
gcagugacagaugugcuuu

SEQ ID NO: 1436964 - RNA, 19 nt, Homo sapiens
gaagagagcuacuuauguu

SEQ ID NO: 1436965 - RNA, 19 nt, Homo sapiens
gaaagaggauguuauagga

SEQ ID NO: 1436966 - RNA, 19 nt, Homo sapiens
gaagcaaagucaaauagaa

SEQ ID NO: 1436967 - RNA, 19 nt, Homo sapiens
gaagaggucugaaaucauc

SEQ ID NO: 1436968 - RNA, 19 nt, Homo sapiens
ccaaggagaucccuaagaa

SEQ ID NO: 1436969 - RNA, 19 nt, Homo sapiens
gagaagaggucugaaauca

SEQ ID NO: 1436970 - RNA, 19 nt, Homo sapiens
ggaagaaugugcaagauag

SEQ ID NO: 1436971 - RNA, 19 nt, Homo sapiens
agaggaaucugcauuuaua

SEQ ID NO: 1436972 - RNA, 19 nt, Homo sapiens
caagaggaaucugcauuua

SEQ ID NO: 1436973 - RNA, 19 nt, Homo sapiens
agacaccacugcaaaguua

SEQ ID NO: 1436974 - RNA, 19 nt, Homo sapiens
gaaaccaggucucuaagug

SEQ ID NO: 1436975 - RNA, 19 nt, Homo sapiens
ggacaaauauacuguaaac

SEQ ID NO: 1436976 - RNA, 19 nt, Homo sapiens
gcagaucaguggacuuuau

SEQ ID NO: 1436977 - RNA, 19 nt, Homo sapiens
acaagaaagucguacauuu

SEQ ID NO: 1436978 - RNA, 19 nt, Homo sapiens
gaaauaaacccacuagucu

SEQ ID NO: 1436979 - RNA, 19 nt, Homo sapiens
gagaaaagauuccuguuaa

SEQ ID NO: 1436980 - RNA, 19 nt, Homo sapiens
caggauggcugauaaguga

SEQ ID NO: 1436981 - RNA, 19 nt, Homo sapiens
ggauuaacaucuuuaggaa

SEQ ID NO: 1436982 - RNA, 19 nt, Homo sapiens
gaaauaaacagaugguuca

SEQ ID NO: 1436983 - RNA, 19 nt, Homo sapiens
gaaaaugccugaaggaaga

SEQ ID NO: 1436984 - RNA, 19 nt, Homo sapiens
gcaagagaguggaagaguu

SEQ ID NO: 1436985 - RNA, 19 nt, Homo sapiens
gaaacaucauccaaaguau

SEQ ID NO: 1436986 - RNA, 19 nt, Homo sapiens
gaagaacugcaacagauuu

SEQ ID NO: 1436987 - RNA, 19 nt, Homo sapiens
ggaggaauuuggauuaaca

SEQ ID NO: 1436988 - RNA, 19 nt, Homo sapiens
ggacuaaauuccacugauc

SEQ ID NO: 1436989 - RNA, 19 nt, Homo sapiens
gaaggaagaaugugcaaga

SEQ ID NO: 1436990 - RNA, 19 nt, Homo sapiens
ucagaaagaggauguuaua

SEQ ID NO: 1436991 - RNA, 19 nt, Homo sapiens
caagaucacuuuccauuuu

SEQ ID NO: 1436992 - RNA, 19 nt, Homo sapiens
gacauaagcagcauaaaga

SEQ ID NO: 1436993 - RNA, 19 nt, Homo sapiens
ugaaacaucauccaaagua

SEQ ID NO: 1436994 - RNA, 19 nt, Homo sapiens
ggaaauaaacccacuaguc

SEQ ID NO: 1436995 - RNA, 19 nt, Homo sapiens
gagugaagcugaagacaca

SEQ ID NO: 1436996 - RNA, 19 nt, Homo sapiens
gugaaucucugcuagaaga

SEQ ID NO: 1436997 - RNA, 19 nt, Homo sapiens
guucaugucagcaauaaua

SEQ ID NO: 1436998 - RNA, 19 nt, Homo sapiens
caagucuucucuaauacua

SEQ ID NO: 1436999 - RNA, 19 nt, Homo sapiens
gugaagaacugcaacagau

SEQ ID NO: 1437000 - RNA, 19 nt, Homo sapiens
caagagaguggaagaguuu

SEQ ID NO: 1437001 - RNA, 19 nt, Homo sapiens
uaaggaggaauuuggauua

SEQ ID NO: 1437002 - RNA, 19 nt, Homo sapiens
gagaagagagcuacuuaug

SEQ ID NO: 1437003 - RNA, 19 nt, Homo sapiens
ucaguggacuuuauuccua

SEQ ID NO: 1437004 - RNA, 19 nt, Homo sapiens
gaaaugacaacccugcuau

SEQ ID NO: 1437005 - RNA, 19 nt, Homo sapiens
gaaauuaugcaucacuuca

SEQ ID NO: 1437006 - RNA, 19 nt, Homo sapiens
gaacaaaucuuucuuuucc

SEQ ID NO: 1437007 - RNA, 19 nt, Homo sapiens
aaagacaguuuauccaaug

SEQ ID NO: 1437008 - RNA, 19 nt, Homo sapiens
gaaucugcauuuauaagug

SEQ ID NO: 1437009 - RNA, 19 nt, Homo sapiens
gaaacaaaccauaacauac

SEQ ID NO: 1437010 - RNA, 19 nt, Homo sapiens
acacuucgucgucaaauua

SEQ ID NO: 1437011 - RNA, 19 nt, Homo sapiens
aaagugcuauggaucuuaa

SEQ ID NO: 1437012 - RNA, 19 nt, Homo sapiens
gcuagaagauguuagaacu

SEQ ID NO: 1437013 - RNA, 19 nt, Homo sapiens
ggacuuuauuccuaaugaa

SEQ ID NO: 1437014 - RNA, 19 nt, Homo sapiens
ggacauaagcagcauaaag

SEQ ID NO: 1437015 - RNA, 19 nt, Homo sapiens
gaacagaaaacccuacuaa

SEQ ID NO: 1437016 - RNA, 19 nt, Homo sapiens
gacaagaucacuuuccauu

SEQ ID NO: 1437017 - RNA, 19 nt, Homo sapiens
ugauucaccuaaagaagua

SEQ ID NO: 1437018 - RNA, 19 nt, Homo sapiens
gaaacaagucuucucuaau

SEQ ID NO: 1437019 - RNA, 19 nt, Homo sapiens
gcugauaagugaagauaag

SEQ ID NO: 1437020 - RNA, 19 nt, Homo sapiens
gauguuagaacuccagaaa

SEQ ID NO: 1437021 - RNA, 19 nt, Homo sapiens
caucaugucuccugcaaca

SEQ ID NO: 1437022 - RNA, 19 nt, Homo sapiens
uaagagagaauaugcaguu

SEQ ID NO: 1437023 - RNA, 19 nt, Homo sapiens
uagaagaguuuaugcaaag

SEQ ID NO: 1437024 - RNA, 19 nt, Homo sapiens
gaauaugcaguucacauug

SEQ ID NO: 1437025 - RNA, 19 nt, Homo sapiens
gaagauaagagagaauaug

SEQ ID NO: 1437026 - RNA, 19 nt, Homo sapiens
gaagaaccaaauaugugua

SEQ ID NO: 1437027 - RNA, 19 nt, Homo sapiens
ugaaaguuaugaugcaguu

SEQ ID NO: 1437028 - RNA, 19 nt, Homo sapiens
ccaaaggaaauuaugauga

SEQ ID NO: 1437029 - RNA, 19 nt, Homo sapiens
ccaagaggaaucugcauuu

SEQ ID NO: 1437030 - RNA, 19 nt, Homo sapiens
caaaagacguggcaagaga

SEQ ID NO: 1437031 - RNA, 19 nt, Homo sapiens
cccaggaucugcucugaaa

SEQ ID NO: 1437032 - RNA, 19 nt, Homo sapiens
ccacuagucuugaugaaac

SEQ ID NO: 1437033 - RNA, 19 nt, Homo sapiens
gaagggcaaaggaaugauu

SEQ ID NO: 1437034 - RNA, 19 nt, Homo sapiens
ggucugaaaucaucauguc

SEQ ID NO: 1437035 - RNA, 19 nt, Homo sapiens
guagagaagaggucugaaa

SEQ ID NO: 1437036 - RNA, 19 nt, Homo sapiens
ucaaagacaccacugcaaa

SEQ ID NO: 1437037 - RNA, 19 nt, Homo sapiens
gaaauucacagagcaaaca

SEQ ID NO: 1437038 - RNA, 19 nt, Homo sapiens
cuauggaucuuaaugacaa

SEQ ID NO: 1437039 - RNA, 19 nt, Homo sapiens
caagauaggccgagugaag

SEQ ID NO: 1437040 - RNA, 19 nt, Homo sapiens
cauaagcagcauaaagaua

SEQ ID NO: 1437041 - RNA, 19 nt, Homo sapiens
gaaaacccaucaggaaauu

SEQ ID NO: 1437042 - RNA, 19 nt, Homo sapiens
aagauaugcuuguguccua

SEQ ID NO: 1437043 - RNA, 19 nt, Homo sapiens
acauugccauggagaauaa

SEQ ID NO: 1437044 - RNA, 19 nt, Homo sapiens
acacaaagaguaacaggaa

SEQ ID NO: 1437045 - RNA, 19 nt, Homo sapiens
gcugaagacacaaagagua

SEQ ID NO: 1437046 - RNA, 19 nt, Homo sapiens
gcccgacacugaaaguuau

SEQ ID NO: 1437047 - RNA, 19 nt, Homo sapiens
agcaagagauuacacagaa

SEQ ID NO: 1437048 - RNA, 19 nt, Homo sapiens
gggaaauuaugcaucacuu

SEQ ID NO: 1437049 - RNA, 19 nt, Homo sapiens
gaaugacccugaaaaugaa

SEQ ID NO: 1437050 - RNA, 19 nt, Homo sapiens
cauccaaaguaucuaaugu

SEQ ID NO: 1437051 - RNA, 19 nt, Homo sapiens
gauaagugaagauaagaga

SEQ ID NO: 1437052 - RNA, 19 nt, Homo sapiens
gagauuacacagaacaaau

SEQ ID NO: 1437053 - RNA, 19 nt, Homo sapiens
gaugagaaccaccuuccaa

SEQ ID NO: 1437054 - RNA, 19 nt, Homo sapiens
gaaaaccucuucaucacau

SEQ ID NO: 1437055 - RNA, 19 nt, Homo sapiens
guaaggaggaauuuggauu

SEQ ID NO: 1437056 - RNA, 19 nt, Homo sapiens
ggagaaacaaaccauaaca

SEQ ID NO: 1437057 - RNA, 19 nt, Homo sapiens
caagacaaggaaauaugua

SEQ ID NO: 1437058 - RNA, 19 nt, Homo sapiens
ggaaucugcauuuauaagu

SEQ ID NO: 1437059 - RNA, 19 nt, Homo sapiens
caagaaagucguacauuuu

SEQ ID NO: 1437060 - RNA, 19 nt, Homo sapiens
aaacccaucaggaaauuaa

SEQ ID NO: 1437061 - RNA, 19 nt, Homo sapiens
ugaagcaacuguucguagu

SEQ ID NO: 1437062 - RNA, 19 nt, Homo sapiens
gaagacacaaagaguaaca

SEQ ID NO: 1437063 - RNA, 19 nt, Homo sapiens
gcuccaagacaaggaaaua

SEQ ID NO: 1437064 - RNA, 19 nt, Homo sapiens
gaaaggauguugcagauau

SEQ ID NO: 1437065 - RNA, 19 nt, Homo sapiens
gcaagagaauugauacaaa

SEQ ID NO: 1437066 - RNA, 19 nt, Homo sapiens
ggcaaagggucuagaauaa

SEQ ID NO: 1437067 - RNA, 19 nt, Homo sapiens
ggaaagauacaucagauuu

SEQ ID NO: 1437068 - RNA, 19 nt, Homo sapiens
gagggcagcugaagagaaa

SEQ ID NO: 1437069 - RNA, 19 nt, Homo sapiens
ggaccacucuuuaacauuc

SEQ ID NO: 1437070 - RNA, 19 nt, Homo sapiens
gauagugacuuggauuauu

SEQ ID NO: 1437071 - RNA, 19 nt, Homo sapiens
ugaagcuggugauguauua

SEQ ID NO: 1437072 - RNA, 19 nt, Homo sapiens
ucucauugcucuaaaguaa

SEQ ID NO: 1437073 - RNA, 19 nt, Homo sapiens
gagaauccauccacucaug

SEQ ID NO: 1437074 - RNA, 19 nt, Homo sapiens
gagcaacgcacaauaucua

SEQ ID NO: 1437075 - RNA, 19 nt, Homo sapiens
ucaguaaugucaucaagaa

SEQ ID NO: 1437076 - RNA, 19 nt, Homo sapiens
agaaugugcugcaguguuu

SEQ ID NO: 1437077 - RNA, 19 nt, Homo sapiens
caugaaaucuauugacaga

SEQ ID NO: 1437078 - RNA, 19 nt, Homo sapiens
ccacagaacuuuaccuuuu

SEQ ID NO: 1437079 - RNA, 19 nt, Homo sapiens
gagaugcccaguauuuaua

SEQ ID NO: 1437080 - RNA, 19 nt, Homo sapiens
caagagaauugauacaaag

SEQ ID NO: 1437081 - RNA, 19 nt, Homo sapiens
ccacucauguccuauaaau

SEQ ID NO: 1437082 - RNA, 19 nt, Homo sapiens
gcacauuaacacuuuagua

SEQ ID NO: 1437083 - RNA, 19 nt, Homo sapiens
ggugauguauuauucauuc

SEQ ID NO: 1437084 - RNA, 19 nt, Homo sapiens
cagaaguacugaauauaga

SEQ ID NO: 1437085 - RNA, 19 nt, Homo sapiens
gacaaagccuacagcaaga

SEQ ID NO: 1437086 - RNA, 19 nt, Homo sapiens
uuacaacuauggacucauu

SEQ ID NO: 1437087 - RNA, 19 nt, Homo sapiens
cuccuuaguuuacacauua

SEQ ID NO: 1437088 - RNA, 19 nt, Homo sapiens
caucuaaagcaaucucuua

SEQ ID NO: 1437089 - RNA, 19 nt, Homo sapiens
guuaaagauuucccaacua

SEQ ID NO: 1437090 - RNA, 19 nt, Homo sapiens
aucaagagcugcacaaauu

SEQ ID NO: 1437091 - RNA, 19 nt, Homo sapiens
aaacagauaccuauggaaa

SEQ ID NO: 1437092 - RNA, 19 nt, Homo sapiens
ccuugaagcuggugaugua

SEQ ID NO: 1437093 - RNA, 19 nt, Homo sapiens
cgaauuaguucaccaggau

SEQ ID NO: 1437094 - RNA, 19 nt, Homo sapiens
gagaagacccuagaaagga

SEQ ID NO: 1437095 - RNA, 19 nt, Homo sapiens
ggaugagaaauacuacuua

SEQ ID NO: 1437096 - RNA, 19 nt, Homo sapiens
auaccuaggucccaacuuu

SEQ ID NO: 1437097 - RNA, 19 nt, Homo sapiens
gaaaucuauugacagaaug

SEQ ID NO: 1437098 - RNA, 19 nt, Homo sapiens
uaauacaagugacaggaaa

SEQ ID NO: 1437099 - RNA, 19 nt, Homo sapiens
ucaccaggauuacaacuau

SEQ ID NO: 1437100 - RNA, 19 nt, Homo sapiens
gcuagaagauaugaauguu

SEQ ID NO: 1437101 - RNA, 19 nt, Homo sapiens
agaauucacuuuccauauc

SEQ ID NO: 1437102 - RNA, 19 nt, Homo sapiens
ucaagaguguuugggauuu

SEQ ID NO: 1437103 - RNA, 19 nt, Homo sapiens
gaugagaaauacuacuuac

SEQ ID NO: 1437104 - RNA, 19 nt, Homo sapiens
gauuugguauaggaacuua

SEQ ID NO: 1437105 - RNA, 19 nt, Homo sapiens
uagaaaggauguugcagau

SEQ ID NO: 1437106 - RNA, 19 nt, Homo sapiens
uggcaaagggucuagaaua

SEQ ID NO: 1437107 - RNA, 19 nt, Homo sapiens
ggaagagucaggcuggauu

SEQ ID NO: 1437108 - RNA, 19 nt, Homo sapiens
ccaucugaaugcuaugaua

SEQ ID NO: 1437109 - RNA, 19 nt, Homo sapiens
gaacuuaauagaccucaca

SEQ ID NO: 1437110 - RNA, 19 nt, Homo sapiens
acccagacuuggcuaaaua

SEQ ID NO: 1437111 - RNA, 19 nt, Homo sapiens
ggagaagacccuagaaagg

SEQ ID NO: 1437112 - RNA, 19 nt, Homo sapiens
ccuugugcaucuucauuua

SEQ ID NO: 1437113 - RNA, 19 nt, Homo sapiens
ggauucuacuugauacaga

SEQ ID NO: 1437114 - RNA, 19 nt, Homo sapiens
guauaaauccagagucaug

SEQ ID NO: 1437115 - RNA, 19 nt, Homo sapiens
aaagcaaucucuuaguaca

SEQ ID NO: 1437116 - RNA, 19 nt, Homo sapiens
ccacaacauuggcaucauc

SEQ ID NO: 1437117 - RNA, 19 nt, Homo sapiens
cagcugaagagaaacauaa

SEQ ID NO: 1437118 - RNA, 19 nt, Homo sapiens
caagaguguuugggauuug

SEQ ID NO: 1437119 - RNA, 19 nt, Homo sapiens
gagucaggcuggauucuag

SEQ ID NO: 1437120 - RNA, 19 nt, Homo sapiens
caacauuggcaucauccua

SEQ ID NO: 1437121 - RNA, 19 nt, Homo sapiens
uaggaaagauacaucagau

SEQ ID NO: 1437122 - RNA, 19 nt, Homo sapiens
cgaagacagugagccauug

SEQ ID NO: 1437123 - RNA, 19 nt, Homo sapiens
gugcugggaccacucuuua

SEQ ID NO: 1437124 - RNA, 19 nt, Homo sapiens
cauuaacacuuuaguaagg

SEQ ID NO: 1437125 - RNA, 19 nt, Homo sapiens
ggucuagaauaaccuuuag

SEQ ID NO: 1437126 - RNA, 19 nt, Homo sapiens
gaaaacacuggccgaguua

SEQ ID NO: 1437127 - RNA, 19 nt, Homo sapiens
cagaggaugagaaauacua

SEQ ID NO: 1437128 - RNA, 19 nt, Homo sapiens
ggacagaaaggauaguuuu

SEQ ID NO: 1437129 - RNA, 19 nt, Homo sapiens
ccagaauucacuuuccaua

SEQ ID NO: 1437130 - RNA, 19 nt, Homo sapiens
ggacagagccuugaaaaca

SEQ ID NO: 1437131 - RNA, 19 nt, Homo sapiens
acagauaccuauggaaaca

SEQ ID NO: 1437132 - RNA, 19 nt, Homo sapiens
uuacucaggugaauaaagg

SEQ ID NO: 1437133 - RNA, 19 nt, Homo sapiens
gaauuuccuaggugucuuu

SEQ ID NO: 1437134 - RNA, 19 nt, Homo sapiens
guacaucaauuuggugcau

SEQ ID NO: 1437135 - RNA, 19 nt, Homo sapiens
gguauaggaacuuaauaga

SEQ ID NO: 1437136 - RNA, 19 nt, Homo sapiens
caucugaaugcuaugauaa

SEQ ID NO: 1437137 - RNA, 19 nt, Homo sapiens
cgagaugcccaguauuuau

SEQ ID NO: 1437138 - RNA, 19 nt, Homo sapiens
gauuacaacuauggacuca

SEQ ID NO: 1437139 - RNA, 19 nt, Homo sapiens
caaagggucuagaauaacc

SEQ ID NO: 1437140 - RNA, 19 nt, Homo sapiens
cagauuauguaaguacgaa

SEQ ID NO: 1437141 - RNA, 19 nt, Homo sapiens
gauaugaauguucccuuga

SEQ ID NO: 1437142 - RNA, 19 nt, Homo sapiens
aaguauaaauccagaguca

SEQ ID NO: 1437143 - RNA, 19 nt, Homo sapiens
gaucucugcuuuuguuuug

SEQ ID NO: 1437144 - RNA, 19 nt, Homo sapiens
ggaggccacaugagggaua

SEQ ID NO: 1437145 - RNA, 19 nt, Homo sapiens
gaacuucuuuacugauucc

SEQ ID NO: 1437146 - RNA, 19 nt, Homo sapiens
guguguggaucucugcuuu

SEQ ID NO: 1437147 - RNA, 19 nt, Homo sapiens
gaugauagugacuuggauu

SEQ ID NO: 1437148 - RNA, 19 nt, Homo sapiens
cagcaccucuacccacaga

SEQ ID NO: 1437149 - RNA, 19 nt, Homo sapiens
caugagcaacgcacaauau

SEQ ID NO: 1437150 - RNA, 19 nt, Homo sapiens
gggucuagaauaaccuuua

SEQ ID NO: 1437151 - RNA, 19 nt, Homo sapiens
gaauucacuuuccauaucc

SEQ ID NO: 1437152 - RNA, 19 nt, Homo sapiens
cgaguuaccagaggaauau

SEQ ID NO: 1437153 - RNA, 19 nt, Homo sapiens
agauaccuauggaaacaaa

SEQ ID NO: 1437154 - RNA, 19 nt, Homo sapiens
ggagugggagugaauaucu

SEQ ID NO: 1437155 - RNA, 19 nt, Homo sapiens
uuuggaaacagguaaguua

SEQ ID NO: 1437156 - RNA, 19 nt, Homo sapiens
acaucaauuuggugcauuu

SEQ ID NO: 1437157 - RNA, 19 nt, Homo sapiens
gaagacagugagccauugu

SEQ ID NO: 1437158 - RNA, 19 nt, Homo sapiens
aaaguguugucaucgaaga

SEQ ID NO: 1437159 - RNA, 19 nt, Homo sapiens
ugaaaacacuggccgaguu

SEQ ID NO: 1437160 - RNA, 19 nt, Homo sapiens
gagugggagugaauaucuu

SEQ ID NO: 1437161 - RNA, 19 nt, Homo sapiens
caacuauggacucauuaug

SEQ ID NO: 1437162 - RNA, 19 nt, Homo sapiens
agacaaaacucuccuuagu

SEQ ID NO: 1437163 - RNA, 19 nt, Homo sapiens
ggauguugcagauaucaga

SEQ ID NO: 1437164 - RNA, 19 nt, Homo sapiens
caagagacauggcuucuaa

SEQ ID NO: 1437165 - RNA, 19 nt, Homo sapiens
gaacaggacccuauauaaa

SEQ ID NO: 1437166 - RNA, 19 nt, Homo sapiens
ccaagaccaugaucacaua

SEQ ID NO: 1437167 - RNA, 19 nt, Homo sapiens
ugccauaccuccugaaaua

SEQ ID NO: 1437168 - RNA, 19 nt, Homo sapiens
gaggagcacugacugaaga

SEQ ID NO: 1437169 - RNA, 19 nt, Homo sapiens
ccaaguaccucaagagaca

SEQ ID NO: 1437170 - RNA, 19 nt, Homo sapiens
gagaacaggacccuauaua

SEQ ID NO: 1437171 - RNA, 19 nt, Homo sapiens
agacauggcuucuaacauc

SEQ ID NO: 1437172 - RNA, 19 nt, Homo sapiens
aggaugagaugaacacuuu

SEQ ID NO: 1437173 - RNA, 19 nt, Homo sapiens
uaugcagccucaaauguua

SEQ ID NO: 1437174 - RNA, 19 nt, Homo sapiens
cgugaucgcuggugucuug

SEQ ID NO: 1437175 - RNA, 19 nt, Homo sapiens
ugucauaaaucucuccaaa

SEQ ID NO: 1437176 - RNA, 19 nt, Homo sapiens
cauuaugccuuacaaacuu

SEQ ID NO: 1437177 - RNA, 19 nt, Homo sapiens
acacagugcuuugggaauu

SEQ ID NO: 1437178 - RNA, 19 nt, Homo sapiens
caagagaacaggacccuau

SEQ ID NO: 1437179 - RNA, 19 nt, Homo sapiens
aaucugaguuugaccuaaa

SEQ ID NO: 1437180 - RNA, 19 nt, Homo sapiens
ccucaaauguuacacagau

SEQ ID NO: 1437181 - RNA, 19 nt, Homo sapiens
gaaucugaguuugaccuaa

SEQ ID NO: 1437182 - RNA, 19 nt, Homo sapiens
cugaaaggcuggcugaaau

SEQ ID NO: 1437183 - RNA, 19 nt, Homo sapiens
agaacaggacccuauauaa

SEQ ID NO: 1437184 - RNA, 19 nt, Homo sapiens
ucacauaugcagccucaaa

SEQ ID NO: 1437185 - RNA, 19 nt, Homo sapiens
cugauggacuugucugaaa

SEQ ID NO: 1437186 - RNA, 19 nt, Homo sapiens
ugaaaggcuggcugaaaua

SEQ ID NO: 1437187 - RNA, 19 nt, Homo sapiens
gcugugacuucugcaauga

SEQ ID NO: 1437188 - RNA, 19 nt, Homo sapiens
gaccugagcugugacuucu

SEQ ID NO: 1437189 - RNA, 19 nt, Homo sapiens
gaagucucccggugacaaa

SEQ ID NO: 1437190 - RNA, 19 nt, Homo sapiens
ggaguucgugcuucugaaa

SEQ ID NO: 1437191 - RNA, 19 nt, Homo sapiens
gaaucacauuaaaggaaga

SEQ ID NO: 1437192 - RNA, 19 nt, Homo sapiens
uggagcaucuugugggauu

SEQ ID NO: 1437193 - RNA, 19 nt, Homo sapiens
caaaauaggaugagaugaa

SEQ ID NO: 1437194 - RNA, 19 nt, Homo sapiens
gaaaggcuggcugaaauag

SEQ ID NO: 1437195 - RNA, 19 nt, Homo sapiens
gaugaacacuuuuaacaag

SEQ ID NO: 1437196 - RNA, 19 nt, Homo sapiens
acaggacccuauauaaauc

SEQ ID NO: 1437197 - RNA, 19 nt, Homo sapiens
ggaaucugaguuugaccua

SEQ ID NO: 1437198 - RNA, 19 nt, Homo sapiens
aaacuuacacagugcuuug

SEQ ID NO: 1437199 - RNA, 19 nt, Homo sapiens
ggaagucucccggugacaa

SEQ ID NO: 1437200 - RNA, 19 nt, Homo sapiens
gaacugaagaagacauggu

SEQ ID NO: 1437201 - RNA, 19 nt, Homo sapiens
ggaccugagcugugacuuc

SEQ ID NO: 1437202 - RNA, 19 nt, Homo sapiens
cauaccuccugaaauauca

SEQ ID NO: 1437203 - RNA, 19 nt, Homo sapiens
aacaggacccuauauaaau

SEQ ID NO: 1437204 - RNA, 19 nt, Homo sapiens
gaugagaugaacacuuuua

SEQ ID NO: 1437205 - RNA, 19 nt, Homo sapiens
cugaaguucugacuacuag

SEQ ID NO: 1437206 - RNA, 19 nt, Homo sapiens
gguccauuaugccuuacaa

SEQ ID NO: 1437207 - RNA, 19 nt, Homo sapiens
cauaugcagccucaaaugu

SEQ ID NO: 1437208 - RNA, 19 nt, Homo sapiens
gacauggcuucuaacaucu

SEQ ID NO: 1437209 - RNA, 19 nt, Homo sapiens
uagccaagggcaccuguaa

SEQ ID NO: 1437210 - RNA, 19 nt, Homo sapiens
gcauggauccugccgugau

SEQ ID NO: 1437211 - RNA, 19 nt, Homo sapiens
gaaauagacaugccauacc

SEQ ID NO: 1437212 - RNA, 19 nt, Homo sapiens
aaauagacaugccauaccu

SEQ ID NO: 1437213 - RNA, 19 nt, Homo sapiens
gagaugaacacuuuuaaca

SEQ ID NO: 1437214 - RNA, 19 nt, Homo sapiens
uugaugaacugaagaagac

SEQ ID NO: 1437215 - RNA, 19 nt, Homo sapiens
aagagaacaggacccuaua

SEQ ID NO: 1437216 - RNA, 19 nt, Homo sapiens
cucaaauguuacacagaua

SEQ ID NO: 1437217 - RNA, 19 nt, Homo sapiens
gagcugugacuucugcaau

SEQ ID NO: 1437218 - RNA, 19 nt, Homo sapiens
ugaaauagacaugccauac

SEQ ID NO: 1437219 - RNA, 19 nt, Homo sapiens
ggacaccccuggagcaucu

SEQ ID NO: 1437220 - RNA, 19 nt, Homo sapiens
gaagaauuuugaccugcaa

SEQ ID NO: 1437221 - RNA, 19 nt, Homo sapiens
ggaggagcacugacugaag

SEQ ID NO: 1437222 - RNA, 19 nt, Homo sapiens
ugacuacuagaaucaaaga

SEQ ID NO: 1437223 - RNA, 19 nt, Homo sapiens
cgagccaaguaccucaaga

SEQ ID NO: 1437224 - RNA, 19 nt, Homo sapiens
gaacacuuuuaacaagaga

SEQ ID NO: 1437225 - RNA, 19 nt, Homo sapiens
ucugacuacuagaaucaaa

SEQ ID NO: 1437226 - RNA, 19 nt, Homo sapiens
gcaaaccauuggccaaaag

SEQ ID NO: 1437227 - RNA, 19 nt, Homo sapiens
gaagacgucacggccugaa

SEQ ID NO: 1437228 - RNA, 19 nt, Homo sapiens
ugauggacuugucugaaag

SEQ ID NO: 1437229 - RNA, 19 nt, Homo sapiens
gccaagggcaccuguaacu

SEQ ID NO: 1437230 - RNA, 19 nt, Homo sapiens
ucaagagacauggcuucua

SEQ ID NO: 1437231 - RNA, 19 nt, Homo sapiens
ucucagguuucccagacaa

SEQ ID NO: 1437232 - RNA, 19 nt, Homo sapiens
ucugaaaggcuggcugaaa

SEQ ID NO: 1437233 - RNA, 19 nt, Homo sapiens
caaacuuacacagugcuuu

SEQ ID NO: 1437234 - RNA, 19 nt, Homo sapiens
agaccaugaucacauaugc

SEQ ID NO: 1437235 - RNA, 19 nt, Homo sapiens
cuucugcaaugauguccuu

SEQ ID NO: 1437236 - RNA, 19 nt, Homo sapiens
ugugacuucugcaaugaug

SEQ ID NO: 1437237 - RNA, 19 nt, Homo sapiens
ccauaccuccugaaauauc

SEQ ID NO: 1437238 - RNA, 19 nt, Homo sapiens
ggagcaucuugugggauug

SEQ ID NO: 1437239 - RNA, 19 nt, Homo sapiens
gcacugacugaagacagaa

SEQ ID NO: 1437240 - RNA, 19 nt, Homo sapiens
gagacauggcuucuaacau

SEQ ID NO: 1437241 - RNA, 19 nt, Homo sapiens
gguggacucugugccuaca

SEQ ID NO: 1437242 - RNA, 19 nt, Homo sapiens
gcucucaagcucccacauc

SEQ ID NO: 1437243 - RNA, 19 nt, Homo sapiens
auaugcagccucaaauguu

SEQ ID NO: 1437244 - RNA, 19 nt, Homo sapiens
gagccaaguaccucaagag

SEQ ID NO: 1437245 - RNA, 19 nt, Homo sapiens
gucacggccugaacuacug

SEQ ID NO: 1437246 - RNA, 19 nt, Homo sapiens
gacgucacggccugaacua

SEQ ID NO: 1437247 - RNA, 19 nt, Homo sapiens
ccauuaugccuuacaaacu

SEQ ID NO: 1437248 - RNA, 19 nt, Homo sapiens
gagccagaucgucaucaug

SEQ ID NO: 1437249 - RNA, 19 nt, Homo sapiens
gaaauuagguucaacaaug

SEQ ID NO: 1437250 - RNA, 19 nt, Homo sapiens
gaggagaacuuccagaauu

SEQ ID NO: 1437251 - RNA, 19 nt, Homo sapiens
gaaggggacuugauuauuu

SEQ ID NO: 1437252 - RNA, 19 nt, Homo sapiens
uaagagaccauguaaagua

SEQ ID NO: 1437253 - RNA, 19 nt, Homo sapiens
aacaauggauggaugauua

SEQ ID NO: 1437254 - RNA, 19 nt, Homo sapiens
ggugguagccuaauuugua

SEQ ID NO: 1437255 - RNA, 19 nt, Homo sapiens
caacagguuucaguuauga

SEQ ID NO: 1437256 - RNA, 19 nt, Homo sapiens
ggacagagcggaaaacaua

SEQ ID NO: 1437257 - RNA, 19 nt, Homo sapiens
guagaggccugcaagaaau

SEQ ID NO: 1437258 - RNA, 19 nt, Homo sapiens
gcaacagguuucaguuaug

SEQ ID NO: 1437259 - RNA, 19 nt, Homo sapiens
aggagaacuuccagaauua

SEQ ID NO: 1437260 - RNA, 19 nt, Homo sapiens
ugaaagguaccaaagauaa

SEQ ID NO: 1437261 - RNA, 19 nt, Homo sapiens
gaaacaacaguagacauuu

SEQ ID NO: 1437262 - RNA, 19 nt, Homo sapiens
auacaugaccgagaaauua

SEQ ID NO: 1437263 - RNA, 19 nt, Homo sapiens
gagcaagugcagcaaagua

SEQ ID NO: 1437264 - RNA, 19 nt, Homo sapiens
cgcaggcucugguguguua

SEQ ID NO: 1437265 - RNA, 19 nt, Homo sapiens
aagagaccauguaaaguaa

SEQ ID NO: 1437266 - RNA, 19 nt, Homo sapiens
gaagagaaugcaacagguu

SEQ ID NO: 1437267 - RNA, 19 nt, Homo sapiens
ugaaacaacaguagacauu

SEQ ID NO: 1437268 - RNA, 19 nt, Homo sapiens
gaaagguaccaaagauaau

SEQ ID NO: 1437269 - RNA, 19 nt, Homo sapiens
gaugggugguagccuaauu

SEQ ID NO: 1437270 - RNA, 19 nt, Homo sapiens
gaagauccuuauauuagac

SEQ ID NO: 1437271 - RNA, 19 nt, Homo sapiens
guucaauacucuucuucaa

SEQ ID NO: 1437272 - RNA, 19 nt, Homo sapiens
uuacagaaguuuggauaga

SEQ ID NO: 1437273 - RNA, 19 nt, Homo sapiens
ugagacaguuacagaaguu

SEQ ID NO: 1437274 - RNA, 19 nt, Homo sapiens
gcaagaaauagaagaguca

SEQ ID NO: 1437275 - RNA, 19 nt, Homo sapiens
ggauggaugauuaagauug

SEQ ID NO: 1437276 - RNA, 19 nt, Homo sapiens
gauggaugauuaagauugg

SEQ ID NO: 1437277 - RNA, 19 nt, Homo sapiens
ggagugcuguuggaaguuc

SEQ ID NO: 1437278 - RNA, 19 nt, Homo sapiens
ccaaagauaauacuaagag

SEQ ID NO: 1437279 - RNA, 19 nt, Homo sapiens
gugguagccuaauuuguau

SEQ ID NO: 1437280 - RNA, 19 nt, Homo sapiens
caucagcuguauaacuuuc

SEQ ID NO: 1437281 - RNA, 19 nt, Homo sapiens
cucaucagcuguauaacuu

SEQ ID NO: 1437282 - RNA, 19 nt, Homo sapiens
cggaaaacauaaagaagua

SEQ ID NO: 1437283 - RNA, 19 nt, Homo sapiens
ucugaaagguaccaaagau

SEQ ID NO: 1437284 - RNA, 19 nt, Homo sapiens
gacauacucaucagcugua

SEQ ID NO: 1437285 - RNA, 19 nt, Homo sapiens
uacagaaguuuggauagaa

SEQ ID NO: 1437286 - RNA, 19 nt, Homo sapiens
ggaggagaacuuccagaau

SEQ ID NO: 1437287 - RNA, 19 nt, Homo sapiens
ugcaacagguuucaguuau

SEQ ID NO: 1437288 - RNA, 19 nt, Homo sapiens
caacaauggauggaugauu

SEQ ID NO: 1437289 - RNA, 19 nt, Homo sapiens
aaauuagguucaacaaugg

SEQ ID NO: 1437290 - RNA, 19 nt, Homo sapiens
gagaaauuagguucaacaa

SEQ ID NO: 1437291 - RNA, 19 nt, Homo sapiens
guuggaaguucaauacucu

SEQ ID NO: 1437292 - RNA, 19 nt, Homo sapiens
gcaagugcagcaaaguaga

SEQ ID NO: 1437293 - RNA, 19 nt, Homo sapiens
gcuaaagcgggcaguagaa

SEQ ID NO: 1437294 - RNA, 19 nt, Homo sapiens
uuaaugagacaguuacaga

SEQ ID NO: 1437295 - RNA, 19 nt, Homo sapiens
ccagaauuauggcgaaguc

SEQ ID NO: 1437296 - RNA, 19 nt, Homo sapiens
ggaugaaggcauugagcaa

SEQ ID NO: 1437297 - RNA, 19 nt, Homo sapiens
cuguauaacuuucuucgau

SEQ ID NO: 1437298 - RNA, 19 nt, Homo sapiens
gaaugcaacagguuucagu

SEQ ID NO: 1437299 - RNA, 19 nt, Homo sapiens
ggagaacuuccagaauuau

SEQ ID NO: 1437300 - RNA, 19 nt, Homo sapiens
aaagcgggcaguagaacua

SEQ ID NO: 1437301 - RNA, 19 nt, Homo sapiens
uucaauacaugaccgagaa

SEQ ID NO: 1437302 - RNA, 19 nt, Homo sapiens
cgaauaccuuaaugagaca

SEQ ID NO: 1437303 - RNA, 19 nt, Homo sapiens
gagaacuuccagaauuaug

SEQ ID NO: 1437304 - RNA, 19 nt, Homo sapiens
aguagaggccugcaagaaa

SEQ ID NO: 1437305 - RNA, 19 nt, Homo sapiens
gagaccauguaaaguaaaa

SEQ ID NO: 1437306 - RNA, 19 nt, Homo sapiens
ucccuuggauauugugauu

SEQ ID NO: 1437307 - RNA, 19 nt, Homo sapiens
uaaugagacaguuacagaa

SEQ ID NO: 1437308 - RNA, 19 nt, Homo sapiens
gcaaaguagaggccugcaa

SEQ ID NO: 1437309 - RNA, 19 nt, Homo sapiens
acagaaguuuggauagaag

SEQ ID NO: 1437310 - RNA, 19 nt, Homo sapiens
cugaaagguaccaaagaua

SEQ ID NO: 1437311 - RNA, 19 nt, Homo sapiens
aaauauaugauggguggua

SEQ ID NO: 1437312 - RNA, 19 nt, Homo sapiens
acaauggauggaugauuaa

SEQ ID NO: 1437313 - RNA, 19 nt, Homo sapiens
uagaggccugcaagaaaua

SEQ ID NO: 1437314 - RNA, 19 nt, Homo sapiens
auggauggaugauuaagau

SEQ ID NO: 1437315 - RNA, 19 nt, Homo sapiens
caauacucuucuucaauac

SEQ ID NO: 1437316 - RNA, 19 nt, Homo sapiens
gagaaugcaacagguuuca

SEQ ID NO: 1437317 - RNA, 19 nt, Homo sapiens
cgagaaauuagguucaaca

SEQ ID NO: 1437318 - RNA, 19 nt, Homo sapiens
auuaagagaccauguaaag

SEQ ID NO: 1437319 - RNA, 19 nt, Homo sapiens
ggguugaggcggaggagaa

SEQ ID NO: 1437320 - RNA, 19 nt, Homo sapiens
aagagaaugcaacagguuu

SEQ ID NO: 1437321 - RNA, 19 nt, Homo sapiens
acauaaagaaguacuugga

SEQ ID NO: 1437322 - RNA, 19 nt, Homo sapiens
cggaggagaacuuccagaa

SEQ ID NO: 1437323 - RNA, 19 nt, Homo sapiens
ugaaggcauugagcaagug

SEQ ID NO: 1437324 - RNA, 19 nt, Homo sapiens
ucucaccucucuggaugaa

SEQ ID NO: 1437325 - RNA, 19 nt, Homo sapiens
uaccuuaaugagacaguua

SEQ ID NO: 1437326 - RNA, 19 nt, Homo sapiens
gagcggaaaacauaaagaa

SEQ ID NO: 1437327 - RNA, 19 nt, Homo sapiens
ggaaggggacuugauuauu

SEQ ID NO: 1437328 - RNA, 19 nt, Homo sapiens
gguaccaaagauaauacua

SEQ ID NO: 1437329 - RNA, 19 nt, Homo sapiens
gcuguuggaaguucaauac

SEQ ID NO: 1437330 - RNA, 19 nt, Homo sapiens
gaaguuuggauagaagauc

SEQ ID NO: 1437331 - RNA, 19 nt, Homo sapiens
augcaacagguuucaguua

SEQ ID NO: 1437332 - RNA, 19 nt, Homo sapiens
aauacaugaccgagaaauu

SEQ ID NO: 1437333 - RNA, 19 nt, Homo sapiens
ucagcuguauaacuuucuu

SEQ ID NO: 1437334 - RNA, 19 nt, Homo sapiens
uggaaaauaucacaagcaa

SEQ ID NO: 1437335 - RNA, 19 nt, Homo sapiens
ccuuggauauugugauuuu

SEQ ID NO: 1437336 - RNA, 19 nt, Homo sapiens
gaagauggaaaauaucaca

SEQ ID NO: 1437337 - RNA, 19 nt, Homo sapiens
gcuccugcagguucugaaa

SEQ ID NO: 1437338 - RNA, 19 nt, Homo sapiens
acggagugcuguuggaagu

SEQ ID NO: 1437339 - RNA, 19 nt, Homo sapiens
gcaacucagugucacagaa

SEQ ID NO: 1437340 - RNA, 19 nt, Homo sapiens
guaccagucucuucuuugc

SEQ ID NO: 1437341 - RNA, 19 nt, Homo sapiens
ccgauacccugcagaaaca

SEQ ID NO: 1437342 - RNA, 19 nt, Homo sapiens
guacagcgccauccugaag

SEQ ID NO: 1437343 - RNA, 19 nt, Homo sapiens
acacagcccucaaguacag

SEQ ID NO: 1437344 - RNA, 19 nt, Homo sapiens
caguaccagucucuucuuu

SEQ ID NO: 1437345 - RNA, 19 nt, Homo sapiens
caacucagugucacagaau

SEQ ID NO: 1437346 - RNA, 19 nt, Homo sapiens
cagcucaacuuuuaaacaa

SEQ ID NO: 1437347 - RNA, 19 nt, Homo sapiens
uccagaaggugggcaagaa

SEQ ID NO: 1437348 - RNA, 19 nt, Homo sapiens
gcucaguaccagucucuuc

SEQ ID NO: 1437349 - RNA, 19 nt, Homo sapiens
agaagcgcaucuacugcaa

SEQ ID NO: 1437350 - RNA, 19 nt, Homo sapiens
caacucagggguuuguuuu

SEQ ID NO: 1437351 - RNA, 19 nt, Homo sapiens
cacagcaggucaucaccau

SEQ ID NO: 1437352 - RNA, 19 nt, Homo sapiens
gcuggcgcguuaggcuaua

SEQ ID NO: 1437353 - RNA, 19 nt, Homo sapiens
uuuugcagcucaacuuuua

SEQ ID NO: 1437354 - RNA, 19 nt, Homo sapiens
gcaggucaucaccaucuuc

SEQ ID NO: 1437355 - RNA, 19 nt, Homo sapiens
cagcaggucaucaccaucu

SEQ ID NO: 1437356 - RNA, 19 nt, Homo sapiens
gaaggaggaggaggagucu

SEQ ID NO: 1437357 - RNA, 19 nt, Homo sapiens
ggcaagaagccggaacuca

SEQ ID NO: 1437358 - RNA, 19 nt, Homo sapiens
ggucccaccacuuccagaa

SEQ ID NO: 1437359 - RNA, 19 nt, Homo sapiens
uugcuguucuggucaagga

SEQ ID NO: 1437360 - RNA, 19 nt, Homo sapiens
gaaauagccucgagacauu

SEQ ID NO: 1437361 - RNA, 19 nt, Homo sapiens
gaaggcagaucauaccaua

SEQ ID NO: 1437362 - RNA, 19 nt, Homo sapiens
gaacagagccaucuccaaa

SEQ ID NO: 1437363 - RNA, 19 nt, Homo sapiens
gcacauucuugguaucuua

SEQ ID NO: 1437364 - RNA, 19 nt, Homo sapiens
gaagaaagaauacacauga

SEQ ID NO: 1437365 - RNA, 19 nt, Homo sapiens
gcaauaaguuacacaguug

SEQ ID NO: 1437366 - RNA, 19 nt, Homo sapiens
gaacugacuuccucacaga

SEQ ID NO: 1437367 - RNA, 19 nt, Homo sapiens
gauaguaacucaaguagca

SEQ ID NO: 1437368 - RNA, 19 nt, Homo sapiens
caagagcuaugagaaauaa

SEQ ID NO: 1437369 - RNA, 19 nt, Homo sapiens
gaccaucuguacaacauua

SEQ ID NO: 1437370 - RNA, 19 nt, Homo sapiens
gcaauaaacaucucaguau

SEQ ID NO: 1437371 - RNA, 19 nt, Homo sapiens
gaagagacacaguaugaaa

SEQ ID NO: 1437372 - RNA, 19 nt, Homo sapiens
uaacauggauaguaacuca

SEQ ID NO: 1437373 - RNA, 19 nt, Homo sapiens
aaaugaaugucuugccuua

SEQ ID NO: 1437374 - RNA, 19 nt, Homo sapiens
acagagccaucuccaaaua

SEQ ID NO: 1437375 - RNA, 19 nt, Homo sapiens
uaauaaugcugcaggcuuu

SEQ ID NO: 1437376 - RNA, 19 nt, Homo sapiens
gaaauggacaguuauagau

SEQ ID NO: 1437377 - RNA, 19 nt, Homo sapiens
gauuggaaauggagugaaa

SEQ ID NO: 1437378 - RNA, 19 nt, Homo sapiens
caacauuaccuguggagua

SEQ ID NO: 1437379 - RNA, 19 nt, Homo sapiens
ggaaauggacaguuauaga

SEQ ID NO: 1437380 - RNA, 19 nt, Homo sapiens
gcaagagcuaugagaaaua

SEQ ID NO: 1437381 - RNA, 19 nt, Homo sapiens
gacgcuagcugaugccauu

SEQ ID NO: 1437382 - RNA, 19 nt, Homo sapiens
guucagaagcucuuaguuu

SEQ ID NO: 1437383 - RNA, 19 nt, Homo sapiens
gaucauaccauaucacaca

SEQ ID NO: 1437384 - RNA, 19 nt, Homo sapiens
aaauagagaugucaacaag

SEQ ID NO: 1437385 - RNA, 19 nt, Homo sapiens
uagcugaugccauuaauaa

SEQ ID NO: 1437386 - RNA, 19 nt, Homo sapiens
uaguuuggcuugcgaaauu

SEQ ID NO: 1437387 - RNA, 19 nt, Homo sapiens
gcaaucagaaucaagaaau

SEQ ID NO: 1437388 - RNA, 19 nt, Homo sapiens
auagagaugucaacaaguu

SEQ ID NO: 1437389 - RNA, 19 nt, Homo sapiens
gaaaagaagagacacagua

SEQ ID NO: 1437390 - RNA, 19 nt, Homo sapiens
uaaacccucuauuuccuaa

SEQ ID NO: 1437391 - RNA, 19 nt, Homo sapiens
gaauguauguugcguaucc

SEQ ID NO: 1437392 - RNA, 19 nt, Homo sapiens
uaacagaaaccaaucuuag

SEQ ID NO: 1437393 - RNA, 19 nt, Homo sapiens
ucaacaaguuucaagaugu

SEQ ID NO: 1437394 - RNA, 19 nt, Homo sapiens
cucagaagaucacuaguuu

SEQ ID NO: 1437395 - RNA, 19 nt, Homo sapiens
ggaaauggagugaaacaag

SEQ ID NO: 1437396 - RNA, 19 nt, Homo sapiens
gauguugugugcuguaaag

SEQ ID NO: 1437397 - RNA, 19 nt, Homo sapiens
gguuugaguuuguuggaaa

SEQ ID NO: 1437398 - RNA, 19 nt, Homo sapiens
gggcuguccuuguuauuuc

SEQ ID NO: 1437399 - RNA, 19 nt, Homo sapiens
aagaagagacacaguauga

SEQ ID NO: 1437400 - RNA, 19 nt, Homo sapiens
aaaguuugaugaaggagaa

SEQ ID NO: 1437401 - RNA, 19 nt, Homo sapiens
augaaugucuugccuuaaa

SEQ ID NO: 1437402 - RNA, 19 nt, Homo sapiens
cauuugugcuucuuucuau

SEQ ID NO: 1437403 - RNA, 19 nt, Homo sapiens
guacaacauugaugagcau

SEQ ID NO: 1437404 - RNA, 19 nt, Homo sapiens
aaaccaaucuuagcaccuu

SEQ ID NO: 1437405 - RNA, 19 nt, Homo sapiens
cagaagcucuuaguuugug

SEQ ID NO: 1437406 - RNA, 19 nt, Homo sapiens
gcagcaagagcuaugagaa

SEQ ID NO: 1437407 - RNA, 19 nt, Homo sapiens
gucaacaaguuucaagaug

SEQ ID NO: 1437408 - RNA, 19 nt, Homo sapiens
caacauugaugagcauuuu

SEQ ID NO: 1437409 - RNA, 19 nt, Homo sapiens
uucagaagcucuuaguuug

SEQ ID NO: 1437410 - RNA, 19 nt, Homo sapiens
ucacacgcgugcccuguug

SEQ ID NO: 1437411 - RNA, 19 nt, Homo sapiens
gauguuaacagaaaccaau

SEQ ID NO: 1437412 - RNA, 19 nt, Homo sapiens
uaacucaaguagcaauaag

SEQ ID NO: 1437413 - RNA, 19 nt, Homo sapiens
cagcaagagcuaugagaaa

SEQ ID NO: 1437414 - RNA, 19 nt, Homo sapiens
caaauagagaugucaacaa

SEQ ID NO: 1437415 - RNA, 19 nt, Homo sapiens
auacugcgguuguucagaa

SEQ ID NO: 1437416 - RNA, 19 nt, Homo sapiens
caaguguaauauugugaga

SEQ ID NO: 1437417 - RNA, 19 nt, Homo sapiens
gguauacccaggauauuau

SEQ ID NO: 1437418 - RNA, 19 nt, Homo sapiens
ggaauuugaaacaggauau

SEQ ID NO: 1437419 - RNA, 19 nt, Homo sapiens
ucgagacauucaucacuaa

SEQ ID NO: 1437420 - RNA, 19 nt, Homo sapiens
agcaauaaguuacacaguu

SEQ ID NO: 1437421 - RNA, 19 nt, Homo sapiens
cuucccaacugaaauuauu

SEQ ID NO: 1437422 - RNA, 19 nt, Homo sapiens
cauugaaccuucccaacug

SEQ ID NO: 1437423 - RNA, 19 nt, Homo sapiens
ucaaaaggguguguuauga

SEQ ID NO: 1437424 - RNA, 19 nt, Homo sapiens
acauucagcucucacaauc

SEQ ID NO: 1437425 - RNA, 19 nt, Homo sapiens
aaccaucacucacguuuua

SEQ ID NO: 1437426 - RNA, 19 nt, Homo sapiens
uaucuaacguuucuaacag

SEQ ID NO: 1437427 - RNA, 19 nt, Homo sapiens
caacaaauagagaugucaa

SEQ ID NO: 1437428 - RNA, 19 nt, Homo sapiens
cagagggauuuagcuguaa

SEQ ID NO: 1437429 - RNA, 19 nt, Homo sapiens
cagaagaucacuaguuugg

SEQ ID NO: 1437430 - RNA, 19 nt, Homo sapiens
guccaacuauccagacguu

SEQ ID NO: 1437431 - RNA, 19 nt, Homo sapiens
caaauacugcgguuguuca

SEQ ID NO: 1437432 - RNA, 19 nt, Homo sapiens
gagacacaguaugaaagaa

SEQ ID NO: 1437433 - RNA, 19 nt, Homo sapiens
gacacaguaugaaagaaca

SEQ ID NO: 1437434 - RNA, 19 nt, Homo sapiens
ggaugauagagagaaauua

SEQ ID NO: 1437435 - RNA, 19 nt, Homo sapiens
cugaauguauguugcguau

SEQ ID NO: 1437436 - RNA, 19 nt, Homo sapiens
guaacucaaguagcaauaa

SEQ ID NO: 1437437 - RNA, 19 nt, Homo sapiens
gaaccuucccaacugaaau

SEQ ID NO: 1437438 - RNA, 19 nt, Homo sapiens
gaugaucauuacucagaag

SEQ ID NO: 1437439 - RNA, 19 nt, Homo sapiens
gcuagcugaugccauuaau

SEQ ID NO: 1437440 - RNA, 19 nt, Homo sapiens
ugccuuaaacccucuauuu

SEQ ID NO: 1437441 - RNA, 19 nt, Homo sapiens
caggcccacuuugcucuua

SEQ ID NO: 1437442 - RNA, 19 nt, Homo sapiens
gcugcaggcuuugguuuca

SEQ ID NO: 1437443 - RNA, 19 nt, Homo sapiens
guugugugcuguaaaggau

SEQ ID NO: 1437444 - RNA, 19 nt, Homo sapiens
gugucaaucuggaugauag

SEQ ID NO: 1437445 - RNA, 19 nt, Homo sapiens
agacagcucuuuggcucaa

SEQ ID NO: 1437446 - RNA, 19 nt, Homo sapiens
cauaccauaucacacaauc

SEQ ID NO: 1437447 - RNA, 19 nt, Homo sapiens
cucgagacauucaucacua

SEQ ID NO: 1437448 - RNA, 19 nt, Homo sapiens
agaaauagccucgagacau

SEQ ID NO: 1437449 - RNA, 19 nt, Homo sapiens
ucaaguagcaauaaguuac

SEQ ID NO: 1437450 - RNA, 19 nt, Homo sapiens
gcugggacuuaauuuccaa

SEQ ID NO: 1437451 - RNA, 19 nt, Homo sapiens
ggauguuucggaaggauga

SEQ ID NO: 1437452 - RNA, 19 nt, Homo sapiens
ucggaaggaugaagaacug

SEQ ID NO: 1437453 - RNA, 19 nt, Homo sapiens
ugugugcuguaaaggauuu

SEQ ID NO: 1437454 - RNA, 19 nt, Homo sapiens
uguaaggcaugccaagcuu

SEQ ID NO: 1437455 - RNA, 19 nt, Homo sapiens
uuacagcuccugguauuau

SEQ ID NO: 1437456 - RNA, 19 nt, Homo sapiens
gaugagcauuuucaagcua

SEQ ID NO: 1437457 - RNA, 19 nt, Homo sapiens
cauucuugguaucuuagua

SEQ ID NO: 1437458 - RNA, 19 nt, Homo sapiens
agcaagagcuaugagaaau

SEQ ID NO: 1437459 - RNA, 19 nt, Homo sapiens
gauguuucuugauaauugg

SEQ ID NO: 1437460 - RNA, 19 nt, Homo sapiens
gaagagagcuuaccauuca

SEQ ID NO: 1437461 - RNA, 19 nt, Homo sapiens
gaaguagaguucaggguua

SEQ ID NO: 1437462 - RNA, 19 nt, Homo sapiens
gaacaaggauggucugcuu

SEQ ID NO: 1437463 - RNA, 19 nt, Homo sapiens
gaaauaagcucuccuucag

SEQ ID NO: 1437464 - RNA, 19 nt, Homo sapiens
gaaaugaaauugacuugca

SEQ ID NO: 1437465 - RNA, 19 nt, Homo sapiens
gcagauaacuuugcuaaca

SEQ ID NO: 1437466 - RNA, 19 nt, Homo sapiens
ggaagaaacccauguauuc

SEQ ID NO: 1437467 - RNA, 19 nt, Homo sapiens
ggacuaccuucuauuguaa

SEQ ID NO: 1437468 - RNA, 19 nt, Homo sapiens
ggaauucagugccgauauu

SEQ ID NO: 1437469 - RNA, 19 nt, Homo sapiens
ggaaauggauucuuuacca

SEQ ID NO: 1437470 - RNA, 19 nt, Homo sapiens
ggaaacagaguagagauua

SEQ ID NO: 1437471 - RNA, 19 nt, Homo sapiens
cagcucaagucuauucuua

SEQ ID NO: 1437472 - RNA, 19 nt, Homo sapiens
caagaacccuauccuguga

SEQ ID NO: 1437473 - RNA, 19 nt, Homo sapiens
uaagaaugcuagcuaggua

SEQ ID NO: 1437474 - RNA, 19 nt, Homo sapiens
gagaaggaauauccagaaa

SEQ ID NO: 1437475 - RNA, 19 nt, Homo sapiens
gggaauauuucaucugaga

SEQ ID NO: 1437476 - RNA, 19 nt, Homo sapiens
gcacgucgguuacuuacau

SEQ ID NO: 1437477 - RNA, 19 nt, Homo sapiens
caacugugaugauccacua

SEQ ID NO: 1437478 - RNA, 19 nt, Homo sapiens
ggaaauagcagcuugaaac

SEQ ID NO: 1437479 - RNA, 19 nt, Homo sapiens
gaaauugacuugcaaaaca

SEQ ID NO: 1437480 - RNA, 19 nt, Homo sapiens
gaauacagccggcuucuuc

SEQ ID NO: 1437481 - RNA, 19 nt, Homo sapiens
ccaaggaccucauuucagu

SEQ ID NO: 1437482 - RNA, 19 nt, Homo sapiens
cuacggauguuccuauaaa

SEQ ID NO: 1437483 - RNA, 19 nt, Homo sapiens
cuacuuuguuccuuucuua

SEQ ID NO: 1437484 - RNA, 19 nt, Homo sapiens
ccauuuaccugguggauug

SEQ ID NO: 1437485 - RNA, 19 nt, Homo sapiens
uaagagagguuugguuugu

SEQ ID NO: 1437486 - RNA, 19 nt, Homo sapiens
cagaaaggcuuccuaggau

SEQ ID NO: 1437487 - RNA, 19 nt, Homo sapiens
gaaagcaucagaucuauac

SEQ ID NO: 1437488 - RNA, 19 nt, Homo sapiens
gaugugaucucccugaagu

SEQ ID NO: 1437489 - RNA, 19 nt, Homo sapiens
uaaaucccauuaaggcuuu

SEQ ID NO: 1437490 - RNA, 19 nt, Homo sapiens
caaaaugccuccuccaauu

SEQ ID NO: 1437491 - RNA, 19 nt, Homo sapiens
ccucuucucuccugucuuu

SEQ ID NO: 1437492 - RNA, 19 nt, Homo sapiens
gaaggaauauccagaaaau

SEQ ID NO: 1437493 - RNA, 19 nt, Homo sapiens
aggcucaucuuuauugaua

SEQ ID NO: 1437494 - RNA, 19 nt, Homo sapiens
gacauugacuaugagcuua

SEQ ID NO: 1437495 - RNA, 19 nt, Homo sapiens
caaaugcuguucgaaguga

SEQ ID NO: 1437496 - RNA, 19 nt, Homo sapiens
ucacagagaaucuugguuu

SEQ ID NO: 1437497 - RNA, 19 nt, Homo sapiens
gaagaaacccauguauuca

SEQ ID NO: 1437498 - RNA, 19 nt, Homo sapiens
gcaaguguguggagaagca

SEQ ID NO: 1437499 - RNA, 19 nt, Homo sapiens
gauguuccauaucuucaaa

SEQ ID NO: 1437500 - RNA, 19 nt, Homo sapiens
gacaguuccuucagaaaug

SEQ ID NO: 1437501 - RNA, 19 nt, Homo sapiens
gacaaaugauacuggcuuu

SEQ ID NO: 1437502 - RNA, 19 nt, Homo sapiens
gacgaaagcaucagaucua

SEQ ID NO: 1437503 - RNA, 19 nt, Homo sapiens
gacagcaucuggaccuuug

SEQ ID NO: 1437504 - RNA, 19 nt, Homo sapiens
ggacaguuccuucagaaau

SEQ ID NO: 1437505 - RNA, 19 nt, Homo sapiens
ggugauagcaguggugaua

SEQ ID NO: 1437506 - RNA, 19 nt, Homo sapiens
gcuaucaccuaaacaagga

SEQ ID NO: 1437507 - RNA, 19 nt, Homo sapiens
uggacuaccuucuauugua

SEQ ID NO: 1437508 - RNA, 19 nt, Homo sapiens
ccuuagacauugacuauga

SEQ ID NO: 1437509 - RNA, 19 nt, Homo sapiens
ggaaacaguacaaacaaga

SEQ ID NO: 1437510 - RNA, 19 nt, Homo sapiens
aauagcagcuugaaacuag

SEQ ID NO: 1437511 - RNA, 19 nt, Homo sapiens
ggagaaggaauauccagaa

SEQ ID NO: 1437512 - RNA, 19 nt, Homo sapiens
cugcaagaauggaagcuua

SEQ ID NO: 1437513 - RNA, 19 nt, Homo sapiens
acacuugaauggacagaaa

SEQ ID NO: 1437514 - RNA, 19 nt, Homo sapiens
gaugaauggacaaaugaua

SEQ ID NO: 1437515 - RNA, 19 nt, Homo sapiens
gacaagaucuggacaucag

SEQ ID NO: 1437516 - RNA, 19 nt, Homo sapiens
gaaacaguacaaacaagaa

SEQ ID NO: 1437517 - RNA, 19 nt, Homo sapiens
cacaagcagucacaucgua

SEQ ID NO: 1437518 - RNA, 19 nt, Homo sapiens
gaauggaagcuuacagguu

SEQ ID NO: 1437519 - RNA, 19 nt, Homo sapiens
aaacauugcacuuagcuuu

SEQ ID NO: 1437520 - RNA, 19 nt, Homo sapiens
ggaacgccgucucauuuua

SEQ ID NO: 1437521 - RNA, 19 nt, Homo sapiens
ggcagcaacuugaaugaug

SEQ ID NO: 1437522 - RNA, 19 nt, Homo sapiens
gaaacagaguagagauuac

SEQ ID NO: 1437523 - RNA, 19 nt, Homo sapiens
gguauuccugggauuauua

SEQ ID NO: 1437524 - RNA, 19 nt, Homo sapiens
gaaacuaggagguaacaag

SEQ ID NO: 1437525 - RNA, 19 nt, Homo sapiens
ccacauagcaccacugaag

SEQ ID NO: 1437526 - RNA, 19 nt, Homo sapiens
gggaagagagcuuaccauu

SEQ ID NO: 1437527 - RNA, 19 nt, Homo sapiens
augcaccacuugaagauua

SEQ ID NO: 1437528 - RNA, 19 nt, Homo sapiens
uaauugaccuggcuaagag

SEQ ID NO: 1437529 - RNA, 19 nt, Homo sapiens
cuaauuggguuuggauuug

SEQ ID NO: 1437530 - RNA, 19 nt, Homo sapiens
ccuuagacccugaguauuu

SEQ ID NO: 1437531 - RNA, 19 nt, Homo sapiens
gauuuggucauucucuuua

SEQ ID NO: 1437532 - RNA, 19 nt, Homo sapiens
ggaagagagcuuaccauuc

SEQ ID NO: 1437533 - RNA, 19 nt, Homo sapiens
ggacucagaugugaaugca

SEQ ID NO: 1437534 - RNA, 19 nt, Homo sapiens
gaaggaugcaccacuugaa

SEQ ID NO: 1437535 - RNA, 19 nt, Homo sapiens
cgacagaucaaacucagaa

SEQ ID NO: 1437536 - RNA, 19 nt, Homo sapiens
aaagaccacuugccuguca

SEQ ID NO: 1437537 - RNA, 19 nt, Homo sapiens
aaacuacugugaacaugga

SEQ ID NO: 1437538 - RNA, 19 nt, Homo sapiens
uaacagcgacaaacuacaa

SEQ ID NO: 1437539 - RNA, 19 nt, Homo sapiens
ugauagcaguggugauauu

SEQ ID NO: 1437540 - RNA, 19 nt, Homo sapiens
cagagaaucuugguuugga

SEQ ID NO: 1437541 - RNA, 19 nt, Homo sapiens
caaggaagaaacccaugua

SEQ ID NO: 1437542 - RNA, 19 nt, Homo sapiens
ccucagcuauuuacacaga

SEQ ID NO: 1437543 - RNA, 19 nt, Homo sapiens
gcaccaauucaccuuauga

SEQ ID NO: 1437544 - RNA, 19 nt, Homo sapiens
cgaaauaagcucuccuuca

SEQ ID NO: 1437545 - RNA, 19 nt, Homo sapiens
uaacugcagugacacaagu

SEQ ID NO: 1437546 - RNA, 19 nt, Homo sapiens
gcucacuucuguacagguu

SEQ ID NO: 1437547 - RNA, 19 nt, Homo sapiens
ccacugccuuccucucuga

SEQ ID NO: 1437548 - RNA, 19 nt, Homo sapiens
gggaaccacucacaaaugc

SEQ ID NO: 1437549 - RNA, 19 nt, Homo sapiens
gaucuauacuggcaauguc

SEQ ID NO: 1437550 - RNA, 19 nt, Homo sapiens
cuuguggcauuuaggauua

SEQ ID NO: 1437551 - RNA, 19 nt, Homo sapiens
cgacaaacuacaacuguga

SEQ ID NO: 1437552 - RNA, 19 nt, Homo sapiens
gauuaacagcgacaaacua

SEQ ID NO: 1437553 - RNA, 19 nt, Homo sapiens
cuacaauggaguaaacaua

SEQ ID NO: 1437554 - RNA, 19 nt, Homo sapiens
acacacacacacauauaua

SEQ ID NO: 1437555 - RNA, 19 nt, Homo sapiens
acuaggagguaacaagaaa

SEQ ID NO: 1437556 - RNA, 19 nt, Homo sapiens
aaagagguuucugcuguuu

SEQ ID NO: 1437557 - RNA, 19 nt, Homo sapiens
ggaacgucauccagacaga

SEQ ID NO: 1437558 - RNA, 19 nt, Homo sapiens
ucagugaguuuccaguuuc

SEQ ID NO: 1437559 - RNA, 19 nt, Homo sapiens
gcaugagagucgaggucua

SEQ ID NO: 1437560 - RNA, 19 nt, Homo sapiens
gaacaaggauggucugcuu

SEQ ID NO: 1437561 - RNA, 19 nt, Homo sapiens
gaaauaagcucuccuucag

SEQ ID NO: 1437562 - RNA, 19 nt, Homo sapiens
ggacuaccuucuauuguaa

SEQ ID NO: 1437563 - RNA, 19 nt, Homo sapiens
ggaauucagugccgauauu

SEQ ID NO: 1437564 - RNA, 19 nt, Homo sapiens
ggaaauggauucuuuacca

SEQ ID NO: 1437565 - RNA, 19 nt, Homo sapiens
ggaaacagaguagagauua

SEQ ID NO: 1437566 - RNA, 19 nt, Homo sapiens
gaaagagccuaaaccaucu

SEQ ID NO: 1437567 - RNA, 19 nt, Homo sapiens
caacugugaugauccacua

SEQ ID NO: 1437568 - RNA, 19 nt, Homo sapiens
gaauacagccggcuucuuc

SEQ ID NO: 1437569 - RNA, 19 nt, Homo sapiens
ccaaggaccucauuucagu

SEQ ID NO: 1437570 - RNA, 19 nt, Homo sapiens
cuacggauguuccuauaaa

SEQ ID NO: 1437571 - RNA, 19 nt, Homo sapiens
ccauuuaccugguggauug

SEQ ID NO: 1437572 - RNA, 19 nt, Homo sapiens
cagaaaggcuuccuaggau

SEQ ID NO: 1437573 - RNA, 19 nt, Homo sapiens
gaaagcaucagaucuauac

SEQ ID NO: 1437574 - RNA, 19 nt, Homo sapiens
gaugugaucucccugaagu

SEQ ID NO: 1437575 - RNA, 19 nt, Homo sapiens
uaaaucccauuaaggcuuu

SEQ ID NO: 1437576 - RNA, 19 nt, Homo sapiens
aggcucaucuuuauugaua

SEQ ID NO: 1437577 - RNA, 19 nt, Homo sapiens
gacauugacuaugagcuua

SEQ ID NO: 1437578 - RNA, 19 nt, Homo sapiens
gacaaaugauacuggcuuu

SEQ ID NO: 1437579 - RNA, 19 nt, Homo sapiens
gacgaaagcaucagaucua

SEQ ID NO: 1437580 - RNA, 19 nt, Homo sapiens
gacagcaucuggaccuuug

SEQ ID NO: 1437581 - RNA, 19 nt, Homo sapiens
uggacuaccuucuauugua

SEQ ID NO: 1437582 - RNA, 19 nt, Homo sapiens
ccuuagacauugacuauga

SEQ ID NO: 1437583 - RNA, 19 nt, Homo sapiens
ggaaacaguacaaacaaga

SEQ ID NO: 1437584 - RNA, 19 nt, Homo sapiens
acacuugaauggacagaaa

SEQ ID NO: 1437585 - RNA, 19 nt, Homo sapiens
gaugaauggacaaaugaua

SEQ ID NO: 1437586 - RNA, 19 nt, Homo sapiens
gacaagaucuggacaucag

SEQ ID NO: 1437587 - RNA, 19 nt, Homo sapiens
gaaacaguacaaacaagaa

SEQ ID NO: 1437588 - RNA, 19 nt, Homo sapiens
ggaacgccgucucauuuua

SEQ ID NO: 1437589 - RNA, 19 nt, Homo sapiens
ggcagcaacuugaaugaug

SEQ ID NO: 1437590 - RNA, 19 nt, Homo sapiens
gaaacagaguagagauuac

SEQ ID NO: 1437591 - RNA, 19 nt, Homo sapiens
uaauugaccuggcuaagag

SEQ ID NO: 1437592 - RNA, 19 nt, Homo sapiens
cuaauuggguuuggauuug

SEQ ID NO: 1437593 - RNA, 19 nt, Homo sapiens
ccuaaaccaucuuaacuca

SEQ ID NO: 1437594 - RNA, 19 nt, Homo sapiens
cgacagaucaaacucagaa

SEQ ID NO: 1437595 - RNA, 19 nt, Homo sapiens
aaagaccacuugccuguca

SEQ ID NO: 1437596 - RNA, 19 nt, Homo sapiens
aaacuacugugaacaugga

SEQ ID NO: 1437597 - RNA, 19 nt, Homo sapiens
uaacagcgacaaacuacaa

SEQ ID NO: 1437598 - RNA, 19 nt, Homo sapiens
cgaaauaagcucuccuuca

SEQ ID NO: 1437599 - RNA, 19 nt, Homo sapiens
uaacugcagugacacaagu

SEQ ID NO: 1437600 - RNA, 19 nt, Homo sapiens
gcucacuucuguacagguu

SEQ ID NO: 1437601 - RNA, 19 nt, Homo sapiens
gaucuauacuggcaauguc

SEQ ID NO: 1437602 - RNA, 19 nt, Homo sapiens
cuuguggcauuuaggauua

SEQ ID NO: 1437603 - RNA, 19 nt, Homo sapiens
cuacaauggaguaaacaua

SEQ ID NO: 1437604 - RNA, 19 nt, Homo sapiens
cgacaaacuacaacuguga

SEQ ID NO: 1437605 - RNA, 19 nt, Homo sapiens
gauuaacagcgacaaacua

SEQ ID NO: 1437606 - RNA, 19 nt, Homo sapiens
ggaacgucauccagacaga

SEQ ID NO: 1437607 - RNA, 19 nt, Homo sapiens
ucagugaguuuccaguuuc

SEQ ID NO: 1437608 - RNA, 19 nt, Homo sapiens
gcaugagagucgaggucua

SEQ ID NO: 1437609 - RNA, 19 nt, Homo sapiens
cugacugggugacgaguua

SEQ ID NO: 1437610 - RNA, 19 nt, Homo sapiens
guuuggauuugcaccguua

SEQ ID NO: 1437611 - RNA, 19 nt, Homo sapiens
ccaaauugaugggcucuca

SEQ ID NO: 1437612 - RNA, 19 nt, Homo sapiens
gggcgagacggaugccuua

SEQ ID NO: 1437613 - RNA, 19 nt, Homo sapiens
gaagauacggaagcucuga

SEQ ID NO: 1437614 - RNA, 19 nt, Homo sapiens
cuccuucucuucugaauga

SEQ ID NO: 1437615 - RNA, 19 nt, Homo sapiens
gaauucagugccgauauuu

SEQ ID NO: 1437616 - RNA, 19 nt, Homo sapiens
ggagagagacagcgagaag

SEQ ID NO: 1437617 - RNA, 19 nt, Homo sapiens
aaggaugaauggacaaaug

SEQ ID NO: 1437618 - RNA, 19 nt, Homo sapiens
cagguguacugcaauauca

SEQ ID NO: 1437619 - RNA, 19 nt, Homo sapiens
acagaaaggcuuccuagga

SEQ ID NO: 1437620 - RNA, 19 nt, Homo sapiens
caauaucacugaggacaag

SEQ ID NO: 1437621 - RNA, 19 nt, Homo sapiens
gcugcagcauaaagaaauu

SEQ ID NO: 1437622 - RNA, 19 nt, Homo sapiens
aggccaggcugcagcauaa

SEQ ID NO: 1437623 - RNA, 19 nt, Homo sapiens
ggcacgggauggagugaaa

SEQ ID NO: 1437624 - RNA, 19 nt, Homo sapiens
ggcacucgguccucauuga

SEQ ID NO: 1437625 - RNA, 19 nt, Homo sapiens
gacaaccaauggcacuaug

SEQ ID NO: 1437626 - RNA, 19 nt, Homo sapiens
ccaaacuacugugaacaug

SEQ ID NO: 1437627 - RNA, 19 nt, Homo sapiens
cgaaagcaucagaucuaua

SEQ ID NO: 1437628 - RNA, 19 nt, Homo sapiens
gagaccacaucaccuugga

SEQ ID NO: 1437629 - RNA, 19 nt, Homo sapiens
gggaaacagaguagagauu

SEQ ID NO: 1437630 - RNA, 19 nt, Homo sapiens
gauacuggcuuucuuuccu

SEQ ID NO: 1437631 - RNA, 19 nt, Homo sapiens
ucucaccgauucccaaugu

SEQ ID NO: 1437632 - RNA, 19 nt, Homo sapiens
gaucaccuuugccaucgau

SEQ ID NO: 1437633 - RNA, 19 nt, Homo sapiens
uauuguaacugcagugaca

SEQ ID NO: 1437634 - RNA, 19 nt, Homo sapiens
ggaccugggaaacagagua

SEQ ID NO: 1437635 - RNA, 19 nt, Homo sapiens
ucgaaaaccuuuacuacaa

SEQ ID NO: 1437636 - RNA, 19 nt, Homo sapiens
aauaguacccgguucaaug

SEQ ID NO: 1437637 - RNA, 19 nt, Homo sapiens
gaacgucauccagacagaa

SEQ ID NO: 1437638 - RNA, 19 nt, Homo sapiens
cuggaacgccgucucauuu

SEQ ID NO: 1437639 - RNA, 19 nt, Homo sapiens
gacggaugccuuagacauu

SEQ ID NO: 1437640 - RNA, 19 nt, Homo sapiens
cuucagagaucaccuuugc

SEQ ID NO: 1437641 - RNA, 19 nt, Homo sapiens
gugccgauauuuccuucuu

SEQ ID NO: 1437642 - RNA, 19 nt, Homo sapiens
gcaauaucacugaggacaa

SEQ ID NO: 1437643 - RNA, 19 nt, Homo sapiens
ucaccgauucccaauguuu

SEQ ID NO: 1437644 - RNA, 19 nt, Homo sapiens
gcgccugucguucuaauug

SEQ ID NO: 1437645 - RNA, 19 nt, Homo sapiens
gaaaaccuuuacuacaaug

SEQ ID NO: 1437646 - RNA, 19 nt, Homo sapiens
gaaugguccuguggagcuu

SEQ ID NO: 1437647 - RNA, 19 nt, Homo sapiens
ggacaagaucuggacauca

SEQ ID NO: 1437648 - RNA, 19 nt, Homo sapiens
gcccaaggaccucauuuca

SEQ ID NO: 1437649 - RNA, 19 nt, Homo sapiens
caaacuacaacugugauga

SEQ ID NO: 1437650 - RNA, 19 nt, Homo sapiens
caccgauucccaauguuua

SEQ ID NO: 1437651 - RNA, 19 nt, Homo sapiens
gaacuucacgguggacaag

SEQ ID NO: 1437652 - RNA, 19 nt, Homo sapiens
ucagugagagcccgauuug

SEQ ID NO: 1437653 - RNA, 19 nt, Homo sapiens
ucagaucuauacuggcaau

SEQ ID NO: 1437654 - RNA, 19 nt, Homo sapiens
agugagagcccgauuuguu

SEQ ID NO: 1437655 - RNA, 19 nt, Homo sapiens
ggauuugcaccguuaagga

SEQ ID NO: 1437656 - RNA, 19 nt, Homo sapiens
caaaugauacuggcuuucu

SEQ ID NO: 1437657 - RNA, 19 nt, Homo sapiens
gcaauugcgacgcugacaa

SEQ ID NO: 1437658 - RNA, 19 nt, Homo sapiens
cuacaacugugaugaucca

SEQ ID NO: 1437659 - RNA, 19 nt, Homo sapiens
cagguucaaucagaaguug

SEQ ID NO: 1437660 - RNA, 19 nt, Homo sapiens
gaaaggagcacaucagaga

SEQ ID NO: 1437661 - RNA, 19 nt, Homo sapiens
gaaggaagcucuuggaaaa

SEQ ID NO: 1437662 - RNA, 19 nt, Homo sapiens
gcgaugaacuggagauuau

SEQ ID NO: 1437663 - RNA, 19 nt, Homo sapiens
gacaaugacuugacaugaa

SEQ ID NO: 1437664 - RNA, 19 nt, Homo sapiens
gaauacugauugugcauug

SEQ ID NO: 1437665 - RNA, 19 nt, Homo sapiens
uaaggagucugaaaugaug

SEQ ID NO: 1437666 - RNA, 19 nt, Homo sapiens
ugaagaaggugcuuguuuc

SEQ ID NO: 1437667 - RNA, 19 nt, Homo sapiens
ggaaggaagcucuuggaaa

SEQ ID NO: 1437668 - RNA, 19 nt, Homo sapiens
ugaagaaguccaugucaua

SEQ ID NO: 1437669 - RNA, 19 nt, Homo sapiens
gaagaaugcacaagagaga

SEQ ID NO: 1437670 - RNA, 19 nt, Homo sapiens
uuagagacccagauauuua

SEQ ID NO: 1437671 - RNA, 19 nt, Homo sapiens
caagagagaagaaaggaaa

SEQ ID NO: 1437672 - RNA, 19 nt, Homo sapiens
gagcaaucgucuuaauuuc

SEQ ID NO: 1437673 - RNA, 19 nt, Homo sapiens
acagaaagaugauuaaggu

SEQ ID NO: 1437674 - RNA, 19 nt, Homo sapiens
gcucuugguuccugucaaa

SEQ ID NO: 1437675 - RNA, 19 nt, Homo sapiens
acaaugacuugacaugaaa

SEQ ID NO: 1437676 - RNA, 19 nt, Homo sapiens
ugacugaccugaagaaugc

SEQ ID NO: 1437677 - RNA, 19 nt, Homo sapiens
cugcagagcuucauaacug

SEQ ID NO: 1437678 - RNA, 19 nt, Homo sapiens
uggcaaugcucucuggaua

SEQ ID NO: 1437679 - RNA, 19 nt, Homo sapiens
gaacuuugaauuccaugaa

SEQ ID NO: 1437680 - RNA, 19 nt, Homo sapiens
gaacugagucaauuaaacu

SEQ ID NO: 1437681 - RNA, 19 nt, Homo sapiens
ggaacugagucaauuaaac

SEQ ID NO: 1437682 - RNA, 19 nt, Homo sapiens
ugucaaauguggaccugua

SEQ ID NO: 1437683 - RNA, 19 nt, Homo sapiens
gaagaaguccaugucauau

SEQ ID NO: 1437684 - RNA, 19 nt, Homo sapiens
guuaugggcugcuuuacug

SEQ ID NO: 1437685 - RNA, 19 nt, Homo sapiens
cuucauaacugggaauuug

SEQ ID NO: 1437686 - RNA, 19 nt, Homo sapiens
uggaagacuuugaauguga

SEQ ID NO: 1437687 - RNA, 19 nt, Homo sapiens
aagcgugucuuuccuaaug

SEQ ID NO: 1437688 - RNA, 19 nt, Homo sapiens
ucaguuugaugaaccaauu

SEQ ID NO: 1437689 - RNA, 19 nt, Homo sapiens
ggaauuugauuugaagaag

SEQ ID NO: 1437690 - RNA, 19 nt, Homo sapiens
uaacugggaauuugauuug

SEQ ID NO: 1437691 - RNA, 19 nt, Homo sapiens
ugagcaaucgucuuaauuu

SEQ ID NO: 1437692 - RNA, 19 nt, Homo sapiens
agaaguccaugucauaugu

SEQ ID NO: 1437693 - RNA, 19 nt, Homo sapiens
gagaaggaaagaagacuga

SEQ ID NO: 1437694 - RNA, 19 nt, Homo sapiens
gaugaacuggagauuauuu

SEQ ID NO: 1437695 - RNA, 19 nt, Homo sapiens
guagauauuugacuucacu

SEQ ID NO: 1437696 - RNA, 19 nt, Homo sapiens
gaagugggacagaaagaug

SEQ ID NO: 1437697 - RNA, 19 nt, Homo sapiens
gguuagagacccagauauu

SEQ ID NO: 1437698 - RNA, 19 nt, Homo sapiens
gaacacaaugcucccaguu

SEQ ID NO: 1437699 - RNA, 19 nt, Homo sapiens
ggaagacuuugaaugugau

SEQ ID NO: 1437700 - RNA, 19 nt, Homo sapiens
gugaagaaggugcuuguuu

SEQ ID NO: 1437701 - RNA, 19 nt, Homo sapiens
cuacugugcugaauacauc

SEQ ID NO: 1437702 - RNA, 19 nt, Homo sapiens
gauaugguuuggcuuugug

SEQ ID NO: 1437703 - RNA, 19 nt, Homo sapiens
gaagucaacacuccaugga

SEQ ID NO: 1437704 - RNA, 19 nt, Homo sapiens
gcaaugcucucuggauacu

SEQ ID NO: 1437705 - RNA, 19 nt, Homo sapiens
gcugagaagugggacagaa

SEQ ID NO: 1437706 - RNA, 19 nt, Homo sapiens
uggauagcaugccuaauug

SEQ ID NO: 1437707 - RNA, 19 nt, Homo sapiens
cugguguucuguugauuua

SEQ ID NO: 1437708 - RNA, 19 nt, Homo sapiens
gcacugaauguauccauca

SEQ ID NO: 1437709 - RNA, 19 nt, Homo sapiens
gagccaagugcaucucuuu

SEQ ID NO: 1437710 - RNA, 19 nt, Homo sapiens
agagggaguucucacaaga

SEQ ID NO: 1437711 - RNA, 19 nt, Homo sapiens
agacaagccugggaagaga

SEQ ID NO: 1437712 - RNA, 19 nt, Homo sapiens
aaugacaggugguuagaga

SEQ ID NO: 1437713 - RNA, 19 nt, Homo sapiens
gagaagcgugucuuuccua

SEQ ID NO: 1437714 - RNA, 19 nt, Homo sapiens
gcaaaguuaugggcugcuu

SEQ ID NO: 1437715 - RNA, 19 nt, Homo sapiens
ccagcugacucaugguuug

SEQ ID NO: 1437716 - RNA, 19 nt, Homo sapiens
gaaaagaaaaggagaagga

SEQ ID NO: 1437717 - RNA, 19 nt, Homo sapiens
ccacccaaauugcaucuca

SEQ ID NO: 1437718 - RNA, 19 nt, Homo sapiens
guuagagacccagauauuu

SEQ ID NO: 1437719 - RNA, 19 nt, Homo sapiens
gaccuguaguuuaagaaug

SEQ ID NO: 1437720 - RNA, 19 nt, Homo sapiens
gcaaucgucuuaauuuccu

SEQ ID NO: 1437721 - RNA, 19 nt, Homo sapiens
ggaugguaauuccuuuaau

SEQ ID NO: 1437722 - RNA, 19 nt, Homo sapiens
cacaagaucugcugguuuu

SEQ ID NO: 1437723 - RNA, 19 nt, Homo sapiens
cuggauagcaugccuaauu

SEQ ID NO: 1437724 - RNA, 19 nt, Homo sapiens
gguguucaauaagggaaua

SEQ ID NO: 1437725 - RNA, 19 nt, Homo sapiens
uagagacccagauauuuaa

SEQ ID NO: 1437726 - RNA, 19 nt, Homo sapiens
caauuaucaucguaaagga

SEQ ID NO: 1437727 - RNA, 19 nt, Homo sapiens
agaagcgugucuuuccuaa

SEQ ID NO: 1437728 - RNA, 19 nt, Homo sapiens
caucacagacaaugacuug

SEQ ID NO: 1437729 - RNA, 19 nt, Homo sapiens
ugacuucacugacagaaaa

SEQ ID NO: 1437730 - RNA, 19 nt, Homo sapiens
caugucauauguguaacua

SEQ ID NO: 1437731 - RNA, 19 nt, Homo sapiens
guccaugucauauguguaa

SEQ ID NO: 1437732 - RNA, 19 nt, Homo sapiens
uauggaagacuuugaaugu

SEQ ID NO: 1437733 - RNA, 19 nt, Homo sapiens
gccaugaucauugugguua

SEQ ID NO: 1437734 - RNA, 19 nt, Homo sapiens
caaauguggaccuguaguu

SEQ ID NO: 1437735 - RNA, 19 nt, Homo sapiens
gaauggaagcccugaaguc

SEQ ID NO: 1437736 - RNA, 19 nt, Homo sapiens
ugucauauguguaacuagu

SEQ ID NO: 1437737 - RNA, 19 nt, Homo sapiens
gcugacucaugguuugaaa

SEQ ID NO: 1437738 - RNA, 19 nt, Homo sapiens
gcacaagagagaagaaagg

SEQ ID NO: 1437739 - RNA, 19 nt, Homo sapiens
gugcaucucuuugagcaau

SEQ ID NO: 1437740 - RNA, 19 nt, Homo sapiens
caauaagggaauacugauu

SEQ ID NO: 1437741 - RNA, 19 nt, Homo sapiens
aaauagguguucaauaagg

SEQ ID NO: 1437742 - RNA, 19 nt, Homo sapiens
aauguggaccuguaguuua

SEQ ID NO: 1437743 - RNA, 19 nt, Homo sapiens
ucagagaugccuucaguuc

SEQ ID NO: 1437744 - RNA, 19 nt, Homo sapiens
acacaaugcucccaguucu

SEQ ID NO: 1437745 - RNA, 19 nt, Homo sapiens
agagaugccuucaguucug

SEQ ID NO: 1437746 - RNA, 19 nt, Homo sapiens
ucacaagaucugcugguuu

SEQ ID NO: 1437747 - RNA, 19 nt, Homo sapiens
ggaacaguuaucuuugauu

SEQ ID NO: 1437748 - RNA, 19 nt, Homo sapiens
acuaaggagucugaaauga

SEQ ID NO: 1437749 - RNA, 19 nt, Homo sapiens
ccaagugcaucucuuugag

SEQ ID NO: 1437750 - RNA, 19 nt, Homo sapiens
ggauguucauuucuauagu

SEQ ID NO: 1437751 - RNA, 19 nt, Homo sapiens
ccagggccguuguguagau

SEQ ID NO: 1437752 - RNA, 19 nt, Homo sapiens
gagcucaccagccaaguuc

SEQ ID NO: 1437753 - RNA, 19 nt, Homo sapiens
gauagcaugccuaauugug

SEQ ID NO: 1437754 - RNA, 19 nt, Homo sapiens
aauaagggaauacugauug

SEQ ID NO: 1437755 - RNA, 19 nt, Homo sapiens
gccaagugcaucucuuuga

SEQ ID NO: 1437756 - RNA, 19 nt, Homo sapiens
gggcagagagaccuuggaa

SEQ ID NO: 1437757 - RNA, 19 nt, Homo sapiens
gagaagaaaggaaaagaaa

SEQ ID NO: 1437758 - RNA, 19 nt, Homo sapiens
gaaaagaaaccagggaguu

SEQ ID NO: 1437759 - RNA, 19 nt, Homo sapiens
ggcccucucuagcaaaguu

SEQ ID NO: 1437760 - RNA, 19 nt, Homo sapiens
gaucagggcuggcgauaua

SEQ ID NO: 1437761 - RNA, 19 nt, Homo sapiens
gaaauuaccaaccaacuua

SEQ ID NO: 1437762 - RNA, 19 nt, Homo sapiens
cgacguagguguuaggaua

SEQ ID NO: 1437763 - RNA, 19 nt, Homo sapiens
gcagaaaugaguaaaguuu

SEQ ID NO: 1437764 - RNA, 19 nt, Homo sapiens
gaaagcagggucuaaagaa

SEQ ID NO: 1437765 - RNA, 19 nt, Homo sapiens
ugaaauggcaguuguauug

SEQ ID NO: 1437766 - RNA, 19 nt, Homo sapiens
gggaugggacguaugauua

SEQ ID NO: 1437767 - RNA, 19 nt, Homo sapiens
gaagaaauuuggccgaaaa

SEQ ID NO: 1437768 - RNA, 19 nt, Homo sapiens
caacagcccugguacuucu

SEQ ID NO: 1437769 - RNA, 19 nt, Homo sapiens
ccagguggacucaguauuu

SEQ ID NO: 1437770 - RNA, 19 nt, Homo sapiens
cuaaagaaauuaccaacca

SEQ ID NO: 1437771 - RNA, 19 nt, Homo sapiens
aaagcagggucuaaagaaa

SEQ ID NO: 1437772 - RNA, 19 nt, Homo sapiens
caugagcuccuuauuugua

SEQ ID NO: 1437773 - RNA, 19 nt, Homo sapiens
accaugagcuccuuauuug

SEQ ID NO: 1437774 - RNA, 19 nt, Homo sapiens
ggaagggucuuugcagucu

SEQ ID NO: 1437775 - RNA, 19 nt, Homo sapiens
gcaguuguauugcugucuu

SEQ ID NO: 1437776 - RNA, 19 nt, Homo sapiens
gcaagcucaucuuccuaaa

SEQ ID NO: 1437777 - RNA, 19 nt, Homo sapiens
guauugcugucuuaucaug

SEQ ID NO: 1437778 - RNA, 19 nt, Homo sapiens
gaauguagaaccagcaaca

SEQ ID NO: 1437779 - RNA, 19 nt, Homo sapiens
ccuggaaaccauuguauuu

SEQ ID NO: 1437780 - RNA, 19 nt, Homo sapiens
ugauaucuaugcaugcuau

SEQ ID NO: 1437781 - RNA, 19 nt, Homo sapiens
ggugagggccugaagcuau

SEQ ID NO: 1437782 - RNA, 19 nt, Homo sapiens
uaggauaacagccauaaau

SEQ ID NO: 1437783 - RNA, 19 nt, Homo sapiens
aagggucuuugcagucuua

SEQ ID NO: 1437784 - RNA, 19 nt, Homo sapiens
ggcaagcucaucuuccuaa

SEQ ID NO: 1437785 - RNA, 19 nt, Homo sapiens
aagcagaaaugaguaaagu

SEQ ID NO: 1437786 - RNA, 19 nt, Homo sapiens
cauaaaugguuguaagacu

SEQ ID NO: 1437787 - RNA, 19 nt, Homo sapiens
gugagggccugaagcuaug

SEQ ID NO: 1437788 - RNA, 19 nt, Homo sapiens
ugaaagcagggucuaaaga

SEQ ID NO: 1437789 - RNA, 19 nt, Homo sapiens
ccaaccagguggacucagu

SEQ ID NO: 1437790 - RNA, 19 nt, Homo sapiens
guaagacuuugggcucaga

SEQ ID NO: 1437791 - RNA, 19 nt, Homo sapiens
caaccaacuuagacuggau

SEQ ID NO: 1437792 - RNA, 19 nt, Homo sapiens
uuacucgacgccacaaaua

SEQ ID NO: 1437793 - RNA, 19 nt, Homo sapiens
uaugguagccacccuguga

SEQ ID NO: 1437794 - RNA, 19 nt, Homo sapiens
caguuguauugcugucuua

SEQ ID NO: 1437795 - RNA, 19 nt, Homo sapiens
aaccaugagcuccuuauuu

SEQ ID NO: 1437796 - RNA, 19 nt, Homo sapiens
agaagaaauuuggccgaaa

SEQ ID NO: 1437797 - RNA, 19 nt, Homo sapiens
gaagggucuuugcagucuu

SEQ ID NO: 1437798 - RNA, 19 nt, Homo sapiens
cagaagcagaaaugaguaa

SEQ ID NO: 1437799 - RNA, 19 nt, Homo sapiens
cuggaacccucccucugua

SEQ ID NO: 1437800 - RNA, 19 nt, Homo sapiens
ugacacaucggagugaauu

SEQ ID NO: 1437801 - RNA, 19 nt, Homo sapiens
caaccagguggacucagua

SEQ ID NO: 1437802 - RNA, 19 nt, Homo sapiens
gaagcagaaaugaguaaag

SEQ ID NO: 1437803 - RNA, 19 nt, Homo sapiens
ggaacuggcagagcugaga

SEQ ID NO: 1437804 - RNA, 19 nt, Homo sapiens
aaggaggguucuacaggaa

SEQ ID NO: 1437805 - RNA, 19 nt, Homo sapiens
ggucuuugcagucuuagga

SEQ ID NO: 1437806 - RNA, 19 nt, Homo sapiens
agcagggucuaaagaaauu

SEQ ID NO: 1437807 - RNA, 19 nt, Homo sapiens
ggaugggacguaugauuag

SEQ ID NO: 1437808 - RNA, 19 nt, Homo sapiens
gcaacagcccugguacuuc

SEQ ID NO: 1437809 - RNA, 19 nt, Homo sapiens
gacguagguguuaggauaa

SEQ ID NO: 1437810 - RNA, 19 nt, Homo sapiens
cagaaaugaguaaaguuug

SEQ ID NO: 1437811 - RNA, 19 nt, Homo sapiens
ccagaagcagaaaugagua

SEQ ID NO: 1437812 - RNA, 19 nt, Homo sapiens
ccuuauggcuguggugaga

SEQ ID NO: 1437813 - RNA, 19 nt, Homo sapiens
cccauguccuggugacgua

SEQ ID NO: 1437814 - RNA, 19 nt, Homo sapiens
uuguauugcugucuuauca

SEQ ID NO: 1437815 - RNA, 19 nt, Homo sapiens
gcagagccuuccggugcuu

SEQ ID NO: 1437816 - RNA, 19 nt, Homo sapiens
gcaugcuauuaccgccuua

SEQ ID NO: 1437817 - RNA, 19 nt, Homo sapiens
agacuuugggcucagauaa

SEQ ID NO: 1437818 - RNA, 19 nt, Homo sapiens
guuguggccuggauacucu

SEQ ID NO: 1437819 - RNA, 19 nt, Homo sapiens
ccugugagcucgggcuguu

SEQ ID NO: 1437820 - RNA, 19 nt, Homo sapiens
guggugagauuaaaacaug

SEQ ID NO: 1437821 - RNA, 19 nt, Homo sapiens
uuauggcuguggugagauu

SEQ ID NO: 1437822 - RNA, 19 nt, Homo sapiens
ugaggcaacgcguuccuuu

SEQ ID NO: 1437823 - RNA, 19 nt, Homo sapiens
uagccacucuccagcaaca

SEQ ID NO: 1437824 - RNA, 19 nt, Homo sapiens
agaaauuaccaaccaacuu

SEQ ID NO: 1437825 - RNA, 19 nt, Homo sapiens
acacaucggagugaauuga

SEQ ID NO: 1437826 - RNA, 19 nt, Homo sapiens
ggucuaaagaaauuaccaa

SEQ ID NO: 1437827 - RNA, 19 nt, Homo sapiens
gacuggaucuagaagaaaa

SEQ ID NO: 1437828 - RNA, 19 nt, Homo sapiens
cugcuucccuucucuuaag

SEQ ID NO: 1437829 - RNA, 19 nt, Homo sapiens
ggggucugguuuucuguua

SEQ ID NO: 1437830 - RNA, 19 nt, Homo sapiens
cuaacugaauguagaacca

SEQ ID NO: 1437831 - RNA, 19 nt, Homo sapiens
augagcuccuuauuuguaa

SEQ ID NO: 1437832 - RNA, 19 nt, Homo sapiens
gcagggucuaaagaaauua

SEQ ID NO: 1437833 - RNA, 19 nt, Homo sapiens
ccuaaaccaugagcuccuu

SEQ ID NO: 1437834 - RNA, 19 nt, Homo sapiens
gaaauggcaguuguauugc

SEQ ID NO: 1437835 - RNA, 19 nt, Homo sapiens
aagcagggucuaaagaaau

SEQ ID NO: 1437836 - RNA, 19 nt, Homo sapiens
uggcuguggugagauuaaa

SEQ ID NO: 1437837 - RNA, 19 nt, Homo sapiens
cuguuagucuuuucucuua

SEQ ID NO: 1437838 - RNA, 19 nt, Homo sapiens
cuggcgauauaucuaggua

SEQ ID NO: 1437839 - RNA, 19 nt, Homo sapiens
gcccgugaccagugacuug

SEQ ID NO: 1437840 - RNA, 19 nt, Homo sapiens
ggaacccucccucuguauc

SEQ ID NO: 1437841 - RNA, 19 nt, Homo sapiens
aaaccaugagcuccuuauu

SEQ ID NO: 1437842 - RNA, 19 nt, Homo sapiens
gcugcuucccuucucuuaa

SEQ ID NO: 1437843 - RNA, 19 nt, Homo sapiens
acuccagccucggauguuu

SEQ ID NO: 1437844 - RNA, 19 nt, Homo sapiens
gaggcaacgcguuccuuuc

SEQ ID NO: 1437845 - RNA, 19 nt, Homo sapiens
uagccuaagcgaaccagaa

SEQ ID NO: 1437846 - RNA, 19 nt, Homo sapiens
ccugggaugggacguauga

SEQ ID NO: 1437847 - RNA, 19 nt, Homo sapiens
ugagcuccuuauuuguaaa

SEQ ID NO: 1437848 - RNA, 19 nt, Homo sapiens
uaaaccaugagcuccuuau

SEQ ID NO: 1437849 - RNA, 19 nt, Homo sapiens
aagcucaucuuccuaaacc

SEQ ID NO: 1437850 - RNA, 19 nt, Homo sapiens
gcucgcugcuucccuucuc

SEQ ID NO: 1437851 - RNA, 19 nt, Homo sapiens
ccucugcuguuccucucuu

SEQ ID NO: 1437852 - RNA, 19 nt, Homo sapiens
cggguuguguuuccugcuu

SEQ ID NO: 1437853 - RNA, 19 nt, Homo sapiens
cagguggacucaguauuuu

SEQ ID NO: 1437854 - RNA, 19 nt, Homo sapiens
aggauaacagccauaaaug

SEQ ID NO: 1437855 - RNA, 19 nt, Homo sapiens
cccagaagcagaaaugagu

SEQ ID NO: 1437856 - RNA, 19 nt, Homo sapiens
ggucugauuuuguaguugu

SEQ ID NO: 1437857 - RNA, 19 nt, Homo sapiens
ccuggaacccucccucugu

SEQ ID NO: 1437858 - RNA, 19 nt, Homo sapiens
caaauggccuugugaguuu

SEQ ID NO: 1437859 - RNA, 19 nt, Homo sapiens
ucaaauacauaaccuggua

SEQ ID NO: 1437860 - RNA, 19 nt, Homo sapiens
guggagagcugaccucauu

SEQ ID NO: 1437861 - RNA, 19 nt, Homo sapiens
gaccaaggacccauuguua

SEQ ID NO: 1437862 - RNA, 19 nt, Homo sapiens
gagcugaccucauuucucu

SEQ ID NO: 1437863 - RNA, 19 nt, Homo sapiens
gcaaauggccuugugaguu

SEQ ID NO: 1437864 - RNA, 19 nt, Homo sapiens
uaucagcccuucugccuuu

SEQ ID NO: 1437865 - RNA, 19 nt, Homo sapiens
gcaaguacuuaguggauca

SEQ ID NO: 1437866 - RNA, 19 nt, Homo sapiens
gcagaaaguuuggaagcaa

SEQ ID NO: 1437867 - RNA, 19 nt, Homo sapiens
uagaaggagucaaccagua

SEQ ID NO: 1437868 - RNA, 19 nt, Homo sapiens
ccagaugcccuuccaguuu

SEQ ID NO: 1437869 - RNA, 19 nt, Homo sapiens
ccaaggacccauuguuaaa

SEQ ID NO: 1437870 - RNA, 19 nt, Homo sapiens
ccagaacugucucagcaaa

SEQ ID NO: 1437871 - RNA, 19 nt, Homo sapiens
gcagauccuucuagaccaa

SEQ ID NO: 1437872 - RNA, 19 nt, Homo sapiens
ccacgcagauccuucuaga

SEQ ID NO: 1437873 - RNA, 19 nt, Homo sapiens
gaagagcugugaggaugug

SEQ ID NO: 1437874 - RNA, 19 nt, Homo sapiens
gugaggauguggaugaaug

SEQ ID NO: 1437875 - RNA, 19 nt, Homo sapiens
gaacgagugugagcucuac

SEQ ID NO: 1437876 - RNA, 19 nt, Homo sapiens
gaaugaaacgguucuaguc

SEQ ID NO: 1437877 - RNA, 19 nt, Homo sapiens
gagaaaagguggcaaugug

SEQ ID NO: 1437878 - RNA, 19 nt, Homo sapiens
caaggucaccaucuuugua

SEQ ID NO: 1437879 - RNA, 19 nt, Homo sapiens
ucccuuagauuaugcacua

SEQ ID NO: 1437880 - RNA, 19 nt, Homo sapiens
gcagacggcagaaaguuug

SEQ ID NO: 1437881 - RNA, 19 nt, Homo sapiens
guagagguaucagugaaug

SEQ ID NO: 1437882 - RNA, 19 nt, Homo sapiens
guacuuaguggaucacgaa

SEQ ID NO: 1437883 - RNA, 19 nt, Homo sapiens
cagaugcccuuccaguuuc

SEQ ID NO: 1437884 - RNA, 19 nt, Homo sapiens
gagggcagcggcaauguga

SEQ ID NO: 1437885 - RNA, 19 nt, Homo sapiens
ggagguggacgucgacaug

SEQ ID NO: 1437886 - RNA, 19 nt, Homo sapiens
gagggcauccgccacauga

SEQ ID NO: 1437887 - RNA, 19 nt, Homo sapiens
gcugugaggauguggauga

SEQ ID NO: 1437888 - RNA, 19 nt, Homo sapiens
cagcggaggcaaaguuauu

SEQ ID NO: 1437889 - RNA, 19 nt, Homo sapiens
gaccaucuccuuccauuac

SEQ ID NO: 1437890 - RNA, 19 nt, Homo sapiens
gcccuucccuuagauuaug

SEQ ID NO: 1437891 - RNA, 19 nt, Homo sapiens
ggagagcugaccucauuuc

SEQ ID NO: 1437892 - RNA, 19 nt, Homo sapiens
gaaaguuuggaagcaagua

SEQ ID NO: 1437893 - RNA, 19 nt, Homo sapiens
cauggauucugccugaguu

SEQ ID NO: 1437894 - RNA, 19 nt, Homo sapiens
ccaaaaugcugugcaaaug

SEQ ID NO: 1437895 - RNA, 19 nt, Homo sapiens
aagaccaucuccuuccauu

SEQ ID NO: 1437896 - RNA, 19 nt, Homo sapiens
uuacuucccuuuugagaaa

SEQ ID NO: 1437897 - RNA, 19 nt, Homo sapiens
ccucugcgcauguggcaua

SEQ ID NO: 1437898 - RNA, 19 nt, Homo sapiens
aaugugagcuacgugaaga

SEQ ID NO: 1437899 - RNA, 19 nt, Homo sapiens
gcaaugugagcuacgugaa

SEQ ID NO: 1437900 - RNA, 19 nt, Homo sapiens
ggagucaaccaguacagau

SEQ ID NO: 1437901 - RNA, 19 nt, Homo sapiens
caaauacauaaccugguaa

SEQ ID NO: 1437902 - RNA, 19 nt, Homo sapiens
caguacagaugcauuuguc

SEQ ID NO: 1437903 - RNA, 19 nt, Homo sapiens
ggcagcggaggcaaaguua

SEQ ID NO: 1437904 - RNA, 19 nt, Homo sapiens
gauucugccugaguuacuu

SEQ ID NO: 1437905 - RNA, 19 nt, Homo sapiens
uguccaaggucaccaucuu

SEQ ID NO: 1437906 - RNA, 19 nt, Homo sapiens
gggaccacaugcaucaaca

SEQ ID NO: 1437907 - RNA, 19 nt, Homo sapiens
ggcagaaaguuuggaagca

SEQ ID NO: 1437908 - RNA, 19 nt, Homo sapiens
agaacugucucagcaaaca

SEQ ID NO: 1437909 - RNA, 19 nt, Homo sapiens
ccaagaccaucuccuucca

SEQ ID NO: 1437910 - RNA, 19 nt, Homo sapiens
gugaagacgucuccauucc

SEQ ID NO: 1437911 - RNA, 19 nt, Homo sapiens
gauuccgacuggcaagaug

SEQ ID NO: 1437912 - RNA, 19 nt, Homo sapiens
gaucacgaaguccauuuua

SEQ ID NO: 1437913 - RNA, 19 nt, Homo sapiens
ccagcacguuguucuuauc

SEQ ID NO: 1437914 - RNA, 19 nt, Homo sapiens
caacugcugccaucacucu

SEQ ID NO: 1437915 - RNA, 19 nt, Homo sapiens
ccaaccacguguccaaggu

SEQ ID NO: 1437916 - RNA, 19 nt, Homo sapiens
ugaaugaaacgguucuagu

SEQ ID NO: 1437917 - RNA, 19 nt, Homo sapiens
ggaagagcugugaggaugu

SEQ ID NO: 1437918 - RNA, 19 nt, Homo sapiens
gaaggagucaaccaguaca

SEQ ID NO: 1437919 - RNA, 19 nt, Homo sapiens
cuuaguggaucacgaaguc

SEQ ID NO: 1437920 - RNA, 19 nt, Homo sapiens
gcauguggcauaggaagug

SEQ ID NO: 1437921 - RNA, 19 nt, Homo sapiens
uugaggcccuucccuuaga

SEQ ID NO: 1437922 - RNA, 19 nt, Homo sapiens
cccaacagccugcgguuug

SEQ ID NO: 1437923 - RNA, 19 nt, Homo sapiens
ggacugggaaccgcuguca

SEQ ID NO: 1437924 - RNA, 19 nt, Homo sapiens
caaccaguacagaugcauu

SEQ ID NO: 1437925 - RNA, 19 nt, Homo sapiens
cauggugugucuucccaau

SEQ ID NO: 1437926 - RNA, 19 nt, Homo sapiens
ucaaaauggugguacaugu

SEQ ID NO: 1437927 - RNA, 19 nt, Homo sapiens
gcugaccucauuucucuuc

SEQ ID NO: 1437928 - RNA, 19 nt, Homo sapiens
ccgcaucgcugggacaaac

SEQ ID NO: 1437929 - RNA, 19 nt, Homo sapiens
gagucaaccaguacagaug

SEQ ID NO: 1437930 - RNA, 19 nt, Homo sapiens
ugaguuacuucccuuuuga

SEQ ID NO: 1437931 - RNA, 19 nt, Homo sapiens
accaaggacccauuguuaa

SEQ ID NO: 1437932 - RNA, 19 nt, Homo sapiens
cuuugaggcccuucccuua

SEQ ID NO: 1437933 - RNA, 19 nt, Homo sapiens
cccagcacguuguucuuau

SEQ ID NO: 1437934 - RNA, 19 nt, Homo sapiens
cggcagcggaggcaaaguu

SEQ ID NO: 1437935 - RNA, 19 nt, Homo sapiens
ggauggguggcuuuccaaa

SEQ ID NO: 1437936 - RNA, 19 nt, Homo sapiens
guccaaggucaccaucuuu

SEQ ID NO: 1437937 - RNA, 19 nt, Homo sapiens
cgucuccauuccaguguga

SEQ ID NO: 1437938 - RNA, 19 nt, Homo sapiens
agaccaaggacccauuguu

SEQ ID NO: 1437939 - RNA, 19 nt, Homo sapiens
ugaacuagcuggggagaga

SEQ ID NO: 1437940 - RNA, 19 nt, Homo sapiens
gggcauccgccacaugaag

SEQ ID NO: 1437941 - RNA, 19 nt, Homo sapiens
cuguagagguaucagugaa

SEQ ID NO: 1437942 - RNA, 19 nt, Homo sapiens
gcagcggcaaugugagcua

SEQ ID NO: 1437943 - RNA, 19 nt, Homo sapiens
gcauggauucugccugagu

SEQ ID NO: 1437944 - RNA, 19 nt, Homo sapiens
cugcgcauguggcauagga

SEQ ID NO: 1437945 - RNA, 19 nt, Homo sapiens
cggaagagcagccacaaaa

SEQ ID NO: 1437946 - RNA, 19 nt, Homo sapiens
cauggaauagcacggaaga

SEQ ID NO: 1437947 - RNA, 19 nt, Homo sapiens
ccaggcuugcuaugaauga

SEQ ID NO: 1437948 - RNA, 19 nt, Homo sapiens
gcacuaauucucuuaaaac

SEQ ID NO: 1437949 - RNA, 19 nt, Homo sapiens
ccaaggucaccaucuuugu

SEQ ID NO: 1437950 - RNA, 19 nt, Homo sapiens
guuuggaagcaaguacuua

SEQ ID NO: 1437951 - RNA, 19 nt, Homo sapiens
aaccaguacagaugcauuu

SEQ ID NO: 1437952 - RNA, 19 nt, Homo sapiens
ccagcagcauggugugucu

SEQ ID NO: 1437953 - RNA, 19 nt, Homo sapiens
agaccaucuccuuccauua

SEQ ID NO: 1437954 - RNA, 19 nt, Homo sapiens
ccacguggcugcuguacuc

SEQ ID NO: 1437955 - RNA, 19 nt, Homo sapiens
gaugagauuuccuuuugua

SEQ ID NO: 1437956 - RNA, 19 nt, Homo sapiens
gaccuccuaugaugagauu

SEQ ID NO: 1437957 - RNA, 19 nt, Homo sapiens
ggacagagcccugggugau

SEQ ID NO: 1437958 - RNA, 19 nt, Homo sapiens
aaaggaaucgugcuuguga

SEQ ID NO: 1437959 - RNA, 19 nt, Homo sapiens
gcagguagcccaggguguu

SEQ ID NO: 1437960 - RNA, 19 nt, Homo sapiens
uggcagcacuuguuuacug

SEQ ID NO: 1437961 - RNA, 19 nt, Homo sapiens
cagcacagcccuuguugga

SEQ ID NO: 1437962 - RNA, 19 nt, Homo sapiens
ggaccagcccucacuccuu

SEQ ID NO: 1437963 - RNA, 19 nt, Homo sapiens
auaaaggaaucgugcuugu

SEQ ID NO: 1437964 - RNA, 19 nt, Homo sapiens
cagaggaggcugcuguaga

SEQ ID NO: 1437965 - RNA, 19 nt, Homo sapiens
agaggaggcugcuguagac

SEQ ID NO: 1437966 - RNA, 19 nt, Homo sapiens
ccacccugcuggccuuugu

SEQ ID NO: 1437967 - RNA, 19 nt, Homo sapiens
gcaccgucuuccucuucuu

SEQ ID NO: 1437968 - RNA, 19 nt, Homo sapiens
cuuguuuacuggcugcuuu

SEQ ID NO: 1437969 - RNA, 19 nt, Homo sapiens
gagauuuccuuuuguacau

SEQ ID NO: 1437970 - RNA, 19 nt, Homo sapiens
gcacagugggcccuugucu

SEQ ID NO: 1437971 - RNA, 19 nt, Homo sapiens
aaacaaguugcuccucaga

SEQ ID NO: 1437972 - RNA, 19 nt, Homo sapiens
gcagagggguggaauacgu

SEQ ID NO: 1437973 - RNA, 19 nt, Homo sapiens
ugcgugagguccuggagaa

SEQ ID NO: 1437974 - RNA, 19 nt, Homo sapiens
gcaggacugggccacauuc

SEQ ID NO: 1437975 - RNA, 19 nt, Homo sapiens
ggucaacugcggccucaca

SEQ ID NO: 1437976 - RNA, 19 nt, Homo sapiens
aaauaaaggaaucgugcuu

SEQ ID NO: 1437977 - RNA, 19 nt, Homo sapiens
agggacugcucuuuaggaa

SEQ ID NO: 1437978 - RNA, 19 nt, Homo sapiens
gguggcagcacuuguuuac

SEQ ID NO: 1437979 - RNA, 19 nt, Homo sapiens
gggcaccgucuuccucuuc

SEQ ID NO: 1437980 - RNA, 19 nt, Homo sapiens
acagagcccugggugaucu

SEQ ID NO: 1437981 - RNA, 19 nt, Homo sapiens
ccaacaggccacgggauga

SEQ ID NO: 1437982 - RNA, 19 nt, Homo sapiens
uaaaggaaucgugcuugug

SEQ ID NO: 1437983 - RNA, 19 nt, Homo sapiens
gcagggcucggcuacacau

SEQ ID NO: 1437984 - RNA, 19 nt, Homo sapiens
gugcaggacugggccacau

SEQ ID NO: 1437985 - RNA, 19 nt, Homo sapiens
ggguggcagcacuuguuua

SEQ ID NO: 1437986 - RNA, 19 nt, Homo sapiens
ggccacgggaugacaguug

SEQ ID NO: 1437987 - RNA, 19 nt, Homo sapiens
gccggcagcuuccucuacu

SEQ ID NO: 1437988 - RNA, 19 nt, Homo sapiens
gcaaagaacuuacugauuc

SEQ ID NO: 1437989 - RNA, 19 nt, Homo sapiens
gaagauauauucugucguu

SEQ ID NO: 1437990 - RNA, 19 nt, Homo sapiens
gauaggacuugaagaauaa

SEQ ID NO: 1437991 - RNA, 19 nt, Homo sapiens
ggacaugaaccuagaguaa

SEQ ID NO: 1437992 - RNA, 19 nt, Homo sapiens
ugauaggacuugaagaaua

SEQ ID NO: 1437993 - RNA, 19 nt, Homo sapiens
gaaccuagaguaaauaugu

SEQ ID NO: 1437994 - RNA, 19 nt, Homo sapiens
gcaagaagcuuugggacau

SEQ ID NO: 1437995 - RNA, 19 nt, Homo sapiens
uaaagugacuggagaaagu

SEQ ID NO: 1437996 - RNA, 19 nt, Homo sapiens
gaguauugcagcauuauua

SEQ ID NO: 1437997 - RNA, 19 nt, Homo sapiens
gaaguaaugcaacagagua

SEQ ID NO: 1437998 - RNA, 19 nt, Homo sapiens
caaguaugccgauagaaua

SEQ ID NO: 1437999 - RNA, 19 nt, Homo sapiens
gaucacaguugccucaaau

SEQ ID NO: 1438000 - RNA, 19 nt, Homo sapiens
gaucgaaguuuaccuugug

SEQ ID NO: 1438001 - RNA, 19 nt, Homo sapiens
ccagacagauguuguacuu

SEQ ID NO: 1438002 - RNA, 19 nt, Homo sapiens
gaacagcuuuucagcauuu

SEQ ID NO: 1438003 - RNA, 19 nt, Homo sapiens
caucagcuauuuaugcaaa

SEQ ID NO: 1438004 - RNA, 19 nt, Homo sapiens
caucaaugguguggaauaa

SEQ ID NO: 1438005 - RNA, 19 nt, Homo sapiens
ucaacgagauccuuauuca

SEQ ID NO: 1438006 - RNA, 19 nt, Homo sapiens
guaaccugaucgaaguuua

SEQ ID NO: 1438007 - RNA, 19 nt, Homo sapiens
ccucugaacaagauuauua

SEQ ID NO: 1438008 - RNA, 19 nt, Homo sapiens
guauggagauaucgaguau

SEQ ID NO: 1438009 - RNA, 19 nt, Homo sapiens
ggcaaaggcuuggguguga

SEQ ID NO: 1438010 - RNA, 19 nt, Homo sapiens
aaucuuggcugaaccuaaa

SEQ ID NO: 1438011 - RNA, 19 nt, Homo sapiens
cgagauccuuauucaaauu

SEQ ID NO: 1438012 - RNA, 19 nt, Homo sapiens
gaugaagaacuuacaagaa

SEQ ID NO: 1438013 - RNA, 19 nt, Homo sapiens
guuuaauccucauccuuua

SEQ ID NO: 1438014 - RNA, 19 nt, Homo sapiens
gaauagguguuuccuucau

SEQ ID NO: 1438015 - RNA, 19 nt, Homo sapiens
ucaccgagauguugaagau

SEQ ID NO: 1438016 - RNA, 19 nt, Homo sapiens
ccaagucagcaacaauuua

SEQ ID NO: 1438017 - RNA, 19 nt, Homo sapiens
gaguguacaugauugauag

SEQ ID NO: 1438018 - RNA, 19 nt, Homo sapiens
guaccaggauuggaauauu

SEQ ID NO: 1438019 - RNA, 19 nt, Homo sapiens
uccaaacgcuugucaguug

SEQ ID NO: 1438020 - RNA, 19 nt, Homo sapiens
gggcauugcuuucgucaag

SEQ ID NO: 1438021 - RNA, 19 nt, Homo sapiens
caagaguuccuuucacuga

SEQ ID NO: 1438022 - RNA, 19 nt, Homo sapiens
cagcaacaauuuaugcaau

SEQ ID NO: 1438023 - RNA, 19 nt, Homo sapiens
ggaagucaccgagauguug

SEQ ID NO: 1438024 - RNA, 19 nt, Homo sapiens
gcauugcuuucgucaaguu

SEQ ID NO: 1438025 - RNA, 19 nt, Homo sapiens
ugaauccucugaacaagau

SEQ ID NO: 1438026 - RNA, 19 nt, Homo sapiens
gaagaagaucugcgggaaa

SEQ ID NO: 1438027 - RNA, 19 nt, Homo sapiens
gaagaugaagaacuuacaa

SEQ ID NO: 1438028 - RNA, 19 nt, Homo sapiens
ggauugcugacauguauuu

SEQ ID NO: 1438029 - RNA, 19 nt, Homo sapiens
ggaucacaguugccucaaa

SEQ ID NO: 1438030 - RNA, 19 nt, Homo sapiens
caacagaguaaguaccauu

SEQ ID NO: 1438031 - RNA, 19 nt, Homo sapiens
guggacaguugacagcuuu

SEQ ID NO: 1438032 - RNA, 19 nt, Homo sapiens
caagucagcaacaauuuau

SEQ ID NO: 1438033 - RNA, 19 nt, Homo sapiens
gggcuacguacgauacuua

SEQ ID NO: 1438034 - RNA, 19 nt, Homo sapiens
gaauaaagugacuggagaa

SEQ ID NO: 1438035 - RNA, 19 nt, Homo sapiens
guuguuacguguagcagaa

SEQ ID NO: 1438036 - RNA, 19 nt, Homo sapiens
uauaguaguuguuccuuag

SEQ ID NO: 1438037 - RNA, 19 nt, Homo sapiens
agaaacaauugaccucuca

SEQ ID NO: 1438038 - RNA, 19 nt, Homo sapiens
gguguuuccuucauugaug

SEQ ID NO: 1438039 - RNA, 19 nt, Homo sapiens
uaccaggauuggaauauug

SEQ ID NO: 1438040 - RNA, 19 nt, Homo sapiens
ucaguuguaucaagaguuc

SEQ ID NO: 1438041 - RNA, 19 nt, Homo sapiens
acaugaaccuagaguaaau

SEQ ID NO: 1438042 - RNA, 19 nt, Homo sapiens
uaagguguauggagauauc

SEQ ID NO: 1438043 - RNA, 19 nt, Homo sapiens
ccaaguaugccgauagaau

SEQ ID NO: 1438044 - RNA, 19 nt, Homo sapiens
gaaacuccugugaaagaaa

SEQ ID NO: 1438045 - RNA, 19 nt, Homo sapiens
gcaucaaugguguggaaua

SEQ ID NO: 1438046 - RNA, 19 nt, Homo sapiens
gaagucaccgagauguuga

SEQ ID NO: 1438047 - RNA, 19 nt, Homo sapiens
caagagaagaaucuaacaa

SEQ ID NO: 1438048 - RNA, 19 nt, Homo sapiens
gauauauucugucguuuug

SEQ ID NO: 1438049 - RNA, 19 nt, Homo sapiens
ugaaacuccugugaaagaa

SEQ ID NO: 1438050 - RNA, 19 nt, Homo sapiens
gacaugaaccuagaguaaa

SEQ ID NO: 1438051 - RNA, 19 nt, Homo sapiens
uaucgaguauugcagcauu

SEQ ID NO: 1438052 - RNA, 19 nt, Homo sapiens
gaagaacuuacaagaaucu

SEQ ID NO: 1438053 - RNA, 19 nt, Homo sapiens
ggcaaagaacuuacugauu

SEQ ID NO: 1438054 - RNA, 19 nt, Homo sapiens
gauagaauaagugcuaaug

SEQ ID NO: 1438055 - RNA, 19 nt, Homo sapiens
gcagggccauggaggagau

SEQ ID NO: 1438056 - RNA, 19 nt, Homo sapiens
guacuuccaucaugcaaaa

SEQ ID NO: 1438057 - RNA, 19 nt, Homo sapiens
gucauggagugguucagua

SEQ ID NO: 1438058 - RNA, 19 nt, Homo sapiens
ggagauaucgaguauugca

SEQ ID NO: 1438059 - RNA, 19 nt, Homo sapiens
auggagauaucgaguauug

SEQ ID NO: 1438060 - RNA, 19 nt, Homo sapiens
ccaaaguccuacacagaag

SEQ ID NO: 1438061 - RNA, 19 nt, Homo sapiens
cagugaggcuccugcauuc

SEQ ID NO: 1438062 - RNA, 19 nt, Homo sapiens
ggaggaagcucuggaucac

SEQ ID NO: 1438063 - RNA, 19 nt, Homo sapiens
gagcuuugaguguacauga

SEQ ID NO: 1438064 - RNA, 19 nt, Homo sapiens
gaugauggaaguaaugcaa

SEQ ID NO: 1438065 - RNA, 19 nt, Homo sapiens
ugaagaacuuacaagaauc

SEQ ID NO: 1438066 - RNA, 19 nt, Homo sapiens
gaaucuaacaaacggcaaa

SEQ ID NO: 1438067 - RNA, 19 nt, Homo sapiens
gccgauagaauaagugcua

SEQ ID NO: 1438068 - RNA, 19 nt, Homo sapiens
uccuuuaccuuuagacgua

SEQ ID NO: 1438069 - RNA, 19 nt, Homo sapiens
aacgagauccuuauucaaa

SEQ ID NO: 1438070 - RNA, 19 nt, Homo sapiens
ccaggaagcaaucuccaaa

SEQ ID NO: 1438071 - RNA, 19 nt, Homo sapiens
caagaagcuuugggacaug

SEQ ID NO: 1438072 - RNA, 19 nt, Homo sapiens
gaucgaaguuuuagagcaa

SEQ ID NO: 1438073 - RNA, 19 nt, Homo sapiens
gggacaagcacaccaagga

SEQ ID NO: 1438074 - RNA, 19 nt, Homo sapiens
uguugaagaugaagaacuu

SEQ ID NO: 1438075 - RNA, 19 nt, Homo sapiens
agggauugcugacauguau

SEQ ID NO: 1438076 - RNA, 19 nt, Homo sapiens
acaaacggcaaagaacuua

SEQ ID NO: 1438077 - RNA, 19 nt, Homo sapiens
gaauaacccaagucagcaa

SEQ ID NO: 1438078 - RNA, 19 nt, Homo sapiens
ggauuggaauauugugaag

SEQ ID NO: 1438079 - RNA, 19 nt, Homo sapiens
uauaguaccaggauuggaa

SEQ ID NO: 1438080 - RNA, 19 nt, Homo sapiens
acaagcugcccaagcaaua

SEQ ID NO: 1438081 - RNA, 19 nt, Homo sapiens
guuguuccuuagagcaaua

SEQ ID NO: 1438082 - RNA, 19 nt, Homo sapiens
gagaagaaucuaacaaacg

SEQ ID NO: 1438083 - RNA, 19 nt, Homo sapiens
cuacauggaaagauucuga

SEQ ID NO: 1438084 - RNA, 19 nt, Homo sapiens
ccucaaauccagacagaug

SEQ ID NO: 1438085 - RNA, 19 nt, Homo sapiens
ugaguguacaugauugaua

SEQ ID NO: 1438086 - RNA, 19 nt, Homo sapiens
ggaaguaaugcaacagagu

SEQ ID NO: 1438087 - RNA, 19 nt, Homo sapiens
aaacuccugugaaagaaag

SEQ ID NO: 1438088 - RNA, 19 nt, Homo sapiens
gagaaacucuuaaagcaaa

SEQ ID NO: 1438089 - RNA, 19 nt, Homo sapiens
gcacaaugguuaacucuga

SEQ ID NO: 1438090 - RNA, 19 nt, Homo sapiens
gaggacauauuucuucuuu

SEQ ID NO: 1438091 - RNA, 19 nt, Homo sapiens
gaaguaaccaaucacaaua

SEQ ID NO: 1438092 - RNA, 19 nt, Homo sapiens
gaagguggauaaucauuuc

SEQ ID NO: 1438093 - RNA, 19 nt, Homo sapiens
gugagaaguuggauguuua

SEQ ID NO: 1438094 - RNA, 19 nt, Homo sapiens
gagcugaauucaucugauu

SEQ ID NO: 1438095 - RNA, 19 nt, Homo sapiens
ccacagaugaucaggauua

SEQ ID NO: 1438096 - RNA, 19 nt, Homo sapiens
aagaauagcacaaugguua

SEQ ID NO: 1438097 - RNA, 19 nt, Homo sapiens
ggaaaugugucauaaacca

SEQ ID NO: 1438098 - RNA, 19 nt, Homo sapiens
ugacagaucugacuauuuu

SEQ ID NO: 1438099 - RNA, 19 nt, Homo sapiens
gggagaaacucuuaaagca

SEQ ID NO: 1438100 - RNA, 19 nt, Homo sapiens
gggcacagaugaucaggaa

SEQ ID NO: 1438101 - RNA, 19 nt, Homo sapiens
ggacauauuucuucuuuug

SEQ ID NO: 1438102 - RNA, 19 nt, Homo sapiens
uuacccagcuggcuccuua

SEQ ID NO: 1438103 - RNA, 19 nt, Homo sapiens
gaaagaaauguaucaggaa

SEQ ID NO: 1438104 - RNA, 19 nt, Homo sapiens
caccaagaguucccucaua

SEQ ID NO: 1438105 - RNA, 19 nt, Homo sapiens
gaacaaggaauaccaagag

SEQ ID NO: 1438106 - RNA, 19 nt, Homo sapiens
gcacagaugaucaggaaug

SEQ ID NO: 1438107 - RNA, 19 nt, Homo sapiens
gaacucaccugcgucaucu

SEQ ID NO: 1438108 - RNA, 19 nt, Homo sapiens
gguuaacucugaggacaua

SEQ ID NO: 1438109 - RNA, 19 nt, Homo sapiens
ccagagaaguugggucaaa

SEQ ID NO: 1438110 - RNA, 19 nt, Homo sapiens
caaggaauaccaagagauu

SEQ ID NO: 1438111 - RNA, 19 nt, Homo sapiens
agaaauguaucaggaacua

SEQ ID NO: 1438112 - RNA, 19 nt, Homo sapiens
caaacaccaucccaucgaa

SEQ ID NO: 1438113 - RNA, 19 nt, Homo sapiens
ccagcuggcuccuuaacuu

SEQ ID NO: 1438114 - RNA, 19 nt, Homo sapiens
uagagagacugaacaagga

SEQ ID NO: 1438115 - RNA, 19 nt, Homo sapiens
ggagaaacucuuaaagcaa

SEQ ID NO: 1438116 - RNA, 19 nt, Homo sapiens
uaccagcacugcacuguga

SEQ ID NO: 1438117 - RNA, 19 nt, Homo sapiens
cagaugaucaggauuaaga

SEQ ID NO: 1438118 - RNA, 19 nt, Homo sapiens
ucaccugcgucaucuguuu

SEQ ID NO: 1438119 - RNA, 19 nt, Homo sapiens
ucagagaaaucuauaugag

SEQ ID NO: 1438120 - RNA, 19 nt, Homo sapiens
caaaauggaucaaaagagu

SEQ ID NO: 1438121 - RNA, 19 nt, Homo sapiens
gaaaauggacucagacuuc

SEQ ID NO: 1438122 - RNA, 19 nt, Homo sapiens
ggugagaacauagauauau

SEQ ID NO: 1438123 - RNA, 19 nt, Homo sapiens
gaaaguggaagugugaguu

SEQ ID NO: 1438124 - RNA, 19 nt, Homo sapiens
gccagggucuucuccuuug

SEQ ID NO: 1438125 - RNA, 19 nt, Homo sapiens
ggccacagaugaucaggau

SEQ ID NO: 1438126 - RNA, 19 nt, Homo sapiens
gagccagggucuucuccuu

SEQ ID NO: 1438127 - RNA, 19 nt, Homo sapiens
gaaguugggucaaaaugga

SEQ ID NO: 1438128 - RNA, 19 nt, Homo sapiens
guugguguguuucuugauu

SEQ ID NO: 1438129 - RNA, 19 nt, Homo sapiens
ggucuucuccuuugggaaa

SEQ ID NO: 1438130 - RNA, 19 nt, Homo sapiens
ugugagaaguuggauguuu

SEQ ID NO: 1438131 - RNA, 19 nt, Homo sapiens
ugaaguaaccaaucacaau

SEQ ID NO: 1438132 - RNA, 19 nt, Homo sapiens
caaagaaaucauacuguuc

SEQ ID NO: 1438133 - RNA, 19 nt, Homo sapiens
gcccuucacuguugauaca

SEQ ID NO: 1438134 - RNA, 19 nt, Homo sapiens
uaacucugaggacauauuu

SEQ ID NO: 1438135 - RNA, 19 nt, Homo sapiens
gaagaauagcacaaugguu

SEQ ID NO: 1438136 - RNA, 19 nt, Homo sapiens
gaugugagaaguuggaugu

SEQ ID NO: 1438137 - RNA, 19 nt, Homo sapiens
gaguaaacacuugaaagaa

SEQ ID NO: 1438138 - RNA, 19 nt, Homo sapiens
agaguaaacacuugaaaga

SEQ ID NO: 1438139 - RNA, 19 nt, Homo sapiens
ggacucagacuucucacau

SEQ ID NO: 1438140 - RNA, 19 nt, Homo sapiens
ucccugagcugaauucauc

SEQ ID NO: 1438141 - RNA, 19 nt, Homo sapiens
cuaauggaaaugugucaua

SEQ ID NO: 1438142 - RNA, 19 nt, Homo sapiens
cgaagaggcagcugaggaa

SEQ ID NO: 1438143 - RNA, 19 nt, Homo sapiens
agacguggaccuuugaauu

SEQ ID NO: 1438144 - RNA, 19 nt, Homo sapiens
guuuagacguggaccuuug

SEQ ID NO: 1438145 - RNA, 19 nt, Homo sapiens
caagaguucccucauaugg

SEQ ID NO: 1438146 - RNA, 19 nt, Homo sapiens
gucugaagguggauaauca

SEQ ID NO: 1438147 - RNA, 19 nt, Homo sapiens
gacguggaccuuugaauuc

SEQ ID NO: 1438148 - RNA, 19 nt, Homo sapiens
gaucaggaaugaguauagg

SEQ ID NO: 1438149 - RNA, 19 nt, Homo sapiens
ggacccauaggcaaacaaa

SEQ ID NO: 1438150 - RNA, 19 nt, Homo sapiens
ggcaauuccugagcucuga

SEQ ID NO: 1438151 - RNA, 19 nt, Homo sapiens
gaugaucaggauuaagaaa

SEQ ID NO: 1438152 - RNA, 19 nt, Homo sapiens
ugaagguggauaaucauuu

SEQ ID NO: 1438153 - RNA, 19 nt, Homo sapiens
ggaagaauagcacaauggu

SEQ ID NO: 1438154 - RNA, 19 nt, Homo sapiens
ggaacucaccugcgucauc

SEQ ID NO: 1438155 - RNA, 19 nt, Homo sapiens
cacaauaucaggcucuuug

SEQ ID NO: 1438156 - RNA, 19 nt, Homo sapiens
ucacuggacugguguacag

SEQ ID NO: 1438157 - RNA, 19 nt, Homo sapiens
gagcucugagaaacaaaua

SEQ ID NO: 1438158 - RNA, 19 nt, Homo sapiens
accaagaguucccucauau

SEQ ID NO: 1438159 - RNA, 19 nt, Homo sapiens
aagcuuuggugagaacaua

SEQ ID NO: 1438160 - RNA, 19 nt, Homo sapiens
gcucugagaaacaaauaug

SEQ ID NO: 1438161 - RNA, 19 nt, Homo sapiens
cacagaugaucaggauuaa

SEQ ID NO: 1438162 - RNA, 19 nt, Homo sapiens
gguggauaaucauuucaau

SEQ ID NO: 1438163 - RNA, 19 nt, Homo sapiens
ggaacuaauggaaaugugu

SEQ ID NO: 1438164 - RNA, 19 nt, Homo sapiens
uaucaggaacuaauggaaa

SEQ ID NO: 1438165 - RNA, 19 nt, Homo sapiens
gaaauguaucaggaacuaa

SEQ ID NO: 1438166 - RNA, 19 nt, Homo sapiens
ggauaaucauuucaaucuc

SEQ ID NO: 1438167 - RNA, 19 nt, Homo sapiens
caacauuuagagagacuga

SEQ ID NO: 1438168 - RNA, 19 nt, Homo sapiens
ggguugguguguuucuuga

SEQ ID NO: 1438169 - RNA, 19 nt, Homo sapiens
ggagacaucguggcaagga

SEQ ID NO: 1438170 - RNA, 19 nt, Homo sapiens
cacagaugaucaggaauga

SEQ ID NO: 1438171 - RNA, 19 nt, Homo sapiens
aaaguggaagugugaguuu

SEQ ID NO: 1438172 - RNA, 19 nt, Homo sapiens
ccugagcucugagaaacaa

SEQ ID NO: 1438173 - RNA, 19 nt, Homo sapiens
guggaccuuugaauucuga

SEQ ID NO: 1438174 - RNA, 19 nt, Homo sapiens
gacucagacuucucacaug

SEQ ID NO: 1438175 - RNA, 19 nt, Homo sapiens
ugcauccgguucuccauaa

SEQ ID NO: 1438176 - RNA, 19 nt, Homo sapiens
gaacaccgggagaaacucu

SEQ ID NO: 1438177 - RNA, 19 nt, Homo sapiens
ucaaaagaguaaacacuug

SEQ ID NO: 1438178 - RNA, 19 nt, Homo sapiens
gaugaucaggaaugaguau

SEQ ID NO: 1438179 - RNA, 19 nt, Homo sapiens
cagaugaucaggaaugagu

SEQ ID NO: 1438180 - RNA, 19 nt, Homo sapiens
gaggggcaaugugguuuua

SEQ ID NO: 1438181 - RNA, 19 nt, Homo sapiens
ugaagaauuuagugaccau

SEQ ID NO: 1438182 - RNA, 19 nt, Homo sapiens
cagcuggcuccuuaacuuu

SEQ ID NO: 1438183 - RNA, 19 nt, Homo sapiens
uaaggaagaauagcacaau

SEQ ID NO: 1438184 - RNA, 19 nt, Homo sapiens
uagugaccauugccagaaa

SEQ ID NO: 1438185 - RNA, 19 nt, Homo sapiens
uuugggaacuccauauaca

SEQ ID NO: 1438186 - RNA, 19 nt, Homo sapiens
agaauagcacaaugguuaa

SEQ ID NO: 1438187 - RNA, 19 nt, Homo sapiens
ucaggaaugaguauaggaa

SEQ ID NO: 1438188 - RNA, 19 nt, Homo sapiens
caagggagcugauaaagaa

SEQ ID NO: 1438189 - RNA, 19 nt, Homo sapiens
gaagcucucuauauacuaa

SEQ ID NO: 1438190 - RNA, 19 nt, Homo sapiens
gagaaguccuuauugauug

SEQ ID NO: 1438191 - RNA, 19 nt, Homo sapiens
gaagugcacuaauucagaa

SEQ ID NO: 1438192 - RNA, 19 nt, Homo sapiens
ggagaaguccuuauugauu

SEQ ID NO: 1438193 - RNA, 19 nt, Homo sapiens
acacagagcuuaugaaacu

SEQ ID NO: 1438194 - RNA, 19 nt, Homo sapiens
gcaaauucguucaauaaag

SEQ ID NO: 1438195 - RNA, 19 nt, Homo sapiens
gaguugagauggauuucua

SEQ ID NO: 1438196 - RNA, 19 nt, Homo sapiens
gaaaucaauucacuucaca

SEQ ID NO: 1438197 - RNA, 19 nt, Homo sapiens
gaaguaaugaguugauuga

SEQ ID NO: 1438198 - RNA, 19 nt, Homo sapiens
aaagaggacuggugaucua

SEQ ID NO: 1438199 - RNA, 19 nt, Homo sapiens
gauauguucuuggcuuuaa

SEQ ID NO: 1438200 - RNA, 19 nt, Homo sapiens
gcagagugguggauauguu

SEQ ID NO: 1438201 - RNA, 19 nt, Homo sapiens
gaagacaccaaaggaaaua

SEQ ID NO: 1438202 - RNA, 19 nt, Homo sapiens
ugguuuagcucuugucaua

SEQ ID NO: 1438203 - RNA, 19 nt, Homo sapiens
uaaaauagauccuguggaa

SEQ ID NO: 1438204 - RNA, 19 nt, Homo sapiens
guacacagagcuuaugaaa

SEQ ID NO: 1438205 - RNA, 19 nt, Homo sapiens
caaaggaaauaauggagau

SEQ ID NO: 1438206 - RNA, 19 nt, Homo sapiens
ggacugcuaacucuaaauu

SEQ ID NO: 1438207 - RNA, 19 nt, Homo sapiens
cacaagaacauguauauga

SEQ ID NO: 1438208 - RNA, 19 nt, Homo sapiens
aacugaagcucucuauaua

SEQ ID NO: 1438209 - RNA, 19 nt, Homo sapiens
aaacugaagcucucuauau

SEQ ID NO: 1438210 - RNA, 19 nt, Homo sapiens
caaccucccugccugauuc

SEQ ID NO: 1438211 - RNA, 19 nt, Homo sapiens
gaaauugaaggauggauuc

SEQ ID NO: 1438212 - RNA, 19 nt, Homo sapiens
guagaaagaaguagacaug

SEQ ID NO: 1438213 - RNA, 19 nt, Homo sapiens
cauaagucauggaauaguu

SEQ ID NO: 1438214 - RNA, 19 nt, Homo sapiens
ucgaacaaauucaagauga

SEQ ID NO: 1438215 - RNA, 19 nt, Homo sapiens
gagcuuaugaaacuucuaa

SEQ ID NO: 1438216 - RNA, 19 nt, Homo sapiens
uuaagugacuguaucaugu

SEQ ID NO: 1438217 - RNA, 19 nt, Homo sapiens
gaucagggcaauuuaggaa

SEQ ID NO: 1438218 - RNA, 19 nt, Homo sapiens
ggccgaagcuggacuguac

SEQ ID NO: 1438219 - RNA, 19 nt, Homo sapiens
gcaacaagaucgugaaccu

SEQ ID NO: 1438220 - RNA, 19 nt, Homo sapiens
gaacaaauucaagaugaug

SEQ ID NO: 1438221 - RNA, 19 nt, Homo sapiens
ggaaaucaauucacuucac

SEQ ID NO: 1438222 - RNA, 19 nt, Homo sapiens
caaggacugcuaacucuaa

SEQ ID NO: 1438223 - RNA, 19 nt, Homo sapiens
gacauuaagugacuguauc

SEQ ID NO: 1438224 - RNA, 19 nt, Homo sapiens
cuuaauaccuguaaagucu

SEQ ID NO: 1438225 - RNA, 19 nt, Homo sapiens
gguagacucuugguaacaa

SEQ ID NO: 1438226 - RNA, 19 nt, Homo sapiens
ccuggaagcccuagacuuu

SEQ ID NO: 1438227 - RNA, 19 nt, Homo sapiens
gaauuuaugcagcaccaaa

SEQ ID NO: 1438228 - RNA, 19 nt, Homo sapiens
guuuagcucuugucauaga

SEQ ID NO: 1438229 - RNA, 19 nt, Homo sapiens
uaucaagagucaauguuuc

SEQ ID NO: 1438230 - RNA, 19 nt, Homo sapiens
gaucuccgcucgcuacaac

SEQ ID NO: 1438231 - RNA, 19 nt, Homo sapiens
cgccacaccugacugguuu

SEQ ID NO: 1438232 - RNA, 19 nt, Homo sapiens
ggaaguaaugaguugauug

SEQ ID NO: 1438233 - RNA, 19 nt, Homo sapiens
caacaaggacugcuaacuc

SEQ ID NO: 1438234 - RNA, 19 nt, Homo sapiens
uaauggagauagagguaga

SEQ ID NO: 1438235 - RNA, 19 nt, Homo sapiens
ggagugcaguggcgugauc

SEQ ID NO: 1438236 - RNA, 19 nt, Homo sapiens
gggaaguaaugaguugauu

SEQ ID NO: 1438237 - RNA, 19 nt, Homo sapiens
cuggagaaguccuuauuga

SEQ ID NO: 1438238 - RNA, 19 nt, Homo sapiens
acaagaaucaguuaaggaa

SEQ ID NO: 1438239 - RNA, 19 nt, Homo sapiens
cugcaaauucguucaauaa

SEQ ID NO: 1438240 - RNA, 19 nt, Homo sapiens
ccagugaucagggcaauuu

SEQ ID NO: 1438241 - RNA, 19 nt, Homo sapiens
gaccuugaguugagaugga

SEQ ID NO: 1438242 - RNA, 19 nt, Homo sapiens
cgaacaaauucaagaugau

SEQ ID NO: 1438243 - RNA, 19 nt, Homo sapiens
uaccauaucugcaaauucg

SEQ ID NO: 1438244 - RNA, 19 nt, Homo sapiens
aacaagaccuggagaaguc

SEQ ID NO: 1438245 - RNA, 19 nt, Homo sapiens
gacggagucugguucacuu

SEQ ID NO: 1438246 - RNA, 19 nt, Homo sapiens
cuagucaccugccauaagu

SEQ ID NO: 1438247 - RNA, 19 nt, Homo sapiens
guucuuggcuuuaaaauag

SEQ ID NO: 1438248 - RNA, 19 nt, Homo sapiens
uaacaguacucguuuugaa

SEQ ID NO: 1438249 - RNA, 19 nt, Homo sapiens
caaacugaagcucucuaua

SEQ ID NO: 1438250 - RNA, 19 nt, Homo sapiens
agaauucucuggcacucuu

SEQ ID NO: 1438251 - RNA, 19 nt, Homo sapiens
ggauauguucuuggcuuua

SEQ ID NO: 1438252 - RNA, 19 nt, Homo sapiens
guagacucuugguaacaaa

SEQ ID NO: 1438253 - RNA, 19 nt, Homo sapiens
guacccaacagcucauuga

SEQ ID NO: 1438254 - RNA, 19 nt, Homo sapiens
ucaagggagcugauaaaga

SEQ ID NO: 1438255 - RNA, 19 nt, Homo sapiens
agaaauagacucugauggu

SEQ ID NO: 1438256 - RNA, 19 nt, Homo sapiens
ucugcaaauucguucaaua

SEQ ID NO: 1438257 - RNA, 19 nt, Homo sapiens
agaauuguguggcaugcaa

SEQ ID NO: 1438258 - RNA, 19 nt, Homo sapiens
gagguagacucuugguaac

SEQ ID NO: 1438259 - RNA, 19 nt, Homo sapiens
uguaucauguucgguuuaa

SEQ ID NO: 1438260 - RNA, 19 nt, Homo sapiens
ggagucugguucacuuagu

SEQ ID NO: 1438261 - RNA, 19 nt, Homo sapiens
guagaaauagacucugaug

SEQ ID NO: 1438262 - RNA, 19 nt, Homo sapiens
ggaucgggauguccguuuc

SEQ ID NO: 1438263 - RNA, 19 nt, Homo sapiens
gccacaagaacauguauau

SEQ ID NO: 1438264 - RNA, 19 nt, Homo sapiens
uaagacuguugccacaaga

SEQ ID NO: 1438265 - RNA, 19 nt, Homo sapiens
guacuuaauaccuguaaag

SEQ ID NO: 1438266 - RNA, 19 nt, Homo sapiens
ugauugaccuugaguugag

SEQ ID NO: 1438267 - RNA, 19 nt, Homo sapiens
acaagaucgugaaccugua

SEQ ID NO: 1438268 - RNA, 19 nt, Homo sapiens
gacucuugguaacaaauuu

SEQ ID NO: 1438269 - RNA, 19 nt, Homo sapiens
uuaagaagugcacuaauuc

SEQ ID NO: 1438270 - RNA, 19 nt, Homo sapiens
ugaugacaguggcggcuuu

SEQ ID NO: 1438271 - RNA, 19 nt, Homo sapiens
gaaccuguauuuucagaag

SEQ ID NO: 1438272 - RNA, 19 nt, Homo sapiens
caagaaucaguuaaggaaa

SEQ ID NO: 1438273 - RNA, 19 nt, Homo sapiens
cuacaagaaucaguuaagg

SEQ ID NO: 1438274 - RNA, 19 nt, Homo sapiens
aaauuugguuuagcucuug

SEQ ID NO: 1438275 - RNA, 19 nt, Homo sapiens
ggcaugcaaauaugaauga

SEQ ID NO: 1438276 - RNA, 19 nt, Homo sapiens
ggaaauaauggagauagag

SEQ ID NO: 1438277 - RNA, 19 nt, Homo sapiens
gaauuuauccagugaucag

SEQ ID NO: 1438278 - RNA, 19 nt, Homo sapiens
cuaagacuguugccacaag

SEQ ID NO: 1438279 - RNA, 19 nt, Homo sapiens
ucagaacaagcaacuaaga

SEQ ID NO: 1438280 - RNA, 19 nt, Homo sapiens
uaagaagugcacuaauuca

SEQ ID NO: 1438281 - RNA, 19 nt, Homo sapiens
aaauguaacaguacucguu

SEQ ID NO: 1438282 - RNA, 19 nt, Homo sapiens
uggaguugauuaugagaug

SEQ ID NO: 1438283 - RNA, 19 nt, Homo sapiens
ucagcagagugguggauau

SEQ ID NO: 1438284 - RNA, 19 nt, Homo sapiens
gugcacuaauucagaacaa

SEQ ID NO: 1438285 - RNA, 19 nt, Homo sapiens
ggcuugcaauagagaaauu

SEQ ID NO: 1438286 - RNA, 19 nt, Homo sapiens
caagaucgugaaccuguau

SEQ ID NO: 1438287 - RNA, 19 nt, Homo sapiens
gaaaacaagaccuggagaa

SEQ ID NO: 1438288 - RNA, 19 nt, Homo sapiens
gaucauggguggaguauuu

SEQ ID NO: 1438289 - RNA, 19 nt, Homo sapiens
ucacaaaggucucuugaua

SEQ ID NO: 1438290 - RNA, 19 nt, Homo sapiens
ggaagaauuugaugaagaa

SEQ ID NO: 1438291 - RNA, 19 nt, Homo sapiens
gaaaugaaugucccaaaua

SEQ ID NO: 1438292 - RNA, 19 nt, Homo sapiens
uaacagaugucauaggaaa

SEQ ID NO: 1438293 - RNA, 19 nt, Homo sapiens
gaaauaccuugguuccuuu

SEQ ID NO: 1438294 - RNA, 19 nt, Homo sapiens
ggaagaaucucccauggau

SEQ ID NO: 1438295 - RNA, 19 nt, Homo sapiens
gcagauggauggacgaaug

SEQ ID NO: 1438296 - RNA, 19 nt, Homo sapiens
gcaaaguuguugaaagaug

SEQ ID NO: 1438297 - RNA, 19 nt, Homo sapiens
ggaaacaccaguagaguga

SEQ ID NO: 1438298 - RNA, 19 nt, Homo sapiens
aagcaaaguuguugaaaga

SEQ ID NO: 1438299 - RNA, 19 nt, Homo sapiens
gaagcaaaguuguugaaag

SEQ ID NO: 1438300 - RNA, 19 nt, Homo sapiens
guuaacagaugucauagga

SEQ ID NO: 1438301 - RNA, 19 nt, Homo sapiens
ccaugaacccgaagaaaua

SEQ ID NO: 1438302 - RNA, 19 nt, Homo sapiens
ccgaaaggcugaaguguuc

SEQ ID NO: 1438303 - RNA, 19 nt, Homo sapiens
uuacacagaugcuuugguu

SEQ ID NO: 1438304 - RNA, 19 nt, Homo sapiens
acaaaggucucuugauauc

SEQ ID NO: 1438305 - RNA, 19 nt, Homo sapiens
gauccagaaguucguauua

SEQ ID NO: 1438306 - RNA, 19 nt, Homo sapiens
gcuggaaccugggaaacua

SEQ ID NO: 1438307 - RNA, 19 nt, Homo sapiens
gaaguucguauuagagaaa

SEQ ID NO: 1438308 - RNA, 19 nt, Homo sapiens
agaaauaccuugguuccuu

SEQ ID NO: 1438309 - RNA, 19 nt, Homo sapiens
agaaaugaaugucccaaau

SEQ ID NO: 1438310 - RNA, 19 nt, Homo sapiens
caagggagaagcaaaguug

SEQ ID NO: 1438311 - RNA, 19 nt, Homo sapiens
caacagguaucaacaaaau

SEQ ID NO: 1438312 - RNA, 19 nt, Homo sapiens
uagaguccauggaagaauu

SEQ ID NO: 1438313 - RNA, 19 nt, Homo sapiens
uggaagaauuugaugaaga

SEQ ID NO: 1438314 - RNA, 19 nt, Homo sapiens
gccauuugcuccaugauca

SEQ ID NO: 1438315 - RNA, 19 nt, Homo sapiens
gcugaaguguucccuguuc

SEQ ID NO: 1438316 - RNA, 19 nt, Homo sapiens
ccgaagaaauaccuugguu

SEQ ID NO: 1438317 - RNA, 19 nt, Homo sapiens
cagaugcuuugguucauga

SEQ ID NO: 1438318 - RNA, 19 nt, Homo sapiens
ggauucagaugcaaguagu

SEQ ID NO: 1438319 - RNA, 19 nt, Homo sapiens
agacaaggauucagaugca

SEQ ID NO: 1438320 - RNA, 19 nt, Homo sapiens
aggaaaggauaaagucauu

SEQ ID NO: 1438321 - RNA, 19 nt, Homo sapiens
ggagcucuuuccugucuau

SEQ ID NO: 1438322 - RNA, 19 nt, Homo sapiens
gagaagcaaaguuguugaa

SEQ ID NO: 1438323 - RNA, 19 nt, Homo sapiens
gaaccugggaaacuaauag

SEQ ID NO: 1438324 - RNA, 19 nt, Homo sapiens
uuaaaccugugccagcuuu

SEQ ID NO: 1438325 - RNA, 19 nt, Homo sapiens
uaauagaguccauggaaga

SEQ ID NO: 1438326 - RNA, 19 nt, Homo sapiens
gaaugucccaaauauccua

SEQ ID NO: 1438327 - RNA, 19 nt, Homo sapiens
gagauggagcgcuguguga

SEQ ID NO: 1438328 - RNA, 19 nt, Homo sapiens
gaugucauaggaaaggaua

SEQ ID NO: 1438329 - RNA, 19 nt, Homo sapiens
guugaaagaugggaaaguc

SEQ ID NO: 1438330 - RNA, 19 nt, Homo sapiens
aaacagggcagccagugaa

SEQ ID NO: 1438331 - RNA, 19 nt, Homo sapiens
ggaaaggauaaagucauuu

SEQ ID NO: 1438332 - RNA, 19 nt, Homo sapiens
uggaguauuugagaaguuu

SEQ ID NO: 1438333 - RNA, 19 nt, Homo sapiens
ccaaaccugaggacacuuu

SEQ ID NO: 1438334 - RNA, 19 nt, Homo sapiens
gcaagggagaagcaaaguu

SEQ ID NO: 1438335 - RNA, 19 nt, Homo sapiens
guaaguguuuucauucuga

SEQ ID NO: 1438336 - RNA, 19 nt, Homo sapiens
cauggaagaauuugaugaa

SEQ ID NO: 1438337 - RNA, 19 nt, Homo sapiens
gauggagcgcugugugaaa

SEQ ID NO: 1438338 - RNA, 19 nt, Homo sapiens
aagaauggccagaucuaaa

SEQ ID NO: 1438339 - RNA, 19 nt, Homo sapiens
gggagaagcaaaguuguug

SEQ ID NO: 1438340 - RNA, 19 nt, Homo sapiens
ggaaccugggaaacuaaua

SEQ ID NO: 1438341 - RNA, 19 nt, Homo sapiens
acacagaugcuuugguuca

SEQ ID NO: 1438342 - RNA, 19 nt, Homo sapiens
uccagaaguucguauuaga

SEQ ID NO: 1438343 - RNA, 19 nt, Homo sapiens
ggagaagcaaaguuguuga

SEQ ID NO: 1438344 - RNA, 19 nt, Homo sapiens
cauccauagucauauucua

SEQ ID NO: 1438345 - RNA, 19 nt, Homo sapiens
ggaaacuaauagaguccau

SEQ ID NO: 1438346 - RNA, 19 nt, Homo sapiens
ccagcaccguugugagcua

SEQ ID NO: 1438347 - RNA, 19 nt, Homo sapiens
gaggugaucccaggaaaca

SEQ ID NO: 1438348 - RNA, 19 nt, Homo sapiens
aaagaauggccagaucuaa

SEQ ID NO: 1438349 - RNA, 19 nt, Homo sapiens
gaacgcgcaggagcucuuu

SEQ ID NO: 1438350 - RNA, 19 nt, Homo sapiens
gggaaccgauuaccccuuu

SEQ ID NO: 1438351 - RNA, 19 nt, Homo sapiens
cacaaaggucucuugauau

SEQ ID NO: 1438352 - RNA, 19 nt, Homo sapiens
ggacgaauggccaaauacu

SEQ ID NO: 1438353 - RNA, 19 nt, Homo sapiens
caaaccugaggacacuuua

SEQ ID NO: 1438354 - RNA, 19 nt, Homo sapiens
uuagagaaauggaccaaaa

SEQ ID NO: 1438355 - RNA, 19 nt, Homo sapiens
guggaguauuugagaaguu

SEQ ID NO: 1438356 - RNA, 19 nt, Homo sapiens
gagaccaccauagccauuu

SEQ ID NO: 1438357 - RNA, 19 nt, Homo sapiens
gccgaaaggcugaaguguu

SEQ ID NO: 1438358 - RNA, 19 nt, Homo sapiens
gacaaggauucagaugcaa

SEQ ID NO: 1438359 - RNA, 19 nt, Homo sapiens
ggccaaaccugaggacacu

SEQ ID NO: 1438360 - RNA, 19 nt, Homo sapiens
cagaaguucguauuagaga

SEQ ID NO: 1438361 - RNA, 19 nt, Homo sapiens
acuaauagaguccauggaa

SEQ ID NO: 1438362 - RNA, 19 nt, Homo sapiens
ucccuuggcuuguaggaau

SEQ ID NO: 1438363 - RNA, 19 nt, Homo sapiens
agaaguucguauuagagaa

SEQ ID NO: 1438364 - RNA, 19 nt, Homo sapiens
guagagugaggaagugaga

SEQ ID NO: 1438365 - RNA, 19 nt, Homo sapiens
ccaguagagugaggaagug

SEQ ID NO: 1438366 - RNA, 19 nt, Homo sapiens
cagaaaugaaugucccaaa

SEQ ID NO: 1438367 - RNA, 19 nt, Homo sapiens
auggacgaauggccaaaua

SEQ ID NO: 1438368 - RNA, 19 nt, Homo sapiens
ucagaguggugcgagagaa

SEQ ID NO: 1438369 - RNA, 19 nt, Homo sapiens
cagggcagccagugaaaga

SEQ ID NO: 1438370 - RNA, 19 nt, Homo sapiens
uaucaacagguaucaacaa

SEQ ID NO: 1438371 - RNA, 19 nt, Homo sapiens
agaccaccauagccauuug

SEQ ID NO: 1438372 - RNA, 19 nt, Homo sapiens
caaagaauaaacucaaagc

SEQ ID NO: 1438373 - RNA, 19 nt, Homo sapiens
cauaggaaaggauaaaguc

SEQ ID NO: 1438374 - RNA, 19 nt, Homo sapiens
ccaggaaacaccaguagag

SEQ ID NO: 1438375 - RNA, 19 nt, Homo sapiens
ccugggacaugcagaugga

SEQ ID NO: 1438376 - RNA, 19 nt, Homo sapiens
aucaacagguaucaacaaa

SEQ ID NO: 1438377 - RNA, 19 nt, Homo sapiens
guaggaaugccagcagaga

SEQ ID NO: 1438378 - RNA, 19 nt, Homo sapiens
ccaaaagaauggccagauc

SEQ ID NO: 1438379 - RNA, 19 nt, Homo sapiens
cccaugaacccgaagaaau

SEQ ID NO: 1438380 - RNA, 19 nt, Homo sapiens
uggaggugaucccaggaaa

SEQ ID NO: 1438381 - RNA, 19 nt, Homo sapiens
aaccugaggacacuuuaaa

SEQ ID NO: 1438382 - RNA, 19 nt, Homo sapiens
ggauccagaaguucguauu

SEQ ID NO: 1438383 - RNA, 19 nt, Homo sapiens
ccauggaagaauuugauga

SEQ ID NO: 1438384 - RNA, 19 nt, Homo sapiens
gguggaguauuugagaagu

SEQ ID NO: 1438385 - RNA, 19 nt, Homo sapiens
cagcagagaccaccauagc

SEQ ID NO: 1438386 - RNA, 19 nt, Homo sapiens
gaguggugcgagagaauug

SEQ ID NO: 1438387 - RNA, 19 nt, Homo sapiens
gacugaauuuacuacaaag

SEQ ID NO: 1438388 - RNA, 19 nt, Homo sapiens
ggaaguagcaggauaauua

SEQ ID NO: 1438389 - RNA, 19 nt, Homo sapiens
gaguugagcuuauuucuuu

SEQ ID NO: 1438390 - RNA, 19 nt, Homo sapiens
ggaaagaccuuaucugaag

SEQ ID NO: 1438391 - RNA, 19 nt, Homo sapiens
gaucugagguucuauuuga

SEQ ID NO: 1438392 - RNA, 19 nt, Homo sapiens
guacacaucuuucauaucu

SEQ ID NO: 1438393 - RNA, 19 nt, Homo sapiens
gaaaacagcucgaaugaug

SEQ ID NO: 1438394 - RNA, 19 nt, Homo sapiens
ggaaggcuauuuaauggaa

SEQ ID NO: 1438395 - RNA, 19 nt, Homo sapiens
gaaacccugucucuacuaa

SEQ ID NO: 1438396 - RNA, 19 nt, Homo sapiens
gaccacauuugaauaagua

SEQ ID NO: 1438397 - RNA, 19 nt, Homo sapiens
cagcuaagacucaauguua

SEQ ID NO: 1438398 - RNA, 19 nt, Homo sapiens
ggaaaggauuuagauugua

SEQ ID NO: 1438399 - RNA, 19 nt, Homo sapiens
gcaauaugcuaucucauuc

SEQ ID NO: 1438400 - RNA, 19 nt, Homo sapiens
gaaugucacuccauggauu

SEQ ID NO: 1438401 - RNA, 19 nt, Homo sapiens
cuacagaguuugcgauauu

SEQ ID NO: 1438402 - RNA, 19 nt, Homo sapiens
gaaauuucccagaauguaa

SEQ ID NO: 1438403 - RNA, 19 nt, Homo sapiens
uaaauuggguugugguuug

SEQ ID NO: 1438404 - RNA, 19 nt, Homo sapiens
gaggaaggcuauuuaaugg

SEQ ID NO: 1438405 - RNA, 19 nt, Homo sapiens
gcacgguguuugugaauau

SEQ ID NO: 1438406 - RNA, 19 nt, Homo sapiens
ccagacaccuuaaagcaaa

SEQ ID NO: 1438407 - RNA, 19 nt, Homo sapiens
caagaggaaucagaacuuu

SEQ ID NO: 1438408 - RNA, 19 nt, Homo sapiens
gcaaggcacuuuguucuuc

SEQ ID NO: 1438409 - RNA, 19 nt, Homo sapiens
ucagaaacauugacucaga

SEQ ID NO: 1438410 - RNA, 19 nt, Homo sapiens
acacaucaaucacucaauu

SEQ ID NO: 1438411 - RNA, 19 nt, Homo sapiens
gaaguagcaggauaauuaa

SEQ ID NO: 1438412 - RNA, 19 nt, Homo sapiens
guaaagaccacauuugaau

SEQ ID NO: 1438413 - RNA, 19 nt, Homo sapiens
guagcaacauucagucaaa

SEQ ID NO: 1438414 - RNA, 19 nt, Homo sapiens
gacaugaucugagguucua

SEQ ID NO: 1438415 - RNA, 19 nt, Homo sapiens
ugaaagauguaucccaaga

SEQ ID NO: 1438416 - RNA, 19 nt, Homo sapiens
gaguaaacaucuccgaaug

SEQ ID NO: 1438417 - RNA, 19 nt, Homo sapiens
caccuuauccuuacauaua

SEQ ID NO: 1438418 - RNA, 19 nt, Homo sapiens
acaggugccucauccuuua

SEQ ID NO: 1438419 - RNA, 19 nt, Homo sapiens
cagagaaacuugguacuug

SEQ ID NO: 1438420 - RNA, 19 nt, Homo sapiens
gaagcaauuucccaagugu

SEQ ID NO: 1438421 - RNA, 19 nt, Homo sapiens
uuacugaacagcucaauaa

SEQ ID NO: 1438422 - RNA, 19 nt, Homo sapiens
gcuagucgcugcaauaugc

SEQ ID NO: 1438423 - RNA, 19 nt, Homo sapiens
gauaaucagucaguaguca

SEQ ID NO: 1438424 - RNA, 19 nt, Homo sapiens
caaacaaagaucacaauga

SEQ ID NO: 1438425 - RNA, 19 nt, Homo sapiens
ucagugaaauuucccagaa

SEQ ID NO: 1438426 - RNA, 19 nt, Homo sapiens
uaugaacaccuuauccuua

SEQ ID NO: 1438427 - RNA, 19 nt, Homo sapiens
ugaaugagggagacacuua

SEQ ID NO: 1438428 - RNA, 19 nt, Homo sapiens
acacaucuuucauaucuug

SEQ ID NO: 1438429 - RNA, 19 nt, Homo sapiens
caagcaagauuagugaaga

SEQ ID NO: 1438430 - RNA, 19 nt, Homo sapiens
ggagcuagucgcugcaaua

SEQ ID NO: 1438431 - RNA, 19 nt, Homo sapiens
gcuaagacucaauguuaua

SEQ ID NO: 1438432 - RNA, 19 nt, Homo sapiens
gcagaagaauugcuugaac

SEQ ID NO: 1438433 - RNA, 19 nt, Homo sapiens
caucuucacaucaguauuu

SEQ ID NO: 1438434 - RNA, 19 nt, Homo sapiens
gaugaugaacuucuuaaug

SEQ ID NO: 1438435 - RNA, 19 nt, Homo sapiens
acacucagaugaugaacuu

SEQ ID NO: 1438436 - RNA, 19 nt, Homo sapiens
caaauaggcgguuuucuua

SEQ ID NO: 1438437 - RNA, 19 nt, Homo sapiens
caagauuagugaagacaau

SEQ ID NO: 1438438 - RNA, 19 nt, Homo sapiens
gaacacugcuuggauucug

SEQ ID NO: 1438439 - RNA, 19 nt, Homo sapiens
agagaacacugcuuggauu

SEQ ID NO: 1438440 - RNA, 19 nt, Homo sapiens
caagagacaugcacugaac

SEQ ID NO: 1438441 - RNA, 19 nt, Homo sapiens
gcaagaaguagcaacauuc

SEQ ID NO: 1438442 - RNA, 19 nt, Homo sapiens
gaaaucacagagaaacuug

SEQ ID NO: 1438443 - RNA, 19 nt, Homo sapiens
ugacugaaguuauaauguc

SEQ ID NO: 1438444 - RNA, 19 nt, Homo sapiens
gaaucagaacuuugucuuu

SEQ ID NO: 1438445 - RNA, 19 nt, Homo sapiens
gauggauguuugucagaaa

SEQ ID NO: 1438446 - RNA, 19 nt, Homo sapiens
gaagauaaucagucaguag

SEQ ID NO: 1438447 - RNA, 19 nt, Homo sapiens
ucaccaagaucaugauuac

SEQ ID NO: 1438448 - RNA, 19 nt, Homo sapiens
agaaaaggauugcuuguaa

SEQ ID NO: 1438449 - RNA, 19 nt, Homo sapiens
uggaaaggauuuagauugu

SEQ ID NO: 1438450 - RNA, 19 nt, Homo sapiens
agacuuggauccacuuuca

SEQ ID NO: 1438451 - RNA, 19 nt, Homo sapiens
gaacuggaugcuaaacuug

SEQ ID NO: 1438452 - RNA, 19 nt, Homo sapiens
ugaacuggaugcuaaacuu

SEQ ID NO: 1438453 - RNA, 19 nt, Homo sapiens
cagaaacauugacucagaa

SEQ ID NO: 1438454 - RNA, 19 nt, Homo sapiens
ccauagccaucuacaauag

SEQ ID NO: 1438455 - RNA, 19 nt, Homo sapiens
uagcuuccaugugcucuua

SEQ ID NO: 1438456 - RNA, 19 nt, Homo sapiens
ucugauaccuugaugacaa

SEQ ID NO: 1438457 - RNA, 19 nt, Homo sapiens
gaagauaaucgagaaauac

SEQ ID NO: 1438458 - RNA, 19 nt, Homo sapiens
ccaagaucaugauuacgaa

SEQ ID NO: 1438459 - RNA, 19 nt, Homo sapiens
auaagggagugucucauuu

SEQ ID NO: 1438460 - RNA, 19 nt, Homo sapiens
gagaauauucccuaagcaa

SEQ ID NO: 1438461 - RNA, 19 nt, Homo sapiens
guuauaaugucacuucagu

SEQ ID NO: 1438462 - RNA, 19 nt, Homo sapiens
uguaauguuugucauggua

SEQ ID NO: 1438463 - RNA, 19 nt, Homo sapiens
ucaauuuccuguccuuuua

SEQ ID NO: 1438464 - RNA, 19 nt, Homo sapiens
ucacaucaguauuuaugga

SEQ ID NO: 1438465 - RNA, 19 nt, Homo sapiens
agaaagcucugugugauca

SEQ ID NO: 1438466 - RNA, 19 nt, Homo sapiens
ccugaaauaccuagaaauu

SEQ ID NO: 1438467 - RNA, 19 nt, Homo sapiens
gaaccagaccagcuuuguu

SEQ ID NO: 1438468 - RNA, 19 nt, Homo sapiens
augcuugacugaaguuaua

SEQ ID NO: 1438469 - RNA, 19 nt, Homo sapiens
ucacagaguccaaagaaau

SEQ ID NO: 1438470 - RNA, 19 nt, Homo sapiens
aaucagaacuuugucuuuc

SEQ ID NO: 1438471 - RNA, 19 nt, Homo sapiens
aaggauugcuuguaauguu

SEQ ID NO: 1438472 - RNA, 19 nt, Homo sapiens
uagagaggaaggcuauuua

SEQ ID NO: 1438473 - RNA, 19 nt, Homo sapiens
cugagguucuauuugauua

SEQ ID NO: 1438474 - RNA, 19 nt, Homo sapiens
aaacucagaaugcacagua

SEQ ID NO: 1438475 - RNA, 19 nt, Homo sapiens
gguaaagaccacauuugaa

SEQ ID NO: 1438476 - RNA, 19 nt, Homo sapiens
aaggaauucucauuucuga

SEQ ID NO: 1438477 - RNA, 19 nt, Homo sapiens
gugaagacaauaaagauga

SEQ ID NO: 1438478 - RNA, 19 nt, Homo sapiens
gaggagcucuacuguggau

SEQ ID NO: 1438479 - RNA, 19 nt, Homo sapiens
ucacuguucugccaaguuc

SEQ ID NO: 1438480 - RNA, 19 nt, Homo sapiens
cuaagcaacuggcaauagu

SEQ ID NO: 1438481 - RNA, 19 nt, Homo sapiens
uaauggacacucccuaauu

SEQ ID NO: 1438482 - RNA, 19 nt, Homo sapiens
gcaaacaaagaucacaaug

SEQ ID NO: 1438483 - RNA, 19 nt, Homo sapiens
gaacaagcaaacaaagauc

SEQ ID NO: 1438484 - RNA, 19 nt, Homo sapiens
cagaugcaagugagaaaua

SEQ ID NO: 1438485 - RNA, 19 nt, Homo sapiens
gacaugcacugaacuucug

SEQ ID NO: 1438486 - RNA, 19 nt, Homo sapiens
cauggcggguggaacauuu

SEQ ID NO: 1438487 - RNA, 19 nt, Homo sapiens
guaauacugucacuguucu

SEQ ID NO: 1438488 - RNA, 19 nt, Homo sapiens
caacugaccuuauuguauu

SEQ ID NO: 1438489 - RNA, 19 nt, Homo sapiens
gaauucagcugcucaaaca

SEQ ID NO: 1438490 - RNA, 19 nt, Homo sapiens
gaaauucuccgcuaaguug

SEQ ID NO: 1438491 - RNA, 19 nt, Homo sapiens
gcucauagcacacgcaaua

SEQ ID NO: 1438492 - RNA, 19 nt, Homo sapiens
ggaaggcccuguaaauaau

SEQ ID NO: 1438493 - RNA, 19 nt, Homo sapiens
gaaggcauccugucaauga

SEQ ID NO: 1438494 - RNA, 19 nt, Homo sapiens
cccauaaucucaauacaua

SEQ ID NO: 1438495 - RNA, 19 nt, Homo sapiens
gaaauuaagcccaaagaau

SEQ ID NO: 1438496 - RNA, 19 nt, Homo sapiens
caaauacuaugaagaggaa

SEQ ID NO: 1438497 - RNA, 19 nt, Homo sapiens
ugaagaauguugaaaccua

SEQ ID NO: 1438498 - RNA, 19 nt, Homo sapiens
gaaaguggacaguaucaaa

SEQ ID NO: 1438499 - RNA, 19 nt, Homo sapiens
ucaggaaguuacagucuua

SEQ ID NO: 1438500 - RNA, 19 nt, Homo sapiens
gaagagaccgcaaguggaa

SEQ ID NO: 1438501 - RNA, 19 nt, Homo sapiens
ggaaguuacagucuuauuu

SEQ ID NO: 1438502 - RNA, 19 nt, Homo sapiens
gaauaaagccacuaguaga

SEQ ID NO: 1438503 - RNA, 19 nt, Homo sapiens
ggaaacaaagacagaauuu

SEQ ID NO: 1438504 - RNA, 19 nt, Homo sapiens
cuauugcgcuugaaauuaa

SEQ ID NO: 1438505 - RNA, 19 nt, Homo sapiens
caaagcagcaucucuuaaa

SEQ ID NO: 1438506 - RNA, 19 nt, Homo sapiens
gaauucggauggcuucuga

SEQ ID NO: 1438507 - RNA, 19 nt, Homo sapiens
uguagcagcuugcauguuu

SEQ ID NO: 1438508 - RNA, 19 nt, Homo sapiens
ggagaagccucagauaaca

SEQ ID NO: 1438509 - RNA, 19 nt, Homo sapiens
ggaaugaaauuuguuggau

SEQ ID NO: 1438510 - RNA, 19 nt, Homo sapiens
ggaagaauaaccaacauau

SEQ ID NO: 1438511 - RNA, 19 nt, Homo sapiens
gaaagccagccaccacaua

SEQ ID NO: 1438512 - RNA, 19 nt, Homo sapiens
ugagggaugugaaaucaaa

SEQ ID NO: 1438513 - RNA, 19 nt, Homo sapiens
gacccagccuuuccucuaa

SEQ ID NO: 1438514 - RNA, 19 nt, Homo sapiens
gcaaaggaaggcccuguaa

SEQ ID NO: 1438515 - RNA, 19 nt, Homo sapiens
caaauuguauacagucuuc

SEQ ID NO: 1438516 - RNA, 19 nt, Homo sapiens
caaguuaccuauacagagu

SEQ ID NO: 1438517 - RNA, 19 nt, Homo sapiens
uaaauguuguugcuccuaa

SEQ ID NO: 1438518 - RNA, 19 nt, Homo sapiens
guuaaauccugaagaaugu

SEQ ID NO: 1438519 - RNA, 19 nt, Homo sapiens
caccaacccuguacugauu

SEQ ID NO: 1438520 - RNA, 19 nt, Homo sapiens
gaagggaauuuggcuacaa

SEQ ID NO: 1438521 - RNA, 19 nt, Homo sapiens
gcauuauucuccaucuaaa

SEQ ID NO: 1438522 - RNA, 19 nt, Homo sapiens
gaugauagcagcccuggaa

SEQ ID NO: 1438523 - RNA, 19 nt, Homo sapiens
gcaaagcagcaucucuuaa

SEQ ID NO: 1438524 - RNA, 19 nt, Homo sapiens
guaaggagacugaauaucu

SEQ ID NO: 1438525 - RNA, 19 nt, Homo sapiens
cuacaaagcagaucguauu

SEQ ID NO: 1438526 - RNA, 19 nt, Homo sapiens
gcccacaccuguauugaga

SEQ ID NO: 1438527 - RNA, 19 nt, Homo sapiens
ucaaagcaguuaagucugu

SEQ ID NO: 1438528 - RNA, 19 nt, Homo sapiens
uagaaucgaugcuacaugu

SEQ ID NO: 1438529 - RNA, 19 nt, Homo sapiens
ggauucauaucacagcauu

SEQ ID NO: 1438530 - RNA, 19 nt, Homo sapiens
ccagaagucaucaagauaa

SEQ ID NO: 1438531 - RNA, 19 nt, Homo sapiens
gacagaauuugcuuacgaa

SEQ ID NO: 1438532 - RNA, 19 nt, Homo sapiens
gcacacgcaauauguauga

SEQ ID NO: 1438533 - RNA, 19 nt, Homo sapiens
guagaaagaugcucauagc

SEQ ID NO: 1438534 - RNA, 19 nt, Homo sapiens
acacacacacagcuaauua

SEQ ID NO: 1438535 - RNA, 19 nt, Homo sapiens
uuacacuucucucaacuaa

SEQ ID NO: 1438536 - RNA, 19 nt, Homo sapiens
gaccgcaaguggaaacaaa

SEQ ID NO: 1438537 - RNA, 19 nt, Homo sapiens
cagaagucaucaagauaaa

SEQ ID NO: 1438538 - RNA, 19 nt, Homo sapiens
gcauguuucucuaagauca

SEQ ID NO: 1438539 - RNA, 19 nt, Homo sapiens
ucaaacaccagauaagaaa

SEQ ID NO: 1438540 - RNA, 19 nt, Homo sapiens
gcuauugcgcuugaaauua

SEQ ID NO: 1438541 - RNA, 19 nt, Homo sapiens
ggaguuaacuaccuuuuau

SEQ ID NO: 1438542 - RNA, 19 nt, Homo sapiens
ggaguuccagguucuagua

SEQ ID NO: 1438543 - RNA, 19 nt, Homo sapiens
gaaucgaugcuacauguga

SEQ ID NO: 1438544 - RNA, 19 nt, Homo sapiens
agaaucauguuuacacuuc

SEQ ID NO: 1438545 - RNA, 19 nt, Homo sapiens
agacagaauuugcuuacga

SEQ ID NO: 1438546 - RNA, 19 nt, Homo sapiens
cacgcaauauguaugauaa

SEQ ID NO: 1438547 - RNA, 19 nt, Homo sapiens
gauguuccauucgguuauu

SEQ ID NO: 1438548 - RNA, 19 nt, Homo sapiens
aagaauaaagccacuagua

SEQ ID NO: 1438549 - RNA, 19 nt, Homo sapiens
ucaugaaaguggacaguau

SEQ ID NO: 1438550 - RNA, 19 nt, Homo sapiens
cauggaaauucuccgcuaa

SEQ ID NO: 1438551 - RNA, 19 nt, Homo sapiens
caaagcaguuaagucugua

SEQ ID NO: 1438552 - RNA, 19 nt, Homo sapiens
gccaugaggugaagcaaag

SEQ ID NO: 1438553 - RNA, 19 nt, Homo sapiens
caacguccuccgggaauua

SEQ ID NO: 1438554 - RNA, 19 nt, Homo sapiens
guagaagcaucggauuaga

SEQ ID NO: 1438555 - RNA, 19 nt, Homo sapiens
agaaaaggaucagucauua

SEQ ID NO: 1438556 - RNA, 19 nt, Homo sapiens
uaagugggcagucaucuga

SEQ ID NO: 1438557 - RNA, 19 nt, Homo sapiens
agauuaaugucgcugcuaa

SEQ ID NO: 1438558 - RNA, 19 nt, Homo sapiens
cagaauuugcuuacgaaua

SEQ ID NO: 1438559 - RNA, 19 nt, Homo sapiens
uagaagacccugaugauag

SEQ ID NO: 1438560 - RNA, 19 nt, Homo sapiens
aggaaggcccuguaaauaa

SEQ ID NO: 1438561 - RNA, 19 nt, Homo sapiens
aaaggaaggcccuguaaau

SEQ ID NO: 1438562 - RNA, 19 nt, Homo sapiens
gcucaaacaccagauaaga

SEQ ID NO: 1438563 - RNA, 19 nt, Homo sapiens
ucuaaauucugcaauggaa

SEQ ID NO: 1438564 - RNA, 19 nt, Homo sapiens
aaacaaaugacgcagcaaa

SEQ ID NO: 1438565 - RNA, 19 nt, Homo sapiens
ggaaauucuccgcuaaguu

SEQ ID NO: 1438566 - RNA, 19 nt, Homo sapiens
aaauugacguggcauggaa

SEQ ID NO: 1438567 - RNA, 19 nt, Homo sapiens
ccaacugaccuuauuguau

SEQ ID NO: 1438568 - RNA, 19 nt, Homo sapiens
caaaggaaggcccuguaaa

SEQ ID NO: 1438569 - RNA, 19 nt, Homo sapiens
acacuucucucaacuaaaa

SEQ ID NO: 1438570 - RNA, 19 nt, Homo sapiens
aaggaaggcccuguaaaua

SEQ ID NO: 1438571 - RNA, 19 nt, Homo sapiens
cagcuugcauguuucucua

SEQ ID NO: 1438572 - RNA, 19 nt, Homo sapiens
gcaaaagaacugauagaaa

SEQ ID NO: 1438573 - RNA, 19 nt, Homo sapiens
ggaaccuccaagugaauua

SEQ ID NO: 1438574 - RNA, 19 nt, Homo sapiens
gacccagccuuuaacaauc

SEQ ID NO: 1438575 - RNA, 19 nt, Homo sapiens
cuuguuaaauccugaagaa

SEQ ID NO: 1438576 - RNA, 19 nt, Homo sapiens
caaggaagaauaaccaaca

SEQ ID NO: 1438577 - RNA, 19 nt, Homo sapiens
ggacuuagaaagcuagaag

SEQ ID NO: 1438578 - RNA, 19 nt, Homo sapiens
gaaaagaacccauaaucuc

SEQ ID NO: 1438579 - RNA, 19 nt, Homo sapiens
ucucaugaauguacaaagu

SEQ ID NO: 1438580 - RNA, 19 nt, Homo sapiens
gccuaaaucuuuggaagga

SEQ ID NO: 1438581 - RNA, 19 nt, Homo sapiens
ccaucuaaauucugcaaug

SEQ ID NO: 1438582 - RNA, 19 nt, Homo sapiens
gaugaauucagccuauuau

SEQ ID NO: 1438583 - RNA, 19 nt, Homo sapiens
gaacccauaaucucaauac

SEQ ID NO: 1438584 - RNA, 19 nt, Homo sapiens
uaaaaucauugccaacuga

SEQ ID NO: 1438585 - RNA, 19 nt, Homo sapiens
gaaggcccuguaaauaauu

SEQ ID NO: 1438586 - RNA, 19 nt, Homo sapiens
caaagcagaucguauuccu

SEQ ID NO: 1438587 - RNA, 19 nt, Homo sapiens
gaugugaaaucaaaacaga

SEQ ID NO: 1438588 - RNA, 19 nt, Homo sapiens
gcaaauauauguucacaga

SEQ ID NO: 1438589 - RNA, 19 nt, Homo sapiens
gugcagagauacauaauua

SEQ ID NO: 1438590 - RNA, 19 nt, Homo sapiens
gcauacaaauccauucuua

SEQ ID NO: 1438591 - RNA, 19 nt, Homo sapiens
gcacuuaguucauggguaa

SEQ ID NO: 1438592 - RNA, 19 nt, Homo sapiens
ggaaggaccugcugaugaa

SEQ ID NO: 1438593 - RNA, 19 nt, Homo sapiens
gaaaguaauuccucgaaga

SEQ ID NO: 1438594 - RNA, 19 nt, Homo sapiens
gcauaucacugcauacaaa

SEQ ID NO: 1438595 - RNA, 19 nt, Homo sapiens
guaagaagaucucagaaau

SEQ ID NO: 1438596 - RNA, 19 nt, Homo sapiens
cuacagcuuugguauauua

SEQ ID NO: 1438597 - RNA, 19 nt, Homo sapiens
uagaugcucucacuaaaua

SEQ ID NO: 1438598 - RNA, 19 nt, Homo sapiens
gcauuaagcuacuucaaga

SEQ ID NO: 1438599 - RNA, 19 nt, Homo sapiens
gaggaaggcugauuuagau

SEQ ID NO: 1438600 - RNA, 19 nt, Homo sapiens
gcaagaaguggcaaauaua

SEQ ID NO: 1438601 - RNA, 19 nt, Homo sapiens
ucaaauagaucacaucaag

SEQ ID NO: 1438602 - RNA, 19 nt, Homo sapiens
caucaaagacugcagauaa

SEQ ID NO: 1438603 - RNA, 19 nt, Homo sapiens
ggcaagaaguggcaaauau

SEQ ID NO: 1438604 - RNA, 19 nt, Homo sapiens
cuaaagaguugaaugagaa

SEQ ID NO: 1438605 - RNA, 19 nt, Homo sapiens
uaacagaugagacagaaua

SEQ ID NO: 1438606 - RNA, 19 nt, Homo sapiens
aagagcaggucaagauuua

SEQ ID NO: 1438607 - RNA, 19 nt, Homo sapiens
gcaaacaguccuagaagaa

SEQ ID NO: 1438608 - RNA, 19 nt, Homo sapiens
cagcagagccuacagcuuu

SEQ ID NO: 1438609 - RNA, 19 nt, Homo sapiens
gcagugugguggaaggaua

SEQ ID NO: 1438610 - RNA, 19 nt, Homo sapiens
gggaugugauuugugauua

SEQ ID NO: 1438611 - RNA, 19 nt, Homo sapiens
ggugaggacuggagccuaa

SEQ ID NO: 1438612 - RNA, 19 nt, Homo sapiens
gaaacaaccaucuuuaucu

SEQ ID NO: 1438613 - RNA, 19 nt, Homo sapiens
gaggaagugcacaguauua

SEQ ID NO: 1438614 - RNA, 19 nt, Homo sapiens
cagaugagacagaauauaa

SEQ ID NO: 1438615 - RNA, 19 nt, Homo sapiens
cuaaugacaucacgucuau

SEQ ID NO: 1438616 - RNA, 19 nt, Homo sapiens
gcacugaagucgguguuug

SEQ ID NO: 1438617 - RNA, 19 nt, Homo sapiens
gaaauuaugcuucacuaca

SEQ ID NO: 1438618 - RNA, 19 nt, Homo sapiens
gaaggcugauuuagaugaa

SEQ ID NO: 1438619 - RNA, 19 nt, Homo sapiens
ugagggagcuuguacaaca

SEQ ID NO: 1438620 - RNA, 19 nt, Homo sapiens
gaaagccucuuccauuacu

SEQ ID NO: 1438621 - RNA, 19 nt, Homo sapiens
aaacaguccuagaagaauu

SEQ ID NO: 1438622 - RNA, 19 nt, Homo sapiens
caaagacugcagauaauuu

SEQ ID NO: 1438623 - RNA, 19 nt, Homo sapiens
gaacauagcaguggcaucu

SEQ ID NO: 1438624 - RNA, 19 nt, Homo sapiens
gauaugagcagcccauuuc

SEQ ID NO: 1438625 - RNA, 19 nt, Homo sapiens
gugugcagauugucaaaua

SEQ ID NO: 1438626 - RNA, 19 nt, Homo sapiens
caauaaaggugggauagau

SEQ ID NO: 1438627 - RNA, 19 nt, Homo sapiens
gagaaacaaccaucuuuau

SEQ ID NO: 1438628 - RNA, 19 nt, Homo sapiens
aaagaacaauccaacuuga

SEQ ID NO: 1438629 - RNA, 19 nt, Homo sapiens
gacagaauauaaacaggaa

SEQ ID NO: 1438630 - RNA, 19 nt, Homo sapiens
ugggauagaugcaguagaa

SEQ ID NO: 1438631 - RNA, 19 nt, Homo sapiens
uaugaugccuuuauugaga

SEQ ID NO: 1438632 - RNA, 19 nt, Homo sapiens
acaaauccauucuuacuuc

SEQ ID NO: 1438633 - RNA, 19 nt, Homo sapiens
gaccugcugaugaauauua

SEQ ID NO: 1438634 - RNA, 19 nt, Homo sapiens
uggaaagugugcagagaua

SEQ ID NO: 1438635 - RNA, 19 nt, Homo sapiens
gcaggauacuuauaacaag

SEQ ID NO: 1438636 - RNA, 19 nt, Homo sapiens
ugagaaacaaccaucuuua

SEQ ID NO: 1438637 - RNA, 19 nt, Homo sapiens
gggagcaggauacuuauaa

SEQ ID NO: 1438638 - RNA, 19 nt, Homo sapiens
ccaaggcauuguugaagaa

SEQ ID NO: 1438639 - RNA, 19 nt, Homo sapiens
gcaguucucccaccuauca

SEQ ID NO: 1438640 - RNA, 19 nt, Homo sapiens
ucacuacauugaaagguuu

SEQ ID NO: 1438641 - RNA, 19 nt, Homo sapiens
uagagcauaucacugcaua

SEQ ID NO: 1438642 - RNA, 19 nt, Homo sapiens
caagaaguggcaaauauau

SEQ ID NO: 1438643 - RNA, 19 nt, Homo sapiens
gcaguagaaagucuuauga

SEQ ID NO: 1438644 - RNA, 19 nt, Homo sapiens
ggaugugauuugugauuau

SEQ ID NO: 1438645 - RNA, 19 nt, Homo sapiens
ucaaauaugucaguucauc

SEQ ID NO: 1438646 - RNA, 19 nt, Homo sapiens
gaaggauaauaccaugaug

SEQ ID NO: 1438647 - RNA, 19 nt, Homo sapiens
gacaucacgucuauucuuc

SEQ ID NO: 1438648 - RNA, 19 nt, Homo sapiens
ucacuaaagaguugaauga

SEQ ID NO: 1438649 - RNA, 19 nt, Homo sapiens
gcuauucuuugcuugugua

SEQ ID NO: 1438650 - RNA, 19 nt, Homo sapiens
ggaaggcugauuuagauga

SEQ ID NO: 1438651 - RNA, 19 nt, Homo sapiens
gaaucuagaugcucucacu

SEQ ID NO: 1438652 - RNA, 19 nt, Homo sapiens
caauccaacuugaagcaaa

SEQ ID NO: 1438653 - RNA, 19 nt, Homo sapiens
gaagugcacaguauuaugg

SEQ ID NO: 1438654 - RNA, 19 nt, Homo sapiens
gagcuuguacaacaccuua

SEQ ID NO: 1438655 - RNA, 19 nt, Homo sapiens
gcagcaaacaguccuagaa

SEQ ID NO: 1438656 - RNA, 19 nt, Homo sapiens
caucauauaccgaaauguu

SEQ ID NO: 1438657 - RNA, 19 nt, Homo sapiens
caagagcaggucaagauuu

SEQ ID NO: 1438658 - RNA, 19 nt, Homo sapiens
ugaggauuaucgaaaguaa

SEQ ID NO: 1438659 - RNA, 19 nt, Homo sapiens
gcagagauacauaauuaca

SEQ ID NO: 1438660 - RNA, 19 nt, Homo sapiens
ccaccuaucauuuguagaa

SEQ ID NO: 1438661 - RNA, 19 nt, Homo sapiens
aaaggcagcuuguuaugca

SEQ ID NO: 1438662 - RNA, 19 nt, Homo sapiens
gccuacagcuuugguauau

SEQ ID NO: 1438663 - RNA, 19 nt, Homo sapiens
aaacagggucagacucaua

SEQ ID NO: 1438664 - RNA, 19 nt, Homo sapiens
gaaggaaucaaauguggau

SEQ ID NO: 1438665 - RNA, 19 nt, Homo sapiens
gggcagaguaugacacaaa

SEQ ID NO: 1438666 - RNA, 19 nt, Homo sapiens
ugucaaauaugucaguuca

SEQ ID NO: 1438667 - RNA, 19 nt, Homo sapiens
gcaagagcaggucaagauu

SEQ ID NO: 1438668 - RNA, 19 nt, Homo sapiens
aguggcaucugaccaauuu

SEQ ID NO: 1438669 - RNA, 19 nt, Homo sapiens
guaaacagggucagacuca

SEQ ID NO: 1438670 - RNA, 19 nt, Homo sapiens
uugaagaacuaauggaaga

SEQ ID NO: 1438671 - RNA, 19 nt, Homo sapiens
gaucacaucaagcagugua

SEQ ID NO: 1438672 - RNA, 19 nt, Homo sapiens
aagaaagaccgaagaacua

SEQ ID NO: 1438673 - RNA, 19 nt, Homo sapiens
gaaagacugggcuguagug

SEQ ID NO: 1438674 - RNA, 19 nt, Homo sapiens
ggaaggauaauaccaugau

SEQ ID NO: 1438675 - RNA, 19 nt, Homo sapiens
uaagcuacuucaagaaauc

SEQ ID NO: 1438676 - RNA, 19 nt, Homo sapiens
gaugaccuguugcagcuau

SEQ ID NO: 1438677 - RNA, 19 nt, Homo sapiens
gaugugauuugugauuaug

SEQ ID NO: 1438678 - RNA, 19 nt, Homo sapiens
gaaaagaacaauccaacuu

SEQ ID NO: 1438679 - RNA, 19 nt, Homo sapiens
gcaaaagaagcugaaauua

SEQ ID NO: 1438680 - RNA, 19 nt, Homo sapiens
gcagaaauuaaacaagcua

SEQ ID NO: 1438681 - RNA, 19 nt, Homo sapiens
gauaagguaauagagcaua

SEQ ID NO: 1438682 - RNA, 19 nt, Homo sapiens
caaauccauucuuacuuca

SEQ ID NO: 1438683 - RNA, 19 nt, Homo sapiens
ucuagaugcucucacuaaa

SEQ ID NO: 1438684 - RNA, 19 nt, Homo sapiens
ggaggaagugcacaguauu

SEQ ID NO: 1438685 - RNA, 19 nt, Homo sapiens
ccuaacagaugagacagaa

SEQ ID NO: 1438686 - RNA, 19 nt, Homo sapiens
gugaacaagugugcagauu

SEQ ID NO: 1438687 - RNA, 19 nt, Homo sapiens
aagaauccaugaaucuaga

SEQ ID NO: 1438688 - RNA, 19 nt, Homo sapiens
ugaagugccuuacaaguuu

SEQ ID NO: 1438689 - RNA, 19 nt, Homo sapiens
caucugcgcuacaaccuuu

SEQ ID NO: 1438690 - RNA, 19 nt, Homo sapiens
agaaguacgucgugaagaa

SEQ ID NO: 1438691 - RNA, 19 nt, Homo sapiens
ucacagguuucugggauua

SEQ ID NO: 1438692 - RNA, 19 nt, Homo sapiens
gauucuggaucaaccauuu

SEQ ID NO: 1438693 - RNA, 19 nt, Homo sapiens
acaauuacccuguuucuga

SEQ ID NO: 1438694 - RNA, 19 nt, Homo sapiens
gaagugccuuacaaguuug

SEQ ID NO: 1438695 - RNA, 19 nt, Homo sapiens
ucucuacuauggacagaua

SEQ ID NO: 1438696 - RNA, 19 nt, Homo sapiens
acuggaauauugacccuua

SEQ ID NO: 1438697 - RNA, 19 nt, Homo sapiens
agagacugaucgcugaaua

SEQ ID NO: 1438698 - RNA, 19 nt, Homo sapiens
aggcuuauguacagaagua

SEQ ID NO: 1438699 - RNA, 19 nt, Homo sapiens
ggcggagacuggagauuga

SEQ ID NO: 1438700 - RNA, 19 nt, Homo sapiens
ggugauggccgugguguuu

SEQ ID NO: 1438701 - RNA, 19 nt, Homo sapiens
caauuacccuguuucugau

SEQ ID NO: 1438702 - RNA, 19 nt, Homo sapiens
cugaaucucucccuguuau

SEQ ID NO: 1438703 - RNA, 19 nt, Homo sapiens
acugaucgcugaauaugga

SEQ ID NO: 1438704 - RNA, 19 nt, Homo sapiens
agauugaagugccuuacaa

SEQ ID NO: 1438705 - RNA, 19 nt, Homo sapiens
gaauuguguugauccucuu

SEQ ID NO: 1438706 - RNA, 19 nt, Homo sapiens
aguacgucgugaagaauua

SEQ ID NO: 1438707 - RNA, 19 nt, Homo sapiens
gccgaugcuucacagguuu

SEQ ID NO: 1438708 - RNA, 19 nt, Homo sapiens
ccaccuacauguuaguuuu

SEQ ID NO: 1438709 - RNA, 19 nt, Homo sapiens
ugucauaguugugccauuc

SEQ ID NO: 1438710 - RNA, 19 nt, Homo sapiens
gaucaccgcacuccucauc

SEQ ID NO: 1438711 - RNA, 19 nt, Homo sapiens
cuccuuaucucuacuaugg

SEQ ID NO: 1438712 - RNA, 19 nt, Homo sapiens
caucacguuucuuccauuc

SEQ ID NO: 1438713 - RNA, 19 nt, Homo sapiens
gcugaaucucucccuguua

SEQ ID NO: 1438714 - RNA, 19 nt, Homo sapiens
gaaguacgucgugaagaau

SEQ ID NO: 1438715 - RNA, 19 nt, Homo sapiens
ugccauucuuccuguguua

SEQ ID NO: 1438716 - RNA, 19 nt, Homo sapiens
gagacugaucgcugaauau

SEQ ID NO: 1438717 - RNA, 19 nt, Homo sapiens
gauguauauuggccaagug

SEQ ID NO: 1438718 - RNA, 19 nt, Homo sapiens
caaguuuguuaccuacaca

SEQ ID NO: 1438719 - RNA, 19 nt, Homo sapiens
gccggaggcuuauguacag

SEQ ID NO: 1438720 - RNA, 19 nt, Homo sapiens
ucucucacugcaaguauua

SEQ ID NO: 1438721 - RNA, 19 nt, Homo sapiens
gcagugggaauuguguuga

SEQ ID NO: 1438722 - RNA, 19 nt, Homo sapiens
ggacaccaccaccauucug

SEQ ID NO: 1438723 - RNA, 19 nt, Homo sapiens
ggaggcuuauguacagaag

SEQ ID NO: 1438724 - RNA, 19 nt, Homo sapiens
uauccaagcccgcugaauc

SEQ ID NO: 1438725 - RNA, 19 nt, Homo sapiens
gcucuacacugggaugcau

SEQ ID NO: 1438726 - RNA, 19 nt, Homo sapiens
uucacucacuggaauauug

SEQ ID NO: 1438727 - RNA, 19 nt, Homo sapiens
uugaagugccuuacaaguu

SEQ ID NO: 1438728 - RNA, 19 nt, Homo sapiens
ggagugaccauaggauucu

SEQ ID NO: 1438729 - RNA, 19 nt, Homo sapiens
ccaguauccauuuguguug

SEQ ID NO: 1438730 - RNA, 19 nt, Homo sapiens
guuggcaucugcgcuacaa

SEQ ID NO: 1438731 - RNA, 19 nt, Homo sapiens
gagauugaagugccuuaca

SEQ ID NO: 1438732 - RNA, 19 nt, Homo sapiens
ccucuugguucgucagcuu

SEQ ID NO: 1438733 - RNA, 19 nt, Homo sapiens
gggcuggagugaccauagg

SEQ ID NO: 1438734 - RNA, 19 nt, Homo sapiens
gcggacaccaccaccauuc

SEQ ID NO: 1438735 - RNA, 19 nt, Homo sapiens
auuacccuguuucugauua

SEQ ID NO: 1438736 - RNA, 19 nt, Homo sapiens
gacccuuauuuauccagaa

SEQ ID NO: 1438737 - RNA, 19 nt, Homo sapiens
ugccgaugcuucacagguu

SEQ ID NO: 1438738 - RNA, 19 nt, Homo sapiens
accauaggauucuggauca

SEQ ID NO: 1438739 - RNA, 19 nt, Homo sapiens
ucacucacuggaauauuga

SEQ ID NO: 1438740 - RNA, 19 nt, Homo sapiens
ucauaguugugccauucuu

SEQ ID NO: 1438741 - RNA, 19 nt, Homo sapiens
agacugaucgcugaauaug

SEQ ID NO: 1438742 - RNA, 19 nt, Homo sapiens
ucucacugcaaguauuaua

SEQ ID NO: 1438743 - RNA, 19 nt, Homo sapiens
uguuacaauuacccuguuu

SEQ ID NO: 1438744 - RNA, 19 nt, Homo sapiens
gugccauucuuccuguguu

SEQ ID NO: 1438745 - RNA, 19 nt, Homo sapiens
ugcauacgguccuggaugu

SEQ ID NO: 1438746 - RNA, 19 nt, Homo sapiens
acacaucuguuggcaucug

SEQ ID NO: 1438747 - RNA, 19 nt, Homo sapiens
gagacuggagauugaagug

SEQ ID NO: 1438748 - RNA, 19 nt, Homo sapiens
guguuacaauuacccuguu

SEQ ID NO: 1438749 - RNA, 19 nt, Homo sapiens
gaucgcugaauauggaaug

SEQ ID NO: 1438750 - RNA, 19 nt, Homo sapiens
ugauguauauuggccaagu

SEQ ID NO: 1438751 - RNA, 19 nt, Homo sapiens
uauugacccuuauuuaucc

SEQ ID NO: 1438752 - RNA, 19 nt, Homo sapiens
cgcugaaucucucccuguu

SEQ ID NO: 1438753 - RNA, 19 nt, Homo sapiens
acaucacguuucuuccauu

SEQ ID NO: 1438754 - RNA, 19 nt, Homo sapiens
ccuuauuuauccagaagau

SEQ ID NO: 1438755 - RNA, 19 nt, Homo sapiens
ggagacuggagauugaagu

SEQ ID NO: 1438756 - RNA, 19 nt, Homo sapiens
cagugggaauuguguugau

SEQ ID NO: 1438757 - RNA, 19 nt, Homo sapiens
ucuuccagcuuguauccaa

SEQ ID NO: 1438758 - RNA, 19 nt, Homo sapiens
ucaccgcacuccucaucgu

SEQ ID NO: 1438759 - RNA, 19 nt, Homo sapiens
ucacguuucuuccauucac

SEQ ID NO: 1438760 - RNA, 19 nt, Homo sapiens
gaacagggcuccuuauaug

SEQ ID NO: 1438761 - RNA, 19 nt, Homo sapiens
gcucaagucuucugucaua

SEQ ID NO: 1438762 - RNA, 19 nt, Homo sapiens
gauaguacauguuagcaua

SEQ ID NO: 1438763 - RNA, 19 nt, Homo sapiens
ccacuaaacuuguuccuuu

SEQ ID NO: 1438764 - RNA, 19 nt, Homo sapiens
caaacgagcugacaucuau

SEQ ID NO: 1438765 - RNA, 19 nt, Homo sapiens
gaaggcauauugaguuauu

SEQ ID NO: 1438766 - RNA, 19 nt, Homo sapiens
ggacacagaguaaugaaua

SEQ ID NO: 1438767 - RNA, 19 nt, Homo sapiens
gcacaugaaugaacaggaa

SEQ ID NO: 1438768 - RNA, 19 nt, Homo sapiens
gaagaaugcucaugauagu

SEQ ID NO: 1438769 - RNA, 19 nt, Homo sapiens
ugagaaagguuguuuguga

SEQ ID NO: 1438770 - RNA, 19 nt, Homo sapiens
guauauggcuccugaaaug

SEQ ID NO: 1438771 - RNA, 19 nt, Homo sapiens
agaaaucucucauagcuuu

SEQ ID NO: 1438772 - RNA, 19 nt, Homo sapiens
gagcuggccaucauuauua

SEQ ID NO: 1438773 - RNA, 19 nt, Homo sapiens
uaacugcucuucguauuaa

SEQ ID NO: 1438774 - RNA, 19 nt, Homo sapiens
gaacauucuucuacugaga

SEQ ID NO: 1438775 - RNA, 19 nt, Homo sapiens
gaaauguccugaagucaca

SEQ ID NO: 1438776 - RNA, 19 nt, Homo sapiens
gaacuuggacucaacuuug

SEQ ID NO: 1438777 - RNA, 19 nt, Homo sapiens
gagcugacaucuauucugu

SEQ ID NO: 1438778 - RNA, 19 nt, Homo sapiens
caacaaagauaauggaacu

SEQ ID NO: 1438779 - RNA, 19 nt, Homo sapiens
uagaaggcauauugaguua

SEQ ID NO: 1438780 - RNA, 19 nt, Homo sapiens
gaacacuuccaaagauuaa

SEQ ID NO: 1438781 - RNA, 19 nt, Homo sapiens
uuagcuagcuuccuacuuu

SEQ ID NO: 1438782 - RNA, 19 nt, Homo sapiens
gaccauggcuggaaugauc

SEQ ID NO: 1438783 - RNA, 19 nt, Homo sapiens
cuacugagaugauccaaga

SEQ ID NO: 1438784 - RNA, 19 nt, Homo sapiens
gaaaugagaaagguuguuu

SEQ ID NO: 1438785 - RNA, 19 nt, Homo sapiens
gaaugcugcuucacagauu

SEQ ID NO: 1438786 - RNA, 19 nt, Homo sapiens
caaacuccauuccuuagaa

SEQ ID NO: 1438787 - RNA, 19 nt, Homo sapiens
aaccauaucuguugacauu

SEQ ID NO: 1438788 - RNA, 19 nt, Homo sapiens
ggaguugacuucauccaau

SEQ ID NO: 1438789 - RNA, 19 nt, Homo sapiens
gacuauaucucaacuuugu

SEQ ID NO: 1438790 - RNA, 19 nt, Homo sapiens
guacauacacacuuagaaa

SEQ ID NO: 1438791 - RNA, 19 nt, Homo sapiens
guccaaaucuugugauaau

SEQ ID NO: 1438792 - RNA, 19 nt, Homo sapiens
gcugacaucuauucuguug

SEQ ID NO: 1438793 - RNA, 19 nt, Homo sapiens
gaccagaaguuucgaccaa

SEQ ID NO: 1438794 - RNA, 19 nt, Homo sapiens
gaggaauuguugaggagua

SEQ ID NO: 1438795 - RNA, 19 nt, Homo sapiens
cauccaaucucuauguuau

SEQ ID NO: 1438796 - RNA, 19 nt, Homo sapiens
aaagaaaucucucauagcu

SEQ ID NO: 1438797 - RNA, 19 nt, Homo sapiens
gggaagauguggcugugaa

SEQ ID NO: 1438798 - RNA, 19 nt, Homo sapiens
gaaauagcccggagguguu

SEQ ID NO: 1438799 - RNA, 19 nt, Homo sapiens
gaaccaagagcacaugaau

SEQ ID NO: 1438800 - RNA, 19 nt, Homo sapiens
gauaagacaguacaguauu

SEQ ID NO: 1438801 - RNA, 19 nt, Homo sapiens
gaauaaugcgugaguguug

SEQ ID NO: 1438802 - RNA, 19 nt, Homo sapiens
ccaaaccaguggcaaaguu

SEQ ID NO: 1438803 - RNA, 19 nt, Homo sapiens
gaugauacaaugaauguga

SEQ ID NO: 1438804 - RNA, 19 nt, Homo sapiens
gcacuagguccaaaucuug

SEQ ID NO: 1438805 - RNA, 19 nt, Homo sapiens
gugugaaacuugugccaua

SEQ ID NO: 1438806 - RNA, 19 nt, Homo sapiens
ccucaaagauaagacagua

SEQ ID NO: 1438807 - RNA, 19 nt, Homo sapiens
cugcaaagccuaaugauga

SEQ ID NO: 1438808 - RNA, 19 nt, Homo sapiens
gaagcaugauucaauacug

SEQ ID NO: 1438809 - RNA, 19 nt, Homo sapiens
caaggacgauugugcuuca

SEQ ID NO: 1438810 - RNA, 19 nt, Homo sapiens
caagucuucugucauaguu

SEQ ID NO: 1438811 - RNA, 19 nt, Homo sapiens
aauaugcccuucaaaucua

SEQ ID NO: 1438812 - RNA, 19 nt, Homo sapiens
ugagaaauguccugaaguc

SEQ ID NO: 1438813 - RNA, 19 nt, Homo sapiens
gaucugauuuaugauguga

SEQ ID NO: 1438814 - RNA, 19 nt, Homo sapiens
ugucauaguuccaacaaug

SEQ ID NO: 1438815 - RNA, 19 nt, Homo sapiens
gaaaagagcaggugaucaa

SEQ ID NO: 1438816 - RNA, 19 nt, Homo sapiens
uaaauaugcccuucaaauc

SEQ ID NO: 1438817 - RNA, 19 nt, Homo sapiens
gcugguaucugaauaucau

SEQ ID NO: 1438818 - RNA, 19 nt, Homo sapiens
guucuuugguacuugcuua

SEQ ID NO: 1438819 - RNA, 19 nt, Homo sapiens
gaggaaggaaggaaauauu

SEQ ID NO: 1438820 - RNA, 19 nt, Homo sapiens
ggaagaggaaggaaggaaa

SEQ ID NO: 1438821 - RNA, 19 nt, Homo sapiens
ggacugaaguguguauguc

SEQ ID NO: 1438822 - RNA, 19 nt, Homo sapiens
cuccagagaugaaagauau

SEQ ID NO: 1438823 - RNA, 19 nt, Homo sapiens
aagguuagcuagcuuccua

SEQ ID NO: 1438824 - RNA, 19 nt, Homo sapiens
guucuccuguucuucauaa

SEQ ID NO: 1438825 - RNA, 19 nt, Homo sapiens
gaguaccaauugccuuauu

SEQ ID NO: 1438826 - RNA, 19 nt, Homo sapiens
ccaacagcaucaccaaaug

SEQ ID NO: 1438827 - RNA, 19 nt, Homo sapiens
cagaagaaugcucaugaua

SEQ ID NO: 1438828 - RNA, 19 nt, Homo sapiens
cagaaacagcaaauagaua

SEQ ID NO: 1438829 - RNA, 19 nt, Homo sapiens
ucaaugaaguguuaacaac

SEQ ID NO: 1438830 - RNA, 19 nt, Homo sapiens
ggaaggaaauauuuugaga

SEQ ID NO: 1438831 - RNA, 19 nt, Homo sapiens
gaagaggaaggaaggaaau

SEQ ID NO: 1438832 - RNA, 19 nt, Homo sapiens
ccaaaucuugugauaauga

SEQ ID NO: 1438833 - RNA, 19 nt, Homo sapiens
gacacagaguaaugaauau

SEQ ID NO: 1438834 - RNA, 19 nt, Homo sapiens
cauacacacuuagaaagaa

SEQ ID NO: 1438835 - RNA, 19 nt, Homo sapiens
ccuauuuccuuuguacaua

SEQ ID NO: 1438836 - RNA, 19 nt, Homo sapiens
aaugaacaccguaagguua

SEQ ID NO: 1438837 - RNA, 19 nt, Homo sapiens
caaagccuaaugaugauaa

SEQ ID NO: 1438838 - RNA, 19 nt, Homo sapiens
ccaauugccuuauuaugac

SEQ ID NO: 1438839 - RNA, 19 nt, Homo sapiens
acugaacacuaucgacaua

SEQ ID NO: 1438840 - RNA, 19 nt, Homo sapiens
aagcaugauucaauacuga

SEQ ID NO: 1438841 - RNA, 19 nt, Homo sapiens
gauugugcuucaggaaaua

SEQ ID NO: 1438842 - RNA, 19 nt, Homo sapiens
ggagcuggccaucauuauu

SEQ ID NO: 1438843 - RNA, 19 nt, Homo sapiens
cauuaaauaugcccuucaa

SEQ ID NO: 1438844 - RNA, 19 nt, Homo sapiens
agaaugcucaugauaguuu

SEQ ID NO: 1438845 - RNA, 19 nt, Homo sapiens
caaauuagagcaugcuauc

SEQ ID NO: 1438846 - RNA, 19 nt, Homo sapiens
gaaagcaacaccucaacuc

SEQ ID NO: 1438847 - RNA, 19 nt, Homo sapiens
ugaaaugcuugaugauaca

SEQ ID NO: 1438848 - RNA, 19 nt, Homo sapiens
ggugagguguggcauggaa

SEQ ID NO: 1438849 - RNA, 19 nt, Homo sapiens
guauuuaagugcccauaag

SEQ ID NO: 1438850 - RNA, 19 nt, Homo sapiens
uguucuaccucaaagauaa

SEQ ID NO: 1438851 - RNA, 19 nt, Homo sapiens
caacauaacacugcaccuu

SEQ ID NO: 1438852 - RNA, 19 nt, Homo sapiens
cuacagacgguaucagaaa

SEQ ID NO: 1438853 - RNA, 19 nt, Homo sapiens
agaggucccuauuuccuuu

SEQ ID NO: 1438854 - RNA, 19 nt, Homo sapiens
ccuaacugcucuucguauu

SEQ ID NO: 1438855 - RNA, 19 nt, Homo sapiens
ugacaucuauucuguuggu

SEQ ID NO: 1438856 - RNA, 19 nt, Homo sapiens
ggaacuuggacucaacuuu

SEQ ID NO: 1438857 - RNA, 19 nt, Homo sapiens
agauauuccucuacccuuu

SEQ ID NO: 1438858 - RNA, 19 nt, Homo sapiens
gugugauucuucaaacuuu

SEQ ID NO: 1438859 - RNA, 19 nt, Homo sapiens
aguaccaauugccuuauua

SEQ ID NO: 1438860 - RNA, 19 nt, Homo sapiens
gaagggaaacugcauuaaa

SEQ ID NO: 1438861 - RNA, 19 nt, Homo sapiens
cauauaagcuuguaacucu

SEQ ID NO: 1438862 - RNA, 19 nt, Homo sapiens
ggaacaagauccggauuga

SEQ ID NO: 1438863 - RNA, 19 nt, Homo sapiens
ggacgcggcuaaacucuug

SEQ ID NO: 1438864 - RNA, 19 nt, Homo sapiens
uauauucacuccaaagaga

SEQ ID NO: 1438865 - RNA, 19 nt, Homo sapiens
acagauauauucacuccaa

SEQ ID NO: 1438866 - RNA, 19 nt, Homo sapiens
ccuccaagaucaaaugcua

SEQ ID NO: 1438867 - RNA, 19 nt, Homo sapiens
ggaauucgucugcaaguuc

SEQ ID NO: 1438868 - RNA, 19 nt, Homo sapiens
gauauauucacuccaaaga

SEQ ID NO: 1438869 - RNA, 19 nt, Homo sapiens
ggacgucugccuuccaaga

SEQ ID NO: 1438870 - RNA, 19 nt, Homo sapiens
gaauucgucugcaaguucu

SEQ ID NO: 1438871 - RNA, 19 nt, Homo sapiens
ggaagggaaacugcauuaa

SEQ ID NO: 1438872 - RNA, 19 nt, Homo sapiens
acaagacgcuacacucaca

SEQ ID NO: 1438873 - RNA, 19 nt, Homo sapiens
gaccacagauauauucacu

SEQ ID NO: 1438874 - RNA, 19 nt, Homo sapiens
ccacaagacgcuacacuca

SEQ ID NO: 1438875 - RNA, 19 nt, Homo sapiens
gcgcucuucuuucuccaaa

SEQ ID NO: 1438876 - RNA, 19 nt, Homo sapiens
caucgguaacggacauuua

SEQ ID NO: 1438877 - RNA, 19 nt, Homo sapiens
cggaagggaaacugcauua

SEQ ID NO: 1438878 - RNA, 19 nt, Homo sapiens
agaaggaauucgucugcaa

SEQ ID NO: 1438879 - RNA, 19 nt, Homo sapiens
caccaaguccuacaaccua

SEQ ID NO: 1438880 - RNA, 19 nt, Homo sapiens
gaccaucgguaacggacau

SEQ ID NO: 1438881 - RNA, 19 nt, Homo sapiens
gaggagaggcaacgaaguc

SEQ ID NO: 1438882 - RNA, 19 nt, Homo sapiens
aagggaaacugcauuaaaa

SEQ ID NO: 1438883 - RNA, 19 nt, Homo sapiens
gcuaaacucuuggccaaaa

SEQ ID NO: 1438884 - RNA, 19 nt, Homo sapiens
cgagaccacagauauauuc

SEQ ID NO: 1438885 - RNA, 19 nt, Homo sapiens
ggaccucugcggaacaaga

SEQ ID NO: 1438886 - RNA, 19 nt, Homo sapiens
aacaagauccggauugaga

SEQ ID NO: 1438887 - RNA, 19 nt, Homo sapiens
ucacguggcggaagggaaa

SEQ ID NO: 1438888 - RNA, 19 nt, Homo sapiens
ccaagaccaagaaggaauu

SEQ ID NO: 1438889 - RNA, 19 nt, Homo sapiens
gagaagccacugcaacuac

SEQ ID NO: 1438890 - RNA, 19 nt, Homo sapiens
ucaagagugugggaaagga

SEQ ID NO: 1438891 - RNA, 19 nt, Homo sapiens
gagaggagucgggacacua

SEQ ID NO: 1438892 - RNA, 19 nt, Homo sapiens
acaaccuacuuauccauga

SEQ ID NO: 1438893 - RNA, 19 nt, Homo sapiens
cugguucccucaugucauu

SEQ ID NO: 1438894 - RNA, 19 nt, Homo sapiens
ggcguuauauugcgauugg

SEQ ID NO: 1438895 - RNA, 19 nt, Homo sapiens
cuucaagugucaagagugu

SEQ ID NO: 1438896 - RNA, 19 nt, Homo sapiens
cagauauauucacuccaaa

SEQ ID NO: 1438897 - RNA, 19 nt, Homo sapiens
cccugcagcucaccaacua

SEQ ID NO: 1438898 - RNA, 19 nt, Homo sapiens
ccacugcaacuaccgaaau

SEQ ID NO: 1438899 - RNA, 19 nt, Homo sapiens
gagaggcaacgaaguccuu

SEQ ID NO: 1438900 - RNA, 19 nt, Homo sapiens
gcgagaccacagauauauu

SEQ ID NO: 1438901 - RNA, 19 nt, Homo sapiens
caacuacuccuuccuucag

SEQ ID NO: 1438902 - RNA, 19 nt, Homo sapiens
caaccuacuuauccaugag

SEQ ID NO: 1438903 - RNA, 19 nt, Homo sapiens
ugaacggccugcccacagu

SEQ ID NO: 1438904 - RNA, 19 nt, Homo sapiens
accaagcugucuccagaaa

SEQ ID NO: 1438905 - RNA, 19 nt, Homo sapiens
ggagaggagucgggacacu

SEQ ID NO: 1438906 - RNA, 19 nt, Homo sapiens
uuccagcgcucaagaccaa

SEQ ID NO: 1438907 - RNA, 19 nt, Homo sapiens
auauugcgauuggcacuuu

SEQ ID NO: 1438908 - RNA, 19 nt, Homo sapiens
uauaagcuuguaacucuga

SEQ ID NO: 1438909 - RNA, 19 nt, Homo sapiens
gccucucccagaaguauua

SEQ ID NO: 1438910 - RNA, 19 nt, Homo sapiens
ugagaagccacugcaacua

SEQ ID NO: 1438911 - RNA, 19 nt, Homo sapiens
gaacaagauccggauugag

SEQ ID NO: 1438912 - RNA, 19 nt, Homo sapiens
gacucucgcuguccacaag

SEQ ID NO: 1438913 - RNA, 19 nt, Homo sapiens
caggaccucugcggaacaa

SEQ ID NO: 1438914 - RNA, 19 nt, Homo sapiens
acauuuaucacuggaguuu

SEQ ID NO: 1438915 - RNA, 19 nt, Homo sapiens
uuccaccucuccaacauug

SEQ ID NO: 1438916 - RNA, 19 nt, Homo sapiens
gcucaaaaccuccaagauc

SEQ ID NO: 1438917 - RNA, 19 nt, Homo sapiens
uauugcgauuggcacuuua

SEQ ID NO: 1438918 - RNA, 19 nt, Homo sapiens
cacugcaacuaccgaaaug

SEQ ID NO: 1438919 - RNA, 19 nt, Homo sapiens
aaaccuccaagaucaaaug

SEQ ID NO: 1438920 - RNA, 19 nt, Homo sapiens
cugcgagaccacagauaua

SEQ ID NO: 1438921 - RNA, 19 nt, Homo sapiens
aaaguguaaucccuguauc

SEQ ID NO: 1438922 - RNA, 19 nt, Homo sapiens
gaccauauaagcuuguaac

SEQ ID NO: 1438923 - RNA, 19 nt, Homo sapiens
caagcugucuccagaaaag

SEQ ID NO: 1438924 - RNA, 19 nt, Homo sapiens
cuaccgaaaugggcagcaa

SEQ ID NO: 1438925 - RNA, 19 nt, Homo sapiens
gcccuacaccugugacauc

SEQ ID NO: 1438926 - RNA, 19 nt, Homo sapiens
gcggaagggaaacugcauu

SEQ ID NO: 1438927 - RNA, 19 nt, Homo sapiens
uccaagaucaaaugcuaaa

SEQ ID NO: 1438928 - RNA, 19 nt, Homo sapiens
gaccaagcugucuccagaa

SEQ ID NO: 1438929 - RNA, 19 nt, Homo sapiens
aagaagauccggccaagcu

SEQ ID NO: 1438930 - RNA, 19 nt, Homo sapiens
guaacggacauuuaucacu

SEQ ID NO: 1438931 - RNA, 19 nt, Homo sapiens
ggaccuuccaccucuccaa

SEQ ID NO: 1438932 - RNA, 19 nt, Homo sapiens
ccaacuacuccuuccuuca

SEQ ID NO: 1438933 - RNA, 19 nt, Homo sapiens
ccugcgagaccacagauau

SEQ ID NO: 1438934 - RNA, 19 nt, Homo sapiens
ccuacaaccuacuuaucca

SEQ ID NO: 1438935 - RNA, 19 nt, Homo sapiens
ggcagcaacgcaagaagau

SEQ ID NO: 1438936 - RNA, 19 nt, Homo sapiens
ggagaaagcucacccaguu

SEQ ID NO: 1438937 - RNA, 19 nt, Homo sapiens
ggacuuccauggcuuguua

SEQ ID NO: 1438938 - RNA, 19 nt, Homo sapiens
guagauagcugcuguuaau

SEQ ID NO: 1438939 - RNA, 19 nt, Homo sapiens
gaaauuaccacaccuacua

SEQ ID NO: 1438940 - RNA, 19 nt, Homo sapiens
gcaccaagguuccuaaaga

SEQ ID NO: 1438941 - RNA, 19 nt, Homo sapiens
gauagcugcuguuaauaua

SEQ ID NO: 1438942 - RNA, 19 nt, Homo sapiens
uaaaucagcuguuucaugu

SEQ ID NO: 1438943 - RNA, 19 nt, Homo sapiens
gcugggauaugaagaauaa

SEQ ID NO: 1438944 - RNA, 19 nt, Homo sapiens
caacaaaguuacugugaau

SEQ ID NO: 1438945 - RNA, 19 nt, Homo sapiens
uuacugagcuuugugauaa

SEQ ID NO: 1438946 - RNA, 19 nt, Homo sapiens
gaaggaagauuacugaaaa

SEQ ID NO: 1438947 - RNA, 19 nt, Homo sapiens
ggugugauaucuuguauga

SEQ ID NO: 1438948 - RNA, 19 nt, Homo sapiens
gcauugaucguuaugaaua

SEQ ID NO: 1438949 - RNA, 19 nt, Homo sapiens
ugaaagacaugcagaacaa

SEQ ID NO: 1438950 - RNA, 19 nt, Homo sapiens
cauaucagcuauucauuga

SEQ ID NO: 1438951 - RNA, 19 nt, Homo sapiens
gaacagguauuuuccuuuu

SEQ ID NO: 1438952 - RNA, 19 nt, Homo sapiens
gcaacaaaguuacugugaa

SEQ ID NO: 1438953 - RNA, 19 nt, Homo sapiens
guacuggugugauaucuug

SEQ ID NO: 1438954 - RNA, 19 nt, Homo sapiens
gaaccaauuuagaacuuga

SEQ ID NO: 1438955 - RNA, 19 nt, Homo sapiens
ucaguuggaugaauuacua

SEQ ID NO: 1438956 - RNA, 19 nt, Homo sapiens
uaagugaacuguuuaaagg

SEQ ID NO: 1438957 - RNA, 19 nt, Homo sapiens
gagugggugugauuuauuu

SEQ ID NO: 1438958 - RNA, 19 nt, Homo sapiens
ggaaaggccuugcuuaucc

SEQ ID NO: 1438959 - RNA, 19 nt, Homo sapiens
gcauauggaugugaaguga

SEQ ID NO: 1438960 - RNA, 19 nt, Homo sapiens
gaaagcagagcaguacaua

SEQ ID NO: 1438961 - RNA, 19 nt, Homo sapiens
gaaaugauucucccaacaa

SEQ ID NO: 1438962 - RNA, 19 nt, Homo sapiens
gaaacucugaugcuauaua

SEQ ID NO: 1438963 - RNA, 19 nt, Homo sapiens
guaaucacguuaaugguau

SEQ ID NO: 1438964 - RNA, 19 nt, Homo sapiens
gagccacgcuucugcauuc

SEQ ID NO: 1438965 - RNA, 19 nt, Homo sapiens
gaacuguggugcaggaaca

SEQ ID NO: 1438966 - RNA, 19 nt, Homo sapiens
guuuaaagcuuugcugaaa

SEQ ID NO: 1438967 - RNA, 19 nt, Homo sapiens
caacaguggauuucucaua

SEQ ID NO: 1438968 - RNA, 19 nt, Homo sapiens
ccaggaagaagaagaauuu

SEQ ID NO: 1438969 - RNA, 19 nt, Homo sapiens
ugacaucucuaguaaauac

SEQ ID NO: 1438970 - RNA, 19 nt, Homo sapiens
uuccauggcuuguuauaua

SEQ ID NO: 1438971 - RNA, 19 nt, Homo sapiens
aggcaaaccucucuacauu

SEQ ID NO: 1438972 - RNA, 19 nt, Homo sapiens
ugugauaagugaacuguuu

SEQ ID NO: 1438973 - RNA, 19 nt, Homo sapiens
gcagagcaguacauauuca

SEQ ID NO: 1438974 - RNA, 19 nt, Homo sapiens
caacaaugcauaucagcua

SEQ ID NO: 1438975 - RNA, 19 nt, Homo sapiens
gguaaucacguuaauggua

SEQ ID NO: 1438976 - RNA, 19 nt, Homo sapiens
ccacaacccuuacgcaaag

SEQ ID NO: 1438977 - RNA, 19 nt, Homo sapiens
cuuagaaacugcugugaaa

SEQ ID NO: 1438978 - RNA, 19 nt, Homo sapiens
ucagcuguuucauguauua

SEQ ID NO: 1438979 - RNA, 19 nt, Homo sapiens
cuaaauagcuguccuuucc

SEQ ID NO: 1438980 - RNA, 19 nt, Homo sapiens
gaacuuccuuucagcucaa

SEQ ID NO: 1438981 - RNA, 19 nt, Homo sapiens
guacuugaauacauacaug

SEQ ID NO: 1438982 - RNA, 19 nt, Homo sapiens
ggcaaaaggucuuguuuaa

SEQ ID NO: 1438983 - RNA, 19 nt, Homo sapiens
uugaaacucugaugcuaua

SEQ ID NO: 1438984 - RNA, 19 nt, Homo sapiens
cuaaagauccugcuguuug

SEQ ID NO: 1438985 - RNA, 19 nt, Homo sapiens
gaagaagaauuuucaguuc

SEQ ID NO: 1438986 - RNA, 19 nt, Homo sapiens
agaaaagucuuacgaagua

SEQ ID NO: 1438987 - RNA, 19 nt, Homo sapiens
gacaugacauuacaagagu

SEQ ID NO: 1438988 - RNA, 19 nt, Homo sapiens
cucaagagguucagcuaua

SEQ ID NO: 1438989 - RNA, 19 nt, Homo sapiens
caagagguuuaagaacaua

SEQ ID NO: 1438990 - RNA, 19 nt, Homo sapiens
aaaauuaggugcuugguaa

SEQ ID NO: 1438991 - RNA, 19 nt, Homo sapiens
guuccagcauuugauauua

SEQ ID NO: 1438992 - RNA, 19 nt, Homo sapiens
aagauuaccuaucguucua

SEQ ID NO: 1438993 - RNA, 19 nt, Homo sapiens
agaaggaacucaggaaugu

SEQ ID NO: 1438994 - RNA, 19 nt, Homo sapiens
gaauuagucaccaguaaau

SEQ ID NO: 1438995 - RNA, 19 nt, Homo sapiens
ucuaugagaaggaagauua

SEQ ID NO: 1438996 - RNA, 19 nt, Homo sapiens
gcauaucagcuauucauug

SEQ ID NO: 1438997 - RNA, 19 nt, Homo sapiens
gaguacaugugaugcagaa

SEQ ID NO: 1438998 - RNA, 19 nt, Homo sapiens
gcagcacucucaguuaaau

SEQ ID NO: 1438999 - RNA, 19 nt, Homo sapiens
gagaaagcucacccaguua

SEQ ID NO: 1439000 - RNA, 19 nt, Homo sapiens
cuaauugacaucucuagua

SEQ ID NO: 1439001 - RNA, 19 nt, Homo sapiens
aagcagagcaguacauauu

SEQ ID NO: 1439002 - RNA, 19 nt, Homo sapiens
gaacauacacugggcagau

SEQ ID NO: 1439003 - RNA, 19 nt, Homo sapiens
gcugcaagcaacaaaguua

SEQ ID NO: 1439004 - RNA, 19 nt, Homo sapiens
uacaguugccugagaauua

SEQ ID NO: 1439005 - RNA, 19 nt, Homo sapiens
ucaggaaugugcaaugguu

SEQ ID NO: 1439006 - RNA, 19 nt, Homo sapiens
uguagaagcuaaauugauc

SEQ ID NO: 1439007 - RNA, 19 nt, Homo sapiens
aaucagcuguuucauguau

SEQ ID NO: 1439008 - RNA, 19 nt, Homo sapiens
auacaaaguucuugagcaa

SEQ ID NO: 1439009 - RNA, 19 nt, Homo sapiens
gaucaaugcaucgguaauu

SEQ ID NO: 1439010 - RNA, 19 nt, Homo sapiens
gaagaaggaacucaggaau

SEQ ID NO: 1439011 - RNA, 19 nt, Homo sapiens
ggaaaguuauaccaugaag

SEQ ID NO: 1439012 - RNA, 19 nt, Homo sapiens
guacugcacucucagaacu

SEQ ID NO: 1439013 - RNA, 19 nt, Homo sapiens
gcaugcugcuaaacuagaa

SEQ ID NO: 1439014 - RNA, 19 nt, Homo sapiens
ggagaacauuaauaacaag

SEQ ID NO: 1439015 - RNA, 19 nt, Homo sapiens
aaggaaagauacaaaguuc

SEQ ID NO: 1439016 - RNA, 19 nt, Homo sapiens
gagguucagcuauauugua

SEQ ID NO: 1439017 - RNA, 19 nt, Homo sapiens
ucaagagguucagcuauau

SEQ ID NO: 1439018 - RNA, 19 nt, Homo sapiens
aaggaaaguuauaccauga

SEQ ID NO: 1439019 - RNA, 19 nt, Homo sapiens
cacuuuaccugcauuguga

SEQ ID NO: 1439020 - RNA, 19 nt, Homo sapiens
caugcaugcugcuaaacua

SEQ ID NO: 1439021 - RNA, 19 nt, Homo sapiens
guuauaccaugaagaagga

SEQ ID NO: 1439022 - RNA, 19 nt, Homo sapiens
uugcagcacucucaguuaa

SEQ ID NO: 1439023 - RNA, 19 nt, Homo sapiens
aaauuuggguguuugauag

SEQ ID NO: 1439024 - RNA, 19 nt, Homo sapiens
uccaacacauugcuacuuu

SEQ ID NO: 1439025 - RNA, 19 nt, Homo sapiens
gagcaacaguggauuucuc

SEQ ID NO: 1439026 - RNA, 19 nt, Homo sapiens
acaaaguucuugagcaaca

SEQ ID NO: 1439027 - RNA, 19 nt, Homo sapiens
guauuuggaugcucaugga

SEQ ID NO: 1439028 - RNA, 19 nt, Homo sapiens
caaaguuacugugaaugug

SEQ ID NO: 1439029 - RNA, 19 nt, Homo sapiens
gaaaggccuugcuuaucca

SEQ ID NO: 1439030 - RNA, 19 nt, Homo sapiens
ccaaacagaacauccauuc

SEQ ID NO: 1439031 - RNA, 19 nt, Homo sapiens
gcugucauuugguuuguga

SEQ ID NO: 1439032 - RNA, 19 nt, Homo sapiens
gaauaccagaccauuugua

SEQ ID NO: 1439033 - RNA, 19 nt, Homo sapiens
aaucauggccuugcauuaa

SEQ ID NO: 1439034 - RNA, 19 nt, Homo sapiens
ugacauauugcuacaaaga

SEQ ID NO: 1439035 - RNA, 19 nt, Homo sapiens
ugugacauauugcuacaaa

SEQ ID NO: 1439036 - RNA, 19 nt, Homo sapiens
ggaagaggcugauuacuuu

SEQ ID NO: 1439037 - RNA, 19 nt, Homo sapiens
ggaagcagguggacuuuaa

SEQ ID NO: 1439038 - RNA, 19 nt, Homo sapiens
ccaaugaaauggagacaua

SEQ ID NO: 1439039 - RNA, 19 nt, Homo sapiens
gaacguggguggcuguauu

SEQ ID NO: 1439040 - RNA, 19 nt, Homo sapiens
gcgaugaccuugagcagua

SEQ ID NO: 1439041 - RNA, 19 nt, Homo sapiens
gaaacccugucuuuacuaa

SEQ ID NO: 1439042 - RNA, 19 nt, Homo sapiens
caaauaauccugaaagcua

SEQ ID NO: 1439043 - RNA, 19 nt, Homo sapiens
gaucacagguuacguguuc

SEQ ID NO: 1439044 - RNA, 19 nt, Homo sapiens
gcuguaagcugagauugua

SEQ ID NO: 1439045 - RNA, 19 nt, Homo sapiens
ucauaaggaucacagguua

SEQ ID NO: 1439046 - RNA, 19 nt, Homo sapiens
acacuaggcauaaauguua

SEQ ID NO: 1439047 - RNA, 19 nt, Homo sapiens
ggagacauauucuuuaagg

SEQ ID NO: 1439048 - RNA, 19 nt, Homo sapiens
cuacuuaccauuccuauuu

SEQ ID NO: 1439049 - RNA, 19 nt, Homo sapiens
gcaguuuacuuacaaaucu

SEQ ID NO: 1439050 - RNA, 19 nt, Homo sapiens
uaacaaccauguauugagu

SEQ ID NO: 1439051 - RNA, 19 nt, Homo sapiens
uggagaagaugucuaaaga

SEQ ID NO: 1439052 - RNA, 19 nt, Homo sapiens
gacaaaguaagcucaaaua

SEQ ID NO: 1439053 - RNA, 19 nt, Homo sapiens
gcaccuauugucucaguua

SEQ ID NO: 1439054 - RNA, 19 nt, Homo sapiens
ugacagagcaagacauaaa

SEQ ID NO: 1439055 - RNA, 19 nt, Homo sapiens
gaaagcuaguaaagacuga

SEQ ID NO: 1439056 - RNA, 19 nt, Homo sapiens
gaacagacgcuauugaaaa

SEQ ID NO: 1439057 - RNA, 19 nt, Homo sapiens
gaccaagacaucauuguuu

SEQ ID NO: 1439058 - RNA, 19 nt, Homo sapiens
aaagagaggcgggaaauaa

SEQ ID NO: 1439059 - RNA, 19 nt, Homo sapiens
aaucagaucuuggcgauga

SEQ ID NO: 1439060 - RNA, 19 nt, Homo sapiens
cgaggcagguggaucauga

SEQ ID NO: 1439061 - RNA, 19 nt, Homo sapiens
ggugcaagcugugagagua

SEQ ID NO: 1439062 - RNA, 19 nt, Homo sapiens
gaaugaaacuccgucucaa

SEQ ID NO: 1439063 - RNA, 19 nt, Homo sapiens
aagcugagauuguaccauu

SEQ ID NO: 1439064 - RNA, 19 nt, Homo sapiens
gaggaagaauucacagcaa

SEQ ID NO: 1439065 - RNA, 19 nt, Homo sapiens
cuaaagagcccuuauaaaa

SEQ ID NO: 1439066 - RNA, 19 nt, Homo sapiens
ugauggacgucuauuuaaa

SEQ ID NO: 1439067 - RNA, 19 nt, Homo sapiens
ggagcccacugccuuagaa

SEQ ID NO: 1439068 - RNA, 19 nt, Homo sapiens
gaagggcuuugacacuuuc

SEQ ID NO: 1439069 - RNA, 19 nt, Homo sapiens
gagugagaguugguaauaa

SEQ ID NO: 1439070 - RNA, 19 nt, Homo sapiens
caauguauuugucaucuca

SEQ ID NO: 1439071 - RNA, 19 nt, Homo sapiens
ggaacagacgcuauugaaa

SEQ ID NO: 1439072 - RNA, 19 nt, Homo sapiens
gaguagaauuauuggugua

SEQ ID NO: 1439073 - RNA, 19 nt, Homo sapiens
agacuucugugauucauau

SEQ ID NO: 1439074 - RNA, 19 nt, Homo sapiens
cgugauggacgucuauuua

SEQ ID NO: 1439075 - RNA, 19 nt, Homo sapiens
gcaguaggauauaaauaac

SEQ ID NO: 1439076 - RNA, 19 nt, Homo sapiens
cagaagggcuuugacacuu

SEQ ID NO: 1439077 - RNA, 19 nt, Homo sapiens
gagcaguaggauauaaaua

SEQ ID NO: 1439078 - RNA, 19 nt, Homo sapiens
ggugacagagcaagacaua

SEQ ID NO: 1439079 - RNA, 19 nt, Homo sapiens
gaaauggagacauauucuu

SEQ ID NO: 1439080 - RNA, 19 nt, Homo sapiens
ucuguuaggugcaaaguau

SEQ ID NO: 1439081 - RNA, 19 nt, Homo sapiens
aguggucgcuuuccucuaa

SEQ ID NO: 1439082 - RNA, 19 nt, Homo sapiens
agaagggcuuugacacuuu

SEQ ID NO: 1439083 - RNA, 19 nt, Homo sapiens
cagccugucugaccauuug

SEQ ID NO: 1439084 - RNA, 19 nt, Homo sapiens
uaauggaacacuaggcaua

SEQ ID NO: 1439085 - RNA, 19 nt, Homo sapiens
gaagaggaggugcuagaug

SEQ ID NO: 1439086 - RNA, 19 nt, Homo sapiens
ucccaugaguugcuagaua

SEQ ID NO: 1439087 - RNA, 19 nt, Homo sapiens
aagaggaggugcuagaugu

SEQ ID NO: 1439088 - RNA, 19 nt, Homo sapiens
caaaguaugauaacaaguc

SEQ ID NO: 1439089 - RNA, 19 nt, Homo sapiens
cagguuacguguucuguuc

SEQ ID NO: 1439090 - RNA, 19 nt, Homo sapiens
ggauuaccuucauggagaa

SEQ ID NO: 1439091 - RNA, 19 nt, Homo sapiens
gaacacuaggcauaaaugu

SEQ ID NO: 1439092 - RNA, 19 nt, Homo sapiens
ggaaagggagagaaaauaa

SEQ ID NO: 1439093 - RNA, 19 nt, Homo sapiens
ugaggcaguuuacuuacaa

SEQ ID NO: 1439094 - RNA, 19 nt, Homo sapiens
ggaaauaauguucaguaca

SEQ ID NO: 1439095 - RNA, 19 nt, Homo sapiens
gaaaccccaucucuacuaa

SEQ ID NO: 1439096 - RNA, 19 nt, Homo sapiens
gggaaauaauguucaguac

SEQ ID NO: 1439097 - RNA, 19 nt, Homo sapiens
gauggacgucuauuuaaau

SEQ ID NO: 1439098 - RNA, 19 nt, Homo sapiens
gugauggacgucuauuuaa

SEQ ID NO: 1439099 - RNA, 19 nt, Homo sapiens
gugaaacccugucuuuacu

SEQ ID NO: 1439100 - RNA, 19 nt, Homo sapiens
ggugaaacccugucuuuac

SEQ ID NO: 1439101 - RNA, 19 nt, Homo sapiens
ccugaaagcuaguaaagac

SEQ ID NO: 1439102 - RNA, 19 nt, Homo sapiens
cccaugaguugcuagauau

SEQ ID NO: 1439103 - RNA, 19 nt, Homo sapiens
ggaacacuaggcauaaaug

SEQ ID NO: 1439104 - RNA, 19 nt, Homo sapiens
gcuuaguguuccaauaaug

SEQ ID NO: 1439105 - RNA, 19 nt, Homo sapiens
ccucuggacuggcaagaug

SEQ ID NO: 1439106 - RNA, 19 nt, Homo sapiens
ggaggcagagguugcugua

SEQ ID NO: 1439107 - RNA, 19 nt, Homo sapiens
cuagguauguuucuguuag

SEQ ID NO: 1439108 - RNA, 19 nt, Homo sapiens
uaaaucccaugaguugcua

SEQ ID NO: 1439109 - RNA, 19 nt, Homo sapiens
gaagcagguggacuuuaaa

SEQ ID NO: 1439110 - RNA, 19 nt, Homo sapiens
agagugagaguugguaaua

SEQ ID NO: 1439111 - RNA, 19 nt, Homo sapiens
ucaaggaaagggagagaaa

SEQ ID NO: 1439112 - RNA, 19 nt, Homo sapiens
gugcaaaguaugauaacaa

SEQ ID NO: 1439113 - RNA, 19 nt, Homo sapiens
gggcuuugacacuuucaua

SEQ ID NO: 1439114 - RNA, 19 nt, Homo sapiens
uauguucaguggucgcuuu

SEQ ID NO: 1439115 - RNA, 19 nt, Homo sapiens
aggaagaauucacagcaaa

SEQ ID NO: 1439116 - RNA, 19 nt, Homo sapiens
caguuuggguucuccacua

SEQ ID NO: 1439117 - RNA, 19 nt, Homo sapiens
gaaacuccgucucaaaaca

SEQ ID NO: 1439118 - RNA, 19 nt, Homo sapiens
ccuauugucucaguuacuu

SEQ ID NO: 1439119 - RNA, 19 nt, Homo sapiens
gucuaaagagcccuuauaa

SEQ ID NO: 1439120 - RNA, 19 nt, Homo sapiens
ucuguuagcuaggcuuauu

SEQ ID NO: 1439121 - RNA, 19 nt, Homo sapiens
caugaguugcuagauauua

SEQ ID NO: 1439122 - RNA, 19 nt, Homo sapiens
guacagugcaauucuuuua

SEQ ID NO: 1439123 - RNA, 19 nt, Homo sapiens
gaaaagguacagugcaauu

SEQ ID NO: 1439124 - RNA, 19 nt, Homo sapiens
uuggagcuauuauucagua

SEQ ID NO: 1439125 - RNA, 19 nt, Homo sapiens
uggcaucccuuauccauac

SEQ ID NO: 1439126 - RNA, 19 nt, Homo sapiens
caugcuuaguguuccaaua

SEQ ID NO: 1439127 - RNA, 19 nt, Homo sapiens
ccaggagcccacugccuua

SEQ ID NO: 1439128 - RNA, 19 nt, Homo sapiens
gguuacguguucuguucua

SEQ ID NO: 1439129 - RNA, 19 nt, Homo sapiens
agugagaguugguaauaau

SEQ ID NO: 1439130 - RNA, 19 nt, Homo sapiens
gcaucgcccuacaggaaga

SEQ ID NO: 1439131 - RNA, 19 nt, Homo sapiens
ccgcaucgcccuacaggaa

SEQ ID NO: 1439132 - RNA, 19 nt, Homo sapiens
gugagaguugguaauaaua

SEQ ID NO: 1439133 - RNA, 19 nt, Homo sapiens
uagcagaguugaagaaaau

SEQ ID NO: 1439134 - RNA, 19 nt, Homo sapiens
uacaggaagaggcugauua

SEQ ID NO: 1439135 - RNA, 19 nt, Homo sapiens
gucaugagauugagaccau

SEQ ID NO: 1439136 - RNA, 19 nt, Homo sapiens
gaaagaaacugauuugaag

SEQ ID NO: 1439137 - RNA, 19 nt, Homo sapiens
ggacaagaaucauaaacaa

SEQ ID NO: 1439138 - RNA, 19 nt, Homo sapiens
gaagagaacauucaucuga

SEQ ID NO: 1439139 - RNA, 19 nt, Homo sapiens
gaaaggacaagaaucauaa

SEQ ID NO: 1439140 - RNA, 19 nt, Homo sapiens
ggaccaacaucauuucuga

SEQ ID NO: 1439141 - RNA, 19 nt, Homo sapiens
gagaagagaccaaauaaau

SEQ ID NO: 1439142 - RNA, 19 nt, Homo sapiens
gaacacaaaccucuacuau

SEQ ID NO: 1439143 - RNA, 19 nt, Homo sapiens
gaagaaggaugagaaguuc

SEQ ID NO: 1439144 - RNA, 19 nt, Homo sapiens
acacaaaccucuacuauac

SEQ ID NO: 1439145 - RNA, 19 nt, Homo sapiens
gaagagaccaaauaaauag

SEQ ID NO: 1439146 - RNA, 19 nt, Homo sapiens
caacaucauuucugaccua

SEQ ID NO: 1439147 - RNA, 19 nt, Homo sapiens
caagcuaacuccucuucua

SEQ ID NO: 1439148 - RNA, 19 nt, Homo sapiens
ggaagaaggaugagaaguu

SEQ ID NO: 1439149 - RNA, 19 nt, Homo sapiens
agaaauugcucuccaguga

SEQ ID NO: 1439150 - RNA, 19 nt, Homo sapiens
gcaagaugguagcaagaaa

SEQ ID NO: 1439151 - RNA, 19 nt, Homo sapiens
gcaagaagagacuaauaaa

SEQ ID NO: 1439152 - RNA, 19 nt, Homo sapiens
ggacaguauuuaugaugaa

SEQ ID NO: 1439153 - RNA, 19 nt, Homo sapiens
caagaaaggacaagaauca

SEQ ID NO: 1439154 - RNA, 19 nt, Homo sapiens
gaauauguuucguacguau

SEQ ID NO: 1439155 - RNA, 19 nt, Homo sapiens
gaagaaauuugugaaggau

SEQ ID NO: 1439156 - RNA, 19 nt, Homo sapiens
gugcugagaugaaacagaa

SEQ ID NO: 1439157 - RNA, 19 nt, Homo sapiens
gcagugcugucuuugagaa

SEQ ID NO: 1439158 - RNA, 19 nt, Homo sapiens
uagagucacugaacacaaa

SEQ ID NO: 1439159 - RNA, 19 nt, Homo sapiens
ugaagaaauuugugaagga

SEQ ID NO: 1439160 - RNA, 19 nt, Homo sapiens
gaaggaggagcucuugaaa

SEQ ID NO: 1439161 - RNA, 19 nt, Homo sapiens
guacguaucaggacaguau

SEQ ID NO: 1439162 - RNA, 19 nt, Homo sapiens
ggcaagaagagacuaauaa

SEQ ID NO: 1439163 - RNA, 19 nt, Homo sapiens
gaaagagaaagcuauagug

SEQ ID NO: 1439164 - RNA, 19 nt, Homo sapiens
ugaaacaacaucaaaguga

SEQ ID NO: 1439165 - RNA, 19 nt, Homo sapiens
aaauugcucuccagugaaa

SEQ ID NO: 1439166 - RNA, 19 nt, Homo sapiens
cgaaauggaagaaggauga

SEQ ID NO: 1439167 - RNA, 19 nt, Homo sapiens
gaacagggagcucaaagag

SEQ ID NO: 1439168 - RNA, 19 nt, Homo sapiens
ucaccuggcuaucaacuug

SEQ ID NO: 1439169 - RNA, 19 nt, Homo sapiens
ggagaagagaccaaauaaa

SEQ ID NO: 1439170 - RNA, 19 nt, Homo sapiens
gaggagcucuugaaacaac

SEQ ID NO: 1439171 - RNA, 19 nt, Homo sapiens
gaaauggagucaggagaag

SEQ ID NO: 1439172 - RNA, 19 nt, Homo sapiens
ccagaaagagaaagcuaua

SEQ ID NO: 1439173 - RNA, 19 nt, Homo sapiens
gcaacagcuucuucuuaug

SEQ ID NO: 1439174 - RNA, 19 nt, Homo sapiens
ucagugaguuggagaacaa

SEQ ID NO: 1439175 - RNA, 19 nt, Homo sapiens
caaagaggcccaugaagca

SEQ ID NO: 1439176 - RNA, 19 nt, Homo sapiens
aggaggagcucuugaaaca

SEQ ID NO: 1439177 - RNA, 19 nt, Homo sapiens
acagggaguuccaagcuaa

SEQ ID NO: 1439178 - RNA, 19 nt, Homo sapiens
gcaauuagaagagcugaga

SEQ ID NO: 1439179 - RNA, 19 nt, Homo sapiens
ugcaacagcuucuucuuau

SEQ ID NO: 1439180 - RNA, 19 nt, Homo sapiens
gaagagaaguggucaaaac

SEQ ID NO: 1439181 - RNA, 19 nt, Homo sapiens
agaaaggacaagaaucaua

SEQ ID NO: 1439182 - RNA, 19 nt, Homo sapiens
gcucaaagaggcccaugaa

SEQ ID NO: 1439183 - RNA, 19 nt, Homo sapiens
cacaagcccuuauccuaga

SEQ ID NO: 1439184 - RNA, 19 nt, Homo sapiens
agaaagcuauagugggaaa

SEQ ID NO: 1439185 - RNA, 19 nt, Homo sapiens
ccacggaagcuaaucaaga

SEQ ID NO: 1439186 - RNA, 19 nt, Homo sapiens
gagaugaaacagaacuuug

SEQ ID NO: 1439187 - RNA, 19 nt, Homo sapiens
gaaauugcucuccagugaa

SEQ ID NO: 1439188 - RNA, 19 nt, Homo sapiens
ggucaugcaggaagaauug

SEQ ID NO: 1439189 - RNA, 19 nt, Homo sapiens
cgaaauggagucaggagaa

SEQ ID NO: 1439190 - RNA, 19 nt, Homo sapiens
ggagaacaacuacaaagca

SEQ ID NO: 1439191 - RNA, 19 nt, Homo sapiens
aaagugacaccuugcaauu

SEQ ID NO: 1439192 - RNA, 19 nt, Homo sapiens
aagagaagcuagaggagau

SEQ ID NO: 1439193 - RNA, 19 nt, Homo sapiens
uagaagagcaaaucucaga

SEQ ID NO: 1439194 - RNA, 19 nt, Homo sapiens
gagauuggccucuauuacu

SEQ ID NO: 1439195 - RNA, 19 nt, Homo sapiens
agaaauuugugaaggaugu

SEQ ID NO: 1439196 - RNA, 19 nt, Homo sapiens
gaggugcccuggagaagag

SEQ ID NO: 1439197 - RNA, 19 nt, Homo sapiens
cuacaaagcagccuugaag

SEQ ID NO: 1439198 - RNA, 19 nt, Homo sapiens
gcugagcuuucucugaguu

SEQ ID NO: 1439199 - RNA, 19 nt, Homo sapiens
gggagauuggccucuauua

SEQ ID NO: 1439200 - RNA, 19 nt, Homo sapiens
cuucuaccuugacguauuu

SEQ ID NO: 1439201 - RNA, 19 nt, Homo sapiens
gcucugcauuguugaagau

SEQ ID NO: 1439202 - RNA, 19 nt, Homo sapiens
cugcaacagcuucuucuua

SEQ ID NO: 1439203 - RNA, 19 nt, Homo sapiens
uaaauagacauuggcauga

SEQ ID NO: 1439204 - RNA, 19 nt, Homo sapiens
aagaauauguuucguacgu

SEQ ID NO: 1439205 - RNA, 19 nt, Homo sapiens
gaugaaacagaacuuugaa

SEQ ID NO: 1439206 - RNA, 19 nt, Homo sapiens
aaucggagaucccggacaa

SEQ ID NO: 1439207 - RNA, 19 nt, Homo sapiens
ggaagaauugcaugcacaa

SEQ ID NO: 1439208 - RNA, 19 nt, Homo sapiens
ggcaugauguccugcaaca

SEQ ID NO: 1439209 - RNA, 19 nt, Homo sapiens
gagaccaaauaaauagaca

SEQ ID NO: 1439210 - RNA, 19 nt, Homo sapiens
caacgugucaccuggcuau

SEQ ID NO: 1439211 - RNA, 19 nt, Homo sapiens
gcaagaaaggacaagaauc

SEQ ID NO: 1439212 - RNA, 19 nt, Homo sapiens
caaagugacaccuugcaau

SEQ ID NO: 1439213 - RNA, 19 nt, Homo sapiens
ggagucaggagaagaagau

SEQ ID NO: 1439214 - RNA, 19 nt, Homo sapiens
gagaaaauauccugcuaca

SEQ ID NO: 1439215 - RNA, 19 nt, Homo sapiens
gagaaguggucaaaacaga

SEQ ID NO: 1439216 - RNA, 19 nt, Homo sapiens
uggagaagagaccaaauaa

SEQ ID NO: 1439217 - RNA, 19 nt, Homo sapiens
aaacagaaggcgaaaugga

SEQ ID NO: 1439218 - RNA, 19 nt, Homo sapiens
gcucugacucucugaaugu

SEQ ID NO: 1439219 - RNA, 19 nt, Homo sapiens
ggagauuggccucuauuac

SEQ ID NO: 1439220 - RNA, 19 nt, Homo sapiens
gagaaguucgagcgagaaa

SEQ ID NO: 1439221 - RNA, 19 nt, Homo sapiens
uaucaggacaguauuuaug

SEQ ID NO: 1439222 - RNA, 19 nt, Homo sapiens
uugaacaaaugaacagaga

SEQ ID NO: 1439223 - RNA, 19 nt, Homo sapiens
cuauuacuguuucuaagga

SEQ ID NO: 1439224 - RNA, 19 nt, Homo sapiens
uauaagcacaccauacaga

SEQ ID NO: 1439225 - RNA, 19 nt, Homo sapiens
caacagcuucuucuuaugc

SEQ ID NO: 1439226 - RNA, 19 nt, Homo sapiens
cacagggaguuccaagcua

SEQ ID NO: 1439227 - RNA, 19 nt, Homo sapiens
gagaacuucauucaagaga

SEQ ID NO: 1439228 - RNA, 19 nt, Homo sapiens
ccaacccucucaucuacug

SEQ ID NO: 1439229 - RNA, 19 nt, Homo sapiens
agaauauguuucguacgua

SEQ ID NO: 1439230 - RNA, 19 nt, Homo sapiens
aaguugcucugcauuguug

SEQ ID NO: 1439231 - RNA, 19 nt, Homo sapiens
ccgcugugcugagaugaaa

SEQ ID NO: 1439232 - RNA, 19 nt, Homo sapiens
gaaggauguucugggagau

SEQ ID NO: 1439233 - RNA, 19 nt, Homo sapiens
gcuaacuccucuucuacca

SEQ ID NO: 1439234 - RNA, 19 nt, Homo sapiens
ccucuacuauacccaguug

SEQ ID NO: 1439235 - RNA, 19 nt, Homo sapiens
aaauagacauuggcaugau

SEQ ID NO: 1439236 - RNA, 19 nt, Homo sapiens
gaaagaugcucuacauuau

SEQ ID NO: 1439237 - RNA, 19 nt, Homo sapiens
gcaaugagccaucaacuaa

SEQ ID NO: 1439238 - RNA, 19 nt, Homo sapiens
gaaacuggcuuagugauug

SEQ ID NO: 1439239 - RNA, 19 nt, Homo sapiens
guacuuuacugcucuuaua

SEQ ID NO: 1439240 - RNA, 19 nt, Homo sapiens
ugaaagaugcucuacauua

SEQ ID NO: 1439241 - RNA, 19 nt, Homo sapiens
aaucaaagccucuucauaa

SEQ ID NO: 1439242 - RNA, 19 nt, Homo sapiens
caaagggaauaaugaacua

SEQ ID NO: 1439243 - RNA, 19 nt, Homo sapiens
aguagaagaugaagacaua

SEQ ID NO: 1439244 - RNA, 19 nt, Homo sapiens
gcaucuuucuuguacuuua

SEQ ID NO: 1439245 - RNA, 19 nt, Homo sapiens
caaagccucuucauaauac

SEQ ID NO: 1439246 - RNA, 19 nt, Homo sapiens
caaaagaagucaucuaguu

SEQ ID NO: 1439247 - RNA, 19 nt, Homo sapiens
uggauuaucuuggcuauuu

SEQ ID NO: 1439248 - RNA, 19 nt, Homo sapiens
caaaccuucugcaacaaua

SEQ ID NO: 1439249 - RNA, 19 nt, Homo sapiens
gaagucaucuaguucaucu

SEQ ID NO: 1439250 - RNA, 19 nt, Homo sapiens
gaggaauaaugacccagua

SEQ ID NO: 1439251 - RNA, 19 nt, Homo sapiens
acugaaacaucucucaaua

SEQ ID NO: 1439252 - RNA, 19 nt, Homo sapiens
ucaaagccucuucauaaua

SEQ ID NO: 1439253 - RNA, 19 nt, Homo sapiens
caagaugauauuccacuua

SEQ ID NO: 1439254 - RNA, 19 nt, Homo sapiens
gcucaccuuuggaggaaua

SEQ ID NO: 1439255 - RNA, 19 nt, Homo sapiens
gcucuuauacuaucucuga

SEQ ID NO: 1439256 - RNA, 19 nt, Homo sapiens
aagaugcucuacauuauga

SEQ ID NO: 1439257 - RNA, 19 nt, Homo sapiens
ugaguacaauuucagcuuu

SEQ ID NO: 1439258 - RNA, 19 nt, Homo sapiens
uuacacaccuucuucuguu

SEQ ID NO: 1439259 - RNA, 19 nt, Homo sapiens
gcaaaugacaagugacaga

SEQ ID NO: 1439260 - RNA, 19 nt, Homo sapiens
gaagaugaagacauaauca

SEQ ID NO: 1439261 - RNA, 19 nt, Homo sapiens
ccaaugagcuaggaguaga

SEQ ID NO: 1439262 - RNA, 19 nt, Homo sapiens
ucucaaaccuucugcaaca

SEQ ID NO: 1439263 - RNA, 19 nt, Homo sapiens
gggaauguauguuuuguuu

SEQ ID NO: 1439264 - RNA, 19 nt, Homo sapiens
agccauaacuuaaauagug

SEQ ID NO: 1439265 - RNA, 19 nt, Homo sapiens
cuacagcuuuagcaucuuu

SEQ ID NO: 1439266 - RNA, 19 nt, Homo sapiens
caggaugauuggucucuuu

SEQ ID NO: 1439267 - RNA, 19 nt, Homo sapiens
gugacagaauccaccuuua

SEQ ID NO: 1439268 - RNA, 19 nt, Homo sapiens
aaggcuaccucuugaauug

SEQ ID NO: 1439269 - RNA, 19 nt, Homo sapiens
caacuaaagaacucaaaga

SEQ ID NO: 1439270 - RNA, 19 nt, Homo sapiens
gaaaccagcaagugaaagu

SEQ ID NO: 1439271 - RNA, 19 nt, Homo sapiens
guucagaguugauaaagac

SEQ ID NO: 1439272 - RNA, 19 nt, Homo sapiens
gaauaugguagaagggaaa

SEQ ID NO: 1439273 - RNA, 19 nt, Homo sapiens
ugacaaagggaauaaugaa

SEQ ID NO: 1439274 - RNA, 19 nt, Homo sapiens
gagacuuccuccacccaaa

SEQ ID NO: 1439275 - RNA, 19 nt, Homo sapiens
caguagcaauccgaaauuu

SEQ ID NO: 1439276 - RNA, 19 nt, Homo sapiens
guggaauauuguugugaua

SEQ ID NO: 1439277 - RNA, 19 nt, Homo sapiens
uagcaucuuucuuguacuu

SEQ ID NO: 1439278 - RNA, 19 nt, Homo sapiens
ccagagauguggcacuuac

SEQ ID NO: 1439279 - RNA, 19 nt, Homo sapiens
ugagcaaacuacuguggaa

SEQ ID NO: 1439280 - RNA, 19 nt, Homo sapiens
aaacuggcuuagugauuga

SEQ ID NO: 1439281 - RNA, 19 nt, Homo sapiens
cccaguauuugucccauuu

SEQ ID NO: 1439282 - RNA, 19 nt, Homo sapiens
gagaucagcuauccaaccu

SEQ ID NO: 1439283 - RNA, 19 nt, Homo sapiens
gaacuagaaaccagcaagu

SEQ ID NO: 1439284 - RNA, 19 nt, Homo sapiens
cgugguggcucuucugguu

SEQ ID NO: 1439285 - RNA, 19 nt, Homo sapiens
uuacugcucuuauacuauc

SEQ ID NO: 1439286 - RNA, 19 nt, Homo sapiens
gaggaggcaguuauucaaa

SEQ ID NO: 1439287 - RNA, 19 nt, Homo sapiens
gcaagugaaaguguuuauu

SEQ ID NO: 1439288 - RNA, 19 nt, Homo sapiens
cauaauaccagcucaccuu

SEQ ID NO: 1439289 - RNA, 19 nt, Homo sapiens
ggaagcaggaauugaggaa

SEQ ID NO: 1439290 - RNA, 19 nt, Homo sapiens
gaauuacaguaugccaaug

SEQ ID NO: 1439291 - RNA, 19 nt, Homo sapiens
ugugauauauguucuagca

SEQ ID NO: 1439292 - RNA, 19 nt, Homo sapiens
ggcaaugagccaucaacua

SEQ ID NO: 1439293 - RNA, 19 nt, Homo sapiens
gaugauauuccacuuaguc

SEQ ID NO: 1439294 - RNA, 19 nt, Homo sapiens
aagaugauauuccacuuag

SEQ ID NO: 1439295 - RNA, 19 nt, Homo sapiens
cuugaaagaugcucuacau

SEQ ID NO: 1439296 - RNA, 19 nt, Homo sapiens
gggaauaaugaacuagaaa

SEQ ID NO: 1439297 - RNA, 19 nt, Homo sapiens
cagcucaccuuuggaggaa

SEQ ID NO: 1439298 - RNA, 19 nt, Homo sapiens
gacccuagcguauccauuc

SEQ ID NO: 1439299 - RNA, 19 nt, Homo sapiens
gccauaacuuaaauagugu

SEQ ID NO: 1439300 - RNA, 19 nt, Homo sapiens
aaaucaaagccucuucaua

SEQ ID NO: 1439301 - RNA, 19 nt, Homo sapiens
gaaaucaaagccucuucau

SEQ ID NO: 1439302 - RNA, 19 nt, Homo sapiens
uacacaccuucuucuguua

SEQ ID NO: 1439303 - RNA, 19 nt, Homo sapiens
gcugugcuguguggaauau

SEQ ID NO: 1439304 - RNA, 19 nt, Homo sapiens
gaccuccccuuacugaaua

SEQ ID NO: 1439305 - RNA, 19 nt, Homo sapiens
aggcauggaucuuagugaa

SEQ ID NO: 1439306 - RNA, 19 nt, Homo sapiens
caaaugacaagugacagaa

SEQ ID NO: 1439307 - RNA, 19 nt, Homo sapiens
caccagagauguggcacuu

SEQ ID NO: 1439308 - RNA, 19 nt, Homo sapiens
augaagacauaaucacuga

SEQ ID NO: 1439309 - RNA, 19 nt, Homo sapiens
caaaucaccgccaccacuu

SEQ ID NO: 1439310 - RNA, 19 nt, Homo sapiens
ucaagaugauauuccacuu

SEQ ID NO: 1439311 - RNA, 19 nt, Homo sapiens
gcuaggaguagaagaugaa

SEQ ID NO: 1439312 - RNA, 19 nt, Homo sapiens
cagcagaauuacaguaugc

SEQ ID NO: 1439313 - RNA, 19 nt, Homo sapiens
aaacccagccagcagaauu

SEQ ID NO: 1439314 - RNA, 19 nt, Homo sapiens
ugaaacuggcuuagugauu

SEQ ID NO: 1439315 - RNA, 19 nt, Homo sapiens
ggaaggccuugcucagacu

SEQ ID NO: 1439316 - RNA, 19 nt, Homo sapiens
gacagaauccaccuuuaca

SEQ ID NO: 1439317 - RNA, 19 nt, Homo sapiens
gucuagcauuaucaucuua

SEQ ID NO: 1439318 - RNA, 19 nt, Homo sapiens
aagcaggaauugaggaaca

SEQ ID NO: 1439319 - RNA, 19 nt, Homo sapiens
cgggaaagcugugauugca

SEQ ID NO: 1439320 - RNA, 19 nt, Homo sapiens
ccuggauccuacagcuuua

SEQ ID NO: 1439321 - RNA, 19 nt, Homo sapiens
gucaucuaguucaucuuua

SEQ ID NO: 1439322 - RNA, 19 nt, Homo sapiens
aaugagccaucaacuaaag

SEQ ID NO: 1439323 - RNA, 19 nt, Homo sapiens
cuagaaaccagcaagugaa

SEQ ID NO: 1439324 - RNA, 19 nt, Homo sapiens
ggaauaaugaacuagaaac

SEQ ID NO: 1439325 - RNA, 19 nt, Homo sapiens
gugaagaguuaauguucuc

SEQ ID NO: 1439326 - RNA, 19 nt, Homo sapiens
ggccaggcauggaucuuag

SEQ ID NO: 1439327 - RNA, 19 nt, Homo sapiens
ggauugacuuugcuaaaau

SEQ ID NO: 1439328 - RNA, 19 nt, Homo sapiens
ggcauuagccagccuguag

SEQ ID NO: 1439329 - RNA, 19 nt, Homo sapiens
cccagaggcuccuguucaa

SEQ ID NO: 1439330 - RNA, 19 nt, Homo sapiens
caaugagccaucaacuaaa

SEQ ID NO: 1439331 - RNA, 19 nt, Homo sapiens
aaagaagucaucuaguuca

SEQ ID NO: 1439332 - RNA, 19 nt, Homo sapiens
cuuuacugcucuuauacua

SEQ ID NO: 1439333 - RNA, 19 nt, Homo sapiens
ccagcagaauuacaguaug

SEQ ID NO: 1439334 - RNA, 19 nt, Homo sapiens
uagaaaccagcaagugaaa

SEQ ID NO: 1439335 - RNA, 19 nt, Homo sapiens
aauaccagcucaccuuugg

SEQ ID NO: 1439336 - RNA, 19 nt, Homo sapiens
gagagaagcccuacaagug

SEQ ID NO: 1439337 - RNA, 19 nt, Homo sapiens
ggagagugauuugcuacua

SEQ ID NO: 1439338 - RNA, 19 nt, Homo sapiens
ccucccaccuguuuauuua

SEQ ID NO: 1439339 - RNA, 19 nt, Homo sapiens
gcugggagcugccaugugu

SEQ ID NO: 1439340 - RNA, 19 nt, Homo sapiens
cauccacucuggugacaaa

SEQ ID NO: 1439341 - RNA, 19 nt, Homo sapiens
gguguagccuuugcaacua

SEQ ID NO: 1439342 - RNA, 19 nt, Homo sapiens
gagcugcuauucccuugga

SEQ ID NO: 1439343 - RNA, 19 nt, Homo sapiens
gagagugauuugcuacuag

SEQ ID NO: 1439344 - RNA, 19 nt, Homo sapiens
gagaagggcccuguauuca

SEQ ID NO: 1439345 - RNA, 19 nt, Homo sapiens
ggagagaagcccuacaagu

SEQ ID NO: 1439346 - RNA, 19 nt, Homo sapiens
gcaccuucgugucccacua

SEQ ID NO: 1439347 - RNA, 19 nt, Homo sapiens
gcucaugggcuucgagaga

SEQ ID NO: 1439348 - RNA, 19 nt, Homo sapiens
cagagugggucagcgagua

SEQ ID NO: 1439349 - RNA, 19 nt, Homo sapiens
gcacuaagggaaucagagu

SEQ ID NO: 1439350 - RNA, 19 nt, Homo sapiens
ugagaagggcccuguauuc

SEQ ID NO: 1439351 - RNA, 19 nt, Homo sapiens
ggaaggcgacggcaacagu

SEQ ID NO: 1439352 - RNA, 19 nt, Homo sapiens
gaaccucaaacgucacaug

SEQ ID NO: 1439353 - RNA, 19 nt, Homo sapiens
uaacguaggcacuauaagg

SEQ ID NO: 1439354 - RNA, 19 nt, Homo sapiens
ugaagacucccucgacgaa

SEQ ID NO: 1439355 - RNA, 19 nt, Homo sapiens
ugaagaugcucugcuccuu

SEQ ID NO: 1439356 - RNA, 19 nt, Homo sapiens
ggaagaggaagaggaggaa

SEQ ID NO: 1439357 - RNA, 19 nt, Homo sapiens
ccaccuguuuauuuaacuu

SEQ ID NO: 1439358 - RNA, 19 nt, Homo sapiens
agacuaacguaggcacuau

SEQ ID NO: 1439359 - RNA, 19 nt, Homo sapiens
ccucugcucaucuggauaa

SEQ ID NO: 1439360 - RNA, 19 nt, Homo sapiens
acagacucauccugaacua

SEQ ID NO: 1439361 - RNA, 19 nt, Homo sapiens
caggagagaagcccuacaa

SEQ ID NO: 1439362 - RNA, 19 nt, Homo sapiens
gguauuggagagugauuug

SEQ ID NO: 1439363 - RNA, 19 nt, Homo sapiens
gagcaugaaccucaaacgu

SEQ ID NO: 1439364 - RNA, 19 nt, Homo sapiens
ucaucuggauaaccugaaa

SEQ ID NO: 1439365 - RNA, 19 nt, Homo sapiens
cugcgggacuggaucagaa

SEQ ID NO: 1439366 - RNA, 19 nt, Homo sapiens
caacagugaccagcucaug

SEQ ID NO: 1439367 - RNA, 19 nt, Homo sapiens
gcacaugaagacacacagu

SEQ ID NO: 1439368 - RNA, 19 nt, Homo sapiens
ggaggagggugaggguagu

SEQ ID NO: 1439369 - RNA, 19 nt, Homo sapiens
gugcggagagugaaguuga

SEQ ID NO: 1439370 - RNA, 19 nt, Homo sapiens
cacacagacucauccugaa

SEQ ID NO: 1439371 - RNA, 19 nt, Homo sapiens
gugagaagggcccuguauu

SEQ ID NO: 1439372 - RNA, 19 nt, Homo sapiens
gaagugggcgauccagacu

SEQ ID NO: 1439373 - RNA, 19 nt, Homo sapiens
gacacacaguggugagaag

SEQ ID NO: 1439374 - RNA, 19 nt, Homo sapiens
cauagcccacccucuguuu

SEQ ID NO: 1439375 - RNA, 19 nt, Homo sapiens
gacaaaccuuuucggugua

SEQ ID NO: 1439376 - RNA, 19 nt, Homo sapiens
gacuaacguaggcacuaua

SEQ ID NO: 1439377 - RNA, 19 nt, Homo sapiens
gcugguuccugagggagaa

SEQ ID NO: 1439378 - RNA, 19 nt, Homo sapiens
gcugagcgacgaugagucu

SEQ ID NO: 1439379 - RNA, 19 nt, Homo sapiens
gcaccagcgcguccauaca

SEQ ID NO: 1439380 - RNA, 19 nt, Homo sapiens
ccacugggacaacuacaag

SEQ ID NO: 1439381 - RNA, 19 nt, Homo sapiens
gcaaucuggccaaccucaa

SEQ ID NO: 1439382 - RNA, 19 nt, Homo sapiens
acuaacguaggcacuauaa

SEQ ID NO: 1439383 - RNA, 19 nt, Homo sapiens
uuauacagacggaccagaa

SEQ ID NO: 1439384 - RNA, 19 nt, Homo sapiens
cagcccagcucgucaaccu

SEQ ID NO: 1439385 - RNA, 19 nt, Homo sapiens
cagacuaacguaggcacua

SEQ ID NO: 1439386 - RNA, 19 nt, Homo sapiens
gcacccacacuggcgagaa

SEQ ID NO: 1439387 - RNA, 19 nt, Homo sapiens
ucaugggcuucgagagaga

SEQ ID NO: 1439388 - RNA, 19 nt, Homo sapiens
gaacaaagcauccuucauu

SEQ ID NO: 1439389 - RNA, 19 nt, Homo sapiens
gagaagauguucagaauau

SEQ ID NO: 1439390 - RNA, 19 nt, Homo sapiens
ugaagaaggucaagaagaa

SEQ ID NO: 1439391 - RNA, 19 nt, Homo sapiens
ggacgaugcuauucagaaa

SEQ ID NO: 1439392 - RNA, 19 nt, Homo sapiens
ggacugcaaugacugcuuu

SEQ ID NO: 1439393 - RNA, 19 nt, Homo sapiens
ggagggagccgggagauua

SEQ ID NO: 1439394 - RNA, 19 nt, Homo sapiens
ccauguagguccacguuua

SEQ ID NO: 1439395 - RNA, 19 nt, Homo sapiens
gaagaggacugcaaugacu

SEQ ID NO: 1439396 - RNA, 19 nt, Homo sapiens
gaaaacguccugauauuua

SEQ ID NO: 1439397 - RNA, 19 nt, Homo sapiens
gggagaagauguucagaau

SEQ ID NO: 1439398 - RNA, 19 nt, Homo sapiens
gaaagcagggccucugauu

SEQ ID NO: 1439399 - RNA, 19 nt, Homo sapiens
ggucaucccuaaaggcaaa

SEQ ID NO: 1439400 - RNA, 19 nt, Homo sapiens
gagaagaggacugcaauga

SEQ ID NO: 1439401 - RNA, 19 nt, Homo sapiens
ucaauauccuccucagauu

SEQ ID NO: 1439402 - RNA, 19 nt, Homo sapiens
gguauuauguacagaagau

SEQ ID NO: 1439403 - RNA, 19 nt, Homo sapiens
ggagaagauguucagaaua

SEQ ID NO: 1439404 - RNA, 19 nt, Homo sapiens
gaauaaaggccagauaaag

SEQ ID NO: 1439405 - RNA, 19 nt, Homo sapiens
gaagguauuauguacagaa

SEQ ID NO: 1439406 - RNA, 19 nt, Homo sapiens
gaucuaccaugaagaaggu

SEQ ID NO: 1439407 - RNA, 19 nt, Homo sapiens
ugcaaugacugcuuucaaa

SEQ ID NO: 1439408 - RNA, 19 nt, Homo sapiens
aacaaagcauccuucauuu

SEQ ID NO: 1439409 - RNA, 19 nt, Homo sapiens
gaggaucuaccaugaagaa

SEQ ID NO: 1439410 - RNA, 19 nt, Homo sapiens
cgaauaaaggccagauaaa

SEQ ID NO: 1439411 - RNA, 19 nt, Homo sapiens
gggaggaucuaccaugaag

SEQ ID NO: 1439412 - RNA, 19 nt, Homo sapiens
gaaagagacuugggcuacu

SEQ ID NO: 1439413 - RNA, 19 nt, Homo sapiens
ggagcugccuacuacauca

SEQ ID NO: 1439414 - RNA, 19 nt, Homo sapiens
ccagauaaagccaaacuug

SEQ ID NO: 1439415 - RNA, 19 nt, Homo sapiens
gaagaaggucaagaagaaa

SEQ ID NO: 1439416 - RNA, 19 nt, Homo sapiens
ggcuugaagucccugauuu

SEQ ID NO: 1439417 - RNA, 19 nt, Homo sapiens
caagauguuuguagcucaa

SEQ ID NO: 1439418 - RNA, 19 nt, Homo sapiens
uaaugaugcuaacuagaga

SEQ ID NO: 1439419 - RNA, 19 nt, Homo sapiens
acugaaggaucauuucuug

SEQ ID NO: 1439420 - RNA, 19 nt, Homo sapiens
gauuugcccugcacuucuu

SEQ ID NO: 1439421 - RNA, 19 nt, Homo sapiens
ucaggaagguauuauguac

SEQ ID NO: 1439422 - RNA, 19 nt, Homo sapiens
cuacuaucauuaccucuau

SEQ ID NO: 1439423 - RNA, 19 nt, Homo sapiens
caauauccuccucagauuu

SEQ ID NO: 1439424 - RNA, 19 nt, Homo sapiens
caaggcugcuguugcugaa

SEQ ID NO: 1439425 - RNA, 19 nt, Homo sapiens
gauaaaccaaccucaggaa

SEQ ID NO: 1439426 - RNA, 19 nt, Homo sapiens
ccaaccugcucaccuucua

SEQ ID NO: 1439427 - RNA, 19 nt, Homo sapiens
agccaaacuugcuggguua

SEQ ID NO: 1439428 - RNA, 19 nt, Homo sapiens
ucgaauaaaggccagauaa

SEQ ID NO: 1439429 - RNA, 19 nt, Homo sapiens
caaacuugcuggguuacau

SEQ ID NO: 1439430 - RNA, 19 nt, Homo sapiens
gacugcaccucgaauaaag

SEQ ID NO: 1439431 - RNA, 19 nt, Homo sapiens
uuaaugugcugauaaacca

SEQ ID NO: 1439432 - RNA, 19 nt, Homo sapiens
ccaugaagaaggucaagaa

SEQ ID NO: 1439433 - RNA, 19 nt, Homo sapiens
aagcauccuucauuugaga

SEQ ID NO: 1439434 - RNA, 19 nt, Homo sapiens
cuaagaacaagccaucuga

SEQ ID NO: 1439435 - RNA, 19 nt, Homo sapiens
ggaacuagggucucacucu

SEQ ID NO: 1439436 - RNA, 19 nt, Homo sapiens
ccagggaacuagggucuca

SEQ ID NO: 1439437 - RNA, 19 nt, Homo sapiens
augcugaacugaagaagau

SEQ ID NO: 1439438 - RNA, 19 nt, Homo sapiens
uagacacccuucaucacaa

SEQ ID NO: 1439439 - RNA, 19 nt, Homo sapiens
cauccuucauuugagaaua

SEQ ID NO: 1439440 - RNA, 19 nt, Homo sapiens
ugacugcaccucgaauaaa

SEQ ID NO: 1439441 - RNA, 19 nt, Homo sapiens
gcucacugaaggaucauuu

SEQ ID NO: 1439442 - RNA, 19 nt, Homo sapiens
caugcuagcuccaauucca

SEQ ID NO: 1439443 - RNA, 19 nt, Homo sapiens
gggacgaugcuauucagaa

SEQ ID NO: 1439444 - RNA, 19 nt, Homo sapiens
caagaaaacccuccaguca

SEQ ID NO: 1439445 - RNA, 19 nt, Homo sapiens
ggacaugcugaacugaaga

SEQ ID NO: 1439446 - RNA, 19 nt, Homo sapiens
aaaccaauaccccaaaaua

SEQ ID NO: 1439447 - RNA, 19 nt, Homo sapiens
guccugauauuuaaagaac

SEQ ID NO: 1439448 - RNA, 19 nt, Homo sapiens
aaagccaaguccagaagga

SEQ ID NO: 1439449 - RNA, 19 nt, Homo sapiens
ccuacuacaucacugaauc

SEQ ID NO: 1439450 - RNA, 19 nt, Homo sapiens
gguuagacacccuucauca

SEQ ID NO: 1439451 - RNA, 19 nt, Homo sapiens
gugacugcaccucgaauaa

SEQ ID NO: 1439452 - RNA, 19 nt, Homo sapiens
guagguccacguuuagguu

SEQ ID NO: 1439453 - RNA, 19 nt, Homo sapiens
ggaagguauuauguacaga

SEQ ID NO: 1439454 - RNA, 19 nt, Homo sapiens
agaaggaggugcuuuuaau

SEQ ID NO: 1439455 - RNA, 19 nt, Homo sapiens
ugauggcgcugggagaaga

SEQ ID NO: 1439456 - RNA, 19 nt, Homo sapiens
cagcauuccagccuugaaa

SEQ ID NO: 1439457 - RNA, 19 nt, Homo sapiens
gaauccacaccacagcauu

SEQ ID NO: 1439458 - RNA, 19 nt, Homo sapiens
uaaagaacaaagcauccuu

SEQ ID NO: 1439459 - RNA, 19 nt, Homo sapiens
ugaaggaucauuucuuggu

SEQ ID NO: 1439460 - RNA, 19 nt, Homo sapiens
aaagagacuugggcuacug

SEQ ID NO: 1439461 - RNA, 19 nt, Homo sapiens
ucaaagaagggguuaauga

SEQ ID NO: 1439462 - RNA, 19 nt, Homo sapiens
uugggaggaucuaccauga

SEQ ID NO: 1439463 - RNA, 19 nt, Homo sapiens
ggaaagcagggccucugau

SEQ ID NO: 1439464 - RNA, 19 nt, Homo sapiens
gcaaugacugcuuucaaaa

SEQ ID NO: 1439465 - RNA, 19 nt, Homo sapiens
uuaaugaugcuaacuagag

SEQ ID NO: 1439466 - RNA, 19 nt, Homo sapiens
aauauccuccucagauuug

SEQ ID NO: 1439467 - RNA, 19 nt, Homo sapiens
aaacuugcuggguuacauu

SEQ ID NO: 1439468 - RNA, 19 nt, Homo sapiens
gcugagaagaggacugcaa

SEQ ID NO: 1439469 - RNA, 19 nt, Homo sapiens
cugaaaacguccugauauu

SEQ ID NO: 1439470 - RNA, 19 nt, Homo sapiens
gcuugaagucccugauuuc

SEQ ID NO: 1439471 - RNA, 19 nt, Homo sapiens
uuagacacccuucaucaca

SEQ ID NO: 1439472 - RNA, 19 nt, Homo sapiens
ccucaggaagguauuaugu

SEQ ID NO: 1439473 - RNA, 19 nt, Homo sapiens
agaaaacccuccagucauc

SEQ ID NO: 1439474 - RNA, 19 nt, Homo sapiens
gauuacgcagcuccaugua

SEQ ID NO: 1439475 - RNA, 19 nt, Homo sapiens
ggugauggcgcugggagaa

SEQ ID NO: 1439476 - RNA, 19 nt, Homo sapiens
cguaacgcguguccuccaa

SEQ ID NO: 1439477 - RNA, 19 nt, Homo sapiens
ccagcaugcuagcuccaau

SEQ ID NO: 1439478 - RNA, 19 nt, Homo sapiens
gacaugcugaacugaagaa

SEQ ID NO: 1439479 - RNA, 19 nt, Homo sapiens
cagcaugcuagcuccaauu

SEQ ID NO: 1439480 - RNA, 19 nt, Homo sapiens
gaaggaggugcuuuuaaug

SEQ ID NO: 1439481 - RNA, 19 nt, Homo sapiens
ugaaaacguccugauauuu

SEQ ID NO: 1439482 - RNA, 19 nt, Homo sapiens
agacacccuucaucacaag

SEQ ID NO: 1439483 - RNA, 19 nt, Homo sapiens
aggaagguauuauguacag

SEQ ID NO: 1439484 - RNA, 19 nt, Homo sapiens
aaagcauccuucauuugag

SEQ ID NO: 1439485 - RNA, 19 nt, Homo sapiens
caaagaagggguuaaugau

SEQ ID NO: 1439486 - RNA, 19 nt, Homo sapiens
aauaaaggccagauaaagc

SEQ ID NO: 1439487 - RNA, 19 nt, Homo sapiens
gcuccaauuccaccucuca

SEQ ID NO: 1439488 - RNA, 19 nt, Homo sapiens
uuaagaagcuuucagaaug

SEQ ID NO: 1439489 - RNA, 19 nt, Homo sapiens
uaagaagcuuucagaauga

SEQ ID NO: 1439490 - RNA, 19 nt, Homo sapiens
gaugaaacccugauuccua

SEQ ID NO: 1439491 - RNA, 19 nt, Homo sapiens
guagaugauugauaaguga

SEQ ID NO: 1439492 - RNA, 19 nt, Homo sapiens
gcggagagcucauagucaa

SEQ ID NO: 1439493 - RNA, 19 nt, Homo sapiens
ccauagaagcggauacuua

SEQ ID NO: 1439494 - RNA, 19 nt, Homo sapiens
ccaacaaugucgucaucua

SEQ ID NO: 1439495 - RNA, 19 nt, Homo sapiens
gaccaaccauucuuacuuc

SEQ ID NO: 1439496 - RNA, 19 nt, Homo sapiens
ggagucagaggguuugaua

SEQ ID NO: 1439497 - RNA, 19 nt, Homo sapiens
caacaaugucgucaucuaa

SEQ ID NO: 1439498 - RNA, 19 nt, Homo sapiens
gaccacaauuucugucuga

SEQ ID NO: 1439499 - RNA, 19 nt, Homo sapiens
gaaaacaccugcaggacuu

SEQ ID NO: 1439500 - RNA, 19 nt, Homo sapiens
uuaaggaagugugaagaua

SEQ ID NO: 1439501 - RNA, 19 nt, Homo sapiens
agauggaccugucucuaua

SEQ ID NO: 1439502 - RNA, 19 nt, Homo sapiens
gaaucagucuggguauuga

SEQ ID NO: 1439503 - RNA, 19 nt, Homo sapiens
agcaguagaugauugauaa

SEQ ID NO: 1439504 - RNA, 19 nt, Homo sapiens
gagaaucagucuggguauu

SEQ ID NO: 1439505 - RNA, 19 nt, Homo sapiens
cugaagggaucuaaagaaa

SEQ ID NO: 1439506 - RNA, 19 nt, Homo sapiens
ccacacugccucuuucuuu

SEQ ID NO: 1439507 - RNA, 19 nt, Homo sapiens
gagggacaguggagaaguu

SEQ ID NO: 1439508 - RNA, 19 nt, Homo sapiens
uagaagcggauacuuauuu

SEQ ID NO: 1439509 - RNA, 19 nt, Homo sapiens
gaagaccaacaagcuaaua

SEQ ID NO: 1439510 - RNA, 19 nt, Homo sapiens
gcagugagccgagaucaug

SEQ ID NO: 1439511 - RNA, 19 nt, Homo sapiens
gaagggaucuaaagaaaag

SEQ ID NO: 1439512 - RNA, 19 nt, Homo sapiens
gaguaucaccuggccauua

SEQ ID NO: 1439513 - RNA, 19 nt, Homo sapiens
aguaucaccuggccauuaa

SEQ ID NO: 1439514 - RNA, 19 nt, Homo sapiens
gugaggaaacugaggcuua

SEQ ID NO: 1439515 - RNA, 19 nt, Homo sapiens
gcagucagaccucuugaga

SEQ ID NO: 1439516 - RNA, 19 nt, Homo sapiens
cauagaagcggauacuuau

SEQ ID NO: 1439517 - RNA, 19 nt, Homo sapiens
ucagaggguuugauaaagu

SEQ ID NO: 1439518 - RNA, 19 nt, Homo sapiens
gagcaaaacucgaucucaa

SEQ ID NO: 1439519 - RNA, 19 nt, Homo sapiens
caagugaacccaaccaaca

SEQ ID NO: 1439520 - RNA, 19 nt, Homo sapiens
cuuccuggauggcacauua

SEQ ID NO: 1439521 - RNA, 19 nt, Homo sapiens
gcuauucucacauugcuuu

SEQ ID NO: 1439522 - RNA, 19 nt, Homo sapiens
ggacucccaugcugcuguu

SEQ ID NO: 1439523 - RNA, 19 nt, Homo sapiens
gaaaccccgucucuacaua

SEQ ID NO: 1439524 - RNA, 19 nt, Homo sapiens
aaugguggcuguucugaga

SEQ ID NO: 1439525 - RNA, 19 nt, Homo sapiens
uaaggaagugugaagauau

SEQ ID NO: 1439526 - RNA, 19 nt, Homo sapiens
agaagcggauacuuauuug

SEQ ID NO: 1439527 - RNA, 19 nt, Homo sapiens
gcaggagaaucgcuugaac

SEQ ID NO: 1439528 - RNA, 19 nt, Homo sapiens
gaccaacaagcuaauaaau

SEQ ID NO: 1439529 - RNA, 19 nt, Homo sapiens
auacagcaguagaugauug

SEQ ID NO: 1439530 - RNA, 19 nt, Homo sapiens
ucacagcccuagaggucaa

SEQ ID NO: 1439531 - RNA, 19 nt, Homo sapiens
uaaagcuauucucacauug

SEQ ID NO: 1439532 - RNA, 19 nt, Homo sapiens
cugcaggacuuccaucuca

SEQ ID NO: 1439533 - RNA, 19 nt, Homo sapiens
caaccauucuuacuucaac

SEQ ID NO: 1439534 - RNA, 19 nt, Homo sapiens
gcacugggcaacagagcaa

SEQ ID NO: 1439535 - RNA, 19 nt, Homo sapiens
gcaagaauggagcugucua

SEQ ID NO: 1439536 - RNA, 19 nt, Homo sapiens
ggaaacugaggcuuacaga

SEQ ID NO: 1439537 - RNA, 19 nt, Homo sapiens
caaauggcguccaguucuc

SEQ ID NO: 1439538 - RNA, 19 nt, Homo sapiens
cagaggguuugauaaagug

SEQ ID NO: 1439539 - RNA, 19 nt, Homo sapiens
gaagugugaagauaugauc

SEQ ID NO: 1439540 - RNA, 19 nt, Homo sapiens
caagaauggagcugucuau

SEQ ID NO: 1439541 - RNA, 19 nt, Homo sapiens
ucgccgaguuggaaggaua

SEQ ID NO: 1439542 - RNA, 19 nt, Homo sapiens
uaacaaggaacccaacagu

SEQ ID NO: 1439543 - RNA, 19 nt, Homo sapiens
cuuuaaagcuauucucaca

SEQ ID NO: 1439544 - RNA, 19 nt, Homo sapiens
cuaaugaccagcucgauuc

SEQ ID NO: 1439545 - RNA, 19 nt, Homo sapiens
aaggaagugugaagauaug

SEQ ID NO: 1439546 - RNA, 19 nt, Homo sapiens
cagcaguagaugauugaua

SEQ ID NO: 1439547 - RNA, 19 nt, Homo sapiens
gaacccaaccaacaauguc

SEQ ID NO: 1439548 - RNA, 19 nt, Homo sapiens
ugaccaaccauucuuacuu

SEQ ID NO: 1439549 - RNA, 19 nt, Homo sapiens
agucagaggguuugauaaa

SEQ ID NO: 1439550 - RNA, 19 nt, Homo sapiens
gcaaaacucgaucucaaaa

SEQ ID NO: 1439551 - RNA, 19 nt, Homo sapiens
ucgagaccauccuggcuaa

SEQ ID NO: 1439552 - RNA, 19 nt, Homo sapiens
gaggagggacaguggagaa

SEQ ID NO: 1439553 - RNA, 19 nt, Homo sapiens
uccaggccaugucuaauga

SEQ ID NO: 1439554 - RNA, 19 nt, Homo sapiens
gcacauuaaagggcaagaa

SEQ ID NO: 1439555 - RNA, 19 nt, Homo sapiens
gccauacuuuggagcaguu

SEQ ID NO: 1439556 - RNA, 19 nt, Homo sapiens
gauuaagaagcuuucagaa

SEQ ID NO: 1439557 - RNA, 19 nt, Homo sapiens
caguccagauggugaagaa

SEQ ID NO: 1439558 - RNA, 19 nt, Homo sapiens
caaccgaaucgccaaagga

SEQ ID NO: 1439559 - RNA, 19 nt, Homo sapiens
acaaggaacccaacagucu

SEQ ID NO: 1439560 - RNA, 19 nt, Homo sapiens
guccaguucucgcgcauca

SEQ ID NO: 1439561 - RNA, 19 nt, Homo sapiens
gucaggagaucgagaccau

SEQ ID NO: 1439562 - RNA, 19 nt, Homo sapiens
ccuguaaucccagcacuuu

SEQ ID NO: 1439563 - RNA, 19 nt, Homo sapiens
ugaggaaacugaggcuuac

SEQ ID NO: 1439564 - RNA, 19 nt, Homo sapiens
aguagaugauugauaagug

SEQ ID NO: 1439565 - RNA, 19 nt, Homo sapiens
gaccagggccguguuugga

SEQ ID NO: 1439566 - RNA, 19 nt, Homo sapiens
caaaugguggcuguucuga

SEQ ID NO: 1439567 - RNA, 19 nt, Homo sapiens
cgccaaacuuucccuaugg

SEQ ID NO: 1439568 - RNA, 19 nt, Homo sapiens
gcaggacuuccaucucaau

SEQ ID NO: 1439569 - RNA, 19 nt, Homo sapiens
ggauggcggagagcucaua

SEQ ID NO: 1439570 - RNA, 19 nt, Homo sapiens
ucaaauggcguccaguucu

SEQ ID NO: 1439571 - RNA, 19 nt, Homo sapiens
agaccaacaagcuaauaaa

SEQ ID NO: 1439572 - RNA, 19 nt, Homo sapiens
acgccaaacuuucccuaug

SEQ ID NO: 1439573 - RNA, 19 nt, Homo sapiens
gugaagauuaagaagcuuu

SEQ ID NO: 1439574 - RNA, 19 nt, Homo sapiens
gcugcacacgccaaacuuu

SEQ ID NO: 1439575 - RNA, 19 nt, Homo sapiens
ccaugaagucaccauagaa

SEQ ID NO: 1439576 - RNA, 19 nt, Homo sapiens
gaccaugaagucaccauag

SEQ ID NO: 1439577 - RNA, 19 nt, Homo sapiens
ggccaggcuuccccaaaua

SEQ ID NO: 1439578 - RNA, 19 nt, Homo sapiens
gaggguggccaaccgaauc

SEQ ID NO: 1439579 - RNA, 19 nt, Homo sapiens
ggaaggauaccuccaaaag

SEQ ID NO: 1439580 - RNA, 19 nt, Homo sapiens
ggaagugugaagauaugau

SEQ ID NO: 1439581 - RNA, 19 nt, Homo sapiens
accaugaagucaccauaga

SEQ ID NO: 1439582 - RNA, 19 nt, Homo sapiens
caacagagcaaaacucgau

SEQ ID NO: 1439583 - RNA, 19 nt, Homo sapiens
ccacugcacugggcaacag

SEQ ID NO: 1439584 - RNA, 19 nt, Homo sapiens
aaccaacaaugucgucauc

SEQ ID NO: 1439585 - RNA, 19 nt, Homo sapiens
cuuauuugccuguggauga

SEQ ID NO: 1439586 - RNA, 19 nt, Homo sapiens
uauaaaugaccaugaaguc

SEQ ID NO: 1439587 - RNA, 19 nt, Homo sapiens
uacagagguugaagaccaa

SEQ ID NO: 1439588 - RNA, 19 nt, Homo sapiens
ggaagaagaccuagcuuua

SEQ ID NO: 1439589 - RNA, 19 nt, Homo sapiens
cguaagaucuucaccaaua

SEQ ID NO: 1439590 - RNA, 19 nt, Homo sapiens
uaaaggaucuuggcaguug

SEQ ID NO: 1439591 - RNA, 19 nt, Homo sapiens
guaagaucuucaccaauaa

SEQ ID NO: 1439592 - RNA, 19 nt, Homo sapiens
gaucuuggcaguugauaaa

SEQ ID NO: 1439593 - RNA, 19 nt, Homo sapiens
ugaugaaacugaccuguga

SEQ ID NO: 1439594 - RNA, 19 nt, Homo sapiens
gagagcacauugacagaga

SEQ ID NO: 1439595 - RNA, 19 nt, Homo sapiens
agaccuagcuuuagcacaa

SEQ ID NO: 1439596 - RNA, 19 nt, Homo sapiens
caucaugucaucucccuua

SEQ ID NO: 1439597 - RNA, 19 nt, Homo sapiens
gaagaagaccuagcuuuag

SEQ ID NO: 1439598 - RNA, 19 nt, Homo sapiens
ggaaaugucccuggcagaa

SEQ ID NO: 1439599 - RNA, 19 nt, Homo sapiens
gagagcggcuagcaacugu

SEQ ID NO: 1439600 - RNA, 19 nt, Homo sapiens
gaaaugucccuggcagaaa

SEQ ID NO: 1439601 - RNA, 19 nt, Homo sapiens
cgagaaaugaugaaacuga

SEQ ID NO: 1439602 - RNA, 19 nt, Homo sapiens
gagacaagcgggagugaug

SEQ ID NO: 1439603 - RNA, 19 nt, Homo sapiens
gcucgaagccguccaacug

SEQ ID NO: 1439604 - RNA, 19 nt, Homo sapiens
uagcaacuguucccugguu

SEQ ID NO: 1439605 - RNA, 19 nt, Homo sapiens
ccaaaaggauauccaggua

SEQ ID NO: 1439606 - RNA, 19 nt, Homo sapiens
gaucuucaccaauaagugu

SEQ ID NO: 1439607 - RNA, 19 nt, Homo sapiens
gcacucgucgcuucuccua

SEQ ID NO: 1439608 - RNA, 19 nt, Homo sapiens
ggaagagagcggcuagcaa

SEQ ID NO: 1439609 - RNA, 19 nt, Homo sapiens
caaguugucaggaggaaga

SEQ ID NO: 1439610 - RNA, 19 nt, Homo sapiens
caugucaucucccuuaugc

SEQ ID NO: 1439611 - RNA, 19 nt, Homo sapiens
caaaccaugccuuccugua

SEQ ID NO: 1439612 - RNA, 19 nt, Homo sapiens
gugauugcuuugcagaaug

SEQ ID NO: 1439613 - RNA, 19 nt, Homo sapiens
agccgaaacuucugcauca

SEQ ID NO: 1439614 - RNA, 19 nt, Homo sapiens
gauguggagugggcaggaa

SEQ ID NO: 1439615 - RNA, 19 nt, Homo sapiens
aacguaagaucuucaccaa

SEQ ID NO: 1439616 - RNA, 19 nt, Homo sapiens
cagcaucacuguggaucug

SEQ ID NO: 1439617 - RNA, 19 nt, Homo sapiens
ggaggaagaagaccuagcu

SEQ ID NO: 1439618 - RNA, 19 nt, Homo sapiens
guaccugugugcccucucu

SEQ ID NO: 1439619 - RNA, 19 nt, Homo sapiens
aagaagaccuagcuuuagc

SEQ ID NO: 1439620 - RNA, 19 nt, Homo sapiens
gcagcgagaaaugaugaaa

SEQ ID NO: 1439621 - RNA, 19 nt, Homo sapiens
ggaucuuggcaguugauaa

SEQ ID NO: 1439622 - RNA, 19 nt, Homo sapiens
gagcggcuagcaacuguuc

SEQ ID NO: 1439623 - RNA, 19 nt, Homo sapiens
aaaugucccuggcagaaac

SEQ ID NO: 1439624 - RNA, 19 nt, Homo sapiens
aaaggaucuuggcaguuga

SEQ ID NO: 1439625 - RNA, 19 nt, Homo sapiens
ucaggaggaagaagaccua

SEQ ID NO: 1439626 - RNA, 19 nt, Homo sapiens
aggaagaagaccuagcuuu

SEQ ID NO: 1439627 - RNA, 19 nt, Homo sapiens
cuguggaucugcuuaccaa

SEQ ID NO: 1439628 - RNA, 19 nt, Homo sapiens
gccgaaacuucugcaucaa

SEQ ID NO: 1439629 - RNA, 19 nt, Homo sapiens
cggcagcgagaaaugauga

SEQ ID NO: 1439630 - RNA, 19 nt, Homo sapiens
ugugugcccucucuguaau

SEQ ID NO: 1439631 - RNA, 19 nt, Homo sapiens
cagccagugaggcagaaua

SEQ ID NO: 1439632 - RNA, 19 nt, Homo sapiens
ugauugcuuugcagaaugg

SEQ ID NO: 1439633 - RNA, 19 nt, Homo sapiens
gacagccccuccagugauu

SEQ ID NO: 1439634 - RNA, 19 nt, Homo sapiens
gaugaaacugaccugugaa

SEQ ID NO: 1439635 - RNA, 19 nt, Homo sapiens
gggagagcacauugacaga

SEQ ID NO: 1439636 - RNA, 19 nt, Homo sapiens
agugauugcuuugcagaau

SEQ ID NO: 1439637 - RNA, 19 nt, Homo sapiens
cgagcacgagcccuaaaga

SEQ ID NO: 1439638 - RNA, 19 nt, Homo sapiens
ccagugaggcagaauacca

SEQ ID NO: 1439639 - RNA, 19 nt, Homo sapiens
aaaccaugccuuccuguac

SEQ ID NO: 1439640 - RNA, 19 nt, Homo sapiens
gaacagaagugguuauaga

SEQ ID NO: 1439641 - RNA, 19 nt, Homo sapiens
guaaaggacugcaauguuu

SEQ ID NO: 1439642 - RNA, 19 nt, Homo sapiens
caaaucagcuuaucauaca

SEQ ID NO: 1439643 - RNA, 19 nt, Homo sapiens
gcauuucccugauuacuaa

SEQ ID NO: 1439644 - RNA, 19 nt, Homo sapiens
gauaucuucucucaucuua

SEQ ID NO: 1439645 - RNA, 19 nt, Homo sapiens
gaaaggagaccacaaggaa

SEQ ID NO: 1439646 - RNA, 19 nt, Homo sapiens
ggacugcaauguuucacua

SEQ ID NO: 1439647 - RNA, 19 nt, Homo sapiens
gaacaugggcuauuucugu

SEQ ID NO: 1439648 - RNA, 19 nt, Homo sapiens
gcaaauccucuuauucuaa

SEQ ID NO: 1439649 - RNA, 19 nt, Homo sapiens
caaggaaucugguucugaa

SEQ ID NO: 1439650 - RNA, 19 nt, Homo sapiens
ggauuuaauuggaccuaua

SEQ ID NO: 1439651 - RNA, 19 nt, Homo sapiens
cuugauagcugguaguaua

SEQ ID NO: 1439652 - RNA, 19 nt, Homo sapiens
gcacauccuuaguuagauu

SEQ ID NO: 1439653 - RNA, 19 nt, Homo sapiens
guguauauguguccaguua

SEQ ID NO: 1439654 - RNA, 19 nt, Homo sapiens
gggaauagacgcaggagua

SEQ ID NO: 1439655 - RNA, 19 nt, Homo sapiens
uaugaaggcucacgugauu

SEQ ID NO: 1439656 - RNA, 19 nt, Homo sapiens
gaucaagucuguggccauu

SEQ ID NO: 1439657 - RNA, 19 nt, Homo sapiens
ccauguaccuguucacuug

SEQ ID NO: 1439658 - RNA, 19 nt, Homo sapiens
gugcauggauuucuuuaga

SEQ ID NO: 1439659 - RNA, 19 nt, Homo sapiens
ccuuugaucucuuacauaa

SEQ ID NO: 1439660 - RNA, 19 nt, Homo sapiens
aaagcaggcucucuucaaa

SEQ ID NO: 1439661 - RNA, 19 nt, Homo sapiens
cugcaauguuucacuauua

SEQ ID NO: 1439662 - RNA, 19 nt, Homo sapiens
gguauuauguucagugauc

SEQ ID NO: 1439663 - RNA, 19 nt, Homo sapiens
uaacugcuauugucagaau

SEQ ID NO: 1439664 - RNA, 19 nt, Homo sapiens
caaagugcauggauuucuu

SEQ ID NO: 1439665 - RNA, 19 nt, Homo sapiens
gaaagcaggcucucuucaa

SEQ ID NO: 1439666 - RNA, 19 nt, Homo sapiens
caaacuauuucccaaagug

SEQ ID NO: 1439667 - RNA, 19 nt, Homo sapiens
gaaggaaguuugggcuguu

SEQ ID NO: 1439668 - RNA, 19 nt, Homo sapiens
ggcaaauccucuuauucua

SEQ ID NO: 1439669 - RNA, 19 nt, Homo sapiens
guauacguccuccuacuua

SEQ ID NO: 1439670 - RNA, 19 nt, Homo sapiens
guggauaucuucucucauc

SEQ ID NO: 1439671 - RNA, 19 nt, Homo sapiens
aaugguaacuuguggcuuu

SEQ ID NO: 1439672 - RNA, 19 nt, Homo sapiens
ccuuuaacaugccauauaa

SEQ ID NO: 1439673 - RNA, 19 nt, Homo sapiens
uaucuucucucaucuuaug

SEQ ID NO: 1439674 - RNA, 19 nt, Homo sapiens
cugcguaguuguuaaauug

SEQ ID NO: 1439675 - RNA, 19 nt, Homo sapiens
uggaggcgaucuuacauuu

SEQ ID NO: 1439676 - RNA, 19 nt, Homo sapiens
caaagaagcaggagagagu

SEQ ID NO: 1439677 - RNA, 19 nt, Homo sapiens
cugaggagcugcauuggaa

SEQ ID NO: 1439678 - RNA, 19 nt, Homo sapiens
gaggcgaucuuacauuucu

SEQ ID NO: 1439679 - RNA, 19 nt, Homo sapiens
uauagaggcaucuuuguuu

SEQ ID NO: 1439680 - RNA, 19 nt, Homo sapiens
uuuagcacauccuuaguua

SEQ ID NO: 1439681 - RNA, 19 nt, Homo sapiens
guucuuaucccaauuacaa

SEQ ID NO: 1439682 - RNA, 19 nt, Homo sapiens
gcauggauuucuuuagaca

SEQ ID NO: 1439683 - RNA, 19 nt, Homo sapiens
guucagugaucuuggcaaa

SEQ ID NO: 1439684 - RNA, 19 nt, Homo sapiens
ucagugaucuuggcaaauc

SEQ ID NO: 1439685 - RNA, 19 nt, Homo sapiens
caauauggaggcgaucuua

SEQ ID NO: 1439686 - RNA, 19 nt, Homo sapiens
ggaaaggagaccacaagga

SEQ ID NO: 1439687 - RNA, 19 nt, Homo sapiens
ucagagugcucccuuugga

SEQ ID NO: 1439688 - RNA, 19 nt, Homo sapiens
uaauuggaccuauagauga

SEQ ID NO: 1439689 - RNA, 19 nt, Homo sapiens
gguaguauacguccuccua

SEQ ID NO: 1439690 - RNA, 19 nt, Homo sapiens
ggcuauuucuguauucauu

SEQ ID NO: 1439691 - RNA, 19 nt, Homo sapiens
guauauguguccaguuaca

SEQ ID NO: 1439692 - RNA, 19 nt, Homo sapiens
uagguuaucuuuccugucu

SEQ ID NO: 1439693 - RNA, 19 nt, Homo sapiens
gguauagugucccaaugug

SEQ ID NO: 1439694 - RNA, 19 nt, Homo sapiens
gcugggagcuaggaaagga

SEQ ID NO: 1439695 - RNA, 19 nt, Homo sapiens
uagcacauccuuaguuaga

SEQ ID NO: 1439696 - RNA, 19 nt, Homo sapiens
ccauagacauuuagcacau

SEQ ID NO: 1439697 - RNA, 19 nt, Homo sapiens
gaaugaggaugagugucuu

SEQ ID NO: 1439698 - RNA, 19 nt, Homo sapiens
gcacauaaaacacuucuug

SEQ ID NO: 1439699 - RNA, 19 nt, Homo sapiens
ugucuuuacucccuuuauu

SEQ ID NO: 1439700 - RNA, 19 nt, Homo sapiens
gcaggaaccacaccgugaa

SEQ ID NO: 1439701 - RNA, 19 nt, Homo sapiens
caugggcuauuucuguauu

SEQ ID NO: 1439702 - RNA, 19 nt, Homo sapiens
aacaugggcuauuucugua

SEQ ID NO: 1439703 - RNA, 19 nt, Homo sapiens
ugauugggauuuaauugga

SEQ ID NO: 1439704 - RNA, 19 nt, Homo sapiens
uuuccuuacugcauuguua

SEQ ID NO: 1439705 - RNA, 19 nt, Homo sapiens
caagcuccauggacacuca

SEQ ID NO: 1439706 - RNA, 19 nt, Homo sapiens
uauacguccuccuacuuaa

SEQ ID NO: 1439707 - RNA, 19 nt, Homo sapiens
uguagguuauugacacuuu

SEQ ID NO: 1439708 - RNA, 19 nt, Homo sapiens
ccucuaguaucuucuaaag

SEQ ID NO: 1439709 - RNA, 19 nt, Homo sapiens
ccuaggucauuaagauauu

SEQ ID NO: 1439710 - RNA, 19 nt, Homo sapiens
gguaacuuguggcuuuaau

SEQ ID NO: 1439711 - RNA, 19 nt, Homo sapiens
gggauggaaccuucuauuc

SEQ ID NO: 1439712 - RNA, 19 nt, Homo sapiens
guaccauaauguauucauc

SEQ ID NO: 1439713 - RNA, 19 nt, Homo sapiens
ccuugaaacuccagaagau

SEQ ID NO: 1439714 - RNA, 19 nt, Homo sapiens
caugcacacauuuguauuu

SEQ ID NO: 1439715 - RNA, 19 nt, Homo sapiens
caggagagagugaacaaga

SEQ ID NO: 1439716 - RNA, 19 nt, Homo sapiens
gguuauagaggcaucuuug

SEQ ID NO: 1439717 - RNA, 19 nt, Homo sapiens
agaugaauaugaggagaaa

SEQ ID NO: 1439718 - RNA, 19 nt, Homo sapiens
uuaauuggaccuauagaug

SEQ ID NO: 1439719 - RNA, 19 nt, Homo sapiens
ucaaaucagcuuaucauac

SEQ ID NO: 1439720 - RNA, 19 nt, Homo sapiens
guagguuauugacacuuug

SEQ ID NO: 1439721 - RNA, 19 nt, Homo sapiens
cuccacauccuuaccaaua

SEQ ID NO: 1439722 - RNA, 19 nt, Homo sapiens
acacccaccagcagcauua

SEQ ID NO: 1439723 - RNA, 19 nt, Homo sapiens
uagguauuauguucaguga

SEQ ID NO: 1439724 - RNA, 19 nt, Homo sapiens
ggccaucccugccaucaac

SEQ ID NO: 1439725 - RNA, 19 nt, Homo sapiens
gaauaguaagucuugauag

SEQ ID NO: 1439726 - RNA, 19 nt, Homo sapiens
ucucuuacauuaucuuguc

SEQ ID NO: 1439727 - RNA, 19 nt, Homo sapiens
uccacauccuuaccaauaa

SEQ ID NO: 1439728 - RNA, 19 nt, Homo sapiens
aauuggaccuauagaugaa

SEQ ID NO: 1439729 - RNA, 19 nt, Homo sapiens
cagcagcauuagagaguuc

SEQ ID NO: 1439730 - RNA, 19 nt, Homo sapiens
ccaaacuauuucccaaagu

SEQ ID NO: 1439731 - RNA, 19 nt, Homo sapiens
ccuguucacuugcuguaga

SEQ ID NO: 1439732 - RNA, 19 nt, Homo sapiens
gaguaaaggacugcaaugu

SEQ ID NO: 1439733 - RNA, 19 nt, Homo sapiens
uggcaaauccucuuauucu

SEQ ID NO: 1439734 - RNA, 19 nt, Homo sapiens
gacauuuagcacauccuua

SEQ ID NO: 1439735 - RNA, 19 nt, Homo sapiens
gaccuauagaugaauauga

SEQ ID NO: 1439736 - RNA, 19 nt, Homo sapiens
ucaagucuguggccauuuu

SEQ ID NO: 1439737 - RNA, 19 nt, Homo sapiens
guuauugacacuuugcauu

SEQ ID NO: 1439738 - RNA, 19 nt, Homo sapiens
uggcuuuccuuacugcauu

SEQ ID NO: 1439739 - RNA, 19 nt, Homo sapiens
gaaaggcugggagcuagga

SEQ ID NO: 1439740 - RNA, 19 nt, Homo sapiens
uaacuggauuucugcauua

SEQ ID NO: 1439741 - RNA, 19 nt, Homo sapiens
gccaguaucucguaugauu

SEQ ID NO: 1439742 - RNA, 19 nt, Homo sapiens
gaucaaacgugcuuaagag

SEQ ID NO: 1439743 - RNA, 19 nt, Homo sapiens
agaagaaacugcaauggaa

SEQ ID NO: 1439744 - RNA, 19 nt, Homo sapiens
ggacaagacuacuguggau

SEQ ID NO: 1439745 - RNA, 19 nt, Homo sapiens
caaacgugcuuaagagcua

SEQ ID NO: 1439746 - RNA, 19 nt, Homo sapiens
gaaagaagaaacugcaaug

SEQ ID NO: 1439747 - RNA, 19 nt, Homo sapiens
ggacuccuguuccucauga

SEQ ID NO: 1439748 - RNA, 19 nt, Homo sapiens
ggauucaagugcuuuaaug

SEQ ID NO: 1439749 - RNA, 19 nt, Homo sapiens
cugcaucgcuuauccguuu

SEQ ID NO: 1439750 - RNA, 19 nt, Homo sapiens
ccauuucccucuguacuua

SEQ ID NO: 1439751 - RNA, 19 nt, Homo sapiens
gcaccugcuucauuuaaga

SEQ ID NO: 1439752 - RNA, 19 nt, Homo sapiens
ucccaaagcuaauuuauag

SEQ ID NO: 1439753 - RNA, 19 nt, Homo sapiens
gaagaaacugcaauggaaa

SEQ ID NO: 1439754 - RNA, 19 nt, Homo sapiens
gcagugccaugggacauuu

SEQ ID NO: 1439755 - RNA, 19 nt, Homo sapiens
ucucuucucugucuuugua

SEQ ID NO: 1439756 - RNA, 19 nt, Homo sapiens
caaccucugucucuuuaug

SEQ ID NO: 1439757 - RNA, 19 nt, Homo sapiens
cauuguaucaugcuuguua

SEQ ID NO: 1439758 - RNA, 19 nt, Homo sapiens
cgagagucauuucuacuug

SEQ ID NO: 1439759 - RNA, 19 nt, Homo sapiens
gaccaagauugcacagcua

SEQ ID NO: 1439760 - RNA, 19 nt, Homo sapiens
ucaagugcuuuaaugacua

SEQ ID NO: 1439761 - RNA, 19 nt, Homo sapiens
gcaaaaggauucguaacaa

SEQ ID NO: 1439762 - RNA, 19 nt, Homo sapiens
gcacggccaucaaguacca

SEQ ID NO: 1439763 - RNA, 19 nt, Homo sapiens
caaaaggauucguaacaaa

SEQ ID NO: 1439764 - RNA, 19 nt, Homo sapiens
caagugcuuuaaugacuau

SEQ ID NO: 1439765 - RNA, 19 nt, Homo sapiens
gugacacuaugcaguauug

SEQ ID NO: 1439766 - RNA, 19 nt, Homo sapiens
guacuggaaucgaaaucau

SEQ ID NO: 1439767 - RNA, 19 nt, Homo sapiens
gguuacagcugguccaucu

SEQ ID NO: 1439768 - RNA, 19 nt, Homo sapiens
uauguuaacuggauuucug

SEQ ID NO: 1439769 - RNA, 19 nt, Homo sapiens
ccaagaccauacagcaaga

SEQ ID NO: 1439770 - RNA, 19 nt, Homo sapiens
uuaacuggauuucugcauu

SEQ ID NO: 1439771 - RNA, 19 nt, Homo sapiens
ggacaucgacacccucauc

SEQ ID NO: 1439772 - RNA, 19 nt, Homo sapiens
acacuaugcaguauuguuu

SEQ ID NO: 1439773 - RNA, 19 nt, Homo sapiens
cguaacaaagcgaguauaa

SEQ ID NO: 1439774 - RNA, 19 nt, Homo sapiens
ggcagagacuccacgguau

SEQ ID NO: 1439775 - RNA, 19 nt, Homo sapiens
uuaagucucuucucugucu

SEQ ID NO: 1439776 - RNA, 19 nt, Homo sapiens
uucaaccucugucucuuua

SEQ ID NO: 1439777 - RNA, 19 nt, Homo sapiens
aaacagaucaaacgugcuu

SEQ ID NO: 1439778 - RNA, 19 nt, Homo sapiens
aguggcaccugcuucauuu

SEQ ID NO: 1439779 - RNA, 19 nt, Homo sapiens
caagacuacuguggauuca

SEQ ID NO: 1439780 - RNA, 19 nt, Homo sapiens
gcagagacuccacgguaug

SEQ ID NO: 1439781 - RNA, 19 nt, Homo sapiens
gauucaagugcuuuaauga

SEQ ID NO: 1439782 - RNA, 19 nt, Homo sapiens
gaaccggcucccaaagcua

SEQ ID NO: 1439783 - RNA, 19 nt, Homo sapiens
ccgccaguaucucguauga

SEQ ID NO: 1439784 - RNA, 19 nt, Homo sapiens
guucaaccucugucucuuu

SEQ ID NO: 1439785 - RNA, 19 nt, Homo sapiens
ggaaucgaaaucauaagau

SEQ ID NO: 1439786 - RNA, 19 nt, Homo sapiens
cuucuucuguugccuuauu

SEQ ID NO: 1439787 - RNA, 19 nt, Homo sapiens
gaguggcaccugcuucauu

SEQ ID NO: 1439788 - RNA, 19 nt, Homo sapiens
ccucaugacagggauauuu

SEQ ID NO: 1439789 - RNA, 19 nt, Homo sapiens
agacuacuguggauucaag

SEQ ID NO: 1439790 - RNA, 19 nt, Homo sapiens
uuuauuagccggaccaaga

SEQ ID NO: 1439791 - RNA, 19 nt, Homo sapiens
ucgcuuauccguuuauuag

SEQ ID NO: 1439792 - RNA, 19 nt, Homo sapiens
uuacagcugguccaucuuu

SEQ ID NO: 1439793 - RNA, 19 nt, Homo sapiens
ugcagcaucuucagaacuu

SEQ ID NO: 1439794 - RNA, 19 nt, Homo sapiens
gagcuaacucgugacacua

SEQ ID NO: 1439795 - RNA, 19 nt, Homo sapiens
gcuaacucgugacacuaug

SEQ ID NO: 1439796 - RNA, 19 nt, Homo sapiens
aaacgugcuuaagagcuaa

SEQ ID NO: 1439797 - RNA, 19 nt, Homo sapiens
agucauuucuacuugcaaa

SEQ ID NO: 1439798 - RNA, 19 nt, Homo sapiens
aagaagaaacugcaaugga

SEQ ID NO: 1439799 - RNA, 19 nt, Homo sapiens
gagaaagaagaaacugcaa

SEQ ID NO: 1439800 - RNA, 19 nt, Homo sapiens
caguaucucguaugauuug

SEQ ID NO: 1439801 - RNA, 19 nt, Homo sapiens
acuaugcaguauuguuuga

SEQ ID NO: 1439802 - RNA, 19 nt, Homo sapiens
guaacaaagcgaguauaau

SEQ ID NO: 1439803 - RNA, 19 nt, Homo sapiens
ccagaagaaccgccugaug

SEQ ID NO: 1439804 - RNA, 19 nt, Homo sapiens
cccauccgcuugcgaaaca

SEQ ID NO: 1439805 - RNA, 19 nt, Homo sapiens
cagaaaguuuguauguaac

SEQ ID NO: 1439806 - RNA, 19 nt, Homo sapiens
ugcguugacugugagaaua

SEQ ID NO: 1439807 - RNA, 19 nt, Homo sapiens
caauuacccgagagucauu

SEQ ID NO: 1439808 - RNA, 19 nt, Homo sapiens
ugggacauuucuaggugua

SEQ ID NO: 1439809 - RNA, 19 nt, Homo sapiens
caagauugcacagcuaaag

SEQ ID NO: 1439810 - RNA, 19 nt, Homo sapiens
ccucugucucuuuauguua

SEQ ID NO: 1439811 - RNA, 19 nt, Homo sapiens
gcucgucacggccaucuuc

SEQ ID NO: 1439812 - RNA, 19 nt, Homo sapiens
acagaucaaacgugcuuaa

SEQ ID NO: 1439813 - RNA, 19 nt, Homo sapiens
gucauuguaucaugcuugu

SEQ ID NO: 1439814 - RNA, 19 nt, Homo sapiens
gcaaaaccucccaaccuuu

SEQ ID NO: 1439815 - RNA, 19 nt, Homo sapiens
gacacuaugcaguauuguu

SEQ ID NO: 1439816 - RNA, 19 nt, Homo sapiens
agagcuaacucgugacacu

SEQ ID NO: 1439817 - RNA, 19 nt, Homo sapiens
acaagacuacuguggauuc

SEQ ID NO: 1439818 - RNA, 19 nt, Homo sapiens
cuaaggacaagacuacugu

SEQ ID NO: 1439819 - RNA, 19 nt, Homo sapiens
caguuuaggcuuuauugug

SEQ ID NO: 1439820 - RNA, 19 nt, Homo sapiens
uagccugccugcugaugug

SEQ ID NO: 1439821 - RNA, 19 nt, Homo sapiens
ccaguaucucguaugauuu

SEQ ID NO: 1439822 - RNA, 19 nt, Homo sapiens
cucugucucuuuauguuaa

SEQ ID NO: 1439823 - RNA, 19 nt, Homo sapiens
uggaaucgaaaucauaaga

SEQ ID NO: 1439824 - RNA, 19 nt, Homo sapiens
ugugucagcaccaaauauu

SEQ ID NO: 1439825 - RNA, 19 nt, Homo sapiens
uggcaccugcuucauuuaa

SEQ ID NO: 1439826 - RNA, 19 nt, Homo sapiens
gcgaaacauuccuuuuaau

SEQ ID NO: 1439827 - RNA, 19 nt, Homo sapiens
gcaguuuaggcuuuauugu

SEQ ID NO: 1439828 - RNA, 19 nt, Homo sapiens
cuggugcaguuuaggcuuu

SEQ ID NO: 1439829 - RNA, 19 nt, Homo sapiens
gcagcaucuucagaacuug

SEQ ID NO: 1439830 - RNA, 19 nt, Homo sapiens
cagagacuccacgguauga

SEQ ID NO: 1439831 - RNA, 19 nt, Homo sapiens
gaccauacagcaagaugag

SEQ ID NO: 1439832 - RNA, 19 nt, Homo sapiens
uaagagcuaacucgugaca

SEQ ID NO: 1439833 - RNA, 19 nt, Homo sapiens
acuggaaucgaaaucauaa

SEQ ID NO: 1439834 - RNA, 19 nt, Homo sapiens
gcucccaaagcuaauuuau

SEQ ID NO: 1439835 - RNA, 19 nt, Homo sapiens
ugaaccggcucccaaagcu

SEQ ID NO: 1439836 - RNA, 19 nt, Homo sapiens
ucgacacccucauccugaa

SEQ ID NO: 1439837 - RNA, 19 nt, Homo sapiens
cugauggugucuuauugug

SEQ ID NO: 1439838 - RNA, 19 nt, Homo sapiens
guccugauggugucuuauu

SEQ ID NO: 1439839 - RNA, 19 nt, Homo sapiens
ccgagagucauuucuacuu

SEQ ID NO: 1439840 - RNA, 19 nt, Homo sapiens
ggacggaucucaaucgaaa

SEQ ID NO: 1439841 - RNA, 19 nt, Homo sapiens
gcaaaugcauugaaagcaa

SEQ ID NO: 1439842 - RNA, 19 nt, Homo sapiens
caaaguauggaaccaauua

SEQ ID NO: 1439843 - RNA, 19 nt, Homo sapiens
aaagacaacucaaguauac

SEQ ID NO: 1439844 - RNA, 19 nt, Homo sapiens
caaaugcauugaaagcaaa

SEQ ID NO: 1439845 - RNA, 19 nt, Homo sapiens
cugcaugucucuucucuaa

SEQ ID NO: 1439846 - RNA, 19 nt, Homo sapiens
gaaggcagcaaaugcauug

SEQ ID NO: 1439847 - RNA, 19 nt, Homo sapiens
gcacucuuaugggcaguua

SEQ ID NO: 1439848 - RNA, 19 nt, Homo sapiens
caagaaggaugauauuuug

SEQ ID NO: 1439849 - RNA, 19 nt, Homo sapiens
gccaaugguucgucaaaga

SEQ ID NO: 1439850 - RNA, 19 nt, Homo sapiens
ugagagagaucagugagaa

SEQ ID NO: 1439851 - RNA, 19 nt, Homo sapiens
uuaggaaccuggacuucua

SEQ ID NO: 1439852 - RNA, 19 nt, Homo sapiens
gagggacaguggaacauau

SEQ ID NO: 1439853 - RNA, 19 nt, Homo sapiens
gcaucuugguguaguauug

SEQ ID NO: 1439854 - RNA, 19 nt, Homo sapiens
ggaaccaauuauagaguug

SEQ ID NO: 1439855 - RNA, 19 nt, Homo sapiens
gaaauuucaaugcaucuug

SEQ ID NO: 1439856 - RNA, 19 nt, Homo sapiens
ggugacaucugccacuaug

SEQ ID NO: 1439857 - RNA, 19 nt, Homo sapiens
gguuauaucuacacuugga

SEQ ID NO: 1439858 - RNA, 19 nt, Homo sapiens
cauggagccuggagacgua

SEQ ID NO: 1439859 - RNA, 19 nt, Homo sapiens
ggcagcaaaugcauugaaa

SEQ ID NO: 1439860 - RNA, 19 nt, Homo sapiens
gcaagaaggaugauauuuu

SEQ ID NO: 1439861 - RNA, 19 nt, Homo sapiens
gagcaagaaggaugauauu

SEQ ID NO: 1439862 - RNA, 19 nt, Homo sapiens
cauaaagacaacucaagua

SEQ ID NO: 1439863 - RNA, 19 nt, Homo sapiens
cuugaaacccuuuaucuuu

SEQ ID NO: 1439864 - RNA, 19 nt, Homo sapiens
ggacagaaggcagcaaaug

SEQ ID NO: 1439865 - RNA, 19 nt, Homo sapiens
ccagaaaugauucaaguug

SEQ ID NO: 1439866 - RNA, 19 nt, Homo sapiens
ucaaguaaccacccagaaa

SEQ ID NO: 1439867 - RNA, 19 nt, Homo sapiens
gaucgucuuuggaggaaau

SEQ ID NO: 1439868 - RNA, 19 nt, Homo sapiens
ggagggcugggauaugaua

SEQ ID NO: 1439869 - RNA, 19 nt, Homo sapiens
gacguauuccuauaacaua

SEQ ID NO: 1439870 - RNA, 19 nt, Homo sapiens
caaguaaccacccagaaau

SEQ ID NO: 1439871 - RNA, 19 nt, Homo sapiens
ucuagaaacugccaagauc

SEQ ID NO: 1439872 - RNA, 19 nt, Homo sapiens
ggaucucaaucgaaauuuc

SEQ ID NO: 1439873 - RNA, 19 nt, Homo sapiens
caacacagacaagagauug

SEQ ID NO: 1439874 - RNA, 19 nt, Homo sapiens
ggagacguauuccuauaac

SEQ ID NO: 1439875 - RNA, 19 nt, Homo sapiens
agaaaugauucaaguugga

SEQ ID NO: 1439876 - RNA, 19 nt, Homo sapiens
guugccagcuucauagaga

SEQ ID NO: 1439877 - RNA, 19 nt, Homo sapiens
gaaccuggacuucuauguc

SEQ ID NO: 1439878 - RNA, 19 nt, Homo sapiens
acaaggaaguggugacaca

SEQ ID NO: 1439879 - RNA, 19 nt, Homo sapiens
guauggaaccaauuauaga

SEQ ID NO: 1439880 - RNA, 19 nt, Homo sapiens
gcaaaguauggaaccaauu

SEQ ID NO: 1439881 - RNA, 19 nt, Homo sapiens
gaaguggugacacagcauu

SEQ ID NO: 1439882 - RNA, 19 nt, Homo sapiens
uaaccacccagaaaugauu

SEQ ID NO: 1439883 - RNA, 19 nt, Homo sapiens
gacacagcauuuccuagga

SEQ ID NO: 1439884 - RNA, 19 nt, Homo sapiens
gagagaucagugagaagua

SEQ ID NO: 1439885 - RNA, 19 nt, Homo sapiens
aguuaauucucacaccuua

SEQ ID NO: 1439886 - RNA, 19 nt, Homo sapiens
cuggagggcugggauauga

SEQ ID NO: 1439887 - RNA, 19 nt, Homo sapiens
caaucgaaauuucaaugca

SEQ ID NO: 1439888 - RNA, 19 nt, Homo sapiens
cuggagacguauuccuaua

SEQ ID NO: 1439889 - RNA, 19 nt, Homo sapiens
gaucucaaucgaaauuuca

SEQ ID NO: 1439890 - RNA, 19 nt, Homo sapiens
cugccaagaucaaacauuc

SEQ ID NO: 1439891 - RNA, 19 nt, Homo sapiens
gagcugagggacaguggaa

SEQ ID NO: 1439892 - RNA, 19 nt, Homo sapiens
uggaaccaauuauagaguu

SEQ ID NO: 1439893 - RNA, 19 nt, Homo sapiens
ccaaugguucgucaaagaa

SEQ ID NO: 1439894 - RNA, 19 nt, Homo sapiens
cauggaggcugugcuguca

SEQ ID NO: 1439895 - RNA, 19 nt, Homo sapiens
ggacaacugaucgucuuug

SEQ ID NO: 1439896 - RNA, 19 nt, Homo sapiens
gauucaaguuggacagaag

SEQ ID NO: 1439897 - RNA, 19 nt, Homo sapiens
uaugggcaguuaauucuca

SEQ ID NO: 1439898 - RNA, 19 nt, Homo sapiens
cauaauaauggcacauguu

SEQ ID NO: 1439899 - RNA, 19 nt, Homo sapiens
gacaacugaucgucuuugg

SEQ ID NO: 1439900 - RNA, 19 nt, Homo sapiens
ucagugagaaguacaagga

SEQ ID NO: 1439901 - RNA, 19 nt, Homo sapiens
gcuugaaacccuuuaucuu

SEQ ID NO: 1439902 - RNA, 19 nt, Homo sapiens
ugucaguccuggaugaugu

SEQ ID NO: 1439903 - RNA, 19 nt, Homo sapiens
gcauugaaagcaaaguaug

SEQ ID NO: 1439904 - RNA, 19 nt, Homo sapiens
ucauagagagcaagaagga

SEQ ID NO: 1439905 - RNA, 19 nt, Homo sapiens
ggaucgagugcagauauuu

SEQ ID NO: 1439906 - RNA, 19 nt, Homo sapiens
gggcugggauaugauagau

SEQ ID NO: 1439907 - RNA, 19 nt, Homo sapiens
gagacguauuccuauaaca

SEQ ID NO: 1439908 - RNA, 19 nt, Homo sapiens
uggauggacuguggaauuc

SEQ ID NO: 1439909 - RNA, 19 nt, Homo sapiens
ggauucccuucucauauac

SEQ ID NO: 1439910 - RNA, 19 nt, Homo sapiens
guauuggugccucuagaaa

SEQ ID NO: 1439911 - RNA, 19 nt, Homo sapiens
ccuuccaguucuuaacaua

SEQ ID NO: 1439912 - RNA, 19 nt, Homo sapiens
ggaugagagagaucaguga

SEQ ID NO: 1439913 - RNA, 19 nt, Homo sapiens
gcccaacacagacaagaga

SEQ ID NO: 1439914 - RNA, 19 nt, Homo sapiens
augguuauaucuacacuug

SEQ ID NO: 1439915 - RNA, 19 nt, Homo sapiens
ccauaaagacaacucaagu

SEQ ID NO: 1439916 - RNA, 19 nt, Homo sapiens
caguggaacauauggguuu

SEQ ID NO: 1439917 - RNA, 19 nt, Homo sapiens
caaugguucgucaaagaaa

SEQ ID NO: 1439918 - RNA, 19 nt, Homo sapiens
aguccuggaugauguguau

SEQ ID NO: 1439919 - RNA, 19 nt, Homo sapiens
guucuuaacauagaugguu

SEQ ID NO: 1439920 - RNA, 19 nt, Homo sapiens
ggugacacagcauuuccua

SEQ ID NO: 1439921 - RNA, 19 nt, Homo sapiens
uggaucgagugcagauauu

SEQ ID NO: 1439922 - RNA, 19 nt, Homo sapiens
acccagaaaugauucaagu

SEQ ID NO: 1439923 - RNA, 19 nt, Homo sapiens
gagagcaagaaggaugaua

SEQ ID NO: 1439924 - RNA, 19 nt, Homo sapiens
caaugcaucuugguguagu

SEQ ID NO: 1439925 - RNA, 19 nt, Homo sapiens
uggagacguauuccuauaa

SEQ ID NO: 1439926 - RNA, 19 nt, Homo sapiens
gacagaaggcagcaaaugc

SEQ ID NO: 1439927 - RNA, 19 nt, Homo sapiens
gaaacugccaagaucaaac

SEQ ID NO: 1439928 - RNA, 19 nt, Homo sapiens
uucaaugcaucuuggugua

SEQ ID NO: 1439929 - RNA, 19 nt, Homo sapiens
aguauacgcaagcuccuua

SEQ ID NO: 1439930 - RNA, 19 nt, Homo sapiens
gaauggauugcuccugcuu

SEQ ID NO: 1439931 - RNA, 19 nt, Homo sapiens
caucugguaaucccaagaa

SEQ ID NO: 1439932 - RNA, 19 nt, Homo sapiens
cagcauuuccuaggaguga

SEQ ID NO: 1439933 - RNA, 19 nt, Homo sapiens
ugagggacaguggaacaua

SEQ ID NO: 1439934 - RNA, 19 nt, Homo sapiens
uccugaccaugcacucuua

SEQ ID NO: 1439935 - RNA, 19 nt, Homo sapiens
aaacugccaagaucaaaca

SEQ ID NO: 1439936 - RNA, 19 nt, Homo sapiens
uagaaacugccaagaucaa

SEQ ID NO: 1439937 - RNA, 19 nt, Homo sapiens
guacaaggaaguggugaca

SEQ ID NO: 1439938 - RNA, 19 nt, Homo sapiens
ccaacacagacaagagauu

SEQ ID NO: 1439939 - RNA, 19 nt, Homo sapiens
gccuggagacguauuccua

SEQ ID NO: 1439940 - RNA, 19 nt, Homo sapiens
ggacugauguuuaauugua

SEQ ID NO: 1439941 - RNA, 19 nt, Homo sapiens
gaagcucuuugcuaaauua

SEQ ID NO: 1439942 - RNA, 19 nt, Homo sapiens
ggccacaacuauagaauua

SEQ ID NO: 1439943 - RNA, 19 nt, Homo sapiens
gaacuacauugauuuguug

SEQ ID NO: 1439944 - RNA, 19 nt, Homo sapiens
ccaguaagcuuucugauuc

SEQ ID NO: 1439945 - RNA, 19 nt, Homo sapiens
uaaaugguguuguuaggua

SEQ ID NO: 1439946 - RNA, 19 nt, Homo sapiens
gaaagagccacuuaaauuc

SEQ ID NO: 1439947 - RNA, 19 nt, Homo sapiens
gaaagaaagagccacuuaa

SEQ ID NO: 1439948 - RNA, 19 nt, Homo sapiens
agaaagagccacuuaaauu

SEQ ID NO: 1439949 - RNA, 19 nt, Homo sapiens
caugcuggcuuuaaauaua

SEQ ID NO: 1439950 - RNA, 19 nt, Homo sapiens
ggaaaucccaguaagcuuu

SEQ ID NO: 1439951 - RNA, 19 nt, Homo sapiens
gaagaacuacauugauuug

SEQ ID NO: 1439952 - RNA, 19 nt, Homo sapiens
aaacaguccuucaacuuug

SEQ ID NO: 1439953 - RNA, 19 nt, Homo sapiens
gcagaucuccgcugugcua

SEQ ID NO: 1439954 - RNA, 19 nt, Homo sapiens
gggcaccuauaauaaauga

SEQ ID NO: 1439955 - RNA, 19 nt, Homo sapiens
ugaaagaaagagccacuua

SEQ ID NO: 1439956 - RNA, 19 nt, Homo sapiens
uaccagagauuauuguuuc

SEQ ID NO: 1439957 - RNA, 19 nt, Homo sapiens
uagcugcaaucucuacuuu

SEQ ID NO: 1439958 - RNA, 19 nt, Homo sapiens
guagcuggcuugaguuugu

SEQ ID NO: 1439959 - RNA, 19 nt, Homo sapiens
acucuuaaguucucuauga

SEQ ID NO: 1439960 - RNA, 19 nt, Homo sapiens
aaagaaagagccacuuaaa

SEQ ID NO: 1439961 - RNA, 19 nt, Homo sapiens
ccaugaaucuauguacuuu

SEQ ID NO: 1439962 - RNA, 19 nt, Homo sapiens
gcaacaagaauaaucacaa

SEQ ID NO: 1439963 - RNA, 19 nt, Homo sapiens
caagaauaaucacaaccuu

SEQ ID NO: 1439964 - RNA, 19 nt, Homo sapiens
caacaagaauaaucacaac

SEQ ID NO: 1439965 - RNA, 19 nt, Homo sapiens
ugaagcaggccacuccuua

SEQ ID NO: 1439966 - RNA, 19 nt, Homo sapiens
aaacauacacgguaaaugg

SEQ ID NO: 1439967 - RNA, 19 nt, Homo sapiens
uuaaagggccacaacuaua

SEQ ID NO: 1439968 - RNA, 19 nt, Homo sapiens
gaaucuauguacuuucauc

SEQ ID NO: 1439969 - RNA, 19 nt, Homo sapiens
guacuaggauuagcugcaa

SEQ ID NO: 1439970 - RNA, 19 nt, Homo sapiens
gcaggccacuccuuacauc

SEQ ID NO: 1439971 - RNA, 19 nt, Homo sapiens
gaugaggaaaucccaguaa

SEQ ID NO: 1439972 - RNA, 19 nt, Homo sapiens
gguagguucuguccaguuc

SEQ ID NO: 1439973 - RNA, 19 nt, Homo sapiens
ugacuaggguucacuuucu

SEQ ID NO: 1439974 - RNA, 19 nt, Homo sapiens
cagagauuauuguuuccua

SEQ ID NO: 1439975 - RNA, 19 nt, Homo sapiens
gcucuuugcuaaauuaagg

SEQ ID NO: 1439976 - RNA, 19 nt, Homo sapiens
uuuguuagaugcaguaaug

SEQ ID NO: 1439977 - RNA, 19 nt, Homo sapiens
uaaagggccacaacuauag

SEQ ID NO: 1439978 - RNA, 19 nt, Homo sapiens
uuaaugaccaccaaugauu

SEQ ID NO: 1439979 - RNA, 19 nt, Homo sapiens
acauguagcuggcuugagu

SEQ ID NO: 1439980 - RNA, 19 nt, Homo sapiens
gguaaaugguguuguuagg

SEQ ID NO: 1439981 - RNA, 19 nt, Homo sapiens
cuuaaguucucuaugaaga

SEQ ID NO: 1439982 - RNA, 19 nt, Homo sapiens
ugaaggcauuguuuuguua

SEQ ID NO: 1439983 - RNA, 19 nt, Homo sapiens
gugggcaccuauaauaaau

SEQ ID NO: 1439984 - RNA, 19 nt, Homo sapiens
acauugauuuguuggcuuu

SEQ ID NO: 1439985 - RNA, 19 nt, Homo sapiens
uaaugaccaccaaugauuu

SEQ ID NO: 1439986 - RNA, 19 nt, Homo sapiens
uggagccucucuuccuaua

SEQ ID NO: 1439987 - RNA, 19 nt, Homo sapiens
cugcagaaguggaucauag

SEQ ID NO: 1439988 - RNA, 19 nt, Homo sapiens
gaugcaguaaugauguuua

SEQ ID NO: 1439989 - RNA, 19 nt, Homo sapiens
cuauaaaggcugaaugaug

SEQ ID NO: 1439990 - RNA, 19 nt, Homo sapiens
gaucaugcuggcuuuaaau

SEQ ID NO: 1439991 - RNA, 19 nt, Homo sapiens
ugaucaugcuggcuuuaaa

SEQ ID NO: 1439992 - RNA, 19 nt, Homo sapiens
cacgguaaaugguguuguu

SEQ ID NO: 1439993 - RNA, 19 nt, Homo sapiens
caaggcaagcauacaugua

SEQ ID NO: 1439994 - RNA, 19 nt, Homo sapiens
gauacauuauuccuucaca

SEQ ID NO: 1439995 - RNA, 19 nt, Homo sapiens
caaccuuaaugaccaccaa

SEQ ID NO: 1439996 - RNA, 19 nt, Homo sapiens
gaauuaccacuguuggaau

SEQ ID NO: 1439997 - RNA, 19 nt, Homo sapiens
guaacugaaccaaaggaaa

SEQ ID NO: 1439998 - RNA, 19 nt, Homo sapiens
gagauuauuguuuccuaug

SEQ ID NO: 1439999 - RNA, 19 nt, Homo sapiens
uaaugauguuuaccagaga

SEQ ID NO: 1440000 - RNA, 19 nt, Homo sapiens
uagaugcaguaaugauguu

SEQ ID NO: 1440001 - RNA, 19 nt, Homo sapiens
uaagcuuucugauucaagu

SEQ ID NO: 1440002 - RNA, 19 nt, Homo sapiens
gcugcaaucucuacuuucg

SEQ ID NO: 1440003 - RNA, 19 nt, Homo sapiens
ugggacugauguuuaauug

SEQ ID NO: 1440004 - RNA, 19 nt, Homo sapiens
ccucagccuuccgaguuua

SEQ ID NO: 1440005 - RNA, 19 nt, Homo sapiens
uugaguaacugaaccaaag

SEQ ID NO: 1440006 - RNA, 19 nt, Homo sapiens
ggccuuguuguguauaaua

SEQ ID NO: 1440007 - RNA, 19 nt, Homo sapiens
ggauaccaaggcaagcaua

SEQ ID NO: 1440008 - RNA, 19 nt, Homo sapiens
ggccucagccuuccgaguu

SEQ ID NO: 1440009 - RNA, 19 nt, Homo sapiens
uaacugaaccaaaggaaaa

SEQ ID NO: 1440010 - RNA, 19 nt, Homo sapiens
cacaguggauuuugaguaa

SEQ ID NO: 1440011 - RNA, 19 nt, Homo sapiens
gauguuuaccagagauuau

SEQ ID NO: 1440012 - RNA, 19 nt, Homo sapiens
cuaugaagaacuacauuga

SEQ ID NO: 1440013 - RNA, 19 nt, Homo sapiens
gggccacaacuauagaauu

SEQ ID NO: 1440014 - RNA, 19 nt, Homo sapiens
uuucugggacugauguuua

SEQ ID NO: 1440015 - RNA, 19 nt, Homo sapiens
gcaccuauaauaaaugacu

SEQ ID NO: 1440016 - RNA, 19 nt, Homo sapiens
aagaaagagccacuuaaau

SEQ ID NO: 1440017 - RNA, 19 nt, Homo sapiens
gccucagccuuccgaguuu

SEQ ID NO: 1440018 - RNA, 19 nt, Homo sapiens
agaagcucuuugcuaaauu

SEQ ID NO: 1440019 - RNA, 19 nt, Homo sapiens
uugcacagcuccagugucu

SEQ ID NO: 1440020 - RNA, 19 nt, Homo sapiens
acuauagaauuaccacugu

SEQ ID NO: 1440021 - RNA, 19 nt, Homo sapiens
caguaagcuuucugauuca

SEQ ID NO: 1440022 - RNA, 19 nt, Homo sapiens
caaucucuacuuucgauga

SEQ ID NO: 1440023 - RNA, 19 nt, Homo sapiens
uuuguuggcuuucagaauc

SEQ ID NO: 1440024 - RNA, 19 nt, Homo sapiens
cauuauuccuucacacagu

SEQ ID NO: 1440025 - RNA, 19 nt, Homo sapiens
cuuggagccucucuuccua

SEQ ID NO: 1440026 - RNA, 19 nt, Homo sapiens
gaggaaaucccaguaagcu

SEQ ID NO: 1440027 - RNA, 19 nt, Homo sapiens
gccaugaaucuauguacuu

SEQ ID NO: 1440028 - RNA, 19 nt, Homo sapiens
gaagcaggccacuccuuac

SEQ ID NO: 1440029 - RNA, 19 nt, Homo sapiens
guuguuagguagguucugu

SEQ ID NO: 1440030 - RNA, 19 nt, Homo sapiens
agaauuaccacuguuggaa

SEQ ID NO: 1440031 - RNA, 19 nt, Homo sapiens
uagcuggcuugaguuugua

SEQ ID NO: 1440032 - RNA, 19 nt, Homo sapiens
aggguggccuuguugugua

SEQ ID NO: 1440033 - RNA, 19 nt, Homo sapiens
cuauaccugugcaacaaga

SEQ ID NO: 1440034 - RNA, 19 nt, Homo sapiens
gacgagagacucaggaacu

SEQ ID NO: 1440035 - RNA, 19 nt, Homo sapiens
guuagaugcaguaaugaug

SEQ ID NO: 1440036 - RNA, 19 nt, Homo sapiens
ugacuuggagccucucuuc

SEQ ID NO: 1440037 - RNA, 19 nt, Homo sapiens
uauagaauuaccacuguug

SEQ ID NO: 1440038 - RNA, 19 nt, Homo sapiens
cuauagaauuaccacuguu

SEQ ID NO: 1440039 - RNA, 19 nt, Homo sapiens
cccaguaagcuuucugauu

SEQ ID NO: 1440040 - RNA, 19 nt, Homo sapiens
gagaaugacuccaauauuu

SEQ ID NO: 1440041 - RNA, 19 nt, Homo sapiens
ucaaggaccuaguucuuua

SEQ ID NO: 1440042 - RNA, 19 nt, Homo sapiens
guaagaagguccuagaauc

SEQ ID NO: 1440043 - RNA, 19 nt, Homo sapiens
guaaacaggucucccuuuc

SEQ ID NO: 1440044 - RNA, 19 nt, Homo sapiens
gacagcaguuguucuaauu

SEQ ID NO: 1440045 - RNA, 19 nt, Homo sapiens
uagcaaaucugcauaccaa

SEQ ID NO: 1440046 - RNA, 19 nt, Homo sapiens
ucagauacaucacuaaauc

SEQ ID NO: 1440047 - RNA, 19 nt, Homo sapiens
gccauguacucaccaguua

SEQ ID NO: 1440048 - RNA, 19 nt, Homo sapiens
gcaaaggccugauaauagc

SEQ ID NO: 1440049 - RNA, 19 nt, Homo sapiens
gaagagaaugacuccaaua

SEQ ID NO: 1440050 - RNA, 19 nt, Homo sapiens
ggaagagaaugacuccaau

SEQ ID NO: 1440051 - RNA, 19 nt, Homo sapiens
gaaagcuaccgaaacauga

SEQ ID NO: 1440052 - RNA, 19 nt, Homo sapiens
ggaaagcuaccgaaacaug

SEQ ID NO: 1440053 - RNA, 19 nt, Homo sapiens
gggcaagguugucagagaa

SEQ ID NO: 1440054 - RNA, 19 nt, Homo sapiens
ucaacguacuuccauauga

SEQ ID NO: 1440055 - RNA, 19 nt, Homo sapiens
ggcaguggcugacauggaa

SEQ ID NO: 1440056 - RNA, 19 nt, Homo sapiens
gcacaucaucaauacgaua

SEQ ID NO: 1440057 - RNA, 19 nt, Homo sapiens
gcaguuauuuaccgugguu

SEQ ID NO: 1440058 - RNA, 19 nt, Homo sapiens
caaaucugcauaccaaauu

SEQ ID NO: 1440059 - RNA, 19 nt, Homo sapiens
aaacaggucucccuuucau

SEQ ID NO: 1440060 - RNA, 19 nt, Homo sapiens
gcaagguugucagagaauu

SEQ ID NO: 1440061 - RNA, 19 nt, Homo sapiens
gguaguugcuguagucauc

SEQ ID NO: 1440062 - RNA, 19 nt, Homo sapiens
uuaaugggauuguggaaga

SEQ ID NO: 1440063 - RNA, 19 nt, Homo sapiens
ggacugggcacaucaucaa

SEQ ID NO: 1440064 - RNA, 19 nt, Homo sapiens
cgauagagaacgucacuuu

SEQ ID NO: 1440065 - RNA, 19 nt, Homo sapiens
gcaaaucugcauaccaaau

SEQ ID NO: 1440066 - RNA, 19 nt, Homo sapiens
caacguacuuccauaugag

SEQ ID NO: 1440067 - RNA, 19 nt, Homo sapiens
ucgcaaaggccugauaaua

SEQ ID NO: 1440068 - RNA, 19 nt, Homo sapiens
ccuagaaucucuccagaca

SEQ ID NO: 1440069 - RNA, 19 nt, Homo sapiens
uccaagaacugcacacaug

SEQ ID NO: 1440070 - RNA, 19 nt, Homo sapiens
gagagcauguacuuaucuu

SEQ ID NO: 1440071 - RNA, 19 nt, Homo sapiens
cgauagauuuggcuuaaag

SEQ ID NO: 1440072 - RNA, 19 nt, Homo sapiens
cuaugacucugcaguuauu

SEQ ID NO: 1440073 - RNA, 19 nt, Homo sapiens
gcauucacuucugcuaauu

SEQ ID NO: 1440074 - RNA, 19 nt, Homo sapiens
uuugcuagcuggauuacua

SEQ ID NO: 1440075 - RNA, 19 nt, Homo sapiens
gguccauaauucuauuuga

SEQ ID NO: 1440076 - RNA, 19 nt, Homo sapiens
ccacaacaaacaagacuga

SEQ ID NO: 1440077 - RNA, 19 nt, Homo sapiens
cauugaacauguuagaguu

SEQ ID NO: 1440078 - RNA, 19 nt, Homo sapiens
gcacaacucgaccuccuau

SEQ ID NO: 1440079 - RNA, 19 nt, Homo sapiens
agacagcaguuguucuaau

SEQ ID NO: 1440080 - RNA, 19 nt, Homo sapiens
ggcauucacuucugcuaau

SEQ ID NO: 1440081 - RNA, 19 nt, Homo sapiens
gaacgucacuuuucaccau

SEQ ID NO: 1440082 - RNA, 19 nt, Homo sapiens
uggcugacauggaaagcua

SEQ ID NO: 1440083 - RNA, 19 nt, Homo sapiens
gaacugcacacaugcuuac

SEQ ID NO: 1440084 - RNA, 19 nt, Homo sapiens
cagcaguuguucuaauuag

SEQ ID NO: 1440085 - RNA, 19 nt, Homo sapiens
gcauguacuuaucuugcuu

SEQ ID NO: 1440086 - RNA, 19 nt, Homo sapiens
aagccucuaucuugucuaa

SEQ ID NO: 1440087 - RNA, 19 nt, Homo sapiens
guacuuccauaugaggauu

SEQ ID NO: 1440088 - RNA, 19 nt, Homo sapiens
cagcauaaaguuaguagau

SEQ ID NO: 1440089 - RNA, 19 nt, Homo sapiens
uuucauugaucccagcaua

SEQ ID NO: 1440090 - RNA, 19 nt, Homo sapiens
aauugugcaugcuuacaua

SEQ ID NO: 1440091 - RNA, 19 nt, Homo sapiens
gcaguuguucuaauuagug

SEQ ID NO: 1440092 - RNA, 19 nt, Homo sapiens
gguaaacaggucucccuuu

SEQ ID NO: 1440093 - RNA, 19 nt, Homo sapiens
cuagcuggauuacuauuuc

SEQ ID NO: 1440094 - RNA, 19 nt, Homo sapiens
gugguuugguuaccuaguu

SEQ ID NO: 1440095 - RNA, 19 nt, Homo sapiens
caaacaagacugagagcau

SEQ ID NO: 1440096 - RNA, 19 nt, Homo sapiens
caagguugucagagaauuu

SEQ ID NO: 1440097 - RNA, 19 nt, Homo sapiens
cgcaaaggccugauaauag

SEQ ID NO: 1440098 - RNA, 19 nt, Homo sapiens
agaaugacuccaauauuug

SEQ ID NO: 1440099 - RNA, 19 nt, Homo sapiens
gggcacaucaucaauacga

SEQ ID NO: 1440100 - RNA, 19 nt, Homo sapiens
uaaaaugggccacaacaaa

SEQ ID NO: 1440101 - RNA, 19 nt, Homo sapiens
uaaagucuccuuggcauuc

SEQ ID NO: 1440102 - RNA, 19 nt, Homo sapiens
uaagaagguccuagaaucu

SEQ ID NO: 1440103 - RNA, 19 nt, Homo sapiens
agacugagagcauguacuu

SEQ ID NO: 1440104 - RNA, 19 nt, Homo sapiens
cacauucacuggcucuugu

SEQ ID NO: 1440105 - RNA, 19 nt, Homo sapiens
ggucgcaaaggccugauaa

SEQ ID NO: 1440106 - RNA, 19 nt, Homo sapiens
ucaauacgauagagaacgu

SEQ ID NO: 1440107 - RNA, 19 nt, Homo sapiens
gacggcauauucagauaca

SEQ ID NO: 1440108 - RNA, 19 nt, Homo sapiens
gcuagcuggauuacuauuu

SEQ ID NO: 1440109 - RNA, 19 nt, Homo sapiens
acaacucgaccuccuauga

SEQ ID NO: 1440110 - RNA, 19 nt, Homo sapiens
gaucccagcauaaaguuag

SEQ ID NO: 1440111 - RNA, 19 nt, Homo sapiens
ugaaggacugccuggauuu

SEQ ID NO: 1440112 - RNA, 19 nt, Homo sapiens
cauuuccgcuugguccaua

SEQ ID NO: 1440113 - RNA, 19 nt, Homo sapiens
agagaaugacuccaauauu

SEQ ID NO: 1440114 - RNA, 19 nt, Homo sapiens
cucgauagauuuggcuuaa

SEQ ID NO: 1440115 - RNA, 19 nt, Homo sapiens
gccugauaauagcuuaaua

SEQ ID NO: 1440116 - RNA, 19 nt, Homo sapiens
gccucuaucuugucuaagu

SEQ ID NO: 1440117 - RNA, 19 nt, Homo sapiens
ccaaucagccaccguccaa

SEQ ID NO: 1440118 - RNA, 19 nt, Homo sapiens
auggaaagcuaccgaaaca

SEQ ID NO: 1440119 - RNA, 19 nt, Homo sapiens
uccuaugacucugcaguua

SEQ ID NO: 1440120 - RNA, 19 nt, Homo sapiens
acaggucucccuuucauug

SEQ ID NO: 1440121 - RNA, 19 nt, Homo sapiens
gucaaggaccuaguucuuu

SEQ ID NO: 1440122 - RNA, 19 nt, Homo sapiens
gcugggaguucuggucuca

SEQ ID NO: 1440123 - RNA, 19 nt, Homo sapiens
gaaggacugccuggauuuc

SEQ ID NO: 1440124 - RNA, 19 nt, Homo sapiens
aagagaaugacuccaauau

SEQ ID NO: 1440125 - RNA, 19 nt, Homo sapiens
aaacuagcaaaucugcaua

SEQ ID NO: 1440126 - RNA, 19 nt, Homo sapiens
acagugguuugguuaccua

SEQ ID NO: 1440127 - RNA, 19 nt, Homo sapiens
cauguacucaccaguuaaa

SEQ ID NO: 1440128 - RNA, 19 nt, Homo sapiens
augaaggacugccuggauu

SEQ ID NO: 1440129 - RNA, 19 nt, Homo sapiens
ucauugaucccagcauaaa

SEQ ID NO: 1440130 - RNA, 19 nt, Homo sapiens
uggacggcauauucagaua

SEQ ID NO: 1440131 - RNA, 19 nt, Homo sapiens
uucuggagguguugguuua

SEQ ID NO: 1440132 - RNA, 19 nt, Homo sapiens
acuuaauugugcaugcuua

SEQ ID NO: 1440133 - RNA, 19 nt, Homo sapiens
ugggcaagguugucagaga

SEQ ID NO: 1440134 - RNA, 19 nt, Homo sapiens
guuguuggacggcauauuc

SEQ ID NO: 1440135 - RNA, 19 nt, Homo sapiens
ggauuguggaagagaauga

SEQ ID NO: 1440136 - RNA, 19 nt, Homo sapiens
acugagagcauguacuuau

SEQ ID NO: 1440137 - RNA, 19 nt, Homo sapiens
cauucacuucugcuaauua

SEQ ID NO: 1440138 - RNA, 19 nt, Homo sapiens
uaaacaggucucccuuuca

SEQ ID NO: 1440139 - RNA, 19 nt, Homo sapiens
ucaguaagaagguccuaga

SEQ ID NO: 1440140 - RNA, 19 nt, Homo sapiens
gaagggagcuggauugaga

SEQ ID NO: 1440141 - RNA, 19 nt, Homo sapiens
ggaaaggcaucguuaaaga

SEQ ID NO: 1440142 - RNA, 19 nt, Homo sapiens
uaaagaaucuggagugaag

SEQ ID NO: 1440143 - RNA, 19 nt, Homo sapiens
uauagcaucuucacuguaa

SEQ ID NO: 1440144 - RNA, 19 nt, Homo sapiens
ggaauacccugcagguuca

SEQ ID NO: 1440145 - RNA, 19 nt, Homo sapiens
gcuagauccuccucccuua

SEQ ID NO: 1440146 - RNA, 19 nt, Homo sapiens
cacaagggauugauugaaa

SEQ ID NO: 1440147 - RNA, 19 nt, Homo sapiens
gaaaggcaucguuaaagaa

SEQ ID NO: 1440148 - RNA, 19 nt, Homo sapiens
ggacaugucauuucucuca

SEQ ID NO: 1440149 - RNA, 19 nt, Homo sapiens
ggauugagagacuguguua

SEQ ID NO: 1440150 - RNA, 19 nt, Homo sapiens
gaacugagcaggaugaaaa

SEQ ID NO: 1440151 - RNA, 19 nt, Homo sapiens
ggaaagggcagaaauuugg

SEQ ID NO: 1440152 - RNA, 19 nt, Homo sapiens
guaaagaagagaacaugaa

SEQ ID NO: 1440153 - RNA, 19 nt, Homo sapiens
uagaugacacugagaauuu

SEQ ID NO: 1440154 - RNA, 19 nt, Homo sapiens
cuacuaaagugcugggauu

SEQ ID NO: 1440155 - RNA, 19 nt, Homo sapiens
agaugacacugagaauuua

SEQ ID NO: 1440156 - RNA, 19 nt, Homo sapiens
uaagacagaauacuacuug

SEQ ID NO: 1440157 - RNA, 19 nt, Homo sapiens
gaaauuuggaucucaguuc

SEQ ID NO: 1440158 - RNA, 19 nt, Homo sapiens
guuccuaucuaucuguaaa

SEQ ID NO: 1440159 - RNA, 19 nt, Homo sapiens
caagggauugauugaaaua

SEQ ID NO: 1440160 - RNA, 19 nt, Homo sapiens
gaucugggcugggcuugga

SEQ ID NO: 1440161 - RNA, 19 nt, Homo sapiens
acagaauacuacuugcaua

SEQ ID NO: 1440162 - RNA, 19 nt, Homo sapiens
guuaaagaaucuggaguga

SEQ ID NO: 1440163 - RNA, 19 nt, Homo sapiens
gguauugucaugauucuga

SEQ ID NO: 1440164 - RNA, 19 nt, Homo sapiens
acauuuaccucuucccuau

SEQ ID NO: 1440165 - RNA, 19 nt, Homo sapiens
gaauuuacaacgggaauga

SEQ ID NO: 1440166 - RNA, 19 nt, Homo sapiens
gcacaagggauugauugaa

SEQ ID NO: 1440167 - RNA, 19 nt, Homo sapiens
uuaaagaacugagcaggau

SEQ ID NO: 1440168 - RNA, 19 nt, Homo sapiens
gauccuccucccuuaaaua

SEQ ID NO: 1440169 - RNA, 19 nt, Homo sapiens
gaagauuacauuagacgau

SEQ ID NO: 1440170 - RNA, 19 nt, Homo sapiens
gcggcgagaucaacgaguu

SEQ ID NO: 1440171 - RNA, 19 nt, Homo sapiens
gcauaguggacaauaauau

SEQ ID NO: 1440172 - RNA, 19 nt, Homo sapiens
ucucucagcucguuucugu

SEQ ID NO: 1440173 - RNA, 19 nt, Homo sapiens
agacaggguuucaccaugu

SEQ ID NO: 1440174 - RNA, 19 nt, Homo sapiens
gagcagcuguauagcaucu

SEQ ID NO: 1440175 - RNA, 19 nt, Homo sapiens
cuugauagcugguauuguc

SEQ ID NO: 1440176 - RNA, 19 nt, Homo sapiens
ggaguuaacaaauaagaag

SEQ ID NO: 1440177 - RNA, 19 nt, Homo sapiens
uagagcagcuguauagcau

SEQ ID NO: 1440178 - RNA, 19 nt, Homo sapiens
gagugaagcacaagggauu

SEQ ID NO: 1440179 - RNA, 19 nt, Homo sapiens
gcaucguuguggagaauga

SEQ ID NO: 1440180 - RNA, 19 nt, Homo sapiens
aagagugacuuccgacaga

SEQ ID NO: 1440181 - RNA, 19 nt, Homo sapiens
gaagcagcauuuugaagaa

SEQ ID NO: 1440182 - RNA, 19 nt, Homo sapiens
cugggaagauuacauuaga

SEQ ID NO: 1440183 - RNA, 19 nt, Homo sapiens
cuacguccgucugauguuu

SEQ ID NO: 1440184 - RNA, 19 nt, Homo sapiens
gaguuccuaucuaucugua

SEQ ID NO: 1440185 - RNA, 19 nt, Homo sapiens
gcagcuguauagcaucuuc

SEQ ID NO: 1440186 - RNA, 19 nt, Homo sapiens
gaagcacaagggauugauu

SEQ ID NO: 1440187 - RNA, 19 nt, Homo sapiens
gggcuuccauucacgacuu

SEQ ID NO: 1440188 - RNA, 19 nt, Homo sapiens
gaauauugccugggaagau

SEQ ID NO: 1440189 - RNA, 19 nt, Homo sapiens
aaccucagcuuccagaguu

SEQ ID NO: 1440190 - RNA, 19 nt, Homo sapiens
uggaugaaaucuaugaaca

SEQ ID NO: 1440191 - RNA, 19 nt, Homo sapiens
ggaaugauuuuaccaacga

SEQ ID NO: 1440192 - RNA, 19 nt, Homo sapiens
guggaaagggcagaaauuu

SEQ ID NO: 1440193 - RNA, 19 nt, Homo sapiens
aauauugccugggaagauu

SEQ ID NO: 1440194 - RNA, 19 nt, Homo sapiens
ggaacuggccagaagaaca

SEQ ID NO: 1440195 - RNA, 19 nt, Homo sapiens
gcacuggguguaaggauuc

SEQ ID NO: 1440196 - RNA, 19 nt, Homo sapiens
guagaugacacugagaauu

SEQ ID NO: 1440197 - RNA, 19 nt, Homo sapiens
gauagcugguauugucaug

SEQ ID NO: 1440198 - RNA, 19 nt, Homo sapiens
cuaaagugcugggauuaca

SEQ ID NO: 1440199 - RNA, 19 nt, Homo sapiens
gacaggguuucaccauguu

SEQ ID NO: 1440200 - RNA, 19 nt, Homo sapiens
ucacaugauggaacuguuu

SEQ ID NO: 1440201 - RNA, 19 nt, Homo sapiens
gggcaucguuguggagaau

SEQ ID NO: 1440202 - RNA, 19 nt, Homo sapiens
ggagcuggauugagagacu

SEQ ID NO: 1440203 - RNA, 19 nt, Homo sapiens
ggcacuggguguaaggauu

SEQ ID NO: 1440204 - RNA, 19 nt, Homo sapiens
acaagggauugauugaaau

SEQ ID NO: 1440205 - RNA, 19 nt, Homo sapiens
gcaaaggaaagcugauuuu

SEQ ID NO: 1440206 - RNA, 19 nt, Homo sapiens
ucaugauucugauuaguuc

SEQ ID NO: 1440207 - RNA, 19 nt, Homo sapiens
gaaagggcagaaauuugga

SEQ ID NO: 1440208 - RNA, 19 nt, Homo sapiens
guguaaggauucccacugu

SEQ ID NO: 1440209 - RNA, 19 nt, Homo sapiens
guacggagaccggcuagga

SEQ ID NO: 1440210 - RNA, 19 nt, Homo sapiens
cgauggacaugucauuucu

SEQ ID NO: 1440211 - RNA, 19 nt, Homo sapiens
cuaucuaucuguaaagaag

SEQ ID NO: 1440212 - RNA, 19 nt, Homo sapiens
gggcaaacagaauuacaau

SEQ ID NO: 1440213 - RNA, 19 nt, Homo sapiens
agaacacuaugccaugguu

SEQ ID NO: 1440214 - RNA, 19 nt, Homo sapiens
ggaacuguuugacacaacu

SEQ ID NO: 1440215 - RNA, 19 nt, Homo sapiens
gggcagaaauuuggaucuc

SEQ ID NO: 1440216 - RNA, 19 nt, Homo sapiens
gaacuggccagaagaacac

SEQ ID NO: 1440217 - RNA, 19 nt, Homo sapiens
gguauggaacguaguggaa

SEQ ID NO: 1440218 - RNA, 19 nt, Homo sapiens
gcuggaaaggcaucguuaa

SEQ ID NO: 1440219 - RNA, 19 nt, Homo sapiens
guucacuacugcuacuuuc

SEQ ID NO: 1440220 - RNA, 19 nt, Homo sapiens
uguauagcaucuucacugu

SEQ ID NO: 1440221 - RNA, 19 nt, Homo sapiens
gccaccagcuugcccaaag

SEQ ID NO: 1440222 - RNA, 19 nt, Homo sapiens
aaagaacugagcaggauga

SEQ ID NO: 1440223 - RNA, 19 nt, Homo sapiens
uagcugguauugucaugau

SEQ ID NO: 1440224 - RNA, 19 nt, Homo sapiens
ggaugaaaucuaugaacau

SEQ ID NO: 1440225 - RNA, 19 nt, Homo sapiens
guagagcagcuguauagca

SEQ ID NO: 1440226 - RNA, 19 nt, Homo sapiens
guauagcaucuucacugua

SEQ ID NO: 1440227 - RNA, 19 nt, Homo sapiens
aaaggcaucguuaaagaau

SEQ ID NO: 1440228 - RNA, 19 nt, Homo sapiens
gcagcagccgcaaaggaaa

SEQ ID NO: 1440229 - RNA, 19 nt, Homo sapiens
cuacuugcauaguggacaa

SEQ ID NO: 1440230 - RNA, 19 nt, Homo sapiens
ggcagaaauuuggaucuca

SEQ ID NO: 1440231 - RNA, 19 nt, Homo sapiens
ugagcuagaucugacuuuc

SEQ ID NO: 1440232 - RNA, 19 nt, Homo sapiens
ucgggagaguccuugagua

SEQ ID NO: 1440233 - RNA, 19 nt, Homo sapiens
gacagaauacuacuugcau

SEQ ID NO: 1440234 - RNA, 19 nt, Homo sapiens
gacgauguauaugcgaaga

SEQ ID NO: 1440235 - RNA, 19 nt, Homo sapiens
ucauuucucucagcucguu

SEQ ID NO: 1440236 - RNA, 19 nt, Homo sapiens
ccacuacguccgucugaug

SEQ ID NO: 1440237 - RNA, 19 nt, Homo sapiens
cuacagaugcgugccacua

SEQ ID NO: 1440238 - RNA, 19 nt, Homo sapiens
aaucuggagugaagcacaa

SEQ ID NO: 1440239 - RNA, 19 nt, Homo sapiens
cauuggagguuggcagguu

SEQ ID NO: 1440240 - RNA, 19 nt, Homo sapiens
caaagacuauuaccaguua

SEQ ID NO: 1440241 - RNA, 19 nt, Homo sapiens
gaacggcucucagacgauu

SEQ ID NO: 1440242 - RNA, 19 nt, Homo sapiens
gcaagaauauuagacuaug

SEQ ID NO: 1440243 - RNA, 19 nt, Homo sapiens
uggaagaucucucuaagga

SEQ ID NO: 1440244 - RNA, 19 nt, Homo sapiens
gaagauauugccaggcuuu

SEQ ID NO: 1440245 - RNA, 19 nt, Homo sapiens
ucaaacaucacacagauuu

SEQ ID NO: 1440246 - RNA, 19 nt, Homo sapiens
ggacaagggcuguaagaca

SEQ ID NO: 1440247 - RNA, 19 nt, Homo sapiens
gcaaagacuauuaccaguu

SEQ ID NO: 1440248 - RNA, 19 nt, Homo sapiens
ggagacagcuguucuucac

SEQ ID NO: 1440249 - RNA, 19 nt, Homo sapiens
gugcaugucugauaaacug

SEQ ID NO: 1440250 - RNA, 19 nt, Homo sapiens
gaauucacaucuucaaggu

SEQ ID NO: 1440251 - RNA, 19 nt, Homo sapiens
gaacuaagagguuuuguug

SEQ ID NO: 1440252 - RNA, 19 nt, Homo sapiens
gugcaagaauauuagacua

SEQ ID NO: 1440253 - RNA, 19 nt, Homo sapiens
guccaaaucucuucugucu

SEQ ID NO: 1440254 - RNA, 19 nt, Homo sapiens
cuagagaauucacaucuuc

SEQ ID NO: 1440255 - RNA, 19 nt, Homo sapiens
uuucuuaucuggaucuuga

SEQ ID NO: 1440256 - RNA, 19 nt, Homo sapiens
ggucucagguaaucuuuag

SEQ ID NO: 1440257 - RNA, 19 nt, Homo sapiens
ggucaaacugccuuaauau

SEQ ID NO: 1440258 - RNA, 19 nt, Homo sapiens
gcucaggcauggcuguguu

SEQ ID NO: 1440259 - RNA, 19 nt, Homo sapiens
aggucaaacugccuuaaua

SEQ ID NO: 1440260 - RNA, 19 nt, Homo sapiens
gguggaagaucucucuaag

SEQ ID NO: 1440261 - RNA, 19 nt, Homo sapiens
uauggaaaccugagagaaa

SEQ ID NO: 1440262 - RNA, 19 nt, Homo sapiens
cuuaauauuuggugcaaga

SEQ ID NO: 1440263 - RNA, 19 nt, Homo sapiens
ugucaaacaucacacagau

SEQ ID NO: 1440264 - RNA, 19 nt, Homo sapiens
gauuugcuccugacuauca

SEQ ID NO: 1440265 - RNA, 19 nt, Homo sapiens
caaaagaaacccaugaaga

SEQ ID NO: 1440266 - RNA, 19 nt, Homo sapiens
auucugaggucaaaucaug

SEQ ID NO: 1440267 - RNA, 19 nt, Homo sapiens
guugaugcguggagccauu

SEQ ID NO: 1440268 - RNA, 19 nt, Homo sapiens
gcauggcuguguuucucuu

SEQ ID NO: 1440269 - RNA, 19 nt, Homo sapiens
acgauuugcuccugacuau

SEQ ID NO: 1440270 - RNA, 19 nt, Homo sapiens
gugaguaucgaucaacaaa

SEQ ID NO: 1440271 - RNA, 19 nt, Homo sapiens
gaggacaagggcuguaaga

SEQ ID NO: 1440272 - RNA, 19 nt, Homo sapiens
ucacacagauuugcaaagc

SEQ ID NO: 1440273 - RNA, 19 nt, Homo sapiens
guaaauuugacuuccuuga

SEQ ID NO: 1440274 - RNA, 19 nt, Homo sapiens
gagugaguaucgaucaaca

SEQ ID NO: 1440275 - RNA, 19 nt, Homo sapiens
ccacacccauuauaaaaga

SEQ ID NO: 1440276 - RNA, 19 nt, Homo sapiens
uaucccacacccauuauaa

SEQ ID NO: 1440277 - RNA, 19 nt, Homo sapiens
uccugacuaucauuucuua

SEQ ID NO: 1440278 - RNA, 19 nt, Homo sapiens
aaauuugacuuccuugaac

SEQ ID NO: 1440279 - RNA, 19 nt, Homo sapiens
ccuagagaauucacaucuu

SEQ ID NO: 1440280 - RNA, 19 nt, Homo sapiens
ccuuaucccacacccauua

SEQ ID NO: 1440281 - RNA, 19 nt, Homo sapiens
aaucucuucugucuccuuu

SEQ ID NO: 1440282 - RNA, 19 nt, Homo sapiens
gucaaacugccuuaauauu

SEQ ID NO: 1440283 - RNA, 19 nt, Homo sapiens
gcuccugacuaucauuucu

SEQ ID NO: 1440284 - RNA, 19 nt, Homo sapiens
aaucauggcccgaggacaa

SEQ ID NO: 1440285 - RNA, 19 nt, Homo sapiens
ucucuucaguguccaaauc

SEQ ID NO: 1440286 - RNA, 19 nt, Homo sapiens
aagcugugcaugucugaua

SEQ ID NO: 1440287 - RNA, 19 nt, Homo sapiens
caaccuuaggcacacauuu

SEQ ID NO: 1440288 - RNA, 19 nt, Homo sapiens
aaacugccuuaauauuugg

SEQ ID NO: 1440289 - RNA, 19 nt, Homo sapiens
gauauugccaggcuuuguc

SEQ ID NO: 1440290 - RNA, 19 nt, Homo sapiens
cuuugaaacuguaggacaa

SEQ ID NO: 1440291 - RNA, 19 nt, Homo sapiens
cugauaaacugugggaaca

SEQ ID NO: 1440292 - RNA, 19 nt, Homo sapiens
agagucaccgucauucuga

SEQ ID NO: 1440293 - RNA, 19 nt, Homo sapiens
gacuaucauuucuuaucug

SEQ ID NO: 1440294 - RNA, 19 nt, Homo sapiens
ggucacccggucucaggua

SEQ ID NO: 1440295 - RNA, 19 nt, Homo sapiens
uaggccaucaucauccuua

SEQ ID NO: 1440296 - RNA, 19 nt, Homo sapiens
ugagagaaaagcaaccuua

SEQ ID NO: 1440297 - RNA, 19 nt, Homo sapiens
gaguaucgaucaacaaaac

SEQ ID NO: 1440298 - RNA, 19 nt, Homo sapiens
caucacacagauuugcaaa

SEQ ID NO: 1440299 - RNA, 19 nt, Homo sapiens
gacgauuugcuccugacua

SEQ ID NO: 1440300 - RNA, 19 nt, Homo sapiens
gacucucuuugaaacugua

SEQ ID NO: 1440301 - RNA, 19 nt, Homo sapiens
gagaauucacaucuucaag

SEQ ID NO: 1440302 - RNA, 19 nt, Homo sapiens
aagacuuccuagagaauuc

SEQ ID NO: 1440303 - RNA, 19 nt, Homo sapiens
cccagugccuugcuagagu

SEQ ID NO: 1440304 - RNA, 19 nt, Homo sapiens
gucacccggucucagguaa

SEQ ID NO: 1440305 - RNA, 19 nt, Homo sapiens
gacagcuguucuucaccaa

SEQ ID NO: 1440306 - RNA, 19 nt, Homo sapiens
cgccuagcaaagacuauua

SEQ ID NO: 1440307 - RNA, 19 nt, Homo sapiens
caaagcugugcaugucuga

SEQ ID NO: 1440308 - RNA, 19 nt, Homo sapiens
aagaaacccaugaagacuu

SEQ ID NO: 1440309 - RNA, 19 nt, Homo sapiens
gaugguggaagaucucucu

SEQ ID NO: 1440310 - RNA, 19 nt, Homo sapiens
gccuuaauauuuggugcaa

SEQ ID NO: 1440311 - RNA, 19 nt, Homo sapiens
acuaagagguuuuguugau

SEQ ID NO: 1440312 - RNA, 19 nt, Homo sapiens
gagaaaggguuaaauauag

SEQ ID NO: 1440313 - RNA, 19 nt, Homo sapiens
aaacagaaguggcaagaaa

SEQ ID NO: 1440314 - RNA, 19 nt, Homo sapiens
caacagugcacauaucuua

SEQ ID NO: 1440315 - RNA, 19 nt, Homo sapiens
gaacaacagugcacauauc

SEQ ID NO: 1440316 - RNA, 19 nt, Homo sapiens
gaaaggacauggagucuac

SEQ ID NO: 1440317 - RNA, 19 nt, Homo sapiens
ggaaaugaaugucuuugug

SEQ ID NO: 1440318 - RNA, 19 nt, Homo sapiens
gcaaagagcagagaagaaa

SEQ ID NO: 1440319 - RNA, 19 nt, Homo sapiens
gaagaagaccacuggauuu

SEQ ID NO: 1440320 - RNA, 19 nt, Homo sapiens
gcauugaaauugaagaaga

SEQ ID NO: 1440321 - RNA, 19 nt, Homo sapiens
gagaaacuguggaagaaga

SEQ ID NO: 1440322 - RNA, 19 nt, Homo sapiens
gaaaugaaugucuuuguga

SEQ ID NO: 1440323 - RNA, 19 nt, Homo sapiens
guacaaaccaguagacuau

SEQ ID NO: 1440324 - RNA, 19 nt, Homo sapiens
caauaucgcuuugcuauag

SEQ ID NO: 1440325 - RNA, 19 nt, Homo sapiens
uaaaaucccuucucaauga

SEQ ID NO: 1440326 - RNA, 19 nt, Homo sapiens
gauaauuucugacccuaga

SEQ ID NO: 1440327 - RNA, 19 nt, Homo sapiens
ugaaugaagucagauguaa

SEQ ID NO: 1440328 - RNA, 19 nt, Homo sapiens
ugagaaacaucaaguacaa

SEQ ID NO: 1440329 - RNA, 19 nt, Homo sapiens
ggagucuacuguauuuaaa

SEQ ID NO: 1440330 - RNA, 19 nt, Homo sapiens
ggaagaagaaggaauuguu

SEQ ID NO: 1440331 - RNA, 19 nt, Homo sapiens
gaaauaaaaucccuucuca

SEQ ID NO: 1440332 - RNA, 19 nt, Homo sapiens
cgagaaauauugugaccaa

SEQ ID NO: 1440333 - RNA, 19 nt, Homo sapiens
gaagaaggacucuguaucu

SEQ ID NO: 1440334 - RNA, 19 nt, Homo sapiens
ucagugaguucuauaaguu

SEQ ID NO: 1440335 - RNA, 19 nt, Homo sapiens
ggacauggagucuacugua

SEQ ID NO: 1440336 - RNA, 19 nt, Homo sapiens
gcuagaagcccuuaggaaa

SEQ ID NO: 1440337 - RNA, 19 nt, Homo sapiens
ucaagaagcucaugaagac

SEQ ID NO: 1440338 - RNA, 19 nt, Homo sapiens
gaagaagaaggaauuguug

SEQ ID NO: 1440339 - RNA, 19 nt, Homo sapiens
gaagacauauacagaaacu

SEQ ID NO: 1440340 - RNA, 19 nt, Homo sapiens
cauggagucuacuguauuu

SEQ ID NO: 1440341 - RNA, 19 nt, Homo sapiens
ggaagagguugacuuugug

SEQ ID NO: 1440342 - RNA, 19 nt, Homo sapiens
gaaaagcaauguugacuuc

SEQ ID NO: 1440343 - RNA, 19 nt, Homo sapiens
gaaugucuuugugaccuua

SEQ ID NO: 1440344 - RNA, 19 nt, Homo sapiens
gauaaucugguauuccaua

SEQ ID NO: 1440345 - RNA, 19 nt, Homo sapiens
acacagaaauaucagaaga

SEQ ID NO: 1440346 - RNA, 19 nt, Homo sapiens
uuagugaacugcccauuga

SEQ ID NO: 1440347 - RNA, 19 nt, Homo sapiens
gauucuagaucauucuuug

SEQ ID NO: 1440348 - RNA, 19 nt, Homo sapiens
cagauacaauggcaucaaa

SEQ ID NO: 1440349 - RNA, 19 nt, Homo sapiens
gaaaguauuggaagagguu

SEQ ID NO: 1440350 - RNA, 19 nt, Homo sapiens
acagagaaaggguuaaaua

SEQ ID NO: 1440351 - RNA, 19 nt, Homo sapiens
gacauggagucuacuguau

SEQ ID NO: 1440352 - RNA, 19 nt, Homo sapiens
ggaauugugugcugaucug

SEQ ID NO: 1440353 - RNA, 19 nt, Homo sapiens
ugaacugcccauugaauua

SEQ ID NO: 1440354 - RNA, 19 nt, Homo sapiens
uggaagagguugacuuugu

SEQ ID NO: 1440355 - RNA, 19 nt, Homo sapiens
gcuaugcccuuugaccuuu

SEQ ID NO: 1440356 - RNA, 19 nt, Homo sapiens
gaaacugucaacuaaguga

SEQ ID NO: 1440357 - RNA, 19 nt, Homo sapiens
cagaaacugucaacuaagu

SEQ ID NO: 1440358 - RNA, 19 nt, Homo sapiens
gaacagcugagcccuuaga

SEQ ID NO: 1440359 - RNA, 19 nt, Homo sapiens
aaucugguauuccauauga

SEQ ID NO: 1440360 - RNA, 19 nt, Homo sapiens
uagcaagacuggaaaugga

SEQ ID NO: 1440361 - RNA, 19 nt, Homo sapiens
uggaagacauauacagaaa

SEQ ID NO: 1440362 - RNA, 19 nt, Homo sapiens
ggacauguuacaaagauau

SEQ ID NO: 1440363 - RNA, 19 nt, Homo sapiens
gagcaacagagaauagaaa

SEQ ID NO: 1440364 - RNA, 19 nt, Homo sapiens
gagguugacuuugugaaga

SEQ ID NO: 1440365 - RNA, 19 nt, Homo sapiens
aggaacagcugagcccuua

SEQ ID NO: 1440366 - RNA, 19 nt, Homo sapiens
ggacuucauagaacacuuu

SEQ ID NO: 1440367 - RNA, 19 nt, Homo sapiens
aagagaaacuguggaagaa

SEQ ID NO: 1440368 - RNA, 19 nt, Homo sapiens
ggaagaggagaaagagaaa

SEQ ID NO: 1440369 - RNA, 19 nt, Homo sapiens
gcccauacccugauuugaa

SEQ ID NO: 1440370 - RNA, 19 nt, Homo sapiens
gaagucagauguaaaaugg

SEQ ID NO: 1440371 - RNA, 19 nt, Homo sapiens
gcaagaaauggaaaugaga

SEQ ID NO: 1440372 - RNA, 19 nt, Homo sapiens
ugaagaagaccacuggauu

SEQ ID NO: 1440373 - RNA, 19 nt, Homo sapiens
aaacaacuuugccuuucuu

SEQ ID NO: 1440374 - RNA, 19 nt, Homo sapiens
cgaguuagcacuucgagaa

SEQ ID NO: 1440375 - RNA, 19 nt, Homo sapiens
aagaaggaauuguugcaaa

SEQ ID NO: 1440376 - RNA, 19 nt, Homo sapiens
cagcugagcccuuagaugu

SEQ ID NO: 1440377 - RNA, 19 nt, Homo sapiens
acagacagcaucacacuuu

SEQ ID NO: 1440378 - RNA, 19 nt, Homo sapiens
gaaugaagucagauguaaa

SEQ ID NO: 1440379 - RNA, 19 nt, Homo sapiens
cuucaaaguuauccaaaga

SEQ ID NO: 1440380 - RNA, 19 nt, Homo sapiens
ccaguagacuaucaacaau

SEQ ID NO: 1440381 - RNA, 19 nt, Homo sapiens
guuagaaugaugucagaua

SEQ ID NO: 1440382 - RNA, 19 nt, Homo sapiens
gaaauuaaucgcugaacag

SEQ ID NO: 1440383 - RNA, 19 nt, Homo sapiens
gaaauggaaaugagagauc

SEQ ID NO: 1440384 - RNA, 19 nt, Homo sapiens
aaucuucaauucucaguga

SEQ ID NO: 1440385 - RNA, 19 nt, Homo sapiens
gauguaaaauggaaucuga

SEQ ID NO: 1440386 - RNA, 19 nt, Homo sapiens
gacaagaauuauuggaaag

SEQ ID NO: 1440387 - RNA, 19 nt, Homo sapiens
aaagagaaacuguggaaga

SEQ ID NO: 1440388 - RNA, 19 nt, Homo sapiens
ccaagaagagguagcaaga

SEQ ID NO: 1440389 - RNA, 19 nt, Homo sapiens
ucacaaaucuaggcaugau

SEQ ID NO: 1440390 - RNA, 19 nt, Homo sapiens
aagaagaccacuggauuua

SEQ ID NO: 1440391 - RNA, 19 nt, Homo sapiens
cccauacccugauuugaaa

SEQ ID NO: 1440392 - RNA, 19 nt, Homo sapiens
agaaugaugucagauacaa

SEQ ID NO: 1440393 - RNA, 19 nt, Homo sapiens
gaacugaagaaauuaaucg

SEQ ID NO: 1440394 - RNA, 19 nt, Homo sapiens
ggaagaaggacucuguauc

SEQ ID NO: 1440395 - RNA, 19 nt, Homo sapiens
agacuggaguauaaagauu

SEQ ID NO: 1440396 - RNA, 19 nt, Homo sapiens
caucacacuuugcagcauu

SEQ ID NO: 1440397 - RNA, 19 nt, Homo sapiens
gcaaagcuaaagaucagaa

SEQ ID NO: 1440398 - RNA, 19 nt, Homo sapiens
cagagaaaggguuaaauau

SEQ ID NO: 1440399 - RNA, 19 nt, Homo sapiens
aaagacagagaaaggguua

SEQ ID NO: 1440400 - RNA, 19 nt, Homo sapiens
auuaaucgcugaacaguca

SEQ ID NO: 1440401 - RNA, 19 nt, Homo sapiens
ggcaagaaauggaaaugag

SEQ ID NO: 1440402 - RNA, 19 nt, Homo sapiens
gaaguggcaagaaauggaa

SEQ ID NO: 1440403 - RNA, 19 nt, Homo sapiens
gaagaccacuggauuuacc

SEQ ID NO: 1440404 - RNA, 19 nt, Homo sapiens
gaaugcccauacccugauu

SEQ ID NO: 1440405 - RNA, 19 nt, Homo sapiens
aguagacuaucaacaauug

SEQ ID NO: 1440406 - RNA, 19 nt, Homo sapiens
gaacugcccauugaauuag

SEQ ID NO: 1440407 - RNA, 19 nt, Homo sapiens
gaagaaggaauuguugcaa

SEQ ID NO: 1440408 - RNA, 19 nt, Homo sapiens
caacaauugcgugcauuaa

SEQ ID NO: 1440409 - RNA, 19 nt, Homo sapiens
auauagagcucauccucaa

SEQ ID NO: 1440410 - RNA, 19 nt, Homo sapiens
uagaagcccuuaggaaaca

SEQ ID NO: 1440411 - RNA, 19 nt, Homo sapiens
gaagaaauuaaucgcugaa

SEQ ID NO: 1440412 - RNA, 19 nt, Homo sapiens
gaggaaggguugaaagaua

SEQ ID NO: 1440413 - RNA, 19 nt, Homo sapiens
gggaugagcuggagacaaa

SEQ ID NO: 1440414 - RNA, 19 nt, Homo sapiens
gaacaaauccaucuucuuc

SEQ ID NO: 1440415 - RNA, 19 nt, Homo sapiens
gaacugacauugaccuuca

SEQ ID NO: 1440416 - RNA, 19 nt, Homo sapiens
ccaguaagcuucuaccauu

SEQ ID NO: 1440417 - RNA, 19 nt, Homo sapiens
gagaauggaugacccuaaa

SEQ ID NO: 1440418 - RNA, 19 nt, Homo sapiens
gaugauagccuuaagaaug

SEQ ID NO: 1440419 - RNA, 19 nt, Homo sapiens
uuacacaggugaagauuaa

SEQ ID NO: 1440420 - RNA, 19 nt, Homo sapiens
gaaaagagguggucaaaca

SEQ ID NO: 1440421 - RNA, 19 nt, Homo sapiens
gcaugucccuguucaguuu

SEQ ID NO: 1440422 - RNA, 19 nt, Homo sapiens
ggacacagccagagaauuc

SEQ ID NO: 1440423 - RNA, 19 nt, Homo sapiens
gaacagaccaagaacaaau

SEQ ID NO: 1440424 - RNA, 19 nt, Homo sapiens
caaugugucugaaauguga

SEQ ID NO: 1440425 - RNA, 19 nt, Homo sapiens
ccagauggcuucccaguca

SEQ ID NO: 1440426 - RNA, 19 nt, Homo sapiens
gaaaugugaucuccaagag

SEQ ID NO: 1440427 - RNA, 19 nt, Homo sapiens
cgccaucucuacauaaaua

SEQ ID NO: 1440428 - RNA, 19 nt, Homo sapiens
gaggugggaugaucacuug

SEQ ID NO: 1440429 - RNA, 19 nt, Homo sapiens
ggucagaucaccuuuggua

SEQ ID NO: 1440430 - RNA, 19 nt, Homo sapiens
ggucagacuugcucucuau

SEQ ID NO: 1440431 - RNA, 19 nt, Homo sapiens
guaaagggcccucuacuca

SEQ ID NO: 1440432 - RNA, 19 nt, Homo sapiens
gaucaaggcuuuaaaaucu

SEQ ID NO: 1440433 - RNA, 19 nt, Homo sapiens
gggcagcucugaccuauac

SEQ ID NO: 1440434 - RNA, 19 nt, Homo sapiens
gaacuccgcauguuacaga

SEQ ID NO: 1440435 - RNA, 19 nt, Homo sapiens
gaacaaggaugagguuuug

SEQ ID NO: 1440436 - RNA, 19 nt, Homo sapiens
guugaaagauacagaccua

SEQ ID NO: 1440437 - RNA, 19 nt, Homo sapiens
guaccuacaugcaaagugu

SEQ ID NO: 1440438 - RNA, 19 nt, Homo sapiens
gccagcaccuucuauguga

SEQ ID NO: 1440439 - RNA, 19 nt, Homo sapiens
gcugacggcuccuugagaa

SEQ ID NO: 1440440 - RNA, 19 nt, Homo sapiens
caauacagcagacauguga

SEQ ID NO: 1440441 - RNA, 19 nt, Homo sapiens
gaagauuaaacacccagua

SEQ ID NO: 1440442 - RNA, 19 nt, Homo sapiens
uaaaggagacuucaucaca

SEQ ID NO: 1440443 - RNA, 19 nt, Homo sapiens
gauaauccaaugugucuga

SEQ ID NO: 1440444 - RNA, 19 nt, Homo sapiens
acauugaccuucagacuau

SEQ ID NO: 1440445 - RNA, 19 nt, Homo sapiens
gagcauucauaacucagaa

SEQ ID NO: 1440446 - RNA, 19 nt, Homo sapiens
gaggauaccagcaaugaug

SEQ ID NO: 1440447 - RNA, 19 nt, Homo sapiens
gagagaaggguguuucaga

SEQ ID NO: 1440448 - RNA, 19 nt, Homo sapiens
gcagguggaugaggucaga

SEQ ID NO: 1440449 - RNA, 19 nt, Homo sapiens
acaaauccaucuucuucuu

SEQ ID NO: 1440450 - RNA, 19 nt, Homo sapiens
guuuauacaugguacaaga

SEQ ID NO: 1440451 - RNA, 19 nt, Homo sapiens
gggaauggcugcuguuagc

SEQ ID NO: 1440452 - RNA, 19 nt, Homo sapiens
ggacucagcgucuccuguu

SEQ ID NO: 1440453 - RNA, 19 nt, Homo sapiens
gacauugaccuucagacua

SEQ ID NO: 1440454 - RNA, 19 nt, Homo sapiens
cgagaaagcaucccugcaa

SEQ ID NO: 1440455 - RNA, 19 nt, Homo sapiens
ggagacaaaucagcaacau

SEQ ID NO: 1440456 - RNA, 19 nt, Homo sapiens
gugaggcucugcagaacuu

SEQ ID NO: 1440457 - RNA, 19 nt, Homo sapiens
ccuguaaucccaacacuuu

SEQ ID NO: 1440458 - RNA, 19 nt, Homo sapiens
caaauccaucuucuucuuu

SEQ ID NO: 1440459 - RNA, 19 nt, Homo sapiens
gcaaugaugagaguucuau

SEQ ID NO: 1440460 - RNA, 19 nt, Homo sapiens
aggaugggcuccagcaauu

SEQ ID NO: 1440461 - RNA, 19 nt, Homo sapiens
ucagaucaccuuugguaaa

SEQ ID NO: 1440462 - RNA, 19 nt, Homo sapiens
agucaucggccucucauua

SEQ ID NO: 1440463 - RNA, 19 nt, Homo sapiens
gagauaauccaaugugucu

SEQ ID NO: 1440464 - RNA, 19 nt, Homo sapiens
ggagauuacuauucugacu

SEQ ID NO: 1440465 - RNA, 19 nt, Homo sapiens
gaucaccuuugguaaacug

SEQ ID NO: 1440466 - RNA, 19 nt, Homo sapiens
ccauauccaugcucagguu

SEQ ID NO: 1440467 - RNA, 19 nt, Homo sapiens
gggagaggaugguguaaaa

SEQ ID NO: 1440468 - RNA, 19 nt, Homo sapiens
ccagcaaggacuuucauuu

SEQ ID NO: 1440469 - RNA, 19 nt, Homo sapiens
cagccuuccuguccuguuu

SEQ ID NO: 1440470 - RNA, 19 nt, Homo sapiens
uuacuauucugacuucuca

SEQ ID NO: 1440471 - RNA, 19 nt, Homo sapiens
agaaggguguuucagauca

SEQ ID NO: 1440472 - RNA, 19 nt, Homo sapiens
agagaaggguguuucagau

SEQ ID NO: 1440473 - RNA, 19 nt, Homo sapiens
ucucagaacuccgcauguu

SEQ ID NO: 1440474 - RNA, 19 nt, Homo sapiens
guaagcuucuaccauuguu

SEQ ID NO: 1440475 - RNA, 19 nt, Homo sapiens
uagaaucauuugcuacugu

SEQ ID NO: 1440476 - RNA, 19 nt, Homo sapiens
caagugaucaaggcuuuaa

SEQ ID NO: 1440477 - RNA, 19 nt, Homo sapiens
aaagggcccucuacucaca

SEQ ID NO: 1440478 - RNA, 19 nt, Homo sapiens
acaaugauaucgucagcau

SEQ ID NO: 1440479 - RNA, 19 nt, Homo sapiens
ucugaaaugugaucuccaa

SEQ ID NO: 1440480 - RNA, 19 nt, Homo sapiens
gcauggagauuuucuucaa

SEQ ID NO: 1440481 - RNA, 19 nt, Homo sapiens
auacagaccuagccagagu

SEQ ID NO: 1440482 - RNA, 19 nt, Homo sapiens
cugcccagcuuaaccauau

SEQ ID NO: 1440483 - RNA, 19 nt, Homo sapiens
ucucuagccugcagcuuga

SEQ ID NO: 1440484 - RNA, 19 nt, Homo sapiens
ccacaugaugauagccuua

SEQ ID NO: 1440485 - RNA, 19 nt, Homo sapiens
cauauggacucccguucau

SEQ ID NO: 1440486 - RNA, 19 nt, Homo sapiens
gagacuucaucacacucua

SEQ ID NO: 1440487 - RNA, 19 nt, Homo sapiens
ggaacagaccaagaacaaa

SEQ ID NO: 1440488 - RNA, 19 nt, Homo sapiens
gagaccagccugagcaaca

SEQ ID NO: 1440489 - RNA, 19 nt, Homo sapiens
aauccaaugugucugaaau

SEQ ID NO: 1440490 - RNA, 19 nt, Homo sapiens
ggucacaaagggaauccua

SEQ ID NO: 1440491 - RNA, 19 nt, Homo sapiens
uccagcaauucaaacaaua

SEQ ID NO: 1440492 - RNA, 19 nt, Homo sapiens
caguaagcuucuaccauug

SEQ ID NO: 1440493 - RNA, 19 nt, Homo sapiens
aagauuaaacacccaguaa

SEQ ID NO: 1440494 - RNA, 19 nt, Homo sapiens
gaaagcaucccugcaagac

SEQ ID NO: 1440495 - RNA, 19 nt, Homo sapiens
uuaagaauguggagagcau

SEQ ID NO: 1440496 - RNA, 19 nt, Homo sapiens
augauagccuuaagaaugu

SEQ ID NO: 1440497 - RNA, 19 nt, Homo sapiens
cagagauaauccaaugugu

SEQ ID NO: 1440498 - RNA, 19 nt, Homo sapiens
gggcugacaucugcaccaa

SEQ ID NO: 1440499 - RNA, 19 nt, Homo sapiens
ggaggaaggguugaaagau

SEQ ID NO: 1440500 - RNA, 19 nt, Homo sapiens
cagaauaauagcuaccauu

SEQ ID NO: 1440501 - RNA, 19 nt, Homo sapiens
gaccuacuccuuuccuguu

SEQ ID NO: 1440502 - RNA, 19 nt, Homo sapiens
gcucauaaaagacaaguaa

SEQ ID NO: 1440503 - RNA, 19 nt, Homo sapiens
agaaucauuugcuacuguu

SEQ ID NO: 1440504 - RNA, 19 nt, Homo sapiens
ccuguucaguuuauacaug

SEQ ID NO: 1440505 - RNA, 19 nt, Homo sapiens
cuacucacacucagauuga

SEQ ID NO: 1440506 - RNA, 19 nt, Homo sapiens
aaagccaccuguacucaca

SEQ ID NO: 1440507 - RNA, 19 nt, Homo sapiens
uccaagugaucaaggcuuu

SEQ ID NO: 1440508 - RNA, 19 nt, Homo sapiens
ugaaaugugaucuccaaga

SEQ ID NO: 1440509 - RNA, 19 nt, Homo sapiens
aaauccaucuucuucuuuc

SEQ ID NO: 1440510 - RNA, 19 nt, Homo sapiens
ucacaaagggaauccuaga

SEQ ID NO: 1440511 - RNA, 19 nt, Homo sapiens
gagauuacuauucugacuu

SEQ ID NO: 1440512 - RNA, 19 nt, Homo sapiens
gaacugagguugugaugaa

SEQ ID NO: 1440513 - RNA, 19 nt, Homo sapiens
ggugauugcugaagaauua

SEQ ID NO: 1440514 - RNA, 19 nt, Homo sapiens
gcaaaggaauuaaaccaaa

SEQ ID NO: 1440515 - RNA, 19 nt, Homo sapiens
uaucagagcugucuuccua

SEQ ID NO: 1440516 - RNA, 19 nt, Homo sapiens
gaaauuggaugacaaggau

SEQ ID NO: 1440517 - RNA, 19 nt, Homo sapiens
gcaaucaacuuuaaugaag

SEQ ID NO: 1440518 - RNA, 19 nt, Homo sapiens
agagaaagcuguccaaauc

SEQ ID NO: 1440519 - RNA, 19 nt, Homo sapiens
gcagaugcauggacuguau

SEQ ID NO: 1440520 - RNA, 19 nt, Homo sapiens
gaagaagaauuacaagaac

SEQ ID NO: 1440521 - RNA, 19 nt, Homo sapiens
gacgaaauauacuugguuu

SEQ ID NO: 1440522 - RNA, 19 nt, Homo sapiens
acaaggauuucuucaguaa

SEQ ID NO: 1440523 - RNA, 19 nt, Homo sapiens
gacaaggauuucuucagua

SEQ ID NO: 1440524 - RNA, 19 nt, Homo sapiens
guuaagcccuuguauuguu

SEQ ID NO: 1440525 - RNA, 19 nt, Homo sapiens
caucagaaauguaugaauc

SEQ ID NO: 1440526 - RNA, 19 nt, Homo sapiens
ggacggugaugaugggauu

SEQ ID NO: 1440527 - RNA, 19 nt, Homo sapiens
gaacucaggcacugugauu

SEQ ID NO: 1440528 - RNA, 19 nt, Homo sapiens
ggaaaucauucaaaguauc

SEQ ID NO: 1440529 - RNA, 19 nt, Homo sapiens
ccugacaucuccaacauuu

SEQ ID NO: 1440530 - RNA, 19 nt, Homo sapiens
gcaugucgccuugaaauaa

SEQ ID NO: 1440531 - RNA, 19 nt, Homo sapiens
ugacaaggauuucuucagu

SEQ ID NO: 1440532 - RNA, 19 nt, Homo sapiens
ccaacaacauauacacauu

SEQ ID NO: 1440533 - RNA, 19 nt, Homo sapiens
guaugaaucuuccagaaca

SEQ ID NO: 1440534 - RNA, 19 nt, Homo sapiens
caaaccaaguuguggacua

SEQ ID NO: 1440535 - RNA, 19 nt, Homo sapiens
gaagaugagcaacauuuau

SEQ ID NO: 1440536 - RNA, 19 nt, Homo sapiens
cuacuacuccuguacuuua

SEQ ID NO: 1440537 - RNA, 19 nt, Homo sapiens
ccaaggaggcaucgcaaua

SEQ ID NO: 1440538 - RNA, 19 nt, Homo sapiens
ugacaggacugaggugauu

SEQ ID NO: 1440539 - RNA, 19 nt, Homo sapiens
gcacggaaauuggaugaca

SEQ ID NO: 1440540 - RNA, 19 nt, Homo sapiens
gaagaauuaucuggcaaug

SEQ ID NO: 1440541 - RNA, 19 nt, Homo sapiens
gaacacagcagggaaaucu

SEQ ID NO: 1440542 - RNA, 19 nt, Homo sapiens
gagaauggagucaggguuu

SEQ ID NO: 1440543 - RNA, 19 nt, Homo sapiens
uacaguagcuauagauuuc

SEQ ID NO: 1440544 - RNA, 19 nt, Homo sapiens
caaauccaguuuacaguag

SEQ ID NO: 1440545 - RNA, 19 nt, Homo sapiens
gcaaugacgacuauguuga

SEQ ID NO: 1440546 - RNA, 19 nt, Homo sapiens
ccaagaagaagaauuacaa

SEQ ID NO: 1440547 - RNA, 19 nt, Homo sapiens
gcaccgaacugagguugug

SEQ ID NO: 1440548 - RNA, 19 nt, Homo sapiens
caggauaccuccagaguac

SEQ ID NO: 1440549 - RNA, 19 nt, Homo sapiens
ccaaauccaguuuacagua

SEQ ID NO: 1440550 - RNA, 19 nt, Homo sapiens
cggcuaaagugcauaguau

SEQ ID NO: 1440551 - RNA, 19 nt, Homo sapiens
gaauguugauagacgaaau

SEQ ID NO: 1440552 - RNA, 19 nt, Homo sapiens
aagccaagaagaagaauua

SEQ ID NO: 1440553 - RNA, 19 nt, Homo sapiens
gaugagaggagcaauggaa

SEQ ID NO: 1440554 - RNA, 19 nt, Homo sapiens
uuaagcccuuguauuguua

SEQ ID NO: 1440555 - RNA, 19 nt, Homo sapiens
ccagaagguugccaaguca

SEQ ID NO: 1440556 - RNA, 19 nt, Homo sapiens
cacggucucucaugacuuu

SEQ ID NO: 1440557 - RNA, 19 nt, Homo sapiens
ugacuucauuggagaauuc

SEQ ID NO: 1440558 - RNA, 19 nt, Homo sapiens
ggaaauuggaugacaagga

SEQ ID NO: 1440559 - RNA, 19 nt, Homo sapiens
caacacacugggaaucuuu

SEQ ID NO: 1440560 - RNA, 19 nt, Homo sapiens
gaaugaagaagaugagcaa

SEQ ID NO: 1440561 - RNA, 19 nt, Homo sapiens
caugucgccuugaaauaaa

SEQ ID NO: 1440562 - RNA, 19 nt, Homo sapiens
augaguaucugaaagcuuu

SEQ ID NO: 1440563 - RNA, 19 nt, Homo sapiens
gagauuggcacacccagaa

SEQ ID NO: 1440564 - RNA, 19 nt, Homo sapiens
ugaauucucucuccacucu

SEQ ID NO: 1440565 - RNA, 19 nt, Homo sapiens
caaagaaacacagauaaca

SEQ ID NO: 1440566 - RNA, 19 nt, Homo sapiens
cagaugguguuaucacaga

SEQ ID NO: 1440567 - RNA, 19 nt, Homo sapiens
gaagacaacccagaaugug

SEQ ID NO: 1440568 - RNA, 19 nt, Homo sapiens
gaccugacaucuccaacau

SEQ ID NO: 1440569 - RNA, 19 nt, Homo sapiens
acacuuggccagauuguuu

SEQ ID NO: 1440570 - RNA, 19 nt, Homo sapiens
uaaacccaguguacucaaa

SEQ ID NO: 1440571 - RNA, 19 nt, Homo sapiens
ugaagaagaugagcaacau

SEQ ID NO: 1440572 - RNA, 19 nt, Homo sapiens
gauagacgaaauauacuug

SEQ ID NO: 1440573 - RNA, 19 nt, Homo sapiens
gcccuuguauuguuaacuu

SEQ ID NO: 1440574 - RNA, 19 nt, Homo sapiens
guacaaagccaagaagaag

SEQ ID NO: 1440575 - RNA, 19 nt, Homo sapiens
gcaucaaucccaaguacaa

SEQ ID NO: 1440576 - RNA, 19 nt, Homo sapiens
gugauucgcaccugcauaa

SEQ ID NO: 1440577 - RNA, 19 nt, Homo sapiens
guugauagacgaaauauac

SEQ ID NO: 1440578 - RNA, 19 nt, Homo sapiens
accaaguuguggacuauua

SEQ ID NO: 1440579 - RNA, 19 nt, Homo sapiens
caagucagcgucagaggaa

SEQ ID NO: 1440580 - RNA, 19 nt, Homo sapiens
ucucaugacuuugcaauca

SEQ ID NO: 1440581 - RNA, 19 nt, Homo sapiens
gagaauucaccucgacauu

SEQ ID NO: 1440582 - RNA, 19 nt, Homo sapiens
ugacagagaugcccuuucc

SEQ ID NO: 1440583 - RNA, 19 nt, Homo sapiens
ccaaccaccuccacuucaa

SEQ ID NO: 1440584 - RNA, 19 nt, Homo sapiens
aaaccaaguuguggacuau

SEQ ID NO: 1440585 - RNA, 19 nt, Homo sapiens
ggagauuugccaagacuau

SEQ ID NO: 1440586 - RNA, 19 nt, Homo sapiens
cuggaaaucauucaaagua

SEQ ID NO: 1440587 - RNA, 19 nt, Homo sapiens
agaauuaucuggcaaugac

SEQ ID NO: 1440588 - RNA, 19 nt, Homo sapiens
gggagagccuguucuucga

SEQ ID NO: 1440589 - RNA, 19 nt, Homo sapiens
ugacgacuauguugagcuu

SEQ ID NO: 1440590 - RNA, 19 nt, Homo sapiens
ccagauuguuucccagaga

SEQ ID NO: 1440591 - RNA, 19 nt, Homo sapiens
agaagaugagcaacauuua

SEQ ID NO: 1440592 - RNA, 19 nt, Homo sapiens
aagaagaugagcaacauuu

SEQ ID NO: 1440593 - RNA, 19 nt, Homo sapiens
gaagaagaugagcaacauu

SEQ ID NO: 1440594 - RNA, 19 nt, Homo sapiens
gcuauaggaugagagacuu

SEQ ID NO: 1440595 - RNA, 19 nt, Homo sapiens
uacaauggcaaaggaauua

SEQ ID NO: 1440596 - RNA, 19 nt, Homo sapiens
ggaggcaucgcaauacuuc

SEQ ID NO: 1440597 - RNA, 19 nt, Homo sapiens
cccagaaugugcaggaauu

SEQ ID NO: 1440598 - RNA, 19 nt, Homo sapiens
caacuuuaaugaagacaac

SEQ ID NO: 1440599 - RNA, 19 nt, Homo sapiens
gugcaagauucacaagaug

SEQ ID NO: 1440600 - RNA, 19 nt, Homo sapiens
gugcacacuuggccagauu

SEQ ID NO: 1440601 - RNA, 19 nt, Homo sapiens
gacagaugguguuaucaca

SEQ ID NO: 1440602 - RNA, 19 nt, Homo sapiens
gagaugcccuuuccaaacc

SEQ ID NO: 1440603 - RNA, 19 nt, Homo sapiens
gaacuucaaacacgcaucu

SEQ ID NO: 1440604 - RNA, 19 nt, Homo sapiens
ugacuuugcaaucaacuuu

SEQ ID NO: 1440605 - RNA, 19 nt, Homo sapiens
ggacuccaauggcaagcau

SEQ ID NO: 1440606 - RNA, 19 nt, Homo sapiens
cugagguugugaugaauaa

SEQ ID NO: 1440607 - RNA, 19 nt, Homo sapiens
cagauuguuucccagagaa

SEQ ID NO: 1440608 - RNA, 19 nt, Homo sapiens
ucaguacccuccucuuuac

SEQ ID NO: 1440609 - RNA, 19 nt, Homo sapiens
ggcagugguuugagguuga

SEQ ID NO: 1440610 - RNA, 19 nt, Homo sapiens
ccacuucaaagccggauuu

SEQ ID NO: 1440611 - RNA, 19 nt, Homo sapiens
gugcaucaaucccaaguac

SEQ ID NO: 1440612 - RNA, 19 nt, Homo sapiens
gaacugaagucaugcagaa

SEQ ID NO: 1440613 - RNA, 19 nt, Homo sapiens
uaaacaaacucaacaguga

SEQ ID NO: 1440614 - RNA, 19 nt, Homo sapiens
cagcagaagugaaagauaa

SEQ ID NO: 1440615 - RNA, 19 nt, Homo sapiens
gaacgucucugcuaauaca

SEQ ID NO: 1440616 - RNA, 19 nt, Homo sapiens
ggaaacaucuuugcaccua

SEQ ID NO: 1440617 - RNA, 19 nt, Homo sapiens
gaacuaaggaucugaaaga

SEQ ID NO: 1440618 - RNA, 19 nt, Homo sapiens
caacaaauguauucucaug

SEQ ID NO: 1440619 - RNA, 19 nt, Homo sapiens
gaagauuacuccagaagau

SEQ ID NO: 1440620 - RNA, 19 nt, Homo sapiens
gagaagaacuugaaauugc

SEQ ID NO: 1440621 - RNA, 19 nt, Homo sapiens
gcaaaucuaucaauuaagg

SEQ ID NO: 1440622 - RNA, 19 nt, Homo sapiens
gcacuacuguuguguauag

SEQ ID NO: 1440623 - RNA, 19 nt, Homo sapiens
gaaggcaaagggacaauua

SEQ ID NO: 1440624 - RNA, 19 nt, Homo sapiens
gcaguaauaucaccucaga

SEQ ID NO: 1440625 - RNA, 19 nt, Homo sapiens
gaaaugcacuacuguugug

SEQ ID NO: 1440626 - RNA, 19 nt, Homo sapiens
ggaaagagaagaacuugaa

SEQ ID NO: 1440627 - RNA, 19 nt, Homo sapiens
gaugugauaucaagacuau

SEQ ID NO: 1440628 - RNA, 19 nt, Homo sapiens
ggagcaaaucuaucaauua

SEQ ID NO: 1440629 - RNA, 19 nt, Homo sapiens
caaacaaccuggucaguca

SEQ ID NO: 1440630 - RNA, 19 nt, Homo sapiens
ccaagaaggucauuugcaa

SEQ ID NO: 1440631 - RNA, 19 nt, Homo sapiens
gggaacgucucugcuaaua

SEQ ID NO: 1440632 - RNA, 19 nt, Homo sapiens
gcaaacaauuucuagauac

SEQ ID NO: 1440633 - RNA, 19 nt, Homo sapiens
gauccgaagugccuauauu

SEQ ID NO: 1440634 - RNA, 19 nt, Homo sapiens
ccucagagauuacacaguu

SEQ ID NO: 1440635 - RNA, 19 nt, Homo sapiens
acaaggagaucuuacaguu

SEQ ID NO: 1440636 - RNA, 19 nt, Homo sapiens
agaggaugcucgaauauuu

SEQ ID NO: 1440637 - RNA, 19 nt, Homo sapiens
cagcaagucuggccaaguu

SEQ ID NO: 1440638 - RNA, 19 nt, Homo sapiens
gaacaguuacagucuaauu

SEQ ID NO: 1440639 - RNA, 19 nt, Homo sapiens
caccuucacuaaagucuua

SEQ ID NO: 1440640 - RNA, 19 nt, Homo sapiens
ggauguaguuuccaaagga

SEQ ID NO: 1440641 - RNA, 19 nt, Homo sapiens
ggaaacagcagugaagaaa

SEQ ID NO: 1440642 - RNA, 19 nt, Homo sapiens
caagaccaaugcagaugua

SEQ ID NO: 1440643 - RNA, 19 nt, Homo sapiens
cagaauaugcucacaaauu

SEQ ID NO: 1440644 - RNA, 19 nt, Homo sapiens
caaguuaucuuugaagcaa

SEQ ID NO: 1440645 - RNA, 19 nt, Homo sapiens
caagacuucugagcuauaa

SEQ ID NO: 1440646 - RNA, 19 nt, Homo sapiens
cagcaacucucucaucuuc

SEQ ID NO: 1440647 - RNA, 19 nt, Homo sapiens
acagugaacuuuaucauuc

SEQ ID NO: 1440648 - RNA, 19 nt, Homo sapiens
gaucagagcccagaauuuc

SEQ ID NO: 1440649 - RNA, 19 nt, Homo sapiens
gcagcuaauuucaaaccua

SEQ ID NO: 1440650 - RNA, 19 nt, Homo sapiens
aaacaaaucuauggucuca

SEQ ID NO: 1440651 - RNA, 19 nt, Homo sapiens
caacugaugcuucaaauag

SEQ ID NO: 1440652 - RNA, 19 nt, Homo sapiens
gcacguuauuugccaugua

SEQ ID NO: 1440653 - RNA, 19 nt, Homo sapiens
agaaaugucucuccucuag

SEQ ID NO: 1440654 - RNA, 19 nt, Homo sapiens
caugagugccugauuguua

SEQ ID NO: 1440655 - RNA, 19 nt, Homo sapiens
gaaccauccuucuggacaa

SEQ ID NO: 1440656 - RNA, 19 nt, Homo sapiens
gcaguuguuuccauuccua

SEQ ID NO: 1440657 - RNA, 19 nt, Homo sapiens
ucaggaaguuucucaguug

SEQ ID NO: 1440658 - RNA, 19 nt, Homo sapiens
aaacagcagugaagaaagu

SEQ ID NO: 1440659 - RNA, 19 nt, Homo sapiens
ggaauggcaucagcuucua

SEQ ID NO: 1440660 - RNA, 19 nt, Homo sapiens
gaaaugugauccagcuucu

SEQ ID NO: 1440661 - RNA, 19 nt, Homo sapiens
gagaaggucaugagaguga

SEQ ID NO: 1440662 - RNA, 19 nt, Homo sapiens
uggaagacauucagcauga

SEQ ID NO: 1440663 - RNA, 19 nt, Homo sapiens
gagcagggacccacuuuga

SEQ ID NO: 1440664 - RNA, 19 nt, Homo sapiens
gcaaugggucagcacuuua

SEQ ID NO: 1440665 - RNA, 19 nt, Homo sapiens
gugcaucucuccacauuca

SEQ ID NO: 1440666 - RNA, 19 nt, Homo sapiens
caagggaaauggcaacauc

SEQ ID NO: 1440667 - RNA, 19 nt, Homo sapiens
gaagacaaagucaaaggaa

SEQ ID NO: 1440668 - RNA, 19 nt, Homo sapiens
ucaaugacaugauuuaagg

SEQ ID NO: 1440669 - RNA, 19 nt, Homo sapiens
gaaagauaacaaagccaua

SEQ ID NO: 1440670 - RNA, 19 nt, Homo sapiens
gcaacucucucaucuucug

SEQ ID NO: 1440671 - RNA, 19 nt, Homo sapiens
gaaagagaagaacuugaaa

SEQ ID NO: 1440672 - RNA, 19 nt, Homo sapiens
gaaaggggauuuaauugga

SEQ ID NO: 1440673 - RNA, 19 nt, Homo sapiens
gauaacaaagccauaaaug

SEQ ID NO: 1440674 - RNA, 19 nt, Homo sapiens
caagaagguuggaagcaau

SEQ ID NO: 1440675 - RNA, 19 nt, Homo sapiens
gaaauggcaacaucaacaa

SEQ ID NO: 1440676 - RNA, 19 nt, Homo sapiens
aaacgugacagcaaucaua

SEQ ID NO: 1440677 - RNA, 19 nt, Homo sapiens
cagcauuuccggaguauaa

SEQ ID NO: 1440678 - RNA, 19 nt, Homo sapiens
caacuuuguagcaguaaua

SEQ ID NO: 1440679 - RNA, 19 nt, Homo sapiens
gguaaagacaugagaaaug

SEQ ID NO: 1440680 - RNA, 19 nt, Homo sapiens
acagugagguaacaacauu

SEQ ID NO: 1440681 - RNA, 19 nt, Homo sapiens
aaaccaagcaggaaauuga

SEQ ID NO: 1440682 - RNA, 19 nt, Homo sapiens
ggaaauggcaacaucaaca

SEQ ID NO: 1440683 - RNA, 19 nt, Homo sapiens
gauuuaagcaccuucacua

SEQ ID NO: 1440684 - RNA, 19 nt, Homo sapiens
gcacuuuccuuucgaacca

SEQ ID NO: 1440685 - RNA, 19 nt, Homo sapiens
gacaaucagucaaauagag

SEQ ID NO: 1440686 - RNA, 19 nt, Homo sapiens
caauuugcauccacuaugu

SEQ ID NO: 1440687 - RNA, 19 nt, Homo sapiens
gcuauaacuugugggagua

SEQ ID NO: 1440688 - RNA, 19 nt, Homo sapiens
gcuauucgcacguuauuug

SEQ ID NO: 1440689 - RNA, 19 nt, Homo sapiens
gauacuagaagcauaauag

SEQ ID NO: 1440690 - RNA, 19 nt, Homo sapiens
uaauaucaccucagacauu

SEQ ID NO: 1440691 - RNA, 19 nt, Homo sapiens
ucaugagagugaugugaua

SEQ ID NO: 1440692 - RNA, 19 nt, Homo sapiens
ugacaucacuaugcacuug

SEQ ID NO: 1440693 - RNA, 19 nt, Homo sapiens
guauaaaguuucugaugca

SEQ ID NO: 1440694 - RNA, 19 nt, Homo sapiens
gagcaguccuuuaucacau

SEQ ID NO: 1440695 - RNA, 19 nt, Homo sapiens
caaaggagaaauuauguuc

SEQ ID NO: 1440696 - RNA, 19 nt, Homo sapiens
gcaacugaugcuucaaaua

SEQ ID NO: 1440697 - RNA, 19 nt, Homo sapiens
gaaggucauuugcaauuuu

SEQ ID NO: 1440698 - RNA, 19 nt, Homo sapiens
aauaucaccucagacauuu

SEQ ID NO: 1440699 - RNA, 19 nt, Homo sapiens
ggcugggacuggcuuauuu

SEQ ID NO: 1440700 - RNA, 19 nt, Homo sapiens
uuaagcaccuucacuaaag

SEQ ID NO: 1440701 - RNA, 19 nt, Homo sapiens
ggucagcacuuuaccuuuu

SEQ ID NO: 1440702 - RNA, 19 nt, Homo sapiens
aaacauggacugaguguca

SEQ ID NO: 1440703 - RNA, 19 nt, Homo sapiens
guacagguauuaaacuacu

SEQ ID NO: 1440704 - RNA, 19 nt, Homo sapiens
ccaagcagcagauaaacaa

SEQ ID NO: 1440705 - RNA, 19 nt, Homo sapiens
ggauauuguucccauaaag

SEQ ID NO: 1440706 - RNA, 19 nt, Homo sapiens
gaagauauauuggguucac

SEQ ID NO: 1440707 - RNA, 19 nt, Homo sapiens
aaaugggucuguggacaua

SEQ ID NO: 1440708 - RNA, 19 nt, Homo sapiens
ugacagacuuugguaacaa

SEQ ID NO: 1440709 - RNA, 19 nt, Homo sapiens
aaggagaucuuacaguugu

SEQ ID NO: 1440710 - RNA, 19 nt, Homo sapiens
gugcgccucuugcgucuuu

SEQ ID NO: 1440711 - RNA, 19 nt, Homo sapiens
gaacaacuuaugucagcaa

SEQ ID NO: 1440712 - RNA, 19 nt, Homo sapiens
ggaagcagcauuaauacua

SEQ ID NO: 1440713 - RNA, 19 nt, Homo sapiens
ccucagagcuacaauuuua

SEQ ID NO: 1440714 - RNA, 19 nt, Homo sapiens
gaagcagcauuaauacuag

SEQ ID NO: 1440715 - RNA, 19 nt, Homo sapiens
gcauauggagccucaagua

SEQ ID NO: 1440716 - RNA, 19 nt, Homo sapiens
guaaaggcgugcagguguu

SEQ ID NO: 1440717 - RNA, 19 nt, Homo sapiens
gcauuaauacuagguguaa

SEQ ID NO: 1440718 - RNA, 19 nt, Homo sapiens
acuagaaggucaagcuaaa

SEQ ID NO: 1440719 - RNA, 19 nt, Homo sapiens
uugcgucgcucucugguaa

SEQ ID NO: 1440720 - RNA, 19 nt, Homo sapiens
uaaaucauccugacaaagg

SEQ ID NO: 1440721 - RNA, 19 nt, Homo sapiens
acgggaagcagcauuaaua

SEQ ID NO: 1440722 - RNA, 19 nt, Homo sapiens
cauauggagccucaaguaa

SEQ ID NO: 1440723 - RNA, 19 nt, Homo sapiens
gcucaucgacgaauuaugc

SEQ ID NO: 1440724 - RNA, 19 nt, Homo sapiens
caucgacgaauuaugcuuu

SEQ ID NO: 1440725 - RNA, 19 nt, Homo sapiens
uuauagagguggguuugaa

SEQ ID NO: 1440726 - RNA, 19 nt, Homo sapiens
cuucagugguggcuauuau

SEQ ID NO: 1440727 - RNA, 19 nt, Homo sapiens
ugcaagccaugaagcauau

SEQ ID NO: 1440728 - RNA, 19 nt, Homo sapiens
gccaauaaagggaaaauaa

SEQ ID NO: 1440729 - RNA, 19 nt, Homo sapiens
uaagcccuacugccaauaa

SEQ ID NO: 1440730 - RNA, 19 nt, Homo sapiens
uauggagccucaaguaaaa

SEQ ID NO: 1440731 - RNA, 19 nt, Homo sapiens
auauggagccucaaguaaa

SEQ ID NO: 1440732 - RNA, 19 nt, Homo sapiens
uguaagcccuacugccaau

SEQ ID NO: 1440733 - RNA, 19 nt, Homo sapiens
cauggccaguacaguggua

SEQ ID NO: 1440734 - RNA, 19 nt, Homo sapiens
aaacgggaagcagcauuaa

SEQ ID NO: 1440735 - RNA, 19 nt, Homo sapiens
ugccucagagcuacaauuu

SEQ ID NO: 1440736 - RNA, 19 nt, Homo sapiens
uugcaagccaugaagcaua

SEQ ID NO: 1440737 - RNA, 19 nt, Homo sapiens
gaaaauaagagaugcucau

SEQ ID NO: 1440738 - RNA, 19 nt, Homo sapiens
uuacuagaaggucaagcua

SEQ ID NO: 1440739 - RNA, 19 nt, Homo sapiens
cgacgaauuaugcuuuuaa

SEQ ID NO: 1440740 - RNA, 19 nt, Homo sapiens
aagcccuacugccaauaaa

SEQ ID NO: 1440741 - RNA, 19 nt, Homo sapiens
uaaaggcgugcagguguug

SEQ ID NO: 1440742 - RNA, 19 nt, Homo sapiens
uuucaaagccuaccaaaau

SEQ ID NO: 1440743 - RNA, 19 nt, Homo sapiens
gcaggaaacucuucucuga

SEQ ID NO: 1440744 - RNA, 19 nt, Homo sapiens
ccaaggagauccagguuaa

SEQ ID NO: 1440745 - RNA, 19 nt, Homo sapiens
gaucaugaguccugugaaa

SEQ ID NO: 1440746 - RNA, 19 nt, Homo sapiens
ggacagcugggucuucaua

SEQ ID NO: 1440747 - RNA, 19 nt, Homo sapiens
ccaacuacuuugcguuuaa

SEQ ID NO: 1440748 - RNA, 19 nt, Homo sapiens
gcccagacacaaacaaaua

SEQ ID NO: 1440749 - RNA, 19 nt, Homo sapiens
guacaaguguggccucauc

SEQ ID NO: 1440750 - RNA, 19 nt, Homo sapiens
caacuacuuugcguuuaaa

SEQ ID NO: 1440751 - RNA, 19 nt, Homo sapiens
gaaggcauuugacauguac

SEQ ID NO: 1440752 - RNA, 19 nt, Homo sapiens
gaugaaagcaggaaacucu

SEQ ID NO: 1440753 - RNA, 19 nt, Homo sapiens
ggacagaaggcauuugaca

SEQ ID NO: 1440754 - RNA, 19 nt, Homo sapiens
gacuugagcccaauuaaau

SEQ ID NO: 1440755 - RNA, 19 nt, Homo sapiens
ggaccaaaaugaacgauga

SEQ ID NO: 1440756 - RNA, 19 nt, Homo sapiens
cuagugaaauuccuuaaag

SEQ ID NO: 1440757 - RNA, 19 nt, Homo sapiens
gaaacucuucucugacuug

SEQ ID NO: 1440758 - RNA, 19 nt, Homo sapiens
cauguacucuggagauguu

SEQ ID NO: 1440759 - RNA, 19 nt, Homo sapiens
gaacagcccagacacaaac

SEQ ID NO: 1440760 - RNA, 19 nt, Homo sapiens
agaaggcauuugacaugua

SEQ ID NO: 1440761 - RNA, 19 nt, Homo sapiens
gggcagaggccuaaacauc

SEQ ID NO: 1440762 - RNA, 19 nt, Homo sapiens
gaagcuccugccugacuua

SEQ ID NO: 1440763 - RNA, 19 nt, Homo sapiens
ccaaagaccucagggguaa

SEQ ID NO: 1440764 - RNA, 19 nt, Homo sapiens
gccaacuacuuugcguuua

SEQ ID NO: 1440765 - RNA, 19 nt, Homo sapiens
gauguuaugcaccuaguga

SEQ ID NO: 1440766 - RNA, 19 nt, Homo sapiens
gacaaacugcccagacuug

SEQ ID NO: 1440767 - RNA, 19 nt, Homo sapiens
ggaaacucuucucugacuu

SEQ ID NO: 1440768 - RNA, 19 nt, Homo sapiens
ggacaaacugcccagacuu

SEQ ID NO: 1440769 - RNA, 19 nt, Homo sapiens
gaacgaugaaagcaggaaa

SEQ ID NO: 1440770 - RNA, 19 nt, Homo sapiens
uuaugcaccuagugaaauu

SEQ ID NO: 1440771 - RNA, 19 nt, Homo sapiens
aaacaucgcccuggugaau

SEQ ID NO: 1440772 - RNA, 19 nt, Homo sapiens
cagaaggcauuugacaugu

SEQ ID NO: 1440773 - RNA, 19 nt, Homo sapiens
acagaaggcauuugacaug

SEQ ID NO: 1440774 - RNA, 19 nt, Homo sapiens
gcacauccuacccggaaga

SEQ ID NO: 1440775 - RNA, 19 nt, Homo sapiens
ggauguuuauucgaagcua

SEQ ID NO: 1440776 - RNA, 19 nt, Homo sapiens
agacuugagcccaauuaaa

SEQ ID NO: 1440777 - RNA, 19 nt, Homo sapiens
ccagacuugagcccaauua

SEQ ID NO: 1440778 - RNA, 19 nt, Homo sapiens
ccuccuggcccucaucuuu

SEQ ID NO: 1440779 - RNA, 19 nt, Homo sapiens
gacauguacucuggagaug

SEQ ID NO: 1440780 - RNA, 19 nt, Homo sapiens
gcccuacuaugugcuuuga

SEQ ID NO: 1440781 - RNA, 19 nt, Homo sapiens
gagauguuaugcaccuagu

SEQ ID NO: 1440782 - RNA, 19 nt, Homo sapiens
gagagugucaggugugcuu

SEQ ID NO: 1440783 - RNA, 19 nt, Homo sapiens
uuaaagaacagcccagaca

SEQ ID NO: 1440784 - RNA, 19 nt, Homo sapiens
ccuuugagcaguucuuaaa

SEQ ID NO: 1440785 - RNA, 19 nt, Homo sapiens
gaaagcaggaaacucuucu

SEQ ID NO: 1440786 - RNA, 19 nt, Homo sapiens
gcccucaucuuugccauag

SEQ ID NO: 1440787 - RNA, 19 nt, Homo sapiens
cagagcugcuggagaugga

SEQ ID NO: 1440788 - RNA, 19 nt, Homo sapiens
ugacauguacucuggagau

SEQ ID NO: 1440789 - RNA, 19 nt, Homo sapiens
ccuacuaugugcuuugaag

SEQ ID NO: 1440790 - RNA, 19 nt, Homo sapiens
ccagcugucuguggagaga

SEQ ID NO: 1440791 - RNA, 19 nt, Homo sapiens
gcaccuagugaaauuccuu

SEQ ID NO: 1440792 - RNA, 19 nt, Homo sapiens
ccucaucuuugccauaguc

SEQ ID NO: 1440793 - RNA, 19 nt, Homo sapiens
aggaaacucuucucugacu

SEQ ID NO: 1440794 - RNA, 19 nt, Homo sapiens
gaggugggacugucagaag

SEQ ID NO: 1440795 - RNA, 19 nt, Homo sapiens
cgggacagcugggucuuca

SEQ ID NO: 1440796 - RNA, 19 nt, Homo sapiens
gacagaaggcauuugacau

SEQ ID NO: 1440797 - RNA, 19 nt, Homo sapiens
cagcugggucuucauagga

SEQ ID NO: 1440798 - RNA, 19 nt, Homo sapiens
ccuagugaaauuccuuaaa

SEQ ID NO: 1440799 - RNA, 19 nt, Homo sapiens
ggaggugggacugucagaa

SEQ ID NO: 1440800 - RNA, 19 nt, Homo sapiens
aaagaacagcccagacaca

SEQ ID NO: 1440801 - RNA, 19 nt, Homo sapiens
agaggagggccgucuguga

SEQ ID NO: 1440802 - RNA, 19 nt, Homo sapiens
cagcccagacacaaacaaa

SEQ ID NO: 1440803 - RNA, 19 nt, Homo sapiens
caaggagauccagguuaaa

SEQ ID NO: 1440804 - RNA, 19 nt, Homo sapiens
ugaaagcaggaaacucuuc

SEQ ID NO: 1440805 - RNA, 19 nt, Homo sapiens
cagacuugagcccaauuaa

SEQ ID NO: 1440806 - RNA, 19 nt, Homo sapiens
gcccagacuugagcccaau

SEQ ID NO: 1440807 - RNA, 19 nt, Homo sapiens
agaagcuccugccugacuu

SEQ ID NO: 1440808 - RNA, 19 nt, Homo sapiens
agaacagcccagacacaaa

SEQ ID NO: 1440809 - RNA, 19 nt, Homo sapiens
aagaacagcccagacacaa

SEQ ID NO: 1440810 - RNA, 19 nt, Homo sapiens
caccuagugaaauuccuua

SEQ ID NO: 1440811 - RNA, 19 nt, Homo sapiens
guuaugcaccuagugaaau

SEQ ID NO: 1440812 - RNA, 19 nt, Homo sapiens
gucgugggcccuacuaugu

SEQ ID NO: 1440813 - RNA, 19 nt, Homo sapiens
guacucuggagauguuaug

SEQ ID NO: 1440814 - RNA, 19 nt, Homo sapiens
caaguguggccucaucaag

SEQ ID NO: 1440815 - RNA, 19 nt, Homo sapiens
gaaagucucuggauaauuu

SEQ ID NO: 1440816 - RNA, 19 nt, Homo sapiens
gcaguuauauggaguauuu

SEQ ID NO: 1440817 - RNA, 19 nt, Homo sapiens
caacguaaguaucacauua

SEQ ID NO: 1440818 - RNA, 19 nt, Homo sapiens
ggaaaugucuacaauguga

SEQ ID NO: 1440819 - RNA, 19 nt, Homo sapiens
gcagaggguucaucaauaa

SEQ ID NO: 1440820 - RNA, 19 nt, Homo sapiens
gcaaauguuucuucaguuu

SEQ ID NO: 1440821 - RNA, 19 nt, Homo sapiens
gaaauaugcugguaaaucu

SEQ ID NO: 1440822 - RNA, 19 nt, Homo sapiens
caacauuugugacccauua

SEQ ID NO: 1440823 - RNA, 19 nt, Homo sapiens
uggaauaccugguuaauaa

SEQ ID NO: 1440824 - RNA, 19 nt, Homo sapiens
ggaggaaguguuuauauua

SEQ ID NO: 1440825 - RNA, 19 nt, Homo sapiens
uaauaggacuggccaauuu

SEQ ID NO: 1440826 - RNA, 19 nt, Homo sapiens
gaagggacccacaaguuua

SEQ ID NO: 1440827 - RNA, 19 nt, Homo sapiens
ggaagaaucagaguuauaa

SEQ ID NO: 1440828 - RNA, 19 nt, Homo sapiens
caaaggaaaugucuacaau

SEQ ID NO: 1440829 - RNA, 19 nt, Homo sapiens
gauggcagauggaauguuu

SEQ ID NO: 1440830 - RNA, 19 nt, Homo sapiens
aaacagaucuggcacugaa

SEQ ID NO: 1440831 - RNA, 19 nt, Homo sapiens
gaaacaaccuggugguauc

SEQ ID NO: 1440832 - RNA, 19 nt, Homo sapiens
uaacugaccauacuacuaa

SEQ ID NO: 1440833 - RNA, 19 nt, Homo sapiens
ccaauuugccugaauauuu

SEQ ID NO: 1440834 - RNA, 19 nt, Homo sapiens
gaauugccauguuaacuau

SEQ ID NO: 1440835 - RNA, 19 nt, Homo sapiens
ggaagggacccacaaguuu

SEQ ID NO: 1440836 - RNA, 19 nt, Homo sapiens
gguaaggucugaugacaug

SEQ ID NO: 1440837 - RNA, 19 nt, Homo sapiens
gcaauugcuucaaaggaaa

SEQ ID NO: 1440838 - RNA, 19 nt, Homo sapiens
gcacauuugucagcacuuu

SEQ ID NO: 1440839 - RNA, 19 nt, Homo sapiens
ucuaugaccuccuguguuu

SEQ ID NO: 1440840 - RNA, 19 nt, Homo sapiens
gcaagaugaugcucagguu

SEQ ID NO: 1440841 - RNA, 19 nt, Homo sapiens
gcuauuacgaugaagauua

SEQ ID NO: 1440842 - RNA, 19 nt, Homo sapiens
caucauaaauggaagaauc

SEQ ID NO: 1440843 - RNA, 19 nt, Homo sapiens
gggcuucuuuacaaauuua

SEQ ID NO: 1440844 - RNA, 19 nt, Homo sapiens
caauuugccugaauauuuc

SEQ ID NO: 1440845 - RNA, 19 nt, Homo sapiens
gccauugauucuacgauua

SEQ ID NO: 1440846 - RNA, 19 nt, Homo sapiens
gcauaaugauagugaaaga

SEQ ID NO: 1440847 - RNA, 19 nt, Homo sapiens
ggaagcaacguaaguauca

SEQ ID NO: 1440848 - RNA, 19 nt, Homo sapiens
ugaaccugcuccuuuauaa

SEQ ID NO: 1440849 - RNA, 19 nt, Homo sapiens
cuacuaaugugacccugua

SEQ ID NO: 1440850 - RNA, 19 nt, Homo sapiens
gaaguguuccgauuuguga

SEQ ID NO: 1440851 - RNA, 19 nt, Homo sapiens
cgauuaaguucugugaaua

SEQ ID NO: 1440852 - RNA, 19 nt, Homo sapiens
caauugcuguaaucacuaa

SEQ ID NO: 1440853 - RNA, 19 nt, Homo sapiens
gacauucgauaugaucuuu

SEQ ID NO: 1440854 - RNA, 19 nt, Homo sapiens
gcagugagguaacuaugca

SEQ ID NO: 1440855 - RNA, 19 nt, Homo sapiens
gugcaaauguuucuucagu

SEQ ID NO: 1440856 - RNA, 19 nt, Homo sapiens
aaggaaaugucuacaaugu

SEQ ID NO: 1440857 - RNA, 19 nt, Homo sapiens
gaauggcugcgaucaguuu

SEQ ID NO: 1440858 - RNA, 19 nt, Homo sapiens
uuaagugaauugccauuga

SEQ ID NO: 1440859 - RNA, 19 nt, Homo sapiens
uaacucuccucccagguaa

SEQ ID NO: 1440860 - RNA, 19 nt, Homo sapiens
ggaaacaaccuggugguau

SEQ ID NO: 1440861 - RNA, 19 nt, Homo sapiens
uacuagaauugccauguua

SEQ ID NO: 1440862 - RNA, 19 nt, Homo sapiens
caugugaaguuacuagaau

SEQ ID NO: 1440863 - RNA, 19 nt, Homo sapiens
ucuuguaggugucauaauu

SEQ ID NO: 1440864 - RNA, 19 nt, Homo sapiens
ggcccuagaucauuauuca

SEQ ID NO: 1440865 - RNA, 19 nt, Homo sapiens
uuucaugucugaccauauu

SEQ ID NO: 1440866 - RNA, 19 nt, Homo sapiens
caguauagcuugucagcau

SEQ ID NO: 1440867 - RNA, 19 nt, Homo sapiens
uaccugggcuucuuuacaa

SEQ ID NO: 1440868 - RNA, 19 nt, Homo sapiens
ugagguaacuaugcaaaga

SEQ ID NO: 1440869 - RNA, 19 nt, Homo sapiens
ccacaaguuuaguguugaa

SEQ ID NO: 1440870 - RNA, 19 nt, Homo sapiens
gauaugaucuuuuccuuag

SEQ ID NO: 1440871 - RNA, 19 nt, Homo sapiens
caccaacaaucaucagcua

SEQ ID NO: 1440872 - RNA, 19 nt, Homo sapiens
gugcaaguaggaaauauuu

SEQ ID NO: 1440873 - RNA, 19 nt, Homo sapiens
ccuaugcacugaacaaaca

SEQ ID NO: 1440874 - RNA, 19 nt, Homo sapiens
aguauaggauuaccuuuga

SEQ ID NO: 1440875 - RNA, 19 nt, Homo sapiens
cuuugaaccugcuccuuua

SEQ ID NO: 1440876 - RNA, 19 nt, Homo sapiens
ugcagaggguucaucaaua

SEQ ID NO: 1440877 - RNA, 19 nt, Homo sapiens
aauggaagaaucagaguua

SEQ ID NO: 1440878 - RNA, 19 nt, Homo sapiens
aggaggaaguguuuauauu

SEQ ID NO: 1440879 - RNA, 19 nt, Homo sapiens
uuggauaccugagauuuaa

SEQ ID NO: 1440880 - RNA, 19 nt, Homo sapiens
caggaaacccaaaugauga

SEQ ID NO: 1440881 - RNA, 19 nt, Homo sapiens
ccauuggaauaccugguua

SEQ ID NO: 1440882 - RNA, 19 nt, Homo sapiens
uaagugaauugccauugau

SEQ ID NO: 1440883 - RNA, 19 nt, Homo sapiens
gcaugcaaaucaucaagca

SEQ ID NO: 1440884 - RNA, 19 nt, Homo sapiens
gaaacacaagaaucagaaa

SEQ ID NO: 1440885 - RNA, 19 nt, Homo sapiens
ucuggaaagucucuggaua

SEQ ID NO: 1440886 - RNA, 19 nt, Homo sapiens
uuacuauacugcaugcaaa

SEQ ID NO: 1440887 - RNA, 19 nt, Homo sapiens
uaagcuaccuaugcacuga

SEQ ID NO: 1440888 - RNA, 19 nt, Homo sapiens
gguccuagaauaaauguug

SEQ ID NO: 1440889 - RNA, 19 nt, Homo sapiens
acacgugguccuagaauaa

SEQ ID NO: 1440890 - RNA, 19 nt, Homo sapiens
caaguuuaguguugaaugg

SEQ ID NO: 1440891 - RNA, 19 nt, Homo sapiens
gaggguucaucaauaacaa

SEQ ID NO: 1440892 - RNA, 19 nt, Homo sapiens
gaccauacuacuaauguga

SEQ ID NO: 1440893 - RNA, 19 nt, Homo sapiens
gcaaaucaucaagcaauug

SEQ ID NO: 1440894 - RNA, 19 nt, Homo sapiens
uuacuagaauugccauguu

SEQ ID NO: 1440895 - RNA, 19 nt, Homo sapiens
cagcccauguucuuacaaa

SEQ ID NO: 1440896 - RNA, 19 nt, Homo sapiens
ugucugaccauauucauuu

SEQ ID NO: 1440897 - RNA, 19 nt, Homo sapiens
caguccacauucaauauuu

SEQ ID NO: 1440898 - RNA, 19 nt, Homo sapiens
ucaggaaacccaaaugaug

SEQ ID NO: 1440899 - RNA, 19 nt, Homo sapiens
caacaaucaucagcuaucu

SEQ ID NO: 1440900 - RNA, 19 nt, Homo sapiens
ugacuauucugagcuuuau

SEQ ID NO: 1440901 - RNA, 19 nt, Homo sapiens
agguauaguugccaaguaa

SEQ ID NO: 1440902 - RNA, 19 nt, Homo sapiens
ucuccaauuugccugaaua

SEQ ID NO: 1440903 - RNA, 19 nt, Homo sapiens
uaaaucaauccucaaguug

SEQ ID NO: 1440904 - RNA, 19 nt, Homo sapiens
gcaauugcuguaaucacua

SEQ ID NO: 1440905 - RNA, 19 nt, Homo sapiens
agaauugccauguuaacua

SEQ ID NO: 1440906 - RNA, 19 nt, Homo sapiens
uggaacggcugcuguuuca

SEQ ID NO: 1440907 - RNA, 19 nt, Homo sapiens
aaucuacucuucccugugu

SEQ ID NO: 1440908 - RNA, 19 nt, Homo sapiens
gaaucagaguuauaaugag

SEQ ID NO: 1440909 - RNA, 19 nt, Homo sapiens
ggaaagucucuggauaauu

SEQ ID NO: 1440910 - RNA, 19 nt, Homo sapiens
aaguggcccuagaucauua

SEQ ID NO: 1440911 - RNA, 19 nt, Homo sapiens
caggaucaguaauauuuca

SEQ ID NO: 1440912 - RNA, 19 nt, Homo sapiens
caucaggaaacccaaauga

SEQ ID NO: 1440913 - RNA, 19 nt, Homo sapiens
agucagugcuuauggaaau

SEQ ID NO: 1440914 - RNA, 19 nt, Homo sapiens
gaugccaaccuccacagua

SEQ ID NO: 1440915 - RNA, 19 nt, Homo sapiens
cggaguggaugauuaauga

SEQ ID NO: 1440916 - RNA, 19 nt, Homo sapiens
gaugaucucaccacuuuaa

SEQ ID NO: 1440917 - RNA, 19 nt, Homo sapiens
aaaccaaacuaguuacuca

SEQ ID NO: 1440918 - RNA, 19 nt, Homo sapiens
uugaugaucucaccacuuu

SEQ ID NO: 1440919 - RNA, 19 nt, Homo sapiens
gcuauagccuugagaacug

SEQ ID NO: 1440920 - RNA, 19 nt, Homo sapiens
uuaaugaaguagcaucuga

SEQ ID NO: 1440921 - RNA, 19 nt, Homo sapiens
uaugucauguuccgcuuua

SEQ ID NO: 1440922 - RNA, 19 nt, Homo sapiens
gagaagacaauuaaaugug

SEQ ID NO: 1440923 - RNA, 19 nt, Homo sapiens
gaugauuaaugaaguagca

SEQ ID NO: 1440924 - RNA, 19 nt, Homo sapiens
acaauuaaaugugccaaga

SEQ ID NO: 1440925 - RNA, 19 nt, Homo sapiens
guggaugauuaaugaagua

SEQ ID NO: 1440926 - RNA, 19 nt, Homo sapiens
ccgcuuuacugaauccuaa

SEQ ID NO: 1440927 - RNA, 19 nt, Homo sapiens
ccaguugcaucuugugaau

SEQ ID NO: 1440928 - RNA, 19 nt, Homo sapiens
cugcagcacucaccaguug

SEQ ID NO: 1440929 - RNA, 19 nt, Homo sapiens
auggaggccuggauuauuu

SEQ ID NO: 1440930 - RNA, 19 nt, Homo sapiens
ucucaccacuuuaagaguu

SEQ ID NO: 1440931 - RNA, 19 nt, Homo sapiens
gaaccgcugccauauguca

SEQ ID NO: 1440932 - RNA, 19 nt, Homo sapiens
gauggaggccuggauuauu

SEQ ID NO: 1440933 - RNA, 19 nt, Homo sapiens
gcacaguggcuaagaaacu

SEQ ID NO: 1440934 - RNA, 19 nt, Homo sapiens
aggaaccgcugccauaugu

SEQ ID NO: 1440935 - RNA, 19 nt, Homo sapiens
ggaugcagaauaaaccaaa

SEQ ID NO: 1440936 - RNA, 19 nt, Homo sapiens
gaaugaaggugcuuuucug

SEQ ID NO: 1440937 - RNA, 19 nt, Homo sapiens
gcacucaccaguugcaucu

SEQ ID NO: 1440938 - RNA, 19 nt, Homo sapiens
aguugcaucuugugaauga

SEQ ID NO: 1440939 - RNA, 19 nt, Homo sapiens
cagaauaaaccaaacuagu

SEQ ID NO: 1440940 - RNA, 19 nt, Homo sapiens
gaucucaccacuuuaagag

SEQ ID NO: 1440941 - RNA, 19 nt, Homo sapiens
cugcuucagucaauccuuu

SEQ ID NO: 1440942 - RNA, 19 nt, Homo sapiens
aaauguagguggagcaacu

SEQ ID NO: 1440943 - RNA, 19 nt, Homo sapiens
gcuuuggccucuuucagau

SEQ ID NO: 1440944 - RNA, 19 nt, Homo sapiens
ccauggccaucuacgagaa

SEQ ID NO: 1440945 - RNA, 19 nt, Homo sapiens
gggugugccuggccuacuu

SEQ ID NO: 1440946 - RNA, 19 nt, Homo sapiens
gugccaagaccauuguaaa

SEQ ID NO: 1440947 - RNA, 19 nt, Homo sapiens
gcugccauaugucauguuc

SEQ ID NO: 1440948 - RNA, 19 nt, Homo sapiens
gcagaauaaaccaaacuag

SEQ ID NO: 1440949 - RNA, 19 nt, Homo sapiens
uggagcaacuucccugcaa

SEQ ID NO: 1440950 - RNA, 19 nt, Homo sapiens
aaguggugcuuacaucuug

SEQ ID NO: 1440951 - RNA, 19 nt, Homo sapiens
caaggaaccaaauguaggu

SEQ ID NO: 1440952 - RNA, 19 nt, Homo sapiens
caaguggugcuuacaucuu

SEQ ID NO: 1440953 - RNA, 19 nt, Homo sapiens
gcccuucuuucccuucaga

SEQ ID NO: 1440954 - RNA, 19 nt, Homo sapiens
gguggacugugcccuucuu

SEQ ID NO: 1440955 - RNA, 19 nt, Homo sapiens
guugcacaguggcuaagaa

SEQ ID NO: 1440956 - RNA, 19 nt, Homo sapiens
gagcaacuucccugcaaca

SEQ ID NO: 1440957 - RNA, 19 nt, Homo sapiens
gcaacuucccugcaacaca

SEQ ID NO: 1440958 - RNA, 19 nt, Homo sapiens
acucaccaguugcaucuug

SEQ ID NO: 1440959 - RNA, 19 nt, Homo sapiens
gcuugcugcuucagucaau

SEQ ID NO: 1440960 - RNA, 19 nt, Homo sapiens
ccaaacuaguuacucaaaa

SEQ ID NO: 1440961 - RNA, 19 nt, Homo sapiens
ggacugugcccuucuuucc

SEQ ID NO: 1440962 - RNA, 19 nt, Homo sapiens
gcacgguggcuggaugguu

SEQ ID NO: 1440963 - RNA, 19 nt, Homo sapiens
ggcuuuggccucuuucaga

SEQ ID NO: 1440964 - RNA, 19 nt, Homo sapiens
uaaugaaguagcaucugaa

SEQ ID NO: 1440965 - RNA, 19 nt, Homo sapiens
ggaguggaugauuaaugaa

SEQ ID NO: 1440966 - RNA, 19 nt, Homo sapiens
ugaaggugcuuuucugcuu

SEQ ID NO: 1440967 - RNA, 19 nt, Homo sapiens
cgauggaggccuggauuau

SEQ ID NO: 1440968 - RNA, 19 nt, Homo sapiens
gaugcagaauaaaccaaac

SEQ ID NO: 1440969 - RNA, 19 nt, Homo sapiens
caagaccauuguaaaagga

SEQ ID NO: 1440970 - RNA, 19 nt, Homo sapiens
aaugaaguagcaucugaaa

SEQ ID NO: 1440971 - RNA, 19 nt, Homo sapiens
gaaggcauccgugguucuc

SEQ ID NO: 1440972 - RNA, 19 nt, Homo sapiens
gaguggaugauuaaugaag

SEQ ID NO: 1440973 - RNA, 19 nt, Homo sapiens
caggaaccgcugccauaug

SEQ ID NO: 1440974 - RNA, 19 nt, Homo sapiens
ccacagagcucaaugacau

SEQ ID NO: 1440975 - RNA, 19 nt, Homo sapiens
gcagauaugucuccuucuu

SEQ ID NO: 1440976 - RNA, 19 nt, Homo sapiens
agauaugucuccuucuuua

SEQ ID NO: 1440977 - RNA, 19 nt, Homo sapiens
gaaagggaagugcugcuua

SEQ ID NO: 1440978 - RNA, 19 nt, Homo sapiens
uaaagugccuucugagcaa

SEQ ID NO: 1440979 - RNA, 19 nt, Homo sapiens
acacagggcugaccaguuc

SEQ ID NO: 1440980 - RNA, 19 nt, Homo sapiens
gcaaguuccucgacugugu

SEQ ID NO: 1440981 - RNA, 19 nt, Homo sapiens
gggcaagggugagaaacua

SEQ ID NO: 1440982 - RNA, 19 nt, Homo sapiens
aaugacaucuggagguaua

SEQ ID NO: 1440983 - RNA, 19 nt, Homo sapiens
ucaaugacaucuggaggua

SEQ ID NO: 1440984 - RNA, 19 nt, Homo sapiens
gcgcauacuuccugcaguu

SEQ ID NO: 1440985 - RNA, 19 nt, Homo sapiens
ugagugugcuggcaaaguu

SEQ ID NO: 1440986 - RNA, 19 nt, Homo sapiens
gaccaguucugccgaagug

SEQ ID NO: 1440987 - RNA, 19 nt, Homo sapiens
gauaagggcacaagcaaag

SEQ ID NO: 1440988 - RNA, 19 nt, Homo sapiens
caacgaagacaacaaagag

SEQ ID NO: 1440989 - RNA, 19 nt, Homo sapiens
cuacaacgaagacaacaaa

SEQ ID NO: 1440990 - RNA, 19 nt, Homo sapiens
gaaggaggaggcaguguuc

SEQ ID NO: 1440991 - RNA, 19 nt, Homo sapiens
ucaccacgcugcggaagaa

SEQ ID NO: 1440992 - RNA, 19 nt, Homo sapiens
cauacuuccugcaguuuga

SEQ ID NO: 1440993 - RNA, 19 nt, Homo sapiens
gugcugcgccugacuaaga

SEQ ID NO: 1440994 - RNA, 19 nt, Homo sapiens
aaagggaagugcugcuuag

SEQ ID NO: 1440995 - RNA, 19 nt, Homo sapiens
gagagcugguucccacaga

SEQ ID NO: 1440996 - RNA, 19 nt, Homo sapiens
gggccaaggaggcugauaa

SEQ ID NO: 1440997 - RNA, 19 nt, Homo sapiens
gcaaggugcagauggugaa

SEQ ID NO: 1440998 - RNA, 19 nt, Homo sapiens
ccaaagcagaggaggauga

SEQ ID NO: 1440999 - RNA, 19 nt, Homo sapiens
guacagugcagauaugucu

SEQ ID NO: 1441000 - RNA, 19 nt, Homo sapiens
gcuggaccauggcaaguuc

SEQ ID NO: 1441001 - RNA, 19 nt, Homo sapiens
gcaguguacagugcagaua

SEQ ID NO: 1441002 - RNA, 19 nt, Homo sapiens
gcaagggugagaaacuaga

SEQ ID NO: 1441003 - RNA, 19 nt, Homo sapiens
gaggcgagcgugcaggauu

SEQ ID NO: 1441004 - RNA, 19 nt, Homo sapiens
ccacaggacucagccuucu

SEQ ID NO: 1441005 - RNA, 19 nt, Homo sapiens
ggaaagggaagugcugcuu

SEQ ID NO: 1441006 - RNA, 19 nt, Homo sapiens
gguauaacgaggaggagaa

SEQ ID NO: 1441007 - RNA, 19 nt, Homo sapiens
gcgccugacuaagauguga

SEQ ID NO: 1441008 - RNA, 19 nt, Homo sapiens
uaacgaggaggagaagaaa

SEQ ID NO: 1441009 - RNA, 19 nt, Homo sapiens
cuggaggccucuucuacaa

SEQ ID NO: 1441010 - RNA, 19 nt, Homo sapiens
cagauaugucuccuucuuu

SEQ ID NO: 1441011 - RNA, 19 nt, Homo sapiens
gcacuaccuguacacauca

SEQ ID NO: 1441012 - RNA, 19 nt, Homo sapiens
caagacgggcucaaagaca

SEQ ID NO: 1441013 - RNA, 19 nt, Homo sapiens
uuccugggauccucaauga

SEQ ID NO: 1441014 - RNA, 19 nt, Homo sapiens
aggcgagcgugcaggauuu

SEQ ID NO: 1441015 - RNA, 19 nt, Homo sapiens
cuugauccaugaaccagaa

SEQ ID NO: 1441016 - RNA, 19 nt, Homo sapiens
uggacucggucaugugcua

SEQ ID NO: 1441017 - RNA, 19 nt, Homo sapiens
gcauacuuccugcaguuug

SEQ ID NO: 1441018 - RNA, 19 nt, Homo sapiens
gagcgugcaggauuuguuc

SEQ ID NO: 1441019 - RNA, 19 nt, Homo sapiens
cuagaggcuucuccagugu

SEQ ID NO: 1441020 - RNA, 19 nt, Homo sapiens
ccaguucugccgaagugua

SEQ ID NO: 1441021 - RNA, 19 nt, Homo sapiens
ccaaggagaaccaggucuu

SEQ ID NO: 1441022 - RNA, 19 nt, Homo sapiens
gggcacaagcaaagccaaa

SEQ ID NO: 1441023 - RNA, 19 nt, Homo sapiens
gcaagacgggcucaaagac

SEQ ID NO: 1441024 - RNA, 19 nt, Homo sapiens
gagcucaucgccaucaucu

SEQ ID NO: 1441025 - RNA, 19 nt, Homo sapiens
gaaagcagggguacagaga

SEQ ID NO: 1441026 - RNA, 19 nt, Homo sapiens
gccgaaguguacagcauca

SEQ ID NO: 1441027 - RNA, 19 nt, Homo sapiens
cuucuccaguguugccaua

SEQ ID NO: 1441028 - RNA, 19 nt, Homo sapiens
agaggcuucuccaguguug

SEQ ID NO: 1441029 - RNA, 19 nt, Homo sapiens
acaacgaagacaacaaaga

SEQ ID NO: 1441030 - RNA, 19 nt, Homo sapiens
cagcaucacagacaacaag

SEQ ID NO: 1441031 - RNA, 19 nt, Homo sapiens
cggaggagcagcgguugua

SEQ ID NO: 1441032 - RNA, 19 nt, Homo sapiens
ugcaggaucucaucuucau

SEQ ID NO: 1441033 - RNA, 19 nt, Homo sapiens
gcucagggucugcaucagu

SEQ ID NO: 1441034 - RNA, 19 nt, Homo sapiens
aagacgggcucaaagacau

SEQ ID NO: 1441035 - RNA, 19 nt, Homo sapiens
ccugguggguacccucuau

SEQ ID NO: 1441036 - RNA, 19 nt, Homo sapiens
ccugcaggaucucaucuuc

SEQ ID NO: 1441037 - RNA, 19 nt, Homo sapiens
ugcacuaccuguacacauc

SEQ ID NO: 1441038 - RNA, 19 nt, Homo sapiens
gacacagggcugaccaguu

SEQ ID NO: 1441039 - RNA, 19 nt, Homo sapiens
gcuggaggccucuucuaca

SEQ ID NO: 1441040 - RNA, 19 nt, Homo sapiens
gaugaggaggccgaacgua

SEQ ID NO: 1441041 - RNA, 19 nt, Homo sapiens
gcugauaagggcacaagca

SEQ ID NO: 1441042 - RNA, 19 nt, Homo sapiens
gguacccucuaugccauug

SEQ ID NO: 1441043 - RNA, 19 nt, Homo sapiens
agaaggaggaggcaguguu

SEQ ID NO: 1441044 - RNA, 19 nt, Homo sapiens
gauaugucuccuucuuuag

SEQ ID NO: 1441045 - RNA, 19 nt, Homo sapiens
auaacgaggaggagaagaa

SEQ ID NO: 1441046 - RNA, 19 nt, Homo sapiens
ugauaagggcacaagcaaa

SEQ ID NO: 1441047 - RNA, 19 nt, Homo sapiens
acgaggaggagaagaaaug

SEQ ID NO: 1441048 - RNA, 19 nt, Homo sapiens
caacugcuuggccgucuuc

SEQ ID NO: 1441049 - RNA, 19 nt, Homo sapiens
gaagcucucaacuccaucu

SEQ ID NO: 1441050 - RNA, 19 nt, Homo sapiens
ugaggaggccgaacguauc

SEQ ID NO: 1441051 - RNA, 19 nt, Homo sapiens
cagcucagggucugcauca

SEQ ID NO: 1441052 - RNA, 19 nt, Homo sapiens
gcguguccuuccugcagaa

SEQ ID NO: 1441053 - RNA, 19 nt, Homo sapiens
ccugggauccucaaugaca

SEQ ID NO: 1441054 - RNA, 19 nt, Homo sapiens
ggaggccgaacguauccuu

SEQ ID NO: 1441055 - RNA, 19 nt, Homo sapiens
gcacaagcaaagccaaagc

SEQ ID NO: 1441056 - RNA, 19 nt, Homo sapiens
gccugugccucuccaacug

SEQ ID NO: 1441057 - RNA, 19 nt, Homo sapiens
caaggagaaccaggucuuc

SEQ ID NO: 1441058 - RNA, 19 nt, Homo sapiens
gcacaagcauucuauauau

SEQ ID NO: 1441059 - RNA, 19 nt, Homo sapiens
guggguggcuuuagaauua

SEQ ID NO: 1441060 - RNA, 19 nt, Homo sapiens
ccacagagcugggacuuca

SEQ ID NO: 1441061 - RNA, 19 nt, Homo sapiens
guagagccuuucugucuga

SEQ ID NO: 1441062 - RNA, 19 nt, Homo sapiens
gguaagagggcccaaggua

SEQ ID NO: 1441063 - RNA, 19 nt, Homo sapiens
ccgaguggcucaccucauu

SEQ ID NO: 1441064 - RNA, 19 nt, Homo sapiens
ggcacaagcauucuauaua

SEQ ID NO: 1441065 - RNA, 19 nt, Homo sapiens
gagggagugucucuucuug

SEQ ID NO: 1441066 - RNA, 19 nt, Homo sapiens
gugcagugcuugauagaau

SEQ ID NO: 1441067 - RNA, 19 nt, Homo sapiens
gaacaagaggcucgcuuug

SEQ ID NO: 1441068 - RNA, 19 nt, Homo sapiens
guaagagggcccaagguaa

SEQ ID NO: 1441069 - RNA, 19 nt, Homo sapiens
cggauaaugugaaccacua

SEQ ID NO: 1441070 - RNA, 19 nt, Homo sapiens
caaggucacuggacuguac

SEQ ID NO: 1441071 - RNA, 19 nt, Homo sapiens
cauguacccuccacccuuu

SEQ ID NO: 1441072 - RNA, 19 nt, Homo sapiens
agacagugauguucauguu

SEQ ID NO: 1441073 - RNA, 19 nt, Homo sapiens
ccacugaugacuccuauga

SEQ ID NO: 1441074 - RNA, 19 nt, Homo sapiens
gcucauuagguguuuauuu

SEQ ID NO: 1441075 - RNA, 19 nt, Homo sapiens
gagccuuucugucugaaug

SEQ ID NO: 1441076 - RNA, 19 nt, Homo sapiens
ccucugaccuggccucuuc

SEQ ID NO: 1441077 - RNA, 19 nt, Homo sapiens
gaauugugccagugaguga

SEQ ID NO: 1441078 - RNA, 19 nt, Homo sapiens
gagcugggacuucauguuc

SEQ ID NO: 1441079 - RNA, 19 nt, Homo sapiens
gaacagugacccacaucau

SEQ ID NO: 1441080 - RNA, 19 nt, Homo sapiens
cacauuuccuccucggaua

SEQ ID NO: 1441081 - RNA, 19 nt, Homo sapiens
ggaaugaugaaagcaugua

SEQ ID NO: 1441082 - RNA, 19 nt, Homo sapiens
ggcgaggacuccacugaug

SEQ ID NO: 1441083 - RNA, 19 nt, Homo sapiens
acaagaggcucgcuuugca

SEQ ID NO: 1441084 - RNA, 19 nt, Homo sapiens
gguccucccugcaugguau

SEQ ID NO: 1441085 - RNA, 19 nt, Homo sapiens
gggcacaagcauucuauau

SEQ ID NO: 1441086 - RNA, 19 nt, Homo sapiens
ccacucugcccaccacuaa

SEQ ID NO: 1441087 - RNA, 19 nt, Homo sapiens
gcaggaauugugccaguga

SEQ ID NO: 1441088 - RNA, 19 nt, Homo sapiens
gagccucugugcccaagug

SEQ ID NO: 1441089 - RNA, 19 nt, Homo sapiens
cgaacaagaggcucgcuuu

SEQ ID NO: 1441090 - RNA, 19 nt, Homo sapiens
ggaaggguggguggcuuua

SEQ ID NO: 1441091 - RNA, 19 nt, Homo sapiens
gggaggcuuuggaaugaug

SEQ ID NO: 1441092 - RNA, 19 nt, Homo sapiens
gaggaacagugacccacau

SEQ ID NO: 1441093 - RNA, 19 nt, Homo sapiens
gcccaggacucacucuaca

SEQ ID NO: 1441094 - RNA, 19 nt, Homo sapiens
aggaguggcugagcaguuu

SEQ ID NO: 1441095 - RNA, 19 nt, Homo sapiens
ucagucggaucuucucuuc

SEQ ID NO: 1441096 - RNA, 19 nt, Homo sapiens
ucacuggacuguacguuuu

SEQ ID NO: 1441097 - RNA, 19 nt, Homo sapiens
cagcuaaaggugaauguug

SEQ ID NO: 1441098 - RNA, 19 nt, Homo sapiens
ccagacacccugugcucua

SEQ ID NO: 1441099 - RNA, 19 nt, Homo sapiens
acugaugacuccuaugaug

SEQ ID NO: 1441100 - RNA, 19 nt, Homo sapiens
uaagagggcccaagguaag

SEQ ID NO: 1441101 - RNA, 19 nt, Homo sapiens
ggccaaggcuacaguacag

SEQ ID NO: 1441102 - RNA, 19 nt, Homo sapiens
gaaaggccaaggcuacagu

SEQ ID NO: 1441103 - RNA, 19 nt, Homo sapiens
gcugggacuucauguucuu

SEQ ID NO: 1441104 - RNA, 19 nt, Homo sapiens
gcuucuccguuguguguuu

SEQ ID NO: 1441105 - RNA, 19 nt, Homo sapiens
gggaauggacacagacaug

SEQ ID NO: 1441106 - RNA, 19 nt, Homo sapiens
gggacuucauguucuucua

SEQ ID NO: 1441107 - RNA, 19 nt, Homo sapiens
gcgaggacuccacugauga

SEQ ID NO: 1441108 - RNA, 19 nt, Homo sapiens
cugggaggcuuuggaauga

SEQ ID NO: 1441109 - RNA, 19 nt, Homo sapiens
ggacuucauguucuucuag

SEQ ID NO: 1441110 - RNA, 19 nt, Homo sapiens
ucucuaaaucuuccucuuu

SEQ ID NO: 1441111 - RNA, 19 nt, Homo sapiens
caugugcagugcuugauag

SEQ ID NO: 1441112 - RNA, 19 nt, Homo sapiens
ggugaauguuggagacaca

SEQ ID NO: 1441113 - RNA, 19 nt, Homo sapiens
gacuucauguucuucuaga

SEQ ID NO: 1441114 - RNA, 19 nt, Homo sapiens
ugaaggaccacgugaccaa

SEQ ID NO: 1441115 - RNA, 19 nt, Homo sapiens
ccaacgggcacaagcauuc

SEQ ID NO: 1441116 - RNA, 19 nt, Homo sapiens
gggaaggguggguggcuuu

SEQ ID NO: 1441117 - RNA, 19 nt, Homo sapiens
ggauaaugugaaccacuaa

SEQ ID NO: 1441118 - RNA, 19 nt, Homo sapiens
acagugauguucauguucu

SEQ ID NO: 1441119 - RNA, 19 nt, Homo sapiens
aaggguggguggcuuuaga

SEQ ID NO: 1441120 - RNA, 19 nt, Homo sapiens
ggguguuaaugcccacgua

SEQ ID NO: 1441121 - RNA, 19 nt, Homo sapiens
uguaggcuuuggcagguaa

SEQ ID NO: 1441122 - RNA, 19 nt, Homo sapiens
gaguggcucaccucauuga

SEQ ID NO: 1441123 - RNA, 19 nt, Homo sapiens
gguggguggcuuuagaauu

SEQ ID NO: 1441124 - RNA, 19 nt, Homo sapiens
gugauguucauguucuuaa

SEQ ID NO: 1441125 - RNA, 19 nt, Homo sapiens
ggaacagugacccacauca

SEQ ID NO: 1441126 - RNA, 19 nt, Homo sapiens
ccaugugcagugcuugaua

SEQ ID NO: 1441127 - RNA, 19 nt, Homo sapiens
uauauaaguggcucauuag

SEQ ID NO: 1441128 - RNA, 19 nt, Homo sapiens
ccuggaggauggguuguug

SEQ ID NO: 1441129 - RNA, 19 nt, Homo sapiens
caugagggagugucucuuc

SEQ ID NO: 1441130 - RNA, 19 nt, Homo sapiens
agucggaucuucucuucuc

SEQ ID NO: 1441131 - RNA, 19 nt, Homo sapiens
ggcagacagugauguucau

SEQ ID NO: 1441132 - RNA, 19 nt, Homo sapiens
ccaugccucucucuucucu

SEQ ID NO: 1441133 - RNA, 19 nt, Homo sapiens
ucacagaguccugccuuuc

SEQ ID NO: 1441134 - RNA, 19 nt, Homo sapiens
gcugggcgaugagcugcuu

SEQ ID NO: 1441135 - RNA, 19 nt, Homo sapiens
cagacacccugugcucuag

SEQ ID NO: 1441136 - RNA, 19 nt, Homo sapiens
uggccgaggcucagggaua

SEQ ID NO: 1441137 - RNA, 19 nt, Homo sapiens
gaguccaugugcagugcuu

SEQ ID NO: 1441138 - RNA, 19 nt, Homo sapiens
gguugugacugggcugugu

SEQ ID NO: 1441139 - RNA, 19 nt, Homo sapiens
ucgcgaugcugcccaaguc

SEQ ID NO: 1441140 - RNA, 19 nt, Homo sapiens
gcugagaggcaggaauugu

SEQ ID NO: 1441141 - RNA, 19 nt, Homo sapiens
uauaaguggcucauuaggu

SEQ ID NO: 1441142 - RNA, 19 nt, Homo sapiens
cuagagagggccacaagag

SEQ ID NO: 1441143 - RNA, 19 nt, Homo sapiens
gagcgggagguggaagaaa

SEQ ID NO: 1441144 - RNA, 19 nt, Homo sapiens
gcuaaaggugaauguugga

SEQ ID NO: 1441145 - RNA, 19 nt, Homo sapiens
cugaugacuccuaugauga

SEQ ID NO: 1441146 - RNA, 19 nt, Homo sapiens
ucugggaggcuuuggaaug

SEQ ID NO: 1441147 - RNA, 19 nt, Homo sapiens
uccaucgucucuaaaucuu

SEQ ID NO: 1441148 - RNA, 19 nt, Homo sapiens
gcucgugcugugcuucauu

SEQ ID NO: 1441149 - RNA, 19 nt, Homo sapiens
gauaaugugaaccacuaag

SEQ ID NO: 1441150 - RNA, 19 nt, Homo sapiens
gcagacagugauguucaug

SEQ ID NO: 1441151 - RNA, 19 nt, Homo sapiens
aggcagagccagaggaaca

SEQ ID NO: 1441152 - RNA, 19 nt, Homo sapiens
ugagcugcuucucgccaaa

SEQ ID NO: 1441153 - RNA, 19 nt, Homo sapiens
gaaggcaucugaggcauua

SEQ ID NO: 1441154 - RNA, 19 nt, Homo sapiens
acacagaccuccauacuuu

SEQ ID NO: 1441155 - RNA, 19 nt, Homo sapiens
gaagaacaauccucucuau

SEQ ID NO: 1441156 - RNA, 19 nt, Homo sapiens
caacaaacgagauacauua

SEQ ID NO: 1441157 - RNA, 19 nt, Homo sapiens
gagcaagugugaacaguuu

SEQ ID NO: 1441158 - RNA, 19 nt, Homo sapiens
gaauagaacugcaguaugc

SEQ ID NO: 1441159 - RNA, 19 nt, Homo sapiens
gaagugacccuguuucaaa

SEQ ID NO: 1441160 - RNA, 19 nt, Homo sapiens
gaaaccaacuguacugaug

SEQ ID NO: 1441161 - RNA, 19 nt, Homo sapiens
agaaauaacugaagaagga

SEQ ID NO: 1441162 - RNA, 19 nt, Homo sapiens
gaacaauccucucuaugau

SEQ ID NO: 1441163 - RNA, 19 nt, Homo sapiens
caacaagagucuguacaua

SEQ ID NO: 1441164 - RNA, 19 nt, Homo sapiens
gaaaugcucugcccuugga

SEQ ID NO: 1441165 - RNA, 19 nt, Homo sapiens
caaggagaaucaugcuuua

SEQ ID NO: 1441166 - RNA, 19 nt, Homo sapiens
guucuagaaugaagacuua

SEQ ID NO: 1441167 - RNA, 19 nt, Homo sapiens
gcaggacaguaaauaauga

SEQ ID NO: 1441168 - RNA, 19 nt, Homo sapiens
gcaaggagaaucaugcuuu

SEQ ID NO: 1441169 - RNA, 19 nt, Homo sapiens
ccaaacaacucauuaaugc

SEQ ID NO: 1441170 - RNA, 19 nt, Homo sapiens
cugaagaacugauguuauu

SEQ ID NO: 1441171 - RNA, 19 nt, Homo sapiens
gaaaguacucgcagaaguu

SEQ ID NO: 1441172 - RNA, 19 nt, Homo sapiens
gaagaaggagcaaguguga

SEQ ID NO: 1441173 - RNA, 19 nt, Homo sapiens
gauaucaccuccaaguguu

SEQ ID NO: 1441174 - RNA, 19 nt, Homo sapiens
caacuguacugaugagaga

SEQ ID NO: 1441175 - RNA, 19 nt, Homo sapiens
caagaauacuggagcaaug

SEQ ID NO: 1441176 - RNA, 19 nt, Homo sapiens
guaaagauggcuacaaaug

SEQ ID NO: 1441177 - RNA, 19 nt, Homo sapiens
gguaacaccugaugggaau

SEQ ID NO: 1441178 - RNA, 19 nt, Homo sapiens
aaagugaaguugacacaga

SEQ ID NO: 1441179 - RNA, 19 nt, Homo sapiens
acaagagucuguacauaga

SEQ ID NO: 1441180 - RNA, 19 nt, Homo sapiens
caaccaaacaacucauuaa

SEQ ID NO: 1441181 - RNA, 19 nt, Homo sapiens
ccauauaucauccuuacua

SEQ ID NO: 1441182 - RNA, 19 nt, Homo sapiens
gaaucaugcuuuagcuuca

SEQ ID NO: 1441183 - RNA, 19 nt, Homo sapiens
agaacaauccucucuauga

SEQ ID NO: 1441184 - RNA, 19 nt, Homo sapiens
acacagaacuacucgaaag

SEQ ID NO: 1441185 - RNA, 19 nt, Homo sapiens
gaagccagcugcgcauauc

SEQ ID NO: 1441186 - RNA, 19 nt, Homo sapiens
cgaaaguacucgcagaagu

SEQ ID NO: 1441187 - RNA, 19 nt, Homo sapiens
aaaccaaauuuccucaaga

SEQ ID NO: 1441188 - RNA, 19 nt, Homo sapiens
agaccuccauacuuuauaa

SEQ ID NO: 1441189 - RNA, 19 nt, Homo sapiens
ucaagcaguuuauguaugg

SEQ ID NO: 1441190 - RNA, 19 nt, Homo sapiens
ggauucauuugguuguuga

SEQ ID NO: 1441191 - RNA, 19 nt, Homo sapiens
ggauaucaccuccaagugu

SEQ ID NO: 1441192 - RNA, 19 nt, Homo sapiens
gaauucggaccuucagauu

SEQ ID NO: 1441193 - RNA, 19 nt, Homo sapiens
caaaugagaccaaggaaac

SEQ ID NO: 1441194 - RNA, 19 nt, Homo sapiens
gcacaaaagccuacaagaa

SEQ ID NO: 1441195 - RNA, 19 nt, Homo sapiens
gaagaacugauguuauuac

SEQ ID NO: 1441196 - RNA, 19 nt, Homo sapiens
ccagcuaguucucugaaga

SEQ ID NO: 1441197 - RNA, 19 nt, Homo sapiens
ggacucuaguaccaagaaa

SEQ ID NO: 1441198 - RNA, 19 nt, Homo sapiens
ccuaucgcauuaagaaauu

SEQ ID NO: 1441199 - RNA, 19 nt, Homo sapiens
aaccaaauuuccucaagaa

SEQ ID NO: 1441200 - RNA, 19 nt, Homo sapiens
uuggagaacugcuaaccua

SEQ ID NO: 1441201 - RNA, 19 nt, Homo sapiens
ggaauagaacugcaguaug

SEQ ID NO: 1441202 - RNA, 19 nt, Homo sapiens
aaacaaaugagaccaagga

SEQ ID NO: 1441203 - RNA, 19 nt, Homo sapiens
ggagggugcugcucaacca

SEQ ID NO: 1441204 - RNA, 19 nt, Homo sapiens
uuacagaugcauaauggua

SEQ ID NO: 1441205 - RNA, 19 nt, Homo sapiens
cauuaaugcugcaaacuag

SEQ ID NO: 1441206 - RNA, 19 nt, Homo sapiens
uaaccuagggcuacuguug

SEQ ID NO: 1441207 - RNA, 19 nt, Homo sapiens
gcaacaagagucuguacau

SEQ ID NO: 1441208 - RNA, 19 nt, Homo sapiens
ucuuacaguucuagaauga

SEQ ID NO: 1441209 - RNA, 19 nt, Homo sapiens
ccacuaagcaagaauacug

SEQ ID NO: 1441210 - RNA, 19 nt, Homo sapiens
aaaguacucgcagaaguua

SEQ ID NO: 1441211 - RNA, 19 nt, Homo sapiens
ggagaaucaugcuuuagcu

SEQ ID NO: 1441212 - RNA, 19 nt, Homo sapiens
ucaaccaaacaacucauua

SEQ ID NO: 1441213 - RNA, 19 nt, Homo sapiens
gaggaaaaguacugaguga

SEQ ID NO: 1441214 - RNA, 19 nt, Homo sapiens
cuccagaccugaucagaau

SEQ ID NO: 1441215 - RNA, 19 nt, Homo sapiens
caacaacaaacgagauaca

SEQ ID NO: 1441216 - RNA, 19 nt, Homo sapiens
gcaagaauacuggagcaau

SEQ ID NO: 1441217 - RNA, 19 nt, Homo sapiens
aaagauggcuacaaaugcu

SEQ ID NO: 1441218 - RNA, 19 nt, Homo sapiens
ucauuaaugcugcaaacua

SEQ ID NO: 1441219 - RNA, 19 nt, Homo sapiens
acaauccucucuaugauac

SEQ ID NO: 1441220 - RNA, 19 nt, Homo sapiens
aacagaaucuacuccaguu

SEQ ID NO: 1441221 - RNA, 19 nt, Homo sapiens
gggauucauuugguuguug

SEQ ID NO: 1441222 - RNA, 19 nt, Homo sapiens
ucacucaugacggguauua

SEQ ID NO: 1441223 - RNA, 19 nt, Homo sapiens
ccauuugacuggcaacaag

SEQ ID NO: 1441224 - RNA, 19 nt, Homo sapiens
ggaagccagcugcgcauau

SEQ ID NO: 1441225 - RNA, 19 nt, Homo sapiens
gaccaucgugggauucauu

SEQ ID NO: 1441226 - RNA, 19 nt, Homo sapiens
uaacaccugaugggaauuu

SEQ ID NO: 1441227 - RNA, 19 nt, Homo sapiens
cacaaaagccuacaagaaa

SEQ ID NO: 1441228 - RNA, 19 nt, Homo sapiens
agaaucuacuccaguuguu

SEQ ID NO: 1441229 - RNA, 19 nt, Homo sapiens
ccaaggaaaccaacuguac

SEQ ID NO: 1441230 - RNA, 19 nt, Homo sapiens
caagaaagaaacaaaugag

SEQ ID NO: 1441231 - RNA, 19 nt, Homo sapiens
ggagcaagugugaacaguu

SEQ ID NO: 1441232 - RNA, 19 nt, Homo sapiens
ucauuugguuguugaaagu

SEQ ID NO: 1441233 - RNA, 19 nt, Homo sapiens
acugggagguccacaaugu

SEQ ID NO: 1441234 - RNA, 19 nt, Homo sapiens
caccugaagugacccuguu

SEQ ID NO: 1441235 - RNA, 19 nt, Homo sapiens
ggaaaccaacuguacugau

SEQ ID NO: 1441236 - RNA, 19 nt, Homo sapiens
cucaagaaauaacugaaga

SEQ ID NO: 1441237 - RNA, 19 nt, Homo sapiens
caaauugugcaggacagua

SEQ ID NO: 1441238 - RNA, 19 nt, Homo sapiens
gaugaaaugcagcccuaug

SEQ ID NO: 1441239 - RNA, 19 nt, Homo sapiens
gucaauggcugcagaaaau

SEQ ID NO: 1441240 - RNA, 19 nt, Homo sapiens
cuucauggccuguaaagau

SEQ ID NO: 1441241 - RNA, 19 nt, Homo sapiens
gugcaggacaguaaauaau

SEQ ID NO: 1441242 - RNA, 19 nt, Homo sapiens
gcccaugaccaaauauuca

SEQ ID NO: 1441243 - RNA, 19 nt, Homo sapiens
uuacaguucuagaaugaag

SEQ ID NO: 1441244 - RNA, 19 nt, Homo sapiens
cuagggcuacuguugauuu

SEQ ID NO: 1441245 - RNA, 19 nt, Homo sapiens
ucugaggcauuacaaagug

SEQ ID NO: 1441246 - RNA, 19 nt, Homo sapiens
aaacuagcaaggagaauca

SEQ ID NO: 1441247 - RNA, 19 nt, Homo sapiens
ugccacgucucccauuuga

SEQ ID NO: 1441248 - RNA, 19 nt, Homo sapiens
ggguauuacagaugcauaa

SEQ ID NO: 1441249 - RNA, 19 nt, Homo sapiens
uuacacagaacuacucgaa

SEQ ID NO: 1441250 - RNA, 19 nt, Homo sapiens
aaauugugcaggacaguaa

SEQ ID NO: 1441251 - RNA, 19 nt, Homo sapiens
ucucauucauacccuugua

SEQ ID NO: 1441252 - RNA, 19 nt, Homo sapiens
caagaaacaacaacaaacg

SEQ ID NO: 1441253 - RNA, 19 nt, Homo sapiens
gaauagaacugcaguaugc

SEQ ID NO: 1441254 - RNA, 19 nt, Homo sapiens
gaagugacccuguuucaaa

SEQ ID NO: 1441255 - RNA, 19 nt, Homo sapiens
gaaaccaacuguacugaug

SEQ ID NO: 1441256 - RNA, 19 nt, Homo sapiens
gaaaugcucugcccuugga

SEQ ID NO: 1441257 - RNA, 19 nt, Homo sapiens
caaggagaaucaugcuuua

SEQ ID NO: 1441258 - RNA, 19 nt, Homo sapiens
acaaaugucucucugaauu

SEQ ID NO: 1441259 - RNA, 19 nt, Homo sapiens
guaaggagcaucauauauu

SEQ ID NO: 1441260 - RNA, 19 nt, Homo sapiens
aaacaaaugucucucugaa

SEQ ID NO: 1441261 - RNA, 19 nt, Homo sapiens
gcaaggagaaucaugcuuu

SEQ ID NO: 1441262 - RNA, 19 nt, Homo sapiens
uaaggagcaucauauauug

SEQ ID NO: 1441263 - RNA, 19 nt, Homo sapiens
ccaaacaacucauuaaugc

SEQ ID NO: 1441264 - RNA, 19 nt, Homo sapiens
gaaaguacucgcagaaguu

SEQ ID NO: 1441265 - RNA, 19 nt, Homo sapiens
gauaucaccuccaaguguu

SEQ ID NO: 1441266 - RNA, 19 nt, Homo sapiens
caacuguacugaugagaga

SEQ ID NO: 1441267 - RNA, 19 nt, Homo sapiens
caagaauacuggagcaaug

SEQ ID NO: 1441268 - RNA, 19 nt, Homo sapiens
guaaagauggcuacaaaug

SEQ ID NO: 1441269 - RNA, 19 nt, Homo sapiens
gguaacaccugaugggaau

SEQ ID NO: 1441270 - RNA, 19 nt, Homo sapiens
caaccaaacaacucauuaa

SEQ ID NO: 1441271 - RNA, 19 nt, Homo sapiens
gaaacaaaugucucucuga

SEQ ID NO: 1441272 - RNA, 19 nt, Homo sapiens
gaaucaugcuuuagcuuca

SEQ ID NO: 1441273 - RNA, 19 nt, Homo sapiens
acacagaacuacucgaaag

SEQ ID NO: 1441274 - RNA, 19 nt, Homo sapiens
gaagccagcugcgcauauc

SEQ ID NO: 1441275 - RNA, 19 nt, Homo sapiens
cgaaaguacucgcagaagu

SEQ ID NO: 1441276 - RNA, 19 nt, Homo sapiens
ucaagcaguuuauguaugg

SEQ ID NO: 1441277 - RNA, 19 nt, Homo sapiens
ggauaucaccuccaagugu

SEQ ID NO: 1441278 - RNA, 19 nt, Homo sapiens
gaauucggaccuucagauu

SEQ ID NO: 1441279 - RNA, 19 nt, Homo sapiens
caaaugagaccaaggaaac

SEQ ID NO: 1441280 - RNA, 19 nt, Homo sapiens
gcacaaaagccuacaagaa

SEQ ID NO: 1441281 - RNA, 19 nt, Homo sapiens
ccuaucgcauuaagaaauu

SEQ ID NO: 1441282 - RNA, 19 nt, Homo sapiens
ggaauagaacugcaguaug

SEQ ID NO: 1441283 - RNA, 19 nt, Homo sapiens
gcaguuacaccugaaguga

SEQ ID NO: 1441284 - RNA, 19 nt, Homo sapiens
uuggagaacugcuaaccua

SEQ ID NO: 1441285 - RNA, 19 nt, Homo sapiens
aaacaaaugagaccaagga

SEQ ID NO: 1441286 - RNA, 19 nt, Homo sapiens
gguaaggagcaucauauau

SEQ ID NO: 1441287 - RNA, 19 nt, Homo sapiens
uuacagaugcauaauggua

SEQ ID NO: 1441288 - RNA, 19 nt, Homo sapiens
cauuaaugcugcaaacuag

SEQ ID NO: 1441289 - RNA, 19 nt, Homo sapiens
ggagggugcugcucaacca

SEQ ID NO: 1441290 - RNA, 19 nt, Homo sapiens
uaaccuagggcuacuguug

SEQ ID NO: 1441291 - RNA, 19 nt, Homo sapiens
ccacuaagcaagaauacug

SEQ ID NO: 1441292 - RNA, 19 nt, Homo sapiens
aaaguacucgcagaaguua

SEQ ID NO: 1441293 - RNA, 19 nt, Homo sapiens
ggagaaucaugcuuuagcu

SEQ ID NO: 1441294 - RNA, 19 nt, Homo sapiens
ucaaccaaacaacucauua

SEQ ID NO: 1441295 - RNA, 19 nt, Homo sapiens
cuccagaccugaucagaau

SEQ ID NO: 1441296 - RNA, 19 nt, Homo sapiens
gaggaaaaguacugaguga

SEQ ID NO: 1441297 - RNA, 19 nt, Homo sapiens
gcaagaauacuggagcaau

SEQ ID NO: 1441298 - RNA, 19 nt, Homo sapiens
aaagauggcuacaaaugcu

SEQ ID NO: 1441299 - RNA, 19 nt, Homo sapiens
ucauuaaugcugcaaacua

SEQ ID NO: 1441300 - RNA, 19 nt, Homo sapiens
ucacucaugacggguauua

SEQ ID NO: 1441301 - RNA, 19 nt, Homo sapiens
ggaagccagcugcgcauau

SEQ ID NO: 1441302 - RNA, 19 nt, Homo sapiens
uaacaccugaugggaauuu

SEQ ID NO: 1441303 - RNA, 19 nt, Homo sapiens
cacaaaagccuacaagaaa

SEQ ID NO: 1441304 - RNA, 19 nt, Homo sapiens
ccaaggaaaccaacuguac

SEQ ID NO: 1441305 - RNA, 19 nt, Homo sapiens
caagaaagaaacaaaugag

SEQ ID NO: 1441306 - RNA, 19 nt, Homo sapiens
caccugaagugacccuguu

SEQ ID NO: 1441307 - RNA, 19 nt, Homo sapiens
caaaugucucucugaauuc

SEQ ID NO: 1441308 - RNA, 19 nt, Homo sapiens
uauuucacaucaccagauu

SEQ ID NO: 1441309 - RNA, 19 nt, Homo sapiens
ggaaaccaacuguacugau

SEQ ID NO: 1441310 - RNA, 19 nt, Homo sapiens
cuucauggccuguaaagau

SEQ ID NO: 1441311 - RNA, 19 nt, Homo sapiens
ggguauuacagaugcauaa

SEQ ID NO: 1441312 - RNA, 19 nt, Homo sapiens
uuacacagaacuacucgaa

SEQ ID NO: 1441313 - RNA, 19 nt, Homo sapiens
aaacuagcaaggagaauca

SEQ ID NO: 1441314 - RNA, 19 nt, Homo sapiens
cuagggcuacuguugauuu

SEQ ID NO: 1441315 - RNA, 19 nt, Homo sapiens
gggcuacuguugauuuuga

SEQ ID NO: 1441316 - RNA, 19 nt, Homo sapiens
cugaauuccauaugcuuua

SEQ ID NO: 1441317 - RNA, 19 nt, Homo sapiens
ccuccuaucgcauuaagaa

SEQ ID NO: 1441318 - RNA, 19 nt, Homo sapiens
gagaaucaugcuuuagcuu

SEQ ID NO: 1441319 - RNA, 19 nt, Homo sapiens
uagguaaggagcaucauau

SEQ ID NO: 1441320 - RNA, 19 nt, Homo sapiens
gugcuuuguugcccuccua

SEQ ID NO: 1441321 - RNA, 19 nt, Homo sapiens
uaaagauggcuacaaaugc

SEQ ID NO: 1441322 - RNA, 19 nt, Homo sapiens
acaaaugagaccaaggaaa

SEQ ID NO: 1441323 - RNA, 19 nt, Homo sapiens
caucacucaugacggguau

SEQ ID NO: 1441324 - RNA, 19 nt, Homo sapiens
aaaccaacuguacugauga

SEQ ID NO: 1441325 - RNA, 19 nt, Homo sapiens
gcaguuuauguauggauga

SEQ ID NO: 1441326 - RNA, 19 nt, Homo sapiens
caugacggguauuacagau

SEQ ID NO: 1441327 - RNA, 19 nt, Homo sapiens
caaacuagcaaggagaauc

SEQ ID NO: 1441328 - RNA, 19 nt, Homo sapiens
ucuuuccucucugcaguua

SEQ ID NO: 1441329 - RNA, 19 nt, Homo sapiens
ccagauuugugacggaaac

SEQ ID NO: 1441330 - RNA, 19 nt, Homo sapiens
gaccaaggaaaccaacugu

SEQ ID NO: 1441331 - RNA, 19 nt, Homo sapiens
ggccagccuuccugcacaa

SEQ ID NO: 1441332 - RNA, 19 nt, Homo sapiens
uuagguaaggagcaucaua

SEQ ID NO: 1441333 - RNA, 19 nt, Homo sapiens
uacagaugcauaaugguaa

SEQ ID NO: 1441334 - RNA, 19 nt, Homo sapiens
ggcuacaaaugcugugcuu

SEQ ID NO: 1441335 - RNA, 19 nt, Homo sapiens
agcaucauauauugaggua

SEQ ID NO: 1441336 - RNA, 19 nt, Homo sapiens
caaggaaaccaacuguacu

SEQ ID NO: 1441337 - RNA, 19 nt, Homo sapiens
ccuacaagaaagaaacaaa

SEQ ID NO: 1441338 - RNA, 19 nt, Homo sapiens
gcucugcccuuggagaacu

SEQ ID NO: 1441339 - RNA, 19 nt, Homo sapiens
gugccacuaagcaagaaua

SEQ ID NO: 1441340 - RNA, 19 nt, Homo sapiens
ccagaccugaucagaauuc

SEQ ID NO: 1441341 - RNA, 19 nt, Homo sapiens
uucauggccuguaaagaug

SEQ ID NO: 1441342 - RNA, 19 nt, Homo sapiens
gcgauugugccacuaagca

SEQ ID NO: 1441343 - RNA, 19 nt, Homo sapiens
gaucccagagggcgauugu

SEQ ID NO: 1441344 - RNA, 19 nt, Homo sapiens
caguuuauguauggaugaa

SEQ ID NO: 1441345 - RNA, 19 nt, Homo sapiens
gcaguaugcaaggcaguug

SEQ ID NO: 1441346 - RNA, 19 nt, Homo sapiens
uuucacaucaccagauuug

SEQ ID NO: 1441347 - RNA, 19 nt, Homo sapiens
ggaaaaguacugagugaag

SEQ ID NO: 1441348 - RNA, 19 nt, Homo sapiens
gggaagccagcugcgcaua

SEQ ID NO: 1441349 - RNA, 19 nt, Homo sapiens
aaacagauuacacagaacu

SEQ ID NO: 1441350 - RNA, 19 nt, Homo sapiens
ugugaaaaccgaagcauuu

SEQ ID NO: 1441351 - RNA, 19 nt, Homo sapiens
auugagguauuucacauca

SEQ ID NO: 1441352 - RNA, 19 nt, Homo sapiens
ccguggccaucacucauga

SEQ ID NO: 1441353 - RNA, 19 nt, Homo sapiens
gaauagaacugcaguaugc

SEQ ID NO: 1441354 - RNA, 19 nt, Homo sapiens
gaagugacccuguuucaaa

SEQ ID NO: 1441355 - RNA, 19 nt, Homo sapiens
gaaaccaacuguacugaug

SEQ ID NO: 1441356 - RNA, 19 nt, Homo sapiens
gaaaugcucugcccuugga

SEQ ID NO: 1441357 - RNA, 19 nt, Homo sapiens
acaaaugucucucugaauu

SEQ ID NO: 1441358 - RNA, 19 nt, Homo sapiens
guaaggagcaucauauauu

SEQ ID NO: 1441359 - RNA, 19 nt, Homo sapiens
aaacaaaugucucucugaa

SEQ ID NO: 1441360 - RNA, 19 nt, Homo sapiens
uaaggagcaucauauauug

SEQ ID NO: 1441361 - RNA, 19 nt, Homo sapiens
gaaaguacucgcagaaguu

SEQ ID NO: 1441362 - RNA, 19 nt, Homo sapiens
gauaucaccuccaaguguu

SEQ ID NO: 1441363 - RNA, 19 nt, Homo sapiens
caacuguacugaugagaga

SEQ ID NO: 1441364 - RNA, 19 nt, Homo sapiens
caagaauacuggagcaaug

SEQ ID NO: 1441365 - RNA, 19 nt, Homo sapiens
guaaagauggcuacaaaug

SEQ ID NO: 1441366 - RNA, 19 nt, Homo sapiens
gguaacaccugaugggaau

SEQ ID NO: 1441367 - RNA, 19 nt, Homo sapiens
gaaacaaaugucucucuga

SEQ ID NO: 1441368 - RNA, 19 nt, Homo sapiens
acacagaacuacucgaaag

SEQ ID NO: 1441369 - RNA, 19 nt, Homo sapiens
gaagccagcugcgcauauc

SEQ ID NO: 1441370 - RNA, 19 nt, Homo sapiens
cgaaaguacucgcagaagu

SEQ ID NO: 1441371 - RNA, 19 nt, Homo sapiens
ucaagcaguuuauguaugg

SEQ ID NO: 1441372 - RNA, 19 nt, Homo sapiens
ggauaucaccuccaagugu

SEQ ID NO: 1441373 - RNA, 19 nt, Homo sapiens
gaauucggaccuucagauu

SEQ ID NO: 1441374 - RNA, 19 nt, Homo sapiens
caaaugagaccaaggaaac

SEQ ID NO: 1441375 - RNA, 19 nt, Homo sapiens
gcacaaaagccuacaagaa

SEQ ID NO: 1441376 - RNA, 19 nt, Homo sapiens
ccuaucgcauuaagaaauu

SEQ ID NO: 1441377 - RNA, 19 nt, Homo sapiens
ggaauagaacugcaguaug

SEQ ID NO: 1441378 - RNA, 19 nt, Homo sapiens
gcaguuacaccugaaguga

SEQ ID NO: 1441379 - RNA, 19 nt, Homo sapiens
aaacaaaugagaccaagga

SEQ ID NO: 1441380 - RNA, 19 nt, Homo sapiens
uuggagaacugcuaaccua

SEQ ID NO: 1441381 - RNA, 19 nt, Homo sapiens
gguaaggagcaucauauau

SEQ ID NO: 1441382 - RNA, 19 nt, Homo sapiens
uuacagaugcauaauggua

SEQ ID NO: 1441383 - RNA, 19 nt, Homo sapiens
uaaccuagggcuacuguug

SEQ ID NO: 1441384 - RNA, 19 nt, Homo sapiens
ccacuaagcaagaauacug

SEQ ID NO: 1441385 - RNA, 19 nt, Homo sapiens
aaaguacucgcagaaguua

SEQ ID NO: 1441386 - RNA, 19 nt, Homo sapiens
cuccagaccugaucagaau

SEQ ID NO: 1441387 - RNA, 19 nt, Homo sapiens
gaggaaaaguacugaguga

SEQ ID NO: 1441388 - RNA, 19 nt, Homo sapiens
gcaagaauacuggagcaau

SEQ ID NO: 1441389 - RNA, 19 nt, Homo sapiens
aaagauggcuacaaaugcu

SEQ ID NO: 1441390 - RNA, 19 nt, Homo sapiens
ucacucaugacggguauua

SEQ ID NO: 1441391 - RNA, 19 nt, Homo sapiens
ggaagccagcugcgcauau

SEQ ID NO: 1441392 - RNA, 19 nt, Homo sapiens
uaacaccugaugggaauuu

SEQ ID NO: 1441393 - RNA, 19 nt, Homo sapiens
cacaaaagccuacaagaaa

SEQ ID NO: 1441394 - RNA, 19 nt, Homo sapiens
ccaaggaaaccaacuguac

SEQ ID NO: 1441395 - RNA, 19 nt, Homo sapiens
caagaaagaaacaaaugag

SEQ ID NO: 1441396 - RNA, 19 nt, Homo sapiens
caccugaagugacccuguu

SEQ ID NO: 1441397 - RNA, 19 nt, Homo sapiens
caaaugucucucugaauuc

SEQ ID NO: 1441398 - RNA, 19 nt, Homo sapiens
uauuucacaucaccagauu

SEQ ID NO: 1441399 - RNA, 19 nt, Homo sapiens
ggaaaccaacuguacugau

SEQ ID NO: 1441400 - RNA, 19 nt, Homo sapiens
cuucauggccuguaaagau

SEQ ID NO: 1441401 - RNA, 19 nt, Homo sapiens
cuagggcuacuguugauuu

SEQ ID NO: 1441402 - RNA, 19 nt, Homo sapiens
ggguauuacagaugcauaa

SEQ ID NO: 1441403 - RNA, 19 nt, Homo sapiens
uuacacagaacuacucgaa

SEQ ID NO: 1441404 - RNA, 19 nt, Homo sapiens
gggcuacuguugauuuuga

SEQ ID NO: 1441405 - RNA, 19 nt, Homo sapiens
cugaauuccauaugcuuua

SEQ ID NO: 1441406 - RNA, 19 nt, Homo sapiens
ccuccuaucgcauuaagaa

SEQ ID NO: 1441407 - RNA, 19 nt, Homo sapiens
uagguaaggagcaucauau

SEQ ID NO: 1441408 - RNA, 19 nt, Homo sapiens
gugcuuuguugcccuccua

SEQ ID NO: 1441409 - RNA, 19 nt, Homo sapiens
uaaagauggcuacaaaugc

SEQ ID NO: 1441410 - RNA, 19 nt, Homo sapiens
acaaaugagaccaaggaaa

SEQ ID NO: 1441411 - RNA, 19 nt, Homo sapiens
caucacucaugacggguau

SEQ ID NO: 1441412 - RNA, 19 nt, Homo sapiens
aaaccaacuguacugauga

SEQ ID NO: 1441413 - RNA, 19 nt, Homo sapiens
gcaguuuauguauggauga

SEQ ID NO: 1441414 - RNA, 19 nt, Homo sapiens
caugacggguauuacagau

SEQ ID NO: 1441415 - RNA, 19 nt, Homo sapiens
ucuuuccucucugcaguua

SEQ ID NO: 1441416 - RNA, 19 nt, Homo sapiens
ccagauuugugacggaaac

SEQ ID NO: 1441417 - RNA, 19 nt, Homo sapiens
gaccaaggaaaccaacugu

SEQ ID NO: 1441418 - RNA, 19 nt, Homo sapiens
ggccagccuuccugcacaa

SEQ ID NO: 1441419 - RNA, 19 nt, Homo sapiens
uuagguaaggagcaucaua

SEQ ID NO: 1441420 - RNA, 19 nt, Homo sapiens
uacagaugcauaaugguaa

SEQ ID NO: 1441421 - RNA, 19 nt, Homo sapiens
ggcuacaaaugcugugcuu

SEQ ID NO: 1441422 - RNA, 19 nt, Homo sapiens
agcaucauauauugaggua

SEQ ID NO: 1441423 - RNA, 19 nt, Homo sapiens
gcucugcccuuggagaacu

SEQ ID NO: 1441424 - RNA, 19 nt, Homo sapiens
caaggaaaccaacuguacu

SEQ ID NO: 1441425 - RNA, 19 nt, Homo sapiens
ccuacaagaaagaaacaaa

SEQ ID NO: 1441426 - RNA, 19 nt, Homo sapiens
gugccacuaagcaagaaua

SEQ ID NO: 1441427 - RNA, 19 nt, Homo sapiens
ccagaccugaucagaauuc

SEQ ID NO: 1441428 - RNA, 19 nt, Homo sapiens
uucauggccuguaaagaug

SEQ ID NO: 1441429 - RNA, 19 nt, Homo sapiens
gcgauugugccacuaagca

SEQ ID NO: 1441430 - RNA, 19 nt, Homo sapiens
gaucccagagggcgauugu

SEQ ID NO: 1441431 - RNA, 19 nt, Homo sapiens
gcaguaugcaaggcaguug

SEQ ID NO: 1441432 - RNA, 19 nt, Homo sapiens
uuucacaucaccagauuug

SEQ ID NO: 1441433 - RNA, 19 nt, Homo sapiens
caguuuauguauggaugaa

SEQ ID NO: 1441434 - RNA, 19 nt, Homo sapiens
ggaaaaguacugagugaag

SEQ ID NO: 1441435 - RNA, 19 nt, Homo sapiens
gggaagccagcugcgcaua

SEQ ID NO: 1441436 - RNA, 19 nt, Homo sapiens
ugugaaaaccgaagcauuu

SEQ ID NO: 1441437 - RNA, 19 nt, Homo sapiens
aaacagauuacacagaacu

SEQ ID NO: 1441438 - RNA, 19 nt, Homo sapiens
auugagguauuucacauca

SEQ ID NO: 1441439 - RNA, 19 nt, Homo sapiens
ccguggccaucacucauga

SEQ ID NO: 1441440 - RNA, 19 nt, Homo sapiens
guauuucacaucaccagau

SEQ ID NO: 1441441 - RNA, 19 nt, Homo sapiens
guaccguggccaucacuca

SEQ ID NO: 1441442 - RNA, 19 nt, Homo sapiens
cuucaagcaguuuauguau

SEQ ID NO: 1441443 - RNA, 19 nt, Homo sapiens
uucaagcaguuuauguaug

SEQ ID NO: 1441444 - RNA, 19 nt, Homo sapiens
gcccuuggagaacugcuaa

SEQ ID NO: 1441445 - RNA, 19 nt, Homo sapiens
gaaggcaucugaggcauua

SEQ ID NO: 1441446 - RNA, 19 nt, Homo sapiens
acacagaccuccauacuuu

SEQ ID NO: 1441447 - RNA, 19 nt, Homo sapiens
gaagaacaauccucucuau

SEQ ID NO: 1441448 - RNA, 19 nt, Homo sapiens
caacaaacgagauacauua

SEQ ID NO: 1441449 - RNA, 19 nt, Homo sapiens
gagcaagugugaacaguuu

SEQ ID NO: 1441450 - RNA, 19 nt, Homo sapiens
gaauagaacugcaguaugc

SEQ ID NO: 1441451 - RNA, 19 nt, Homo sapiens
gaagugacccuguuucaaa

SEQ ID NO: 1441452 - RNA, 19 nt, Homo sapiens
gaaaccaacuguacugaug

SEQ ID NO: 1441453 - RNA, 19 nt, Homo sapiens
agaaauaacugaagaagga

SEQ ID NO: 1441454 - RNA, 19 nt, Homo sapiens
gaacaauccucucuaugau

SEQ ID NO: 1441455 - RNA, 19 nt, Homo sapiens
caacaagagucuguacaua

SEQ ID NO: 1441456 - RNA, 19 nt, Homo sapiens
gaaaugcucugcccuugga

SEQ ID NO: 1441457 - RNA, 19 nt, Homo sapiens
guucuagaaugaagacuua

SEQ ID NO: 1441458 - RNA, 19 nt, Homo sapiens
gcaggacaguaaauaauga

SEQ ID NO: 1441459 - RNA, 19 nt, Homo sapiens
cugaagaacugauguuauu

SEQ ID NO: 1441460 - RNA, 19 nt, Homo sapiens
gaaaguacucgcagaaguu

SEQ ID NO: 1441461 - RNA, 19 nt, Homo sapiens
gaagaaggagcaaguguga

SEQ ID NO: 1441462 - RNA, 19 nt, Homo sapiens
gauaucaccuccaaguguu

SEQ ID NO: 1441463 - RNA, 19 nt, Homo sapiens
caacuguacugaugagaga

SEQ ID NO: 1441464 - RNA, 19 nt, Homo sapiens
caagaauacuggagcaaug

SEQ ID NO: 1441465 - RNA, 19 nt, Homo sapiens
guaaagauggcuacaaaug

SEQ ID NO: 1441466 - RNA, 19 nt, Homo sapiens
gguaacaccugaugggaau

SEQ ID NO: 1441467 - RNA, 19 nt, Homo sapiens
aaagugaaguugacacaga

SEQ ID NO: 1441468 - RNA, 19 nt, Homo sapiens
acaagagucuguacauaga

SEQ ID NO: 1441469 - RNA, 19 nt, Homo sapiens
ccauauaucauccuuacua

SEQ ID NO: 1441470 - RNA, 19 nt, Homo sapiens
agaacaauccucucuauga

SEQ ID NO: 1441471 - RNA, 19 nt, Homo sapiens
acacagaacuacucgaaag

SEQ ID NO: 1441472 - RNA, 19 nt, Homo sapiens
gaagccagcugcgcauauc

SEQ ID NO: 1441473 - RNA, 19 nt, Homo sapiens
cgaaaguacucgcagaagu

SEQ ID NO: 1441474 - RNA, 19 nt, Homo sapiens
aaaccaaauuuccucaaga

SEQ ID NO: 1441475 - RNA, 19 nt, Homo sapiens
agaccuccauacuuuauaa

SEQ ID NO: 1441476 - RNA, 19 nt, Homo sapiens
ucaagcaguuuauguaugg

SEQ ID NO: 1441477 - RNA, 19 nt, Homo sapiens
ggauucauuugguuguuga

SEQ ID NO: 1441478 - RNA, 19 nt, Homo sapiens
ggauaucaccuccaagugu

SEQ ID NO: 1441479 - RNA, 19 nt, Homo sapiens
gaauucggaccuucagauu

SEQ ID NO: 1441480 - RNA, 19 nt, Homo sapiens
caaaugagaccaaggaaac

SEQ ID NO: 1441481 - RNA, 19 nt, Homo sapiens
gcacaaaagccuacaagaa

SEQ ID NO: 1441482 - RNA, 19 nt, Homo sapiens
gaagaacugauguuauuac

SEQ ID NO: 1441483 - RNA, 19 nt, Homo sapiens
ccagcuaguucucugaaga

SEQ ID NO: 1441484 - RNA, 19 nt, Homo sapiens
ggacucuaguaccaagaaa

SEQ ID NO: 1441485 - RNA, 19 nt, Homo sapiens
ccuaucgcauuaagaaauu

SEQ ID NO: 1441486 - RNA, 19 nt, Homo sapiens
aaccaaauuuccucaagaa

SEQ ID NO: 1441487 - RNA, 19 nt, Homo sapiens
ggaauagaacugcaguaug

SEQ ID NO: 1441488 - RNA, 19 nt, Homo sapiens
aaacaaaugagaccaagga

SEQ ID NO: 1441489 - RNA, 19 nt, Homo sapiens
uuggagaacugcuaaccua

SEQ ID NO: 1441490 - RNA, 19 nt, Homo sapiens
uuacagaugcauaauggua

SEQ ID NO: 1441491 - RNA, 19 nt, Homo sapiens
uaaccuagggcuacuguug

SEQ ID NO: 1441492 - RNA, 19 nt, Homo sapiens
gcaacaagagucuguacau

SEQ ID NO: 1441493 - RNA, 19 nt, Homo sapiens
ucuuacaguucuagaauga

SEQ ID NO: 1441494 - RNA, 19 nt, Homo sapiens
ccacuaagcaagaauacug

SEQ ID NO: 1441495 - RNA, 19 nt, Homo sapiens
aaaguacucgcagaaguua

SEQ ID NO: 1441496 - RNA, 19 nt, Homo sapiens
gaggaaaaguacugaguga

SEQ ID NO: 1441497 - RNA, 19 nt, Homo sapiens
cuccagaccugaucagaau

SEQ ID NO: 1441498 - RNA, 19 nt, Homo sapiens
caacaacaaacgagauaca

SEQ ID NO: 1441499 - RNA, 19 nt, Homo sapiens
gcaagaauacuggagcaau

SEQ ID NO: 1441500 - RNA, 19 nt, Homo sapiens
aaagauggcuacaaaugcu

SEQ ID NO: 1441501 - RNA, 19 nt, Homo sapiens
acaauccucucuaugauac

SEQ ID NO: 1441502 - RNA, 19 nt, Homo sapiens
aacagaaucuacuccaguu

SEQ ID NO: 1441503 - RNA, 19 nt, Homo sapiens
gggauucauuugguuguug

SEQ ID NO: 1441504 - RNA, 19 nt, Homo sapiens
ucacucaugacggguauua

SEQ ID NO: 1441505 - RNA, 19 nt, Homo sapiens
ccauuugacuggcaacaag

SEQ ID NO: 1441506 - RNA, 19 nt, Homo sapiens
ggaagccagcugcgcauau

SEQ ID NO: 1441507 - RNA, 19 nt, Homo sapiens
gaccaucgugggauucauu

SEQ ID NO: 1441508 - RNA, 19 nt, Homo sapiens
uaacaccugaugggaauuu

SEQ ID NO: 1441509 - RNA, 19 nt, Homo sapiens
cacaaaagccuacaagaaa

SEQ ID NO: 1441510 - RNA, 19 nt, Homo sapiens
agaaucuacuccaguuguu

SEQ ID NO: 1441511 - RNA, 19 nt, Homo sapiens
ccaaggaaaccaacuguac

SEQ ID NO: 1441512 - RNA, 19 nt, Homo sapiens
caagaaagaaacaaaugag

SEQ ID NO: 1441513 - RNA, 19 nt, Homo sapiens
ggagcaagugugaacaguu

SEQ ID NO: 1441514 - RNA, 19 nt, Homo sapiens
ucauuugguuguugaaagu

SEQ ID NO: 1441515 - RNA, 19 nt, Homo sapiens
acugggagguccacaaugu

SEQ ID NO: 1441516 - RNA, 19 nt, Homo sapiens
caccugaagugacccuguu

SEQ ID NO: 1441517 - RNA, 19 nt, Homo sapiens
ggaaaccaacuguacugau

SEQ ID NO: 1441518 - RNA, 19 nt, Homo sapiens
cucaagaaauaacugaaga

SEQ ID NO: 1441519 - RNA, 19 nt, Homo sapiens
caaauugugcaggacagua

SEQ ID NO: 1441520 - RNA, 19 nt, Homo sapiens
gaugaaaugcagcccuaug

SEQ ID NO: 1441521 - RNA, 19 nt, Homo sapiens
gucaauggcugcagaaaau

SEQ ID NO: 1441522 - RNA, 19 nt, Homo sapiens
cuucauggccuguaaagau

SEQ ID NO: 1441523 - RNA, 19 nt, Homo sapiens
gugcaggacaguaaauaau

SEQ ID NO: 1441524 - RNA, 19 nt, Homo sapiens
gcccaugaccaaauauuca

SEQ ID NO: 1441525 - RNA, 19 nt, Homo sapiens
uuacaguucuagaaugaag

SEQ ID NO: 1441526 - RNA, 19 nt, Homo sapiens
ucugaggcauuacaaagug

SEQ ID NO: 1441527 - RNA, 19 nt, Homo sapiens
ugccacgucucccauuuga

SEQ ID NO: 1441528 - RNA, 19 nt, Homo sapiens
uuacacagaacuacucgaa

SEQ ID NO: 1441529 - RNA, 19 nt, Homo sapiens
ggguauuacagaugcauaa

SEQ ID NO: 1441530 - RNA, 19 nt, Homo sapiens
cuagggcuacuguugauuu

SEQ ID NO: 1441531 - RNA, 19 nt, Homo sapiens
aaauugugcaggacaguaa

SEQ ID NO: 1441532 - RNA, 19 nt, Homo sapiens
gggcuacuguugauuuuga

SEQ ID NO: 1441533 - RNA, 19 nt, Homo sapiens
ucucauucauacccuugua

SEQ ID NO: 1441534 - RNA, 19 nt, Homo sapiens
caagaaacaacaacaaacg

SEQ ID NO: 1441535 - RNA, 19 nt, Homo sapiens
acaacaaacgagauacauu

SEQ ID NO: 1441536 - RNA, 19 nt, Homo sapiens
gacacagaccuccauacuu

SEQ ID NO: 1441537 - RNA, 19 nt, Homo sapiens
uaugccagcuacacagaga

SEQ ID NO: 1441538 - RNA, 19 nt, Homo sapiens
ccuccuaucgcauuaagaa

SEQ ID NO: 1441539 - RNA, 19 nt, Homo sapiens
caagaaauaacugaagaag

SEQ ID NO: 1441540 - RNA, 19 nt, Homo sapiens
gugcuuuguugcccuccua

SEQ ID NO: 1441541 - RNA, 19 nt, Homo sapiens
uaaagauggcuacaaaugc

SEQ ID NO: 1441542 - RNA, 19 nt, Homo sapiens
aacaacaacaaacgagaua

SEQ ID NO: 1441543 - RNA, 19 nt, Homo sapiens
guacauagagcuacuuccu

SEQ ID NO: 1441544 - RNA, 19 nt, Homo sapiens
acaaaugagaccaaggaaa

SEQ ID NO: 1441545 - RNA, 19 nt, Homo sapiens
gaggaaacguugugaauua

SEQ ID NO: 1441546 - RNA, 19 nt, Homo sapiens
gaacguuucuugugaguga

SEQ ID NO: 1441547 - RNA, 19 nt, Homo sapiens
ugagugagcugauuuauuc

SEQ ID NO: 1441548 - RNA, 19 nt, Homo sapiens
ugaauaagcucagcaacua

SEQ ID NO: 1441549 - RNA, 19 nt, Homo sapiens
caaagaagaucaugaaacu

SEQ ID NO: 1441550 - RNA, 19 nt, Homo sapiens
gaagaaacagcucccauug

SEQ ID NO: 1441551 - RNA, 19 nt, Homo sapiens
gaggagggaucaaguuaau

SEQ ID NO: 1441552 - RNA, 19 nt, Homo sapiens
gaaauacccagaccucuau

SEQ ID NO: 1441553 - RNA, 19 nt, Homo sapiens
gagcugauuuauucugauu

SEQ ID NO: 1441554 - RNA, 19 nt, Homo sapiens
gaggccagauggucagaua

SEQ ID NO: 1441555 - RNA, 19 nt, Homo sapiens
ggaaggaucgaaucauauu

SEQ ID NO: 1441556 - RNA, 19 nt, Homo sapiens
cgaggagcauggauugaua

SEQ ID NO: 1441557 - RNA, 19 nt, Homo sapiens
ggagggaucaaguuaauga

SEQ ID NO: 1441558 - RNA, 19 nt, Homo sapiens
gaaacguugugaauuaagu

SEQ ID NO: 1441559 - RNA, 19 nt, Homo sapiens
gcaaacccaucuugaccuu

SEQ ID NO: 1441560 - RNA, 19 nt, Homo sapiens
gaagaagccagcagaacaa

SEQ ID NO: 1441561 - RNA, 19 nt, Homo sapiens
aggaaugcaugcagaaaua

SEQ ID NO: 1441562 - RNA, 19 nt, Homo sapiens
gcuuggcuguuccuuguua

SEQ ID NO: 1441563 - RNA, 19 nt, Homo sapiens
cagaauugguggcugauga

SEQ ID NO: 1441564 - RNA, 19 nt, Homo sapiens
gaagaggagggaucaaguu

SEQ ID NO: 1441565 - RNA, 19 nt, Homo sapiens
aaacccaucuugaccuuga

SEQ ID NO: 1441566 - RNA, 19 nt, Homo sapiens
agaaacagcucccauugag

SEQ ID NO: 1441567 - RNA, 19 nt, Homo sapiens
agggaaggaucgaaucaua

SEQ ID NO: 1441568 - RNA, 19 nt, Homo sapiens
gucaucaccuuccaagaaa

SEQ ID NO: 1441569 - RNA, 19 nt, Homo sapiens
ggauugauacugccaaaug

SEQ ID NO: 1441570 - RNA, 19 nt, Homo sapiens
gagaggaaacguugugaau

SEQ ID NO: 1441571 - RNA, 19 nt, Homo sapiens
gaauaagcucagcaacuaa

SEQ ID NO: 1441572 - RNA, 19 nt, Homo sapiens
guuguccugugcauuauaa

SEQ ID NO: 1441573 - RNA, 19 nt, Homo sapiens
gaaggaucgaaucauauuu

SEQ ID NO: 1441574 - RNA, 19 nt, Homo sapiens
gaagggaaggaucgaauca

SEQ ID NO: 1441575 - RNA, 19 nt, Homo sapiens
gcugauuuauucugauuca

SEQ ID NO: 1441576 - RNA, 19 nt, Homo sapiens
cuagucaggugcaauguuc

SEQ ID NO: 1441577 - RNA, 19 nt, Homo sapiens
ucagaggucuugaggucuu

SEQ ID NO: 1441578 - RNA, 19 nt, Homo sapiens
ggaugccugugucguauuc

SEQ ID NO: 1441579 - RNA, 19 nt, Homo sapiens
ggaaggcuuugcccaggau

SEQ ID NO: 1441580 - RNA, 19 nt, Homo sapiens
cugcagccauguccuauug

SEQ ID NO: 1441581 - RNA, 19 nt, Homo sapiens
gugagcugauuuauucuga

SEQ ID NO: 1441582 - RNA, 19 nt, Homo sapiens
agaaauacccagaccucua

SEQ ID NO: 1441583 - RNA, 19 nt, Homo sapiens
ucuguuguccugugcauua

SEQ ID NO: 1441584 - RNA, 19 nt, Homo sapiens
aagaggagggaucaaguua

SEQ ID NO: 1441585 - RNA, 19 nt, Homo sapiens
gaagccagcagaacaagca

SEQ ID NO: 1441586 - RNA, 19 nt, Homo sapiens
gauugauacugccaaaugg

SEQ ID NO: 1441587 - RNA, 19 nt, Homo sapiens
uccaagcagugcagaauug

SEQ ID NO: 1441588 - RNA, 19 nt, Homo sapiens
aggaaacguugugaauuaa

SEQ ID NO: 1441589 - RNA, 19 nt, Homo sapiens
cagauggucagauaugauu

SEQ ID NO: 1441590 - RNA, 19 nt, Homo sapiens
ugucaucaccuuccaagaa

SEQ ID NO: 1441591 - RNA, 19 nt, Homo sapiens
caaagaagaggagggauca

SEQ ID NO: 1441592 - RNA, 19 nt, Homo sapiens
gaagaggaaagagagaaga

SEQ ID NO: 1441593 - RNA, 19 nt, Homo sapiens
gaggcuggcuuggcuguuc

SEQ ID NO: 1441594 - RNA, 19 nt, Homo sapiens
gccagauggucagauauga

SEQ ID NO: 1441595 - RNA, 19 nt, Homo sapiens
ugaggccacugcaaccaaa

SEQ ID NO: 1441596 - RNA, 19 nt, Homo sapiens
gcagaacaagcagaagaaa

SEQ ID NO: 1441597 - RNA, 19 nt, Homo sapiens
guacuuuauuccugauaca

SEQ ID NO: 1441598 - RNA, 19 nt, Homo sapiens
agaagaaacagcucccauu

SEQ ID NO: 1441599 - RNA, 19 nt, Homo sapiens
gggaaggaucgaaucauau

SEQ ID NO: 1441600 - RNA, 19 nt, Homo sapiens
agaacaagcagaagaaaca

SEQ ID NO: 1441601 - RNA, 19 nt, Homo sapiens
caagagaggaaacguugug

SEQ ID NO: 1441602 - RNA, 19 nt, Homo sapiens
uggcuuggcuguuccuugu

SEQ ID NO: 1441603 - RNA, 19 nt, Homo sapiens
ccacugcaaccaaagaaga

SEQ ID NO: 1441604 - RNA, 19 nt, Homo sapiens
cagcagaacaagcagaaga

SEQ ID NO: 1441605 - RNA, 19 nt, Homo sapiens
gcaggaaugcaugcagaaa

SEQ ID NO: 1441606 - RNA, 19 nt, Homo sapiens
agaagaagccagcagaaca

SEQ ID NO: 1441607 - RNA, 19 nt, Homo sapiens
cgaaucauauuuguaacca

SEQ ID NO: 1441608 - RNA, 19 nt, Homo sapiens
gaucaugaaacuccaagca

SEQ ID NO: 1441609 - RNA, 19 nt, Homo sapiens
uaaccaaagaagaucauga

SEQ ID NO: 1441610 - RNA, 19 nt, Homo sapiens
guguuuggaugaugaagau

SEQ ID NO: 1441611 - RNA, 19 nt, Homo sapiens
gcaaaaggccuugucauca

SEQ ID NO: 1441612 - RNA, 19 nt, Homo sapiens
ggaugaggaugaggaagag

SEQ ID NO: 1441613 - RNA, 19 nt, Homo sapiens
ccaaagaagaucaugaaac

SEQ ID NO: 1441614 - RNA, 19 nt, Homo sapiens
ggaagggaaggaucgaauc

SEQ ID NO: 1441615 - RNA, 19 nt, Homo sapiens
gugagugagcugauuuauu

SEQ ID NO: 1441616 - RNA, 19 nt, Homo sapiens
aaaguuuccuucuguuguc

SEQ ID NO: 1441617 - RNA, 19 nt, Homo sapiens
ggaucgaaucauauuugua

SEQ ID NO: 1441618 - RNA, 19 nt, Homo sapiens
auggaaacauuaacuggaa

SEQ ID NO: 1441619 - RNA, 19 nt, Homo sapiens
gaagaucaugaaacuccaa

SEQ ID NO: 1441620 - RNA, 19 nt, Homo sapiens
aauaagcucagcaacuaaa

SEQ ID NO: 1441621 - RNA, 19 nt, Homo sapiens
cuugacauauacacugaaa

SEQ ID NO: 1441622 - RNA, 19 nt, Homo sapiens
aagaaacagcucccauuga

SEQ ID NO: 1441623 - RNA, 19 nt, Homo sapiens
caucugugaccaccaggua

SEQ ID NO: 1441624 - RNA, 19 nt, Homo sapiens
ggaagaggaaagagagaag

SEQ ID NO: 1441625 - RNA, 19 nt, Homo sapiens
cccaagaggaugaggauga

SEQ ID NO: 1441626 - RNA, 19 nt, Homo sapiens
aaccaaagaagaucaugaa

SEQ ID NO: 1441627 - RNA, 19 nt, Homo sapiens
ccaagaggaugaggaugag

SEQ ID NO: 1441628 - RNA, 19 nt, Homo sapiens
guggagaacaguuuaaguc

SEQ ID NO: 1441629 - RNA, 19 nt, Homo sapiens
guguugagcuccugguuuu

SEQ ID NO: 1441630 - RNA, 19 nt, Homo sapiens
gguguugagcuccugguuu

SEQ ID NO: 1441631 - RNA, 19 nt, Homo sapiens
gauggucagauaugauuuc

SEQ ID NO: 1441632 - RNA, 19 nt, Homo sapiens
ggccagauggucagauaug

SEQ ID NO: 1441633 - RNA, 19 nt, Homo sapiens
auaaugugcugaauaagcu

SEQ ID NO: 1441634 - RNA, 19 nt, Homo sapiens
guccugugcauuauaauau

SEQ ID NO: 1441635 - RNA, 19 nt, Homo sapiens
aaggaucgaaucauauuug

SEQ ID NO: 1441636 - RNA, 19 nt, Homo sapiens
ggaaacguugugaauuaag

SEQ ID NO: 1441637 - RNA, 19 nt, Homo sapiens
guuuggaugaugaagauuu

SEQ ID NO: 1441638 - RNA, 19 nt, Homo sapiens
gauaugauuucugcaaacc

SEQ ID NO: 1441639 - RNA, 19 nt, Homo sapiens
agaggaaacguugugaauu

SEQ ID NO: 1441640 - RNA, 19 nt, Homo sapiens
cauacgaggagcauggauu

SEQ ID NO: 1441641 - RNA, 19 nt, Homo sapiens
ggaugaggaagaggaaaga

SEQ ID NO: 1441642 - RNA, 19 nt, Homo sapiens
cagcaagagaggaaacguu

SEQ ID NO: 1441643 - RNA, 19 nt, Homo sapiens
ggaguggaccuuuugcaaa

SEQ ID NO: 1441644 - RNA, 19 nt, Homo sapiens
agaggagggaucaaguuaa

SEQ ID NO: 1441645 - RNA, 19 nt, Homo sapiens
gcagacaccuucagggaua

SEQ ID NO: 1441646 - RNA, 19 nt, Homo sapiens
gagugggccuuuccuguua

SEQ ID NO: 1441647 - RNA, 19 nt, Homo sapiens
gcagguggcuggcucagaa

SEQ ID NO: 1441648 - RNA, 19 nt, Homo sapiens
gcaagugggucaauaacug

SEQ ID NO: 1441649 - RNA, 19 nt, Homo sapiens
gaaggaggcccagccauga

SEQ ID NO: 1441650 - RNA, 19 nt, Homo sapiens
ggagugggccuuuccuguu

SEQ ID NO: 1441651 - RNA, 19 nt, Homo sapiens
uaucacaggcucccucuuu

SEQ ID NO: 1441652 - RNA, 19 nt, Homo sapiens
cucagacccuggcaucuua

SEQ ID NO: 1441653 - RNA, 19 nt, Homo sapiens
ggucaccugucucaucuuc

SEQ ID NO: 1441654 - RNA, 19 nt, Homo sapiens
caacuuccgcuucuucaug

SEQ ID NO: 1441655 - RNA, 19 nt, Homo sapiens
guuccucccuagccucuuu

SEQ ID NO: 1441656 - RNA, 19 nt, Homo sapiens
ccucuuugcugccuucaau

SEQ ID NO: 1441657 - RNA, 19 nt, Homo sapiens
uccugaaccugccuccuua

SEQ ID NO: 1441658 - RNA, 19 nt, Homo sapiens
gcaacugguauuuaacaau

SEQ ID NO: 1441659 - RNA, 19 nt, Homo sapiens
gaacccgccuccugaaccu

SEQ ID NO: 1441660 - RNA, 19 nt, Homo sapiens
caacccaccugcccuucuc

SEQ ID NO: 1441661 - RNA, 19 nt, Homo sapiens
ggccuuuccuguuaucaca

SEQ ID NO: 1441662 - RNA, 19 nt, Homo sapiens
cagcaacugguauuuaaca

SEQ ID NO: 1441663 - RNA, 19 nt, Homo sapiens
ccuggcaucuuacaucaag

SEQ ID NO: 1441664 - RNA, 19 nt, Homo sapiens
cuucuucagucuuguuuca

SEQ ID NO: 1441665 - RNA, 19 nt, Homo sapiens
gcccagccaugacacucuu

SEQ ID NO: 1441666 - RNA, 19 nt, Homo sapiens
cugcaaugguguccaaagu

SEQ ID NO: 1441667 - RNA, 19 nt, Homo sapiens
gcccugaguggaagccuuu

SEQ ID NO: 1441668 - RNA, 19 nt, Homo sapiens
ggacugccaagacccucaa

SEQ ID NO: 1441669 - RNA, 19 nt, Homo sapiens
gcuggucaccugucucauc

SEQ ID NO: 1441670 - RNA, 19 nt, Homo sapiens
gcaagugcagacaccuuca

SEQ ID NO: 1441671 - RNA, 19 nt, Homo sapiens
gcaccuacaagggcaagug

SEQ ID NO: 1441672 - RNA, 19 nt, Homo sapiens
gacccuggcaucuuacauc

SEQ ID NO: 1441673 - RNA, 19 nt, Homo sapiens
caccgcaacuuccgcuucu

SEQ ID NO: 1441674 - RNA, 19 nt, Homo sapiens
ucacaggcucccucuuugu

SEQ ID NO: 1441675 - RNA, 19 nt, Homo sapiens
acucuugccugccucucaa

SEQ ID NO: 1441676 - RNA, 19 nt, Homo sapiens
gcaaacagaugaguaauuu

SEQ ID NO: 1441677 - RNA, 19 nt, Homo sapiens
ggaaaucaccuuugacuua

SEQ ID NO: 1441678 - RNA, 19 nt, Homo sapiens
gaaauuggcuuuggcagua

SEQ ID NO: 1441679 - RNA, 19 nt, Homo sapiens
ugacaagacucauguaauu

SEQ ID NO: 1441680 - RNA, 19 nt, Homo sapiens
ggacacaccuggagcuaaa

SEQ ID NO: 1441681 - RNA, 19 nt, Homo sapiens
gaacaaagccagguuaaug

SEQ ID NO: 1441682 - RNA, 19 nt, Homo sapiens
caagaagacauguuuguua

SEQ ID NO: 1441683 - RNA, 19 nt, Homo sapiens
caagauccauucauguuaa

SEQ ID NO: 1441684 - RNA, 19 nt, Homo sapiens
gaagagaguuacaucuaga

SEQ ID NO: 1441685 - RNA, 19 nt, Homo sapiens
gaacaaggaccuacacuuc

SEQ ID NO: 1441686 - RNA, 19 nt, Homo sapiens
ggccaaacuugcacuguua

SEQ ID NO: 1441687 - RNA, 19 nt, Homo sapiens
ucaaauggguggacugaaa

SEQ ID NO: 1441688 - RNA, 19 nt, Homo sapiens
ggaaacacaucugucauug

SEQ ID NO: 1441689 - RNA, 19 nt, Homo sapiens
gaaaugcccaugaacuuaa

SEQ ID NO: 1441690 - RNA, 19 nt, Homo sapiens
caaguuuccugaaguguuu

SEQ ID NO: 1441691 - RNA, 19 nt, Homo sapiens
gaaucaacaucccuagaaa

SEQ ID NO: 1441692 - RNA, 19 nt, Homo sapiens
guugcuggcuccucuauua

SEQ ID NO: 1441693 - RNA, 19 nt, Homo sapiens
ggaaaugcccaugaacuua

SEQ ID NO: 1441694 - RNA, 19 nt, Homo sapiens
gguaggaaaucaccuuuga

SEQ ID NO: 1441695 - RNA, 19 nt, Homo sapiens
gaagacauguuuguuaauc

SEQ ID NO: 1441696 - RNA, 19 nt, Homo sapiens
cccaugaacuuaaagguua

SEQ ID NO: 1441697 - RNA, 19 nt, Homo sapiens
gaaaucaccuuugacuuag

SEQ ID NO: 1441698 - RNA, 19 nt, Homo sapiens
caacuuguccuugauguua

SEQ ID NO: 1441699 - RNA, 19 nt, Homo sapiens
ggaagagaguuacaucuag

SEQ ID NO: 1441700 - RNA, 19 nt, Homo sapiens
caaggugaauguauagauu

SEQ ID NO: 1441701 - RNA, 19 nt, Homo sapiens
ggaguugauuucucuacua

SEQ ID NO: 1441702 - RNA, 19 nt, Homo sapiens
caacaucccuagaaagauc

SEQ ID NO: 1441703 - RNA, 19 nt, Homo sapiens
gaaagugggaaguuuauug

SEQ ID NO: 1441704 - RNA, 19 nt, Homo sapiens
gaguugauuucucuacuaa

SEQ ID NO: 1441705 - RNA, 19 nt, Homo sapiens
guuccaaggugaauguaua

SEQ ID NO: 1441706 - RNA, 19 nt, Homo sapiens
gcucaaagcauucagcaaa

SEQ ID NO: 1441707 - RNA, 19 nt, Homo sapiens
gcaccucguuaaguauuua

SEQ ID NO: 1441708 - RNA, 19 nt, Homo sapiens
gaaggaaacacaucuguca

SEQ ID NO: 1441709 - RNA, 19 nt, Homo sapiens
agaaagaucccuagaaaga

SEQ ID NO: 1441710 - RNA, 19 nt, Homo sapiens
ugacuuagcuuccaguagu

SEQ ID NO: 1441711 - RNA, 19 nt, Homo sapiens
ggacacuggugaugcuauu

SEQ ID NO: 1441712 - RNA, 19 nt, Homo sapiens
uaaauaaccuauggccaaa

SEQ ID NO: 1441713 - RNA, 19 nt, Homo sapiens
caaccuacaugcacuuuag

SEQ ID NO: 1441714 - RNA, 19 nt, Homo sapiens
gaccuuaccaucucuuuaa

SEQ ID NO: 1441715 - RNA, 19 nt, Homo sapiens
gaguaaggcacaagaagua

SEQ ID NO: 1441716 - RNA, 19 nt, Homo sapiens
gaaggagacuuugaagaca

SEQ ID NO: 1441717 - RNA, 19 nt, Homo sapiens
gaguguggguugccuauga

SEQ ID NO: 1441718 - RNA, 19 nt, Homo sapiens
ccucaguccuucaaacuaa

SEQ ID NO: 1441719 - RNA, 19 nt, Homo sapiens
guacaaagcauaaagaaac

SEQ ID NO: 1441720 - RNA, 19 nt, Homo sapiens
aaacacaucugucauuguc

SEQ ID NO: 1441721 - RNA, 19 nt, Homo sapiens
gagaagaaacacagaaaug

SEQ ID NO: 1441722 - RNA, 19 nt, Homo sapiens
gcucuuaucucagugauca

SEQ ID NO: 1441723 - RNA, 19 nt, Homo sapiens
gaaagaauacucagaucug

SEQ ID NO: 1441724 - RNA, 19 nt, Homo sapiens
caagacucauguaauugua

SEQ ID NO: 1441725 - RNA, 19 nt, Homo sapiens
gggaggaucaaauaauaua

SEQ ID NO: 1441726 - RNA, 19 nt, Homo sapiens
uaaccaagacaucccuuua

SEQ ID NO: 1441727 - RNA, 19 nt, Homo sapiens
gcagggaccucagcuuugu

SEQ ID NO: 1441728 - RNA, 19 nt, Homo sapiens
gagcaaguuuccugaagug

SEQ ID NO: 1441729 - RNA, 19 nt, Homo sapiens
caacaucugugugcauuuc

SEQ ID NO: 1441730 - RNA, 19 nt, Homo sapiens
gcaguguacaucagaauaa

SEQ ID NO: 1441731 - RNA, 19 nt, Homo sapiens
cuaaugagaucccaaacug

SEQ ID NO: 1441732 - RNA, 19 nt, Homo sapiens
acaaggaccuacacuucua

SEQ ID NO: 1441733 - RNA, 19 nt, Homo sapiens
ucacucccauuguaaguaa

SEQ ID NO: 1441734 - RNA, 19 nt, Homo sapiens
gggaagagaguuacaucua

SEQ ID NO: 1441735 - RNA, 19 nt, Homo sapiens
gaccucagcuuuguuagga

SEQ ID NO: 1441736 - RNA, 19 nt, Homo sapiens
ugacaagacucuauaacag

SEQ ID NO: 1441737 - RNA, 19 nt, Homo sapiens
gaaagguucuauuccugau

SEQ ID NO: 1441738 - RNA, 19 nt, Homo sapiens
ggaaguuuauugacauuac

SEQ ID NO: 1441739 - RNA, 19 nt, Homo sapiens
ggcaugggcuugucuauac

SEQ ID NO: 1441740 - RNA, 19 nt, Homo sapiens
ggacugaacaugggcaauu

SEQ ID NO: 1441741 - RNA, 19 nt, Homo sapiens
gagcaaagaaggaaacaca

SEQ ID NO: 1441742 - RNA, 19 nt, Homo sapiens
gaaauauugugagagaauc

SEQ ID NO: 1441743 - RNA, 19 nt, Homo sapiens
ggacauugaaauauuguga

SEQ ID NO: 1441744 - RNA, 19 nt, Homo sapiens
cuaccacacuggauuaaau

SEQ ID NO: 1441745 - RNA, 19 nt, Homo sapiens
uaucagcucuuaucucagu

SEQ ID NO: 1441746 - RNA, 19 nt, Homo sapiens
ugaaggauccaauuucuug

SEQ ID NO: 1441747 - RNA, 19 nt, Homo sapiens
cuagaugcuuguaugagua

SEQ ID NO: 1441748 - RNA, 19 nt, Homo sapiens
gccgaggacucuuuaaauc

SEQ ID NO: 1441749 - RNA, 19 nt, Homo sapiens
ggacagcauucagcagaug

SEQ ID NO: 1441750 - RNA, 19 nt, Homo sapiens
caucuaaagucaaaucucu

SEQ ID NO: 1441751 - RNA, 19 nt, Homo sapiens
gcuccucuauuaccaagaa

SEQ ID NO: 1441752 - RNA, 19 nt, Homo sapiens
gugaugcuauuauccugua

SEQ ID NO: 1441753 - RNA, 19 nt, Homo sapiens
ggaggaaauuauugugaca

SEQ ID NO: 1441754 - RNA, 19 nt, Homo sapiens
auggauagcuuaugaagga

SEQ ID NO: 1441755 - RNA, 19 nt, Homo sapiens
cuagaaagugggaaguuua

SEQ ID NO: 1441756 - RNA, 19 nt, Homo sapiens
gcacaauucacaagcaugu

SEQ ID NO: 1441757 - RNA, 19 nt, Homo sapiens
cuaccuagaugcuuguaug

SEQ ID NO: 1441758 - RNA, 19 nt, Homo sapiens
acuaucagcucuuaucuca

SEQ ID NO: 1441759 - RNA, 19 nt, Homo sapiens
ccuagaaagugggaaguuu

SEQ ID NO: 1441760 - RNA, 19 nt, Homo sapiens
gacuuuaaauacuggguuu

SEQ ID NO: 1441761 - RNA, 19 nt, Homo sapiens
uaaggcacaagaaguauuu

SEQ ID NO: 1441762 - RNA, 19 nt, Homo sapiens
ggaagcuacuguccucaca

SEQ ID NO: 1441763 - RNA, 19 nt, Homo sapiens
ggaacuaucagcucuuauc

SEQ ID NO: 1441764 - RNA, 19 nt, Homo sapiens
gacacuucauccuagauuu

SEQ ID NO: 1441765 - RNA, 19 nt, Homo sapiens
gcaaagaaggaaacacauc

SEQ ID NO: 1441766 - RNA, 19 nt, Homo sapiens
gaaagagcaaagaaggaaa

SEQ ID NO: 1441767 - RNA, 19 nt, Homo sapiens
aggcagaaguggagacuga

SEQ ID NO: 1441768 - RNA, 19 nt, Homo sapiens
ggcaacaucugugugcauu

SEQ ID NO: 1441769 - RNA, 19 nt, Homo sapiens
ugauuugacuucacucaug

SEQ ID NO: 1441770 - RNA, 19 nt, Homo sapiens
guagcccuaucuugucuuu

SEQ ID NO: 1441771 - RNA, 19 nt, Homo sapiens
aaagaacaaagccagguua

SEQ ID NO: 1441772 - RNA, 19 nt, Homo sapiens
acucgaagacccacuauuu

SEQ ID NO: 1441773 - RNA, 19 nt, Homo sapiens
uaaggagaggcaucaauuu

SEQ ID NO: 1441774 - RNA, 19 nt, Homo sapiens
acacuucauccuagauuua

SEQ ID NO: 1441775 - RNA, 19 nt, Homo sapiens
gcaaguuuccugaaguguu

SEQ ID NO: 1441776 - RNA, 19 nt, Homo sapiens
gaacagacauuauagcuua

SEQ ID NO: 1441777 - RNA, 19 nt, Homo sapiens
gaacagcaaugaccucaaa

SEQ ID NO: 1441778 - RNA, 19 nt, Homo sapiens
gaacugaaauaggcaaaua

SEQ ID NO: 1441779 - RNA, 19 nt, Homo sapiens
caaagucacugguauauug

SEQ ID NO: 1441780 - RNA, 19 nt, Homo sapiens
aaacaucgcuucagaaaga

SEQ ID NO: 1441781 - RNA, 19 nt, Homo sapiens
ccaaaucaguguuguaauu

SEQ ID NO: 1441782 - RNA, 19 nt, Homo sapiens
ugagauaucuggaacaauu

SEQ ID NO: 1441783 - RNA, 19 nt, Homo sapiens
gaacaauuccucauggaua

SEQ ID NO: 1441784 - RNA, 19 nt, Homo sapiens
guggaaagcacauauauua

SEQ ID NO: 1441785 - RNA, 19 nt, Homo sapiens
ggaaaggaaugaagcaguu

SEQ ID NO: 1441786 - RNA, 19 nt, Homo sapiens
gaacaguacuuuuccauaa

SEQ ID NO: 1441787 - RNA, 19 nt, Homo sapiens
gaauauucaugccuuguuu

SEQ ID NO: 1441788 - RNA, 19 nt, Homo sapiens
gaagagagcaaaccaguug

SEQ ID NO: 1441789 - RNA, 19 nt, Homo sapiens
ggaacaacuuuaugauuug

SEQ ID NO: 1441790 - RNA, 19 nt, Homo sapiens
gaaaucacauugcuguuca

SEQ ID NO: 1441791 - RNA, 19 nt, Homo sapiens
caucaaauuuggugacuuu

SEQ ID NO: 1441792 - RNA, 19 nt, Homo sapiens
ggagcaagauaagauauuu

SEQ ID NO: 1441793 - RNA, 19 nt, Homo sapiens
guaaagguauccccuauua

SEQ ID NO: 1441794 - RNA, 19 nt, Homo sapiens
ugacuuggcuguuacuuga

SEQ ID NO: 1441795 - RNA, 19 nt, Homo sapiens
gaauucagaucccuucaug

SEQ ID NO: 1441796 - RNA, 19 nt, Homo sapiens
cuaaauagauccuguugga

SEQ ID NO: 1441797 - RNA, 19 nt, Homo sapiens
ucacugguauauuggauua

SEQ ID NO: 1441798 - RNA, 19 nt, Homo sapiens
ggagauccguguaaagaug

SEQ ID NO: 1441799 - RNA, 19 nt, Homo sapiens
uuacauaacugucacugaa

SEQ ID NO: 1441800 - RNA, 19 nt, Homo sapiens
gaugucaguuuauuccuaa

SEQ ID NO: 1441801 - RNA, 19 nt, Homo sapiens
caagaggucuauagaaaca

SEQ ID NO: 1441802 - RNA, 19 nt, Homo sapiens
agacauagaugguagacuu

SEQ ID NO: 1441803 - RNA, 19 nt, Homo sapiens
cauuauagcuuacuagcaa

SEQ ID NO: 1441804 - RNA, 19 nt, Homo sapiens
aaacaugacccacuuauau

SEQ ID NO: 1441805 - RNA, 19 nt, Homo sapiens
cagcacaguuuaagauauu

SEQ ID NO: 1441806 - RNA, 19 nt, Homo sapiens
gaaguuugcuauucuugug

SEQ ID NO: 1441807 - RNA, 19 nt, Homo sapiens
ugaaggcaccuaugacuua

SEQ ID NO: 1441808 - RNA, 19 nt, Homo sapiens
uaaguaugcuccucaaugu

SEQ ID NO: 1441809 - RNA, 19 nt, Homo sapiens
uaccguaacuccaaaugua

SEQ ID NO: 1441810 - RNA, 19 nt, Homo sapiens
caaguaauauaccuguuug

SEQ ID NO: 1441811 - RNA, 19 nt, Homo sapiens
gggcagaaauggacugugu

SEQ ID NO: 1441812 - RNA, 19 nt, Homo sapiens
gaguauuucugaugaguga

SEQ ID NO: 1441813 - RNA, 19 nt, Homo sapiens
cuacuaaucuugccaucuu

SEQ ID NO: 1441814 - RNA, 19 nt, Homo sapiens
gcugaaccacucccaauua

SEQ ID NO: 1441815 - RNA, 19 nt, Homo sapiens
caagagaagucaccacagu

SEQ ID NO: 1441816 - RNA, 19 nt, Homo sapiens
gcaccuaugacuuaccuua

SEQ ID NO: 1441817 - RNA, 19 nt, Homo sapiens
ccacagaccuaucccaaca

SEQ ID NO: 1441818 - RNA, 19 nt, Homo sapiens
agaguugggugguuauuaa

SEQ ID NO: 1441819 - RNA, 19 nt, Homo sapiens
ggaugucaguuuauuccua

SEQ ID NO: 1441820 - RNA, 19 nt, Homo sapiens
agagagaguucgcaucaaa

SEQ ID NO: 1441821 - RNA, 19 nt, Homo sapiens
ggccugagccaccagauua

SEQ ID NO: 1441822 - RNA, 19 nt, Homo sapiens
ggaaguuuaucaugccuau

SEQ ID NO: 1441823 - RNA, 19 nt, Homo sapiens
ggaugugcguaauaacuuu

SEQ ID NO: 1441824 - RNA, 19 nt, Homo sapiens
uaagacaaguggauguuau

SEQ ID NO: 1441825 - RNA, 19 nt, Homo sapiens
gugaagaauuaaugcagua

SEQ ID NO: 1441826 - RNA, 19 nt, Homo sapiens
gcucagauuauuugguuua

SEQ ID NO: 1441827 - RNA, 19 nt, Homo sapiens
ggucuaguccaguuuauuu

SEQ ID NO: 1441828 - RNA, 19 nt, Homo sapiens
gcagguacauuaaugaacu

SEQ ID NO: 1441829 - RNA, 19 nt, Homo sapiens
uaucuuaccucggcaugua

SEQ ID NO: 1441830 - RNA, 19 nt, Homo sapiens
gacaacacauacacacuug

SEQ ID NO: 1441831 - RNA, 19 nt, Homo sapiens
aaacuuuacuuuccagaug

SEQ ID NO: 1441832 - RNA, 19 nt, Homo sapiens
ccuaauggcuugaaauucu

SEQ ID NO: 1441833 - RNA, 19 nt, Homo sapiens
auaaugcacuucagagaaa

SEQ ID NO: 1441834 - RNA, 19 nt, Homo sapiens
agaaauccuuugaagauga

SEQ ID NO: 1441835 - RNA, 19 nt, Homo sapiens
acaaguggauguuauggaa

SEQ ID NO: 1441836 - RNA, 19 nt, Homo sapiens
ggagagagaguucgcauca

SEQ ID NO: 1441837 - RNA, 19 nt, Homo sapiens
gcacuucagagaaauuaaa

SEQ ID NO: 1441838 - RNA, 19 nt, Homo sapiens
gaaauccuuugaagaugau

SEQ ID NO: 1441839 - RNA, 19 nt, Homo sapiens
gcagguugguggaaaggaa

SEQ ID NO: 1441840 - RNA, 19 nt, Homo sapiens
ucagaaagagaacuguuua

SEQ ID NO: 1441841 - RNA, 19 nt, Homo sapiens
gaaauucuagucuguuugu

SEQ ID NO: 1441842 - RNA, 19 nt, Homo sapiens
gcucggaugucaguuuauu

SEQ ID NO: 1441843 - RNA, 19 nt, Homo sapiens
ccucauggauauagagauu

SEQ ID NO: 1441844 - RNA, 19 nt, Homo sapiens
ucuaagaguugggugguua

SEQ ID NO: 1441845 - RNA, 19 nt, Homo sapiens
guaagagguuugaguaguc

SEQ ID NO: 1441846 - RNA, 19 nt, Homo sapiens
aaagauggguacuaucaug

SEQ ID NO: 1441847 - RNA, 19 nt, Homo sapiens
gguuugagcgucagugaua

SEQ ID NO: 1441848 - RNA, 19 nt, Homo sapiens
agcaagaggucuauagaaa

SEQ ID NO: 1441849 - RNA, 19 nt, Homo sapiens
gcacagacagaacaaacaa

SEQ ID NO: 1441850 - RNA, 19 nt, Homo sapiens
gcagaaaauugccaugaaa

SEQ ID NO: 1441851 - RNA, 19 nt, Homo sapiens
ccacugugcuauccuugaa

SEQ ID NO: 1441852 - RNA, 19 nt, Homo sapiens
gauggguacuaucaugauu

SEQ ID NO: 1441853 - RNA, 19 nt, Homo sapiens
augcagaccuagauccuua

SEQ ID NO: 1441854 - RNA, 19 nt, Homo sapiens
gauggagucuggugugauc

SEQ ID NO: 1441855 - RNA, 19 nt, Homo sapiens
ggaauuggagucagcagaa

SEQ ID NO: 1441856 - RNA, 19 nt, Homo sapiens
aguccgagcuuaucuaaau

SEQ ID NO: 1441857 - RNA, 19 nt, Homo sapiens
gagcagaguccgagcuuau

SEQ ID NO: 1441858 - RNA, 19 nt, Homo sapiens
ccacagagcacacaagaag

SEQ ID NO: 1441859 - RNA, 19 nt, Homo sapiens
ugaaauaggcaaauacugu

SEQ ID NO: 1441860 - RNA, 19 nt, Homo sapiens
ggaaacaaacauguauuga

SEQ ID NO: 1441861 - RNA, 19 nt, Homo sapiens
gagcaagaggucuauagaa

SEQ ID NO: 1441862 - RNA, 19 nt, Homo sapiens
gcagcucaccauaugauaa

SEQ ID NO: 1441863 - RNA, 19 nt, Homo sapiens
cuagggaacagacauuaua

SEQ ID NO: 1441864 - RNA, 19 nt, Homo sapiens
gguaagagguuugaguagu

SEQ ID NO: 1441865 - RNA, 19 nt, Homo sapiens
ccucuucuauuccuauauu

SEQ ID NO: 1441866 - RNA, 19 nt, Homo sapiens
gcugagauaucuggaacaa

SEQ ID NO: 1441867 - RNA, 19 nt, Homo sapiens
ugaaacgauucucugcuuu

SEQ ID NO: 1441868 - RNA, 19 nt, Homo sapiens
ggagcagaguccgagcuua

SEQ ID NO: 1441869 - RNA, 19 nt, Homo sapiens
uuaaugcagucaucccuuu

SEQ ID NO: 1441870 - RNA, 19 nt, Homo sapiens
ugaaagauggguacuauca

SEQ ID NO: 1441871 - RNA, 19 nt, Homo sapiens
gaacuuacaauacacuucu

SEQ ID NO: 1441872 - RNA, 19 nt, Homo sapiens
ccagcaaggugauggaugu

SEQ ID NO: 1441873 - RNA, 19 nt, Homo sapiens
aaacugaaggcaccuauga

SEQ ID NO: 1441874 - RNA, 19 nt, Homo sapiens
ucacauugcuguucaugag

SEQ ID NO: 1441875 - RNA, 19 nt, Homo sapiens
acaaucaaguaacaacuga

SEQ ID NO: 1441876 - RNA, 19 nt, Homo sapiens
gcacaucacugaacucaau

SEQ ID NO: 1441877 - RNA, 19 nt, Homo sapiens
gagccaagcuguccugaug

SEQ ID NO: 1441878 - RNA, 19 nt, Homo sapiens
gcagaacaaucgccucaga

SEQ ID NO: 1441879 - RNA, 19 nt, Homo sapiens
gagaacaggcucacggaua

SEQ ID NO: 1441880 - RNA, 19 nt, Homo sapiens
gcaacuggcuccugcucaa

SEQ ID NO: 1441881 - RNA, 19 nt, Homo sapiens
ucccugaggugccuaguua

SEQ ID NO: 1441882 - RNA, 19 nt, Homo sapiens
caacgucaauggccucaug

SEQ ID NO: 1441883 - RNA, 19 nt, Homo sapiens
gcaaccaccuggaauacau

SEQ ID NO: 1441884 - RNA, 19 nt, Homo sapiens
guaaccagcuguugcagau

SEQ ID NO: 1441885 - RNA, 19 nt, Homo sapiens
uaucaucaaugucaacguu

SEQ ID NO: 1441886 - RNA, 19 nt, Homo sapiens
agaacaggcucacggauau

SEQ ID NO: 1441887 - RNA, 19 nt, Homo sapiens
acaaccagcuggagaacuu

SEQ ID NO: 1441888 - RNA, 19 nt, Homo sapiens
ccacauccgucucuucuac

SEQ ID NO: 1441889 - RNA, 19 nt, Homo sapiens
gcaaucagaucagcuucau

SEQ ID NO: 1441890 - RNA, 19 nt, Homo sapiens
acacugaucugacuaccau

SEQ ID NO: 1441891 - RNA, 19 nt, Homo sapiens
gaaggcacccaaugagugu

SEQ ID NO: 1441892 - RNA, 19 nt, Homo sapiens
ccauccagcugcagaacaa

SEQ ID NO: 1441893 - RNA, 19 nt, Homo sapiens
gaacaucucccugcagaac

SEQ ID NO: 1441894 - RNA, 19 nt, Homo sapiens
ggccauugccgccauugua

SEQ ID NO: 1441895 - RNA, 19 nt, Homo sapiens
gacucuaccuguccaacaa

SEQ ID NO: 1441896 - RNA, 19 nt, Homo sapiens
gcacggcaaccaccuggaa

SEQ ID NO: 1441897 - RNA, 19 nt, Homo sapiens
acaacaagcugcagguucu

SEQ ID NO: 1441898 - RNA, 19 nt, Homo sapiens
gaaugucuuccgcauguug

SEQ ID NO: 1441899 - RNA, 19 nt, Homo sapiens
gugccuaguuacccagaaa

SEQ ID NO: 1441900 - RNA, 19 nt, Homo sapiens
caaccgucuuacucucuuu

SEQ ID NO: 1441901 - RNA, 19 nt, Homo sapiens
ucaacacgcacaucacuga

SEQ ID NO: 1441902 - RNA, 19 nt, Homo sapiens
gccauugccgccauuguaa

SEQ ID NO: 1441903 - RNA, 19 nt, Homo sapiens
agacuacacugaucugacu

SEQ ID NO: 1441904 - RNA, 19 nt, Homo sapiens
gaagacuacacugaucuga

SEQ ID NO: 1441905 - RNA, 19 nt, Homo sapiens
uaaccagcccuguggaaga

SEQ ID NO: 1441906 - RNA, 19 nt, Homo sapiens
gagcugcggcuguaugaca

SEQ ID NO: 1441907 - RNA, 19 nt, Homo sapiens
ugugugagcugcggcugua

SEQ ID NO: 1441908 - RNA, 19 nt, Homo sapiens
agaauagccucacccacau

SEQ ID NO: 1441909 - RNA, 19 nt, Homo sapiens
guggaagacuacacugauc

SEQ ID NO: 1441910 - RNA, 19 nt, Homo sapiens
gccagucccucauuaucau

SEQ ID NO: 1441911 - RNA, 19 nt, Homo sapiens
aaccacaucucuucucuac

SEQ ID NO: 1441912 - RNA, 19 nt, Homo sapiens
gaugaaggcacccaaugag

SEQ ID NO: 1441913 - RNA, 19 nt, Homo sapiens
ggccagucccucauuauca

SEQ ID NO: 1441914 - RNA, 19 nt, Homo sapiens
ggaauaucuucgccaacgu

SEQ ID NO: 1441915 - RNA, 19 nt, Homo sapiens
caaccacaaccuccagaga

SEQ ID NO: 1441916 - RNA, 19 nt, Homo sapiens
ucagcaaccuccgccaguu

SEQ ID NO: 1441917 - RNA, 19 nt, Homo sapiens
gcagaugaaggcacccaau

SEQ ID NO: 1441918 - RNA, 19 nt, Homo sapiens
gaagcauuaucuccuuuug

SEQ ID NO: 1441919 - RNA, 19 nt, Homo sapiens
caacaacaagcugcagguu

SEQ ID NO: 1441920 - RNA, 19 nt, Homo sapiens
gccaagcuguccugaugca

SEQ ID NO: 1441921 - RNA, 19 nt, Homo sapiens
ccuggucucuuccacaaca

SEQ ID NO: 1441922 - RNA, 19 nt, Homo sapiens
agaugaaggcacccaauga

SEQ ID NO: 1441923 - RNA, 19 nt, Homo sapiens
uaucuucgccaacgucaau

SEQ ID NO: 1441924 - RNA, 19 nt, Homo sapiens
cugaagcauuaucuccuuu

SEQ ID NO: 1441925 - RNA, 19 nt, Homo sapiens
auucuuagccgcaaucaga

SEQ ID NO: 1441926 - RNA, 19 nt, Homo sapiens
aaugagcugucgcgcauca

SEQ ID NO: 1441927 - RNA, 19 nt, Homo sapiens
ucaaccgucuuacucucuu

SEQ ID NO: 1441928 - RNA, 19 nt, Homo sapiens
ggaagacuacacugaucug

SEQ ID NO: 1441929 - RNA, 19 nt, Homo sapiens
uggccaaccugcagaacau

SEQ ID NO: 1441930 - RNA, 19 nt, Homo sapiens
caacacgcacaucacugaa

SEQ ID NO: 1441931 - RNA, 19 nt, Homo sapiens
gcuaaccagcccuguggaa

SEQ ID NO: 1441932 - RNA, 19 nt, Homo sapiens
guuagggacggacacugua

SEQ ID NO: 1441933 - RNA, 19 nt, Homo sapiens
agaacaaccagcuggagaa

SEQ ID NO: 1441934 - RNA, 19 nt, Homo sapiens
cagaugaaggcacccaaug

SEQ ID NO: 1441935 - RNA, 19 nt, Homo sapiens
cccugaggauugagaagaa

SEQ ID NO: 1441936 - RNA, 19 nt, Homo sapiens
ccagcccuguggaagacua

SEQ ID NO: 1441937 - RNA, 19 nt, Homo sapiens
gaacaaccagcuggagaac

SEQ ID NO: 1441938 - RNA, 19 nt, Homo sapiens
gugcaggguuggccuacca

SEQ ID NO: 1441939 - RNA, 19 nt, Homo sapiens
acaucucccugcagaacaa

SEQ ID NO: 1441940 - RNA, 19 nt, Homo sapiens
ucucuucucuacccgacaa

SEQ ID NO: 1441941 - RNA, 19 nt, Homo sapiens
caaccacaucucuucucua

SEQ ID NO: 1441942 - RNA, 19 nt, Homo sapiens
cuuacucucuuugggaauu

SEQ ID NO: 1441943 - RNA, 19 nt, Homo sapiens
acccagacacacccaguua

SEQ ID NO: 1441944 - RNA, 19 nt, Homo sapiens
acugaagcauuaucuccuu

SEQ ID NO: 1441945 - RNA, 19 nt, Homo sapiens
cauugccgccauuguaauu

SEQ ID NO: 1441946 - RNA, 19 nt, Homo sapiens
acacgcacaucacugaacu

SEQ ID NO: 1441947 - RNA, 19 nt, Homo sapiens
gguuagggacggacacugu

SEQ ID NO: 1441948 - RNA, 19 nt, Homo sapiens
acaaccacaucucuucucu

SEQ ID NO: 1441949 - RNA, 19 nt, Homo sapiens
ugcaggaacuggcucuaca

SEQ ID NO: 1441950 - RNA, 19 nt, Homo sapiens
gaacaggcucacggauauc

SEQ ID NO: 1441951 - RNA, 19 nt, Homo sapiens
caaugucaacguugcuguu

SEQ ID NO: 1441952 - RNA, 19 nt, Homo sapiens
ccaguaaccagcuguugca

SEQ ID NO: 1441953 - RNA, 19 nt, Homo sapiens
ggacucacgaagcucaauc

SEQ ID NO: 1441954 - RNA, 19 nt, Homo sapiens
aagcuguccugaugcagau

SEQ ID NO: 1441955 - RNA, 19 nt, Homo sapiens
ucaucgcccugaggauuga

SEQ ID NO: 1441956 - RNA, 19 nt, Homo sapiens
cuacagcagaaccagauug

SEQ ID NO: 1441957 - RNA, 19 nt, Homo sapiens
cauuguaauuggcauuguc

SEQ ID NO: 1441958 - RNA, 19 nt, Homo sapiens
acugaugaccgcagcguuu

SEQ ID NO: 1441959 - RNA, 19 nt, Homo sapiens
gaggugugacucagacauc

SEQ ID NO: 1441960 - RNA, 19 nt, Homo sapiens
gugagcugcggcuguauga

SEQ ID NO: 1441961 - RNA, 19 nt, Homo sapiens
ugaggauugagaagaauga

SEQ ID NO: 1441962 - RNA, 19 nt, Homo sapiens
cagcucaaccgucuuacuc

SEQ ID NO: 1441963 - RNA, 19 nt, Homo sapiens
gaauagccucacccacauc

SEQ ID NO: 1441964 - RNA, 19 nt, Homo sapiens
uggcugcccuagcgagugu

SEQ ID NO: 1441965 - RNA, 19 nt, Homo sapiens
ucacugacaucucauuaaa

SEQ ID NO: 1441966 - RNA, 19 nt, Homo sapiens
gcugagcugucgcaacuua

SEQ ID NO: 1441967 - RNA, 19 nt, Homo sapiens
guaggugccuggccaguuu

SEQ ID NO: 1441968 - RNA, 19 nt, Homo sapiens
ggcaagaucuggagcaaga

SEQ ID NO: 1441969 - RNA, 19 nt, Homo sapiens
gcaagaagcugcacaucac

SEQ ID NO: 1441970 - RNA, 19 nt, Homo sapiens
ccaacgcgcuggcggaauu

SEQ ID NO: 1441971 - RNA, 19 nt, Homo sapiens
ggaagaagcacaaguucga

SEQ ID NO: 1441972 - RNA, 19 nt, Homo sapiens
gagcugucgcaacuuauua

SEQ ID NO: 1441973 - RNA, 19 nt, Homo sapiens
caacuuacaccgugcucua

SEQ ID NO: 1441974 - RNA, 19 nt, Homo sapiens
ggcacgagcugaagcacaa

SEQ ID NO: 1441975 - RNA, 19 nt, Homo sapiens
gcccagaccuacacuugga

SEQ ID NO: 1441976 - RNA, 19 nt, Homo sapiens
ggacccugcugcuauaaac

SEQ ID NO: 1441977 - RNA, 19 nt, Homo sapiens
cacggacccugcugcuaua

SEQ ID NO: 1441978 - RNA, 19 nt, Homo sapiens
gagggaagguuggcugaag

SEQ ID NO: 1441979 - RNA, 19 nt, Homo sapiens
cgucagggcaccaagauga

SEQ ID NO: 1441980 - RNA, 19 nt, Homo sapiens
uggauacucuggagaaugg

SEQ ID NO: 1441981 - RNA, 19 nt, Homo sapiens
cuagcgaggacccaacuua

SEQ ID NO: 1441982 - RNA, 19 nt, Homo sapiens
cggagaugcugccguggaa

SEQ ID NO: 1441983 - RNA, 19 nt, Homo sapiens
gagaugcugccguggaaga

SEQ ID NO: 1441984 - RNA, 19 nt, Homo sapiens
ccauggcccugcugcucua

SEQ ID NO: 1441985 - RNA, 19 nt, Homo sapiens
acacggacccugcugcuau

SEQ ID NO: 1441986 - RNA, 19 nt, Homo sapiens
gggcccagaccuacacuug

SEQ ID NO: 1441987 - RNA, 19 nt, Homo sapiens
cccaagggcuacgcuguga

SEQ ID NO: 1441988 - RNA, 19 nt, Homo sapiens
ccuggccaguuuccuguuu

SEQ ID NO: 1441989 - RNA, 19 nt, Homo sapiens
aggcugagcugucgcaacu

SEQ ID NO: 1441990 - RNA, 19 nt, Homo sapiens
uggcugaaguuccuagucu

SEQ ID NO: 1441991 - RNA, 19 nt, Homo sapiens
ggaagaggaagaggagcaa

SEQ ID NO: 1441992 - RNA, 19 nt, Homo sapiens
gggaagguuggcugaaguu

SEQ ID NO: 1441993 - RNA, 19 nt, Homo sapiens
gaagcacaaggccgugaug

SEQ ID NO: 1441994 - RNA, 19 nt, Homo sapiens
cguggaagaagcacaaguu

SEQ ID NO: 1441995 - RNA, 19 nt, Homo sapiens
gcugugagccugcacuacu

SEQ ID NO: 1441996 - RNA, 19 nt, Homo sapiens
gcugaaguuccuagucuca

SEQ ID NO: 1441997 - RNA, 19 nt, Homo sapiens
ggaauuuaaacgccucaag

SEQ ID NO: 1441998 - RNA, 19 nt, Homo sapiens
gcaaugccaccaccaucca

SEQ ID NO: 1441999 - RNA, 19 nt, Homo sapiens
cgcaagaagcugcacauca

SEQ ID NO: 1442000 - RNA, 19 nt, Homo sapiens
gcagcgagagcuccaucga

SEQ ID NO: 1442001 - RNA, 19 nt, Homo sapiens
ugagcugucgcaacuuauu

SEQ ID NO: 1442002 - RNA, 19 nt, Homo sapiens
gcuccaagcgcaagaagcu

SEQ ID NO: 1442003 - RNA, 19 nt, Homo sapiens
ggucuucgccuggguguac

SEQ ID NO: 1442004 - RNA, 19 nt, Homo sapiens
ggacugaaguguguauauu

SEQ ID NO: 1442005 - RNA, 19 nt, Homo sapiens
gagaguaaguccagcauca

SEQ ID NO: 1442006 - RNA, 19 nt, Homo sapiens
gcugaggacuuuaauaucu

SEQ ID NO: 1442007 - RNA, 19 nt, Homo sapiens
ggagccagauguacaccua

SEQ ID NO: 1442008 - RNA, 19 nt, Homo sapiens
ggagugugcugcugugcuu

SEQ ID NO: 1442009 - RNA, 19 nt, Homo sapiens
ggagaucacccgcuucuuc

SEQ ID NO: 1442010 - RNA, 19 nt, Homo sapiens
ggaggagcuucuacgugua

SEQ ID NO: 1442011 - RNA, 19 nt, Homo sapiens
ccacaaccuuccuguacuu

SEQ ID NO: 1442012 - RNA, 19 nt, Homo sapiens
cagcugaggacuuuaauau

SEQ ID NO: 1442013 - RNA, 19 nt, Homo sapiens
ggucagcuccugcuucuuc

SEQ ID NO: 1442014 - RNA, 19 nt, Homo sapiens
gacugaaguguguauauuu

SEQ ID NO: 1442015 - RNA, 19 nt, Homo sapiens
cuucccaccugcucucaua

SEQ ID NO: 1442016 - RNA, 19 nt, Homo sapiens
ugagauagagccugagaug

SEQ ID NO: 1442017 - RNA, 19 nt, Homo sapiens
gacagaggagccagaugua

SEQ ID NO: 1442018 - RNA, 19 nt, Homo sapiens
cugaggacuuuaauaucua

SEQ ID NO: 1442019 - RNA, 19 nt, Homo sapiens
ccaaugugcucuuccucau

SEQ ID NO: 1442020 - RNA, 19 nt, Homo sapiens
uggauggacugaagugugu

SEQ ID NO: 1442021 - RNA, 19 nt, Homo sapiens
gagauccuguacccugaug

SEQ ID NO: 1442022 - RNA, 19 nt, Homo sapiens
uggcuuuguuagacuauuu

SEQ ID NO: 1442023 - RNA, 19 nt, Homo sapiens
agacagaggagccagaugu

SEQ ID NO: 1442024 - RNA, 19 nt, Homo sapiens
gaggagcuucuacguguau

SEQ ID NO: 1442025 - RNA, 19 nt, Homo sapiens
caugguggauggacugaag

SEQ ID NO: 1442026 - RNA, 19 nt, Homo sapiens
gauccucuucuccuacaaa

SEQ ID NO: 1442027 - RNA, 19 nt, Homo sapiens
ugacauggcccaggcuuuc

SEQ ID NO: 1442028 - RNA, 19 nt, Homo sapiens
gggcucugcuguguagaug

SEQ ID NO: 1442029 - RNA, 19 nt, Homo sapiens
ggguggcuuuguuagacua

SEQ ID NO: 1442030 - RNA, 19 nt, Homo sapiens
gcuggaaggccaucaaugc

SEQ ID NO: 1442031 - RNA, 19 nt, Homo sapiens
cagaggagccagauguaca

SEQ ID NO: 1442032 - RNA, 19 nt, Homo sapiens
caaccuuccuguacuucag

SEQ ID NO: 1442033 - RNA, 19 nt, Homo sapiens
cucgaacgcugcaacuguu

SEQ ID NO: 1442034 - RNA, 19 nt, Homo sapiens
aaugugcucuuccucaucu

SEQ ID NO: 1442035 - RNA, 19 nt, Homo sapiens
gccacaaccuuccuguacu

SEQ ID NO: 1442036 - RNA, 19 nt, Homo sapiens
auuugcaggucgugagaua

SEQ ID NO: 1442037 - RNA, 19 nt, Homo sapiens
guggucauccuucccaaga

SEQ ID NO: 1442038 - RNA, 19 nt, Homo sapiens
ccaucgagcugagugugau

SEQ ID NO: 1442039 - RNA, 19 nt, Homo sapiens
aaacaucagugugccucau

SEQ ID NO: 1442040 - RNA, 19 nt, Homo sapiens
ucagcugaggacuuuaaua

SEQ ID NO: 1442041 - RNA, 19 nt, Homo sapiens
gaguaaguccagcaucaag

SEQ ID NO: 1442042 - RNA, 19 nt, Homo sapiens
ggcccaggcuuuccuucca

SEQ ID NO: 1442043 - RNA, 19 nt, Homo sapiens
uggccuaccuggaugacau

SEQ ID NO: 1442044 - RNA, 19 nt, Homo sapiens
gaggggcucugcuguguag

SEQ ID NO: 1442045 - RNA, 19 nt, Homo sapiens
gcugcucuacgaagacauu

SEQ ID NO: 1442046 - RNA, 19 nt, Homo sapiens
gauggacugaaguguguau

SEQ ID NO: 1442047 - RNA, 19 nt, Homo sapiens
gugcagccccucugauuuu

SEQ ID NO: 1442048 - RNA, 19 nt, Homo sapiens
gcugccugcugcugcucua

SEQ ID NO: 1442049 - RNA, 19 nt, Homo sapiens
gacguucugugggcaguag

SEQ ID NO: 1442050 - RNA, 19 nt, Homo sapiens
ccucuucuccuacaaaugc

SEQ ID NO: 1442051 - RNA, 19 nt, Homo sapiens
cuucuucgcuccgcucauc

SEQ ID NO: 1442052 - RNA, 19 nt, Homo sapiens
ccucgaacgcugcaacugu

SEQ ID NO: 1442053 - RNA, 19 nt, Homo sapiens
gaggaaaacuggauuaaua

SEQ ID NO: 1442054 - RNA, 19 nt, Homo sapiens
aaaccacgcuguaauuauu

SEQ ID NO: 1442055 - RNA, 19 nt, Homo sapiens
gugucaugcuuauguauua

SEQ ID NO: 1442056 - RNA, 19 nt, Homo sapiens
gagcaccaauucucugaug

SEQ ID NO: 1442057 - RNA, 19 nt, Homo sapiens
gaaaccacgcuguaauuau

SEQ ID NO: 1442058 - RNA, 19 nt, Homo sapiens
gaucaucuguacagugcuu

SEQ ID NO: 1442059 - RNA, 19 nt, Homo sapiens
ugaaaccacgcuguaauua

SEQ ID NO: 1442060 - RNA, 19 nt, Homo sapiens
guacagugcuuuggauucu

SEQ ID NO: 1442061 - RNA, 19 nt, Homo sapiens
ucauguaacucuagaagca

SEQ ID NO: 1442062 - RNA, 19 nt, Homo sapiens
gaagcaggccucugaugga

SEQ ID NO: 1442063 - RNA, 19 nt, Homo sapiens
acaguuccaugcugaugua

SEQ ID NO: 1442064 - RNA, 19 nt, Homo sapiens
ccagugagccuucgcagau

SEQ ID NO: 1442065 - RNA, 19 nt, Homo sapiens
gaggugagcauggguuuau

SEQ ID NO: 1442066 - RNA, 19 nt, Homo sapiens
gaagaggaaaacuggauua

SEQ ID NO: 1442067 - RNA, 19 nt, Homo sapiens
ggccaucugugucaugcuu

SEQ ID NO: 1442068 - RNA, 19 nt, Homo sapiens
ggguuggucugcuuugugu

SEQ ID NO: 1442069 - RNA, 19 nt, Homo sapiens
gcaguguucuaccggaagu

SEQ ID NO: 1442070 - RNA, 19 nt, Homo sapiens
ggccucaguuucuccaugu

SEQ ID NO: 1442071 - RNA, 19 nt, Homo sapiens
cuccaugucuucagccauu

SEQ ID NO: 1442072 - RNA, 19 nt, Homo sapiens
gcaccaauucucugaugug

SEQ ID NO: 1442073 - RNA, 19 nt, Homo sapiens
ccagucauguaacucuaga

SEQ ID NO: 1442074 - RNA, 19 nt, Homo sapiens
cggaccagcuggaaagauc

SEQ ID NO: 1442075 - RNA, 19 nt, Homo sapiens
uguaauuauuguccuguug

SEQ ID NO: 1442076 - RNA, 19 nt, Homo sapiens
ggaguguuccuuauucucu

SEQ ID NO: 1442077 - RNA, 19 nt, Homo sapiens
cuagggcgauccaguugug

SEQ ID NO: 1442078 - RNA, 19 nt, Homo sapiens
cuggaaagaucaugauggu

SEQ ID NO: 1442079 - RNA, 19 nt, Homo sapiens
cuucagccauugcaucugu

SEQ ID NO: 1442080 - RNA, 19 nt, Homo sapiens
gcgagcaccaauucucuga

SEQ ID NO: 1442081 - RNA, 19 nt, Homo sapiens
uaucaggccaucuguguca

SEQ ID NO: 1442082 - RNA, 19 nt, Homo sapiens
acagugcuuuggauucuuc

SEQ ID NO: 1442083 - RNA, 19 nt, Homo sapiens
aagggaagcaggccucuga

SEQ ID NO: 1442084 - RNA, 19 nt, Homo sapiens
ucugugucaugcuuaugua

SEQ ID NO: 1442085 - RNA, 19 nt, Homo sapiens
ccaucugugucaugcuuau

SEQ ID NO: 1442086 - RNA, 19 nt, Homo sapiens
uugaaaccacgcuguaauu

SEQ ID NO: 1442087 - RNA, 19 nt, Homo sapiens
gcagcaguagcaccacuug

SEQ ID NO: 1442088 - RNA, 19 nt, Homo sapiens
uuauuguccuguugccaaa

SEQ ID NO: 1442089 - RNA, 19 nt, Homo sapiens
ggaaguguuuugaucaucu

SEQ ID NO: 1442090 - RNA, 19 nt, Homo sapiens
gggaagcaggccucugaug

SEQ ID NO: 1442091 - RNA, 19 nt, Homo sapiens
cgucuuaggcauuauugug

SEQ ID NO: 1442092 - RNA, 19 nt, Homo sapiens
acaaaagccagucauguaa

SEQ ID NO: 1442093 - RNA, 19 nt, Homo sapiens
gcgaggugagcauggguuu

SEQ ID NO: 1442094 - RNA, 19 nt, Homo sapiens
gagagugccaggaggucuu

SEQ ID NO: 1442095 - RNA, 19 nt, Homo sapiens
cuucgcagaugcuggagau

SEQ ID NO: 1442096 - RNA, 19 nt, Homo sapiens
cuuauucucugcggacuca

SEQ ID NO: 1442097 - RNA, 19 nt, Homo sapiens
ucucugauguggaccuucu

SEQ ID NO: 1442098 - RNA, 19 nt, Homo sapiens
guuggucugcuuuguguau

SEQ ID NO: 1442099 - RNA, 19 nt, Homo sapiens
gauguggaccuucuuuagc

SEQ ID NO: 1442100 - RNA, 19 nt, Homo sapiens
ggaccagcuggaaagauca

SEQ ID NO: 1442101 - RNA, 19 nt, Homo sapiens
gucuuaggcauuauuguga

SEQ ID NO: 1442102 - RNA, 19 nt, Homo sapiens
agacggaccagcuggaaag

SEQ ID NO: 1442103 - RNA, 19 nt, Homo sapiens
ugauguggaccuucuuuag

SEQ ID NO: 1442104 - RNA, 19 nt, Homo sapiens
gagcggauguggagaagaa

SEQ ID NO: 1442105 - RNA, 19 nt, Homo sapiens
acagauaacucauccuaaa

SEQ ID NO: 1442106 - RNA, 19 nt, Homo sapiens
gaggauagaccaggaaaua

SEQ ID NO: 1442107 - RNA, 19 nt, Homo sapiens
gaaauaaagggucaacaga

SEQ ID NO: 1442108 - RNA, 19 nt, Homo sapiens
gauaaaugaucacuuacug

SEQ ID NO: 1442109 - RNA, 19 nt, Homo sapiens
uaaagcagcccuugagaaa

SEQ ID NO: 1442110 - RNA, 19 nt, Homo sapiens
ggauagaccaggaaauaaa

SEQ ID NO: 1442111 - RNA, 19 nt, Homo sapiens
caacagauaacucauccua

SEQ ID NO: 1442112 - RNA, 19 nt, Homo sapiens
gaaaugagaaagagucugu

SEQ ID NO: 1442113 - RNA, 19 nt, Homo sapiens
ugacagaggagcagacuuu

SEQ ID NO: 1442114 - RNA, 19 nt, Homo sapiens
gcaacagaccaacagauaa

SEQ ID NO: 1442115 - RNA, 19 nt, Homo sapiens
gggcagcaauauaggguaa

SEQ ID NO: 1442116 - RNA, 19 nt, Homo sapiens
ggccagggcucaugaaucu

SEQ ID NO: 1442117 - RNA, 19 nt, Homo sapiens
gcacccacuuggccucuuu

SEQ ID NO: 1442118 - RNA, 19 nt, Homo sapiens
gagugaaggugucugugaa

SEQ ID NO: 1442119 - RNA, 19 nt, Homo sapiens
cccaggagcugcaacugua

SEQ ID NO: 1442120 - RNA, 19 nt, Homo sapiens
cgacggcucugccuucugu

SEQ ID NO: 1442121 - RNA, 19 nt, Homo sapiens
ggaaccagaaggccuauga

SEQ ID NO: 1442122 - RNA, 19 nt, Homo sapiens
gcaaugccuuccucuugga

SEQ ID NO: 1442123 - RNA, 19 nt, Homo sapiens
gagcagacuuuggucaugu

SEQ ID NO: 1442124 - RNA, 19 nt, Homo sapiens
gcaacgugguggcucuuug

SEQ ID NO: 1442125 - RNA, 19 nt, Homo sapiens
ggagugaaggugucuguga

SEQ ID NO: 1442126 - RNA, 19 nt, Homo sapiens
ggauggucauucccaacua

SEQ ID NO: 1442127 - RNA, 19 nt, Homo sapiens
uagcagagguggauaaagc

SEQ ID NO: 1442128 - RNA, 19 nt, Homo sapiens
ggaaauaaagggucaacag

SEQ ID NO: 1442129 - RNA, 19 nt, Homo sapiens
ccugaaggcugucaaaguc

SEQ ID NO: 1442130 - RNA, 19 nt, Homo sapiens
ggaacgcccugcgcuacuu

SEQ ID NO: 1442131 - RNA, 19 nt, Homo sapiens
gcagcaauauaggguaaau

SEQ ID NO: 1442132 - RNA, 19 nt, Homo sapiens
ccagaaggccuaugagauc

SEQ ID NO: 1442133 - RNA, 19 nt, Homo sapiens
ggagcagacuuuggucaug

SEQ ID NO: 1442134 - RNA, 19 nt, Homo sapiens
ggucugcccuaaggauaaa

SEQ ID NO: 1442135 - RNA, 19 nt, Homo sapiens
gcugggaugucuccaaugg

SEQ ID NO: 1442136 - RNA, 19 nt, Homo sapiens
ccucagcccuguggagaaa

SEQ ID NO: 1442137 - RNA, 19 nt, Homo sapiens
ggaggaagccauugcugau

SEQ ID NO: 1442138 - RNA, 19 nt, Homo sapiens
cagacgaacuggccacauc

SEQ ID NO: 1442139 - RNA, 19 nt, Homo sapiens
gaaaugggcagguguucag

SEQ ID NO: 1442140 - RNA, 19 nt, Homo sapiens
gauaaagcagcccuugaga

SEQ ID NO: 1442141 - RNA, 19 nt, Homo sapiens
ggauaaagcagcccuugag

SEQ ID NO: 1442142 - RNA, 19 nt, Homo sapiens
ggugaacacuggucaagcu

SEQ ID NO: 1442143 - RNA, 19 nt, Homo sapiens
cagcugggaugucuccaau

SEQ ID NO: 1442144 - RNA, 19 nt, Homo sapiens
gcagcucucuguccacaac

SEQ ID NO: 1442145 - RNA, 19 nt, Homo sapiens
guacggacacaucuacaug

SEQ ID NO: 1442146 - RNA, 19 nt, Homo sapiens
caacagaccaacagauaac

SEQ ID NO: 1442147 - RNA, 19 nt, Homo sapiens
cagaaggccuaugagauca

SEQ ID NO: 1442148 - RNA, 19 nt, Homo sapiens
gagccgagaucaccaugac

SEQ ID NO: 1442149 - RNA, 19 nt, Homo sapiens
gcucagggaagcaaggaaa

SEQ ID NO: 1442150 - RNA, 19 nt, Homo sapiens
ugcaacagaccaacagaua

SEQ ID NO: 1442151 - RNA, 19 nt, Homo sapiens
ucucagccaucaacagguu

SEQ ID NO: 1442152 - RNA, 19 nt, Homo sapiens
ggugaccuauggaggaaau

SEQ ID NO: 1442153 - RNA, 19 nt, Homo sapiens
gccagaccaugcaggagaa

SEQ ID NO: 1442154 - RNA, 19 nt, Homo sapiens
ccaucgcuguggccauuaa

SEQ ID NO: 1442155 - RNA, 19 nt, Homo sapiens
gauagcagagguggauaaa

SEQ ID NO: 1442156 - RNA, 19 nt, Homo sapiens
ucccauagcccgguaauga

SEQ ID NO: 1442157 - RNA, 19 nt, Homo sapiens
agacauggcugugcagaac

SEQ ID NO: 1442158 - RNA, 19 nt, Homo sapiens
gauaacucauccuaaacag

SEQ ID NO: 1442159 - RNA, 19 nt, Homo sapiens
gauagaccaggaaauaaag

SEQ ID NO: 1442160 - RNA, 19 nt, Homo sapiens
ccgcuacccuuccuaugug

SEQ ID NO: 1442161 - RNA, 19 nt, Homo sapiens
gggcagguguucagcaacu

SEQ ID NO: 1442162 - RNA, 19 nt, Homo sapiens
acagagaaaugagaaagag

SEQ ID NO: 1442163 - RNA, 19 nt, Homo sapiens
gcacaugauuaugaacaac

SEQ ID NO: 1442164 - RNA, 19 nt, Homo sapiens
cuaaacagagaaaugagaa

SEQ ID NO: 1442165 - RNA, 19 nt, Homo sapiens
ccuacccgauugagcagua

SEQ ID NO: 1442166 - RNA, 19 nt, Homo sapiens
gcaagucucagccaucaac

SEQ ID NO: 1442167 - RNA, 19 nt, Homo sapiens
gugcaucggugugauagca

SEQ ID NO: 1442168 - RNA, 19 nt, Homo sapiens
gauggucauucccaacuac

SEQ ID NO: 1442169 - RNA, 19 nt, Homo sapiens
ggaaaugggcagguguuca

SEQ ID NO: 1442170 - RNA, 19 nt, Homo sapiens
gaggaaaugggcagguguu

SEQ ID NO: 1442171 - RNA, 19 nt, Homo sapiens
ggauaaaugaucacuuacu

SEQ ID NO: 1442172 - RNA, 19 nt, Homo sapiens
gcaacuguacggacacauc

SEQ ID NO: 1442173 - RNA, 19 nt, Homo sapiens
aaugagggccuacccgauu

SEQ ID NO: 1442174 - RNA, 19 nt, Homo sapiens
ggacggaguaugagaagcu

SEQ ID NO: 1442175 - RNA, 19 nt, Homo sapiens
gcccuaaggauaaaugauc

SEQ ID NO: 1442176 - RNA, 19 nt, Homo sapiens
cuccaacccugcuguguuc

SEQ ID NO: 1442177 - RNA, 19 nt, Homo sapiens
gaggugcucagccuugguu

SEQ ID NO: 1442178 - RNA, 19 nt, Homo sapiens
aagcagcccuugagaaacg

SEQ ID NO: 1442179 - RNA, 19 nt, Homo sapiens
cauccuaaacagagaaaug

SEQ ID NO: 1442180 - RNA, 19 nt, Homo sapiens
cugcuggccuggaggaguu

SEQ ID NO: 1442181 - RNA, 19 nt, Homo sapiens
gggucugcccuaaggauaa

SEQ ID NO: 1442182 - RNA, 19 nt, Homo sapiens
cugugaagcugcaguacau

SEQ ID NO: 1442183 - RNA, 19 nt, Homo sapiens
gcgccugguccacgaauug

SEQ ID NO: 1442184 - RNA, 19 nt, Homo sapiens
ugauagcagagguggauaa

SEQ ID NO: 1442185 - RNA, 19 nt, Homo sapiens
cagaggagcagacuuuggu

SEQ ID NO: 1442186 - RNA, 19 nt, Homo sapiens
gaccaacagauaacucauc

SEQ ID NO: 1442187 - RNA, 19 nt, Homo sapiens
uagcugggcgugcaacaga

SEQ ID NO: 1442188 - RNA, 19 nt, Homo sapiens
ccagggcucaugaaucuca

SEQ ID NO: 1442189 - RNA, 19 nt, Homo sapiens
gaggaagccauugcugaug

SEQ ID NO: 1442190 - RNA, 19 nt, Homo sapiens
aggcaagucucagccauca

SEQ ID NO: 1442191 - RNA, 19 nt, Homo sapiens
gccacaacccguucaaugg

SEQ ID NO: 1442192 - RNA, 19 nt, Homo sapiens
agacuuuggucauguacag

SEQ ID NO: 1442193 - RNA, 19 nt, Homo sapiens
aaacagagaaaugagaaag

SEQ ID NO: 1442194 - RNA, 19 nt, Homo sapiens
ccuaaacagagaaaugaga

SEQ ID NO: 1442195 - RNA, 19 nt, Homo sapiens
ccaucucagucacacaugu

SEQ ID NO: 1442196 - RNA, 19 nt, Homo sapiens
caacccugcuguguucaag

SEQ ID NO: 1442197 - RNA, 19 nt, Homo sapiens
auaaagcagcccuugagaa

SEQ ID NO: 1442198 - RNA, 19 nt, Homo sapiens
ggaguaugagaagcucuuu

SEQ ID NO: 1442199 - RNA, 19 nt, Homo sapiens
acauggcugugcagaacuu

SEQ ID NO: 1442200 - RNA, 19 nt, Homo sapiens
gaacgcccugcgcuacuuc

SEQ ID NO: 1442201 - RNA, 19 nt, Homo sapiens
ggcugaccauguucuacuu

SEQ ID NO: 1442202 - RNA, 19 nt, Homo sapiens
gcugggaaggucuuuguca

SEQ ID NO: 1442203 - RNA, 19 nt, Homo sapiens
ggccagaugacagcaggua

SEQ ID NO: 1442204 - RNA, 19 nt, Homo sapiens
gaagagagcuccaauuuag

SEQ ID NO: 1442205 - RNA, 19 nt, Homo sapiens
uauaugagcuggaguuuaa

SEQ ID NO: 1442206 - RNA, 19 nt, Homo sapiens
ccaaagagcuggcuguaau

SEQ ID NO: 1442207 - RNA, 19 nt, Homo sapiens
gggcaugccuccuguugua

SEQ ID NO: 1442208 - RNA, 19 nt, Homo sapiens
gagaagcacuacaaacaug

SEQ ID NO: 1442209 - RNA, 19 nt, Homo sapiens
ccagaagagucgaaacuaa

SEQ ID NO: 1442210 - RNA, 19 nt, Homo sapiens
gaacaagacaagauuucua

SEQ ID NO: 1442211 - RNA, 19 nt, Homo sapiens
ggaagaaagccucuaaaga

SEQ ID NO: 1442212 - RNA, 19 nt, Homo sapiens
aagaagauaugcccacuaa

SEQ ID NO: 1442213 - RNA, 19 nt, Homo sapiens
ggaaaugucuggguauaca

SEQ ID NO: 1442214 - RNA, 19 nt, Homo sapiens
gaaagguugucaggaauga

SEQ ID NO: 1442215 - RNA, 19 nt, Homo sapiens
agagaaagcugaaccugaa

SEQ ID NO: 1442216 - RNA, 19 nt, Homo sapiens
cccuaaagcugaauuaauu

SEQ ID NO: 1442217 - RNA, 19 nt, Homo sapiens
gcaucuaaguuaagagaaa

SEQ ID NO: 1442218 - RNA, 19 nt, Homo sapiens
ccaacaagguaaaugguuu

SEQ ID NO: 1442219 - RNA, 19 nt, Homo sapiens
gcauuaacuucaaggauga

SEQ ID NO: 1442220 - RNA, 19 nt, Homo sapiens
gaggagacaucacccaaau

SEQ ID NO: 1442221 - RNA, 19 nt, Homo sapiens
caagggaacagacucauuu

SEQ ID NO: 1442222 - RNA, 19 nt, Homo sapiens
aaagauccgucgccuguuu

SEQ ID NO: 1442223 - RNA, 19 nt, Homo sapiens
ggacaacacaaauauucua

SEQ ID NO: 1442224 - RNA, 19 nt, Homo sapiens
gauagcauguggaaagguu

SEQ ID NO: 1442225 - RNA, 19 nt, Homo sapiens
ggaacagacucauuucucu

SEQ ID NO: 1442226 - RNA, 19 nt, Homo sapiens
cugaaugucuggcaucuaa

SEQ ID NO: 1442227 - RNA, 19 nt, Homo sapiens
guggaaagguugucaggaa

SEQ ID NO: 1442228 - RNA, 19 nt, Homo sapiens
gaauaagggcuuggaauug

SEQ ID NO: 1442229 - RNA, 19 nt, Homo sapiens
gaagagucgaaacuaaaua

SEQ ID NO: 1442230 - RNA, 19 nt, Homo sapiens
guucgagccuucucuaaga

SEQ ID NO: 1442231 - RNA, 19 nt, Homo sapiens
ggaagaaggaccagaagga

SEQ ID NO: 1442232 - RNA, 19 nt, Homo sapiens
ucacaguucugguauaaag

SEQ ID NO: 1442233 - RNA, 19 nt, Homo sapiens
aagaagagagcuccaauuu

SEQ ID NO: 1442234 - RNA, 19 nt, Homo sapiens
gcuuugaaccguuauauug

SEQ ID NO: 1442235 - RNA, 19 nt, Homo sapiens
caccauccauucuggcaua

SEQ ID NO: 1442236 - RNA, 19 nt, Homo sapiens
gcaagaaucaguguuggaa

SEQ ID NO: 1442237 - RNA, 19 nt, Homo sapiens
ggguauacaucaauaucuu

SEQ ID NO: 1442238 - RNA, 19 nt, Homo sapiens
gagcuccaauuuaggcauu

SEQ ID NO: 1442239 - RNA, 19 nt, Homo sapiens
gaaacaguaacaugucuau

SEQ ID NO: 1442240 - RNA, 19 nt, Homo sapiens
agaagagagcuccaauuua

SEQ ID NO: 1442241 - RNA, 19 nt, Homo sapiens
uccaagauuugucugauaa

SEQ ID NO: 1442242 - RNA, 19 nt, Homo sapiens
ggagucagaggaggaguua

SEQ ID NO: 1442243 - RNA, 19 nt, Homo sapiens
caacacaaauauucuaucc

SEQ ID NO: 1442244 - RNA, 19 nt, Homo sapiens
ugucaggaaugagcucuua

SEQ ID NO: 1442245 - RNA, 19 nt, Homo sapiens
caacuaagaaacaguaaca

SEQ ID NO: 1442246 - RNA, 19 nt, Homo sapiens
ugucacaguucugguauaa

SEQ ID NO: 1442247 - RNA, 19 nt, Homo sapiens
gaucaagccggcaacagaa

SEQ ID NO: 1442248 - RNA, 19 nt, Homo sapiens
ggccagacauuuugcaaua

SEQ ID NO: 1442249 - RNA, 19 nt, Homo sapiens
gaaacaggagcaacgaaug

SEQ ID NO: 1442250 - RNA, 19 nt, Homo sapiens
gggaagagcaggaguugga

SEQ ID NO: 1442251 - RNA, 19 nt, Homo sapiens
cagaagagucgaaacuaaa

SEQ ID NO: 1442252 - RNA, 19 nt, Homo sapiens
aaagcaaccuuccuaccuu

SEQ ID NO: 1442253 - RNA, 19 nt, Homo sapiens
gaugggacaacacaaauau

SEQ ID NO: 1442254 - RNA, 19 nt, Homo sapiens
ggaaacaggagcaacgaau

SEQ ID NO: 1442255 - RNA, 19 nt, Homo sapiens
gcagcgaucuaagagcauu

SEQ ID NO: 1442256 - RNA, 19 nt, Homo sapiens
gcauaaaaguuucccuaaa

SEQ ID NO: 1442257 - RNA, 19 nt, Homo sapiens
ggaggucaauauucagauc

SEQ ID NO: 1442258 - RNA, 19 nt, Homo sapiens
gcuaucaucccaauggaaa

SEQ ID NO: 1442259 - RNA, 19 nt, Homo sapiens
guagugaggucgacagacu

SEQ ID NO: 1442260 - RNA, 19 nt, Homo sapiens
caaauauucuauccaucug

SEQ ID NO: 1442261 - RNA, 19 nt, Homo sapiens
agaauaagggcuuggaauu

SEQ ID NO: 1442262 - RNA, 19 nt, Homo sapiens
aaagugcaaucgaggaaga

SEQ ID NO: 1442263 - RNA, 19 nt, Homo sapiens
ucauaaacuugaaggaugu

SEQ ID NO: 1442264 - RNA, 19 nt, Homo sapiens
ccaauccuccgauacguaa

SEQ ID NO: 1442265 - RNA, 19 nt, Homo sapiens
ggucaaauuccaucacuuc

SEQ ID NO: 1442266 - RNA, 19 nt, Homo sapiens
uagagaagcacuacaaaca

SEQ ID NO: 1442267 - RNA, 19 nt, Homo sapiens
caauuuaggcauuaacuuc

SEQ ID NO: 1442268 - RNA, 19 nt, Homo sapiens
gguaauuaauccagaagag

SEQ ID NO: 1442269 - RNA, 19 nt, Homo sapiens
agauuugucugauaaagug

SEQ ID NO: 1442270 - RNA, 19 nt, Homo sapiens
gaagauaugcccacuaacc

SEQ ID NO: 1442271 - RNA, 19 nt, Homo sapiens
ccagaugggacaacacaaa

SEQ ID NO: 1442272 - RNA, 19 nt, Homo sapiens
cuaagaaacaguaacaugu

SEQ ID NO: 1442273 - RNA, 19 nt, Homo sapiens
ggaggagacaucacccaaa

SEQ ID NO: 1442274 - RNA, 19 nt, Homo sapiens
ugucuggcaucuaaguuaa

SEQ ID NO: 1442275 - RNA, 19 nt, Homo sapiens
gaaagcugaaccugaaugu

SEQ ID NO: 1442276 - RNA, 19 nt, Homo sapiens
ggaaagguugucaggaaug

SEQ ID NO: 1442277 - RNA, 19 nt, Homo sapiens
caagauuugucugauaaag

SEQ ID NO: 1442278 - RNA, 19 nt, Homo sapiens
aagcaaccuuccuaccuuu

SEQ ID NO: 1442279 - RNA, 19 nt, Homo sapiens
ggaaaccuagccaucauuc

SEQ ID NO: 1442280 - RNA, 19 nt, Homo sapiens
guacaaacagaagaaaguu

SEQ ID NO: 1442281 - RNA, 19 nt, Homo sapiens
cacuaacccugcuauccua

SEQ ID NO: 1442282 - RNA, 19 nt, Homo sapiens
acaugucuaucauuuguug

SEQ ID NO: 1442283 - RNA, 19 nt, Homo sapiens
agacucauuucucugaaga

SEQ ID NO: 1442284 - RNA, 19 nt, Homo sapiens
aauaagggcuuggaauugg

SEQ ID NO: 1442285 - RNA, 19 nt, Homo sapiens
guucugguauaaagcaaga

SEQ ID NO: 1442286 - RNA, 19 nt, Homo sapiens
ugacuacgacgaugacuuc

SEQ ID NO: 1442287 - RNA, 19 nt, Homo sapiens
uauuggaguccgcaucuua

SEQ ID NO: 1442288 - RNA, 19 nt, Homo sapiens
cuugggaggucaauauuca

SEQ ID NO: 1442289 - RNA, 19 nt, Homo sapiens
gcuccaauuuaggcauuaa

SEQ ID NO: 1442290 - RNA, 19 nt, Homo sapiens
caaagaagagagcuccaau

SEQ ID NO: 1442291 - RNA, 19 nt, Homo sapiens
cuccaagauuugucugaua

SEQ ID NO: 1442292 - RNA, 19 nt, Homo sapiens
caaccuuccuaccuuucuu

SEQ ID NO: 1442293 - RNA, 19 nt, Homo sapiens
aaacuugaaggauguguga

SEQ ID NO: 1442294 - RNA, 19 nt, Homo sapiens
caagccggcaacagaauaa

SEQ ID NO: 1442295 - RNA, 19 nt, Homo sapiens
agaaguuccugcuaucauc

SEQ ID NO: 1442296 - RNA, 19 nt, Homo sapiens
caugggagcaaguuucuga

SEQ ID NO: 1442297 - RNA, 19 nt, Homo sapiens
ucaacuuucuguggauauu

SEQ ID NO: 1442298 - RNA, 19 nt, Homo sapiens
cauccauucuggcauacaa

SEQ ID NO: 1442299 - RNA, 19 nt, Homo sapiens
ccaaagugaagcuaccaaa

SEQ ID NO: 1442300 - RNA, 19 nt, Homo sapiens
uccagcaccuccucgcaua

SEQ ID NO: 1442301 - RNA, 19 nt, Homo sapiens
ggaauuccaguaucaguac

SEQ ID NO: 1442302 - RNA, 19 nt, Homo sapiens
ucuaugaggagcaaauaaa

SEQ ID NO: 1442303 - RNA, 19 nt, Homo sapiens
ugaaggaugugugaauuuu

SEQ ID NO: 1442304 - RNA, 19 nt, Homo sapiens
gaugaaaugugcagucuaa

SEQ ID NO: 1442305 - RNA, 19 nt, Homo sapiens
gggagcagcuguacaauga

SEQ ID NO: 1442306 - RNA, 19 nt, Homo sapiens
cagcucaucuguccacuua

SEQ ID NO: 1442307 - RNA, 19 nt, Homo sapiens
gggcaaguauagaagauua

SEQ ID NO: 1442308 - RNA, 19 nt, Homo sapiens
gaagugagacuaucagcua

SEQ ID NO: 1442309 - RNA, 19 nt, Homo sapiens
ggagaaguguguaccauau

SEQ ID NO: 1442310 - RNA, 19 nt, Homo sapiens
cgacagauguugaggagaa

SEQ ID NO: 1442311 - RNA, 19 nt, Homo sapiens
caaagcaguuggcucuuaa

SEQ ID NO: 1442312 - RNA, 19 nt, Homo sapiens
ggaggagccuuaagaagug

SEQ ID NO: 1442313 - RNA, 19 nt, Homo sapiens
gcaagaaaccgacagaugu

SEQ ID NO: 1442314 - RNA, 19 nt, Homo sapiens
gcucaucuguccacuuauu

SEQ ID NO: 1442315 - RNA, 19 nt, Homo sapiens
gaaauuagaggucuugaca

SEQ ID NO: 1442316 - RNA, 19 nt, Homo sapiens
gguuuaaucugaccaagaa

SEQ ID NO: 1442317 - RNA, 19 nt, Homo sapiens
gaagagggcucaggacaag

SEQ ID NO: 1442318 - RNA, 19 nt, Homo sapiens
gggcucagguuaauaauag

SEQ ID NO: 1442319 - RNA, 19 nt, Homo sapiens
gaaccaggcacguuaaaga

SEQ ID NO: 1442320 - RNA, 19 nt, Homo sapiens
gaaaugaagugagacuauc

SEQ ID NO: 1442321 - RNA, 19 nt, Homo sapiens
gagcagaguccaugagaaa

SEQ ID NO: 1442322 - RNA, 19 nt, Homo sapiens
gggcaaggcugagcucuga

SEQ ID NO: 1442323 - RNA, 19 nt, Homo sapiens
gaguuugaaucucuucuuu

SEQ ID NO: 1442324 - RNA, 19 nt, Homo sapiens
ggagugcuuuggaaauuga

SEQ ID NO: 1442325 - RNA, 19 nt, Homo sapiens
ucugagagaugauacauga

SEQ ID NO: 1442326 - RNA, 19 nt, Homo sapiens
ggaaggacgugggaauguu

SEQ ID NO: 1442327 - RNA, 19 nt, Homo sapiens
gaaaacagguugauuaagg

SEQ ID NO: 1442328 - RNA, 19 nt, Homo sapiens
gguaauccauggagagaga

SEQ ID NO: 1442329 - RNA, 19 nt, Homo sapiens
cagagccacugacccuuua

SEQ ID NO: 1442330 - RNA, 19 nt, Homo sapiens
agucuaagguuuaaucuga

SEQ ID NO: 1442331 - RNA, 19 nt, Homo sapiens
gggaaaugaugaaggaguu

SEQ ID NO: 1442332 - RNA, 19 nt, Homo sapiens
gaugggaccuuuguaggaa

SEQ ID NO: 1442333 - RNA, 19 nt, Homo sapiens
acaaugagguagacuccua

SEQ ID NO: 1442334 - RNA, 19 nt, Homo sapiens
uaauccaggucaacacuaa

SEQ ID NO: 1442335 - RNA, 19 nt, Homo sapiens
gagggaaccaggcacguua

SEQ ID NO: 1442336 - RNA, 19 nt, Homo sapiens
guagagcacgccaauauug

SEQ ID NO: 1442337 - RNA, 19 nt, Homo sapiens
uagcccagccuauuuguua

SEQ ID NO: 1442338 - RNA, 19 nt, Homo sapiens
ugagagaugauacaugaua

SEQ ID NO: 1442339 - RNA, 19 nt, Homo sapiens
gaaggacgugggaauguuu

SEQ ID NO: 1442340 - RNA, 19 nt, Homo sapiens
ggagcaaucucagguaaag

SEQ ID NO: 1442341 - RNA, 19 nt, Homo sapiens
gagaaauuguagugaugaa

SEQ ID NO: 1442342 - RNA, 19 nt, Homo sapiens
cagaagguaugaaguagau

SEQ ID NO: 1442343 - RNA, 19 nt, Homo sapiens
uugaaucucuucuuuguga

SEQ ID NO: 1442344 - RNA, 19 nt, Homo sapiens
cucuagagcuuucaucuuu

SEQ ID NO: 1442345 - RNA, 19 nt, Homo sapiens
gaaaauagacuugcucuug

SEQ ID NO: 1442346 - RNA, 19 nt, Homo sapiens
caggagugcuuuggaaauu

SEQ ID NO: 1442347 - RNA, 19 nt, Homo sapiens
gcagggagguauauuugag

SEQ ID NO: 1442348 - RNA, 19 nt, Homo sapiens
ugucaaacguuaucuagau

SEQ ID NO: 1442349 - RNA, 19 nt, Homo sapiens
gaagacauacacaggagaa

SEQ ID NO: 1442350 - RNA, 19 nt, Homo sapiens
gaaggaguuugaaucucuu

SEQ ID NO: 1442351 - RNA, 19 nt, Homo sapiens
gaagacagaaagcggacua

SEQ ID NO: 1442352 - RNA, 19 nt, Homo sapiens
gggagggauuaggaaauua

SEQ ID NO: 1442353 - RNA, 19 nt, Homo sapiens
gauggucaguuuagaguag

SEQ ID NO: 1442354 - RNA, 19 nt, Homo sapiens
ugaaggaguuugaaucucu

SEQ ID NO: 1442355 - RNA, 19 nt, Homo sapiens
aagcaggcaugacaggaua

SEQ ID NO: 1442356 - RNA, 19 nt, Homo sapiens
agacaggagugcuuuggaa

SEQ ID NO: 1442357 - RNA, 19 nt, Homo sapiens
gaaaugugcagucuaaggu

SEQ ID NO: 1442358 - RNA, 19 nt, Homo sapiens
gacauacacaggagaaauu

SEQ ID NO: 1442359 - RNA, 19 nt, Homo sapiens
ggucaguucagaagacaua

SEQ ID NO: 1442360 - RNA, 19 nt, Homo sapiens
ggagucaaggcauguuuaa

SEQ ID NO: 1442361 - RNA, 19 nt, Homo sapiens
ugaaguguuugaugacuau

SEQ ID NO: 1442362 - RNA, 19 nt, Homo sapiens
gauacaugauaccagauga

SEQ ID NO: 1442363 - RNA, 19 nt, Homo sapiens
aaacugagaugaggaccuu

SEQ ID NO: 1442364 - RNA, 19 nt, Homo sapiens
cuuaagaagugaaaucuag

SEQ ID NO: 1442365 - RNA, 19 nt, Homo sapiens
gggaggagccuuaagaagu

SEQ ID NO: 1442366 - RNA, 19 nt, Homo sapiens
agagaaagaugggucaguu

SEQ ID NO: 1442367 - RNA, 19 nt, Homo sapiens
ugaaguagauguuuuccua

SEQ ID NO: 1442368 - RNA, 19 nt, Homo sapiens
ggagcagaguccaugagaa

SEQ ID NO: 1442369 - RNA, 19 nt, Homo sapiens
gcaaaacuguccauugaau

SEQ ID NO: 1442370 - RNA, 19 nt, Homo sapiens
cuacauaaaggugguauaa

SEQ ID NO: 1442371 - RNA, 19 nt, Homo sapiens
ggucuagcccagccuauuu

SEQ ID NO: 1442372 - RNA, 19 nt, Homo sapiens
caagaaaccgacagauguu

SEQ ID NO: 1442373 - RNA, 19 nt, Homo sapiens
guggagcaaucucagguaa

SEQ ID NO: 1442374 - RNA, 19 nt, Homo sapiens
aaagaugggucaguucaga

SEQ ID NO: 1442375 - RNA, 19 nt, Homo sapiens
guuugaaucucuucuuugu

SEQ ID NO: 1442376 - RNA, 19 nt, Homo sapiens
gauuccagcucaucacuag

SEQ ID NO: 1442377 - RNA, 19 nt, Homo sapiens
guagacuccuagagguuaa

SEQ ID NO: 1442378 - RNA, 19 nt, Homo sapiens
gguagacuccuagagguua

SEQ ID NO: 1442379 - RNA, 19 nt, Homo sapiens
gcugggauggguacacuua

SEQ ID NO: 1442380 - RNA, 19 nt, Homo sapiens
gcagaguccaugagaaaga

SEQ ID NO: 1442381 - RNA, 19 nt, Homo sapiens
ccaggcacguuaaagaaga

SEQ ID NO: 1442382 - RNA, 19 nt, Homo sapiens
gagagcagcccaaccaauc

SEQ ID NO: 1442383 - RNA, 19 nt, Homo sapiens
gaugaggaccuugguacua

SEQ ID NO: 1442384 - RNA, 19 nt, Homo sapiens
caagaggaguggccacaag

SEQ ID NO: 1442385 - RNA, 19 nt, Homo sapiens
gcacuugguucucagucau

SEQ ID NO: 1442386 - RNA, 19 nt, Homo sapiens
gauuaaaccucaguauagg

SEQ ID NO: 1442387 - RNA, 19 nt, Homo sapiens
cuggagaauuccuuuauug

SEQ ID NO: 1442388 - RNA, 19 nt, Homo sapiens
caauauugauggcaacagu

SEQ ID NO: 1442389 - RNA, 19 nt, Homo sapiens
gggcagggagguauauuug

SEQ ID NO: 1442390 - RNA, 19 nt, Homo sapiens
gaagguaugaaguagaugu

SEQ ID NO: 1442391 - RNA, 19 nt, Homo sapiens
gcaugcaaauauacaaucu

SEQ ID NO: 1442392 - RNA, 19 nt, Homo sapiens
gucaaacguuaucuagauu

SEQ ID NO: 1442393 - RNA, 19 nt, Homo sapiens
aaucuuacccugacccuuu

SEQ ID NO: 1442394 - RNA, 19 nt, Homo sapiens
cagcauccuuggugaacaa

SEQ ID NO: 1442395 - RNA, 19 nt, Homo sapiens
ggagaaauuguagugauga

SEQ ID NO: 1442396 - RNA, 19 nt, Homo sapiens
caggagaaauuguagugau

SEQ ID NO: 1442397 - RNA, 19 nt, Homo sapiens
ucucagaagguaugaagua

SEQ ID NO: 1442398 - RNA, 19 nt, Homo sapiens
gaacucauuaugggaugua

SEQ ID NO: 1442399 - RNA, 19 nt, Homo sapiens
gguuaauuaucaucuccua

SEQ ID NO: 1442400 - RNA, 19 nt, Homo sapiens
uccuagagguuaauuauca

SEQ ID NO: 1442401 - RNA, 19 nt, Homo sapiens
agaauggugugaccuagga

SEQ ID NO: 1442402 - RNA, 19 nt, Homo sapiens
gcaccacccugccuucacu

SEQ ID NO: 1442403 - RNA, 19 nt, Homo sapiens
gagagaugauacaugauac

SEQ ID NO: 1442404 - RNA, 19 nt, Homo sapiens
gagaacagcuugaccauuu

SEQ ID NO: 1442405 - RNA, 19 nt, Homo sapiens
gaacaccauucaaagauua

SEQ ID NO: 1442406 - RNA, 19 nt, Homo sapiens
guaagaaacuggacaagaa

SEQ ID NO: 1442407 - RNA, 19 nt, Homo sapiens
gaagaaagguggcgagaag

SEQ ID NO: 1442408 - RNA, 19 nt, Homo sapiens
gaacagagaauggaacuuu

SEQ ID NO: 1442409 - RNA, 19 nt, Homo sapiens
gcucaaaacuucaaucaua

SEQ ID NO: 1442410 - RNA, 19 nt, Homo sapiens
gagccaagaucgcaacauu

SEQ ID NO: 1442411 - RNA, 19 nt, Homo sapiens
caaggcagauggaucauga

SEQ ID NO: 1442412 - RNA, 19 nt, Homo sapiens
aaugagggcuaaucaguua

SEQ ID NO: 1442413 - RNA, 19 nt, Homo sapiens
ccaaagacaucgcugaaau

SEQ ID NO: 1442414 - RNA, 19 nt, Homo sapiens
ggaguggauuacaauauuu

SEQ ID NO: 1442415 - RNA, 19 nt, Homo sapiens
gagcaagacucuaucucaa

SEQ ID NO: 1442416 - RNA, 19 nt, Homo sapiens
ggaacacucagguuuauuu

SEQ ID NO: 1442417 - RNA, 19 nt, Homo sapiens
ccuggaagcuggccuaauu

SEQ ID NO: 1442418 - RNA, 19 nt, Homo sapiens
gaaaccagagcaacgcuua

SEQ ID NO: 1442419 - RNA, 19 nt, Homo sapiens
gcaaagaacucugcaagac

SEQ ID NO: 1442420 - RNA, 19 nt, Homo sapiens
guggaaaucuguggaauga

SEQ ID NO: 1442421 - RNA, 19 nt, Homo sapiens
agacaucgcugaaauugau

SEQ ID NO: 1442422 - RNA, 19 nt, Homo sapiens
caugacaucugugaauuaa

SEQ ID NO: 1442423 - RNA, 19 nt, Homo sapiens
gaagauguaugccuguaag

SEQ ID NO: 1442424 - RNA, 19 nt, Homo sapiens
gcuugaccauuuagaauuu

SEQ ID NO: 1442425 - RNA, 19 nt, Homo sapiens
gcuuagaaauugaguugaa

SEQ ID NO: 1442426 - RNA, 19 nt, Homo sapiens
ugacaucugugaauuaaag

SEQ ID NO: 1442427 - RNA, 19 nt, Homo sapiens
aaacauccaugacaucugu

SEQ ID NO: 1442428 - RNA, 19 nt, Homo sapiens
ggccauggcuuucuugcaa

SEQ ID NO: 1442429 - RNA, 19 nt, Homo sapiens
gccagaagcugucccugaa

SEQ ID NO: 1442430 - RNA, 19 nt, Homo sapiens
ccuaugggcuuagaaauug

SEQ ID NO: 1442431 - RNA, 19 nt, Homo sapiens
gcaggaagaaauuauagaa

SEQ ID NO: 1442432 - RNA, 19 nt, Homo sapiens
agaagcggcugaagaagaa

SEQ ID NO: 1442433 - RNA, 19 nt, Homo sapiens
gcaagacgaggucaaauuc

SEQ ID NO: 1442434 - RNA, 19 nt, Homo sapiens
uuacauggcuccugagauc

SEQ ID NO: 1442435 - RNA, 19 nt, Homo sapiens
ugacaaagauaagcaguuc

SEQ ID NO: 1442436 - RNA, 19 nt, Homo sapiens
cgaacaccauucaaagauu

SEQ ID NO: 1442437 - RNA, 19 nt, Homo sapiens
aaaggaacacucagguuua

SEQ ID NO: 1442438 - RNA, 19 nt, Homo sapiens
gacagucuauucaucuuau

SEQ ID NO: 1442439 - RNA, 19 nt, Homo sapiens
gcaagacucuaucucaaaa

SEQ ID NO: 1442440 - RNA, 19 nt, Homo sapiens
gcaaaguccuaggaacaga

SEQ ID NO: 1442441 - RNA, 19 nt, Homo sapiens
gauaagcaguucuucaaaa

SEQ ID NO: 1442442 - RNA, 19 nt, Homo sapiens
gauguaugccuguaagaaa

SEQ ID NO: 1442443 - RNA, 19 nt, Homo sapiens
gaaugagggcuaaucaguu

SEQ ID NO: 1442444 - RNA, 19 nt, Homo sapiens
caaagacaucgcugaaauu

SEQ ID NO: 1442445 - RNA, 19 nt, Homo sapiens
guaaagaggaucugaagca

SEQ ID NO: 1442446 - RNA, 19 nt, Homo sapiens
agaacagcuugaccauuua

SEQ ID NO: 1442447 - RNA, 19 nt, Homo sapiens
ggaaucaucuagggaucuu

SEQ ID NO: 1442448 - RNA, 19 nt, Homo sapiens
ggaaugagggcuaaucagu

SEQ ID NO: 1442449 - RNA, 19 nt, Homo sapiens
acaagaagcggcugaagaa

SEQ ID NO: 1442450 - RNA, 19 nt, Homo sapiens
caggcaagcucacuacuag

SEQ ID NO: 1442451 - RNA, 19 nt, Homo sapiens
ggaagaaauuauagaaacg

SEQ ID NO: 1442452 - RNA, 19 nt, Homo sapiens
uaaagaggaucugaagcaa

SEQ ID NO: 1442453 - RNA, 19 nt, Homo sapiens
ggacgaacaccauucaaag

SEQ ID NO: 1442454 - RNA, 19 nt, Homo sapiens
gcauuugcaauucuuagua

SEQ ID NO: 1442455 - RNA, 19 nt, Homo sapiens
ucaaauuccagcaugauaa

SEQ ID NO: 1442456 - RNA, 19 nt, Homo sapiens
gggaagauguaugccugua

SEQ ID NO: 1442457 - RNA, 19 nt, Homo sapiens
gacaaguacuucacugagu

SEQ ID NO: 1442458 - RNA, 19 nt, Homo sapiens
guacaaauugcuucaacuu

SEQ ID NO: 1442459 - RNA, 19 nt, Homo sapiens
acaaguacuucacugaguu

SEQ ID NO: 1442460 - RNA, 19 nt, Homo sapiens
aaggagaccuaugggcuua

SEQ ID NO: 1442461 - RNA, 19 nt, Homo sapiens
aggaguggauuacaauauu

SEQ ID NO: 1442462 - RNA, 19 nt, Homo sapiens
uuucuucgcuucuauacuu

SEQ ID NO: 1442463 - RNA, 19 nt, Homo sapiens
gccagacccuucagugguu

SEQ ID NO: 1442464 - RNA, 19 nt, Homo sapiens
ggacaugaagccugagaau

SEQ ID NO: 1442465 - RNA, 19 nt, Homo sapiens
cagcagcccuuucauuguc

SEQ ID NO: 1442466 - RNA, 19 nt, Homo sapiens
gacaagaagcggcugaaga

SEQ ID NO: 1442467 - RNA, 19 nt, Homo sapiens
ggaagauguaugccuguaa

SEQ ID NO: 1442468 - RNA, 19 nt, Homo sapiens
gcucaugccugcaauucca

SEQ ID NO: 1442469 - RNA, 19 nt, Homo sapiens
caacuugcacuaccauaug

SEQ ID NO: 1442470 - RNA, 19 nt, Homo sapiens
gaggguaauucauccaagu

SEQ ID NO: 1442471 - RNA, 19 nt, Homo sapiens
aagaggaucugaagcaaag

SEQ ID NO: 1442472 - RNA, 19 nt, Homo sapiens
gcaggagaauugcuugaac

SEQ ID NO: 1442473 - RNA, 19 nt, Homo sapiens
gauggcaacuuuucaaaug

SEQ ID NO: 1442474 - RNA, 19 nt, Homo sapiens
cccaaacucugcugaacuu

SEQ ID NO: 1442475 - RNA, 19 nt, Homo sapiens
caaauugcuucaacuugca

SEQ ID NO: 1442476 - RNA, 19 nt, Homo sapiens
ccaugacaucugugaauua

SEQ ID NO: 1442477 - RNA, 19 nt, Homo sapiens
acaaguuucugcaguggaa

SEQ ID NO: 1442478 - RNA, 19 nt, Homo sapiens
caauuucagugacaguuuc

SEQ ID NO: 1442479 - RNA, 19 nt, Homo sapiens
gaagcuggccuaauugaac

SEQ ID NO: 1442480 - RNA, 19 nt, Homo sapiens
ggucagcagcccuuucauu

SEQ ID NO: 1442481 - RNA, 19 nt, Homo sapiens
gggcuuagaaauugaguug

SEQ ID NO: 1442482 - RNA, 19 nt, Homo sapiens
ggagaccuaugggcuuaga

SEQ ID NO: 1442483 - RNA, 19 nt, Homo sapiens
ccugagauccuaauggaaa

SEQ ID NO: 1442484 - RNA, 19 nt, Homo sapiens
ugcaagagcagcccuuuaa

SEQ ID NO: 1442485 - RNA, 19 nt, Homo sapiens
gcaggagucucggcugaca

SEQ ID NO: 1442486 - RNA, 19 nt, Homo sapiens
gacgaacaccauucaaaga

SEQ ID NO: 1442487 - RNA, 19 nt, Homo sapiens
cugcugaacuuuggaauca

SEQ ID NO: 1442488 - RNA, 19 nt, Homo sapiens
aaacucugcugaacuuugg

SEQ ID NO: 1442489 - RNA, 19 nt, Homo sapiens
caagcucacuacuagaaca

SEQ ID NO: 1442490 - RNA, 19 nt, Homo sapiens
gcguguguuuguuauugua

SEQ ID NO: 1442491 - RNA, 19 nt, Homo sapiens
gcaacugcagguuaucuga

SEQ ID NO: 1442492 - RNA, 19 nt, Homo sapiens
ggucagggguucaagacua

SEQ ID NO: 1442493 - RNA, 19 nt, Homo sapiens
cuaaugugcagcagaguuu

SEQ ID NO: 1442494 - RNA, 19 nt, Homo sapiens
gaacuuuggaaucaucuag

SEQ ID NO: 1442495 - RNA, 19 nt, Homo sapiens
ggcaagcucacuacuagaa

SEQ ID NO: 1442496 - RNA, 19 nt, Homo sapiens
aaaaggaaaucuuggagaa

SEQ ID NO: 1442497 - RNA, 19 nt, Homo sapiens
agacuagccuggccaacau

SEQ ID NO: 1442498 - RNA, 19 nt, Homo sapiens
gaacagcuugaccauuuag

SEQ ID NO: 1442499 - RNA, 19 nt, Homo sapiens
gcugaacuuuggaaucauc

SEQ ID NO: 1442500 - RNA, 19 nt, Homo sapiens
aaagacaucgcugaaauug

SEQ ID NO: 1442501 - RNA, 19 nt, Homo sapiens
gaaagguggcgagaagaug

SEQ ID NO: 1442502 - RNA, 19 nt, Homo sapiens
caucuuauggcuucucuug

SEQ ID NO: 1442503 - RNA, 19 nt, Homo sapiens
guaauaugguacaaauugc

SEQ ID NO: 1442504 - RNA, 19 nt, Homo sapiens
ggacacagguuaugaagaa

SEQ ID NO: 1442505 - RNA, 19 nt, Homo sapiens
guagagaguuugaagauca

SEQ ID NO: 1442506 - RNA, 19 nt, Homo sapiens
caagagccauugaauaugu

SEQ ID NO: 1442507 - RNA, 19 nt, Homo sapiens
gagcuaagaucauguagag

SEQ ID NO: 1442508 - RNA, 19 nt, Homo sapiens
aaacuuuggugucugauuu

SEQ ID NO: 1442509 - RNA, 19 nt, Homo sapiens
uuucagagauggcuucuuu

SEQ ID NO: 1442510 - RNA, 19 nt, Homo sapiens
acagaaagaugcaagguau

SEQ ID NO: 1442511 - RNA, 19 nt, Homo sapiens
caaggauucucaccucuga

SEQ ID NO: 1442512 - RNA, 19 nt, Homo sapiens
ucagcuguguuaaguguua

SEQ ID NO: 1442513 - RNA, 19 nt, Homo sapiens
ggaacaagaggcucagaaa

SEQ ID NO: 1442514 - RNA, 19 nt, Homo sapiens
agagauggcuucuuugcaa

SEQ ID NO: 1442515 - RNA, 19 nt, Homo sapiens
gaaacucaccucaggaaau

SEQ ID NO: 1442516 - RNA, 19 nt, Homo sapiens
uagcguggauucauauuau

SEQ ID NO: 1442517 - RNA, 19 nt, Homo sapiens
gcaagguauuccaguguga

SEQ ID NO: 1442518 - RNA, 19 nt, Homo sapiens
ccauuagcguggauucaua

SEQ ID NO: 1442519 - RNA, 19 nt, Homo sapiens
aaacucaccucaggaaaug

SEQ ID NO: 1442520 - RNA, 19 nt, Homo sapiens
gagauggcuucuuugcaaa

SEQ ID NO: 1442521 - RNA, 19 nt, Homo sapiens
gaguauguguuucgagaga

SEQ ID NO: 1442522 - RNA, 19 nt, Homo sapiens
gaugggaccagaucauauu

SEQ ID NO: 1442523 - RNA, 19 nt, Homo sapiens
ggaaauguaucugauccau

SEQ ID NO: 1442524 - RNA, 19 nt, Homo sapiens
gaagaagaggagaaacuga

SEQ ID NO: 1442525 - RNA, 19 nt, Homo sapiens
agugugaucugacuaaaga

SEQ ID NO: 1442526 - RNA, 19 nt, Homo sapiens
cauauuauuuggugaugga

SEQ ID NO: 1442527 - RNA, 19 nt, Homo sapiens
ccgaauaucuuugccuaug

SEQ ID NO: 1442528 - RNA, 19 nt, Homo sapiens
gaucaaaaguuaacaaugc

SEQ ID NO: 1442529 - RNA, 19 nt, Homo sapiens
uagaagaagauccgaauau

SEQ ID NO: 1442530 - RNA, 19 nt, Homo sapiens
agaagaagauccgaauauc

SEQ ID NO: 1442531 - RNA, 19 nt, Homo sapiens
gaggagcuaagaucaugua

SEQ ID NO: 1442532 - RNA, 19 nt, Homo sapiens
aagaagugguaaacgagua

SEQ ID NO: 1442533 - RNA, 19 nt, Homo sapiens
uggcucagcucuuuaugga

SEQ ID NO: 1442534 - RNA, 19 nt, Homo sapiens
uccaagagccauugaauau

SEQ ID NO: 1442535 - RNA, 19 nt, Homo sapiens
gaucauguagagaguuuga

SEQ ID NO: 1442536 - RNA, 19 nt, Homo sapiens
aagaucauguagagaguuu

SEQ ID NO: 1442537 - RNA, 19 nt, Homo sapiens
ggauguuguuauguugaua

SEQ ID NO: 1442538 - RNA, 19 nt, Homo sapiens
cagcagaaauuggaacaag

SEQ ID NO: 1442539 - RNA, 19 nt, Homo sapiens
gauaagaugcaccuugucu

SEQ ID NO: 1442540 - RNA, 19 nt, Homo sapiens
uuaaacagcagaaauugga

SEQ ID NO: 1442541 - RNA, 19 nt, Homo sapiens
gcagcaaacuuggagaaaa

SEQ ID NO: 1442542 - RNA, 19 nt, Homo sapiens
gaacaagaggcucagaaaa

SEQ ID NO: 1442543 - RNA, 19 nt, Homo sapiens
cugauaagaugcaccuugu

SEQ ID NO: 1442544 - RNA, 19 nt, Homo sapiens
gcagaaauuggaacaagag

SEQ ID NO: 1442545 - RNA, 19 nt, Homo sapiens
guuuaaagccagcagcaaa

SEQ ID NO: 1442546 - RNA, 19 nt, Homo sapiens
gaucauguaccgccagagu

SEQ ID NO: 1442547 - RNA, 19 nt, Homo sapiens
uaaguguuaccgucaguuu

SEQ ID NO: 1442548 - RNA, 19 nt, Homo sapiens
gcguggauucauauuauuu

SEQ ID NO: 1442549 - RNA, 19 nt, Homo sapiens
cuucagcuguguuaagugu

SEQ ID NO: 1442550 - RNA, 19 nt, Homo sapiens
cagcuguucauccugauaa

SEQ ID NO: 1442551 - RNA, 19 nt, Homo sapiens
guugauauuugugcuguca

SEQ ID NO: 1442552 - RNA, 19 nt, Homo sapiens
ccagugugaucugacuaaa

SEQ ID NO: 1442553 - RNA, 19 nt, Homo sapiens
agaaucuucagcuguguua

SEQ ID NO: 1442554 - RNA, 19 nt, Homo sapiens
uucgagagacggugaauaa

SEQ ID NO: 1442555 - RNA, 19 nt, Homo sapiens
cuuccuggcucagcucuuu

SEQ ID NO: 1442556 - RNA, 19 nt, Homo sapiens
gcaaaagugucuuguuucg

SEQ ID NO: 1442557 - RNA, 19 nt, Homo sapiens
gaauugguuuaggguuguu

SEQ ID NO: 1442558 - RNA, 19 nt, Homo sapiens
ggagaaucuucagcugugu

SEQ ID NO: 1442559 - RNA, 19 nt, Homo sapiens
augaagaagugguaaacga

SEQ ID NO: 1442560 - RNA, 19 nt, Homo sapiens
gacaagaugggaccagauc

SEQ ID NO: 1442561 - RNA, 19 nt, Homo sapiens
aaagccagcagcaaacuug

SEQ ID NO: 1442562 - RNA, 19 nt, Homo sapiens
aggcaaaagugucuuguuu

SEQ ID NO: 1442563 - RNA, 19 nt, Homo sapiens
ggagcuaagaucauguaga

SEQ ID NO: 1442564 - RNA, 19 nt, Homo sapiens
aagaagaggagaaacugaa

SEQ ID NO: 1442565 - RNA, 19 nt, Homo sapiens
agaugcaccuugucuuaca

SEQ ID NO: 1442566 - RNA, 19 nt, Homo sapiens
agaaagaugcaagguauuc

SEQ ID NO: 1442567 - RNA, 19 nt, Homo sapiens
aagaugggaccagaucaua

SEQ ID NO: 1442568 - RNA, 19 nt, Homo sapiens
guauuccagugugaucuga

SEQ ID NO: 1442569 - RNA, 19 nt, Homo sapiens
cuaagaucauguagagagu

SEQ ID NO: 1442570 - RNA, 19 nt, Homo sapiens
uugaggagcuaagaucaug

SEQ ID NO: 1442571 - RNA, 19 nt, Homo sapiens
acuacggacuguaugauca

SEQ ID NO: 1442572 - RNA, 19 nt, Homo sapiens
uacagaaagaugcaaggua

SEQ ID NO: 1442573 - RNA, 19 nt, Homo sapiens
cgaauaucuuugccuaugc

SEQ ID NO: 1442574 - RNA, 19 nt, Homo sapiens
ggaccaccagagaguuuga

SEQ ID NO: 1442575 - RNA, 19 nt, Homo sapiens
uuagcguggauucauauua

SEQ ID NO: 1442576 - RNA, 19 nt, Homo sapiens
agaagaggagaaacugaaa

SEQ ID NO: 1442577 - RNA, 19 nt, Homo sapiens
cacagguuaugaagaagug

SEQ ID NO: 1442578 - RNA, 19 nt, Homo sapiens
cgaauucgugguccucaga

SEQ ID NO: 1442579 - RNA, 19 nt, Homo sapiens
caagaugggaccagaucau

SEQ ID NO: 1442580 - RNA, 19 nt, Homo sapiens
gagaaucuucagcuguguu

SEQ ID NO: 1442581 - RNA, 19 nt, Homo sapiens
cagcagcaaacuuggagaa

SEQ ID NO: 1442582 - RNA, 19 nt, Homo sapiens
ccaagagccauugaauaug

SEQ ID NO: 1442583 - RNA, 19 nt, Homo sapiens
uuagaagaagauccgaaua

SEQ ID NO: 1442584 - RNA, 19 nt, Homo sapiens
cagagaguuugaggagcua

SEQ ID NO: 1442585 - RNA, 19 nt, Homo sapiens
ucgcgguucuucccguauu

SEQ ID NO: 1442586 - RNA, 19 nt, Homo sapiens
cuccaagagccauugaaua

SEQ ID NO: 1442587 - RNA, 19 nt, Homo sapiens
cgagagacggugaauaaaa

SEQ ID NO: 1442588 - RNA, 19 nt, Homo sapiens
agaauugguuuaggguugu

SEQ ID NO: 1442589 - RNA, 19 nt, Homo sapiens
gucuguggauguuguuaug

SEQ ID NO: 1442590 - RNA, 19 nt, Homo sapiens
gaauucgugguccucagaa

SEQ ID NO: 1442591 - RNA, 19 nt, Homo sapiens
gguccucagaauugguuua

SEQ ID NO: 1442592 - RNA, 19 nt, Homo sapiens
uguggauguuguuauguug

SEQ ID NO: 1442593 - RNA, 19 nt, Homo sapiens
cuguggauguuguuauguu

SEQ ID NO: 1442594 - RNA, 19 nt, Homo sapiens
gaagaggagaaacugaaaa

SEQ ID NO: 1442595 - RNA, 19 nt, Homo sapiens
guuaugaagaagugguaaa

SEQ ID NO: 1442596 - RNA, 19 nt, Homo sapiens
cagaaagaugcaagguauu

SEQ ID NO: 1442597 - RNA, 19 nt, Homo sapiens
agcagaaauuggaacaaga

SEQ ID NO: 1442598 - RNA, 19 nt, Homo sapiens
aggagaaacugaaaagaga

SEQ ID NO: 1442599 - RNA, 19 nt, Homo sapiens
ugaagaagaggagaaacug

SEQ ID NO: 1442600 - RNA, 19 nt, Homo sapiens
uaccgucaguuucagagau

SEQ ID NO: 1442601 - RNA, 19 nt, Homo sapiens
aagagccauugaauauguu

SEQ ID NO: 1442602 - RNA, 19 nt, Homo sapiens
guuaaguguuaccgucagu

SEQ ID NO: 1442603 - RNA, 19 nt, Homo sapiens
auuauuuggugauggagaa

SEQ ID NO: 1442604 - RNA, 19 nt, Homo sapiens
gcacuaacguucugauuga

SEQ ID NO: 1442605 - RNA, 19 nt, Homo sapiens
gaucagcccucgauagaaa

SEQ ID NO: 1442606 - RNA, 19 nt, Homo sapiens
ucacucagcugaugacauu

SEQ ID NO: 1442607 - RNA, 19 nt, Homo sapiens
aaacagagauguggaagaa

SEQ ID NO: 1442608 - RNA, 19 nt, Homo sapiens
gaacgaggaugucacucuu

SEQ ID NO: 1442609 - RNA, 19 nt, Homo sapiens
ucacguccauccagaauaa

SEQ ID NO: 1442610 - RNA, 19 nt, Homo sapiens
ggaugucacucuuagauca

SEQ ID NO: 1442611 - RNA, 19 nt, Homo sapiens
gcaagauccugucucacuu

SEQ ID NO: 1442612 - RNA, 19 nt, Homo sapiens
ugaagaagucagugauuua

SEQ ID NO: 1442613 - RNA, 19 nt, Homo sapiens
gaagaagucagugauuuau

SEQ ID NO: 1442614 - RNA, 19 nt, Homo sapiens
augguaggcuuaucaaaua

SEQ ID NO: 1442615 - RNA, 19 nt, Homo sapiens
agaagucagugauuuauag

SEQ ID NO: 1442616 - RNA, 19 nt, Homo sapiens
caauauagcccacuuucga

SEQ ID NO: 1442617 - RNA, 19 nt, Homo sapiens
gcgcuggaguuuacuacaa

SEQ ID NO: 1442618 - RNA, 19 nt, Homo sapiens
cagcaacagauaaaucaua

SEQ ID NO: 1442619 - RNA, 19 nt, Homo sapiens
ucacuacucuuuccuaaaa

SEQ ID NO: 1442620 - RNA, 19 nt, Homo sapiens
gauggugguuggagaagau

SEQ ID NO: 1442621 - RNA, 19 nt, Homo sapiens
ggaaaggguggcugaggaa

SEQ ID NO: 1442622 - RNA, 19 nt, Homo sapiens
ucaaagaaccugaagaaaa

SEQ ID NO: 1442623 - RNA, 19 nt, Homo sapiens
cgacuaggccugaagaagu

SEQ ID NO: 1442624 - RNA, 19 nt, Homo sapiens
gaucuccucaacuggaaua

SEQ ID NO: 1442625 - RNA, 19 nt, Homo sapiens
gaccgcugcuuuccucaug

SEQ ID NO: 1442626 - RNA, 19 nt, Homo sapiens
gaggaugucacucuuagau

SEQ ID NO: 1442627 - RNA, 19 nt, Homo sapiens
ggaguuuacuacaauucau

SEQ ID NO: 1442628 - RNA, 19 nt, Homo sapiens
gcaaggcuggcuggagaua

SEQ ID NO: 1442629 - RNA, 19 nt, Homo sapiens
cuaacguucugauugaaga

SEQ ID NO: 1442630 - RNA, 19 nt, Homo sapiens
ucgcauggcauucaaagaa

SEQ ID NO: 1442631 - RNA, 19 nt, Homo sapiens
uagaucagcccucgauaga

SEQ ID NO: 1442632 - RNA, 19 nt, Homo sapiens
uugaucauguguaauggua

SEQ ID NO: 1442633 - RNA, 19 nt, Homo sapiens
gagucuggcuuucgucuac

SEQ ID NO: 1442634 - RNA, 19 nt, Homo sapiens
agucagugauuuauaguuc

SEQ ID NO: 1442635 - RNA, 19 nt, Homo sapiens
gagauguggaagaaacuuu

SEQ ID NO: 1442636 - RNA, 19 nt, Homo sapiens
acagagauguggaagaaac

SEQ ID NO: 1442637 - RNA, 19 nt, Homo sapiens
ccucaacuggaauaacuua

SEQ ID NO: 1442638 - RNA, 19 nt, Homo sapiens
ugggugaccuuccgcaaga

SEQ ID NO: 1442639 - RNA, 19 nt, Homo sapiens
agaaugcuaugcuggacuu

SEQ ID NO: 1442640 - RNA, 19 nt, Homo sapiens
cgauagaaaucugaagagu

SEQ ID NO: 1442641 - RNA, 19 nt, Homo sapiens
gcuggaguuuacuacaauu

SEQ ID NO: 1442642 - RNA, 19 nt, Homo sapiens
gaaaggguggcugaggaaa

SEQ ID NO: 1442643 - RNA, 19 nt, Homo sapiens
cagaaggacaguucacuca

SEQ ID NO: 1442644 - RNA, 19 nt, Homo sapiens
gauugccggucucuccuau

SEQ ID NO: 1442645 - RNA, 19 nt, Homo sapiens
agucacuacucuuuccuaa

SEQ ID NO: 1442646 - RNA, 19 nt, Homo sapiens
ggagauguggugcgacuag

SEQ ID NO: 1442647 - RNA, 19 nt, Homo sapiens
ggauggugguuggagaaga

SEQ ID NO: 1442648 - RNA, 19 nt, Homo sapiens
guaggcuuaucaaauaugg

SEQ ID NO: 1442649 - RNA, 19 nt, Homo sapiens
cuauggcgcuggaguuuac

SEQ ID NO: 1442650 - RNA, 19 nt, Homo sapiens
guucagaccagaagaaugc

SEQ ID NO: 1442651 - RNA, 19 nt, Homo sapiens
gaagucagugauuuauagu

SEQ ID NO: 1442652 - RNA, 19 nt, Homo sapiens
gaucccgacuguggagaug

SEQ ID NO: 1442653 - RNA, 19 nt, Homo sapiens
agauguggaagaaacuuua

SEQ ID NO: 1442654 - RNA, 19 nt, Homo sapiens
acaguucacucagcugaug

SEQ ID NO: 1442655 - RNA, 19 nt, Homo sapiens
aaggcuggcuggagauaga

SEQ ID NO: 1442656 - RNA, 19 nt, Homo sapiens
guaaugguaggcuuaucaa

SEQ ID NO: 1442657 - RNA, 19 nt, Homo sapiens
auccucaagugguguauaa

SEQ ID NO: 1442658 - RNA, 19 nt, Homo sapiens
aaugguaggcuuaucaaau

SEQ ID NO: 1442659 - RNA, 19 nt, Homo sapiens
ccaagauuaucacguccau

SEQ ID NO: 1442660 - RNA, 19 nt, Homo sapiens
aaccuuacagcaacagaua

SEQ ID NO: 1442661 - RNA, 19 nt, Homo sapiens
gaauaaaguguuugauccu

SEQ ID NO: 1442662 - RNA, 19 nt, Homo sapiens
cacuaaaacugcacaaaau

SEQ ID NO: 1442663 - RNA, 19 nt, Homo sapiens
caagauccugucucacuuc

SEQ ID NO: 1442664 - RNA, 19 nt, Homo sapiens
gauguggaagaaacuuuau

SEQ ID NO: 1442665 - RNA, 19 nt, Homo sapiens
cgaguucagaccagaagaa

SEQ ID NO: 1442666 - RNA, 19 nt, Homo sapiens
ucacuaaaacugcacaaaa

SEQ ID NO: 1442667 - RNA, 19 nt, Homo sapiens
uacagcaacagauaaauca

SEQ ID NO: 1442668 - RNA, 19 nt, Homo sapiens
ggagcugagucuggcuuuc

SEQ ID NO: 1442669 - RNA, 19 nt, Homo sapiens
aagaucuccucaacuggaa

SEQ ID NO: 1442670 - RNA, 19 nt, Homo sapiens
uuacagcaacagauaaauc

SEQ ID NO: 1442671 - RNA, 19 nt, Homo sapiens
ggcagcauacuacaggaaa

SEQ ID NO: 1442672 - RNA, 19 nt, Homo sapiens
acgaggaugucacucuuag

SEQ ID NO: 1442673 - RNA, 19 nt, Homo sapiens
gucagugauuuauaguuca

SEQ ID NO: 1442674 - RNA, 19 nt, Homo sapiens
gacauugcccaaaaccuua

SEQ ID NO: 1442675 - RNA, 19 nt, Homo sapiens
uugccggucucuccuauuc

SEQ ID NO: 1442676 - RNA, 19 nt, Homo sapiens
gcuuaucaaauauggaguu

SEQ ID NO: 1442677 - RNA, 19 nt, Homo sapiens
uuauggacccuccuggaaa

SEQ ID NO: 1442678 - RNA, 19 nt, Homo sapiens
gcugaugacauugcccaaa

SEQ ID NO: 1442679 - RNA, 19 nt, Homo sapiens
uaucugggcugcgucuucu

SEQ ID NO: 1442680 - RNA, 19 nt, Homo sapiens
ggugguuggagaagauaaa

SEQ ID NO: 1442681 - RNA, 19 nt, Homo sapiens
uauuccaaguggcucauga

SEQ ID NO: 1442682 - RNA, 19 nt, Homo sapiens
ccuuacagcaacagauaaa

SEQ ID NO: 1442683 - RNA, 19 nt, Homo sapiens
gcagcauacuacaggaaaa

SEQ ID NO: 1442684 - RNA, 19 nt, Homo sapiens
uguaaugguaggcuuauca

SEQ ID NO: 1442685 - RNA, 19 nt, Homo sapiens
augcuaugcuggacuuugu

SEQ ID NO: 1442686 - RNA, 19 nt, Homo sapiens
gugcugugaccgcugcuuu

SEQ ID NO: 1442687 - RNA, 19 nt, Homo sapiens
gguaggcuuaucaaauaug

SEQ ID NO: 1442688 - RNA, 19 nt, Homo sapiens
ugguaggcuuaucaaauau

SEQ ID NO: 1442689 - RNA, 19 nt, Homo sapiens
gagaagagccaucacauuu

SEQ ID NO: 1442690 - RNA, 19 nt, Homo sapiens
gaagaugccuggcucauag

SEQ ID NO: 1442691 - RNA, 19 nt, Homo sapiens
gcaaagaccucccgaaugc

SEQ ID NO: 1442692 - RNA, 19 nt, Homo sapiens
agacaaacaugacaaacua

SEQ ID NO: 1442693 - RNA, 19 nt, Homo sapiens
ucagaugggugguauguuu

SEQ ID NO: 1442694 - RNA, 19 nt, Homo sapiens
ccggaaagaugaauaaaga

SEQ ID NO: 1442695 - RNA, 19 nt, Homo sapiens
ggaccaagauccggaaaga

SEQ ID NO: 1442696 - RNA, 19 nt, Homo sapiens
gcggucagauguccaguuu

SEQ ID NO: 1442697 - RNA, 19 nt, Homo sapiens
gcagugugcuuaugcuuca

SEQ ID NO: 1442698 - RNA, 19 nt, Homo sapiens
ggacuucgcucuaaaagga

SEQ ID NO: 1442699 - RNA, 19 nt, Homo sapiens
cuguagagcugccuuauga

SEQ ID NO: 1442700 - RNA, 19 nt, Homo sapiens
caagggacuucgcucuaaa

SEQ ID NO: 1442701 - RNA, 19 nt, Homo sapiens
gacccgaguucuccuuuga

SEQ ID NO: 1442702 - RNA, 19 nt, Homo sapiens
acaagggacuucgcucuaa

SEQ ID NO: 1442703 - RNA, 19 nt, Homo sapiens
cuccagaacuccagaaaga

SEQ ID NO: 1442704 - RNA, 19 nt, Homo sapiens
gaggucagcgugcgucuuu

SEQ ID NO: 1442705 - RNA, 19 nt, Homo sapiens
gaagagccaucacauuucc

SEQ ID NO: 1442706 - RNA, 19 nt, Homo sapiens
ccacacggaugacaguuuc

SEQ ID NO: 1442707 - RNA, 19 nt, Homo sapiens
ggaaagaugaauaaagaca

SEQ ID NO: 1442708 - RNA, 19 nt, Homo sapiens
acacuccgcugcccacuga

SEQ ID NO: 1442709 - RNA, 19 nt, Homo sapiens
ggucagauguccaguuugc

SEQ ID NO: 1442710 - RNA, 19 nt, Homo sapiens
gagcugagcagucccuaug

SEQ ID NO: 1442711 - RNA, 19 nt, Homo sapiens
gauccggaaagaugaauaa

SEQ ID NO: 1442712 - RNA, 19 nt, Homo sapiens
cgaguucuccuuugauuug

SEQ ID NO: 1442713 - RNA, 19 nt, Homo sapiens
agagcugccuuaugaauuc

SEQ ID NO: 1442714 - RNA, 19 nt, Homo sapiens
ggacccgaguucuccuuug

SEQ ID NO: 1442715 - RNA, 19 nt, Homo sapiens
gcacuguucccgcuguuug

SEQ ID NO: 1442716 - RNA, 19 nt, Homo sapiens
gaauaaagacaaacaugac

SEQ ID NO: 1442717 - RNA, 19 nt, Homo sapiens
ucacuagaccucaucauuc

SEQ ID NO: 1442718 - RNA, 19 nt, Homo sapiens
gcagcugauucuucacuuc

SEQ ID NO: 1442719 - RNA, 19 nt, Homo sapiens
gcugcucgcuuacuucagu

SEQ ID NO: 1442720 - RNA, 19 nt, Homo sapiens
ugccacagcucgagaguca

SEQ ID NO: 1442721 - RNA, 19 nt, Homo sapiens
ccagagacaugggaaaguc

SEQ ID NO: 1442722 - RNA, 19 nt, Homo sapiens
cagcagccauguugaaugc

SEQ ID NO: 1442723 - RNA, 19 nt, Homo sapiens
gaaagucuucccagauugg

SEQ ID NO: 1442724 - RNA, 19 nt, Homo sapiens
ucagguggcucaggucuuc

SEQ ID NO: 1442725 - RNA, 19 nt, Homo sapiens
gcaggagccaugucaguuc

SEQ ID NO: 1442726 - RNA, 19 nt, Homo sapiens
guagagcugccuuaugaau

SEQ ID NO: 1442727 - RNA, 19 nt, Homo sapiens
gcugagcagucccuaugau

SEQ ID NO: 1442728 - RNA, 19 nt, Homo sapiens
ugagaagagccaucacauu

SEQ ID NO: 1442729 - RNA, 19 nt, Homo sapiens
caaacaugacaaacuaaga

SEQ ID NO: 1442730 - RNA, 19 nt, Homo sapiens
gcuauucgggugaccauau

SEQ ID NO: 1442731 - RNA, 19 nt, Homo sapiens
caagaaugcaugccaccuu

SEQ ID NO: 1442732 - RNA, 19 nt, Homo sapiens
gacaaacaugacaaacuaa

SEQ ID NO: 1442733 - RNA, 19 nt, Homo sapiens
ccaagauccggaaagauga

SEQ ID NO: 1442734 - RNA, 19 nt, Homo sapiens
caacggacacuggcuggaa

SEQ ID NO: 1442735 - RNA, 19 nt, Homo sapiens
agaagaugccuggcucaua

SEQ ID NO: 1442736 - RNA, 19 nt, Homo sapiens
gcuguguccugcuccauag

SEQ ID NO: 1442737 - RNA, 19 nt, Homo sapiens
gagcuggccagaagccuau

SEQ ID NO: 1442738 - RNA, 19 nt, Homo sapiens
gcauggaggacccgaguuc

SEQ ID NO: 1442739 - RNA, 19 nt, Homo sapiens
acauucaaguucuauagga

SEQ ID NO: 1442740 - RNA, 19 nt, Homo sapiens
ggaggcaggagccauguca

SEQ ID NO: 1442741 - RNA, 19 nt, Homo sapiens
gaggacgacuggccgaaaa

SEQ ID NO: 1442742 - RNA, 19 nt, Homo sapiens
ccacagcucgagagucaga

SEQ ID NO: 1442743 - RNA, 19 nt, Homo sapiens
cccgaguucuccuuugauu

SEQ ID NO: 1442744 - RNA, 19 nt, Homo sapiens
uggaaguucugccuauauc

SEQ ID NO: 1442745 - RNA, 19 nt, Homo sapiens
gucgucaccugucugagaa

SEQ ID NO: 1442746 - RNA, 19 nt, Homo sapiens
ccacauucaaguucuauag

SEQ ID NO: 1442747 - RNA, 19 nt, Homo sapiens
gagcagucccuaugauguc

SEQ ID NO: 1442748 - RNA, 19 nt, Homo sapiens
cuucgacccugaaauccuu

SEQ ID NO: 1442749 - RNA, 19 nt, Homo sapiens
gucacuagaccucaucauu

SEQ ID NO: 1442750 - RNA, 19 nt, Homo sapiens
ucucucacauccuggaaug

SEQ ID NO: 1442751 - RNA, 19 nt, Homo sapiens
caagauccggaaagaugaa

SEQ ID NO: 1442752 - RNA, 19 nt, Homo sapiens
uagagcugccuuaugaauu

SEQ ID NO: 1442753 - RNA, 19 nt, Homo sapiens
gagcccuaauugcacagaa

SEQ ID NO: 1442754 - RNA, 19 nt, Homo sapiens
ggugguauguuuuggagaa

SEQ ID NO: 1442755 - RNA, 19 nt, Homo sapiens
ggacucuggaccuaggaaa

SEQ ID NO: 1442756 - RNA, 19 nt, Homo sapiens
uggaauguaagcauggaua

SEQ ID NO: 1442757 - RNA, 19 nt, Homo sapiens
ucccuaugauguccagaaa

SEQ ID NO: 1442758 - RNA, 19 nt, Homo sapiens
cacaagggacuucgcucua

SEQ ID NO: 1442759 - RNA, 19 nt, Homo sapiens
agaagagccaucacauuuc

SEQ ID NO: 1442760 - RNA, 19 nt, Homo sapiens
cauacuuucccuugacuga

SEQ ID NO: 1442761 - RNA, 19 nt, Homo sapiens
agagucagaugggugguau

SEQ ID NO: 1442762 - RNA, 19 nt, Homo sapiens
gagagucagauggguggua

SEQ ID NO: 1442763 - RNA, 19 nt, Homo sapiens
uacuuucccuugacugaga

SEQ ID NO: 1442764 - RNA, 19 nt, Homo sapiens
acuggaaguucugccuaua

SEQ ID NO: 1442765 - RNA, 19 nt, Homo sapiens
caaguucucuuuuggaaac

SEQ ID NO: 1442766 - RNA, 19 nt, Homo sapiens
ccuaugauguccagaaaau

SEQ ID NO: 1442767 - RNA, 19 nt, Homo sapiens
cagauuggacucacaaagg

SEQ ID NO: 1442768 - RNA, 19 nt, Homo sapiens
accaagauccggaaagaug

SEQ ID NO: 1442769 - RNA, 19 nt, Homo sapiens
cacuggaaguucugccuau

SEQ ID NO: 1442770 - RNA, 19 nt, Homo sapiens
ggaauguaagcauggauac

SEQ ID NO: 1442771 - RNA, 19 nt, Homo sapiens
cagcucugcuucaaguucu

SEQ ID NO: 1442772 - RNA, 19 nt, Homo sapiens
cagaggcacgacuggcaua

SEQ ID NO: 1442773 - RNA, 19 nt, Homo sapiens
cgucgucaccugucugaga

SEQ ID NO: 1442774 - RNA, 19 nt, Homo sapiens
caggagccaugucaguucu

SEQ ID NO: 1442775 - RNA, 19 nt, Homo sapiens
ggcaggagccaugucaguu

SEQ ID NO: 1442776 - RNA, 19 nt, Homo sapiens
ggucagcgugcgucuuugu

SEQ ID NO: 1442777 - RNA, 19 nt, Homo sapiens
gauccagagacaugggaaa

SEQ ID NO: 1442778 - RNA, 19 nt, Homo sapiens
ccucauacuuucccuugac

SEQ ID NO: 1442779 - RNA, 19 nt, Homo sapiens
ugggagcgcuggcugaacu

SEQ ID NO: 1442780 - RNA, 19 nt, Homo sapiens
cgacuggcauacccuuugc

SEQ ID NO: 1442781 - RNA, 19 nt, Homo sapiens
guccggaugucucuuacag

SEQ ID NO: 1442782 - RNA, 19 nt, Homo sapiens
gcauagaggcauccuaccu

SEQ ID NO: 1442783 - RNA, 19 nt, Homo sapiens
cacuagaccucaucauucc

SEQ ID NO: 1442784 - RNA, 19 nt, Homo sapiens
acacuguagagcugccuua

SEQ ID NO: 1442785 - RNA, 19 nt, Homo sapiens
guuccgggagcccuaauug

SEQ ID NO: 1442786 - RNA, 19 nt, Homo sapiens
ccuacuggguguuguucug

SEQ ID NO: 1442787 - RNA, 19 nt, Homo sapiens
ugagcagucccuaugaugu

SEQ ID NO: 1442788 - RNA, 19 nt, Homo sapiens
gacccaaccuucggaucca

SEQ ID NO: 1442789 - RNA, 19 nt, Homo sapiens
gagaagagccaucacauuu

SEQ ID NO: 1442790 - RNA, 19 nt, Homo sapiens
gcaaagaccucccgaaugc

SEQ ID NO: 1442791 - RNA, 19 nt, Homo sapiens
agacaaacaugacaaacua

SEQ ID NO: 1442792 - RNA, 19 nt, Homo sapiens
ucagaugggugguauguuu

SEQ ID NO: 1442793 - RNA, 19 nt, Homo sapiens
ccggaaagaugaauaaaga

SEQ ID NO: 1442794 - RNA, 19 nt, Homo sapiens
ggaccaagauccggaaaga

SEQ ID NO: 1442795 - RNA, 19 nt, Homo sapiens
gcggucagauguccaguuu

SEQ ID NO: 1442796 - RNA, 19 nt, Homo sapiens
gcagugugcuuaugcuuca

SEQ ID NO: 1442797 - RNA, 19 nt, Homo sapiens
ggacuucgcucuaaaagga

SEQ ID NO: 1442798 - RNA, 19 nt, Homo sapiens
cuguagagcugccuuauga

SEQ ID NO: 1442799 - RNA, 19 nt, Homo sapiens
caagggacuucgcucuaaa

SEQ ID NO: 1442800 - RNA, 19 nt, Homo sapiens
gacccgaguucuccuuuga

SEQ ID NO: 1442801 - RNA, 19 nt, Homo sapiens
acaagggacuucgcucuaa

SEQ ID NO: 1442802 - RNA, 19 nt, Homo sapiens
cuccagaacuccagaaaga

SEQ ID NO: 1442803 - RNA, 19 nt, Homo sapiens
gaggucagcgugcgucuuu

SEQ ID NO: 1442804 - RNA, 19 nt, Homo sapiens
gaagagccaucacauuucc

SEQ ID NO: 1442805 - RNA, 19 nt, Homo sapiens
ccacacggaugacaguuuc

SEQ ID NO: 1442806 - RNA, 19 nt, Homo sapiens
ggaaagaugaauaaagaca

SEQ ID NO: 1442807 - RNA, 19 nt, Homo sapiens
acacuccgcugcccacuga

SEQ ID NO: 1442808 - RNA, 19 nt, Homo sapiens
ggucagauguccaguuugc

SEQ ID NO: 1442809 - RNA, 19 nt, Homo sapiens
gagcugagcagucccuaug

SEQ ID NO: 1442810 - RNA, 19 nt, Homo sapiens
gauccggaaagaugaauaa

SEQ ID NO: 1442811 - RNA, 19 nt, Homo sapiens
cgaguucuccuuugauuug

SEQ ID NO: 1442812 - RNA, 19 nt, Homo sapiens
agagcugccuuaugaauuc

SEQ ID NO: 1442813 - RNA, 19 nt, Homo sapiens
ggacccgaguucuccuuug

SEQ ID NO: 1442814 - RNA, 19 nt, Homo sapiens
gcacuguucccgcuguuug

SEQ ID NO: 1442815 - RNA, 19 nt, Homo sapiens
gaauaaagacaaacaugac

SEQ ID NO: 1442816 - RNA, 19 nt, Homo sapiens
ucacuagaccucaucauuc

SEQ ID NO: 1442817 - RNA, 19 nt, Homo sapiens
gcagcugauucuucacuuc

SEQ ID NO: 1442818 - RNA, 19 nt, Homo sapiens
gcugcucgcuuacuucagu

SEQ ID NO: 1442819 - RNA, 19 nt, Homo sapiens
ugccacagcucgagaguca

SEQ ID NO: 1442820 - RNA, 19 nt, Homo sapiens
ccagagacaugggaaaguc

SEQ ID NO: 1442821 - RNA, 19 nt, Homo sapiens
cagcagccauguugaaugc

SEQ ID NO: 1442822 - RNA, 19 nt, Homo sapiens
gaaagucuucccagauugg

SEQ ID NO: 1442823 - RNA, 19 nt, Homo sapiens
ucagguggcucaggucuuc

SEQ ID NO: 1442824 - RNA, 19 nt, Homo sapiens
gcaggagccaugucaguuc

SEQ ID NO: 1442825 - RNA, 19 nt, Homo sapiens
guagagcugccuuaugaau

SEQ ID NO: 1442826 - RNA, 19 nt, Homo sapiens
gcugagcagucccuaugau

SEQ ID NO: 1442827 - RNA, 19 nt, Homo sapiens
ugagaagagccaucacauu

SEQ ID NO: 1442828 - RNA, 19 nt, Homo sapiens
caaacaugacaaacuaaga

SEQ ID NO: 1442829 - RNA, 19 nt, Homo sapiens
gcuauucgggugaccauau

SEQ ID NO: 1442830 - RNA, 19 nt, Homo sapiens
caagaaugcaugccaccuu

SEQ ID NO: 1442831 - RNA, 19 nt, Homo sapiens
gacaaacaugacaaacuaa

SEQ ID NO: 1442832 - RNA, 19 nt, Homo sapiens
ccaagauccggaaagauga

SEQ ID NO: 1442833 - RNA, 19 nt, Homo sapiens
caacggacacuggcuggaa

SEQ ID NO: 1442834 - RNA, 19 nt, Homo sapiens
gagcuggccagaagccuau

SEQ ID NO: 1442835 - RNA, 19 nt, Homo sapiens
gcauggaggacccgaguuc

SEQ ID NO: 1442836 - RNA, 19 nt, Homo sapiens
acauucaaguucuauagga

SEQ ID NO: 1442837 - RNA, 19 nt, Homo sapiens
ggaggcaggagccauguca

SEQ ID NO: 1442838 - RNA, 19 nt, Homo sapiens
gaggacgacuggccgaaaa

SEQ ID NO: 1442839 - RNA, 19 nt, Homo sapiens
uggaaguucugccuauauc

SEQ ID NO: 1442840 - RNA, 19 nt, Homo sapiens
ccacagcucgagagucaga

SEQ ID NO: 1442841 - RNA, 19 nt, Homo sapiens
cccgaguucuccuuugauu

SEQ ID NO: 1442842 - RNA, 19 nt, Homo sapiens
gucgucaccugucugagaa

SEQ ID NO: 1442843 - RNA, 19 nt, Homo sapiens
ccacauucaaguucuauag

SEQ ID NO: 1442844 - RNA, 19 nt, Homo sapiens
gagcagucccuaugauguc

SEQ ID NO: 1442845 - RNA, 19 nt, Homo sapiens
cuucgacccugaaauccuu

SEQ ID NO: 1442846 - RNA, 19 nt, Homo sapiens
gucacuagaccucaucauu

SEQ ID NO: 1442847 - RNA, 19 nt, Homo sapiens
ucucucacauccuggaaug

SEQ ID NO: 1442848 - RNA, 19 nt, Homo sapiens
caagauccggaaagaugaa

SEQ ID NO: 1442849 - RNA, 19 nt, Homo sapiens
gagcccuaauugcacagaa

SEQ ID NO: 1442850 - RNA, 19 nt, Homo sapiens
uagagcugccuuaugaauu

SEQ ID NO: 1442851 - RNA, 19 nt, Homo sapiens
ggugguauguuuuggagaa

SEQ ID NO: 1442852 - RNA, 19 nt, Homo sapiens
ggacucuggaccuaggaaa

SEQ ID NO: 1442853 - RNA, 19 nt, Homo sapiens
uggaauguaagcauggaua

SEQ ID NO: 1442854 - RNA, 19 nt, Homo sapiens
ucccuaugauguccagaaa

SEQ ID NO: 1442855 - RNA, 19 nt, Homo sapiens
cacaagggacuucgcucua

SEQ ID NO: 1442856 - RNA, 19 nt, Homo sapiens
agaagagccaucacauuuc

SEQ ID NO: 1442857 - RNA, 19 nt, Homo sapiens
cauacuuucccuugacuga

SEQ ID NO: 1442858 - RNA, 19 nt, Homo sapiens
agagucagaugggugguau

SEQ ID NO: 1442859 - RNA, 19 nt, Homo sapiens
gagagucagauggguggua

SEQ ID NO: 1442860 - RNA, 19 nt, Homo sapiens
uacuuucccuugacugaga

SEQ ID NO: 1442861 - RNA, 19 nt, Homo sapiens
caaguucucuuuuggaaac

SEQ ID NO: 1442862 - RNA, 19 nt, Homo sapiens
ccuaugauguccagaaaau

SEQ ID NO: 1442863 - RNA, 19 nt, Homo sapiens
cagauuggacucacaaagg

SEQ ID NO: 1442864 - RNA, 19 nt, Homo sapiens
acuggaaguucugccuaua

SEQ ID NO: 1442865 - RNA, 19 nt, Homo sapiens
accaagauccggaaagaug

SEQ ID NO: 1442866 - RNA, 19 nt, Homo sapiens
ggaauguaagcauggauac

SEQ ID NO: 1442867 - RNA, 19 nt, Homo sapiens
cagcucugcuucaaguucu

SEQ ID NO: 1442868 - RNA, 19 nt, Homo sapiens
cagaggcacgacuggcaua

SEQ ID NO: 1442869 - RNA, 19 nt, Homo sapiens
cacuggaaguucugccuau

SEQ ID NO: 1442870 - RNA, 19 nt, Homo sapiens
cgucgucaccugucugaga

SEQ ID NO: 1442871 - RNA, 19 nt, Homo sapiens
caggagccaugucaguucu

SEQ ID NO: 1442872 - RNA, 19 nt, Homo sapiens
ggcaggagccaugucaguu

SEQ ID NO: 1442873 - RNA, 19 nt, Homo sapiens
ggucagcgugcgucuuugu

SEQ ID NO: 1442874 - RNA, 19 nt, Homo sapiens
gauccagagacaugggaaa

SEQ ID NO: 1442875 - RNA, 19 nt, Homo sapiens
ccucauacuuucccuugac

SEQ ID NO: 1442876 - RNA, 19 nt, Homo sapiens
ugggagcgcuggcugaacu

SEQ ID NO: 1442877 - RNA, 19 nt, Homo sapiens
cgacuggcauacccuuugc

SEQ ID NO: 1442878 - RNA, 19 nt, Homo sapiens
guccggaugucucuuacag

SEQ ID NO: 1442879 - RNA, 19 nt, Homo sapiens
gcauagaggcauccuaccu

SEQ ID NO: 1442880 - RNA, 19 nt, Homo sapiens
cacuagaccucaucauucc

SEQ ID NO: 1442881 - RNA, 19 nt, Homo sapiens
guuccgggagcccuaauug

SEQ ID NO: 1442882 - RNA, 19 nt, Homo sapiens
acacuguagagcugccuua

SEQ ID NO: 1442883 - RNA, 19 nt, Homo sapiens
ccuacuggguguuguucug

SEQ ID NO: 1442884 - RNA, 19 nt, Homo sapiens
ugagcagucccuaugaugu

SEQ ID NO: 1442885 - RNA, 19 nt, Homo sapiens
gacccaaccuucggaucca

SEQ ID NO: 1442886 - RNA, 19 nt, Homo sapiens
cgucaccugucugagaaga

SEQ ID NO: 1442887 - RNA, 19 nt, Homo sapiens
gagaagagccaucacauuu

SEQ ID NO: 1442888 - RNA, 19 nt, Homo sapiens
gcaaagaccucccgaaugc

SEQ ID NO: 1442889 - RNA, 19 nt, Homo sapiens
agacaaacaugacaaacua

SEQ ID NO: 1442890 - RNA, 19 nt, Homo sapiens
ucagaugggugguauguuu

SEQ ID NO: 1442891 - RNA, 19 nt, Homo sapiens
ccggaaagaugaauaaaga

SEQ ID NO: 1442892 - RNA, 19 nt, Homo sapiens
ggaccaagauccggaaaga

SEQ ID NO: 1442893 - RNA, 19 nt, Homo sapiens
gcggucagauguccaguuu

SEQ ID NO: 1442894 - RNA, 19 nt, Homo sapiens
gcagugugcuuaugcuuca

SEQ ID NO: 1442895 - RNA, 19 nt, Homo sapiens
ggacuucgcucuaaaagga

SEQ ID NO: 1442896 - RNA, 19 nt, Homo sapiens
cuguagagcugccuuauga

SEQ ID NO: 1442897 - RNA, 19 nt, Homo sapiens
caagggacuucgcucuaaa

SEQ ID NO: 1442898 - RNA, 19 nt, Homo sapiens
gacccgaguucuccuuuga

SEQ ID NO: 1442899 - RNA, 19 nt, Homo sapiens
acaagggacuucgcucuaa

SEQ ID NO: 1442900 - RNA, 19 nt, Homo sapiens
cuccagaacuccagaaaga

SEQ ID NO: 1442901 - RNA, 19 nt, Homo sapiens
gaggucagcgugcgucuuu

SEQ ID NO: 1442902 - RNA, 19 nt, Homo sapiens
gaagagccaucacauuucc

SEQ ID NO: 1442903 - RNA, 19 nt, Homo sapiens
ggaaagaugaauaaagaca

SEQ ID NO: 1442904 - RNA, 19 nt, Homo sapiens
acacuccgcugcccacuga

SEQ ID NO: 1442905 - RNA, 19 nt, Homo sapiens
ggucagauguccaguuugc

SEQ ID NO: 1442906 - RNA, 19 nt, Homo sapiens
gagcugagcagucccuaug

SEQ ID NO: 1442907 - RNA, 19 nt, Homo sapiens
gauccggaaagaugaauaa

SEQ ID NO: 1442908 - RNA, 19 nt, Homo sapiens
cgaguucuccuuugauuug

SEQ ID NO: 1442909 - RNA, 19 nt, Homo sapiens
agagcugccuuaugaauuc

SEQ ID NO: 1442910 - RNA, 19 nt, Homo sapiens
ggacccgaguucuccuuug

SEQ ID NO: 1442911 - RNA, 19 nt, Homo sapiens
gaauaaagacaaacaugac

SEQ ID NO: 1442912 - RNA, 19 nt, Homo sapiens
ucacuagaccucaucauuc

SEQ ID NO: 1442913 - RNA, 19 nt, Homo sapiens
gcagcugauucuucacuuc

SEQ ID NO: 1442914 - RNA, 19 nt, Homo sapiens
gcugcucgcuuacuucagu

SEQ ID NO: 1442915 - RNA, 19 nt, Homo sapiens
ugccacagcucgagaguca

SEQ ID NO: 1442916 - RNA, 19 nt, Homo sapiens
ccagagacaugggaaaguc

SEQ ID NO: 1442917 - RNA, 19 nt, Homo sapiens
cagcagccauguugaaugc

SEQ ID NO: 1442918 - RNA, 19 nt, Homo sapiens
gaaagucuucccagauugg

SEQ ID NO: 1442919 - RNA, 19 nt, Homo sapiens
gcaggagccaugucaguuc

SEQ ID NO: 1442920 - RNA, 19 nt, Homo sapiens
guagagcugccuuaugaau

SEQ ID NO: 1442921 - RNA, 19 nt, Homo sapiens
gcugagcagucccuaugau

SEQ ID NO: 1442922 - RNA, 19 nt, Homo sapiens
ugagaagagccaucacauu

SEQ ID NO: 1442923 - RNA, 19 nt, Homo sapiens
caaacaugacaaacuaaga

SEQ ID NO: 1442924 - RNA, 19 nt, Homo sapiens
gcuauucgggugaccauau

SEQ ID NO: 1442925 - RNA, 19 nt, Homo sapiens
caagaaugcaugccaccuu

SEQ ID NO: 1442926 - RNA, 19 nt, Homo sapiens
gacaaacaugacaaacuaa

SEQ ID NO: 1442927 - RNA, 19 nt, Homo sapiens
ccaagauccggaaagauga

SEQ ID NO: 1442928 - RNA, 19 nt, Homo sapiens
caacggacacuggcuggaa

SEQ ID NO: 1442929 - RNA, 19 nt, Homo sapiens
gagcuggccagaagccuau

SEQ ID NO: 1442930 - RNA, 19 nt, Homo sapiens
gcauggaggacccgaguuc

SEQ ID NO: 1442931 - RNA, 19 nt, Homo sapiens
acauucaaguucuauagga

SEQ ID NO: 1442932 - RNA, 19 nt, Homo sapiens
ggaggcaggagccauguca

SEQ ID NO: 1442933 - RNA, 19 nt, Homo sapiens
gaggacgacuggccgaaaa

SEQ ID NO: 1442934 - RNA, 19 nt, Homo sapiens
ccacagcucgagagucaga

SEQ ID NO: 1442935 - RNA, 19 nt, Homo sapiens
cccgaguucuccuuugauu

SEQ ID NO: 1442936 - RNA, 19 nt, Homo sapiens
gucgucaccugucugagaa

SEQ ID NO: 1442937 - RNA, 19 nt, Homo sapiens
ccacauucaaguucuauag

SEQ ID NO: 1442938 - RNA, 19 nt, Homo sapiens
gagcagucccuaugauguc

SEQ ID NO: 1442939 - RNA, 19 nt, Homo sapiens
cuucgacccugaaauccuu

SEQ ID NO: 1442940 - RNA, 19 nt, Homo sapiens
gucacuagaccucaucauu

SEQ ID NO: 1442941 - RNA, 19 nt, Homo sapiens
ucucucacauccuggaaug

SEQ ID NO: 1442942 - RNA, 19 nt, Homo sapiens
caagauccggaaagaugaa

SEQ ID NO: 1442943 - RNA, 19 nt, Homo sapiens
gagcccuaauugcacagaa

SEQ ID NO: 1442944 - RNA, 19 nt, Homo sapiens
uagagcugccuuaugaauu

SEQ ID NO: 1442945 - RNA, 19 nt, Homo sapiens
ggugguauguuuuggagaa

SEQ ID NO: 1442946 - RNA, 19 nt, Homo sapiens
ggacucuggaccuaggaaa

SEQ ID NO: 1442947 - RNA, 19 nt, Homo sapiens
uggaauguaagcauggaua

SEQ ID NO: 1442948 - RNA, 19 nt, Homo sapiens
ucccuaugauguccagaaa

SEQ ID NO: 1442949 - RNA, 19 nt, Homo sapiens
cacaagggacuucgcucua

SEQ ID NO: 1442950 - RNA, 19 nt, Homo sapiens
agaagagccaucacauuuc

SEQ ID NO: 1442951 - RNA, 19 nt, Homo sapiens
cauacuuucccuugacuga

SEQ ID NO: 1442952 - RNA, 19 nt, Homo sapiens
agagucagaugggugguau

SEQ ID NO: 1442953 - RNA, 19 nt, Homo sapiens
gagagucagauggguggua

SEQ ID NO: 1442954 - RNA, 19 nt, Homo sapiens
uacuuucccuugacugaga

SEQ ID NO: 1442955 - RNA, 19 nt, Homo sapiens
caaguucucuuuuggaaac

SEQ ID NO: 1442956 - RNA, 19 nt, Homo sapiens
ccuaugauguccagaaaau

SEQ ID NO: 1442957 - RNA, 19 nt, Homo sapiens
cagauuggacucacaaagg

SEQ ID NO: 1442958 - RNA, 19 nt, Homo sapiens
accaagauccggaaagaug

SEQ ID NO: 1442959 - RNA, 19 nt, Homo sapiens
ggaauguaagcauggauac

SEQ ID NO: 1442960 - RNA, 19 nt, Homo sapiens
cgucgucaccugucugaga

SEQ ID NO: 1442961 - RNA, 19 nt, Homo sapiens
cagcucugcuucaaguucu

SEQ ID NO: 1442962 - RNA, 19 nt, Homo sapiens
cagaggcacgacuggcaua

SEQ ID NO: 1442963 - RNA, 19 nt, Homo sapiens
caggagccaugucaguucu

SEQ ID NO: 1442964 - RNA, 19 nt, Homo sapiens
ggcaggagccaugucaguu

SEQ ID NO: 1442965 - RNA, 19 nt, Homo sapiens
ggucagcgugcgucuuugu

SEQ ID NO: 1442966 - RNA, 19 nt, Homo sapiens
gauccagagacaugggaaa

SEQ ID NO: 1442967 - RNA, 19 nt, Homo sapiens
ccucauacuuucccuugac

SEQ ID NO: 1442968 - RNA, 19 nt, Homo sapiens
ugggagcgcuggcugaacu

SEQ ID NO: 1442969 - RNA, 19 nt, Homo sapiens
cgacuggcauacccuuugc

SEQ ID NO: 1442970 - RNA, 19 nt, Homo sapiens
guccggaugucucuuacag

SEQ ID NO: 1442971 - RNA, 19 nt, Homo sapiens
gcauagaggcauccuaccu

SEQ ID NO: 1442972 - RNA, 19 nt, Homo sapiens
cacuagaccucaucauucc

SEQ ID NO: 1442973 - RNA, 19 nt, Homo sapiens
guuccgggagcccuaauug

SEQ ID NO: 1442974 - RNA, 19 nt, Homo sapiens
acacuguagagcugccuua

SEQ ID NO: 1442975 - RNA, 19 nt, Homo sapiens
cgucaccugucugagaaga

SEQ ID NO: 1442976 - RNA, 19 nt, Homo sapiens
ccuacuggguguuguucug

SEQ ID NO: 1442977 - RNA, 19 nt, Homo sapiens
ugagcagucccuaugaugu

SEQ ID NO: 1442978 - RNA, 19 nt, Homo sapiens
gacccaaccuucggaucca

SEQ ID NO: 1442979 - RNA, 19 nt, Homo sapiens
gagaagagccaucacauuu

SEQ ID NO: 1442980 - RNA, 19 nt, Homo sapiens
gaagaugccuggcucauag

SEQ ID NO: 1442981 - RNA, 19 nt, Homo sapiens
gcaaagaccucccgaaugc

SEQ ID NO: 1442982 - RNA, 19 nt, Homo sapiens
agacaaacaugacaaacua

SEQ ID NO: 1442983 - RNA, 19 nt, Homo sapiens
ucagaugggugguauguuu

SEQ ID NO: 1442984 - RNA, 19 nt, Homo sapiens
ccggaaagaugaauaaaga

SEQ ID NO: 1442985 - RNA, 19 nt, Homo sapiens
ggaccaagauccggaaaga

SEQ ID NO: 1442986 - RNA, 19 nt, Homo sapiens
gcggucagauguccaguuu

SEQ ID NO: 1442987 - RNA, 19 nt, Homo sapiens
gcagugugcuuaugcuuca

SEQ ID NO: 1442988 - RNA, 19 nt, Homo sapiens
ggacuucgcucuaaaagga

SEQ ID NO: 1442989 - RNA, 19 nt, Homo sapiens
cuguagagcugccuuauga

SEQ ID NO: 1442990 - RNA, 19 nt, Homo sapiens
caagggacuucgcucuaaa

SEQ ID NO: 1442991 - RNA, 19 nt, Homo sapiens
gacccgaguucuccuuuga

SEQ ID NO: 1442992 - RNA, 19 nt, Homo sapiens
acaagggacuucgcucuaa

SEQ ID NO: 1442993 - RNA, 19 nt, Homo sapiens
cuccagaacuccagaaaga

SEQ ID NO: 1442994 - RNA, 19 nt, Homo sapiens
gaggucagcgugcgucuuu

SEQ ID NO: 1442995 - RNA, 19 nt, Homo sapiens
gaagagccaucacauuucc

SEQ ID NO: 1442996 - RNA, 19 nt, Homo sapiens
ggaaagaugaauaaagaca

SEQ ID NO: 1442997 - RNA, 19 nt, Homo sapiens
acacuccgcugcccacuga

SEQ ID NO: 1442998 - RNA, 19 nt, Homo sapiens
ggucagauguccaguuugc

SEQ ID NO: 1442999 - RNA, 19 nt, Homo sapiens
gagcugagcagucccuaug

SEQ ID NO: 1443000 - RNA, 19 nt, Homo sapiens
acacggaaguucugccuau

SEQ ID NO: 1443001 - RNA, 19 nt, Homo sapiens
gauccggaaagaugaauaa

SEQ ID NO: 1443002 - RNA, 19 nt, Homo sapiens
cgaguucuccuuugauuug

SEQ ID NO: 1443003 - RNA, 19 nt, Homo sapiens
agagcugccuuaugaauuc

SEQ ID NO: 1443004 - RNA, 19 nt, Homo sapiens
ggacccgaguucuccuuug

SEQ ID NO: 1443005 - RNA, 19 nt, Homo sapiens
gcacuguucccgcuguuug

SEQ ID NO: 1443006 - RNA, 19 nt, Homo sapiens
gaauaaagacaaacaugac

SEQ ID NO: 1443007 - RNA, 19 nt, Homo sapiens
ucacuagaccucaucauuc

SEQ ID NO: 1443008 - RNA, 19 nt, Homo sapiens
gcagcugauucuucacuuc

SEQ ID NO: 1443009 - RNA, 19 nt, Homo sapiens
gcugcucgcuuacuucagu

SEQ ID NO: 1443010 - RNA, 19 nt, Homo sapiens
ugccacagcucgagaguca

SEQ ID NO: 1443011 - RNA, 19 nt, Homo sapiens
ccagagacaugggaaaguc

SEQ ID NO: 1443012 - RNA, 19 nt, Homo sapiens
cagcagccauguugaaugc

SEQ ID NO: 1443013 - RNA, 19 nt, Homo sapiens
gaaagucuucccagauugg

SEQ ID NO: 1443014 - RNA, 19 nt, Homo sapiens
ucagguggcucaggucuuc

SEQ ID NO: 1443015 - RNA, 19 nt, Homo sapiens
gcaggagccaugucaguuc

SEQ ID NO: 1443016 - RNA, 19 nt, Homo sapiens
guagagcugccuuaugaau

SEQ ID NO: 1443017 - RNA, 19 nt, Homo sapiens
gcugagcagucccuaugau

SEQ ID NO: 1443018 - RNA, 19 nt, Homo sapiens
ugagaagagccaucacauu

SEQ ID NO: 1443019 - RNA, 19 nt, Homo sapiens
gcuauucgggugaccauau

SEQ ID NO: 1443020 - RNA, 19 nt, Homo sapiens
caagaaugcaugccaccuu

SEQ ID NO: 1443021 - RNA, 19 nt, Homo sapiens
cggaaguucugccuauauc

SEQ ID NO: 1443022 - RNA, 19 nt, Homo sapiens
gacaaacaugacaaacuaa

SEQ ID NO: 1443023 - RNA, 19 nt, Homo sapiens
ccaagauccggaaagauga

SEQ ID NO: 1443024 - RNA, 19 nt, Homo sapiens
caacggacacuggcuggaa

SEQ ID NO: 1443025 - RNA, 19 nt, Homo sapiens
agaagaugccuggcucaua

SEQ ID NO: 1443026 - RNA, 19 nt, Homo sapiens
gagcuggccagaagccuau

SEQ ID NO: 1443027 - RNA, 19 nt, Homo sapiens
gcauggaggacccgaguuc

SEQ ID NO: 1443028 - RNA, 19 nt, Homo sapiens
acauucaaguucuauagga

SEQ ID NO: 1443029 - RNA, 19 nt, Homo sapiens
cacggaaguucugccuaua

SEQ ID NO: 1443030 - RNA, 19 nt, Homo sapiens
ggaggcaggagccauguca

SEQ ID NO: 1443031 - RNA, 19 nt, Homo sapiens
gaggacgacuggccgaaaa

SEQ ID NO: 1443032 - RNA, 19 nt, Homo sapiens
ccacagcucgagagucaga

SEQ ID NO: 1443033 - RNA, 19 nt, Homo sapiens
cccgaguucuccuuugauu

SEQ ID NO: 1443034 - RNA, 19 nt, Homo sapiens
gucgucaccugucugagaa

SEQ ID NO: 1443035 - RNA, 19 nt, Homo sapiens
ccacauucaaguucuauag

SEQ ID NO: 1443036 - RNA, 19 nt, Homo sapiens
gagcagucccuaugauguc

SEQ ID NO: 1443037 - RNA, 19 nt, Homo sapiens
cuucgacccugaaauccuu

SEQ ID NO: 1443038 - RNA, 19 nt, Homo sapiens
gucacuagaccucaucauu

SEQ ID NO: 1443039 - RNA, 19 nt, Homo sapiens
ucucucacauccuggaaug

SEQ ID NO: 1443040 - RNA, 19 nt, Homo sapiens
caagauccggaaagaugaa

SEQ ID NO: 1443041 - RNA, 19 nt, Homo sapiens
uagagcugccuuaugaauu

SEQ ID NO: 1443042 - RNA, 19 nt, Homo sapiens
gagcccuaauugcacagaa

SEQ ID NO: 1443043 - RNA, 19 nt, Homo sapiens
ggugguauguuuuggagaa

SEQ ID NO: 1443044 - RNA, 19 nt, Homo sapiens
ggacucuggaccuaggaaa

SEQ ID NO: 1443045 - RNA, 19 nt, Homo sapiens
uggaauguaagcauggaua

SEQ ID NO: 1443046 - RNA, 19 nt, Homo sapiens
ucccuaugauguccagaaa

SEQ ID NO: 1443047 - RNA, 19 nt, Homo sapiens
cacaagggacuucgcucua

SEQ ID NO: 1443048 - RNA, 19 nt, Homo sapiens
agaagagccaucacauuuc

SEQ ID NO: 1443049 - RNA, 19 nt, Homo sapiens
cauacuuucccuugacuga

SEQ ID NO: 1443050 - RNA, 19 nt, Homo sapiens
agagucagaugggugguau

SEQ ID NO: 1443051 - RNA, 19 nt, Homo sapiens
gagagucagauggguggua

SEQ ID NO: 1443052 - RNA, 19 nt, Homo sapiens
uacuuucccuugacugaga

SEQ ID NO: 1443053 - RNA, 19 nt, Homo sapiens
caaguucucuuuuggaaac

SEQ ID NO: 1443054 - RNA, 19 nt, Homo sapiens
ccuaugauguccagaaaau

SEQ ID NO: 1443055 - RNA, 19 nt, Homo sapiens
cagauuggacucacaaagg

SEQ ID NO: 1443056 - RNA, 19 nt, Homo sapiens
accaagauccggaaagaug

SEQ ID NO: 1443057 - RNA, 19 nt, Homo sapiens
ggaauguaagcauggauac

SEQ ID NO: 1443058 - RNA, 19 nt, Homo sapiens
cagcucugcuucaaguucu

SEQ ID NO: 1443059 - RNA, 19 nt, Homo sapiens
cagaggcacgacuggcaua

SEQ ID NO: 1443060 - RNA, 19 nt, Homo sapiens
cgucgucaccugucugaga

SEQ ID NO: 1443061 - RNA, 19 nt, Homo sapiens
caggagccaugucaguucu

SEQ ID NO: 1443062 - RNA, 19 nt, Homo sapiens
ggcaggagccaugucaguu

SEQ ID NO: 1443063 - RNA, 19 nt, Homo sapiens
ggucagcgugcgucuuugu

SEQ ID NO: 1443064 - RNA, 19 nt, Homo sapiens
gauccagagacaugggaaa

SEQ ID NO: 1443065 - RNA, 19 nt, Homo sapiens
ccucauacuuucccuugac

SEQ ID NO: 1443066 - RNA, 19 nt, Homo sapiens
ugggagcgcuggcugaacu

SEQ ID NO: 1443067 - RNA, 19 nt, Homo sapiens
cgacuggcauacccuuugc

SEQ ID NO: 1443068 - RNA, 19 nt, Homo sapiens
guccggaugucucuuacag

SEQ ID NO: 1443069 - RNA, 19 nt, Homo sapiens
gcauagaggcauccuaccu

SEQ ID NO: 1443070 - RNA, 19 nt, Homo sapiens
cagcuggagcagacacaaa

SEQ ID NO: 1443071 - RNA, 19 nt, Homo sapiens
cacuagaccucaucauucc

SEQ ID NO: 1443072 - RNA, 19 nt, Homo sapiens
acacuguagagcugccuua

SEQ ID NO: 1443073 - RNA, 19 nt, Homo sapiens
guuccgggagcccuaauug

SEQ ID NO: 1443074 - RNA, 19 nt, Homo sapiens
ccuacuggguguuguucug

SEQ ID NO: 1443075 - RNA, 19 nt, Homo sapiens
ugagcagucccuaugaugu

SEQ ID NO: 1443076 - RNA, 19 nt, Homo sapiens
cgucaccugucugagaaga

SEQ ID NO: 1443077 - RNA, 19 nt, Homo sapiens
gacccaaccuucggaucca

SEQ ID NO: 1443078 - RNA, 19 nt, Homo sapiens
gagaagagccaucacauuu

SEQ ID NO: 1443079 - RNA, 19 nt, Homo sapiens
gcaaagaccucccgaaugc

SEQ ID NO: 1443080 - RNA, 19 nt, Homo sapiens
agacaaacaugacaaacua

SEQ ID NO: 1443081 - RNA, 19 nt, Homo sapiens
ucagaugggugguauguuu

SEQ ID NO: 1443082 - RNA, 19 nt, Homo sapiens
ccggaaagaugaauaaaga

SEQ ID NO: 1443083 - RNA, 19 nt, Homo sapiens
ggaccaagauccggaaaga

SEQ ID NO: 1443084 - RNA, 19 nt, Homo sapiens
gcggucagauguccaguuu

SEQ ID NO: 1443085 - RNA, 19 nt, Homo sapiens
gcagugugcuuaugcuuca

SEQ ID NO: 1443086 - RNA, 19 nt, Homo sapiens
ggacuucgcucuaaaagga

SEQ ID NO: 1443087 - RNA, 19 nt, Homo sapiens
cuguagagcugccuuauga

SEQ ID NO: 1443088 - RNA, 19 nt, Homo sapiens
caagggacuucgcucuaaa

SEQ ID NO: 1443089 - RNA, 19 nt, Homo sapiens
gacccgaguucuccuuuga

SEQ ID NO: 1443090 - RNA, 19 nt, Homo sapiens
acaagggacuucgcucuaa

SEQ ID NO: 1443091 - RNA, 19 nt, Homo sapiens
cuccagaacuccagaaaga

SEQ ID NO: 1443092 - RNA, 19 nt, Homo sapiens
gaggucagcgugcgucuuu

SEQ ID NO: 1443093 - RNA, 19 nt, Homo sapiens
gaagagccaucacauuucc

SEQ ID NO: 1443094 - RNA, 19 nt, Homo sapiens
ccacacggaugacaguuuc

SEQ ID NO: 1443095 - RNA, 19 nt, Homo sapiens
ggaaagaugaauaaagaca

SEQ ID NO: 1443096 - RNA, 19 nt, Homo sapiens
acacuccgcugcccacuga

SEQ ID NO: 1443097 - RNA, 19 nt, Homo sapiens
ggucagauguccaguuugc

SEQ ID NO: 1443098 - RNA, 19 nt, Homo sapiens
gagcugagcagucccuaug

SEQ ID NO: 1443099 - RNA, 19 nt, Homo sapiens
gauccggaaagaugaauaa

SEQ ID NO: 1443100 - RNA, 19 nt, Homo sapiens
cgaguucuccuuugauuug

SEQ ID NO: 1443101 - RNA, 19 nt, Homo sapiens
gcuagccccuuuccuguua

SEQ ID NO: 1443102 - RNA, 19 nt, Homo sapiens
agagcugccuuaugaauuc

SEQ ID NO: 1443103 - RNA, 19 nt, Homo sapiens
ggacccgaguucuccuuug

SEQ ID NO: 1443104 - RNA, 19 nt, Homo sapiens
gcacuguucccgcuguuug

SEQ ID NO: 1443105 - RNA, 19 nt, Homo sapiens
gaauaaagacaaacaugac

SEQ ID NO: 1443106 - RNA, 19 nt, Homo sapiens
ucacuagaccucaucauuc

SEQ ID NO: 1443107 - RNA, 19 nt, Homo sapiens
gcagcugauucuucacuuc

SEQ ID NO: 1443108 - RNA, 19 nt, Homo sapiens
gcugcucgcuuacuucagu

SEQ ID NO: 1443109 - RNA, 19 nt, Homo sapiens
ugccacagcucgagaguca

SEQ ID NO: 1443110 - RNA, 19 nt, Homo sapiens
ccagagacaugggaaaguc

SEQ ID NO: 1443111 - RNA, 19 nt, Homo sapiens
cagcagccauguugaaugc

SEQ ID NO: 1443112 - RNA, 19 nt, Homo sapiens
gaaagucuucccagauugg

SEQ ID NO: 1443113 - RNA, 19 nt, Homo sapiens
ucagguggcucaggucuuc

SEQ ID NO: 1443114 - RNA, 19 nt, Homo sapiens
gcaggagccaugucaguuc

SEQ ID NO: 1443115 - RNA, 19 nt, Homo sapiens
guagagcugccuuaugaau

SEQ ID NO: 1443116 - RNA, 19 nt, Homo sapiens
gcugagcagucccuaugau

SEQ ID NO: 1443117 - RNA, 19 nt, Homo sapiens
ugagaagagccaucacauu

SEQ ID NO: 1443118 - RNA, 19 nt, Homo sapiens
caaacaugacaaacuaaga

SEQ ID NO: 1443119 - RNA, 19 nt, Homo sapiens
gcuauucgggugaccauau

SEQ ID NO: 1443120 - RNA, 19 nt, Homo sapiens
caagaaugcaugccaccuu

SEQ ID NO: 1443121 - RNA, 19 nt, Homo sapiens
gacaaacaugacaaacuaa

SEQ ID NO: 1443122 - RNA, 19 nt, Homo sapiens
ccaagauccggaaagauga

SEQ ID NO: 1443123 - RNA, 19 nt, Homo sapiens
caacggacacuggcuggaa

SEQ ID NO: 1443124 - RNA, 19 nt, Homo sapiens
gagcuggccagaagccuau

SEQ ID NO: 1443125 - RNA, 19 nt, Homo sapiens
gcauggaggacccgaguuc

SEQ ID NO: 1443126 - RNA, 19 nt, Homo sapiens
acauucaaguucuauagga

SEQ ID NO: 1443127 - RNA, 19 nt, Homo sapiens
ggaggcaggagccauguca

SEQ ID NO: 1443128 - RNA, 19 nt, Homo sapiens
gaggacgacuggccgaaaa

SEQ ID NO: 1443129 - RNA, 19 nt, Homo sapiens
ccacagcucgagagucaga

SEQ ID NO: 1443130 - RNA, 19 nt, Homo sapiens
cccgaguucuccuuugauu

SEQ ID NO: 1443131 - RNA, 19 nt, Homo sapiens
gucgucaccugucugagaa

SEQ ID NO: 1443132 - RNA, 19 nt, Homo sapiens
ccacauucaaguucuauag

SEQ ID NO: 1443133 - RNA, 19 nt, Homo sapiens
uggaaguucugccuauauc

SEQ ID NO: 1443134 - RNA, 19 nt, Homo sapiens
gcaggagccccuugucuuu

SEQ ID NO: 1443135 - RNA, 19 nt, Homo sapiens
gagcagucccuaugauguc

SEQ ID NO: 1443136 - RNA, 19 nt, Homo sapiens
cuucgacccugaaauccuu

SEQ ID NO: 1443137 - RNA, 19 nt, Homo sapiens
gucacuagaccucaucauu

SEQ ID NO: 1443138 - RNA, 19 nt, Homo sapiens
ucucucacauccuggaaug

SEQ ID NO: 1443139 - RNA, 19 nt, Homo sapiens
caagauccggaaagaugaa

SEQ ID NO: 1443140 - RNA, 19 nt, Homo sapiens
gagcccuaauugcacagaa

SEQ ID NO: 1443141 - RNA, 19 nt, Homo sapiens
uagagcugccuuaugaauu

SEQ ID NO: 1443142 - RNA, 19 nt, Homo sapiens
ggugguauguuuuggagaa

SEQ ID NO: 1443143 - RNA, 19 nt, Homo sapiens
ggacucuggaccuaggaaa

SEQ ID NO: 1443144 - RNA, 19 nt, Homo sapiens
uggaauguaagcauggaua

SEQ ID NO: 1443145 - RNA, 19 nt, Homo sapiens
ucccuaugauguccagaaa

SEQ ID NO: 1443146 - RNA, 19 nt, Homo sapiens
cacaagggacuucgcucua

SEQ ID NO: 1443147 - RNA, 19 nt, Homo sapiens
agaagagccaucacauuuc

SEQ ID NO: 1443148 - RNA, 19 nt, Homo sapiens
cauacuuucccuugacuga

SEQ ID NO: 1443149 - RNA, 19 nt, Homo sapiens
agagucagaugggugguau

SEQ ID NO: 1443150 - RNA, 19 nt, Homo sapiens
gagagucagauggguggua

SEQ ID NO: 1443151 - RNA, 19 nt, Homo sapiens
uacuuucccuugacugaga

SEQ ID NO: 1443152 - RNA, 19 nt, Homo sapiens
caaguucucuuuuggaaac

SEQ ID NO: 1443153 - RNA, 19 nt, Homo sapiens
acuggaaguucugccuaua

SEQ ID NO: 1443154 - RNA, 19 nt, Homo sapiens
ccuaugauguccagaaaau

SEQ ID NO: 1443155 - RNA, 19 nt, Homo sapiens
cagauuggacucacaaagg

SEQ ID NO: 1443156 - RNA, 19 nt, Homo sapiens
accaagauccggaaagaug

SEQ ID NO: 1443157 - RNA, 19 nt, Homo sapiens
cacuggaaguucugccuau

SEQ ID NO: 1443158 - RNA, 19 nt, Homo sapiens
ggaauguaagcauggauac

SEQ ID NO: 1443159 - RNA, 19 nt, Homo sapiens
cagcucugcuucaaguucu

SEQ ID NO: 1443160 - RNA, 19 nt, Homo sapiens
cagaggcacgacuggcaua

SEQ ID NO: 1443161 - RNA, 19 nt, Homo sapiens
cgucgucaccugucugaga

SEQ ID NO: 1443162 - RNA, 19 nt, Homo sapiens
caggagccaugucaguucu

SEQ ID NO: 1443163 - RNA, 19 nt, Homo sapiens
ggcaggagccaugucaguu

SEQ ID NO: 1443164 - RNA, 19 nt, Homo sapiens
ggucagcgugcgucuuugu

SEQ ID NO: 1443165 - RNA, 19 nt, Homo sapiens
gauccagagacaugggaaa

SEQ ID NO: 1443166 - RNA, 19 nt, Homo sapiens
ccucauacuuucccuugac

SEQ ID NO: 1443167 - RNA, 19 nt, Homo sapiens
ugggagcgcuggcugaacu

SEQ ID NO: 1443168 - RNA, 19 nt, Homo sapiens
cgacuggcauacccuuugc

SEQ ID NO: 1443169 - RNA, 19 nt, Homo sapiens
guccggaugucucuuacag

SEQ ID NO: 1443170 - RNA, 19 nt, Homo sapiens
gcauagaggcauccuaccu

SEQ ID NO: 1443171 - RNA, 19 nt, Homo sapiens
cacuagaccucaucauucc

SEQ ID NO: 1443172 - RNA, 19 nt, Homo sapiens
acacuguagagcugccuua

SEQ ID NO: 1443173 - RNA, 19 nt, Homo sapiens
guuccgggagcccuaauug

SEQ ID NO: 1443174 - RNA, 19 nt, Homo sapiens
ccuacuggguguuguucug

SEQ ID NO: 1443175 - RNA, 19 nt, Homo sapiens
ugagcagucccuaugaugu

SEQ ID NO: 1443176 - RNA, 19 nt, Homo sapiens
gacccaaccuucggaucca

SEQ ID NO: 1443177 - RNA, 19 nt, Homo sapiens
cgucaccugucugagaaga

SEQ ID NO: 1443178 - RNA, 19 nt, Homo sapiens
gaagcucucugacaaagau

SEQ ID NO: 1443179 - RNA, 19 nt, Homo sapiens
ggacaaugccaaugagaaa

SEQ ID NO: 1443180 - RNA, 19 nt, Homo sapiens
caucuacaaucaauccaua

SEQ ID NO: 1443181 - RNA, 19 nt, Homo sapiens
ggaaugaaguggucuuuuc

SEQ ID NO: 1443182 - RNA, 19 nt, Homo sapiens
gaaggaacccucaaaagaa

SEQ ID NO: 1443183 - RNA, 19 nt, Homo sapiens
aaaagaagcucucugacaa

SEQ ID NO: 1443184 - RNA, 19 nt, Homo sapiens
ggacucagggccuugcauu

SEQ ID NO: 1443185 - RNA, 19 nt, Homo sapiens
ggagaugccaacccauuug

SEQ ID NO: 1443186 - RNA, 19 nt, Homo sapiens
gccaacccauuuguccuua

SEQ ID NO: 1443187 - RNA, 19 nt, Homo sapiens
ugaaccaucuacaaucaau

SEQ ID NO: 1443188 - RNA, 19 nt, Homo sapiens
ggccuugcauugugacaga

SEQ ID NO: 1443189 - RNA, 19 nt, Homo sapiens
gauuugaaccaucuacaau

SEQ ID NO: 1443190 - RNA, 19 nt, Homo sapiens
ggauuugaaccaucuacaa

SEQ ID NO: 1443191 - RNA, 19 nt, Homo sapiens
uacaaucaauccauaugug

SEQ ID NO: 1443192 - RNA, 19 nt, Homo sapiens
ggagugggcagcagucaca

SEQ ID NO: 1443193 - RNA, 19 nt, Homo sapiens
ccucagugccugcaucauu

SEQ ID NO: 1443194 - RNA, 19 nt, Homo sapiens
ucagggccuugcauuguga

SEQ ID NO: 1443195 - RNA, 19 nt, Homo sapiens
gcugauacuguccaagauu

SEQ ID NO: 1443196 - RNA, 19 nt, Homo sapiens
aaagaagcucucugacaaa

SEQ ID NO: 1443197 - RNA, 19 nt, Homo sapiens
cgaaggaacccucaaaaga

SEQ ID NO: 1443198 - RNA, 19 nt, Homo sapiens
uuugaaccaucuacaauca

SEQ ID NO: 1443199 - RNA, 19 nt, Homo sapiens
caaugccaaugagaaauca

SEQ ID NO: 1443200 - RNA, 19 nt, Homo sapiens
acaaucaauccauauguga

SEQ ID NO: 1443201 - RNA, 19 nt, Homo sapiens
ucaauaaaggaaugaagug

SEQ ID NO: 1443202 - RNA, 19 nt, Homo sapiens
aagaagcucucugacaaag

SEQ ID NO: 1443203 - RNA, 19 nt, Homo sapiens
agucaaaggcagaggcuaa

SEQ ID NO: 1443204 - RNA, 19 nt, Homo sapiens
agacgaaggaacccucaaa

SEQ ID NO: 1443205 - RNA, 19 nt, Homo sapiens
cugauacuguccaagauuc

SEQ ID NO: 1443206 - RNA, 19 nt, Homo sapiens
gagaugccaacccauuugu

SEQ ID NO: 1443207 - RNA, 19 nt, Homo sapiens
caucaagggccaguacaga

SEQ ID NO: 1443208 - RNA, 19 nt, Homo sapiens
caaaagaagcucucugaca

SEQ ID NO: 1443209 - RNA, 19 nt, Homo sapiens
caacccauuuguccuuagg

SEQ ID NO: 1443210 - RNA, 19 nt, Homo sapiens
gcauugugacagaguguau

SEQ ID NO: 1443211 - RNA, 19 nt, Homo sapiens
cggcugauacuguccaaga

SEQ ID NO: 1443212 - RNA, 19 nt, Homo sapiens
aagauacgguagccaccaa

SEQ ID NO: 1443213 - RNA, 19 nt, Homo sapiens
gccaaugagaaaucagaaa

SEQ ID NO: 1443214 - RNA, 19 nt, Homo sapiens
cuacaaucaauccauaugu

SEQ ID NO: 1443215 - RNA, 19 nt, Homo sapiens
cagaguguauucccuucuc

SEQ ID NO: 1443216 - RNA, 19 nt, Homo sapiens
cucagugccugcaucauuc

SEQ ID NO: 1443217 - RNA, 19 nt, Homo sapiens
agacacagacaguggacaa

SEQ ID NO: 1443218 - RNA, 19 nt, Homo sapiens
gagaagcagccccaaaaga

SEQ ID NO: 1443219 - RNA, 19 nt, Homo sapiens
caguggacaaugccaauga

SEQ ID NO: 1443220 - RNA, 19 nt, Homo sapiens
aaggagaugccaacccauu

SEQ ID NO: 1443221 - RNA, 19 nt, Homo sapiens
ccaaugagaaaucagaaaa

SEQ ID NO: 1443222 - RNA, 19 nt, Homo sapiens
cacagacaguggacaaugc

SEQ ID NO: 1443223 - RNA, 19 nt, Homo sapiens
ugugaccaauggaggagaa

SEQ ID NO: 1443224 - RNA, 19 nt, Homo sapiens
gauacgguagccaccaaga

SEQ ID NO: 1443225 - RNA, 19 nt, Homo sapiens
gacaguggacaaugccaau

SEQ ID NO: 1443226 - RNA, 19 nt, Homo sapiens
gcuauugccaggugcucaa

SEQ ID NO: 1443227 - RNA, 19 nt, Homo sapiens
gcgcauccgcagacgcuau

SEQ ID NO: 1443228 - RNA, 19 nt, Homo sapiens
ggcugauacuguccaagau

SEQ ID NO: 1443229 - RNA, 19 nt, Homo sapiens
acaaugccaaugagaaauc

SEQ ID NO: 1443230 - RNA, 19 nt, Homo sapiens
gacaaugccaaugagaaau

SEQ ID NO: 1443231 - RNA, 19 nt, Homo sapiens
acacagacaguggacaaug

SEQ ID NO: 1443232 - RNA, 19 nt, Homo sapiens
ggacauagccaccuuccua

SEQ ID NO: 1443233 - RNA, 19 nt, Homo sapiens
ggccuuggcuguuugguua

SEQ ID NO: 1443234 - RNA, 19 nt, Homo sapiens
gaacuggcccugcguguug

SEQ ID NO: 1443235 - RNA, 19 nt, Homo sapiens
gaagcgagaaugucugaaa

SEQ ID NO: 1443236 - RNA, 19 nt, Homo sapiens
gcaaggcugugcuggguau

SEQ ID NO: 1443237 - RNA, 19 nt, Homo sapiens
gccgauagaugugcuguuu

SEQ ID NO: 1443238 - RNA, 19 nt, Homo sapiens
gcgagaaugucugaaaaua

SEQ ID NO: 1443239 - RNA, 19 nt, Homo sapiens
ggccauguccugaauguga

SEQ ID NO: 1443240 - RNA, 19 nt, Homo sapiens
cagggccucugcucuauau

SEQ ID NO: 1443241 - RNA, 19 nt, Homo sapiens
gagccaccauccaggaguu

SEQ ID NO: 1443242 - RNA, 19 nt, Homo sapiens
gagaagcagacacucacua

SEQ ID NO: 1443243 - RNA, 19 nt, Homo sapiens
ccucugcucuauaucuauu

SEQ ID NO: 1443244 - RNA, 19 nt, Homo sapiens
ggccucugcucuauaucua

SEQ ID NO: 1443245 - RNA, 19 nt, Homo sapiens
gcuguuugguuaacuguca

SEQ ID NO: 1443246 - RNA, 19 nt, Homo sapiens
ggacacccaccucuuguuc

SEQ ID NO: 1443247 - RNA, 19 nt, Homo sapiens
gauggcauaggucacauuu

SEQ ID NO: 1443248 - RNA, 19 nt, Homo sapiens
ugacucacauaccuucuuc

SEQ ID NO: 1443249 - RNA, 19 nt, Homo sapiens
acauagccguguccaggua

SEQ ID NO: 1443250 - RNA, 19 nt, Homo sapiens
ggagcagaguugagaaggu

SEQ ID NO: 1443251 - RNA, 19 nt, Homo sapiens
cggccucggugauggcaua

SEQ ID NO: 1443252 - RNA, 19 nt, Homo sapiens
guucagaggaggccuacaa

SEQ ID NO: 1443253 - RNA, 19 nt, Homo sapiens
gaagcagacacucacuaga

SEQ ID NO: 1443254 - RNA, 19 nt, Homo sapiens
gaggagaagcagacacuca

SEQ ID NO: 1443255 - RNA, 19 nt, Homo sapiens
guucagcguucccgugcuu

SEQ ID NO: 1443256 - RNA, 19 nt, Homo sapiens
uggcauaggucacauuuug

SEQ ID NO: 1443257 - RNA, 19 nt, Homo sapiens
caugcaaggugauguaaaa

SEQ ID NO: 1443258 - RNA, 19 nt, Homo sapiens
caagauugccugcauaucc

SEQ ID NO: 1443259 - RNA, 19 nt, Homo sapiens
gggaugacagguaccaaug

SEQ ID NO: 1443260 - RNA, 19 nt, Homo sapiens
cacaaugacucacauaccu

SEQ ID NO: 1443261 - RNA, 19 nt, Homo sapiens
ggaacuggcccugcguguu

SEQ ID NO: 1443262 - RNA, 19 nt, Homo sapiens
cauggacacccaccucuug

SEQ ID NO: 1443263 - RNA, 19 nt, Homo sapiens
gugaagcgagaaugucuga

SEQ ID NO: 1443264 - RNA, 19 nt, Homo sapiens
ggaugacagguaccaaugu

SEQ ID NO: 1443265 - RNA, 19 nt, Homo sapiens
gcugagggccuggacauag

SEQ ID NO: 1443266 - RNA, 19 nt, Homo sapiens
aaaguauggcccaguucua

SEQ ID NO: 1443267 - RNA, 19 nt, Homo sapiens
acucagggccucugcucua

SEQ ID NO: 1443268 - RNA, 19 nt, Homo sapiens
gccauguccugaaugugau

SEQ ID NO: 1443269 - RNA, 19 nt, Homo sapiens
cacguucugugaagacugu

SEQ ID NO: 1443270 - RNA, 19 nt, Homo sapiens
cgagaaugucugaaaauaa

SEQ ID NO: 1443271 - RNA, 19 nt, Homo sapiens
aagaugcacagcuccauga

SEQ ID NO: 1443272 - RNA, 19 nt, Homo sapiens
guggccauguccugaaugu

SEQ ID NO: 1443273 - RNA, 19 nt, Homo sapiens
ccaccuuccuagcccacaa

SEQ ID NO: 1443274 - RNA, 19 nt, Homo sapiens
gcccugccacguucuguga

SEQ ID NO: 1443275 - RNA, 19 nt, Homo sapiens
guccucagggccucucuaa

SEQ ID NO: 1443276 - RNA, 19 nt, Homo sapiens
gcccacaaugacucacaua

SEQ ID NO: 1443277 - RNA, 19 nt, Homo sapiens
gguuaacugucaccuucca

SEQ ID NO: 1443278 - RNA, 19 nt, Homo sapiens
ccucagggccucucuaagc

SEQ ID NO: 1443279 - RNA, 19 nt, Homo sapiens
ucagggccucugcucuaua

SEQ ID NO: 1443280 - RNA, 19 nt, Homo sapiens
agaagcagacacucacuag

SEQ ID NO: 1443281 - RNA, 19 nt, Homo sapiens
gggcaucccuccaguguga

SEQ ID NO: 1443282 - RNA, 19 nt, Homo sapiens
gaaaucggaucucaaguac

SEQ ID NO: 1443283 - RNA, 19 nt, Homo sapiens
guaguagccugccucuuaa

SEQ ID NO: 1443284 - RNA, 19 nt, Homo sapiens
agagugacuuuacaacuua

SEQ ID NO: 1443285 - RNA, 19 nt, Homo sapiens
agucagagcuggaagugua

SEQ ID NO: 1443286 - RNA, 19 nt, Homo sapiens
gcagcaagcccaaguaguu

SEQ ID NO: 1443287 - RNA, 19 nt, Homo sapiens
gauuaucaaugcagagaaa

SEQ ID NO: 1443288 - RNA, 19 nt, Homo sapiens
uguaguagccugccucuua

SEQ ID NO: 1443289 - RNA, 19 nt, Homo sapiens
ggucuccaauucaugguua

SEQ ID NO: 1443290 - RNA, 19 nt, Homo sapiens
gcagguggcuuguagaaac

SEQ ID NO: 1443291 - RNA, 19 nt, Homo sapiens
cagagugacuuuacaacuu

SEQ ID NO: 1443292 - RNA, 19 nt, Homo sapiens
caacacacauccaucucaa

SEQ ID NO: 1443293 - RNA, 19 nt, Homo sapiens
gagagugccuuucaggaau

SEQ ID NO: 1443294 - RNA, 19 nt, Homo sapiens
ccacugagcuucgaguuca

SEQ ID NO: 1443295 - RNA, 19 nt, Homo sapiens
gcagugaguucuccuaagg

SEQ ID NO: 1443296 - RNA, 19 nt, Homo sapiens
gaucucaaguacccacuga

SEQ ID NO: 1443297 - RNA, 19 nt, Homo sapiens
cuacaaacguguggagaaa

SEQ ID NO: 1443298 - RNA, 19 nt, Homo sapiens
gcacaagggacaagaggaa

SEQ ID NO: 1443299 - RNA, 19 nt, Homo sapiens
ggagagugccuuucaggaa

SEQ ID NO: 1443300 - RNA, 19 nt, Homo sapiens
ugucaccucccuauuauua

SEQ ID NO: 1443301 - RNA, 19 nt, Homo sapiens
gaugagauacggccacuga

SEQ ID NO: 1443302 - RNA, 19 nt, Homo sapiens
caaaguaucauucucagau

SEQ ID NO: 1443303 - RNA, 19 nt, Homo sapiens
guucagggaucaccacaug

SEQ ID NO: 1443304 - RNA, 19 nt, Homo sapiens
ucaccucccuauuauuaaa

SEQ ID NO: 1443305 - RNA, 19 nt, Homo sapiens
gaagacagagcacugacaa

SEQ ID NO: 1443306 - RNA, 19 nt, Homo sapiens
agaaaucggaucucaagua

SEQ ID NO: 1443307 - RNA, 19 nt, Homo sapiens
gcagcuggccuuugucuau

SEQ ID NO: 1443308 - RNA, 19 nt, Homo sapiens
acacugcccuugcuuuguu

SEQ ID NO: 1443309 - RNA, 19 nt, Homo sapiens
acacaaacauccagcucaa

SEQ ID NO: 1443310 - RNA, 19 nt, Homo sapiens
caucagggcagaagacuug

SEQ ID NO: 1443311 - RNA, 19 nt, Homo sapiens
guagcuagcccauguuuag

SEQ ID NO: 1443312 - RNA, 19 nt, Homo sapiens
gcacacagggaaaggaaga

SEQ ID NO: 1443313 - RNA, 19 nt, Homo sapiens
caacacugcccuugcuuug

SEQ ID NO: 1443314 - RNA, 19 nt, Homo sapiens
gacaggaggucgggaagga

SEQ ID NO: 1443315 - RNA, 19 nt, Homo sapiens
ucccagaacugcucuagug

SEQ ID NO: 1443316 - RNA, 19 nt, Homo sapiens
ggaaugugaugaggugauc

SEQ ID NO: 1443317 - RNA, 19 nt, Homo sapiens
gacagagcacugacaauga

SEQ ID NO: 1443318 - RNA, 19 nt, Homo sapiens
cagcaagcccaaguaguua

SEQ ID NO: 1443319 - RNA, 19 nt, Homo sapiens
acaggaggaugaugugguu

SEQ ID NO: 1443320 - RNA, 19 nt, Homo sapiens
ccugucaccucccuauuau

SEQ ID NO: 1443321 - RNA, 19 nt, Homo sapiens
ccagagacucggauuauca

SEQ ID NO: 1443322 - RNA, 19 nt, Homo sapiens
gggauguacuguccaacga

SEQ ID NO: 1443323 - RNA, 19 nt, Homo sapiens
acaaacguguggagaaauc

SEQ ID NO: 1443324 - RNA, 19 nt, Homo sapiens
ccagugacccucaguuugu

SEQ ID NO: 1443325 - RNA, 19 nt, Homo sapiens
gagugacuuuacaacuuaa

SEQ ID NO: 1443326 - RNA, 19 nt, Homo sapiens
ggauuuagacucucauggu

SEQ ID NO: 1443327 - RNA, 19 nt, Homo sapiens
agacagagcacugacaaug

SEQ ID NO: 1443328 - RNA, 19 nt, Homo sapiens
gcuucuggcuggugaguuc

SEQ ID NO: 1443329 - RNA, 19 nt, Homo sapiens
cuuuacaacuuaacuagga

SEQ ID NO: 1443330 - RNA, 19 nt, Homo sapiens
gcuacaaacguguggagaa

SEQ ID NO: 1443331 - RNA, 19 nt, Homo sapiens
gggaugacuugggacagaa

SEQ ID NO: 1443332 - RNA, 19 nt, Homo sapiens
caucucaagaggaacauuu

SEQ ID NO: 1443333 - RNA, 19 nt, Homo sapiens
acacacauccaucucaaga

SEQ ID NO: 1443334 - RNA, 19 nt, Homo sapiens
acagagcacugacaaugag

SEQ ID NO: 1443335 - RNA, 19 nt, Homo sapiens
gauggacucugggauguac

SEQ ID NO: 1443336 - RNA, 19 nt, Homo sapiens
ugaauucaaugaggaucaa

SEQ ID NO: 1443337 - RNA, 19 nt, Homo sapiens
gcuagcccauguuuagauc

SEQ ID NO: 1443338 - RNA, 19 nt, Homo sapiens
aggauggucuucacagguu

SEQ ID NO: 1443339 - RNA, 19 nt, Homo sapiens
gcccagagacucggauuau

SEQ ID NO: 1443340 - RNA, 19 nt, Homo sapiens
uaucagggcauguguucaa

SEQ ID NO: 1443341 - RNA, 19 nt, Homo sapiens
gagacucggauuaucaaug

SEQ ID NO: 1443342 - RNA, 19 nt, Homo sapiens
gcccaaaguaucauucuca

SEQ ID NO: 1443343 - RNA, 19 nt, Homo sapiens
ucaagaggaacauuuauac

SEQ ID NO: 1443344 - RNA, 19 nt, Homo sapiens
agacucggauuaucaaugc

SEQ ID NO: 1443345 - RNA, 19 nt, Homo sapiens
caggcucgguuacuaggaa

SEQ ID NO: 1443346 - RNA, 19 nt, Homo sapiens
ggauagcagggccaucuug

SEQ ID NO: 1443347 - RNA, 19 nt, Homo sapiens
gggagaccaucagcucaga

SEQ ID NO: 1443348 - RNA, 19 nt, Homo sapiens
uaggcaggcucgguuacua

SEQ ID NO: 1443349 - RNA, 19 nt, Homo sapiens
guucuuugcuggagaugag

SEQ ID NO: 1443350 - RNA, 19 nt, Homo sapiens
gcagagugacuuuacaacu

SEQ ID NO: 1443351 - RNA, 19 nt, Homo sapiens
aagaggacccacacaggua

SEQ ID NO: 1443352 - RNA, 19 nt, Homo sapiens
ggucuggccuugccccuuu

SEQ ID NO: 1443353 - RNA, 19 nt, Homo sapiens
gcaagcccaaguaguuaug

SEQ ID NO: 1443354 - RNA, 19 nt, Homo sapiens
ccaacacugcccuugcuuu

SEQ ID NO: 1443355 - RNA, 19 nt, Homo sapiens
uaaggguauuagccaaaga

SEQ ID NO: 1443356 - RNA, 19 nt, Homo sapiens
gaacagcccaaaguaucau

SEQ ID NO: 1443357 - RNA, 19 nt, Homo sapiens
cucaagaggaacauuuaua

SEQ ID NO: 1443358 - RNA, 19 nt, Homo sapiens
gcccagaugcugauacaca

SEQ ID NO: 1443359 - RNA, 19 nt, Homo sapiens
ucagggcugucucaagcuu

SEQ ID NO: 1443360 - RNA, 19 nt, Homo sapiens
gaaaucugaauucaaugag

SEQ ID NO: 1443361 - RNA, 19 nt, Homo sapiens
gauccaggucuccaauuca

SEQ ID NO: 1443362 - RNA, 19 nt, Homo sapiens
agauccaggucuccaauuc

SEQ ID NO: 1443363 - RNA, 19 nt, Homo sapiens
acauccaucucaagaggaa

SEQ ID NO: 1443364 - RNA, 19 nt, Homo sapiens
cccugucaccucccuauua

SEQ ID NO: 1443365 - RNA, 19 nt, Homo sapiens
guccugcccugcuguucuu

SEQ ID NO: 1443366 - RNA, 19 nt, Homo sapiens
gguagcuagcccauguuua

SEQ ID NO: 1443367 - RNA, 19 nt, Homo sapiens
ugaacagcccaaaguauca

SEQ ID NO: 1443368 - RNA, 19 nt, Homo sapiens
ccucagacaggaucuugaa

SEQ ID NO: 1443369 - RNA, 19 nt, Homo sapiens
gaccguggguuccgaaaau

SEQ ID NO: 1443370 - RNA, 19 nt, Homo sapiens
ggaggaugaugugguuguc

SEQ ID NO: 1443371 - RNA, 19 nt, Homo sapiens
gcagggaaagcuguacaug

SEQ ID NO: 1443372 - RNA, 19 nt, Homo sapiens
caagacagccccugaaaag

SEQ ID NO: 1443373 - RNA, 19 nt, Homo sapiens
ccucaugucugcuaaaaca

SEQ ID NO: 1443374 - RNA, 19 nt, Homo sapiens
cagacaggaucuugaacag

SEQ ID NO: 1443375 - RNA, 19 nt, Homo sapiens
acgaugacgucucuguguu

SEQ ID NO: 1443376 - RNA, 19 nt, Homo sapiens
ugaagucuaucugcaggau

SEQ ID NO: 1443377 - RNA, 19 nt, Homo sapiens
gugcagugaguucuccuaa

SEQ ID NO: 1443378 - RNA, 19 nt, Homo sapiens
ggccauuacugggcacugu

SEQ ID NO: 1443379 - RNA, 19 nt, Homo sapiens
cagacacuguaucccagaa

SEQ ID NO: 1443380 - RNA, 19 nt, Homo sapiens
ggacagaagguuuuguuca

SEQ ID NO: 1443381 - RNA, 19 nt, Homo sapiens
ggagacagcugaccugaga

SEQ ID NO: 1443382 - RNA, 19 nt, Homo sapiens
ccagaacccuuuaagauug

SEQ ID NO: 1443383 - RNA, 19 nt, Homo sapiens
caucuuacguguauucauu

SEQ ID NO: 1443384 - RNA, 19 nt, Homo sapiens
uaaagaagcccuccuguca

SEQ ID NO: 1443385 - RNA, 19 nt, Homo sapiens
gaaccaugaggaaguauaa

SEQ ID NO: 1443386 - RNA, 19 nt, Homo sapiens
ucaaagacaugcugagcuu

SEQ ID NO: 1443387 - RNA, 19 nt, Homo sapiens
gaaccaauauacaucuuac

SEQ ID NO: 1443388 - RNA, 19 nt, Homo sapiens
cagaggauauccaagagaa

SEQ ID NO: 1443389 - RNA, 19 nt, Homo sapiens
uaggaaagcuucaaaugca

SEQ ID NO: 1443390 - RNA, 19 nt, Homo sapiens
gaaaacauccuucgaaaau

SEQ ID NO: 1443391 - RNA, 19 nt, Homo sapiens
aagaagcccuccugucaaa

SEQ ID NO: 1443392 - RNA, 19 nt, Homo sapiens
gaaugcgacuauacaacuu

SEQ ID NO: 1443393 - RNA, 19 nt, Homo sapiens
gggcuccacugaccauaaa

SEQ ID NO: 1443394 - RNA, 19 nt, Homo sapiens
guauugaagucuguaaguu

SEQ ID NO: 1443395 - RNA, 19 nt, Homo sapiens
gaaauucuucagucuucua

SEQ ID NO: 1443396 - RNA, 19 nt, Homo sapiens
aaagaagcguggcauggaa

SEQ ID NO: 1443397 - RNA, 19 nt, Homo sapiens
guacugaaccaauauacau

SEQ ID NO: 1443398 - RNA, 19 nt, Homo sapiens
agagaaccaugaggaagua

SEQ ID NO: 1443399 - RNA, 19 nt, Homo sapiens
uuacguguauucauugaug

SEQ ID NO: 1443400 - RNA, 19 nt, Homo sapiens
gaaaaucgacuccaccuau

SEQ ID NO: 1443401 - RNA, 19 nt, Homo sapiens
auagaaagauggcauagag

SEQ ID NO: 1443402 - RNA, 19 nt, Homo sapiens
cuaaacaguuccagaggau

SEQ ID NO: 1443403 - RNA, 19 nt, Homo sapiens
gcuacuggcucaaagacau

SEQ ID NO: 1443404 - RNA, 19 nt, Homo sapiens
uuucuguacugaaccaaua

SEQ ID NO: 1443405 - RNA, 19 nt, Homo sapiens
ccaaguuauuuacagcaaa

SEQ ID NO: 1443406 - RNA, 19 nt, Homo sapiens
gcagagacagaggagauaa

SEQ ID NO: 1443407 - RNA, 19 nt, Homo sapiens
ccaccaagcgguuaucugu

SEQ ID NO: 1443408 - RNA, 19 nt, Homo sapiens
caggugaaguugagagcaa

SEQ ID NO: 1443409 - RNA, 19 nt, Homo sapiens
gaagcuacuggcucaaaga

SEQ ID NO: 1443410 - RNA, 19 nt, Homo sapiens
gccaagagggcuccacuga

SEQ ID NO: 1443411 - RNA, 19 nt, Homo sapiens
uccagcaacucaagaagaa

SEQ ID NO: 1443412 - RNA, 19 nt, Homo sapiens
gaugcuguccuacaaguau

SEQ ID NO: 1443413 - RNA, 19 nt, Homo sapiens
uaccagaacccuuuaagau

SEQ ID NO: 1443414 - RNA, 19 nt, Homo sapiens
ccaugaggaaguauaaauu

SEQ ID NO: 1443415 - RNA, 19 nt, Homo sapiens
gcgguuaucugugacaucu

SEQ ID NO: 1443416 - RNA, 19 nt, Homo sapiens
accaagcgguuaucuguga

SEQ ID NO: 1443417 - RNA, 19 nt, Homo sapiens
ggaaggggauagaaagaug

SEQ ID NO: 1443418 - RNA, 19 nt, Homo sapiens
gaagauuccagcaacucaa

SEQ ID NO: 1443419 - RNA, 19 nt, Homo sapiens
cuuaaccaauuaccaauca

SEQ ID NO: 1443420 - RNA, 19 nt, Homo sapiens
ggagauaacccagggaaac

SEQ ID NO: 1443421 - RNA, 19 nt, Homo sapiens
gggauagaaagauggcaua

SEQ ID NO: 1443422 - RNA, 19 nt, Homo sapiens
ccaagagaaccaugaggaa

SEQ ID NO: 1443423 - RNA, 19 nt, Homo sapiens
aaacaguuccagaggauau

SEQ ID NO: 1443424 - RNA, 19 nt, Homo sapiens
gaagcccuccugucaaaca

SEQ ID NO: 1443425 - RNA, 19 nt, Homo sapiens
ggcccaaccucagcuguau

SEQ ID NO: 1443426 - RNA, 19 nt, Homo sapiens
ugugacaucucuuccuuca

SEQ ID NO: 1443427 - RNA, 19 nt, Homo sapiens
gagauaacccagggaaaca

SEQ ID NO: 1443428 - RNA, 19 nt, Homo sapiens
guaggaaagcuucaaaugc

SEQ ID NO: 1443429 - RNA, 19 nt, Homo sapiens
ggacagugccgaagauucc

SEQ ID NO: 1443430 - RNA, 19 nt, Homo sapiens
ucagcuguaucuaccagaa

SEQ ID NO: 1443431 - RNA, 19 nt, Homo sapiens
guuuucaucucccaaguua

SEQ ID NO: 1443432 - RNA, 19 nt, Homo sapiens
gauagaaagauggcauaga

SEQ ID NO: 1443433 - RNA, 19 nt, Homo sapiens
guaucuaccagaacccuuu

SEQ ID NO: 1443434 - RNA, 19 nt, Homo sapiens
ucauugaugucugccugua

SEQ ID NO: 1443435 - RNA, 19 nt, Homo sapiens
aaacauccuucgaaaauca

SEQ ID NO: 1443436 - RNA, 19 nt, Homo sapiens
ggaaaacauccuucgaaaa

SEQ ID NO: 1443437 - RNA, 19 nt, Homo sapiens
gguuaucugugacaucucu

SEQ ID NO: 1443438 - RNA, 19 nt, Homo sapiens
uuucaucucccaaguuauu

SEQ ID NO: 1443439 - RNA, 19 nt, Homo sapiens
guaauuugaagacgaaagu

SEQ ID NO: 1443440 - RNA, 19 nt, Homo sapiens
gaugucugccuguaacuuc

SEQ ID NO: 1443441 - RNA, 19 nt, Homo sapiens
uaagauugccuacagaaaa

SEQ ID NO: 1443442 - RNA, 19 nt, Homo sapiens
gauagugacaugggauuuc

SEQ ID NO: 1443443 - RNA, 19 nt, Homo sapiens
gacuauacaacuugauguu

SEQ ID NO: 1443444 - RNA, 19 nt, Homo sapiens
cagagaaugcgacuauaca

SEQ ID NO: 1443445 - RNA, 19 nt, Homo sapiens
ucccuaggauugucaagga

SEQ ID NO: 1443446 - RNA, 19 nt, Homo sapiens
uaaccaauuaccaaucaga

SEQ ID NO: 1443447 - RNA, 19 nt, Homo sapiens
ugauaaauccaugaagcua

SEQ ID NO: 1443448 - RNA, 19 nt, Homo sapiens
ugacugauaaauccaugaa

SEQ ID NO: 1443449 - RNA, 19 nt, Homo sapiens
aaagaagcccuccugucaa

SEQ ID NO: 1443450 - RNA, 19 nt, Homo sapiens
accagaacccuuuaagauu

SEQ ID NO: 1443451 - RNA, 19 nt, Homo sapiens
gcaaaaggggccauauuca

SEQ ID NO: 1443452 - RNA, 19 nt, Homo sapiens
ucugugacaucucuuccuu

SEQ ID NO: 1443453 - RNA, 19 nt, Homo sapiens
ggaugcuguccuacaagua

SEQ ID NO: 1443454 - RNA, 19 nt, Homo sapiens
gagcugugucuaccaacuu

SEQ ID NO: 1443455 - RNA, 19 nt, Homo sapiens
ugaagcuacuggcucaaag

SEQ ID NO: 1443456 - RNA, 19 nt, Homo sapiens
cuaggauugucaaggaguu

SEQ ID NO: 1443457 - RNA, 19 nt, Homo sapiens
gcuguggcaugucuuuaac

SEQ ID NO: 1443458 - RNA, 19 nt, Homo sapiens
aaagacaugcugagcuuca

SEQ ID NO: 1443459 - RNA, 19 nt, Homo sapiens
gcgacuauacaacuugaug

SEQ ID NO: 1443460 - RNA, 19 nt, Homo sapiens
gagaaugcgacuauacaac

SEQ ID NO: 1443461 - RNA, 19 nt, Homo sapiens
guuggacagugccgaagau

SEQ ID NO: 1443462 - RNA, 19 nt, Homo sapiens
ucagucuucuaaacaguuc

SEQ ID NO: 1443463 - RNA, 19 nt, Homo sapiens
uggaaaacauccuucgaaa

SEQ ID NO: 1443464 - RNA, 19 nt, Homo sapiens
acacuuuccagcacuuaaa

SEQ ID NO: 1443465 - RNA, 19 nt, Homo sapiens
ggcagagacagaggagaua

SEQ ID NO: 1443466 - RNA, 19 nt, Homo sapiens
ucaucucccaaguuauuua

SEQ ID NO: 1443467 - RNA, 19 nt, Homo sapiens
cuaccagaacccuuuaaga

SEQ ID NO: 1443468 - RNA, 19 nt, Homo sapiens
ccaauuaccaaucagaaaa

SEQ ID NO: 1443469 - RNA, 19 nt, Homo sapiens
caaccucagcuguaucuac

SEQ ID NO: 1443470 - RNA, 19 nt, Homo sapiens
cgaagauuccagcaacuca

SEQ ID NO: 1443471 - RNA, 19 nt, Homo sapiens
uaucuaccagaacccuuua

SEQ ID NO: 1443472 - RNA, 19 nt, Homo sapiens
gaccucauagaaacaguga

SEQ ID NO: 1443473 - RNA, 19 nt, Homo sapiens
gauuccagcaacucaagaa

SEQ ID NO: 1443474 - RNA, 19 nt, Homo sapiens
ccuuuaagauugccuacag

SEQ ID NO: 1443475 - RNA, 19 nt, Homo sapiens
agcugugucuaccaacuua

SEQ ID NO: 1443476 - RNA, 19 nt, Homo sapiens
gcuucaacagugugaguuu

SEQ ID NO: 1443477 - RNA, 19 nt, Homo sapiens
ccacacuuuccagcacuua

SEQ ID NO: 1443478 - RNA, 19 nt, Homo sapiens
gauaacccagggaaacaca

SEQ ID NO: 1443479 - RNA, 19 nt, Homo sapiens
cccaaguuauuuacagcaa

SEQ ID NO: 1443480 - RNA, 19 nt, Homo sapiens
auagugacaugggauuuca

SEQ ID NO: 1443481 - RNA, 19 nt, Homo sapiens
gagaguaccuuguuauaua

SEQ ID NO: 1443482 - RNA, 19 nt, Homo sapiens
gaaguuggauuaucaauuc

SEQ ID NO: 1443483 - RNA, 19 nt, Homo sapiens
ggacagagaagcuuuauuu

SEQ ID NO: 1443484 - RNA, 19 nt, Homo sapiens
uaauggagaugcagauaua

SEQ ID NO: 1443485 - RNA, 19 nt, Homo sapiens
cagcuaaacuuacuaauuc

SEQ ID NO: 1443486 - RNA, 19 nt, Homo sapiens
gacaugaggagauauauua

SEQ ID NO: 1443487 - RNA, 19 nt, Homo sapiens
gauaacugcccaauauuua

SEQ ID NO: 1443488 - RNA, 19 nt, Homo sapiens
uaugauaacugcccaauau

SEQ ID NO: 1443489 - RNA, 19 nt, Homo sapiens
ggagagggaaguuggauua

SEQ ID NO: 1443490 - RNA, 19 nt, Homo sapiens
uaaauaacacggcccaaua

SEQ ID NO: 1443491 - RNA, 19 nt, Homo sapiens
gagggaaguuggauuauca

SEQ ID NO: 1443492 - RNA, 19 nt, Homo sapiens
gcaaacagccauccaacaa

SEQ ID NO: 1443493 - RNA, 19 nt, Homo sapiens
guaaauguguauggugaua

SEQ ID NO: 1443494 - RNA, 19 nt, Homo sapiens
ggauaaaacuguauuguga

SEQ ID NO: 1443495 - RNA, 19 nt, Homo sapiens
cagagaguauugaauguaa

SEQ ID NO: 1443496 - RNA, 19 nt, Homo sapiens
ucucugggcuggaaacaua

SEQ ID NO: 1443497 - RNA, 19 nt, Homo sapiens
ggacagagauaucuuucag

SEQ ID NO: 1443498 - RNA, 19 nt, Homo sapiens
uaaacucguugcgugauua

SEQ ID NO: 1443499 - RNA, 19 nt, Homo sapiens
cuaauaugcuccucaaugu

SEQ ID NO: 1443500 - RNA, 19 nt, Homo sapiens
aaacagccauccaacaaau

SEQ ID NO: 1443501 - RNA, 19 nt, Homo sapiens
aagcugagcaucuguauuu

SEQ ID NO: 1443502 - RNA, 19 nt, Homo sapiens
ccaauaacucuuuguguuu

SEQ ID NO: 1443503 - RNA, 19 nt, Homo sapiens
gaaacaccaggacccaaua

SEQ ID NO: 1443504 - RNA, 19 nt, Homo sapiens
ggcagaagcuggcauugau

SEQ ID NO: 1443505 - RNA, 19 nt, Homo sapiens
cuuaaagucucuaguaugu

SEQ ID NO: 1443506 - RNA, 19 nt, Homo sapiens
cauugucacuguagucuuu

SEQ ID NO: 1443507 - RNA, 19 nt, Homo sapiens
gcuccucaauguaauuauu

SEQ ID NO: 1443508 - RNA, 19 nt, Homo sapiens
ggagaugcagauauagaua

SEQ ID NO: 1443509 - RNA, 19 nt, Homo sapiens
cccaauaacucuuuguguu

SEQ ID NO: 1443510 - RNA, 19 nt, Homo sapiens
caagacagcuauggaucaa

SEQ ID NO: 1443511 - RNA, 19 nt, Homo sapiens
gcuaauaugcuccucaaug

SEQ ID NO: 1443512 - RNA, 19 nt, Homo sapiens
ggaaguuggauuaucaauu

SEQ ID NO: 1443513 - RNA, 19 nt, Homo sapiens
ccgccuugcugaaguauuu

SEQ ID NO: 1443514 - RNA, 19 nt, Homo sapiens
guaccgccuugcugaagua

SEQ ID NO: 1443515 - RNA, 19 nt, Homo sapiens
gcagagaguauugaaugua

SEQ ID NO: 1443516 - RNA, 19 nt, Homo sapiens
ccacuuccuuuaccaauca

SEQ ID NO: 1443517 - RNA, 19 nt, Homo sapiens
aaucgucacuuccucguuu

SEQ ID NO: 1443518 - RNA, 19 nt, Homo sapiens
gaaccucuacuaccagcua

SEQ ID NO: 1443519 - RNA, 19 nt, Homo sapiens
gaggcgacaugaggagaua

SEQ ID NO: 1443520 - RNA, 19 nt, Homo sapiens
aaacacuucuguggucuuu

SEQ ID NO: 1443521 - RNA, 19 nt, Homo sapiens
ccuguuaugucaagcuuaa

SEQ ID NO: 1443522 - RNA, 19 nt, Homo sapiens
caacggaucccaaggaagu

SEQ ID NO: 1443523 - RNA, 19 nt, Homo sapiens
aaaacagccuugugucuua

SEQ ID NO: 1443524 - RNA, 19 nt, Homo sapiens
ggagaguaccuuguuauau

SEQ ID NO: 1443525 - RNA, 19 nt, Homo sapiens
ucaacaagacagaaaguaa

SEQ ID NO: 1443526 - RNA, 19 nt, Homo sapiens
ugauaucuguaaccaguuu

SEQ ID NO: 1443527 - RNA, 19 nt, Homo sapiens
aaauaacacggcccaauaa

SEQ ID NO: 1443528 - RNA, 19 nt, Homo sapiens
cagaguagcauuugcauuc

SEQ ID NO: 1443529 - RNA, 19 nt, Homo sapiens
gaaaggaacggcagaagcu

SEQ ID NO: 1443530 - RNA, 19 nt, Homo sapiens
gcucucuagucuucauuaa

SEQ ID NO: 1443531 - RNA, 19 nt, Homo sapiens
gcagucgccucaccaucuu

SEQ ID NO: 1443532 - RNA, 19 nt, Homo sapiens
uaugagacaaccucuauuu

SEQ ID NO: 1443533 - RNA, 19 nt, Homo sapiens
acuaugagucucuaaguua

SEQ ID NO: 1443534 - RNA, 19 nt, Homo sapiens
aauaugcuccucaauguaa

SEQ ID NO: 1443535 - RNA, 19 nt, Homo sapiens
ugauaacugcccaauauuu

SEQ ID NO: 1443536 - RNA, 19 nt, Homo sapiens
gaagacaauuugguguauc

SEQ ID NO: 1443537 - RNA, 19 nt, Homo sapiens
uagcuuaaagucucuagua

SEQ ID NO: 1443538 - RNA, 19 nt, Homo sapiens
cagaacaaauaccgggaaa

SEQ ID NO: 1443539 - RNA, 19 nt, Homo sapiens
gcagauauagauaccauag

SEQ ID NO: 1443540 - RNA, 19 nt, Homo sapiens
guaaucuucuaugguguuu

SEQ ID NO: 1443541 - RNA, 19 nt, Homo sapiens
gagaccggcuggcauucuu

SEQ ID NO: 1443542 - RNA, 19 nt, Homo sapiens
caaacagccauccaacaaa

SEQ ID NO: 1443543 - RNA, 19 nt, Homo sapiens
gcuauaaucaaggugguua

SEQ ID NO: 1443544 - RNA, 19 nt, Homo sapiens
agauauagauaccauaguc

SEQ ID NO: 1443545 - RNA, 19 nt, Homo sapiens
cauuugaacuguguuuaug

SEQ ID NO: 1443546 - RNA, 19 nt, Homo sapiens
cuaugagucucuaaguuau

SEQ ID NO: 1443547 - RNA, 19 nt, Homo sapiens
acaauuugguguaucacaa

SEQ ID NO: 1443548 - RNA, 19 nt, Homo sapiens
ucacagcuaaacuuacuaa

SEQ ID NO: 1443549 - RNA, 19 nt, Homo sapiens
ucuacuaccagcuauauuu

SEQ ID NO: 1443550 - RNA, 19 nt, Homo sapiens
uaacacggcccaauaacuc

SEQ ID NO: 1443551 - RNA, 19 nt, Homo sapiens
uagaagacaauuuggugua

SEQ ID NO: 1443552 - RNA, 19 nt, Homo sapiens
gacaaccucuauuuucuuu

SEQ ID NO: 1443553 - RNA, 19 nt, Homo sapiens
cagcaucgacauagcguuu

SEQ ID NO: 1443554 - RNA, 19 nt, Homo sapiens
agaagacaauuugguguau

SEQ ID NO: 1443555 - RNA, 19 nt, Homo sapiens
gcagaagcuggcauugauu

SEQ ID NO: 1443556 - RNA, 19 nt, Homo sapiens
ccuugugucuuagaugaua

SEQ ID NO: 1443557 - RNA, 19 nt, Homo sapiens
aaaguaaccucagcaucga

SEQ ID NO: 1443558 - RNA, 19 nt, Homo sapiens
gaguagcauuugcauucuu

SEQ ID NO: 1443559 - RNA, 19 nt, Homo sapiens
aaaugucaaucgucacuuc

SEQ ID NO: 1443560 - RNA, 19 nt, Homo sapiens
uuaagugcaugaauaagca

SEQ ID NO: 1443561 - RNA, 19 nt, Homo sapiens
caaauagcguugaguuuuc

SEQ ID NO: 1443562 - RNA, 19 nt, Homo sapiens
ccauuucaguggcagaaga

SEQ ID NO: 1443563 - RNA, 19 nt, Homo sapiens
uaguguagccccuaaauua

SEQ ID NO: 1443564 - RNA, 19 nt, Homo sapiens
uaauaugcuccucaaugua

SEQ ID NO: 1443565 - RNA, 19 nt, Homo sapiens
cccaaguucugaaugcauu

SEQ ID NO: 1443566 - RNA, 19 nt, Homo sapiens
uaaccucagcaucgacaua

SEQ ID NO: 1443567 - RNA, 19 nt, Homo sapiens
aagacaauuugguguauca

SEQ ID NO: 1443568 - RNA, 19 nt, Homo sapiens
cgacaugaggagauauauu

SEQ ID NO: 1443569 - RNA, 19 nt, Homo sapiens
ucucuagucuucauuaagg

SEQ ID NO: 1443570 - RNA, 19 nt, Homo sapiens
uaacagaguagcauuugca

SEQ ID NO: 1443571 - RNA, 19 nt, Homo sapiens
caaccaagacagcuaugga

SEQ ID NO: 1443572 - RNA, 19 nt, Homo sapiens
acagucagcaggcgaguuu

SEQ ID NO: 1443573 - RNA, 19 nt, Homo sapiens
uaaucaaggugguuacaac

SEQ ID NO: 1443574 - RNA, 19 nt, Homo sapiens
cagcagcuauaaucaaggu

SEQ ID NO: 1443575 - RNA, 19 nt, Homo sapiens
gaagcacuccagcagcuau

SEQ ID NO: 1443576 - RNA, 19 nt, Homo sapiens
caacaagacagaaaguaac

SEQ ID NO: 1443577 - RNA, 19 nt, Homo sapiens
gaguucucaugaaauauuc

SEQ ID NO: 1443578 - RNA, 19 nt, Homo sapiens
aagcuaauaugcuccucaa

SEQ ID NO: 1443579 - RNA, 19 nt, Homo sapiens
ccaagacagcuauggauca

SEQ ID NO: 1443580 - RNA, 19 nt, Homo sapiens
gagacaaccucuauuuucu

SEQ ID NO: 1443581 - RNA, 19 nt, Homo sapiens
ugaccguucuguuuaauua

SEQ ID NO: 1443582 - RNA, 19 nt, Homo sapiens
gaaaggaaaggaagggaaa

SEQ ID NO: 1443583 - RNA, 19 nt, Homo sapiens
ugaggaaggcacauauuua

SEQ ID NO: 1443584 - RNA, 19 nt, Homo sapiens
gguccagccucagcucuua

SEQ ID NO: 1443585 - RNA, 19 nt, Homo sapiens
ugccacaucuacacuauuu

SEQ ID NO: 1443586 - RNA, 19 nt, Homo sapiens
gagcaaggccugagaaagg

SEQ ID NO: 1443587 - RNA, 19 nt, Homo sapiens
ggaggagacacuacucaaa

SEQ ID NO: 1443588 - RNA, 19 nt, Homo sapiens
gaggaaggcacauauuuag

SEQ ID NO: 1443589 - RNA, 19 nt, Homo sapiens
gauggcagguucugaaguc

SEQ ID NO: 1443590 - RNA, 19 nt, Homo sapiens
ccaagccucuggugccaaa

SEQ ID NO: 1443591 - RNA, 19 nt, Homo sapiens
cagcugagaugccauuugg

SEQ ID NO: 1443592 - RNA, 19 nt, Homo sapiens
agaaccuguuguuaacuua

SEQ ID NO: 1443593 - RNA, 19 nt, Homo sapiens
gacaaauacugguggaaaa

SEQ ID NO: 1443594 - RNA, 19 nt, Homo sapiens
ugacaaauacugguggaaa

SEQ ID NO: 1443595 - RNA, 19 nt, Homo sapiens
ugagcgugcugcagaguga

SEQ ID NO: 1443596 - RNA, 19 nt, Homo sapiens
aagaaccuguuguuaacuu

SEQ ID NO: 1443597 - RNA, 19 nt, Homo sapiens
ggcugaccguucuguuuaa

SEQ ID NO: 1443598 - RNA, 19 nt, Homo sapiens
gcugccacaucuacacuau

SEQ ID NO: 1443599 - RNA, 19 nt, Homo sapiens
aggcugaccguucuguuua

SEQ ID NO: 1443600 - RNA, 19 nt, Homo sapiens
aaggugacaucguggaaga

SEQ ID NO: 1443601 - RNA, 19 nt, Homo sapiens
ggcagguucugaagucuag

SEQ ID NO: 1443602 - RNA, 19 nt, Homo sapiens
gaggagacacuacucaaac

SEQ ID NO: 1443603 - RNA, 19 nt, Homo sapiens
caaccacgugcaugaggua

SEQ ID NO: 1443604 - RNA, 19 nt, Homo sapiens
gcugagaugccauuuggau

SEQ ID NO: 1443605 - RNA, 19 nt, Homo sapiens
uauuuagccuggccugaga

SEQ ID NO: 1443606 - RNA, 19 nt, Homo sapiens
gguggcauuuguccagaug

SEQ ID NO: 1443607 - RNA, 19 nt, Homo sapiens
caaaggugacaucguggaa

SEQ ID NO: 1443608 - RNA, 19 nt, Homo sapiens
caucagcgaccuacauagu

SEQ ID NO: 1443609 - RNA, 19 nt, Homo sapiens
cugaggaaggcacauauuu

SEQ ID NO: 1443610 - RNA, 19 nt, Homo sapiens
caucguggaagaccaguug

SEQ ID NO: 1443611 - RNA, 19 nt, Homo sapiens
aagacaggcugggcucuga

SEQ ID NO: 1443612 - RNA, 19 nt, Homo sapiens
cuauuuccuuggugagauu

SEQ ID NO: 1443613 - RNA, 19 nt, Homo sapiens
cacaaauccauuccaggua

SEQ ID NO: 1443614 - RNA, 19 nt, Homo sapiens
gaaggcugaccguucuguu

SEQ ID NO: 1443615 - RNA, 19 nt, Homo sapiens
ccauagcaaucacccaaac

SEQ ID NO: 1443616 - RNA, 19 nt, Homo sapiens
ggucucuccuucccuacug

SEQ ID NO: 1443617 - RNA, 19 nt, Homo sapiens
gaugagcugcugggcguuu

SEQ ID NO: 1443618 - RNA, 19 nt, Homo sapiens
gggagcaaggccugagaaa

SEQ ID NO: 1443619 - RNA, 19 nt, Homo sapiens
gcugaccguucuguuuaau

SEQ ID NO: 1443620 - RNA, 19 nt, Homo sapiens
gggaauaaaguggcuaugg

SEQ ID NO: 1443621 - RNA, 19 nt, Homo sapiens
cugaggagacccaagaaga

SEQ ID NO: 1443622 - RNA, 19 nt, Homo sapiens
gcacgcaggaggagacacu

SEQ ID NO: 1443623 - RNA, 19 nt, Homo sapiens
gcaaggccugagaaaggaa

SEQ ID NO: 1443624 - RNA, 19 nt, Homo sapiens
ggagcaaggccugagaaag

SEQ ID NO: 1443625 - RNA, 19 nt, Homo sapiens
caagcacccagcugagaug

SEQ ID NO: 1443626 - RNA, 19 nt, Homo sapiens
gggucagggucccaagugu

SEQ ID NO: 1443627 - RNA, 19 nt, Homo sapiens
ggagggcaaaggugacauc

SEQ ID NO: 1443628 - RNA, 19 nt, Homo sapiens
ccaagcacccagcugagau

SEQ ID NO: 1443629 - RNA, 19 nt, Homo sapiens
gcccugaggaaggcacaua

SEQ ID NO: 1443630 - RNA, 19 nt, Homo sapiens
uccaucagcgaccuacaua

SEQ ID NO: 1443631 - RNA, 19 nt, Homo sapiens
aaggcugaccguucuguuu

SEQ ID NO: 1443632 - RNA, 19 nt, Homo sapiens
ggagacacuacucaaacuc

SEQ ID NO: 1443633 - RNA, 19 nt, Homo sapiens
ggugguaccugcacauuug

SEQ ID NO: 1443634 - RNA, 19 nt, Homo sapiens
gcacauuuguccaggaaga

SEQ ID NO: 1443635 - RNA, 19 nt, Homo sapiens
gcacgucgguggcagcuau

SEQ ID NO: 1443636 - RNA, 19 nt, Homo sapiens
ccagagggcugaagcuuag

SEQ ID NO: 1443637 - RNA, 19 nt, Homo sapiens
agagaaggcucgcaagcaa

SEQ ID NO: 1443638 - RNA, 19 nt, Homo sapiens
aaaccaaagcugagaguaa

SEQ ID NO: 1443639 - RNA, 19 nt, Homo sapiens
ccagcaaggucaagaaugg

SEQ ID NO: 1443640 - RNA, 19 nt, Homo sapiens
gccagagggcugaagcuua

SEQ ID NO: 1443641 - RNA, 19 nt, Homo sapiens
ucaaauuaguucccaagca

SEQ ID NO: 1443642 - RNA, 19 nt, Homo sapiens
ccacuggcagcuucaaauu

SEQ ID NO: 1443643 - RNA, 19 nt, Homo sapiens
ucuacauccugcacaagua

SEQ ID NO: 1443644 - RNA, 19 nt, Homo sapiens
acuggcagcuucaaauuag

SEQ ID NO: 1443645 - RNA, 19 nt, Homo sapiens
caacgugggcaaggugaaa

SEQ ID NO: 1443646 - RNA, 19 nt, Homo sapiens
aaccaaagcugagaguaag

SEQ ID NO: 1443647 - RNA, 19 nt, Homo sapiens
cacuggcagcuucaaauua

SEQ ID NO: 1443648 - RNA, 19 nt, Homo sapiens
ccaagaggccagcaaaggu

SEQ ID NO: 1443649 - RNA, 19 nt, Homo sapiens
caaggccucaucauccaaa

SEQ ID NO: 1443650 - RNA, 19 nt, Homo sapiens
aagcugagaguaagaguuc

SEQ ID NO: 1443651 - RNA, 19 nt, Homo sapiens
gcugaggccuacaggaaaa

SEQ ID NO: 1443652 - RNA, 19 nt, Homo sapiens
gagcgucaccagcgacauc

SEQ ID NO: 1443653 - RNA, 19 nt, Homo sapiens
cugcacauuuguccaggaa

SEQ ID NO: 1443654 - RNA, 19 nt, Homo sapiens
ggaaggcaaaggccaaagg

SEQ ID NO: 1443655 - RNA, 19 nt, Homo sapiens
ggacguccuccgcuucaag

SEQ ID NO: 1443656 - RNA, 19 nt, Homo sapiens
ggccucaucauccaaagug

SEQ ID NO: 1443657 - RNA, 19 nt, Homo sapiens
cagccaagaggccagcaaa

SEQ ID NO: 1443658 - RNA, 19 nt, Homo sapiens
gcugagaguaagaguucaa

SEQ ID NO: 1443659 - RNA, 19 nt, Homo sapiens
ggacuagucuaccaagguu

SEQ ID NO: 1443660 - RNA, 19 nt, Homo sapiens
gcagcuaauucuagauuug

SEQ ID NO: 1443661 - RNA, 19 nt, Homo sapiens
gccuucagcuuccuaaauu

SEQ ID NO: 1443662 - RNA, 19 nt, Homo sapiens
ggaguaagcagaggauaaa

SEQ ID NO: 1443663 - RNA, 19 nt, Homo sapiens
gacacugggucaaggagua

SEQ ID NO: 1443664 - RNA, 19 nt, Homo sapiens
aagcauggauuaagugaga

SEQ ID NO: 1443665 - RNA, 19 nt, Homo sapiens
gcgagaaugucaggaagaa

SEQ ID NO: 1443666 - RNA, 19 nt, Homo sapiens
ggaaggagagcaagcacaa

SEQ ID NO: 1443667 - RNA, 19 nt, Homo sapiens
gcaagcagagccuguuguu

SEQ ID NO: 1443668 - RNA, 19 nt, Homo sapiens
ccacagagcagagaucuca

SEQ ID NO: 1443669 - RNA, 19 nt, Homo sapiens
guaagcagaggauaaacaa

SEQ ID NO: 1443670 - RNA, 19 nt, Homo sapiens
gagaaugucaggaagaaag

SEQ ID NO: 1443671 - RNA, 19 nt, Homo sapiens
caaagauuaugcgagaaug

SEQ ID NO: 1443672 - RNA, 19 nt, Homo sapiens
agauaaagaugcccauuuu

SEQ ID NO: 1443673 - RNA, 19 nt, Homo sapiens
gcucguggaaaccaagaua

SEQ ID NO: 1443674 - RNA, 19 nt, Homo sapiens
ggcagcuaauucuagauuu

SEQ ID NO: 1443675 - RNA, 19 nt, Homo sapiens
aagguuauuuggcagcuaa

SEQ ID NO: 1443676 - RNA, 19 nt, Homo sapiens
ggaaaccaagauaaagaug

SEQ ID NO: 1443677 - RNA, 19 nt, Homo sapiens
guggaaaccaagauaaaga

SEQ ID NO: 1443678 - RNA, 19 nt, Homo sapiens
uaaagcauggauuaaguga

SEQ ID NO: 1443679 - RNA, 19 nt, Homo sapiens
aagauaaagaugcccauuu

SEQ ID NO: 1443680 - RNA, 19 nt, Homo sapiens
ucaaagauuaugcgagaau

SEQ ID NO: 1443681 - RNA, 19 nt, Homo sapiens
gaaggagagcaagcacaaa

SEQ ID NO: 1443682 - RNA, 19 nt, Homo sapiens
ugcacgcacugccuccuua

SEQ ID NO: 1443683 - RNA, 19 nt, Homo sapiens
ggagagcaagcacaaaguc

SEQ ID NO: 1443684 - RNA, 19 nt, Homo sapiens
gagcaagcacaaagucauc

SEQ ID NO: 1443685 - RNA, 19 nt, Homo sapiens
ggauaaacaacuggaagga

SEQ ID NO: 1443686 - RNA, 19 nt, Homo sapiens
aagcagagccuguuguuuu

SEQ ID NO: 1443687 - RNA, 19 nt, Homo sapiens
gagagcaagcacaaaguca

SEQ ID NO: 1443688 - RNA, 19 nt, Homo sapiens
ugugaggaaugcaaaauaa

SEQ ID NO: 1443689 - RNA, 19 nt, Homo sapiens
caagauaaagaugcccauu

SEQ ID NO: 1443690 - RNA, 19 nt, Homo sapiens
ccucugaauuuguacacau

SEQ ID NO: 1443691 - RNA, 19 nt, Homo sapiens
caagguuauuuggcagcua

SEQ ID NO: 1443692 - RNA, 19 nt, Homo sapiens
caagcagagccuguuguuu

SEQ ID NO: 1443693 - RNA, 19 nt, Homo sapiens
acagagcagagaucucaaa

SEQ ID NO: 1443694 - RNA, 19 nt, Homo sapiens
caagcaagcagagccuguu

SEQ ID NO: 1443695 - RNA, 19 nt, Homo sapiens
ucagcuuccuaaauucugu

SEQ ID NO: 1443696 - RNA, 19 nt, Homo sapiens
uggcagcuaauucuagauu

SEQ ID NO: 1443697 - RNA, 19 nt, Homo sapiens
aggaguaagcagaggauaa

SEQ ID NO: 1443698 - RNA, 19 nt, Homo sapiens
uuuggcagcuaauucuaga

SEQ ID NO: 1443699 - RNA, 19 nt, Homo sapiens
guuauuuggcagcuaauuc

SEQ ID NO: 1443700 - RNA, 19 nt, Homo sapiens
gaaugucaggaagaaaguu

SEQ ID NO: 1443701 - RNA, 19 nt, Homo sapiens
cuuccuaaauucugugucu

SEQ ID NO: 1443702 - RNA, 19 nt, Homo sapiens
caagcacaaagucaucaug

SEQ ID NO: 1443703 - RNA, 19 nt, Homo sapiens
gggacuagucuaccaaggu

SEQ ID NO: 1443704 - RNA, 19 nt, Homo sapiens
ggugaaagcucuaaacuaa

SEQ ID NO: 1443705 - RNA, 19 nt, Homo sapiens
gaaagagacugagaguuua

SEQ ID NO: 1443706 - RNA, 19 nt, Homo sapiens
ggaaagagacugagaguuu

SEQ ID NO: 1443707 - RNA, 19 nt, Homo sapiens
ccaagaagccaaccaauua

SEQ ID NO: 1443708 - RNA, 19 nt, Homo sapiens
gaaagcaguuggacuagaa

SEQ ID NO: 1443709 - RNA, 19 nt, Homo sapiens
gguaggaacugacauauau

SEQ ID NO: 1443710 - RNA, 19 nt, Homo sapiens
gagaugaaauuacaacuug

SEQ ID NO: 1443711 - RNA, 19 nt, Homo sapiens
gagcuucaguggagaauaa

SEQ ID NO: 1443712 - RNA, 19 nt, Homo sapiens
gaagaaacgaagaaacuua

SEQ ID NO: 1443713 - RNA, 19 nt, Homo sapiens
cgaaauggcugcagaaauc

SEQ ID NO: 1443714 - RNA, 19 nt, Homo sapiens
cagaagaaauaucacguua

SEQ ID NO: 1443715 - RNA, 19 nt, Homo sapiens
gcacagagguaggaacuga

SEQ ID NO: 1443716 - RNA, 19 nt, Homo sapiens
gcugaaauauuaccagaaa

SEQ ID NO: 1443717 - RNA, 19 nt, Homo sapiens
gguaaagccugcaaaguau

SEQ ID NO: 1443718 - RNA, 19 nt, Homo sapiens
gaaguucaauugagagaga

SEQ ID NO: 1443719 - RNA, 19 nt, Homo sapiens
uaaaugggcagcugaaaua

SEQ ID NO: 1443720 - RNA, 19 nt, Homo sapiens
ccagagagcuacaagcaaa

SEQ ID NO: 1443721 - RNA, 19 nt, Homo sapiens
uaacuaaugugacugaaga

SEQ ID NO: 1443722 - RNA, 19 nt, Homo sapiens
gguaucaaauggaaaguuu

SEQ ID NO: 1443723 - RNA, 19 nt, Homo sapiens
cgaagaaacuuacugaaag

SEQ ID NO: 1443724 - RNA, 19 nt, Homo sapiens
gaaauagcaugcaacucuu

SEQ ID NO: 1443725 - RNA, 19 nt, Homo sapiens
gaaguguauugaaauggua

SEQ ID NO: 1443726 - RNA, 19 nt, Homo sapiens
gaaauuccauuguugaacu

SEQ ID NO: 1443727 - RNA, 19 nt, Homo sapiens
gaacgagucauuaaggaaa

SEQ ID NO: 1443728 - RNA, 19 nt, Homo sapiens
ucagaaaccuucaagaaca

SEQ ID NO: 1443729 - RNA, 19 nt, Homo sapiens
gacuagaaguguauugaaa

SEQ ID NO: 1443730 - RNA, 19 nt, Homo sapiens
ggaagacaguaauagaaau

SEQ ID NO: 1443731 - RNA, 19 nt, Homo sapiens
aaagguagcugagaaugaa

SEQ ID NO: 1443732 - RNA, 19 nt, Homo sapiens
ugacauauaugcagaugau

SEQ ID NO: 1443733 - RNA, 19 nt, Homo sapiens
ggaaagaagaaacgaagaa

SEQ ID NO: 1443734 - RNA, 19 nt, Homo sapiens
guaaagaucaguacaaugg

SEQ ID NO: 1443735 - RNA, 19 nt, Homo sapiens
caaauugaacgagucauua

SEQ ID NO: 1443736 - RNA, 19 nt, Homo sapiens
gaacaaagugugauaaucg

SEQ ID NO: 1443737 - RNA, 19 nt, Homo sapiens
gaacaaaggcuaaaacuuc

SEQ ID NO: 1443738 - RNA, 19 nt, Homo sapiens
cccaagagcugcuuucuca

SEQ ID NO: 1443739 - RNA, 19 nt, Homo sapiens
gaaagaagaaacgaagaaa

SEQ ID NO: 1443740 - RNA, 19 nt, Homo sapiens
gaagaaauaucacguuacc

SEQ ID NO: 1443741 - RNA, 19 nt, Homo sapiens
gaagaaaugcaccaaagau

SEQ ID NO: 1443742 - RNA, 19 nt, Homo sapiens
ggaaaugagugugauuaca

SEQ ID NO: 1443743 - RNA, 19 nt, Homo sapiens
gcaguuacagucuaguaua

SEQ ID NO: 1443744 - RNA, 19 nt, Homo sapiens
augggcagcugaaauauua

SEQ ID NO: 1443745 - RNA, 19 nt, Homo sapiens
gaagagaggaagcaucaga

SEQ ID NO: 1443746 - RNA, 19 nt, Homo sapiens
gcagcuagccaaucaagaa

SEQ ID NO: 1443747 - RNA, 19 nt, Homo sapiens
gccaauagguggaaagaag

SEQ ID NO: 1443748 - RNA, 19 nt, Homo sapiens
gaaaugauucagaaacuuc

SEQ ID NO: 1443749 - RNA, 19 nt, Homo sapiens
caaauggagugugcugaaa

SEQ ID NO: 1443750 - RNA, 19 nt, Homo sapiens
ggaaagcaguuggacuaga

SEQ ID NO: 1443751 - RNA, 19 nt, Homo sapiens
aaaggaacguggauuugaa

SEQ ID NO: 1443752 - RNA, 19 nt, Homo sapiens
gaggaaaugagugugauua

SEQ ID NO: 1443753 - RNA, 19 nt, Homo sapiens
agaaggagacgacacauuu

SEQ ID NO: 1443754 - RNA, 19 nt, Homo sapiens
gaaagugcagaaauuagaa

SEQ ID NO: 1443755 - RNA, 19 nt, Homo sapiens
caacagaaggcagccaaua

SEQ ID NO: 1443756 - RNA, 19 nt, Homo sapiens
caagcaaagugcaaugaau

SEQ ID NO: 1443757 - RNA, 19 nt, Homo sapiens
aaagauuccugguuucaga

SEQ ID NO: 1443758 - RNA, 19 nt, Homo sapiens
uguacaagaugcuaccaua

SEQ ID NO: 1443759 - RNA, 19 nt, Homo sapiens
caguuacagucuaguauaa

SEQ ID NO: 1443760 - RNA, 19 nt, Homo sapiens
gaagccaaccaauuaagaa

SEQ ID NO: 1443761 - RNA, 19 nt, Homo sapiens
caagaagccaaccaauuaa

SEQ ID NO: 1443762 - RNA, 19 nt, Homo sapiens
gaagaguuaacuaauguga

SEQ ID NO: 1443763 - RNA, 19 nt, Homo sapiens
gaauaaaccagcugagaag

SEQ ID NO: 1443764 - RNA, 19 nt, Homo sapiens
guuaaggcuuguguuauuu

SEQ ID NO: 1443765 - RNA, 19 nt, Homo sapiens
ucaguacaauggaacauga

SEQ ID NO: 1443766 - RNA, 19 nt, Homo sapiens
ggaagaaaugcaccaaaga

SEQ ID NO: 1443767 - RNA, 19 nt, Homo sapiens
ggaagugacuaaccaacag

SEQ ID NO: 1443768 - RNA, 19 nt, Homo sapiens
acaagaugcuaccauaaga

SEQ ID NO: 1443769 - RNA, 19 nt, Homo sapiens
guggaagaguuaacuaaug

SEQ ID NO: 1443770 - RNA, 19 nt, Homo sapiens
ggagacgacacauuugaaa

SEQ ID NO: 1443771 - RNA, 19 nt, Homo sapiens
gagauggaagacaguaaua

SEQ ID NO: 1443772 - RNA, 19 nt, Homo sapiens
ugguaaagccugcaaagua

SEQ ID NO: 1443773 - RNA, 19 nt, Homo sapiens
guacaagaugcuaccauaa

SEQ ID NO: 1443774 - RNA, 19 nt, Homo sapiens
aagcauuguuguucuguuu

SEQ ID NO: 1443775 - RNA, 19 nt, Homo sapiens
aaagaucaguacaauggaa

SEQ ID NO: 1443776 - RNA, 19 nt, Homo sapiens
ugacuccucagaagaaaua

SEQ ID NO: 1443777 - RNA, 19 nt, Homo sapiens
gaaaugagugugauuacag

SEQ ID NO: 1443778 - RNA, 19 nt, Homo sapiens
gcagaggaaaugaguguga

SEQ ID NO: 1443779 - RNA, 19 nt, Homo sapiens
ggagaaggauguggugucu

SEQ ID NO: 1443780 - RNA, 19 nt, Homo sapiens
uggaagaguuaacuaaugu

SEQ ID NO: 1443781 - RNA, 19 nt, Homo sapiens
cagaaaccuucaagaacaa

SEQ ID NO: 1443782 - RNA, 19 nt, Homo sapiens
uagcuccucuuguuacuga

SEQ ID NO: 1443783 - RNA, 19 nt, Homo sapiens
gaaggagacgacacauuug

SEQ ID NO: 1443784 - RNA, 19 nt, Homo sapiens
gagaauaaaccagcugaga

SEQ ID NO: 1443785 - RNA, 19 nt, Homo sapiens
cuagaaguguauugaaaug

SEQ ID NO: 1443786 - RNA, 19 nt, Homo sapiens
ggacuagaaguguauugaa

SEQ ID NO: 1443787 - RNA, 19 nt, Homo sapiens
uaaaggaacguggauuuga

SEQ ID NO: 1443788 - RNA, 19 nt, Homo sapiens
gaacuuucagcccuucaaa

SEQ ID NO: 1443789 - RNA, 19 nt, Homo sapiens
gaagguaaagguggugaaa

SEQ ID NO: 1443790 - RNA, 19 nt, Homo sapiens
gauaugaggcuauuguaag

SEQ ID NO: 1443791 - RNA, 19 nt, Homo sapiens
ugagagauaugaggcuauu

SEQ ID NO: 1443792 - RNA, 19 nt, Homo sapiens
caacugaccaaacaacuuc

SEQ ID NO: 1443793 - RNA, 19 nt, Homo sapiens
gaaaaugucaucaaggaaa

SEQ ID NO: 1443794 - RNA, 19 nt, Homo sapiens
aguuaaggcuuguguuauu

SEQ ID NO: 1443795 - RNA, 19 nt, Homo sapiens
aaagcagccucccugauga

SEQ ID NO: 1443796 - RNA, 19 nt, Homo sapiens
aaacgaagaaacuuacuga

SEQ ID NO: 1443797 - RNA, 19 nt, Homo sapiens
gauggaagacaguaauaga

SEQ ID NO: 1443798 - RNA, 19 nt, Homo sapiens
aauaucacguuaccaagaa

SEQ ID NO: 1443799 - RNA, 19 nt, Homo sapiens
gacaguuucucgguuugua

SEQ ID NO: 1443800 - RNA, 19 nt, Homo sapiens
agaagaagacauagagaaa

SEQ ID NO: 1443801 - RNA, 19 nt, Homo sapiens
uuacagcaguuacagucua

SEQ ID NO: 1443802 - RNA, 19 nt, Homo sapiens
guaaagccugcaaaguaua

SEQ ID NO: 1443803 - RNA, 19 nt, Homo sapiens
gugcagaaauuagaaucaa

SEQ ID NO: 1443804 - RNA, 19 nt, Homo sapiens
cauagcagcuuuauucaua

SEQ ID NO: 1443805 - RNA, 19 nt, Homo sapiens
gaaacaagaacuuccuuua

SEQ ID NO: 1443806 - RNA, 19 nt, Homo sapiens
ucaaugaacugugggauua

SEQ ID NO: 1443807 - RNA, 19 nt, Homo sapiens
ggacauuagugcuccauuu

SEQ ID NO: 1443808 - RNA, 19 nt, Homo sapiens
gaagaaauguguggaaaca

SEQ ID NO: 1443809 - RNA, 19 nt, Homo sapiens
caacauuccucaugcugua

SEQ ID NO: 1443810 - RNA, 19 nt, Homo sapiens
gcaacaaccuguaugaauc

SEQ ID NO: 1443811 - RNA, 19 nt, Homo sapiens
guggaauacuguucauuua

SEQ ID NO: 1443812 - RNA, 19 nt, Homo sapiens
gcucauagcagcuuuauuc

SEQ ID NO: 1443813 - RNA, 19 nt, Homo sapiens
ggaaacaaccggaaucaga

SEQ ID NO: 1443814 - RNA, 19 nt, Homo sapiens
ccagaacaguggcugcuua

SEQ ID NO: 1443815 - RNA, 19 nt, Homo sapiens
gaaguuaugaagcucuuua

SEQ ID NO: 1443816 - RNA, 19 nt, Homo sapiens
gaugauagauaccagaaca

SEQ ID NO: 1443817 - RNA, 19 nt, Homo sapiens
uaaaugcccucacuaucuu

SEQ ID NO: 1443818 - RNA, 19 nt, Homo sapiens
gaacacacuugggaugguu

SEQ ID NO: 1443819 - RNA, 19 nt, Homo sapiens
gauuucaucuguaaaguca

SEQ ID NO: 1443820 - RNA, 19 nt, Homo sapiens
caauauagucaguggaaua

SEQ ID NO: 1443821 - RNA, 19 nt, Homo sapiens
gcauacauuucaacaacaa

SEQ ID NO: 1443822 - RNA, 19 nt, Homo sapiens
aaacgugaguagagaauga

SEQ ID NO: 1443823 - RNA, 19 nt, Homo sapiens
ggauagacaaacuacaaua

SEQ ID NO: 1443824 - RNA, 19 nt, Homo sapiens
gaagaagaaauguguggaa

SEQ ID NO: 1443825 - RNA, 19 nt, Homo sapiens
ggagugaugauggacauua

SEQ ID NO: 1443826 - RNA, 19 nt, Homo sapiens
gaaauuuccauccauagga

SEQ ID NO: 1443827 - RNA, 19 nt, Homo sapiens
gugaguagagaaugaaaua

SEQ ID NO: 1443828 - RNA, 19 nt, Homo sapiens
ggaguaauagauaaccaua

SEQ ID NO: 1443829 - RNA, 19 nt, Homo sapiens
ggagaagaguggaaacaac

SEQ ID NO: 1443830 - RNA, 19 nt, Homo sapiens
aacaagaacuuccuuuauc

SEQ ID NO: 1443831 - RNA, 19 nt, Homo sapiens
gaacaguggcugcuuagag

SEQ ID NO: 1443832 - RNA, 19 nt, Homo sapiens
gaaaauggauagacaaacu

SEQ ID NO: 1443833 - RNA, 19 nt, Homo sapiens
uauaguaucuguggcaaau

SEQ ID NO: 1443834 - RNA, 19 nt, Homo sapiens
gaaucagaccuguggcuaa

SEQ ID NO: 1443835 - RNA, 19 nt, Homo sapiens
gagaaugaaauacacaguu

SEQ ID NO: 1443836 - RNA, 19 nt, Homo sapiens
gagcaauauuuagaaguug

SEQ ID NO: 1443837 - RNA, 19 nt, Homo sapiens
gaagcaugagcccguauuu

SEQ ID NO: 1443838 - RNA, 19 nt, Homo sapiens
uaguaucuguggcaaauug

SEQ ID NO: 1443839 - RNA, 19 nt, Homo sapiens
gcaaaacaaaccaaacaua

SEQ ID NO: 1443840 - RNA, 19 nt, Homo sapiens
caaccuguaugaaucucaa

SEQ ID NO: 1443841 - RNA, 19 nt, Homo sapiens
uaaacgaaguuaugaagcu

SEQ ID NO: 1443842 - RNA, 19 nt, Homo sapiens
gaaauguguggaaacaaga

SEQ ID NO: 1443843 - RNA, 19 nt, Homo sapiens
agaaauguguggaaacaag

SEQ ID NO: 1443844 - RNA, 19 nt, Homo sapiens
aagaagaaauguguggaaa

SEQ ID NO: 1443845 - RNA, 19 nt, Homo sapiens
agugaaauuuccauccaua

SEQ ID NO: 1443846 - RNA, 19 nt, Homo sapiens
gcacacaguacaguuauuc

SEQ ID NO: 1443847 - RNA, 19 nt, Homo sapiens
uguggcaaauuguauauga

SEQ ID NO: 1443848 - RNA, 19 nt, Homo sapiens
acaguacaguuauucuuga

SEQ ID NO: 1443849 - RNA, 19 nt, Homo sapiens
ccagcacacaguacaguua

SEQ ID NO: 1443850 - RNA, 19 nt, Homo sapiens
caccaaaugugacaaaauu

SEQ ID NO: 1443851 - RNA, 19 nt, Homo sapiens
gcacuaccuugugauucaa

SEQ ID NO: 1443852 - RNA, 19 nt, Homo sapiens
ugauuuccauugccuagaa

SEQ ID NO: 1443853 - RNA, 19 nt, Homo sapiens
caugcuguauguuuagauu

SEQ ID NO: 1443854 - RNA, 19 nt, Homo sapiens
gaacugcagcaaggacaaa

SEQ ID NO: 1443855 - RNA, 19 nt, Homo sapiens
gaguagagaaugaaauaca

SEQ ID NO: 1443856 - RNA, 19 nt, Homo sapiens
ucagaccuguggcuaauag

SEQ ID NO: 1443857 - RNA, 19 nt, Homo sapiens
ccauuucauuccuagauau

SEQ ID NO: 1443858 - RNA, 19 nt, Homo sapiens
ucacaauguuucucagagu

SEQ ID NO: 1443859 - RNA, 19 nt, Homo sapiens
ucuguaaagucacaauguu

SEQ ID NO: 1443860 - RNA, 19 nt, Homo sapiens
ggaguuauuuuccaccaaa

SEQ ID NO: 1443861 - RNA, 19 nt, Homo sapiens
gaggagugaugauggacau

SEQ ID NO: 1443862 - RNA, 19 nt, Homo sapiens
uggaggaguucuagguuug

SEQ ID NO: 1443863 - RNA, 19 nt, Homo sapiens
gcaaacgugaguagagaau

SEQ ID NO: 1443864 - RNA, 19 nt, Homo sapiens
aaucagaccuguggcuaau

SEQ ID NO: 1443865 - RNA, 19 nt, Homo sapiens
agaggacugucuugcacua

SEQ ID NO: 1443866 - RNA, 19 nt, Homo sapiens
gagugaugauggacauuag

SEQ ID NO: 1443867 - RNA, 19 nt, Homo sapiens
gauuuggucaucucaagaa

SEQ ID NO: 1443868 - RNA, 19 nt, Homo sapiens
ggaguucuagguuuggauu

SEQ ID NO: 1443869 - RNA, 19 nt, Homo sapiens
gugauucaaccauuucauu

SEQ ID NO: 1443870 - RNA, 19 nt, Homo sapiens
acaagaacuuccuuuaucg

SEQ ID NO: 1443871 - RNA, 19 nt, Homo sapiens
acugugggauuaugaaguu

SEQ ID NO: 1443872 - RNA, 19 nt, Homo sapiens
caugagcccguauuuauca

SEQ ID NO: 1443873 - RNA, 19 nt, Homo sapiens
uuaaaugcccucacuaucu

SEQ ID NO: 1443874 - RNA, 19 nt, Homo sapiens
ggacugcugauacaugcaa

SEQ ID NO: 1443875 - RNA, 19 nt, Homo sapiens
uuuaagaugucaugcauac

SEQ ID NO: 1443876 - RNA, 19 nt, Homo sapiens
uagauaaccauaccgauca

SEQ ID NO: 1443877 - RNA, 19 nt, Homo sapiens
acagaggagugaugaugga

SEQ ID NO: 1443878 - RNA, 19 nt, Homo sapiens
gcaugagcccguauuuauc

SEQ ID NO: 1443879 - RNA, 19 nt, Homo sapiens
ucuggaugaugguuaugua

SEQ ID NO: 1443880 - RNA, 19 nt, Homo sapiens
caacaaccuguaugaaucu

SEQ ID NO: 1443881 - RNA, 19 nt, Homo sapiens
acacacugcuuggagaaga

SEQ ID NO: 1443882 - RNA, 19 nt, Homo sapiens
ccacggacagcauuuagug

SEQ ID NO: 1443883 - RNA, 19 nt, Homo sapiens
caguacaguuauucuugaa

SEQ ID NO: 1443884 - RNA, 19 nt, Homo sapiens
ucauagaagucacugaaaa

SEQ ID NO: 1443885 - RNA, 19 nt, Homo sapiens
gcuaauagagaaaugugau

SEQ ID NO: 1443886 - RNA, 19 nt, Homo sapiens
ggaugaugguuauguagcu

SEQ ID NO: 1443887 - RNA, 19 nt, Homo sapiens
cuggaggaguucuagguuu

SEQ ID NO: 1443888 - RNA, 19 nt, Homo sapiens
ugacagaggagugaugaug

SEQ ID NO: 1443889 - RNA, 19 nt, Homo sapiens
aagcaugagcccguauuua

SEQ ID NO: 1443890 - RNA, 19 nt, Homo sapiens
aacaguggcugcuuagagu

SEQ ID NO: 1443891 - RNA, 19 nt, Homo sapiens
ugcacuaccuugugauuca

SEQ ID NO: 1443892 - RNA, 19 nt, Homo sapiens
uaacacacugcuuggagaa

SEQ ID NO: 1443893 - RNA, 19 nt, Homo sapiens
cugcauauauuugucaaca

SEQ ID NO: 1443894 - RNA, 19 nt, Homo sapiens
ugaucuggaugaugguuau

SEQ ID NO: 1443895 - RNA, 19 nt, Homo sapiens
guuuaaaugcccucacuau

SEQ ID NO: 1443896 - RNA, 19 nt, Homo sapiens
cacaguacaguuauucuug

SEQ ID NO: 1443897 - RNA, 19 nt, Homo sapiens
gaagcucuuuacccuguac

SEQ ID NO: 1443898 - RNA, 19 nt, Homo sapiens
gaacugugggauuaugaag

SEQ ID NO: 1443899 - RNA, 19 nt, Homo sapiens
acuaagccuuucuggacua

SEQ ID NO: 1443900 - RNA, 19 nt, Homo sapiens
gaaaaggggccugaggaaa

SEQ ID NO: 1443901 - RNA, 19 nt, Homo sapiens
ccaaacauaacauacuauc

SEQ ID NO: 1443902 - RNA, 19 nt, Homo sapiens
ugucaugcauacauuucaa

SEQ ID NO: 1443903 - RNA, 19 nt, Homo sapiens
agcaugagcccguauuuau

SEQ ID NO: 1443904 - RNA, 19 nt, Homo sapiens
gauggaagcuuucugcaaa

SEQ ID NO: 1443905 - RNA, 19 nt, Homo sapiens
gcacuaauuuccaaacuug

SEQ ID NO: 1443906 - RNA, 19 nt, Homo sapiens
gaaagaaugguauuuggaa

SEQ ID NO: 1443907 - RNA, 19 nt, Homo sapiens
ggaggaagcccacagagaa

SEQ ID NO: 1443908 - RNA, 19 nt, Homo sapiens
gaccacagcugcaaugaca

SEQ ID NO: 1443909 - RNA, 19 nt, Homo sapiens
gaauuuaaccugcccauca

SEQ ID NO: 1443910 - RNA, 19 nt, Homo sapiens
ccacugguauccaugaauu

SEQ ID NO: 1443911 - RNA, 19 nt, Homo sapiens
gaggguugguguaggauaa

SEQ ID NO: 1443912 - RNA, 19 nt, Homo sapiens
gaggacaacuaacauuuua

SEQ ID NO: 1443913 - RNA, 19 nt, Homo sapiens
uguggcagcuaaaugauua

SEQ ID NO: 1443914 - RNA, 19 nt, Homo sapiens
guaauauuguggcagcuaa

SEQ ID NO: 1443915 - RNA, 19 nt, Homo sapiens
gaccaucgcuuucaugcau

SEQ ID NO: 1443916 - RNA, 19 nt, Homo sapiens
ucauuucucuccucucuaa

SEQ ID NO: 1443917 - RNA, 19 nt, Homo sapiens
ggccagaacugugucauug

SEQ ID NO: 1443918 - RNA, 19 nt, Homo sapiens
gauccuuacucauauucua

SEQ ID NO: 1443919 - RNA, 19 nt, Homo sapiens
gaauaguuccugugacuga

SEQ ID NO: 1443920 - RNA, 19 nt, Homo sapiens
caaaauggcuucagaucuu

SEQ ID NO: 1443921 - RNA, 19 nt, Homo sapiens
gcagcuaaaugauuauucu

SEQ ID NO: 1443922 - RNA, 19 nt, Homo sapiens
ugacagggcugaccucucu

SEQ ID NO: 1443923 - RNA, 19 nt, Homo sapiens
gauagcacgguauacuuua

SEQ ID NO: 1443924 - RNA, 19 nt, Homo sapiens
ggaauauccugggagaaga

SEQ ID NO: 1443925 - RNA, 19 nt, Homo sapiens
caaauccacuuccuuuuaa

SEQ ID NO: 1443926 - RNA, 19 nt, Homo sapiens
gguuagugcuugcggauug

SEQ ID NO: 1443927 - RNA, 19 nt, Homo sapiens
guucaaauccacuuccuuu

SEQ ID NO: 1443928 - RNA, 19 nt, Homo sapiens
uauucuagcuugccauuga

SEQ ID NO: 1443929 - RNA, 19 nt, Homo sapiens
uaucugcaguguccaauau

SEQ ID NO: 1443930 - RNA, 19 nt, Homo sapiens
cagccuacauccuagcuaa

SEQ ID NO: 1443931 - RNA, 19 nt, Homo sapiens
gaaggcaugucagguguuc

SEQ ID NO: 1443932 - RNA, 19 nt, Homo sapiens
gaucuuaucaggacaaucu

SEQ ID NO: 1443933 - RNA, 19 nt, Homo sapiens
gguguaggauaaagaaugu

SEQ ID NO: 1443934 - RNA, 19 nt, Homo sapiens
cauccuagcuaagcaaaga

SEQ ID NO: 1443935 - RNA, 19 nt, Homo sapiens
gggaaucuacgcaaagaaa

SEQ ID NO: 1443936 - RNA, 19 nt, Homo sapiens
gaucuugggaggacaacua

SEQ ID NO: 1443937 - RNA, 19 nt, Homo sapiens
cagcagagauuauuuuguu

SEQ ID NO: 1443938 - RNA, 19 nt, Homo sapiens
caccaccagucuaggaaua

SEQ ID NO: 1443939 - RNA, 19 nt, Homo sapiens
ucccucaucuguaucauuu

SEQ ID NO: 1443940 - RNA, 19 nt, Homo sapiens
gggaggacaacuaacauuu

SEQ ID NO: 1443941 - RNA, 19 nt, Homo sapiens
agucuggguuuguguauuu

SEQ ID NO: 1443942 - RNA, 19 nt, Homo sapiens
ccggugauccuuacucaua

SEQ ID NO: 1443943 - RNA, 19 nt, Homo sapiens
acauauuccuguauaguga

SEQ ID NO: 1443944 - RNA, 19 nt, Homo sapiens
ugucagguguucucacaaa

SEQ ID NO: 1443945 - RNA, 19 nt, Homo sapiens
gguggaaacuuggaacuag

SEQ ID NO: 1443946 - RNA, 19 nt, Homo sapiens
aagaaacacuucccacauc

SEQ ID NO: 1443947 - RNA, 19 nt, Homo sapiens
uugcacauauuccuguaua

SEQ ID NO: 1443948 - RNA, 19 nt, Homo sapiens
aaauucagauagccaaaug

SEQ ID NO: 1443949 - RNA, 19 nt, Homo sapiens
gaaacacuucccacaucua

SEQ ID NO: 1443950 - RNA, 19 nt, Homo sapiens
gcaagauugucugagaaau

SEQ ID NO: 1443951 - RNA, 19 nt, Homo sapiens
gaggaagcccacagagaaa

SEQ ID NO: 1443952 - RNA, 19 nt, Homo sapiens
gaaggaggaagcccacaga

SEQ ID NO: 1443953 - RNA, 19 nt, Homo sapiens
gcugcucccucaucuguau

SEQ ID NO: 1443954 - RNA, 19 nt, Homo sapiens
cagcugcaaugacaguuug

SEQ ID NO: 1443955 - RNA, 19 nt, Homo sapiens
gauauauaacugccuuuga

SEQ ID NO: 1443956 - RNA, 19 nt, Homo sapiens
ggugauccuuacucauauu

SEQ ID NO: 1443957 - RNA, 19 nt, Homo sapiens
caagauugucugagaaaug

SEQ ID NO: 1443958 - RNA, 19 nt, Homo sapiens
gacaagagacuauugaaaa

SEQ ID NO: 1443959 - RNA, 19 nt, Homo sapiens
gaauauccugggagaagaa

SEQ ID NO: 1443960 - RNA, 19 nt, Homo sapiens
aaucuugguuguugcacua

SEQ ID NO: 1443961 - RNA, 19 nt, Homo sapiens
caaaauauuagguggcuua

SEQ ID NO: 1443962 - RNA, 19 nt, Homo sapiens
gcacauauuccuguauagu

SEQ ID NO: 1443963 - RNA, 19 nt, Homo sapiens
aagauugucugagaaaugu

SEQ ID NO: 1443964 - RNA, 19 nt, Homo sapiens
ugaaauguggcuaguguga

SEQ ID NO: 1443965 - RNA, 19 nt, Homo sapiens
aacgggagauggaagcuuu

SEQ ID NO: 1443966 - RNA, 19 nt, Homo sapiens
gaagaauugccucucaaag

SEQ ID NO: 1443967 - RNA, 19 nt, Homo sapiens
uggcacagcuguagaugca

SEQ ID NO: 1443968 - RNA, 19 nt, Homo sapiens
aagaaagaaugguauuugg

SEQ ID NO: 1443969 - RNA, 19 nt, Homo sapiens
auaagcagccuacauccua

SEQ ID NO: 1443970 - RNA, 19 nt, Homo sapiens
uaucauuucucuccucucu

SEQ ID NO: 1443971 - RNA, 19 nt, Homo sapiens
guagcuggauauauaacug

SEQ ID NO: 1443972 - RNA, 19 nt, Homo sapiens
ucaaauccacuuccuuuua

SEQ ID NO: 1443973 - RNA, 19 nt, Homo sapiens
gggcaugccaguucaaauc

SEQ ID NO: 1443974 - RNA, 19 nt, Homo sapiens
uggaugaccuccugggaau

SEQ ID NO: 1443975 - RNA, 19 nt, Homo sapiens
caugucagguguucucaca

SEQ ID NO: 1443976 - RNA, 19 nt, Homo sapiens
agacaagagacuauugaaa

SEQ ID NO: 1443977 - RNA, 19 nt, Homo sapiens
uuuguucucuugugcaauu

SEQ ID NO: 1443978 - RNA, 19 nt, Homo sapiens
ugacucagcagagauuauu

SEQ ID NO: 1443979 - RNA, 19 nt, Homo sapiens
ggucuucacuauucuagcu

SEQ ID NO: 1443980 - RNA, 19 nt, Homo sapiens
aggcacauguggcuaguga

SEQ ID NO: 1443981 - RNA, 19 nt, Homo sapiens
agaauugccucucaaagcu

SEQ ID NO: 1443982 - RNA, 19 nt, Homo sapiens
caaggugccaggauuuguu

SEQ ID NO: 1443983 - RNA, 19 nt, Homo sapiens
uauuauguguuccuaguca

SEQ ID NO: 1443984 - RNA, 19 nt, Homo sapiens
cuugaaauguggcuagugu

SEQ ID NO: 1443985 - RNA, 19 nt, Homo sapiens
gcuaagcaaagaagaaaca

SEQ ID NO: 1443986 - RNA, 19 nt, Homo sapiens
uuucucuccucucuaauuu

SEQ ID NO: 1443987 - RNA, 19 nt, Homo sapiens
guggaggguugguguagga

SEQ ID NO: 1443988 - RNA, 19 nt, Homo sapiens
ugacuauuauguguuccua

SEQ ID NO: 1443989 - RNA, 19 nt, Homo sapiens
agauagcacgguauacuuu

SEQ ID NO: 1443990 - RNA, 19 nt, Homo sapiens
gcagagugaaggcauguca

SEQ ID NO: 1443991 - RNA, 19 nt, Homo sapiens
gcccaucauucuuccuaga

SEQ ID NO: 1443992 - RNA, 19 nt, Homo sapiens
ucugcaagauugucugaga

SEQ ID NO: 1443993 - RNA, 19 nt, Homo sapiens
gcaguguccaauaugguaa

SEQ ID NO: 1443994 - RNA, 19 nt, Homo sapiens
ggauauauaacugccuuug

SEQ ID NO: 1443995 - RNA, 19 nt, Homo sapiens
aagcaaagaagaaacacuu

SEQ ID NO: 1443996 - RNA, 19 nt, Homo sapiens
cuaccuuacuccuuucugu

SEQ ID NO: 1443997 - RNA, 19 nt, Homo sapiens
uauuguggcagcuaaauga

SEQ ID NO: 1443998 - RNA, 19 nt, Homo sapiens
caucauucuuccuagacaa

SEQ ID NO: 1443999 - RNA, 19 nt, Homo sapiens
agaaacacuucccacaucu

SEQ ID NO: 1444000 - RNA, 19 nt, Homo sapiens
uagcuaagcaaagaagaaa

SEQ ID NO: 1444001 - RNA, 19 nt, Homo sapiens
gcacauguggcuagugaac

SEQ ID NO: 1444002 - RNA, 19 nt, Homo sapiens
ggaggguugguguaggaua

SEQ ID NO: 1444003 - RNA, 19 nt, Homo sapiens
uuuaugcccuggcuacaga

SEQ ID NO: 1444004 - RNA, 19 nt, Homo sapiens
caacagaccucauauuagu

SEQ ID NO: 1444005 - RNA, 19 nt, Homo sapiens
cagaauaccugaaauauag

SEQ ID NO: 1444006 - RNA, 19 nt, Homo sapiens
gaagcuaaauguaaguuga

SEQ ID NO: 1444007 - RNA, 19 nt, Homo sapiens
ugaaauaggcaauccauua

SEQ ID NO: 1444008 - RNA, 19 nt, Homo sapiens
ugaaagagcuggacaacau

SEQ ID NO: 1444009 - RNA, 19 nt, Homo sapiens
gcacaggugaauacaauua

SEQ ID NO: 1444010 - RNA, 19 nt, Homo sapiens
gcaauccauuaucacauua

SEQ ID NO: 1444011 - RNA, 19 nt, Homo sapiens
guacauaucaugcagcuaa

SEQ ID NO: 1444012 - RNA, 19 nt, Homo sapiens
gaugggaauugcagugaua

SEQ ID NO: 1444013 - RNA, 19 nt, Homo sapiens
gaguucagcuugaccuuaa

SEQ ID NO: 1444014 - RNA, 19 nt, Homo sapiens
auacaaacguggagagaua

SEQ ID NO: 1444015 - RNA, 19 nt, Homo sapiens
gaaauaggcaauccauuau

SEQ ID NO: 1444016 - RNA, 19 nt, Homo sapiens
gaaccugaaccacgaauuu

SEQ ID NO: 1444017 - RNA, 19 nt, Homo sapiens
gaaaauggcuagcaacaau

SEQ ID NO: 1444018 - RNA, 19 nt, Homo sapiens
acaaggagauguuucuuug

SEQ ID NO: 1444019 - RNA, 19 nt, Homo sapiens
gcuuagaaaucgcuauaaa

SEQ ID NO: 1444020 - RNA, 19 nt, Homo sapiens
ucacagaucguuaaagaaa

SEQ ID NO: 1444021 - RNA, 19 nt, Homo sapiens
ugugaaaucucccugcaua

SEQ ID NO: 1444022 - RNA, 19 nt, Homo sapiens
gucaacagaccucauauua

SEQ ID NO: 1444023 - RNA, 19 nt, Homo sapiens
gaaccaacuucuaaucuac

SEQ ID NO: 1444024 - RNA, 19 nt, Homo sapiens
ggaagaguauugcaugaca

SEQ ID NO: 1444025 - RNA, 19 nt, Homo sapiens
agaaaucgcuauaaagcaa

SEQ ID NO: 1444026 - RNA, 19 nt, Homo sapiens
ggcaauccauuaucacauu

SEQ ID NO: 1444027 - RNA, 19 nt, Homo sapiens
gaagggagacauauucaau

SEQ ID NO: 1444028 - RNA, 19 nt, Homo sapiens
uaagccagauggaagagua

SEQ ID NO: 1444029 - RNA, 19 nt, Homo sapiens
uaucugaacuagcauaugu

SEQ ID NO: 1444030 - RNA, 19 nt, Homo sapiens
ucaagaagcuaaauguaag

SEQ ID NO: 1444031 - RNA, 19 nt, Homo sapiens
uuguaaggcugcaauguua

SEQ ID NO: 1444032 - RNA, 19 nt, Homo sapiens
gaaauccuacuuacaacaa

SEQ ID NO: 1444033 - RNA, 19 nt, Homo sapiens
uaaaggaucagcccagauu

SEQ ID NO: 1444034 - RNA, 19 nt, Homo sapiens
caucagcaguauacuuauu

SEQ ID NO: 1444035 - RNA, 19 nt, Homo sapiens
agagauaaauccuguguca

SEQ ID NO: 1444036 - RNA, 19 nt, Homo sapiens
gaacuagcauauguuucaa

SEQ ID NO: 1444037 - RNA, 19 nt, Homo sapiens
gcacaaaugcagcgaguuc

SEQ ID NO: 1444038 - RNA, 19 nt, Homo sapiens
cgacaaagacgauaacuac

SEQ ID NO: 1444039 - RNA, 19 nt, Homo sapiens
gcaauguuaagucgguuua

SEQ ID NO: 1444040 - RNA, 19 nt, Homo sapiens
uacaucagcaguauacuua

SEQ ID NO: 1444041 - RNA, 19 nt, Homo sapiens
gacaacuucugcucuucua

SEQ ID NO: 1444042 - RNA, 19 nt, Homo sapiens
gaaauauagcaguucauug

SEQ ID NO: 1444043 - RNA, 19 nt, Homo sapiens
uaaggaaacugugacaaca

SEQ ID NO: 1444044 - RNA, 19 nt, Homo sapiens
guugaaauccuacuuacaa

SEQ ID NO: 1444045 - RNA, 19 nt, Homo sapiens
ucuaaucuacucacucuua

SEQ ID NO: 1444046 - RNA, 19 nt, Homo sapiens
uuucacagaucguuaaaga

SEQ ID NO: 1444047 - RNA, 19 nt, Homo sapiens
gcaaguaacggguaauuuu

SEQ ID NO: 1444048 - RNA, 19 nt, Homo sapiens
gcauagagcaauuuaacau

SEQ ID NO: 1444049 - RNA, 19 nt, Homo sapiens
gaaaguuccccauuuaaaa

SEQ ID NO: 1444050 - RNA, 19 nt, Homo sapiens
cuaaucuacucacucuuaa

SEQ ID NO: 1444051 - RNA, 19 nt, Homo sapiens
caucagguccuccuccuuu

SEQ ID NO: 1444052 - RNA, 19 nt, Homo sapiens
gggaagaucacugaaaguu

SEQ ID NO: 1444053 - RNA, 19 nt, Homo sapiens
acagaucguuaaagaaaga

SEQ ID NO: 1444054 - RNA, 19 nt, Homo sapiens
uaaccugcuugccaaagaa

SEQ ID NO: 1444055 - RNA, 19 nt, Homo sapiens
gcaagucggcuuuguaagg

SEQ ID NO: 1444056 - RNA, 19 nt, Homo sapiens
guccucaagugacaaauug

SEQ ID NO: 1444057 - RNA, 19 nt, Homo sapiens
cuaaagaugguguuaauag

SEQ ID NO: 1444058 - RNA, 19 nt, Homo sapiens
ccaguugccuaaaggauca

SEQ ID NO: 1444059 - RNA, 19 nt, Homo sapiens
aauaggcaauccauuauca

SEQ ID NO: 1444060 - RNA, 19 nt, Homo sapiens
ccagauuaagucacaguua

SEQ ID NO: 1444061 - RNA, 19 nt, Homo sapiens
caacauuugccuuuacaug

SEQ ID NO: 1444062 - RNA, 19 nt, Homo sapiens
aaucauugguuucagaguu

SEQ ID NO: 1444063 - RNA, 19 nt, Homo sapiens
acuugaagcugguacauau

SEQ ID NO: 1444064 - RNA, 19 nt, Homo sapiens
agauugcgauuguggauga

SEQ ID NO: 1444065 - RNA, 19 nt, Homo sapiens
cagauuaagucacaguuac

SEQ ID NO: 1444066 - RNA, 19 nt, Homo sapiens
gaucagcccagauuaaguc

SEQ ID NO: 1444067 - RNA, 19 nt, Homo sapiens
acauuugccuuuacaugaa

SEQ ID NO: 1444068 - RNA, 19 nt, Homo sapiens
aacaugagguuguagcuau

SEQ ID NO: 1444069 - RNA, 19 nt, Homo sapiens
cauccaagguuacgcaagu

SEQ ID NO: 1444070 - RNA, 19 nt, Homo sapiens
ggaugguccucagaaaguu

SEQ ID NO: 1444071 - RNA, 19 nt, Homo sapiens
ggaagaucacugaaaguuc

SEQ ID NO: 1444072 - RNA, 19 nt, Homo sapiens
gugggaagaucacugaaag

SEQ ID NO: 1444073 - RNA, 19 nt, Homo sapiens
aaggagauguuucuuugga

SEQ ID NO: 1444074 - RNA, 19 nt, Homo sapiens
gaauugggcacaaggagau

SEQ ID NO: 1444075 - RNA, 19 nt, Homo sapiens
gauaccagaggcuuagaaa

SEQ ID NO: 1444076 - RNA, 19 nt, Homo sapiens
gaaagagcuggacaacaug

SEQ ID NO: 1444077 - RNA, 19 nt, Homo sapiens
aaaauuagcucuugaugag

SEQ ID NO: 1444078 - RNA, 19 nt, Homo sapiens
ggagagauaaauccugugu

SEQ ID NO: 1444079 - RNA, 19 nt, Homo sapiens
gaugguccucagaaaguua

SEQ ID NO: 1444080 - RNA, 19 nt, Homo sapiens
ggaagugcuugguguacag

SEQ ID NO: 1444081 - RNA, 19 nt, Homo sapiens
aaauauagcaguucauugg

SEQ ID NO: 1444082 - RNA, 19 nt, Homo sapiens
gaccauauuuugccuuuug

SEQ ID NO: 1444083 - RNA, 19 nt, Homo sapiens
cagcuugaccuuaaggaaa

SEQ ID NO: 1444084 - RNA, 19 nt, Homo sapiens
aggcacaggugaauacaau

SEQ ID NO: 1444085 - RNA, 19 nt, Homo sapiens
acaugagguuguagcuaua

SEQ ID NO: 1444086 - RNA, 19 nt, Homo sapiens
ugcagaaccuguuguuuua

SEQ ID NO: 1444087 - RNA, 19 nt, Homo sapiens
acaacaacauggcuaugga

SEQ ID NO: 1444088 - RNA, 19 nt, Homo sapiens
guguaugucugccuccuau

SEQ ID NO: 1444089 - RNA, 19 nt, Homo sapiens
gcauauccccuucaaauga

SEQ ID NO: 1444090 - RNA, 19 nt, Homo sapiens
gcaguauguccucaaguga

SEQ ID NO: 1444091 - RNA, 19 nt, Homo sapiens
augcaaagauuucacagau

SEQ ID NO: 1444092 - RNA, 19 nt, Homo sapiens
aaaggagucuagauccaau

SEQ ID NO: 1444093 - RNA, 19 nt, Homo sapiens
ggacugggacaaaauaaaa

SEQ ID NO: 1444094 - RNA, 19 nt, Homo sapiens
gaaaucucccugcauagag

SEQ ID NO: 1444095 - RNA, 19 nt, Homo sapiens
gauuguggauggccugagu

SEQ ID NO: 1444096 - RNA, 19 nt, Homo sapiens
uaccagaggcuuagaaauc

SEQ ID NO: 1444097 - RNA, 19 nt, Homo sapiens
acaacuggaugaaccugaa

SEQ ID NO: 1444098 - RNA, 19 nt, Homo sapiens
ugaaaucucccugcauaga

SEQ ID NO: 1444099 - RNA, 19 nt, Homo sapiens
gcgacaaagacgauaacua

SEQ ID NO: 1444100 - RNA, 19 nt, Homo sapiens
acagaccucauauuaguuu

SEQ ID NO: 1444101 - RNA, 19 nt, Homo sapiens
augaugcacucacuucaaa

SEQ ID NO: 1444102 - RNA, 19 nt, Homo sapiens
gaugaugcacucacuucaa

SEQ ID NO: 1444103 - RNA, 19 nt, Homo sapiens
gccuuuacaugaaccaguu

SEQ ID NO: 1444104 - RNA, 19 nt, Homo sapiens
aaacaugccucauugauua

SEQ ID NO: 1444105 - RNA, 19 nt, Homo sapiens
gaauagagcugcccugaga

SEQ ID NO: 1444106 - RNA, 19 nt, Homo sapiens
gaagacagcuuacucagau

SEQ ID NO: 1444107 - RNA, 19 nt, Homo sapiens
gaaagcaucuccucauuca

SEQ ID NO: 1444108 - RNA, 19 nt, Homo sapiens
gaaggucagugauaaauug

SEQ ID NO: 1444109 - RNA, 19 nt, Homo sapiens
gaaaucauaugguuagaug

SEQ ID NO: 1444110 - RNA, 19 nt, Homo sapiens
gaacaagaaugaacaagag

SEQ ID NO: 1444111 - RNA, 19 nt, Homo sapiens
cuaaacagcucgcagaauu

SEQ ID NO: 1444112 - RNA, 19 nt, Homo sapiens
gaacaacagcuuucucaaa

SEQ ID NO: 1444113 - RNA, 19 nt, Homo sapiens
ugacaaacaugccucauug

SEQ ID NO: 1444114 - RNA, 19 nt, Homo sapiens
gguuagaugugauuauuug

SEQ ID NO: 1444115 - RNA, 19 nt, Homo sapiens
caaauacgaacaagaauga

SEQ ID NO: 1444116 - RNA, 19 nt, Homo sapiens
uuaaggacauggugcauuu

SEQ ID NO: 1444117 - RNA, 19 nt, Homo sapiens
aaagagacauuuccugguu

SEQ ID NO: 1444118 - RNA, 19 nt, Homo sapiens
gcagagugcuucgcgguaa

SEQ ID NO: 1444119 - RNA, 19 nt, Homo sapiens
aaagauaguuggagagaau

SEQ ID NO: 1444120 - RNA, 19 nt, Homo sapiens
ggagguggcauuggaaaua

SEQ ID NO: 1444121 - RNA, 19 nt, Homo sapiens
ggagguuuauucagucaaa

SEQ ID NO: 1444122 - RNA, 19 nt, Homo sapiens
agaaagagcuuccacaaaa

SEQ ID NO: 1444123 - RNA, 19 nt, Homo sapiens
uuacauagaaugcgucaua

SEQ ID NO: 1444124 - RNA, 19 nt, Homo sapiens
ggagagaauucgcuugagu

SEQ ID NO: 1444125 - RNA, 19 nt, Homo sapiens
guugauauauccuggugua

SEQ ID NO: 1444126 - RNA, 19 nt, Homo sapiens
caacuguauuucauuguga

SEQ ID NO: 1444127 - RNA, 19 nt, Homo sapiens
gcgcuucucucuggacuuu

SEQ ID NO: 1444128 - RNA, 19 nt, Homo sapiens
ugcaguagauagucaauaa

SEQ ID NO: 1444129 - RNA, 19 nt, Homo sapiens
gaagagugaucagugacaa

SEQ ID NO: 1444130 - RNA, 19 nt, Homo sapiens
ggaaaguaguccuccaaca

SEQ ID NO: 1444131 - RNA, 19 nt, Homo sapiens
acuaggaaguugaggaaua

SEQ ID NO: 1444132 - RNA, 19 nt, Homo sapiens
gaaaggaucagaacaacag

SEQ ID NO: 1444133 - RNA, 19 nt, Homo sapiens
acaggaaggucagugauaa

SEQ ID NO: 1444134 - RNA, 19 nt, Homo sapiens
gcaaauacgaacaagaaug

SEQ ID NO: 1444135 - RNA, 19 nt, Homo sapiens
gagagaauucgcuugagua

SEQ ID NO: 1444136 - RNA, 19 nt, Homo sapiens
gggaggagguggcauugga

SEQ ID NO: 1444137 - RNA, 19 nt, Homo sapiens
caaacaugccucauugauu

SEQ ID NO: 1444138 - RNA, 19 nt, Homo sapiens
gauauauccugguguaaac

SEQ ID NO: 1444139 - RNA, 19 nt, Homo sapiens
gcuccuacacuuugugaua

SEQ ID NO: 1444140 - RNA, 19 nt, Homo sapiens
acagaagagugaucaguga

SEQ ID NO: 1444141 - RNA, 19 nt, Homo sapiens
ugaagcagauuaacagaag

SEQ ID NO: 1444142 - RNA, 19 nt, Homo sapiens
gaagaaacgggcaaagaca

SEQ ID NO: 1444143 - RNA, 19 nt, Homo sapiens
cagauuaacagaagaguga

SEQ ID NO: 1444144 - RNA, 19 nt, Homo sapiens
gaaaguaguccuccaacag

SEQ ID NO: 1444145 - RNA, 19 nt, Homo sapiens
gcacuaggaaguugaggaa

SEQ ID NO: 1444146 - RNA, 19 nt, Homo sapiens
ucgcagaauuugcuagaaa

SEQ ID NO: 1444147 - RNA, 19 nt, Homo sapiens
ggccucagccucccaagua

SEQ ID NO: 1444148 - RNA, 19 nt, Homo sapiens
ucuguuggauuauuggaua

SEQ ID NO: 1444149 - RNA, 19 nt, Homo sapiens
gcuucucucuggacuuuaa

SEQ ID NO: 1444150 - RNA, 19 nt, Homo sapiens
aaagaaaggaucagaacaa

SEQ ID NO: 1444151 - RNA, 19 nt, Homo sapiens
ggaaggucagugauaaauu

SEQ ID NO: 1444152 - RNA, 19 nt, Homo sapiens
ccugaaagcccacauccua

SEQ ID NO: 1444153 - RNA, 19 nt, Homo sapiens
gcaaucgcuuguccucaga

SEQ ID NO: 1444154 - RNA, 19 nt, Homo sapiens
ggccuuaugugauggcuau

SEQ ID NO: 1444155 - RNA, 19 nt, Homo sapiens
ugucauagcccuagagaau

SEQ ID NO: 1444156 - RNA, 19 nt, Homo sapiens
ccaaagugcugggauuaca

SEQ ID NO: 1444157 - RNA, 19 nt, Homo sapiens
cuaagaugcuccuacacuu

SEQ ID NO: 1444158 - RNA, 19 nt, Homo sapiens
gaagcagauuaacagaaga

SEQ ID NO: 1444159 - RNA, 19 nt, Homo sapiens
gaagggcacaggcaggaaa

SEQ ID NO: 1444160 - RNA, 19 nt, Homo sapiens
ccuguaaucccaacacuuu

SEQ ID NO: 1444161 - RNA, 19 nt, Homo sapiens
uaagaugcuccuacacuuu

SEQ ID NO: 1444162 - RNA, 19 nt, Homo sapiens
uuacuaagaugcuccuaca

SEQ ID NO: 1444163 - RNA, 19 nt, Homo sapiens
gaucagaacaacagcuuuc

SEQ ID NO: 1444164 - RNA, 19 nt, Homo sapiens
gguaacagggacaaaugua

SEQ ID NO: 1444165 - RNA, 19 nt, Homo sapiens
gaacaagagggaaaguagu

SEQ ID NO: 1444166 - RNA, 19 nt, Homo sapiens
uggaauaccuaaagaaagg

SEQ ID NO: 1444167 - RNA, 19 nt, Homo sapiens
ccucauugauuauuguuuc

SEQ ID NO: 1444168 - RNA, 19 nt, Homo sapiens
ccaacaggaugaagcagau

SEQ ID NO: 1444169 - RNA, 19 nt, Homo sapiens
gggaaagcguucguugaga

SEQ ID NO: 1444170 - RNA, 19 nt, Homo sapiens
gaugauuucucagacuguu

SEQ ID NO: 1444171 - RNA, 19 nt, Homo sapiens
ggccaaagcaggaggauag

SEQ ID NO: 1444172 - RNA, 19 nt, Homo sapiens
gccuggaggugguugauau

SEQ ID NO: 1444173 - RNA, 19 nt, Homo sapiens
cgaacaagaaugaacaaga

SEQ ID NO: 1444174 - RNA, 19 nt, Homo sapiens
gcaacaggagguuuauuca

SEQ ID NO: 1444175 - RNA, 19 nt, Homo sapiens
gagcugcccugagaaagca

SEQ ID NO: 1444176 - RNA, 19 nt, Homo sapiens
uaaacagcucgcagaauuu

SEQ ID NO: 1444177 - RNA, 19 nt, Homo sapiens
ggaggaauaccuggcauug

SEQ ID NO: 1444178 - RNA, 19 nt, Homo sapiens
ggaggugguugauauaucc

SEQ ID NO: 1444179 - RNA, 19 nt, Homo sapiens
gacauuuccugguucauac

SEQ ID NO: 1444180 - RNA, 19 nt, Homo sapiens
aaagaaagagcuuccacaa

SEQ ID NO: 1444181 - RNA, 19 nt, Homo sapiens
gagguggcauuggaaauag

SEQ ID NO: 1444182 - RNA, 19 nt, Homo sapiens
ucaacuguauuucauugug

SEQ ID NO: 1444183 - RNA, 19 nt, Homo sapiens
gcaguagauagucaauaaa

SEQ ID NO: 1444184 - RNA, 19 nt, Homo sapiens
ggaugaagcagauuaacag

SEQ ID NO: 1444185 - RNA, 19 nt, Homo sapiens
guacaugacaggcaagaag

SEQ ID NO: 1444186 - RNA, 19 nt, Homo sapiens
ggacuacagguguguguca

SEQ ID NO: 1444187 - RNA, 19 nt, Homo sapiens
agacauuuccugguucaua

SEQ ID NO: 1444188 - RNA, 19 nt, Homo sapiens
gcucaaaacuaaagagaca

SEQ ID NO: 1444189 - RNA, 19 nt, Homo sapiens
agaauuugcuagaaagaag

SEQ ID NO: 1444190 - RNA, 19 nt, Homo sapiens
agucaacuguauuucauug

SEQ ID NO: 1444191 - RNA, 19 nt, Homo sapiens
ccacgucugugcggaaugu

SEQ ID NO: 1444192 - RNA, 19 nt, Homo sapiens
cuaggaaguugaggaauag

SEQ ID NO: 1444193 - RNA, 19 nt, Homo sapiens
gaaagagcuuccacaaaag

SEQ ID NO: 1444194 - RNA, 19 nt, Homo sapiens
ugaauguucuuuggaauac

SEQ ID NO: 1444195 - RNA, 19 nt, Homo sapiens
caacauguuuaaacuuagc

SEQ ID NO: 1444196 - RNA, 19 nt, Homo sapiens
aacaggagguuuauucagu

SEQ ID NO: 1444197 - RNA, 19 nt, Homo sapiens
gcggaaagcgcuucucucu

SEQ ID NO: 1444198 - RNA, 19 nt, Homo sapiens
aaacagcucgcagaauuug

SEQ ID NO: 1444199 - RNA, 19 nt, Homo sapiens
ugaccuaucagauccuaaa

SEQ ID NO: 1444200 - RNA, 19 nt, Homo sapiens
uacauagaaugcgucauaa

SEQ ID NO: 1444201 - RNA, 19 nt, Homo sapiens
gaaaggccuggguggaaga

SEQ ID NO: 1444202 - RNA, 19 nt, Homo sapiens
gaaacgggcaaagacaaga

SEQ ID NO: 1444203 - RNA, 19 nt, Homo sapiens
ccuugaauguucuuuggaa

SEQ ID NO: 1444204 - RNA, 19 nt, Homo sapiens
gcagauggaucguaaauau

SEQ ID NO: 1444205 - RNA, 19 nt, Homo sapiens
ggaaauaaaucagcugaaa

SEQ ID NO: 1444206 - RNA, 19 nt, Homo sapiens
ggagauagcuguucugucu

SEQ ID NO: 1444207 - RNA, 19 nt, Homo sapiens
ggauuucacugcucccuua

SEQ ID NO: 1444208 - RNA, 19 nt, Homo sapiens
gaagacagcccuaaucuca

SEQ ID NO: 1444209 - RNA, 19 nt, Homo sapiens
cagaggagcucagagaaua

SEQ ID NO: 1444210 - RNA, 19 nt, Homo sapiens
cagaagccauguccgauua

SEQ ID NO: 1444211 - RNA, 19 nt, Homo sapiens
gaaaggucuucacuaauau

SEQ ID NO: 1444212 - RNA, 19 nt, Homo sapiens
gaacugaaguggaaagcau

SEQ ID NO: 1444213 - RNA, 19 nt, Homo sapiens
ccucagaccucacuuaaga

SEQ ID NO: 1444214 - RNA, 19 nt, Homo sapiens
acaaacagcuucucuaaag

SEQ ID NO: 1444215 - RNA, 19 nt, Homo sapiens
gaacacccuucccgccaua

SEQ ID NO: 1444216 - RNA, 19 nt, Homo sapiens
agaaugcugucuuggauua

SEQ ID NO: 1444217 - RNA, 19 nt, Homo sapiens
gcuccaagcuguccaaugu

SEQ ID NO: 1444218 - RNA, 19 nt, Homo sapiens
ggaacucacucaagcagaa

SEQ ID NO: 1444219 - RNA, 19 nt, Homo sapiens
guagagcagugauuugauu

SEQ ID NO: 1444220 - RNA, 19 nt, Homo sapiens
ugucaaagcuacuuaguug

SEQ ID NO: 1444221 - RNA, 19 nt, Homo sapiens
gcacauauacugauuugga

SEQ ID NO: 1444222 - RNA, 19 nt, Homo sapiens
gcacagguagcucaguuua

SEQ ID NO: 1444223 - RNA, 19 nt, Homo sapiens
gggcaauucuuguuaaugu

SEQ ID NO: 1444224 - RNA, 19 nt, Homo sapiens
uaaccacccuagaagauaa

SEQ ID NO: 1444225 - RNA, 19 nt, Homo sapiens
gaagaaagcaagaacagau

SEQ ID NO: 1444226 - RNA, 19 nt, Homo sapiens
caggagauauguugcauug

SEQ ID NO: 1444227 - RNA, 19 nt, Homo sapiens
gaagccauguccgauuaua

SEQ ID NO: 1444228 - RNA, 19 nt, Homo sapiens
uaaugagaaugccuacaua

SEQ ID NO: 1444229 - RNA, 19 nt, Homo sapiens
aaacaaacagcuucucuaa

SEQ ID NO: 1444230 - RNA, 19 nt, Homo sapiens
ggauguaccuuacccuuag

SEQ ID NO: 1444231 - RNA, 19 nt, Homo sapiens
gggaauauuucaaacuguu

SEQ ID NO: 1444232 - RNA, 19 nt, Homo sapiens
ucacaaacaucuacuuucu

SEQ ID NO: 1444233 - RNA, 19 nt, Homo sapiens
acagguagcucaguuuauu

SEQ ID NO: 1444234 - RNA, 19 nt, Homo sapiens
aaacuucacguucaagaua

SEQ ID NO: 1444235 - RNA, 19 nt, Homo sapiens
gagaauuuccuuguucaua

SEQ ID NO: 1444236 - RNA, 19 nt, Homo sapiens
gaaggaggacguaaugaug

SEQ ID NO: 1444237 - RNA, 19 nt, Homo sapiens
caaaggagacuggccuaua

SEQ ID NO: 1444238 - RNA, 19 nt, Homo sapiens
caucuacuuucuccacaua

SEQ ID NO: 1444239 - RNA, 19 nt, Homo sapiens
gcagugauuugauuagaag

SEQ ID NO: 1444240 - RNA, 19 nt, Homo sapiens
gagagaauuuccuuguuca

SEQ ID NO: 1444241 - RNA, 19 nt, Homo sapiens
gaagcaaaguccguuacaa

SEQ ID NO: 1444242 - RNA, 19 nt, Homo sapiens
ggaauucggugcgaucugu

SEQ ID NO: 1444243 - RNA, 19 nt, Homo sapiens
ggucuucacuaauaucuca

SEQ ID NO: 1444244 - RNA, 19 nt, Homo sapiens
caccagaccugcuccuuug

SEQ ID NO: 1444245 - RNA, 19 nt, Homo sapiens
gaacagaucggccauaucc

SEQ ID NO: 1444246 - RNA, 19 nt, Homo sapiens
ccaagcacauauacugauu

SEQ ID NO: 1444247 - RNA, 19 nt, Homo sapiens
guauauaucccuugacuuc

SEQ ID NO: 1444248 - RNA, 19 nt, Homo sapiens
gggcaccauuuacugauuu

SEQ ID NO: 1444249 - RNA, 19 nt, Homo sapiens
gagcagugauuugauuaga

SEQ ID NO: 1444250 - RNA, 19 nt, Homo sapiens
cacagagaguuaaauguuu

SEQ ID NO: 1444251 - RNA, 19 nt, Homo sapiens
gaucagaggagcucagaga

SEQ ID NO: 1444252 - RNA, 19 nt, Homo sapiens
caaaguccguuacaaaggu

SEQ ID NO: 1444253 - RNA, 19 nt, Homo sapiens
ggucucaaacgaaacuuua

SEQ ID NO: 1444254 - RNA, 19 nt, Homo sapiens
ugagagaauuuccuuguuc

SEQ ID NO: 1444255 - RNA, 19 nt, Homo sapiens
cuacuuaguugagagaauu

SEQ ID NO: 1444256 - RNA, 19 nt, Homo sapiens
ggugggcaauucuuguuaa

SEQ ID NO: 1444257 - RNA, 19 nt, Homo sapiens
gcaaugcagugugcuggaa

SEQ ID NO: 1444258 - RNA, 19 nt, Homo sapiens
ugagagagacacugaauug

SEQ ID NO: 1444259 - RNA, 19 nt, Homo sapiens
gacaugcucuucaccuguu

SEQ ID NO: 1444260 - RNA, 19 nt, Homo sapiens
guauaggcauuuaggauca

SEQ ID NO: 1444261 - RNA, 19 nt, Homo sapiens
ugucuuggauuaugucauu

SEQ ID NO: 1444262 - RNA, 19 nt, Homo sapiens
acacaaggaaagcuaaaua

SEQ ID NO: 1444263 - RNA, 19 nt, Homo sapiens
acacaugccucacaaacau

SEQ ID NO: 1444264 - RNA, 19 nt, Homo sapiens
gcaccagaccugcuccuuu

SEQ ID NO: 1444265 - RNA, 19 nt, Homo sapiens
gcaauaaaaugcuuuccuu

SEQ ID NO: 1444266 - RNA, 19 nt, Homo sapiens
agacuggccuauacucauu

SEQ ID NO: 1444267 - RNA, 19 nt, Homo sapiens
gauguggauugccaagauu

SEQ ID NO: 1444268 - RNA, 19 nt, Homo sapiens
cauguccgauuauaagaaa

SEQ ID NO: 1444269 - RNA, 19 nt, Homo sapiens
acaaucaagucacgccuuu

SEQ ID NO: 1444270 - RNA, 19 nt, Homo sapiens
caccuguucuaccuaguua

SEQ ID NO: 1444271 - RNA, 19 nt, Homo sapiens
uuacgaacguugcaggaaa

SEQ ID NO: 1444272 - RNA, 19 nt, Homo sapiens
guaagucguugucgaagca

SEQ ID NO: 1444273 - RNA, 19 nt, Homo sapiens
ucaaagcagugucaaugau

SEQ ID NO: 1444274 - RNA, 19 nt, Homo sapiens
cagcuuaaaucucuucaag

SEQ ID NO: 1444275 - RNA, 19 nt, Homo sapiens
caagaaggaggacguaaug

SEQ ID NO: 1444276 - RNA, 19 nt, Homo sapiens
ggguaaauguuaguuucua

SEQ ID NO: 1444277 - RNA, 19 nt, Homo sapiens
gggauguaccuuacccuua

SEQ ID NO: 1444278 - RNA, 19 nt, Homo sapiens
ucacuaauaucucacuaag

SEQ ID NO: 1444279 - RNA, 19 nt, Homo sapiens
ggaacugugugaacugaag

SEQ ID NO: 1444280 - RNA, 19 nt, Homo sapiens
gcauuuaggaucauauuca

SEQ ID NO: 1444281 - RNA, 19 nt, Homo sapiens
acacagagaguuaaauguu

SEQ ID NO: 1444282 - RNA, 19 nt, Homo sapiens
gugaagcucuuauuuugua

SEQ ID NO: 1444283 - RNA, 19 nt, Homo sapiens
aaaggagacuggccuauac

SEQ ID NO: 1444284 - RNA, 19 nt, Homo sapiens
aaggaaagcuaaauagucu

SEQ ID NO: 1444285 - RNA, 19 nt, Homo sapiens
ucaucuaugugcauguaua

SEQ ID NO: 1444286 - RNA, 19 nt, Homo sapiens
guuaauuaccucaugcaua

SEQ ID NO: 1444287 - RNA, 19 nt, Homo sapiens
acaaacacgugugaucaaa

SEQ ID NO: 1444288 - RNA, 19 nt, Homo sapiens
ugagaaugcugucuuggau

SEQ ID NO: 1444289 - RNA, 19 nt, Homo sapiens
cgaaugacuuugagaaugc

SEQ ID NO: 1444290 - RNA, 19 nt, Homo sapiens
gagaaugccuacauaucag

SEQ ID NO: 1444291 - RNA, 19 nt, Homo sapiens
ugagaaugccuacauauca

SEQ ID NO: 1444292 - RNA, 19 nt, Homo sapiens
agauaagaauggaauguug

SEQ ID NO: 1444293 - RNA, 19 nt, Homo sapiens
ugucgaagcaggaguuuaa

SEQ ID NO: 1444294 - RNA, 19 nt, Homo sapiens
uggauuaugucauuuguca

SEQ ID NO: 1444295 - RNA, 19 nt, Homo sapiens
ggucaccaccucauucuga

SEQ ID NO: 1444296 - RNA, 19 nt, Homo sapiens
gaguauauaucccuugacu

SEQ ID NO: 1444297 - RNA, 19 nt, Homo sapiens
ugugugaacugaaguggaa

SEQ ID NO: 1444298 - RNA, 19 nt, Homo sapiens
agaccucacuuaagauaau

SEQ ID NO: 1444299 - RNA, 19 nt, Homo sapiens
gagguuggauacaauuagu

SEQ ID NO: 1444300 - RNA, 19 nt, Homo sapiens
gugaggagguuggauacaa

SEQ ID NO: 1444301 - RNA, 19 nt, Homo sapiens
cauauucauucgaagcaaa

SEQ ID NO: 1444302 - RNA, 19 nt, Homo sapiens
caaggaaagcuaaauaguc

SEQ ID NO: 1444303 - RNA, 19 nt, Homo sapiens
aagcacauauacugauuug

SEQ ID NO: 1444304 - RNA, 19 nt, Homo sapiens
gagaauggcuuuagugaua

SEQ ID NO: 1444305 - RNA, 19 nt, Homo sapiens
caauagaugucaugagauu

SEQ ID NO: 1444306 - RNA, 19 nt, Homo sapiens
gcucccagguuaaauauaa

SEQ ID NO: 1444307 - RNA, 19 nt, Homo sapiens
ggaccuagaccuacuuuaa

SEQ ID NO: 1444308 - RNA, 19 nt, Homo sapiens
aaaccucugugcauucuua

SEQ ID NO: 1444309 - RNA, 19 nt, Homo sapiens
ggacauggaauucaaauca

SEQ ID NO: 1444310 - RNA, 19 nt, Homo sapiens
gcuaaagucacaucaguaa

SEQ ID NO: 1444311 - RNA, 19 nt, Homo sapiens
caauguauuuccuaucuug

SEQ ID NO: 1444312 - RNA, 19 nt, Homo sapiens
ggaaagcucccagguuaaa

SEQ ID NO: 1444313 - RNA, 19 nt, Homo sapiens
gcuguucuuugccuuguua

SEQ ID NO: 1444314 - RNA, 19 nt, Homo sapiens
aaacauggccgaauugaau

SEQ ID NO: 1444315 - RNA, 19 nt, Homo sapiens
caguaaagauagaacguuu

SEQ ID NO: 1444316 - RNA, 19 nt, Homo sapiens
gacauuugguagccauaua

SEQ ID NO: 1444317 - RNA, 19 nt, Homo sapiens
ggaguuggcugcgggaugu

SEQ ID NO: 1444318 - RNA, 19 nt, Homo sapiens
ugccaaaucuuaaguaaca

SEQ ID NO: 1444319 - RNA, 19 nt, Homo sapiens
ggaugucacuuaaaacuaa

SEQ ID NO: 1444320 - RNA, 19 nt, Homo sapiens
gaauggcuuuagugauauu

SEQ ID NO: 1444321 - RNA, 19 nt, Homo sapiens
guucuuugccuuguuauua

SEQ ID NO: 1444322 - RNA, 19 nt, Homo sapiens
aaacuuugccuauguaaug

SEQ ID NO: 1444323 - RNA, 19 nt, Homo sapiens
ggagaugacuacaagaaaa

SEQ ID NO: 1444324 - RNA, 19 nt, Homo sapiens
gacauggaauucaaaucaa

SEQ ID NO: 1444325 - RNA, 19 nt, Homo sapiens
uaaguaacaccaccagaaa

SEQ ID NO: 1444326 - RNA, 19 nt, Homo sapiens
ugugaucucugucuccuuu

SEQ ID NO: 1444327 - RNA, 19 nt, Homo sapiens
gaacucaguauaagugcaa

SEQ ID NO: 1444328 - RNA, 19 nt, Homo sapiens
aaagucacaucaguaauug

SEQ ID NO: 1444329 - RNA, 19 nt, Homo sapiens
gaaacaagcuaaaaguaag

SEQ ID NO: 1444330 - RNA, 19 nt, Homo sapiens
caugccaaaucuuaaguaa

SEQ ID NO: 1444331 - RNA, 19 nt, Homo sapiens
gaaaauaacaggacaugga

SEQ ID NO: 1444332 - RNA, 19 nt, Homo sapiens
gaucauaacaggguugaau

SEQ ID NO: 1444333 - RNA, 19 nt, Homo sapiens
gcaggauguugaagacuca

SEQ ID NO: 1444334 - RNA, 19 nt, Homo sapiens
ugacugcacccuaugguaa

SEQ ID NO: 1444335 - RNA, 19 nt, Homo sapiens
gaaccaguaauagucauuu

SEQ ID NO: 1444336 - RNA, 19 nt, Homo sapiens
gaacuuagccaauuuugau

SEQ ID NO: 1444337 - RNA, 19 nt, Homo sapiens
accuagaccuacuuuaaua

SEQ ID NO: 1444338 - RNA, 19 nt, Homo sapiens
agcauacacuaccuuaaua

SEQ ID NO: 1444339 - RNA, 19 nt, Homo sapiens
uaacaccaccagaaaguga

SEQ ID NO: 1444340 - RNA, 19 nt, Homo sapiens
uucaauagaugucaugaga

SEQ ID NO: 1444341 - RNA, 19 nt, Homo sapiens
cauaacaggguugaauaua

SEQ ID NO: 1444342 - RNA, 19 nt, Homo sapiens
aauaguggaaccaguaaua

SEQ ID NO: 1444343 - RNA, 19 nt, Homo sapiens
cuaguugacugcacccuau

SEQ ID NO: 1444344 - RNA, 19 nt, Homo sapiens
aaagcucccagguuaaaua

SEQ ID NO: 1444345 - RNA, 19 nt, Homo sapiens
gaaaacuucuccccacuca

SEQ ID NO: 1444346 - RNA, 19 nt, Homo sapiens
gaccuagaccuacuuuaau

SEQ ID NO: 1444347 - RNA, 19 nt, Homo sapiens
gguuggagaugacuacaag

SEQ ID NO: 1444348 - RNA, 19 nt, Homo sapiens
aacaugggcuucacaagga

SEQ ID NO: 1444349 - RNA, 19 nt, Homo sapiens
gcuuaaauuuggaacuuag

SEQ ID NO: 1444350 - RNA, 19 nt, Homo sapiens
caguauaagugcaaguugu

SEQ ID NO: 1444351 - RNA, 19 nt, Homo sapiens
uauaguagccuuuaugaac

SEQ ID NO: 1444352 - RNA, 19 nt, Homo sapiens
gucaggcauuuguaucuuu

SEQ ID NO: 1444353 - RNA, 19 nt, Homo sapiens
gaaaauggagaauggcuuu

SEQ ID NO: 1444354 - RNA, 19 nt, Homo sapiens
gcauacacuaccuuaauau

SEQ ID NO: 1444355 - RNA, 19 nt, Homo sapiens
uagcauacacuaccuuaau

SEQ ID NO: 1444356 - RNA, 19 nt, Homo sapiens
ggaauucaaaucaagcaau

SEQ ID NO: 1444357 - RNA, 19 nt, Homo sapiens
gaucucugucuccuuuaua

SEQ ID NO: 1444358 - RNA, 19 nt, Homo sapiens
caaaauaacagcucugguu

SEQ ID NO: 1444359 - RNA, 19 nt, Homo sapiens
ccuaaacuaagguaaauga

SEQ ID NO: 1444360 - RNA, 19 nt, Homo sapiens
cuaaugcuacuggaaauuu

SEQ ID NO: 1444361 - RNA, 19 nt, Homo sapiens
guagccauauauguaauug

SEQ ID NO: 1444362 - RNA, 19 nt, Homo sapiens
ugaauuguuugacauuugg

SEQ ID NO: 1444363 - RNA, 19 nt, Homo sapiens
cauguagagugcuugcuau

SEQ ID NO: 1444364 - RNA, 19 nt, Homo sapiens
ucaggcauuuguaucuuug

SEQ ID NO: 1444365 - RNA, 19 nt, Homo sapiens
uaacaggacauggaauuca

SEQ ID NO: 1444366 - RNA, 19 nt, Homo sapiens
uuaaguaacaccaccagaa

SEQ ID NO: 1444367 - RNA, 19 nt, Homo sapiens
aauaacaggacauggaauu

SEQ ID NO: 1444368 - RNA, 19 nt, Homo sapiens
ggacuaguugcuguucuuu

SEQ ID NO: 1444369 - RNA, 19 nt, Homo sapiens
ggucaguacaucaaauaau

SEQ ID NO: 1444370 - RNA, 19 nt, Homo sapiens
guaaugccauauuuucuug

SEQ ID NO: 1444371 - RNA, 19 nt, Homo sapiens
cgaauaguggaaccaguaa

SEQ ID NO: 1444372 - RNA, 19 nt, Homo sapiens
ggagaauggcuuuagugau

SEQ ID NO: 1444373 - RNA, 19 nt, Homo sapiens
guaucuaacaaguugcaua

SEQ ID NO: 1444374 - RNA, 19 nt, Homo sapiens
ggaaccaguaauagucauu

SEQ ID NO: 1444375 - RNA, 19 nt, Homo sapiens
ccaccaguaccuaauguug

SEQ ID NO: 1444376 - RNA, 19 nt, Homo sapiens
cagccuaaacuaagguaaa

SEQ ID NO: 1444377 - RNA, 19 nt, Homo sapiens
accaguaccuaauguugaa

SEQ ID NO: 1444378 - RNA, 19 nt, Homo sapiens
ucacaaggauguauuuugg

SEQ ID NO: 1444379 - RNA, 19 nt, Homo sapiens
ggagagcgagcaggauguu

SEQ ID NO: 1444380 - RNA, 19 nt, Homo sapiens
ucuuuacacuuucaucuca

SEQ ID NO: 1444381 - RNA, 19 nt, Homo sapiens
agaauggcuuuagugauau

SEQ ID NO: 1444382 - RNA, 19 nt, Homo sapiens
gagagacauuuucagugua

SEQ ID NO: 1444383 - RNA, 19 nt, Homo sapiens
aacaggacauggaauucaa

SEQ ID NO: 1444384 - RNA, 19 nt, Homo sapiens
uuugguagccauauaugua

SEQ ID NO: 1444385 - RNA, 19 nt, Homo sapiens
gcgagcaggauguugaaga

SEQ ID NO: 1444386 - RNA, 19 nt, Homo sapiens
aagugcaaguuguuugaaa

SEQ ID NO: 1444387 - RNA, 19 nt, Homo sapiens
uaugaacucaguauaagug

SEQ ID NO: 1444388 - RNA, 19 nt, Homo sapiens
cuuagugucuucucauucu

SEQ ID NO: 1444389 - RNA, 19 nt, Homo sapiens
cuugcuaucccacuucaua

SEQ ID NO: 1444390 - RNA, 19 nt, Homo sapiens
uuuccuaucuugacaugga

SEQ ID NO: 1444391 - RNA, 19 nt, Homo sapiens
gagcgagcaggauguugaa

SEQ ID NO: 1444392 - RNA, 19 nt, Homo sapiens
cccaccaaauaaucucaua

SEQ ID NO: 1444393 - RNA, 19 nt, Homo sapiens
cuaaaccucugugcauucu

SEQ ID NO: 1444394 - RNA, 19 nt, Homo sapiens
acgaauaguggaaccagua

SEQ ID NO: 1444395 - RNA, 19 nt, Homo sapiens
uguaacauuuggaccuaga

SEQ ID NO: 1444396 - RNA, 19 nt, Homo sapiens
gaaagcucccagguuaaau

SEQ ID NO: 1444397 - RNA, 19 nt, Homo sapiens
ucauaacaggguugaauau

SEQ ID NO: 1444398 - RNA, 19 nt, Homo sapiens
gguguuaauaggguauaua

SEQ ID NO: 1444399 - RNA, 19 nt, Homo sapiens
guauaagugcaaguuguuu

SEQ ID NO: 1444400 - RNA, 19 nt, Homo sapiens
gcagucaggcauuuguauc

SEQ ID NO: 1444401 - RNA, 19 nt, Homo sapiens
gggcagucaggcauuugua

SEQ ID NO: 1444402 - RNA, 19 nt, Homo sapiens
ugaucucugucuccuuuau

SEQ ID NO: 1444403 - RNA, 19 nt, Homo sapiens
gugagccgguuggagauga

SEQ ID NO: 1444404 - RNA, 19 nt, Homo sapiens
agaaaugucugccuguuua

SEQ ID NO: 1444405 - RNA, 19 nt, Homo sapiens
gaaaucauccugaaagcua

SEQ ID NO: 1444406 - RNA, 19 nt, Homo sapiens
cgaugaagaugcuacuuua

SEQ ID NO: 1444407 - RNA, 19 nt, Homo sapiens
aagauugacuggcuauuua

SEQ ID NO: 1444408 - RNA, 19 nt, Homo sapiens
guacuuggguuuaagagaa

SEQ ID NO: 1444409 - RNA, 19 nt, Homo sapiens
guacaaagcaauagaagaa

SEQ ID NO: 1444410 - RNA, 19 nt, Homo sapiens
uaugaaagauggaaacuga

SEQ ID NO: 1444411 - RNA, 19 nt, Homo sapiens
aaaagaagcuggaggaaua

SEQ ID NO: 1444412 - RNA, 19 nt, Homo sapiens
gugaagaccuuuaauaugg

SEQ ID NO: 1444413 - RNA, 19 nt, Homo sapiens
guucaugucccuaauauaa

SEQ ID NO: 1444414 - RNA, 19 nt, Homo sapiens
gauccacuauucaguauga

SEQ ID NO: 1444415 - RNA, 19 nt, Homo sapiens
gauggaugcuagagaagua

SEQ ID NO: 1444416 - RNA, 19 nt, Homo sapiens
cgggaaugcugcagauuua

SEQ ID NO: 1444417 - RNA, 19 nt, Homo sapiens
gcaagccacuucaggaaau

SEQ ID NO: 1444418 - RNA, 19 nt, Homo sapiens
guagcuggcucucaagauu

SEQ ID NO: 1444419 - RNA, 19 nt, Homo sapiens
cuccaaaccuuucagauaa

SEQ ID NO: 1444420 - RNA, 19 nt, Homo sapiens
gaagucacauagccaccua

SEQ ID NO: 1444421 - RNA, 19 nt, Homo sapiens
gaaagcuaccauucuuaua

SEQ ID NO: 1444422 - RNA, 19 nt, Homo sapiens
ugaagaugcuacuuuagaa

SEQ ID NO: 1444423 - RNA, 19 nt, Homo sapiens
gagaaguaaugauccuuau

SEQ ID NO: 1444424 - RNA, 19 nt, Homo sapiens
ggaugaauauguaggacuu

SEQ ID NO: 1444425 - RNA, 19 nt, Homo sapiens
caacagggaguacaccuuu

SEQ ID NO: 1444426 - RNA, 19 nt, Homo sapiens
ggacaggacagauauuuua

SEQ ID NO: 1444427 - RNA, 19 nt, Homo sapiens
agaaguagcuggcucucaa

SEQ ID NO: 1444428 - RNA, 19 nt, Homo sapiens
aaucacauguggacuguuu

SEQ ID NO: 1444429 - RNA, 19 nt, Homo sapiens
gaaggagacuggagcaaaa

SEQ ID NO: 1444430 - RNA, 19 nt, Homo sapiens
gcacgugguugccuuaguc

SEQ ID NO: 1444431 - RNA, 19 nt, Homo sapiens
uaaagacucuagcaaugga

SEQ ID NO: 1444432 - RNA, 19 nt, Homo sapiens
ggucauaucgcuuucaaug

SEQ ID NO: 1444433 - RNA, 19 nt, Homo sapiens
guaaugaggcuuguaauuc

SEQ ID NO: 1444434 - RNA, 19 nt, Homo sapiens
gauaccaucuuggcaaaug

SEQ ID NO: 1444435 - RNA, 19 nt, Homo sapiens
gaagaaggagucaaucaca

SEQ ID NO: 1444436 - RNA, 19 nt, Homo sapiens
guaaucgcaucauucaguu

SEQ ID NO: 1444437 - RNA, 19 nt, Homo sapiens
ugacuuggcuagugaaugg

SEQ ID NO: 1444438 - RNA, 19 nt, Homo sapiens
uaaugaggcuuguaauucu

SEQ ID NO: 1444439 - RNA, 19 nt, Homo sapiens
guaaugauccuuauaacag

SEQ ID NO: 1444440 - RNA, 19 nt, Homo sapiens
ggacaagauuaaagacucu

SEQ ID NO: 1444441 - RNA, 19 nt, Homo sapiens
caagauugacuggcuauuu

SEQ ID NO: 1444442 - RNA, 19 nt, Homo sapiens
uuaaaggucuaaugcaugu

SEQ ID NO: 1444443 - RNA, 19 nt, Homo sapiens
ccugaaagcuaccauucuu

SEQ ID NO: 1444444 - RNA, 19 nt, Homo sapiens
caagaaaucauccugaaag

SEQ ID NO: 1444445 - RNA, 19 nt, Homo sapiens
gugaaugggcagccaaaua

SEQ ID NO: 1444446 - RNA, 19 nt, Homo sapiens
uuucagcuaugcaauauga

SEQ ID NO: 1444447 - RNA, 19 nt, Homo sapiens
gcgaugaagaugcuacuuu

SEQ ID NO: 1444448 - RNA, 19 nt, Homo sapiens
acaagacacuccaaaccuu

SEQ ID NO: 1444449 - RNA, 19 nt, Homo sapiens
gaaaugucugccuguuuaa

SEQ ID NO: 1444450 - RNA, 19 nt, Homo sapiens
gacaaaacauggggaauuu

SEQ ID NO: 1444451 - RNA, 19 nt, Homo sapiens
gauuaaagacucuagcaau

SEQ ID NO: 1444452 - RNA, 19 nt, Homo sapiens
gaagaccuuuaauauggau

SEQ ID NO: 1444453 - RNA, 19 nt, Homo sapiens
ugccauagcaauuuacaua

SEQ ID NO: 1444454 - RNA, 19 nt, Homo sapiens
ggguucaugucccuaauau

SEQ ID NO: 1444455 - RNA, 19 nt, Homo sapiens
ugaaugaacagagcacuuu

SEQ ID NO: 1444456 - RNA, 19 nt, Homo sapiens
gaagaugcuacuuuagaau

SEQ ID NO: 1444457 - RNA, 19 nt, Homo sapiens
ucaaggacaagauuaaaga

SEQ ID NO: 1444458 - RNA, 19 nt, Homo sapiens
caagacacuccaaaccuuu

SEQ ID NO: 1444459 - RNA, 19 nt, Homo sapiens
caucuguaaucgcaucauu

SEQ ID NO: 1444460 - RNA, 19 nt, Homo sapiens
ucaggcaccauuugugaua

SEQ ID NO: 1444461 - RNA, 19 nt, Homo sapiens
gaaggagucaaucacaugu

SEQ ID NO: 1444462 - RNA, 19 nt, Homo sapiens
aaggaaauuugaagagaug

SEQ ID NO: 1444463 - RNA, 19 nt, Homo sapiens
caucaggcaccauuuguga

SEQ ID NO: 1444464 - RNA, 19 nt, Homo sapiens
ugaaagcuaccauucuuau

SEQ ID NO: 1444465 - RNA, 19 nt, Homo sapiens
ugaagaccuuuaauaugga

SEQ ID NO: 1444466 - RNA, 19 nt, Homo sapiens
gguaaaggaaauuugaaga

SEQ ID NO: 1444467 - RNA, 19 nt, Homo sapiens
agagaaguaaugauccuua

SEQ ID NO: 1444468 - RNA, 19 nt, Homo sapiens
caacuauggcucuaacugu

SEQ ID NO: 1444469 - RNA, 19 nt, Homo sapiens
auuaaagacucuagcaaug

SEQ ID NO: 1444470 - RNA, 19 nt, Homo sapiens
gaauauguaggacuuccaa

SEQ ID NO: 1444471 - RNA, 19 nt, Homo sapiens
auucgagucucuauguuaa

SEQ ID NO: 1444472 - RNA, 19 nt, Homo sapiens
aagcuaccauucuuauaug

SEQ ID NO: 1444473 - RNA, 19 nt, Homo sapiens
ccaagaaaucauccugaaa

SEQ ID NO: 1444474 - RNA, 19 nt, Homo sapiens
ggacaccuuucuuuuaaau

SEQ ID NO: 1444475 - RNA, 19 nt, Homo sapiens
cauaagaauggacaccuuu

SEQ ID NO: 1444476 - RNA, 19 nt, Homo sapiens
aaacuacauugccauagca

SEQ ID NO: 1444477 - RNA, 19 nt, Homo sapiens
acuccaaaccuuucagaua

SEQ ID NO: 1444478 - RNA, 19 nt, Homo sapiens
ccacaucaggcaccauuug

SEQ ID NO: 1444479 - RNA, 19 nt, Homo sapiens
auaaaguacugaagucaca

SEQ ID NO: 1444480 - RNA, 19 nt, Homo sapiens
uaaacuacauugccauagc

SEQ ID NO: 1444481 - RNA, 19 nt, Homo sapiens
guaaaggaaauuugaagag

SEQ ID NO: 1444482 - RNA, 19 nt, Homo sapiens
cauucgagucucuauguua

SEQ ID NO: 1444483 - RNA, 19 nt, Homo sapiens
uaucaaaagugccaacuau

SEQ ID NO: 1444484 - RNA, 19 nt, Homo sapiens
cagauggucauaucgcuuu

SEQ ID NO: 1444485 - RNA, 19 nt, Homo sapiens
uccaagaaaucauccugaa

SEQ ID NO: 1444486 - RNA, 19 nt, Homo sapiens
ggacuuccaagaaaucauc

SEQ ID NO: 1444487 - RNA, 19 nt, Homo sapiens
gccauagcaauuuacauaa

SEQ ID NO: 1444488 - RNA, 19 nt, Homo sapiens
ccacuucaggaaauucuuu

SEQ ID NO: 1444489 - RNA, 19 nt, Homo sapiens
caagccacuucaggaaauu

SEQ ID NO: 1444490 - RNA, 19 nt, Homo sapiens
ccuuucagauaacaaacua

SEQ ID NO: 1444491 - RNA, 19 nt, Homo sapiens
agugauggaugcuagagaa

SEQ ID NO: 1444492 - RNA, 19 nt, Homo sapiens
ucauaagaauggacaccuu

SEQ ID NO: 1444493 - RNA, 19 nt, Homo sapiens
ucaugucccuaauauaagu

SEQ ID NO: 1444494 - RNA, 19 nt, Homo sapiens
ggagcaaaauucagcuuga

SEQ ID NO: 1444495 - RNA, 19 nt, Homo sapiens
cguaaugaggcuuguaauu

SEQ ID NO: 1444496 - RNA, 19 nt, Homo sapiens
ugaaugggcagccaaauac

SEQ ID NO: 1444497 - RNA, 19 nt, Homo sapiens
gaaugcugcagauuuacaa

SEQ ID NO: 1444498 - RNA, 19 nt, Homo sapiens
ugaaggagacuggagcaaa

SEQ ID NO: 1444499 - RNA, 19 nt, Homo sapiens
ggcuuguaauucuugauaa

SEQ ID NO: 1444500 - RNA, 19 nt, Homo sapiens
gaagcuggaggaauagauc

SEQ ID NO: 1444501 - RNA, 19 nt, Homo sapiens
ggaaugcugcagauuuaca

SEQ ID NO: 1444502 - RNA, 19 nt, Homo sapiens
ugacgggaaugcugcagau

SEQ ID NO: 1444503 - RNA, 19 nt, Homo sapiens
gaaauuugaagagaugaca

SEQ ID NO: 1444504 - RNA, 19 nt, Homo sapiens
ucaaauggcuuccuaauug

SEQ ID NO: 1444505 - RNA, 19 nt, Homo sapiens
gaaacagaaucaccuagua

SEQ ID NO: 1444506 - RNA, 19 nt, Homo sapiens
uagaagagguuuacacuuu

SEQ ID NO: 1444507 - RNA, 19 nt, Homo sapiens
gaagcaagcuggacaacau

SEQ ID NO: 1444508 - RNA, 19 nt, Homo sapiens
uaaauagaguggugucuuu

SEQ ID NO: 1444509 - RNA, 19 nt, Homo sapiens
ucagaaacauggacaagaa

SEQ ID NO: 1444510 - RNA, 19 nt, Homo sapiens
gggcgcagauauaauuuaa

SEQ ID NO: 1444511 - RNA, 19 nt, Homo sapiens
gaagagguuuacacuuuau

SEQ ID NO: 1444512 - RNA, 19 nt, Homo sapiens
agaagagguuuacacuuua

SEQ ID NO: 1444513 - RNA, 19 nt, Homo sapiens
ccaacaugcugaccaauga

SEQ ID NO: 1444514 - RNA, 19 nt, Homo sapiens
gaacauuucuuuuccauuc

SEQ ID NO: 1444515 - RNA, 19 nt, Homo sapiens
gggcacaguuggagaaguu

SEQ ID NO: 1444516 - RNA, 19 nt, Homo sapiens
gaacuaauccauggaacaa

SEQ ID NO: 1444517 - RNA, 19 nt, Homo sapiens
ggacaacauucuuauuacu

SEQ ID NO: 1444518 - RNA, 19 nt, Homo sapiens
ccaggaacaucaacagaga

SEQ ID NO: 1444519 - RNA, 19 nt, Homo sapiens
gaaaagcaccugucaaaug

SEQ ID NO: 1444520 - RNA, 19 nt, Homo sapiens
uggagugccugaaauauug

SEQ ID NO: 1444521 - RNA, 19 nt, Homo sapiens
ccgaagagcucccgcuugu

SEQ ID NO: 1444522 - RNA, 19 nt, Homo sapiens
gcugaccaaugaacuuaaa

SEQ ID NO: 1444523 - RNA, 19 nt, Homo sapiens
caggaugacuuugugaauu

SEQ ID NO: 1444524 - RNA, 19 nt, Homo sapiens
gaacuugaauuaucauccu

SEQ ID NO: 1444525 - RNA, 19 nt, Homo sapiens
cagaaugguuugaugugaa

SEQ ID NO: 1444526 - RNA, 19 nt, Homo sapiens
aggaugacuuugugaauuu

SEQ ID NO: 1444527 - RNA, 19 nt, Homo sapiens
gaagagcucccgcuugucu

SEQ ID NO: 1444528 - RNA, 19 nt, Homo sapiens
gccaccaucucuagccaua

SEQ ID NO: 1444529 - RNA, 19 nt, Homo sapiens
agaaguuccuggcaagaaa

SEQ ID NO: 1444530 - RNA, 19 nt, Homo sapiens
uaagaagugucuggucuau

SEQ ID NO: 1444531 - RNA, 19 nt, Homo sapiens
gcuaugaaaccuaucagaa

SEQ ID NO: 1444532 - RNA, 19 nt, Homo sapiens
agaaauacaugugaagcaa

SEQ ID NO: 1444533 - RNA, 19 nt, Homo sapiens
caguucacauagagaaaua

SEQ ID NO: 1444534 - RNA, 19 nt, Homo sapiens
agaaugguuugaugugaaa

SEQ ID NO: 1444535 - RNA, 19 nt, Homo sapiens
ccagaaugguuugauguga

SEQ ID NO: 1444536 - RNA, 19 nt, Homo sapiens
cuuccuaauugcagaaaua

SEQ ID NO: 1444537 - RNA, 19 nt, Homo sapiens
cuggacaacauucuuauua

SEQ ID NO: 1444538 - RNA, 19 nt, Homo sapiens
gaacaucaacagagauuuu

SEQ ID NO: 1444539 - RNA, 19 nt, Homo sapiens
gagggaggccuaagaagug

SEQ ID NO: 1444540 - RNA, 19 nt, Homo sapiens
ucacauagagaaauacaug

SEQ ID NO: 1444541 - RNA, 19 nt, Homo sapiens
ggaagaguugucccuguuu

SEQ ID NO: 1444542 - RNA, 19 nt, Homo sapiens
acuaauccauggaacaauu

SEQ ID NO: 1444543 - RNA, 19 nt, Homo sapiens
ccugaaauauugauagaag

SEQ ID NO: 1444544 - RNA, 19 nt, Homo sapiens
gaagaguugucccuguuuu

SEQ ID NO: 1444545 - RNA, 19 nt, Homo sapiens
ggucuacaguuucgaaguc

SEQ ID NO: 1444546 - RNA, 19 nt, Homo sapiens
ccugggaacuugaauuauc

SEQ ID NO: 1444547 - RNA, 19 nt, Homo sapiens
cuaugaaaccuaucagaaa

SEQ ID NO: 1444548 - RNA, 19 nt, Homo sapiens
agaaucaccuaguauugga

SEQ ID NO: 1444549 - RNA, 19 nt, Homo sapiens
gaaaacgggaccucuuuaa

SEQ ID NO: 1444550 - RNA, 19 nt, Homo sapiens
aaacagaaucaccuaguau

SEQ ID NO: 1444551 - RNA, 19 nt, Homo sapiens
caccaucucuagccauaau

SEQ ID NO: 1444552 - RNA, 19 nt, Homo sapiens
uaugaaaccuaucagaaac

SEQ ID NO: 1444553 - RNA, 19 nt, Homo sapiens
gagaaguuccuggcaagaa

SEQ ID NO: 1444554 - RNA, 19 nt, Homo sapiens
gcaccugucaaauggcuuu

SEQ ID NO: 1444555 - RNA, 19 nt, Homo sapiens
ccuaauugcagaaauauuc

SEQ ID NO: 1444556 - RNA, 19 nt, Homo sapiens
caaauggcuuccuaauugc

SEQ ID NO: 1444557 - RNA, 19 nt, Homo sapiens
ccuaguauuggauguauuu

SEQ ID NO: 1444558 - RNA, 19 nt, Homo sapiens
caaagaaaauuaggcagaa

SEQ ID NO: 1444559 - RNA, 19 nt, Homo sapiens
ggacuauagcuaccagaug

SEQ ID NO: 1444560 - RNA, 19 nt, Homo sapiens
gauagaagagguuuacacu

SEQ ID NO: 1444561 - RNA, 19 nt, Homo sapiens
gaaaccaacagugggagaa

SEQ ID NO: 1444562 - RNA, 19 nt, Homo sapiens
guuuccaggucuacaguuu

SEQ ID NO: 1444563 - RNA, 19 nt, Homo sapiens
gagaaauacaugugaagca

SEQ ID NO: 1444564 - RNA, 19 nt, Homo sapiens
aaagaaacagaaucaccua

SEQ ID NO: 1444565 - RNA, 19 nt, Homo sapiens
gcggaguuccucauccuuu

SEQ ID NO: 1444566 - RNA, 19 nt, Homo sapiens
aagcuggacaacauucuua

SEQ ID NO: 1444567 - RNA, 19 nt, Homo sapiens
gcugaggucucgccccaua

SEQ ID NO: 1444568 - RNA, 19 nt, Homo sapiens
aggaagaguugucccuguu

SEQ ID NO: 1444569 - RNA, 19 nt, Homo sapiens
acuaagcaaucccaacaug

SEQ ID NO: 1444570 - RNA, 19 nt, Homo sapiens
cauagagaaauacauguga

SEQ ID NO: 1444571 - RNA, 19 nt, Homo sapiens
agaagugucuggucuaucc

SEQ ID NO: 1444572 - RNA, 19 nt, Homo sapiens
gaaaauugaauccagaaug

SEQ ID NO: 1444573 - RNA, 19 nt, Homo sapiens
ggaugacuuugugaauuuc

SEQ ID NO: 1444574 - RNA, 19 nt, Homo sapiens
gaagaagugaugccaccau

SEQ ID NO: 1444575 - RNA, 19 nt, Homo sapiens
gcaguucacauagagaaau

SEQ ID NO: 1444576 - RNA, 19 nt, Homo sapiens
aaagaacuaauccauggaa

SEQ ID NO: 1444577 - RNA, 19 nt, Homo sapiens
cgagggaggccuaagaagu

SEQ ID NO: 1444578 - RNA, 19 nt, Homo sapiens
aaaagcaccugucaaaugg

SEQ ID NO: 1444579 - RNA, 19 nt, Homo sapiens
gguggcaguucacauagag

SEQ ID NO: 1444580 - RNA, 19 nt, Homo sapiens
aaacgggaccucuuuaaaa

SEQ ID NO: 1444581 - RNA, 19 nt, Homo sapiens
caccuaguauuggauguau

SEQ ID NO: 1444582 - RNA, 19 nt, Homo sapiens
cugggaacuugaauuauca

SEQ ID NO: 1444583 - RNA, 19 nt, Homo sapiens
acagaaucaccuaguauug

SEQ ID NO: 1444584 - RNA, 19 nt, Homo sapiens
cagaaacauggacaagaaa

SEQ ID NO: 1444585 - RNA, 19 nt, Homo sapiens
ugaaaccuaucagaaacau

SEQ ID NO: 1444586 - RNA, 19 nt, Homo sapiens
cggcagcccuagacaaguc

SEQ ID NO: 1444587 - RNA, 19 nt, Homo sapiens
caguuucgaagucuauuaa

SEQ ID NO: 1444588 - RNA, 19 nt, Homo sapiens
ucucuagccauaauaaaga

SEQ ID NO: 1444589 - RNA, 19 nt, Homo sapiens
aaauggcuuugaagaagug

SEQ ID NO: 1444590 - RNA, 19 nt, Homo sapiens
ugccugaaauauugauaga

SEQ ID NO: 1444591 - RNA, 19 nt, Homo sapiens
ucuuauuacucugcuauga

SEQ ID NO: 1444592 - RNA, 19 nt, Homo sapiens
uggacaacauucuuauuac

SEQ ID NO: 1444593 - RNA, 19 nt, Homo sapiens
ccaacagugggagaaguua

SEQ ID NO: 1444594 - RNA, 19 nt, Homo sapiens
aauccagaaugguuugaug

SEQ ID NO: 1444595 - RNA, 19 nt, Homo sapiens
caacaugcugaccaaugaa

SEQ ID NO: 1444596 - RNA, 19 nt, Homo sapiens
aaaggguauuugacacaga

SEQ ID NO: 1444597 - RNA, 19 nt, Homo sapiens
guuucgaagucuauuaaag

SEQ ID NO: 1444598 - RNA, 19 nt, Homo sapiens
aagcuggagugccugaaau

SEQ ID NO: 1444599 - RNA, 19 nt, Homo sapiens
cuaagaagugucuggucua

SEQ ID NO: 1444600 - RNA, 19 nt, Homo sapiens
acucugcuaugaaaccuau

SEQ ID NO: 1444601 - RNA, 19 nt, Homo sapiens
uuacuaagcaaucccaaca

SEQ ID NO: 1444602 - RNA, 19 nt, Homo sapiens
ccaucucuagccauaauaa

SEQ ID NO: 1444603 - RNA, 19 nt, Homo sapiens
ggagaaguuccuggcaaga

SEQ ID NO: 1444604 - RNA, 19 nt, Homo sapiens
gcacaaagcuguuuauuac

SEQ ID NO: 1444605 - RNA, 19 nt, Homo sapiens
gcauauggcugcuuguuaa

SEQ ID NO: 1444606 - RNA, 19 nt, Homo sapiens
gcacaacucgcaaauauaa

SEQ ID NO: 1444607 - RNA, 19 nt, Homo sapiens
gagaagcucuuuauauuca

SEQ ID NO: 1444608 - RNA, 19 nt, Homo sapiens
gccaugggcucauuccuua

SEQ ID NO: 1444609 - RNA, 19 nt, Homo sapiens
gaaugaaauuggacaagaa

SEQ ID NO: 1444610 - RNA, 19 nt, Homo sapiens
gaacacaaaucagcaagga

SEQ ID NO: 1444611 - RNA, 19 nt, Homo sapiens
gaaagcagagcauauuaaa

SEQ ID NO: 1444612 - RNA, 19 nt, Homo sapiens
gaacagaacacagcugaaa

SEQ ID NO: 1444613 - RNA, 19 nt, Homo sapiens
ggaaugaaauuggacaaga

SEQ ID NO: 1444614 - RNA, 19 nt, Homo sapiens
gcaacaagaagaagacuuu

SEQ ID NO: 1444615 - RNA, 19 nt, Homo sapiens
guggaaugcugucacuuua

SEQ ID NO: 1444616 - RNA, 19 nt, Homo sapiens
gccagauucucuacucuua

SEQ ID NO: 1444617 - RNA, 19 nt, Homo sapiens
gaggaagucucucgcuuug

SEQ ID NO: 1444618 - RNA, 19 nt, Homo sapiens
gaaacaugcucaccagaca

SEQ ID NO: 1444619 - RNA, 19 nt, Homo sapiens
ggacuugcccuguaugauu

SEQ ID NO: 1444620 - RNA, 19 nt, Homo sapiens
gagaaagcagagcauauua

SEQ ID NO: 1444621 - RNA, 19 nt, Homo sapiens
gcagcaggguucuucauug

SEQ ID NO: 1444622 - RNA, 19 nt, Homo sapiens
gaagagagaagggaugauu

SEQ ID NO: 1444623 - RNA, 19 nt, Homo sapiens
aguaagagguaucaucuaa

SEQ ID NO: 1444624 - RNA, 19 nt, Homo sapiens
cauaaacacuccuucuuuc

SEQ ID NO: 1444625 - RNA, 19 nt, Homo sapiens
ggagguccauggcugcuuu

SEQ ID NO: 1444626 - RNA, 19 nt, Homo sapiens
ugacucaccucauucagaa

SEQ ID NO: 1444627 - RNA, 19 nt, Homo sapiens
ggaagucucucgcuuugca

SEQ ID NO: 1444628 - RNA, 19 nt, Homo sapiens
ggagaugccuuugcuguca

SEQ ID NO: 1444629 - RNA, 19 nt, Homo sapiens
gggaaacucuggauucaca

SEQ ID NO: 1444630 - RNA, 19 nt, Homo sapiens
ggaaugcugucacuuuaag

SEQ ID NO: 1444631 - RNA, 19 nt, Homo sapiens
gguuuaaucuugucucaug

SEQ ID NO: 1444632 - RNA, 19 nt, Homo sapiens
gggagcaucugaagagaga

SEQ ID NO: 1444633 - RNA, 19 nt, Homo sapiens
cagaaaccauugaucuauu

SEQ ID NO: 1444634 - RNA, 19 nt, Homo sapiens
uaagagguaucaucuaagu

SEQ ID NO: 1444635 - RNA, 19 nt, Homo sapiens
ggagaauguagaagaguua

SEQ ID NO: 1444636 - RNA, 19 nt, Homo sapiens
acacaaaucagcaaggaua

SEQ ID NO: 1444637 - RNA, 19 nt, Homo sapiens
cuagaagacuugugggaaa

SEQ ID NO: 1444638 - RNA, 19 nt, Homo sapiens
gagcaagagccagacauua

SEQ ID NO: 1444639 - RNA, 19 nt, Homo sapiens
gacuugcccuguaugauuu

SEQ ID NO: 1444640 - RNA, 19 nt, Homo sapiens
gggacucgguuuaaucuug

SEQ ID NO: 1444641 - RNA, 19 nt, Homo sapiens
gcagaaaccauugaucuau

SEQ ID NO: 1444642 - RNA, 19 nt, Homo sapiens
aagcagagcauauuaaaga

SEQ ID NO: 1444643 - RNA, 19 nt, Homo sapiens
ggagguggauucugaaagg

SEQ ID NO: 1444644 - RNA, 19 nt, Homo sapiens
ggcagagacugaaggauga

SEQ ID NO: 1444645 - RNA, 19 nt, Homo sapiens
gccaguaccugcaccagaa

SEQ ID NO: 1444646 - RNA, 19 nt, Homo sapiens
gaaagaagauggaaaacca

SEQ ID NO: 1444647 - RNA, 19 nt, Homo sapiens
gcacagacagcccgcauau

SEQ ID NO: 1444648 - RNA, 19 nt, Homo sapiens
gcucauuccuuauuugcuu

SEQ ID NO: 1444649 - RNA, 19 nt, Homo sapiens
ggaugaagaccaaauggaa

SEQ ID NO: 1444650 - RNA, 19 nt, Homo sapiens
cagagcauauuaaagaaga

SEQ ID NO: 1444651 - RNA, 19 nt, Homo sapiens
ggaggaggcagaagaguug

SEQ ID NO: 1444652 - RNA, 19 nt, Homo sapiens
gcaagugggagaugccuuu

SEQ ID NO: 1444653 - RNA, 19 nt, Homo sapiens
agagagagaugauggcaau

SEQ ID NO: 1444654 - RNA, 19 nt, Homo sapiens
ggaguacgaucggaagaug

SEQ ID NO: 1444655 - RNA, 19 nt, Homo sapiens
ggacucgguuuaaucuugu

SEQ ID NO: 1444656 - RNA, 19 nt, Homo sapiens
gauaagcagaggauuagaa

SEQ ID NO: 1444657 - RNA, 19 nt, Homo sapiens
gcagaagaguugcugaaac

SEQ ID NO: 1444658 - RNA, 19 nt, Homo sapiens
gaagugcaucgaagacaaa

SEQ ID NO: 1444659 - RNA, 19 nt, Homo sapiens
agacgagaguugcuacaaa

SEQ ID NO: 1444660 - RNA, 19 nt, Homo sapiens
guaccuggaugaagaccaa

SEQ ID NO: 1444661 - RNA, 19 nt, Homo sapiens
gaauguagaagaguuaaug

SEQ ID NO: 1444662 - RNA, 19 nt, Homo sapiens
cagauucucuacucuuaug

SEQ ID NO: 1444663 - RNA, 19 nt, Homo sapiens
gaagcucuuuauauucaga

SEQ ID NO: 1444664 - RNA, 19 nt, Homo sapiens
ucagagagaggaugauauu

SEQ ID NO: 1444665 - RNA, 19 nt, Homo sapiens
ccagcugacucaccucauu

SEQ ID NO: 1444666 - RNA, 19 nt, Homo sapiens
gagagaugauggcaaugga

SEQ ID NO: 1444667 - RNA, 19 nt, Homo sapiens
ggacauuucaagagaaguu

SEQ ID NO: 1444668 - RNA, 19 nt, Homo sapiens
caucguaccuggcgaggau

SEQ ID NO: 1444669 - RNA, 19 nt, Homo sapiens
agagguaucaucuaaguaa

SEQ ID NO: 1444670 - RNA, 19 nt, Homo sapiens
gaaaccagaggcagcuaaa

SEQ ID NO: 1444671 - RNA, 19 nt, Homo sapiens
ggaagcaccacuuggaaug

SEQ ID NO: 1444672 - RNA, 19 nt, Homo sapiens
gaaagucacgguccaagag

SEQ ID NO: 1444673 - RNA, 19 nt, Homo sapiens
gaugaagaccaaauggaaa

SEQ ID NO: 1444674 - RNA, 19 nt, Homo sapiens
gagguaucaucuaaguaaa

SEQ ID NO: 1444675 - RNA, 19 nt, Homo sapiens
gauauucucuggaaaagga

SEQ ID NO: 1444676 - RNA, 19 nt, Homo sapiens
gaacagugucgugcuagaa

SEQ ID NO: 1444677 - RNA, 19 nt, Homo sapiens
aaaggcaggucucuacugu

SEQ ID NO: 1444678 - RNA, 19 nt, Homo sapiens
uaagagaagacgagaguug

SEQ ID NO: 1444679 - RNA, 19 nt, Homo sapiens
uagaagaguuaauggacuu

SEQ ID NO: 1444680 - RNA, 19 nt, Homo sapiens
ggugagaggucugcuguag

SEQ ID NO: 1444681 - RNA, 19 nt, Homo sapiens
augcacaacucgcaaauau

SEQ ID NO: 1444682 - RNA, 19 nt, Homo sapiens
caagagaaagcagagcaua

SEQ ID NO: 1444683 - RNA, 19 nt, Homo sapiens
acagaacagugucgugcua

SEQ ID NO: 1444684 - RNA, 19 nt, Homo sapiens
cugcagaacucagccauga

SEQ ID NO: 1444685 - RNA, 19 nt, Homo sapiens
ugagaggucugcuguagag

SEQ ID NO: 1444686 - RNA, 19 nt, Homo sapiens
uccaaaugcuucuccguuu

SEQ ID NO: 1444687 - RNA, 19 nt, Homo sapiens
acauaaacacuccuucuuu

SEQ ID NO: 1444688 - RNA, 19 nt, Homo sapiens
gagcugguggcaagccuua

SEQ ID NO: 1444689 - RNA, 19 nt, Homo sapiens
aaauggaaaugcuauugga

SEQ ID NO: 1444690 - RNA, 19 nt, Homo sapiens
aaugaggaccuuucccuua

SEQ ID NO: 1444691 - RNA, 19 nt, Homo sapiens
ucucaugaauuuccagaug

SEQ ID NO: 1444692 - RNA, 19 nt, Homo sapiens
agaaagcagagcauauuaa

SEQ ID NO: 1444693 - RNA, 19 nt, Homo sapiens
agacauuacuggagcaaca

SEQ ID NO: 1444694 - RNA, 19 nt, Homo sapiens
cagaagaguugcugaaacg

SEQ ID NO: 1444695 - RNA, 19 nt, Homo sapiens
augaggaccuuucccuuaa

SEQ ID NO: 1444696 - RNA, 19 nt, Homo sapiens
ggacauaaacacuccuucu

SEQ ID NO: 1444697 - RNA, 19 nt, Homo sapiens
ggcccacucucuuccauau

SEQ ID NO: 1444698 - RNA, 19 nt, Homo sapiens
cuaaaaugcugcugcaaaa

SEQ ID NO: 1444699 - RNA, 19 nt, Homo sapiens
gaagaugguggcauugaca

SEQ ID NO: 1444700 - RNA, 19 nt, Homo sapiens
gacaucggguuuggcagua

SEQ ID NO: 1444701 - RNA, 19 nt, Homo sapiens
ggagcaacaucagcagugu

SEQ ID NO: 1444702 - RNA, 19 nt, Homo sapiens
gagggaggcuuugcacagu

SEQ ID NO: 1444703 - RNA, 19 nt, Homo sapiens
ggaaaagguucgaggugaa

SEQ ID NO: 1444704 - RNA, 19 nt, Homo sapiens
cagcaacacugaagaauua

SEQ ID NO: 1444705 - RNA, 19 nt, Homo sapiens
ccaaagauauaaccaagaa

SEQ ID NO: 1444706 - RNA, 19 nt, Homo sapiens
cgaaugcgaucaaaccuaa

SEQ ID NO: 1444707 - RNA, 19 nt, Homo sapiens
ggcaagaauugguguuaua

SEQ ID NO: 1444708 - RNA, 19 nt, Homo sapiens
acaaccagcuuccaguuua

SEQ ID NO: 1444709 - RNA, 19 nt, Homo sapiens
uaacuaagcuugcauuuug

SEQ ID NO: 1444710 - RNA, 19 nt, Homo sapiens
gaauugguguuauaucuuc

SEQ ID NO: 1444711 - RNA, 19 nt, Homo sapiens
gcccaugcuucauuguuua

SEQ ID NO: 1444712 - RNA, 19 nt, Homo sapiens
gacuuacccucuuggauuu

SEQ ID NO: 1444713 - RNA, 19 nt, Homo sapiens
ggauagacuuacccucuug

SEQ ID NO: 1444714 - RNA, 19 nt, Homo sapiens
aaaugacucuucaggaauu

SEQ ID NO: 1444715 - RNA, 19 nt, Homo sapiens
cagaguagcuguauguuuu

SEQ ID NO: 1444716 - RNA, 19 nt, Homo sapiens
guacuuagaggagaucuuu

SEQ ID NO: 1444717 - RNA, 19 nt, Homo sapiens
gaaaugacucuucaggaau

SEQ ID NO: 1444718 - RNA, 19 nt, Homo sapiens
gguguuauaucuucagcaa

SEQ ID NO: 1444719 - RNA, 19 nt, Homo sapiens
ugaggaguguuccguauau

SEQ ID NO: 1444720 - RNA, 19 nt, Homo sapiens
guucugugcuacaaauuga

SEQ ID NO: 1444721 - RNA, 19 nt, Homo sapiens
gcuguuacacugugacuuu

SEQ ID NO: 1444722 - RNA, 19 nt, Homo sapiens
ggaguguuccguauauuau

SEQ ID NO: 1444723 - RNA, 19 nt, Homo sapiens
cuacaagacugugguuaau

SEQ ID NO: 1444724 - RNA, 19 nt, Homo sapiens
gggauagacuuacccucuu

SEQ ID NO: 1444725 - RNA, 19 nt, Homo sapiens
gcaagaauugguguuauau

SEQ ID NO: 1444726 - RNA, 19 nt, Homo sapiens
gcuacaaauugauguuuag

SEQ ID NO: 1444727 - RNA, 19 nt, Homo sapiens
gcaacacugaagaauuaua

SEQ ID NO: 1444728 - RNA, 19 nt, Homo sapiens
agacuuacccucuuggauu

SEQ ID NO: 1444729 - RNA, 19 nt, Homo sapiens
gguuaaugcugcuucugaa

SEQ ID NO: 1444730 - RNA, 19 nt, Homo sapiens
gcaagguuucucagucuuu

SEQ ID NO: 1444731 - RNA, 19 nt, Homo sapiens
gggcaagaauugguguuau

SEQ ID NO: 1444732 - RNA, 19 nt, Homo sapiens
uugcuaagguucugugcua

SEQ ID NO: 1444733 - RNA, 19 nt, Homo sapiens
caacaaccagcuuccaguu

SEQ ID NO: 1444734 - RNA, 19 nt, Homo sapiens
caagguuucucagucuuug

SEQ ID NO: 1444735 - RNA, 19 nt, Homo sapiens
gaggaguguuccguauauu

SEQ ID NO: 1444736 - RNA, 19 nt, Homo sapiens
uaauguaagucuggauguu

SEQ ID NO: 1444737 - RNA, 19 nt, Homo sapiens
gauauaaccaagaaacucu

SEQ ID NO: 1444738 - RNA, 19 nt, Homo sapiens
uaaaugauugccaaccaaa

SEQ ID NO: 1444739 - RNA, 19 nt, Homo sapiens
uuaaaugauugccaaccaa

SEQ ID NO: 1444740 - RNA, 19 nt, Homo sapiens
cuggauguuucaauuguuu

SEQ ID NO: 1444741 - RNA, 19 nt, Homo sapiens
guaccuaucgagccagauu

SEQ ID NO: 1444742 - RNA, 19 nt, Homo sapiens
caaccaaagauauaaccaa

SEQ ID NO: 1444743 - RNA, 19 nt, Homo sapiens
gcaccucccagucauaaca

SEQ ID NO: 1444744 - RNA, 19 nt, Homo sapiens
ccuacaagacugugguuaa

SEQ ID NO: 1444745 - RNA, 19 nt, Homo sapiens
cagaucuguuagccuuaua

SEQ ID NO: 1444746 - RNA, 19 nt, Homo sapiens
ucucccaucuggauuccua

SEQ ID NO: 1444747 - RNA, 19 nt, Homo sapiens
acaagacugugguuaaugc

SEQ ID NO: 1444748 - RNA, 19 nt, Homo sapiens
gugaggaguguuccguaua

SEQ ID NO: 1444749 - RNA, 19 nt, Homo sapiens
ucaccaccgucauuaucaa

SEQ ID NO: 1444750 - RNA, 19 nt, Homo sapiens
cuucaggaauuggugcaua

SEQ ID NO: 1444751 - RNA, 19 nt, Homo sapiens
cagauucaccaccgucauu

SEQ ID NO: 1444752 - RNA, 19 nt, Homo sapiens
uuaaugcugcuucugaauu

SEQ ID NO: 1444753 - RNA, 19 nt, Homo sapiens
caaccagcuuccaguuuac

SEQ ID NO: 1444754 - RNA, 19 nt, Homo sapiens
ccgcgagacuugcuaaggu

SEQ ID NO: 1444755 - RNA, 19 nt, Homo sapiens
cuaagguucugugcuacaa

SEQ ID NO: 1444756 - RNA, 19 nt, Homo sapiens
aggaguguuccguauauua

SEQ ID NO: 1444757 - RNA, 19 nt, Homo sapiens
cacugugacuuucaaggaa

SEQ ID NO: 1444758 - RNA, 19 nt, Homo sapiens
caaauuuucugcuguuaca

SEQ ID NO: 1444759 - RNA, 19 nt, Homo sapiens
gcuaaauguggcaagguuu

SEQ ID NO: 1444760 - RNA, 19 nt, Homo sapiens
agucccggcugcuuaugua

SEQ ID NO: 1444761 - RNA, 19 nt, Homo sapiens
aaagagacugguacuuaga

SEQ ID NO: 1444762 - RNA, 19 nt, Homo sapiens
uccuaagucugcuaaaugu

SEQ ID NO: 1444763 - RNA, 19 nt, Homo sapiens
gaaacauuccuuccuucuc

SEQ ID NO: 1444764 - RNA, 19 nt, Homo sapiens
guuacacugugacuuucaa

SEQ ID NO: 1444765 - RNA, 19 nt, Homo sapiens
uucaggaauuggugcauaa

SEQ ID NO: 1444766 - RNA, 19 nt, Homo sapiens
gugagccacuauucuguag

SEQ ID NO: 1444767 - RNA, 19 nt, Homo sapiens
ccaucuggauuccuaaguc

SEQ ID NO: 1444768 - RNA, 19 nt, Homo sapiens
ccaagucccggcugcuuau

SEQ ID NO: 1444769 - RNA, 19 nt, Homo sapiens
agcccaugcuucauuguuu

SEQ ID NO: 1444770 - RNA, 19 nt, Homo sapiens
uagcaccucccagucauaa

SEQ ID NO: 1444771 - RNA, 19 nt, Homo sapiens
aagucuggauguuucaauu

SEQ ID NO: 1444772 - RNA, 19 nt, Homo sapiens
aaaagagacugguacuuag

SEQ ID NO: 1444773 - RNA, 19 nt, Homo sapiens
guagcaccucccagucaua

SEQ ID NO: 1444774 - RNA, 19 nt, Homo sapiens
ugugaggaguguuccguau

SEQ ID NO: 1444775 - RNA, 19 nt, Homo sapiens
ggcaagguuucucagucuu

SEQ ID NO: 1444776 - RNA, 19 nt, Homo sapiens
caucuggauuccuaagucu

SEQ ID NO: 1444777 - RNA, 19 nt, Homo sapiens
caagaugcagcccaugcuu

SEQ ID NO: 1444778 - RNA, 19 nt, Homo sapiens
uggcaagguuucucagucu

SEQ ID NO: 1444779 - RNA, 19 nt, Homo sapiens
aagguucugugcuacaaau

SEQ ID NO: 1444780 - RNA, 19 nt, Homo sapiens
caagaauugguguuauauc

SEQ ID NO: 1444781 - RNA, 19 nt, Homo sapiens
ugauugccaaccaaagaua

SEQ ID NO: 1444782 - RNA, 19 nt, Homo sapiens
cgcgagacuugcuaagguu

SEQ ID NO: 1444783 - RNA, 19 nt, Homo sapiens
gaucuguuagccuuauaau

SEQ ID NO: 1444784 - RNA, 19 nt, Homo sapiens
ggauuccuaagucugcuaa

SEQ ID NO: 1444785 - RNA, 19 nt, Homo sapiens
auugaaacauuccuuccuu

SEQ ID NO: 1444786 - RNA, 19 nt, Homo sapiens
gucuggauguuucaauugu

SEQ ID NO: 1444787 - RNA, 19 nt, Homo sapiens
aaugauugccaaccaaaga

SEQ ID NO: 1444788 - RNA, 19 nt, Homo sapiens
cucagucuuugcacuauga

SEQ ID NO: 1444789 - RNA, 19 nt, Homo sapiens
cuacugccaaccugggaua

SEQ ID NO: 1444790 - RNA, 19 nt, Homo sapiens
acacugugacuuucaagga

SEQ ID NO: 1444791 - RNA, 19 nt, Homo sapiens
ccaguuuacuacaccuaca

SEQ ID NO: 1444792 - RNA, 19 nt, Homo sapiens
cuaaaggggaagaacauua

SEQ ID NO: 1444793 - RNA, 19 nt, Homo sapiens
ugcuaaauguggcaagguu

SEQ ID NO: 1444794 - RNA, 19 nt, Homo sapiens
aauguaagucuggauguuu

SEQ ID NO: 1444795 - RNA, 19 nt, Homo sapiens
gauugccaaccaaagauau

SEQ ID NO: 1444796 - RNA, 19 nt, Homo sapiens
ccgaaugcgaucaaaccua

SEQ ID NO: 1444797 - RNA, 19 nt, Homo sapiens
gugcuacaaauugauguuu

SEQ ID NO: 1444798 - RNA, 19 nt, Homo sapiens
ucuuugcacuaugacauuu

SEQ ID NO: 1444799 - RNA, 19 nt, Homo sapiens
cuaaauguggcaagguuuc

SEQ ID NO: 1444800 - RNA, 19 nt, Homo sapiens
gguucugugcuacaaauug

SEQ ID NO: 1444801 - RNA, 19 nt, Homo sapiens
gacgagcuauccgggaaag

SEQ ID NO: 1444802 - RNA, 19 nt, Homo sapiens
caguagcaccucccaguca

SEQ ID NO: 1444803 - RNA, 19 nt, Homo sapiens
agauucaccaccgucauua

SEQ ID NO: 1444804 - RNA, 19 nt, Homo sapiens
gaagauguguggguuauaa

SEQ ID NO: 1444805 - RNA, 19 nt, Homo sapiens
gaugguaucuucaauuaga

SEQ ID NO: 1444806 - RNA, 19 nt, Homo sapiens
gaaaagacaugguagauau

SEQ ID NO: 1444807 - RNA, 19 nt, Homo sapiens
aaaggaagcugaagaugaa

SEQ ID NO: 1444808 - RNA, 19 nt, Homo sapiens
gauagaagccaaauucauu

SEQ ID NO: 1444809 - RNA, 19 nt, Homo sapiens
gaaaucaguaugugaauga

SEQ ID NO: 1444810 - RNA, 19 nt, Homo sapiens
gaaagaagcaauggugaaa

SEQ ID NO: 1444811 - RNA, 19 nt, Homo sapiens
uggaagaacuugaauggaa

SEQ ID NO: 1444812 - RNA, 19 nt, Homo sapiens
uauagaauguggagggaua

SEQ ID NO: 1444813 - RNA, 19 nt, Homo sapiens
gaagaagauguguggguua

SEQ ID NO: 1444814 - RNA, 19 nt, Homo sapiens
gaucaagcaucccaaugug

SEQ ID NO: 1444815 - RNA, 19 nt, Homo sapiens
uaaaggaagcugaagauga

SEQ ID NO: 1444816 - RNA, 19 nt, Homo sapiens
ggaaaucaguaugugaaug

SEQ ID NO: 1444817 - RNA, 19 nt, Homo sapiens
auggaaagcucuuaagaaa

SEQ ID NO: 1444818 - RNA, 19 nt, Homo sapiens
gagcaauacagacugauuu

SEQ ID NO: 1444819 - RNA, 19 nt, Homo sapiens
gaaacacuucuauucauga

SEQ ID NO: 1444820 - RNA, 19 nt, Homo sapiens
gaagauacagaauggaaug

SEQ ID NO: 1444821 - RNA, 19 nt, Homo sapiens
caaugaagauacagaaugg

SEQ ID NO: 1444822 - RNA, 19 nt, Homo sapiens
gaaguuggagcaauacaga

SEQ ID NO: 1444823 - RNA, 19 nt, Homo sapiens
gaagcuagcagaaguugga

SEQ ID NO: 1444824 - RNA, 19 nt, Homo sapiens
gaauggaaagcucuuaaga

SEQ ID NO: 1444825 - RNA, 19 nt, Homo sapiens
uuuaagagauuucggcauu

SEQ ID NO: 1444826 - RNA, 19 nt, Homo sapiens
uuaaagccaucgugaauag

SEQ ID NO: 1444827 - RNA, 19 nt, Homo sapiens
ugaaugaagucacaaaugc

SEQ ID NO: 1444828 - RNA, 19 nt, Homo sapiens
ggaagcugaagaugaauuu

SEQ ID NO: 1444829 - RNA, 19 nt, Homo sapiens
caauguguuuguugguuaa

SEQ ID NO: 1444830 - RNA, 19 nt, Homo sapiens
gaagauaugcaggcuguug

SEQ ID NO: 1444831 - RNA, 19 nt, Homo sapiens
ucagauagaagccaaauuc

SEQ ID NO: 1444832 - RNA, 19 nt, Homo sapiens
caacagugauaaugaacca

SEQ ID NO: 1444833 - RNA, 19 nt, Homo sapiens
caugguagauaugauggua

SEQ ID NO: 1444834 - RNA, 19 nt, Homo sapiens
gaagaaaaccccagaaaag

SEQ ID NO: 1444835 - RNA, 19 nt, Homo sapiens
gauaaugaaccaaauagag

SEQ ID NO: 1444836 - RNA, 19 nt, Homo sapiens
gauacagaauggaaugaca

SEQ ID NO: 1444837 - RNA, 19 nt, Homo sapiens
agucacaaaugcagaagaa

SEQ ID NO: 1444838 - RNA, 19 nt, Homo sapiens
ugaaccaaauagagagaaa

SEQ ID NO: 1444839 - RNA, 19 nt, Homo sapiens
agcagaaguuggagcaaua

SEQ ID NO: 1444840 - RNA, 19 nt, Homo sapiens
gaauguggagggauaaauc

SEQ ID NO: 1444841 - RNA, 19 nt, Homo sapiens
acacuaccaugacaauugu

SEQ ID NO: 1444842 - RNA, 19 nt, Homo sapiens
ucacaaaugcagaagaaga

SEQ ID NO: 1444843 - RNA, 19 nt, Homo sapiens
aauacagacugauuuggaa

SEQ ID NO: 1444844 - RNA, 19 nt, Homo sapiens
caauacagacugauuugga

SEQ ID NO: 1444845 - RNA, 19 nt, Homo sapiens
ccaaugaagauacagaaug

SEQ ID NO: 1444846 - RNA, 19 nt, Homo sapiens
gcuccaacagugauaauga

SEQ ID NO: 1444847 - RNA, 19 nt, Homo sapiens
ggagcaauacagacugauu

SEQ ID NO: 1444848 - RNA, 19 nt, Homo sapiens
aagaagcgguuacaggaau

SEQ ID NO: 1444849 - RNA, 19 nt, Homo sapiens
ggaagaaaaccccagaaaa

SEQ ID NO: 1444850 - RNA, 19 nt, Homo sapiens
guuaaagccaucgugaaua

SEQ ID NO: 1444851 - RNA, 19 nt, Homo sapiens
gaagcugaagaugaauuua

SEQ ID NO: 1444852 - RNA, 19 nt, Homo sapiens
gcuaaaggaagcugaagau

SEQ ID NO: 1444853 - RNA, 19 nt, Homo sapiens
gaagaaaugguuuuacguu

SEQ ID NO: 1444854 - RNA, 19 nt, Homo sapiens
caugacaauuguuuaccaa

SEQ ID NO: 1444855 - RNA, 19 nt, Homo sapiens
guauucaacacuaccauga

SEQ ID NO: 1444856 - RNA, 19 nt, Homo sapiens
uaaccagcaucuuagucuu

SEQ ID NO: 1444857 - RNA, 19 nt, Homo sapiens
aagaagauguguggguuau

SEQ ID NO: 1444858 - RNA, 19 nt, Homo sapiens
gaaaccauuugaaaagaug

SEQ ID NO: 1444859 - RNA, 19 nt, Homo sapiens
aauggaagcuagcagaagu

SEQ ID NO: 1444860 - RNA, 19 nt, Homo sapiens
gaaaugguuuuacguuuac

SEQ ID NO: 1444861 - RNA, 19 nt, Homo sapiens
uaagagauuucggcauucu

SEQ ID NO: 1444862 - RNA, 19 nt, Homo sapiens
caucuuagucuucuagcaa

SEQ ID NO: 1444863 - RNA, 19 nt, Homo sapiens
ucaagcaucccaauguguu

SEQ ID NO: 1444864 - RNA, 19 nt, Homo sapiens
caugcaggaucccaaugaa

SEQ ID NO: 1444865 - RNA, 19 nt, Homo sapiens
uagcagaaguuggagcaau

SEQ ID NO: 1444866 - RNA, 19 nt, Homo sapiens
gauguguggguuauaauuc

SEQ ID NO: 1444867 - RNA, 19 nt, Homo sapiens
ggaauggaaagcucuuaag

SEQ ID NO: 1444868 - RNA, 19 nt, Homo sapiens
gaugacucuugcacagcua

SEQ ID NO: 1444869 - RNA, 19 nt, Homo sapiens
gaaccaaauagagagaaau

SEQ ID NO: 1444870 - RNA, 19 nt, Homo sapiens
aaagacaugguagauauga

SEQ ID NO: 1444871 - RNA, 19 nt, Homo sapiens
gcuggaagaacuugaaugg

SEQ ID NO: 1444872 - RNA, 19 nt, Homo sapiens
gaaugaagucacaaaugca

SEQ ID NO: 1444873 - RNA, 19 nt, Homo sapiens
gauagcuccaacagugaua

SEQ ID NO: 1444874 - RNA, 19 nt, Homo sapiens
caagcaucccaauguguuu

SEQ ID NO: 1444875 - RNA, 19 nt, Homo sapiens
aauggaaagcucuuaagaa

SEQ ID NO: 1444876 - RNA, 19 nt, Homo sapiens
agaaagaagcaauggugaa

SEQ ID NO: 1444877 - RNA, 19 nt, Homo sapiens
cuccaacagugauaaugaa

SEQ ID NO: 1444878 - RNA, 19 nt, Homo sapiens
gguuuuacguuuacagaaa

SEQ ID NO: 1444879 - RNA, 19 nt, Homo sapiens
guggagggauaaaucucaa

SEQ ID NO: 1444880 - RNA, 19 nt, Homo sapiens
aaagaagagucaaaagaug

SEQ ID NO: 1444881 - RNA, 19 nt, Homo sapiens
agacugauuuggaagaaaa

SEQ ID NO: 1444882 - RNA, 19 nt, Homo sapiens
caacacuaccaugacaauu

SEQ ID NO: 1444883 - RNA, 19 nt, Homo sapiens
gauaugcaggcuguugaaa

SEQ ID NO: 1444884 - RNA, 19 nt, Homo sapiens
agacaugguagauaugaug

SEQ ID NO: 1444885 - RNA, 19 nt, Homo sapiens
acagacugauuuggaagaa

SEQ ID NO: 1444886 - RNA, 19 nt, Homo sapiens
gcaggaucccaaugaagau

SEQ ID NO: 1444887 - RNA, 19 nt, Homo sapiens
ccaugacaauuguuuacca

SEQ ID NO: 1444888 - RNA, 19 nt, Homo sapiens
cuaccaugacaauuguuua

SEQ ID NO: 1444889 - RNA, 19 nt, Homo sapiens
caaaugcagaagaagaugu

SEQ ID NO: 1444890 - RNA, 19 nt, Homo sapiens
ugaagucacaaaugcagaa

SEQ ID NO: 1444891 - RNA, 19 nt, Homo sapiens
gcgguuacaggaauggaaa

SEQ ID NO: 1444892 - RNA, 19 nt, Homo sapiens
gaauggaagcuagcagaag

SEQ ID NO: 1444893 - RNA, 19 nt, Homo sapiens
aaagaagcgguuacaggaa

SEQ ID NO: 1444894 - RNA, 19 nt, Homo sapiens
acagugauaaugaaccaaa

SEQ ID NO: 1444895 - RNA, 19 nt, Homo sapiens
ggaucccaaugaagauaca

SEQ ID NO: 1444896 - RNA, 19 nt, Homo sapiens
auagcuguauucaacacua

SEQ ID NO: 1444897 - RNA, 19 nt, Homo sapiens
gugauaaugaaccaaauag

SEQ ID NO: 1444898 - RNA, 19 nt, Homo sapiens
cagacugauuuggaagaaa

SEQ ID NO: 1444899 - RNA, 19 nt, Homo sapiens
ugaauggaagcuagcagaa

SEQ ID NO: 1444900 - RNA, 19 nt, Homo sapiens
gcaucuuagucuucuagca

SEQ ID NO: 1444901 - RNA, 19 nt, Homo sapiens
cacaaaugcagaagaagau

SEQ ID NO: 1444902 - RNA, 19 nt, Homo sapiens
cggcauucuuccuccuaaa

SEQ ID NO: 1444903 - RNA, 19 nt, Homo sapiens
gaaaaccccagaaaagaca

SEQ ID NO: 1444904 - RNA, 19 nt, Homo sapiens
gcaaagaccugguacacaa

SEQ ID NO: 1444905 - RNA, 19 nt, Homo sapiens
aaacugaagugucaagaaa

SEQ ID NO: 1444906 - RNA, 19 nt, Homo sapiens
acacaaaccuagccaauau

SEQ ID NO: 1444907 - RNA, 19 nt, Homo sapiens
gaagugaagcgucuuugua

SEQ ID NO: 1444908 - RNA, 19 nt, Homo sapiens
gaaagggaguaugaaguga

SEQ ID NO: 1444909 - RNA, 19 nt, Homo sapiens
gggcaguuguuauaaugua

SEQ ID NO: 1444910 - RNA, 19 nt, Homo sapiens
gcaccuauguaacgaaauc

SEQ ID NO: 1444911 - RNA, 19 nt, Homo sapiens
guacaggaaccuugggaua

SEQ ID NO: 1444912 - RNA, 19 nt, Homo sapiens
gauuguagaugaagaaacu

SEQ ID NO: 1444913 - RNA, 19 nt, Homo sapiens
caagaaagaacacagugaa

SEQ ID NO: 1444914 - RNA, 19 nt, Homo sapiens
ggaaaggccagccgguuug

SEQ ID NO: 1444915 - RNA, 19 nt, Homo sapiens
gguaaagugaacagaguua

SEQ ID NO: 1444916 - RNA, 19 nt, Homo sapiens
gaaaucauaccguaauaac

SEQ ID NO: 1444917 - RNA, 19 nt, Homo sapiens
gggaaaggccagccgguuu

SEQ ID NO: 1444918 - RNA, 19 nt, Homo sapiens
acaggaaccuugggauauu

SEQ ID NO: 1444919 - RNA, 19 nt, Homo sapiens
agaguuaucugugacauuc

SEQ ID NO: 1444920 - RNA, 19 nt, Homo sapiens
cgaaagggaguaugaagug

SEQ ID NO: 1444921 - RNA, 19 nt, Homo sapiens
uaacgaaaucauaccguaa

SEQ ID NO: 1444922 - RNA, 19 nt, Homo sapiens
cguauggagugccaagaaa

SEQ ID NO: 1444923 - RNA, 19 nt, Homo sapiens
gaaucuaucaaacucgaaa

SEQ ID NO: 1444924 - RNA, 19 nt, Homo sapiens
acgaaaucauaccguaaua

SEQ ID NO: 1444925 - RNA, 19 nt, Homo sapiens
ucucuuaauuucaguggaa

SEQ ID NO: 1444926 - RNA, 19 nt, Homo sapiens
cuaaggaaauucagcuucu

SEQ ID NO: 1444927 - RNA, 19 nt, Homo sapiens
guacacaaaccuagccaau

SEQ ID NO: 1444928 - RNA, 19 nt, Homo sapiens
cgaaaucauaccguaauaa

SEQ ID NO: 1444929 - RNA, 19 nt, Homo sapiens
uuuguaaacugaaguguca

SEQ ID NO: 1444930 - RNA, 19 nt, Homo sapiens
cagguaaagugaacagagu

SEQ ID NO: 1444931 - RNA, 19 nt, Homo sapiens
aagcgcggauuguagauga

SEQ ID NO: 1444932 - RNA, 19 nt, Homo sapiens
gaaaggccagccgguuuga

SEQ ID NO: 1444933 - RNA, 19 nt, Homo sapiens
ccaagaaagaacacaguga

SEQ ID NO: 1444934 - RNA, 19 nt, Homo sapiens
aagcgucuuuguaaacuga

SEQ ID NO: 1444935 - RNA, 19 nt, Homo sapiens
aagugaagcgucuuuguaa

SEQ ID NO: 1444936 - RNA, 19 nt, Homo sapiens
aaaccuagccaauaucaag

SEQ ID NO: 1444937 - RNA, 19 nt, Homo sapiens
caaagaccugguacacaaa

SEQ ID NO: 1444938 - RNA, 19 nt, Homo sapiens
cagcuucuccugagggaaa

SEQ ID NO: 1444939 - RNA, 19 nt, Homo sapiens
uaaacugaagugucaagaa

SEQ ID NO: 1444940 - RNA, 19 nt, Homo sapiens
gaagcgucuuuguaaacug

SEQ ID NO: 1444941 - RNA, 19 nt, Homo sapiens
caggaaccuugggauauug

SEQ ID NO: 1444942 - RNA, 19 nt, Homo sapiens
ccaucaggcaccuauguaa

SEQ ID NO: 1444943 - RNA, 19 nt, Homo sapiens
agugaagcgucuuuguaaa

SEQ ID NO: 1444944 - RNA, 19 nt, Homo sapiens
aaucauaccguaauaacuc

SEQ ID NO: 1444945 - RNA, 19 nt, Homo sapiens
uacacaaaccuagccaaua

SEQ ID NO: 1444946 - RNA, 19 nt, Homo sapiens
ugaagcgucuuuguaaacu

SEQ ID NO: 1444947 - RNA, 19 nt, Homo sapiens
aauaucaaguugccuuucu

SEQ ID NO: 1444948 - RNA, 19 nt, Homo sapiens
ccaauaucaaguugccuuu

SEQ ID NO: 1444949 - RNA, 19 nt, Homo sapiens
uaaagugaacagaguuauc

SEQ ID NO: 1444950 - RNA, 19 nt, Homo sapiens
gcguauggagugccaagaa

SEQ ID NO: 1444951 - RNA, 19 nt, Homo sapiens
guaaagugaacagaguuau

SEQ ID NO: 1444952 - RNA, 19 nt, Homo sapiens
ccuagccaauaucaaguug

SEQ ID NO: 1444953 - RNA, 19 nt, Homo sapiens
aagaaagaacacagugaaa

SEQ ID NO: 1444954 - RNA, 19 nt, Homo sapiens
aggcaccuauguaacgaaa

SEQ ID NO: 1444955 - RNA, 19 nt, Homo sapiens
ggagugccaagaaagaaca

SEQ ID NO: 1444956 - RNA, 19 nt, Homo sapiens
gaccugguacacaaaccua

SEQ ID NO: 1444957 - RNA, 19 nt, Homo sapiens
gaacacagugaaaaccauu

SEQ ID NO: 1444958 - RNA, 19 nt, Homo sapiens
gaagcgcggauuguagaug

SEQ ID NO: 1444959 - RNA, 19 nt, Homo sapiens
aaagggaguaugaagugaa

SEQ ID NO: 1444960 - RNA, 19 nt, Homo sapiens
acaaaccuagccaauauca

SEQ ID NO: 1444961 - RNA, 19 nt, Homo sapiens
aaagugaacagaguuaucu

SEQ ID NO: 1444962 - RNA, 19 nt, Homo sapiens
gaaagaacacagugaaaac

SEQ ID NO: 1444963 - RNA, 19 nt, Homo sapiens
ugcagaaucuaucaaacuc

SEQ ID NO: 1444964 - RNA, 19 nt, Homo sapiens
gcggauuguagaugaagaa

SEQ ID NO: 1444965 - RNA, 19 nt, Homo sapiens
gccagccgguuugagaaga

SEQ ID NO: 1444966 - RNA, 19 nt, Homo sapiens
gugaagcgucuuuguaaac

SEQ ID NO: 1444967 - RNA, 19 nt, Homo sapiens
uacaggaaccuugggauau

SEQ ID NO: 1444968 - RNA, 19 nt, Homo sapiens
ucaggcaccuauguaacga

SEQ ID NO: 1444969 - RNA, 19 nt, Homo sapiens
uauggagugccaagaaaga

SEQ ID NO: 1444970 - RNA, 19 nt, Homo sapiens
uaaggaaauucagcuucuc

SEQ ID NO: 1444971 - RNA, 19 nt, Homo sapiens
ugaagugaagcgucuuugu

SEQ ID NO: 1444972 - RNA, 19 nt, Homo sapiens
gcccagagaccgagaaaau

SEQ ID NO: 1444973 - RNA, 19 nt, Homo sapiens
gaccucuuccaucuaaaug

SEQ ID NO: 1444974 - RNA, 19 nt, Homo sapiens
gcaguuguuauaauguaca

SEQ ID NO: 1444975 - RNA, 19 nt, Homo sapiens
guaaacugaagugucaaga

SEQ ID NO: 1444976 - RNA, 19 nt, Homo sapiens
uaugaagugaagcgucuuu

SEQ ID NO: 1444977 - RNA, 19 nt, Homo sapiens
uaacaaggcuauagaaguu

SEQ ID NO: 1444978 - RNA, 19 nt, Homo sapiens
gaagaaccauuauugaguu

SEQ ID NO: 1444979 - RNA, 19 nt, Homo sapiens
gaaauuugcuuguagagau

SEQ ID NO: 1444980 - RNA, 19 nt, Homo sapiens
gugauaaacugaacccuaa

SEQ ID NO: 1444981 - RNA, 19 nt, Homo sapiens
gaauagacacugaaucaaa

SEQ ID NO: 1444982 - RNA, 19 nt, Homo sapiens
ggucaaaggugcuccugaa

SEQ ID NO: 1444983 - RNA, 19 nt, Homo sapiens
ggaagcaaauccucauugu

SEQ ID NO: 1444984 - RNA, 19 nt, Homo sapiens
caaaggacaucaucaagca

SEQ ID NO: 1444985 - RNA, 19 nt, Homo sapiens
gaugggaucucacucuguu

SEQ ID NO: 1444986 - RNA, 19 nt, Homo sapiens
gaagaagggagccaacaaa

SEQ ID NO: 1444987 - RNA, 19 nt, Homo sapiens
gaacaguuacuaauggaaa

SEQ ID NO: 1444988 - RNA, 19 nt, Homo sapiens
ggaauguccuccugaaagu

SEQ ID NO: 1444989 - RNA, 19 nt, Homo sapiens
ucacagccaccauucauua

SEQ ID NO: 1444990 - RNA, 19 nt, Homo sapiens
uaagaugaauagacacuga

SEQ ID NO: 1444991 - RNA, 19 nt, Homo sapiens
cagccaccauucauuauuu

SEQ ID NO: 1444992 - RNA, 19 nt, Homo sapiens
gggaagcaaugcagaaauc

SEQ ID NO: 1444993 - RNA, 19 nt, Homo sapiens
ggagugcaguggcauaauc

SEQ ID NO: 1444994 - RNA, 19 nt, Homo sapiens
acaaggcuauagaaguuua

SEQ ID NO: 1444995 - RNA, 19 nt, Homo sapiens
gaucaaaggacaucaucaa

SEQ ID NO: 1444996 - RNA, 19 nt, Homo sapiens
gagcaacagguaacuauga

SEQ ID NO: 1444997 - RNA, 19 nt, Homo sapiens
guuuguagcugugcccuua

SEQ ID NO: 1444998 - RNA, 19 nt, Homo sapiens
aaagaacaguuacuaaugg

SEQ ID NO: 1444999 - RNA, 19 nt, Homo sapiens
cugauuagcugggacuaua

SEQ ID NO: 1445000 - RNA, 19 nt, Homo sapiens
cauccuagaccaagugaua

SEQ ID NO: 1445001 - RNA, 19 nt, Homo sapiens
gagaguagccuucguuaac

SEQ ID NO: 1445002 - RNA, 19 nt, Homo sapiens
guaaaucacagccaccauu

SEQ ID NO: 1445003 - RNA, 19 nt, Homo sapiens
guacaaugcuuggaaaauu

SEQ ID NO: 1445004 - RNA, 19 nt, Homo sapiens
aauugaaacuggagugaaa

SEQ ID NO: 1445005 - RNA, 19 nt, Homo sapiens
ccaacauacugcuccauau

SEQ ID NO: 1445006 - RNA, 19 nt, Homo sapiens
gcuauuccuuugcuaccua

SEQ ID NO: 1445007 - RNA, 19 nt, Homo sapiens
uugcagcuauuuacucuaa

SEQ ID NO: 1445008 - RNA, 19 nt, Homo sapiens
auagauaguuugccauuuc

SEQ ID NO: 1445009 - RNA, 19 nt, Homo sapiens
uguggguacucauuuauuu

SEQ ID NO: 1445010 - RNA, 19 nt, Homo sapiens
gaugaugaaguguuugaaa

SEQ ID NO: 1445011 - RNA, 19 nt, Homo sapiens
ccaaagugcugggauuaca

SEQ ID NO: 1445012 - RNA, 19 nt, Homo sapiens
gugcgaagaaccauuauug

SEQ ID NO: 1445013 - RNA, 19 nt, Homo sapiens
acgagugccuucugcauuu

SEQ ID NO: 1445014 - RNA, 19 nt, Homo sapiens
caacagguaacuaugauca

SEQ ID NO: 1445015 - RNA, 19 nt, Homo sapiens
aagcaaauccucauuguca

SEQ ID NO: 1445016 - RNA, 19 nt, Homo sapiens
acagguaacuaugaucaaa

SEQ ID NO: 1445017 - RNA, 19 nt, Homo sapiens
gagagacuaagcauccaua

SEQ ID NO: 1445018 - RNA, 19 nt, Homo sapiens
gaaccauuauugaguuugc

SEQ ID NO: 1445019 - RNA, 19 nt, Homo sapiens
gacacugaaucaaaguuau

SEQ ID NO: 1445020 - RNA, 19 nt, Homo sapiens
uaacuguggguacucauuu

SEQ ID NO: 1445021 - RNA, 19 nt, Homo sapiens
cuaagcauccauacacuuu

SEQ ID NO: 1445022 - RNA, 19 nt, Homo sapiens
caccaugcccagcuaauuu

SEQ ID NO: 1445023 - RNA, 19 nt, Homo sapiens
cgaagaaccauuauugagu

SEQ ID NO: 1445024 - RNA, 19 nt, Homo sapiens
gagggucagucgagaguag

SEQ ID NO: 1445025 - RNA, 19 nt, Homo sapiens
gauaguuugccauuucuug

SEQ ID NO: 1445026 - RNA, 19 nt, Homo sapiens
agacacugaaucaaaguua

SEQ ID NO: 1445027 - RNA, 19 nt, Homo sapiens
aauagacacugaaucaaag

SEQ ID NO: 1445028 - RNA, 19 nt, Homo sapiens
ucagcuaagugucguuguu

SEQ ID NO: 1445029 - RNA, 19 nt, Homo sapiens
gaugaaguguuugaaagag

SEQ ID NO: 1445030 - RNA, 19 nt, Homo sapiens
uccauaugcuguugaagaa

SEQ ID NO: 1445031 - RNA, 19 nt, Homo sapiens
gcaagaaaacuucauccua

SEQ ID NO: 1445032 - RNA, 19 nt, Homo sapiens
cgugagcgcuuggagugua

SEQ ID NO: 1445033 - RNA, 19 nt, Homo sapiens
gggaauguccuccugaaag

SEQ ID NO: 1445034 - RNA, 19 nt, Homo sapiens
gggaagcaaauccucauug

SEQ ID NO: 1445035 - RNA, 19 nt, Homo sapiens
gcgaagaaccauuauugag

SEQ ID NO: 1445036 - RNA, 19 nt, Homo sapiens
gugcaguggcauaaucaua

SEQ ID NO: 1445037 - RNA, 19 nt, Homo sapiens
aggcagcucugguccauuc

SEQ ID NO: 1445038 - RNA, 19 nt, Homo sapiens
ggaggguuuuagagaauua

SEQ ID NO: 1445039 - RNA, 19 nt, Homo sapiens
aggauugaaugcucuaguu

SEQ ID NO: 1445040 - RNA, 19 nt, Homo sapiens
ccauucggaugaugaagug

SEQ ID NO: 1445041 - RNA, 19 nt, Homo sapiens
caucaagcacacaguuaaa

SEQ ID NO: 1445042 - RNA, 19 nt, Homo sapiens
caccgcaagccucaaauuu

SEQ ID NO: 1445043 - RNA, 19 nt, Homo sapiens
agccaccauucauuauuua

SEQ ID NO: 1445044 - RNA, 19 nt, Homo sapiens
ggagugaaagggaagcaau

SEQ ID NO: 1445045 - RNA, 19 nt, Homo sapiens
ucauuugauccacuucuua

SEQ ID NO: 1445046 - RNA, 19 nt, Homo sapiens
ucaucaagcacacaguuaa

SEQ ID NO: 1445047 - RNA, 19 nt, Homo sapiens
aauguacaaugcuuggaaa

SEQ ID NO: 1445048 - RNA, 19 nt, Homo sapiens
cuuacaagcgggagccuua

SEQ ID NO: 1445049 - RNA, 19 nt, Homo sapiens
uaaacgaccaucugaagca

SEQ ID NO: 1445050 - RNA, 19 nt, Homo sapiens
cagagcaacagguaacuau

SEQ ID NO: 1445051 - RNA, 19 nt, Homo sapiens
gugggaauguccuccugaa

SEQ ID NO: 1445052 - RNA, 19 nt, Homo sapiens
ggagguauuccuugcagau

SEQ ID NO: 1445053 - RNA, 19 nt, Homo sapiens
gcucaccgcaagccucaaa

SEQ ID NO: 1445054 - RNA, 19 nt, Homo sapiens
aagaacaguuacuaaugga

SEQ ID NO: 1445055 - RNA, 19 nt, Homo sapiens
gagaauuacuuuuggucaa

SEQ ID NO: 1445056 - RNA, 19 nt, Homo sapiens
gguauuccuugcagauugg

SEQ ID NO: 1445057 - RNA, 19 nt, Homo sapiens
aaauuugcuuguagagaug

SEQ ID NO: 1445058 - RNA, 19 nt, Homo sapiens
ugccauuucuuggguuuaa

SEQ ID NO: 1445059 - RNA, 19 nt, Homo sapiens
uaaaucacagccaccauuc

SEQ ID NO: 1445060 - RNA, 19 nt, Homo sapiens
aacuguggguacucauuua

SEQ ID NO: 1445061 - RNA, 19 nt, Homo sapiens
auugguacaugguucagua

SEQ ID NO: 1445062 - RNA, 19 nt, Homo sapiens
cgagaguagccuucguuaa

SEQ ID NO: 1445063 - RNA, 19 nt, Homo sapiens
guuguugguccuucucuaa

SEQ ID NO: 1445064 - RNA, 19 nt, Homo sapiens
aaacugaacccuaaaacaa

SEQ ID NO: 1445065 - RNA, 19 nt, Homo sapiens
gaagcaaauccucauuguc

SEQ ID NO: 1445066 - RNA, 19 nt, Homo sapiens
gcaguucagggaagcaaau

SEQ ID NO: 1445067 - RNA, 19 nt, Homo sapiens
uaauguacaaugcuuggaa

SEQ ID NO: 1445068 - RNA, 19 nt, Homo sapiens
ugaagaagggagccaacaa

SEQ ID NO: 1445069 - RNA, 19 nt, Homo sapiens
gauccacuucuuauuacuu

SEQ ID NO: 1445070 - RNA, 19 nt, Homo sapiens
gaccaagugauaaacugaa

SEQ ID NO: 1445071 - RNA, 19 nt, Homo sapiens
ugagugauccucccacagu

SEQ ID NO: 1445072 - RNA, 19 nt, Homo sapiens
ccaccaugcccagcuaauu

SEQ ID NO: 1445073 - RNA, 19 nt, Homo sapiens
gugcucagaugauccuuuu

SEQ ID NO: 1445074 - RNA, 19 nt, Homo sapiens
aaacagagcaacagguaac

SEQ ID NO: 1445075 - RNA, 19 nt, Homo sapiens
ggauugaaugcucuaguuc

SEQ ID NO: 1445076 - RNA, 19 nt, Homo sapiens
ugaugaaguguuugaaaga

SEQ ID NO: 1445077 - RNA, 19 nt, Homo sapiens
caaagucccucuauuauua

SEQ ID NO: 1445078 - RNA, 19 nt, Homo sapiens
agagauaacugcacaauuu

SEQ ID NO: 1445079 - RNA, 19 nt, Homo sapiens
gagcuuaucucuuguacuu

SEQ ID NO: 1445080 - RNA, 19 nt, Homo sapiens
gcucaaagucccucuauua

SEQ ID NO: 1445081 - RNA, 19 nt, Homo sapiens
uaacgagucuggucaguuu

SEQ ID NO: 1445082 - RNA, 19 nt, Homo sapiens
ggaggaggauuauuaugaa

SEQ ID NO: 1445083 - RNA, 19 nt, Homo sapiens
ccaccaguguuucauaaua

SEQ ID NO: 1445084 - RNA, 19 nt, Homo sapiens
gagguuugcugccauauau

SEQ ID NO: 1445085 - RNA, 19 nt, Homo sapiens
cuaaugauuugcagagaua

SEQ ID NO: 1445086 - RNA, 19 nt, Homo sapiens
uaacacauauggagguuug

SEQ ID NO: 1445087 - RNA, 19 nt, Homo sapiens
cuagcaagauuauguguuu

SEQ ID NO: 1445088 - RNA, 19 nt, Homo sapiens
aggaauauguguuggauaa

SEQ ID NO: 1445089 - RNA, 19 nt, Homo sapiens
ggaguggaaacuucaaaua

SEQ ID NO: 1445090 - RNA, 19 nt, Homo sapiens
cuucaccucuuccacauua

SEQ ID NO: 1445091 - RNA, 19 nt, Homo sapiens
ccacauuacuggagcuuau

SEQ ID NO: 1445092 - RNA, 19 nt, Homo sapiens
guaagaagagcaccaagaa

SEQ ID NO: 1445093 - RNA, 19 nt, Homo sapiens
gggaggaggauuauuauga

SEQ ID NO: 1445094 - RNA, 19 nt, Homo sapiens
guaaauguguuggcagcua

SEQ ID NO: 1445095 - RNA, 19 nt, Homo sapiens
gcuuaucucuuguacuuga

SEQ ID NO: 1445096 - RNA, 19 nt, Homo sapiens
agacaucccucgucaacuu

SEQ ID NO: 1445097 - RNA, 19 nt, Homo sapiens
gauccaagccuacguaaca

SEQ ID NO: 1445098 - RNA, 19 nt, Homo sapiens
ucaaugauacugguucuua

SEQ ID NO: 1445099 - RNA, 19 nt, Homo sapiens
gaaaauaguucgugcucuu

SEQ ID NO: 1445100 - RNA, 19 nt, Homo sapiens
uaaauguguuggcagcuaa

SEQ ID NO: 1445101 - RNA, 19 nt, Homo sapiens
ugaauuacuuucccacaug

SEQ ID NO: 1445102 - RNA, 19 nt, Homo sapiens
ggaagucaaaucaguauuc

SEQ ID NO: 1445103 - RNA, 19 nt, Homo sapiens
gaauuacuuucccacaugu

SEQ ID NO: 1445104 - RNA, 19 nt, Homo sapiens
acacaguacuaauggguaa

SEQ ID NO: 1445105 - RNA, 19 nt, Homo sapiens
ggaggauuauuaugaaugg

SEQ ID NO: 1445106 - RNA, 19 nt, Homo sapiens
cuacguaacauggaacuua

SEQ ID NO: 1445107 - RNA, 19 nt, Homo sapiens
gaugagaaguaccagaaag

SEQ ID NO: 1445108 - RNA, 19 nt, Homo sapiens
ggcccucgccuuugauuua

SEQ ID NO: 1445109 - RNA, 19 nt, Homo sapiens
gaagucaaaucaguauucu

SEQ ID NO: 1445110 - RNA, 19 nt, Homo sapiens
ccacaugugcggccuguuu

SEQ ID NO: 1445111 - RNA, 19 nt, Homo sapiens
uacuggagcuuaucucuug

SEQ ID NO: 1445112 - RNA, 19 nt, Homo sapiens
gaacucuacuuccagaaaa

SEQ ID NO: 1445113 - RNA, 19 nt, Homo sapiens
ucaaagucccucuauuauu

SEQ ID NO: 1445114 - RNA, 19 nt, Homo sapiens
ggaaacuucaaauagagua

SEQ ID NO: 1445115 - RNA, 19 nt, Homo sapiens
ggguagacuugugacuuua

SEQ ID NO: 1445116 - RNA, 19 nt, Homo sapiens
uggguagacuugugacuuu

SEQ ID NO: 1445117 - RNA, 19 nt, Homo sapiens
guaaaugggaauucaugaa

SEQ ID NO: 1445118 - RNA, 19 nt, Homo sapiens
ggagguuugcugccauaua

SEQ ID NO: 1445119 - RNA, 19 nt, Homo sapiens
cuaaauuacucaucgucaa

SEQ ID NO: 1445120 - RNA, 19 nt, Homo sapiens
gaaguaccagaaaggcaua

SEQ ID NO: 1445121 - RNA, 19 nt, Homo sapiens
gaacuuacaacucagaaaa

SEQ ID NO: 1445122 - RNA, 19 nt, Homo sapiens
gaggaggauuauuaugaau

SEQ ID NO: 1445123 - RNA, 19 nt, Homo sapiens
aguggaaacuucaaauaga

SEQ ID NO: 1445124 - RNA, 19 nt, Homo sapiens
uacguaacauggaacuuaa

SEQ ID NO: 1445125 - RNA, 19 nt, Homo sapiens
cguacucacuguuggguuu

SEQ ID NO: 1445126 - RNA, 19 nt, Homo sapiens
gcaguucaccaaagcgaaa

SEQ ID NO: 1445127 - RNA, 19 nt, Homo sapiens
gagaaugcaguucaccaaa

SEQ ID NO: 1445128 - RNA, 19 nt, Homo sapiens
acuaauggguaacacauau

SEQ ID NO: 1445129 - RNA, 19 nt, Homo sapiens
ccucgccuuugauuuauuu

SEQ ID NO: 1445130 - RNA, 19 nt, Homo sapiens
gaggggaggaggauuauua

SEQ ID NO: 1445131 - RNA, 19 nt, Homo sapiens
agacccaacucuuauaugg

SEQ ID NO: 1445132 - RNA, 19 nt, Homo sapiens
gaaugcaguucaccaaagc

SEQ ID NO: 1445133 - RNA, 19 nt, Homo sapiens
aaucugcucuuugagguuu

SEQ ID NO: 1445134 - RNA, 19 nt, Homo sapiens
auuaaugucugcaaaggaa

SEQ ID NO: 1445135 - RNA, 19 nt, Homo sapiens
gaguggaaacuucaaauag

SEQ ID NO: 1445136 - RNA, 19 nt, Homo sapiens
gcuguucugucguccaguu

SEQ ID NO: 1445137 - RNA, 19 nt, Homo sapiens
guagacuugugacuuuaau

SEQ ID NO: 1445138 - RNA, 19 nt, Homo sapiens
agaagcauccaucguguuu

SEQ ID NO: 1445139 - RNA, 19 nt, Homo sapiens
acauggaacuuaauuacuc

SEQ ID NO: 1445140 - RNA, 19 nt, Homo sapiens
acccaacucuuauauggaa

SEQ ID NO: 1445141 - RNA, 19 nt, Homo sapiens
gguaacacauauggagguu

SEQ ID NO: 1445142 - RNA, 19 nt, Homo sapiens
gguggaagucaaaucagua

SEQ ID NO: 1445143 - RNA, 19 nt, Homo sapiens
caaagaggaaagagaaauc

SEQ ID NO: 1445144 - RNA, 19 nt, Homo sapiens
gagugggaguggaaacuuc

SEQ ID NO: 1445145 - RNA, 19 nt, Homo sapiens
gagguuucuuucugcacua

SEQ ID NO: 1445146 - RNA, 19 nt, Homo sapiens
guggaaacuucaaauagag

SEQ ID NO: 1445147 - RNA, 19 nt, Homo sapiens
cugaugcccuuacuggaaa

SEQ ID NO: 1445148 - RNA, 19 nt, Homo sapiens
cauuauucaugccacaauu

SEQ ID NO: 1445149 - RNA, 19 nt, Homo sapiens
ggucucuccuagcaagauu

SEQ ID NO: 1445150 - RNA, 19 nt, Homo sapiens
gcugccauauauauuguau

SEQ ID NO: 1445151 - RNA, 19 nt, Homo sapiens
agacuugugacuuuaauug

SEQ ID NO: 1445152 - RNA, 19 nt, Homo sapiens
gugaugagaaguaccagaa

SEQ ID NO: 1445153 - RNA, 19 nt, Homo sapiens
cauuugggacuucuucuuu

SEQ ID NO: 1445154 - RNA, 19 nt, Homo sapiens
acauaucccaguuggcuua

SEQ ID NO: 1445155 - RNA, 19 nt, Homo sapiens
cccauagcaugaugacauu

SEQ ID NO: 1445156 - RNA, 19 nt, Homo sapiens
gaaaagauugcuagacuca

SEQ ID NO: 1445157 - RNA, 19 nt, Homo sapiens
aagauggucucuccuagca

SEQ ID NO: 1445158 - RNA, 19 nt, Homo sapiens
ucccaccaguguuucauaa

SEQ ID NO: 1445159 - RNA, 19 nt, Homo sapiens
gguagacuugugacuuuaa

SEQ ID NO: 1445160 - RNA, 19 nt, Homo sapiens
caagacaucccucgucaac

SEQ ID NO: 1445161 - RNA, 19 nt, Homo sapiens
agaaugcaguucaccaaag

SEQ ID NO: 1445162 - RNA, 19 nt, Homo sapiens
aaagguggaagucaaauca

SEQ ID NO: 1445163 - RNA, 19 nt, Homo sapiens
gaucaccacuauauuuugu

SEQ ID NO: 1445164 - RNA, 19 nt, Homo sapiens
uuugcaagcgcauugauua

SEQ ID NO: 1445165 - RNA, 19 nt, Homo sapiens
gcagaaucaugcggacauc

SEQ ID NO: 1445166 - RNA, 19 nt, Homo sapiens
gcugguggcaaucauuauu

SEQ ID NO: 1445167 - RNA, 19 nt, Homo sapiens
caccaguguuucauaauac

SEQ ID NO: 1445168 - RNA, 19 nt, Homo sapiens
caaugauacugguucuuac

SEQ ID NO: 1445169 - RNA, 19 nt, Homo sapiens
agagguggguagaagauuc

SEQ ID NO: 1445170 - RNA, 19 nt, Homo sapiens
uaauuacucucuggcuuca

SEQ ID NO: 1445171 - RNA, 19 nt, Homo sapiens
uaucuuggguagacuugug

SEQ ID NO: 1445172 - RNA, 19 nt, Homo sapiens
ccuaaugauuugcagagau

SEQ ID NO: 1445173 - RNA, 19 nt, Homo sapiens
ccaaagaggaaagagaaau

SEQ ID NO: 1445174 - RNA, 19 nt, Homo sapiens
ugaacucuacuuccagaaa

SEQ ID NO: 1445175 - RNA, 19 nt, Homo sapiens
ggaauauguguuggauaaa

SEQ ID NO: 1445176 - RNA, 19 nt, Homo sapiens
ucaggaauauguguuggau

SEQ ID NO: 1445177 - RNA, 19 nt, Homo sapiens
ugauugagcugaauaagua

SEQ ID NO: 1445178 - RNA, 19 nt, Homo sapiens
caagagaggcauaaacuua

SEQ ID NO: 1445179 - RNA, 19 nt, Homo sapiens
gaaacacucugagauauau

SEQ ID NO: 1445180 - RNA, 19 nt, Homo sapiens
gaagaaucccuaagagaua

SEQ ID NO: 1445181 - RNA, 19 nt, Homo sapiens
ggccuuauaugguguguua

SEQ ID NO: 1445182 - RNA, 19 nt, Homo sapiens
gcauagaauuccaaagaaa

SEQ ID NO: 1445183 - RNA, 19 nt, Homo sapiens
aaaggaaggucuacaugua

SEQ ID NO: 1445184 - RNA, 19 nt, Homo sapiens
caacaaguccuuugacauu

SEQ ID NO: 1445185 - RNA, 19 nt, Homo sapiens
gaaaggacguaacuuagca

SEQ ID NO: 1445186 - RNA, 19 nt, Homo sapiens
ccagaaaggacguaacuua

SEQ ID NO: 1445187 - RNA, 19 nt, Homo sapiens
ggaaacacucugagauaua

SEQ ID NO: 1445188 - RNA, 19 nt, Homo sapiens
ucagagaggugaugcacua

SEQ ID NO: 1445189 - RNA, 19 nt, Homo sapiens
ggacguaacuuagcaugga

SEQ ID NO: 1445190 - RNA, 19 nt, Homo sapiens
ucucguaucccaauuauua

SEQ ID NO: 1445191 - RNA, 19 nt, Homo sapiens
caacaaagacagccuaaug

SEQ ID NO: 1445192 - RNA, 19 nt, Homo sapiens
gcauauugauggacaaaug

SEQ ID NO: 1445193 - RNA, 19 nt, Homo sapiens
gacaugggcuucugugaga

SEQ ID NO: 1445194 - RNA, 19 nt, Homo sapiens
ccuaagagauacucaaaug

SEQ ID NO: 1445195 - RNA, 19 nt, Homo sapiens
ccaacuaacuggucguuug

SEQ ID NO: 1445196 - RNA, 19 nt, Homo sapiens
uaaagaagauucagacacu

SEQ ID NO: 1445197 - RNA, 19 nt, Homo sapiens
ggaagaaucccuaagagau

SEQ ID NO: 1445198 - RNA, 19 nt, Homo sapiens
ugacccagcucauggaauu

SEQ ID NO: 1445199 - RNA, 19 nt, Homo sapiens
aauccuagcuuuccauuug

SEQ ID NO: 1445200 - RNA, 19 nt, Homo sapiens
gccaggaguuccagacuaa

SEQ ID NO: 1445201 - RNA, 19 nt, Homo sapiens
ccacugagccugaguugaa

SEQ ID NO: 1445202 - RNA, 19 nt, Homo sapiens
uagcauggaucaccaauca

SEQ ID NO: 1445203 - RNA, 19 nt, Homo sapiens
gggaaacacucugagauau

SEQ ID NO: 1445204 - RNA, 19 nt, Homo sapiens
ccacaauccuguacuguuc

SEQ ID NO: 1445205 - RNA, 19 nt, Homo sapiens
gagccugaguugaaauauu

SEQ ID NO: 1445206 - RNA, 19 nt, Homo sapiens
ugaaguacaugaccaagug

SEQ ID NO: 1445207 - RNA, 19 nt, Homo sapiens
ggaggaagaaucccuaaga

SEQ ID NO: 1445208 - RNA, 19 nt, Homo sapiens
cacaagaaauaacuccuuu

SEQ ID NO: 1445209 - RNA, 19 nt, Homo sapiens
ugaaugaccugcagcaagu

SEQ ID NO: 1445210 - RNA, 19 nt, Homo sapiens
ccuauaaucccaacacuuu

SEQ ID NO: 1445211 - RNA, 19 nt, Homo sapiens
gcaaaggcuuccucagaca

SEQ ID NO: 1445212 - RNA, 19 nt, Homo sapiens
ccaagcagguucuauuaca

SEQ ID NO: 1445213 - RNA, 19 nt, Homo sapiens
cuucggaccugauuucaaa

SEQ ID NO: 1445214 - RNA, 19 nt, Homo sapiens
gaauccugguaaacaauaa

SEQ ID NO: 1445215 - RNA, 19 nt, Homo sapiens
gacaaaguguaauuacuca

SEQ ID NO: 1445216 - RNA, 19 nt, Homo sapiens
gaauuuaccuucacaaaag

SEQ ID NO: 1445217 - RNA, 19 nt, Homo sapiens
gaccuaaguucuuuugaua

SEQ ID NO: 1445218 - RNA, 19 nt, Homo sapiens
ggcauagaauuccaaagaa

SEQ ID NO: 1445219 - RNA, 19 nt, Homo sapiens
gaaaggaaaguuugucucu

SEQ ID NO: 1445220 - RNA, 19 nt, Homo sapiens
cugaauaaaugacugagaa

SEQ ID NO: 1445221 - RNA, 19 nt, Homo sapiens
ggacgguguuccaaugaau

SEQ ID NO: 1445222 - RNA, 19 nt, Homo sapiens
caaaggaucacugcuuaaa

SEQ ID NO: 1445223 - RNA, 19 nt, Homo sapiens
ccuacugccuagaauauaa

SEQ ID NO: 1445224 - RNA, 19 nt, Homo sapiens
ucauauugcuugucucaga

SEQ ID NO: 1445225 - RNA, 19 nt, Homo sapiens
gcgaugcucuugacuccuu

SEQ ID NO: 1445226 - RNA, 19 nt, Homo sapiens
ggacgauggaggccuuaua

SEQ ID NO: 1445227 - RNA, 19 nt, Homo sapiens
agccugaguugaaauauuu

SEQ ID NO: 1445228 - RNA, 19 nt, Homo sapiens
ucccugacaugacauuaua

SEQ ID NO: 1445229 - RNA, 19 nt, Homo sapiens
gaacaaggugaaagacaug

SEQ ID NO: 1445230 - RNA, 19 nt, Homo sapiens
ggaagcugcugguguuucu

SEQ ID NO: 1445231 - RNA, 19 nt, Homo sapiens
gucauugccugguuucaaa

SEQ ID NO: 1445232 - RNA, 19 nt, Homo sapiens
aaaggacgguguuccaaug

SEQ ID NO: 1445233 - RNA, 19 nt, Homo sapiens
auacugagcuccagaaagg

SEQ ID NO: 1445234 - RNA, 19 nt, Homo sapiens
caagcagguucuauuacaa

SEQ ID NO: 1445235 - RNA, 19 nt, Homo sapiens
uuacuugacuccagacuuc

SEQ ID NO: 1445236 - RNA, 19 nt, Homo sapiens
caugaauccugguaaacaa

SEQ ID NO: 1445237 - RNA, 19 nt, Homo sapiens
gaggaagaaucccuaagag

SEQ ID NO: 1445238 - RNA, 19 nt, Homo sapiens
gcaaaggaucacugcuuaa

SEQ ID NO: 1445239 - RNA, 19 nt, Homo sapiens
caaaagcuacugucuauuu

SEQ ID NO: 1445240 - RNA, 19 nt, Homo sapiens
gcaguuauaugucauuuuc

SEQ ID NO: 1445241 - RNA, 19 nt, Homo sapiens
gaaggcugguucauaacug

SEQ ID NO: 1445242 - RNA, 19 nt, Homo sapiens
gcugugagguugagauucu

SEQ ID NO: 1445243 - RNA, 19 nt, Homo sapiens
aaucaugaauccugguaaa

SEQ ID NO: 1445244 - RNA, 19 nt, Homo sapiens
uaaaccaucggaucaauug

SEQ ID NO: 1445245 - RNA, 19 nt, Homo sapiens
uaggagaaauuguaacaca

SEQ ID NO: 1445246 - RNA, 19 nt, Homo sapiens
guucauaacugagaaucga

SEQ ID NO: 1445247 - RNA, 19 nt, Homo sapiens
ccugaacucuucugccauu

SEQ ID NO: 1445248 - RNA, 19 nt, Homo sapiens
gaauaucaacguucaccuu

SEQ ID NO: 1445249 - RNA, 19 nt, Homo sapiens
ggccaggaguuccagacua

SEQ ID NO: 1445250 - RNA, 19 nt, Homo sapiens
gagaauggagagagcauga

SEQ ID NO: 1445251 - RNA, 19 nt, Homo sapiens
gccggaagcugcugguguu

SEQ ID NO: 1445252 - RNA, 19 nt, Homo sapiens
gcauaaacuuagacacagu

SEQ ID NO: 1445253 - RNA, 19 nt, Homo sapiens
gaucaucaaacucaagaga

SEQ ID NO: 1445254 - RNA, 19 nt, Homo sapiens
cgucuauuguucaaaguuu

SEQ ID NO: 1445255 - RNA, 19 nt, Homo sapiens
gcuauaggagaaauuguaa

SEQ ID NO: 1445256 - RNA, 19 nt, Homo sapiens
caacuaacuggucguuuga

SEQ ID NO: 1445257 - RNA, 19 nt, Homo sapiens
gugcaaaggcuuccucaga

SEQ ID NO: 1445258 - RNA, 19 nt, Homo sapiens
ucaagaccaugcacauugu

SEQ ID NO: 1445259 - RNA, 19 nt, Homo sapiens
gaucauauugcuugucuca

SEQ ID NO: 1445260 - RNA, 19 nt, Homo sapiens
ugacuuuaguggcugauga

SEQ ID NO: 1445261 - RNA, 19 nt, Homo sapiens
acaaagugauugagcugaa

SEQ ID NO: 1445262 - RNA, 19 nt, Homo sapiens
ggaaucaugaauccuggua

SEQ ID NO: 1445263 - RNA, 19 nt, Homo sapiens
caagagcaaucccugacau

SEQ ID NO: 1445264 - RNA, 19 nt, Homo sapiens
gauuggagaacucauagaa

SEQ ID NO: 1445265 - RNA, 19 nt, Homo sapiens
cuaacuggucguuugauua

SEQ ID NO: 1445266 - RNA, 19 nt, Homo sapiens
aaaaggaggucuacaugaa

SEQ ID NO: 1445267 - RNA, 19 nt, Homo sapiens
acaacgagcucauggacau

SEQ ID NO: 1445268 - RNA, 19 nt, Homo sapiens
guaccaccuuugagaccua

SEQ ID NO: 1445269 - RNA, 19 nt, Homo sapiens
gaaagggcuggcucacuga

SEQ ID NO: 1445270 - RNA, 19 nt, Homo sapiens
gaucaccaaucaaucaaaa

SEQ ID NO: 1445271 - RNA, 19 nt, Homo sapiens
gcauggaucaccaaucaau

SEQ ID NO: 1445272 - RNA, 19 nt, Homo sapiens
gagagaugcuuccguuuug

SEQ ID NO: 1445273 - RNA, 19 nt, Homo sapiens
caacugaauaaaugacuga

SEQ ID NO: 1445274 - RNA, 19 nt, Homo sapiens
aaagacgucuauuguucaa

SEQ ID NO: 1445275 - RNA, 19 nt, Homo sapiens
cauauugcuugucucagaa

SEQ ID NO: 1445276 - RNA, 19 nt, Homo sapiens
cgccugaacgucauuauuu

SEQ ID NO: 1445277 - RNA, 19 nt, Homo sapiens
gcaacuagcucauugauuu

SEQ ID NO: 1445278 - RNA, 19 nt, Homo sapiens
ggacaucaaucaaggagaa

SEQ ID NO: 1445279 - RNA, 19 nt, Homo sapiens
guaaugcaauuccaaguuu

SEQ ID NO: 1445280 - RNA, 19 nt, Homo sapiens
guacauggcuaacgucaga

SEQ ID NO: 1445281 - RNA, 19 nt, Homo sapiens
aaacagacaucaacagcaa

SEQ ID NO: 1445282 - RNA, 19 nt, Homo sapiens
gagcagcuaaugucuguua

SEQ ID NO: 1445283 - RNA, 19 nt, Homo sapiens
ucagaaaucuugacuaugc

SEQ ID NO: 1445284 - RNA, 19 nt, Homo sapiens
ccaagcaacuagcucauug

SEQ ID NO: 1445285 - RNA, 19 nt, Homo sapiens
aaacaaagcccacuucgau

SEQ ID NO: 1445286 - RNA, 19 nt, Homo sapiens
ggaauaggaauuucuuaug

SEQ ID NO: 1445287 - RNA, 19 nt, Homo sapiens
uuuccaggcucuauucuua

SEQ ID NO: 1445288 - RNA, 19 nt, Homo sapiens
cuacagcuaugacaaacaa

SEQ ID NO: 1445289 - RNA, 19 nt, Homo sapiens
cuacacaauugucagcuaa

SEQ ID NO: 1445290 - RNA, 19 nt, Homo sapiens
ucaaacuacuacacaauug

SEQ ID NO: 1445291 - RNA, 19 nt, Homo sapiens
gcuacuugcuucauuacaa

SEQ ID NO: 1445292 - RNA, 19 nt, Homo sapiens
guuaaucacuucucugagu

SEQ ID NO: 1445293 - RNA, 19 nt, Homo sapiens
gauaguacauggcuaacgu

SEQ ID NO: 1445294 - RNA, 19 nt, Homo sapiens
aaaggugucuucguuacua

SEQ ID NO: 1445295 - RNA, 19 nt, Homo sapiens
gaucgacucggcccuuuaa

SEQ ID NO: 1445296 - RNA, 19 nt, Homo sapiens
agacuuaauuggaauagga

SEQ ID NO: 1445297 - RNA, 19 nt, Homo sapiens
gcaguaucuuccaaacauu

SEQ ID NO: 1445298 - RNA, 19 nt, Homo sapiens
aaccuacucuuugaacuua

SEQ ID NO: 1445299 - RNA, 19 nt, Homo sapiens
cagcuaaugucuguuauca

SEQ ID NO: 1445300 - RNA, 19 nt, Homo sapiens
ugacuaugcuuccagaauc

SEQ ID NO: 1445301 - RNA, 19 nt, Homo sapiens
caguauaucagaaguauga

SEQ ID NO: 1445302 - RNA, 19 nt, Homo sapiens
ggaacauuacugaaaguuu

SEQ ID NO: 1445303 - RNA, 19 nt, Homo sapiens
ucaccuaaauacacaauag

SEQ ID NO: 1445304 - RNA, 19 nt, Homo sapiens
cuacucagcuauuaauucu

SEQ ID NO: 1445305 - RNA, 19 nt, Homo sapiens
ccacuucgauguguuguuc

SEQ ID NO: 1445306 - RNA, 19 nt, Homo sapiens
aaacauugccuacagcuau

SEQ ID NO: 1445307 - RNA, 19 nt, Homo sapiens
uaaugucuguuaucaggaa

SEQ ID NO: 1445308 - RNA, 19 nt, Homo sapiens
guaucuauguauccuggua

SEQ ID NO: 1445309 - RNA, 19 nt, Homo sapiens
gcgcagucguaucuaugua

SEQ ID NO: 1445310 - RNA, 19 nt, Homo sapiens
ucucugaguucuaccugua

SEQ ID NO: 1445311 - RNA, 19 nt, Homo sapiens
agaugaagauguccuagga

SEQ ID NO: 1445312 - RNA, 19 nt, Homo sapiens
ccagaggaauccaaagaca

SEQ ID NO: 1445313 - RNA, 19 nt, Homo sapiens
gaauccaaagacaaaguua

SEQ ID NO: 1445314 - RNA, 19 nt, Homo sapiens
gcucuacgcgccucucauu

SEQ ID NO: 1445315 - RNA, 19 nt, Homo sapiens
gcacuuagggacaucaauc

SEQ ID NO: 1445316 - RNA, 19 nt, Homo sapiens
guacaguauaucagaagua

SEQ ID NO: 1445317 - RNA, 19 nt, Homo sapiens
agacaucaacagcaaagua

SEQ ID NO: 1445318 - RNA, 19 nt, Homo sapiens
ggaauccaaagacaaaguu

SEQ ID NO: 1445319 - RNA, 19 nt, Homo sapiens
ccuacucuuugaacuuaua

SEQ ID NO: 1445320 - RNA, 19 nt, Homo sapiens
guguacagaucuugcaaug

SEQ ID NO: 1445321 - RNA, 19 nt, Homo sapiens
ccuaggaacauuacugaaa

SEQ ID NO: 1445322 - RNA, 19 nt, Homo sapiens
caaagacaaaguuaucuca

SEQ ID NO: 1445323 - RNA, 19 nt, Homo sapiens
ggaccuccuuccagcucua

SEQ ID NO: 1445324 - RNA, 19 nt, Homo sapiens
gaaguaugagccgaucuuu

SEQ ID NO: 1445325 - RNA, 19 nt, Homo sapiens
gaaaaggugucuucguuac

SEQ ID NO: 1445326 - RNA, 19 nt, Homo sapiens
ggaaaaggugucuucguua

SEQ ID NO: 1445327 - RNA, 19 nt, Homo sapiens
gaaacugcgugaaaacaga

SEQ ID NO: 1445328 - RNA, 19 nt, Homo sapiens
cuaggaacauuacugaaag

SEQ ID NO: 1445329 - RNA, 19 nt, Homo sapiens
aagacaaaguuaucucaga

SEQ ID NO: 1445330 - RNA, 19 nt, Homo sapiens
gaggugaggucaggaaagg

SEQ ID NO: 1445331 - RNA, 19 nt, Homo sapiens
gcagucguaucuauguauc

SEQ ID NO: 1445332 - RNA, 19 nt, Homo sapiens
uuacaagacuuuggguuuc

SEQ ID NO: 1445333 - RNA, 19 nt, Homo sapiens
cuacuugcuucauuacaau

SEQ ID NO: 1445334 - RNA, 19 nt, Homo sapiens
agaggaauccaaagacaaa

SEQ ID NO: 1445335 - RNA, 19 nt, Homo sapiens
caggcucuauucuuaaaug

SEQ ID NO: 1445336 - RNA, 19 nt, Homo sapiens
ucacuucucugaguucuac

SEQ ID NO: 1445337 - RNA, 19 nt, Homo sapiens
aaagggauaucaaaaguug

SEQ ID NO: 1445338 - RNA, 19 nt, Homo sapiens
uuaaucacuucucugaguu

SEQ ID NO: 1445339 - RNA, 19 nt, Homo sapiens
gggaucgacucggcccuuu

SEQ ID NO: 1445340 - RNA, 19 nt, Homo sapiens
cauuggaaauccguuuauu

SEQ ID NO: 1445341 - RNA, 19 nt, Homo sapiens
gacuuuggguuucaguguu

SEQ ID NO: 1445342 - RNA, 19 nt, Homo sapiens
ccaaugacagagcagcuaa

SEQ ID NO: 1445343 - RNA, 19 nt, Homo sapiens
ggacgaagccccagagcaa

SEQ ID NO: 1445344 - RNA, 19 nt, Homo sapiens
cagcuaacucugugaauca

SEQ ID NO: 1445345 - RNA, 19 nt, Homo sapiens
uggcuaacgucagaaauuc

SEQ ID NO: 1445346 - RNA, 19 nt, Homo sapiens
ggaucgacucggcccuuua

SEQ ID NO: 1445347 - RNA, 19 nt, Homo sapiens
ucagcuaacucugugaauc

SEQ ID NO: 1445348 - RNA, 19 nt, Homo sapiens
ggaucgcacugaaccuaag

SEQ ID NO: 1445349 - RNA, 19 nt, Homo sapiens
aaaguuguguacagaucuu

SEQ ID NO: 1445350 - RNA, 19 nt, Homo sapiens
uccaggcucuauucuuaaa

SEQ ID NO: 1445351 - RNA, 19 nt, Homo sapiens
ugucuguuaucaggaauuu

SEQ ID NO: 1445352 - RNA, 19 nt, Homo sapiens
caaacuacuacacaauugu

SEQ ID NO: 1445353 - RNA, 19 nt, Homo sapiens
caaacaaagcccacuucga

SEQ ID NO: 1445354 - RNA, 19 nt, Homo sapiens
ucuguuaucaggaauuuga

SEQ ID NO: 1445355 - RNA, 19 nt, Homo sapiens
aaaccuacucuuugaacuu

SEQ ID NO: 1445356 - RNA, 19 nt, Homo sapiens
acaaagcccacuucgaugu

SEQ ID NO: 1445357 - RNA, 19 nt, Homo sapiens
gacaaacaaagcccacuuc

SEQ ID NO: 1445358 - RNA, 19 nt, Homo sapiens
agcaguaucuuccaaacau

SEQ ID NO: 1445359 - RNA, 19 nt, Homo sapiens
uggaaaaggugucuucguu

SEQ ID NO: 1445360 - RNA, 19 nt, Homo sapiens
caacuagcucauugauuuc

SEQ ID NO: 1445361 - RNA, 19 nt, Homo sapiens
uuacaaguaccgcuucguu

SEQ ID NO: 1445362 - RNA, 19 nt, Homo sapiens
caaacauugccuacagcua

SEQ ID NO: 1445363 - RNA, 19 nt, Homo sapiens
gaaugacaaagggauauca

SEQ ID NO: 1445364 - RNA, 19 nt, Homo sapiens
gagaggugaggucaggaaa

SEQ ID NO: 1445365 - RNA, 19 nt, Homo sapiens
caaaaguuguguacagauc

SEQ ID NO: 1445366 - RNA, 19 nt, Homo sapiens
gguacaguauaucagaagu

SEQ ID NO: 1445367 - RNA, 19 nt, Homo sapiens
cuucguuacuaaaggauug

SEQ ID NO: 1445368 - RNA, 19 nt, Homo sapiens
caagcaacuagcucauuga

SEQ ID NO: 1445369 - RNA, 19 nt, Homo sapiens
gacuaugcuuccagaaucu

SEQ ID NO: 1445370 - RNA, 19 nt, Homo sapiens
gaugaagauguccuaggaa

SEQ ID NO: 1445371 - RNA, 19 nt, Homo sapiens
ugucuucguuacuaaagga

SEQ ID NO: 1445372 - RNA, 19 nt, Homo sapiens
uacaagacuuuggguuuca

SEQ ID NO: 1445373 - RNA, 19 nt, Homo sapiens
gagcgaccggagaaagaaa

SEQ ID NO: 1445374 - RNA, 19 nt, Homo sapiens
gguacucauugaugggaau

SEQ ID NO: 1445375 - RNA, 19 nt, Homo sapiens
gacaucaacagcaaaguac

SEQ ID NO: 1445376 - RNA, 19 nt, Homo sapiens
uguaaugcaauuccaaguu

SEQ ID NO: 1445377 - RNA, 19 nt, Homo sapiens
gaauaacgaucccagauaa

SEQ ID NO: 1445378 - RNA, 19 nt, Homo sapiens
gagaugauuucaaggauaa

SEQ ID NO: 1445379 - RNA, 19 nt, Homo sapiens
ggagaugauuucaaggaua

SEQ ID NO: 1445380 - RNA, 19 nt, Homo sapiens
ccucauaacuucucugauu

SEQ ID NO: 1445381 - RNA, 19 nt, Homo sapiens
caaauugacucaucugugu

SEQ ID NO: 1445382 - RNA, 19 nt, Homo sapiens
gcuaagaaccguaaggaua

SEQ ID NO: 1445383 - RNA, 19 nt, Homo sapiens
gcuauaacaucucugugua

SEQ ID NO: 1445384 - RNA, 19 nt, Homo sapiens
aaauggagaugguguaauu

SEQ ID NO: 1445385 - RNA, 19 nt, Homo sapiens
ggaaaggaaaccaguuaua

SEQ ID NO: 1445386 - RNA, 19 nt, Homo sapiens
gggaauuucuugugucuga

SEQ ID NO: 1445387 - RNA, 19 nt, Homo sapiens
gcaaagcucugcucuagac

SEQ ID NO: 1445388 - RNA, 19 nt, Homo sapiens
cauauuccauccaggcuua

SEQ ID NO: 1445389 - RNA, 19 nt, Homo sapiens
uaacgaucccagauaauua

SEQ ID NO: 1445390 - RNA, 19 nt, Homo sapiens
gcauggagaugauuucaag

SEQ ID NO: 1445391 - RNA, 19 nt, Homo sapiens
cagcauaaauuucaagaca

SEQ ID NO: 1445392 - RNA, 19 nt, Homo sapiens
gggugucuaugauuucuua

SEQ ID NO: 1445393 - RNA, 19 nt, Homo sapiens
gggaaugacugaggaagaa

SEQ ID NO: 1445394 - RNA, 19 nt, Homo sapiens
gaaagagauucccaagagu

SEQ ID NO: 1445395 - RNA, 19 nt, Homo sapiens
caaagaaggcguuccauca

SEQ ID NO: 1445396 - RNA, 19 nt, Homo sapiens
ccagauaauuauaccauug

SEQ ID NO: 1445397 - RNA, 19 nt, Homo sapiens
ggaaaaggauucuccaaga

SEQ ID NO: 1445398 - RNA, 19 nt, Homo sapiens
gauccagcaagauaaauua

SEQ ID NO: 1445399 - RNA, 19 nt, Homo sapiens
acacuuggcuacaacauau

SEQ ID NO: 1445400 - RNA, 19 nt, Homo sapiens
gaaacaaugaacacuacua

SEQ ID NO: 1445401 - RNA, 19 nt, Homo sapiens
gaacauuuccugugucuac

SEQ ID NO: 1445402 - RNA, 19 nt, Homo sapiens
cuaagaaccguaaggauaa

SEQ ID NO: 1445403 - RNA, 19 nt, Homo sapiens
gagaugguguaauuaaauc

SEQ ID NO: 1445404 - RNA, 19 nt, Homo sapiens
acacuuggaugauugaaug

SEQ ID NO: 1445405 - RNA, 19 nt, Homo sapiens
gaaaggaaaccaguuauac

SEQ ID NO: 1445406 - RNA, 19 nt, Homo sapiens
cauccaggcuuaugccaaa

SEQ ID NO: 1445407 - RNA, 19 nt, Homo sapiens
aaaccuuucuggugcuaua

SEQ ID NO: 1445408 - RNA, 19 nt, Homo sapiens
ggacgauccagcaagauaa

SEQ ID NO: 1445409 - RNA, 19 nt, Homo sapiens
gauuccagcuauucaagaa

SEQ ID NO: 1445410 - RNA, 19 nt, Homo sapiens
caaauugaauggauaaagc

SEQ ID NO: 1445411 - RNA, 19 nt, Homo sapiens
ggagaugguguaauuaaau

SEQ ID NO: 1445412 - RNA, 19 nt, Homo sapiens
caggaaaggaaaccaguua

SEQ ID NO: 1445413 - RNA, 19 nt, Homo sapiens
gugacaaguuggugauuga

SEQ ID NO: 1445414 - RNA, 19 nt, Homo sapiens
gaaaggggaucaucugcaa

SEQ ID NO: 1445415 - RNA, 19 nt, Homo sapiens
ugucauagcucugcgaugu

SEQ ID NO: 1445416 - RNA, 19 nt, Homo sapiens
gcaacuacaccaucuuuua

SEQ ID NO: 1445417 - RNA, 19 nt, Homo sapiens
gugaacacuuggaugauug

SEQ ID NO: 1445418 - RNA, 19 nt, Homo sapiens
gagaacauuuccugugucu

SEQ ID NO: 1445419 - RNA, 19 nt, Homo sapiens
ggaccagcauaaauuucaa

SEQ ID NO: 1445420 - RNA, 19 nt, Homo sapiens
cagaaacaaugaacacuac

SEQ ID NO: 1445421 - RNA, 19 nt, Homo sapiens
acacuaaccucacagaaac

SEQ ID NO: 1445422 - RNA, 19 nt, Homo sapiens
gaacauagcgaaaacugaa

SEQ ID NO: 1445423 - RNA, 19 nt, Homo sapiens
gguggaggccuucuuauuc

SEQ ID NO: 1445424 - RNA, 19 nt, Homo sapiens
gggaucaucugcaacuaca

SEQ ID NO: 1445425 - RNA, 19 nt, Homo sapiens
ggagaacauuggcgugaag

SEQ ID NO: 1445426 - RNA, 19 nt, Homo sapiens
uggcaaagcucugcucuag

SEQ ID NO: 1445427 - RNA, 19 nt, Homo sapiens
caacgggaccagcauaaau

SEQ ID NO: 1445428 - RNA, 19 nt, Homo sapiens
ccagugcgguuguuaugga

SEQ ID NO: 1445429 - RNA, 19 nt, Homo sapiens
uaagaaccguaaggauaaa

SEQ ID NO: 1445430 - RNA, 19 nt, Homo sapiens
agaauaacgaucccagaua

SEQ ID NO: 1445431 - RNA, 19 nt, Homo sapiens
cagcuaagccugagaacau

SEQ ID NO: 1445432 - RNA, 19 nt, Homo sapiens
uaacaucucuguguaucca

SEQ ID NO: 1445433 - RNA, 19 nt, Homo sapiens
caauaguucuacaagugaa

SEQ ID NO: 1445434 - RNA, 19 nt, Homo sapiens
gaaaagaauggguauguga

SEQ ID NO: 1445435 - RNA, 19 nt, Homo sapiens
aggauaagcuaaaccugaa

SEQ ID NO: 1445436 - RNA, 19 nt, Homo sapiens
gcucugcucuagacgugaa

SEQ ID NO: 1445437 - RNA, 19 nt, Homo sapiens
gcuacaacauaugguacua

SEQ ID NO: 1445438 - RNA, 19 nt, Homo sapiens
aaacugaaccaccuaagau

SEQ ID NO: 1445439 - RNA, 19 nt, Homo sapiens
gaucacauggaaagagauu

SEQ ID NO: 1445440 - RNA, 19 nt, Homo sapiens
agaaggcguuccaucagaa

SEQ ID NO: 1445441 - RNA, 19 nt, Homo sapiens
cgugaacacuuggaugauu

SEQ ID NO: 1445442 - RNA, 19 nt, Homo sapiens
gacgugaacacuuggauga

SEQ ID NO: 1445443 - RNA, 19 nt, Homo sapiens
uggagucccugaaacgaaa

SEQ ID NO: 1445444 - RNA, 19 nt, Homo sapiens
ggucaaggagucaaaguuc

SEQ ID NO: 1445445 - RNA, 19 nt, Homo sapiens
uggagaugguguaauuaaa

SEQ ID NO: 1445446 - RNA, 19 nt, Homo sapiens
aagaaggcguuccaucaga

SEQ ID NO: 1445447 - RNA, 19 nt, Homo sapiens
ccaauaguucuacaaguga

SEQ ID NO: 1445448 - RNA, 19 nt, Homo sapiens
guggugaacuuugggaaug

SEQ ID NO: 1445449 - RNA, 19 nt, Homo sapiens
ccaacaaauugacucaucu

SEQ ID NO: 1445450 - RNA, 19 nt, Homo sapiens
caugauaauuguacaacca

SEQ ID NO: 1445451 - RNA, 19 nt, Homo sapiens
agaccaagguggagaacau

SEQ ID NO: 1445452 - RNA, 19 nt, Homo sapiens
gccagggaauuucuugugu

SEQ ID NO: 1445453 - RNA, 19 nt, Homo sapiens
uugaggagcucccaguuuc

SEQ ID NO: 1445454 - RNA, 19 nt, Homo sapiens
acaaguuggugauugacaa

SEQ ID NO: 1445455 - RNA, 19 nt, Homo sapiens
guggaggccuucuuauucu

SEQ ID NO: 1445456 - RNA, 19 nt, Homo sapiens
uucagugucuuugagauua

SEQ ID NO: 1445457 - RNA, 19 nt, Homo sapiens
aauguugcaugacaaaguu

SEQ ID NO: 1445458 - RNA, 19 nt, Homo sapiens
gaaggccagugcgguuguu

SEQ ID NO: 1445459 - RNA, 19 nt, Homo sapiens
ucaaaguucuggagugacu

SEQ ID NO: 1445460 - RNA, 19 nt, Homo sapiens
agucaaaguucuggaguga

SEQ ID NO: 1445461 - RNA, 19 nt, Homo sapiens
gcgccuguuucaucugauu

SEQ ID NO: 1445462 - RNA, 19 nt, Homo sapiens
caccaagggagaagucuaa

SEQ ID NO: 1445463 - RNA, 19 nt, Homo sapiens
aaaguaguauagccacaug

SEQ ID NO: 1445464 - RNA, 19 nt, Homo sapiens
accaauaguucuacaagug

SEQ ID NO: 1445465 - RNA, 19 nt, Homo sapiens
uauaacaucucuguguauc

SEQ ID NO: 1445466 - RNA, 19 nt, Homo sapiens
uauacccaguacacaguua

SEQ ID NO: 1445467 - RNA, 19 nt, Homo sapiens
cuacuaaccagcagcuuga

SEQ ID NO: 1445468 - RNA, 19 nt, Homo sapiens
caacauaugguacuaucca

SEQ ID NO: 1445469 - RNA, 19 nt, Homo sapiens
gguggaagcugaaaaugga

SEQ ID NO: 1445470 - RNA, 19 nt, Homo sapiens
acagaaacaaugaacacua

SEQ ID NO: 1445471 - RNA, 19 nt, Homo sapiens
uauccaauguugcaugaca

SEQ ID NO: 1445472 - RNA, 19 nt, Homo sapiens
cugagaacauuuccugugu

SEQ ID NO: 1445473 - RNA, 19 nt, Homo sapiens
aagcaacacuaaccucaca

SEQ ID NO: 1445474 - RNA, 19 nt, Homo sapiens
ggaauuucuugugucugaa

SEQ ID NO: 1445475 - RNA, 19 nt, Homo sapiens
cagaaaaucccaauaccua

SEQ ID NO: 1445476 - RNA, 19 nt, Homo sapiens
gaaaguaguauagccacau

SEQ ID NO: 1445477 - RNA, 19 nt, Homo sapiens
gaaggaauaucaacugaaa

SEQ ID NO: 1445478 - RNA, 19 nt, Homo sapiens
guaaagcccuuaugagauu

SEQ ID NO: 1445479 - RNA, 19 nt, Homo sapiens
agaagaaacugacuuguaa

SEQ ID NO: 1445480 - RNA, 19 nt, Homo sapiens
gaagauauuugcgaagaaa

SEQ ID NO: 1445481 - RNA, 19 nt, Homo sapiens
ggacguuguuggauauaua

SEQ ID NO: 1445482 - RNA, 19 nt, Homo sapiens
uauuggagcuucugaauuu

SEQ ID NO: 1445483 - RNA, 19 nt, Homo sapiens
gcugguaucuauuuaggua

SEQ ID NO: 1445484 - RNA, 19 nt, Homo sapiens
gcaggaaugccucuuuaua

SEQ ID NO: 1445485 - RNA, 19 nt, Homo sapiens
gguuguagcuuccuccuuu

SEQ ID NO: 1445486 - RNA, 19 nt, Homo sapiens
gguguaagcuaugugauuu

SEQ ID NO: 1445487 - RNA, 19 nt, Homo sapiens
gaacagggaaguugggaaa

SEQ ID NO: 1445488 - RNA, 19 nt, Homo sapiens
ggacuugguggauuaauuu

SEQ ID NO: 1445489 - RNA, 19 nt, Homo sapiens
acacucagcugguaucuau

SEQ ID NO: 1445490 - RNA, 19 nt, Homo sapiens
caaugaagauuaugaugga

SEQ ID NO: 1445491 - RNA, 19 nt, Homo sapiens
gguaggaauugaagauauu

SEQ ID NO: 1445492 - RNA, 19 nt, Homo sapiens
uggaagagaugauauugaa

SEQ ID NO: 1445493 - RNA, 19 nt, Homo sapiens
uagcaggaaugccucuuua

SEQ ID NO: 1445494 - RNA, 19 nt, Homo sapiens
gcaaagugcuauaaguuac

SEQ ID NO: 1445495 - RNA, 19 nt, Homo sapiens
gauaugcucuggguuaugu

SEQ ID NO: 1445496 - RNA, 19 nt, Homo sapiens
caaaauaccugucuuucuu

SEQ ID NO: 1445497 - RNA, 19 nt, Homo sapiens
ggaaaagaguuacgauauu

SEQ ID NO: 1445498 - RNA, 19 nt, Homo sapiens
gcaauaacauucgcugcuu

SEQ ID NO: 1445499 - RNA, 19 nt, Homo sapiens
guaacuggaucaucauugu

SEQ ID NO: 1445500 - RNA, 19 nt, Homo sapiens
auacaaacgucgucuaaau

SEQ ID NO: 1445501 - RNA, 19 nt, Homo sapiens
gcuauaaguuaccuuuguu

SEQ ID NO: 1445502 - RNA, 19 nt, Homo sapiens
gaauguugcuacacacuca

SEQ ID NO: 1445503 - RNA, 19 nt, Homo sapiens
ccagagcagugguauauca

SEQ ID NO: 1445504 - RNA, 19 nt, Homo sapiens
ugucauuguuuccacauua

SEQ ID NO: 1445505 - RNA, 19 nt, Homo sapiens
gagcaccacuaguuaaagu

SEQ ID NO: 1445506 - RNA, 19 nt, Homo sapiens
gagcagugguauaucauuc

SEQ ID NO: 1445507 - RNA, 19 nt, Homo sapiens
ggacuuggaucacuuuuau

SEQ ID NO: 1445508 - RNA, 19 nt, Homo sapiens
cagaaggaauaucaacuga

SEQ ID NO: 1445509 - RNA, 19 nt, Homo sapiens
cacaggacguuguuggaua

SEQ ID NO: 1445510 - RNA, 19 nt, Homo sapiens
cagaauggcuauggacuug

SEQ ID NO: 1445511 - RNA, 19 nt, Homo sapiens
gcgaagaaauaaagguugu

SEQ ID NO: 1445512 - RNA, 19 nt, Homo sapiens
gaagaauccagugcucaua

SEQ ID NO: 1445513 - RNA, 19 nt, Homo sapiens
caacaaacacuacagucaa

SEQ ID NO: 1445514 - RNA, 19 nt, Homo sapiens
gcaacaaacacuacaguca

SEQ ID NO: 1445515 - RNA, 19 nt, Homo sapiens
gaauacuacuucugcaaca

SEQ ID NO: 1445516 - RNA, 19 nt, Homo sapiens
gagccaggaugaagucuca

SEQ ID NO: 1445517 - RNA, 19 nt, Homo sapiens
acuaucaucuucacuacua

SEQ ID NO: 1445518 - RNA, 19 nt, Homo sapiens
gaugcaaagugcuauaagu

SEQ ID NO: 1445519 - RNA, 19 nt, Homo sapiens
cuauggacuugguggauua

SEQ ID NO: 1445520 - RNA, 19 nt, Homo sapiens
ggugugguguuuggucuua

SEQ ID NO: 1445521 - RNA, 19 nt, Homo sapiens
agaaguggaugacaguuug

SEQ ID NO: 1445522 - RNA, 19 nt, Homo sapiens
ggaaaugugaugcaaagug

SEQ ID NO: 1445523 - RNA, 19 nt, Homo sapiens
gaucugaaacuuggaacua

SEQ ID NO: 1445524 - RNA, 19 nt, Homo sapiens
caaacacuacagucaauaa

SEQ ID NO: 1445525 - RNA, 19 nt, Homo sapiens
aaaguaagguaggaauuga

SEQ ID NO: 1445526 - RNA, 19 nt, Homo sapiens
aacauucgcugcuucauga

SEQ ID NO: 1445527 - RNA, 19 nt, Homo sapiens
gagaaguggaugacaguuu

SEQ ID NO: 1445528 - RNA, 19 nt, Homo sapiens
uaaaguguccuauugugaa

SEQ ID NO: 1445529 - RNA, 19 nt, Homo sapiens
gcacuaucaucuucacuac

SEQ ID NO: 1445530 - RNA, 19 nt, Homo sapiens
ggauuuaugugcugcucuu

SEQ ID NO: 1445531 - RNA, 19 nt, Homo sapiens
caaaguaagguaggaauug

SEQ ID NO: 1445532 - RNA, 19 nt, Homo sapiens
aagaagaaacugacuugua

SEQ ID NO: 1445533 - RNA, 19 nt, Homo sapiens
gguuacaucugugauauca

SEQ ID NO: 1445534 - RNA, 19 nt, Homo sapiens
guuaaagucccugagaaua

SEQ ID NO: 1445535 - RNA, 19 nt, Homo sapiens
gcagaauguacaucaauga

SEQ ID NO: 1445536 - RNA, 19 nt, Homo sapiens
gguuugggcugcuuaguca

SEQ ID NO: 1445537 - RNA, 19 nt, Homo sapiens
uacagauucuccaagauuu

SEQ ID NO: 1445538 - RNA, 19 nt, Homo sapiens
uaaaugagaacacugacuu

SEQ ID NO: 1445539 - RNA, 19 nt, Homo sapiens
ccuggaccaucaaucuuua

SEQ ID NO: 1445540 - RNA, 19 nt, Homo sapiens
cuacaauuguucuugcauu

SEQ ID NO: 1445541 - RNA, 19 nt, Homo sapiens
gcuauggacuugguggauu

SEQ ID NO: 1445542 - RNA, 19 nt, Homo sapiens
caggaaugccucuuuauau

SEQ ID NO: 1445543 - RNA, 19 nt, Homo sapiens
aaagccaaguccucaguuu

SEQ ID NO: 1445544 - RNA, 19 nt, Homo sapiens
ucuuauagaugucagcauu

SEQ ID NO: 1445545 - RNA, 19 nt, Homo sapiens
aaaguguccuauugugaaa

SEQ ID NO: 1445546 - RNA, 19 nt, Homo sapiens
agaggaaaaucacacauua

SEQ ID NO: 1445547 - RNA, 19 nt, Homo sapiens
ggacacacaggacguuguu

SEQ ID NO: 1445548 - RNA, 19 nt, Homo sapiens
gucaaaagcuacagaauau

SEQ ID NO: 1445549 - RNA, 19 nt, Homo sapiens
caauaaugguaguccagaa

SEQ ID NO: 1445550 - RNA, 19 nt, Homo sapiens
gcuacacacucagcuggua

SEQ ID NO: 1445551 - RNA, 19 nt, Homo sapiens
aaacguaaacagcuucauu

SEQ ID NO: 1445552 - RNA, 19 nt, Homo sapiens
gagcagcccugugguuugg

SEQ ID NO: 1445553 - RNA, 19 nt, Homo sapiens
ccugguagcaauauuuaua

SEQ ID NO: 1445554 - RNA, 19 nt, Homo sapiens
uacgggauguuaauaaaug

SEQ ID NO: 1445555 - RNA, 19 nt, Homo sapiens
ggccuuggguguaagcuau

SEQ ID NO: 1445556 - RNA, 19 nt, Homo sapiens
gcuguaauccagugcaauu

SEQ ID NO: 1445557 - RNA, 19 nt, Homo sapiens
acacuacagucaauaaugg

SEQ ID NO: 1445558 - RNA, 19 nt, Homo sapiens
cuauuuagguauugcagaa

SEQ ID NO: 1445559 - RNA, 19 nt, Homo sapiens
uauuucaucuggccuggua

SEQ ID NO: 1445560 - RNA, 19 nt, Homo sapiens
gaacacugacuucccagau

SEQ ID NO: 1445561 - RNA, 19 nt, Homo sapiens
acaaacgucgucuaaauga

SEQ ID NO: 1445562 - RNA, 19 nt, Homo sapiens
gaagaaauaaagguuguca

SEQ ID NO: 1445563 - RNA, 19 nt, Homo sapiens
gugcccaacuuucagaaga

SEQ ID NO: 1445564 - RNA, 19 nt, Homo sapiens
gauaucacuuauacugcuu

SEQ ID NO: 1445565 - RNA, 19 nt, Homo sapiens
gaauggcuauggacuuggu

SEQ ID NO: 1445566 - RNA, 19 nt, Homo sapiens
ugaagauauuugcgaagaa

SEQ ID NO: 1445567 - RNA, 19 nt, Homo sapiens
caucuggccugguagcaau

SEQ ID NO: 1445568 - RNA, 19 nt, Homo sapiens
gguguuuggucuuauagau

SEQ ID NO: 1445569 - RNA, 19 nt, Homo sapiens
uuacagauucuccaagauu

SEQ ID NO: 1445570 - RNA, 19 nt, Homo sapiens
ugcaaagugcuauaaguua

SEQ ID NO: 1445571 - RNA, 19 nt, Homo sapiens
ucacuuauacugcuugugu

SEQ ID NO: 1445572 - RNA, 19 nt, Homo sapiens
ggaacuaauaucaaggauu

SEQ ID NO: 1445573 - RNA, 19 nt, Homo sapiens
ugcaugguguacauuaaua

SEQ ID NO: 1445574 - RNA, 19 nt, Homo sapiens
gguauaucauuccaaucaa

SEQ ID NO: 1445575 - RNA, 19 nt, Homo sapiens
uaaacaaaguaagguagga

SEQ ID NO: 1445576 - RNA, 19 nt, Homo sapiens
caagaagccgggagaagug

SEQ ID NO: 1445577 - RNA, 19 nt, Homo sapiens
caagaaggcucccaugaug

SEQ ID NO: 1445578 - RNA, 19 nt, Homo sapiens
guacagaacuacauaagca

SEQ ID NO: 1445579 - RNA, 19 nt, Homo sapiens
gcaacucuaugcugacuuu

SEQ ID NO: 1445580 - RNA, 19 nt, Homo sapiens
ugaaacugcuguccuuuaa

SEQ ID NO: 1445581 - RNA, 19 nt, Homo sapiens
gcaagagcccugaguauga

SEQ ID NO: 1445582 - RNA, 19 nt, Homo sapiens
gcgaggugcugacaagaaa

SEQ ID NO: 1445583 - RNA, 19 nt, Homo sapiens
ugacuacgauuccaauuca

SEQ ID NO: 1445584 - RNA, 19 nt, Homo sapiens
ggaggaagaggaagaagaa

SEQ ID NO: 1445585 - RNA, 19 nt, Homo sapiens
gagccgaaguuguacagaa

SEQ ID NO: 1445586 - RNA, 19 nt, Homo sapiens
gcugaguucuccauucuga

SEQ ID NO: 1445587 - RNA, 19 nt, Homo sapiens
ucucagagccgaaguugua

SEQ ID NO: 1445588 - RNA, 19 nt, Homo sapiens
ggaggacgaugaagaagag

SEQ ID NO: 1445589 - RNA, 19 nt, Homo sapiens
gaagaggcgcuuugaagug

SEQ ID NO: 1445590 - RNA, 19 nt, Homo sapiens
ggaggaggacgaugaagaa

SEQ ID NO: 1445591 - RNA, 19 nt, Homo sapiens
ccuuaacccucgaggaaua

SEQ ID NO: 1445592 - RNA, 19 nt, Homo sapiens
ggacagcacccaagacaag

SEQ ID NO: 1445593 - RNA, 19 nt, Homo sapiens
gaccuggccuccugcaaga

SEQ ID NO: 1445594 - RNA, 19 nt, Homo sapiens
ggaggaagacgaggaagaa

SEQ ID NO: 1445595 - RNA, 19 nt, Homo sapiens
acgaagagcucuccuccuu

SEQ ID NO: 1445596 - RNA, 19 nt, Homo sapiens
ugaaguguuuggugagauu

SEQ ID NO: 1445597 - RNA, 19 nt, Homo sapiens
cccacaagcugccaaagaa

SEQ ID NO: 1445598 - RNA, 19 nt, Homo sapiens
gaggugcugacaagaaaua

SEQ ID NO: 1445599 - RNA, 19 nt, Homo sapiens
agaggaggaucccuucaaa

SEQ ID NO: 1445600 - RNA, 19 nt, Homo sapiens
gcucugugaugucagcaaa

SEQ ID NO: 1445601 - RNA, 19 nt, Homo sapiens
cagauacacugacuacgau

SEQ ID NO: 1445602 - RNA, 19 nt, Homo sapiens
gcagagggccguguucaga

SEQ ID NO: 1445603 - RNA, 19 nt, Homo sapiens
ucacaaagcgacccaacuu

SEQ ID NO: 1445604 - RNA, 19 nt, Homo sapiens
ggacgaagcuggggaggaa

SEQ ID NO: 1445605 - RNA, 19 nt, Homo sapiens
gugcuagccucaccaaaca

SEQ ID NO: 1445606 - RNA, 19 nt, Homo sapiens
gggaacuucuggcucaaga

SEQ ID NO: 1445607 - RNA, 19 nt, Homo sapiens
gaggcgcuuugaaguguuu

SEQ ID NO: 1445608 - RNA, 19 nt, Homo sapiens
ggaagaagaggaggaggaa

SEQ ID NO: 1445609 - RNA, 19 nt, Homo sapiens
gggcugaguucuccauucu

SEQ ID NO: 1445610 - RNA, 19 nt, Homo sapiens
gacaagaaggcucccauga

SEQ ID NO: 1445611 - RNA, 19 nt, Homo sapiens
agucaacggccuuguguua

SEQ ID NO: 1445612 - RNA, 19 nt, Homo sapiens
ccaagacccuggaugacau

SEQ ID NO: 1445613 - RNA, 19 nt, Homo sapiens
uggcagagcucaccaagac

SEQ ID NO: 1445614 - RNA, 19 nt, Homo sapiens
gaaacugcuguccuuuaaa

SEQ ID NO: 1445615 - RNA, 19 nt, Homo sapiens
ccagaaggcguccugcaaa

SEQ ID NO: 1445616 - RNA, 19 nt, Homo sapiens
ucaccaagacccuggauga

SEQ ID NO: 1445617 - RNA, 19 nt, Homo sapiens
aaacugcuguccuuuaaaa

SEQ ID NO: 1445618 - RNA, 19 nt, Homo sapiens
gcugagagaccaugagauc

SEQ ID NO: 1445619 - RNA, 19 nt, Homo sapiens
ccagauacacugacuacga

SEQ ID NO: 1445620 - RNA, 19 nt, Homo sapiens
gcaacgagcccuccuucca

SEQ ID NO: 1445621 - RNA, 19 nt, Homo sapiens
aaccagacaucaagcauag

SEQ ID NO: 1445622 - RNA, 19 nt, Homo sapiens
aaaccagacaucaagcaua

SEQ ID NO: 1445623 - RNA, 19 nt, Homo sapiens
ugagagaacacccgugaga

SEQ ID NO: 1445624 - RNA, 19 nt, Homo sapiens
ggaagacgaggaagaagag

SEQ ID NO: 1445625 - RNA, 19 nt, Homo sapiens
cucaagacgugcucuguga

SEQ ID NO: 1445626 - RNA, 19 nt, Homo sapiens
ggaggaggaggacgaugaa

SEQ ID NO: 1445627 - RNA, 19 nt, Homo sapiens
ggaggaggaagacgaggaa

SEQ ID NO: 1445628 - RNA, 19 nt, Homo sapiens
ucaacggccuuguguuaag

SEQ ID NO: 1445629 - RNA, 19 nt, Homo sapiens
gaaauaggagaggcgagaa

SEQ ID NO: 1445630 - RNA, 19 nt, Homo sapiens
cagaaggcguccugcaaag

SEQ ID NO: 1445631 - RNA, 19 nt, Homo sapiens
caagcauagucuaggcaaa

SEQ ID NO: 1445632 - RNA, 19 nt, Homo sapiens
gcaaguaugaagccaugga

SEQ ID NO: 1445633 - RNA, 19 nt, Homo sapiens
gagcugaagaggcgcuuug

SEQ ID NO: 1445634 - RNA, 19 nt, Homo sapiens
cuuccaauauguuuacguu

SEQ ID NO: 1445635 - RNA, 19 nt, Homo sapiens
uuugacagcuuacugaaag

SEQ ID NO: 1445636 - RNA, 19 nt, Homo sapiens
uccgagcucuuccagauug

SEQ ID NO: 1445637 - RNA, 19 nt, Homo sapiens
aagaggcgcuuugaagugu

SEQ ID NO: 1445638 - RNA, 19 nt, Homo sapiens
gacgugcucugugauguca

SEQ ID NO: 1445639 - RNA, 19 nt, Homo sapiens
aguaugaagccauggauuu

SEQ ID NO: 1445640 - RNA, 19 nt, Homo sapiens
gcauugauaacagccuuaa

SEQ ID NO: 1445641 - RNA, 19 nt, Homo sapiens
gagccugcauugauaacag

SEQ ID NO: 1445642 - RNA, 19 nt, Homo sapiens
uaccagagcccaccaagca

SEQ ID NO: 1445643 - RNA, 19 nt, Homo sapiens
caagagcccugaguaugac

SEQ ID NO: 1445644 - RNA, 19 nt, Homo sapiens
aagcgucccuucuccuguu

SEQ ID NO: 1445645 - RNA, 19 nt, Homo sapiens
ggaggaggaagaggaagaa

SEQ ID NO: 1445646 - RNA, 19 nt, Homo sapiens
agagaacacccgugagaga

SEQ ID NO: 1445647 - RNA, 19 nt, Homo sapiens
gagcgagcgugagagaaca

SEQ ID NO: 1445648 - RNA, 19 nt, Homo sapiens
gcccacaagcugccaaaga

SEQ ID NO: 1445649 - RNA, 19 nt, Homo sapiens
uagucuaggcaaagaaaua

SEQ ID NO: 1445650 - RNA, 19 nt, Homo sapiens
aagaagaggaggaggaaga

SEQ ID NO: 1445651 - RNA, 19 nt, Homo sapiens
uugaaacugcuguccuuua

SEQ ID NO: 1445652 - RNA, 19 nt, Homo sapiens
ugaagaggcgcuuugaagu

SEQ ID NO: 1445653 - RNA, 19 nt, Homo sapiens
gaccaugagauccgugcua

SEQ ID NO: 1445654 - RNA, 19 nt, Homo sapiens
acuccgagcucuuccagau

SEQ ID NO: 1445655 - RNA, 19 nt, Homo sapiens
cauagucuaggcaaagaaa

SEQ ID NO: 1445656 - RNA, 19 nt, Homo sapiens
caagacgugcucugugaug

SEQ ID NO: 1445657 - RNA, 19 nt, Homo sapiens
acaagaaggcucccaugau

SEQ ID NO: 1445658 - RNA, 19 nt, Homo sapiens
ugagagagacuugaaacug

SEQ ID NO: 1445659 - RNA, 19 nt, Homo sapiens
ugacucggccaccugcuuu

SEQ ID NO: 1445660 - RNA, 19 nt, Homo sapiens
gagcagagggccguguuca

SEQ ID NO: 1445661 - RNA, 19 nt, Homo sapiens
ggcgauggugcaacucaua

SEQ ID NO: 1445662 - RNA, 19 nt, Homo sapiens
guggagacgcucuaucaug

SEQ ID NO: 1445663 - RNA, 19 nt, Homo sapiens
gggaggagcaacucuaugc

SEQ ID NO: 1445664 - RNA, 19 nt, Homo sapiens
ggccacauccuacccaaca

SEQ ID NO: 1445665 - RNA, 19 nt, Homo sapiens
gugcugacaagaaauagga

SEQ ID NO: 1445666 - RNA, 19 nt, Homo sapiens
agauugacagugagaauga

SEQ ID NO: 1445667 - RNA, 19 nt, Homo sapiens
gcagggaggaagacagaag

SEQ ID NO: 1445668 - RNA, 19 nt, Homo sapiens
gcggacagcacccaagaca

SEQ ID NO: 1445669 - RNA, 19 nt, Homo sapiens
gagagcagagggccguguu

SEQ ID NO: 1445670 - RNA, 19 nt, Homo sapiens
uagccucaccaaacacuuu

SEQ ID NO: 1445671 - RNA, 19 nt, Homo sapiens
cagaggaggaucccuucaa

SEQ ID NO: 1445672 - RNA, 19 nt, Homo sapiens
gcugacauuugcagaugag

SEQ ID NO: 1445673 - RNA, 19 nt, Homo sapiens
uggcugacauuugcagaug

SEQ ID NO: 1445674 - RNA, 19 nt, Homo sapiens
gauacacugacuacgauuc

SEQ ID NO: 1445675 - RNA, 19 nt, Homo sapiens
cucaagcucuggcucuuca

SEQ ID NO: 1445676 - RNA, 19 nt, Homo sapiens
cagaggaggaagaggaaga

SEQ ID NO: 1445677 - RNA, 19 nt, Homo sapiens
gaaauaaacugcuggcuuu

SEQ ID NO: 1445678 - RNA, 19 nt, Homo sapiens
ggaagaagguggaagauuu

SEQ ID NO: 1445679 - RNA, 19 nt, Homo sapiens
gaagaaacauaagcaguua

SEQ ID NO: 1445680 - RNA, 19 nt, Homo sapiens
cgaaagugcugacaaauga

SEQ ID NO: 1445681 - RNA, 19 nt, Homo sapiens
gaaagagccuuccagauca

SEQ ID NO: 1445682 - RNA, 19 nt, Homo sapiens
gcagaggacugucaagaaa

SEQ ID NO: 1445683 - RNA, 19 nt, Homo sapiens
gcacugaagucgucuguga

SEQ ID NO: 1445684 - RNA, 19 nt, Homo sapiens
gaaaugugcugaucuugau

SEQ ID NO: 1445685 - RNA, 19 nt, Homo sapiens
cagcugcucucaucucuua

SEQ ID NO: 1445686 - RNA, 19 nt, Homo sapiens
uagcuaagauugucaguaa

SEQ ID NO: 1445687 - RNA, 19 nt, Homo sapiens
gcugcuagcucaacuauug

SEQ ID NO: 1445688 - RNA, 19 nt, Homo sapiens
uguaagccaucaagaaaua

SEQ ID NO: 1445689 - RNA, 19 nt, Homo sapiens
caagauccauguauuagug

SEQ ID NO: 1445690 - RNA, 19 nt, Homo sapiens
gcauauggaugaucacugu

SEQ ID NO: 1445691 - RNA, 19 nt, Homo sapiens
gcuuucaacugcuacuuua

SEQ ID NO: 1445692 - RNA, 19 nt, Homo sapiens
ccagagaacuuuaaaauug

SEQ ID NO: 1445693 - RNA, 19 nt, Homo sapiens
gacaagcauuccucuguaa

SEQ ID NO: 1445694 - RNA, 19 nt, Homo sapiens
gaaauagugcugcaaacaa

SEQ ID NO: 1445695 - RNA, 19 nt, Homo sapiens
gacgugagcuucuacuuca

SEQ ID NO: 1445696 - RNA, 19 nt, Homo sapiens
gccagaagaugcccacuug

SEQ ID NO: 1445697 - RNA, 19 nt, Homo sapiens
ucucugagcucaugaagga

SEQ ID NO: 1445698 - RNA, 19 nt, Homo sapiens
ggaaggcgcuggcugaaaa

SEQ ID NO: 1445699 - RNA, 19 nt, Homo sapiens
gaugaucacuguccugaag

SEQ ID NO: 1445700 - RNA, 19 nt, Homo sapiens
uagacaaacuggagacuga

SEQ ID NO: 1445701 - RNA, 19 nt, Homo sapiens
ucacauggauacaguuguu

SEQ ID NO: 1445702 - RNA, 19 nt, Homo sapiens
ugacugccaucuucuuauu

SEQ ID NO: 1445703 - RNA, 19 nt, Homo sapiens
ucaccuagcucgcacugaa

SEQ ID NO: 1445704 - RNA, 19 nt, Homo sapiens
cagccaauauguggaguua

SEQ ID NO: 1445705 - RNA, 19 nt, Homo sapiens
agacaagcauuccucugua

SEQ ID NO: 1445706 - RNA, 19 nt, Homo sapiens
ucaguaaguucaucccaaa

SEQ ID NO: 1445707 - RNA, 19 nt, Homo sapiens
aggaagggcuggaaaguga

SEQ ID NO: 1445708 - RNA, 19 nt, Homo sapiens
gcgcagcuuucuucucuga

SEQ ID NO: 1445709 - RNA, 19 nt, Homo sapiens
acaaggagcacauucaauu

SEQ ID NO: 1445710 - RNA, 19 nt, Homo sapiens
agacugaguuagaagauga

SEQ ID NO: 1445711 - RNA, 19 nt, Homo sapiens
caucccaaaugaagaaauu

SEQ ID NO: 1445712 - RNA, 19 nt, Homo sapiens
uggaaagacugcaggguuu

SEQ ID NO: 1445713 - RNA, 19 nt, Homo sapiens
ucggagaacuaccggauaa

SEQ ID NO: 1445714 - RNA, 19 nt, Homo sapiens
cuauuggucuguucuauau

SEQ ID NO: 1445715 - RNA, 19 nt, Homo sapiens
agaaagagccuuccagauc

SEQ ID NO: 1445716 - RNA, 19 nt, Homo sapiens
gagaagguguaaagagaca

SEQ ID NO: 1445717 - RNA, 19 nt, Homo sapiens
cgucaagauccauguauua

SEQ ID NO: 1445718 - RNA, 19 nt, Homo sapiens
gaaacucuugcaagccuua

SEQ ID NO: 1445719 - RNA, 19 nt, Homo sapiens
ggacaaggagcacauucaa

SEQ ID NO: 1445720 - RNA, 19 nt, Homo sapiens
gaugugggauaaugugaau

SEQ ID NO: 1445721 - RNA, 19 nt, Homo sapiens
gcaauucugugugaaacug

SEQ ID NO: 1445722 - RNA, 19 nt, Homo sapiens
uauaggcaauucuguguga

SEQ ID NO: 1445723 - RNA, 19 nt, Homo sapiens
gcaggaugaugugagauug

SEQ ID NO: 1445724 - RNA, 19 nt, Homo sapiens
gugugaaacuggccaagaa

SEQ ID NO: 1445725 - RNA, 19 nt, Homo sapiens
caaggagcacauucaauuu

SEQ ID NO: 1445726 - RNA, 19 nt, Homo sapiens
ugaagaaacauaagcaguu

SEQ ID NO: 1445727 - RNA, 19 nt, Homo sapiens
acaaaggccuguggcauau

SEQ ID NO: 1445728 - RNA, 19 nt, Homo sapiens
gcacauucaauuucucuau

SEQ ID NO: 1445729 - RNA, 19 nt, Homo sapiens
gagacaagcauuccucugu

SEQ ID NO: 1445730 - RNA, 19 nt, Homo sapiens
cugagaagguguaaagaga

SEQ ID NO: 1445731 - RNA, 19 nt, Homo sapiens
ggacugucaagaaauguuu

SEQ ID NO: 1445732 - RNA, 19 nt, Homo sapiens
caagaccaccuuaacauuc

SEQ ID NO: 1445733 - RNA, 19 nt, Homo sapiens
ggaaauagugcugcaaaca

SEQ ID NO: 1445734 - RNA, 19 nt, Homo sapiens
cgaaaugugcugaucuuga

SEQ ID NO: 1445735 - RNA, 19 nt, Homo sapiens
uggaacagcugcucucauc

SEQ ID NO: 1445736 - RNA, 19 nt, Homo sapiens
uacaaaggccuguggcaua

SEQ ID NO: 1445737 - RNA, 19 nt, Homo sapiens
ggaguugcuugccgugaug

SEQ ID NO: 1445738 - RNA, 19 nt, Homo sapiens
gagagaaggccuugcaaag

SEQ ID NO: 1445739 - RNA, 19 nt, Homo sapiens
gcgaaagugcugacaaaug

SEQ ID NO: 1445740 - RNA, 19 nt, Homo sapiens
cuccaaauguggccuguuu

SEQ ID NO: 1445741 - RNA, 19 nt, Homo sapiens
aaaagagccugauuucauu

SEQ ID NO: 1445742 - RNA, 19 nt, Homo sapiens
uggaaaaucugaaaaguga

SEQ ID NO: 1445743 - RNA, 19 nt, Homo sapiens
gagcuucuacuucaaggaa

SEQ ID NO: 1445744 - RNA, 19 nt, Homo sapiens
uguaugaagugaucucaau

SEQ ID NO: 1445745 - RNA, 19 nt, Homo sapiens
aaauagugcugcaaacaag

SEQ ID NO: 1445746 - RNA, 19 nt, Homo sapiens
gccaauauguggaguuacu

SEQ ID NO: 1445747 - RNA, 19 nt, Homo sapiens
gaacagcugcucucaucuc

SEQ ID NO: 1445748 - RNA, 19 nt, Homo sapiens
gaucuuaggcacaaucuac

SEQ ID NO: 1445749 - RNA, 19 nt, Homo sapiens
ucuggaagaucagcuauug

SEQ ID NO: 1445750 - RNA, 19 nt, Homo sapiens
cugcgaaagugcugacaaa

SEQ ID NO: 1445751 - RNA, 19 nt, Homo sapiens
agaggacugucaagaaaug

SEQ ID NO: 1445752 - RNA, 19 nt, Homo sapiens
ccaagcacuucgucaagau

SEQ ID NO: 1445753 - RNA, 19 nt, Homo sapiens
caauuugaccagccaauau

SEQ ID NO: 1445754 - RNA, 19 nt, Homo sapiens
gcucaacuauuggucuguu

SEQ ID NO: 1445755 - RNA, 19 nt, Homo sapiens
gcugacaaaugauauugag

SEQ ID NO: 1445756 - RNA, 19 nt, Homo sapiens
acucacagaugccguuguu

SEQ ID NO: 1445757 - RNA, 19 nt, Homo sapiens
ggauuucuauaggcaauuc

SEQ ID NO: 1445758 - RNA, 19 nt, Homo sapiens
ugagcaggaugaugugaga

SEQ ID NO: 1445759 - RNA, 19 nt, Homo sapiens
gugaugacgugcagguuca

SEQ ID NO: 1445760 - RNA, 19 nt, Homo sapiens
aaagugcugacaaaugaua

SEQ ID NO: 1445761 - RNA, 19 nt, Homo sapiens
ggaguuacuagacagagaa

SEQ ID NO: 1445762 - RNA, 19 nt, Homo sapiens
ggccagggauuucuauagg

SEQ ID NO: 1445763 - RNA, 19 nt, Homo sapiens
gaagaagguggaagauuuu

SEQ ID NO: 1445764 - RNA, 19 nt, Homo sapiens
cggcgcagcuuucuucucu

SEQ ID NO: 1445765 - RNA, 19 nt, Homo sapiens
gagacugaguuagaagaug

SEQ ID NO: 1445766 - RNA, 19 nt, Homo sapiens
gagaaagagccuuccagau

SEQ ID NO: 1445767 - RNA, 19 nt, Homo sapiens
ggagcucuaugggguauua

SEQ ID NO: 1445768 - RNA, 19 nt, Homo sapiens
gaagucgucugugaaagcu

SEQ ID NO: 1445769 - RNA, 19 nt, Homo sapiens
aaacauaagcaguuaaugc

SEQ ID NO: 1445770 - RNA, 19 nt, Homo sapiens
aagaucagcuauuggagau

SEQ ID NO: 1445771 - RNA, 19 nt, Homo sapiens
cacauucaauuucucuaug

SEQ ID NO: 1445772 - RNA, 19 nt, Homo sapiens
gagccugauuucauuccuu

SEQ ID NO: 1445773 - RNA, 19 nt, Homo sapiens
ucaguggccugugcuaugu

SEQ ID NO: 1445774 - RNA, 19 nt, Homo sapiens
ucacaugccaguccucaga

SEQ ID NO: 1445775 - RNA, 19 nt, Homo sapiens
ucuguaagccaucaagaaa

SEQ ID NO: 1445776 - RNA, 19 nt, Homo sapiens
gcaguuaaugcuagaaucu

SEQ ID NO: 1445777 - RNA, 19 nt, Homo sapiens
gagcuuaccucgaauguga

SEQ ID NO: 1445778 - RNA, 19 nt, Homo sapiens
gcaagaagaugucuauauc

SEQ ID NO: 1445779 - RNA, 19 nt, Homo sapiens
ggacagagccuucuauucu

SEQ ID NO: 1445780 - RNA, 19 nt, Homo sapiens
gaucaaacacagaaucaua

SEQ ID NO: 1445781 - RNA, 19 nt, Homo sapiens
gaucacacaucaaugcaaa

SEQ ID NO: 1445782 - RNA, 19 nt, Homo sapiens
cgacuuagauuuggauauu

SEQ ID NO: 1445783 - RNA, 19 nt, Homo sapiens
ggaugacucugaauucuug

SEQ ID NO: 1445784 - RNA, 19 nt, Homo sapiens
ugacaugccuugugaugaa

SEQ ID NO: 1445785 - RNA, 19 nt, Homo sapiens
ggaagugauuggagauuug

SEQ ID NO: 1445786 - RNA, 19 nt, Homo sapiens
ucaagaggaugaauaugaa

SEQ ID NO: 1445787 - RNA, 19 nt, Homo sapiens
aaauugcucugcacacuaa

SEQ ID NO: 1445788 - RNA, 19 nt, Homo sapiens
ugaaaucccuacuucuuau

SEQ ID NO: 1445789 - RNA, 19 nt, Homo sapiens
ggaugaauaugaagcuuuc

SEQ ID NO: 1445790 - RNA, 19 nt, Homo sapiens
gaaaccaggcacugaauau

SEQ ID NO: 1445791 - RNA, 19 nt, Homo sapiens
gugaaaucccuacuucuua

SEQ ID NO: 1445792 - RNA, 19 nt, Homo sapiens
gacccugccugaugcuaua

SEQ ID NO: 1445793 - RNA, 19 nt, Homo sapiens
gaaagauaaccguggauga

SEQ ID NO: 1445794 - RNA, 19 nt, Homo sapiens
caaaggagggaauaagaaa

SEQ ID NO: 1445795 - RNA, 19 nt, Homo sapiens
gaagacgacuuagauuugg

SEQ ID NO: 1445796 - RNA, 19 nt, Homo sapiens
ggccagauuucgacaagaa

SEQ ID NO: 1445797 - RNA, 19 nt, Homo sapiens
gaaauugcucugcacacua

SEQ ID NO: 1445798 - RNA, 19 nt, Homo sapiens
gaaaucccuacuucuuaua

SEQ ID NO: 1445799 - RNA, 19 nt, Homo sapiens
agaagaaaguacacacuga

SEQ ID NO: 1445800 - RNA, 19 nt, Homo sapiens
ugaggaugaugaaggauuu

SEQ ID NO: 1445801 - RNA, 19 nt, Homo sapiens
uaugaagcuuuccaagaua

SEQ ID NO: 1445802 - RNA, 19 nt, Homo sapiens
gacaagaaguggaccucaa

SEQ ID NO: 1445803 - RNA, 19 nt, Homo sapiens
ucaguggaauggauaggua

SEQ ID NO: 1445804 - RNA, 19 nt, Homo sapiens
caauggagcucuguaugug

SEQ ID NO: 1445805 - RNA, 19 nt, Homo sapiens
ggauggagcccucguguuc

SEQ ID NO: 1445806 - RNA, 19 nt, Homo sapiens
ggaaauugcucugcacacu

SEQ ID NO: 1445807 - RNA, 19 nt, Homo sapiens
guaggaagcaucggacuuu

SEQ ID NO: 1445808 - RNA, 19 nt, Homo sapiens
gaauucaucaggccagauu

SEQ ID NO: 1445809 - RNA, 19 nt, Homo sapiens
caugggagcuggugaggau

SEQ ID NO: 1445810 - RNA, 19 nt, Homo sapiens
uaacuugggugggcaacuu

SEQ ID NO: 1445811 - RNA, 19 nt, Homo sapiens
gcagauuguccacacagua

SEQ ID NO: 1445812 - RNA, 19 nt, Homo sapiens
ugaagacgacuuagauuug

SEQ ID NO: 1445813 - RNA, 19 nt, Homo sapiens
gaagaaaguacacacugau

SEQ ID NO: 1445814 - RNA, 19 nt, Homo sapiens
auaugaagcuuuccaagau

SEQ ID NO: 1445815 - RNA, 19 nt, Homo sapiens
ggagcugaccauucucuuu

SEQ ID NO: 1445816 - RNA, 19 nt, Homo sapiens
ccagagaucacacaucaau

SEQ ID NO: 1445817 - RNA, 19 nt, Homo sapiens
ccagggaccagguguguuu

SEQ ID NO: 1445818 - RNA, 19 nt, Homo sapiens
gcucagaagauauuguuau

SEQ ID NO: 1445819 - RNA, 19 nt, Homo sapiens
ucaguacuauucuguggaa

SEQ ID NO: 1445820 - RNA, 19 nt, Homo sapiens
ugccagagaucacacauca

SEQ ID NO: 1445821 - RNA, 19 nt, Homo sapiens
agaauucucuguguaggaa

SEQ ID NO: 1445822 - RNA, 19 nt, Homo sapiens
uaacaggcaauauaugaga

SEQ ID NO: 1445823 - RNA, 19 nt, Homo sapiens
ccaaaggagggaauaagaa

SEQ ID NO: 1445824 - RNA, 19 nt, Homo sapiens
aaagagagagagagagaaa

SEQ ID NO: 1445825 - RNA, 19 nt, Homo sapiens
gaaaguacacacugaugag

SEQ ID NO: 1445826 - RNA, 19 nt, Homo sapiens
gauggaaggagaucaaaca

SEQ ID NO: 1445827 - RNA, 19 nt, Homo sapiens
gagaaacugagaaccaaga

SEQ ID NO: 1445828 - RNA, 19 nt, Homo sapiens
guccaccgauuaccacauu

SEQ ID NO: 1445829 - RNA, 19 nt, Homo sapiens
ggaauggauagguaacuug

SEQ ID NO: 1445830 - RNA, 19 nt, Homo sapiens
ccagguguguuuccucuca

SEQ ID NO: 1445831 - RNA, 19 nt, Homo sapiens
acacuaacaggcaauauau

SEQ ID NO: 1445832 - RNA, 19 nt, Homo sapiens
gaaagcaagaagaugucua

SEQ ID NO: 1445833 - RNA, 19 nt, Homo sapiens
gaagugauuggagauuuga

SEQ ID NO: 1445834 - RNA, 19 nt, Homo sapiens
gagaucaaacacagaauca

SEQ ID NO: 1445835 - RNA, 19 nt, Homo sapiens
gaauggcuccuucaacgau

SEQ ID NO: 1445836 - RNA, 19 nt, Homo sapiens
ugaauaucaugugagcaua

SEQ ID NO: 1445837 - RNA, 19 nt, Homo sapiens
ccacagggcacuauuaaaa

SEQ ID NO: 1445838 - RNA, 19 nt, Homo sapiens
aaugugaaaucccuacuuc

SEQ ID NO: 1445839 - RNA, 19 nt, Homo sapiens
cacauuggcccuuggauug

SEQ ID NO: 1445840 - RNA, 19 nt, Homo sapiens
cacacuaacaggcaauaua

SEQ ID NO: 1445841 - RNA, 19 nt, Homo sapiens
guauguggguggaaugaag

SEQ ID NO: 1445842 - RNA, 19 nt, Homo sapiens
gagccugucugcuauagcu

SEQ ID NO: 1445843 - RNA, 19 nt, Homo sapiens
gaugagaaacugagaacca

SEQ ID NO: 1445844 - RNA, 19 nt, Homo sapiens
agauaaccguggaugacua

SEQ ID NO: 1445845 - RNA, 19 nt, Homo sapiens
gggacuuggugaaacuuug

SEQ ID NO: 1445846 - RNA, 19 nt, Homo sapiens
gcagugguguggcauccau

SEQ ID NO: 1445847 - RNA, 19 nt, Homo sapiens
gcccucguguucagcuaua

SEQ ID NO: 1445848 - RNA, 19 nt, Homo sapiens
ugaaaccaggcacugaaua

SEQ ID NO: 1445849 - RNA, 19 nt, Homo sapiens
ggagaucaaacacagaauc

SEQ ID NO: 1445850 - RNA, 19 nt, Homo sapiens
ccacauuggcccuuggauu

SEQ ID NO: 1445851 - RNA, 19 nt, Homo sapiens
aguacacacugaugagaaa

SEQ ID NO: 1445852 - RNA, 19 nt, Homo sapiens
gauuggagauuugaaacca

SEQ ID NO: 1445853 - RNA, 19 nt, Homo sapiens
gaaugugaaaucccuacuu

SEQ ID NO: 1445854 - RNA, 19 nt, Homo sapiens
ggaagcaucggacuuuguc

SEQ ID NO: 1445855 - RNA, 19 nt, Homo sapiens
ggcuguaucucucacuuca

SEQ ID NO: 1445856 - RNA, 19 nt, Homo sapiens
gauaaccguggaugacuau

SEQ ID NO: 1445857 - RNA, 19 nt, Homo sapiens
gacaugccuugugaugaaa

SEQ ID NO: 1445858 - RNA, 19 nt, Homo sapiens
guuaaaccacuuccugcua

SEQ ID NO: 1445859 - RNA, 19 nt, Homo sapiens
gagcuggugaggaugauga

SEQ ID NO: 1445860 - RNA, 19 nt, Homo sapiens
gaaggagaucaaacacaga

SEQ ID NO: 1445861 - RNA, 19 nt, Homo sapiens
ucacacaucaaugcaaauu

SEQ ID NO: 1445862 - RNA, 19 nt, Homo sapiens
augaagcuuuccaagauaa

SEQ ID NO: 1445863 - RNA, 19 nt, Homo sapiens
gaggaugaauaugaagcuu

SEQ ID NO: 1445864 - RNA, 19 nt, Homo sapiens
cucaagaggaugaauauga

SEQ ID NO: 1445865 - RNA, 19 nt, Homo sapiens
cuucacauuucccacauug

SEQ ID NO: 1445866 - RNA, 19 nt, Homo sapiens
agaaaguacacacugauga

SEQ ID NO: 1445867 - RNA, 19 nt, Homo sapiens
acuaacaggcaauauauga

SEQ ID NO: 1445868 - RNA, 19 nt, Homo sapiens
ucaauggagcucuguaugu

SEQ ID NO: 1445869 - RNA, 19 nt, Homo sapiens
aaagcaagaagaugucuau

SEQ ID NO: 1445870 - RNA, 19 nt, Homo sapiens
gaauaucaugugagcauag

SEQ ID NO: 1445871 - RNA, 19 nt, Homo sapiens
aggaagugauuggagauuu

SEQ ID NO: 1445872 - RNA, 19 nt, Homo sapiens
agagagagagagagaaaga

SEQ ID NO: 1445873 - RNA, 19 nt, Homo sapiens
gccaaggcauccuggaagu

SEQ ID NO: 1445874 - RNA, 19 nt, Homo sapiens
aaggagggaauaagaaauu

SEQ ID NO: 1445875 - RNA, 19 nt, Homo sapiens
aauaugaagcuuuccaaga

SEQ ID NO: 1445876 - RNA, 19 nt, Homo sapiens
cagauuguccacacaguau

SEQ ID NO: 1445877 - RNA, 19 nt, Homo sapiens
caacaacagucuuucauua

SEQ ID NO: 1445878 - RNA, 19 nt, Homo sapiens
ggaagcauguccuuacuua

SEQ ID NO: 1445879 - RNA, 19 nt, Homo sapiens
caagaagacccuagaauua

SEQ ID NO: 1445880 - RNA, 19 nt, Homo sapiens
ggagagugcuguuugcuuu

SEQ ID NO: 1445881 - RNA, 19 nt, Homo sapiens
gaagaacuccugguuguua

SEQ ID NO: 1445882 - RNA, 19 nt, Homo sapiens
gaugagagauggucagaug

SEQ ID NO: 1445883 - RNA, 19 nt, Homo sapiens
gcaagaagacccuagaauu

SEQ ID NO: 1445884 - RNA, 19 nt, Homo sapiens
uaaagaacauguugguuga

SEQ ID NO: 1445885 - RNA, 19 nt, Homo sapiens
gaaaagaguuuacugaaug

SEQ ID NO: 1445886 - RNA, 19 nt, Homo sapiens
guagugaccucaaauaaag

SEQ ID NO: 1445887 - RNA, 19 nt, Homo sapiens
gaggugaacuggauauugu

SEQ ID NO: 1445888 - RNA, 19 nt, Homo sapiens
gagcaugacugacuucaca

SEQ ID NO: 1445889 - RNA, 19 nt, Homo sapiens
gaacugcucuggccucucu

SEQ ID NO: 1445890 - RNA, 19 nt, Homo sapiens
uaucauagguaucagguuu

SEQ ID NO: 1445891 - RNA, 19 nt, Homo sapiens
guagaaagcaugauuacaa

SEQ ID NO: 1445892 - RNA, 19 nt, Homo sapiens
ggaaccacaucagccauua

SEQ ID NO: 1445893 - RNA, 19 nt, Homo sapiens
gccauguacuugauuauuu

SEQ ID NO: 1445894 - RNA, 19 nt, Homo sapiens
gcauucaucuagaaacauu

SEQ ID NO: 1445895 - RNA, 19 nt, Homo sapiens
ugaagucugugcuugauaa

SEQ ID NO: 1445896 - RNA, 19 nt, Homo sapiens
gcuaguaauuuccucguaa

SEQ ID NO: 1445897 - RNA, 19 nt, Homo sapiens
cuaaaugaauccaguaguu

SEQ ID NO: 1445898 - RNA, 19 nt, Homo sapiens
uaucaaaucuggaggugaa

SEQ ID NO: 1445899 - RNA, 19 nt, Homo sapiens
ggcaaaugauucaaguaua

SEQ ID NO: 1445900 - RNA, 19 nt, Homo sapiens
gaccucaaauaaagaagua

SEQ ID NO: 1445901 - RNA, 19 nt, Homo sapiens
gugcucagauuauucaauu

SEQ ID NO: 1445902 - RNA, 19 nt, Homo sapiens
gaagagaggaauacaugaa

SEQ ID NO: 1445903 - RNA, 19 nt, Homo sapiens
auagauagcuugcgucgaa

SEQ ID NO: 1445904 - RNA, 19 nt, Homo sapiens
gaagagaguggaauagaga

SEQ ID NO: 1445905 - RNA, 19 nt, Homo sapiens
cauguugguugaauguuua

SEQ ID NO: 1445906 - RNA, 19 nt, Homo sapiens
aaacuucauugcagaauug

SEQ ID NO: 1445907 - RNA, 19 nt, Homo sapiens
agaaaggcaucaugucauu

SEQ ID NO: 1445908 - RNA, 19 nt, Homo sapiens
gaacuggggugauccauga

SEQ ID NO: 1445909 - RNA, 19 nt, Homo sapiens
gcacagagagguuauaggu

SEQ ID NO: 1445910 - RNA, 19 nt, Homo sapiens
ccacaucagccauuacuuu

SEQ ID NO: 1445911 - RNA, 19 nt, Homo sapiens
ggaagagaguggaauagag

SEQ ID NO: 1445912 - RNA, 19 nt, Homo sapiens
aaacaaagaaugcaggaaa

SEQ ID NO: 1445913 - RNA, 19 nt, Homo sapiens
uccaagcacuguauaauga

SEQ ID NO: 1445914 - RNA, 19 nt, Homo sapiens
guaaaggaauuagcacaau

SEQ ID NO: 1445915 - RNA, 19 nt, Homo sapiens
gccauuuggucuuuacuuu

SEQ ID NO: 1445916 - RNA, 19 nt, Homo sapiens
cgaauagucuaaaugaauc

SEQ ID NO: 1445917 - RNA, 19 nt, Homo sapiens
gcucaggaacggauagaua

SEQ ID NO: 1445918 - RNA, 19 nt, Homo sapiens
guaugucucuuacuucaau

SEQ ID NO: 1445919 - RNA, 19 nt, Homo sapiens
gguuguaccuuccuaaauc

SEQ ID NO: 1445920 - RNA, 19 nt, Homo sapiens
guaauuuccucguaaugau

SEQ ID NO: 1445921 - RNA, 19 nt, Homo sapiens
ugacaaggugcucagauua

SEQ ID NO: 1445922 - RNA, 19 nt, Homo sapiens
agaauaagcucugacaaca

SEQ ID NO: 1445923 - RNA, 19 nt, Homo sapiens
ggaaauucaugugcagaga

SEQ ID NO: 1445924 - RNA, 19 nt, Homo sapiens
ucuccaagcuguaguucua

SEQ ID NO: 1445925 - RNA, 19 nt, Homo sapiens
uggcuuagcugugguugua

SEQ ID NO: 1445926 - RNA, 19 nt, Homo sapiens
aaaguugggcuauacauaa

SEQ ID NO: 1445927 - RNA, 19 nt, Homo sapiens
ugagguggauaaauacaaa

SEQ ID NO: 1445928 - RNA, 19 nt, Homo sapiens
gaaaggaaacaaagaaugc

SEQ ID NO: 1445929 - RNA, 19 nt, Homo sapiens
gcuacuuucccuccuauua

SEQ ID NO: 1445930 - RNA, 19 nt, Homo sapiens
cagaauugcugccugacaa

SEQ ID NO: 1445931 - RNA, 19 nt, Homo sapiens
agacaacccuagaccuaaa

SEQ ID NO: 1445932 - RNA, 19 nt, Homo sapiens
agacuuccgugucauuaaa

SEQ ID NO: 1445933 - RNA, 19 nt, Homo sapiens
gauggaagagaguggaaua

SEQ ID NO: 1445934 - RNA, 19 nt, Homo sapiens
gacaaaacauucaguagaa

SEQ ID NO: 1445935 - RNA, 19 nt, Homo sapiens
cagaugaaaguguguuaua

SEQ ID NO: 1445936 - RNA, 19 nt, Homo sapiens
ccgaagaacuccugguugu

SEQ ID NO: 1445937 - RNA, 19 nt, Homo sapiens
gcaauggcaugaugacaac

SEQ ID NO: 1445938 - RNA, 19 nt, Homo sapiens
ccauuugcgucuacacuuu

SEQ ID NO: 1445939 - RNA, 19 nt, Homo sapiens
ugguuugccuuaagcauua

SEQ ID NO: 1445940 - RNA, 19 nt, Homo sapiens
ggaaaagaguuuacugaau

SEQ ID NO: 1445941 - RNA, 19 nt, Homo sapiens
cuagaaacauuuacacaag

SEQ ID NO: 1445942 - RNA, 19 nt, Homo sapiens
gggcuaugcagcuggauua

SEQ ID NO: 1445943 - RNA, 19 nt, Homo sapiens
ggaauccuauggugaaguc

SEQ ID NO: 1445944 - RNA, 19 nt, Homo sapiens
gcaggaugauguauugagu

SEQ ID NO: 1445945 - RNA, 19 nt, Homo sapiens
gaugacaacaacagucuuu

SEQ ID NO: 1445946 - RNA, 19 nt, Homo sapiens
gcucaacagucacuauaag

SEQ ID NO: 1445947 - RNA, 19 nt, Homo sapiens
uaaacaggacuuuguaguu

SEQ ID NO: 1445948 - RNA, 19 nt, Homo sapiens
gggcaaaugauucaaguau

SEQ ID NO: 1445949 - RNA, 19 nt, Homo sapiens
ggaagccaaauugauaaua

SEQ ID NO: 1445950 - RNA, 19 nt, Homo sapiens
guucaguacuuccaagaau

SEQ ID NO: 1445951 - RNA, 19 nt, Homo sapiens
uagcaggcauguauaaaca

SEQ ID NO: 1445952 - RNA, 19 nt, Homo sapiens
uaacagggacagaauacuu

SEQ ID NO: 1445953 - RNA, 19 nt, Homo sapiens
uaaaggaauuagcacaauc

SEQ ID NO: 1445954 - RNA, 19 nt, Homo sapiens
gguuugacauugguuguuu

SEQ ID NO: 1445955 - RNA, 19 nt, Homo sapiens
ggagggagagugcuguuug

SEQ ID NO: 1445956 - RNA, 19 nt, Homo sapiens
cuuuauugcuuguggguua

SEQ ID NO: 1445957 - RNA, 19 nt, Homo sapiens
aggaugauguauugaguaa

SEQ ID NO: 1445958 - RNA, 19 nt, Homo sapiens
caggauaugguguucauuu

SEQ ID NO: 1445959 - RNA, 19 nt, Homo sapiens
acaaggugcucagauuauu

SEQ ID NO: 1445960 - RNA, 19 nt, Homo sapiens
ccaagucacaaaugucuuu

SEQ ID NO: 1445961 - RNA, 19 nt, Homo sapiens
aagcauguccuuacuuaaa

SEQ ID NO: 1445962 - RNA, 19 nt, Homo sapiens
uggcauggcucccuauauc

SEQ ID NO: 1445963 - RNA, 19 nt, Homo sapiens
gaagacccuagaauuacua

SEQ ID NO: 1445964 - RNA, 19 nt, Homo sapiens
gagacaacccuagaccuaa

SEQ ID NO: 1445965 - RNA, 19 nt, Homo sapiens
uaacucaucaucucuaaca

SEQ ID NO: 1445966 - RNA, 19 nt, Homo sapiens
guccuuagauuucccuguu

SEQ ID NO: 1445967 - RNA, 19 nt, Homo sapiens
uacuuucccuccuauuaua

SEQ ID NO: 1445968 - RNA, 19 nt, Homo sapiens
gguaucagguuugcuuugu

SEQ ID NO: 1445969 - RNA, 19 nt, Homo sapiens
accaguaccuuuggaauuu

SEQ ID NO: 1445970 - RNA, 19 nt, Homo sapiens
cagcuugaguguucuguuc

SEQ ID NO: 1445971 - RNA, 19 nt, Homo sapiens
gguugaagcuagaaauuuu

SEQ ID NO: 1445972 - RNA, 19 nt, Homo sapiens
ucaguagaaagcaugauua

SEQ ID NO: 1445973 - RNA, 19 nt, Homo sapiens
guugggcuauacauaaauu

SEQ ID NO: 1445974 - RNA, 19 nt, Homo sapiens
ugagacaacccuagaccua

SEQ ID NO: 1445975 - RNA, 19 nt, Homo sapiens
gacaaggugcucagauuau

SEQ ID NO: 1445976 - RNA, 19 nt, Homo sapiens
guggugguguuuaggcaua

SEQ ID NO: 1445977 - RNA, 19 nt, Homo sapiens
gaacugaacacauaucauu

SEQ ID NO: 1445978 - RNA, 19 nt, Homo sapiens
gaagugagauuugcauuau

SEQ ID NO: 1445979 - RNA, 19 nt, Homo sapiens
caagagugcugauaccuuu

SEQ ID NO: 1445980 - RNA, 19 nt, Homo sapiens
gaacugugcuucuugaaca

SEQ ID NO: 1445981 - RNA, 19 nt, Homo sapiens
gacauucacuguauaagaa

SEQ ID NO: 1445982 - RNA, 19 nt, Homo sapiens
caauagagcccuuaacauu

SEQ ID NO: 1445983 - RNA, 19 nt, Homo sapiens
gguaaacacugauccagaa

SEQ ID NO: 1445984 - RNA, 19 nt, Homo sapiens
gcaauugcuucgaugauga

SEQ ID NO: 1445985 - RNA, 19 nt, Homo sapiens
ggacagacuuaaaccaguu

SEQ ID NO: 1445986 - RNA, 19 nt, Homo sapiens
gaaaggcucuaguuacagu

SEQ ID NO: 1445987 - RNA, 19 nt, Homo sapiens
gagagaauaugaugaagag

SEQ ID NO: 1445988 - RNA, 19 nt, Homo sapiens
ucaaaggccuggucauuca

SEQ ID NO: 1445989 - RNA, 19 nt, Homo sapiens
ggacugaaccaauuagaau

SEQ ID NO: 1445990 - RNA, 19 nt, Homo sapiens
caaggaaauuugagucuuc

SEQ ID NO: 1445991 - RNA, 19 nt, Homo sapiens
guucagggcucaauuugug

SEQ ID NO: 1445992 - RNA, 19 nt, Homo sapiens
gaucaaaggccuggucauu

SEQ ID NO: 1445993 - RNA, 19 nt, Homo sapiens
gauaugagucuuacagguu

SEQ ID NO: 1445994 - RNA, 19 nt, Homo sapiens
gagaaccaauagcaaauag

SEQ ID NO: 1445995 - RNA, 19 nt, Homo sapiens
guagagaaaguaacaaaug

SEQ ID NO: 1445996 - RNA, 19 nt, Homo sapiens
gagaauugguagagaaagu

SEQ ID NO: 1445997 - RNA, 19 nt, Homo sapiens
gaaauuugagucuuccauu

SEQ ID NO: 1445998 - RNA, 19 nt, Homo sapiens
gaggagagaauaugaugaa

SEQ ID NO: 1445999 - RNA, 19 nt, Homo sapiens
ugauaaauccugacauuga

SEQ ID NO: 1446000 - RNA, 19 nt, Homo sapiens
gaacagagaauugguagag

SEQ ID NO: 1446001 - RNA, 19 nt, Homo sapiens
ccagaagccuuacagaagu

SEQ ID NO: 1446002 - RNA, 19 nt, Homo sapiens
auagagcccuuaacauuga

SEQ ID NO: 1446003 - RNA, 19 nt, Homo sapiens
caacucaggcuguagaaga

SEQ ID NO: 1446004 - RNA, 19 nt, Homo sapiens
acuaugagauuucaguuga

SEQ ID NO: 1446005 - RNA, 19 nt, Homo sapiens
ggaguauuaucagaaagaa

SEQ ID NO: 1446006 - RNA, 19 nt, Homo sapiens
acagguuucuuccaucuuu

SEQ ID NO: 1446007 - RNA, 19 nt, Homo sapiens
gaaaauggauggacugaac

SEQ ID NO: 1446008 - RNA, 19 nt, Homo sapiens
gcauuauucuucuguugga

SEQ ID NO: 1446009 - RNA, 19 nt, Homo sapiens
uaaagaggagagaauauga

SEQ ID NO: 1446010 - RNA, 19 nt, Homo sapiens
gaauugagguucgucuagu

SEQ ID NO: 1446011 - RNA, 19 nt, Homo sapiens
uggauggacugaaccaauu

SEQ ID NO: 1446012 - RNA, 19 nt, Homo sapiens
gacaucauauucacaccaa

SEQ ID NO: 1446013 - RNA, 19 nt, Homo sapiens
acagagaauugguagagaa

SEQ ID NO: 1446014 - RNA, 19 nt, Homo sapiens
ggagagaauaugaugaaga

SEQ ID NO: 1446015 - RNA, 19 nt, Homo sapiens
auagauaguuuacggaaug

SEQ ID NO: 1446016 - RNA, 19 nt, Homo sapiens
gauaaauccugacauugac

SEQ ID NO: 1446017 - RNA, 19 nt, Homo sapiens
ggauggacugaaccaauua

SEQ ID NO: 1446018 - RNA, 19 nt, Homo sapiens
gagauuugcauuauucuuc

SEQ ID NO: 1446019 - RNA, 19 nt, Homo sapiens
guaaagaggagagaauaug

SEQ ID NO: 1446020 - RNA, 19 nt, Homo sapiens
aagaugagcuucgaacugu

SEQ ID NO: 1446021 - RNA, 19 nt, Homo sapiens
aaauuugagucuuccauug

SEQ ID NO: 1446022 - RNA, 19 nt, Homo sapiens
gccuggucauucaauauua

SEQ ID NO: 1446023 - RNA, 19 nt, Homo sapiens
ugaagggacuggcauaaac

SEQ ID NO: 1446024 - RNA, 19 nt, Homo sapiens
gaugaacugauuagacauu

SEQ ID NO: 1446025 - RNA, 19 nt, Homo sapiens
agaagugagauuugcauua

SEQ ID NO: 1446026 - RNA, 19 nt, Homo sapiens
gaaccaauagcaaauagag

SEQ ID NO: 1446027 - RNA, 19 nt, Homo sapiens
ggcagagaaucagguuaua

SEQ ID NO: 1446028 - RNA, 19 nt, Homo sapiens
cuaaaaggaugaacugauu

SEQ ID NO: 1446029 - RNA, 19 nt, Homo sapiens
acgaugauguuaugacuau

SEQ ID NO: 1446030 - RNA, 19 nt, Homo sapiens
caauaaagaagaugagcuu

SEQ ID NO: 1446031 - RNA, 19 nt, Homo sapiens
gaauugguagagaaaguaa

SEQ ID NO: 1446032 - RNA, 19 nt, Homo sapiens
gaugauguuaugacuauug

SEQ ID NO: 1446033 - RNA, 19 nt, Homo sapiens
cuugaacagugaaggauuu

SEQ ID NO: 1446034 - RNA, 19 nt, Homo sapiens
ugagagcacuaaaugaagu

SEQ ID NO: 1446035 - RNA, 19 nt, Homo sapiens
uugaaaggcucuaguuaca

SEQ ID NO: 1446036 - RNA, 19 nt, Homo sapiens
gcauugaaaggcucuaguu

SEQ ID NO: 1446037 - RNA, 19 nt, Homo sapiens
aggaugaacugauuagaca

SEQ ID NO: 1446038 - RNA, 19 nt, Homo sapiens
ucaugaugcuguuacaaau

SEQ ID NO: 1446039 - RNA, 19 nt, Homo sapiens
cauuugaguuucauucugu

SEQ ID NO: 1446040 - RNA, 19 nt, Homo sapiens
guuuaaugauggugcaauu

SEQ ID NO: 1446041 - RNA, 19 nt, Homo sapiens
cagaagccuuacagaaguu

SEQ ID NO: 1446042 - RNA, 19 nt, Homo sapiens
ggucugagggucauuuaug

SEQ ID NO: 1446043 - RNA, 19 nt, Homo sapiens
gaauugauaccagugaaau

SEQ ID NO: 1446044 - RNA, 19 nt, Homo sapiens
cgagaaccaauagcaaaua

SEQ ID NO: 1446045 - RNA, 19 nt, Homo sapiens
gcucuacaguccggaagaa

SEQ ID NO: 1446046 - RNA, 19 nt, Homo sapiens
ccuggucauucaauauuaa

SEQ ID NO: 1446047 - RNA, 19 nt, Homo sapiens
acacauuccuuuccagaag

SEQ ID NO: 1446048 - RNA, 19 nt, Homo sapiens
ggaguuugguaaaauauug

SEQ ID NO: 1446049 - RNA, 19 nt, Homo sapiens
auaugagucuuacagguuu

SEQ ID NO: 1446050 - RNA, 19 nt, Homo sapiens
gacauugaccuaauugaca

SEQ ID NO: 1446051 - RNA, 19 nt, Homo sapiens
cugaacacauaucauuuga

SEQ ID NO: 1446052 - RNA, 19 nt, Homo sapiens
agugagauuugcauuauuc

SEQ ID NO: 1446053 - RNA, 19 nt, Homo sapiens
cauugaaaggcucuaguua

SEQ ID NO: 1446054 - RNA, 19 nt, Homo sapiens
ggaauugagguucgucuag

SEQ ID NO: 1446055 - RNA, 19 nt, Homo sapiens
cagguuucuuccaucuuua

SEQ ID NO: 1446056 - RNA, 19 nt, Homo sapiens
ccaauagcaaauagaguuu

SEQ ID NO: 1446057 - RNA, 19 nt, Homo sapiens
aaacgacaaggaaauuuga

SEQ ID NO: 1446058 - RNA, 19 nt, Homo sapiens
ucuauuaggaguuugguaa

SEQ ID NO: 1446059 - RNA, 19 nt, Homo sapiens
gaacgacaucauauucaca

SEQ ID NO: 1446060 - RNA, 19 nt, Homo sapiens
uuaacaggguugcaacuca

SEQ ID NO: 1446061 - RNA, 19 nt, Homo sapiens
aggcuuaaauaaaggacua

SEQ ID NO: 1446062 - RNA, 19 nt, Homo sapiens
ucuguuggauucugauaga

SEQ ID NO: 1446063 - RNA, 19 nt, Homo sapiens
aauagagcccuuaacauug

SEQ ID NO: 1446064 - RNA, 19 nt, Homo sapiens
aauugagguucgucuagua

SEQ ID NO: 1446065 - RNA, 19 nt, Homo sapiens
uagaauugauaccagugaa

SEQ ID NO: 1446066 - RNA, 19 nt, Homo sapiens
gcaaauagaguuuucucaa

SEQ ID NO: 1446067 - RNA, 19 nt, Homo sapiens
gggcucaauuuguguacug

SEQ ID NO: 1446068 - RNA, 19 nt, Homo sapiens
cacaauagagcccuuaaca

SEQ ID NO: 1446069 - RNA, 19 nt, Homo sapiens
agacauucacuguauaaga

SEQ ID NO: 1446070 - RNA, 19 nt, Homo sapiens
cagcaguucugggugaaau

SEQ ID NO: 1446071 - RNA, 19 nt, Homo sapiens
gaguuucauucuguaauuc

SEQ ID NO: 1446072 - RNA, 19 nt, Homo sapiens
gaaugagggaauugagguu

SEQ ID NO: 1446073 - RNA, 19 nt, Homo sapiens
uaugagauuucaguugaug

SEQ ID NO: 1446074 - RNA, 19 nt, Homo sapiens
auccagggcuuccuacuau

SEQ ID NO: 1446075 - RNA, 19 nt, Homo sapiens
guuaggaguauuaucagaa

SEQ ID NO: 1446076 - RNA, 19 nt, Homo sapiens
ggugaaauacagauagcaa

SEQ ID NO: 1446077 - RNA, 19 nt, Homo sapiens
gaaaggauauaauggauuc

SEQ ID NO: 1446078 - RNA, 19 nt, Homo sapiens
gaacugugaucugguauuu

SEQ ID NO: 1446079 - RNA, 19 nt, Homo sapiens
gcagaguugugguuuguua

SEQ ID NO: 1446080 - RNA, 19 nt, Homo sapiens
ugacauaucuuccauuuca

SEQ ID NO: 1446081 - RNA, 19 nt, Homo sapiens
ccuauaagcucuccucaaa

SEQ ID NO: 1446082 - RNA, 19 nt, Homo sapiens
gcccagagauguucauuug

SEQ ID NO: 1446083 - RNA, 19 nt, Homo sapiens
caaacuaccucucugauag

SEQ ID NO: 1446084 - RNA, 19 nt, Homo sapiens
ggucugcucuccugcauuu

SEQ ID NO: 1446085 - RNA, 19 nt, Homo sapiens
caacuucauugccaacuuu

SEQ ID NO: 1446086 - RNA, 19 nt, Homo sapiens
gguaaaaccuuagagauua

SEQ ID NO: 1446087 - RNA, 19 nt, Homo sapiens
uuagaugacuucccaguuu

SEQ ID NO: 1446088 - RNA, 19 nt, Homo sapiens
ggacaugcagucuacauuu

SEQ ID NO: 1446089 - RNA, 19 nt, Homo sapiens
gcuuuagaguucugaaaua

SEQ ID NO: 1446090 - RNA, 19 nt, Homo sapiens
ugaaacaagucauagaaga

SEQ ID NO: 1446091 - RNA, 19 nt, Homo sapiens
guacagggaaccucaagua

SEQ ID NO: 1446092 - RNA, 19 nt, Homo sapiens
caacuugcuucuuucuauu

SEQ ID NO: 1446093 - RNA, 19 nt, Homo sapiens
gggcaucccugguccuuug

SEQ ID NO: 1446094 - RNA, 19 nt, Homo sapiens
gguauuuguugaagcauuu

SEQ ID NO: 1446095 - RNA, 19 nt, Homo sapiens
ugagaacugugaucuggua

SEQ ID NO: 1446096 - RNA, 19 nt, Homo sapiens
ccacugauccugcaacuug

SEQ ID NO: 1446097 - RNA, 19 nt, Homo sapiens
ggauauaauggauuccuua

SEQ ID NO: 1446098 - RNA, 19 nt, Homo sapiens
gcagaaaggauauaaugga

SEQ ID NO: 1446099 - RNA, 19 nt, Homo sapiens
ucaagaagaugcacaaugc

SEQ ID NO: 1446100 - RNA, 19 nt, Homo sapiens
cuaguggccuuccuucuuu

SEQ ID NO: 1446101 - RNA, 19 nt, Homo sapiens
guuaauacccuucuauaug

SEQ ID NO: 1446102 - RNA, 19 nt, Homo sapiens
guaccucauugaugucuuu

SEQ ID NO: 1446103 - RNA, 19 nt, Homo sapiens
aaacaugguccgaguagua

SEQ ID NO: 1446104 - RNA, 19 nt, Homo sapiens
gaagaugcacaaugccuuu

SEQ ID NO: 1446105 - RNA, 19 nt, Homo sapiens
gacaugcagucuacauuug

SEQ ID NO: 1446106 - RNA, 19 nt, Homo sapiens
ggagugauauggacauguc

SEQ ID NO: 1446107 - RNA, 19 nt, Homo sapiens
ggaaauauuugggacucaa

SEQ ID NO: 1446108 - RNA, 19 nt, Homo sapiens
uaucuugcccuuccuauaa

SEQ ID NO: 1446109 - RNA, 19 nt, Homo sapiens
gaaagcagaguugugguuu

SEQ ID NO: 1446110 - RNA, 19 nt, Homo sapiens
caaggagcauuucccagaa

SEQ ID NO: 1446111 - RNA, 19 nt, Homo sapiens
cagggaaccucaaguagug

SEQ ID NO: 1446112 - RNA, 19 nt, Homo sapiens
uaaagaaugagaacuguga

SEQ ID NO: 1446113 - RNA, 19 nt, Homo sapiens
uuaauacccuucuauaugg

SEQ ID NO: 1446114 - RNA, 19 nt, Homo sapiens
ccaaacuaccucucugaua

SEQ ID NO: 1446115 - RNA, 19 nt, Homo sapiens
acacugacacuuacaauga

SEQ ID NO: 1446116 - RNA, 19 nt, Homo sapiens
gaacagaagggcgagagaa

SEQ ID NO: 1446117 - RNA, 19 nt, Homo sapiens
gggacucaauguaguuauu

SEQ ID NO: 1446118 - RNA, 19 nt, Homo sapiens
ucacagaugauacugcuuu

SEQ ID NO: 1446119 - RNA, 19 nt, Homo sapiens
cagaaaggauauaauggau

SEQ ID NO: 1446120 - RNA, 19 nt, Homo sapiens
gauagcugguguucaugaa

SEQ ID NO: 1446121 - RNA, 19 nt, Homo sapiens
cagaugauacugcuuuauu

SEQ ID NO: 1446122 - RNA, 19 nt, Homo sapiens
gagcauggucauaauguga

SEQ ID NO: 1446123 - RNA, 19 nt, Homo sapiens
ucaagagcauggucauaau

SEQ ID NO: 1446124 - RNA, 19 nt, Homo sapiens
gagcaguaccucauugaug

SEQ ID NO: 1446125 - RNA, 19 nt, Homo sapiens
ugucuuauguuccaguauu

SEQ ID NO: 1446126 - RNA, 19 nt, Homo sapiens
gaaaccauuuguggccauu

SEQ ID NO: 1446127 - RNA, 19 nt, Homo sapiens
ggacucaauguaguuauuu

SEQ ID NO: 1446128 - RNA, 19 nt, Homo sapiens
acaguugccuucuuaagau

SEQ ID NO: 1446129 - RNA, 19 nt, Homo sapiens
gccauuaccuacuguugga

SEQ ID NO: 1446130 - RNA, 19 nt, Homo sapiens
gcuaggaacagaagcaaga

SEQ ID NO: 1446131 - RNA, 19 nt, Homo sapiens
cagaagggcgagagaauug

SEQ ID NO: 1446132 - RNA, 19 nt, Homo sapiens
ccaggaaggugaagaagac

SEQ ID NO: 1446133 - RNA, 19 nt, Homo sapiens
ggacaugucagaguucuca

SEQ ID NO: 1446134 - RNA, 19 nt, Homo sapiens
cuacauagaaacagcauug

SEQ ID NO: 1446135 - RNA, 19 nt, Homo sapiens
ucugauagcugguguucau

SEQ ID NO: 1446136 - RNA, 19 nt, Homo sapiens
cacagaugauacugcuuua

SEQ ID NO: 1446137 - RNA, 19 nt, Homo sapiens
acaggacucugacaacuuc

SEQ ID NO: 1446138 - RNA, 19 nt, Homo sapiens
ggaaacaugguccgaguag

SEQ ID NO: 1446139 - RNA, 19 nt, Homo sapiens
ggacuggcuuccucagagu

SEQ ID NO: 1446140 - RNA, 19 nt, Homo sapiens
ugaagcauuugauuucugu

SEQ ID NO: 1446141 - RNA, 19 nt, Homo sapiens
gaucccagauauuaaagag

SEQ ID NO: 1446142 - RNA, 19 nt, Homo sapiens
aucaauagcccauaucuuu

SEQ ID NO: 1446143 - RNA, 19 nt, Homo sapiens
gcaguuaauacccuucuau

SEQ ID NO: 1446144 - RNA, 19 nt, Homo sapiens
gccgacacacugacacuua

SEQ ID NO: 1446145 - RNA, 19 nt, Homo sapiens
gcauuugauuucuguucuu

SEQ ID NO: 1446146 - RNA, 19 nt, Homo sapiens
gaccgggugucucagauuc

SEQ ID NO: 1446147 - RNA, 19 nt, Homo sapiens
uauaagcucuccucaaagc

SEQ ID NO: 1446148 - RNA, 19 nt, Homo sapiens
gaagacaagagguacaagu

SEQ ID NO: 1446149 - RNA, 19 nt, Homo sapiens
gcccgaagguagcccauuc

SEQ ID NO: 1446150 - RNA, 19 nt, Homo sapiens
gaugauacugcuuuauuuc

SEQ ID NO: 1446151 - RNA, 19 nt, Homo sapiens
ucauugaugucuuuguguu

SEQ ID NO: 1446152 - RNA, 19 nt, Homo sapiens
gccuuuggcuccauguuga

SEQ ID NO: 1446153 - RNA, 19 nt, Homo sapiens
gaucugguauuuguugaag

SEQ ID NO: 1446154 - RNA, 19 nt, Homo sapiens
auucagggcuguugugguu

SEQ ID NO: 1446155 - RNA, 19 nt, Homo sapiens
ugucucaucuucuacugaa

SEQ ID NO: 1446156 - RNA, 19 nt, Homo sapiens
uagcugguguucaugaaau

SEQ ID NO: 1446157 - RNA, 19 nt, Homo sapiens
gaaucugaagcccuuguaa

SEQ ID NO: 1446158 - RNA, 19 nt, Homo sapiens
uuagagagcaccuccuuug

SEQ ID NO: 1446159 - RNA, 19 nt, Homo sapiens
ggaaggugaagaagacaug

SEQ ID NO: 1446160 - RNA, 19 nt, Homo sapiens
gggauuaccagucaaugga

SEQ ID NO: 1446161 - RNA, 19 nt, Homo sapiens
gcccacagccagugccuuu

SEQ ID NO: 1446162 - RNA, 19 nt, Homo sapiens
acugugaucugguauuugu

SEQ ID NO: 1446163 - RNA, 19 nt, Homo sapiens
ucaucagaguggaaaguuu

SEQ ID NO: 1446164 - RNA, 19 nt, Homo sapiens
guugguugcuccaucaugu

SEQ ID NO: 1446165 - RNA, 19 nt, Homo sapiens
ccucauugaugucuuugug

SEQ ID NO: 1446166 - RNA, 19 nt, Homo sapiens
gaaacaagucauagaagac

SEQ ID NO: 1446167 - RNA, 19 nt, Homo sapiens
aagcagaaaggauauaaug

SEQ ID NO: 1446168 - RNA, 19 nt, Homo sapiens
ggaagccauuaccuacugu

SEQ ID NO: 1446169 - RNA, 19 nt, Homo sapiens
ugucaucaauagcccauau

SEQ ID NO: 1446170 - RNA, 19 nt, Homo sapiens
caguuaauacccuucuaua

SEQ ID NO: 1446171 - RNA, 19 nt, Homo sapiens
caacuucauccuccuuguu

SEQ ID NO: 1446172 - RNA, 19 nt, Homo sapiens
ucuauucucugccucuguu

SEQ ID NO: 1446173 - RNA, 19 nt, Homo sapiens
ucauagaagacaagaggua

SEQ ID NO: 1446174 - RNA, 19 nt, Homo sapiens
ugacugaucacauggacuu

SEQ ID NO: 1446175 - RNA, 19 nt, Homo sapiens
gccaaaauccugacaauau

SEQ ID NO: 1446176 - RNA, 19 nt, Homo sapiens
acauucggcucuuuggauu

SEQ ID NO: 1446177 - RNA, 19 nt, Homo sapiens
ggaaauuucuggauaacuu

SEQ ID NO: 1446178 - RNA, 19 nt, Homo sapiens
gaguagagauugacaguga

SEQ ID NO: 1446179 - RNA, 19 nt, Homo sapiens
ggcagaguguuuagaauua

SEQ ID NO: 1446180 - RNA, 19 nt, Homo sapiens
gacuggagaugguguuaua

SEQ ID NO: 1446181 - RNA, 19 nt, Homo sapiens
gaacaauagacuucaauga

SEQ ID NO: 1446182 - RNA, 19 nt, Homo sapiens
gaaccagaguagagauuga

SEQ ID NO: 1446183 - RNA, 19 nt, Homo sapiens
gcgcauccauugacacuga

SEQ ID NO: 1446184 - RNA, 19 nt, Homo sapiens
ggacuuggcagaguguuua

SEQ ID NO: 1446185 - RNA, 19 nt, Homo sapiens
gaucccagguccuccaauu

SEQ ID NO: 1446186 - RNA, 19 nt, Homo sapiens
agauggaaauggaacaaua

SEQ ID NO: 1446187 - RNA, 19 nt, Homo sapiens
ugauaaagauggaaaugga

SEQ ID NO: 1446188 - RNA, 19 nt, Homo sapiens
uaacuuugauucacccuau

SEQ ID NO: 1446189 - RNA, 19 nt, Homo sapiens
aaaccagaaucguauuuga

SEQ ID NO: 1446190 - RNA, 19 nt, Homo sapiens
ggaauggagugaggaacaa

SEQ ID NO: 1446191 - RNA, 19 nt, Homo sapiens
gaaaagagguaaucaugca

SEQ ID NO: 1446192 - RNA, 19 nt, Homo sapiens
gcagaguguuuagaauuau

SEQ ID NO: 1446193 - RNA, 19 nt, Homo sapiens
ggaacaaguauuuaggaaa

SEQ ID NO: 1446194 - RNA, 19 nt, Homo sapiens
gaaauggaacaauagacuu

SEQ ID NO: 1446195 - RNA, 19 nt, Homo sapiens
gacuaaaugucagcucaaa

SEQ ID NO: 1446196 - RNA, 19 nt, Homo sapiens
ggugugagcgcauccauug

SEQ ID NO: 1446197 - RNA, 19 nt, Homo sapiens
gagugaggaacaaguauuu

SEQ ID NO: 1446198 - RNA, 19 nt, Homo sapiens
caaugaauuucuucucaca

SEQ ID NO: 1446199 - RNA, 19 nt, Homo sapiens
uaaaagacauugaguaguc

SEQ ID NO: 1446200 - RNA, 19 nt, Homo sapiens
gaaccgccuggaagcuuua

SEQ ID NO: 1446201 - RNA, 19 nt, Homo sapiens
ggaaauggaacaauagacu

SEQ ID NO: 1446202 - RNA, 19 nt, Homo sapiens
ggagugaggaacaaguauu

SEQ ID NO: 1446203 - RNA, 19 nt, Homo sapiens
ccagguccuccaauuaaua

SEQ ID NO: 1446204 - RNA, 19 nt, Homo sapiens
caaaacaccacccaaagua

SEQ ID NO: 1446205 - RNA, 19 nt, Homo sapiens
agacaagacuggagauggu

SEQ ID NO: 1446206 - RNA, 19 nt, Homo sapiens
guccuccaauuaauacuaa

SEQ ID NO: 1446207 - RNA, 19 nt, Homo sapiens
gaagagguggaagaacuuu

SEQ ID NO: 1446208 - RNA, 19 nt, Homo sapiens
aagaagagguggaagaacu

SEQ ID NO: 1446209 - RNA, 19 nt, Homo sapiens
ucaaaggacuuggcagagu

SEQ ID NO: 1446210 - RNA, 19 nt, Homo sapiens
gauaaagauggaaauggaa

SEQ ID NO: 1446211 - RNA, 19 nt, Homo sapiens
gagguaaucaugcaagcuu

SEQ ID NO: 1446212 - RNA, 19 nt, Homo sapiens
guauuugauuucacacuca

SEQ ID NO: 1446213 - RNA, 19 nt, Homo sapiens
acagugagcugagccaauc

SEQ ID NO: 1446214 - RNA, 19 nt, Homo sapiens
gaggaacaaguauuuagga

SEQ ID NO: 1446215 - RNA, 19 nt, Homo sapiens
ucacacucauccuaauguu

SEQ ID NO: 1446216 - RNA, 19 nt, Homo sapiens
ccaaucaggcugugaaucu

SEQ ID NO: 1446217 - RNA, 19 nt, Homo sapiens
ggaacaauagacuucaaug

SEQ ID NO: 1446218 - RNA, 19 nt, Homo sapiens
gagguuugauaaagaugga

SEQ ID NO: 1446219 - RNA, 19 nt, Homo sapiens
gauuucacacucauccuaa

SEQ ID NO: 1446220 - RNA, 19 nt, Homo sapiens
agaaccgccuggaagcuuu

SEQ ID NO: 1446221 - RNA, 19 nt, Homo sapiens
gggcucugcugggaucaaa

SEQ ID NO: 1446222 - RNA, 19 nt, Homo sapiens
ugauucacccuaugacaaa

SEQ ID NO: 1446223 - RNA, 19 nt, Homo sapiens
gauggaaauggaacaauag

SEQ ID NO: 1446224 - RNA, 19 nt, Homo sapiens
cagaguguuuagaauuaug

SEQ ID NO: 1446225 - RNA, 19 nt, Homo sapiens
ucccagguccuccaauuaa

SEQ ID NO: 1446226 - RNA, 19 nt, Homo sapiens
uggcagaguguuuagaauu

SEQ ID NO: 1446227 - RNA, 19 nt, Homo sapiens
gagaaccgccuggaagcuu

SEQ ID NO: 1446228 - RNA, 19 nt, Homo sapiens
aggaacaaguauuuaggaa

SEQ ID NO: 1446229 - RNA, 19 nt, Homo sapiens
gggaauggagugaggaaca

SEQ ID NO: 1446230 - RNA, 19 nt, Homo sapiens
ccauguggcuccaaaugac

SEQ ID NO: 1446231 - RNA, 19 nt, Homo sapiens
cgugaaguauauaaugcaa

SEQ ID NO: 1446232 - RNA, 19 nt, Homo sapiens
gguccuccaauuaauacua

SEQ ID NO: 1446233 - RNA, 19 nt, Homo sapiens
uuagaaaguuagacaagac

SEQ ID NO: 1446234 - RNA, 19 nt, Homo sapiens
gaacuuuuccggagguuug

SEQ ID NO: 1446235 - RNA, 19 nt, Homo sapiens
caaucaggcugugaaucug

SEQ ID NO: 1446236 - RNA, 19 nt, Homo sapiens
ccggagguuugauaaagau

SEQ ID NO: 1446237 - RNA, 19 nt, Homo sapiens
ugauuaugcuguggucaug

SEQ ID NO: 1446238 - RNA, 19 nt, Homo sapiens
gugaggaacaaguauuuag

SEQ ID NO: 1446239 - RNA, 19 nt, Homo sapiens
gcaaaacaccacccaaagu

SEQ ID NO: 1446240 - RNA, 19 nt, Homo sapiens
cacccaaaguaccagaaug

SEQ ID NO: 1446241 - RNA, 19 nt, Homo sapiens
auaauaaucgaacccuuga

SEQ ID NO: 1446242 - RNA, 19 nt, Homo sapiens
aaauggaacaauagacuuc

SEQ ID NO: 1446243 - RNA, 19 nt, Homo sapiens
cagaaccagaguagagauu

SEQ ID NO: 1446244 - RNA, 19 nt, Homo sapiens
ugauuucacacucauccua

SEQ ID NO: 1446245 - RNA, 19 nt, Homo sapiens
ggcuccaaaugacuaaaug

SEQ ID NO: 1446246 - RNA, 19 nt, Homo sapiens
gcagaaccagaguagagau

SEQ ID NO: 1446247 - RNA, 19 nt, Homo sapiens
uccggagguuugauaaaga

SEQ ID NO: 1446248 - RNA, 19 nt, Homo sapiens
cccagguccuccaauuaau

SEQ ID NO: 1446249 - RNA, 19 nt, Homo sapiens
cagaaaagagguaaucaug

SEQ ID NO: 1446250 - RNA, 19 nt, Homo sapiens
agaauuauggaugacgaua

SEQ ID NO: 1446251 - RNA, 19 nt, Homo sapiens
aaaggcagaaccagaguag

SEQ ID NO: 1446252 - RNA, 19 nt, Homo sapiens
cagaguagagauugacagu

SEQ ID NO: 1446253 - RNA, 19 nt, Homo sapiens
gagcgcauccauugacacu

SEQ ID NO: 1446254 - RNA, 19 nt, Homo sapiens
gugagcgcauccauugaca

SEQ ID NO: 1446255 - RNA, 19 nt, Homo sapiens
uauaacaaucgaagaccuu

SEQ ID NO: 1446256 - RNA, 19 nt, Homo sapiens
acacucauccuaauguuuu

SEQ ID NO: 1446257 - RNA, 19 nt, Homo sapiens
ggcagaaccagaguagaga

SEQ ID NO: 1446258 - RNA, 19 nt, Homo sapiens
gaugagagcuaaagagaua

SEQ ID NO: 1446259 - RNA, 19 nt, Homo sapiens
caaccgaacucuaucagua

SEQ ID NO: 1446260 - RNA, 19 nt, Homo sapiens
gagaugaagugguauacua

SEQ ID NO: 1446261 - RNA, 19 nt, Homo sapiens
gagaagagcugcagaaacu

SEQ ID NO: 1446262 - RNA, 19 nt, Homo sapiens
agaaagaucugccuagaaa

SEQ ID NO: 1446263 - RNA, 19 nt, Homo sapiens
ggauagacuucgaacauuu

SEQ ID NO: 1446264 - RNA, 19 nt, Homo sapiens
gaagaaauuugguaaagca

SEQ ID NO: 1446265 - RNA, 19 nt, Homo sapiens
gcacucggauugaagauga

SEQ ID NO: 1446266 - RNA, 19 nt, Homo sapiens
gcacuugguuccucaguug

SEQ ID NO: 1446267 - RNA, 19 nt, Homo sapiens
gaaauuugguaaagcauca

SEQ ID NO: 1446268 - RNA, 19 nt, Homo sapiens
gaagaaaggaagcacaauu

SEQ ID NO: 1446269 - RNA, 19 nt, Homo sapiens
gagcugaucagaagaaauu

SEQ ID NO: 1446270 - RNA, 19 nt, Homo sapiens
gaacuaacaagugacauaa

SEQ ID NO: 1446271 - RNA, 19 nt, Homo sapiens
gaaagacugcugaagguuu

SEQ ID NO: 1446272 - RNA, 19 nt, Homo sapiens
ggaagaagcucagaaagac

SEQ ID NO: 1446273 - RNA, 19 nt, Homo sapiens
ggagaaagaucugccuaga

SEQ ID NO: 1446274 - RNA, 19 nt, Homo sapiens
caagaaauccuaccucaga

SEQ ID NO: 1446275 - RNA, 19 nt, Homo sapiens
gaagacagcagaucaagau

SEQ ID NO: 1446276 - RNA, 19 nt, Homo sapiens
gcagaaacuucagcagaaa

SEQ ID NO: 1446277 - RNA, 19 nt, Homo sapiens
aggaagagaugcagaguuu

SEQ ID NO: 1446278 - RNA, 19 nt, Homo sapiens
gagagaacuugccaugcua

SEQ ID NO: 1446279 - RNA, 19 nt, Homo sapiens
gauagacuucgaacauuua

SEQ ID NO: 1446280 - RNA, 19 nt, Homo sapiens
caacagcgcacucggauug

SEQ ID NO: 1446281 - RNA, 19 nt, Homo sapiens
ucacauggcuguacugucu

SEQ ID NO: 1446282 - RNA, 19 nt, Homo sapiens
uccaauagaugaugguuaa

SEQ ID NO: 1446283 - RNA, 19 nt, Homo sapiens
cagagacacuggagaaaga

SEQ ID NO: 1446284 - RNA, 19 nt, Homo sapiens
cgaacucuaucaguauuua

SEQ ID NO: 1446285 - RNA, 19 nt, Homo sapiens
caagugacauaacagaaga

SEQ ID NO: 1446286 - RNA, 19 nt, Homo sapiens
ggacgaagaggaggcuuua

SEQ ID NO: 1446287 - RNA, 19 nt, Homo sapiens
gaacuugccaugcuacgaa

SEQ ID NO: 1446288 - RNA, 19 nt, Homo sapiens
ugaagaagguacagaagga

SEQ ID NO: 1446289 - RNA, 19 nt, Homo sapiens
uaaggaaacuuugcagaug

SEQ ID NO: 1446290 - RNA, 19 nt, Homo sapiens
gacagcagaucaagauuuc

SEQ ID NO: 1446291 - RNA, 19 nt, Homo sapiens
gaucagaagaaauuuggua

SEQ ID NO: 1446292 - RNA, 19 nt, Homo sapiens
gcacagacugggagaacua

SEQ ID NO: 1446293 - RNA, 19 nt, Homo sapiens
gaacugccucccacuauau

SEQ ID NO: 1446294 - RNA, 19 nt, Homo sapiens
ugaacugccucccacuaua

SEQ ID NO: 1446295 - RNA, 19 nt, Homo sapiens
gaaguacaguuugaaaucu

SEQ ID NO: 1446296 - RNA, 19 nt, Homo sapiens
gagaaaguuuaucaucaug

SEQ ID NO: 1446297 - RNA, 19 nt, Homo sapiens
gagagaauccuucacacuu

SEQ ID NO: 1446298 - RNA, 19 nt, Homo sapiens
aauccuaccucagaaauaa

SEQ ID NO: 1446299 - RNA, 19 nt, Homo sapiens
gaagugguauacuaugaca

SEQ ID NO: 1446300 - RNA, 19 nt, Homo sapiens
gcggaaacaugcacuaaag

SEQ ID NO: 1446301 - RNA, 19 nt, Homo sapiens
gaaaaggccuucuggagau

SEQ ID NO: 1446302 - RNA, 19 nt, Homo sapiens
gaauauagaacccaucaca

SEQ ID NO: 1446303 - RNA, 19 nt, Homo sapiens
gaacauuuaaacagaggua

SEQ ID NO: 1446304 - RNA, 19 nt, Homo sapiens
cuugaagugugaagaguua

SEQ ID NO: 1446305 - RNA, 19 nt, Homo sapiens
gaugaugguuaacaugaau

SEQ ID NO: 1446306 - RNA, 19 nt, Homo sapiens
gagaagaggaucccaaagu

SEQ ID NO: 1446307 - RNA, 19 nt, Homo sapiens
agacagagaacacuggaua

SEQ ID NO: 1446308 - RNA, 19 nt, Homo sapiens
gaaacaugcacuaaaggaa

SEQ ID NO: 1446309 - RNA, 19 nt, Homo sapiens
ugagaaccaucuuucaaug

SEQ ID NO: 1446310 - RNA, 19 nt, Homo sapiens
cagaaagacugcugaaggu

SEQ ID NO: 1446311 - RNA, 19 nt, Homo sapiens
gaaagcaucaaaagacuua

SEQ ID NO: 1446312 - RNA, 19 nt, Homo sapiens
gcaacuagaaagcaucaaa

SEQ ID NO: 1446313 - RNA, 19 nt, Homo sapiens
cagaagaaauuugguaaag

SEQ ID NO: 1446314 - RNA, 19 nt, Homo sapiens
caagauugguucugauucu

SEQ ID NO: 1446315 - RNA, 19 nt, Homo sapiens
ggaaagggguaaaauugaa

SEQ ID NO: 1446316 - RNA, 19 nt, Homo sapiens
ggaucauugugacucuuua

SEQ ID NO: 1446317 - RNA, 19 nt, Homo sapiens
ggaaacaugcacuaaagga

SEQ ID NO: 1446318 - RNA, 19 nt, Homo sapiens
gaucuacugugagcuguau

SEQ ID NO: 1446319 - RNA, 19 nt, Homo sapiens
aagcacaauuggcagguua

SEQ ID NO: 1446320 - RNA, 19 nt, Homo sapiens
ugggagaacuaacaaguga

SEQ ID NO: 1446321 - RNA, 19 nt, Homo sapiens
cauguucuguuaccauaaa

SEQ ID NO: 1446322 - RNA, 19 nt, Homo sapiens
cagaagcgauagcacgauu

SEQ ID NO: 1446323 - RNA, 19 nt, Homo sapiens
aaagacugcugaagguuug

SEQ ID NO: 1446324 - RNA, 19 nt, Homo sapiens
gaaauccuaccucagaaau

SEQ ID NO: 1446325 - RNA, 19 nt, Homo sapiens
gagaaagaucugccuagaa

SEQ ID NO: 1446326 - RNA, 19 nt, Homo sapiens
uagaacccaucacacagua

SEQ ID NO: 1446327 - RNA, 19 nt, Homo sapiens
guaauggccaguuaagcua

SEQ ID NO: 1446328 - RNA, 19 nt, Homo sapiens
gaagaggaucccaaaguca

SEQ ID NO: 1446329 - RNA, 19 nt, Homo sapiens
ucugggaccucgaagaauu

SEQ ID NO: 1446330 - RNA, 19 nt, Homo sapiens
ucaguuggauaacauuaga

SEQ ID NO: 1446331 - RNA, 19 nt, Homo sapiens
guaugcaguuucuaaggaa

SEQ ID NO: 1446332 - RNA, 19 nt, Homo sapiens
ucaaccagauuacgacuag

SEQ ID NO: 1446333 - RNA, 19 nt, Homo sapiens
cuaaagagauaugcuugga

SEQ ID NO: 1446334 - RNA, 19 nt, Homo sapiens
aaggaaacuuugcagauga

SEQ ID NO: 1446335 - RNA, 19 nt, Homo sapiens
gaagcacaauuggcagguu

SEQ ID NO: 1446336 - RNA, 19 nt, Homo sapiens
uaacaagugacauaacaga

SEQ ID NO: 1446337 - RNA, 19 nt, Homo sapiens
caaguccuguucuccaaga

SEQ ID NO: 1446338 - RNA, 19 nt, Homo sapiens
cuucgaacauuuaaacaga

SEQ ID NO: 1446339 - RNA, 19 nt, Homo sapiens
caucacacaguacaacuaa

SEQ ID NO: 1446340 - RNA, 19 nt, Homo sapiens
ggauugaagaugaauauag

SEQ ID NO: 1446341 - RNA, 19 nt, Homo sapiens
ugugaagaguuacuauuga

SEQ ID NO: 1446342 - RNA, 19 nt, Homo sapiens
cacuauaucucuuccacuu

SEQ ID NO: 1446343 - RNA, 19 nt, Homo sapiens
acgacuagcucaugcaaga

SEQ ID NO: 1446344 - RNA, 19 nt, Homo sapiens
guacaacuaaagagagaaa

SEQ ID NO: 1446345 - RNA, 19 nt, Homo sapiens
ugcagaaacuucagcagaa

SEQ ID NO: 1446346 - RNA, 19 nt, Homo sapiens
gagagaagagcugcagaaa

SEQ ID NO: 1446347 - RNA, 19 nt, Homo sapiens
cugagaaaguuuaucauca

SEQ ID NO: 1446348 - RNA, 19 nt, Homo sapiens
gcaauguuccugacugcaa

SEQ ID NO: 1446349 - RNA, 19 nt, Homo sapiens
gaagaggaggcuuuaccuu

SEQ ID NO: 1446350 - RNA, 19 nt, Homo sapiens
uaacacggagcauccauga

SEQ ID NO: 1446351 - RNA, 19 nt, Homo sapiens
agagaauccuucacacuuc

SEQ ID NO: 1446352 - RNA, 19 nt, Homo sapiens
agaagaggaucccaaaguc

SEQ ID NO: 1446353 - RNA, 19 nt, Homo sapiens
agauuuccauggagaauga

SEQ ID NO: 1446354 - RNA, 19 nt, Homo sapiens
gcaagacguggacggguuu

SEQ ID NO: 1446355 - RNA, 19 nt, Homo sapiens
cggaagaagcucagaaaga

SEQ ID NO: 1446356 - RNA, 19 nt, Homo sapiens
ugagagaacuugccaugcu

SEQ ID NO: 1446357 - RNA, 19 nt, Homo sapiens
caguacaacuaaagagaga

SEQ ID NO: 1446358 - RNA, 19 nt, Homo sapiens
gaaagaauuugaagcuguu

SEQ ID NO: 1446359 - RNA, 19 nt, Homo sapiens
ggaagcagguggaauuaug

SEQ ID NO: 1446360 - RNA, 19 nt, Homo sapiens
ggaaauaccaaguguuaaa

SEQ ID NO: 1446361 - RNA, 19 nt, Homo sapiens
gcaagcggcuggagauaga

SEQ ID NO: 1446362 - RNA, 19 nt, Homo sapiens
gaagaaaacuggcaaagga

SEQ ID NO: 1446363 - RNA, 19 nt, Homo sapiens
uuucaucacucccuaaaua

SEQ ID NO: 1446364 - RNA, 19 nt, Homo sapiens
agacaagagugaaaucaaa

SEQ ID NO: 1446365 - RNA, 19 nt, Homo sapiens
gaagaaguuuaagagagua

SEQ ID NO: 1446366 - RNA, 19 nt, Homo sapiens
gagaguagaggaagccaua

SEQ ID NO: 1446367 - RNA, 19 nt, Homo sapiens
agguauaucuccaugaaua

SEQ ID NO: 1446368 - RNA, 19 nt, Homo sapiens
cgagguauaucuccaugaa

SEQ ID NO: 1446369 - RNA, 19 nt, Homo sapiens
gauggaagcagguggaauu

SEQ ID NO: 1446370 - RNA, 19 nt, Homo sapiens
ggagauagagaagagcuua

SEQ ID NO: 1446371 - RNA, 19 nt, Homo sapiens
gaacaaaacagaacugcua

SEQ ID NO: 1446372 - RNA, 19 nt, Homo sapiens
ugaagaaguuuaagagagu

SEQ ID NO: 1446373 - RNA, 19 nt, Homo sapiens
guauuaagcagaacaguau

SEQ ID NO: 1446374 - RNA, 19 nt, Homo sapiens
uggaauauccggccuaauu

SEQ ID NO: 1446375 - RNA, 19 nt, Homo sapiens
cagauaauguguagaacug

SEQ ID NO: 1446376 - RNA, 19 nt, Homo sapiens
gaggaagccauacuagaaa

SEQ ID NO: 1446377 - RNA, 19 nt, Homo sapiens
ggaacucguugucgaacug

SEQ ID NO: 1446378 - RNA, 19 nt, Homo sapiens
cuaaauacuuucuccucaa

SEQ ID NO: 1446379 - RNA, 19 nt, Homo sapiens
gauaugguuucuugaagca

SEQ ID NO: 1446380 - RNA, 19 nt, Homo sapiens
cagaaagacagaauaucua

SEQ ID NO: 1446381 - RNA, 19 nt, Homo sapiens
ucacagaaagacagaauau

SEQ ID NO: 1446382 - RNA, 19 nt, Homo sapiens
gaauuugucagauaaugug

SEQ ID NO: 1446383 - RNA, 19 nt, Homo sapiens
agaggaagccauacuagaa

SEQ ID NO: 1446384 - RNA, 19 nt, Homo sapiens
cgacauauuucagcaugau

SEQ ID NO: 1446385 - RNA, 19 nt, Homo sapiens
ggaauuaugcccuguuggu

SEQ ID NO: 1446386 - RNA, 19 nt, Homo sapiens
gggcccaggugaugcaaga

SEQ ID NO: 1446387 - RNA, 19 nt, Homo sapiens
gacgcaaguugguagaaga

SEQ ID NO: 1446388 - RNA, 19 nt, Homo sapiens
ggacgcaaguugguagaag

SEQ ID NO: 1446389 - RNA, 19 nt, Homo sapiens
ccaugaauaaccuaaauga

SEQ ID NO: 1446390 - RNA, 19 nt, Homo sapiens
gggauaugguuucuugaag

SEQ ID NO: 1446391 - RNA, 19 nt, Homo sapiens
cagaauggcagacucaugu

SEQ ID NO: 1446392 - RNA, 19 nt, Homo sapiens
gguauaucuccaugaauaa

SEQ ID NO: 1446393 - RNA, 19 nt, Homo sapiens
ggggaaauaccaaguguua

SEQ ID NO: 1446394 - RNA, 19 nt, Homo sapiens
ucauguggcucuaucucaa

SEQ ID NO: 1446395 - RNA, 19 nt, Homo sapiens
gcaaguugguagaagaaaa

SEQ ID NO: 1446396 - RNA, 19 nt, Homo sapiens
agaucucucucacuccaua

SEQ ID NO: 1446397 - RNA, 19 nt, Homo sapiens
agaacaguauaaccucgua

SEQ ID NO: 1446398 - RNA, 19 nt, Homo sapiens
caaauacugggaacucguu

SEQ ID NO: 1446399 - RNA, 19 nt, Homo sapiens
guguagaacugcauaacag

SEQ ID NO: 1446400 - RNA, 19 nt, Homo sapiens
gaauuaugcccuguugguu

SEQ ID NO: 1446401 - RNA, 19 nt, Homo sapiens
uaugguuucuugaagcauu

SEQ ID NO: 1446402 - RNA, 19 nt, Homo sapiens
gauacauacuguggugaug

SEQ ID NO: 1446403 - RNA, 19 nt, Homo sapiens
ggcugccaguauuguauua

SEQ ID NO: 1446404 - RNA, 19 nt, Homo sapiens
gugcagccuuugagaagug

SEQ ID NO: 1446405 - RNA, 19 nt, Homo sapiens
gaaaaggaacaaaacagaa

SEQ ID NO: 1446406 - RNA, 19 nt, Homo sapiens
agaacugcauaacagguaa

SEQ ID NO: 1446407 - RNA, 19 nt, Homo sapiens
ugucagauaauguguagaa

SEQ ID NO: 1446408 - RNA, 19 nt, Homo sapiens
guggaauuaugcccuguug

SEQ ID NO: 1446409 - RNA, 19 nt, Homo sapiens
ucaccagauuacauuaaga

SEQ ID NO: 1446410 - RNA, 19 nt, Homo sapiens
acagaaagacagaauaucu

SEQ ID NO: 1446411 - RNA, 19 nt, Homo sapiens
uauuuuagcuccaggguaa

SEQ ID NO: 1446412 - RNA, 19 nt, Homo sapiens
gaaaucaaacugcuuuuag

SEQ ID NO: 1446413 - RNA, 19 nt, Homo sapiens
ccaaguaccacgccaugau

SEQ ID NO: 1446414 - RNA, 19 nt, Homo sapiens
uagaacugcauaacaggua

SEQ ID NO: 1446415 - RNA, 19 nt, Homo sapiens
ccaacaaacgccagaaugg

SEQ ID NO: 1446416 - RNA, 19 nt, Homo sapiens
aaagacagaauaucuacug

SEQ ID NO: 1446417 - RNA, 19 nt, Homo sapiens
caccagauuacauuaagaa

SEQ ID NO: 1446418 - RNA, 19 nt, Homo sapiens
caaguaauuuucugucugu

SEQ ID NO: 1446419 - RNA, 19 nt, Homo sapiens
ggagucccagaaagaagua

SEQ ID NO: 1446420 - RNA, 19 nt, Homo sapiens
ccgaugcucugccgcuguu

SEQ ID NO: 1446421 - RNA, 19 nt, Homo sapiens
caccgaagccucagagaca

SEQ ID NO: 1446422 - RNA, 19 nt, Homo sapiens
gagaacugcugcuuuucaa

SEQ ID NO: 1446423 - RNA, 19 nt, Homo sapiens
acaguauaaccucguauuu

SEQ ID NO: 1446424 - RNA, 19 nt, Homo sapiens
uguauuaagcagaacagua

SEQ ID NO: 1446425 - RNA, 19 nt, Homo sapiens
ggcucuaucucaaauacug

SEQ ID NO: 1446426 - RNA, 19 nt, Homo sapiens
guaauuuucugucuguuuc

SEQ ID NO: 1446427 - RNA, 19 nt, Homo sapiens
gaacaguauaaccucguau

SEQ ID NO: 1446428 - RNA, 19 nt, Homo sapiens
gcugaaagaauuugaagcu

SEQ ID NO: 1446429 - RNA, 19 nt, Homo sapiens
gggaaauaccaaguguuaa

SEQ ID NO: 1446430 - RNA, 19 nt, Homo sapiens
guagaggaagccauacuag

SEQ ID NO: 1446431 - RNA, 19 nt, Homo sapiens
caucacucccuaaauacuu

SEQ ID NO: 1446432 - RNA, 19 nt, Homo sapiens
uaagacaagagugaaauca

SEQ ID NO: 1446433 - RNA, 19 nt, Homo sapiens
agacucauguggcucuauc

SEQ ID NO: 1446434 - RNA, 19 nt, Homo sapiens
gcagacucauguggcucua

SEQ ID NO: 1446435 - RNA, 19 nt, Homo sapiens
uaucuacugcagucuguuu

SEQ ID NO: 1446436 - RNA, 19 nt, Homo sapiens
guaagacaagagugaaauc

SEQ ID NO: 1446437 - RNA, 19 nt, Homo sapiens
ucggagaacugcugcuuuu

SEQ ID NO: 1446438 - RNA, 19 nt, Homo sapiens
uuugagaagugcguauuug

SEQ ID NO: 1446439 - RNA, 19 nt, Homo sapiens
gaacugcauaacagguaau

SEQ ID NO: 1446440 - RNA, 19 nt, Homo sapiens
aauacaauacugguccuua

SEQ ID NO: 1446441 - RNA, 19 nt, Homo sapiens
uagaggaagccauacuaga

SEQ ID NO: 1446442 - RNA, 19 nt, Homo sapiens
gaacucguugucgaacuga

SEQ ID NO: 1446443 - RNA, 19 nt, Homo sapiens
gacauauuucagcaugaua

SEQ ID NO: 1446444 - RNA, 19 nt, Homo sapiens
gcccaggugaugcaagaaa

SEQ ID NO: 1446445 - RNA, 19 nt, Homo sapiens
caaguaccacgccaugauc

SEQ ID NO: 1446446 - RNA, 19 nt, Homo sapiens
gucaccagauuacauuaag

SEQ ID NO: 1446447 - RNA, 19 nt, Homo sapiens
gaagccuaccgucggagaa

SEQ ID NO: 1446448 - RNA, 19 nt, Homo sapiens
cuccaugaauaaccuaaau

SEQ ID NO: 1446449 - RNA, 19 nt, Homo sapiens
ggucucaccgacauauuuc

SEQ ID NO: 1446450 - RNA, 19 nt, Homo sapiens
cuacugcagucuguuucuu

SEQ ID NO: 1446451 - RNA, 19 nt, Homo sapiens
agacaggugcagccuuuga

SEQ ID NO: 1446452 - RNA, 19 nt, Homo sapiens
ggcgugcugucgcucaguu

SEQ ID NO: 1446453 - RNA, 19 nt, Homo sapiens
gaacugcugcuuuucaaca

SEQ ID NO: 1446454 - RNA, 19 nt, Homo sapiens
aauaucuacugcagucugu

SEQ ID NO: 1446455 - RNA, 19 nt, Homo sapiens
gaauuugaagcuguucuca

SEQ ID NO: 1446456 - RNA, 19 nt, Homo sapiens
agugaaaucaaacugcuuu

SEQ ID NO: 1446457 - RNA, 19 nt, Homo sapiens
gaaagacagaauaucuacu

SEQ ID NO: 1446458 - RNA, 19 nt, Homo sapiens
gaacugcuguccaucauuu

SEQ ID NO: 1446459 - RNA, 19 nt, Homo sapiens
uaacgaagcuuauccuugu

SEQ ID NO: 1446460 - RNA, 19 nt, Homo sapiens
gaaagaacacugcaaaguu

SEQ ID NO: 1446461 - RNA, 19 nt, Homo sapiens
gauagagaaugauagagua

SEQ ID NO: 1446462 - RNA, 19 nt, Homo sapiens
gucaguaccuggagaauuu

SEQ ID NO: 1446463 - RNA, 19 nt, Homo sapiens
aaagaacacugcaaaguug

SEQ ID NO: 1446464 - RNA, 19 nt, Homo sapiens
ggacguaaugcaugaaaua

SEQ ID NO: 1446465 - RNA, 19 nt, Homo sapiens
ggacaagcccgacuuaaau

SEQ ID NO: 1446466 - RNA, 19 nt, Homo sapiens
gcaaagccaugaagaacau

SEQ ID NO: 1446467 - RNA, 19 nt, Homo sapiens
ugaaguaucugaaacaaca

SEQ ID NO: 1446468 - RNA, 19 nt, Homo sapiens
aaacacaaauucaguagga

SEQ ID NO: 1446469 - RNA, 19 nt, Homo sapiens
gaauagcuuucaucccaaa

SEQ ID NO: 1446470 - RNA, 19 nt, Homo sapiens
caaggauucugaagacauu

SEQ ID NO: 1446471 - RNA, 19 nt, Homo sapiens
gaugaaauacucagaauuc

SEQ ID NO: 1446472 - RNA, 19 nt, Homo sapiens
gacaugaucucaggaaaug

SEQ ID NO: 1446473 - RNA, 19 nt, Homo sapiens
ggaaauggauacacaacca

SEQ ID NO: 1446474 - RNA, 19 nt, Homo sapiens
gcacaggaaucaauagaac

SEQ ID NO: 1446475 - RNA, 19 nt, Homo sapiens
gggcaagccuuccuagaau

SEQ ID NO: 1446476 - RNA, 19 nt, Homo sapiens
ucagugcuaucuugaagua

SEQ ID NO: 1446477 - RNA, 19 nt, Homo sapiens
cgacuuaaaucucugcaau

SEQ ID NO: 1446478 - RNA, 19 nt, Homo sapiens
gaacacaucauagaaagug

SEQ ID NO: 1446479 - RNA, 19 nt, Homo sapiens
acauguacaucgaaucaua

SEQ ID NO: 1446480 - RNA, 19 nt, Homo sapiens
acaaguacauguagcaaga

SEQ ID NO: 1446481 - RNA, 19 nt, Homo sapiens
uugaguggcugaacaagua

SEQ ID NO: 1446482 - RNA, 19 nt, Homo sapiens
gaucagugcuaucuugaag

SEQ ID NO: 1446483 - RNA, 19 nt, Homo sapiens
cagcugaauuugucacauu

SEQ ID NO: 1446484 - RNA, 19 nt, Homo sapiens
ggcaagccuuccuagaaua

SEQ ID NO: 1446485 - RNA, 19 nt, Homo sapiens
ggacguaucuuugcugacu

SEQ ID NO: 1446486 - RNA, 19 nt, Homo sapiens
gcaaagcugugauugucau

SEQ ID NO: 1446487 - RNA, 19 nt, Homo sapiens
gggacaagcccgacuuaaa

SEQ ID NO: 1446488 - RNA, 19 nt, Homo sapiens
gcagacaagcccuacauug

SEQ ID NO: 1446489 - RNA, 19 nt, Homo sapiens
cuggagaauuugaaugaua

SEQ ID NO: 1446490 - RNA, 19 nt, Homo sapiens
caaauucaguaggacguaa

SEQ ID NO: 1446491 - RNA, 19 nt, Homo sapiens
cagacaagcccuacauuga

SEQ ID NO: 1446492 - RNA, 19 nt, Homo sapiens
caagaaaugcccagaagau

SEQ ID NO: 1446493 - RNA, 19 nt, Homo sapiens
auauauagcugacaugauc

SEQ ID NO: 1446494 - RNA, 19 nt, Homo sapiens
ggauuccauugaccuaauu

SEQ ID NO: 1446495 - RNA, 19 nt, Homo sapiens
ccacaaaacagcugaauuu

SEQ ID NO: 1446496 - RNA, 19 nt, Homo sapiens
cauagaaagugacaaaugc

SEQ ID NO: 1446497 - RNA, 19 nt, Homo sapiens
guacauguagcaagaauca

SEQ ID NO: 1446498 - RNA, 19 nt, Homo sapiens
caucauagaaagugacaaa

SEQ ID NO: 1446499 - RNA, 19 nt, Homo sapiens
gugauugucauucaagaua

SEQ ID NO: 1446500 - RNA, 19 nt, Homo sapiens
gaaaugcccagaagaucga

SEQ ID NO: 1446501 - RNA, 19 nt, Homo sapiens
ucgagcacaucaaggcuua

SEQ ID NO: 1446502 - RNA, 19 nt, Homo sapiens
cccagaagaucgauagaga

SEQ ID NO: 1446503 - RNA, 19 nt, Homo sapiens
ggaggagaaucacuugaac

SEQ ID NO: 1446504 - RNA, 19 nt, Homo sapiens
gaaaccccaucucuacuaa

SEQ ID NO: 1446505 - RNA, 19 nt, Homo sapiens
gacauuggccacagacuug

SEQ ID NO: 1446506 - RNA, 19 nt, Homo sapiens
ccacagacuugaguaugga

SEQ ID NO: 1446507 - RNA, 19 nt, Homo sapiens
ggucuuugaacacaucaua

SEQ ID NO: 1446508 - RNA, 19 nt, Homo sapiens
ccagauauauagcugacau

SEQ ID NO: 1446509 - RNA, 19 nt, Homo sapiens
cgagguggguggaucacuu

SEQ ID NO: 1446510 - RNA, 19 nt, Homo sapiens
gaacaaguacauguagcaa

SEQ ID NO: 1446511 - RNA, 19 nt, Homo sapiens
uagacuaacugcccagcuu

SEQ ID NO: 1446512 - RNA, 19 nt, Homo sapiens
ugacucagaaguugaaaga

SEQ ID NO: 1446513 - RNA, 19 nt, Homo sapiens
gaugaugaaauacucagaa

SEQ ID NO: 1446514 - RNA, 19 nt, Homo sapiens
guuccagacuucuuuguag

SEQ ID NO: 1446515 - RNA, 19 nt, Homo sapiens
gcccaauaccagauauaua

SEQ ID NO: 1446516 - RNA, 19 nt, Homo sapiens
cagaagaucgauagagaga

SEQ ID NO: 1446517 - RNA, 19 nt, Homo sapiens
acacuuaucuaugccacaa

SEQ ID NO: 1446518 - RNA, 19 nt, Homo sapiens
gcagugagccaagauugug

SEQ ID NO: 1446519 - RNA, 19 nt, Homo sapiens
gaggccagaaggaauuuaa

SEQ ID NO: 1446520 - RNA, 19 nt, Homo sapiens
guugaaagaacacugcaaa

SEQ ID NO: 1446521 - RNA, 19 nt, Homo sapiens
gauagagagaucagugcua

SEQ ID NO: 1446522 - RNA, 19 nt, Homo sapiens
ugacauguacaucgaauca

SEQ ID NO: 1446523 - RNA, 19 nt, Homo sapiens
gacguaaugcaugaaauaa

SEQ ID NO: 1446524 - RNA, 19 nt, Homo sapiens
caauggcuaacgaagcuua

SEQ ID NO: 1446525 - RNA, 19 nt, Homo sapiens
gccacagacuugaguaugg

SEQ ID NO: 1446526 - RNA, 19 nt, Homo sapiens
cuauaaacggguagacuaa

SEQ ID NO: 1446527 - RNA, 19 nt, Homo sapiens
caaggcuuaugucaccaaa

SEQ ID NO: 1446528 - RNA, 19 nt, Homo sapiens
uggagaauuugaaugauag

SEQ ID NO: 1446529 - RNA, 19 nt, Homo sapiens
ugaaagaacacugcaaagu

SEQ ID NO: 1446530 - RNA, 19 nt, Homo sapiens
aaacaagaaaugcccagaa

SEQ ID NO: 1446531 - RNA, 19 nt, Homo sapiens
caaccauuguuccagacuu

SEQ ID NO: 1446532 - RNA, 19 nt, Homo sapiens
cccaauaccagauauauag

SEQ ID NO: 1446533 - RNA, 19 nt, Homo sapiens
gcugaauuugucacauuua

SEQ ID NO: 1446534 - RNA, 19 nt, Homo sapiens
aggcuuaugucaccaaauc

SEQ ID NO: 1446535 - RNA, 19 nt, Homo sapiens
ucauagaaagugacaaaug

SEQ ID NO: 1446536 - RNA, 19 nt, Homo sapiens
gacgaggccagaaggaauu

SEQ ID NO: 1446537 - RNA, 19 nt, Homo sapiens
caaaacaggauuccauuga

SEQ ID NO: 1446538 - RNA, 19 nt, Homo sapiens
aguaggacguaaugcauga

SEQ ID NO: 1446539 - RNA, 19 nt, Homo sapiens
gcaagccuuccuagaauag

SEQ ID NO: 1446540 - RNA, 19 nt, Homo sapiens
uuaauugaguggcugaaca

SEQ ID NO: 1446541 - RNA, 19 nt, Homo sapiens
aaauuggcaucgugggauu

SEQ ID NO: 1446542 - RNA, 19 nt, Homo sapiens
agacuaacugcccagcuua

SEQ ID NO: 1446543 - RNA, 19 nt, Homo sapiens
ccucaugccuguaauucca

SEQ ID NO: 1446544 - RNA, 19 nt, Homo sapiens
aggcaaagcugugauuguc

SEQ ID NO: 1446545 - RNA, 19 nt, Homo sapiens
gaacacugcaaaguugaau

SEQ ID NO: 1446546 - RNA, 19 nt, Homo sapiens
ucuauggcauugucaagga

SEQ ID NO: 1446547 - RNA, 19 nt, Homo sapiens
aagcugugauugucauuca

SEQ ID NO: 1446548 - RNA, 19 nt, Homo sapiens
ugaggcacaggaaucaaua

SEQ ID NO: 1446549 - RNA, 19 nt, Homo sapiens
gcuuggaaauaguuagauc

SEQ ID NO: 1446550 - RNA, 19 nt, Homo sapiens
ugucaaggauucugaagac

SEQ ID NO: 1446551 - RNA, 19 nt, Homo sapiens
aacaagaaaugcccagaag

SEQ ID NO: 1446552 - RNA, 19 nt, Homo sapiens
gcugcaaagccaugaagaa

SEQ ID NO: 1446553 - RNA, 19 nt, Homo sapiens
ggucaguaccuggagaauu

SEQ ID NO: 1446554 - RNA, 19 nt, Homo sapiens
cauguacaucgaaucauaa

SEQ ID NO: 1446555 - RNA, 19 nt, Homo sapiens
acacugcaaaguugaauau

SEQ ID NO: 1446556 - RNA, 19 nt, Homo sapiens
uaacugcccagcuuagaca

SEQ ID NO: 1446557 - RNA, 19 nt, Homo sapiens
gacaagcccgacuuaaauc

SEQ ID NO: 1446558 - RNA, 19 nt, Homo sapiens
gaaacagccuggagaaauu

SEQ ID NO: 1446559 - RNA, 19 nt, Homo sapiens
gagagaagaugaaguuuau

SEQ ID NO: 1446560 - RNA, 19 nt, Homo sapiens
ggagagaagaugaaguuua

SEQ ID NO: 1446561 - RNA, 19 nt, Homo sapiens
uagcauugguuuaaaggua

SEQ ID NO: 1446562 - RNA, 19 nt, Homo sapiens
gagaagaugaaguuuauug

SEQ ID NO: 1446563 - RNA, 19 nt, Homo sapiens
cuaaagaaguuaaggauac

SEQ ID NO: 1446564 - RNA, 19 nt, Homo sapiens
ggaaacagccuggagaaau

SEQ ID NO: 1446565 - RNA, 19 nt, Homo sapiens
ggugggaauuguucaagaa

SEQ ID NO: 1446566 - RNA, 19 nt, Homo sapiens
cagcaaaucagccacauug

SEQ ID NO: 1446567 - RNA, 19 nt, Homo sapiens
gagaugauccugcaacagu

SEQ ID NO: 1446568 - RNA, 19 nt, Homo sapiens
gcaauuggccaaggaguug

SEQ ID NO: 1446569 - RNA, 19 nt, Homo sapiens
gaugaaguuuauugcaguu

SEQ ID NO: 1446570 - RNA, 19 nt, Homo sapiens
gcagaaggaugugguucga

SEQ ID NO: 1446571 - RNA, 19 nt, Homo sapiens
ccaaggaguugaggcagaa

SEQ ID NO: 1446572 - RNA, 19 nt, Homo sapiens
ggacaucucgggcauacug

SEQ ID NO: 1446573 - RNA, 19 nt, Homo sapiens
guucgaguuugguucuaua

SEQ ID NO: 1446574 - RNA, 19 nt, Homo sapiens
gaagaugaaguuuauugca

SEQ ID NO: 1446575 - RNA, 19 nt, Homo sapiens
gcagucgaccaaccaauga

SEQ ID NO: 1446576 - RNA, 19 nt, Homo sapiens
gaaguuaaggauacauagu

SEQ ID NO: 1446577 - RNA, 19 nt, Homo sapiens
gaggacaucucgggcauac

SEQ ID NO: 1446578 - RNA, 19 nt, Homo sapiens
cucauucacugucuaaaga

SEQ ID NO: 1446579 - RNA, 19 nt, Homo sapiens
ggaugugguucgaguuugg

SEQ ID NO: 1446580 - RNA, 19 nt, Homo sapiens
gcaagcagagagcgacgaa

SEQ ID NO: 1446581 - RNA, 19 nt, Homo sapiens
gaaaugucccuaggguuca

SEQ ID NO: 1446582 - RNA, 19 nt, Homo sapiens
gggugggaauuguucaaga

SEQ ID NO: 1446583 - RNA, 19 nt, Homo sapiens
gcuaagcgucgccaacaug

SEQ ID NO: 1446584 - RNA, 19 nt, Homo sapiens
gaaguuuauugcaguuuug

SEQ ID NO: 1446585 - RNA, 19 nt, Homo sapiens
ggacacaggcccucaaacc

SEQ ID NO: 1446586 - RNA, 19 nt, Homo sapiens
aaaaguggcugaaggaagu

SEQ ID NO: 1446587 - RNA, 19 nt, Homo sapiens
guuuaaagguacauuacag

SEQ ID NO: 1446588 - RNA, 19 nt, Homo sapiens
gaaggaugugguucgaguu

SEQ ID NO: 1446589 - RNA, 19 nt, Homo sapiens
ggaaguggaagcagagaac

SEQ ID NO: 1446590 - RNA, 19 nt, Homo sapiens
gggcauacugaaagaguug

SEQ ID NO: 1446591 - RNA, 19 nt, Homo sapiens
ugggagagaagaugaaguu

SEQ ID NO: 1446592 - RNA, 19 nt, Homo sapiens
ucucgggcauacugaaaga

SEQ ID NO: 1446593 - RNA, 19 nt, Homo sapiens
ggcagucgaccaaccaaug

SEQ ID NO: 1446594 - RNA, 19 nt, Homo sapiens
gguucgaguuugguucuau

SEQ ID NO: 1446595 - RNA, 19 nt, Homo sapiens
gccuccagcugcagaagga

SEQ ID NO: 1446596 - RNA, 19 nt, Homo sapiens
cuucugggcuuaugcaaaa

SEQ ID NO: 1446597 - RNA, 19 nt, Homo sapiens
cuauacacgucucuacucu

SEQ ID NO: 1446598 - RNA, 19 nt, Homo sapiens
gcauugguuuaaagguaca

SEQ ID NO: 1446599 - RNA, 19 nt, Homo sapiens
gaagggaaaacccaggaaa

SEQ ID NO: 1446600 - RNA, 19 nt, Homo sapiens
ggauacauaguagggaaug

SEQ ID NO: 1446601 - RNA, 19 nt, Homo sapiens
gagcgacgaaucggaaaca

SEQ ID NO: 1446602 - RNA, 19 nt, Homo sapiens
gagagcgacgaaucggaaa

SEQ ID NO: 1446603 - RNA, 19 nt, Homo sapiens
aagcagagagcgacgaauc

SEQ ID NO: 1446604 - RNA, 19 nt, Homo sapiens
caucucgggcauacugaaa

SEQ ID NO: 1446605 - RNA, 19 nt, Homo sapiens
gguacucgcaggccgaugu

SEQ ID NO: 1446606 - RNA, 19 nt, Homo sapiens
ccugacguguggaggauuc

SEQ ID NO: 1446607 - RNA, 19 nt, Homo sapiens
aaggaugugguucgaguuu

SEQ ID NO: 1446608 - RNA, 19 nt, Homo sapiens
gacacaggcccucaaacca

SEQ ID NO: 1446609 - RNA, 19 nt, Homo sapiens
uugacacucugaccugguu

SEQ ID NO: 1446610 - RNA, 19 nt, Homo sapiens
gugggaauuguucaagaaa

SEQ ID NO: 1446611 - RNA, 19 nt, Homo sapiens
gucccuaggguucauuuga

SEQ ID NO: 1446612 - RNA, 19 nt, Homo sapiens
cagcuaagcgucgccaaca

SEQ ID NO: 1446613 - RNA, 19 nt, Homo sapiens
gcugugggagcucuguuug

SEQ ID NO: 1446614 - RNA, 19 nt, Homo sapiens
gcccugacguguggaggau

SEQ ID NO: 1446615 - RNA, 19 nt, Homo sapiens
aguuaaggauacauaguag

SEQ ID NO: 1446616 - RNA, 19 nt, Homo sapiens
uugagggcuuuuaguauua

SEQ ID NO: 1446617 - RNA, 19 nt, Homo sapiens
uggagaugauccugcaaca

SEQ ID NO: 1446618 - RNA, 19 nt, Homo sapiens
gcaauuaagucuccauuua

SEQ ID NO: 1446619 - RNA, 19 nt, Homo sapiens
gaacaaggaucacugagaa

SEQ ID NO: 1446620 - RNA, 19 nt, Homo sapiens
gaagaggccuuaaugauca

SEQ ID NO: 1446621 - RNA, 19 nt, Homo sapiens
gcacacaaacuuaucaaua

SEQ ID NO: 1446622 - RNA, 19 nt, Homo sapiens
gaucaaaucucacccuuuc

SEQ ID NO: 1446623 - RNA, 19 nt, Homo sapiens
gagcauaggcuugaacuua

SEQ ID NO: 1446624 - RNA, 19 nt, Homo sapiens
gcaaggagcaucgaaauuu

SEQ ID NO: 1446625 - RNA, 19 nt, Homo sapiens
gaagacugguuaaugauga

SEQ ID NO: 1446626 - RNA, 19 nt, Homo sapiens
ggaauguuaugauuaccua

SEQ ID NO: 1446627 - RNA, 19 nt, Homo sapiens
guggaaaguuaaccucuua

SEQ ID NO: 1446628 - RNA, 19 nt, Homo sapiens
agaugaagcuauaguagua

SEQ ID NO: 1446629 - RNA, 19 nt, Homo sapiens
cuaaugagcucaagugauc

SEQ ID NO: 1446630 - RNA, 19 nt, Homo sapiens
caucagauuuagacccuua

SEQ ID NO: 1446631 - RNA, 19 nt, Homo sapiens
uacaguaggugcucagaua

SEQ ID NO: 1446632 - RNA, 19 nt, Homo sapiens
caccaugacuggcuaguuu

SEQ ID NO: 1446633 - RNA, 19 nt, Homo sapiens
gguauggaauguuaugauu

SEQ ID NO: 1446634 - RNA, 19 nt, Homo sapiens
ggaaggcagucaauuaugg

SEQ ID NO: 1446635 - RNA, 19 nt, Homo sapiens
ucagugcucuuaguuauuu

SEQ ID NO: 1446636 - RNA, 19 nt, Homo sapiens
ugacagauggugacaauaa

SEQ ID NO: 1446637 - RNA, 19 nt, Homo sapiens
gagccaaagcagcauauua

SEQ ID NO: 1446638 - RNA, 19 nt, Homo sapiens
ggaagaggccuuaaugauc

SEQ ID NO: 1446639 - RNA, 19 nt, Homo sapiens
caaggagcaucgaaauuug

SEQ ID NO: 1446640 - RNA, 19 nt, Homo sapiens
gcaguuggguauugauaug

SEQ ID NO: 1446641 - RNA, 19 nt, Homo sapiens
gcauaggcuugaacuuaaa

SEQ ID NO: 1446642 - RNA, 19 nt, Homo sapiens
caaucaagguucacaauag

SEQ ID NO: 1446643 - RNA, 19 nt, Homo sapiens
ggaaaguuaaccucuuaua

SEQ ID NO: 1446644 - RNA, 19 nt, Homo sapiens
guggagugguggaaaguua

SEQ ID NO: 1446645 - RNA, 19 nt, Homo sapiens
ccaauaaacgacuuaauga

SEQ ID NO: 1446646 - RNA, 19 nt, Homo sapiens
gacaagcucuauuuccuau

SEQ ID NO: 1446647 - RNA, 19 nt, Homo sapiens
gaaaaugagcugauuguaa

SEQ ID NO: 1446648 - RNA, 19 nt, Homo sapiens
uaaguauucucuccucuug

SEQ ID NO: 1446649 - RNA, 19 nt, Homo sapiens
ggaucuugguguuguagua

SEQ ID NO: 1446650 - RNA, 19 nt, Homo sapiens
ggaaagagcaagaaaauug

SEQ ID NO: 1446651 - RNA, 19 nt, Homo sapiens
uagcuaucauuaccaguua

SEQ ID NO: 1446652 - RNA, 19 nt, Homo sapiens
gguuuagguugaaguuaua

SEQ ID NO: 1446653 - RNA, 19 nt, Homo sapiens
gaguaugaaugaagaacaa

SEQ ID NO: 1446654 - RNA, 19 nt, Homo sapiens
gagcucaccuuuuauauau

SEQ ID NO: 1446655 - RNA, 19 nt, Homo sapiens
gaaaagggaagacugguua

SEQ ID NO: 1446656 - RNA, 19 nt, Homo sapiens
caagcucuauuuccuauuc

SEQ ID NO: 1446657 - RNA, 19 nt, Homo sapiens
guaaaggaaucaggcaguu

SEQ ID NO: 1446658 - RNA, 19 nt, Homo sapiens
gacauugacuugagaugau

SEQ ID NO: 1446659 - RNA, 19 nt, Homo sapiens
gaaugaagaacaacuagau

SEQ ID NO: 1446660 - RNA, 19 nt, Homo sapiens
ccagugagaguaugaauga

SEQ ID NO: 1446661 - RNA, 19 nt, Homo sapiens
ugacuaaauuccagugaga

SEQ ID NO: 1446662 - RNA, 19 nt, Homo sapiens
caaaucacuaccucuguua

SEQ ID NO: 1446663 - RNA, 19 nt, Homo sapiens
gaaaagacauugacuugag

SEQ ID NO: 1446664 - RNA, 19 nt, Homo sapiens
uuaggaaggcagucaauua

SEQ ID NO: 1446665 - RNA, 19 nt, Homo sapiens
gaagaugaagcuauaguag

SEQ ID NO: 1446666 - RNA, 19 nt, Homo sapiens
gcuuuaugcucacaucauu

SEQ ID NO: 1446667 - RNA, 19 nt, Homo sapiens
gcauuccacuaaguauaua

SEQ ID NO: 1446668 - RNA, 19 nt, Homo sapiens
guuguuggaugucuagauu

SEQ ID NO: 1446669 - RNA, 19 nt, Homo sapiens
cuucugagccuguuucuuu

SEQ ID NO: 1446670 - RNA, 19 nt, Homo sapiens
uaagacagcacacaaacuu

SEQ ID NO: 1446671 - RNA, 19 nt, Homo sapiens
acauugagcucaccuuuua

SEQ ID NO: 1446672 - RNA, 19 nt, Homo sapiens
agggaagacugguuaauga

SEQ ID NO: 1446673 - RNA, 19 nt, Homo sapiens
gaaaguuaaccucuuauac

SEQ ID NO: 1446674 - RNA, 19 nt, Homo sapiens
ggcagucaauuauggauau

SEQ ID NO: 1446675 - RNA, 19 nt, Homo sapiens
guuauuuggugcucucauu

SEQ ID NO: 1446676 - RNA, 19 nt, Homo sapiens
gcuaaucauucacugacuu

SEQ ID NO: 1446677 - RNA, 19 nt, Homo sapiens
ggcuugaacuuaaaucuca

SEQ ID NO: 1446678 - RNA, 19 nt, Homo sapiens
caccucagccuaccaagua

SEQ ID NO: 1446679 - RNA, 19 nt, Homo sapiens
ucaaaagacuggugguuaa

SEQ ID NO: 1446680 - RNA, 19 nt, Homo sapiens
acaaaucacuaccucuguu

SEQ ID NO: 1446681 - RNA, 19 nt, Homo sapiens
cagccuccuugucauauaa

SEQ ID NO: 1446682 - RNA, 19 nt, Homo sapiens
ccaggacccuuucaagcaa

SEQ ID NO: 1446683 - RNA, 19 nt, Homo sapiens
ugucagugcucuuaguuau

SEQ ID NO: 1446684 - RNA, 19 nt, Homo sapiens
ccacaggaaacccacauuu

SEQ ID NO: 1446685 - RNA, 19 nt, Homo sapiens
ccaacuagauaggcuuuau

SEQ ID NO: 1446686 - RNA, 19 nt, Homo sapiens
gugagaguaugaaugaaga

SEQ ID NO: 1446687 - RNA, 19 nt, Homo sapiens
ugucuaaagucuagggaaa

SEQ ID NO: 1446688 - RNA, 19 nt, Homo sapiens
agcauaggcuugaacuuaa

SEQ ID NO: 1446689 - RNA, 19 nt, Homo sapiens
gagauacccaggacccuuu

SEQ ID NO: 1446690 - RNA, 19 nt, Homo sapiens
gcaagaaaauugugucagu

SEQ ID NO: 1446691 - RNA, 19 nt, Homo sapiens
ggaagacugguuaaugaug

SEQ ID NO: 1446692 - RNA, 19 nt, Homo sapiens
ugacccagauggcucuauu

SEQ ID NO: 1446693 - RNA, 19 nt, Homo sapiens
guuggguauugauauguua

SEQ ID NO: 1446694 - RNA, 19 nt, Homo sapiens
cuuguaagcuaaucauuca

SEQ ID NO: 1446695 - RNA, 19 nt, Homo sapiens
gaagcuauaguaguaagaa

SEQ ID NO: 1446696 - RNA, 19 nt, Homo sapiens
agaugucucuaccuaauga

SEQ ID NO: 1446697 - RNA, 19 nt, Homo sapiens
uauagcugguguucuguaa

SEQ ID NO: 1446698 - RNA, 19 nt, Homo sapiens
cacuaccucuguuauauug

SEQ ID NO: 1446699 - RNA, 19 nt, Homo sapiens
guaauuacucucugugugu

SEQ ID NO: 1446700 - RNA, 19 nt, Homo sapiens
aggcaacacuaacagcuaa

SEQ ID NO: 1446701 - RNA, 19 nt, Homo sapiens
ugacuugagaugauacuaa

SEQ ID NO: 1446702 - RNA, 19 nt, Homo sapiens
aguaggugcucagauauuu

SEQ ID NO: 1446703 - RNA, 19 nt, Homo sapiens
gggcuaaaggucuagauga

SEQ ID NO: 1446704 - RNA, 19 nt, Homo sapiens
gguggaaaguuaaccucuu

SEQ ID NO: 1446705 - RNA, 19 nt, Homo sapiens
gcagucaauuauggauauu

SEQ ID NO: 1446706 - RNA, 19 nt, Homo sapiens
caaacugaggcaacacuaa

SEQ ID NO: 1446707 - RNA, 19 nt, Homo sapiens
guaggugcucagauauuua

SEQ ID NO: 1446708 - RNA, 19 nt, Homo sapiens
gcaaacugaggcaacacua

SEQ ID NO: 1446709 - RNA, 19 nt, Homo sapiens
gagcaaaacuaaggaugaa

SEQ ID NO: 1446710 - RNA, 19 nt, Homo sapiens
gguuaaugaugaguagaaa

SEQ ID NO: 1446711 - RNA, 19 nt, Homo sapiens
acaaucaagguucacaaua

SEQ ID NO: 1446712 - RNA, 19 nt, Homo sapiens
uaaauuccagugagaguau

SEQ ID NO: 1446713 - RNA, 19 nt, Homo sapiens
uuaaugggccuaugugguu

SEQ ID NO: 1446714 - RNA, 19 nt, Homo sapiens
aaacauugagcucaccuuu

SEQ ID NO: 1446715 - RNA, 19 nt, Homo sapiens
gaucaggacaaaaguguua

SEQ ID NO: 1446716 - RNA, 19 nt, Homo sapiens
gaugggagguggugaucag

SEQ ID NO: 1446717 - RNA, 19 nt, Homo sapiens
gacuugagaugauacuaag

SEQ ID NO: 1446718 - RNA, 19 nt, Homo sapiens
gaaagagacugugaaucua

SEQ ID NO: 1446719 - RNA, 19 nt, Homo sapiens
ggagagagccgccaguuug

SEQ ID NO: 1446720 - RNA, 19 nt, Homo sapiens
guaggugacucgguaauaa

SEQ ID NO: 1446721 - RNA, 19 nt, Homo sapiens
gcagagaggucagcagaug

SEQ ID NO: 1446722 - RNA, 19 nt, Homo sapiens
ugaauugccuccuagauau

SEQ ID NO: 1446723 - RNA, 19 nt, Homo sapiens
ggacagauccagauuaugg

SEQ ID NO: 1446724 - RNA, 19 nt, Homo sapiens
ggacagacacgucagcaaa

SEQ ID NO: 1446725 - RNA, 19 nt, Homo sapiens
ugaaagagacugugaaucu

SEQ ID NO: 1446726 - RNA, 19 nt, Homo sapiens
gacagacacuggcgacuca

SEQ ID NO: 1446727 - RNA, 19 nt, Homo sapiens
ggacgaauucaucuucuga

SEQ ID NO: 1446728 - RNA, 19 nt, Homo sapiens
gcaaacucaucuucugcuu

SEQ ID NO: 1446729 - RNA, 19 nt, Homo sapiens
uauaugcaauggaucacua

SEQ ID NO: 1446730 - RNA, 19 nt, Homo sapiens
aagagacugugaaucuaua

SEQ ID NO: 1446731 - RNA, 19 nt, Homo sapiens
gagggacagauccagauua

SEQ ID NO: 1446732 - RNA, 19 nt, Homo sapiens
aaacucaucuucugcuucu

SEQ ID NO: 1446733 - RNA, 19 nt, Homo sapiens
ggacucuaguucaguuuua

SEQ ID NO: 1446734 - RNA, 19 nt, Homo sapiens
gcuacauucuugccucuau

SEQ ID NO: 1446735 - RNA, 19 nt, Homo sapiens
cgaccgagccuucaucugu

SEQ ID NO: 1446736 - RNA, 19 nt, Homo sapiens
gagccuuccucaccguaaa

SEQ ID NO: 1446737 - RNA, 19 nt, Homo sapiens
acagucugcuuccgaauga

SEQ ID NO: 1446738 - RNA, 19 nt, Homo sapiens
cguaaacuauggacucuag

SEQ ID NO: 1446739 - RNA, 19 nt, Homo sapiens
gcugaaugcuggccaggau

SEQ ID NO: 1446740 - RNA, 19 nt, Homo sapiens
gaagagaaacacgcugaau

SEQ ID NO: 1446741 - RNA, 19 nt, Homo sapiens
cugaauugccuccuagaua

SEQ ID NO: 1446742 - RNA, 19 nt, Homo sapiens
cuccacaucuuccaucuga

SEQ ID NO: 1446743 - RNA, 19 nt, Homo sapiens
ccaccuuacuuuccugaau

SEQ ID NO: 1446744 - RNA, 19 nt, Homo sapiens
gagagaagagggacagauc

SEQ ID NO: 1446745 - RNA, 19 nt, Homo sapiens
ugauugugcuugugggauu

SEQ ID NO: 1446746 - RNA, 19 nt, Homo sapiens
ucagcaaacucaucuucug

SEQ ID NO: 1446747 - RNA, 19 nt, Homo sapiens
guccugcucuccaucuuug

SEQ ID NO: 1446748 - RNA, 19 nt, Homo sapiens
agggacagauccagauuau

SEQ ID NO: 1446749 - RNA, 19 nt, Homo sapiens
uauggacucuaguucaguu

SEQ ID NO: 1446750 - RNA, 19 nt, Homo sapiens
gagacugugaaucuauaua

SEQ ID NO: 1446751 - RNA, 19 nt, Homo sapiens
aaagagacugugaaucuau

SEQ ID NO: 1446752 - RNA, 19 nt, Homo sapiens
gggugcagccucugaaaga

SEQ ID NO: 1446753 - RNA, 19 nt, Homo sapiens
gcugagaguccuggaacua

SEQ ID NO: 1446754 - RNA, 19 nt, Homo sapiens
gcccagugccuuaucuuug

SEQ ID NO: 1446755 - RNA, 19 nt, Homo sapiens
uuccaggcaugccaauaua

SEQ ID NO: 1446756 - RNA, 19 nt, Homo sapiens
ccuccuagauaugaagaaa

SEQ ID NO: 1446757 - RNA, 19 nt, Homo sapiens
gcaauggaucacuauuuua

SEQ ID NO: 1446758 - RNA, 19 nt, Homo sapiens
gaauugccuccuagauaug

SEQ ID NO: 1446759 - RNA, 19 nt, Homo sapiens
ccacaucuuccaucugaau

SEQ ID NO: 1446760 - RNA, 19 nt, Homo sapiens
guuccaggcaugccaauau

SEQ ID NO: 1446761 - RNA, 19 nt, Homo sapiens
caccuuacuuuccugaauc

SEQ ID NO: 1446762 - RNA, 19 nt, Homo sapiens
ccaucugaauugccuccua

SEQ ID NO: 1446763 - RNA, 19 nt, Homo sapiens
ggguuucuguucuugacaa

SEQ ID NO: 1446764 - RNA, 19 nt, Homo sapiens
gggacgaauucaucuucug

SEQ ID NO: 1446765 - RNA, 19 nt, Homo sapiens
ugcaauggaucacuauuuu

SEQ ID NO: 1446766 - RNA, 19 nt, Homo sapiens
ucacacacuccacaucuuc

SEQ ID NO: 1446767 - RNA, 19 nt, Homo sapiens
aagagaaacacgcugaaug

SEQ ID NO: 1446768 - RNA, 19 nt, Homo sapiens
gauugugcuugugggauug

SEQ ID NO: 1446769 - RNA, 19 nt, Homo sapiens
gagaagagggacagaucca

SEQ ID NO: 1446770 - RNA, 19 nt, Homo sapiens
cccagugccuuaucuuugg

SEQ ID NO: 1446771 - RNA, 19 nt, Homo sapiens
caguuugcccagugccuua

SEQ ID NO: 1446772 - RNA, 19 nt, Homo sapiens
acucaucuucugcuucuuu

SEQ ID NO: 1446773 - RNA, 19 nt, Homo sapiens
ugagaguccuggaacuaac

SEQ ID NO: 1446774 - RNA, 19 nt, Homo sapiens
agagaaacacgcugaaugc

SEQ ID NO: 1446775 - RNA, 19 nt, Homo sapiens
ugccuuaucuuuggguuuc

SEQ ID NO: 1446776 - RNA, 19 nt, Homo sapiens
gagaguccuggaacuaaca

SEQ ID NO: 1446777 - RNA, 19 nt, Homo sapiens
agacacgucagcaaacuca

SEQ ID NO: 1446778 - RNA, 19 nt, Homo sapiens
cuucgugguugcccauguu

SEQ ID NO: 1446779 - RNA, 19 nt, Homo sapiens
cuacauucuugccucuauc

SEQ ID NO: 1446780 - RNA, 19 nt, Homo sapiens
uguaggugacucgguaaua

SEQ ID NO: 1446781 - RNA, 19 nt, Homo sapiens
acaagcggcaugcucauca

SEQ ID NO: 1446782 - RNA, 19 nt, Homo sapiens
gccuucaucuguggagaga

SEQ ID NO: 1446783 - RNA, 19 nt, Homo sapiens
ugcugcagcuacauucuug

SEQ ID NO: 1446784 - RNA, 19 nt, Homo sapiens
gaguccugcucuccaucuu

SEQ ID NO: 1446785 - RNA, 19 nt, Homo sapiens
aggugacucgguaauaaua

SEQ ID NO: 1446786 - RNA, 19 nt, Homo sapiens
gcuagaggcuauucugaua

SEQ ID NO: 1446787 - RNA, 19 nt, Homo sapiens
caagauaacucugcauuug

SEQ ID NO: 1446788 - RNA, 19 nt, Homo sapiens
gguaagaaaucuccuguau

SEQ ID NO: 1446789 - RNA, 19 nt, Homo sapiens
ggaggaccaucauuuguuu

SEQ ID NO: 1446790 - RNA, 19 nt, Homo sapiens
guacaucccuccuccuuau

SEQ ID NO: 1446791 - RNA, 19 nt, Homo sapiens
ggacuucccugucaaugug

SEQ ID NO: 1446792 - RNA, 19 nt, Homo sapiens
gaugagggcugccuuucuu

SEQ ID NO: 1446793 - RNA, 19 nt, Homo sapiens
caaauucccucggguaaga

SEQ ID NO: 1446794 - RNA, 19 nt, Homo sapiens
gaaaucuccuguauaaggu

SEQ ID NO: 1446795 - RNA, 19 nt, Homo sapiens
uagaggcuauucugauaua

SEQ ID NO: 1446796 - RNA, 19 nt, Homo sapiens
caaggugucucccacuuug

SEQ ID NO: 1446797 - RNA, 19 nt, Homo sapiens
gaaauucuccuccggaaca

SEQ ID NO: 1446798 - RNA, 19 nt, Homo sapiens
guaagaaaucuccuguaua

SEQ ID NO: 1446799 - RNA, 19 nt, Homo sapiens
ugacaaccgugguguucua

SEQ ID NO: 1446800 - RNA, 19 nt, Homo sapiens
gaagugggaggugcaauuu

SEQ ID NO: 1446801 - RNA, 19 nt, Homo sapiens
gaaggaagcagggaagaga

SEQ ID NO: 1446802 - RNA, 19 nt, Homo sapiens
caaagcagacucacuaauc

SEQ ID NO: 1446803 - RNA, 19 nt, Homo sapiens
ggaagugggaggugcaauu

SEQ ID NO: 1446804 - RNA, 19 nt, Homo sapiens
gcaaguguuuccgucauug

SEQ ID NO: 1446805 - RNA, 19 nt, Homo sapiens
gcaaagaaagugaggaaag

SEQ ID NO: 1446806 - RNA, 19 nt, Homo sapiens
caaccgugguguucuaugu

SEQ ID NO: 1446807 - RNA, 19 nt, Homo sapiens
caaagaaagugaggaaagg

SEQ ID NO: 1446808 - RNA, 19 nt, Homo sapiens
ggaaaucacaggcccaauc

SEQ ID NO: 1446809 - RNA, 19 nt, Homo sapiens
gggaucacauucacuguca

SEQ ID NO: 1446810 - RNA, 19 nt, Homo sapiens
gagcaggaauuucacuuuu

SEQ ID NO: 1446811 - RNA, 19 nt, Homo sapiens
caaguccuccucaauacua

SEQ ID NO: 1446812 - RNA, 19 nt, Homo sapiens
ugucaaguccuccucaaua

SEQ ID NO: 1446813 - RNA, 19 nt, Homo sapiens
ggagcaggaauuucacuuu

SEQ ID NO: 1446814 - RNA, 19 nt, Homo sapiens
ccagcuaccugcagucugu

SEQ ID NO: 1446815 - RNA, 19 nt, Homo sapiens
gcucuucucaggcaucuuu

SEQ ID NO: 1446816 - RNA, 19 nt, Homo sapiens
gucaugggcuggaucaaau

SEQ ID NO: 1446817 - RNA, 19 nt, Homo sapiens
cuggguaccuuaaagacua

SEQ ID NO: 1446818 - RNA, 19 nt, Homo sapiens
ccggaacaguuucaaauuc

SEQ ID NO: 1446819 - RNA, 19 nt, Homo sapiens
gaggugcaauuucucagau

SEQ ID NO: 1446820 - RNA, 19 nt, Homo sapiens
gagcaaguguuuccgucau

SEQ ID NO: 1446821 - RNA, 19 nt, Homo sapiens
agauaacucugcauuugug

SEQ ID NO: 1446822 - RNA, 19 nt, Homo sapiens
cagacucacuaaucccaaa

SEQ ID NO: 1446823 - RNA, 19 nt, Homo sapiens
ccaggaggaccaucauuug

SEQ ID NO: 1446824 - RNA, 19 nt, Homo sapiens
ucaagauaacucugcauuu

SEQ ID NO: 1446825 - RNA, 19 nt, Homo sapiens
agaaaucuccuguauaagg

SEQ ID NO: 1446826 - RNA, 19 nt, Homo sapiens
ucacuaaucccaaacaacu

SEQ ID NO: 1446827 - RNA, 19 nt, Homo sapiens
ggacucuggguaccuuaaa

SEQ ID NO: 1446828 - RNA, 19 nt, Homo sapiens
ucacgacuucugagacuuu

SEQ ID NO: 1446829 - RNA, 19 nt, Homo sapiens
ggaggugcaauuucucaga

SEQ ID NO: 1446830 - RNA, 19 nt, Homo sapiens
gucaaguccuccucaauac

SEQ ID NO: 1446831 - RNA, 19 nt, Homo sapiens
gugcaaagaaagugaggaa

SEQ ID NO: 1446832 - RNA, 19 nt, Homo sapiens
ccaaggugucucccacuuu

SEQ ID NO: 1446833 - RNA, 19 nt, Homo sapiens
ucugagacuuugggaguuu

SEQ ID NO: 1446834 - RNA, 19 nt, Homo sapiens
cugcauuugugguugauga

SEQ ID NO: 1446835 - RNA, 19 nt, Homo sapiens
gaucacauucacugucaug

SEQ ID NO: 1446836 - RNA, 19 nt, Homo sapiens
ggcccaauccugauguuga

SEQ ID NO: 1446837 - RNA, 19 nt, Homo sapiens
uaacucugcauuugugguu

SEQ ID NO: 1446838 - RNA, 19 nt, Homo sapiens
ugacauucauccugauugc

SEQ ID NO: 1446839 - RNA, 19 nt, Homo sapiens
gaaaucacaggcccaaucc

SEQ ID NO: 1446840 - RNA, 19 nt, Homo sapiens
gagccuauggggauaaaua

SEQ ID NO: 1446841 - RNA, 19 nt, Homo sapiens
gugguguucuauguuguaa

SEQ ID NO: 1446842 - RNA, 19 nt, Homo sapiens
gaggcuauucugauauaau

SEQ ID NO: 1446843 - RNA, 19 nt, Homo sapiens
ugaggacucuggguaccuu

SEQ ID NO: 1446844 - RNA, 19 nt, Homo sapiens
aaagcagacucacuaaucc

SEQ ID NO: 1446845 - RNA, 19 nt, Homo sapiens
ccaaagcagacucacuaau

SEQ ID NO: 1446846 - RNA, 19 nt, Homo sapiens
aggcccagcuggagauuuc

SEQ ID NO: 1446847 - RNA, 19 nt, Homo sapiens
ggaggacuucccugucaau

SEQ ID NO: 1446848 - RNA, 19 nt, Homo sapiens
uuggaggacuucccuguca

SEQ ID NO: 1446849 - RNA, 19 nt, Homo sapiens
gagggcugccuuucuuuca

SEQ ID NO: 1446850 - RNA, 19 nt, Homo sapiens
ugccaguugugcaaagaaa

SEQ ID NO: 1446851 - RNA, 19 nt, Homo sapiens
aaucacgacuucugagacu

SEQ ID NO: 1446852 - RNA, 19 nt, Homo sapiens
ccucaauacuacaccaucu

SEQ ID NO: 1446853 - RNA, 19 nt, Homo sapiens
gauguugaccagcuagaag

SEQ ID NO: 1446854 - RNA, 19 nt, Homo sapiens
caugucaaguccuccucaa

SEQ ID NO: 1446855 - RNA, 19 nt, Homo sapiens
uggguaccuuaaagacuaa

SEQ ID NO: 1446856 - RNA, 19 nt, Homo sapiens
ucaaccaacccaucaccuu

SEQ ID NO: 1446857 - RNA, 19 nt, Homo sapiens
caggaggaccaucauuugu

SEQ ID NO: 1446858 - RNA, 19 nt, Homo sapiens
ggugacauucauccugauu

SEQ ID NO: 1446859 - RNA, 19 nt, Homo sapiens
agugggaggugcaauuucu

SEQ ID NO: 1446860 - RNA, 19 nt, Homo sapiens
gcccaauccugauguugac

SEQ ID NO: 1446861 - RNA, 19 nt, Homo sapiens
ggaaggaagcagggaagag

SEQ ID NO: 1446862 - RNA, 19 nt, Homo sapiens
ggguaagaaaucuccugua

SEQ ID NO: 1446863 - RNA, 19 nt, Homo sapiens
gguguucuauguuguaacc

SEQ ID NO: 1446864 - RNA, 19 nt, Homo sapiens
ugucaugggcuggaucaaa

SEQ ID NO: 1446865 - RNA, 19 nt, Homo sapiens
ucaugggcuggaucaaaua

SEQ ID NO: 1446866 - RNA, 19 nt, Homo sapiens
gagagucgggugggaagga

SEQ ID NO: 1446867 - RNA, 19 nt, Homo sapiens
uguucuccgucacuccuua

SEQ ID NO: 1446868 - RNA, 19 nt, Homo sapiens
ggcaucaaccaacccauca

SEQ ID NO: 1446869 - RNA, 19 nt, Homo sapiens
agcaaguguuuccgucauu

SEQ ID NO: 1446870 - RNA, 19 nt, Homo sapiens
ucacggacgguggaaauca

SEQ ID NO: 1446871 - RNA, 19 nt, Homo sapiens
acucugcauuugugguuga

SEQ ID NO: 1446872 - RNA, 19 nt, Homo sapiens
aagauaacucugcauuugu

SEQ ID NO: 1446873 - RNA, 19 nt, Homo sapiens
aggaggaccaucauuuguu

SEQ ID NO: 1446874 - RNA, 19 nt, Homo sapiens
agaaauagccaacuaguua

SEQ ID NO: 1446875 - RNA, 19 nt, Homo sapiens
gguauucacucgacacaua

SEQ ID NO: 1446876 - RNA, 19 nt, Homo sapiens
gaacgggauucuucacuga

SEQ ID NO: 1446877 - RNA, 19 nt, Homo sapiens
gcauuaauaucaaggcaaa

SEQ ID NO: 1446878 - RNA, 19 nt, Homo sapiens
gaacuguccugugagcuuu

SEQ ID NO: 1446879 - RNA, 19 nt, Homo sapiens
gcaaauggcauaccagaug

SEQ ID NO: 1446880 - RNA, 19 nt, Homo sapiens
ggaagcagauucuaagucu

SEQ ID NO: 1446881 - RNA, 19 nt, Homo sapiens
gcaggcguuugcauuaaua

SEQ ID NO: 1446882 - RNA, 19 nt, Homo sapiens
gaagcagggugaauaaagu

SEQ ID NO: 1446883 - RNA, 19 nt, Homo sapiens
uaucugaucuuccauuaga

SEQ ID NO: 1446884 - RNA, 19 nt, Homo sapiens
ccaaauaucugaucuucca

SEQ ID NO: 1446885 - RNA, 19 nt, Homo sapiens
gaaauagccaacuaguuaa

SEQ ID NO: 1446886 - RNA, 19 nt, Homo sapiens
ccacaaauacuucuacuug

SEQ ID NO: 1446887 - RNA, 19 nt, Homo sapiens
cagaauaggcugcauuuga

SEQ ID NO: 1446888 - RNA, 19 nt, Homo sapiens
gcuaugcuguauccuagua

SEQ ID NO: 1446889 - RNA, 19 nt, Homo sapiens
caagaguagugguguaaau

SEQ ID NO: 1446890 - RNA, 19 nt, Homo sapiens
ucaaagaguugugcaugaa

SEQ ID NO: 1446891 - RNA, 19 nt, Homo sapiens
gaaggaagcagauucuaag

SEQ ID NO: 1446892 - RNA, 19 nt, Homo sapiens
gaaagcccaaaguggauua

SEQ ID NO: 1446893 - RNA, 19 nt, Homo sapiens
gacaaguucuggaauaugg

SEQ ID NO: 1446894 - RNA, 19 nt, Homo sapiens
gggcaggcguuugcauuaa

SEQ ID NO: 1446895 - RNA, 19 nt, Homo sapiens
ucaacaacguggcggagua

SEQ ID NO: 1446896 - RNA, 19 nt, Homo sapiens
gaaaaggugagcagacuua

SEQ ID NO: 1446897 - RNA, 19 nt, Homo sapiens
gaaaccaaauaucugaucu

SEQ ID NO: 1446898 - RNA, 19 nt, Homo sapiens
gccagcauguguagaauau

SEQ ID NO: 1446899 - RNA, 19 nt, Homo sapiens
ugacaugauucucucuuga

SEQ ID NO: 1446900 - RNA, 19 nt, Homo sapiens
aaacaggggugguagauuu

SEQ ID NO: 1446901 - RNA, 19 nt, Homo sapiens
cacaaauacuucuacuuga

SEQ ID NO: 1446902 - RNA, 19 nt, Homo sapiens
gauaggcgguaugcucaaa

SEQ ID NO: 1446903 - RNA, 19 nt, Homo sapiens
acaugcaucugauuuggua

SEQ ID NO: 1446904 - RNA, 19 nt, Homo sapiens
gcucaaagcagccagcaau

SEQ ID NO: 1446905 - RNA, 19 nt, Homo sapiens
gugcaugaauugcugcuau

SEQ ID NO: 1446906 - RNA, 19 nt, Homo sapiens
ggacagacggcuccagugu

SEQ ID NO: 1446907 - RNA, 19 nt, Homo sapiens
gaagauuccacucugucua

SEQ ID NO: 1446908 - RNA, 19 nt, Homo sapiens
gaauauggcacuuacugau

SEQ ID NO: 1446909 - RNA, 19 nt, Homo sapiens
ggaauauggcacuuacuga

SEQ ID NO: 1446910 - RNA, 19 nt, Homo sapiens
gaauugcugcuaugcugua

SEQ ID NO: 1446911 - RNA, 19 nt, Homo sapiens
aaagaaguauugcaugucu

SEQ ID NO: 1446912 - RNA, 19 nt, Homo sapiens
uguacaggcuuccuuguug

SEQ ID NO: 1446913 - RNA, 19 nt, Homo sapiens
guagauuuauucccuugug

SEQ ID NO: 1446914 - RNA, 19 nt, Homo sapiens
ggaaagaaaagucucaaaa

SEQ ID NO: 1446915 - RNA, 19 nt, Homo sapiens
agugugaacuguccuguga

SEQ ID NO: 1446916 - RNA, 19 nt, Homo sapiens
caucugauuugguauugug

SEQ ID NO: 1446917 - RNA, 19 nt, Homo sapiens
gcuauuugaucggcugaaa

SEQ ID NO: 1446918 - RNA, 19 nt, Homo sapiens
ugagaagcagggugaauaa

SEQ ID NO: 1446919 - RNA, 19 nt, Homo sapiens
uacaguggguagugucuaa

SEQ ID NO: 1446920 - RNA, 19 nt, Homo sapiens
cagcauguguagaauaucu

SEQ ID NO: 1446921 - RNA, 19 nt, Homo sapiens
caggaccucuucagucuuc

SEQ ID NO: 1446922 - RNA, 19 nt, Homo sapiens
gauaugaguggaauuuaca

SEQ ID NO: 1446923 - RNA, 19 nt, Homo sapiens
gugcaugaacucgguaaua

SEQ ID NO: 1446924 - RNA, 19 nt, Homo sapiens
gaucuuccauuagacuuag

SEQ ID NO: 1446925 - RNA, 19 nt, Homo sapiens
gauacaugcaucugauuug

SEQ ID NO: 1446926 - RNA, 19 nt, Homo sapiens
cauaugaacgggauucuuc

SEQ ID NO: 1446927 - RNA, 19 nt, Homo sapiens
agaauaggcugcauuugac

SEQ ID NO: 1446928 - RNA, 19 nt, Homo sapiens
caccauagcacccacaaau

SEQ ID NO: 1446929 - RNA, 19 nt, Homo sapiens
caugauaugaguggaauuu

SEQ ID NO: 1446930 - RNA, 19 nt, Homo sapiens
auaaauaagccuucugaga

SEQ ID NO: 1446931 - RNA, 19 nt, Homo sapiens
agaaguauugcaugucuaa

SEQ ID NO: 1446932 - RNA, 19 nt, Homo sapiens
guucacauccgcacuuuca

SEQ ID NO: 1446933 - RNA, 19 nt, Homo sapiens
aagcgacacuuuacucaca

SEQ ID NO: 1446934 - RNA, 19 nt, Homo sapiens
gauucuaagucugcaguug

SEQ ID NO: 1446935 - RNA, 19 nt, Homo sapiens
gcauguguagaauaucuuu

SEQ ID NO: 1446936 - RNA, 19 nt, Homo sapiens
uacaggaccucuucagucu

SEQ ID NO: 1446937 - RNA, 19 nt, Homo sapiens
ucaaagcagccagcaauga

SEQ ID NO: 1446938 - RNA, 19 nt, Homo sapiens
ggcaggcguuugcauuaau

SEQ ID NO: 1446939 - RNA, 19 nt, Homo sapiens
ccagaggccagucccguaa

SEQ ID NO: 1446940 - RNA, 19 nt, Homo sapiens
auuccacucugucuagaua

SEQ ID NO: 1446941 - RNA, 19 nt, Homo sapiens
gagaagcagggugaauaaa

SEQ ID NO: 1446942 - RNA, 19 nt, Homo sapiens
ggacgagaccuaccgaaaa

SEQ ID NO: 1446943 - RNA, 19 nt, Homo sapiens
ugauaugaguggaauuuac

SEQ ID NO: 1446944 - RNA, 19 nt, Homo sapiens
gcguuugcauuaauaucaa

SEQ ID NO: 1446945 - RNA, 19 nt, Homo sapiens
gagggcaggcguuugcauu

SEQ ID NO: 1446946 - RNA, 19 nt, Homo sapiens
ccaagaaggaagcagauuc

SEQ ID NO: 1446947 - RNA, 19 nt, Homo sapiens
cagaugggacucuaagaug

SEQ ID NO: 1446948 - RNA, 19 nt, Homo sapiens
aaccaaauaucugaucuuc

SEQ ID NO: 1446949 - RNA, 19 nt, Homo sapiens
ggugaacuccaucgcugua

SEQ ID NO: 1446950 - RNA, 19 nt, Homo sapiens
caacaggaacaccauagca

SEQ ID NO: 1446951 - RNA, 19 nt, Homo sapiens
caaagcagccagcaaugag

SEQ ID NO: 1446952 - RNA, 19 nt, Homo sapiens
ccugaaaccaaauaucuga

SEQ ID NO: 1446953 - RNA, 19 nt, Homo sapiens
gcgaaugcccuugcacgaa

SEQ ID NO: 1446954 - RNA, 19 nt, Homo sapiens
ccauagcacccacaaauac

SEQ ID NO: 1446955 - RNA, 19 nt, Homo sapiens
augauucucucuugaugaa

SEQ ID NO: 1446956 - RNA, 19 nt, Homo sapiens
gaguagugguguaaauugc

SEQ ID NO: 1446957 - RNA, 19 nt, Homo sapiens
agaauguccugcugguuca

SEQ ID NO: 1446958 - RNA, 19 nt, Homo sapiens
guauucacucgacacauaa

SEQ ID NO: 1446959 - RNA, 19 nt, Homo sapiens
caaaguacaguggguagug

SEQ ID NO: 1446960 - RNA, 19 nt, Homo sapiens
ccagaugggacucuaagau

SEQ ID NO: 1446961 - RNA, 19 nt, Homo sapiens
gcaaugagugcucuguuuu

SEQ ID NO: 1446962 - RNA, 19 nt, Homo sapiens
auccacgucuuguaacuaa

SEQ ID NO: 1446963 - RNA, 19 nt, Homo sapiens
ucacucgacacauaaauca

SEQ ID NO: 1446964 - RNA, 19 nt, Homo sapiens
guugaagauuccacucugu

SEQ ID NO: 1446965 - RNA, 19 nt, Homo sapiens
uucgacaaguucuggaaua

SEQ ID NO: 1446966 - RNA, 19 nt, Homo sapiens
ucgacaaguucuggaauau

SEQ ID NO: 1446967 - RNA, 19 nt, Homo sapiens
cugagaagcagggugaaua

SEQ ID NO: 1446968 - RNA, 19 nt, Homo sapiens
acauaaauaagccuucuga

SEQ ID NO: 1446969 - RNA, 19 nt, Homo sapiens
uaagaaauagccaacuagu

SEQ ID NO: 1446970 - RNA, 19 nt, Homo sapiens
caaucacuagugcagaaua

SEQ ID NO: 1446971 - RNA, 19 nt, Homo sapiens
ggccagcauguguagaaua

SEQ ID NO: 1446972 - RNA, 19 nt, Homo sapiens
uucaaagaguugugcauga

SEQ ID NO: 1446973 - RNA, 19 nt, Homo sapiens
gacucucacuaggcuauuu

SEQ ID NO: 1446974 - RNA, 19 nt, Homo sapiens
ggaaauaacucugaaguaa

SEQ ID NO: 1446975 - RNA, 19 nt, Homo sapiens
gggauagacuccacaaaua

SEQ ID NO: 1446976 - RNA, 19 nt, Homo sapiens
gcaacaaauucuagucaua

SEQ ID NO: 1446977 - RNA, 19 nt, Homo sapiens
ggaaagaugugguagaaag

SEQ ID NO: 1446978 - RNA, 19 nt, Homo sapiens
caucauaucugaacuaagu

SEQ ID NO: 1446979 - RNA, 19 nt, Homo sapiens
ggaagaauaugaagaacug

SEQ ID NO: 1446980 - RNA, 19 nt, Homo sapiens
agacaaacaucauaucuga

SEQ ID NO: 1446981 - RNA, 19 nt, Homo sapiens
ggaugugauuuccauauuu

SEQ ID NO: 1446982 - RNA, 19 nt, Homo sapiens
ccgaugcccuuaccaguua

SEQ ID NO: 1446983 - RNA, 19 nt, Homo sapiens
ccagagaacuuuacugaag

SEQ ID NO: 1446984 - RNA, 19 nt, Homo sapiens
uaaacuagcugaccaguac

SEQ ID NO: 1446985 - RNA, 19 nt, Homo sapiens
aagagaaacugcaauagaa

SEQ ID NO: 1446986 - RNA, 19 nt, Homo sapiens
ggauagacuccacaaauaa

SEQ ID NO: 1446987 - RNA, 19 nt, Homo sapiens
aaacaacuguguaaucaga

SEQ ID NO: 1446988 - RNA, 19 nt, Homo sapiens
cagaaaugaugcagggaua

SEQ ID NO: 1446989 - RNA, 19 nt, Homo sapiens
uagcuugucucaugccaua

SEQ ID NO: 1446990 - RNA, 19 nt, Homo sapiens
agccaaaguugcuauguua

SEQ ID NO: 1446991 - RNA, 19 nt, Homo sapiens
gagaauuggugccagaugu

SEQ ID NO: 1446992 - RNA, 19 nt, Homo sapiens
gagcucaguuguuguggaa

SEQ ID NO: 1446993 - RNA, 19 nt, Homo sapiens
agcaagagcugaagaaguu

SEQ ID NO: 1446994 - RNA, 19 nt, Homo sapiens
gaugugauuuccauauuuc

SEQ ID NO: 1446995 - RNA, 19 nt, Homo sapiens
caaagaaugcaacaugaaa

SEQ ID NO: 1446996 - RNA, 19 nt, Homo sapiens
guauccagauuuccaauga

SEQ ID NO: 1446997 - RNA, 19 nt, Homo sapiens
guaugugcauuaaaucuug

SEQ ID NO: 1446998 - RNA, 19 nt, Homo sapiens
uauguuaucuggagcuuug

SEQ ID NO: 1446999 - RNA, 19 nt, Homo sapiens
gaagugggaagaauaugaa

SEQ ID NO: 1447000 - RNA, 19 nt, Homo sapiens
gaaaguaguaccucagcuu

SEQ ID NO: 1447001 - RNA, 19 nt, Homo sapiens
guggaaagaugugguagaa

SEQ ID NO: 1447002 - RNA, 19 nt, Homo sapiens
uaagagaaacugcaauaga

SEQ ID NO: 1447003 - RNA, 19 nt, Homo sapiens
gagaaaagaugaggugauu

SEQ ID NO: 1447004 - RNA, 19 nt, Homo sapiens
gaaagcaggaagaacuauu

SEQ ID NO: 1447005 - RNA, 19 nt, Homo sapiens
aagaugaggugauuucuag

SEQ ID NO: 1447006 - RNA, 19 nt, Homo sapiens
cagagaacuuuacugaaga

SEQ ID NO: 1447007 - RNA, 19 nt, Homo sapiens
ccagacaggauguuuauga

SEQ ID NO: 1447008 - RNA, 19 nt, Homo sapiens
aaacaugcagcacauuuaa

SEQ ID NO: 1447009 - RNA, 19 nt, Homo sapiens
gcuauagugacuccaaaua

SEQ ID NO: 1447010 - RNA, 19 nt, Homo sapiens
aaagcaggaagaacuauua

SEQ ID NO: 1447011 - RNA, 19 nt, Homo sapiens
ggguguaugugcauuaaau

SEQ ID NO: 1447012 - RNA, 19 nt, Homo sapiens
gaaguuuguauccagauuu

SEQ ID NO: 1447013 - RNA, 19 nt, Homo sapiens
gaaagaugugguagaaaga

SEQ ID NO: 1447014 - RNA, 19 nt, Homo sapiens
gaaguaagagaaacugcaa

SEQ ID NO: 1447015 - RNA, 19 nt, Homo sapiens
gaaauaacucugaaguaag

SEQ ID NO: 1447016 - RNA, 19 nt, Homo sapiens
gcaaaccauuccucaagca

SEQ ID NO: 1447017 - RNA, 19 nt, Homo sapiens
gaagaaagucuggaaaguc

SEQ ID NO: 1447018 - RNA, 19 nt, Homo sapiens
ucaaggaaauaacucugaa

SEQ ID NO: 1447019 - RNA, 19 nt, Homo sapiens
ucacagucaucucauccua

SEQ ID NO: 1447020 - RNA, 19 nt, Homo sapiens
caacagaaagcaggaagaa

SEQ ID NO: 1447021 - RNA, 19 nt, Homo sapiens
caaaguugcuauguuaucu

SEQ ID NO: 1447022 - RNA, 19 nt, Homo sapiens
cagacaggauguuuaugaa

SEQ ID NO: 1447023 - RNA, 19 nt, Homo sapiens
gagccagacaggauguuua

SEQ ID NO: 1447024 - RNA, 19 nt, Homo sapiens
gaacugcuucauuaugcua

SEQ ID NO: 1447025 - RNA, 19 nt, Homo sapiens
ugagucaucaccaguguua

SEQ ID NO: 1447026 - RNA, 19 nt, Homo sapiens
ggugccagaugucagaauu

SEQ ID NO: 1447027 - RNA, 19 nt, Homo sapiens
cacaaguguucauuccaua

SEQ ID NO: 1447028 - RNA, 19 nt, Homo sapiens
gaaaugaugcagggauaga

SEQ ID NO: 1447029 - RNA, 19 nt, Homo sapiens
gaccaguacuaccagagaa

SEQ ID NO: 1447030 - RNA, 19 nt, Homo sapiens
gaaauacuugugagcgauu

SEQ ID NO: 1447031 - RNA, 19 nt, Homo sapiens
uaccucagcuuccagauca

SEQ ID NO: 1447032 - RNA, 19 nt, Homo sapiens
cccaugagcucaguuguug

SEQ ID NO: 1447033 - RNA, 19 nt, Homo sapiens
agaauuagcagcaguuuag

SEQ ID NO: 1447034 - RNA, 19 nt, Homo sapiens
gauagacuccacaaauaau

SEQ ID NO: 1447035 - RNA, 19 nt, Homo sapiens
ugaagaaagucuggaaagu

SEQ ID NO: 1447036 - RNA, 19 nt, Homo sapiens
gaaaagauagaguugauga

SEQ ID NO: 1447037 - RNA, 19 nt, Homo sapiens
gaggugauuucuagcuugu

SEQ ID NO: 1447038 - RNA, 19 nt, Homo sapiens
uacagaugcccaugaaaua

SEQ ID NO: 1447039 - RNA, 19 nt, Homo sapiens
caaauucuagucauacaga

SEQ ID NO: 1447040 - RNA, 19 nt, Homo sapiens
ucacaaguguucauuccau

SEQ ID NO: 1447041 - RNA, 19 nt, Homo sapiens
gcaguggaaagauguggua

SEQ ID NO: 1447042 - RNA, 19 nt, Homo sapiens
aagaaagucuggaaagucu

SEQ ID NO: 1447043 - RNA, 19 nt, Homo sapiens
guacuaccagagaacuuua

SEQ ID NO: 1447044 - RNA, 19 nt, Homo sapiens
gcgaaucggccaugucaga

SEQ ID NO: 1447045 - RNA, 19 nt, Homo sapiens
gaaaaugugcuugaucuuu

SEQ ID NO: 1447046 - RNA, 19 nt, Homo sapiens
ggaaccagaucagcucaca

SEQ ID NO: 1447047 - RNA, 19 nt, Homo sapiens
caaaagcaguggaaagaug

SEQ ID NO: 1447048 - RNA, 19 nt, Homo sapiens
agaaauguaugugccaaga

SEQ ID NO: 1447049 - RNA, 19 nt, Homo sapiens
cuuugaagauuccaugaaa

SEQ ID NO: 1447050 - RNA, 19 nt, Homo sapiens
caaugauuaugaagccaaa

SEQ ID NO: 1447051 - RNA, 19 nt, Homo sapiens
aagauagaguugaugagaa

SEQ ID NO: 1447052 - RNA, 19 nt, Homo sapiens
gaauggaaaugagaaaaga

SEQ ID NO: 1447053 - RNA, 19 nt, Homo sapiens
caaguguucauuccauaaa

SEQ ID NO: 1447054 - RNA, 19 nt, Homo sapiens
uugaagccaugacuauauu

SEQ ID NO: 1447055 - RNA, 19 nt, Homo sapiens
gagcugaagaaguuuguau

SEQ ID NO: 1447056 - RNA, 19 nt, Homo sapiens
uaccagagaacuuuacuga

SEQ ID NO: 1447057 - RNA, 19 nt, Homo sapiens
aaaugaagugggaagaaua

SEQ ID NO: 1447058 - RNA, 19 nt, Homo sapiens
guaaacuagcugaccagua

SEQ ID NO: 1447059 - RNA, 19 nt, Homo sapiens
ucaagcaacugcagcaaaa

SEQ ID NO: 1447060 - RNA, 19 nt, Homo sapiens
gcaggaagaacuauuacag

SEQ ID NO: 1447061 - RNA, 19 nt, Homo sapiens
cagaaagcaggaagaacua

SEQ ID NO: 1447062 - RNA, 19 nt, Homo sapiens
ugaagugggaagaauauga

SEQ ID NO: 1447063 - RNA, 19 nt, Homo sapiens
ucaaagaaugcaacaugaa

SEQ ID NO: 1447064 - RNA, 19 nt, Homo sapiens
agagaacuuuacugaagaa

SEQ ID NO: 1447065 - RNA, 19 nt, Homo sapiens
aguaagagaaacugcaaua

SEQ ID NO: 1447066 - RNA, 19 nt, Homo sapiens
ggaccuggacauugacaga

SEQ ID NO: 1447067 - RNA, 19 nt, Homo sapiens
aaauguaugugccaagagu

SEQ ID NO: 1447068 - RNA, 19 nt, Homo sapiens
aaagauagaguugaugaga

SEQ ID NO: 1447069 - RNA, 19 nt, Homo sapiens
uguguaaucagaucaauga

SEQ ID NO: 1447070 - RNA, 19 nt, Homo sapiens
caacaaauucuagucauac

SEQ ID NO: 1447071 - RNA, 19 nt, Homo sapiens
gugggaagaauaugaagaa

SEQ ID NO: 1447072 - RNA, 19 nt, Homo sapiens
caucagaagaaauguaugu

SEQ ID NO: 1447073 - RNA, 19 nt, Homo sapiens
gaagccaugacuauauuuc

SEQ ID NO: 1447074 - RNA, 19 nt, Homo sapiens
caacuucuauggugauuua

SEQ ID NO: 1447075 - RNA, 19 nt, Homo sapiens
gaagauaaguggcgaguug

SEQ ID NO: 1447076 - RNA, 19 nt, Homo sapiens
caaauaaacugcccacuau

SEQ ID NO: 1447077 - RNA, 19 nt, Homo sapiens
gaagagaauugcuguguga

SEQ ID NO: 1447078 - RNA, 19 nt, Homo sapiens
guaaauagcuaucuaagag

SEQ ID NO: 1447079 - RNA, 19 nt, Homo sapiens
gcacaaaggauucuauauu

SEQ ID NO: 1447080 - RNA, 19 nt, Homo sapiens
ggucagcuuuggaauauaa

SEQ ID NO: 1447081 - RNA, 19 nt, Homo sapiens
gcaaauaaacugcccacua

SEQ ID NO: 1447082 - RNA, 19 nt, Homo sapiens
gaacaaauacagucuuaga

SEQ ID NO: 1447083 - RNA, 19 nt, Homo sapiens
gacaagauaguacacauua

SEQ ID NO: 1447084 - RNA, 19 nt, Homo sapiens
cgaaagauguaacuguuug

SEQ ID NO: 1447085 - RNA, 19 nt, Homo sapiens
uaucuaggauggugaaauu

SEQ ID NO: 1447086 - RNA, 19 nt, Homo sapiens
cacaaaggauucuauauuc

SEQ ID NO: 1447087 - RNA, 19 nt, Homo sapiens
gcacacaucucgaaaucca

SEQ ID NO: 1447088 - RNA, 19 nt, Homo sapiens
ggugaauuaucucauagua

SEQ ID NO: 1447089 - RNA, 19 nt, Homo sapiens
uaaagugagcccugaaaua

SEQ ID NO: 1447090 - RNA, 19 nt, Homo sapiens
ggaaauugguaaauguuag

SEQ ID NO: 1447091 - RNA, 19 nt, Homo sapiens
cauggugaauuaucucaua

SEQ ID NO: 1447092 - RNA, 19 nt, Homo sapiens
ggagaacuuugaagagaau

SEQ ID NO: 1447093 - RNA, 19 nt, Homo sapiens
caggauauauucagacaga

SEQ ID NO: 1447094 - RNA, 19 nt, Homo sapiens
guaucuagauugaucaaga

SEQ ID NO: 1447095 - RNA, 19 nt, Homo sapiens
ucagaaagguacauagugu

SEQ ID NO: 1447096 - RNA, 19 nt, Homo sapiens
ccaucuaguuuacuucuaa

SEQ ID NO: 1447097 - RNA, 19 nt, Homo sapiens
ugucugauguugcuucuuu

SEQ ID NO: 1447098 - RNA, 19 nt, Homo sapiens
cauaguaucuagauugauc

SEQ ID NO: 1447099 - RNA, 19 nt, Homo sapiens
agacuuaucuugagacucu

SEQ ID NO: 1447100 - RNA, 19 nt, Homo sapiens
guacauaguguuucaagug

SEQ ID NO: 1447101 - RNA, 19 nt, Homo sapiens
caaaguguugggauuauaa

SEQ ID NO: 1447102 - RNA, 19 nt, Homo sapiens
ccaagagaauuuguugauu

SEQ ID NO: 1447103 - RNA, 19 nt, Homo sapiens
cuacaaagcccaagguguu

SEQ ID NO: 1447104 - RNA, 19 nt, Homo sapiens
uaacuugaguaagggauuu

SEQ ID NO: 1447105 - RNA, 19 nt, Homo sapiens
gaaaagagaccagaauuug

SEQ ID NO: 1447106 - RNA, 19 nt, Homo sapiens
gcccugaaauacaugcuaa

SEQ ID NO: 1447107 - RNA, 19 nt, Homo sapiens
gcuauuauuuccugaacug

SEQ ID NO: 1447108 - RNA, 19 nt, Homo sapiens
cuaguacaauguuugguuu

SEQ ID NO: 1447109 - RNA, 19 nt, Homo sapiens
aaagagagaaguaauggaa

SEQ ID NO: 1447110 - RNA, 19 nt, Homo sapiens
ucaagugcaugguaguuug

SEQ ID NO: 1447111 - RNA, 19 nt, Homo sapiens
aaagagaccagaauuuguu

SEQ ID NO: 1447112 - RNA, 19 nt, Homo sapiens
gcuuuuaucuuguggaaua

SEQ ID NO: 1447113 - RNA, 19 nt, Homo sapiens
ugaacuggaugucccuaaa

SEQ ID NO: 1447114 - RNA, 19 nt, Homo sapiens
cauggaaauugguaaaugu

SEQ ID NO: 1447115 - RNA, 19 nt, Homo sapiens
gcaucagucuguaacuaga

SEQ ID NO: 1447116 - RNA, 19 nt, Homo sapiens
cacuaugcauggcuaauuu

SEQ ID NO: 1447117 - RNA, 19 nt, Homo sapiens
gaaggccugucugauguug

SEQ ID NO: 1447118 - RNA, 19 nt, Homo sapiens
gagaaaacccucagaagaa

SEQ ID NO: 1447119 - RNA, 19 nt, Homo sapiens
aaagguacauaguguuuca

SEQ ID NO: 1447120 - RNA, 19 nt, Homo sapiens
guuaauauggguaaaguga

SEQ ID NO: 1447121 - RNA, 19 nt, Homo sapiens
ggagggcagugguaugauc

SEQ ID NO: 1447122 - RNA, 19 nt, Homo sapiens
gaauauaauuuccccaaga

SEQ ID NO: 1447123 - RNA, 19 nt, Homo sapiens
gaugacuucuuuggauauu

SEQ ID NO: 1447124 - RNA, 19 nt, Homo sapiens
gcacuuuaaccaacuucua

SEQ ID NO: 1447125 - RNA, 19 nt, Homo sapiens
gacaggauauauucagaca

SEQ ID NO: 1447126 - RNA, 19 nt, Homo sapiens
uuacccaagugccuagaua

SEQ ID NO: 1447127 - RNA, 19 nt, Homo sapiens
uuaauuaccaggauccuuu

SEQ ID NO: 1447128 - RNA, 19 nt, Homo sapiens
gagagggcauuuucacuuu

SEQ ID NO: 1447129 - RNA, 19 nt, Homo sapiens
cccaagguguuauagauga

SEQ ID NO: 1447130 - RNA, 19 nt, Homo sapiens
ccaaaggugccuaacuuga

SEQ ID NO: 1447131 - RNA, 19 nt, Homo sapiens
gcaagcacuuuaaccaacu

SEQ ID NO: 1447132 - RNA, 19 nt, Homo sapiens
guucugcaauagugaaaga

SEQ ID NO: 1447133 - RNA, 19 nt, Homo sapiens
gaaggaaugcacaaaggau

SEQ ID NO: 1447134 - RNA, 19 nt, Homo sapiens
gguaaagagagaaguaaug

SEQ ID NO: 1447135 - RNA, 19 nt, Homo sapiens
cugaauagcugggaauaca

SEQ ID NO: 1447136 - RNA, 19 nt, Homo sapiens
cagaauuuguucgaggaua

SEQ ID NO: 1447137 - RNA, 19 nt, Homo sapiens
caaagcccaagguguuaua

SEQ ID NO: 1447138 - RNA, 19 nt, Homo sapiens
cagaaggaaugcacaaagg

SEQ ID NO: 1447139 - RNA, 19 nt, Homo sapiens
agaaagguacauaguguuu

SEQ ID NO: 1447140 - RNA, 19 nt, Homo sapiens
uggaaggccugucugaugu

SEQ ID NO: 1447141 - RNA, 19 nt, Homo sapiens
gaauuuguucgaggauaua

SEQ ID NO: 1447142 - RNA, 19 nt, Homo sapiens
ugggacagcuugaugacuu

SEQ ID NO: 1447143 - RNA, 19 nt, Homo sapiens
ggagaaaacccucagaaga

SEQ ID NO: 1447144 - RNA, 19 nt, Homo sapiens
aacgaaagauguaacuguu

SEQ ID NO: 1447145 - RNA, 19 nt, Homo sapiens
gugccuaacuugaguaagg

SEQ ID NO: 1447146 - RNA, 19 nt, Homo sapiens
gugggugccuuaagugaga

SEQ ID NO: 1447147 - RNA, 19 nt, Homo sapiens
gugccuagauaucauuuua

SEQ ID NO: 1447148 - RNA, 19 nt, Homo sapiens
aagcaucagucuguaacua

SEQ ID NO: 1447149 - RNA, 19 nt, Homo sapiens
agaauuuguucgaggauau

SEQ ID NO: 1447150 - RNA, 19 nt, Homo sapiens
ucauggaaauugguaaaug

SEQ ID NO: 1447151 - RNA, 19 nt, Homo sapiens
guaguuuaguuucaguuuc

SEQ ID NO: 1447152 - RNA, 19 nt, Homo sapiens
gaaauacaugcuaaacaag

SEQ ID NO: 1447153 - RNA, 19 nt, Homo sapiens
ccaagugccuagauaucau

SEQ ID NO: 1447154 - RNA, 19 nt, Homo sapiens
guggcgaguugcuaagaaa

SEQ ID NO: 1447155 - RNA, 19 nt, Homo sapiens
ccaguaccauagcauugaa

SEQ ID NO: 1447156 - RNA, 19 nt, Homo sapiens
uugaugacuucuuuggaua

SEQ ID NO: 1447157 - RNA, 19 nt, Homo sapiens
acagcuugaugacuucuuu

SEQ ID NO: 1447158 - RNA, 19 nt, Homo sapiens
gguaaagugagcccugaaa

SEQ ID NO: 1447159 - RNA, 19 nt, Homo sapiens
caccuuagccucccaaagu

SEQ ID NO: 1447160 - RNA, 19 nt, Homo sapiens
guucacuaguacaauguuu

SEQ ID NO: 1447161 - RNA, 19 nt, Homo sapiens
guugauuucuccuauacug

SEQ ID NO: 1447162 - RNA, 19 nt, Homo sapiens
uuccaaaggugccuaacuu

SEQ ID NO: 1447163 - RNA, 19 nt, Homo sapiens
guaaagagagaaguaaugg

SEQ ID NO: 1447164 - RNA, 19 nt, Homo sapiens
aaaacacucucauccagua

SEQ ID NO: 1447165 - RNA, 19 nt, Homo sapiens
aaagugagcccugaaauac

SEQ ID NO: 1447166 - RNA, 19 nt, Homo sapiens
aaugggaacuugaggcaau

SEQ ID NO: 1447167 - RNA, 19 nt, Homo sapiens
ccauagcauugaagaagau

SEQ ID NO: 1447168 - RNA, 19 nt, Homo sapiens
uggagaacuuugaagagaa

SEQ ID NO: 1447169 - RNA, 19 nt, Homo sapiens
aaacgaaagauguaacugu

SEQ ID NO: 1447170 - RNA, 19 nt, Homo sapiens
gaagucucauauucuacug

SEQ ID NO: 1447171 - RNA, 19 nt, Homo sapiens
cuacagaucaacucucuca

SEQ ID NO: 1447172 - RNA, 19 nt, Homo sapiens
cuggagaacuuugaagaga

SEQ ID NO: 1447173 - RNA, 19 nt, Homo sapiens
gaugaccuugucuauagua

SEQ ID NO: 1447174 - RNA, 19 nt, Homo sapiens
gcacauauauucagaagaa

SEQ ID NO: 1447175 - RNA, 19 nt, Homo sapiens
ggacugacauuucuccaua

SEQ ID NO: 1447176 - RNA, 19 nt, Homo sapiens
gaagaaagaugacauaacu

SEQ ID NO: 1447177 - RNA, 19 nt, Homo sapiens
gaaagugacugggauggua

SEQ ID NO: 1447178 - RNA, 19 nt, Homo sapiens
gaagaaggacugguaaaua

SEQ ID NO: 1447179 - RNA, 19 nt, Homo sapiens
gcagaggacuguuccacua

SEQ ID NO: 1447180 - RNA, 19 nt, Homo sapiens
ugacaaugcucuuaggaua

SEQ ID NO: 1447181 - RNA, 19 nt, Homo sapiens
aagaaggacugguaaauaa

SEQ ID NO: 1447182 - RNA, 19 nt, Homo sapiens
guaaaggacuucagaauac

SEQ ID NO: 1447183 - RNA, 19 nt, Homo sapiens
gauggucguugguuaauaa

SEQ ID NO: 1447184 - RNA, 19 nt, Homo sapiens
gcgauggauugcucuauua

SEQ ID NO: 1447185 - RNA, 19 nt, Homo sapiens
gaaggacugguaaauaaua

SEQ ID NO: 1447186 - RNA, 19 nt, Homo sapiens
caaaagagcuggagaacaa

SEQ ID NO: 1447187 - RNA, 19 nt, Homo sapiens
gaagaaaacuggacccauu

SEQ ID NO: 1447188 - RNA, 19 nt, Homo sapiens
gauauaacuucuuguggaa

SEQ ID NO: 1447189 - RNA, 19 nt, Homo sapiens
gaaagaaucaggcccauca

SEQ ID NO: 1447190 - RNA, 19 nt, Homo sapiens
ggacucggcuccucucaau

SEQ ID NO: 1447191 - RNA, 19 nt, Homo sapiens
uuaaaccaguugacaguua

SEQ ID NO: 1447192 - RNA, 19 nt, Homo sapiens
ggaugaugcuggacagaaa

SEQ ID NO: 1447193 - RNA, 19 nt, Homo sapiens
caaaagaguugaagaaaga

SEQ ID NO: 1447194 - RNA, 19 nt, Homo sapiens
ggucauagugcuccucuua

SEQ ID NO: 1447195 - RNA, 19 nt, Homo sapiens
ugacugggaugguaucauu

SEQ ID NO: 1447196 - RNA, 19 nt, Homo sapiens
gagcuugggacauggauua

SEQ ID NO: 1447197 - RNA, 19 nt, Homo sapiens
gcaagaguuuccacaccua

SEQ ID NO: 1447198 - RNA, 19 nt, Homo sapiens
caggauaucugcuguaugg

SEQ ID NO: 1447199 - RNA, 19 nt, Homo sapiens
gggagaacuuuauguguug

SEQ ID NO: 1447200 - RNA, 19 nt, Homo sapiens
caaucacucuucaaucaaa

SEQ ID NO: 1447201 - RNA, 19 nt, Homo sapiens
ggaauuaucagaaaucuac

SEQ ID NO: 1447202 - RNA, 19 nt, Homo sapiens
gaagaauaccugcaguuga

SEQ ID NO: 1447203 - RNA, 19 nt, Homo sapiens
guagaaguaucagaagaaa

SEQ ID NO: 1447204 - RNA, 19 nt, Homo sapiens
ggacaccaaggccaaauaa

SEQ ID NO: 1447205 - RNA, 19 nt, Homo sapiens
caucaggaauugaaacaga

SEQ ID NO: 1447206 - RNA, 19 nt, Homo sapiens
gaauuuaucuaugguccaa

SEQ ID NO: 1447207 - RNA, 19 nt, Homo sapiens
agaggaagcucgugaaagu

SEQ ID NO: 1447208 - RNA, 19 nt, Homo sapiens
gguccaauauuucccugua

SEQ ID NO: 1447209 - RNA, 19 nt, Homo sapiens
cuaggaagauugucagaga

SEQ ID NO: 1447210 - RNA, 19 nt, Homo sapiens
aauaagagcuugggacaug

SEQ ID NO: 1447211 - RNA, 19 nt, Homo sapiens
cguaaaggacuucagaaua

SEQ ID NO: 1447212 - RNA, 19 nt, Homo sapiens
gcaguugacuuuugauaaa

SEQ ID NO: 1447213 - RNA, 19 nt, Homo sapiens
gauaguacauaccuuuaag

SEQ ID NO: 1447214 - RNA, 19 nt, Homo sapiens
cagauuaugucccuucaau

SEQ ID NO: 1447215 - RNA, 19 nt, Homo sapiens
cauagaaacuaggaagauu

SEQ ID NO: 1447216 - RNA, 19 nt, Homo sapiens
gcucacaagggaucuguua

SEQ ID NO: 1447217 - RNA, 19 nt, Homo sapiens
cagaauaccaugucaguga

SEQ ID NO: 1447218 - RNA, 19 nt, Homo sapiens
cuugggacauggauuaaua

SEQ ID NO: 1447219 - RNA, 19 nt, Homo sapiens
gagauaguacauaccuuua

SEQ ID NO: 1447220 - RNA, 19 nt, Homo sapiens
ggaccaccuuggaauuuau

SEQ ID NO: 1447221 - RNA, 19 nt, Homo sapiens
gaagauugucagagaguuu

SEQ ID NO: 1447222 - RNA, 19 nt, Homo sapiens
caacagcaguggauauaac

SEQ ID NO: 1447223 - RNA, 19 nt, Homo sapiens
aggcauaccuugcauuguu

SEQ ID NO: 1447224 - RNA, 19 nt, Homo sapiens
gcaacgugcuggagaccuu

SEQ ID NO: 1447225 - RNA, 19 nt, Homo sapiens
aaaggaaccacccaaagua

SEQ ID NO: 1447226 - RNA, 19 nt, Homo sapiens
uacaauaggcgcuuacuuu

SEQ ID NO: 1447227 - RNA, 19 nt, Homo sapiens
acugauggcauucuuauua

SEQ ID NO: 1447228 - RNA, 19 nt, Homo sapiens
aacccaagauguagaagua

SEQ ID NO: 1447229 - RNA, 19 nt, Homo sapiens
gaaacuaggaagauuguca

SEQ ID NO: 1447230 - RNA, 19 nt, Homo sapiens
gugcuccucuuaccaauau

SEQ ID NO: 1447231 - RNA, 19 nt, Homo sapiens
gaacaaugcuaggcaacgu

SEQ ID NO: 1447232 - RNA, 19 nt, Homo sapiens
uaucauugcuugccaucaa

SEQ ID NO: 1447233 - RNA, 19 nt, Homo sapiens
caaggaagccugcaguugu

SEQ ID NO: 1447234 - RNA, 19 nt, Homo sapiens
gauuagucuuugcugcuua

SEQ ID NO: 1447235 - RNA, 19 nt, Homo sapiens
ggucguugguuaauaagug

SEQ ID NO: 1447236 - RNA, 19 nt, Homo sapiens
gaugacuucuccauuagug

SEQ ID NO: 1447237 - RNA, 19 nt, Homo sapiens
uaccuugcauuguuucuaa

SEQ ID NO: 1447238 - RNA, 19 nt, Homo sapiens
caaaggaaccacccaaagu

SEQ ID NO: 1447239 - RNA, 19 nt, Homo sapiens
agaaccaagugaugaauug

SEQ ID NO: 1447240 - RNA, 19 nt, Homo sapiens
gauuaugucccuucaauag

SEQ ID NO: 1447241 - RNA, 19 nt, Homo sapiens
gugaaggauuacucaaauu

SEQ ID NO: 1447242 - RNA, 19 nt, Homo sapiens
caggaacuguagauguaua

SEQ ID NO: 1447243 - RNA, 19 nt, Homo sapiens
ggaagcccauguggccaua

SEQ ID NO: 1447244 - RNA, 19 nt, Homo sapiens
ugcaaucacucuucaauca

SEQ ID NO: 1447245 - RNA, 19 nt, Homo sapiens
uggaaacuuugcuguaauu

SEQ ID NO: 1447246 - RNA, 19 nt, Homo sapiens
gguaagcuaucuugcucaa

SEQ ID NO: 1447247 - RNA, 19 nt, Homo sapiens
ggacagcagauucuaagug

SEQ ID NO: 1447248 - RNA, 19 nt, Homo sapiens
gauggcagauuagucuuug

SEQ ID NO: 1447249 - RNA, 19 nt, Homo sapiens
ggcagcugauggcagauua

SEQ ID NO: 1447250 - RNA, 19 nt, Homo sapiens
ggcauaccuugcauuguuu

SEQ ID NO: 1447251 - RNA, 19 nt, Homo sapiens
gaaucaggcccaucaggaa

SEQ ID NO: 1447252 - RNA, 19 nt, Homo sapiens
ccagcagucuaaaguggua

SEQ ID NO: 1447253 - RNA, 19 nt, Homo sapiens
gagacuuucuggcaacuuc

SEQ ID NO: 1447254 - RNA, 19 nt, Homo sapiens
cucaaauucuggaacuuua

SEQ ID NO: 1447255 - RNA, 19 nt, Homo sapiens
uguggaaacuuugcuguaa

SEQ ID NO: 1447256 - RNA, 19 nt, Homo sapiens
caaguuaucauucacaaca

SEQ ID NO: 1447257 - RNA, 19 nt, Homo sapiens
gauauuugaugguccuaca

SEQ ID NO: 1447258 - RNA, 19 nt, Homo sapiens
ggacccauuacuucaauuu

SEQ ID NO: 1447259 - RNA, 19 nt, Homo sapiens
ugacacugcucucaaccuu

SEQ ID NO: 1447260 - RNA, 19 nt, Homo sapiens
cagauaugcugcaccugaa

SEQ ID NO: 1447261 - RNA, 19 nt, Homo sapiens
gaagaaacaguagaaccaa

SEQ ID NO: 1447262 - RNA, 19 nt, Homo sapiens
ggaagauugucagagaguu

SEQ ID NO: 1447263 - RNA, 19 nt, Homo sapiens
gcaaggaucaagcucacaa

SEQ ID NO: 1447264 - RNA, 19 nt, Homo sapiens
gcagaggaagcucgugaaa

SEQ ID NO: 1447265 - RNA, 19 nt, Homo sapiens
agauggaacucuucaguca

SEQ ID NO: 1447266 - RNA, 19 nt, Homo sapiens
ggacagaaagcgugauuuu

SEQ ID NO: 1447267 - RNA, 19 nt, Homo sapiens
ggagggagaacuuuaugug

SEQ ID NO: 1447268 - RNA, 19 nt, Homo sapiens
uuaaugaaguuucgucaag

SEQ ID NO: 1447269 - RNA, 19 nt, Homo sapiens
gagcaauuggugacucuuu

SEQ ID NO: 1447270 - RNA, 19 nt, Homo sapiens
accaagugaugaauugaua

SEQ ID NO: 1447271 - RNA, 19 nt, Homo sapiens
caaauaucauguugcuaca

SEQ ID NO: 1447272 - RNA, 19 nt, Homo sapiens
agggagaacuuuauguguu

SEQ ID NO: 1447273 - RNA, 19 nt, Homo sapiens
acaaugcucuuaggauaug

SEQ ID NO: 1447274 - RNA, 19 nt, Homo sapiens
gaguauagaucaugugaaa

SEQ ID NO: 1447275 - RNA, 19 nt, Homo sapiens
gcagagaaagcuuacauua

SEQ ID NO: 1447276 - RNA, 19 nt, Homo sapiens
gagcagaaaucucaggaaa

SEQ ID NO: 1447277 - RNA, 19 nt, Homo sapiens
agagaaagcuuacauuaga

SEQ ID NO: 1447278 - RNA, 19 nt, Homo sapiens
aaagagagaugcagcaaau

SEQ ID NO: 1447279 - RNA, 19 nt, Homo sapiens
gcagaaaucucaggaaacu

SEQ ID NO: 1447280 - RNA, 19 nt, Homo sapiens
gggagggacuggauuaugu

SEQ ID NO: 1447281 - RNA, 19 nt, Homo sapiens
uagcagauauugccaacuu

SEQ ID NO: 1447282 - RNA, 19 nt, Homo sapiens
caaaugcagagaaagcuua

SEQ ID NO: 1447283 - RNA, 19 nt, Homo sapiens
guauagaucaugugaaaug

SEQ ID NO: 1447284 - RNA, 19 nt, Homo sapiens
gcagauauugccaacuuaa

SEQ ID NO: 1447285 - RNA, 19 nt, Homo sapiens
uggaggagguguucauuga

SEQ ID NO: 1447286 - RNA, 19 nt, Homo sapiens
ggaacuauucuauggauau

SEQ ID NO: 1447287 - RNA, 19 nt, Homo sapiens
ucaggaaacuacacuaaag

SEQ ID NO: 1447288 - RNA, 19 nt, Homo sapiens
ugacuucaguggagcagaa

SEQ ID NO: 1447289 - RNA, 19 nt, Homo sapiens
gcagcaaauuguuggacuu

SEQ ID NO: 1447290 - RNA, 19 nt, Homo sapiens
gagggaacauggacuuugg

SEQ ID NO: 1447291 - RNA, 19 nt, Homo sapiens
gaacauuagaguauagauc

SEQ ID NO: 1447292 - RNA, 19 nt, Homo sapiens
gcaaauuguuggacuucuc

SEQ ID NO: 1447293 - RNA, 19 nt, Homo sapiens
gaaauguacugugggaacu

SEQ ID NO: 1447294 - RNA, 19 nt, Homo sapiens
gauauugccaacuuaauca

SEQ ID NO: 1447295 - RNA, 19 nt, Homo sapiens
gggaacuauucuauggaua

SEQ ID NO: 1447296 - RNA, 19 nt, Homo sapiens
ggacuuuggaggacagaaa

SEQ ID NO: 1447297 - RNA, 19 nt, Homo sapiens
gagaaagcuuacauuagag

SEQ ID NO: 1447298 - RNA, 19 nt, Homo sapiens
uuacaaagacaaagagaga

SEQ ID NO: 1447299 - RNA, 19 nt, Homo sapiens
guuaacagauugcaaaaug

SEQ ID NO: 1447300 - RNA, 19 nt, Homo sapiens
ggauauaugguaaaguugu

SEQ ID NO: 1447301 - RNA, 19 nt, Homo sapiens
cuugagaaauaacugcuuu

SEQ ID NO: 1447302 - RNA, 19 nt, Homo sapiens
gagaugcagcaaauuguug

SEQ ID NO: 1447303 - RNA, 19 nt, Homo sapiens
acuagaaucugaauaugca

SEQ ID NO: 1447304 - RNA, 19 nt, Homo sapiens
gagagaugcagcaaauugu

SEQ ID NO: 1447305 - RNA, 19 nt, Homo sapiens
agagagaugcagcaaauug

SEQ ID NO: 1447306 - RNA, 19 nt, Homo sapiens
caaagagagaugcagcaaa

SEQ ID NO: 1447307 - RNA, 19 nt, Homo sapiens
ccucaagggcaaacucuuu

SEQ ID NO: 1447308 - RNA, 19 nt, Homo sapiens
cagagaaagcuuacauuag

SEQ ID NO: 1447309 - RNA, 19 nt, Homo sapiens
cuacuagaaucugaauaug

SEQ ID NO: 1447310 - RNA, 19 nt, Homo sapiens
acaguuaacagauugcaaa

SEQ ID NO: 1447311 - RNA, 19 nt, Homo sapiens
gaccagauuucucaaaccu

SEQ ID NO: 1447312 - RNA, 19 nt, Homo sapiens
aagaccaaaugcagagaaa

SEQ ID NO: 1447313 - RNA, 19 nt, Homo sapiens
cacuaaagguggaccagau

SEQ ID NO: 1447314 - RNA, 19 nt, Homo sapiens
gaugagggaacauggacuu

SEQ ID NO: 1447315 - RNA, 19 nt, Homo sapiens
ugugggaacuauucuaugg

SEQ ID NO: 1447316 - RNA, 19 nt, Homo sapiens
gccuacaguuaacagauug

SEQ ID NO: 1447317 - RNA, 19 nt, Homo sapiens
ugccuacaguuaacagauu

SEQ ID NO: 1447318 - RNA, 19 nt, Homo sapiens
gcggaugccuacaguuaac

SEQ ID NO: 1447319 - RNA, 19 nt, Homo sapiens
cuaaagguggaccagauuu

SEQ ID NO: 1447320 - RNA, 19 nt, Homo sapiens
gccgggagggacuggauua

SEQ ID NO: 1447321 - RNA, 19 nt, Homo sapiens
ucucaggaaacuacacuaa

SEQ ID NO: 1447322 - RNA, 19 nt, Homo sapiens
agaaaucucaggaaacuac

SEQ ID NO: 1447323 - RNA, 19 nt, Homo sapiens
caagaccaaaugcagagaa

SEQ ID NO: 1447324 - RNA, 19 nt, Homo sapiens
uagaguauagaucauguga

SEQ ID NO: 1447325 - RNA, 19 nt, Homo sapiens
augcggaugccuacaguua

SEQ ID NO: 1447326 - RNA, 19 nt, Homo sapiens
caguggagcagaaaucuca

SEQ ID NO: 1447327 - RNA, 19 nt, Homo sapiens
acaaagacaaagagagaug

SEQ ID NO: 1447328 - RNA, 19 nt, Homo sapiens
uuguuggacuucucuacua

SEQ ID NO: 1447329 - RNA, 19 nt, Homo sapiens
uaaagguggaccagauuuc

SEQ ID NO: 1447330 - RNA, 19 nt, Homo sapiens
aagcuuacauuagagagau

SEQ ID NO: 1447331 - RNA, 19 nt, Homo sapiens
ugggaacuauucuauggau

SEQ ID NO: 1447332 - RNA, 19 nt, Homo sapiens
uugccaacuuaaucagaua

SEQ ID NO: 1447333 - RNA, 19 nt, Homo sapiens
ggaccagauuucucaaacc

SEQ ID NO: 1447334 - RNA, 19 nt, Homo sapiens
ggagcagaaaucucaggaa

SEQ ID NO: 1447335 - RNA, 19 nt, Homo sapiens
agcagauauugccaacuua

SEQ ID NO: 1447336 - RNA, 19 nt, Homo sapiens
agaaagcuuacauuagaga

SEQ ID NO: 1447337 - RNA, 19 nt, Homo sapiens
ccaaaugcagagaaagcuu

SEQ ID NO: 1447338 - RNA, 19 nt, Homo sapiens
gaccaaaugcagagaaagc

SEQ ID NO: 1447339 - RNA, 19 nt, Homo sapiens
aaaugcggaugccuacagu

SEQ ID NO: 1447340 - RNA, 19 nt, Homo sapiens
caaauuguuggacuucucu

SEQ ID NO: 1447341 - RNA, 19 nt, Homo sapiens
auucuacaauagcugauga

SEQ ID NO: 1447342 - RNA, 19 nt, Homo sapiens
agagaugcagcaaauuguu

SEQ ID NO: 1447343 - RNA, 19 nt, Homo sapiens
gaaaucucaggaaacuaca

SEQ ID NO: 1447344 - RNA, 19 nt, Homo sapiens
gaauaugcagcggauccuu

SEQ ID NO: 1447345 - RNA, 19 nt, Homo sapiens
aauguacugugggaacuau

SEQ ID NO: 1447346 - RNA, 19 nt, Homo sapiens
agauauugccaacuuaauc

SEQ ID NO: 1447347 - RNA, 19 nt, Homo sapiens
ggagggacuggauuauguc

SEQ ID NO: 1447348 - RNA, 19 nt, Homo sapiens
ugagggaacauggacuuug

SEQ ID NO: 1447349 - RNA, 19 nt, Homo sapiens
gcaagaccaaaugcagaga

SEQ ID NO: 1447350 - RNA, 19 nt, Homo sapiens
ggacaguaguuacaaguua

SEQ ID NO: 1447351 - RNA, 19 nt, Homo sapiens
gcaaauaccauacugcuua

SEQ ID NO: 1447352 - RNA, 19 nt, Homo sapiens
ggaaagauaucucucaaag

SEQ ID NO: 1447353 - RNA, 19 nt, Homo sapiens
ggccauaucuucaugaauu

SEQ ID NO: 1447354 - RNA, 19 nt, Homo sapiens
acagaagacugaagaauaa

SEQ ID NO: 1447355 - RNA, 19 nt, Homo sapiens
gcaccuaaaucgugauaaa

SEQ ID NO: 1447356 - RNA, 19 nt, Homo sapiens
uaaagaaccuaguuugcua

SEQ ID NO: 1447357 - RNA, 19 nt, Homo sapiens
caacaaauaugaaguggau

SEQ ID NO: 1447358 - RNA, 19 nt, Homo sapiens
gagcacaaaugcaaauuau

SEQ ID NO: 1447359 - RNA, 19 nt, Homo sapiens
ggacaggaguauucaguga

SEQ ID NO: 1447360 - RNA, 19 nt, Homo sapiens
ugaaguaguugaaguagaa

SEQ ID NO: 1447361 - RNA, 19 nt, Homo sapiens
ugaaguggauugaagcuaa

SEQ ID NO: 1447362 - RNA, 19 nt, Homo sapiens
gaaacaugguguauauugu

SEQ ID NO: 1447363 - RNA, 19 nt, Homo sapiens
gaggagagcuugggagaug

SEQ ID NO: 1447364 - RNA, 19 nt, Homo sapiens
ucacaaauauugggaaaga

SEQ ID NO: 1447365 - RNA, 19 nt, Homo sapiens
ccagcuauaucuugucuaa

SEQ ID NO: 1447366 - RNA, 19 nt, Homo sapiens
gaaguggauugaagcuaaa

SEQ ID NO: 1447367 - RNA, 19 nt, Homo sapiens
cagaauggacuaaagauaa

SEQ ID NO: 1447368 - RNA, 19 nt, Homo sapiens
gaagaaaaccuacugaaaa

SEQ ID NO: 1447369 - RNA, 19 nt, Homo sapiens
gaaaauaucuagccauaag

SEQ ID NO: 1447370 - RNA, 19 nt, Homo sapiens
gagcuugggagaugucuua

SEQ ID NO: 1447371 - RNA, 19 nt, Homo sapiens
gaagcaaggacaguaguua

SEQ ID NO: 1447372 - RNA, 19 nt, Homo sapiens
ggugcuagauguugauuau

SEQ ID NO: 1447373 - RNA, 19 nt, Homo sapiens
ccucauauguuucaagaau

SEQ ID NO: 1447374 - RNA, 19 nt, Homo sapiens
guuauugucugacuaaauc

SEQ ID NO: 1447375 - RNA, 19 nt, Homo sapiens
caaauaccauacugcuuau

SEQ ID NO: 1447376 - RNA, 19 nt, Homo sapiens
gaagauacuuaagauccaa

SEQ ID NO: 1447377 - RNA, 19 nt, Homo sapiens
ggagugagcacaaaugcaa

SEQ ID NO: 1447378 - RNA, 19 nt, Homo sapiens
gcaguuaaaggcaauaaau

SEQ ID NO: 1447379 - RNA, 19 nt, Homo sapiens
gaaagaguacaaaguggaa

SEQ ID NO: 1447380 - RNA, 19 nt, Homo sapiens
ccaccgcgcuccagguauu

SEQ ID NO: 1447381 - RNA, 19 nt, Homo sapiens
gaaccuaguuugcuaugcu

SEQ ID NO: 1447382 - RNA, 19 nt, Homo sapiens
gacaguaguuacaaguuau

SEQ ID NO: 1447383 - RNA, 19 nt, Homo sapiens
caaagaagcaaggacagua

SEQ ID NO: 1447384 - RNA, 19 nt, Homo sapiens
ucuaacaucugccuaugaa

SEQ ID NO: 1447385 - RNA, 19 nt, Homo sapiens
cacaauuucucuucuguau

SEQ ID NO: 1447386 - RNA, 19 nt, Homo sapiens
gaaagauaucucucaaaga

SEQ ID NO: 1447387 - RNA, 19 nt, Homo sapiens
gcuuggagcucucaaacug

SEQ ID NO: 1447388 - RNA, 19 nt, Homo sapiens
guguguacauguccaagua

SEQ ID NO: 1447389 - RNA, 19 nt, Homo sapiens
ugaccacacuuucagaaga

SEQ ID NO: 1447390 - RNA, 19 nt, Homo sapiens
gaauggcucucccuaucau

SEQ ID NO: 1447391 - RNA, 19 nt, Homo sapiens
ccaaggagaggauuaauag

SEQ ID NO: 1447392 - RNA, 19 nt, Homo sapiens
guucuuacaggacuaauuu

SEQ ID NO: 1447393 - RNA, 19 nt, Homo sapiens
cuaaguagaaucuuccuaa

SEQ ID NO: 1447394 - RNA, 19 nt, Homo sapiens
caauuucucuucuguaugc

SEQ ID NO: 1447395 - RNA, 19 nt, Homo sapiens
guaaagccucuugguguua

SEQ ID NO: 1447396 - RNA, 19 nt, Homo sapiens
uaacaucugccuaugaaga

SEQ ID NO: 1447397 - RNA, 19 nt, Homo sapiens
gcuggacacugaagcaaau

SEQ ID NO: 1447398 - RNA, 19 nt, Homo sapiens
gaugacauagggagaaauu

SEQ ID NO: 1447399 - RNA, 19 nt, Homo sapiens
gugaaaauaucuagccaua

SEQ ID NO: 1447400 - RNA, 19 nt, Homo sapiens
uaugaaagcgcaccuaaau

SEQ ID NO: 1447401 - RNA, 19 nt, Homo sapiens
cuaaugaacccacagaaug

SEQ ID NO: 1447402 - RNA, 19 nt, Homo sapiens
cguaaagccucuugguguu

SEQ ID NO: 1447403 - RNA, 19 nt, Homo sapiens
gcugcuuccucauauguuu

SEQ ID NO: 1447404 - RNA, 19 nt, Homo sapiens
gccauaucuucaugaauuu

SEQ ID NO: 1447405 - RNA, 19 nt, Homo sapiens
aacagaagacugaagaaua

SEQ ID NO: 1447406 - RNA, 19 nt, Homo sapiens
gaccacacuuucagaagau

SEQ ID NO: 1447407 - RNA, 19 nt, Homo sapiens
aaaccaaacccauguugaa

SEQ ID NO: 1447408 - RNA, 19 nt, Homo sapiens
ucaaggagauagcaaaauu

SEQ ID NO: 1447409 - RNA, 19 nt, Homo sapiens
ccacagaauggacuaaaga

SEQ ID NO: 1447410 - RNA, 19 nt, Homo sapiens
gaggauuaauagacguaaa

SEQ ID NO: 1447411 - RNA, 19 nt, Homo sapiens
aagaauggcucucccuauc

SEQ ID NO: 1447412 - RNA, 19 nt, Homo sapiens
gaauuaaugcggccauauc

SEQ ID NO: 1447413 - RNA, 19 nt, Homo sapiens
uuacaggacuaauuucagu

SEQ ID NO: 1447414 - RNA, 19 nt, Homo sapiens
agaaacaugguguauauug

SEQ ID NO: 1447415 - RNA, 19 nt, Homo sapiens
uaaagccucuugguguuau

SEQ ID NO: 1447416 - RNA, 19 nt, Homo sapiens
gaaacagaagacugaagaa

SEQ ID NO: 1447417 - RNA, 19 nt, Homo sapiens
guaugccacuaguuacauu

SEQ ID NO: 1447418 - RNA, 19 nt, Homo sapiens
gacacaauuucucuucugu

SEQ ID NO: 1447419 - RNA, 19 nt, Homo sapiens
ggaagaaaaccuacugaaa

SEQ ID NO: 1447420 - RNA, 19 nt, Homo sapiens
aaacccauguugaaacuag

SEQ ID NO: 1447421 - RNA, 19 nt, Homo sapiens
ccaaacccauguugaaacu

SEQ ID NO: 1447422 - RNA, 19 nt, Homo sapiens
ugaagaugauagcaauaug

SEQ ID NO: 1447423 - RNA, 19 nt, Homo sapiens
uaucuugucuaagugcuaa

SEQ ID NO: 1447424 - RNA, 19 nt, Homo sapiens
ggaacaagaaugagucucu

SEQ ID NO: 1447425 - RNA, 19 nt, Homo sapiens
aauauucuguuacgcuuga

SEQ ID NO: 1447426 - RNA, 19 nt, Homo sapiens
gcaaggacaguaguuacaa

SEQ ID NO: 1447427 - RNA, 19 nt, Homo sapiens
acucaaaguuaaaggcaaa

SEQ ID NO: 1447428 - RNA, 19 nt, Homo sapiens
ccacuaguuacauuucuaa

SEQ ID NO: 1447429 - RNA, 19 nt, Homo sapiens
gccacuaguuacauuucua

SEQ ID NO: 1447430 - RNA, 19 nt, Homo sapiens
agaauggacuaaagauaag

SEQ ID NO: 1447431 - RNA, 19 nt, Homo sapiens
ugagcacaaaugcaaauua

SEQ ID NO: 1447432 - RNA, 19 nt, Homo sapiens
aauaugaaguggauugaag

SEQ ID NO: 1447433 - RNA, 19 nt, Homo sapiens
aaacuaaggaacaagaaug

SEQ ID NO: 1447434 - RNA, 19 nt, Homo sapiens
gagaggauuaauagacgua

SEQ ID NO: 1447435 - RNA, 19 nt, Homo sapiens
gcuagauguugauuauaca

SEQ ID NO: 1447436 - RNA, 19 nt, Homo sapiens
agaaacagaagacugaaga

SEQ ID NO: 1447437 - RNA, 19 nt, Homo sapiens
caaggacaguaguuacaag

SEQ ID NO: 1447438 - RNA, 19 nt, Homo sapiens
acaaauaugaaguggauug

SEQ ID NO: 1447439 - RNA, 19 nt, Homo sapiens
caagaauggcucucccuau

SEQ ID NO: 1447440 - RNA, 19 nt, Homo sapiens
guucuuguauuugaaagga

SEQ ID NO: 1447441 - RNA, 19 nt, Homo sapiens
gcuauaucuugucuaagug

SEQ ID NO: 1447442 - RNA, 19 nt, Homo sapiens
guguacauguccaaguaaa

SEQ ID NO: 1447443 - RNA, 19 nt, Homo sapiens
gaagaugauagcaauaugc

SEQ ID NO: 1447444 - RNA, 19 nt, Homo sapiens
ugaagcaaauaccauacug

SEQ ID NO: 1447445 - RNA, 19 nt, Homo sapiens
ggagauagcaaaauuagau

SEQ ID NO: 1447446 - RNA, 19 nt, Homo sapiens
acagaauggacuaaagaua

SEQ ID NO: 1447447 - RNA, 19 nt, Homo sapiens
acaccauuauguuugauga

SEQ ID NO: 1447448 - RNA, 19 nt, Homo sapiens
uagaauuaaugcggccaua

SEQ ID NO: 1447449 - RNA, 19 nt, Homo sapiens
gaguacaaaguggaaauuu

SEQ ID NO: 1447450 - RNA, 19 nt, Homo sapiens
gaaggaaaguagcaaauuu

SEQ ID NO: 1447451 - RNA, 19 nt, Homo sapiens
caucagaagugaaaucaua

SEQ ID NO: 1447452 - RNA, 19 nt, Homo sapiens
gaaaguagcaaauuugaug

SEQ ID NO: 1447453 - RNA, 19 nt, Homo sapiens
ucaaagaugguaacacuua

SEQ ID NO: 1447454 - RNA, 19 nt, Homo sapiens
gcagugaagucggucauuu

SEQ ID NO: 1447455 - RNA, 19 nt, Homo sapiens
ggagacagcuagaguugga

SEQ ID NO: 1447456 - RNA, 19 nt, Homo sapiens
gagaaggaaaguucgauua

SEQ ID NO: 1447457 - RNA, 19 nt, Homo sapiens
ggaagagcaugauguuuua

SEQ ID NO: 1447458 - RNA, 19 nt, Homo sapiens
ugaacaagaucauguggaa

SEQ ID NO: 1447459 - RNA, 19 nt, Homo sapiens
gaaggaaaguucgauuaca

SEQ ID NO: 1447460 - RNA, 19 nt, Homo sapiens
aagaagagguuccacuuug

SEQ ID NO: 1447461 - RNA, 19 nt, Homo sapiens
ucacaucaccuguccuaua

SEQ ID NO: 1447462 - RNA, 19 nt, Homo sapiens
caacagugcuuuucucauu

SEQ ID NO: 1447463 - RNA, 19 nt, Homo sapiens
gcucaucccuuucugaagu

SEQ ID NO: 1447464 - RNA, 19 nt, Homo sapiens
ugagaaacaugcuggaguu

SEQ ID NO: 1447465 - RNA, 19 nt, Homo sapiens
gaagaaaaccccucaaaga

SEQ ID NO: 1447466 - RNA, 19 nt, Homo sapiens
gaucagcuguaucacauca

SEQ ID NO: 1447467 - RNA, 19 nt, Homo sapiens
caacaugaagauaccuuua

SEQ ID NO: 1447468 - RNA, 19 nt, Homo sapiens
aaaguucgauuacaacaug

SEQ ID NO: 1447469 - RNA, 19 nt, Homo sapiens
ugacaaacccaaagacuug

SEQ ID NO: 1447470 - RNA, 19 nt, Homo sapiens
caucguaucuuacuuuaac

SEQ ID NO: 1447471 - RNA, 19 nt, Homo sapiens
uagcauccuuccuuacuuu

SEQ ID NO: 1447472 - RNA, 19 nt, Homo sapiens
gaauccaacccauuucaaa

SEQ ID NO: 1447473 - RNA, 19 nt, Homo sapiens
auucaugcaucguaucuua

SEQ ID NO: 1447474 - RNA, 19 nt, Homo sapiens
gcauggagaucaguaucaa

SEQ ID NO: 1447475 - RNA, 19 nt, Homo sapiens
ccguagauauguuuaaguu

SEQ ID NO: 1447476 - RNA, 19 nt, Homo sapiens
uugagaagcuuguuagugu

SEQ ID NO: 1447477 - RNA, 19 nt, Homo sapiens
uagagaauccuccugauga

SEQ ID NO: 1447478 - RNA, 19 nt, Homo sapiens
gaaacagcagccucuugua

SEQ ID NO: 1447479 - RNA, 19 nt, Homo sapiens
caaagaagagguuccacuu

SEQ ID NO: 1447480 - RNA, 19 nt, Homo sapiens
gaaguccguagauauguuu

SEQ ID NO: 1447481 - RNA, 19 nt, Homo sapiens
aaggaaaguucgauuacaa

SEQ ID NO: 1447482 - RNA, 19 nt, Homo sapiens
gcacaagcauggagaucag

SEQ ID NO: 1447483 - RNA, 19 nt, Homo sapiens
ggucaacuuucaauuacug

SEQ ID NO: 1447484 - RNA, 19 nt, Homo sapiens
gaugauggguuuguaagca

SEQ ID NO: 1447485 - RNA, 19 nt, Homo sapiens
gcuggaguuuccugcguua

SEQ ID NO: 1447486 - RNA, 19 nt, Homo sapiens
gacaguggcuacuauuucu

SEQ ID NO: 1447487 - RNA, 19 nt, Homo sapiens
uaaucuggcugcugagaga

SEQ ID NO: 1447488 - RNA, 19 nt, Homo sapiens
ccucaaagaugguaacacu

SEQ ID NO: 1447489 - RNA, 19 nt, Homo sapiens
uuacaaugcugcugaugau

SEQ ID NO: 1447490 - RNA, 19 nt, Homo sapiens
ucagaccuguguugaaguu

SEQ ID NO: 1447491 - RNA, 19 nt, Homo sapiens
guguugggcucaucccuuu

SEQ ID NO: 1447492 - RNA, 19 nt, Homo sapiens
gaggagacagcuagaguug

SEQ ID NO: 1447493 - RNA, 19 nt, Homo sapiens
uuacuuugcuggaaaucuu

SEQ ID NO: 1447494 - RNA, 19 nt, Homo sapiens
ggacaaguuauaaccauca

SEQ ID NO: 1447495 - RNA, 19 nt, Homo sapiens
aaacagcagccucuuguau

SEQ ID NO: 1447496 - RNA, 19 nt, Homo sapiens
gagacaguggcuacuauuu

SEQ ID NO: 1447497 - RNA, 19 nt, Homo sapiens
uaacugaacaagaucaugu

SEQ ID NO: 1447498 - RNA, 19 nt, Homo sapiens
cugcuagcauccuuccuua

SEQ ID NO: 1447499 - RNA, 19 nt, Homo sapiens
guccuauacugaaugauga

SEQ ID NO: 1447500 - RNA, 19 nt, Homo sapiens
gaauucgccuaggcagaaa

SEQ ID NO: 1447501 - RNA, 19 nt, Homo sapiens
caacuuucaauuacuggua

SEQ ID NO: 1447502 - RNA, 19 nt, Homo sapiens
uggaugacauacaguuuga

SEQ ID NO: 1447503 - RNA, 19 nt, Homo sapiens
acaaugcugcugaugauaa

SEQ ID NO: 1447504 - RNA, 19 nt, Homo sapiens
ugaaguccguagauauguu

SEQ ID NO: 1447505 - RNA, 19 nt, Homo sapiens
gcuagaguuggacaaguua

SEQ ID NO: 1447506 - RNA, 19 nt, Homo sapiens
gcugagagaaggaaaguuc

SEQ ID NO: 1447507 - RNA, 19 nt, Homo sapiens
aaaccagucacacuucuaa

SEQ ID NO: 1447508 - RNA, 19 nt, Homo sapiens
cacaguacaucagaaguga

SEQ ID NO: 1447509 - RNA, 19 nt, Homo sapiens
cacaucaccuguccuauac

SEQ ID NO: 1447510 - RNA, 19 nt, Homo sapiens
ggagacaguggcuacuauu

SEQ ID NO: 1447511 - RNA, 19 nt, Homo sapiens
gcaaaccaucacggaaaua

SEQ ID NO: 1447512 - RNA, 19 nt, Homo sapiens
gaagaggaaggagcgguuu

SEQ ID NO: 1447513 - RNA, 19 nt, Homo sapiens
uguauacaguucuuagaga

SEQ ID NO: 1447514 - RNA, 19 nt, Homo sapiens
ugaagaugaucagcuguau

SEQ ID NO: 1447515 - RNA, 19 nt, Homo sapiens
guccagcacauuuggcuua

SEQ ID NO: 1447516 - RNA, 19 nt, Homo sapiens
cgaauucgccuaggcagaa

SEQ ID NO: 1447517 - RNA, 19 nt, Homo sapiens
guagcaaauuugaugaucu

SEQ ID NO: 1447518 - RNA, 19 nt, Homo sapiens
gacaaguuauaaccaucaa

SEQ ID NO: 1447519 - RNA, 19 nt, Homo sapiens
cagcaauucaugcaucgua

SEQ ID NO: 1447520 - RNA, 19 nt, Homo sapiens
gugaagaugaucagcugua

SEQ ID NO: 1447521 - RNA, 19 nt, Homo sapiens
ucucuugucugacuuuaca

SEQ ID NO: 1447522 - RNA, 19 nt, Homo sapiens
cuuaucgucucuugucuga

SEQ ID NO: 1447523 - RNA, 19 nt, Homo sapiens
uuucugaaguccguagaua

SEQ ID NO: 1447524 - RNA, 19 nt, Homo sapiens
ugaaggaaaguagcaaauu

SEQ ID NO: 1447525 - RNA, 19 nt, Homo sapiens
ggaaaguucgauuacaaca

SEQ ID NO: 1447526 - RNA, 19 nt, Homo sapiens
guaucaaggucaugguaca

SEQ ID NO: 1447527 - RNA, 19 nt, Homo sapiens
guuauaaccaucaaagcaa

SEQ ID NO: 1447528 - RNA, 19 nt, Homo sapiens
gcaccuccguucagagcau

SEQ ID NO: 1447529 - RNA, 19 nt, Homo sapiens
aacagcagccucuuguaua

SEQ ID NO: 1447530 - RNA, 19 nt, Homo sapiens
caaguuauaaccaucaaag

SEQ ID NO: 1447531 - RNA, 19 nt, Homo sapiens
ugcaucguaucuuacuuua

SEQ ID NO: 1447532 - RNA, 19 nt, Homo sapiens
caucaccuguccuauacug

SEQ ID NO: 1447533 - RNA, 19 nt, Homo sapiens
uaucacaucaccuguccua

SEQ ID NO: 1447534 - RNA, 19 nt, Homo sapiens
uucaaaggaugauuucaga

SEQ ID NO: 1447535 - RNA, 19 nt, Homo sapiens
gaaaguucgauuacaacau

SEQ ID NO: 1447536 - RNA, 19 nt, Homo sapiens
caaaccaguuggaaaagaa

SEQ ID NO: 1447537 - RNA, 19 nt, Homo sapiens
gcauugagaagcuuguuag

SEQ ID NO: 1447538 - RNA, 19 nt, Homo sapiens
gaaugaugacaaacccaaa

SEQ ID NO: 1447539 - RNA, 19 nt, Homo sapiens
gaagagguuccacuuugca

SEQ ID NO: 1447540 - RNA, 19 nt, Homo sapiens
caaugcugcugaugauaag

SEQ ID NO: 1447541 - RNA, 19 nt, Homo sapiens
gggcucaucccuuucugaa

SEQ ID NO: 1447542 - RNA, 19 nt, Homo sapiens
uagcaaauuugaugaucuc

SEQ ID NO: 1447543 - RNA, 19 nt, Homo sapiens
ggaaaguagcaaauuugau

SEQ ID NO: 1447544 - RNA, 19 nt, Homo sapiens
guacaucagaagugaaauc

SEQ ID NO: 1447545 - RNA, 19 nt, Homo sapiens
ccacaguacaucagaagug

SEQ ID NO: 1447546 - RNA, 19 nt, Homo sapiens
gggaaguccagcacauuug

SEQ ID NO: 1447547 - RNA, 19 nt, Homo sapiens
gggaccaucuacaguugga

SEQ ID NO: 1447548 - RNA, 19 nt, Homo sapiens
uacauuugguggccagauu

SEQ ID NO: 1447549 - RNA, 19 nt, Homo sapiens
gaaggagcgguuuccacaa

SEQ ID NO: 1447550 - RNA, 19 nt, Homo sapiens
gcaaagugcuuagacauuu

SEQ ID NO: 1447551 - RNA, 19 nt, Homo sapiens
gcaagggucucuuuaaaug

SEQ ID NO: 1447552 - RNA, 19 nt, Homo sapiens
gagcaagggucucuuuaaa

SEQ ID NO: 1447553 - RNA, 19 nt, Homo sapiens
guagacaacuuauuccaaa

SEQ ID NO: 1447554 - RNA, 19 nt, Homo sapiens
gaacacagaauaacgauug

SEQ ID NO: 1447555 - RNA, 19 nt, Homo sapiens
gaaaugagguaaugcaacu

SEQ ID NO: 1447556 - RNA, 19 nt, Homo sapiens
gauuuggcaugacuacuua

SEQ ID NO: 1447557 - RNA, 19 nt, Homo sapiens
uggcaugacuacuuaauuu

SEQ ID NO: 1447558 - RNA, 19 nt, Homo sapiens
gauguuagguugucagcuu

SEQ ID NO: 1447559 - RNA, 19 nt, Homo sapiens
gaauaacgauugugaccau

SEQ ID NO: 1447560 - RNA, 19 nt, Homo sapiens
ggaaauuaaucccaaccaa

SEQ ID NO: 1447561 - RNA, 19 nt, Homo sapiens
agugagagcuuccuauaaa

SEQ ID NO: 1447562 - RNA, 19 nt, Homo sapiens
guugucagcuuuaagauau

SEQ ID NO: 1447563 - RNA, 19 nt, Homo sapiens
gcccauggcuccacguaaa

SEQ ID NO: 1447564 - RNA, 19 nt, Homo sapiens
aauaaacaguccuccauuu

SEQ ID NO: 1447565 - RNA, 19 nt, Homo sapiens
gaaauaaacaguccuccau

SEQ ID NO: 1447566 - RNA, 19 nt, Homo sapiens
agugaagccuuugaaauua

SEQ ID NO: 1447567 - RNA, 19 nt, Homo sapiens
guacugugaaugcuaaaua

SEQ ID NO: 1447568 - RNA, 19 nt, Homo sapiens
gcuaaauacuuuggaauuc

SEQ ID NO: 1447569 - RNA, 19 nt, Homo sapiens
cagugaagccuuugaaauu

SEQ ID NO: 1447570 - RNA, 19 nt, Homo sapiens
guuugcaugucauuaguua

SEQ ID NO: 1447571 - RNA, 19 nt, Homo sapiens
guagauauugccaagauuu

SEQ ID NO: 1447572 - RNA, 19 nt, Homo sapiens
uaacgauugugaccauuau

SEQ ID NO: 1447573 - RNA, 19 nt, Homo sapiens
agacaggccugaacucuag

SEQ ID NO: 1447574 - RNA, 19 nt, Homo sapiens
uaacuucucugggccuuug

SEQ ID NO: 1447575 - RNA, 19 nt, Homo sapiens
gugguugucuccaucauga

SEQ ID NO: 1447576 - RNA, 19 nt, Homo sapiens
aauccagggucaaagguua

SEQ ID NO: 1447577 - RNA, 19 nt, Homo sapiens
uaagauauguggugguuuu

SEQ ID NO: 1447578 - RNA, 19 nt, Homo sapiens
gccuuuagcuggucuagug

SEQ ID NO: 1447579 - RNA, 19 nt, Homo sapiens
uaaaggugacuuagagaaa

SEQ ID NO: 1447580 - RNA, 19 nt, Homo sapiens
ggagagucuugaacacaga

SEQ ID NO: 1447581 - RNA, 19 nt, Homo sapiens
gaaaucucccgucgaccua

SEQ ID NO: 1447582 - RNA, 19 nt, Homo sapiens
ugaaaucuguuuacucaac

SEQ ID NO: 1447583 - RNA, 19 nt, Homo sapiens
gaaaguuuguagauauugc

SEQ ID NO: 1447584 - RNA, 19 nt, Homo sapiens
guuguacugugaaugcuaa

SEQ ID NO: 1447585 - RNA, 19 nt, Homo sapiens
gaaagauguuagguuguca

SEQ ID NO: 1447586 - RNA, 19 nt, Homo sapiens
ucagugagcuuggaugagu

SEQ ID NO: 1447587 - RNA, 19 nt, Homo sapiens
guaaaggugacuuagagaa

SEQ ID NO: 1447588 - RNA, 19 nt, Homo sapiens
gcccgaggcuugaagaagu

SEQ ID NO: 1447589 - RNA, 19 nt, Homo sapiens
gguaaugcaacuuucguaa

SEQ ID NO: 1447590 - RNA, 19 nt, Homo sapiens
gagacaggccugaacucua

SEQ ID NO: 1447591 - RNA, 19 nt, Homo sapiens
ucagugagagcuuccuaua

SEQ ID NO: 1447592 - RNA, 19 nt, Homo sapiens
caauuaaggagcaacuauu

SEQ ID NO: 1447593 - RNA, 19 nt, Homo sapiens
ugaaagauguuagguuguc

SEQ ID NO: 1447594 - RNA, 19 nt, Homo sapiens
caaaauagcaaaugcagaa

SEQ ID NO: 1447595 - RNA, 19 nt, Homo sapiens
caguggagccuuucaguga

SEQ ID NO: 1447596 - RNA, 19 nt, Homo sapiens
caacuuucguaauaaccuu

SEQ ID NO: 1447597 - RNA, 19 nt, Homo sapiens
gauauguggugguuuugua

SEQ ID NO: 1447598 - RNA, 19 nt, Homo sapiens
aagggucucuuuaaauguu

SEQ ID NO: 1447599 - RNA, 19 nt, Homo sapiens
gagagcuuccuauaaagaa

SEQ ID NO: 1447600 - RNA, 19 nt, Homo sapiens
guuccuaucuguaaaugag

SEQ ID NO: 1447601 - RNA, 19 nt, Homo sapiens
aaguuuaucuaccucguuu

SEQ ID NO: 1447602 - RNA, 19 nt, Homo sapiens
aaagagacauuuugacaga

SEQ ID NO: 1447603 - RNA, 19 nt, Homo sapiens
ggcaaagugcuuagacauu

SEQ ID NO: 1447604 - RNA, 19 nt, Homo sapiens
caagacagagcuagagcaa

SEQ ID NO: 1447605 - RNA, 19 nt, Homo sapiens
ccagagaugggauuugaga

SEQ ID NO: 1447606 - RNA, 19 nt, Homo sapiens
guaaugcaacuuucguaau

SEQ ID NO: 1447607 - RNA, 19 nt, Homo sapiens
gguugucagcuuuaagaua

SEQ ID NO: 1447608 - RNA, 19 nt, Homo sapiens
uuauaugacuguucuguac

SEQ ID NO: 1447609 - RNA, 19 nt, Homo sapiens
ucuguuuacucaaccaauu

SEQ ID NO: 1447610 - RNA, 19 nt, Homo sapiens
ucagugaaauaggugacua

SEQ ID NO: 1447611 - RNA, 19 nt, Homo sapiens
guuugugaauugcaccuuu

SEQ ID NO: 1447612 - RNA, 19 nt, Homo sapiens
agagggaacuugaaaucca

SEQ ID NO: 1447613 - RNA, 19 nt, Homo sapiens
agagaugggauuugagaaa

SEQ ID NO: 1447614 - RNA, 19 nt, Homo sapiens
cuccagagaugggauuuga

SEQ ID NO: 1447615 - RNA, 19 nt, Homo sapiens
gugaagccuuugaaauuac

SEQ ID NO: 1447616 - RNA, 19 nt, Homo sapiens
aauagcaaaugcagaaucu

SEQ ID NO: 1447617 - RNA, 19 nt, Homo sapiens
ucaagguucuggagagucu

SEQ ID NO: 1447618 - RNA, 19 nt, Homo sapiens
aaauuaaucccaaccaaca

SEQ ID NO: 1447619 - RNA, 19 nt, Homo sapiens
caaagugcuuagacauuuu

SEQ ID NO: 1447620 - RNA, 19 nt, Homo sapiens
gcgcaccagucgacgugaa

SEQ ID NO: 1447621 - RNA, 19 nt, Homo sapiens
caagacugcagcccaauca

SEQ ID NO: 1447622 - RNA, 19 nt, Homo sapiens
agucuuucauggaauguuu

SEQ ID NO: 1447623 - RNA, 19 nt, Homo sapiens
gcaugucauuaguuauauc

SEQ ID NO: 1447624 - RNA, 19 nt, Homo sapiens
guuagguugucagcuuuaa

SEQ ID NO: 1447625 - RNA, 19 nt, Homo sapiens
gcuacacaaucccaagaca

SEQ ID NO: 1447626 - RNA, 19 nt, Homo sapiens
cauggaauguuuugauuga

SEQ ID NO: 1447627 - RNA, 19 nt, Homo sapiens
ggcagucuuucauggaaug

SEQ ID NO: 1447628 - RNA, 19 nt, Homo sapiens
ucagugaagccuuugaaau

SEQ ID NO: 1447629 - RNA, 19 nt, Homo sapiens
ugagagcuuccuauaaaga

SEQ ID NO: 1447630 - RNA, 19 nt, Homo sapiens
aaauaaacaguccuccauu

SEQ ID NO: 1447631 - RNA, 19 nt, Homo sapiens
uuuaagauauguggugguu

SEQ ID NO: 1447632 - RNA, 19 nt, Homo sapiens
ccugaugccucugcagcua

SEQ ID NO: 1447633 - RNA, 19 nt, Homo sapiens
gaaauccagggucaaaggu

SEQ ID NO: 1447634 - RNA, 19 nt, Homo sapiens
gugagagcuuccuauaaag

SEQ ID NO: 1447635 - RNA, 19 nt, Homo sapiens
cagugagagcuuccuauaa

SEQ ID NO: 1447636 - RNA, 19 nt, Homo sapiens
ccaccugguugaucuaucg

SEQ ID NO: 1447637 - RNA, 19 nt, Homo sapiens
ccuggagccucauucuguu

SEQ ID NO: 1447638 - RNA, 19 nt, Homo sapiens
aaggcagucuuucauggaa

SEQ ID NO: 1447639 - RNA, 19 nt, Homo sapiens
gcucugcuuuugcaaauug

SEQ ID NO: 1447640 - RNA, 19 nt, Homo sapiens
agagacauuuugacagaua

SEQ ID NO: 1447641 - RNA, 19 nt, Homo sapiens
gauugugaccauuaugaau

SEQ ID NO: 1447642 - RNA, 19 nt, Homo sapiens
gguggaaguggcagucuug

SEQ ID NO: 1447643 - RNA, 19 nt, Homo sapiens
aaauuguguuugcauguca

SEQ ID NO: 1447644 - RNA, 19 nt, Homo sapiens
auaacgauugugaccauua

SEQ ID NO: 1447645 - RNA, 19 nt, Homo sapiens
ggagacaggccugaacucu

SEQ ID NO: 1447646 - RNA, 19 nt, Homo sapiens
agauuucccaggcucaaua

SEQ ID NO: 1447647 - RNA, 19 nt, Homo sapiens
ggccuuuguuccuaucugu

SEQ ID NO: 1447648 - RNA, 19 nt, Homo sapiens
acaauuaaggagcaacuau

SEQ ID NO: 1447649 - RNA, 19 nt, Homo sapiens
ggauacaauuaaggagcaa

SEQ ID NO: 1447650 - RNA, 19 nt, Homo sapiens
gaaggaagauugugaauaa

SEQ ID NO: 1447651 - RNA, 19 nt, Homo sapiens
gaaguaagccuacaguaua

SEQ ID NO: 1447652 - RNA, 19 nt, Homo sapiens
gaggauagcauauuucaua

SEQ ID NO: 1447653 - RNA, 19 nt, Homo sapiens
gaaacacacuugcagacua

SEQ ID NO: 1447654 - RNA, 19 nt, Homo sapiens
gaaauauagugcauucuga

SEQ ID NO: 1447655 - RNA, 19 nt, Homo sapiens
caaagcagcuggauuuaag

SEQ ID NO: 1447656 - RNA, 19 nt, Homo sapiens
gcagaagcauagaaauaaa

SEQ ID NO: 1447657 - RNA, 19 nt, Homo sapiens
ccuauuaguuugugaagua

SEQ ID NO: 1447658 - RNA, 19 nt, Homo sapiens
agugauagguuguguauuu

SEQ ID NO: 1447659 - RNA, 19 nt, Homo sapiens
ggccugggcuuuccaaauu

SEQ ID NO: 1447660 - RNA, 19 nt, Homo sapiens
gagagcugcugaucaguuu

SEQ ID NO: 1447661 - RNA, 19 nt, Homo sapiens
gcaggagaauugcuuaaau

SEQ ID NO: 1447662 - RNA, 19 nt, Homo sapiens
caagaugggacacauauuu

SEQ ID NO: 1447663 - RNA, 19 nt, Homo sapiens
caaugaagaugccaugaga

SEQ ID NO: 1447664 - RNA, 19 nt, Homo sapiens
gagcagcggcauuguauuu

SEQ ID NO: 1447665 - RNA, 19 nt, Homo sapiens
gguaauggcugugugaguu

SEQ ID NO: 1447666 - RNA, 19 nt, Homo sapiens
gaaaagagggccagguuua

SEQ ID NO: 1447667 - RNA, 19 nt, Homo sapiens
caacuaaagcugcgggaua

SEQ ID NO: 1447668 - RNA, 19 nt, Homo sapiens
ggucagcaguucaagacua

SEQ ID NO: 1447669 - RNA, 19 nt, Homo sapiens
gcauauauaccaaacacua

SEQ ID NO: 1447670 - RNA, 19 nt, Homo sapiens
gaagcauucucuagguuug

SEQ ID NO: 1447671 - RNA, 19 nt, Homo sapiens
gcauuuacauccacuucaa

SEQ ID NO: 1447672 - RNA, 19 nt, Homo sapiens
ggugaaauauagugcauuc

SEQ ID NO: 1447673 - RNA, 19 nt, Homo sapiens
gaaacuagcagugaaguca

SEQ ID NO: 1447674 - RNA, 19 nt, Homo sapiens
gcagcuggauuuaagacaa

SEQ ID NO: 1447675 - RNA, 19 nt, Homo sapiens
caccaaagcagcuggauuu

SEQ ID NO: 1447676 - RNA, 19 nt, Homo sapiens
gcauguagcuauagucacu

SEQ ID NO: 1447677 - RNA, 19 nt, Homo sapiens
ggcagaagcauagaaauaa

SEQ ID NO: 1447678 - RNA, 19 nt, Homo sapiens
guaagccuacaguauaaua

SEQ ID NO: 1447679 - RNA, 19 nt, Homo sapiens
aaguaagccuacaguauaa

SEQ ID NO: 1447680 - RNA, 19 nt, Homo sapiens
caggagaauugcuuaaauc

SEQ ID NO: 1447681 - RNA, 19 nt, Homo sapiens
gcagugauagguuguguau

SEQ ID NO: 1447682 - RNA, 19 nt, Homo sapiens
gaagucaaaccacccaaug

SEQ ID NO: 1447683 - RNA, 19 nt, Homo sapiens
gcaaauacagccacacagu

SEQ ID NO: 1447684 - RNA, 19 nt, Homo sapiens
cugaucaguuugacauaua

SEQ ID NO: 1447685 - RNA, 19 nt, Homo sapiens
gagcauauauaccaaacac

SEQ ID NO: 1447686 - RNA, 19 nt, Homo sapiens
cagccugggugacagagua

SEQ ID NO: 1447687 - RNA, 19 nt, Homo sapiens
gaugggacacauauuugua

SEQ ID NO: 1447688 - RNA, 19 nt, Homo sapiens
cagcggcauuguauuugua

SEQ ID NO: 1447689 - RNA, 19 nt, Homo sapiens
ugaaguaagccuacaguau

SEQ ID NO: 1447690 - RNA, 19 nt, Homo sapiens
gcagcggcauuguauuugu

SEQ ID NO: 1447691 - RNA, 19 nt, Homo sapiens
uggcagaagcauagaaaua

SEQ ID NO: 1447692 - RNA, 19 nt, Homo sapiens
caugagagcugcugaucag

SEQ ID NO: 1447693 - RNA, 19 nt, Homo sapiens
uguaacaccuaacuaaauc

SEQ ID NO: 1447694 - RNA, 19 nt, Homo sapiens
gaggcaagacccauuaaau

SEQ ID NO: 1447695 - RNA, 19 nt, Homo sapiens
gcugaucaguuugacauau

SEQ ID NO: 1447696 - RNA, 19 nt, Homo sapiens
gcuacgagcggcugagaaa

SEQ ID NO: 1447697 - RNA, 19 nt, Homo sapiens
ccaaagcagcuggauuuaa

SEQ ID NO: 1447698 - RNA, 19 nt, Homo sapiens
gaaaccccaucucuacuaa

SEQ ID NO: 1447699 - RNA, 19 nt, Homo sapiens
gaucuacauggcauuaauu

SEQ ID NO: 1447700 - RNA, 19 nt, Homo sapiens
uuaauugccuaagagcaua

SEQ ID NO: 1447701 - RNA, 19 nt, Homo sapiens
ucagaggcaagacccauua

SEQ ID NO: 1447702 - RNA, 19 nt, Homo sapiens
caaaccacccaaugaguga

SEQ ID NO: 1447703 - RNA, 19 nt, Homo sapiens
cuacauggcauuaauugau

SEQ ID NO: 1447704 - RNA, 19 nt, Homo sapiens
agaggaaacuagcagugaa

SEQ ID NO: 1447705 - RNA, 19 nt, Homo sapiens
aaacacacuugcagacuac

SEQ ID NO: 1447706 - RNA, 19 nt, Homo sapiens
ccaaacacuacaaacaauu

SEQ ID NO: 1447707 - RNA, 19 nt, Homo sapiens
gauaaacaacugaaaccau

SEQ ID NO: 1447708 - RNA, 19 nt, Homo sapiens
gaguuauggucaugucuca

SEQ ID NO: 1447709 - RNA, 19 nt, Homo sapiens
ccacacagucaaccacaaa

SEQ ID NO: 1447710 - RNA, 19 nt, Homo sapiens
ucacaagaugggacacaua

SEQ ID NO: 1447711 - RNA, 19 nt, Homo sapiens
cugaaaccauuauaccuau

SEQ ID NO: 1447712 - RNA, 19 nt, Homo sapiens
gcaguaauccagcuuucug

SEQ ID NO: 1447713 - RNA, 19 nt, Homo sapiens
gcagugagccaagauugug

SEQ ID NO: 1447714 - RNA, 19 nt, Homo sapiens
agacuagccuggccaacau

SEQ ID NO: 1447715 - RNA, 19 nt, Homo sapiens
caaacacuacaaacaauuc

SEQ ID NO: 1447716 - RNA, 19 nt, Homo sapiens
guaauggcugugugaguuu

SEQ ID NO: 1447717 - RNA, 19 nt, Homo sapiens
aaagcucuaucccgucuug

SEQ ID NO: 1447718 - RNA, 19 nt, Homo sapiens
gagcugcugaucaguuuga

SEQ ID NO: 1447719 - RNA, 19 nt, Homo sapiens
ccuaagagcauauauacca

SEQ ID NO: 1447720 - RNA, 19 nt, Homo sapiens
gagcagugauagguugugu

SEQ ID NO: 1447721 - RNA, 19 nt, Homo sapiens
aaucucaaccgaucuggua

SEQ ID NO: 1447722 - RNA, 19 nt, Homo sapiens
cuaagagcauauauaccaa

SEQ ID NO: 1447723 - RNA, 19 nt, Homo sapiens
uaaagcugcgggauacaaa

SEQ ID NO: 1447724 - RNA, 19 nt, Homo sapiens
gcucacacccagcacuuug

SEQ ID NO: 1447725 - RNA, 19 nt, Homo sapiens
uaccaaacacuacaaacaa

SEQ ID NO: 1447726 - RNA, 19 nt, Homo sapiens
agaaggaagauugugaaua

SEQ ID NO: 1447727 - RNA, 19 nt, Homo sapiens
uauagugcauucugaggau

SEQ ID NO: 1447728 - RNA, 19 nt, Homo sapiens
ugaaauauagugcauucug

SEQ ID NO: 1447729 - RNA, 19 nt, Homo sapiens
ugaucuacauggcauuaau

SEQ ID NO: 1447730 - RNA, 19 nt, Homo sapiens
gccugggcuuuccaaauuu

SEQ ID NO: 1447731 - RNA, 19 nt, Homo sapiens
cagcaguaauccagcuuuc

SEQ ID NO: 1447732 - RNA, 19 nt, Homo sapiens
gaggcaggcggaucacuug

SEQ ID NO: 1447733 - RNA, 19 nt, Homo sapiens
aaauacagccacacaguca

SEQ ID NO: 1447734 - RNA, 19 nt, Homo sapiens
uaagguaauggcuguguga

SEQ ID NO: 1447735 - RNA, 19 nt, Homo sapiens
caugagcagcggcauugua

SEQ ID NO: 1447736 - RNA, 19 nt, Homo sapiens
gaggcaggagaauugcuua

SEQ ID NO: 1447737 - RNA, 19 nt, Homo sapiens
cuucaguguuugccuuuga

SEQ ID NO: 1447738 - RNA, 19 nt, Homo sapiens
cacaagaugggacacauau

SEQ ID NO: 1447739 - RNA, 19 nt, Homo sapiens
gggcuuuccaaauuuguuu

SEQ ID NO: 1447740 - RNA, 19 nt, Homo sapiens
acaaguggcagaagcauag

SEQ ID NO: 1447741 - RNA, 19 nt, Homo sapiens
uaaaugaaacacacuugca

SEQ ID NO: 1447742 - RNA, 19 nt, Homo sapiens
ucucuagguuugcauguag

SEQ ID NO: 1447743 - RNA, 19 nt, Homo sapiens
acugaaaccauuauaccua

SEQ ID NO: 1447744 - RNA, 19 nt, Homo sapiens
gugaauaaucccaaagcuu

SEQ ID NO: 1447745 - RNA, 19 nt, Homo sapiens
gcacuguugcuuuuccuua

SEQ ID NO: 1447746 - RNA, 19 nt, Homo sapiens
ugagagcugcugaucaguu

SEQ ID NO: 1447747 - RNA, 19 nt, Homo sapiens
gcuguggcacuguugcuuu

SEQ ID NO: 1447748 - RNA, 19 nt, Homo sapiens
gcugcgggauacaaaguca

SEQ ID NO: 1447749 - RNA, 19 nt, Homo sapiens
cagcuggauuuaagacaag

SEQ ID NO: 1447750 - RNA, 19 nt, Homo sapiens
gcacacaccuacaaacuuu

SEQ ID NO: 1447751 - RNA, 19 nt, Homo sapiens
gaacgaauccugcauuaaa

SEQ ID NO: 1447752 - RNA, 19 nt, Homo sapiens
ggagagcuguugguacuuu

SEQ ID NO: 1447753 - RNA, 19 nt, Homo sapiens
gugaacgaauccugcauua

SEQ ID NO: 1447754 - RNA, 19 nt, Homo sapiens
uaacuccuccuuauguuua

SEQ ID NO: 1447755 - RNA, 19 nt, Homo sapiens
cagcauuucuugucucuug

SEQ ID NO: 1447756 - RNA, 19 nt, Homo sapiens
gaaacuuacuggucaugau

SEQ ID NO: 1447757 - RNA, 19 nt, Homo sapiens
ccuacaaacuuucugauug

SEQ ID NO: 1447758 - RNA, 19 nt, Homo sapiens
ggauaugcauuguucuuuc

SEQ ID NO: 1447759 - RNA, 19 nt, Homo sapiens
ucagagaguuacaaggaaa

SEQ ID NO: 1447760 - RNA, 19 nt, Homo sapiens
gcaucaggcuaggaagaua

SEQ ID NO: 1447761 - RNA, 19 nt, Homo sapiens
ggaauuaguaguugcucua

SEQ ID NO: 1447762 - RNA, 19 nt, Homo sapiens
gcucaguccuccucagaga

SEQ ID NO: 1447763 - RNA, 19 nt, Homo sapiens
gcauuguucuuuccugguu

SEQ ID NO: 1447764 - RNA, 19 nt, Homo sapiens
gaagaaguagagacagauu

SEQ ID NO: 1447765 - RNA, 19 nt, Homo sapiens
ucagggauaugcauuguuc

SEQ ID NO: 1447766 - RNA, 19 nt, Homo sapiens
ggccugugcugacuucuug

SEQ ID NO: 1447767 - RNA, 19 nt, Homo sapiens
gauagauacauugcuguua

SEQ ID NO: 1447768 - RNA, 19 nt, Homo sapiens
acaagaacgugaacgaauc

SEQ ID NO: 1447769 - RNA, 19 nt, Homo sapiens
ggucaugauugcuauccuu

SEQ ID NO: 1447770 - RNA, 19 nt, Homo sapiens
agaaguagagacagauuaa

SEQ ID NO: 1447771 - RNA, 19 nt, Homo sapiens
uuacugauccucugaccua

SEQ ID NO: 1447772 - RNA, 19 nt, Homo sapiens
caacugcacacaccuacaa

SEQ ID NO: 1447773 - RNA, 19 nt, Homo sapiens
ccaaccaaguuuacugugu

SEQ ID NO: 1447774 - RNA, 19 nt, Homo sapiens
gcuaggaagauagaaagua

SEQ ID NO: 1447775 - RNA, 19 nt, Homo sapiens
augcagugauugaugcuua

SEQ ID NO: 1447776 - RNA, 19 nt, Homo sapiens
guggagcuguguuacaaga

SEQ ID NO: 1447777 - RNA, 19 nt, Homo sapiens
guggagagcuguugguacu

SEQ ID NO: 1447778 - RNA, 19 nt, Homo sapiens
cuacaaacuuucugauugc

SEQ ID NO: 1447779 - RNA, 19 nt, Homo sapiens
cuaggaagauagaaaguac

SEQ ID NO: 1447780 - RNA, 19 nt, Homo sapiens
gaagaaggaauugaggaau

SEQ ID NO: 1447781 - RNA, 19 nt, Homo sapiens
gcuaugaaccccuugauuu

SEQ ID NO: 1447782 - RNA, 19 nt, Homo sapiens
ccucguugaugcagugauu

SEQ ID NO: 1447783 - RNA, 19 nt, Homo sapiens
cgaagaaggaauugaggaa

SEQ ID NO: 1447784 - RNA, 19 nt, Homo sapiens
caacgaagaaggaauugag

SEQ ID NO: 1447785 - RNA, 19 nt, Homo sapiens
gccaugguguuuauauaca

SEQ ID NO: 1447786 - RNA, 19 nt, Homo sapiens
ucgccaugguguuuauaua

SEQ ID NO: 1447787 - RNA, 19 nt, Homo sapiens
ugaccuauccaaccaaguu

SEQ ID NO: 1447788 - RNA, 19 nt, Homo sapiens
auacauugcuguuacugau

SEQ ID NO: 1447789 - RNA, 19 nt, Homo sapiens
aaacuuacuggucaugauu

SEQ ID NO: 1447790 - RNA, 19 nt, Homo sapiens
cugaagaaguagagacaga

SEQ ID NO: 1447791 - RNA, 19 nt, Homo sapiens
ccucagagaguuacaagga

SEQ ID NO: 1447792 - RNA, 19 nt, Homo sapiens
gagagcuguugguacuuug

SEQ ID NO: 1447793 - RNA, 19 nt, Homo sapiens
gggauaugcauuguucuuu

SEQ ID NO: 1447794 - RNA, 19 nt, Homo sapiens
ccaagcaucaggcuaggaa

SEQ ID NO: 1447795 - RNA, 19 nt, Homo sapiens
ugugucaguuucagggaua

SEQ ID NO: 1447796 - RNA, 19 nt, Homo sapiens
aaacaacugcacacaccua

SEQ ID NO: 1447797 - RNA, 19 nt, Homo sapiens
ggacugauucgucaacaac

SEQ ID NO: 1447798 - RNA, 19 nt, Homo sapiens
ggagcuguguuacaagaac

SEQ ID NO: 1447799 - RNA, 19 nt, Homo sapiens
caaugucgccaugguguuu

SEQ ID NO: 1447800 - RNA, 19 nt, Homo sapiens
gcagugauugaugcuuaua

SEQ ID NO: 1447801 - RNA, 19 nt, Homo sapiens
ggaaacuuacuggucauga

SEQ ID NO: 1447802 - RNA, 19 nt, Homo sapiens
aagaaguagagacagauua

SEQ ID NO: 1447803 - RNA, 19 nt, Homo sapiens
gcaaggucuuaaggacuga

SEQ ID NO: 1447804 - RNA, 19 nt, Homo sapiens
gauacauugcuguuacuga

SEQ ID NO: 1447805 - RNA, 19 nt, Homo sapiens
auagauacauugcuguuac

SEQ ID NO: 1447806 - RNA, 19 nt, Homo sapiens
gggaaggcaauaaaacuua

SEQ ID NO: 1447807 - RNA, 19 nt, Homo sapiens
gcuauggcagcauuucuug

SEQ ID NO: 1447808 - RNA, 19 nt, Homo sapiens
gaguuacaaggaaagagua

SEQ ID NO: 1447809 - RNA, 19 nt, Homo sapiens
gauaugcauuguucuuucc

SEQ ID NO: 1447810 - RNA, 19 nt, Homo sapiens
uuacuggucaugauugcua

SEQ ID NO: 1447811 - RNA, 19 nt, Homo sapiens
aaacuggguccuacuuugu

SEQ ID NO: 1447812 - RNA, 19 nt, Homo sapiens
ccucugaccuauccaacca

SEQ ID NO: 1447813 - RNA, 19 nt, Homo sapiens
ugacacauccuucuguuuu

SEQ ID NO: 1447814 - RNA, 19 nt, Homo sapiens
agugauugaugcuuauaug

SEQ ID NO: 1447815 - RNA, 19 nt, Homo sapiens
gagaaaggcugccaaaacc

SEQ ID NO: 1447816 - RNA, 19 nt, Homo sapiens
cacgggagccaacgaagaa

SEQ ID NO: 1447817 - RNA, 19 nt, Homo sapiens
ugauugcuauccuucacuu

SEQ ID NO: 1447818 - RNA, 19 nt, Homo sapiens
acugauucgucaacaacua

SEQ ID NO: 1447819 - RNA, 19 nt, Homo sapiens
gugauugaugcuuauauga

SEQ ID NO: 1447820 - RNA, 19 nt, Homo sapiens
cuaugaaccccuugauuua

SEQ ID NO: 1447821 - RNA, 19 nt, Homo sapiens
gaccuauccaaccaaguuu

SEQ ID NO: 1447822 - RNA, 19 nt, Homo sapiens
uaugcuguaucucuguuga

SEQ ID NO: 1447823 - RNA, 19 nt, Homo sapiens
agagagaaaggcugccaaa

SEQ ID NO: 1447824 - RNA, 19 nt, Homo sapiens
cugccaggcuccacugaau

SEQ ID NO: 1447825 - RNA, 19 nt, Homo sapiens
uacaagaacgugaacgaau

SEQ ID NO: 1447826 - RNA, 19 nt, Homo sapiens
cuccuuauguuuaugagau

SEQ ID NO: 1447827 - RNA, 19 nt, Homo sapiens
ugaacgaauccugcauuaa

SEQ ID NO: 1447828 - RNA, 19 nt, Homo sapiens
gcuggccugugcugacuuc

SEQ ID NO: 1447829 - RNA, 19 nt, Homo sapiens
cuguggagcuguguuacaa

SEQ ID NO: 1447830 - RNA, 19 nt, Homo sapiens
ucuacgccguccuugguuu

SEQ ID NO: 1447831 - RNA, 19 nt, Homo sapiens
gguuugggaaggcaauaaa

SEQ ID NO: 1447832 - RNA, 19 nt, Homo sapiens
gccaggcuccacugaauca

SEQ ID NO: 1447833 - RNA, 19 nt, Homo sapiens
acaaggaaagaguagcaaa

SEQ ID NO: 1447834 - RNA, 19 nt, Homo sapiens
aaaacuggguccuacuuug

SEQ ID NO: 1447835 - RNA, 19 nt, Homo sapiens
guucuuuccugguucuuuu

SEQ ID NO: 1447836 - RNA, 19 nt, Homo sapiens
ggcagcauuucuugucucu

SEQ ID NO: 1447837 - RNA, 19 nt, Homo sapiens
acuggguccuacuuuguuu

SEQ ID NO: 1447838 - RNA, 19 nt, Homo sapiens
uaguugcucuaaccugugu

SEQ ID NO: 1447839 - RNA, 19 nt, Homo sapiens
gccagguccucgaucuauc

SEQ ID NO: 1447840 - RNA, 19 nt, Homo sapiens
ugauagauacauugcuguu

SEQ ID NO: 1447841 - RNA, 19 nt, Homo sapiens
caaggaaagaguagcaaaa

SEQ ID NO: 1447842 - RNA, 19 nt, Homo sapiens
cucagagaguuacaaggaa

SEQ ID NO: 1447843 - RNA, 19 nt, Homo sapiens
guuacaagaacgugaacga

SEQ ID NO: 1447844 - RNA, 19 nt, Homo sapiens
uuacaagaacgugaacgaa

SEQ ID NO: 1447845 - RNA, 19 nt, Homo sapiens
caaaggcgcugaagagaua

SEQ ID NO: 1447846 - RNA, 19 nt, Homo sapiens
gaacaggcaagauuaauua

SEQ ID NO: 1447847 - RNA, 19 nt, Homo sapiens
caaauuggcucauucauuc

SEQ ID NO: 1447848 - RNA, 19 nt, Homo sapiens
ggaaagcugugaagacauu

SEQ ID NO: 1447849 - RNA, 19 nt, Homo sapiens
caaauuggauuggaaauga

SEQ ID NO: 1447850 - RNA, 19 nt, Homo sapiens
guacugaccuuuaugacuu

SEQ ID NO: 1447851 - RNA, 19 nt, Homo sapiens
uaaagaacaggcaagauua

SEQ ID NO: 1447852 - RNA, 19 nt, Homo sapiens
gcgcugaagagauauauua

SEQ ID NO: 1447853 - RNA, 19 nt, Homo sapiens
gugcuucccuguacaguuu

SEQ ID NO: 1447854 - RNA, 19 nt, Homo sapiens
ggucaugccuuacaguaug

SEQ ID NO: 1447855 - RNA, 19 nt, Homo sapiens
gaaaagcacugaagaugau

SEQ ID NO: 1447856 - RNA, 19 nt, Homo sapiens
guacagucauggacccuuu

SEQ ID NO: 1447857 - RNA, 19 nt, Homo sapiens
gcugagcacuguugguauu

SEQ ID NO: 1447858 - RNA, 19 nt, Homo sapiens
gaugggaguuuuccuaaua

SEQ ID NO: 1447859 - RNA, 19 nt, Homo sapiens
gauauaaagccaagaugaa

SEQ ID NO: 1447860 - RNA, 19 nt, Homo sapiens
cuaaagaacaggcaagauu

SEQ ID NO: 1447861 - RNA, 19 nt, Homo sapiens
gugauccacugagauauaa

SEQ ID NO: 1447862 - RNA, 19 nt, Homo sapiens
caggcaagauuaauuagug

SEQ ID NO: 1447863 - RNA, 19 nt, Homo sapiens
gaaaggaaagcugugaaga

SEQ ID NO: 1447864 - RNA, 19 nt, Homo sapiens
aaucagaagcuccaaauug

SEQ ID NO: 1447865 - RNA, 19 nt, Homo sapiens
ccaccuacuuugaaugaug

SEQ ID NO: 1447866 - RNA, 19 nt, Homo sapiens
caacaaauuggcucauuca

SEQ ID NO: 1447867 - RNA, 19 nt, Homo sapiens
aaagauucauccaggugua

SEQ ID NO: 1447868 - RNA, 19 nt, Homo sapiens
ugaccuuuaugacuucuuu

SEQ ID NO: 1447869 - RNA, 19 nt, Homo sapiens
cuacuugaacucuacauuu

SEQ ID NO: 1447870 - RNA, 19 nt, Homo sapiens
agaugaugcuguuugguaa

SEQ ID NO: 1447871 - RNA, 19 nt, Homo sapiens
ggugucuggucaugccuua

SEQ ID NO: 1447872 - RNA, 19 nt, Homo sapiens
aaagaacaggcaagauuaa

SEQ ID NO: 1447873 - RNA, 19 nt, Homo sapiens
caaaauaucugggguacug

SEQ ID NO: 1447874 - RNA, 19 nt, Homo sapiens
gauuugguuuggcuacuug

SEQ ID NO: 1447875 - RNA, 19 nt, Homo sapiens
aaggaaagcugugaagaca

SEQ ID NO: 1447876 - RNA, 19 nt, Homo sapiens
acaaauuggcucauucauu

SEQ ID NO: 1447877 - RNA, 19 nt, Homo sapiens
uaauggugcucauaauucu

SEQ ID NO: 1447878 - RNA, 19 nt, Homo sapiens
auaccuggaucuauuaugu

SEQ ID NO: 1447879 - RNA, 19 nt, Homo sapiens
ucacaaagcaaagaaagga

SEQ ID NO: 1447880 - RNA, 19 nt, Homo sapiens
gcuacuaugcuguguguga

SEQ ID NO: 1447881 - RNA, 19 nt, Homo sapiens
ucauccagguguaaauuau

SEQ ID NO: 1447882 - RNA, 19 nt, Homo sapiens
aagaugaugcuguuuggua

SEQ ID NO: 1447883 - RNA, 19 nt, Homo sapiens
accuggaucuauuauguua

SEQ ID NO: 1447884 - RNA, 19 nt, Homo sapiens
gcaagauuaauuagugaug

SEQ ID NO: 1447885 - RNA, 19 nt, Homo sapiens
ugaagaugaugcuguuugg

SEQ ID NO: 1447886 - RNA, 19 nt, Homo sapiens
gcuggugcccuuucuuuau

SEQ ID NO: 1447887 - RNA, 19 nt, Homo sapiens
cacacaagcaccgacauua

SEQ ID NO: 1447888 - RNA, 19 nt, Homo sapiens
acacaagcaccgacauuau

SEQ ID NO: 1447889 - RNA, 19 nt, Homo sapiens
gaauuucacaaagcaaaga

SEQ ID NO: 1447890 - RNA, 19 nt, Homo sapiens
ccaaucagaagcuccaaau

SEQ ID NO: 1447891 - RNA, 19 nt, Homo sapiens
guuggcaaucugauaguua

SEQ ID NO: 1447892 - RNA, 19 nt, Homo sapiens
agaacaggcaagauuaauu

SEQ ID NO: 1447893 - RNA, 19 nt, Homo sapiens
cuggaucuauuauguuaug

SEQ ID NO: 1447894 - RNA, 19 nt, Homo sapiens
ggagguugcucugucuucu

SEQ ID NO: 1447895 - RNA, 19 nt, Homo sapiens
ugugugauccacugagaua

SEQ ID NO: 1447896 - RNA, 19 nt, Homo sapiens
cacaagcaccgacauuaug

SEQ ID NO: 1447897 - RNA, 19 nt, Homo sapiens
uuaauggugcucauaauuc

SEQ ID NO: 1447898 - RNA, 19 nt, Homo sapiens
agguugcucugucuucuuu

SEQ ID NO: 1447899 - RNA, 19 nt, Homo sapiens
ugugauccacugagauaua

SEQ ID NO: 1447900 - RNA, 19 nt, Homo sapiens
ucacacaagcaccgacauu

SEQ ID NO: 1447901 - RNA, 19 nt, Homo sapiens
cacugaagaugaugcuguu

SEQ ID NO: 1447902 - RNA, 19 nt, Homo sapiens
acaaagcaaagaaaggaaa

SEQ ID NO: 1447903 - RNA, 19 nt, Homo sapiens
guuuaauggugcucauaau

SEQ ID NO: 1447904 - RNA, 19 nt, Homo sapiens
agauauaaagccaagauga

SEQ ID NO: 1447905 - RNA, 19 nt, Homo sapiens
aaagaaaggaaagcuguga

SEQ ID NO: 1447906 - RNA, 19 nt, Homo sapiens
ccgcuacuaugcugugugu

SEQ ID NO: 1447907 - RNA, 19 nt, Homo sapiens
ugucuuucaucuccauuga

SEQ ID NO: 1447908 - RNA, 19 nt, Homo sapiens
gaugaugcuguuugguaaa

SEQ ID NO: 1447909 - RNA, 19 nt, Homo sapiens
aggcaagauuaauuaguga

SEQ ID NO: 1447910 - RNA, 19 nt, Homo sapiens
caccuacuuugaaugaugu

SEQ ID NO: 1447911 - RNA, 19 nt, Homo sapiens
aaacaacuggucaaaugau

SEQ ID NO: 1447912 - RNA, 19 nt, Homo sapiens
gcucugucuucuuuagcaa

SEQ ID NO: 1447913 - RNA, 19 nt, Homo sapiens
uuggcaaucugauaguuau

SEQ ID NO: 1447914 - RNA, 19 nt, Homo sapiens
uaucacacuucaaacaacu

SEQ ID NO: 1447915 - RNA, 19 nt, Homo sapiens
ucaaaggcgcugaagagau

SEQ ID NO: 1447916 - RNA, 19 nt, Homo sapiens
gagcucagccuccauuuuc

SEQ ID NO: 1447917 - RNA, 19 nt, Homo sapiens
uuaauccaaugguuuaugc

SEQ ID NO: 1447918 - RNA, 19 nt, Homo sapiens
gaacucuacauuuaaucca

SEQ ID NO: 1447919 - RNA, 19 nt, Homo sapiens
aauggaauuucacaaagca

SEQ ID NO: 1447920 - RNA, 19 nt, Homo sapiens
caaucagaagcuccaaauu

SEQ ID NO: 1447921 - RNA, 19 nt, Homo sapiens
gagauauaaagccaagaug

SEQ ID NO: 1447922 - RNA, 19 nt, Homo sapiens
caacuggucaaaugauguc

SEQ ID NO: 1447923 - RNA, 19 nt, Homo sapiens
ggaauuucacaaagcaaag

SEQ ID NO: 1447924 - RNA, 19 nt, Homo sapiens
ugaucuuucuggagcuaaa

SEQ ID NO: 1447925 - RNA, 19 nt, Homo sapiens
ugagauauaaagccaagau

SEQ ID NO: 1447926 - RNA, 19 nt, Homo sapiens
gagcacuguugguauuuug

SEQ ID NO: 1447927 - RNA, 19 nt, Homo sapiens
gaugcuguuugguaaaauu

SEQ ID NO: 1447928 - RNA, 19 nt, Homo sapiens
cuucauaccccaacaaauu

SEQ ID NO: 1447929 - RNA, 19 nt, Homo sapiens
ucauaauucugaccacacu

SEQ ID NO: 1447930 - RNA, 19 nt, Homo sapiens
guuucuauaucacacuuca

SEQ ID NO: 1447931 - RNA, 19 nt, Homo sapiens
gcugaagagauauauuaca

SEQ ID NO: 1447932 - RNA, 19 nt, Homo sapiens
gauccacugagauauaaag

SEQ ID NO: 1447933 - RNA, 19 nt, Homo sapiens
cuacuaugcugugugugau

SEQ ID NO: 1447934 - RNA, 19 nt, Homo sapiens
cuauaucacacuucaaaca

SEQ ID NO: 1447935 - RNA, 19 nt, Homo sapiens
gcuacuugaacucuacauu

SEQ ID NO: 1447936 - RNA, 19 nt, Homo sapiens
gggauugugaugggaguuu

SEQ ID NO: 1447937 - RNA, 19 nt, Homo sapiens
aacaacuggucaaaugaug

SEQ ID NO: 1447938 - RNA, 19 nt, Homo sapiens
cauccagguguaaauuauu

SEQ ID NO: 1447939 - RNA, 19 nt, Homo sapiens
gugaagacauuggggauug

SEQ ID NO: 1447940 - RNA, 19 nt, Homo sapiens
caaagcaaagaaaggaaag

SEQ ID NO: 1447941 - RNA, 19 nt, Homo sapiens
guugcucugucuucuuuag

SEQ ID NO: 1447942 - RNA, 19 nt, Homo sapiens
ugauuugguuuggcuacuu

SEQ ID NO: 1447943 - RNA, 19 nt, Homo sapiens
gauguauugauuugguuug

SEQ ID NO: 1447944 - RNA, 19 nt, Homo sapiens
cuggugcccuuucuuuauc

SEQ ID NO: 1447945 - RNA, 19 nt, Homo sapiens
gaaauggacuauucaauug

SEQ ID NO: 1447946 - RNA, 19 nt, Homo sapiens
gaagaggccugccauacua

SEQ ID NO: 1447947 - RNA, 19 nt, Homo sapiens
gcagugauauguucugaaa

SEQ ID NO: 1447948 - RNA, 19 nt, Homo sapiens
gcuugaaguucgauuauua

SEQ ID NO: 1447949 - RNA, 19 nt, Homo sapiens
gcaaagaugucaaggaagu

SEQ ID NO: 1447950 - RNA, 19 nt, Homo sapiens
uaacaagcauugacaaaga

SEQ ID NO: 1447951 - RNA, 19 nt, Homo sapiens
ggaagaagaccuugcuuaa

SEQ ID NO: 1447952 - RNA, 19 nt, Homo sapiens
ccauugaacugucaucuaa

SEQ ID NO: 1447953 - RNA, 19 nt, Homo sapiens
gaacagugcuugucauugc

SEQ ID NO: 1447954 - RNA, 19 nt, Homo sapiens
cagcucaugucauuauuua

SEQ ID NO: 1447955 - RNA, 19 nt, Homo sapiens
gaaauuggcuguguuuuaa

SEQ ID NO: 1447956 - RNA, 19 nt, Homo sapiens
gcacaauguuccugaagaa

SEQ ID NO: 1447957 - RNA, 19 nt, Homo sapiens
ugacagagaagaacuauuu

SEQ ID NO: 1447958 - RNA, 19 nt, Homo sapiens
ucacggaguucaaguguaa

SEQ ID NO: 1447959 - RNA, 19 nt, Homo sapiens
ugcaauaacucuacaagua

SEQ ID NO: 1447960 - RNA, 19 nt, Homo sapiens
gauggcaccuugacuauau

SEQ ID NO: 1447961 - RNA, 19 nt, Homo sapiens
acacagacauuguagauga

SEQ ID NO: 1447962 - RNA, 19 nt, Homo sapiens
ggagguuugucauaugaua

SEQ ID NO: 1447963 - RNA, 19 nt, Homo sapiens
gaugacaccuuacacuuau

SEQ ID NO: 1447964 - RNA, 19 nt, Homo sapiens
gaacaacgcuaggaacagu

SEQ ID NO: 1447965 - RNA, 19 nt, Homo sapiens
ucauuggacuggauuauaa

SEQ ID NO: 1447966 - RNA, 19 nt, Homo sapiens
gcucaaaguuacccagaaa

SEQ ID NO: 1447967 - RNA, 19 nt, Homo sapiens
gaagaacuauuuggagaau

SEQ ID NO: 1447968 - RNA, 19 nt, Homo sapiens
gaucuccgcucuucauuuc

SEQ ID NO: 1447969 - RNA, 19 nt, Homo sapiens
gcuaaagacaucuaaagua

SEQ ID NO: 1447970 - RNA, 19 nt, Homo sapiens
guagaaauguugaaauugg

SEQ ID NO: 1447971 - RNA, 19 nt, Homo sapiens
gguacuauauugagguuaa

SEQ ID NO: 1447972 - RNA, 19 nt, Homo sapiens
ugagauaaaugauguggaa

SEQ ID NO: 1447973 - RNA, 19 nt, Homo sapiens
gaauaaagccauugaacug

SEQ ID NO: 1447974 - RNA, 19 nt, Homo sapiens
uaucaucucuuuagacaga

SEQ ID NO: 1447975 - RNA, 19 nt, Homo sapiens
gaaaaucccuacccuuuga

SEQ ID NO: 1447976 - RNA, 19 nt, Homo sapiens
gaaacaccauacccaaaug

SEQ ID NO: 1447977 - RNA, 19 nt, Homo sapiens
ucagaagucuugaaguuga

SEQ ID NO: 1447978 - RNA, 19 nt, Homo sapiens
gaacgagguaauauacaua

SEQ ID NO: 1447979 - RNA, 19 nt, Homo sapiens
gaagauacaucacuuuuca

SEQ ID NO: 1447980 - RNA, 19 nt, Homo sapiens
gaucauuccuguauuaaac

SEQ ID NO: 1447981 - RNA, 19 nt, Homo sapiens
gaaagagggcagaaacuug

SEQ ID NO: 1447982 - RNA, 19 nt, Homo sapiens
gaaccaccacaacaaauaa

SEQ ID NO: 1447983 - RNA, 19 nt, Homo sapiens
gacagaaacgucaagguua

SEQ ID NO: 1447984 - RNA, 19 nt, Homo sapiens
aagaagaccuugcuuaaca

SEQ ID NO: 1447985 - RNA, 19 nt, Homo sapiens
aaagaaagccgacuacaga

SEQ ID NO: 1447986 - RNA, 19 nt, Homo sapiens
acagaaauccagagacuua

SEQ ID NO: 1447987 - RNA, 19 nt, Homo sapiens
gugcaucgcuggaguuuca

SEQ ID NO: 1447988 - RNA, 19 nt, Homo sapiens
gcaauaacucuacaaguau

SEQ ID NO: 1447989 - RNA, 19 nt, Homo sapiens
uaugggaccucaaaucaaa

SEQ ID NO: 1447990 - RNA, 19 nt, Homo sapiens
guuaugaguugaccauuug

SEQ ID NO: 1447991 - RNA, 19 nt, Homo sapiens
aaaccaguaugcagugaua

SEQ ID NO: 1447992 - RNA, 19 nt, Homo sapiens
ccugggcacuauugaauua

SEQ ID NO: 1447993 - RNA, 19 nt, Homo sapiens
gugauaauguaccuuguuu

SEQ ID NO: 1447994 - RNA, 19 nt, Homo sapiens
guaauugugucuccaagug

SEQ ID NO: 1447995 - RNA, 19 nt, Homo sapiens
gcagagaaaggguuacauu

SEQ ID NO: 1447996 - RNA, 19 nt, Homo sapiens
ugaauacuguucuuuccua

SEQ ID NO: 1447997 - RNA, 19 nt, Homo sapiens
gaacucagacuggugcuuu

SEQ ID NO: 1447998 - RNA, 19 nt, Homo sapiens
ggauguucgucacugaaua

SEQ ID NO: 1447999 - RNA, 19 nt, Homo sapiens
gaauggugggcuuuaaaua

SEQ ID NO: 1448000 - RNA, 19 nt, Homo sapiens
gcauugcuaugguugacua

SEQ ID NO: 1448001 - RNA, 19 nt, Homo sapiens
uaaacagucuccagguuau

SEQ ID NO: 1448002 - RNA, 19 nt, Homo sapiens
ccagaaccaugcaaaccua

SEQ ID NO: 1448003 - RNA, 19 nt, Homo sapiens
gagaaaggguuacauuuug

SEQ ID NO: 1448004 - RNA, 19 nt, Homo sapiens
cagcuccaguuccugauua

SEQ ID NO: 1448005 - RNA, 19 nt, Homo sapiens
ggagaaccaccacaacaaa

SEQ ID NO: 1448006 - RNA, 19 nt, Homo sapiens
caaaguuacccagaaauaa

SEQ ID NO: 1448007 - RNA, 19 nt, Homo sapiens
auaguugacuuguguauga

SEQ ID NO: 1448008 - RNA, 19 nt, Homo sapiens
gaacugcggccauguuauc

SEQ ID NO: 1448009 - RNA, 19 nt, Homo sapiens
gggauucuuuaaaggcuua

SEQ ID NO: 1448010 - RNA, 19 nt, Homo sapiens
uaagaccucuguuggaugu

SEQ ID NO: 1448011 - RNA, 19 nt, Homo sapiens
guggagauauuguagcauu

SEQ ID NO: 1448012 - RNA, 19 nt, Homo sapiens
cugcaaagaugucaaggaa

SEQ ID NO: 1448013 - RNA, 19 nt, Homo sapiens
gaagauccauaugccauuc

SEQ ID NO: 1448014 - RNA, 19 nt, Homo sapiens
ucaaaguuacccagaaaua

SEQ ID NO: 1448015 - RNA, 19 nt, Homo sapiens
gugaaacguuuacucgaaa

SEQ ID NO: 1448016 - RNA, 19 nt, Homo sapiens
gaggaucgcugcaaaucuc

SEQ ID NO: 1448017 - RNA, 19 nt, Homo sapiens
guccaggaguagaauguua

SEQ ID NO: 1448018 - RNA, 19 nt, Homo sapiens
caaccagaauccaauaagu

SEQ ID NO: 1448019 - RNA, 19 nt, Homo sapiens
guaucugccuugccuguuu

SEQ ID NO: 1448020 - RNA, 19 nt, Homo sapiens
ggugggcuuuaaauaauaa

SEQ ID NO: 1448021 - RNA, 19 nt, Homo sapiens
aaacagcugucuuggacuu

SEQ ID NO: 1448022 - RNA, 19 nt, Homo sapiens
agucagaagucuugaaguu

SEQ ID NO: 1448023 - RNA, 19 nt, Homo sapiens
uggaguuguuggugaauua

SEQ ID NO: 1448024 - RNA, 19 nt, Homo sapiens
ccucagcccuggccuuuga

SEQ ID NO: 1448025 - RNA, 19 nt, Homo sapiens
gaaguaaucacagaaguca

SEQ ID NO: 1448026 - RNA, 19 nt, Homo sapiens
acaagaagauacaucacuu

SEQ ID NO: 1448027 - RNA, 19 nt, Homo sapiens
guuaucaucucuuuagaca

SEQ ID NO: 1448028 - RNA, 19 nt, Homo sapiens
cuggaucauuccuguauua

SEQ ID NO: 1448029 - RNA, 19 nt, Homo sapiens
gauauuguagcauugagua

SEQ ID NO: 1448030 - RNA, 19 nt, Homo sapiens
caggagguuugucauauga

SEQ ID NO: 1448031 - RNA, 19 nt, Homo sapiens
caguggagcugcaguaauc

SEQ ID NO: 1448032 - RNA, 19 nt, Homo sapiens
gagcuacucuuggauucuu

SEQ ID NO: 1448033 - RNA, 19 nt, Homo sapiens
guucgucacugaauacugu

SEQ ID NO: 1448034 - RNA, 19 nt, Homo sapiens
acaaagauaagaaguggua

SEQ ID NO: 1448035 - RNA, 19 nt, Homo sapiens
gaaaagcaagcaaaaguaa

SEQ ID NO: 1448036 - RNA, 19 nt, Homo sapiens
uaccacaggcugcuuaaua

SEQ ID NO: 1448037 - RNA, 19 nt, Homo sapiens
ggugcaaucuugagaaugg

SEQ ID NO: 1448038 - RNA, 19 nt, Homo sapiens
ucucauccaucuaccagua

SEQ ID NO: 1448039 - RNA, 19 nt, Homo sapiens
gcacugaacgagguaauau

SEQ ID NO: 1448040 - RNA, 19 nt, Homo sapiens
ugaugacaccuuacacuua

SEQ ID NO: 1448041 - RNA, 19 nt, Homo sapiens
guuaaaaggugcaaucuug

SEQ ID NO: 1448042 - RNA, 19 nt, Homo sapiens
ugacaaagaaucccgagaa

SEQ ID NO: 1448043 - RNA, 19 nt, Homo sapiens
gggcuugggugcucaaagu

SEQ ID NO: 1448044 - RNA, 19 nt, Homo sapiens
agaccuugcuuaacaguga

SEQ ID NO: 1448045 - RNA, 19 nt, Homo sapiens
gaagaaacauaaagugguu

SEQ ID NO: 1448046 - RNA, 19 nt, Homo sapiens
caacaagggcucuguauuu

SEQ ID NO: 1448047 - RNA, 19 nt, Homo sapiens
caaagaagcauauuggaaa

SEQ ID NO: 1448048 - RNA, 19 nt, Homo sapiens
gaaugucuguuuccuaaga

SEQ ID NO: 1448049 - RNA, 19 nt, Homo sapiens
gggaaggaauuauauaugu

SEQ ID NO: 1448050 - RNA, 19 nt, Homo sapiens
acacaaugaucucugauuu

SEQ ID NO: 1448051 - RNA, 19 nt, Homo sapiens
uaugagaggcuguuacuua

SEQ ID NO: 1448052 - RNA, 19 nt, Homo sapiens
aaggaaagaucaaguagaa

SEQ ID NO: 1448053 - RNA, 19 nt, Homo sapiens
gcagaacucuaaggaaaga

SEQ ID NO: 1448054 - RNA, 19 nt, Homo sapiens
ugacuuguuucaaugguua

SEQ ID NO: 1448055 - RNA, 19 nt, Homo sapiens
aauggaaucuugccucuaa

SEQ ID NO: 1448056 - RNA, 19 nt, Homo sapiens
ggaaacugcagaacucuaa

SEQ ID NO: 1448057 - RNA, 19 nt, Homo sapiens
agaauucacuguaauggaa

SEQ ID NO: 1448058 - RNA, 19 nt, Homo sapiens
ggaaggaauuauauaugug

SEQ ID NO: 1448059 - RNA, 19 nt, Homo sapiens
uuaguggccuuaaaucuuu

SEQ ID NO: 1448060 - RNA, 19 nt, Homo sapiens
cagcagcaacucaucauua

SEQ ID NO: 1448061 - RNA, 19 nt, Homo sapiens
gagaggcuguuacuuagug

SEQ ID NO: 1448062 - RNA, 19 nt, Homo sapiens
ccaccauucuguuccauuu

SEQ ID NO: 1448063 - RNA, 19 nt, Homo sapiens
gaaccuuuauuacugugaa

SEQ ID NO: 1448064 - RNA, 19 nt, Homo sapiens
cugaaugucuguuuccuaa

SEQ ID NO: 1448065 - RNA, 19 nt, Homo sapiens
cugcagaacucuaaggaaa

SEQ ID NO: 1448066 - RNA, 19 nt, Homo sapiens
ugucaagaguggaagauuu

SEQ ID NO: 1448067 - RNA, 19 nt, Homo sapiens
ggaucagcuuggcuucuua

SEQ ID NO: 1448068 - RNA, 19 nt, Homo sapiens
gagaaugaggaccuaauuu

SEQ ID NO: 1448069 - RNA, 19 nt, Homo sapiens
ggaaucuugccucuaauaa

SEQ ID NO: 1448070 - RNA, 19 nt, Homo sapiens
ucacugacuucacgaaugu

SEQ ID NO: 1448071 - RNA, 19 nt, Homo sapiens
gcugagggaaggaauuaua

SEQ ID NO: 1448072 - RNA, 19 nt, Homo sapiens
guauuuaggucccuuuuaa

SEQ ID NO: 1448073 - RNA, 19 nt, Homo sapiens
caccagagcccaaggacua

SEQ ID NO: 1448074 - RNA, 19 nt, Homo sapiens
gagggaaggaauuauauau

SEQ ID NO: 1448075 - RNA, 19 nt, Homo sapiens
ugaagccgcugccaaguca

SEQ ID NO: 1448076 - RNA, 19 nt, Homo sapiens
aaucuugccucuaauaaca

SEQ ID NO: 1448077 - RNA, 19 nt, Homo sapiens
gugggaaccuuuauuacug

SEQ ID NO: 1448078 - RNA, 19 nt, Homo sapiens
guagucaguuauaauagug

SEQ ID NO: 1448079 - RNA, 19 nt, Homo sapiens
aaguagaacugguugagaa

SEQ ID NO: 1448080 - RNA, 19 nt, Homo sapiens
ucacuguaauggaaucuug

SEQ ID NO: 1448081 - RNA, 19 nt, Homo sapiens
acauaaagugguucucuua

SEQ ID NO: 1448082 - RNA, 19 nt, Homo sapiens
cuugacaguucuauaguuu

SEQ ID NO: 1448083 - RNA, 19 nt, Homo sapiens
ggaaagaucaaguagaacu

SEQ ID NO: 1448084 - RNA, 19 nt, Homo sapiens
uuacugacuuguuucaaug

SEQ ID NO: 1448085 - RNA, 19 nt, Homo sapiens
guuacugacuuguuucaau

SEQ ID NO: 1448086 - RNA, 19 nt, Homo sapiens
cgacagcaccugcguguuc

SEQ ID NO: 1448087 - RNA, 19 nt, Homo sapiens
cucaguaaguagucaguua

SEQ ID NO: 1448088 - RNA, 19 nt, Homo sapiens
gugauacaguuaugugaau

SEQ ID NO: 1448089 - RNA, 19 nt, Homo sapiens
caacucaucauuaucuugu

SEQ ID NO: 1448090 - RNA, 19 nt, Homo sapiens
agaaugaggaccuaauuug

SEQ ID NO: 1448091 - RNA, 19 nt, Homo sapiens
gcuaucagaauucacugua

SEQ ID NO: 1448092 - RNA, 19 nt, Homo sapiens
cagcuuggcuucuuaucca

SEQ ID NO: 1448093 - RNA, 19 nt, Homo sapiens
cauaaagugguucucuuaa

SEQ ID NO: 1448094 - RNA, 19 nt, Homo sapiens
uuugaagcauugcaucuuu

SEQ ID NO: 1448095 - RNA, 19 nt, Homo sapiens
cagcaugaagugguauuua

SEQ ID NO: 1448096 - RNA, 19 nt, Homo sapiens
gaggauggguuuucauaug

SEQ ID NO: 1448097 - RNA, 19 nt, Homo sapiens
caugguaacuguuggaaaa

SEQ ID NO: 1448098 - RNA, 19 nt, Homo sapiens
cgagaaugaggaccuaauu

SEQ ID NO: 1448099 - RNA, 19 nt, Homo sapiens
cuaucagaauucacuguaa

SEQ ID NO: 1448100 - RNA, 19 nt, Homo sapiens
ucaaauuggcuaucagaau

SEQ ID NO: 1448101 - RNA, 19 nt, Homo sapiens
uaaucuugguucagcauga

SEQ ID NO: 1448102 - RNA, 19 nt, Homo sapiens
ugagggaaggaauuauaua

SEQ ID NO: 1448103 - RNA, 19 nt, Homo sapiens
ggcgacgucucgagguaaa

SEQ ID NO: 1448104 - RNA, 19 nt, Homo sapiens
cuucaaagauaucaaacca

SEQ ID NO: 1448105 - RNA, 19 nt, Homo sapiens
aaucuauccugaaagcuau

SEQ ID NO: 1448106 - RNA, 19 nt, Homo sapiens
aaaucuauccugaaagcua

SEQ ID NO: 1448107 - RNA, 19 nt, Homo sapiens
gaaagaucaaguagaacug

SEQ ID NO: 1448108 - RNA, 19 nt, Homo sapiens
ggccuuaaaucuuuucuga

SEQ ID NO: 1448109 - RNA, 19 nt, Homo sapiens
gaaaaugucaagaguggaa

SEQ ID NO: 1448110 - RNA, 19 nt, Homo sapiens
gaaugaggaccuaauuugc

SEQ ID NO: 1448111 - RNA, 19 nt, Homo sapiens
ucuaaggaaagaucaagua

SEQ ID NO: 1448112 - RNA, 19 nt, Homo sapiens
cagcaacucaucauuaucu

SEQ ID NO: 1448113 - RNA, 19 nt, Homo sapiens
agaauaccauacuacacaa

SEQ ID NO: 1448114 - RNA, 19 nt, Homo sapiens
ccacuugcaccuucauguu

SEQ ID NO: 1448115 - RNA, 19 nt, Homo sapiens
gcaacucaucauuaucuug

SEQ ID NO: 1448116 - RNA, 19 nt, Homo sapiens
acaaugaucucugauuuug

SEQ ID NO: 1448117 - RNA, 19 nt, Homo sapiens
aagaauaccauacuacaca

SEQ ID NO: 1448118 - RNA, 19 nt, Homo sapiens
gaacucuaaggaaagauca

SEQ ID NO: 1448119 - RNA, 19 nt, Homo sapiens
auaccauacuacacaauga

SEQ ID NO: 1448120 - RNA, 19 nt, Homo sapiens
caguaaguagucaguuaua

SEQ ID NO: 1448121 - RNA, 19 nt, Homo sapiens
agcagcaacucaucauuau

SEQ ID NO: 1448122 - RNA, 19 nt, Homo sapiens
uaaggaaagaucaaguaga

SEQ ID NO: 1448123 - RNA, 19 nt, Homo sapiens
ucaacaagggcucuguauu

SEQ ID NO: 1448124 - RNA, 19 nt, Homo sapiens
cgaaugugaggauggguuu

SEQ ID NO: 1448125 - RNA, 19 nt, Homo sapiens
uugagaacaugguaacugu

SEQ ID NO: 1448126 - RNA, 19 nt, Homo sapiens
aaagaagcauauuggaaac

SEQ ID NO: 1448127 - RNA, 19 nt, Homo sapiens
uggaaucuugccucuaaua

SEQ ID NO: 1448128 - RNA, 19 nt, Homo sapiens
auaaaucuauccugaaagc

SEQ ID NO: 1448129 - RNA, 19 nt, Homo sapiens
uuugugggaaccuuuauua

SEQ ID NO: 1448130 - RNA, 19 nt, Homo sapiens
uuacuuaguggccuuaaau

SEQ ID NO: 1448131 - RNA, 19 nt, Homo sapiens
guuacuuaguggccuuaaa

SEQ ID NO: 1448132 - RNA, 19 nt, Homo sapiens
gaucagcuuggcuucuuau

SEQ ID NO: 1448133 - RNA, 19 nt, Homo sapiens
uaucaaauuggcuaucaga

SEQ ID NO: 1448134 - RNA, 19 nt, Homo sapiens
guacuuugugggaaccuuu

SEQ ID NO: 1448135 - RNA, 19 nt, Homo sapiens
ucuugccucuaauaacaua

SEQ ID NO: 1448136 - RNA, 19 nt, Homo sapiens
uuauuacugugaaggagaa

SEQ ID NO: 1448137 - RNA, 19 nt, Homo sapiens
acuacacaaugaucucuga

SEQ ID NO: 1448138 - RNA, 19 nt, Homo sapiens
uggaucagcuuggcuucuu

SEQ ID NO: 1448139 - RNA, 19 nt, Homo sapiens
uagaacugguugagaacau

SEQ ID NO: 1448140 - RNA, 19 nt, Homo sapiens
aacauaaagugguucucuu

SEQ ID NO: 1448141 - RNA, 19 nt, Homo sapiens
gaaucuugccucuaauaac

SEQ ID NO: 1448142 - RNA, 19 nt, Homo sapiens
ucuugacaguucuauaguu

SEQ ID NO: 1448143 - RNA, 19 nt, Homo sapiens
ucaguaaguagucaguuau

SEQ ID NO: 1448144 - RNA, 19 nt, Homo sapiens
agaagcauauuggaaacug

SEQ ID NO: 1448145 - RNA, 19 nt, Homo sapiens
aaaggacgcuguauugauu

SEQ ID NO: 1448146 - RNA, 19 nt, Homo sapiens
gagcugaggucgcgccauu

SEQ ID NO: 1448147 - RNA, 19 nt, Homo sapiens
gagaccagccugaccaaua

SEQ ID NO: 1448148 - RNA, 19 nt, Homo sapiens
ggccuuuacuucaucauuu

SEQ ID NO: 1448149 - RNA, 19 nt, Homo sapiens
caucgaggcuucccugguu

SEQ ID NO: 1448150 - RNA, 19 nt, Homo sapiens
uaugauggcuuuggaagaa

SEQ ID NO: 1448151 - RNA, 19 nt, Homo sapiens
gcccagaaccuacccgaua

SEQ ID NO: 1448152 - RNA, 19 nt, Homo sapiens
gaaaauaugcugcuguaaa

SEQ ID NO: 1448153 - RNA, 19 nt, Homo sapiens
ggauucccauuuagagaaa

SEQ ID NO: 1448154 - RNA, 19 nt, Homo sapiens
ugaccaauauggagaaauc

SEQ ID NO: 1448155 - RNA, 19 nt, Homo sapiens
gagaaagaaccacuggaaa

SEQ ID NO: 1448156 - RNA, 19 nt, Homo sapiens
agaccagccugaccaauau

SEQ ID NO: 1448157 - RNA, 19 nt, Homo sapiens
gaaaacaaguucuucucaa

SEQ ID NO: 1448158 - RNA, 19 nt, Homo sapiens
gacaagguuucaccauguu

SEQ ID NO: 1448159 - RNA, 19 nt, Homo sapiens
gagcgaaacuccgucucaa

SEQ ID NO: 1448160 - RNA, 19 nt, Homo sapiens
aggcuucccugguugcuua

SEQ ID NO: 1448161 - RNA, 19 nt, Homo sapiens
agacaagguuucaccaugu

SEQ ID NO: 1448162 - RNA, 19 nt, Homo sapiens
accagaggauucccauuua

SEQ ID NO: 1448163 - RNA, 19 nt, Homo sapiens
cauugcgccuggcuaauuu

SEQ ID NO: 1448164 - RNA, 19 nt, Homo sapiens
caccagaggauucccauuu

SEQ ID NO: 1448165 - RNA, 19 nt, Homo sapiens
uuacagacacccaccauug

SEQ ID NO: 1448166 - RNA, 19 nt, Homo sapiens
gcaggagaauggcuugaac

SEQ ID NO: 1448167 - RNA, 19 nt, Homo sapiens
gcaccuguaaucccaacua

SEQ ID NO: 1448168 - RNA, 19 nt, Homo sapiens
ccagaggauucccauuuag

SEQ ID NO: 1448169 - RNA, 19 nt, Homo sapiens
uuaauccagugaccaaaga

SEQ ID NO: 1448170 - RNA, 19 nt, Homo sapiens
ccaaagugcugggauugca

SEQ ID NO: 1448171 - RNA, 19 nt, Homo sapiens
ggaguggaguggcgcuauc

SEQ ID NO: 1448172 - RNA, 19 nt, Homo sapiens
uauauaugauggcuuugga

SEQ ID NO: 1448173 - RNA, 19 nt, Homo sapiens
cccagaaccuacccgauau

SEQ ID NO: 1448174 - RNA, 19 nt, Homo sapiens
gcuguaggccuuuacuuca

SEQ ID NO: 1448175 - RNA, 19 nt, Homo sapiens
guggagagcggcaagauca

SEQ ID NO: 1448176 - RNA, 19 nt, Homo sapiens
cugaauauguacaucugaa

SEQ ID NO: 1448177 - RNA, 19 nt, Homo sapiens
agagaaagaaccacuggaa

SEQ ID NO: 1448178 - RNA, 19 nt, Homo sapiens
gaaaaggacgcuguauuga

SEQ ID NO: 1448179 - RNA, 19 nt, Homo sapiens
cgaaaaggacgcuguauug

SEQ ID NO: 1448180 - RNA, 19 nt, Homo sapiens
aacaaguucuucucaagga

SEQ ID NO: 1448181 - RNA, 19 nt, Homo sapiens
gaucaccccuucuguguca

SEQ ID NO: 1448182 - RNA, 19 nt, Homo sapiens
gaacgaaaaggacgcugua

SEQ ID NO: 1448183 - RNA, 19 nt, Homo sapiens
gaggauucccauuuagaga

SEQ ID NO: 1448184 - RNA, 19 nt, Homo sapiens
uuagagcuguaggccuuua

SEQ ID NO: 1448185 - RNA, 19 nt, Homo sapiens
ccauugcgccuggcuaauu

SEQ ID NO: 1448186 - RNA, 19 nt, Homo sapiens
cugaguagcugggauuaca

SEQ ID NO: 1448187 - RNA, 19 nt, Homo sapiens
aagaaaauaugcugcugua

SEQ ID NO: 1448188 - RNA, 19 nt, Homo sapiens
gauaggaaagggaaaauau

SEQ ID NO: 1448189 - RNA, 19 nt, Homo sapiens
cagaggauucccauuuaga

SEQ ID NO: 1448190 - RNA, 19 nt, Homo sapiens
gcgaaacuccgucucaaaa

SEQ ID NO: 1448191 - RNA, 19 nt, Homo sapiens
aaucucgccuuugcugaaa

SEQ ID NO: 1448192 - RNA, 19 nt, Homo sapiens
ucgcauauucuuuaacuuc

SEQ ID NO: 1448193 - RNA, 19 nt, Homo sapiens
cgcauauucuuuaacuuca

SEQ ID NO: 1448194 - RNA, 19 nt, Homo sapiens
gaugauguuaauccaguga

SEQ ID NO: 1448195 - RNA, 19 nt, Homo sapiens
caccauugcgccuggcuaa

SEQ ID NO: 1448196 - RNA, 19 nt, Homo sapiens
ggaaaacaaguucuucuca

SEQ ID NO: 1448197 - RNA, 19 nt, Homo sapiens
agaaagaaccacuggaaaa

SEQ ID NO: 1448198 - RNA, 19 nt, Homo sapiens
guaggccuuuacuucauca

SEQ ID NO: 1448199 - RNA, 19 nt, Homo sapiens
gaguagcugggauuacaga

SEQ ID NO: 1448200 - RNA, 19 nt, Homo sapiens
uccuuuaugucguguaguu

SEQ ID NO: 1448201 - RNA, 19 nt, Homo sapiens
acaagguuucaccauguua

SEQ ID NO: 1448202 - RNA, 19 nt, Homo sapiens
aagccgauguuaccagaag

SEQ ID NO: 1448203 - RNA, 19 nt, Homo sapiens
gagcuguaggccuuuacuu

SEQ ID NO: 1448204 - RNA, 19 nt, Homo sapiens
aaaucucgccuuugcugaa

SEQ ID NO: 1448205 - RNA, 19 nt, Homo sapiens
agucgcauauucuuuaacu

SEQ ID NO: 1448206 - RNA, 19 nt, Homo sapiens
gcaccagaggauucccauu

SEQ ID NO: 1448207 - RNA, 19 nt, Homo sapiens
gcccagccuagaaaugauu

SEQ ID NO: 1448208 - RNA, 19 nt, Homo sapiens
caagguuucaccauguuag

SEQ ID NO: 1448209 - RNA, 19 nt, Homo sapiens
aaaacaaguucuucucaag

SEQ ID NO: 1448210 - RNA, 19 nt, Homo sapiens
uauccuuuaugucguguag

SEQ ID NO: 1448211 - RNA, 19 nt, Homo sapiens
gagaauaucugucuucauu

SEQ ID NO: 1448212 - RNA, 19 nt, Homo sapiens
caaauggacuuucugaaua

SEQ ID NO: 1448213 - RNA, 19 nt, Homo sapiens
gaaucuagguggugaauuu

SEQ ID NO: 1448214 - RNA, 19 nt, Homo sapiens
uaucagaggugaagaauuu

SEQ ID NO: 1448215 - RNA, 19 nt, Homo sapiens
gaaggaagcuuugaauaug

SEQ ID NO: 1448216 - RNA, 19 nt, Homo sapiens
gaagugaaguuucgcauug

SEQ ID NO: 1448217 - RNA, 19 nt, Homo sapiens
gaagagugauucauaguga

SEQ ID NO: 1448218 - RNA, 19 nt, Homo sapiens
gaaagaagcuggguuugug

SEQ ID NO: 1448219 - RNA, 19 nt, Homo sapiens
gaaccuagauucuuaagca

SEQ ID NO: 1448220 - RNA, 19 nt, Homo sapiens
gaacuuuggcugugauuua

SEQ ID NO: 1448221 - RNA, 19 nt, Homo sapiens
agaaacaacugacagauaa

SEQ ID NO: 1448222 - RNA, 19 nt, Homo sapiens
caacauggguuacaggauu

SEQ ID NO: 1448223 - RNA, 19 nt, Homo sapiens
ugaagaaaguggaauauga

SEQ ID NO: 1448224 - RNA, 19 nt, Homo sapiens
uaacuucucuccugggaua

SEQ ID NO: 1448225 - RNA, 19 nt, Homo sapiens
ugaaugaccagacauauua

SEQ ID NO: 1448226 - RNA, 19 nt, Homo sapiens
uaaaggcucugucugaauu

SEQ ID NO: 1448227 - RNA, 19 nt, Homo sapiens
gcacuaauguguucuucaa

SEQ ID NO: 1448228 - RNA, 19 nt, Homo sapiens
gcacuugguugucagcuuu

SEQ ID NO: 1448229 - RNA, 19 nt, Homo sapiens
gaacauacacuuggcuuaa

SEQ ID NO: 1448230 - RNA, 19 nt, Homo sapiens
aguaaaggcugaaggaaua

SEQ ID NO: 1448231 - RNA, 19 nt, Homo sapiens
gaacagugcagaugagauu

SEQ ID NO: 1448232 - RNA, 19 nt, Homo sapiens
gaagguaacucgugcugau

SEQ ID NO: 1448233 - RNA, 19 nt, Homo sapiens
gcaguugugugucuauauu

SEQ ID NO: 1448234 - RNA, 19 nt, Homo sapiens
gacaauaggcuacagagua

SEQ ID NO: 1448235 - RNA, 19 nt, Homo sapiens
gcaaccaacugacucuuga

SEQ ID NO: 1448236 - RNA, 19 nt, Homo sapiens
caagaaauguaagcacuaa

SEQ ID NO: 1448237 - RNA, 19 nt, Homo sapiens
ugacaugacugcugaccua

SEQ ID NO: 1448238 - RNA, 19 nt, Homo sapiens
ggaguuaagcuauauggua

SEQ ID NO: 1448239 - RNA, 19 nt, Homo sapiens
ccuagauucuuaagcauua

SEQ ID NO: 1448240 - RNA, 19 nt, Homo sapiens
ugaaagaaaugaaccuaga

SEQ ID NO: 1448241 - RNA, 19 nt, Homo sapiens
agaaauagcuugggugguu

SEQ ID NO: 1448242 - RNA, 19 nt, Homo sapiens
agacauacauccaacuaaa

SEQ ID NO: 1448243 - RNA, 19 nt, Homo sapiens
ccagacauauuaucaauca

SEQ ID NO: 1448244 - RNA, 19 nt, Homo sapiens
agacgaagaucuauccaaa

SEQ ID NO: 1448245 - RNA, 19 nt, Homo sapiens
gaaaugaaccuagauucuu

SEQ ID NO: 1448246 - RNA, 19 nt, Homo sapiens
ugaagccgauccuuacaua

SEQ ID NO: 1448247 - RNA, 19 nt, Homo sapiens
caacacaucugggagaaau

SEQ ID NO: 1448248 - RNA, 19 nt, Homo sapiens
ccagugagcuacaguugaa

SEQ ID NO: 1448249 - RNA, 19 nt, Homo sapiens
aauggaagcuguucagaaa

SEQ ID NO: 1448250 - RNA, 19 nt, Homo sapiens
caucaucacucuucaguca

SEQ ID NO: 1448251 - RNA, 19 nt, Homo sapiens
gacaggcggugagaaguua

SEQ ID NO: 1448252 - RNA, 19 nt, Homo sapiens
gaaaguaucagccuaacau

SEQ ID NO: 1448253 - RNA, 19 nt, Homo sapiens
ccacugagguuaagguaau

SEQ ID NO: 1448254 - RNA, 19 nt, Homo sapiens
gaaauagcuugggugguuu

SEQ ID NO: 1448255 - RNA, 19 nt, Homo sapiens
gaaugccucuaaugauauu

SEQ ID NO: 1448256 - RNA, 19 nt, Homo sapiens
guaauggauucuucaaaug

SEQ ID NO: 1448257 - RNA, 19 nt, Homo sapiens
ggaagcagaaggagucuuu

SEQ ID NO: 1448258 - RNA, 19 nt, Homo sapiens
gaauguguguacaagcuuu

SEQ ID NO: 1448259 - RNA, 19 nt, Homo sapiens
gaggaaaugugacuauugg

SEQ ID NO: 1448260 - RNA, 19 nt, Homo sapiens
aaucuucccuacucuguua

SEQ ID NO: 1448261 - RNA, 19 nt, Homo sapiens
gaccagacauauuaucaau

SEQ ID NO: 1448262 - RNA, 19 nt, Homo sapiens
gcagaaggagucuuugaaa

SEQ ID NO: 1448263 - RNA, 19 nt, Homo sapiens
ugauuuagauguugcugua

SEQ ID NO: 1448264 - RNA, 19 nt, Homo sapiens
caagaagccuuugauuuag

SEQ ID NO: 1448265 - RNA, 19 nt, Homo sapiens
gaagaucuauccaaaauca

SEQ ID NO: 1448266 - RNA, 19 nt, Homo sapiens
cauuucagguuucagaaua

SEQ ID NO: 1448267 - RNA, 19 nt, Homo sapiens
aaacagacaaggccuuaua

SEQ ID NO: 1448268 - RNA, 19 nt, Homo sapiens
ccaguggucucaguagaua

SEQ ID NO: 1448269 - RNA, 19 nt, Homo sapiens
cgaaggaagcuuugaauau

SEQ ID NO: 1448270 - RNA, 19 nt, Homo sapiens
ugacuggucuauucaaguu

SEQ ID NO: 1448271 - RNA, 19 nt, Homo sapiens
agagagcacugcaauaugu

SEQ ID NO: 1448272 - RNA, 19 nt, Homo sapiens
caacagguccuagcaugua

SEQ ID NO: 1448273 - RNA, 19 nt, Homo sapiens
gaagaaaguggaauaugau

SEQ ID NO: 1448274 - RNA, 19 nt, Homo sapiens
uggcauggcucuuauggaa

SEQ ID NO: 1448275 - RNA, 19 nt, Homo sapiens
gcacugcucucacacuucu

SEQ ID NO: 1448276 - RNA, 19 nt, Homo sapiens
guagaggaauuucagacaa

SEQ ID NO: 1448277 - RNA, 19 nt, Homo sapiens
gcaagagucuauccauuuu

SEQ ID NO: 1448278 - RNA, 19 nt, Homo sapiens
ccaggaagagugauucaua

SEQ ID NO: 1448279 - RNA, 19 nt, Homo sapiens
gaggcaagguuaccagaga

SEQ ID NO: 1448280 - RNA, 19 nt, Homo sapiens
ugaagaauuugcuuuggaa

SEQ ID NO: 1448281 - RNA, 19 nt, Homo sapiens
gacacagccugacuccaua

SEQ ID NO: 1448282 - RNA, 19 nt, Homo sapiens
aaauggaucugcaaacuuc

SEQ ID NO: 1448283 - RNA, 19 nt, Homo sapiens
ugaaguaacuguaccugau

SEQ ID NO: 1448284 - RNA, 19 nt, Homo sapiens
augaaugccucuaaugaua

SEQ ID NO: 1448285 - RNA, 19 nt, Homo sapiens
cagccacgcucccuggaua

SEQ ID NO: 1448286 - RNA, 19 nt, Homo sapiens
gaaagaugccacugagguu

SEQ ID NO: 1448287 - RNA, 19 nt, Homo sapiens
ccaauggcaguuaauauuu

SEQ ID NO: 1448288 - RNA, 19 nt, Homo sapiens
gggccuagcucaccaaguc

SEQ ID NO: 1448289 - RNA, 19 nt, Homo sapiens
ucagaucacugcaauugga

SEQ ID NO: 1448290 - RNA, 19 nt, Homo sapiens
gaaguaacuguaccugauu

SEQ ID NO: 1448291 - RNA, 19 nt, Homo sapiens
cagaaucaguuacagguau

SEQ ID NO: 1448292 - RNA, 19 nt, Homo sapiens
gccaugggcuccaaagaau

SEQ ID NO: 1448293 - RNA, 19 nt, Homo sapiens
acacuaacauuuccaguag

SEQ ID NO: 1448294 - RNA, 19 nt, Homo sapiens
ggaguggcauggcucuuau

SEQ ID NO: 1448295 - RNA, 19 nt, Homo sapiens
acaagaagguggcaugcaa

SEQ ID NO: 1448296 - RNA, 19 nt, Homo sapiens
guugucagcuuuuguuuua

SEQ ID NO: 1448297 - RNA, 19 nt, Homo sapiens
ggucuuggacuaacaacua

SEQ ID NO: 1448298 - RNA, 19 nt, Homo sapiens
ccacauguccgaaagcauu

SEQ ID NO: 1448299 - RNA, 19 nt, Homo sapiens
ucacgaaggauuauauuga

SEQ ID NO: 1448300 - RNA, 19 nt, Homo sapiens
gcagacaccauuauauugu

SEQ ID NO: 1448301 - RNA, 19 nt, Homo sapiens
caagcaacaugauuacauc

SEQ ID NO: 1448302 - RNA, 19 nt, Homo sapiens
guuacacucuucucagauu

SEQ ID NO: 1448303 - RNA, 19 nt, Homo sapiens
uagcauguauagcugcaua

SEQ ID NO: 1448304 - RNA, 19 nt, Homo sapiens
ggaauaugaucauggaaaa

SEQ ID NO: 1448305 - RNA, 19 nt, Homo sapiens
gcauggcucuuauggaagu

SEQ ID NO: 1448306 - RNA, 19 nt, Homo sapiens
caauggcaguuaauauuuc

SEQ ID NO: 1448307 - RNA, 19 nt, Homo sapiens
cuaagcaggcaaagaaaua

SEQ ID NO: 1448308 - RNA, 19 nt, Homo sapiens
ucacacuucuuacaauuuc

SEQ ID NO: 1448309 - RNA, 19 nt, Homo sapiens
gcgaaggaagcuuugaaua

SEQ ID NO: 1448310 - RNA, 19 nt, Homo sapiens
ugaaggacauauuguagau

SEQ ID NO: 1448311 - RNA, 19 nt, Homo sapiens
ggacaaaguucuguauaua

SEQ ID NO: 1448312 - RNA, 19 nt, Homo sapiens
gaauacaucuuguuucuga

SEQ ID NO: 1448313 - RNA, 19 nt, Homo sapiens
ucacauagaucuagucuga

SEQ ID NO: 1448314 - RNA, 19 nt, Homo sapiens
uaaaguggcugguuaauuc

SEQ ID NO: 1448315 - RNA, 19 nt, Homo sapiens
gguaaaguguuaaggaaua

SEQ ID NO: 1448316 - RNA, 19 nt, Homo sapiens
ggaccuggcuacguaauua

SEQ ID NO: 1448317 - RNA, 19 nt, Homo sapiens
uaaaugaccucagaucuuu

SEQ ID NO: 1448318 - RNA, 19 nt, Homo sapiens
gaaagaacccucaaucaga

SEQ ID NO: 1448319 - RNA, 19 nt, Homo sapiens
gagagaaggugaaauaaag

SEQ ID NO: 1448320 - RNA, 19 nt, Homo sapiens
gcagaagccugucaucaga

SEQ ID NO: 1448321 - RNA, 19 nt, Homo sapiens
agacacagguugcagguua

SEQ ID NO: 1448322 - RNA, 19 nt, Homo sapiens
ggagaucaguaauuacaaa

SEQ ID NO: 1448323 - RNA, 19 nt, Homo sapiens
gaaacaggauaugcuuuaa

SEQ ID NO: 1448324 - RNA, 19 nt, Homo sapiens
caagagaggugcuaucaca

SEQ ID NO: 1448325 - RNA, 19 nt, Homo sapiens
guccaaugcuucacuguua

SEQ ID NO: 1448326 - RNA, 19 nt, Homo sapiens
ggucagcaguggaguuuaa

SEQ ID NO: 1448327 - RNA, 19 nt, Homo sapiens
caacaucucuugagugucu

SEQ ID NO: 1448328 - RNA, 19 nt, Homo sapiens
gaagcuaccugcuaugagu

SEQ ID NO: 1448329 - RNA, 19 nt, Homo sapiens
uaacugugcuuguugaaug

SEQ ID NO: 1448330 - RNA, 19 nt, Homo sapiens
gugaggcccuuauauaauu

SEQ ID NO: 1448331 - RNA, 19 nt, Homo sapiens
gaugcucaccucuauauua

SEQ ID NO: 1448332 - RNA, 19 nt, Homo sapiens
gcuaacaaguuugagcuua

SEQ ID NO: 1448333 - RNA, 19 nt, Homo sapiens
ggacauguacugagacaaa

SEQ ID NO: 1448334 - RNA, 19 nt, Homo sapiens
caaauaaacucaggcuguu

SEQ ID NO: 1448335 - RNA, 19 nt, Homo sapiens
gaagggauuuaaagggaaa

SEQ ID NO: 1448336 - RNA, 19 nt, Homo sapiens
gggaggaccuguuguguuc

SEQ ID NO: 1448337 - RNA, 19 nt, Homo sapiens
uuaagagccuucaauugua

SEQ ID NO: 1448338 - RNA, 19 nt, Homo sapiens
gcagugcaguuuaagcaaa

SEQ ID NO: 1448339 - RNA, 19 nt, Homo sapiens
gaacugaggcaucgcgaaa

SEQ ID NO: 1448340 - RNA, 19 nt, Homo sapiens
cuaaauacguccaccaaga

SEQ ID NO: 1448341 - RNA, 19 nt, Homo sapiens
ggaaauaguucaguaucug

SEQ ID NO: 1448342 - RNA, 19 nt, Homo sapiens
ucgaugagguuccauguuu

SEQ ID NO: 1448343 - RNA, 19 nt, Homo sapiens
cccaggagaucaguaauua

SEQ ID NO: 1448344 - RNA, 19 nt, Homo sapiens
acagagugauuguaguuua

SEQ ID NO: 1448345 - RNA, 19 nt, Homo sapiens
uauaacaccuuaacaguca

SEQ ID NO: 1448346 - RNA, 19 nt, Homo sapiens
caaaggagccacuucagaa

SEQ ID NO: 1448347 - RNA, 19 nt, Homo sapiens
gacaagaggcugagguuaa

SEQ ID NO: 1448348 - RNA, 19 nt, Homo sapiens
gaauggagaauacaucuug

SEQ ID NO: 1448349 - RNA, 19 nt, Homo sapiens
uaugucaugucuuccauua

SEQ ID NO: 1448350 - RNA, 19 nt, Homo sapiens
gcucaccucuauauuaguu

SEQ ID NO: 1448351 - RNA, 19 nt, Homo sapiens
caccaagccuguuugcuaa

SEQ ID NO: 1448352 - RNA, 19 nt, Homo sapiens
ccacuaaggugaccagagu

SEQ ID NO: 1448353 - RNA, 19 nt, Homo sapiens
acacuuuccucuucuauga

SEQ ID NO: 1448354 - RNA, 19 nt, Homo sapiens
caaaauaggugaggggaua

SEQ ID NO: 1448355 - RNA, 19 nt, Homo sapiens
cuaacaaguuugagcuuaa

SEQ ID NO: 1448356 - RNA, 19 nt, Homo sapiens
ggaaaccucagagcuauaa

SEQ ID NO: 1448357 - RNA, 19 nt, Homo sapiens
ggagaaaggaggagacaga

SEQ ID NO: 1448358 - RNA, 19 nt, Homo sapiens
gauaguaguggcucgauuu

SEQ ID NO: 1448359 - RNA, 19 nt, Homo sapiens
gaauuagguuucuuugaag

SEQ ID NO: 1448360 - RNA, 19 nt, Homo sapiens
ggaaguaugucaucaacac

SEQ ID NO: 1448361 - RNA, 19 nt, Homo sapiens
guucgaagccacuauguaa

SEQ ID NO: 1448362 - RNA, 19 nt, Homo sapiens
cagagugauuguaguuuaa

SEQ ID NO: 1448363 - RNA, 19 nt, Homo sapiens
ggauaugcuuuaagacaga

SEQ ID NO: 1448364 - RNA, 19 nt, Homo sapiens
caagggacuuugcuaacuu

SEQ ID NO: 1448365 - RNA, 19 nt, Homo sapiens
gaaacacucucugaagaag

SEQ ID NO: 1448366 - RNA, 19 nt, Homo sapiens
agaaacaggauaugcuuua

SEQ ID NO: 1448367 - RNA, 19 nt, Homo sapiens
acacaaugauuaacaggaa

SEQ ID NO: 1448368 - RNA, 19 nt, Homo sapiens
gcuauaaaguggagugaca

SEQ ID NO: 1448369 - RNA, 19 nt, Homo sapiens
gaaggagucgguugucuau

SEQ ID NO: 1448370 - RNA, 19 nt, Homo sapiens
gcaaaggagccacuucaga

SEQ ID NO: 1448371 - RNA, 19 nt, Homo sapiens
ggucaucucuccugugucu

SEQ ID NO: 1448372 - RNA, 19 nt, Homo sapiens
gcaguauucacaugcuuua

SEQ ID NO: 1448373 - RNA, 19 nt, Homo sapiens
ggaaugcccugaaacuacu

SEQ ID NO: 1448374 - RNA, 19 nt, Homo sapiens
ccagacagauagugaaaca

SEQ ID NO: 1448375 - RNA, 19 nt, Homo sapiens
aaacauaagcuaccugaau

SEQ ID NO: 1448376 - RNA, 19 nt, Homo sapiens
ugagguggauuuacugaga

SEQ ID NO: 1448377 - RNA, 19 nt, Homo sapiens
ucaccaagccuguuugcua

SEQ ID NO: 1448378 - RNA, 19 nt, Homo sapiens
agaauggucucaguguuaa

SEQ ID NO: 1448379 - RNA, 19 nt, Homo sapiens
uaagaauggucucaguguu

SEQ ID NO: 1448380 - RNA, 19 nt, Homo sapiens
ggacaagaggcugagguua

SEQ ID NO: 1448381 - RNA, 19 nt, Homo sapiens
gauaauacugucuaggaaa

SEQ ID NO: 1448382 - RNA, 19 nt, Homo sapiens
gagugaaacugcgauacaa

SEQ ID NO: 1448383 - RNA, 19 nt, Homo sapiens
gggcagcucuguccaaugc

SEQ ID NO: 1448384 - RNA, 19 nt, Homo sapiens
aagaauggucucaguguua

SEQ ID NO: 1448385 - RNA, 19 nt, Homo sapiens
acagggaaauaguucagua

SEQ ID NO: 1448386 - RNA, 19 nt, Homo sapiens
gaccagaaccgugaacuga

SEQ ID NO: 1448387 - RNA, 19 nt, Homo sapiens
ggaagagcauaguguuugg

SEQ ID NO: 1448388 - RNA, 19 nt, Homo sapiens
gugguaaaguguuaaggaa

SEQ ID NO: 1448389 - RNA, 19 nt, Homo sapiens
ugaggcccuuauauaauua

SEQ ID NO: 1448390 - RNA, 19 nt, Homo sapiens
caacagagagggagaaagg

SEQ ID NO: 1448391 - RNA, 19 nt, Homo sapiens
ggagaaucuuacagaguga

SEQ ID NO: 1448392 - RNA, 19 nt, Homo sapiens
uaagagccuucaauuguag

SEQ ID NO: 1448393 - RNA, 19 nt, Homo sapiens
ccagcucgcacuugacuua

SEQ ID NO: 1448394 - RNA, 19 nt, Homo sapiens
uaaauacguccaccaagaa

SEQ ID NO: 1448395 - RNA, 19 nt, Homo sapiens
ugaugaagcuaccugcuau

SEQ ID NO: 1448396 - RNA, 19 nt, Homo sapiens
gccgaugacuugcagaaug

SEQ ID NO: 1448397 - RNA, 19 nt, Homo sapiens
ucacaugcuuuaaacugaa

SEQ ID NO: 1448398 - RNA, 19 nt, Homo sapiens
uaacugaggcuuagaaagg

SEQ ID NO: 1448399 - RNA, 19 nt, Homo sapiens
aguuugagcuuaauaccua

SEQ ID NO: 1448400 - RNA, 19 nt, Homo sapiens
gaaacuacuguaucugaug

SEQ ID NO: 1448401 - RNA, 19 nt, Homo sapiens
ugaaguaacugaggcuuag

SEQ ID NO: 1448402 - RNA, 19 nt, Homo sapiens
aacaggauaugcuuuaaga

SEQ ID NO: 1448403 - RNA, 19 nt, Homo sapiens
uggacaaaguucuguauau

SEQ ID NO: 1448404 - RNA, 19 nt, Homo sapiens
aacauaagcuaccugaaug

SEQ ID NO: 1448405 - RNA, 19 nt, Homo sapiens
ucacaagggacuuugcuaa

SEQ ID NO: 1448406 - RNA, 19 nt, Homo sapiens
gggaaauaguucaguaucu

SEQ ID NO: 1448407 - RNA, 19 nt, Homo sapiens
cuuuaaaggugcagugaaa

SEQ ID NO: 1448408 - RNA, 19 nt, Homo sapiens
caaggcagguagaucacuu

SEQ ID NO: 1448409 - RNA, 19 nt, Homo sapiens
ccuguaaucccaacacuuu

SEQ ID NO: 1448410 - RNA, 19 nt, Homo sapiens
uaagggaaguuuagaugag

SEQ ID NO: 1448411 - RNA, 19 nt, Homo sapiens
gcgcaggucuucuugaaua

SEQ ID NO: 1448412 - RNA, 19 nt, Homo sapiens
ggacaguaauuaaucauga

SEQ ID NO: 1448413 - RNA, 19 nt, Homo sapiens
gaauaucccugacuucuag

SEQ ID NO: 1448414 - RNA, 19 nt, Homo sapiens
gaacaugaccuggacagua

SEQ ID NO: 1448415 - RNA, 19 nt, Homo sapiens
agaaaucccuccucuuuga

SEQ ID NO: 1448416 - RNA, 19 nt, Homo sapiens
ggacagcccuggugugaag

SEQ ID NO: 1448417 - RNA, 19 nt, Homo sapiens
gcauucauccuguuaguuu

SEQ ID NO: 1448418 - RNA, 19 nt, Homo sapiens
gaauuguucucaucugugu

SEQ ID NO: 1448419 - RNA, 19 nt, Homo sapiens
cgaagaauaucccugacuu

SEQ ID NO: 1448420 - RNA, 19 nt, Homo sapiens
aacaugaccuggacaguaa

SEQ ID NO: 1448421 - RNA, 19 nt, Homo sapiens
gauauccacuggucuucuu

SEQ ID NO: 1448422 - RNA, 19 nt, Homo sapiens
guacaacagugacaacaac

SEQ ID NO: 1448423 - RNA, 19 nt, Homo sapiens
ccacuggucuucuucuagu

SEQ ID NO: 1448424 - RNA, 19 nt, Homo sapiens
acagagggcuggaaaagua

SEQ ID NO: 1448425 - RNA, 19 nt, Homo sapiens
gggaauuguucucaucugu

SEQ ID NO: 1448426 - RNA, 19 nt, Homo sapiens
gagaaaucccuccucuuug

SEQ ID NO: 1448427 - RNA, 19 nt, Homo sapiens
gcuggucucuggcccuuga

SEQ ID NO: 1448428 - RNA, 19 nt, Homo sapiens
ccaguaaaugcuucagaua

SEQ ID NO: 1448429 - RNA, 19 nt, Homo sapiens
cuaauagccuuggagauca

SEQ ID NO: 1448430 - RNA, 19 nt, Homo sapiens
caacagugacaacaacaug

SEQ ID NO: 1448431 - RNA, 19 nt, Homo sapiens
ugcuucaacuucacuauaa

SEQ ID NO: 1448432 - RNA, 19 nt, Homo sapiens
ggacgucuuagucugguaa

SEQ ID NO: 1448433 - RNA, 19 nt, Homo sapiens
cacaguaugcgaagaauau

SEQ ID NO: 1448434 - RNA, 19 nt, Homo sapiens
aguaaaugcuucagauauc

SEQ ID NO: 1448435 - RNA, 19 nt, Homo sapiens
gcaguucgccaccaaugga

SEQ ID NO: 1448436 - RNA, 19 nt, Homo sapiens
aagcgcaggucuucuugaa

SEQ ID NO: 1448437 - RNA, 19 nt, Homo sapiens
cagugagggugaaugugua

SEQ ID NO: 1448438 - RNA, 19 nt, Homo sapiens
gcuucaacuucacuauaaa

SEQ ID NO: 1448439 - RNA, 19 nt, Homo sapiens
uuucugcuguugcuacuaa

SEQ ID NO: 1448440 - RNA, 19 nt, Homo sapiens
caguaaaugcuucagauau

SEQ ID NO: 1448441 - RNA, 19 nt, Homo sapiens
gggcauucauccuguuagu

SEQ ID NO: 1448442 - RNA, 19 nt, Homo sapiens
ugaccuggacaguaauuaa

SEQ ID NO: 1448443 - RNA, 19 nt, Homo sapiens
ucucuuugcuucaacuuca

SEQ ID NO: 1448444 - RNA, 19 nt, Homo sapiens
aaggagacauggaagaaag

SEQ ID NO: 1448445 - RNA, 19 nt, Homo sapiens
ccacaguaugcgaagaaua

SEQ ID NO: 1448446 - RNA, 19 nt, Homo sapiens
gaaagacagagggcuggaa

SEQ ID NO: 1448447 - RNA, 19 nt, Homo sapiens
caaggagacauggaagaaa

SEQ ID NO: 1448448 - RNA, 19 nt, Homo sapiens
ucaaggagacauggaagaa

SEQ ID NO: 1448449 - RNA, 19 nt, Homo sapiens
gaccuggacaguaauuaau

SEQ ID NO: 1448450 - RNA, 19 nt, Homo sapiens
aaagacagagggcuggaaa

SEQ ID NO: 1448451 - RNA, 19 nt, Homo sapiens
ccagugagggugaaugugu

SEQ ID NO: 1448452 - RNA, 19 nt, Homo sapiens
gcaggucuucuugaauaaa

SEQ ID NO: 1448453 - RNA, 19 nt, Homo sapiens
guaaaugcuucagauaucc

SEQ ID NO: 1448454 - RNA, 19 nt, Homo sapiens
caugaagccaguaagauca

SEQ ID NO: 1448455 - RNA, 19 nt, Homo sapiens
ccuggacaguaauuaauca

SEQ ID NO: 1448456 - RNA, 19 nt, Homo sapiens
ucagauauccacuggucuu

SEQ ID NO: 1448457 - RNA, 19 nt, Homo sapiens
cgccaccaauggagagaaa

SEQ ID NO: 1448458 - RNA, 19 nt, Homo sapiens
cgcaggucuucuugaauaa

SEQ ID NO: 1448459 - RNA, 19 nt, Homo sapiens
cuucuagucuaccagauag

SEQ ID NO: 1448460 - RNA, 19 nt, Homo sapiens
ucaugaagccaguaagauc

SEQ ID NO: 1448461 - RNA, 19 nt, Homo sapiens
aaucaugaagccaguaaga

SEQ ID NO: 1448462 - RNA, 19 nt, Homo sapiens
gguggucacucucuuugcu

SEQ ID NO: 1448463 - RNA, 19 nt, Homo sapiens
acuaauagccuuggagauc

SEQ ID NO: 1448464 - RNA, 19 nt, Homo sapiens
guauaugccaccagcacuu

SEQ ID NO: 1448465 - RNA, 19 nt, Homo sapiens
uaauagccuuggagaucau

SEQ ID NO: 1448466 - RNA, 19 nt, Homo sapiens
ucaagagaggugaaucaug

SEQ ID NO: 1448467 - RNA, 19 nt, Homo sapiens
ggacucaagagaggugaau

SEQ ID NO: 1448468 - RNA, 19 nt, Homo sapiens
aaugggaauuguucucauc

SEQ ID NO: 1448469 - RNA, 19 nt, Homo sapiens
uaaugggaauuguucucau

SEQ ID NO: 1448470 - RNA, 19 nt, Homo sapiens
gaucacuggcucagggaau

SEQ ID NO: 1448471 - RNA, 19 nt, Homo sapiens
cagauaaagaccagugauc

SEQ ID NO: 1448472 - RNA, 19 nt, Homo sapiens
guaagaucaaggagacaug

SEQ ID NO: 1448473 - RNA, 19 nt, Homo sapiens
uuaaucaugaagccaguaa

SEQ ID NO: 1448474 - RNA, 19 nt, Homo sapiens
ggcccuugaggacgucuua

SEQ ID NO: 1448475 - RNA, 19 nt, Homo sapiens
accaguaaaugcuucagau

SEQ ID NO: 1448476 - RNA, 19 nt, Homo sapiens
gauaaagaccagugauccu

SEQ ID NO: 1448477 - RNA, 19 nt, Homo sapiens
caugguugguggucacucu

SEQ ID NO: 1448478 - RNA, 19 nt, Homo sapiens
acaacaacauggucaaacc

SEQ ID NO: 1448479 - RNA, 19 nt, Homo sapiens
uugcuucaacuucacuaua

SEQ ID NO: 1448480 - RNA, 19 nt, Homo sapiens
caaagaagaacucgaagua

SEQ ID NO: 1448481 - RNA, 19 nt, Homo sapiens
cagcaaagcauucucauuu

SEQ ID NO: 1448482 - RNA, 19 nt, Homo sapiens
caagaggauuugcuuaugu

SEQ ID NO: 1448483 - RNA, 19 nt, Homo sapiens
aagaagaacucgaaguaga

SEQ ID NO: 1448484 - RNA, 19 nt, Homo sapiens
gaaauacaguuugcacaag

SEQ ID NO: 1448485 - RNA, 19 nt, Homo sapiens
ggacuugcgccgugaguuu

SEQ ID NO: 1448486 - RNA, 19 nt, Homo sapiens
guacaaacagcaaagcauu

SEQ ID NO: 1448487 - RNA, 19 nt, Homo sapiens
gcaccacgccgucuuuaau

SEQ ID NO: 1448488 - RNA, 19 nt, Homo sapiens
ucucgaaguuaucgucaua

SEQ ID NO: 1448489 - RNA, 19 nt, Homo sapiens
gcaaggcagucaagaacuc

SEQ ID NO: 1448490 - RNA, 19 nt, Homo sapiens
gaagacauucugacucaau

SEQ ID NO: 1448491 - RNA, 19 nt, Homo sapiens
ccaagaggauuugcuuaug

SEQ ID NO: 1448492 - RNA, 19 nt, Homo sapiens
aaaucaagaucacauggaa

SEQ ID NO: 1448493 - RNA, 19 nt, Homo sapiens
cagacuagcucaggaacaa

SEQ ID NO: 1448494 - RNA, 19 nt, Homo sapiens
uggaagacauucugacuca

SEQ ID NO: 1448495 - RNA, 19 nt, Homo sapiens
caaaagagguccaagucaa

SEQ ID NO: 1448496 - RNA, 19 nt, Homo sapiens
ggucagacagccuuaaaga

SEQ ID NO: 1448497 - RNA, 19 nt, Homo sapiens
gucuaaaucucguuccaaa

SEQ ID NO: 1448498 - RNA, 19 nt, Homo sapiens
gauauggcccuauaguaga

SEQ ID NO: 1448499 - RNA, 19 nt, Homo sapiens
uaaaucucguuccaaauca

SEQ ID NO: 1448500 - RNA, 19 nt, Homo sapiens
ggaggaagcggucaugucu

SEQ ID NO: 1448501 - RNA, 19 nt, Homo sapiens
aagacauucugacucaaua

SEQ ID NO: 1448502 - RNA, 19 nt, Homo sapiens
caaaggguauaccaauucu

SEQ ID NO: 1448503 - RNA, 19 nt, Homo sapiens
guauguggccgucagauug

SEQ ID NO: 1448504 - RNA, 19 nt, Homo sapiens
ccacgccgucuuuaauaua

SEQ ID NO: 1448505 - RNA, 19 nt, Homo sapiens
gaaaaucacagucaaguuc

SEQ ID NO: 1448506 - RNA, 19 nt, Homo sapiens
cacgccgucuuuaauauaa

SEQ ID NO: 1448507 - RNA, 19 nt, Homo sapiens
gcaaagcauucucauuuuc

SEQ ID NO: 1448508 - RNA, 19 nt, Homo sapiens
ccaaaggguauaccaauuc

SEQ ID NO: 1448509 - RNA, 19 nt, Homo sapiens
gaaauaggaggcggucaga

SEQ ID NO: 1448510 - RNA, 19 nt, Homo sapiens
gaaacuaaaguacaaacag

SEQ ID NO: 1448511 - RNA, 19 nt, Homo sapiens
cgauauggcccuauaguag

SEQ ID NO: 1448512 - RNA, 19 nt, Homo sapiens
cccaaaggguauaccaauu

SEQ ID NO: 1448513 - RNA, 19 nt, Homo sapiens
gaacuccaagaaggaauuu

SEQ ID NO: 1448514 - RNA, 19 nt, Homo sapiens
ucagacagccuuaaagagu

SEQ ID NO: 1448515 - RNA, 19 nt, Homo sapiens
ugaaauacaguuugcacaa

SEQ ID NO: 1448516 - RNA, 19 nt, Homo sapiens
gugaacagcaacagaaaga

SEQ ID NO: 1448517 - RNA, 19 nt, Homo sapiens
aaagagguccaagucaaua

SEQ ID NO: 1448518 - RNA, 19 nt, Homo sapiens
cuaaaucucguuccaaauc

SEQ ID NO: 1448519 - RNA, 19 nt, Homo sapiens
aagaggauuugcuuauguu

SEQ ID NO: 1448520 - RNA, 19 nt, Homo sapiens
caccacgccgucuuuaaua

SEQ ID NO: 1448521 - RNA, 19 nt, Homo sapiens
uuccagaucucgaaguuau

SEQ ID NO: 1448522 - RNA, 19 nt, Homo sapiens
gcccuauaguagacguuua

SEQ ID NO: 1448523 - RNA, 19 nt, Homo sapiens
caggccaaaugaaaucaaa

SEQ ID NO: 1448524 - RNA, 19 nt, Homo sapiens
gagcaccacgccgucuuua

SEQ ID NO: 1448525 - RNA, 19 nt, Homo sapiens
ggguauaccaauucugaaa

SEQ ID NO: 1448526 - RNA, 19 nt, Homo sapiens
gccgugaguuuggucgaua

SEQ ID NO: 1448527 - RNA, 19 nt, Homo sapiens
caccaggccugaggacuug

SEQ ID NO: 1448528 - RNA, 19 nt, Homo sapiens
ggaagacauucugacucaa

SEQ ID NO: 1448529 - RNA, 19 nt, Homo sapiens
cagucaaguucaccucaaa

SEQ ID NO: 1448530 - RNA, 19 nt, Homo sapiens
agaagaacucgaaguagaa

SEQ ID NO: 1448531 - RNA, 19 nt, Homo sapiens
gccgucagauugaaauaca

SEQ ID NO: 1448532 - RNA, 19 nt, Homo sapiens
cacaggcgauuuucuuaua

SEQ ID NO: 1448533 - RNA, 19 nt, Homo sapiens
cauuccagaucucgaaguu

SEQ ID NO: 1448534 - RNA, 19 nt, Homo sapiens
aaacagcaaagcauucuca

SEQ ID NO: 1448535 - RNA, 19 nt, Homo sapiens
guauaccaauucugaaacu

SEQ ID NO: 1448536 - RNA, 19 nt, Homo sapiens
caagaacuccaagaaggaa

SEQ ID NO: 1448537 - RNA, 19 nt, Homo sapiens
acauuccacuugacuucua

SEQ ID NO: 1448538 - RNA, 19 nt, Homo sapiens
ucaagaacuccaagaagga

SEQ ID NO: 1448539 - RNA, 19 nt, Homo sapiens
aggauuugcuuauguucaa

SEQ ID NO: 1448540 - RNA, 19 nt, Homo sapiens
gguauguggccgucagauu

SEQ ID NO: 1448541 - RNA, 19 nt, Homo sapiens
ucacauuccagaucucgaa

SEQ ID NO: 1448542 - RNA, 19 nt, Homo sapiens
gcccaagaggauuugcuua

SEQ ID NO: 1448543 - RNA, 19 nt, Homo sapiens
gaagaacucgaaguagaag

SEQ ID NO: 1448544 - RNA, 19 nt, Homo sapiens
caauagaaaguggguaugu

SEQ ID NO: 1448545 - RNA, 19 nt, Homo sapiens
ccaccaggccugaggacuu

SEQ ID NO: 1448546 - RNA, 19 nt, Homo sapiens
cgucauccuuguucuccaa

SEQ ID NO: 1448547 - RNA, 19 nt, Homo sapiens
caaaacaccaggccaaaug

SEQ ID NO: 1448548 - RNA, 19 nt, Homo sapiens
ugcacaaggugaucgcaaa

SEQ ID NO: 1448549 - RNA, 19 nt, Homo sapiens
aaggguauaccaauucuga

SEQ ID NO: 1448550 - RNA, 19 nt, Homo sapiens
gaacggaggaagcggucau

SEQ ID NO: 1448551 - RNA, 19 nt, Homo sapiens
cuuaaagagucucgacaca

SEQ ID NO: 1448552 - RNA, 19 nt, Homo sapiens
ucgauauggcccuauagua

SEQ ID NO: 1448553 - RNA, 19 nt, Homo sapiens
cauucugacucaauagcaa

SEQ ID NO: 1448554 - RNA, 19 nt, Homo sapiens
ccaaagaagaacucgaagu

SEQ ID NO: 1448555 - RNA, 19 nt, Homo sapiens
gaggauuugcuuauguuca

SEQ ID NO: 1448556 - RNA, 19 nt, Homo sapiens
uaaaguacaaacagcaaag

SEQ ID NO: 1448557 - RNA, 19 nt, Homo sapiens
caagaucacauggaagaca

SEQ ID NO: 1448558 - RNA, 19 nt, Homo sapiens
gguccaagucaauaggaaa

SEQ ID NO: 1448559 - RNA, 19 nt, Homo sapiens
aauagaaaguggguaugug

SEQ ID NO: 1448560 - RNA, 19 nt, Homo sapiens
gaaggaauuuuggcucuag

SEQ ID NO: 1448561 - RNA, 19 nt, Homo sapiens
ucagcaaggcagucaagaa

SEQ ID NO: 1448562 - RNA, 19 nt, Homo sapiens
gcggucagacagccuuaaa

SEQ ID NO: 1448563 - RNA, 19 nt, Homo sapiens
ucaagaagccccagccaaa

SEQ ID NO: 1448564 - RNA, 19 nt, Homo sapiens
ucacauggaagacauucug

SEQ ID NO: 1448565 - RNA, 19 nt, Homo sapiens
uauagcaagucuaaaucuc

SEQ ID NO: 1448566 - RNA, 19 nt, Homo sapiens
aaagaacgucauccuuguu

SEQ ID NO: 1448567 - RNA, 19 nt, Homo sapiens
aaaagaacgucauccuugu

SEQ ID NO: 1448568 - RNA, 19 nt, Homo sapiens
cagauugaaauacaguuug

SEQ ID NO: 1448569 - RNA, 19 nt, Homo sapiens
cccaagaggauuugcuuau

SEQ ID NO: 1448570 - RNA, 19 nt, Homo sapiens
gcagucaagaacuccaaga

SEQ ID NO: 1448571 - RNA, 19 nt, Homo sapiens
cagcaaggcagucaagaac

SEQ ID NO: 1448572 - RNA, 19 nt, Homo sapiens
acagucaaguucaccucaa

SEQ ID NO: 1448573 - RNA, 19 nt, Homo sapiens
ggauuugcuuauguucaau

SEQ ID NO: 1448574 - RNA, 19 nt, Homo sapiens
aaacaccaggccaaaugaa

SEQ ID NO: 1448575 - RNA, 19 nt, Homo sapiens
gcggucaugucucgcuaca

SEQ ID NO: 1448576 - RNA, 19 nt, Homo sapiens
gacguuuacauuccacuug

SEQ ID NO: 1448577 - RNA, 19 nt, Homo sapiens
cuaaaguacaaacagcaaa

SEQ ID NO: 1448578 - RNA, 19 nt, Homo sapiens
acguuuacauuccacuuga

SEQ ID NO: 1448579 - RNA, 19 nt, Homo sapiens
uggucgauauggcccuaua

SEQ ID NO: 1448580 - RNA, 19 nt, Homo sapiens
ccaaguagcuggaacuaua

SEQ ID NO: 1448581 - RNA, 19 nt, Homo sapiens
gcagaacccuguuauuuga

SEQ ID NO: 1448582 - RNA, 19 nt, Homo sapiens
caacuacccuucugucuuu

SEQ ID NO: 1448583 - RNA, 19 nt, Homo sapiens
ggacuuggcucgaggaaau

SEQ ID NO: 1448584 - RNA, 19 nt, Homo sapiens
ggaggcagauuaagaacuu

SEQ ID NO: 1448585 - RNA, 19 nt, Homo sapiens
cagcagacccacccaaaua

SEQ ID NO: 1448586 - RNA, 19 nt, Homo sapiens
gguggaggauuaucaggua

SEQ ID NO: 1448587 - RNA, 19 nt, Homo sapiens
caauuaaccuacagaagga

SEQ ID NO: 1448588 - RNA, 19 nt, Homo sapiens
cgaggaaauuaaacucuaa

SEQ ID NO: 1448589 - RNA, 19 nt, Homo sapiens
ggucuuggcucuuugaucu

SEQ ID NO: 1448590 - RNA, 19 nt, Homo sapiens
gaucuuggcucaccacaac

SEQ ID NO: 1448591 - RNA, 19 nt, Homo sapiens
gaaacuccuuggcuuaagu

SEQ ID NO: 1448592 - RNA, 19 nt, Homo sapiens
gggagugcauccaaaguga

SEQ ID NO: 1448593 - RNA, 19 nt, Homo sapiens
aagcagaacccuguuauuu

SEQ ID NO: 1448594 - RNA, 19 nt, Homo sapiens
ccagugaccauaagauaaa

SEQ ID NO: 1448595 - RNA, 19 nt, Homo sapiens
augaguagcucgagaaaug

SEQ ID NO: 1448596 - RNA, 19 nt, Homo sapiens
aaacuuggguauccucaau

SEQ ID NO: 1448597 - RNA, 19 nt, Homo sapiens
gaaaucuuaucccguuuac

SEQ ID NO: 1448598 - RNA, 19 nt, Homo sapiens
caggugaacugcuugacuu

SEQ ID NO: 1448599 - RNA, 19 nt, Homo sapiens
gagaaaucuuaucccguuu

SEQ ID NO: 1448600 - RNA, 19 nt, Homo sapiens
uaagaacuuuggccugguu

SEQ ID NO: 1448601 - RNA, 19 nt, Homo sapiens
ucaaagaaggaacgaauga

SEQ ID NO: 1448602 - RNA, 19 nt, Homo sapiens
gaccauaagauaaauguca

SEQ ID NO: 1448603 - RNA, 19 nt, Homo sapiens
ccaaagugcugggauuaca

SEQ ID NO: 1448604 - RNA, 19 nt, Homo sapiens
caccucagccucccaagua

SEQ ID NO: 1448605 - RNA, 19 nt, Homo sapiens
gagcuccaaccugcaauua

SEQ ID NO: 1448606 - RNA, 19 nt, Homo sapiens
gaacuauaggcacaagcua

SEQ ID NO: 1448607 - RNA, 19 nt, Homo sapiens
agaaggaacgaaugaauga

SEQ ID NO: 1448608 - RNA, 19 nt, Homo sapiens
ucgaggaaauuaaacucua

SEQ ID NO: 1448609 - RNA, 19 nt, Homo sapiens
cuccuuggcuuaagugauu

SEQ ID NO: 1448610 - RNA, 19 nt, Homo sapiens
gcuccaaccugcaauuaac

SEQ ID NO: 1448611 - RNA, 19 nt, Homo sapiens
ggucaaagaaggaacgaau

SEQ ID NO: 1448612 - RNA, 19 nt, Homo sapiens
aaucuuaucccguuuacaa

SEQ ID NO: 1448613 - RNA, 19 nt, Homo sapiens
gaacccuguuauuugaaga

SEQ ID NO: 1448614 - RNA, 19 nt, Homo sapiens
gaugguggaugagcgauca

SEQ ID NO: 1448615 - RNA, 19 nt, Homo sapiens
uguaguggcaucauuguaa

SEQ ID NO: 1448616 - RNA, 19 nt, Homo sapiens
ugaagagccugagaaaucu

SEQ ID NO: 1448617 - RNA, 19 nt, Homo sapiens
gaacuuuggccugguugaa

SEQ ID NO: 1448618 - RNA, 19 nt, Homo sapiens
guuccgggaugguggauga

SEQ ID NO: 1448619 - RNA, 19 nt, Homo sapiens
uugaagagccugagaaauc

SEQ ID NO: 1448620 - RNA, 19 nt, Homo sapiens
ucuuggcucuuugaucuua

SEQ ID NO: 1448621 - RNA, 19 nt, Homo sapiens
gacugggucuuggcucuuu

SEQ ID NO: 1448622 - RNA, 19 nt, Homo sapiens
agaaaucuuaucccguuua

SEQ ID NO: 1448623 - RNA, 19 nt, Homo sapiens
gugaacugcuugacuuuac

SEQ ID NO: 1448624 - RNA, 19 nt, Homo sapiens
ggugaacugcuugacuuua

SEQ ID NO: 1448625 - RNA, 19 nt, Homo sapiens
gcagcccucuccaggugaa

SEQ ID NO: 1448626 - RNA, 19 nt, Homo sapiens
ccugaaacuccuuggcuua

SEQ ID NO: 1448627 - RNA, 19 nt, Homo sapiens
uaccucagccuccucagua

SEQ ID NO: 1448628 - RNA, 19 nt, Homo sapiens
ggaggauuaucagguaaca

SEQ ID NO: 1448629 - RNA, 19 nt, Homo sapiens
caaagaaggaacgaaugaa

SEQ ID NO: 1448630 - RNA, 19 nt, Homo sapiens
aaagaaggaacgaaugaau

SEQ ID NO: 1448631 - RNA, 19 nt, Homo sapiens
ucagguaacacaagaagug

SEQ ID NO: 1448632 - RNA, 19 nt, Homo sapiens
uaccaugccuggcuauucu

SEQ ID NO: 1448633 - RNA, 19 nt, Homo sapiens
gagugcauccaaagugaaa

SEQ ID NO: 1448634 - RNA, 19 nt, Homo sapiens
caagcagaacccuguuauu

SEQ ID NO: 1448635 - RNA, 19 nt, Homo sapiens
gcagcagacccacccaaau

SEQ ID NO: 1448636 - RNA, 19 nt, Homo sapiens
uuuaccaccugaaggagua

SEQ ID NO: 1448637 - RNA, 19 nt, Homo sapiens
ccaacuacccuucugucuu

SEQ ID NO: 1448638 - RNA, 19 nt, Homo sapiens
guggaggauuaucagguaa

SEQ ID NO: 1448639 - RNA, 19 nt, Homo sapiens
ccaagcagaacccuguuau

SEQ ID NO: 1448640 - RNA, 19 nt, Homo sapiens
gagcccaacuacccuucug

SEQ ID NO: 1448641 - RNA, 19 nt, Homo sapiens
ggacugaggagcacuucgu

SEQ ID NO: 1448642 - RNA, 19 nt, Homo sapiens
guaguggcaucauuguaac

SEQ ID NO: 1448643 - RNA, 19 nt, Homo sapiens
gaaccgcaucaaagacuuc

SEQ ID NO: 1448644 - RNA, 19 nt, Homo sapiens
ccaccugaaggaguauuua

SEQ ID NO: 1448645 - RNA, 19 nt, Homo sapiens
cuaaugaguagcucgagaa

SEQ ID NO: 1448646 - RNA, 19 nt, Homo sapiens
ucuuugaucuuaccucuac

SEQ ID NO: 1448647 - RNA, 19 nt, Homo sapiens
gagcugcgaaucccaugga

SEQ ID NO: 1448648 - RNA, 19 nt, Homo sapiens
gcaucaaagacuuccagaa

SEQ ID NO: 1448649 - RNA, 19 nt, Homo sapiens
gaaacuuggguauccucaa

SEQ ID NO: 1448650 - RNA, 19 nt, Homo sapiens
ggagugcauccaaagugaa

SEQ ID NO: 1448651 - RNA, 19 nt, Homo sapiens
cuuaucccguuuacaaaug

SEQ ID NO: 1448652 - RNA, 19 nt, Homo sapiens
gaggcagauuaagaacuuu

SEQ ID NO: 1448653 - RNA, 19 nt, Homo sapiens
gaaccggucaaagaaggaa

SEQ ID NO: 1448654 - RNA, 19 nt, Homo sapiens
aagaaggaacgaaugaaug

SEQ ID NO: 1448655 - RNA, 19 nt, Homo sapiens
uaaaugucagaaucgcaua

SEQ ID NO: 1448656 - RNA, 19 nt, Homo sapiens
uaccucuacuccucugaaa

SEQ ID NO: 1448657 - RNA, 19 nt, Homo sapiens
ggagcuccaaccugcaauu

SEQ ID NO: 1448658 - RNA, 19 nt, Homo sapiens
gcgaucauccuuaaaagaa

SEQ ID NO: 1448659 - RNA, 19 nt, Homo sapiens
gacuuuaccaccugaagga

SEQ ID NO: 1448660 - RNA, 19 nt, Homo sapiens
gaguagcucgagaaauguu

SEQ ID NO: 1448661 - RNA, 19 nt, Homo sapiens
caaguagcuggaacuauag

SEQ ID NO: 1448662 - RNA, 19 nt, Homo sapiens
agcagaacccuguuauuug

SEQ ID NO: 1448663 - RNA, 19 nt, Homo sapiens
ggaacuauaggcacaagcu

SEQ ID NO: 1448664 - RNA, 19 nt, Homo sapiens
ugaaccgcaucaaagacuu

SEQ ID NO: 1448665 - RNA, 19 nt, Homo sapiens
uaaugaguagcucgagaaa

SEQ ID NO: 1448666 - RNA, 19 nt, Homo sapiens
ugaaacuccuuggcuuaag

SEQ ID NO: 1448667 - RNA, 19 nt, Homo sapiens
ccucaauacuaagaaaucu

SEQ ID NO: 1448668 - RNA, 19 nt, Homo sapiens
cucaguagcugggauuaca

SEQ ID NO: 1448669 - RNA, 19 nt, Homo sapiens
cugcaagaauuaacaaagc

SEQ ID NO: 1448670 - RNA, 19 nt, Homo sapiens
cugaaacuccuuggcuuaa

SEQ ID NO: 1448671 - RNA, 19 nt, Homo sapiens
uccagugaccauaagauaa

SEQ ID NO: 1448672 - RNA, 19 nt, Homo sapiens
cuccagugaccauaagaua

SEQ ID NO: 1448673 - RNA, 19 nt, Homo sapiens
auuaucagguaacacaaga

SEQ ID NO: 1448674 - RNA, 19 nt, Homo sapiens
gcaugaccacgaggacuga

SEQ ID NO: 1448675 - RNA, 19 nt, Homo sapiens
uugugcggguggaggauua

SEQ ID NO: 1448676 - RNA, 19 nt, Homo sapiens
caacgagaaaagcgaauuu

SEQ ID NO: 1448677 - RNA, 19 nt, Homo sapiens
ugcaagaauuaacaaagca

SEQ ID NO: 1448678 - RNA, 19 nt, Homo sapiens
gaacugcuugacuuuacca

SEQ ID NO: 1448679 - RNA, 19 nt, Homo sapiens
gauuaucagguaacacaag

SEQ ID NO: 1448680 - RNA, 19 nt, Homo sapiens
aaacagacccugaguuaau

SEQ ID NO: 1448681 - RNA, 19 nt, Homo sapiens
gaggugguguccauucaaa

SEQ ID NO: 1448682 - RNA, 19 nt, Homo sapiens
ggacagcaaauacauccua

SEQ ID NO: 1448683 - RNA, 19 nt, Homo sapiens
gaaggugucucggaagauc

SEQ ID NO: 1448684 - RNA, 19 nt, Homo sapiens
guugagcccuuccuccuuu

SEQ ID NO: 1448685 - RNA, 19 nt, Homo sapiens
ggacaauacucuucuucag

SEQ ID NO: 1448686 - RNA, 19 nt, Homo sapiens
cgacggcccugugcaauau

SEQ ID NO: 1448687 - RNA, 19 nt, Homo sapiens
uaaaacagacccugaguua

SEQ ID NO: 1448688 - RNA, 19 nt, Homo sapiens
gucuagagcuguucauuca

SEQ ID NO: 1448689 - RNA, 19 nt, Homo sapiens
gaccuucacugacuuaugc

SEQ ID NO: 1448690 - RNA, 19 nt, Homo sapiens
ggaugacccugaguauaga

SEQ ID NO: 1448691 - RNA, 19 nt, Homo sapiens
uuucauuccugccuuguaa

SEQ ID NO: 1448692 - RNA, 19 nt, Homo sapiens
agaugucucucuucaguau

SEQ ID NO: 1448693 - RNA, 19 nt, Homo sapiens
ugaguuaauuggguugaaa

SEQ ID NO: 1448694 - RNA, 19 nt, Homo sapiens
acagagaccuggagagcau

SEQ ID NO: 1448695 - RNA, 19 nt, Homo sapiens
ugguguccauucaaaguua

SEQ ID NO: 1448696 - RNA, 19 nt, Homo sapiens
ggaggacgcugaggagcau

SEQ ID NO: 1448697 - RNA, 19 nt, Homo sapiens
agacggaggugguguccau

SEQ ID NO: 1448698 - RNA, 19 nt, Homo sapiens
aacagacccugaguuaauu

SEQ ID NO: 1448699 - RNA, 19 nt, Homo sapiens
aaauuuggaccuucacuga

SEQ ID NO: 1448700 - RNA, 19 nt, Homo sapiens
uggaaggugucucggaaga

SEQ ID NO: 1448701 - RNA, 19 nt, Homo sapiens
ggagggacagcaaauacau

SEQ ID NO: 1448702 - RNA, 19 nt, Homo sapiens
cagcaaauacauccuacga

SEQ ID NO: 1448703 - RNA, 19 nt, Homo sapiens
gaaguuucgcgccaagauc

SEQ ID NO: 1448704 - RNA, 19 nt, Homo sapiens
ucucuucaguauuucauuc

SEQ ID NO: 1448705 - RNA, 19 nt, Homo sapiens
cggcaaaggcugucuagag

SEQ ID NO: 1448706 - RNA, 19 nt, Homo sapiens
aggaugacccugaguauag

SEQ ID NO: 1448707 - RNA, 19 nt, Homo sapiens
ggaccuucacugacuuaug

SEQ ID NO: 1448708 - RNA, 19 nt, Homo sapiens
gggacaauacucuucuuca

SEQ ID NO: 1448709 - RNA, 19 nt, Homo sapiens
gguguccauucaaaguuau

SEQ ID NO: 1448710 - RNA, 19 nt, Homo sapiens
uuaugcagggcguauauuu

SEQ ID NO: 1448711 - RNA, 19 nt, Homo sapiens
ccagcaguuucgcauggaa

SEQ ID NO: 1448712 - RNA, 19 nt, Homo sapiens
cggaggugguguccauuca

SEQ ID NO: 1448713 - RNA, 19 nt, Homo sapiens
aaauucagccagcuuagau

SEQ ID NO: 1448714 - RNA, 19 nt, Homo sapiens
aucggaagcuucugcaguu

SEQ ID NO: 1448715 - RNA, 19 nt, Homo sapiens
ggaggugguguccauucaa

SEQ ID NO: 1448716 - RNA, 19 nt, Homo sapiens
augucucucuucaguauuu

SEQ ID NO: 1448717 - RNA, 19 nt, Homo sapiens
ggagcaucguggagaggau

SEQ ID NO: 1448718 - RNA, 19 nt, Homo sapiens
gguggaagcaaaccucagu

SEQ ID NO: 1448719 - RNA, 19 nt, Homo sapiens
ggugguguccauucaaagu

SEQ ID NO: 1448720 - RNA, 19 nt, Homo sapiens
caauacucuucuucagcuu

SEQ ID NO: 1448721 - RNA, 19 nt, Homo sapiens
ucucggaagaucucgauga

SEQ ID NO: 1448722 - RNA, 19 nt, Homo sapiens
ucggaagcuucugcaguuu

SEQ ID NO: 1448723 - RNA, 19 nt, Homo sapiens
gguggacaaucggaagcuu

SEQ ID NO: 1448724 - RNA, 19 nt, Homo sapiens
cuacgacggcccugugcaa

SEQ ID NO: 1448725 - RNA, 19 nt, Homo sapiens
gcaagugcggguggacaau

SEQ ID NO: 1448726 - RNA, 19 nt, Homo sapiens
gaagaaugcuggugacuua

SEQ ID NO: 1448727 - RNA, 19 nt, Homo sapiens
ccacagaaauuagagguua

SEQ ID NO: 1448728 - RNA, 19 nt, Homo sapiens
gcaggaagcucagaaagga

SEQ ID NO: 1448729 - RNA, 19 nt, Homo sapiens
gaaaggagucagugaauug

SEQ ID NO: 1448730 - RNA, 19 nt, Homo sapiens
gaaaggagucagugaauug

SEQ ID NO: 1448731 - RNA, 19 nt, Homo sapiens
gagcagacuucuucuaugu

SEQ ID NO: 1448732 - RNA, 19 nt, Homo sapiens
gaaaggacauugcagaacu

SEQ ID NO: 1448733 - RNA, 19 nt, Homo sapiens
ucagaagccuggucauuga

SEQ ID NO: 1448734 - RNA, 19 nt, Homo sapiens
gcagacuucuucuaugugu

SEQ ID NO: 1448735 - RNA, 19 nt, Homo sapiens
gaggagagcagacuucuuc

SEQ ID NO: 1448736 - RNA, 19 nt, Homo sapiens
ggaaaggacggccaaggaa

SEQ ID NO: 1448737 - RNA, 19 nt, Homo sapiens
gagagcagacuucuucuau

SEQ ID NO: 1448738 - RNA, 19 nt, Homo sapiens
ggagaaaggagucagugaa

SEQ ID NO: 1448739 - RNA, 19 nt, Homo sapiens
ggagaaaggagucagugaa

SEQ ID NO: 1448740 - RNA, 19 nt, Homo sapiens
ggaauuagacaccaacaca

SEQ ID NO: 1448741 - RNA, 19 nt, Homo sapiens
gagaaaggagucagugaau

SEQ ID NO: 1448742 - RNA, 19 nt, Homo sapiens
gagaaaggagucagugaau

SEQ ID NO: 1448743 - RNA, 19 nt, Homo sapiens
agaaaggagucagugaauu

SEQ ID NO: 1448744 - RNA, 19 nt, Homo sapiens
agaaaggagucagugaauu

SEQ ID NO: 1448745 - RNA, 19 nt, Homo sapiens
gaaaggacggccaaggaau

SEQ ID NO: 1448746 - RNA, 19 nt, Homo sapiens
gcuggugacuuacugaaca

SEQ ID NO: 1448747 - RNA, 19 nt, Homo sapiens
ccaacacacugaagaaugc

SEQ ID NO: 1448748 - RNA, 19 nt, Homo sapiens
ggagagcagacuucuucua

SEQ ID NO: 1448749 - RNA, 19 nt, Homo sapiens
gcaguaacacagcucagaa

SEQ ID NO: 1448750 - RNA, 19 nt, Homo sapiens
caucaugaacugaccauug

SEQ ID NO: 1448751 - RNA, 19 nt, Homo sapiens
ccaaggaauuagacaccaa

SEQ ID NO: 1448752 - RNA, 19 nt, Homo sapiens
caacugcggacaucucuuc

SEQ ID NO: 1448753 - RNA, 19 nt, Homo sapiens
gaaugcuggugacuuacug

SEQ ID NO: 1448754 - RNA, 19 nt, Homo sapiens
gcucagaagccuggucauu

SEQ ID NO: 1448755 - RNA, 19 nt, Homo sapiens
ggacggccaaggaauuaga

SEQ ID NO: 1448756 - RNA, 19 nt, Homo sapiens
aaaggacggccaaggaauu

SEQ ID NO: 1448757 - RNA, 19 nt, Homo sapiens
aaaggacauugcagaacuu

SEQ ID NO: 1448758 - RNA, 19 nt, Homo sapiens
cagaaaggacauugcagaa

SEQ ID NO: 1448759 - RNA, 19 nt, Homo sapiens
aucaugaacugaccauuga

SEQ ID NO: 1448760 - RNA, 19 nt, Homo sapiens
cugaacacaugucucauca

SEQ ID NO: 1448761 - RNA, 19 nt, Homo sapiens
gaagccuggucauugaucu

SEQ ID NO: 1448762 - RNA, 19 nt, Homo sapiens
gucagugaauugcuucuuc

SEQ ID NO: 1448763 - RNA, 19 nt, Homo sapiens
gucagugaauugcuucuuc

SEQ ID NO: 1448764 - RNA, 19 nt, Homo sapiens
cagcagaagcggccagaau

SEQ ID NO: 1448765 - RNA, 19 nt, Homo sapiens
ggacauugcagaacuucag

SEQ ID NO: 1448766 - RNA, 19 nt, Homo sapiens
agaagagggugugcagguu

SEQ ID NO: 1448767 - RNA, 19 nt, Homo sapiens
ggucauugaucuggaaagg

SEQ ID NO: 1448768 - RNA, 19 nt, Homo sapiens
ccagaauccuugacaucuc

SEQ ID NO: 1448769 - RNA, 19 nt, Homo sapiens
ugacaucuccagggcagua

SEQ ID NO: 1448770 - RNA, 19 nt, Homo sapiens
cuacaaggaacgacucaau

SEQ ID NO: 1448771 - RNA, 19 nt, Homo sapiens
caugaucccuuugcagaag

SEQ ID NO: 1448772 - RNA, 19 nt, Homo sapiens
cacagaaauuagagguuau

SEQ ID NO: 1448773 - RNA, 19 nt, Homo sapiens
caucucuucugucgagugu

SEQ ID NO: 1448774 - RNA, 19 nt, Homo sapiens
agagcagacuucuucuaug

SEQ ID NO: 1448775 - RNA, 19 nt, Homo sapiens
gccggaagcccuguucuga

SEQ ID NO: 1448776 - RNA, 19 nt, Homo sapiens
cugcggacaucucuucugu

SEQ ID NO: 1448777 - RNA, 19 nt, Homo sapiens
caugaacugaccauugaaa

SEQ ID NO: 1448778 - RNA, 19 nt, Homo sapiens
aaggacggccaaggaauua

SEQ ID NO: 1448779 - RNA, 19 nt, Homo sapiens
ucaaggcucagcaggagaa

SEQ ID NO: 1448780 - RNA, 19 nt, Homo sapiens
acgaggccaugaucccuuu

SEQ ID NO: 1448781 - RNA, 19 nt, Homo sapiens
gcucagaaaggacauugca

SEQ ID NO: 1448782 - RNA, 19 nt, Homo sapiens
ugacccaguuggagaaagg

SEQ ID NO: 1448783 - RNA, 19 nt, Homo sapiens
gguaggaacgaggccauga

SEQ ID NO: 1448784 - RNA, 19 nt, Homo sapiens
gacaccaacacacugaaga

SEQ ID NO: 1448785 - RNA, 19 nt, Homo sapiens
gcuagggacaggcuauauc

SEQ ID NO: 1448786 - RNA, 19 nt, Homo sapiens
ccucagccacuacaaggaa

SEQ ID NO: 1448787 - RNA, 19 nt, Homo sapiens
acaccaacacacugaagaa

SEQ ID NO: 1448788 - RNA, 19 nt, Homo sapiens
uggaaaggacggccaagga

SEQ ID NO: 1448789 - RNA, 19 nt, Homo sapiens
gagugcuccacagaaauua

SEQ ID NO: 1448790 - RNA, 19 nt, Homo sapiens
ggccagaauccuugacauc

SEQ ID NO: 1448791 - RNA, 19 nt, Homo sapiens
ugaagaaugcuggugacuu

SEQ ID NO: 1448792 - RNA, 19 nt, Homo sapiens
uuagacaccaacacacuga

SEQ ID NO: 1448793 - RNA, 19 nt, Homo sapiens
ccuggucauugaucuggaa

SEQ ID NO: 1448794 - RNA, 19 nt, Homo sapiens
aaaaugcccucagccacua

SEQ ID NO: 1448795 - RNA, 19 nt, Homo sapiens
aggagucagugaauugcuu

SEQ ID NO: 1448796 - RNA, 19 nt, Homo sapiens
aggagucagugaauugcuu

SEQ ID NO: 1448797 - RNA, 19 nt, Homo sapiens
aggcucagcaggagaagaa

SEQ ID NO: 1448798 - RNA, 19 nt, Homo sapiens
ggcaguaacacagcucaga

SEQ ID NO: 1448799 - RNA, 19 nt, Homo sapiens
gagcacaugccagcagaag

SEQ ID NO: 1448800 - RNA, 19 nt, Homo sapiens
guaggaacgaggccaugau

SEQ ID NO: 1448801 - RNA, 19 nt, Homo sapiens
ggaaugaggugauaagcaa

SEQ ID NO: 1448802 - RNA, 19 nt, Homo sapiens
caaggaggguguaaguuua

SEQ ID NO: 1448803 - RNA, 19 nt, Homo sapiens
gaaccggacucacaauuuc

SEQ ID NO: 1448804 - RNA, 19 nt, Homo sapiens
uaaacaggcucaucucuga

SEQ ID NO: 1448805 - RNA, 19 nt, Homo sapiens
ggacaaagaagaaagaaug

SEQ ID NO: 1448806 - RNA, 19 nt, Homo sapiens
gcaaggaggguguaaguuu

SEQ ID NO: 1448807 - RNA, 19 nt, Homo sapiens
gaugauaguuuccuucugu

SEQ ID NO: 1448808 - RNA, 19 nt, Homo sapiens
ggacagcauuauguuauuu

SEQ ID NO: 1448809 - RNA, 19 nt, Homo sapiens
gaaacgagagccauccaua

SEQ ID NO: 1448810 - RNA, 19 nt, Homo sapiens
ggacucacaauuucuauuu

SEQ ID NO: 1448811 - RNA, 19 nt, Homo sapiens
cuuaagaguuuguguguaa

SEQ ID NO: 1448812 - RNA, 19 nt, Homo sapiens
ccaguaaaguccacagaaa

SEQ ID NO: 1448813 - RNA, 19 nt, Homo sapiens
aaagauggcucacagaaag

SEQ ID NO: 1448814 - RNA, 19 nt, Homo sapiens
ggagaaugaugaugauagu

SEQ ID NO: 1448815 - RNA, 19 nt, Homo sapiens
guaauggucugagaaugaa

SEQ ID NO: 1448816 - RNA, 19 nt, Homo sapiens
ccacggugaucuuggagua

SEQ ID NO: 1448817 - RNA, 19 nt, Homo sapiens
gaaugaugaugauaguuuc

SEQ ID NO: 1448818 - RNA, 19 nt, Homo sapiens
ggaaccggacucacaauuu

SEQ ID NO: 1448819 - RNA, 19 nt, Homo sapiens
gguaauggucugagaauga

SEQ ID NO: 1448820 - RNA, 19 nt, Homo sapiens
cagagaauacugacgguua

SEQ ID NO: 1448821 - RNA, 19 nt, Homo sapiens
guacaaugaugcagaggau

SEQ ID NO: 1448822 - RNA, 19 nt, Homo sapiens
acaaaucucucacuacuac

SEQ ID NO: 1448823 - RNA, 19 nt, Homo sapiens
cauuucaccuuauuacuga

SEQ ID NO: 1448824 - RNA, 19 nt, Homo sapiens
gaagcugaguucuaucaca

SEQ ID NO: 1448825 - RNA, 19 nt, Homo sapiens
agacaaaucucucacuacu

SEQ ID NO: 1448826 - RNA, 19 nt, Homo sapiens
gaagggcagagaauacuga

SEQ ID NO: 1448827 - RNA, 19 nt, Homo sapiens
gcuguagcuuuaucucgua

SEQ ID NO: 1448828 - RNA, 19 nt, Homo sapiens
ccucuucucaucuaaauaa

SEQ ID NO: 1448829 - RNA, 19 nt, Homo sapiens
gaagguaauggucugagaa

SEQ ID NO: 1448830 - RNA, 19 nt, Homo sapiens
auccauaccucaauaaaga

SEQ ID NO: 1448831 - RNA, 19 nt, Homo sapiens
acaccacacugaccacuga

SEQ ID NO: 1448832 - RNA, 19 nt, Homo sapiens
acacugcacugaguccuaa

SEQ ID NO: 1448833 - RNA, 19 nt, Homo sapiens
uaaagauggcucacagaaa

SEQ ID NO: 1448834 - RNA, 19 nt, Homo sapiens
ugaguucuaucacaucaga

SEQ ID NO: 1448835 - RNA, 19 nt, Homo sapiens
cagaaaagccuacagaaaa

SEQ ID NO: 1448836 - RNA, 19 nt, Homo sapiens
cagaaaagccuacgcuaua

SEQ ID NO: 1448837 - RNA, 19 nt, Homo sapiens
guauuaacccuucaucugu

SEQ ID NO: 1448838 - RNA, 19 nt, Homo sapiens
caucagaagccacaggaaa

SEQ ID NO: 1448839 - RNA, 19 nt, Homo sapiens
caaggucacaggagacaaa

SEQ ID NO: 1448840 - RNA, 19 nt, Homo sapiens
gacaaagaagaaagaauga

SEQ ID NO: 1448841 - RNA, 19 nt, Homo sapiens
ggacagaugggagagaaug

SEQ ID NO: 1448842 - RNA, 19 nt, Homo sapiens
gauaguuuccuucugucua

SEQ ID NO: 1448843 - RNA, 19 nt, Homo sapiens
gguguuugauggacauguu

SEQ ID NO: 1448844 - RNA, 19 nt, Homo sapiens
gcugaguucuaucacauca

SEQ ID NO: 1448845 - RNA, 19 nt, Homo sapiens
guaggcauuucaucugugu

SEQ ID NO: 1448846 - RNA, 19 nt, Homo sapiens
aaacacaccagucccagaa

SEQ ID NO: 1448847 - RNA, 19 nt, Homo sapiens
aaacggauccaagaagaaa

SEQ ID NO: 1448848 - RNA, 19 nt, Homo sapiens
ucaggacagcauuauguua

SEQ ID NO: 1448849 - RNA, 19 nt, Homo sapiens
uauuaacccuucaucuguu

SEQ ID NO: 1448850 - RNA, 19 nt, Homo sapiens
gaacacccaguacaaugau

SEQ ID NO: 1448851 - RNA, 19 nt, Homo sapiens
aaaggagaaugaugaugau

SEQ ID NO: 1448852 - RNA, 19 nt, Homo sapiens
caggacagcauuauguuau

SEQ ID NO: 1448853 - RNA, 19 nt, Homo sapiens
aaacagcagcagucacaaa

SEQ ID NO: 1448854 - RNA, 19 nt, Homo sapiens
gaaacugguuggggaauga

SEQ ID NO: 1448855 - RNA, 19 nt, Homo sapiens
uaacccagaacacccagua

SEQ ID NO: 1448856 - RNA, 19 nt, Homo sapiens
aauaauacgagcagacauu

SEQ ID NO: 1448857 - RNA, 19 nt, Homo sapiens
uauaaaaccuucagucaag

SEQ ID NO: 1448858 - RNA, 19 nt, Homo sapiens
cagaacacccaguacaaug

SEQ ID NO: 1448859 - RNA, 19 nt, Homo sapiens
gaagaccauaugcaccaaa

SEQ ID NO: 1448860 - RNA, 19 nt, Homo sapiens
ggucacaggagacaaaucu

SEQ ID NO: 1448861 - RNA, 19 nt, Homo sapiens
gaaaagaccacgucaacca

SEQ ID NO: 1448862 - RNA, 19 nt, Homo sapiens
uuacccaucuucucuacug

SEQ ID NO: 1448863 - RNA, 19 nt, Homo sapiens
agaagguaauggucugaga

SEQ ID NO: 1448864 - RNA, 19 nt, Homo sapiens
ccacgucaaccacagagaa

SEQ ID NO: 1448865 - RNA, 19 nt, Homo sapiens
acaaugaugcagaggauga

SEQ ID NO: 1448866 - RNA, 19 nt, Homo sapiens
gacaaaucucucacuacua

SEQ ID NO: 1448867 - RNA, 19 nt, Homo sapiens
ugauuggugucucagcauu

SEQ ID NO: 1448868 - RNA, 19 nt, Homo sapiens
ccucccaaaucccuuaguu

SEQ ID NO: 1448869 - RNA, 19 nt, Homo sapiens
ccacagaacacccagaaaa

SEQ ID NO: 1448870 - RNA, 19 nt, Homo sapiens
cggacacgccgcacacuaa

SEQ ID NO: 1448871 - RNA, 19 nt, Homo sapiens
cagcagcagucacaaagac

SEQ ID NO: 1448872 - RNA, 19 nt, Homo sapiens
cauaaaagccccaguaaag

SEQ ID NO: 1448873 - RNA, 19 nt, Homo sapiens
gggaaaaggagaaugauga

SEQ ID NO: 1448874 - RNA, 19 nt, Homo sapiens
agaacacccaguacaauga

SEQ ID NO: 1448875 - RNA, 19 nt, Homo sapiens
agccauccauaccucaaua

SEQ ID NO: 1448876 - RNA, 19 nt, Homo sapiens
auuggugucucagcauuua

SEQ ID NO: 1448877 - RNA, 19 nt, Homo sapiens
gauaagcaaggagggugua

SEQ ID NO: 1448878 - RNA, 19 nt, Homo sapiens
cauaugcaccaaagggaaa

SEQ ID NO: 1448879 - RNA, 19 nt, Homo sapiens
aagcugaguucuaucacau

SEQ ID NO: 1448880 - RNA, 19 nt, Homo sapiens
acuacuaccucuucucauc

SEQ ID NO: 1448881 - RNA, 19 nt, Homo sapiens
ucacuacuaccucuucuca

SEQ ID NO: 1448882 - RNA, 19 nt, Homo sapiens
gacucacaauuucuauuuc

SEQ ID NO: 1448883 - RNA, 19 nt, Homo sapiens
acaggaagggcagagaaua

SEQ ID NO: 1448884 - RNA, 19 nt, Homo sapiens
ccagaacacccaguacaau

SEQ ID NO: 1448885 - RNA, 19 nt, Homo sapiens
auaaagauggcucacagaa

SEQ ID NO: 1448886 - RNA, 19 nt, Homo sapiens
aaaaggagaaugaugauga

SEQ ID NO: 1448887 - RNA, 19 nt, Homo sapiens
ccauuucaccuuauuacug

SEQ ID NO: 1448888 - RNA, 19 nt, Homo sapiens
aaaguuacccaucuucucu

SEQ ID NO: 1448889 - RNA, 19 nt, Homo sapiens
aggacagcauuauguuauu

SEQ ID NO: 1448890 - RNA, 19 nt, Homo sapiens
caucaggugcccacugguu

SEQ ID NO: 1448891 - RNA, 19 nt, Homo sapiens
uaccucuucucaucuaaau

SEQ ID NO: 1448892 - RNA, 19 nt, Homo sapiens
uacuaccucuucucaucua

SEQ ID NO: 1448893 - RNA, 19 nt, Homo sapiens
gauuggugucucagcauuu

SEQ ID NO: 1448894 - RNA, 19 nt, Homo sapiens
agagaauacugacgguuac

SEQ ID NO: 1448895 - RNA, 19 nt, Homo sapiens
ccccagaccuucccugauu

SEQ ID NO: 1448896 - RNA, 19 nt, Homo sapiens
guccagaagaaaucauaaa

SEQ ID NO: 1448897 - RNA, 19 nt, Homo sapiens
ccagaaaagccuacagaaa

SEQ ID NO: 1448898 - RNA, 19 nt, Homo sapiens
ugauggagcagcagaaucu

SEQ ID NO: 1448899 - RNA, 19 nt, Homo sapiens
cagaugggagagaaugauu

SEQ ID NO: 1448900 - RNA, 19 nt, Homo sapiens
cucauuacaucuagaacga

SEQ ID NO: 1448901 - RNA, 19 nt, Homo sapiens
ccacaaaggucaagaaaga

SEQ ID NO: 1448902 - RNA, 19 nt, Homo sapiens
gaaguaaacaguccacuaa

SEQ ID NO: 1448903 - RNA, 19 nt, Homo sapiens
ggaagaagccagauacauu

SEQ ID NO: 1448904 - RNA, 19 nt, Homo sapiens
ggaacgagaucgggaagua

SEQ ID NO: 1448905 - RNA, 19 nt, Homo sapiens
ggagaagugccaagucuua

SEQ ID NO: 1448906 - RNA, 19 nt, Homo sapiens
gaaccuugcucuucauauc

SEQ ID NO: 1448907 - RNA, 19 nt, Homo sapiens
ccacuaacccugccgauaa

SEQ ID NO: 1448908 - RNA, 19 nt, Homo sapiens
gaggagaacaucaucgaua

SEQ ID NO: 1448909 - RNA, 19 nt, Homo sapiens
gaagaagccagauacauuc

SEQ ID NO: 1448910 - RNA, 19 nt, Homo sapiens
acacaaaacucaaaaggua

SEQ ID NO: 1448911 - RNA, 19 nt, Homo sapiens
uaugugcgauguacuaauu

SEQ ID NO: 1448912 - RNA, 19 nt, Homo sapiens
gaacagacagacacagaga

SEQ ID NO: 1448913 - RNA, 19 nt, Homo sapiens
gaacuggagaugcaacaaa

SEQ ID NO: 1448914 - RNA, 19 nt, Homo sapiens
gaagccagauacauucuag

SEQ ID NO: 1448915 - RNA, 19 nt, Homo sapiens
ggaaguaaacaguccacua

SEQ ID NO: 1448916 - RNA, 19 nt, Homo sapiens
cagcacauuuccauugauu

SEQ ID NO: 1448917 - RNA, 19 nt, Homo sapiens
uaaauggacacaacacaaa

SEQ ID NO: 1448918 - RNA, 19 nt, Homo sapiens
gagaaagcauccguggaaa

SEQ ID NO: 1448919 - RNA, 19 nt, Homo sapiens
cgagaaagcauccguggaa

SEQ ID NO: 1448920 - RNA, 19 nt, Homo sapiens
aggagaacaucaucgauaa

SEQ ID NO: 1448921 - RNA, 19 nt, Homo sapiens
cagagaugcugcagagcua

SEQ ID NO: 1448922 - RNA, 19 nt, Homo sapiens
ugagauggguuucaaugug

SEQ ID NO: 1448923 - RNA, 19 nt, Homo sapiens
ggucacacuuguugagaug

SEQ ID NO: 1448924 - RNA, 19 nt, Homo sapiens
gaacgagaucgggaaguaa

SEQ ID NO: 1448925 - RNA, 19 nt, Homo sapiens
cugaguagcuggaauuaca

SEQ ID NO: 1448926 - RNA, 19 nt, Homo sapiens
ggagcaggaugaacagaca

SEQ ID NO: 1448927 - RNA, 19 nt, Homo sapiens
ggagugcaguggcaagauc

SEQ ID NO: 1448928 - RNA, 19 nt, Homo sapiens
uggaaacgcugacagagau

SEQ ID NO: 1448929 - RNA, 19 nt, Homo sapiens
gcgauguacuaauuuaagu

SEQ ID NO: 1448930 - RNA, 19 nt, Homo sapiens
ggagaugcaacaaauggaa

SEQ ID NO: 1448931 - RNA, 19 nt, Homo sapiens
uggacacucucccugcuua

SEQ ID NO: 1448932 - RNA, 19 nt, Homo sapiens
gcagagcuacauuucagaa

SEQ ID NO: 1448933 - RNA, 19 nt, Homo sapiens
ugugcgauguacuaauuua

SEQ ID NO: 1448934 - RNA, 19 nt, Homo sapiens
gagaaccuugcucuucaua

SEQ ID NO: 1448935 - RNA, 19 nt, Homo sapiens
gagccugagugcaccaugu

SEQ ID NO: 1448936 - RNA, 19 nt, Homo sapiens
gucagcacauuuccauuga

SEQ ID NO: 1448937 - RNA, 19 nt, Homo sapiens
guucugccgugcccucuga

SEQ ID NO: 1448938 - RNA, 19 nt, Homo sapiens
gcaggaagaagccagauac

SEQ ID NO: 1448939 - RNA, 19 nt, Homo sapiens
cgucugaacuggagaugca

SEQ ID NO: 1448940 - RNA, 19 nt, Homo sapiens
gggaguguguccucagcuu

SEQ ID NO: 1448941 - RNA, 19 nt, Homo sapiens
cagcucuucuuccgucuga

SEQ ID NO: 1448942 - RNA, 19 nt, Homo sapiens
gcacauccccagccauuuu

SEQ ID NO: 1448943 - RNA, 19 nt, Homo sapiens
aagaugacgucagcacauu

SEQ ID NO: 1448944 - RNA, 19 nt, Homo sapiens
gauguggagcgggcacuua

SEQ ID NO: 1448945 - RNA, 19 nt, Homo sapiens
gugcuuacauuuauauagc

SEQ ID NO: 1448946 - RNA, 19 nt, Homo sapiens
ugacagaggcaggguuuga

SEQ ID NO: 1448947 - RNA, 19 nt, Homo sapiens
gcugacagaggcaggguuu

SEQ ID NO: 1448948 - RNA, 19 nt, Homo sapiens
ggagagcagccacaaaggu

SEQ ID NO: 1448949 - RNA, 19 nt, Homo sapiens
cgucagcacauuuccauug

SEQ ID NO: 1448950 - RNA, 19 nt, Homo sapiens
gaagugccaagucuuacug

SEQ ID NO: 1448951 - RNA, 19 nt, Homo sapiens
acacuacgccagaacaaga

SEQ ID NO: 1448952 - RNA, 19 nt, Homo sapiens
uagagaauugugagacuuu

SEQ ID NO: 1448953 - RNA, 19 nt, Homo sapiens
gcacauuuccauugauugc

SEQ ID NO: 1448954 - RNA, 19 nt, Homo sapiens
gaaagcauccguggaaacg

SEQ ID NO: 1448955 - RNA, 19 nt, Homo sapiens
ggacacaacacaaaacuca

SEQ ID NO: 1448956 - RNA, 19 nt, Homo sapiens
ugccgugcccucugaaaua

SEQ ID NO: 1448957 - RNA, 19 nt, Homo sapiens
agacacacacggaagcaaa

SEQ ID NO: 1448958 - RNA, 19 nt, Homo sapiens
cccaagauccgcaggaaga

SEQ ID NO: 1448959 - RNA, 19 nt, Homo sapiens
gaugacgucagcacauuuc

SEQ ID NO: 1448960 - RNA, 19 nt, Homo sapiens
cuccuggucucuccucaaa

SEQ ID NO: 1448961 - RNA, 19 nt, Homo sapiens
caggagagcagccacaaag

SEQ ID NO: 1448962 - RNA, 19 nt, Homo sapiens
uaacccugccgauaacuau

SEQ ID NO: 1448963 - RNA, 19 nt, Homo sapiens
guggaaacgcugacagaga

SEQ ID NO: 1448964 - RNA, 19 nt, Homo sapiens
cuagagaauugugagacuu

SEQ ID NO: 1448965 - RNA, 19 nt, Homo sapiens
cugcagagcuacauuucag

SEQ ID NO: 1448966 - RNA, 19 nt, Homo sapiens
agaaggagaacaccucugu

SEQ ID NO: 1448967 - RNA, 19 nt, Homo sapiens
guuugagagugccgagaaa

SEQ ID NO: 1448968 - RNA, 19 nt, Homo sapiens
gauaucguggucacacuug

SEQ ID NO: 1448969 - RNA, 19 nt, Homo sapiens
gugccaagucuuacuguga

SEQ ID NO: 1448970 - RNA, 19 nt, Homo sapiens
caaauggaagagcagauuc

SEQ ID NO: 1448971 - RNA, 19 nt, Homo sapiens
acaaauggaagagcagauu

SEQ ID NO: 1448972 - RNA, 19 nt, Homo sapiens
gugagcccgugucagacua

SEQ ID NO: 1448973 - RNA, 19 nt, Homo sapiens
uguagacccuguccucaag

SEQ ID NO: 1448974 - RNA, 19 nt, Homo sapiens
gggaggagaacaucaucga

SEQ ID NO: 1448975 - RNA, 19 nt, Homo sapiens
ucuuggaggugcccaggaa

SEQ ID NO: 1448976 - RNA, 19 nt, Homo sapiens
ugggagaagugccaagucu

SEQ ID NO: 1448977 - RNA, 19 nt, Homo sapiens
uagacccuguccucaagaa

SEQ ID NO: 1448978 - RNA, 19 nt, Homo sapiens
ccucggagcaggaugaaca

SEQ ID NO: 1448979 - RNA, 19 nt, Homo sapiens
aacuggagaugcaacaaau

SEQ ID NO: 1448980 - RNA, 19 nt, Homo sapiens
ucagaaauugggagaagug

SEQ ID NO: 1448981 - RNA, 19 nt, Homo sapiens
gguuugagagugccgagaa

SEQ ID NO: 1448982 - RNA, 19 nt, Homo sapiens
gugcgauguacuaauuuaa

SEQ ID NO: 1448983 - RNA, 19 nt, Homo sapiens
gagcagccacaaaggucaa

SEQ ID NO: 1448984 - RNA, 19 nt, Homo sapiens
ggaggagaacaucaucgau

SEQ ID NO: 1448985 - RNA, 19 nt, Homo sapiens
auaaauggacacaacacaa

SEQ ID NO: 1448986 - RNA, 19 nt, Homo sapiens
ucauuuacauagugcuuac

SEQ ID NO: 1448987 - RNA, 19 nt, Homo sapiens
agagaauugugagacuuug

SEQ ID NO: 1448988 - RNA, 19 nt, Homo sapiens
gaguguguccucagcuugu

SEQ ID NO: 1448989 - RNA, 19 nt, Homo sapiens
gccgugcccucugaaauac

SEQ ID NO: 1448990 - RNA, 19 nt, Homo sapiens
acaaaggucaagaaagaca

SEQ ID NO: 1448991 - RNA, 19 nt, Homo sapiens
ccaagacaggcgagacuca

SEQ ID NO: 1448992 - RNA, 19 nt, Homo sapiens
cagcccacacuguccgaua

SEQ ID NO: 1448993 - RNA, 19 nt, Homo sapiens
ggacacucucccugcuuau

SEQ ID NO: 1448994 - RNA, 19 nt, Homo sapiens
gccaagugcuccccaagga

SEQ ID NO: 1448995 - RNA, 19 nt, Homo sapiens
aaagaugacgucagcacau

SEQ ID NO: 1448996 - RNA, 19 nt, Homo sapiens
cucaaaagguacaaaagaa

SEQ ID NO: 1448997 - RNA, 19 nt, Homo sapiens
uuaacuaugugcgauguac

SEQ ID NO: 1448998 - RNA, 19 nt, Homo sapiens
gacccuguccucaagaagu

SEQ ID NO: 1448999 - RNA, 19 nt, Homo sapiens
ugagcuccuugcugacaga

SEQ ID NO: 1449000 - RNA, 19 nt, Homo sapiens
ccaggagagcagccacaaa

SEQ ID NO: 1449001 - RNA, 19 nt, Homo sapiens
gcacacugcuaguaaauaa

SEQ ID NO: 1449002 - RNA, 19 nt, Homo sapiens
caccagaccucguucauuu

SEQ ID NO: 1449003 - RNA, 19 nt, Homo sapiens
gagacucccucuugaauca

SEQ ID NO: 1449004 - RNA, 19 nt, Homo sapiens
gcaaugcacgggacaauga

SEQ ID NO: 1449005 - RNA, 19 nt, Homo sapiens
cagaggaguuugauaaugu

SEQ ID NO: 1449006 - RNA, 19 nt, Homo sapiens
uuaaaugacucucccaaga

SEQ ID NO: 1449007 - RNA, 19 nt, Homo sapiens
caggaaauuugcaaacuga

SEQ ID NO: 1449008 - RNA, 19 nt, Homo sapiens
caaugaagccuuugaagug

SEQ ID NO: 1449009 - RNA, 19 nt, Homo sapiens
gcaggaaauuugcaaacug

SEQ ID NO: 1449010 - RNA, 19 nt, Homo sapiens
gcuggaagcugcuaaacca

SEQ ID NO: 1449011 - RNA, 19 nt, Homo sapiens
ggagggacuuccaguuuua

SEQ ID NO: 1449012 - RNA, 19 nt, Homo sapiens
ggaaggaagcccuggaaga

SEQ ID NO: 1449013 - RNA, 19 nt, Homo sapiens
acagagcgcuggcaacuuc

SEQ ID NO: 1449014 - RNA, 19 nt, Homo sapiens
ggaagcugcuaaaccauag

SEQ ID NO: 1449015 - RNA, 19 nt, Homo sapiens
aaaugacucucccaagauu

SEQ ID NO: 1449016 - RNA, 19 nt, Homo sapiens
ggucccagcuccaaucaau

SEQ ID NO: 1449017 - RNA, 19 nt, Homo sapiens
cagaaggagugaaacaugu

SEQ ID NO: 1449018 - RNA, 19 nt, Homo sapiens
uccaauauuuccagcguua

SEQ ID NO: 1449019 - RNA, 19 nt, Homo sapiens
gaagaggacaggaguuauc

SEQ ID NO: 1449020 - RNA, 19 nt, Homo sapiens
cccaaagccuauuguguuu

SEQ ID NO: 1449021 - RNA, 19 nt, Homo sapiens
gcgacgaacuucugagaca

SEQ ID NO: 1449022 - RNA, 19 nt, Homo sapiens
caacacaagguaauaggaa

SEQ ID NO: 1449023 - RNA, 19 nt, Homo sapiens
gaaggaagcccuggaagag

SEQ ID NO: 1449024 - RNA, 19 nt, Homo sapiens
ggacaaugaagccuuugaa

SEQ ID NO: 1449025 - RNA, 19 nt, Homo sapiens
uagaagaggacaggaguua

SEQ ID NO: 1449026 - RNA, 19 nt, Homo sapiens
ccugagaucccaauauuga

SEQ ID NO: 1449027 - RNA, 19 nt, Homo sapiens
gccuuugccuguacaauug

SEQ ID NO: 1449028 - RNA, 19 nt, Homo sapiens
gcucugaccgcuaggcuuu

SEQ ID NO: 1449029 - RNA, 19 nt, Homo sapiens
gaggagggaaucugcaauu

SEQ ID NO: 1449030 - RNA, 19 nt, Homo sapiens
ccucuugaaucauccauau

SEQ ID NO: 1449031 - RNA, 19 nt, Homo sapiens
ucagaggaguuugauaaug

SEQ ID NO: 1449032 - RNA, 19 nt, Homo sapiens
ggaacaaccuagccaucca

SEQ ID NO: 1449033 - RNA, 19 nt, Homo sapiens
gcacgagggcacacugcua

SEQ ID NO: 1449034 - RNA, 19 nt, Homo sapiens
ggcaacauuuggugaccua

SEQ ID NO: 1449035 - RNA, 19 nt, Homo sapiens
uggcauaauuugagucuuc

SEQ ID NO: 1449036 - RNA, 19 nt, Homo sapiens
gagggcacacugcuaguaa

SEQ ID NO: 1449037 - RNA, 19 nt, Homo sapiens
caggagagccaaacuggaa

SEQ ID NO: 1449038 - RNA, 19 nt, Homo sapiens
gaaggagugaaacauguga

SEQ ID NO: 1449039 - RNA, 19 nt, Homo sapiens
agucagaggaguuugauaa

SEQ ID NO: 1449040 - RNA, 19 nt, Homo sapiens
gaagaaguaaccucugagu

SEQ ID NO: 1449041 - RNA, 19 nt, Homo sapiens
aggaagaaguaaccucuga

SEQ ID NO: 1449042 - RNA, 19 nt, Homo sapiens
agugaaacaugugaacuuu

SEQ ID NO: 1449043 - RNA, 19 nt, Homo sapiens
cacauuggguggcuucuuc

SEQ ID NO: 1449044 - RNA, 19 nt, Homo sapiens
gcuucugccucacuccuaa

SEQ ID NO: 1449045 - RNA, 19 nt, Homo sapiens
gagugaaacaugugaacuu

SEQ ID NO: 1449046 - RNA, 19 nt, Homo sapiens
uaacaauggguugguauga

SEQ ID NO: 1449047 - RNA, 19 nt, Homo sapiens
cagagaaggcggagaagga

SEQ ID NO: 1449048 - RNA, 19 nt, Homo sapiens
uaaaugacucucccaagau

SEQ ID NO: 1449049 - RNA, 19 nt, Homo sapiens
uuccugagaucccaauauu

SEQ ID NO: 1449050 - RNA, 19 nt, Homo sapiens
gagcgacgaacuucugaga

SEQ ID NO: 1449051 - RNA, 19 nt, Homo sapiens
gcuguuacaaggaaagaaa

SEQ ID NO: 1449052 - RNA, 19 nt, Homo sapiens
uccaaucaaugcagacuga

SEQ ID NO: 1449053 - RNA, 19 nt, Homo sapiens
ugagucuucuggcaacauu

SEQ ID NO: 1449054 - RNA, 19 nt, Homo sapiens
caaccguucaacuucaaua

SEQ ID NO: 1449055 - RNA, 19 nt, Homo sapiens
ccagaaggagugaaacaug

SEQ ID NO: 1449056 - RNA, 19 nt, Homo sapiens
guaauaggaagccaagcaa

SEQ ID NO: 1449057 - RNA, 19 nt, Homo sapiens
ccaagagucagaggaguuu

SEQ ID NO: 1449058 - RNA, 19 nt, Homo sapiens
aaaugaggauuccaagagu

SEQ ID NO: 1449059 - RNA, 19 nt, Homo sapiens
acagcuuugugaguuauua

SEQ ID NO: 1449060 - RNA, 19 nt, Homo sapiens
gugcugcgccuccuuccua

SEQ ID NO: 1449061 - RNA, 19 nt, Homo sapiens
ggccuuugccuguacaauu

SEQ ID NO: 1449062 - RNA, 19 nt, Homo sapiens
agcguuagauugaggauga

SEQ ID NO: 1449063 - RNA, 19 nt, Homo sapiens
gcccuucccagcugagaua

SEQ ID NO: 1449064 - RNA, 19 nt, Homo sapiens
ccagaccucguucauuuga

SEQ ID NO: 1449065 - RNA, 19 nt, Homo sapiens
uaacaccggaggaaaggaa

SEQ ID NO: 1449066 - RNA, 19 nt, Homo sapiens
aagcaaaacuccagccaaa

SEQ ID NO: 1449067 - RNA, 19 nt, Homo sapiens
gugcugcggcugugaugua

SEQ ID NO: 1449068 - RNA, 19 nt, Homo sapiens
acaauggguugguaugaag

SEQ ID NO: 1449069 - RNA, 19 nt, Homo sapiens
ucccaaagccuauuguguu

SEQ ID NO: 1449070 - RNA, 19 nt, Homo sapiens
ugacagcuuugugaguuau

SEQ ID NO: 1449071 - RNA, 19 nt, Homo sapiens
cuugacagcuuugugaguu

SEQ ID NO: 1449072 - RNA, 19 nt, Homo sapiens
gagagucaggccacgguaa

SEQ ID NO: 1449073 - RNA, 19 nt, Homo sapiens
gaagagcuccaaucaaccu

SEQ ID NO: 1449074 - RNA, 19 nt, Homo sapiens
ugaagugccagucuaugaa

SEQ ID NO: 1449075 - RNA, 19 nt, Homo sapiens
ccuguacaauuguuucuca

SEQ ID NO: 1449076 - RNA, 19 nt, Homo sapiens
uggaagcugcuaaaccaua

SEQ ID NO: 1449077 - RNA, 19 nt, Homo sapiens
cuugaaucauccauaugua

SEQ ID NO: 1449078 - RNA, 19 nt, Homo sapiens
gguaugaaggccagaagga

SEQ ID NO: 1449079 - RNA, 19 nt, Homo sapiens
ggugcaggauggaagacuu

SEQ ID NO: 1449080 - RNA, 19 nt, Homo sapiens
gguaauaggaagccaagca

SEQ ID NO: 1449081 - RNA, 19 nt, Homo sapiens
gggaggugauccagagaag

SEQ ID NO: 1449082 - RNA, 19 nt, Homo sapiens
ggaaauuugcaaacugagu

SEQ ID NO: 1449083 - RNA, 19 nt, Homo sapiens
gaagugccagucuaugaag

SEQ ID NO: 1449084 - RNA, 19 nt, Homo sapiens
gguggcuucuucuuguuug

SEQ ID NO: 1449085 - RNA, 19 nt, Homo sapiens
gcuuauuucuuucucacau

SEQ ID NO: 1449086 - RNA, 19 nt, Homo sapiens
ccguucaacuucaauaaag

SEQ ID NO: 1449087 - RNA, 19 nt, Homo sapiens
gagcaaagucagucaaagc

SEQ ID NO: 1449088 - RNA, 19 nt, Homo sapiens
aacaauggguugguaugaa

SEQ ID NO: 1449089 - RNA, 19 nt, Homo sapiens
gccuggacaucauaaaugg

SEQ ID NO: 1449090 - RNA, 19 nt, Homo sapiens
uugacagcuuugugaguua

SEQ ID NO: 1449091 - RNA, 19 nt, Homo sapiens
uggcuuugcugggcauaaa

SEQ ID NO: 1449092 - RNA, 19 nt, Homo sapiens
caauauuuccagcguuaga

SEQ ID NO: 1449093 - RNA, 19 nt, Homo sapiens
caucauaaauggggacuug

SEQ ID NO: 1449094 - RNA, 19 nt, Homo sapiens
acaaugaagccuuugaagu

SEQ ID NO: 1449095 - RNA, 19 nt, Homo sapiens
gcauaaagacggacaucac

SEQ ID NO: 1449096 - RNA, 19 nt, Homo sapiens
ggacgagcaaagucaguca

SEQ ID NO: 1449097 - RNA, 19 nt, Homo sapiens
caaagccuauuguguuuuc

SEQ ID NO: 1449098 - RNA, 19 nt, Homo sapiens
ggcaggaaauuugcaaacu

SEQ ID NO: 1449099 - RNA, 19 nt, Homo sapiens
cgagggcacacugcuagua

SEQ ID NO: 1449100 - RNA, 19 nt, Homo sapiens
ugccuaugaugucugcuuu

SEQ ID NO: 1449101 - RNA, 19 nt, Homo sapiens
ucagaagcaucaccaauua

SEQ ID NO: 1449102 - RNA, 19 nt, Homo sapiens
gauaagaugugauuaccuu

SEQ ID NO: 1449103 - RNA, 19 nt, Homo sapiens
gaaacccugucucuacuaa

SEQ ID NO: 1449104 - RNA, 19 nt, Homo sapiens
ggagaacaaccauuuagua

SEQ ID NO: 1449105 - RNA, 19 nt, Homo sapiens
ggagagcccuucaggaaau

SEQ ID NO: 1449106 - RNA, 19 nt, Homo sapiens
gagaacaaccauuuaguaa

SEQ ID NO: 1449107 - RNA, 19 nt, Homo sapiens
ggaggcaucugcaaacgaa

SEQ ID NO: 1449108 - RNA, 19 nt, Homo sapiens
gcacacagaaauccagaua

SEQ ID NO: 1449109 - RNA, 19 nt, Homo sapiens
gaagaaccacaaaggauuu

SEQ ID NO: 1449110 - RNA, 19 nt, Homo sapiens
gagcagguauccuucuuug

SEQ ID NO: 1449111 - RNA, 19 nt, Homo sapiens
uaaggaaguucugacauuu

SEQ ID NO: 1449112 - RNA, 19 nt, Homo sapiens
gaucccagcuauauuggaa

SEQ ID NO: 1449113 - RNA, 19 nt, Homo sapiens
gagcaagagugucaugcaa

SEQ ID NO: 1449114 - RNA, 19 nt, Homo sapiens
acagaaaucaggaaacaua

SEQ ID NO: 1449115 - RNA, 19 nt, Homo sapiens
agaaggaacuuuacaagca

SEQ ID NO: 1449116 - RNA, 19 nt, Homo sapiens
uugaggauguugcuauuua

SEQ ID NO: 1449117 - RNA, 19 nt, Homo sapiens
ggaaaagacagcauuauaa

SEQ ID NO: 1449118 - RNA, 19 nt, Homo sapiens
gcaagagugucaugcaagu

SEQ ID NO: 1449119 - RNA, 19 nt, Homo sapiens
ccaauuagauccugaaagc

SEQ ID NO: 1449120 - RNA, 19 nt, Homo sapiens
gaaggaacuuuacaagcau

SEQ ID NO: 1449121 - RNA, 19 nt, Homo sapiens
ccaacuguuugcaaugaua

SEQ ID NO: 1449122 - RNA, 19 nt, Homo sapiens
gcaagggcuuugugaaaca

SEQ ID NO: 1449123 - RNA, 19 nt, Homo sapiens
ggauguugcuauuuauuuc

SEQ ID NO: 1449124 - RNA, 19 nt, Homo sapiens
auaaggaaguucugacauu

SEQ ID NO: 1449125 - RNA, 19 nt, Homo sapiens
gagguuauaugugauuguu

SEQ ID NO: 1449126 - RNA, 19 nt, Homo sapiens
gacaagaacuuuugggaaa

SEQ ID NO: 1449127 - RNA, 19 nt, Homo sapiens
ucaaaggaccggacacgua

SEQ ID NO: 1449128 - RNA, 19 nt, Homo sapiens
ucacagaaaucaggaaaca

SEQ ID NO: 1449129 - RNA, 19 nt, Homo sapiens
acacagaaauccagauaag

SEQ ID NO: 1449130 - RNA, 19 nt, Homo sapiens
gagaagcaauuaugagacu

SEQ ID NO: 1449131 - RNA, 19 nt, Homo sapiens
gugauuaccuuugugcauu

SEQ ID NO: 1449132 - RNA, 19 nt, Homo sapiens
ggaauccacagcaacagua

SEQ ID NO: 1449133 - RNA, 19 nt, Homo sapiens
ucuacgagguuauauguga

SEQ ID NO: 1449134 - RNA, 19 nt, Homo sapiens
gaacuuuacaagcauguga

SEQ ID NO: 1449135 - RNA, 19 nt, Homo sapiens
auaauuugcuccucuguug

SEQ ID NO: 1449136 - RNA, 19 nt, Homo sapiens
agaagcaucaccaauuaua

SEQ ID NO: 1449137 - RNA, 19 nt, Homo sapiens
gagagaaucacagaaauca

SEQ ID NO: 1449138 - RNA, 19 nt, Homo sapiens
gccaagcaguguaaacuca

SEQ ID NO: 1449139 - RNA, 19 nt, Homo sapiens
gaacgcugacggugaaaug

SEQ ID NO: 1449140 - RNA, 19 nt, Homo sapiens
gaagcaucaccaauuauau

SEQ ID NO: 1449141 - RNA, 19 nt, Homo sapiens
ugaagaaccacaaaggauu

SEQ ID NO: 1449142 - RNA, 19 nt, Homo sapiens
gaauaugaagaaccacaaa

SEQ ID NO: 1449143 - RNA, 19 nt, Homo sapiens
gcagguauccuucuuugag

SEQ ID NO: 1449144 - RNA, 19 nt, Homo sapiens
gaacuggacauuaagaaaa

SEQ ID NO: 1449145 - RNA, 19 nt, Homo sapiens
gcaagggcuucaccagaca

SEQ ID NO: 1449146 - RNA, 19 nt, Homo sapiens
ugggagaaauucaacaaga

SEQ ID NO: 1449147 - RNA, 19 nt, Homo sapiens
ggagugcaguggcgugauc

SEQ ID NO: 1449148 - RNA, 19 nt, Homo sapiens
caaguuaggaauaugaaga

SEQ ID NO: 1449149 - RNA, 19 nt, Homo sapiens
gggagaaauucaacaagag

SEQ ID NO: 1449150 - RNA, 19 nt, Homo sapiens
aagagugucaugcaaguua

SEQ ID NO: 1449151 - RNA, 19 nt, Homo sapiens
ggaaauggagagaaucaca

SEQ ID NO: 1449152 - RNA, 19 nt, Homo sapiens
gcguugagcaggauuggua

SEQ ID NO: 1449153 - RNA, 19 nt, Homo sapiens
gcagaaggaacuuuacaag

SEQ ID NO: 1449154 - RNA, 19 nt, Homo sapiens
ggaaagcuguugggagaac

SEQ ID NO: 1449155 - RNA, 19 nt, Homo sapiens
ggagagaaucacagaaauc

SEQ ID NO: 1449156 - RNA, 19 nt, Homo sapiens
ugauuaccuuugugcauuu

SEQ ID NO: 1449157 - RNA, 19 nt, Homo sapiens
ccaagugugacaagaguuu

SEQ ID NO: 1449158 - RNA, 19 nt, Homo sapiens
gagaccagcuugggcaaca

SEQ ID NO: 1449159 - RNA, 19 nt, Homo sapiens
gcaagaauggcaggaucua

SEQ ID NO: 1449160 - RNA, 19 nt, Homo sapiens
gcacaucagaguacacaca

SEQ ID NO: 1449161 - RNA, 19 nt, Homo sapiens
ccggaacgcugacggugaa

SEQ ID NO: 1449162 - RNA, 19 nt, Homo sapiens
ggugaaacccugucucuac

SEQ ID NO: 1449163 - RNA, 19 nt, Homo sapiens
gaacgcacacgggagagaa

SEQ ID NO: 1449164 - RNA, 19 nt, Homo sapiens
gaaauccagauaagaugug

SEQ ID NO: 1449165 - RNA, 19 nt, Homo sapiens
acagaaauccagauaagau

SEQ ID NO: 1449166 - RNA, 19 nt, Homo sapiens
ugaggauguugcuauuuau

SEQ ID NO: 1449167 - RNA, 19 nt, Homo sapiens
ggaauaugaagaaccacaa

SEQ ID NO: 1449168 - RNA, 19 nt, Homo sapiens
cggcaagggcuuugugaaa

SEQ ID NO: 1449169 - RNA, 19 nt, Homo sapiens
ccagagaggccacucaaag

SEQ ID NO: 1449170 - RNA, 19 nt, Homo sapiens
gggagagcccuucaggaaa

SEQ ID NO: 1449171 - RNA, 19 nt, Homo sapiens
gaggauguugcuauuuauu

SEQ ID NO: 1449172 - RNA, 19 nt, Homo sapiens
gcccaggaauccacagcaa

SEQ ID NO: 1449173 - RNA, 19 nt, Homo sapiens
uuacaagcaugugaugaga

SEQ ID NO: 1449174 - RNA, 19 nt, Homo sapiens
cauggcagaaggaacuuua

SEQ ID NO: 1449175 - RNA, 19 nt, Homo sapiens
gugaugagaagcaauuaug

SEQ ID NO: 1449176 - RNA, 19 nt, Homo sapiens
uaagaugugauuaccuuug

SEQ ID NO: 1449177 - RNA, 19 nt, Homo sapiens
gaaaaggugcacacagaaa

SEQ ID NO: 1449178 - RNA, 19 nt, Homo sapiens
caauuucuacgagguuaua

SEQ ID NO: 1449179 - RNA, 19 nt, Homo sapiens
ggagcagguauccuucuuu

SEQ ID NO: 1449180 - RNA, 19 nt, Homo sapiens
cagaaaucaggaaacauaa

SEQ ID NO: 1449181 - RNA, 19 nt, Homo sapiens
gaucacgagccaaggaguu

SEQ ID NO: 1449182 - RNA, 19 nt, Homo sapiens
ccaaagcguugagcaggau

SEQ ID NO: 1449183 - RNA, 19 nt, Homo sapiens
ggcaagggcuuugugaaac

SEQ ID NO: 1449184 - RNA, 19 nt, Homo sapiens
cccagugaaucuacccuaa

SEQ ID NO: 1449185 - RNA, 19 nt, Homo sapiens
gccagcaggcuaugaauuc

SEQ ID NO: 1449186 - RNA, 19 nt, Homo sapiens
acaagcaugugaugagaag

SEQ ID NO: 1449187 - RNA, 19 nt, Homo sapiens
gugaaacccugucucuacu

SEQ ID NO: 1449188 - RNA, 19 nt, Homo sapiens
uuaccuuugugcauuugua

SEQ ID NO: 1449189 - RNA, 19 nt, Homo sapiens
aagaugugauuaccuuugu

SEQ ID NO: 1449190 - RNA, 19 nt, Homo sapiens
ucaugcaaguuaggaauau

SEQ ID NO: 1449191 - RNA, 19 nt, Homo sapiens
ucagccaacuguuugcaau

SEQ ID NO: 1449192 - RNA, 19 nt, Homo sapiens
ugaacuggacauuaagaaa

SEQ ID NO: 1449193 - RNA, 19 nt, Homo sapiens
gggcuucauuuacaagucu

SEQ ID NO: 1449194 - RNA, 19 nt, Homo sapiens
gcaaaacccugucucuacu

SEQ ID NO: 1449195 - RNA, 19 nt, Homo sapiens
aggaaguucugacauuuua

SEQ ID NO: 1449196 - RNA, 19 nt, Homo sapiens
aagaaaaggugcacacaga

SEQ ID NO: 1449197 - RNA, 19 nt, Homo sapiens
cgugaucccagcuauauug

SEQ ID NO: 1449198 - RNA, 19 nt, Homo sapiens
ucucgucucucuagaugau

SEQ ID NO: 1449199 - RNA, 19 nt, Homo sapiens
uuaggaauaugaagaacca

SEQ ID NO: 1449200 - RNA, 19 nt, Homo sapiens
ccagauaagaugugauuac

SEQ ID NO: 1449201 - RNA, 19 nt, Homo sapiens
gcgccaaccucguaaguua

SEQ ID NO: 1449202 - RNA, 19 nt, Homo sapiens
gagccaaccucaagaugaa

SEQ ID NO: 1449203 - RNA, 19 nt, Homo sapiens
gagcaacugugaugaggaa

SEQ ID NO: 1449204 - RNA, 19 nt, Homo sapiens
caaagacaauggagacuca

SEQ ID NO: 1449205 - RNA, 19 nt, Homo sapiens
gaucagacccaccuacaga

SEQ ID NO: 1449206 - RNA, 19 nt, Homo sapiens
gcagccgccuacagacaaa

SEQ ID NO: 1449207 - RNA, 19 nt, Homo sapiens
gaugaggaaugcaugaacu

SEQ ID NO: 1449208 - RNA, 19 nt, Homo sapiens
ccaagguccuccugcuaga

SEQ ID NO: 1449209 - RNA, 19 nt, Homo sapiens
ugagagaggcccugaagau

SEQ ID NO: 1449210 - RNA, 19 nt, Homo sapiens
caacugugaugaggaaugc

SEQ ID NO: 1449211 - RNA, 19 nt, Homo sapiens
gguccuugcugcccugcuu

SEQ ID NO: 1449212 - RNA, 19 nt, Homo sapiens
gagagaggcccugaagauc

SEQ ID NO: 1449213 - RNA, 19 nt, Homo sapiens
gaccuggaaugaggacuuc

SEQ ID NO: 1449214 - RNA, 19 nt, Homo sapiens
gggagguucuggccaggau

SEQ ID NO: 1449215 - RNA, 19 nt, Homo sapiens
gagaggcccugaagauccu

SEQ ID NO: 1449216 - RNA, 19 nt, Homo sapiens
gcaacugugaugaggaaug

SEQ ID NO: 1449217 - RNA, 19 nt, Homo sapiens
gcacccggcucagugacau

SEQ ID NO: 1449218 - RNA, 19 nt, Homo sapiens
gagagccaaccucaagaug

SEQ ID NO: 1449219 - RNA, 19 nt, Homo sapiens
gacaugagugagcgacuga

SEQ ID NO: 1449220 - RNA, 19 nt, Homo sapiens
agacccaccuacagagugu

SEQ ID NO: 1449221 - RNA, 19 nt, Homo sapiens
ggccaagguccuccugcua

SEQ ID NO: 1449222 - RNA, 19 nt, Homo sapiens
gcugagagaggcccugaag

SEQ ID NO: 1449223 - RNA, 19 nt, Homo sapiens
ggccaccggcuuccucuau

SEQ ID NO: 1449224 - RNA, 19 nt, Homo sapiens
agagccaaccucaagauga

SEQ ID NO: 1449225 - RNA, 19 nt, Homo sapiens
cuacagacaaagacaaugg

SEQ ID NO: 1449226 - RNA, 19 nt, Homo sapiens
cauccuggagcacaugauu

SEQ ID NO: 1449227 - RNA, 19 nt, Homo sapiens
cggugaaccuggcgugaag

SEQ ID NO: 1449228 - RNA, 19 nt, Homo sapiens
uaaguuacaggacucugau

SEQ ID NO: 1449229 - RNA, 19 nt, Homo sapiens
ccaccuacagaguguccua

SEQ ID NO: 1449230 - RNA, 19 nt, Homo sapiens
gccaccggcuuccucuauc

SEQ ID NO: 1449231 - RNA, 19 nt, Homo sapiens
caacguguauaucauccua

SEQ ID NO: 1449232 - RNA, 19 nt, Homo sapiens
gaaaauagcgggaauucuu

SEQ ID NO: 1449233 - RNA, 19 nt, Homo sapiens
aaacuggaauucucagaug

SEQ ID NO: 1449234 - RNA, 19 nt, Homo sapiens
gcaccaaagccuauuacaa

SEQ ID NO: 1449235 - RNA, 19 nt, Homo sapiens
aaaggacucuggugucuca

SEQ ID NO: 1449236 - RNA, 19 nt, Homo sapiens
caccaaagccuauuacaag

SEQ ID NO: 1449237 - RNA, 19 nt, Homo sapiens
gaaacuggaauucucagau

SEQ ID NO: 1449238 - RNA, 19 nt, Homo sapiens
ccagaguacugaagauucu

SEQ ID NO: 1449239 - RNA, 19 nt, Homo sapiens
ucaaaggacucuggugucu

SEQ ID NO: 1449240 - RNA, 19 nt, Homo sapiens
ggaauucuugcaacgugua

SEQ ID NO: 1449241 - RNA, 19 nt, Homo sapiens
gauaagaagggaugaacuc

SEQ ID NO: 1449242 - RNA, 19 nt, Homo sapiens
cccaggaacugauaagaag

SEQ ID NO: 1449243 - RNA, 19 nt, Homo sapiens
auccagauaugaucgagua

SEQ ID NO: 1449244 - RNA, 19 nt, Homo sapiens
gaaccagggaugugaaacu

SEQ ID NO: 1449245 - RNA, 19 nt, Homo sapiens
gcgaccaccugaccaagca

SEQ ID NO: 1449246 - RNA, 19 nt, Homo sapiens
uggcgugccuggacuacuu

SEQ ID NO: 1449247 - RNA, 19 nt, Homo sapiens
cgacugcgacaagaaguuu

SEQ ID NO: 1449248 - RNA, 19 nt, Homo sapiens
gucuuacccucaaggauga

SEQ ID NO: 1449249 - RNA, 19 nt, Homo sapiens
ggagcgaccaccugaccaa

SEQ ID NO: 1449250 - RNA, 19 nt, Homo sapiens
agucauugcugucagucuu

SEQ ID NO: 1449251 - RNA, 19 nt, Homo sapiens
gcugcaccaaagccuauua

SEQ ID NO: 1449252 - RNA, 19 nt, Homo sapiens
acguguauaucauccuaaa

SEQ ID NO: 1449253 - RNA, 19 nt, Homo sapiens
gaugugaaacuggaauucu

SEQ ID NO: 1449254 - RNA, 19 nt, Homo sapiens
ccaaagccuauuacaaguc

SEQ ID NO: 1449255 - RNA, 19 nt, Homo sapiens
gucauugcugucagucuua

SEQ ID NO: 1449256 - RNA, 19 nt, Homo sapiens
ccgagugccugguguccau

SEQ ID NO: 1449257 - RNA, 19 nt, Homo sapiens
gggaugugaaacuggaauu

SEQ ID NO: 1449258 - RNA, 19 nt, Homo sapiens
ggagcucccagucucaaag

SEQ ID NO: 1449259 - RNA, 19 nt, Homo sapiens
gaggagcucccagucucaa

SEQ ID NO: 1449260 - RNA, 19 nt, Homo sapiens
ggaugugaaacuggaauuc

SEQ ID NO: 1449261 - RNA, 19 nt, Homo sapiens
accaaagccuauuacaagu

SEQ ID NO: 1449262 - RNA, 19 nt, Homo sapiens
gcaaagagacuuccuguaa

SEQ ID NO: 1449263 - RNA, 19 nt, Homo sapiens
gaaguugguuggaauagaa

SEQ ID NO: 1449264 - RNA, 19 nt, Homo sapiens
aaaggaaucugggaaguua

SEQ ID NO: 1449265 - RNA, 19 nt, Homo sapiens
ucaagaggcuggaauaaga

SEQ ID NO: 1449266 - RNA, 19 nt, Homo sapiens
gaugggaaauuaccaaaga

SEQ ID NO: 1449267 - RNA, 19 nt, Homo sapiens
ccacuuaaauguauucaga

SEQ ID NO: 1449268 - RNA, 19 nt, Homo sapiens
aaauugagcuccacucuga

SEQ ID NO: 1449269 - RNA, 19 nt, Homo sapiens
ucaaugaggugaaccagaa

SEQ ID NO: 1449270 - RNA, 19 nt, Homo sapiens
ggaaggagagugaaaguga

SEQ ID NO: 1449271 - RNA, 19 nt, Homo sapiens
caaagugcauggcaaaugu

SEQ ID NO: 1449272 - RNA, 19 nt, Homo sapiens
caaagucucucuaccaaca

SEQ ID NO: 1449273 - RNA, 19 nt, Homo sapiens
gcagugagcugagauugug

SEQ ID NO: 1449274 - RNA, 19 nt, Homo sapiens
gagaaaccacuuaaaugua

SEQ ID NO: 1449275 - RNA, 19 nt, Homo sapiens
gaaggagagugaaagugaa

SEQ ID NO: 1449276 - RNA, 19 nt, Homo sapiens
gaacaccaaagaucuauau

SEQ ID NO: 1449277 - RNA, 19 nt, Homo sapiens
gguaaaaucucacacaauu

SEQ ID NO: 1449278 - RNA, 19 nt, Homo sapiens
ugaaauagcacaagacaga

SEQ ID NO: 1449279 - RNA, 19 nt, Homo sapiens
uaacaggauucaugcuaaa

SEQ ID NO: 1449280 - RNA, 19 nt, Homo sapiens
gaaccaacaugacagugau

SEQ ID NO: 1449281 - RNA, 19 nt, Homo sapiens
gcaauagagaguagaaauu

SEQ ID NO: 1449282 - RNA, 19 nt, Homo sapiens
gccaaggacuuacacauca

SEQ ID NO: 1449283 - RNA, 19 nt, Homo sapiens
caaagagacuuccuguaag

SEQ ID NO: 1449284 - RNA, 19 nt, Homo sapiens
auagggagcuuccugcuuu

SEQ ID NO: 1449285 - RNA, 19 nt, Homo sapiens
aaagugaccuaacaggauu

SEQ ID NO: 1449286 - RNA, 19 nt, Homo sapiens
ggagcuuccugcuuuggua

SEQ ID NO: 1449287 - RNA, 19 nt, Homo sapiens
uggcaaauguuaaaggaaa

SEQ ID NO: 1449288 - RNA, 19 nt, Homo sapiens
cuaacaggauucaugcuaa

SEQ ID NO: 1449289 - RNA, 19 nt, Homo sapiens
gaaggcagugggacaagua

SEQ ID NO: 1449290 - RNA, 19 nt, Homo sapiens
gaagccaaaugaaagagau

SEQ ID NO: 1449291 - RNA, 19 nt, Homo sapiens
caacaugacagugauacua

SEQ ID NO: 1449292 - RNA, 19 nt, Homo sapiens
gaguauuccugauaaagug

SEQ ID NO: 1449293 - RNA, 19 nt, Homo sapiens
agagagacaucaaacauag

SEQ ID NO: 1449294 - RNA, 19 nt, Homo sapiens
ggaaauuaccaaagagaga

SEQ ID NO: 1449295 - RNA, 19 nt, Homo sapiens
gcaaaggaaucugggaagu

SEQ ID NO: 1449296 - RNA, 19 nt, Homo sapiens
caucaaaaguggagaauga

SEQ ID NO: 1449297 - RNA, 19 nt, Homo sapiens
ugagaaaccacuuaaaugu

SEQ ID NO: 1449298 - RNA, 19 nt, Homo sapiens
ggacuucauucaagacucu

SEQ ID NO: 1449299 - RNA, 19 nt, Homo sapiens
ccaaagcagaaccaacuua

SEQ ID NO: 1449300 - RNA, 19 nt, Homo sapiens
acacaauucuucguucaaa

SEQ ID NO: 1449301 - RNA, 19 nt, Homo sapiens
caacaaagucucucuacca

SEQ ID NO: 1449302 - RNA, 19 nt, Homo sapiens
gcaaagccuugagaaccaa

SEQ ID NO: 1449303 - RNA, 19 nt, Homo sapiens
gcuaaaggcaggccaagga

SEQ ID NO: 1449304 - RNA, 19 nt, Homo sapiens
caucaaacauaggaguauu

SEQ ID NO: 1449305 - RNA, 19 nt, Homo sapiens
ccacaaagugcauggcaaa

SEQ ID NO: 1449306 - RNA, 19 nt, Homo sapiens
aaggaugacucuuguggaa

SEQ ID NO: 1449307 - RNA, 19 nt, Homo sapiens
gaaaguuccauaucugaca

SEQ ID NO: 1449308 - RNA, 19 nt, Homo sapiens
gaaguggcuuuggucaaug

SEQ ID NO: 1449309 - RNA, 19 nt, Homo sapiens
agaaguggcuuuggucaau

SEQ ID NO: 1449310 - RNA, 19 nt, Homo sapiens
ugaagaaaccaaagcagaa

SEQ ID NO: 1449311 - RNA, 19 nt, Homo sapiens
uaaauugugccauuccaaa

SEQ ID NO: 1449312 - RNA, 19 nt, Homo sapiens
caggaggacuucauucaag

SEQ ID NO: 1449313 - RNA, 19 nt, Homo sapiens
ucacacaauucuucguuca

SEQ ID NO: 1449314 - RNA, 19 nt, Homo sapiens
ucaguaacaccgccaauga

SEQ ID NO: 1449315 - RNA, 19 nt, Homo sapiens
uaucguauuuguccugaug

SEQ ID NO: 1449316 - RNA, 19 nt, Homo sapiens
uaaagugaccuaacaggau

SEQ ID NO: 1449317 - RNA, 19 nt, Homo sapiens
ggaguauuccugauaaagu

SEQ ID NO: 1449318 - RNA, 19 nt, Homo sapiens
cauggcaaauguuaaagga

SEQ ID NO: 1449319 - RNA, 19 nt, Homo sapiens
gugcauggcaaauguuaaa

SEQ ID NO: 1449320 - RNA, 19 nt, Homo sapiens
gggaggagaggcagcauga

SEQ ID NO: 1449321 - RNA, 19 nt, Homo sapiens
gaacuguauugccacacau

SEQ ID NO: 1449322 - RNA, 19 nt, Homo sapiens
guugagaaaccacuuaaau

SEQ ID NO: 1449323 - RNA, 19 nt, Homo sapiens
gcacaagacagauauuuug

SEQ ID NO: 1449324 - RNA, 19 nt, Homo sapiens
ggucaaugccuauccugaa

SEQ ID NO: 1449325 - RNA, 19 nt, Homo sapiens
ccaaggacuuacacaucaa

SEQ ID NO: 1449326 - RNA, 19 nt, Homo sapiens
aagagagacaucaaacaua

SEQ ID NO: 1449327 - RNA, 19 nt, Homo sapiens
ugaaugaacuaggugaagu

SEQ ID NO: 1449328 - RNA, 19 nt, Homo sapiens
aacaaagucucucuaccaa

SEQ ID NO: 1449329 - RNA, 19 nt, Homo sapiens
ucugggaaguuaccaaaug

SEQ ID NO: 1449330 - RNA, 19 nt, Homo sapiens
ugggaucccucacaaacaa

SEQ ID NO: 1449331 - RNA, 19 nt, Homo sapiens
guccugauguucuucucua

SEQ ID NO: 1449332 - RNA, 19 nt, Homo sapiens
ugacucuuguggaaccaua

SEQ ID NO: 1449333 - RNA, 19 nt, Homo sapiens
cugauaaagugaccuaaca

SEQ ID NO: 1449334 - RNA, 19 nt, Homo sapiens
ggacaaguggggauuuaua

SEQ ID NO: 1449335 - RNA, 19 nt, Homo sapiens
caaaggaaucugggaaguu

SEQ ID NO: 1449336 - RNA, 19 nt, Homo sapiens
gcucagaggcaaaggaauc

SEQ ID NO: 1449337 - RNA, 19 nt, Homo sapiens
caaagagagacaucaaaca

SEQ ID NO: 1449338 - RNA, 19 nt, Homo sapiens
gcucaagaggcuggaauaa

SEQ ID NO: 1449339 - RNA, 19 nt, Homo sapiens
gcuggaaggaugacucuug

SEQ ID NO: 1449340 - RNA, 19 nt, Homo sapiens
aaauagcacaagacagaua

SEQ ID NO: 1449341 - RNA, 19 nt, Homo sapiens
gaaaagagacagucaagag

SEQ ID NO: 1449342 - RNA, 19 nt, Homo sapiens
gccagucucaguucaauga

SEQ ID NO: 1449343 - RNA, 19 nt, Homo sapiens
gacaucaaacauaggagua

SEQ ID NO: 1449344 - RNA, 19 nt, Homo sapiens
aaagagagacaucaaacau

SEQ ID NO: 1449345 - RNA, 19 nt, Homo sapiens
gagcuccacucugaauaca

SEQ ID NO: 1449346 - RNA, 19 nt, Homo sapiens
gcuggaauaagaucugauu

SEQ ID NO: 1449347 - RNA, 19 nt, Homo sapiens
ggaacaccaaagaucuaua

SEQ ID NO: 1449348 - RNA, 19 nt, Homo sapiens
caaugccuauccugaacaa

SEQ ID NO: 1449349 - RNA, 19 nt, Homo sapiens
gaggcagcaugacccagaa

SEQ ID NO: 1449350 - RNA, 19 nt, Homo sapiens
ugaaguugguuggaauaga

SEQ ID NO: 1449351 - RNA, 19 nt, Homo sapiens
gaggagacuuuuacaacaa

SEQ ID NO: 1449352 - RNA, 19 nt, Homo sapiens
gcacugccuccacugcaaa

SEQ ID NO: 1449353 - RNA, 19 nt, Homo sapiens
aaagagacuuccuguaagc

SEQ ID NO: 1449354 - RNA, 19 nt, Homo sapiens
gcuccacucugaauacaac

SEQ ID NO: 1449355 - RNA, 19 nt, Homo sapiens
ggugaaguugguuggaaua

SEQ ID NO: 1449356 - RNA, 19 nt, Homo sapiens
aaaaggccaucacguguuu

SEQ ID NO: 1449357 - RNA, 19 nt, Homo sapiens
aagagacagucaagaggaa

SEQ ID NO: 1449358 - RNA, 19 nt, Homo sapiens
auucaagacucuauugcaa

SEQ ID NO: 1449359 - RNA, 19 nt, Homo sapiens
gccuugaguguauauauuu

SEQ ID NO: 1449360 - RNA, 19 nt, Homo sapiens
cugggaaguuaccaaauga

SEQ ID NO: 1449361 - RNA, 19 nt, Homo sapiens
guaaggaaagcaagcaaag

SEQ ID NO: 1449362 - RNA, 19 nt, Homo sapiens
ggaauaaacuugaauugug

SEQ ID NO: 1449363 - RNA, 19 nt, Homo sapiens
gcaguuggguuucucauaa

SEQ ID NO: 1449364 - RNA, 19 nt, Homo sapiens
gagaacaguuaucuuagua

SEQ ID NO: 1449365 - RNA, 19 nt, Homo sapiens
gaaaggagcagauauuaau

SEQ ID NO: 1449366 - RNA, 19 nt, Homo sapiens
gguuauguguugagaauua

SEQ ID NO: 1449367 - RNA, 19 nt, Homo sapiens
ugaaauugcuucugucaaa

SEQ ID NO: 1449368 - RNA, 19 nt, Homo sapiens
gcucuagccuucugccuua

SEQ ID NO: 1449369 - RNA, 19 nt, Homo sapiens
caacccaccugcauaauau

SEQ ID NO: 1449370 - RNA, 19 nt, Homo sapiens
gaaaccaugugauucuuug

SEQ ID NO: 1449371 - RNA, 19 nt, Homo sapiens
ccucuucccuuucuaauaa

SEQ ID NO: 1449372 - RNA, 19 nt, Homo sapiens
ggagacauccucauugaaa

SEQ ID NO: 1449373 - RNA, 19 nt, Homo sapiens
ggaaaccucuucauuaugc

SEQ ID NO: 1449374 - RNA, 19 nt, Homo sapiens
guucuccacugaaguaaua

SEQ ID NO: 1449375 - RNA, 19 nt, Homo sapiens
ggagaaaccauuccaguau

SEQ ID NO: 1449376 - RNA, 19 nt, Homo sapiens
ccaagaugguucacaguuu

SEQ ID NO: 1449377 - RNA, 19 nt, Homo sapiens
caacuagccuaacccugua

SEQ ID NO: 1449378 - RNA, 19 nt, Homo sapiens
agagagaacaguuaucuua

SEQ ID NO: 1449379 - RNA, 19 nt, Homo sapiens
gagagugcccuccuacaua

SEQ ID NO: 1449380 - RNA, 19 nt, Homo sapiens
cuuggaggcugauuacuua

SEQ ID NO: 1449381 - RNA, 19 nt, Homo sapiens
ggauugaccuugguuaugu

SEQ ID NO: 1449382 - RNA, 19 nt, Homo sapiens
uaagagcgcugccuauaag

SEQ ID NO: 1449383 - RNA, 19 nt, Homo sapiens
guagguaggugcagugugu

SEQ ID NO: 1449384 - RNA, 19 nt, Homo sapiens
gagaaaccauuccaguaug

SEQ ID NO: 1449385 - RNA, 19 nt, Homo sapiens
aaggaaaccucuucauuau

SEQ ID NO: 1449386 - RNA, 19 nt, Homo sapiens
auacucagauuguggauaa

SEQ ID NO: 1449387 - RNA, 19 nt, Homo sapiens
ccaccugcauaauauauuu

SEQ ID NO: 1449388 - RNA, 19 nt, Homo sapiens
agaagaagcuggugagagu

SEQ ID NO: 1449389 - RNA, 19 nt, Homo sapiens
gacaaauucacaacacuua

SEQ ID NO: 1449390 - RNA, 19 nt, Homo sapiens
gaacagucacccugguuaa

SEQ ID NO: 1449391 - RNA, 19 nt, Homo sapiens
gaggaagacuagugcuuug

SEQ ID NO: 1449392 - RNA, 19 nt, Homo sapiens
gcauagcucaccuuucuaa

SEQ ID NO: 1449393 - RNA, 19 nt, Homo sapiens
caaauacagcacuugaaua

SEQ ID NO: 1449394 - RNA, 19 nt, Homo sapiens
ggccaacucuacauauuug

SEQ ID NO: 1449395 - RNA, 19 nt, Homo sapiens
gauauuaaugcuccagaua

SEQ ID NO: 1449396 - RNA, 19 nt, Homo sapiens
agagugcccuccuacauaa

SEQ ID NO: 1449397 - RNA, 19 nt, Homo sapiens
caagaugguucacaguuuc

SEQ ID NO: 1449398 - RNA, 19 nt, Homo sapiens
gccauaagccuguuaguau

SEQ ID NO: 1449399 - RNA, 19 nt, Homo sapiens
ggucauguuuccuguguga

SEQ ID NO: 1449400 - RNA, 19 nt, Homo sapiens
gagcaguacagcuaauuaa

SEQ ID NO: 1449401 - RNA, 19 nt, Homo sapiens
gcaagaacaaauggaauaa

SEQ ID NO: 1449402 - RNA, 19 nt, Homo sapiens
ugacuugccauccauauaa

SEQ ID NO: 1449403 - RNA, 19 nt, Homo sapiens
gggauuuccuggcauaguu

SEQ ID NO: 1449404 - RNA, 19 nt, Homo sapiens
gauaagcaauuagcucuag

SEQ ID NO: 1449405 - RNA, 19 nt, Homo sapiens
uggaugaggugaaagacua

SEQ ID NO: 1449406 - RNA, 19 nt, Homo sapiens
ggaauacagugcccuaaaa

SEQ ID NO: 1449407 - RNA, 19 nt, Homo sapiens
ccaguaacauuugaccuuu

SEQ ID NO: 1449408 - RNA, 19 nt, Homo sapiens
ggaggaagacuagugcuuu

SEQ ID NO: 1449409 - RNA, 19 nt, Homo sapiens
agaauagacugaccaagau

SEQ ID NO: 1449410 - RNA, 19 nt, Homo sapiens
gaagagagaacaguuaucu

SEQ ID NO: 1449411 - RNA, 19 nt, Homo sapiens
caaaggccaacucuacaua

SEQ ID NO: 1449412 - RNA, 19 nt, Homo sapiens
gaaggucugauucuacaaa

SEQ ID NO: 1449413 - RNA, 19 nt, Homo sapiens
acuguuaucuauaggcuua

SEQ ID NO: 1449414 - RNA, 19 nt, Homo sapiens
gugauucuuuguacaguuu

SEQ ID NO: 1449415 - RNA, 19 nt, Homo sapiens
acaguuaucuuaguaccua

SEQ ID NO: 1449416 - RNA, 19 nt, Homo sapiens
ucucauaaguauccuaguu

SEQ ID NO: 1449417 - RNA, 19 nt, Homo sapiens
ggagaaacaaucauaucuu

SEQ ID NO: 1449418 - RNA, 19 nt, Homo sapiens
guaaauggagaaacaauca

SEQ ID NO: 1449419 - RNA, 19 nt, Homo sapiens
ccacuuggcagacaaauuc

SEQ ID NO: 1449420 - RNA, 19 nt, Homo sapiens
uagaauagacugaccaaga

SEQ ID NO: 1449421 - RNA, 19 nt, Homo sapiens
cugcugugauguaaacuua

SEQ ID NO: 1449422 - RNA, 19 nt, Homo sapiens
caaauccgacuaccagaaa

SEQ ID NO: 1449423 - RNA, 19 nt, Homo sapiens
gucuauaacuaucaacgua

SEQ ID NO: 1449424 - RNA, 19 nt, Homo sapiens
ggaaaccaugugauucuuu

SEQ ID NO: 1449425 - RNA, 19 nt, Homo sapiens
cagucacccugguuaauaa

SEQ ID NO: 1449426 - RNA, 19 nt, Homo sapiens
gauuucaugucucuuuaga

SEQ ID NO: 1449427 - RNA, 19 nt, Homo sapiens
gaaauugcuucugucaaag

SEQ ID NO: 1449428 - RNA, 19 nt, Homo sapiens
gcugaaaggagcagauauu

SEQ ID NO: 1449429 - RNA, 19 nt, Homo sapiens
caaaauguauucucuguuc

SEQ ID NO: 1449430 - RNA, 19 nt, Homo sapiens
ccaacccaccugcauaaua

SEQ ID NO: 1449431 - RNA, 19 nt, Homo sapiens
ccucuagauucauacauuu

SEQ ID NO: 1449432 - RNA, 19 nt, Homo sapiens
acgcauagcucaccuuucu

SEQ ID NO: 1449433 - RNA, 19 nt, Homo sapiens
gcagacaaauucacaacac

SEQ ID NO: 1449434 - RNA, 19 nt, Homo sapiens
guaaugcaguagaggcuau

SEQ ID NO: 1449435 - RNA, 19 nt, Homo sapiens
ggggugagauuuacuguuu

SEQ ID NO: 1449436 - RNA, 19 nt, Homo sapiens
ugggauuccugaucaagua

SEQ ID NO: 1449437 - RNA, 19 nt, Homo sapiens
ugaaaggagcagauauuaa

SEQ ID NO: 1449438 - RNA, 19 nt, Homo sapiens
ucuauaggcuuaucguuca

SEQ ID NO: 1449439 - RNA, 19 nt, Homo sapiens
gcgaaagguuaaguaaguu

SEQ ID NO: 1449440 - RNA, 19 nt, Homo sapiens
guuaagagcgcugccuaua

SEQ ID NO: 1449441 - RNA, 19 nt, Homo sapiens
uuacugggauuccugauca

SEQ ID NO: 1449442 - RNA, 19 nt, Homo sapiens
ggacugaccgccuuugaag

SEQ ID NO: 1449443 - RNA, 19 nt, Homo sapiens
acuagaagguggaaggaaa

SEQ ID NO: 1449444 - RNA, 19 nt, Homo sapiens
cuacauucaugguauggaa

SEQ ID NO: 1449445 - RNA, 19 nt, Homo sapiens
guaagccucuucccuuucu

SEQ ID NO: 1449446 - RNA, 19 nt, Homo sapiens
gauaacuccggaagaauga

SEQ ID NO: 1449447 - RNA, 19 nt, Homo sapiens
ugucaaagggugcugauaa

SEQ ID NO: 1449448 - RNA, 19 nt, Homo sapiens
agacuuggaugaggugaaa

SEQ ID NO: 1449449 - RNA, 19 nt, Homo sapiens
gagagugcauuguccuauc

SEQ ID NO: 1449450 - RNA, 19 nt, Homo sapiens
ucacaaaguagugguuuaa

SEQ ID NO: 1449451 - RNA, 19 nt, Homo sapiens
ugacugaacuuuggauuuu

SEQ ID NO: 1449452 - RNA, 19 nt, Homo sapiens
ucggugacuuuaagcuuua

SEQ ID NO: 1449453 - RNA, 19 nt, Homo sapiens
aagaccaagucaugcaaua

SEQ ID NO: 1449454 - RNA, 19 nt, Homo sapiens
ugaccuugguuauguguug

SEQ ID NO: 1449455 - RNA, 19 nt, Homo sapiens
ccauaagccuguuaguauc

SEQ ID NO: 1449456 - RNA, 19 nt, Homo sapiens
auaagcaauugcaguguuu

SEQ ID NO: 1449457 - RNA, 19 nt, Homo sapiens
uugaauaucccaaguaguu

SEQ ID NO: 1449458 - RNA, 19 nt, Homo sapiens
gcuucagacuguuaucuau

SEQ ID NO: 1449459 - RNA, 19 nt, Homo sapiens
ggucugcuuucuacauuca

SEQ ID NO: 1449460 - RNA, 19 nt, Homo sapiens
ucacuuacaacuagccuaa

SEQ ID NO: 1449461 - RNA, 19 nt, Homo sapiens
uggauuucaugucucuuua

SEQ ID NO: 1449462 - RNA, 19 nt, Homo sapiens
gacagaaacuaccucauua

SEQ ID NO: 1449463 - RNA, 19 nt, Homo sapiens
gaguggaccuuuauauuaa

SEQ ID NO: 1449464 - RNA, 19 nt, Homo sapiens
gcaaugagauagaagaaau

SEQ ID NO: 1449465 - RNA, 19 nt, Homo sapiens
gcagacaguuuagcacuua

SEQ ID NO: 1449466 - RNA, 19 nt, Homo sapiens
ggaaauagaagguguaaga

SEQ ID NO: 1449467 - RNA, 19 nt, Homo sapiens
gaauauugguucuucguaa

SEQ ID NO: 1449468 - RNA, 19 nt, Homo sapiens
ggaaagagauucuauacac

SEQ ID NO: 1449469 - RNA, 19 nt, Homo sapiens
gaaaggcagcucuaacaua

SEQ ID NO: 1449470 - RNA, 19 nt, Homo sapiens
ugacuacguucuucaauuu

SEQ ID NO: 1449471 - RNA, 19 nt, Homo sapiens
gagcauuucuucacaccua

SEQ ID NO: 1449472 - RNA, 19 nt, Homo sapiens
gauacuagcugguccugaa

SEQ ID NO: 1449473 - RNA, 19 nt, Homo sapiens
ggaaagcacuaccuauaca

SEQ ID NO: 1449474 - RNA, 19 nt, Homo sapiens
gaaagagauucuauacaca

SEQ ID NO: 1449475 - RNA, 19 nt, Homo sapiens
gaagaagauuaaaguggaa

SEQ ID NO: 1449476 - RNA, 19 nt, Homo sapiens
gaacuuaaugcuucucaaa

SEQ ID NO: 1449477 - RNA, 19 nt, Homo sapiens
cuacagaaguuggaucuuu

SEQ ID NO: 1449478 - RNA, 19 nt, Homo sapiens
ccaaagcacuccaucacuu

SEQ ID NO: 1449479 - RNA, 19 nt, Homo sapiens
acaauaagaucacgacaau

SEQ ID NO: 1449480 - RNA, 19 nt, Homo sapiens
agaguggaccuuuauauua

SEQ ID NO: 1449481 - RNA, 19 nt, Homo sapiens
gaagguaucgcaagagaug

SEQ ID NO: 1449482 - RNA, 19 nt, Homo sapiens
ggucuacacuauuauacaa

SEQ ID NO: 1449483 - RNA, 19 nt, Homo sapiens
gagcaagucuaccucaauc

SEQ ID NO: 1449484 - RNA, 19 nt, Homo sapiens
aaaggcagcucuaacauag

SEQ ID NO: 1449485 - RNA, 19 nt, Homo sapiens
cuaccucaaucuaacuuua

SEQ ID NO: 1449486 - RNA, 19 nt, Homo sapiens
uaagacaucccaccugaaa

SEQ ID NO: 1449487 - RNA, 19 nt, Homo sapiens
ugaucaaccuggaggauaa

SEQ ID NO: 1449488 - RNA, 19 nt, Homo sapiens
gcacuuacuucagauaugg

SEQ ID NO: 1449489 - RNA, 19 nt, Homo sapiens
gaagaaaucaguggacuag

SEQ ID NO: 1449490 - RNA, 19 nt, Homo sapiens
gcaagucuaccucaaucua

SEQ ID NO: 1449491 - RNA, 19 nt, Homo sapiens
gaagguguaagaaguuuga

SEQ ID NO: 1449492 - RNA, 19 nt, Homo sapiens
ggaaaagucugaauauugg

SEQ ID NO: 1449493 - RNA, 19 nt, Homo sapiens
gaaaucaguggacuagaga

SEQ ID NO: 1449494 - RNA, 19 nt, Homo sapiens
cuaccugccuuaauucuau

SEQ ID NO: 1449495 - RNA, 19 nt, Homo sapiens
gagaauaccuuggauugac

SEQ ID NO: 1449496 - RNA, 19 nt, Homo sapiens
uuggcaagcuguauucaua

SEQ ID NO: 1449497 - RNA, 19 nt, Homo sapiens
uaagauugcugagcugaga

SEQ ID NO: 1449498 - RNA, 19 nt, Homo sapiens
agacagaaacuaccucauu

SEQ ID NO: 1449499 - RNA, 19 nt, Homo sapiens
gaaauagaagguguaagaa

SEQ ID NO: 1449500 - RNA, 19 nt, Homo sapiens
gaucacagguuuggaggau

SEQ ID NO: 1449501 - RNA, 19 nt, Homo sapiens
gcagguagacuagcacuug

SEQ ID NO: 1449502 - RNA, 19 nt, Homo sapiens
ggccaaacuuucagccaaa

SEQ ID NO: 1449503 - RNA, 19 nt, Homo sapiens
cacaagaccaccuuacuuu

SEQ ID NO: 1449504 - RNA, 19 nt, Homo sapiens
gaucacacacuccuauuuc

SEQ ID NO: 1449505 - RNA, 19 nt, Homo sapiens
gccaguuucucuugugauu

SEQ ID NO: 1449506 - RNA, 19 nt, Homo sapiens
gauacgcccugaucacaca

SEQ ID NO: 1449507 - RNA, 19 nt, Homo sapiens
aauagaagguguaagaagu

SEQ ID NO: 1449508 - RNA, 19 nt, Homo sapiens
uagaagguaucgcaagaga

SEQ ID NO: 1449509 - RNA, 19 nt, Homo sapiens
gcgauuaacagaauuagau

SEQ ID NO: 1449510 - RNA, 19 nt, Homo sapiens
ccggaaagcacuaccuaua

SEQ ID NO: 1449511 - RNA, 19 nt, Homo sapiens
cagaaacuaccucauuaaa

SEQ ID NO: 1449512 - RNA, 19 nt, Homo sapiens
guuuagcacuuacuucaga

SEQ ID NO: 1449513 - RNA, 19 nt, Homo sapiens
ggaaggauacgcccugauc

SEQ ID NO: 1449514 - RNA, 19 nt, Homo sapiens
gagauucuauacacagaca

SEQ ID NO: 1449515 - RNA, 19 nt, Homo sapiens
ugaggaaccugccaagagu

SEQ ID NO: 1449516 - RNA, 19 nt, Homo sapiens
gacuagagaugugcaacaa

SEQ ID NO: 1449517 - RNA, 19 nt, Homo sapiens
ggauggcaaugagauagaa

SEQ ID NO: 1449518 - RNA, 19 nt, Homo sapiens
gaaagcacuaccuauacaa

SEQ ID NO: 1449519 - RNA, 19 nt, Homo sapiens
cguagaagguaucgcaaga

SEQ ID NO: 1449520 - RNA, 19 nt, Homo sapiens
cagaguggaccuuuauauu

SEQ ID NO: 1449521 - RNA, 19 nt, Homo sapiens
agaauuagaucagaagaag

SEQ ID NO: 1449522 - RNA, 19 nt, Homo sapiens
caagcuguauucauaugga

SEQ ID NO: 1449523 - RNA, 19 nt, Homo sapiens
cagcagugaauaaauauga

SEQ ID NO: 1449524 - RNA, 19 nt, Homo sapiens
gaucagaagaagauuaaag

SEQ ID NO: 1449525 - RNA, 19 nt, Homo sapiens
guaucaugcucucacuaaa

SEQ ID NO: 1449526 - RNA, 19 nt, Homo sapiens
caagucuaccucaaucuaa

SEQ ID NO: 1449527 - RNA, 19 nt, Homo sapiens
aagcgcauccuacaaagua

SEQ ID NO: 1449528 - RNA, 19 nt, Homo sapiens
uagaagguguaagaaguuu

SEQ ID NO: 1449529 - RNA, 19 nt, Homo sapiens
ccacaagaccaccuuacuu

SEQ ID NO: 1449530 - RNA, 19 nt, Homo sapiens
gagcugagagaaauagaau

SEQ ID NO: 1449531 - RNA, 19 nt, Homo sapiens
ggccauggguccagcuguu

SEQ ID NO: 1449532 - RNA, 19 nt, Homo sapiens
agaaaucaguggacuagag

SEQ ID NO: 1449533 - RNA, 19 nt, Homo sapiens
gaaaagagugggaaggauu

SEQ ID NO: 1449534 - RNA, 19 nt, Homo sapiens
ggcuacaacugcagauguu

SEQ ID NO: 1449535 - RNA, 19 nt, Homo sapiens
uagagaauaccuuggauug

SEQ ID NO: 1449536 - RNA, 19 nt, Homo sapiens
ggcaagcuguauucauaug

SEQ ID NO: 1449537 - RNA, 19 nt, Homo sapiens
caaagcacuccaucacuug

SEQ ID NO: 1449538 - RNA, 19 nt, Homo sapiens
guggauauguucaucuaca

SEQ ID NO: 1449539 - RNA, 19 nt, Homo sapiens
uguucuaccugccuuaauu

SEQ ID NO: 1449540 - RNA, 19 nt, Homo sapiens
cuucgaauaugggugauuu

SEQ ID NO: 1449541 - RNA, 19 nt, Homo sapiens
gaugugcaacaaccuaauu

SEQ ID NO: 1449542 - RNA, 19 nt, Homo sapiens
gagaugugcaacaaccuaa

SEQ ID NO: 1449543 - RNA, 19 nt, Homo sapiens
gauauguucaucuacagaa

SEQ ID NO: 1449544 - RNA, 19 nt, Homo sapiens
gguguaagaaguuugaaau

SEQ ID NO: 1449545 - RNA, 19 nt, Homo sapiens
gaacauggggaaauucauu

SEQ ID NO: 1449546 - RNA, 19 nt, Homo sapiens
gaagauuaaaguggaagaa

SEQ ID NO: 1449547 - RNA, 19 nt, Homo sapiens
ccuggaggauaauaagauu

SEQ ID NO: 1449548 - RNA, 19 nt, Homo sapiens
cacgacaauuaauggcuua

SEQ ID NO: 1449549 - RNA, 19 nt, Homo sapiens
ugaguuguaugccuuaucu

SEQ ID NO: 1449550 - RNA, 19 nt, Homo sapiens
cagguagacuagcacuuga

SEQ ID NO: 1449551 - RNA, 19 nt, Homo sapiens
guuaugguaaucacaagua

SEQ ID NO: 1449552 - RNA, 19 nt, Homo sapiens
gaacuggagcccgaucguu

SEQ ID NO: 1449553 - RNA, 19 nt, Homo sapiens
gaaggauacgcccugauca

SEQ ID NO: 1449554 - RNA, 19 nt, Homo sapiens
ggugauuuccugcauucua

SEQ ID NO: 1449555 - RNA, 19 nt, Homo sapiens
gaaaauccaauucaggaaa

SEQ ID NO: 1449556 - RNA, 19 nt, Homo sapiens
ugaaagcccugcagaaccu

SEQ ID NO: 1449557 - RNA, 19 nt, Homo sapiens
ugagauagaagaaaucagu

SEQ ID NO: 1449558 - RNA, 19 nt, Homo sapiens
gcuggugucuuuuaguuuu

SEQ ID NO: 1449559 - RNA, 19 nt, Homo sapiens
acagaaacuaccucauuaa

SEQ ID NO: 1449560 - RNA, 19 nt, Homo sapiens
cagccuggaugcuccuuau

SEQ ID NO: 1449561 - RNA, 19 nt, Homo sapiens
uacagaaguuggaucuuuc

SEQ ID NO: 1449562 - RNA, 19 nt, Homo sapiens
ccucaaagcuugcccaaua

SEQ ID NO: 1449563 - RNA, 19 nt, Homo sapiens
caacaucgcugaccaggau

SEQ ID NO: 1449564 - RNA, 19 nt, Homo sapiens
ccaggucgcugcagcauuu

SEQ ID NO: 1449565 - RNA, 19 nt, Homo sapiens
ccuaagggcuugagugaaa

SEQ ID NO: 1449566 - RNA, 19 nt, Homo sapiens
caacauccgugcucugaga

SEQ ID NO: 1449567 - RNA, 19 nt, Homo sapiens
ccagagcgauggagggauu

SEQ ID NO: 1449568 - RNA, 19 nt, Homo sapiens
gcagccgggugaugucuga

SEQ ID NO: 1449569 - RNA, 19 nt, Homo sapiens
gaguuggucuccagaagag

SEQ ID NO: 1449570 - RNA, 19 nt, Homo sapiens
ggagggauuuccgcuucaa

SEQ ID NO: 1449571 - RNA, 19 nt, Homo sapiens
gaccugcccuugccuucug

SEQ ID NO: 1449572 - RNA, 19 nt, Homo sapiens
gccgggugaugucugauga

SEQ ID NO: 1449573 - RNA, 19 nt, Homo sapiens
gcgccaacaccauggacua

SEQ ID NO: 1449574 - RNA, 19 nt, Homo sapiens
gcaauucccaaugcagaga

SEQ ID NO: 1449575 - RNA, 19 nt, Homo sapiens
ccugauuccgucuuugaua

SEQ ID NO: 1449576 - RNA, 19 nt, Homo sapiens
ggccuucugucugucugua

SEQ ID NO: 1449577 - RNA, 19 nt, Homo sapiens
ucauguggagcccagaaua

SEQ ID NO: 1449578 - RNA, 19 nt, Homo sapiens
guccuaagggcuugaguga

SEQ ID NO: 1449579 - RNA, 19 nt, Homo sapiens
ugaugaagacacacuccua

SEQ ID NO: 1449580 - RNA, 19 nt, Homo sapiens
ucuggucucugacauacga

SEQ ID NO: 1449581 - RNA, 19 nt, Homo sapiens
uugagggcgugcucuacua

SEQ ID NO: 1449582 - RNA, 19 nt, Homo sapiens
ggauuuccgcuucaacauc

SEQ ID NO: 1449583 - RNA, 19 nt, Homo sapiens
ugaagacacacuccuacug

SEQ ID NO: 1449584 - RNA, 19 nt, Homo sapiens
caaacccuguaugugcauu

SEQ ID NO: 1449585 - RNA, 19 nt, Homo sapiens
gcaggcagguguggaugcu

SEQ ID NO: 1449586 - RNA, 19 nt, Homo sapiens
gcuaccugcagcuggauuu

SEQ ID NO: 1449587 - RNA, 19 nt, Homo sapiens
ugaguuggucuccagaaga

SEQ ID NO: 1449588 - RNA, 19 nt, Homo sapiens
ccuucugucugucuguauu

SEQ ID NO: 1449589 - RNA, 19 nt, Homo sapiens
agguguggaugcugcaauu

SEQ ID NO: 1449590 - RNA, 19 nt, Homo sapiens
aaacccuguaugugcauua

SEQ ID NO: 1449591 - RNA, 19 nt, Homo sapiens
gacucuggucucugacaua

SEQ ID NO: 1449592 - RNA, 19 nt, Homo sapiens
cuagauguccauggccuuu

SEQ ID NO: 1449593 - RNA, 19 nt, Homo sapiens
cugauuccgucuuugauac

SEQ ID NO: 1449594 - RNA, 19 nt, Homo sapiens
ggaaguaccuaccacauuu

SEQ ID NO: 1449595 - RNA, 19 nt, Homo sapiens
uaggauaacuugcaacauu

SEQ ID NO: 1449596 - RNA, 19 nt, Homo sapiens
gaacgcggcugcgagguuu

SEQ ID NO: 1449597 - RNA, 19 nt, Homo sapiens
gauuuaccguuuccauaua

SEQ ID NO: 1449598 - RNA, 19 nt, Homo sapiens
acauuuagcucuggaagua

SEQ ID NO: 1449599 - RNA, 19 nt, Homo sapiens
gauauaagccaacaauaca

SEQ ID NO: 1449600 - RNA, 19 nt, Homo sapiens
gaucagggcguguuagaga

SEQ ID NO: 1449601 - RNA, 19 nt, Homo sapiens
cagcaauacucaaacauuc

SEQ ID NO: 1449602 - RNA, 19 nt, Homo sapiens
gagauuuaccguuuccaua

SEQ ID NO: 1449603 - RNA, 19 nt, Homo sapiens
gaugaugacuuugauugga

SEQ ID NO: 1449604 - RNA, 19 nt, Homo sapiens
aagaaugucuaaugaguug

SEQ ID NO: 1449605 - RNA, 19 nt, Homo sapiens
ggauaacuugcaacauuua

SEQ ID NO: 1449606 - RNA, 19 nt, Homo sapiens
ggauauaagccaacaauac

SEQ ID NO: 1449607 - RNA, 19 nt, Homo sapiens
aaggacaucuacaccauuu

SEQ ID NO: 1449608 - RNA, 19 nt, Homo sapiens
caauacagcaauacucaaa

SEQ ID NO: 1449609 - RNA, 19 nt, Homo sapiens
gauaugcagcgacagaauu

SEQ ID NO: 1449610 - RNA, 19 nt, Homo sapiens
ccaaggacaucuacaccau

SEQ ID NO: 1449611 - RNA, 19 nt, Homo sapiens
aggauaacuugcaacauuu

SEQ ID NO: 1449612 - RNA, 19 nt, Homo sapiens
ucaggaacaucuuggacaa

SEQ ID NO: 1449613 - RNA, 19 nt, Homo sapiens
gaaauucaacuggaagcuu

SEQ ID NO: 1449614 - RNA, 19 nt, Homo sapiens
caucguaucagguauuguu

SEQ ID NO: 1449615 - RNA, 19 nt, Homo sapiens
ugaugacuuugauuggaua

SEQ ID NO: 1449616 - RNA, 19 nt, Homo sapiens
ggcuuuggcuccugauaug

SEQ ID NO: 1449617 - RNA, 19 nt, Homo sapiens
ggacaucuacaccauuugg

SEQ ID NO: 1449618 - RNA, 19 nt, Homo sapiens
ccuagaaccaguaucugua

SEQ ID NO: 1449619 - RNA, 19 nt, Homo sapiens
auacagcaauacucaaaca

SEQ ID NO: 1449620 - RNA, 19 nt, Homo sapiens
agccaacaauacagcaaua

SEQ ID NO: 1449621 - RNA, 19 nt, Homo sapiens
caacaauacagcaauacuc

SEQ ID NO: 1449622 - RNA, 19 nt, Homo sapiens
gaaugucuaaugaguugga

SEQ ID NO: 1449623 - RNA, 19 nt, Homo sapiens
agauuuaccguuuccauau

SEQ ID NO: 1449624 - RNA, 19 nt, Homo sapiens
cagguauuguugauauuag

SEQ ID NO: 1449625 - RNA, 19 nt, Homo sapiens
aagaugaugacuuugauug

SEQ ID NO: 1449626 - RNA, 19 nt, Homo sapiens
ggaagauacuuuuguuaac

SEQ ID NO: 1449627 - RNA, 19 nt, Homo sapiens
acagcaauacucaaacauu

SEQ ID NO: 1449628 - RNA, 19 nt, Homo sapiens
caaggacaucuacaccauu

SEQ ID NO: 1449629 - RNA, 19 nt, Homo sapiens
caacuggaagcuucaugug

SEQ ID NO: 1449630 - RNA, 19 nt, Homo sapiens
accaguaucuguaguggau

SEQ ID NO: 1449631 - RNA, 19 nt, Homo sapiens
uggaaguaccuaccacauu

SEQ ID NO: 1449632 - RNA, 19 nt, Homo sapiens
ucaaacauucacaggcaaa

SEQ ID NO: 1449633 - RNA, 19 nt, Homo sapiens
guggauauaagccaacaau

SEQ ID NO: 1449634 - RNA, 19 nt, Homo sapiens
gauuggauaauuaguaagg

SEQ ID NO: 1449635 - RNA, 19 nt, Homo sapiens
uccuugggcuggccuagaa

SEQ ID NO: 1449636 - RNA, 19 nt, Homo sapiens
gauaacuugcaacauuuag

SEQ ID NO: 1449637 - RNA, 19 nt, Homo sapiens
gaaguaccuaccacauuuu

SEQ ID NO: 1449638 - RNA, 19 nt, Homo sapiens
auaugcagcgacagaauuu

SEQ ID NO: 1449639 - RNA, 19 nt, Homo sapiens
caucuuggacaaaacuuua

SEQ ID NO: 1449640 - RNA, 19 nt, Homo sapiens
aacaauacagcaauacuca

SEQ ID NO: 1449641 - RNA, 19 nt, Homo sapiens
gccuagaaccaguaucugu

SEQ ID NO: 1449642 - RNA, 19 nt, Homo sapiens
ucagggcguguuagagaaa

SEQ ID NO: 1449643 - RNA, 19 nt, Homo sapiens
ucaacuggaagcuucaugu

SEQ ID NO: 1449644 - RNA, 19 nt, Homo sapiens
gaaccagcaucucugauuu

SEQ ID NO: 1449645 - RNA, 19 nt, Homo sapiens
gaucuuggauugacuguag

SEQ ID NO: 1449646 - RNA, 19 nt, Homo sapiens
ccacagagccuccacuuug

SEQ ID NO: 1449647 - RNA, 19 nt, Homo sapiens
guucauaggugccaaguca

SEQ ID NO: 1449648 - RNA, 19 nt, Homo sapiens
gaaacacccuucaccaucu

SEQ ID NO: 1449649 - RNA, 19 nt, Homo sapiens
ggauguggcuguccugugu

SEQ ID NO: 1449650 - RNA, 19 nt, Homo sapiens
gaaagagcccagaacauuc

SEQ ID NO: 1449651 - RNA, 19 nt, Homo sapiens
gugauucgaucuuggauug

SEQ ID NO: 1449652 - RNA, 19 nt, Homo sapiens
ggacugggcuuggcagaca

SEQ ID NO: 1449653 - RNA, 19 nt, Homo sapiens
aggaagauguuaaccagua

SEQ ID NO: 1449654 - RNA, 19 nt, Homo sapiens
ggaaccagcaucucugauu

SEQ ID NO: 1449655 - RNA, 19 nt, Homo sapiens
ggagagagccuaccuagac

SEQ ID NO: 1449656 - RNA, 19 nt, Homo sapiens
gcacaaggaagcagagaug

SEQ ID NO: 1449657 - RNA, 19 nt, Homo sapiens
agaaagagcccagaacauu

SEQ ID NO: 1449658 - RNA, 19 nt, Homo sapiens
gaagaaacgccuguguuga

SEQ ID NO: 1449659 - RNA, 19 nt, Homo sapiens
agugaaagcuccugugguu

SEQ ID NO: 1449660 - RNA, 19 nt, Homo sapiens
uggauugacuguagaagaa

SEQ ID NO: 1449661 - RNA, 19 nt, Homo sapiens
cugcugcucugcucucaua

SEQ ID NO: 1449662 - RNA, 19 nt, Homo sapiens
gagagagccuaccuagaca

SEQ ID NO: 1449663 - RNA, 19 nt, Homo sapiens
ggacagaaagagcccagaa

SEQ ID NO: 1449664 - RNA, 19 nt, Homo sapiens
gauccuuccuccuccuaaa

SEQ ID NO: 1449665 - RNA, 19 nt, Homo sapiens
ggaagauguuaaccaguag

SEQ ID NO: 1449666 - RNA, 19 nt, Homo sapiens
ccacuccacugcccuuuca

SEQ ID NO: 1449667 - RNA, 19 nt, Homo sapiens
gaaacgccuguguugauuu

SEQ ID NO: 1449668 - RNA, 19 nt, Homo sapiens
auuccuaacucuucuguuu

SEQ ID NO: 1449669 - RNA, 19 nt, Homo sapiens
cuacgacacugccgaaugg

SEQ ID NO: 1449670 - RNA, 19 nt, Homo sapiens
acaaagugauucgaucuug

SEQ ID NO: 1449671 - RNA, 19 nt, Homo sapiens
agaaacgccuguguugauu

SEQ ID NO: 1449672 - RNA, 19 nt, Homo sapiens
aaacacccuucaccaucua

SEQ ID NO: 1449673 - RNA, 19 nt, Homo sapiens
gacgaugacugggacuuug

SEQ ID NO: 1449674 - RNA, 19 nt, Homo sapiens
agaagaaacgccuguguug

SEQ ID NO: 1449675 - RNA, 19 nt, Homo sapiens
guagaagaagggacagaaa

SEQ ID NO: 1449676 - RNA, 19 nt, Homo sapiens
aaacgccuguguugauuuc

SEQ ID NO: 1449677 - RNA, 19 nt, Homo sapiens
gcgagggccuggacuaacu

SEQ ID NO: 1449678 - RNA, 19 nt, Homo sapiens
gaugacuacaguucacuuu

SEQ ID NO: 1449679 - RNA, 19 nt, Homo sapiens
cgacacugccgaauggaaa

SEQ ID NO: 1449680 - RNA, 19 nt, Homo sapiens
gaugauuccuaacucuucu

SEQ ID NO: 1449681 - RNA, 19 nt, Homo sapiens
ggaugccgcuguggucugu

SEQ ID NO: 1449682 - RNA, 19 nt, Homo sapiens
ccugugugaugaauucuug

SEQ ID NO: 1449683 - RNA, 19 nt, Homo sapiens
gcagacaaagugauucgau

SEQ ID NO: 1449684 - RNA, 19 nt, Homo sapiens
ggaugauuccuaacucuuc

SEQ ID NO: 1449685 - RNA, 19 nt, Homo sapiens
ccagauguuccaacuguga

SEQ ID NO: 1449686 - RNA, 19 nt, Homo sapiens
gaagaagggacagaaagag

SEQ ID NO: 1449687 - RNA, 19 nt, Homo sapiens
guugugagcccaauucagu

SEQ ID NO: 1449688 - RNA, 19 nt, Homo sapiens
ugacuacaguucacuuugc

SEQ ID NO: 1449689 - RNA, 19 nt, Homo sapiens
ggaagcccuccucuuguga

SEQ ID NO: 1449690 - RNA, 19 nt, Homo sapiens
gcaucuacgucuggucaau

SEQ ID NO: 1449691 - RNA, 19 nt, Homo sapiens
agaagaagggacagaaaga

SEQ ID NO: 1449692 - RNA, 19 nt, Homo sapiens
aagaaacgccuguguugau

SEQ ID NO: 1449693 - RNA, 19 nt, Homo sapiens
acaauugcuuucacuacga

SEQ ID NO: 1449694 - RNA, 19 nt, Homo sapiens
gaccucagccugucaucga

SEQ ID NO: 1449695 - RNA, 19 nt, Homo sapiens
ggacgccaacguagugugu

SEQ ID NO: 1449696 - RNA, 19 nt, Homo sapiens
aaccagcaucucugauuua

SEQ ID NO: 1449697 - RNA, 19 nt, Homo sapiens
gaagauguuaaccaguaga

SEQ ID NO: 1449698 - RNA, 19 nt, Homo sapiens
cauaggugccaagucaaua

SEQ ID NO: 1449699 - RNA, 19 nt, Homo sapiens
ggccuggacuaacucagau

SEQ ID NO: 1449700 - RNA, 19 nt, Homo sapiens
gcagaccaccucuucuucu

SEQ ID NO: 1449701 - RNA, 19 nt, Homo sapiens
gacacauccugcuggacaa

SEQ ID NO: 1449702 - RNA, 19 nt, Homo sapiens
ggguggagguugggagaug

SEQ ID NO: 1449703 - RNA, 19 nt, Homo sapiens
gaaagcuccugugguuuug

SEQ ID NO: 1449704 - RNA, 19 nt, Homo sapiens
cgacgaugacugggacuuu

SEQ ID NO: 1449705 - RNA, 19 nt, Homo sapiens
uguccugugugaugaauuc

SEQ ID NO: 1449706 - RNA, 19 nt, Homo sapiens
gacaaagugauucgaucuu

SEQ ID NO: 1449707 - RNA, 19 nt, Homo sapiens
gggccuggacuaacucaga

SEQ ID NO: 1449708 - RNA, 19 nt, Homo sapiens
ugaaagcuccugugguuuu

SEQ ID NO: 1449709 - RNA, 19 nt, Homo sapiens
gggcguccacaauugcuuu

SEQ ID NO: 1449710 - RNA, 19 nt, Homo sapiens
aagaagaaacgccuguguu

SEQ ID NO: 1449711 - RNA, 19 nt, Homo sapiens
ggcacugucugugaugaug

SEQ ID NO: 1449712 - RNA, 19 nt, Homo sapiens
gguggacgccaacguagug

SEQ ID NO: 1449713 - RNA, 19 nt, Homo sapiens
acagaaagagcccagaaca

SEQ ID NO: 1449714 - RNA, 19 nt, Homo sapiens
cuacgggacugggccacuu

SEQ ID NO: 1449715 - RNA, 19 nt, Homo sapiens
gagcaccuccuacgacacu

SEQ ID NO: 1449716 - RNA, 19 nt, Homo sapiens
ccacaauugcuuucacuac

SEQ ID NO: 1449717 - RNA, 19 nt, Homo sapiens
aaagugauucgaucuugga

SEQ ID NO: 1449718 - RNA, 19 nt, Homo sapiens
cacagagccuccacuuugc

SEQ ID NO: 1449719 - RNA, 19 nt, Homo sapiens
cagaaagagcccagaacau

SEQ ID NO: 1449720 - RNA, 19 nt, Homo sapiens
auaggugccaagucaauaa

SEQ ID NO: 1449721 - RNA, 19 nt, Homo sapiens
gcucaggggcucuuuaaau

SEQ ID NO: 1449722 - RNA, 19 nt, Homo sapiens
gaagcccuccucuugugau

SEQ ID NO: 1449723 - RNA, 19 nt, Homo sapiens
aaagaagaaacgccugugu

SEQ ID NO: 1449724 - RNA, 19 nt, Homo sapiens
uagaagaagggacagaaag

SEQ ID NO: 1449725 - RNA, 19 nt, Homo sapiens
gggagagagccuaccuaga

SEQ ID NO: 1449726 - RNA, 19 nt, Homo sapiens
cgugguggacgccaacgua

SEQ ID NO: 1449727 - RNA, 19 nt, Homo sapiens
uggcuguccugugugauga

SEQ ID NO: 1449728 - RNA, 19 nt, Homo sapiens
accagcaucucugauuuau

SEQ ID NO: 1449729 - RNA, 19 nt, Homo sapiens
caacgccuucuucggcuau

SEQ ID NO: 1449730 - RNA, 19 nt, Homo sapiens
ggaaagaacucaaaugauc

SEQ ID NO: 1449731 - RNA, 19 nt, Homo sapiens
uaacagaauuuccuucgua

SEQ ID NO: 1449732 - RNA, 19 nt, Homo sapiens
ccaaacaccuaguuaauug

SEQ ID NO: 1449733 - RNA, 19 nt, Homo sapiens
guacagcacuaguuacauu

SEQ ID NO: 1449734 - RNA, 19 nt, Homo sapiens
gagguaauccuuauagaua

SEQ ID NO: 1449735 - RNA, 19 nt, Homo sapiens
ugagaacacugucccuuua

SEQ ID NO: 1449736 - RNA, 19 nt, Homo sapiens
cacggaagcuuucacuuua

SEQ ID NO: 1449737 - RNA, 19 nt, Homo sapiens
gcaauggccuuaauuagca

SEQ ID NO: 1449738 - RNA, 19 nt, Homo sapiens
guagaucacuggaauggaa

SEQ ID NO: 1449739 - RNA, 19 nt, Homo sapiens
caaagaagccaacauacaa

SEQ ID NO: 1449740 - RNA, 19 nt, Homo sapiens
gacaagagguaauccuuau

SEQ ID NO: 1449741 - RNA, 19 nt, Homo sapiens
gaaaauaagucagcgaaaa

SEQ ID NO: 1449742 - RNA, 19 nt, Homo sapiens
auaaagaccucagggauaa

SEQ ID NO: 1449743 - RNA, 19 nt, Homo sapiens
ccuaugaacucccaucuug

SEQ ID NO: 1449744 - RNA, 19 nt, Homo sapiens
aagaaaggauggcuuggua

SEQ ID NO: 1449745 - RNA, 19 nt, Homo sapiens
ggagacagcagucacuaaa

SEQ ID NO: 1449746 - RNA, 19 nt, Homo sapiens
aagagaagaucauagaaga

SEQ ID NO: 1449747 - RNA, 19 nt, Homo sapiens
ggaugaagcaccaauucua

SEQ ID NO: 1449748 - RNA, 19 nt, Homo sapiens
ggaaaucggagcaacaaug

SEQ ID NO: 1449749 - RNA, 19 nt, Homo sapiens
cauaaagaccucagggaua

SEQ ID NO: 1449750 - RNA, 19 nt, Homo sapiens
gaaagaacucaaaugauca

SEQ ID NO: 1449751 - RNA, 19 nt, Homo sapiens
cagaguagaucacuggaau

SEQ ID NO: 1449752 - RNA, 19 nt, Homo sapiens
ccacguuccuguccagauu

SEQ ID NO: 1449753 - RNA, 19 nt, Homo sapiens
ggacgaauugcccgauuaa

SEQ ID NO: 1449754 - RNA, 19 nt, Homo sapiens
cccuugaacuggaugauua

SEQ ID NO: 1449755 - RNA, 19 nt, Homo sapiens
gaaaucggagcaacaaugu

SEQ ID NO: 1449756 - RNA, 19 nt, Homo sapiens
caaccaaggcuuaugauuc

SEQ ID NO: 1449757 - RNA, 19 nt, Homo sapiens
uaaguaagccagaagaaga

SEQ ID NO: 1449758 - RNA, 19 nt, Homo sapiens
gaagagaagaucauagaag

SEQ ID NO: 1449759 - RNA, 19 nt, Homo sapiens
gaagccaacauacaaagaa

SEQ ID NO: 1449760 - RNA, 19 nt, Homo sapiens
ggaaaacaaugaagaaaca

SEQ ID NO: 1449761 - RNA, 19 nt, Homo sapiens
gcuuaugauucaacaguuu

SEQ ID NO: 1449762 - RNA, 19 nt, Homo sapiens
aaccaaggcuuaugauuca

SEQ ID NO: 1449763 - RNA, 19 nt, Homo sapiens
ggacucuguuccuuuaugu

SEQ ID NO: 1449764 - RNA, 19 nt, Homo sapiens
agaccuaacuagcauuuau

SEQ ID NO: 1449765 - RNA, 19 nt, Homo sapiens
gcuccuaacacuucuuuaa

SEQ ID NO: 1449766 - RNA, 19 nt, Homo sapiens
ucccagagguguugagaaa

SEQ ID NO: 1449767 - RNA, 19 nt, Homo sapiens
cuggugaguucuaauuaua

SEQ ID NO: 1449768 - RNA, 19 nt, Homo sapiens
uguggacucuguuccuuua

SEQ ID NO: 1449769 - RNA, 19 nt, Homo sapiens
gcacaaaagcguuuccaua

SEQ ID NO: 1449770 - RNA, 19 nt, Homo sapiens
agaguuaacacgaaagaua

SEQ ID NO: 1449771 - RNA, 19 nt, Homo sapiens
uagcagaguuaacacgaaa

SEQ ID NO: 1449772 - RNA, 19 nt, Homo sapiens
cagaauuuccuucguauug

SEQ ID NO: 1449773 - RNA, 19 nt, Homo sapiens
caaaagcguuuccauaaau

SEQ ID NO: 1449774 - RNA, 19 nt, Homo sapiens
aaagaugguagcagaguua

SEQ ID NO: 1449775 - RNA, 19 nt, Homo sapiens
gucaagguguauauuauga

SEQ ID NO: 1449776 - RNA, 19 nt, Homo sapiens
gaacacugucccuuuaugu

SEQ ID NO: 1449777 - RNA, 19 nt, Homo sapiens
aaagcaauguguacaacaa

SEQ ID NO: 1449778 - RNA, 19 nt, Homo sapiens
gaugaagcaccaauucuau

SEQ ID NO: 1449779 - RNA, 19 nt, Homo sapiens
aaacccaacccacaccuua

SEQ ID NO: 1449780 - RNA, 19 nt, Homo sapiens
gguaauccuuauagauaug

SEQ ID NO: 1449781 - RNA, 19 nt, Homo sapiens
acacggaagcuuucacuuu

SEQ ID NO: 1449782 - RNA, 19 nt, Homo sapiens
aaagaaaugguggcacuua

SEQ ID NO: 1449783 - RNA, 19 nt, Homo sapiens
gccaagagguagauuuuaa

SEQ ID NO: 1449784 - RNA, 19 nt, Homo sapiens
guucuugguuggauuccua

SEQ ID NO: 1449785 - RNA, 19 nt, Homo sapiens
ccaaagaagccaacauaca

SEQ ID NO: 1449786 - RNA, 19 nt, Homo sapiens
gaaaggauggcuugguauc

SEQ ID NO: 1449787 - RNA, 19 nt, Homo sapiens
agacaagagguaauccuua

SEQ ID NO: 1449788 - RNA, 19 nt, Homo sapiens
cauaguagcauuagguaga

SEQ ID NO: 1449789 - RNA, 19 nt, Homo sapiens
cagaaaaggugauguuaug

SEQ ID NO: 1449790 - RNA, 19 nt, Homo sapiens
ccaaccugcuggagcuuaa

SEQ ID NO: 1449791 - RNA, 19 nt, Homo sapiens
gacguucucuggaggcuau

SEQ ID NO: 1449792 - RNA, 19 nt, Homo sapiens
ggcuugguaucaguuauua

SEQ ID NO: 1449793 - RNA, 19 nt, Homo sapiens
caggucaagguguauauua

SEQ ID NO: 1449794 - RNA, 19 nt, Homo sapiens
guaaugcaauugggagugu

SEQ ID NO: 1449795 - RNA, 19 nt, Homo sapiens
cuagcaauggccuuaauua

SEQ ID NO: 1449796 - RNA, 19 nt, Homo sapiens
guacauaguagcauuaggu

SEQ ID NO: 1449797 - RNA, 19 nt, Homo sapiens
guagcagaguuaacacgaa

SEQ ID NO: 1449798 - RNA, 19 nt, Homo sapiens
gaagugagggagauauagu

SEQ ID NO: 1449799 - RNA, 19 nt, Homo sapiens
cuauagccuuugauaugua

SEQ ID NO: 1449800 - RNA, 19 nt, Homo sapiens
gaguuguucuugaauaugg

SEQ ID NO: 1449801 - RNA, 19 nt, Homo sapiens
caagagguaauccuuauag

SEQ ID NO: 1449802 - RNA, 19 nt, Homo sapiens
ccaaaacucucugcaugua

SEQ ID NO: 1449803 - RNA, 19 nt, Homo sapiens
gauguuaugacuucuugaa

SEQ ID NO: 1449804 - RNA, 19 nt, Homo sapiens
ggagugaccaaaccucaga

SEQ ID NO: 1449805 - RNA, 19 nt, Homo sapiens
acauaaagccauuuccaaa

SEQ ID NO: 1449806 - RNA, 19 nt, Homo sapiens
cagccggugugacccauaa

SEQ ID NO: 1449807 - RNA, 19 nt, Homo sapiens
cacgaaagauaggauuuga

SEQ ID NO: 1449808 - RNA, 19 nt, Homo sapiens
ugagggagauauaguguac

SEQ ID NO: 1449809 - RNA, 19 nt, Homo sapiens
acacugucccuuuauguaa

SEQ ID NO: 1449810 - RNA, 19 nt, Homo sapiens
ucuuuaaucucucaucuuc

SEQ ID NO: 1449811 - RNA, 19 nt, Homo sapiens
gugauguuaugacuucuug

SEQ ID NO: 1449812 - RNA, 19 nt, Homo sapiens
cccacuggcucacuucgua

SEQ ID NO: 1449813 - RNA, 19 nt, Homo sapiens
ggaaguucaagaggaauuu

SEQ ID NO: 1449814 - RNA, 19 nt, Homo sapiens
aaacccaaacaccuaguua

SEQ ID NO: 1449815 - RNA, 19 nt, Homo sapiens
guacaacaaaguuuacauc

SEQ ID NO: 1449816 - RNA, 19 nt, Homo sapiens
gacauaaagccauuuccaa

SEQ ID NO: 1449817 - RNA, 19 nt, Homo sapiens
caaaagaccuaacuagcau

SEQ ID NO: 1449818 - RNA, 19 nt, Homo sapiens
gaugguagcagaguuaaca

SEQ ID NO: 1449819 - RNA, 19 nt, Homo sapiens
cguggaaguucaagaggaa

SEQ ID NO: 1449820 - RNA, 19 nt, Homo sapiens
uggaguguguucucuaaga

SEQ ID NO: 1449821 - RNA, 19 nt, Homo sapiens
ugauugauauucccaugga

SEQ ID NO: 1449822 - RNA, 19 nt, Homo sapiens
cccuuaaccuucugauuga

SEQ ID NO: 1449823 - RNA, 19 nt, Homo sapiens
aaggugauguuaugacuuc

SEQ ID NO: 1449824 - RNA, 19 nt, Homo sapiens
gcagaguuaacacgaaaga

SEQ ID NO: 1449825 - RNA, 19 nt, Homo sapiens
ucuauagccuuugauaugu

SEQ ID NO: 1449826 - RNA, 19 nt, Homo sapiens
ucuggaguguguucucuaa

SEQ ID NO: 1449827 - RNA, 19 nt, Homo sapiens
gcguuuccauaaaucaauu

SEQ ID NO: 1449828 - RNA, 19 nt, Homo sapiens
cggaagcuuucacuuuaga

SEQ ID NO: 1449829 - RNA, 19 nt, Homo sapiens
cgugaucaguauaauaugu

SEQ ID NO: 1449830 - RNA, 19 nt, Homo sapiens
ggaaagggauauaacguua

SEQ ID NO: 1449831 - RNA, 19 nt, Homo sapiens
gaaaaggucugcaaacuaa

SEQ ID NO: 1449832 - RNA, 19 nt, Homo sapiens
gaggacagcuauuaccaua

SEQ ID NO: 1449833 - RNA, 19 nt, Homo sapiens
ggacagcuauuaccauaug

SEQ ID NO: 1449834 - RNA, 19 nt, Homo sapiens
ggacagaggugcuaaugca

SEQ ID NO: 1449835 - RNA, 19 nt, Homo sapiens
gaagaaguaucuacaugga

SEQ ID NO: 1449836 - RNA, 19 nt, Homo sapiens
gugauuagguaguaaagua

SEQ ID NO: 1449837 - RNA, 19 nt, Homo sapiens
gaacuacuacuuucaagaa

SEQ ID NO: 1449838 - RNA, 19 nt, Homo sapiens
gauauaacguuaagacauc

SEQ ID NO: 1449839 - RNA, 19 nt, Homo sapiens
gaugauggcugggagauug

SEQ ID NO: 1449840 - RNA, 19 nt, Homo sapiens
aaacaaacaucaugagauc

SEQ ID NO: 1449841 - RNA, 19 nt, Homo sapiens
ggaaagaugccaagugaga

SEQ ID NO: 1449842 - RNA, 19 nt, Homo sapiens
gcagcacaauauaacuuua

SEQ ID NO: 1449843 - RNA, 19 nt, Homo sapiens
gagggaagaugaauuuaca

SEQ ID NO: 1449844 - RNA, 19 nt, Homo sapiens
guaucuacauggaauagua

SEQ ID NO: 1449845 - RNA, 19 nt, Homo sapiens
aauaacagcuguacagaau

SEQ ID NO: 1449846 - RNA, 19 nt, Homo sapiens
gaucguaucuaaaucacau

SEQ ID NO: 1449847 - RNA, 19 nt, Homo sapiens
gggaagaaguaucuacaug

SEQ ID NO: 1449848 - RNA, 19 nt, Homo sapiens
uaacagcuguacagaaugu

SEQ ID NO: 1449849 - RNA, 19 nt, Homo sapiens
gguagaagagauacaauuu

SEQ ID NO: 1449850 - RNA, 19 nt, Homo sapiens
guucauaaauugagcuuuc

SEQ ID NO: 1449851 - RNA, 19 nt, Homo sapiens
gauacaauuuggagagcua

SEQ ID NO: 1449852 - RNA, 19 nt, Homo sapiens
caagaaaugcugauccaaa

SEQ ID NO: 1449853 - RNA, 19 nt, Homo sapiens
uaguguagauuccaacuuu

SEQ ID NO: 1449854 - RNA, 19 nt, Homo sapiens
gcuccuagauucuggcauu

SEQ ID NO: 1449855 - RNA, 19 nt, Homo sapiens
gaaacaaacaucaugagau

SEQ ID NO: 1449856 - RNA, 19 nt, Homo sapiens
gaaaugcugauccaaaugu

SEQ ID NO: 1449857 - RNA, 19 nt, Homo sapiens
gagacaaaguuggaaauca

SEQ ID NO: 1449858 - RNA, 19 nt, Homo sapiens
gaagagacaaaguuggaaa

SEQ ID NO: 1449859 - RNA, 19 nt, Homo sapiens
ggagagcuaucugaagaga

SEQ ID NO: 1449860 - RNA, 19 nt, Homo sapiens
gaaagggauauaacguuaa

SEQ ID NO: 1449861 - RNA, 19 nt, Homo sapiens
gcuauuacccauugaagaa

SEQ ID NO: 1449862 - RNA, 19 nt, Homo sapiens
ggacgucucagaaauugaa

SEQ ID NO: 1449863 - RNA, 19 nt, Homo sapiens
caugagaucuucaacuuac

SEQ ID NO: 1449864 - RNA, 19 nt, Homo sapiens
aaccaaagauggaaagaug

SEQ ID NO: 1449865 - RNA, 19 nt, Homo sapiens
uagaagagauacaauuugg

SEQ ID NO: 1449866 - RNA, 19 nt, Homo sapiens
gagaaugguuacacugcuu

SEQ ID NO: 1449867 - RNA, 19 nt, Homo sapiens
gaccggacgucucagaaau

SEQ ID NO: 1449868 - RNA, 19 nt, Homo sapiens
aagaaaugcugauccaaau

SEQ ID NO: 1449869 - RNA, 19 nt, Homo sapiens
agaaguaucuacauggaau

SEQ ID NO: 1449870 - RNA, 19 nt, Homo sapiens
gaacauaugacagauuuac

SEQ ID NO: 1449871 - RNA, 19 nt, Homo sapiens
gaacuuggagcuaauaaaa

SEQ ID NO: 1449872 - RNA, 19 nt, Homo sapiens
uaaaguguguucauuuguc

SEQ ID NO: 1449873 - RNA, 19 nt, Homo sapiens
acaauuaagggaagaagua

SEQ ID NO: 1449874 - RNA, 19 nt, Homo sapiens
caugagggaagaugaauuu

SEQ ID NO: 1449875 - RNA, 19 nt, Homo sapiens
cagaggaaauaauccaaau

SEQ ID NO: 1449876 - RNA, 19 nt, Homo sapiens
ccucaacuuucuucucaaa

SEQ ID NO: 1449877 - RNA, 19 nt, Homo sapiens
cuaaagaagacacuauuug

SEQ ID NO: 1449878 - RNA, 19 nt, Homo sapiens
guugaagauuugagugaaa

SEQ ID NO: 1449879 - RNA, 19 nt, Homo sapiens
gggaagaugaauuuacaaa

SEQ ID NO: 1449880 - RNA, 19 nt, Homo sapiens
ggucuuggacuugaacaua

SEQ ID NO: 1449881 - RNA, 19 nt, Homo sapiens
gaaguaucuacauggaaua

SEQ ID NO: 1449882 - RNA, 19 nt, Homo sapiens
guagaagagauacaauuug

SEQ ID NO: 1449883 - RNA, 19 nt, Homo sapiens
ggauauaacguuaagacau

SEQ ID NO: 1449884 - RNA, 19 nt, Homo sapiens
gaucuugaaguguguagaa

SEQ ID NO: 1449885 - RNA, 19 nt, Homo sapiens
uuggagaucuggaaguauu

SEQ ID NO: 1449886 - RNA, 19 nt, Homo sapiens
caguguggccauuuaauaa

SEQ ID NO: 1449887 - RNA, 19 nt, Homo sapiens
aggaacagaucuugaagug

SEQ ID NO: 1449888 - RNA, 19 nt, Homo sapiens
gagaaggauaagcaaagua

SEQ ID NO: 1449889 - RNA, 19 nt, Homo sapiens
guacagaauguuauuacug

SEQ ID NO: 1449890 - RNA, 19 nt, Homo sapiens
uuggagagcuaucugaaga

SEQ ID NO: 1449891 - RNA, 19 nt, Homo sapiens
uucaacagcuaacuaaaga

SEQ ID NO: 1449892 - RNA, 19 nt, Homo sapiens
auggaaagaugccaaguga

SEQ ID NO: 1449893 - RNA, 19 nt, Homo sapiens
gcauuaguguagauuccaa

SEQ ID NO: 1449894 - RNA, 19 nt, Homo sapiens
agacaaaguuggaaaucag

SEQ ID NO: 1449895 - RNA, 19 nt, Homo sapiens
gaaugguuacacugcuuua

SEQ ID NO: 1449896 - RNA, 19 nt, Homo sapiens
gcuuguaggagacuuauga

SEQ ID NO: 1449897 - RNA, 19 nt, Homo sapiens
cuugaaguguguagaacua

SEQ ID NO: 1449898 - RNA, 19 nt, Homo sapiens
gauuccaacuuucaguaug

SEQ ID NO: 1449899 - RNA, 19 nt, Homo sapiens
acaguguggccauuuaaua

SEQ ID NO: 1449900 - RNA, 19 nt, Homo sapiens
aagaauggaauuaccagua

SEQ ID NO: 1449901 - RNA, 19 nt, Homo sapiens
gguuguugcucuccuuguu

SEQ ID NO: 1449902 - RNA, 19 nt, Homo sapiens
cagaggaacagaucuugaa

SEQ ID NO: 1449903 - RNA, 19 nt, Homo sapiens
uugaagaggacagcuauua

SEQ ID NO: 1449904 - RNA, 19 nt, Homo sapiens
ugauccaacucauauacaa

SEQ ID NO: 1449905 - RNA, 19 nt, Homo sapiens
agagcuaucugaagagaca

SEQ ID NO: 1449906 - RNA, 19 nt, Homo sapiens
aaagggauauaacguuaag

SEQ ID NO: 1449907 - RNA, 19 nt, Homo sapiens
aaacuucaacagcuaacua

SEQ ID NO: 1449908 - RNA, 19 nt, Homo sapiens
gguuugaucguaucuaaau

SEQ ID NO: 1449909 - RNA, 19 nt, Homo sapiens
cuaaaggaaagggauauaa

SEQ ID NO: 1449910 - RNA, 19 nt, Homo sapiens
caacagcuaacuaaagaag

SEQ ID NO: 1449911 - RNA, 19 nt, Homo sapiens
gaaggauaagcaaaguauu

SEQ ID NO: 1449912 - RNA, 19 nt, Homo sapiens
aaaguguguucauuuguca

SEQ ID NO: 1449913 - RNA, 19 nt, Homo sapiens
aaacaguguggccauuuaa

SEQ ID NO: 1449914 - RNA, 19 nt, Homo sapiens
guaaagaccagcagaaaau

SEQ ID NO: 1449915 - RNA, 19 nt, Homo sapiens
ggaagaugaauuuacaaag

SEQ ID NO: 1449916 - RNA, 19 nt, Homo sapiens
aaaaugaacgggaaaauga

SEQ ID NO: 1449917 - RNA, 19 nt, Homo sapiens
uaauaacagcuguacagaa

SEQ ID NO: 1449918 - RNA, 19 nt, Homo sapiens
uauguaugcugcuaguguu

SEQ ID NO: 1449919 - RNA, 19 nt, Homo sapiens
gaucuucaacuuacuuucu

SEQ ID NO: 1449920 - RNA, 19 nt, Homo sapiens
gguuuguuacuuugacuua

SEQ ID NO: 1449921 - RNA, 19 nt, Homo sapiens
aauucuggcugcucuuaaa

SEQ ID NO: 1449922 - RNA, 19 nt, Homo sapiens
gaaagaugccaagugagau

SEQ ID NO: 1449923 - RNA, 19 nt, Homo sapiens
ggaugagaaugguuacacu

SEQ ID NO: 1449924 - RNA, 19 nt, Homo sapiens
agaaggauaagcaaaguau

SEQ ID NO: 1449925 - RNA, 19 nt, Homo sapiens
gcuaaugcaagcuuugaga

SEQ ID NO: 1449926 - RNA, 19 nt, Homo sapiens
guagcgagagcgaggauga

SEQ ID NO: 1449927 - RNA, 19 nt, Homo sapiens
uaucugaagagacaaaguu

SEQ ID NO: 1449928 - RNA, 19 nt, Homo sapiens
ucaugagaucuucaacuua

SEQ ID NO: 1449929 - RNA, 19 nt, Homo sapiens
aaagaugccaagugagauu

SEQ ID NO: 1449930 - RNA, 19 nt, Homo sapiens
gaagagagcugaaauaauc

SEQ ID NO: 1449931 - RNA, 19 nt, Homo sapiens
gaagaggcauugcgugaaa

SEQ ID NO: 1449932 - RNA, 19 nt, Homo sapiens
gaaguucccuuuccuuuca

SEQ ID NO: 1449933 - RNA, 19 nt, Homo sapiens
gcuaagaucuuguuguguu

SEQ ID NO: 1449934 - RNA, 19 nt, Homo sapiens
gagagaauauccaguacuu

SEQ ID NO: 1449935 - RNA, 19 nt, Homo sapiens
gagcugaaauaaucaaaug

SEQ ID NO: 1449936 - RNA, 19 nt, Homo sapiens
gagaagagagcugaaauaa

SEQ ID NO: 1449937 - RNA, 19 nt, Homo sapiens
ggauagacuucccaaagaa

SEQ ID NO: 1449938 - RNA, 19 nt, Homo sapiens
aagcugaggucggaaauua

SEQ ID NO: 1449939 - RNA, 19 nt, Homo sapiens
uaaaccagaucaccuagaa

SEQ ID NO: 1449940 - RNA, 19 nt, Homo sapiens
caaauuggcuuccguuggu

SEQ ID NO: 1449941 - RNA, 19 nt, Homo sapiens
gagcagagacagagaagaa

SEQ ID NO: 1449942 - RNA, 19 nt, Homo sapiens
caaaugucuucaucuauug

SEQ ID NO: 1449943 - RNA, 19 nt, Homo sapiens
gggcuaagaucuuguugug

SEQ ID NO: 1449944 - RNA, 19 nt, Homo sapiens
uuacgaagaucagcuauga

SEQ ID NO: 1449945 - RNA, 19 nt, Homo sapiens
ggucggaaauuacgaagau

SEQ ID NO: 1449946 - RNA, 19 nt, Homo sapiens
ugucaaaugucuucaucua

SEQ ID NO: 1449947 - RNA, 19 nt, Homo sapiens
gaucuucaguaaauguuga

SEQ ID NO: 1449948 - RNA, 19 nt, Homo sapiens
gcuaugauguguugugcuu

SEQ ID NO: 1449949 - RNA, 19 nt, Homo sapiens
gagaauauccaguacuuca

SEQ ID NO: 1449950 - RNA, 19 nt, Homo sapiens
cccaggaucuucaguaaau

SEQ ID NO: 1449951 - RNA, 19 nt, Homo sapiens
gagaagacacauagucaug

SEQ ID NO: 1449952 - RNA, 19 nt, Homo sapiens
gagagaagacacauaguca

SEQ ID NO: 1449953 - RNA, 19 nt, Homo sapiens
uggauagacuucccaaaga

SEQ ID NO: 1449954 - RNA, 19 nt, Homo sapiens
acagagagaauauccagua

SEQ ID NO: 1449955 - RNA, 19 nt, Homo sapiens
uagcuaccauuaucaguau

SEQ ID NO: 1449956 - RNA, 19 nt, Homo sapiens
caaauggaaacacacaauu

SEQ ID NO: 1449957 - RNA, 19 nt, Homo sapiens
caaccacuuuguaaugaau

SEQ ID NO: 1449958 - RNA, 19 nt, Homo sapiens
ggaaaugauagacaauaug

SEQ ID NO: 1449959 - RNA, 19 nt, Homo sapiens
gaggagagaagacacauag

SEQ ID NO: 1449960 - RNA, 19 nt, Homo sapiens
cuagaauaaucuccauuug

SEQ ID NO: 1449961 - RNA, 19 nt, Homo sapiens
ucaaucuucugucuaccua

SEQ ID NO: 1449962 - RNA, 19 nt, Homo sapiens
caccuagaauuaccaaaug

SEQ ID NO: 1449963 - RNA, 19 nt, Homo sapiens
ccuaaaaucccuagaauaa

SEQ ID NO: 1449964 - RNA, 19 nt, Homo sapiens
ggaagucaacucacaugga

SEQ ID NO: 1449965 - RNA, 19 nt, Homo sapiens
ggagagaagagagcugaaa

SEQ ID NO: 1449966 - RNA, 19 nt, Homo sapiens
aaaugcagguucacuggaa

SEQ ID NO: 1449967 - RNA, 19 nt, Homo sapiens
gaagacacauagucaugcu

SEQ ID NO: 1449968 - RNA, 19 nt, Homo sapiens
ggagagaagacacauaguc

SEQ ID NO: 1449969 - RNA, 19 nt, Homo sapiens
cugcacaucuugccuuguu

SEQ ID NO: 1449970 - RNA, 19 nt, Homo sapiens
agagaagagagcugaaaua

SEQ ID NO: 1449971 - RNA, 19 nt, Homo sapiens
ccuagaauaaucuccauuu

SEQ ID NO: 1449972 - RNA, 19 nt, Homo sapiens
aaucuucugucuaccuaaa

SEQ ID NO: 1449973 - RNA, 19 nt, Homo sapiens
uugaauacgugcagcaaga

SEQ ID NO: 1449974 - RNA, 19 nt, Homo sapiens
uaacccaggaucuucagua

SEQ ID NO: 1449975 - RNA, 19 nt, Homo sapiens
gagagaagagagcugaaau

SEQ ID NO: 1449976 - RNA, 19 nt, Homo sapiens
gaaggaggaagaggcauug

SEQ ID NO: 1449977 - RNA, 19 nt, Homo sapiens
ggaauauaauagcuaccau

SEQ ID NO: 1449978 - RNA, 19 nt, Homo sapiens
cagguucacuggaaaugau

SEQ ID NO: 1449979 - RNA, 19 nt, Homo sapiens
gacuaaaccagaucaccua

SEQ ID NO: 1449980 - RNA, 19 nt, Homo sapiens
auccaguacuucacaauaa

SEQ ID NO: 1449981 - RNA, 19 nt, Homo sapiens
gaauauccaguacuucaca

SEQ ID NO: 1449982 - RNA, 19 nt, Homo sapiens
ggaagaggcauugcgugaa

SEQ ID NO: 1449983 - RNA, 19 nt, Homo sapiens
aacccaggaucuucaguaa

SEQ ID NO: 1449984 - RNA, 19 nt, Homo sapiens
gcugaaauaaucaaaugga

SEQ ID NO: 1449985 - RNA, 19 nt, Homo sapiens
ggauucccguacaguguug

SEQ ID NO: 1449986 - RNA, 19 nt, Homo sapiens
ucaggcaacugcagagucu

SEQ ID NO: 1449987 - RNA, 19 nt, Homo sapiens
gauguguugugcuuuuaua

SEQ ID NO: 1449988 - RNA, 19 nt, Homo sapiens
uauccaguacuucacaaua

SEQ ID NO: 1449989 - RNA, 19 nt, Homo sapiens
aaccagaucaccuagaauu

SEQ ID NO: 1449990 - RNA, 19 nt, Homo sapiens
guuaucuaauguagucuug

SEQ ID NO: 1449991 - RNA, 19 nt, Homo sapiens
ucaccuagaauuaccaaau

SEQ ID NO: 1449992 - RNA, 19 nt, Homo sapiens
ccauuuggcuaugaugugu

SEQ ID NO: 1449993 - RNA, 19 nt, Homo sapiens
caguaaauguugaauucuc

SEQ ID NO: 1449994 - RNA, 19 nt, Homo sapiens
ucaaauggaaacacacaau

SEQ ID NO: 1449995 - RNA, 19 nt, Homo sapiens
gaagcugaggucggaaauu

SEQ ID NO: 1449996 - RNA, 19 nt, Homo sapiens
ugaggaaucuguguguucu

SEQ ID NO: 1449997 - RNA, 19 nt, Homo sapiens
gcagguucacuggaaauga

SEQ ID NO: 1449998 - RNA, 19 nt, Homo sapiens
agcuucaucuuaucuguaa

SEQ ID NO: 1449999 - RNA, 19 nt, Homo sapiens
gaaagaucgagcagagaca

SEQ ID NO: 1450000 - RNA, 19 nt, Homo sapiens
cuaagaucuuguuguguuc

SEQ ID NO: 1450001 - RNA, 19 nt, Homo sapiens
ugaaggaggaagaggcauu

SEQ ID NO: 1450002 - RNA, 19 nt, Homo sapiens
cagagagaauauccaguac

SEQ ID NO: 1450003 - RNA, 19 nt, Homo sapiens
ccugggaagucaacucaca

SEQ ID NO: 1450004 - RNA, 19 nt, Homo sapiens
uagaauaaucuccauuugg

SEQ ID NO: 1450005 - RNA, 19 nt, Homo sapiens
uuuggaacauaguagguuu

SEQ ID NO: 1450006 - RNA, 19 nt, Homo sapiens
agaagagagcugaaauaau

SEQ ID NO: 1450007 - RNA, 19 nt, Homo sapiens
cacuggaaaugauagacaa

SEQ ID NO: 1450008 - RNA, 19 nt, Homo sapiens
aggcaacugcagagucuua

SEQ ID NO: 1450009 - RNA, 19 nt, Homo sapiens
aaauuacgaagaucagcua

SEQ ID NO: 1450010 - RNA, 19 nt, Homo sapiens
auagcuaccauuaucagua

SEQ ID NO: 1450011 - RNA, 19 nt, Homo sapiens
aguuauaccuaccacacaa

SEQ ID NO: 1450012 - RNA, 19 nt, Homo sapiens
ccagaucaccuagaauuac

SEQ ID NO: 1450013 - RNA, 19 nt, Homo sapiens
gagagcugaaauaaucaaa

SEQ ID NO: 1450014 - RNA, 19 nt, Homo sapiens
uggaaaauagggauaguua

SEQ ID NO: 1450015 - RNA, 19 nt, Homo sapiens
gaauuaccaaauggaaaga

SEQ ID NO: 1450016 - RNA, 19 nt, Homo sapiens
ggccagcagugaggaaucu

SEQ ID NO: 1450017 - RNA, 19 nt, Homo sapiens
agaauuaccaaauggaaag

SEQ ID NO: 1450018 - RNA, 19 nt, Homo sapiens
uaugauguguugugcuuuu

SEQ ID NO: 1450019 - RNA, 19 nt, Homo sapiens
ucccguacaguguugaaua

SEQ ID NO: 1450020 - RNA, 19 nt, Homo sapiens
cuagaauuaccaaauggaa

SEQ ID NO: 1450021 - RNA, 19 nt, Homo sapiens
gugaggaaucuguguguuc

SEQ ID NO: 1450022 - RNA, 19 nt, Homo sapiens
gcagagacagagaagaaaa

SEQ ID NO: 1450023 - RNA, 19 nt, Homo sapiens
ugaggagagaagacacaua

SEQ ID NO: 1450024 - RNA, 19 nt, Homo sapiens
acauuucaaucuucugucu

SEQ ID NO: 1450025 - RNA, 19 nt, Homo sapiens
gggguuaucuaauguaguc

SEQ ID NO: 1450026 - RNA, 19 nt, Homo sapiens
ucccuuuccuuucaaguca

SEQ ID NO: 1450027 - RNA, 19 nt, Homo sapiens
uggcuaggauucccguaca

SEQ ID NO: 1450028 - RNA, 19 nt, Homo sapiens
caugcugacuaaaccagau

SEQ ID NO: 1450029 - RNA, 19 nt, Homo sapiens
ccaggaucuucaguaaaug

SEQ ID NO: 1450030 - RNA, 19 nt, Homo sapiens
ggagagaaauccuaugaaa

SEQ ID NO: 1450031 - RNA, 19 nt, Homo sapiens
ggucagaacugcaauguga

SEQ ID NO: 1450032 - RNA, 19 nt, Homo sapiens
agucagagcuuuaaccuua

SEQ ID NO: 1450033 - RNA, 19 nt, Homo sapiens
ucacagcuauguccuaaua

SEQ ID NO: 1450034 - RNA, 19 nt, Homo sapiens
ggguagagauacaucauua

SEQ ID NO: 1450035 - RNA, 19 nt, Homo sapiens
gggaaaagcuucagcaaua

SEQ ID NO: 1450036 - RNA, 19 nt, Homo sapiens
gaauugggauagaguauug

SEQ ID NO: 1450037 - RNA, 19 nt, Homo sapiens
gaaaugcccuucaucucuu

SEQ ID NO: 1450038 - RNA, 19 nt, Homo sapiens
gagagaaaccuuauaaaug

SEQ ID NO: 1450039 - RNA, 19 nt, Homo sapiens
gaacugcaaugugauagaa

SEQ ID NO: 1450040 - RNA, 19 nt, Homo sapiens
ugacauggguucaagauga

SEQ ID NO: 1450041 - RNA, 19 nt, Homo sapiens
gaaugaugcuuuggaaauu

SEQ ID NO: 1450042 - RNA, 19 nt, Homo sapiens
uaacugaggucccaucuuc

SEQ ID NO: 1450043 - RNA, 19 nt, Homo sapiens
gagaauacauacaggagaa

SEQ ID NO: 1450044 - RNA, 19 nt, Homo sapiens
acaaaugucuugaguguga

SEQ ID NO: 1450045 - RNA, 19 nt, Homo sapiens
uaacaguucucaccugauu

SEQ ID NO: 1450046 - RNA, 19 nt, Homo sapiens
uaacuuggcugugaucauu

SEQ ID NO: 1450047 - RNA, 19 nt, Homo sapiens
ggagagaaaccuuauaaau

SEQ ID NO: 1450048 - RNA, 19 nt, Homo sapiens
caauuuagguauucuguga

SEQ ID NO: 1450049 - RNA, 19 nt, Homo sapiens
guucaaaccuuauuacaca

SEQ ID NO: 1450050 - RNA, 19 nt, Homo sapiens
gagagaaacccuacaaaug

SEQ ID NO: 1450051 - RNA, 19 nt, Homo sapiens
gcagauaaacuuaaagaga

SEQ ID NO: 1450052 - RNA, 19 nt, Homo sapiens
gauaugaccucacugucuu

SEQ ID NO: 1450053 - RNA, 19 nt, Homo sapiens
agcaauaccucccaucuua

SEQ ID NO: 1450054 - RNA, 19 nt, Homo sapiens
uggaaaagcuucaguaaua

SEQ ID NO: 1450055 - RNA, 19 nt, Homo sapiens
gaccaaagccagaauagaa

SEQ ID NO: 1450056 - RNA, 19 nt, Homo sapiens
ccauauagauguugugaau

SEQ ID NO: 1450057 - RNA, 19 nt, Homo sapiens
cagcagcucucaccuuauu

SEQ ID NO: 1450058 - RNA, 19 nt, Homo sapiens
gagauuuggugucaugauu

SEQ ID NO: 1450059 - RNA, 19 nt, Homo sapiens
ugaauaauaugcagagaug

SEQ ID NO: 1450060 - RNA, 19 nt, Homo sapiens
gcuacuguauuggauauua

SEQ ID NO: 1450061 - RNA, 19 nt, Homo sapiens
uauaaagacuguagaagug

SEQ ID NO: 1450062 - RNA, 19 nt, Homo sapiens
gaucaucauucuugacaga

SEQ ID NO: 1450063 - RNA, 19 nt, Homo sapiens
gagaaaccauauagauguu

SEQ ID NO: 1450064 - RNA, 19 nt, Homo sapiens
ggccuuagcucccaucuca

SEQ ID NO: 1450065 - RNA, 19 nt, Homo sapiens
cuacaaaugucuugagugu

SEQ ID NO: 1450066 - RNA, 19 nt, Homo sapiens
gagaaaagccuuauaaaug

SEQ ID NO: 1450067 - RNA, 19 nt, Homo sapiens
gcaaaguucuguagcugau

SEQ ID NO: 1450068 - RNA, 19 nt, Homo sapiens
ggaaugaugcuuuggaaau

SEQ ID NO: 1450069 - RNA, 19 nt, Homo sapiens
ggagagaaaccauauagau

SEQ ID NO: 1450070 - RNA, 19 nt, Homo sapiens
gcaaugugauagaagaaug

SEQ ID NO: 1450071 - RNA, 19 nt, Homo sapiens
agagaaaccuucagaaugg

SEQ ID NO: 1450072 - RNA, 19 nt, Homo sapiens
ugacagacccauaaauauu

SEQ ID NO: 1450073 - RNA, 19 nt, Homo sapiens
gaacacauacagaguaauc

SEQ ID NO: 1450074 - RNA, 19 nt, Homo sapiens
guuggaccaugacaauuua

SEQ ID NO: 1450075 - RNA, 19 nt, Homo sapiens
gagaacacauacaggagaa

SEQ ID NO: 1450076 - RNA, 19 nt, Homo sapiens
gacauagaccacaacauua

SEQ ID NO: 1450077 - RNA, 19 nt, Homo sapiens
agacauagaccacaacauu

SEQ ID NO: 1450078 - RNA, 19 nt, Homo sapiens
ggaguacugagacuucuua

SEQ ID NO: 1450079 - RNA, 19 nt, Homo sapiens
gacagacccauaaauauuu

SEQ ID NO: 1450080 - RNA, 19 nt, Homo sapiens
agacagacccuauaaaugu

SEQ ID NO: 1450081 - RNA, 19 nt, Homo sapiens
ggaaaaggcuucagucaca

SEQ ID NO: 1450082 - RNA, 19 nt, Homo sapiens
ggagagaaacccuacaaau

SEQ ID NO: 1450083 - RNA, 19 nt, Homo sapiens
cuacaaaugucccgagugu

SEQ ID NO: 1450084 - RNA, 19 nt, Homo sapiens
gacacuggguuuagacauu

SEQ ID NO: 1450085 - RNA, 19 nt, Homo sapiens
ggaaaugcccuucaucucu

SEQ ID NO: 1450086 - RNA, 19 nt, Homo sapiens
gagagaaaccauauagaug

SEQ ID NO: 1450087 - RNA, 19 nt, Homo sapiens
gaaauccuaugaaaguucu

SEQ ID NO: 1450088 - RNA, 19 nt, Homo sapiens
gagaaauccuaugaaaguu

SEQ ID NO: 1450089 - RNA, 19 nt, Homo sapiens
agucguaguucaaaccuua

SEQ ID NO: 1450090 - RNA, 19 nt, Homo sapiens
gguuguaauucuacucuaa

SEQ ID NO: 1450091 - RNA, 19 nt, Homo sapiens
gugagaagcccuacaaaug

SEQ ID NO: 1450092 - RNA, 19 nt, Homo sapiens
gagaaacccuacaaauguc

SEQ ID NO: 1450093 - RNA, 19 nt, Homo sapiens
ggaaugggacucaggagaa

SEQ ID NO: 1450094 - RNA, 19 nt, Homo sapiens
gaaaccauauagauguugu

SEQ ID NO: 1450095 - RNA, 19 nt, Homo sapiens
gaggaaaguuugggucaga

SEQ ID NO: 1450096 - RNA, 19 nt, Homo sapiens
guagacagacccuauaaau

SEQ ID NO: 1450097 - RNA, 19 nt, Homo sapiens
gcagaauucauccuuugua

SEQ ID NO: 1450098 - RNA, 19 nt, Homo sapiens
cagcagaauucauccuuug

SEQ ID NO: 1450099 - RNA, 19 nt, Homo sapiens
gaagcuagaauugcuauug

SEQ ID NO: 1450100 - RNA, 19 nt, Homo sapiens
agaguaauccugagaguaa

SEQ ID NO: 1450101 - RNA, 19 nt, Homo sapiens
cagcaucacagaucacaua

SEQ ID NO: 1450102 - RNA, 19 nt, Homo sapiens
cuauaaauguuccgaaugu

SEQ ID NO: 1450103 - RNA, 19 nt, Homo sapiens
gacagacccuauaaauguu

SEQ ID NO: 1450104 - RNA, 19 nt, Homo sapiens
gcagagaugcauauuagga

SEQ ID NO: 1450105 - RNA, 19 nt, Homo sapiens
gagaaaagccuuaucaaug

SEQ ID NO: 1450106 - RNA, 19 nt, Homo sapiens
gagaagcccuacaaauguc

SEQ ID NO: 1450107 - RNA, 19 nt, Homo sapiens
ggaaacuguucaccacaau

SEQ ID NO: 1450108 - RNA, 19 nt, Homo sapiens
aaagguagaugaguaggaa

SEQ ID NO: 1450109 - RNA, 19 nt, Homo sapiens
gaacagguuucugaucucu

SEQ ID NO: 1450110 - RNA, 19 nt, Homo sapiens
uagaugaguaggaagauua

SEQ ID NO: 1450111 - RNA, 19 nt, Homo sapiens
acagguuucugaucucuaa

SEQ ID NO: 1450112 - RNA, 19 nt, Homo sapiens
aagaacacauacagaguaa

SEQ ID NO: 1450113 - RNA, 19 nt, Homo sapiens
aaagaacacauacagagua

SEQ ID NO: 1450114 - RNA, 19 nt, Homo sapiens
gaaacuguucaccacaaua

SEQ ID NO: 1450115 - RNA, 19 nt, Homo sapiens
agagaaacccuacaaaugu

SEQ ID NO: 1450116 - RNA, 19 nt, Homo sapiens
ccuuauaaauguccugauu

SEQ ID NO: 1450117 - RNA, 19 nt, Homo sapiens
caggagagaaaccuuauaa

SEQ ID NO: 1450118 - RNA, 19 nt, Homo sapiens
auauggaucugauaacuga

SEQ ID NO: 1450119 - RNA, 19 nt, Homo sapiens
cagaaugugggaagaauuu

SEQ ID NO: 1450120 - RNA, 19 nt, Homo sapiens
aaagucaaccucccaguuu

SEQ ID NO: 1450121 - RNA, 19 nt, Homo sapiens
gauagaagaaugcagaauc

SEQ ID NO: 1450122 - RNA, 19 nt, Homo sapiens
gaacaucagaggacucaca

SEQ ID NO: 1450123 - RNA, 19 nt, Homo sapiens
aaacuguucaccacaauaa

SEQ ID NO: 1450124 - RNA, 19 nt, Homo sapiens
gauuguguguucuaauuca

SEQ ID NO: 1450125 - RNA, 19 nt, Homo sapiens
agagaaauccuaugaaagu

SEQ ID NO: 1450126 - RNA, 19 nt, Homo sapiens
agcagcagcucucaccuua

SEQ ID NO: 1450127 - RNA, 19 nt, Homo sapiens
ggagagggagaguuugaaa

SEQ ID NO: 1450128 - RNA, 19 nt, Homo sapiens
ugaagacacuggguuuaga

SEQ ID NO: 1450129 - RNA, 19 nt, Homo sapiens
aagcuagaauugcuauuga

SEQ ID NO: 1450130 - RNA, 19 nt, Homo sapiens
ggaagaagcacaucuauau

SEQ ID NO: 1450131 - RNA, 19 nt, Homo sapiens
gacaugggcuuuacaguuu

SEQ ID NO: 1450132 - RNA, 19 nt, Homo sapiens
gagggcagcuuguuaaaga

SEQ ID NO: 1450133 - RNA, 19 nt, Homo sapiens
ggaagaagauacuagaauc

SEQ ID NO: 1450134 - RNA, 19 nt, Homo sapiens
cagauuaacuucagcugua

SEQ ID NO: 1450135 - RNA, 19 nt, Homo sapiens
gauauucccugucaagguu

SEQ ID NO: 1450136 - RNA, 19 nt, Homo sapiens
gcaagcagauauucccauu

SEQ ID NO: 1450137 - RNA, 19 nt, Homo sapiens
ggacaugggcuuuacaguu

SEQ ID NO: 1450138 - RNA, 19 nt, Homo sapiens
uaaggaugcucguauaguu

SEQ ID NO: 1450139 - RNA, 19 nt, Homo sapiens
guagagaacaucaugcuaa

SEQ ID NO: 1450140 - RNA, 19 nt, Homo sapiens
gcagaagacucgacuacag

SEQ ID NO: 1450141 - RNA, 19 nt, Homo sapiens
gaauggaagcagagucuaa

SEQ ID NO: 1450142 - RNA, 19 nt, Homo sapiens
gccagucucuguccaagaa

SEQ ID NO: 1450143 - RNA, 19 nt, Homo sapiens
gaacacaggagcagagaca

SEQ ID NO: 1450144 - RNA, 19 nt, Homo sapiens
ucagagaugugucuuccaa

SEQ ID NO: 1450145 - RNA, 19 nt, Homo sapiens
acagagagcucagagaugu

SEQ ID NO: 1450146 - RNA, 19 nt, Homo sapiens
caaaguugauguccaugau

SEQ ID NO: 1450147 - RNA, 19 nt, Homo sapiens
ccaagaagcuaugcaugga

SEQ ID NO: 1450148 - RNA, 19 nt, Homo sapiens
uacaucaucucuucucaaa

SEQ ID NO: 1450149 - RNA, 19 nt, Homo sapiens
uuaaagaccuacaaacaag

SEQ ID NO: 1450150 - RNA, 19 nt, Homo sapiens
ucacugagggcaucaauga

SEQ ID NO: 1450151 - RNA, 19 nt, Homo sapiens
ccaagaacggucagauuaa

SEQ ID NO: 1450152 - RNA, 19 nt, Homo sapiens
ccaugggccugaaaucauu

SEQ ID NO: 1450153 - RNA, 19 nt, Homo sapiens
cccaagaacggucagauua

SEQ ID NO: 1450154 - RNA, 19 nt, Homo sapiens
gggcaaaguugauguccau

SEQ ID NO: 1450155 - RNA, 19 nt, Homo sapiens
gcuagagggcagcuuguua

SEQ ID NO: 1450156 - RNA, 19 nt, Homo sapiens
uaucaaugccaacaacaua

SEQ ID NO: 1450157 - RNA, 19 nt, Homo sapiens
guuaaagaccuacaaacaa

SEQ ID NO: 1450158 - RNA, 19 nt, Homo sapiens
gcaaaguugauguccauga

SEQ ID NO: 1450159 - RNA, 19 nt, Homo sapiens
gagucugcaugacaaauga

SEQ ID NO: 1450160 - RNA, 19 nt, Homo sapiens
uauagagucugcaugacaa

SEQ ID NO: 1450161 - RNA, 19 nt, Homo sapiens
gauaaagagcaagcagaua

SEQ ID NO: 1450162 - RNA, 19 nt, Homo sapiens
gccaagccauuguggagaa

SEQ ID NO: 1450163 - RNA, 19 nt, Homo sapiens
gaagaagcacaucuauauc

SEQ ID NO: 1450164 - RNA, 19 nt, Homo sapiens
aaguugauguccaugauaa

SEQ ID NO: 1450165 - RNA, 19 nt, Homo sapiens
gaugauuacccgaacaaga

SEQ ID NO: 1450166 - RNA, 19 nt, Homo sapiens
caagaacggucagauuaac

SEQ ID NO: 1450167 - RNA, 19 nt, Homo sapiens
gaagcagagucuaaaagaa

SEQ ID NO: 1450168 - RNA, 19 nt, Homo sapiens
auaaagagcaagcagauau

SEQ ID NO: 1450169 - RNA, 19 nt, Homo sapiens
ucucagagcuuggcauaag

SEQ ID NO: 1450170 - RNA, 19 nt, Homo sapiens
ccuacaaacaagaugauua

SEQ ID NO: 1450171 - RNA, 19 nt, Homo sapiens
cuagagggcagcuuguuaa

SEQ ID NO: 1450172 - RNA, 19 nt, Homo sapiens
uaacuucagcuguaucaau

SEQ ID NO: 1450173 - RNA, 19 nt, Homo sapiens
uaaagagcaagcagauauu

SEQ ID NO: 1450174 - RNA, 19 nt, Homo sapiens
aagcagauauucccauuuu

SEQ ID NO: 1450175 - RNA, 19 nt, Homo sapiens
ccaagugggugggcaaagu

SEQ ID NO: 1450176 - RNA, 19 nt, Homo sapiens
gcucguauaguuuacauca

SEQ ID NO: 1450177 - RNA, 19 nt, Homo sapiens
agaugugucuuccaaagga

SEQ ID NO: 1450178 - RNA, 19 nt, Homo sapiens
gagaacaucaugcuaacca

SEQ ID NO: 1450179 - RNA, 19 nt, Homo sapiens
uaguuuacaucaucucuuc

SEQ ID NO: 1450180 - RNA, 19 nt, Homo sapiens
uagcacuccucuuuggaaa

SEQ ID NO: 1450181 - RNA, 19 nt, Homo sapiens
caagaugauuacccgaaca

SEQ ID NO: 1450182 - RNA, 19 nt, Homo sapiens
ucacagagagcucagagau

SEQ ID NO: 1450183 - RNA, 19 nt, Homo sapiens
gaaguuguagagaacauca

SEQ ID NO: 1450184 - RNA, 19 nt, Homo sapiens
acaugggcuuuacaguuua

SEQ ID NO: 1450185 - RNA, 19 nt, Homo sapiens
ucaguuaugcccacccuuu

SEQ ID NO: 1450186 - RNA, 19 nt, Homo sapiens
ucaggaagaagcacaucua

SEQ ID NO: 1450187 - RNA, 19 nt, Homo sapiens
gcagcuuguuaaagaccua

SEQ ID NO: 1450188 - RNA, 19 nt, Homo sapiens
gagaauggaagcagagucu

SEQ ID NO: 1450189 - RNA, 19 nt, Homo sapiens
ucucccagcuggaaggauu

SEQ ID NO: 1450190 - RNA, 19 nt, Homo sapiens
gaagacucgacuacagauu

SEQ ID NO: 1450191 - RNA, 19 nt, Homo sapiens
ccaguuucguuucaguuau

SEQ ID NO: 1450192 - RNA, 19 nt, Homo sapiens
ccaguggcuuggaagaaga

SEQ ID NO: 1450193 - RNA, 19 nt, Homo sapiens
cagaagacucgacuacaga

SEQ ID NO: 1450194 - RNA, 19 nt, Homo sapiens
agagaugugucuuccaaag

SEQ ID NO: 1450195 - RNA, 19 nt, Homo sapiens
ucaaugccaacaacauaaa

SEQ ID NO: 1450196 - RNA, 19 nt, Homo sapiens
ucaaugugguggagcagau

SEQ ID NO: 1450197 - RNA, 19 nt, Homo sapiens
agacucgacuacagauuuc

SEQ ID NO: 1450198 - RNA, 19 nt, Homo sapiens
gccaacaacauaaauuaca

SEQ ID NO: 1450199 - RNA, 19 nt, Homo sapiens
gcccagccuuggaggaaga

SEQ ID NO: 1450200 - RNA, 19 nt, Homo sapiens
uggcauuuaugaugaagga

SEQ ID NO: 1450201 - RNA, 19 nt, Homo sapiens
gaaggccaucccuggguuu

SEQ ID NO: 1450202 - RNA, 19 nt, Homo sapiens
cuacaaacaagaugauuac

SEQ ID NO: 1450203 - RNA, 19 nt, Homo sapiens
gaacggucagauuaacuuc

SEQ ID NO: 1450204 - RNA, 19 nt, Homo sapiens
ggaagcagagucuaaaaga

SEQ ID NO: 1450205 - RNA, 19 nt, Homo sapiens
aaaguugauguccaugaua

SEQ ID NO: 1450206 - RNA, 19 nt, Homo sapiens
caguuucguuucaguuaug

SEQ ID NO: 1450207 - RNA, 19 nt, Homo sapiens
ucguauaguuuacaucauc

SEQ ID NO: 1450208 - RNA, 19 nt, Homo sapiens
gauauucuuagccuauaga

SEQ ID NO: 1450209 - RNA, 19 nt, Homo sapiens
gccuauagagucugcauga

SEQ ID NO: 1450210 - RNA, 19 nt, Homo sapiens
caagugggugggcaaaguu

SEQ ID NO: 1450211 - RNA, 19 nt, Homo sapiens
aggaugcucguauaguuua

SEQ ID NO: 1450212 - RNA, 19 nt, Homo sapiens
aagacucgacuacagauuu

SEQ ID NO: 1450213 - RNA, 19 nt, Homo sapiens
aacuucagcuguaucaaug

SEQ ID NO: 1450214 - RNA, 19 nt, Homo sapiens
uagagaacaucaugcuaac

SEQ ID NO: 1450215 - RNA, 19 nt, Homo sapiens
auacaccaguggcuuggaa

SEQ ID NO: 1450216 - RNA, 19 nt, Homo sapiens
aggaagaagcacaucuaua

SEQ ID NO: 1450217 - RNA, 19 nt, Homo sapiens
uaaagaccuacaaacaaga

SEQ ID NO: 1450218 - RNA, 19 nt, Homo sapiens
ucaccuccauccucugcaa

SEQ ID NO: 1450219 - RNA, 19 nt, Homo sapiens
cuuugugucucaaggcuuu

SEQ ID NO: 1450220 - RNA, 19 nt, Homo sapiens
gggcuuuacaguuuaugaa

SEQ ID NO: 1450221 - RNA, 19 nt, Homo sapiens
caagcagauauucccauuu

SEQ ID NO: 1450222 - RNA, 19 nt, Homo sapiens
ugauuacccgaacaagaua

SEQ ID NO: 1450223 - RNA, 19 nt, Homo sapiens
cagucucuguccaagaauu

SEQ ID NO: 1450224 - RNA, 19 nt, Homo sapiens
ugauaaagagcaagcagau

SEQ ID NO: 1450225 - RNA, 19 nt, Homo sapiens
ugauguccaugauaaagag

SEQ ID NO: 1450226 - RNA, 19 nt, Homo sapiens
caugggcuuuacaguuuau

SEQ ID NO: 1450227 - RNA, 19 nt, Homo sapiens
gcccacccuuucaguguuc

SEQ ID NO: 1450228 - RNA, 19 nt, Homo sapiens
uggaagaagauacuagaau

SEQ ID NO: 1450229 - RNA, 19 nt, Homo sapiens
cagcuuggcguccaguuuc

SEQ ID NO: 1450230 - RNA, 19 nt, Homo sapiens
gcaaacagcugucucaaau

SEQ ID NO: 1450231 - RNA, 19 nt, Homo sapiens
gaaacgggaugaccucaaa

SEQ ID NO: 1450232 - RNA, 19 nt, Homo sapiens
cgaguuagauguuacagaa

SEQ ID NO: 1450233 - RNA, 19 nt, Homo sapiens
ucgagaagcuaagcaauua

SEQ ID NO: 1450234 - RNA, 19 nt, Homo sapiens
uaucuagccuucagaauau

SEQ ID NO: 1450235 - RNA, 19 nt, Homo sapiens
aaacagcugucucaaaugu

SEQ ID NO: 1450236 - RNA, 19 nt, Homo sapiens
gaugacgaguuagauguua

SEQ ID NO: 1450237 - RNA, 19 nt, Homo sapiens
ugaugaggaugacgaguua

SEQ ID NO: 1450238 - RNA, 19 nt, Homo sapiens
agagaucacugucagcuaa

SEQ ID NO: 1450239 - RNA, 19 nt, Homo sapiens
ugaaagacuugaagccaaa

SEQ ID NO: 1450240 - RNA, 19 nt, Homo sapiens
ggagaacugugccaaaucu

SEQ ID NO: 1450241 - RNA, 19 nt, Homo sapiens
gacuugaaauccacaauga

SEQ ID NO: 1450242 - RNA, 19 nt, Homo sapiens
ggaggaaacuauuaacaac

SEQ ID NO: 1450243 - RNA, 19 nt, Homo sapiens
acagagagcugcaauggau

SEQ ID NO: 1450244 - RNA, 19 nt, Homo sapiens
uugccaaacuucaggauua

SEQ ID NO: 1450245 - RNA, 19 nt, Homo sapiens
gguauccacuugucgacua

SEQ ID NO: 1450246 - RNA, 19 nt, Homo sapiens
cuagagagcuaugcccuuu

SEQ ID NO: 1450247 - RNA, 19 nt, Homo sapiens
gaaugaaauuaacgcguau

SEQ ID NO: 1450248 - RNA, 19 nt, Homo sapiens
gcuaagcaauuaacucagu

SEQ ID NO: 1450249 - RNA, 19 nt, Homo sapiens
ccggaacgcucaaacgaaa

SEQ ID NO: 1450250 - RNA, 19 nt, Homo sapiens
ggaaacuuaugcugaccaa

SEQ ID NO: 1450251 - RNA, 19 nt, Homo sapiens
gaugaagauuuagagguuu

SEQ ID NO: 1450252 - RNA, 19 nt, Homo sapiens
agaugaagauuuagagguu

SEQ ID NO: 1450253 - RNA, 19 nt, Homo sapiens
aagcagaccuccuggugaa

SEQ ID NO: 1450254 - RNA, 19 nt, Homo sapiens
ugaaauccacaaugacuaa

SEQ ID NO: 1450255 - RNA, 19 nt, Homo sapiens
caaggaaucgagaagcuaa

SEQ ID NO: 1450256 - RNA, 19 nt, Homo sapiens
gccaaacccugaucuagag

SEQ ID NO: 1450257 - RNA, 19 nt, Homo sapiens
aagaaaggaucaacaagca

SEQ ID NO: 1450258 - RNA, 19 nt, Homo sapiens
gcagaaacggaauuacaga

SEQ ID NO: 1450259 - RNA, 19 nt, Homo sapiens
cagaagaugaugaggauga

SEQ ID NO: 1450260 - RNA, 19 nt, Homo sapiens
ugaugaacuuugcagauga

SEQ ID NO: 1450261 - RNA, 19 nt, Homo sapiens
aaucuucgcugccuaugug

SEQ ID NO: 1450262 - RNA, 19 nt, Homo sapiens
caucuggaggaaacuauua

SEQ ID NO: 1450263 - RNA, 19 nt, Homo sapiens
ggagaagcauuuuggagaa

SEQ ID NO: 1450264 - RNA, 19 nt, Homo sapiens
gauuauucaucucguuuag

SEQ ID NO: 1450265 - RNA, 19 nt, Homo sapiens
gaugcuagccgaacaaguc

SEQ ID NO: 1450266 - RNA, 19 nt, Homo sapiens
gcgcgaggcagcaugauga

SEQ ID NO: 1450267 - RNA, 19 nt, Homo sapiens
aagcagagguugaaagacu

SEQ ID NO: 1450268 - RNA, 19 nt, Homo sapiens
gcaaggaaucgagaagcua

SEQ ID NO: 1450269 - RNA, 19 nt, Homo sapiens
caaacgaaacaacugcaaa

SEQ ID NO: 1450270 - RNA, 19 nt, Homo sapiens
auaucuagccuucagaaua

SEQ ID NO: 1450271 - RNA, 19 nt, Homo sapiens
aagagcaaauucaaaguca

SEQ ID NO: 1450272 - RNA, 19 nt, Homo sapiens
ccacuugucgacuaagaaa

SEQ ID NO: 1450273 - RNA, 19 nt, Homo sapiens
guauccacuugucgacuaa

SEQ ID NO: 1450274 - RNA, 19 nt, Homo sapiens
gaacuuuauacucacuuug

SEQ ID NO: 1450275 - RNA, 19 nt, Homo sapiens
aaagaacacgucagcgaaa

SEQ ID NO: 1450276 - RNA, 19 nt, Homo sapiens
gaaucgagaagcuaagcaa

SEQ ID NO: 1450277 - RNA, 19 nt, Homo sapiens
uauacucacuuugcuaugu

SEQ ID NO: 1450278 - RNA, 19 nt, Homo sapiens
ugaucgacauguuauuuca

SEQ ID NO: 1450279 - RNA, 19 nt, Homo sapiens
aaacccaucugaucgacau

SEQ ID NO: 1450280 - RNA, 19 nt, Homo sapiens
cagcgaaacccaucugauc

SEQ ID NO: 1450281 - RNA, 19 nt, Homo sapiens
gaugaacuuugcagaugag

SEQ ID NO: 1450282 - RNA, 19 nt, Homo sapiens
gaaauccacaaugacuaaa

SEQ ID NO: 1450283 - RNA, 19 nt, Homo sapiens
ggaugacgaguuagauguu

SEQ ID NO: 1450284 - RNA, 19 nt, Homo sapiens
cugaugaacuuugcagaug

SEQ ID NO: 1450285 - RNA, 19 nt, Homo sapiens
guuagauguuacagaagaa

SEQ ID NO: 1450286 - RNA, 19 nt, Homo sapiens
ucaacaagcagaagaugau

SEQ ID NO: 1450287 - RNA, 19 nt, Homo sapiens
aauguuauuucacggcaaa

SEQ ID NO: 1450288 - RNA, 19 nt, Homo sapiens
cagaccuccuggugaauga

SEQ ID NO: 1450289 - RNA, 19 nt, Homo sapiens
aguuagauguuacagaaga

SEQ ID NO: 1450290 - RNA, 19 nt, Homo sapiens
gaggaugacgaguuagaug

SEQ ID NO: 1450291 - RNA, 19 nt, Homo sapiens
acaagcagagguugaaaga

SEQ ID NO: 1450292 - RNA, 19 nt, Homo sapiens
gaagcuaagcaauuaacuc

SEQ ID NO: 1450293 - RNA, 19 nt, Homo sapiens
ccaaaucuucgcugccuau

SEQ ID NO: 1450294 - RNA, 19 nt, Homo sapiens
aagcuaagcaauuaacuca

SEQ ID NO: 1450295 - RNA, 19 nt, Homo sapiens
cuacagagaccccgcauuu

SEQ ID NO: 1450296 - RNA, 19 nt, Homo sapiens
gcagaccuccuggugaaug

SEQ ID NO: 1450297 - RNA, 19 nt, Homo sapiens
uguuaagccucaaagugaa

SEQ ID NO: 1450298 - RNA, 19 nt, Homo sapiens
ggcagaaaaugaaggauau

SEQ ID NO: 1450299 - RNA, 19 nt, Homo sapiens
caucugaucgacauguuau

SEQ ID NO: 1450300 - RNA, 19 nt, Homo sapiens
ggaacgcucaaacgaaaca

SEQ ID NO: 1450301 - RNA, 19 nt, Homo sapiens
gcagagguugaaagacuug

SEQ ID NO: 1450302 - RNA, 19 nt, Homo sapiens
uaacgcguaugcugcuaca

SEQ ID NO: 1450303 - RNA, 19 nt, Homo sapiens
auacucacuuugcuauguu

SEQ ID NO: 1450304 - RNA, 19 nt, Homo sapiens
guagaacuuuauacucacu

SEQ ID NO: 1450305 - RNA, 19 nt, Homo sapiens
gaucaacaagcagaagaug

SEQ ID NO: 1450306 - RNA, 19 nt, Homo sapiens
uaagagcaaauucaaaguc

SEQ ID NO: 1450307 - RNA, 19 nt, Homo sapiens
uggaggaaacuauuaacaa

SEQ ID NO: 1450308 - RNA, 19 nt, Homo sapiens
acccugaucuagagagcua

SEQ ID NO: 1450309 - RNA, 19 nt, Homo sapiens
ucaaagucaccucuucaga

SEQ ID NO: 1450310 - RNA, 19 nt, Homo sapiens
uguaagagcaaauucaaag

SEQ ID NO: 1450311 - RNA, 19 nt, Homo sapiens
ccucaaagcaacacucaca

SEQ ID NO: 1450312 - RNA, 19 nt, Homo sapiens
guaugcaccagauuauuca

SEQ ID NO: 1450313 - RNA, 19 nt, Homo sapiens
ccgaacaagucgucaucug

SEQ ID NO: 1450314 - RNA, 19 nt, Homo sapiens
agaaacggaauuacagaga

SEQ ID NO: 1450315 - RNA, 19 nt, Homo sapiens
gagaagcuaagcaauuaac

SEQ ID NO: 1450316 - RNA, 19 nt, Homo sapiens
aaacuuaugcugaccaaaa

SEQ ID NO: 1450317 - RNA, 19 nt, Homo sapiens
uauguuaagccucaaagug

SEQ ID NO: 1450318 - RNA, 19 nt, Homo sapiens
gauguuacagaagaagaaa

SEQ ID NO: 1450319 - RNA, 19 nt, Homo sapiens
gcgaaacccaucugaucga

SEQ ID NO: 1450320 - RNA, 19 nt, Homo sapiens
acagagaccccgcauuuaa

SEQ ID NO: 1450321 - RNA, 19 nt, Homo sapiens
cgagaagcuaagcaauuaa

SEQ ID NO: 1450322 - RNA, 19 nt, Homo sapiens
gcaacacucacagcaagga

SEQ ID NO: 1450323 - RNA, 19 nt, Homo sapiens
guugaacccuugaaaacuu

SEQ ID NO: 1450324 - RNA, 19 nt, Homo sapiens
caaacagcugucucaaaug

SEQ ID NO: 1450325 - RNA, 19 nt, Homo sapiens
ugacuugaaauccacaaug

SEQ ID NO: 1450326 - RNA, 19 nt, Homo sapiens
agcagaagaugaugaggau

SEQ ID NO: 1450327 - RNA, 19 nt, Homo sapiens
uuaaagcugggccugauga

SEQ ID NO: 1450328 - RNA, 19 nt, Homo sapiens
guaagagcaaauucaaagu

SEQ ID NO: 1450329 - RNA, 19 nt, Homo sapiens
ccaucugaucgacauguua

SEQ ID NO: 1450330 - RNA, 19 nt, Homo sapiens
gaaaguagcugcacaugaa

SEQ ID NO: 1450331 - RNA, 19 nt, Homo sapiens
cgacaaagaugacuuagua

SEQ ID NO: 1450332 - RNA, 19 nt, Homo sapiens
cgacaucacuuaauggaua

SEQ ID NO: 1450333 - RNA, 19 nt, Homo sapiens
caagugggaugucuccuua

SEQ ID NO: 1450334 - RNA, 19 nt, Homo sapiens
gaggaagaaucugauaaua

SEQ ID NO: 1450335 - RNA, 19 nt, Homo sapiens
gaagaauccuccaguuuua

SEQ ID NO: 1450336 - RNA, 19 nt, Homo sapiens
gaacucacacuccaguaua

SEQ ID NO: 1450337 - RNA, 19 nt, Homo sapiens
ccucuuaccuugauuaaau

SEQ ID NO: 1450338 - RNA, 19 nt, Homo sapiens
ccagaacucucagaacuaa

SEQ ID NO: 1450339 - RNA, 19 nt, Homo sapiens
ucacagauaugaaugaaca

SEQ ID NO: 1450340 - RNA, 19 nt, Homo sapiens
gcuaugaucuuugagaaau

SEQ ID NO: 1450341 - RNA, 19 nt, Homo sapiens
cacaguggaugcuucaaua

SEQ ID NO: 1450342 - RNA, 19 nt, Homo sapiens
gaguaucacuucuuuaucu

SEQ ID NO: 1450343 - RNA, 19 nt, Homo sapiens
caacagcauuuccuuaucu

SEQ ID NO: 1450344 - RNA, 19 nt, Homo sapiens
gaagcaaacaggaguauca

SEQ ID NO: 1450345 - RNA, 19 nt, Homo sapiens
uaucaaggaugguauuuag

SEQ ID NO: 1450346 - RNA, 19 nt, Homo sapiens
gagaacaauuugccacugu

SEQ ID NO: 1450347 - RNA, 19 nt, Homo sapiens
gcacucagaucuuggaaaa

SEQ ID NO: 1450348 - RNA, 19 nt, Homo sapiens
gaacuuagugagagcugua

SEQ ID NO: 1450349 - RNA, 19 nt, Homo sapiens
ugucacaacucacagauau

SEQ ID NO: 1450350 - RNA, 19 nt, Homo sapiens
gguacaagaugccagaugu

SEQ ID NO: 1450351 - RNA, 19 nt, Homo sapiens
caaggaugguauuuagauu

SEQ ID NO: 1450352 - RNA, 19 nt, Homo sapiens
ggaaagauggaaauagaug

SEQ ID NO: 1450353 - RNA, 19 nt, Homo sapiens
guggcuaaauucacagaua

SEQ ID NO: 1450354 - RNA, 19 nt, Homo sapiens
gcaaacaggaguaucacuu

SEQ ID NO: 1450355 - RNA, 19 nt, Homo sapiens
caccaaaccugccuaugug

SEQ ID NO: 1450356 - RNA, 19 nt, Homo sapiens
gaaagauggaaauagauga

SEQ ID NO: 1450357 - RNA, 19 nt, Homo sapiens
gacaucacuuaauggauaa

SEQ ID NO: 1450358 - RNA, 19 nt, Homo sapiens
acaggaguaucacuucuuu

SEQ ID NO: 1450359 - RNA, 19 nt, Homo sapiens
uauguuaccucuccauuag

SEQ ID NO: 1450360 - RNA, 19 nt, Homo sapiens
gcaaugcacagccaauuuc

SEQ ID NO: 1450361 - RNA, 19 nt, Homo sapiens
ugaacaagaggagguauua

SEQ ID NO: 1450362 - RNA, 19 nt, Homo sapiens
cagcauuuccuuaucuaua

SEQ ID NO: 1450363 - RNA, 19 nt, Homo sapiens
gaagagccaaggaagagaa

SEQ ID NO: 1450364 - RNA, 19 nt, Homo sapiens
agaugucccugaugcauuu

SEQ ID NO: 1450365 - RNA, 19 nt, Homo sapiens
ggaagaauccuccaguuuu

SEQ ID NO: 1450366 - RNA, 19 nt, Homo sapiens
guauguuaccucuccauua

SEQ ID NO: 1450367 - RNA, 19 nt, Homo sapiens
ggauaaacaaggaguguau

SEQ ID NO: 1450368 - RNA, 19 nt, Homo sapiens
gaacugagacugauuuugu

SEQ ID NO: 1450369 - RNA, 19 nt, Homo sapiens
ccaauuucaugcuccacua

SEQ ID NO: 1450370 - RNA, 19 nt, Homo sapiens
cucaguagcuucauggaaa

SEQ ID NO: 1450371 - RNA, 19 nt, Homo sapiens
acaugaagcugaggaagaa

SEQ ID NO: 1450372 - RNA, 19 nt, Homo sapiens
gcaaaggcagcaugaacuu

SEQ ID NO: 1450373 - RNA, 19 nt, Homo sapiens
agggaaagauggaaauaga

SEQ ID NO: 1450374 - RNA, 19 nt, Homo sapiens
acaaugcacucagaucuug

SEQ ID NO: 1450375 - RNA, 19 nt, Homo sapiens
acagaaagauguggaauac

SEQ ID NO: 1450376 - RNA, 19 nt, Homo sapiens
agaaagauguggaauacag

SEQ ID NO: 1450377 - RNA, 19 nt, Homo sapiens
uuucaucaguggcuaaauu

SEQ ID NO: 1450378 - RNA, 19 nt, Homo sapiens
agugagagcuguagugcaa

SEQ ID NO: 1450379 - RNA, 19 nt, Homo sapiens
ugaauuacuuacacagaug

SEQ ID NO: 1450380 - RNA, 19 nt, Homo sapiens
ccaauacgacaucacuuaa

SEQ ID NO: 1450381 - RNA, 19 nt, Homo sapiens
aacaugaacugccaagaga

SEQ ID NO: 1450382 - RNA, 19 nt, Homo sapiens
ggagggaaagauggaaaua

SEQ ID NO: 1450383 - RNA, 19 nt, Homo sapiens
caaaggcagcaugaacuua

SEQ ID NO: 1450384 - RNA, 19 nt, Homo sapiens
gguauuacuagaacaguuu

SEQ ID NO: 1450385 - RNA, 19 nt, Homo sapiens
aauacgacaucacuuaaug

SEQ ID NO: 1450386 - RNA, 19 nt, Homo sapiens
ugauugcuaugaucuuuga

SEQ ID NO: 1450387 - RNA, 19 nt, Homo sapiens
gaaagauguggaauacaga

SEQ ID NO: 1450388 - RNA, 19 nt, Homo sapiens
cugauaauauugcagaaga

SEQ ID NO: 1450389 - RNA, 19 nt, Homo sapiens
caggcaagauugaaaguag

SEQ ID NO: 1450390 - RNA, 19 nt, Homo sapiens
gaggagguauuacuagaac

SEQ ID NO: 1450391 - RNA, 19 nt, Homo sapiens
ggaacucacacuccaguau

SEQ ID NO: 1450392 - RNA, 19 nt, Homo sapiens
ucacaacucacagauauga

SEQ ID NO: 1450393 - RNA, 19 nt, Homo sapiens
agauugccauucaccauaa

SEQ ID NO: 1450394 - RNA, 19 nt, Homo sapiens
uguuaccucuccauuagua

SEQ ID NO: 1450395 - RNA, 19 nt, Homo sapiens
cgauuagaaugauugcuau

SEQ ID NO: 1450396 - RNA, 19 nt, Homo sapiens
uggcuaaauucacagauau

SEQ ID NO: 1450397 - RNA, 19 nt, Homo sapiens
agaacaauuugccacugua

SEQ ID NO: 1450398 - RNA, 19 nt, Homo sapiens
uugaggaacuagcaagaaa

SEQ ID NO: 1450399 - RNA, 19 nt, Homo sapiens
ugacuuugccucaacuaaa

SEQ ID NO: 1450400 - RNA, 19 nt, Homo sapiens
cuuaauggauaaacaagga

SEQ ID NO: 1450401 - RNA, 19 nt, Homo sapiens
gaaugaacaagaggaggua

SEQ ID NO: 1450402 - RNA, 19 nt, Homo sapiens
cagauugccauucaccaua

SEQ ID NO: 1450403 - RNA, 19 nt, Homo sapiens
gagaggaaugggacacaaa

SEQ ID NO: 1450404 - RNA, 19 nt, Homo sapiens
guagaagagccaaggaaga

SEQ ID NO: 1450405 - RNA, 19 nt, Homo sapiens
aagaggagguauuacuaga

SEQ ID NO: 1450406 - RNA, 19 nt, Homo sapiens
gccugccgcuccuucauuu

SEQ ID NO: 1450407 - RNA, 19 nt, Homo sapiens
uagccgaaauacagaaaga

SEQ ID NO: 1450408 - RNA, 19 nt, Homo sapiens
caaccugacaauuaacauu

SEQ ID NO: 1450409 - RNA, 19 nt, Homo sapiens
gaauuacuuacacagauga

SEQ ID NO: 1450410 - RNA, 19 nt, Homo sapiens
acaagaggagguauuacua

SEQ ID NO: 1450411 - RNA, 19 nt, Homo sapiens
ggacaggcuuagagaagac

SEQ ID NO: 1450412 - RNA, 19 nt, Homo sapiens
uagaaugauugcuaugauc

SEQ ID NO: 1450413 - RNA, 19 nt, Homo sapiens
caagaagcaaacaggagua

SEQ ID NO: 1450414 - RNA, 19 nt, Homo sapiens
ccgauuagaaugauugcua

SEQ ID NO: 1450415 - RNA, 19 nt, Homo sapiens
gcaaacuggcauuucauca

SEQ ID NO: 1450416 - RNA, 19 nt, Homo sapiens
gaacaauuugccacuguag

SEQ ID NO: 1450417 - RNA, 19 nt, Homo sapiens
cagcaugaacuuagugaga

SEQ ID NO: 1450418 - RNA, 19 nt, Homo sapiens
caaacaggaguaucacuuc

SEQ ID NO: 1450419 - RNA, 19 nt, Homo sapiens
caguguuuauccaccaaua

SEQ ID NO: 1450420 - RNA, 19 nt, Homo sapiens
acaccaaaccugccuaugu

SEQ ID NO: 1450421 - RNA, 19 nt, Homo sapiens
ucaaggaugguauuuagau

SEQ ID NO: 1450422 - RNA, 19 nt, Homo sapiens
uacagaaagauguggaaua

SEQ ID NO: 1450423 - RNA, 19 nt, Homo sapiens
ugaaaguagcugcacauga

SEQ ID NO: 1450424 - RNA, 19 nt, Homo sapiens
caagaggagguauuacuag

SEQ ID NO: 1450425 - RNA, 19 nt, Homo sapiens
aaccagugaucaguguuua

SEQ ID NO: 1450426 - RNA, 19 nt, Homo sapiens
ucaacagcauuuccuuauc

SEQ ID NO: 1450427 - RNA, 19 nt, Homo sapiens
ccacugcuguuccucuuac

SEQ ID NO: 1450428 - RNA, 19 nt, Homo sapiens
guaccgauuagaaugauug

SEQ ID NO: 1450429 - RNA, 19 nt, Homo sapiens
auacagaacugagacugau

SEQ ID NO: 1450430 - RNA, 19 nt, Homo sapiens
gacaaagcauaucguaaua

SEQ ID NO: 1450431 - RNA, 19 nt, Homo sapiens
gaagauauauacugugaca

SEQ ID NO: 1450432 - RNA, 19 nt, Homo sapiens
ucaaggaacuggaaaauua

SEQ ID NO: 1450433 - RNA, 19 nt, Homo sapiens
gcacuaggcuguuaaaaga

SEQ ID NO: 1450434 - RNA, 19 nt, Homo sapiens
cgagagcccugauuccuuu

SEQ ID NO: 1450435 - RNA, 19 nt, Homo sapiens
gaaacgggauuaugaaggu

SEQ ID NO: 1450436 - RNA, 19 nt, Homo sapiens
gcagaagaauacauuacuu

SEQ ID NO: 1450437 - RNA, 19 nt, Homo sapiens
gaucugaacacuaaacauu

SEQ ID NO: 1450438 - RNA, 19 nt, Homo sapiens
gcacugagggccuuuaaug

SEQ ID NO: 1450439 - RNA, 19 nt, Homo sapiens
ggaagguugucccagcuuu

SEQ ID NO: 1450440 - RNA, 19 nt, Homo sapiens
gagcucucuucuuuacuua

SEQ ID NO: 1450441 - RNA, 19 nt, Homo sapiens
uuggagcacuuucuuauuu

SEQ ID NO: 1450442 - RNA, 19 nt, Homo sapiens
ugacaaagcauaucguaau

SEQ ID NO: 1450443 - RNA, 19 nt, Homo sapiens
uggaagauauauacuguga

SEQ ID NO: 1450444 - RNA, 19 nt, Homo sapiens
acugggaucugaacacuaa

SEQ ID NO: 1450445 - RNA, 19 nt, Homo sapiens
gcgaguggauuuugauaua

SEQ ID NO: 1450446 - RNA, 19 nt, Homo sapiens
gaacacuaaacauugcuaa

SEQ ID NO: 1450447 - RNA, 19 nt, Homo sapiens
gaucaugcugcaagucaua

SEQ ID NO: 1450448 - RNA, 19 nt, Homo sapiens
cacuaaacauugcuaagaa

SEQ ID NO: 1450449 - RNA, 19 nt, Homo sapiens
gaugacaaagcauaucgua

SEQ ID NO: 1450450 - RNA, 19 nt, Homo sapiens
uauaaaggaucuucaugca

SEQ ID NO: 1450451 - RNA, 19 nt, Homo sapiens
uauauucagucauggagaa

SEQ ID NO: 1450452 - RNA, 19 nt, Homo sapiens
uaaggagaaugguaguaga

SEQ ID NO: 1450453 - RNA, 19 nt, Homo sapiens
gauauauacugugacaauc

SEQ ID NO: 1450454 - RNA, 19 nt, Homo sapiens
gacauaaucugacuaaaag

SEQ ID NO: 1450455 - RNA, 19 nt, Homo sapiens
uauauuccacccaucuuua

SEQ ID NO: 1450456 - RNA, 19 nt, Homo sapiens
acuaaaagauggcuuauga

SEQ ID NO: 1450457 - RNA, 19 nt, Homo sapiens
cuacggaggaaccaagaua

SEQ ID NO: 1450458 - RNA, 19 nt, Homo sapiens
cauugucacuugcuugaga

SEQ ID NO: 1450459 - RNA, 19 nt, Homo sapiens
caugcuagguccuuucaca

SEQ ID NO: 1450460 - RNA, 19 nt, Homo sapiens
gaaauauuggguauaaagg

SEQ ID NO: 1450461 - RNA, 19 nt, Homo sapiens
gggauuaugaagguuauuu

SEQ ID NO: 1450462 - RNA, 19 nt, Homo sapiens
uaucaugggagcagaagaa

SEQ ID NO: 1450463 - RNA, 19 nt, Homo sapiens
uguggaagauauauacugu

SEQ ID NO: 1450464 - RNA, 19 nt, Homo sapiens
acacuaaacauugcuaaga

SEQ ID NO: 1450465 - RNA, 19 nt, Homo sapiens
gaagguugucccagcuuug

SEQ ID NO: 1450466 - RNA, 19 nt, Homo sapiens
gcggaaacgggauuaugaa

SEQ ID NO: 1450467 - RNA, 19 nt, Homo sapiens
gagaaugguaguagagaca

SEQ ID NO: 1450468 - RNA, 19 nt, Homo sapiens
aagcacacuugcaccuaaa

SEQ ID NO: 1450469 - RNA, 19 nt, Homo sapiens
ggaaaauuaugcugaaaac

SEQ ID NO: 1450470 - RNA, 19 nt, Homo sapiens
gaaucccgaagcucuguuu

SEQ ID NO: 1450471 - RNA, 19 nt, Homo sapiens
accaggauauuuggaagua

SEQ ID NO: 1450472 - RNA, 19 nt, Homo sapiens
guaugccacugggaucuga

SEQ ID NO: 1450473 - RNA, 19 nt, Homo sapiens
caaaacuguuccugugaaa

SEQ ID NO: 1450474 - RNA, 19 nt, Homo sapiens
ccuuuggaaucgcccauuu

SEQ ID NO: 1450475 - RNA, 19 nt, Homo sapiens
ccaggauauuuggaaguaa

SEQ ID NO: 1450476 - RNA, 19 nt, Homo sapiens
gcuagguccuuucacaaaa

SEQ ID NO: 1450477 - RNA, 19 nt, Homo sapiens
gguauaaaggaucuucaug

SEQ ID NO: 1450478 - RNA, 19 nt, Homo sapiens
cacuagaaauauuggguau

SEQ ID NO: 1450479 - RNA, 19 nt, Homo sapiens
cuucuuuacuuaacacuag

SEQ ID NO: 1450480 - RNA, 19 nt, Homo sapiens
gaaugguaguagagacaag

SEQ ID NO: 1450481 - RNA, 19 nt, Homo sapiens
gcaugguguuucacaagag

SEQ ID NO: 1450482 - RNA, 19 nt, Homo sapiens
ucugggcacuaggcuguua

SEQ ID NO: 1450483 - RNA, 19 nt, Homo sapiens
gcucucuucuuuacuuaac

SEQ ID NO: 1450484 - RNA, 19 nt, Homo sapiens
uaauaucaaggaacuggaa

SEQ ID NO: 1450485 - RNA, 19 nt, Homo sapiens
aaaucuggaugacaaagca

SEQ ID NO: 1450486 - RNA, 19 nt, Homo sapiens
gauauauuccacccaucuu

SEQ ID NO: 1450487 - RNA, 19 nt, Homo sapiens
ucagacgguuucucuagag

SEQ ID NO: 1450488 - RNA, 19 nt, Homo sapiens
gagagcaacaccauaucau

SEQ ID NO: 1450489 - RNA, 19 nt, Homo sapiens
caggauauuuggaaguaac

SEQ ID NO: 1450490 - RNA, 19 nt, Homo sapiens
ccacugggaucugaacacu

SEQ ID NO: 1450491 - RNA, 19 nt, Homo sapiens
ugagagcaacaccauauca

SEQ ID NO: 1450492 - RNA, 19 nt, Homo sapiens
ucccauggauauuuguaug

SEQ ID NO: 1450493 - RNA, 19 nt, Homo sapiens
gagcagaagaaagguguuc

SEQ ID NO: 1450494 - RNA, 19 nt, Homo sapiens
caugggagcagaagaaagg

SEQ ID NO: 1450495 - RNA, 19 nt, Homo sapiens
ggcauugucacuugcuuga

SEQ ID NO: 1450496 - RNA, 19 nt, Homo sapiens
gagcccugauuccuuuaag

SEQ ID NO: 1450497 - RNA, 19 nt, Homo sapiens
gcacuuucuuauuuucuga

SEQ ID NO: 1450498 - RNA, 19 nt, Homo sapiens
gcugcaugguguuucacaa

SEQ ID NO: 1450499 - RNA, 19 nt, Homo sapiens
cagaucaugcugcaaguca

SEQ ID NO: 1450500 - RNA, 19 nt, Homo sapiens
cagcggaaacuccuucaca

SEQ ID NO: 1450501 - RNA, 19 nt, Homo sapiens
uauauacugugacaaucca

SEQ ID NO: 1450502 - RNA, 19 nt, Homo sapiens
ccacccaccaccaggauau

SEQ ID NO: 1450503 - RNA, 19 nt, Homo sapiens
uacagcagaagaauacauu

SEQ ID NO: 1450504 - RNA, 19 nt, Homo sapiens
ugcaugguguuucacaaga

SEQ ID NO: 1450505 - RNA, 19 nt, Homo sapiens
cuugagagcaacaccauau

SEQ ID NO: 1450506 - RNA, 19 nt, Homo sapiens
cugcaagucauauuggaaa

SEQ ID NO: 1450507 - RNA, 19 nt, Homo sapiens
gagggccuuuaauguggaa

SEQ ID NO: 1450508 - RNA, 19 nt, Homo sapiens
cggcugcuauguccuugug

SEQ ID NO: 1450509 - RNA, 19 nt, Homo sapiens
aaacgggauuaugaagguu

SEQ ID NO: 1450510 - RNA, 19 nt, Homo sapiens
uugcugcugucuugcugua

SEQ ID NO: 1450511 - RNA, 19 nt, Homo sapiens
gguguuccuucccauggau

SEQ ID NO: 1450512 - RNA, 19 nt, Homo sapiens
gccuguggccauugaacua

SEQ ID NO: 1450513 - RNA, 19 nt, Homo sapiens
gugacaauccaccacauca

SEQ ID NO: 1450514 - RNA, 19 nt, Homo sapiens
gagagcccugauuccuuua

SEQ ID NO: 1450515 - RNA, 19 nt, Homo sapiens
cagcagaagaauacauuac

SEQ ID NO: 1450516 - RNA, 19 nt, Homo sapiens
acagcagaagaauacauua

SEQ ID NO: 1450517 - RNA, 19 nt, Homo sapiens
ucugaacacuaaacauugc

SEQ ID NO: 1450518 - RNA, 19 nt, Homo sapiens
acaaaacuguuccugugaa

SEQ ID NO: 1450519 - RNA, 19 nt, Homo sapiens
ugcggaaacgggauuauga

SEQ ID NO: 1450520 - RNA, 19 nt, Homo sapiens
uaaagcaugcuagguccuu

SEQ ID NO: 1450521 - RNA, 19 nt, Homo sapiens
gcugcaagucauauuggaa

SEQ ID NO: 1450522 - RNA, 19 nt, Homo sapiens
cuucacauauggaaaaguu

SEQ ID NO: 1450523 - RNA, 19 nt, Homo sapiens
gaaagaaacugaauuuguc

SEQ ID NO: 1450524 - RNA, 19 nt, Homo sapiens
gcaauugugucaaauacua

SEQ ID NO: 1450525 - RNA, 19 nt, Homo sapiens
aaacaaacauuccuggaua

SEQ ID NO: 1450526 - RNA, 19 nt, Homo sapiens
gaaaucaaaugcaguaucu

SEQ ID NO: 1450527 - RNA, 19 nt, Homo sapiens
gagaagcccuaauuaguga

SEQ ID NO: 1450528 - RNA, 19 nt, Homo sapiens
gguacugucuucugaauuu

SEQ ID NO: 1450529 - RNA, 19 nt, Homo sapiens
gaagauggaccagcacuua

SEQ ID NO: 1450530 - RNA, 19 nt, Homo sapiens
aaagaagccuacucucaua

SEQ ID NO: 1450531 - RNA, 19 nt, Homo sapiens
ccagugaagugguuuauug

SEQ ID NO: 1450532 - RNA, 19 nt, Homo sapiens
aguaguagcugaucacuuu

SEQ ID NO: 1450533 - RNA, 19 nt, Homo sapiens
gaauagagacauugaaguu

SEQ ID NO: 1450534 - RNA, 19 nt, Homo sapiens
gcugaucacuuugucuuua

SEQ ID NO: 1450535 - RNA, 19 nt, Homo sapiens
gaagaaugcuguucaagcu

SEQ ID NO: 1450536 - RNA, 19 nt, Homo sapiens
gaucguaugaugaaugaua

SEQ ID NO: 1450537 - RNA, 19 nt, Homo sapiens
cauuaugagugcuuuguua

SEQ ID NO: 1450538 - RNA, 19 nt, Homo sapiens
gaaagaagccuacucucau

SEQ ID NO: 1450539 - RNA, 19 nt, Homo sapiens
gaagccuacucucauaauu

SEQ ID NO: 1450540 - RNA, 19 nt, Homo sapiens
ucauggagcuauuccuaua

SEQ ID NO: 1450541 - RNA, 19 nt, Homo sapiens
ggaccagcacuuauaauuu

SEQ ID NO: 1450542 - RNA, 19 nt, Homo sapiens
cagccugaaugaugaauuu

SEQ ID NO: 1450543 - RNA, 19 nt, Homo sapiens
gaccagcacuuauaauuuu

SEQ ID NO: 1450544 - RNA, 19 nt, Homo sapiens
gaaacauuaugagugcuuu

SEQ ID NO: 1450545 - RNA, 19 nt, Homo sapiens
gauaacaaagggucaacua

SEQ ID NO: 1450546 - RNA, 19 nt, Homo sapiens
agccuacucucauaauuua

SEQ ID NO: 1450547 - RNA, 19 nt, Homo sapiens
uaacaaagggucaacuaga

SEQ ID NO: 1450548 - RNA, 19 nt, Homo sapiens
agaaugcuguucaagcuuu

SEQ ID NO: 1450549 - RNA, 19 nt, Homo sapiens
ugucgccgcucuaggaaua

SEQ ID NO: 1450550 - RNA, 19 nt, Homo sapiens
cuaagguacugucuucuga

SEQ ID NO: 1450551 - RNA, 19 nt, Homo sapiens
gaacacaaagcccucugaa

SEQ ID NO: 1450552 - RNA, 19 nt, Homo sapiens
uaucuaagguacugucuuc

SEQ ID NO: 1450553 - RNA, 19 nt, Homo sapiens
ucaauuuguugucuucuug

SEQ ID NO: 1450554 - RNA, 19 nt, Homo sapiens
ugaaagaugguauaagcua

SEQ ID NO: 1450555 - RNA, 19 nt, Homo sapiens
auaagcaucuuucacagaa

SEQ ID NO: 1450556 - RNA, 19 nt, Homo sapiens
aacaaagggucaacuagaa

SEQ ID NO: 1450557 - RNA, 19 nt, Homo sapiens
gauaagcaccaaagaauac

SEQ ID NO: 1450558 - RNA, 19 nt, Homo sapiens
cuacauggaccaagagaaa

SEQ ID NO: 1450559 - RNA, 19 nt, Homo sapiens
ucagaaaucaaaugcagua

SEQ ID NO: 1450560 - RNA, 19 nt, Homo sapiens
gcccuauacuguggucuua

SEQ ID NO: 1450561 - RNA, 19 nt, Homo sapiens
caaaauccuuuagcaguua

SEQ ID NO: 1450562 - RNA, 19 nt, Homo sapiens
acaagagucuauaggcaaa

SEQ ID NO: 1450563 - RNA, 19 nt, Homo sapiens
ggguuaguauaguuguuua

SEQ ID NO: 1450564 - RNA, 19 nt, Homo sapiens
gaccugcuauggcaaugaa

SEQ ID NO: 1450565 - RNA, 19 nt, Homo sapiens
auagagacauugaaguuug

SEQ ID NO: 1450566 - RNA, 19 nt, Homo sapiens
gcaguuggaggacuauuug

SEQ ID NO: 1450567 - RNA, 19 nt, Homo sapiens
ggauaaugcguuaaauuuc

SEQ ID NO: 1450568 - RNA, 19 nt, Homo sapiens
ugaaagaagccuacucuca

SEQ ID NO: 1450569 - RNA, 19 nt, Homo sapiens
ugauaacuguugaaccaaa

SEQ ID NO: 1450570 - RNA, 19 nt, Homo sapiens
uaugagugcuuuguuagaa

SEQ ID NO: 1450571 - RNA, 19 nt, Homo sapiens
agaauaccaggaaacauua

SEQ ID NO: 1450572 - RNA, 19 nt, Homo sapiens
aagaauaccaggaaacauu

SEQ ID NO: 1450573 - RNA, 19 nt, Homo sapiens
gauggaccagcacuuauaa

SEQ ID NO: 1450574 - RNA, 19 nt, Homo sapiens
aaacaugaucguaugauga

SEQ ID NO: 1450575 - RNA, 19 nt, Homo sapiens
acaaauuacacaccuagua

SEQ ID NO: 1450576 - RNA, 19 nt, Homo sapiens
aaucaaaccugugguguag

SEQ ID NO: 1450577 - RNA, 19 nt, Homo sapiens
ucaaaccugugguguagga

SEQ ID NO: 1450578 - RNA, 19 nt, Homo sapiens
cgagaagcccuaauuagug

SEQ ID NO: 1450579 - RNA, 19 nt, Homo sapiens
guucgagaagcccuaauua

SEQ ID NO: 1450580 - RNA, 19 nt, Homo sapiens
aagcaucuuucacagaauu

SEQ ID NO: 1450581 - RNA, 19 nt, Homo sapiens
gacgaagaaugcuguucaa

SEQ ID NO: 1450582 - RNA, 19 nt, Homo sapiens
gugaagugguuuauugcuu

SEQ ID NO: 1450583 - RNA, 19 nt, Homo sapiens
ugauaagcaccaaagaaua

SEQ ID NO: 1450584 - RNA, 19 nt, Homo sapiens
aacaaacauuccuggauaa

SEQ ID NO: 1450585 - RNA, 19 nt, Homo sapiens
caaagaauaccaggaaaca

SEQ ID NO: 1450586 - RNA, 19 nt, Homo sapiens
uauugaggcuuacccaguu

SEQ ID NO: 1450587 - RNA, 19 nt, Homo sapiens
caaugaagaaagaaacuga

SEQ ID NO: 1450588 - RNA, 19 nt, Homo sapiens
ccugaaugaugaauuuaug

SEQ ID NO: 1450589 - RNA, 19 nt, Homo sapiens
gggcaagucacguaauguu

SEQ ID NO: 1450590 - RNA, 19 nt, Homo sapiens
gcccugagcugauuuugaa

SEQ ID NO: 1450591 - RNA, 19 nt, Homo sapiens
ucugugcccuauaugauuu

SEQ ID NO: 1450592 - RNA, 19 nt, Homo sapiens
acacaaagcccucugaaaa

SEQ ID NO: 1450593 - RNA, 19 nt, Homo sapiens
aauaacagcaguuuagguu

SEQ ID NO: 1450594 - RNA, 19 nt, Homo sapiens
gaaugcuguucaagcuuug

SEQ ID NO: 1450595 - RNA, 19 nt, Homo sapiens
gaaguucauggaauggaaa

SEQ ID NO: 1450596 - RNA, 19 nt, Homo sapiens
ggugugcugugcauuguca

SEQ ID NO: 1450597 - RNA, 19 nt, Homo sapiens
caaagggucaacuagaaga

SEQ ID NO: 1450598 - RNA, 19 nt, Homo sapiens
ggaaacauuaugagugcuu

SEQ ID NO: 1450599 - RNA, 19 nt, Homo sapiens
uccaggguuuaguuuauua

SEQ ID NO: 1450600 - RNA, 19 nt, Homo sapiens
gaaguuugggacaagauau

SEQ ID NO: 1450601 - RNA, 19 nt, Homo sapiens
cuauggcaaugaagaaaga

SEQ ID NO: 1450602 - RNA, 19 nt, Homo sapiens
cugaucacuuugucuuuaa

SEQ ID NO: 1450603 - RNA, 19 nt, Homo sapiens
uuucuucucuaccuuacua

SEQ ID NO: 1450604 - RNA, 19 nt, Homo sapiens
ggaggacuauuugaauuuu

SEQ ID NO: 1450605 - RNA, 19 nt, Homo sapiens
ccuauacuguggucuuaau

SEQ ID NO: 1450606 - RNA, 19 nt, Homo sapiens
ucacauacucgaagaaugg

SEQ ID NO: 1450607 - RNA, 19 nt, Homo sapiens
gcguuaaauuucuguaucu

SEQ ID NO: 1450608 - RNA, 19 nt, Homo sapiens
uaaacaaacauuccuggau

SEQ ID NO: 1450609 - RNA, 19 nt, Homo sapiens
cuaacaaauuacacaccua

SEQ ID NO: 1450610 - RNA, 19 nt, Homo sapiens
caccaaagaauaccaggaa

SEQ ID NO: 1450611 - RNA, 19 nt, Homo sapiens
ggaauagagacauugaagu

SEQ ID NO: 1450612 - RNA, 19 nt, Homo sapiens
uaucauggagcuauuccua

SEQ ID NO: 1450613 - RNA, 19 nt, Homo sapiens
uuaucuaacuucuguguca

SEQ ID NO: 1450614 - RNA, 19 nt, Homo sapiens
gagcugauuuugaaagaug

SEQ ID NO: 1450615 - RNA, 19 nt, Homo sapiens
guuagaacguuuucauuga

SEQ ID NO: 1450616 - RNA, 19 nt, Homo sapiens
uuacugugauugauaacug

SEQ ID NO: 1450617 - RNA, 19 nt, Homo sapiens
gcaagucacguaauguuuu

SEQ ID NO: 1450618 - RNA, 19 nt, Homo sapiens
aggauucugugcccuauau

SEQ ID NO: 1450619 - RNA, 19 nt, Homo sapiens
agauggaccagcacuuaua

SEQ ID NO: 1450620 - RNA, 19 nt, Homo sapiens
ggaaaacaguggcaacucu

SEQ ID NO: 1450621 - RNA, 19 nt, Homo sapiens
aacuaucucuuguggguuu

SEQ ID NO: 1450622 - RNA, 19 nt, Homo sapiens
ucuuaauaaugccagcuua

SEQ ID NO: 1450623 - RNA, 19 nt, Homo sapiens
ggacaaagcucagagaaag

SEQ ID NO: 1450624 - RNA, 19 nt, Homo sapiens
gcaaagcccaacagaaaua

SEQ ID NO: 1450625 - RNA, 19 nt, Homo sapiens
gagcacaucuacagggaaa

SEQ ID NO: 1450626 - RNA, 19 nt, Homo sapiens
caaacucucuguaauaagu

SEQ ID NO: 1450627 - RNA, 19 nt, Homo sapiens
caggaaacauggacuggua

SEQ ID NO: 1450628 - RNA, 19 nt, Homo sapiens
caaaggagaugagggcuau

SEQ ID NO: 1450629 - RNA, 19 nt, Homo sapiens
cagcaagacuuacgagaga

SEQ ID NO: 1450630 - RNA, 19 nt, Homo sapiens
cccagaagcucaauccuuu

SEQ ID NO: 1450631 - RNA, 19 nt, Homo sapiens
cagagaaacucaacugcaa

SEQ ID NO: 1450632 - RNA, 19 nt, Homo sapiens
gcuaaaugcucauguaggu

SEQ ID NO: 1450633 - RNA, 19 nt, Homo sapiens
gugaagaguuugauuacga

SEQ ID NO: 1450634 - RNA, 19 nt, Homo sapiens
gacaugugcuucauuaucu

SEQ ID NO: 1450635 - RNA, 19 nt, Homo sapiens
gcaagauccagguuacuuu

SEQ ID NO: 1450636 - RNA, 19 nt, Homo sapiens
uaaaugcucauguagguaa

SEQ ID NO: 1450637 - RNA, 19 nt, Homo sapiens
ucagugaagaguuugauua

SEQ ID NO: 1450638 - RNA, 19 nt, Homo sapiens
ugcaaacucucuguaauaa

SEQ ID NO: 1450639 - RNA, 19 nt, Homo sapiens
ggacaugugcuucauuauc

SEQ ID NO: 1450640 - RNA, 19 nt, Homo sapiens
gugccaaccuggugucuga

SEQ ID NO: 1450641 - RNA, 19 nt, Homo sapiens
gaagcucaauccuuucagu

SEQ ID NO: 1450642 - RNA, 19 nt, Homo sapiens
acuauggucuuaaugcuaa

SEQ ID NO: 1450643 - RNA, 19 nt, Homo sapiens
gcagugggcugaugaacac

SEQ ID NO: 1450644 - RNA, 19 nt, Homo sapiens
cugcaaagcccaacagaaa

SEQ ID NO: 1450645 - RNA, 19 nt, Homo sapiens
gggaaaugauggacaugug

SEQ ID NO: 1450646 - RNA, 19 nt, Homo sapiens
gagggaugcuggugugcuu

SEQ ID NO: 1450647 - RNA, 19 nt, Homo sapiens
agaaggacauggagaugga

SEQ ID NO: 1450648 - RNA, 19 nt, Homo sapiens
cagacgagauggcaagauc

SEQ ID NO: 1450649 - RNA, 19 nt, Homo sapiens
accaagggcuggagaguga

SEQ ID NO: 1450650 - RNA, 19 nt, Homo sapiens
aaugcuaaaugcucaugua

SEQ ID NO: 1450651 - RNA, 19 nt, Homo sapiens
ugauuacgcuacucaagug

SEQ ID NO: 1450652 - RNA, 19 nt, Homo sapiens
auggacaugugcuucauua

SEQ ID NO: 1450653 - RNA, 19 nt, Homo sapiens
ggacauggagauggacaaa

SEQ ID NO: 1450654 - RNA, 19 nt, Homo sapiens
gauggcaagauccagguua

SEQ ID NO: 1450655 - RNA, 19 nt, Homo sapiens
gcacaucuacagggaaaug

SEQ ID NO: 1450656 - RNA, 19 nt, Homo sapiens
gagaugaccauguugugau

SEQ ID NO: 1450657 - RNA, 19 nt, Homo sapiens
caaauuuggcccacuaugg

SEQ ID NO: 1450658 - RNA, 19 nt, Homo sapiens
gugggcugaugaacacaua

SEQ ID NO: 1450659 - RNA, 19 nt, Homo sapiens
aaaugcaaacucucuguaa

SEQ ID NO: 1450660 - RNA, 19 nt, Homo sapiens
agaugaccauguugugauu

SEQ ID NO: 1450661 - RNA, 19 nt, Homo sapiens
ucucaugcgugccaggaaa

SEQ ID NO: 1450662 - RNA, 19 nt, Homo sapiens
augcaaacucucuguaaua

SEQ ID NO: 1450663 - RNA, 19 nt, Homo sapiens
ggaaacauggacugguaga

SEQ ID NO: 1450664 - RNA, 19 nt, Homo sapiens
aaagaaagagguguccaaa

SEQ ID NO: 1450665 - RNA, 19 nt, Homo sapiens
gagaaacucaacugcaaag

SEQ ID NO: 1450666 - RNA, 19 nt, Homo sapiens
aaugcaaacucucuguaau

SEQ ID NO: 1450667 - RNA, 19 nt, Homo sapiens
guucguauuucagauaaag

SEQ ID NO: 1450668 - RNA, 19 nt, Homo sapiens
ccaaaacgguggucagcaa

SEQ ID NO: 1450669 - RNA, 19 nt, Homo sapiens
ccucccagguaaacagauu

SEQ ID NO: 1450670 - RNA, 19 nt, Homo sapiens
cgagaugaccauguuguga

SEQ ID NO: 1450671 - RNA, 19 nt, Homo sapiens
agaaagagguguccaaaac

SEQ ID NO: 1450672 - RNA, 19 nt, Homo sapiens
gaugaccauguugugauua

SEQ ID NO: 1450673 - RNA, 19 nt, Homo sapiens
gauaaaguagugggcauuc

SEQ ID NO: 1450674 - RNA, 19 nt, Homo sapiens
acagggaaaugauggacau

SEQ ID NO: 1450675 - RNA, 19 nt, Homo sapiens
ccacuauggucuuaaugcu

SEQ ID NO: 1450676 - RNA, 19 nt, Homo sapiens
aggccgagaugaccauguu

SEQ ID NO: 1450677 - RNA, 19 nt, Homo sapiens
aacauggacugguagacuu

SEQ ID NO: 1450678 - RNA, 19 nt, Homo sapiens
ggcccacuauggucuuaau

SEQ ID NO: 1450679 - RNA, 19 nt, Homo sapiens
caggcuaucagcagagaaa

SEQ ID NO: 1450680 - RNA, 19 nt, Homo sapiens
ggcaagauccagguuacuu

SEQ ID NO: 1450681 - RNA, 19 nt, Homo sapiens
cagaagcucaauccuuuca

SEQ ID NO: 1450682 - RNA, 19 nt, Homo sapiens
caaccuggugucugagcua

SEQ ID NO: 1450683 - RNA, 19 nt, Homo sapiens
gcacagccacccuggucau

SEQ ID NO: 1450684 - RNA, 19 nt, Homo sapiens
caaagcccaacagaaauau

SEQ ID NO: 1450685 - RNA, 19 nt, Homo sapiens
acauggagauggacaaagc

SEQ ID NO: 1450686 - RNA, 19 nt, Homo sapiens
aaagacaggugggcagcau

SEQ ID NO: 1450687 - RNA, 19 nt, Homo sapiens
gugauuacgcuacucaagu

SEQ ID NO: 1450688 - RNA, 19 nt, Homo sapiens
gauggacaugugcuucauu

SEQ ID NO: 1450689 - RNA, 19 nt, Homo sapiens
acacauacaaucccagaag

SEQ ID NO: 1450690 - RNA, 19 nt, Homo sapiens
gcugaugaacacauacaau

SEQ ID NO: 1450691 - RNA, 19 nt, Homo sapiens
uuacagagaaacucaacug

SEQ ID NO: 1450692 - RNA, 19 nt, Homo sapiens
gauggacaaagcucagaga

SEQ ID NO: 1450693 - RNA, 19 nt, Homo sapiens
gcaaacucucuguaauaag

SEQ ID NO: 1450694 - RNA, 19 nt, Homo sapiens
ucaagcuccuaaaccaauc

SEQ ID NO: 1450695 - RNA, 19 nt, Homo sapiens
ggacugguagacuuugaag

SEQ ID NO: 1450696 - RNA, 19 nt, Homo sapiens
gaaccaaaacugcugaaag

SEQ ID NO: 1450697 - RNA, 19 nt, Homo sapiens
gcagugggcgaaugagaac

SEQ ID NO: 1450698 - RNA, 19 nt, Homo sapiens
ggaugcuggugugcuugaa

SEQ ID NO: 1450699 - RNA, 19 nt, Homo sapiens
gaaaaugcaaacucucugu

SEQ ID NO: 1450700 - RNA, 19 nt, Homo sapiens
uggacaaagcucagagaaa

SEQ ID NO: 1450701 - RNA, 19 nt, Homo sapiens
uaaaguagugggcauucuc

SEQ ID NO: 1450702 - RNA, 19 nt, Homo sapiens
gcgaaugagaacagcauca

SEQ ID NO: 1450703 - RNA, 19 nt, Homo sapiens
agagaaacucaacugcaaa

SEQ ID NO: 1450704 - RNA, 19 nt, Homo sapiens
gagauggacaaagcucaga

SEQ ID NO: 1450705 - RNA, 19 nt, Homo sapiens
gagaaagccccugagguuu

SEQ ID NO: 1450706 - RNA, 19 nt, Homo sapiens
acugguagacuuugaagga

SEQ ID NO: 1450707 - RNA, 19 nt, Homo sapiens
ggcagcagugggcgaauga

SEQ ID NO: 1450708 - RNA, 19 nt, Homo sapiens
gccagaaggacauggagau

SEQ ID NO: 1450709 - RNA, 19 nt, Homo sapiens
agagaaagccccugagguu

SEQ ID NO: 1450710 - RNA, 19 nt, Homo sapiens
gggaugcuggugugcuuga

SEQ ID NO: 1450711 - RNA, 19 nt, Homo sapiens
aaaugcucauguagguaaa

SEQ ID NO: 1450712 - RNA, 19 nt, Homo sapiens
aaauuuggcccacuauggu

SEQ ID NO: 1450713 - RNA, 19 nt, Homo sapiens
gcaaggccgagaugaccau

SEQ ID NO: 1450714 - RNA, 19 nt, Homo sapiens
acguucguauuucagauaa

SEQ ID NO: 1450715 - RNA, 19 nt, Homo sapiens
ccacccuggucaucagcuu

SEQ ID NO: 1450716 - RNA, 19 nt, Homo sapiens
cccuugcccucccagguaa

SEQ ID NO: 1450717 - RNA, 19 nt, Homo sapiens
gugacagcguagacacaga

SEQ ID NO: 1450718 - RNA, 19 nt, Homo sapiens
cgacaaagauggcaacaua

SEQ ID NO: 1450719 - RNA, 19 nt, Homo sapiens
gagaaucugugaaguuuga

SEQ ID NO: 1450720 - RNA, 19 nt, Homo sapiens
gcaaauauggccuguaauu

SEQ ID NO: 1450721 - RNA, 19 nt, Homo sapiens
gagaauaguucggaucauu

SEQ ID NO: 1450722 - RNA, 19 nt, Homo sapiens
gcaccuaucucuugcugaa

SEQ ID NO: 1450723 - RNA, 19 nt, Homo sapiens
ggaaguaucuuuggugaca

SEQ ID NO: 1450724 - RNA, 19 nt, Homo sapiens
gaagagaaucugugaaguu

SEQ ID NO: 1450725 - RNA, 19 nt, Homo sapiens
aagcaaauauggccuguaa

SEQ ID NO: 1450726 - RNA, 19 nt, Homo sapiens
gugauucccuggaugguua

SEQ ID NO: 1450727 - RNA, 19 nt, Homo sapiens
gaagaugaaugcagagucu

SEQ ID NO: 1450728 - RNA, 19 nt, Homo sapiens
ccgaauaucucaacugaug

SEQ ID NO: 1450729 - RNA, 19 nt, Homo sapiens
ggacaggaaagaagcauuu

SEQ ID NO: 1450730 - RNA, 19 nt, Homo sapiens
ccaaugcgcuuucaaaugc

SEQ ID NO: 1450731 - RNA, 19 nt, Homo sapiens
guucuucucugacugauga

SEQ ID NO: 1450732 - RNA, 19 nt, Homo sapiens
ggaaucaaguguuuuauug

SEQ ID NO: 1450733 - RNA, 19 nt, Homo sapiens
aaagagaccgccuggaaua

SEQ ID NO: 1450734 - RNA, 19 nt, Homo sapiens
ggaaugccuucgaugaaug

SEQ ID NO: 1450735 - RNA, 19 nt, Homo sapiens
aagagaaucugugaaguuu

SEQ ID NO: 1450736 - RNA, 19 nt, Homo sapiens
ucaguggagugacuugaua

SEQ ID NO: 1450737 - RNA, 19 nt, Homo sapiens
gaaauucugugaggagcuu

SEQ ID NO: 1450738 - RNA, 19 nt, Homo sapiens
cugaauaucuggaaauugu

SEQ ID NO: 1450739 - RNA, 19 nt, Homo sapiens
guuaguaccuccaaaucuu

SEQ ID NO: 1450740 - RNA, 19 nt, Homo sapiens
accaauggcuacuauauuu

SEQ ID NO: 1450741 - RNA, 19 nt, Homo sapiens
gaaugcggcuccauagauc

SEQ ID NO: 1450742 - RNA, 19 nt, Homo sapiens
gcaaacaccggcaguugaa

SEQ ID NO: 1450743 - RNA, 19 nt, Homo sapiens
ucccauagcuugucucuuc

SEQ ID NO: 1450744 - RNA, 19 nt, Homo sapiens
ggacacagaccauugcaau

SEQ ID NO: 1450745 - RNA, 19 nt, Homo sapiens
gacaucaacucuucuccaa

SEQ ID NO: 1450746 - RNA, 19 nt, Homo sapiens
gaacguuuccaagagaaua

SEQ ID NO: 1450747 - RNA, 19 nt, Homo sapiens
caucaacucuucuccaagu

SEQ ID NO: 1450748 - RNA, 19 nt, Homo sapiens
gaagggaguaagcgaguaa

SEQ ID NO: 1450749 - RNA, 19 nt, Homo sapiens
gaaaagagaccgccuggaa

SEQ ID NO: 1450750 - RNA, 19 nt, Homo sapiens
ggaagggaguaagcgagua

SEQ ID NO: 1450751 - RNA, 19 nt, Homo sapiens
gagaccgccuggaauaaau

SEQ ID NO: 1450752 - RNA, 19 nt, Homo sapiens
gcaauggaaaugcagauga

SEQ ID NO: 1450753 - RNA, 19 nt, Homo sapiens
gcaagcggccuucccaaga

SEQ ID NO: 1450754 - RNA, 19 nt, Homo sapiens
cguagaugaugguuaauau

SEQ ID NO: 1450755 - RNA, 19 nt, Homo sapiens
ccugacaacuugaauaaca

SEQ ID NO: 1450756 - RNA, 19 nt, Homo sapiens
auaccaaccugacaacuug

SEQ ID NO: 1450757 - RNA, 19 nt, Homo sapiens
gcuacuauauuuggacuga

SEQ ID NO: 1450758 - RNA, 19 nt, Homo sapiens
uaccgaauaucucaacuga

SEQ ID NO: 1450759 - RNA, 19 nt, Homo sapiens
caacaccaguagcaaguuc

SEQ ID NO: 1450760 - RNA, 19 nt, Homo sapiens
ggcuguagauguucccuuu

SEQ ID NO: 1450761 - RNA, 19 nt, Homo sapiens
gaauaaugagagcaaguuu

SEQ ID NO: 1450762 - RNA, 19 nt, Homo sapiens
aacuguagcuuaugugaaa

SEQ ID NO: 1450763 - RNA, 19 nt, Homo sapiens
caauggaaaugcagaugau

SEQ ID NO: 1450764 - RNA, 19 nt, Homo sapiens
ggagugacuugauauuagg

SEQ ID NO: 1450765 - RNA, 19 nt, Homo sapiens
caaccugacaacuugaaua

SEQ ID NO: 1450766 - RNA, 19 nt, Homo sapiens
ggaguaagcgaguaaugga

SEQ ID NO: 1450767 - RNA, 19 nt, Homo sapiens
caacucuucuccaagugaa

SEQ ID NO: 1450768 - RNA, 19 nt, Homo sapiens
aaauauggccuguaauuca

SEQ ID NO: 1450769 - RNA, 19 nt, Homo sapiens
cuuaaucacuucugcaugu

SEQ ID NO: 1450770 - RNA, 19 nt, Homo sapiens
gcugugugcuuaaucacuu

SEQ ID NO: 1450771 - RNA, 19 nt, Homo sapiens
gaaacagacaagagaacaa

SEQ ID NO: 1450772 - RNA, 19 nt, Homo sapiens
cguaauuaccuuucacuuu

SEQ ID NO: 1450773 - RNA, 19 nt, Homo sapiens
cccaagauguaccgaauau

SEQ ID NO: 1450774 - RNA, 19 nt, Homo sapiens
gcagaugauuuagacuguu

SEQ ID NO: 1450775 - RNA, 19 nt, Homo sapiens
gauggcaacauaacucuga

SEQ ID NO: 1450776 - RNA, 19 nt, Homo sapiens
caagcggccuucccaagau

SEQ ID NO: 1450777 - RNA, 19 nt, Homo sapiens
aauauggccuguaauucaa

SEQ ID NO: 1450778 - RNA, 19 nt, Homo sapiens
gacuugauauuagguggua

SEQ ID NO: 1450779 - RNA, 19 nt, Homo sapiens
ugaauguccuccaucugaa

SEQ ID NO: 1450780 - RNA, 19 nt, Homo sapiens
gcaugugcaagaugguuua

SEQ ID NO: 1450781 - RNA, 19 nt, Homo sapiens
guugacagcuucugaacgu

SEQ ID NO: 1450782 - RNA, 19 nt, Homo sapiens
cucaagggcuguagauguu

SEQ ID NO: 1450783 - RNA, 19 nt, Homo sapiens
uggagugacuugauauuag

SEQ ID NO: 1450784 - RNA, 19 nt, Homo sapiens
guaagcgaguaauggagaa

SEQ ID NO: 1450785 - RNA, 19 nt, Homo sapiens
cugacaggcucccacuaua

SEQ ID NO: 1450786 - RNA, 19 nt, Homo sapiens
cagaugauuuagacuguuc

SEQ ID NO: 1450787 - RNA, 19 nt, Homo sapiens
ccaggagguuggacacaga

SEQ ID NO: 1450788 - RNA, 19 nt, Homo sapiens
gacaaagauggcaacauaa

SEQ ID NO: 1450789 - RNA, 19 nt, Homo sapiens
guggagugacuugauauua

SEQ ID NO: 1450790 - RNA, 19 nt, Homo sapiens
ugagagcaaguuugucuaa

SEQ ID NO: 1450791 - RNA, 19 nt, Homo sapiens
agacaaaacuucucugcaa

SEQ ID NO: 1450792 - RNA, 19 nt, Homo sapiens
cagaccagcguuauguaua

SEQ ID NO: 1450793 - RNA, 19 nt, Homo sapiens
ccaggaaacagacaagaga

SEQ ID NO: 1450794 - RNA, 19 nt, Homo sapiens
gaagaagagaaucugugaa

SEQ ID NO: 1450795 - RNA, 19 nt, Homo sapiens
gagaaauauuagccagugu

SEQ ID NO: 1450796 - RNA, 19 nt, Homo sapiens
caagugaagacaacugguu

SEQ ID NO: 1450797 - RNA, 19 nt, Homo sapiens
caaauauggccuguaauuc

SEQ ID NO: 1450798 - RNA, 19 nt, Homo sapiens
ugaaaauggugcaguugua

SEQ ID NO: 1450799 - RNA, 19 nt, Homo sapiens
ggaaacagacaagagaaca

SEQ ID NO: 1450800 - RNA, 19 nt, Homo sapiens
aauauuagccagugucuuc

SEQ ID NO: 1450801 - RNA, 19 nt, Homo sapiens
acaagaggcugccgaagac

SEQ ID NO: 1450802 - RNA, 19 nt, Homo sapiens
agaagaagagaaucuguga

SEQ ID NO: 1450803 - RNA, 19 nt, Homo sapiens
uaucucaacugaugucaac

SEQ ID NO: 1450804 - RNA, 19 nt, Homo sapiens
ugacagcuucugaacguuu

SEQ ID NO: 1450805 - RNA, 19 nt, Homo sapiens
gauuuagacuguucuucuc

SEQ ID NO: 1450806 - RNA, 19 nt, Homo sapiens
gcauggaaguaucuuuggu

SEQ ID NO: 1450807 - RNA, 19 nt, Homo sapiens
ccucaccaauggcuacuau

SEQ ID NO: 1450808 - RNA, 19 nt, Homo sapiens
ccagccacaucauaucuca

SEQ ID NO: 1450809 - RNA, 19 nt, Homo sapiens
ucaccaauggcuacuauau

SEQ ID NO: 1450810 - RNA, 19 nt, Homo sapiens
ucgaaaugauaaugccaaa

SEQ ID NO: 1450811 - RNA, 19 nt, Homo sapiens
gcaugaaaauggugcaguu

SEQ ID NO: 1450812 - RNA, 19 nt, Homo sapiens
aaacaccaaugcgcuuuca

SEQ ID NO: 1450813 - RNA, 19 nt, Homo sapiens
gaaaauggacaggaaagaa

SEQ ID NO: 1450814 - RNA, 19 nt, Homo sapiens
ggugguaaccguagaugau

SEQ ID NO: 1450815 - RNA, 19 nt, Homo sapiens
uaauuugccuucccuuugc

SEQ ID NO: 1450816 - RNA, 19 nt, Homo sapiens
ggaaauuguccaacuugca

SEQ ID NO: 1450817 - RNA, 19 nt, Homo sapiens
gaggaaacucccauagcuu

SEQ ID NO: 1450818 - RNA, 19 nt, Homo sapiens
gagcugaagugacugauuu

SEQ ID NO: 1450819 - RNA, 19 nt, Homo sapiens
caccuucucuugugauuua

SEQ ID NO: 1450820 - RNA, 19 nt, Homo sapiens
gcacacaguuuuagauuuu

SEQ ID NO: 1450821 - RNA, 19 nt, Homo sapiens
uaacuuagccaugacaaua

SEQ ID NO: 1450822 - RNA, 19 nt, Homo sapiens
gaagugaagcacacaguuu

SEQ ID NO: 1450823 - RNA, 19 nt, Homo sapiens
gaaauucauucucgaaagg

SEQ ID NO: 1450824 - RNA, 19 nt, Homo sapiens
gaagguauaucugaguuuc

SEQ ID NO: 1450825 - RNA, 19 nt, Homo sapiens
cgaaagaggugcuuauacu

SEQ ID NO: 1450826 - RNA, 19 nt, Homo sapiens
gagcagagccaucccaaga

SEQ ID NO: 1450827 - RNA, 19 nt, Homo sapiens
gaagaugagauuaccauug

SEQ ID NO: 1450828 - RNA, 19 nt, Homo sapiens
ucacaguucugcucgguuu

SEQ ID NO: 1450829 - RNA, 19 nt, Homo sapiens
ucacccagcuccucaaguu

SEQ ID NO: 1450830 - RNA, 19 nt, Homo sapiens
uaacauaggugccuuugcu

SEQ ID NO: 1450831 - RNA, 19 nt, Homo sapiens
gaacaauacauacuagcaa

SEQ ID NO: 1450832 - RNA, 19 nt, Homo sapiens
gaacugcacauauauacau

SEQ ID NO: 1450833 - RNA, 19 nt, Homo sapiens
guccagagcuucuucgaau

SEQ ID NO: 1450834 - RNA, 19 nt, Homo sapiens
cgaaagggagaauaacaua

SEQ ID NO: 1450835 - RNA, 19 nt, Homo sapiens
cuacuuccauuguauguga

SEQ ID NO: 1450836 - RNA, 19 nt, Homo sapiens
gaaauucccaguauccaau

SEQ ID NO: 1450837 - RNA, 19 nt, Homo sapiens
gcagagccaucccaagauc

SEQ ID NO: 1450838 - RNA, 19 nt, Homo sapiens
ugaaaugguuaacccugua

SEQ ID NO: 1450839 - RNA, 19 nt, Homo sapiens
cagaauaaccugccaagga

SEQ ID NO: 1450840 - RNA, 19 nt, Homo sapiens
gaaagaggugcuuauacuu

SEQ ID NO: 1450841 - RNA, 19 nt, Homo sapiens
gacacgagaacaauacaua

SEQ ID NO: 1450842 - RNA, 19 nt, Homo sapiens
gaagggaauccgacuugaa

SEQ ID NO: 1450843 - RNA, 19 nt, Homo sapiens
gaaaugguuaacccuguaa

SEQ ID NO: 1450844 - RNA, 19 nt, Homo sapiens
gaauccgacuugaagguau

SEQ ID NO: 1450845 - RNA, 19 nt, Homo sapiens
gcagaugaagaugagauua

SEQ ID NO: 1450846 - RNA, 19 nt, Homo sapiens
gaagugagagccagugaag

SEQ ID NO: 1450847 - RNA, 19 nt, Homo sapiens
cgagaacaauacauacuag

SEQ ID NO: 1450848 - RNA, 19 nt, Homo sapiens
caaucaagcugggaaaucu

SEQ ID NO: 1450849 - RNA, 19 nt, Homo sapiens
caggaaaacuggaucauga

SEQ ID NO: 1450850 - RNA, 19 nt, Homo sapiens
aagaugagauuaccauugg

SEQ ID NO: 1450851 - RNA, 19 nt, Homo sapiens
ggaauccgacuugaaggua

SEQ ID NO: 1450852 - RNA, 19 nt, Homo sapiens
auaguuaacuuagccauga

SEQ ID NO: 1450853 - RNA, 19 nt, Homo sapiens
uacagaaucucucccugaa

SEQ ID NO: 1450854 - RNA, 19 nt, Homo sapiens
gaaaguuacaggcacugaa

SEQ ID NO: 1450855 - RNA, 19 nt, Homo sapiens
gaugguaugggaaaucuga

SEQ ID NO: 1450856 - RNA, 19 nt, Homo sapiens
ggaguagguuccacuuguc

SEQ ID NO: 1450857 - RNA, 19 nt, Homo sapiens
uagcaacccaacagaauaa

SEQ ID NO: 1450858 - RNA, 19 nt, Homo sapiens
cagaaucucucccugaaaa

SEQ ID NO: 1450859 - RNA, 19 nt, Homo sapiens
gaauaacauaggugccuuu

SEQ ID NO: 1450860 - RNA, 19 nt, Homo sapiens
ugacugauuucuccucaca

SEQ ID NO: 1450861 - RNA, 19 nt, Homo sapiens
gaaagggagaauaacauag

SEQ ID NO: 1450862 - RNA, 19 nt, Homo sapiens
gcugaaaagcugaaaguua

SEQ ID NO: 1450863 - RNA, 19 nt, Homo sapiens
gaauuucacuguggauggu

SEQ ID NO: 1450864 - RNA, 19 nt, Homo sapiens
ggacugagaaugcacaacu

SEQ ID NO: 1450865 - RNA, 19 nt, Homo sapiens
aaaacuggaucaugacuuu

SEQ ID NO: 1450866 - RNA, 19 nt, Homo sapiens
ccaccaccuucucuuguga

SEQ ID NO: 1450867 - RNA, 19 nt, Homo sapiens
uguggaagcucaguguaaa

SEQ ID NO: 1450868 - RNA, 19 nt, Homo sapiens
gcacugaaggagccguauu

SEQ ID NO: 1450869 - RNA, 19 nt, Homo sapiens
ggauaguccgcuggucuua

SEQ ID NO: 1450870 - RNA, 19 nt, Homo sapiens
aauccgacuugaagguaua

SEQ ID NO: 1450871 - RNA, 19 nt, Homo sapiens
cuagcaacccaacagaaua

SEQ ID NO: 1450872 - RNA, 19 nt, Homo sapiens
ccaacuggcuccuucucau

SEQ ID NO: 1450873 - RNA, 19 nt, Homo sapiens
cacagugaaugcaagaaau

SEQ ID NO: 1450874 - RNA, 19 nt, Homo sapiens
aaagaggugcuuauacuuc

SEQ ID NO: 1450875 - RNA, 19 nt, Homo sapiens
gguuaacccuguaagaaaa

SEQ ID NO: 1450876 - RNA, 19 nt, Homo sapiens
ccaauggcaagaugaaaug

SEQ ID NO: 1450877 - RNA, 19 nt, Homo sapiens
ggcgaaagaggugcuuaua

SEQ ID NO: 1450878 - RNA, 19 nt, Homo sapiens
ggagacgccgcacaucaga

SEQ ID NO: 1450879 - RNA, 19 nt, Homo sapiens
ggcaagaugaaaugguuaa

SEQ ID NO: 1450880 - RNA, 19 nt, Homo sapiens
gcugggaaaucuaccaacu

SEQ ID NO: 1450881 - RNA, 19 nt, Homo sapiens
gcaggaaggagcuccaucu

SEQ ID NO: 1450882 - RNA, 19 nt, Homo sapiens
gaggugcuuauacuucuuu

SEQ ID NO: 1450883 - RNA, 19 nt, Homo sapiens
gacagacaguguaugaacu

SEQ ID NO: 1450884 - RNA, 19 nt, Homo sapiens
gacugagaaugcacaacuu

SEQ ID NO: 1450885 - RNA, 19 nt, Homo sapiens
gaaaucacauggggcaguu

SEQ ID NO: 1450886 - RNA, 19 nt, Homo sapiens
agagcaacuuccaguguga

SEQ ID NO: 1450887 - RNA, 19 nt, Homo sapiens
aggaguagguuccacuugu

SEQ ID NO: 1450888 - RNA, 19 nt, Homo sapiens
gaaggagcuccaucugcaa

SEQ ID NO: 1450889 - RNA, 19 nt, Homo sapiens
agguauaucugaguuucua

SEQ ID NO: 1450890 - RNA, 19 nt, Homo sapiens
ccacuugucaguccaguag

SEQ ID NO: 1450891 - RNA, 19 nt, Homo sapiens
uggcaaacuuuaccuuucu

SEQ ID NO: 1450892 - RNA, 19 nt, Homo sapiens
gaagcucaguguaaaagau

SEQ ID NO: 1450893 - RNA, 19 nt, Homo sapiens
ggagcugaagugacugauu

SEQ ID NO: 1450894 - RNA, 19 nt, Homo sapiens
ccggacagcugaccauagg

SEQ ID NO: 1450895 - RNA, 19 nt, Homo sapiens
guccuucugcuguugguua

SEQ ID NO: 1450896 - RNA, 19 nt, Homo sapiens
gccaccaccuucucuugug

SEQ ID NO: 1450897 - RNA, 19 nt, Homo sapiens
cugagaaugcacaacuuua

SEQ ID NO: 1450898 - RNA, 19 nt, Homo sapiens
uaaaugcagagacaaucaa

SEQ ID NO: 1450899 - RNA, 19 nt, Homo sapiens
gcgaaagaggugcuuauac

SEQ ID NO: 1450900 - RNA, 19 nt, Homo sapiens
cgacagacaguguaugaac

SEQ ID NO: 1450901 - RNA, 19 nt, Homo sapiens
ggagcuccaucugcaaucu

SEQ ID NO: 1450902 - RNA, 19 nt, Homo sapiens
gacuugaagguauaucuga

SEQ ID NO: 1450903 - RNA, 19 nt, Homo sapiens
gccaaggacugagaaugca

SEQ ID NO: 1450904 - RNA, 19 nt, Homo sapiens
agaagggaauccgacuuga

SEQ ID NO: 1450905 - RNA, 19 nt, Homo sapiens
aaaugaaauucccaguauc

SEQ ID NO: 1450906 - RNA, 19 nt, Homo sapiens
aaucugagagucaccaaga

SEQ ID NO: 1450907 - RNA, 19 nt, Homo sapiens
cgaagugaagcacacaguu

SEQ ID NO: 1450908 - RNA, 19 nt, Homo sapiens
cgaaugguccacagagcaa

SEQ ID NO: 1450909 - RNA, 19 nt, Homo sapiens
gaaugcaagaaaucacaug

SEQ ID NO: 1450910 - RNA, 19 nt, Homo sapiens
aagaagggaauccgacuug

SEQ ID NO: 1450911 - RNA, 19 nt, Homo sapiens
ugguuaacccuguaagaaa

SEQ ID NO: 1450912 - RNA, 19 nt, Homo sapiens
caagaagggaauccgacuu

SEQ ID NO: 1450913 - RNA, 19 nt, Homo sapiens
cacugaaggagccguauuu

SEQ ID NO: 1450914 - RNA, 19 nt, Homo sapiens
aagaggugcuuauacuucu

SEQ ID NO: 1450915 - RNA, 19 nt, Homo sapiens
gcacaauuuuccauucauc

SEQ ID NO: 1450916 - RNA, 19 nt, Homo sapiens
ugaaauucccaguauccaa

SEQ ID NO: 1450917 - RNA, 19 nt, Homo sapiens
gauugacacagcaguggaa

SEQ ID NO: 1450918 - RNA, 19 nt, Homo sapiens
gaagagggcugucagaaau

SEQ ID NO: 1450919 - RNA, 19 nt, Homo sapiens
caagauggcuguuucaaau

SEQ ID NO: 1450920 - RNA, 19 nt, Homo sapiens
guaauucacuucaugucua

SEQ ID NO: 1450921 - RNA, 19 nt, Homo sapiens
cauggaagcuauugaguuu

SEQ ID NO: 1450922 - RNA, 19 nt, Homo sapiens
ggaucuggcugcucuguuu

SEQ ID NO: 1450923 - RNA, 19 nt, Homo sapiens
gaagcaaggucucauaugc

SEQ ID NO: 1450924 - RNA, 19 nt, Homo sapiens
gagcagcaguuacaaagga

SEQ ID NO: 1450925 - RNA, 19 nt, Homo sapiens
caacucauucucauacuua

SEQ ID NO: 1450926 - RNA, 19 nt, Homo sapiens
gaagauguauaaagcaaag

SEQ ID NO: 1450927 - RNA, 19 nt, Homo sapiens
ggacaaaugaccacuaugu

SEQ ID NO: 1450928 - RNA, 19 nt, Homo sapiens
acaaaugaccacuauguua

SEQ ID NO: 1450929 - RNA, 19 nt, Homo sapiens
ggaaugucuuacccaauuu

SEQ ID NO: 1450930 - RNA, 19 nt, Homo sapiens
gccaugcccuggagucaua

SEQ ID NO: 1450931 - RNA, 19 nt, Homo sapiens
uaggugggauauacauuua

SEQ ID NO: 1450932 - RNA, 19 nt, Homo sapiens
uggaaugucuuacccaauu

SEQ ID NO: 1450933 - RNA, 19 nt, Homo sapiens
acauuuaucuugcaggaaa

SEQ ID NO: 1450934 - RNA, 19 nt, Homo sapiens
ggagauggcagaaauacug

SEQ ID NO: 1450935 - RNA, 19 nt, Homo sapiens
caaaugaccacuauguuag

SEQ ID NO: 1450936 - RNA, 19 nt, Homo sapiens
gugaagauguauaaagcaa

SEQ ID NO: 1450937 - RNA, 19 nt, Homo sapiens
gcuauggauucccuaguga

SEQ ID NO: 1450938 - RNA, 19 nt, Homo sapiens
cagacacgcuccggaaauu

SEQ ID NO: 1450939 - RNA, 19 nt, Homo sapiens
guucaucugugccauggaa

SEQ ID NO: 1450940 - RNA, 19 nt, Homo sapiens
gcaaguagcuauggauucc

SEQ ID NO: 1450941 - RNA, 19 nt, Homo sapiens
gcagcaacccaaucaguga

SEQ ID NO: 1450942 - RNA, 19 nt, Homo sapiens
uggcagcacuuuucuaaua

SEQ ID NO: 1450943 - RNA, 19 nt, Homo sapiens
guaaggcugcuaaucugua

SEQ ID NO: 1450944 - RNA, 19 nt, Homo sapiens
caaaggaaguaggaaugga

SEQ ID NO: 1450945 - RNA, 19 nt, Homo sapiens
ugaagagggcugucagaaa

SEQ ID NO: 1450946 - RNA, 19 nt, Homo sapiens
uaaggcugcuaaucuguau

SEQ ID NO: 1450947 - RNA, 19 nt, Homo sapiens
ccuaguaauucacuucaug

SEQ ID NO: 1450948 - RNA, 19 nt, Homo sapiens
uagcuagggcuuugucuuu

SEQ ID NO: 1450949 - RNA, 19 nt, Homo sapiens
ggaaauucuuauucgaucu

SEQ ID NO: 1450950 - RNA, 19 nt, Homo sapiens
uuacccaauuucagguuua

SEQ ID NO: 1450951 - RNA, 19 nt, Homo sapiens
gaaaucccgaugaucuuga

SEQ ID NO: 1450952 - RNA, 19 nt, Homo sapiens
gauggcuguuucaaauauu

SEQ ID NO: 1450953 - RNA, 19 nt, Homo sapiens
caagcucccuccugugcaa

SEQ ID NO: 1450954 - RNA, 19 nt, Homo sapiens
acaagaaccucuccaagcu

SEQ ID NO: 1450955 - RNA, 19 nt, Homo sapiens
ccaagauggcuguuucaaa

SEQ ID NO: 1450956 - RNA, 19 nt, Homo sapiens
gaguccaguuccuuccaua

SEQ ID NO: 1450957 - RNA, 19 nt, Homo sapiens
aagcaaaggauuacaaugu

SEQ ID NO: 1450958 - RNA, 19 nt, Homo sapiens
agauggcuguuucaaauau

SEQ ID NO: 1450959 - RNA, 19 nt, Homo sapiens
gaaaugcugguguucaucu

SEQ ID NO: 1450960 - RNA, 19 nt, Homo sapiens
gaucguggcuaaguaucug

SEQ ID NO: 1450961 - RNA, 19 nt, Homo sapiens
caacaguggcuuugaugug

SEQ ID NO: 1450962 - RNA, 19 nt, Homo sapiens
gacaaaugaccacuauguu

SEQ ID NO: 1450963 - RNA, 19 nt, Homo sapiens
gcagacacgcuccggaaau

SEQ ID NO: 1450964 - RNA, 19 nt, Homo sapiens
ccaacucauucucauacuu

SEQ ID NO: 1450965 - RNA, 19 nt, Homo sapiens
cagguuuagugaagaugua

SEQ ID NO: 1450966 - RNA, 19 nt, Homo sapiens
ggcaucggcuuuggaaaug

SEQ ID NO: 1450967 - RNA, 19 nt, Homo sapiens
ucagaaaucccgaugaucu

SEQ ID NO: 1450968 - RNA, 19 nt, Homo sapiens
uggauucccuagugaagaa

SEQ ID NO: 1450969 - RNA, 19 nt, Homo sapiens
ugucagaaaucccgaugau

SEQ ID NO: 1450970 - RNA, 19 nt, Homo sapiens
aaacaggcuggacaaauga

SEQ ID NO: 1450971 - RNA, 19 nt, Homo sapiens
aaaacaggcuggacaaaug

SEQ ID NO: 1450972 - RNA, 19 nt, Homo sapiens
caucuuugugcauaacuua

SEQ ID NO: 1450973 - RNA, 19 nt, Homo sapiens
ggaaagggucaccaagcuu

SEQ ID NO: 1450974 - RNA, 19 nt, Homo sapiens
uauucgaucuggauguuga

SEQ ID NO: 1450975 - RNA, 19 nt, Homo sapiens
gcacugccaggauccaaga

SEQ ID NO: 1450976 - RNA, 19 nt, Homo sapiens
ucaggaaccgggagugaaa

SEQ ID NO: 1450977 - RNA, 19 nt, Homo sapiens
ccuagcagcuguugguuac

SEQ ID NO: 1450978 - RNA, 19 nt, Homo sapiens
cauacuuacucccaagaug

SEQ ID NO: 1450979 - RNA, 19 nt, Homo sapiens
gaaccgggagugaaacuac

SEQ ID NO: 1450980 - RNA, 19 nt, Homo sapiens
ggauucaagcuucauggaa

SEQ ID NO: 1450981 - RNA, 19 nt, Homo sapiens
gaaauucuuauucgaucug

SEQ ID NO: 1450982 - RNA, 19 nt, Homo sapiens
ucagugacauuugggcuau

SEQ ID NO: 1450983 - RNA, 19 nt, Homo sapiens
gagagcaagagcugaucua

SEQ ID NO: 1450984 - RNA, 19 nt, Homo sapiens
cuacugggguugccauuuu

SEQ ID NO: 1450985 - RNA, 19 nt, Homo sapiens
ccucuuaagccucugauug

SEQ ID NO: 1450986 - RNA, 19 nt, Homo sapiens
caaggucucauaugcacuu

SEQ ID NO: 1450987 - RNA, 19 nt, Homo sapiens
uauuuccuaugccuaguaa

SEQ ID NO: 1450988 - RNA, 19 nt, Homo sapiens
ugacuaugaacacuugaaa

SEQ ID NO: 1450989 - RNA, 19 nt, Homo sapiens
acagaagcauggcaaggau

SEQ ID NO: 1450990 - RNA, 19 nt, Homo sapiens
cuggacaaaugaccacuau

SEQ ID NO: 1450991 - RNA, 19 nt, Homo sapiens
ccagcgguguucacuuuca

SEQ ID NO: 1450992 - RNA, 19 nt, Homo sapiens
cauccagcccucauucuga

SEQ ID NO: 1450993 - RNA, 19 nt, Homo sapiens
gaaacacuagcaccaguac

SEQ ID NO: 1450994 - RNA, 19 nt, Homo sapiens
gaauuaccgcuggccauug

SEQ ID NO: 1450995 - RNA, 19 nt, Homo sapiens
uagugaagauguauaaagc

SEQ ID NO: 1450996 - RNA, 19 nt, Homo sapiens
uggaaaugcugguguucau

SEQ ID NO: 1450997 - RNA, 19 nt, Homo sapiens
gaguggaaccaacggauuc

SEQ ID NO: 1450998 - RNA, 19 nt, Homo sapiens
uagcaccaguacauacaga

SEQ ID NO: 1450999 - RNA, 19 nt, Homo sapiens
agcaaaggauuacaaugug

SEQ ID NO: 1451000 - RNA, 19 nt, Homo sapiens
ccaauuucagguuuaguga

SEQ ID NO: 1451001 - RNA, 19 nt, Homo sapiens
ggcagcacuuuucuaauaa

SEQ ID NO: 1451002 - RNA, 19 nt, Homo sapiens
acacuagcaccaguacaua

SEQ ID NO: 1451003 - RNA, 19 nt, Homo sapiens
agggaaagccugugucugu

SEQ ID NO: 1451004 - RNA, 19 nt, Homo sapiens
guccaguuccuuccauaaa

SEQ ID NO: 1451005 - RNA, 19 nt, Homo sapiens
gcucccuccugugcaagua

SEQ ID NO: 1451006 - RNA, 19 nt, Homo sapiens
aauuaccgcuggccauugu

SEQ ID NO: 1451007 - RNA, 19 nt, Homo sapiens
gccuagcagcuguugguua

SEQ ID NO: 1451008 - RNA, 19 nt, Homo sapiens
cgaucuggauguugaugau

SEQ ID NO: 1451009 - RNA, 19 nt, Homo sapiens
aagauggcuguuucaaaua

SEQ ID NO: 1451010 - RNA, 19 nt, Homo sapiens
gaaugucuuacccaauuuc

SEQ ID NO: 1451011 - RNA, 19 nt, Homo sapiens
cagaaaucccgaugaucuu

SEQ ID NO: 1451012 - RNA, 19 nt, Homo sapiens
ccaacggauucaagcuuca

SEQ ID NO: 1451013 - RNA, 19 nt, Homo sapiens
agaaacacuagcaccagua

SEQ ID NO: 1451014 - RNA, 19 nt, Homo sapiens
agauauggagcagcaguua

SEQ ID NO: 1451015 - RNA, 19 nt, Homo sapiens
gcucagaguccaguuccuu

SEQ ID NO: 1451016 - RNA, 19 nt, Homo sapiens
aaaucccgaugaucuugaa

SEQ ID NO: 1451017 - RNA, 19 nt, Homo sapiens
guggcuaaguaucugaaga

SEQ ID NO: 1451018 - RNA, 19 nt, Homo sapiens
gcaauaaagugcauaugaa

SEQ ID NO: 1451019 - RNA, 19 nt, Homo sapiens
gaagagacauuuaggacuu

SEQ ID NO: 1451020 - RNA, 19 nt, Homo sapiens
ggaguuaagucaucuaaga

SEQ ID NO: 1451021 - RNA, 19 nt, Homo sapiens
ggagauagguucugguaug

SEQ ID NO: 1451022 - RNA, 19 nt, Homo sapiens
aaacaaaguucucccaaga

SEQ ID NO: 1451023 - RNA, 19 nt, Homo sapiens
gaaguaggcaacaagauaa

SEQ ID NO: 1451024 - RNA, 19 nt, Homo sapiens
cagaauacccacaggauua

SEQ ID NO: 1451025 - RNA, 19 nt, Homo sapiens
gauagguucugguaugaaa

SEQ ID NO: 1451026 - RNA, 19 nt, Homo sapiens
ggaaccugcuguccaguuu

SEQ ID NO: 1451027 - RNA, 19 nt, Homo sapiens
gaggagcgcuggaugaaag

SEQ ID NO: 1451028 - RNA, 19 nt, Homo sapiens
gcaagagucucaaaagaaa

SEQ ID NO: 1451029 - RNA, 19 nt, Homo sapiens
cauaugaaguguuugauca

SEQ ID NO: 1451030 - RNA, 19 nt, Homo sapiens
guagucacauuguugauau

SEQ ID NO: 1451031 - RNA, 19 nt, Homo sapiens
gagauagguucugguauga

SEQ ID NO: 1451032 - RNA, 19 nt, Homo sapiens
uauguugacuucagaguuu

SEQ ID NO: 1451033 - RNA, 19 nt, Homo sapiens
ggaaaccacugacuuaagc

SEQ ID NO: 1451034 - RNA, 19 nt, Homo sapiens
ugaaaacccuggaguauuu

SEQ ID NO: 1451035 - RNA, 19 nt, Homo sapiens
gcuaagagauggagauagg

SEQ ID NO: 1451036 - RNA, 19 nt, Homo sapiens
acaaaguucucccaagauu

SEQ ID NO: 1451037 - RNA, 19 nt, Homo sapiens
gauauggaguuaagucauc

SEQ ID NO: 1451038 - RNA, 19 nt, Homo sapiens
gcaggcugaugucuuugua

SEQ ID NO: 1451039 - RNA, 19 nt, Homo sapiens
ggaaauuucucaggaagag

SEQ ID NO: 1451040 - RNA, 19 nt, Homo sapiens
ucagagagcagauaaacaa

SEQ ID NO: 1451041 - RNA, 19 nt, Homo sapiens
gcacucagagagcagauaa

SEQ ID NO: 1451042 - RNA, 19 nt, Homo sapiens
ugauaaggauauggaguua

SEQ ID NO: 1451043 - RNA, 19 nt, Homo sapiens
ccagagaagcgcuaauaaa

SEQ ID NO: 1451044 - RNA, 19 nt, Homo sapiens
gaagaugcuagaaauguga

SEQ ID NO: 1451045 - RNA, 19 nt, Homo sapiens
agaaguaggcaacaagaua

SEQ ID NO: 1451046 - RNA, 19 nt, Homo sapiens
acacuuaugugccuguuug

SEQ ID NO: 1451047 - RNA, 19 nt, Homo sapiens
ucacauuguugauauggaa

SEQ ID NO: 1451048 - RNA, 19 nt, Homo sapiens
uauggaaaccacugacuua

SEQ ID NO: 1451049 - RNA, 19 nt, Homo sapiens
gggugaagaugcuagaaau

SEQ ID NO: 1451050 - RNA, 19 nt, Homo sapiens
gcagcgagaucccgaaggu

SEQ ID NO: 1451051 - RNA, 19 nt, Homo sapiens
gaagaccugauuccuggua

SEQ ID NO: 1451052 - RNA, 19 nt, Homo sapiens
gagaagcgcuaauaaaagu

SEQ ID NO: 1451053 - RNA, 19 nt, Homo sapiens
gcagaauacccacaggauu

SEQ ID NO: 1451054 - RNA, 19 nt, Homo sapiens
gaaacgcucagcucaauac

SEQ ID NO: 1451055 - RNA, 19 nt, Homo sapiens
gaaauucaggaaaccauca

SEQ ID NO: 1451056 - RNA, 19 nt, Homo sapiens
aaauauaugugggugaaga

SEQ ID NO: 1451057 - RNA, 19 nt, Homo sapiens
ucagagcagugacgcaaga

SEQ ID NO: 1451058 - RNA, 19 nt, Homo sapiens
ggccacacauuaaucaauc

SEQ ID NO: 1451059 - RNA, 19 nt, Homo sapiens
uagauuuggccacacauua

SEQ ID NO: 1451060 - RNA, 19 nt, Homo sapiens
aaagaagacugcacucacu

SEQ ID NO: 1451061 - RNA, 19 nt, Homo sapiens
ugaagaugcuagaaaugug

SEQ ID NO: 1451062 - RNA, 19 nt, Homo sapiens
aagaaacgcucagcucaau

SEQ ID NO: 1451063 - RNA, 19 nt, Homo sapiens
cuuaugugccuguuuguua

SEQ ID NO: 1451064 - RNA, 19 nt, Homo sapiens
cgaggaaugccaagugauu

SEQ ID NO: 1451065 - RNA, 19 nt, Homo sapiens
gagagcagauaaacaagcu

SEQ ID NO: 1451066 - RNA, 19 nt, Homo sapiens
caaaguucucccaagauuu

SEQ ID NO: 1451067 - RNA, 19 nt, Homo sapiens
ccgacugaaugccaccuua

SEQ ID NO: 1451068 - RNA, 19 nt, Homo sapiens
cuucagaacuuuuaacuug

SEQ ID NO: 1451069 - RNA, 19 nt, Homo sapiens
uaagucaucuaagaaguag

SEQ ID NO: 1451070 - RNA, 19 nt, Homo sapiens
uggcguggcugcuaaaugg

SEQ ID NO: 1451071 - RNA, 19 nt, Homo sapiens
ggacaguucagagcaguga

SEQ ID NO: 1451072 - RNA, 19 nt, Homo sapiens
aggcugaugucuuuguaaa

SEQ ID NO: 1451073 - RNA, 19 nt, Homo sapiens
caaggaaggugggauagac

SEQ ID NO: 1451074 - RNA, 19 nt, Homo sapiens
aaaguucucccaagauuuc

SEQ ID NO: 1451075 - RNA, 19 nt, Homo sapiens
gaguuaagucaucuaagaa

SEQ ID NO: 1451076 - RNA, 19 nt, Homo sapiens
auaaggauauggaguuaag

SEQ ID NO: 1451077 - RNA, 19 nt, Homo sapiens
agugcaggcugaugucuuu

SEQ ID NO: 1451078 - RNA, 19 nt, Homo sapiens
uaaagugcauaugaagugu

SEQ ID NO: 1451079 - RNA, 19 nt, Homo sapiens
cagcggaaauucaggaaac

SEQ ID NO: 1451080 - RNA, 19 nt, Homo sapiens
ugaaguguuugaucauaag

SEQ ID NO: 1451081 - RNA, 19 nt, Homo sapiens
cagagaagcgcuaauaaaa

SEQ ID NO: 1451082 - RNA, 19 nt, Homo sapiens
caagauuucagcacguuug

SEQ ID NO: 1451083 - RNA, 19 nt, Homo sapiens
ccugauuccugguacaaga

SEQ ID NO: 1451084 - RNA, 19 nt, Homo sapiens
aagugcauaugaaguguuu

SEQ ID NO: 1451085 - RNA, 19 nt, Homo sapiens
gaaaccaucacagcacuca

SEQ ID NO: 1451086 - RNA, 19 nt, Homo sapiens
uaagaaguaggcaacaaga

SEQ ID NO: 1451087 - RNA, 19 nt, Homo sapiens
guuaagucaucuaagaagu

SEQ ID NO: 1451088 - RNA, 19 nt, Homo sapiens
caauaaagugcauaugaag

SEQ ID NO: 1451089 - RNA, 19 nt, Homo sapiens
gugaagaugcuagaaaugu

SEQ ID NO: 1451090 - RNA, 19 nt, Homo sapiens
uaagagauggagauagguu

SEQ ID NO: 1451091 - RNA, 19 nt, Homo sapiens
uuaagaacuuugaggaucu

SEQ ID NO: 1451092 - RNA, 19 nt, Homo sapiens
aaucaaggaaggugggaua

SEQ ID NO: 1451093 - RNA, 19 nt, Homo sapiens
gugcauaugaaguguuuga

SEQ ID NO: 1451094 - RNA, 19 nt, Homo sapiens
agauuuggccacacauuaa

SEQ ID NO: 1451095 - RNA, 19 nt, Homo sapiens
ccacugacuuaagcaacuu

SEQ ID NO: 1451096 - RNA, 19 nt, Homo sapiens
uaacuuguagucacauugu

SEQ ID NO: 1451097 - RNA, 19 nt, Homo sapiens
caggcaucauuaacucuuu

SEQ ID NO: 1451098 - RNA, 19 nt, Homo sapiens
cuacugcagccuuuagauu

SEQ ID NO: 1451099 - RNA, 19 nt, Homo sapiens
ugugcagacuguaggagua

SEQ ID NO: 1451100 - RNA, 19 nt, Homo sapiens
gcaggcaucauuaacucuu

SEQ ID NO: 1451101 - RNA, 19 nt, Homo sapiens
gauaaggauauggaguuaa

SEQ ID NO: 1451102 - RNA, 19 nt, Homo sapiens
ugacagcauucagcaagug

SEQ ID NO: 1451103 - RNA, 19 nt, Homo sapiens
gcauaugaaguguuugauc

SEQ ID NO: 1451104 - RNA, 19 nt, Homo sapiens
gcaggguguacagauguua

SEQ ID NO: 1451105 - RNA, 19 nt, Homo sapiens
caccauauguugacuucag

SEQ ID NO: 1451106 - RNA, 19 nt, Homo sapiens
gcacccuccuaccuucuca

SEQ ID NO: 1451107 - RNA, 19 nt, Homo sapiens
aaagaaacgcucagcucaa

SEQ ID NO: 1451108 - RNA, 19 nt, Homo sapiens
ugagccgggugcuuuguga

SEQ ID NO: 1451109 - RNA, 19 nt, Homo sapiens
caccuuccguuccauaaag

SEQ ID NO: 1451110 - RNA, 19 nt, Homo sapiens
caggcaggguguacagaug

SEQ ID NO: 1451111 - RNA, 19 nt, Homo sapiens
ucuaagaaguaggcaacaa

SEQ ID NO: 1451112 - RNA, 19 nt, Homo sapiens
uacugcagccuuuagauuu

SEQ ID NO: 1451113 - RNA, 19 nt, Homo sapiens
ccuauucuuuaccgacuga

SEQ ID NO: 1451114 - RNA, 19 nt, Homo sapiens
gaaccugcuguccaguuug

SEQ ID NO: 1451115 - RNA, 19 nt, Homo sapiens
ccugugugguggagauuug

SEQ ID NO: 1451116 - RNA, 19 nt, Homo sapiens
gcuagaaaugugacaguuc

SEQ ID NO: 1451117 - RNA, 19 nt, Homo sapiens
gaaguguuugaucauaaga

SEQ ID NO: 1451118 - RNA, 19 nt, Homo sapiens
gaacacagcuuauuacaug

SEQ ID NO: 1451119 - RNA, 19 nt, Homo sapiens
caaaucagcuguaauucua

SEQ ID NO: 1451120 - RNA, 19 nt, Homo sapiens
guaaauguguugagugaua

SEQ ID NO: 1451121 - RNA, 19 nt, Homo sapiens
caacauugcuucuacauuc

SEQ ID NO: 1451122 - RNA, 19 nt, Homo sapiens
caagcucucuuacauauaa

SEQ ID NO: 1451123 - RNA, 19 nt, Homo sapiens
gggaauaccuuuagucuuc

SEQ ID NO: 1451124 - RNA, 19 nt, Homo sapiens
gaaaucaucuuagaacugu

SEQ ID NO: 1451125 - RNA, 19 nt, Homo sapiens
ggaauucagccuucauuua

SEQ ID NO: 1451126 - RNA, 19 nt, Homo sapiens
ggaaacaaccacagcuuua

SEQ ID NO: 1451127 - RNA, 19 nt, Homo sapiens
gaacaagacccacaaggaa

SEQ ID NO: 1451128 - RNA, 19 nt, Homo sapiens
ccaaacuucuggcaaauuu

SEQ ID NO: 1451129 - RNA, 19 nt, Homo sapiens
ugaaagagauuuacucauc

SEQ ID NO: 1451130 - RNA, 19 nt, Homo sapiens
gcagugauauuguggaaga

SEQ ID NO: 1451131 - RNA, 19 nt, Homo sapiens
gaaauuagcagauagucuu

SEQ ID NO: 1451132 - RNA, 19 nt, Homo sapiens
agacaaaucuacccuuauu

SEQ ID NO: 1451133 - RNA, 19 nt, Homo sapiens
gaaguguucaucaauguua

SEQ ID NO: 1451134 - RNA, 19 nt, Homo sapiens
ggagacacguguugaucua

SEQ ID NO: 1451135 - RNA, 19 nt, Homo sapiens
acaaggagcucaugacaga

SEQ ID NO: 1451136 - RNA, 19 nt, Homo sapiens
guagaucccuuguaaaaua

SEQ ID NO: 1451137 - RNA, 19 nt, Homo sapiens
ugagacaaaucuacccuua

SEQ ID NO: 1451138 - RNA, 19 nt, Homo sapiens
gaauucagccuucauuuau

SEQ ID NO: 1451139 - RNA, 19 nt, Homo sapiens
ugacacaguucucuuuaaa

SEQ ID NO: 1451140 - RNA, 19 nt, Homo sapiens
ggauuuaaaugcaaacuuc

SEQ ID NO: 1451141 - RNA, 19 nt, Homo sapiens
gaagcuugcucuauggauu

SEQ ID NO: 1451142 - RNA, 19 nt, Homo sapiens
gaggaaagcugcauucacu

SEQ ID NO: 1451143 - RNA, 19 nt, Homo sapiens
gacuaaaggugaacagauu

SEQ ID NO: 1451144 - RNA, 19 nt, Homo sapiens
gaauaugcuuucucuauag

SEQ ID NO: 1451145 - RNA, 19 nt, Homo sapiens
gaaaccacaugcaucauuc

SEQ ID NO: 1451146 - RNA, 19 nt, Homo sapiens
gacacugccucauuucaua

SEQ ID NO: 1451147 - RNA, 19 nt, Homo sapiens
guagaaagcacauuauaga

SEQ ID NO: 1451148 - RNA, 19 nt, Homo sapiens
gaacaagacgagaacauug

SEQ ID NO: 1451149 - RNA, 19 nt, Homo sapiens
gacgagagcucagguuuga

SEQ ID NO: 1451150 - RNA, 19 nt, Homo sapiens
uaaauagacuugaggaauc

SEQ ID NO: 1451151 - RNA, 19 nt, Homo sapiens
ggaaggcagagauugauua

SEQ ID NO: 1451152 - RNA, 19 nt, Homo sapiens
aaaggaagcuugcucuaug

SEQ ID NO: 1451153 - RNA, 19 nt, Homo sapiens
ggagggcauuuagaauuua

SEQ ID NO: 1451154 - RNA, 19 nt, Homo sapiens
gagcuuacacuugaacuua

SEQ ID NO: 1451155 - RNA, 19 nt, Homo sapiens
uaacuuaauucaccucaga

SEQ ID NO: 1451156 - RNA, 19 nt, Homo sapiens
gcuauuagaacacagcuua

SEQ ID NO: 1451157 - RNA, 19 nt, Homo sapiens
ucaaagagaacccacauuu

SEQ ID NO: 1451158 - RNA, 19 nt, Homo sapiens
ugucagagaucauuguaaa

SEQ ID NO: 1451159 - RNA, 19 nt, Homo sapiens
caaauucugugaaggucua

SEQ ID NO: 1451160 - RNA, 19 nt, Homo sapiens
caacccagcuccucucaau

SEQ ID NO: 1451161 - RNA, 19 nt, Homo sapiens
acgaaacucucaaacauuu

SEQ ID NO: 1451162 - RNA, 19 nt, Homo sapiens
ggacagaacugaggacaac

SEQ ID NO: 1451163 - RNA, 19 nt, Homo sapiens
gaacagauuugcucuugcu

SEQ ID NO: 1451164 - RNA, 19 nt, Homo sapiens
caucuaagccacucaaauu

SEQ ID NO: 1451165 - RNA, 19 nt, Homo sapiens
gaaaagaugagcuaugaua

SEQ ID NO: 1451166 - RNA, 19 nt, Homo sapiens
ggaauccacauuuggguua

SEQ ID NO: 1451167 - RNA, 19 nt, Homo sapiens
ggagaauucuugggagauu

SEQ ID NO: 1451168 - RNA, 19 nt, Homo sapiens
ugaaagagaaagagaagua

SEQ ID NO: 1451169 - RNA, 19 nt, Homo sapiens
gaguuugaauccucaguaa

SEQ ID NO: 1451170 - RNA, 19 nt, Homo sapiens
guacuuggcaguugggaua

SEQ ID NO: 1451171 - RNA, 19 nt, Homo sapiens
gauagucuuugcucuaaau

SEQ ID NO: 1451172 - RNA, 19 nt, Homo sapiens
cagauagucuuugcucuaa

SEQ ID NO: 1451173 - RNA, 19 nt, Homo sapiens
guacaagcucucuuacaua

SEQ ID NO: 1451174 - RNA, 19 nt, Homo sapiens
gaaggccucugugcgcaua

SEQ ID NO: 1451175 - RNA, 19 nt, Homo sapiens
caugaaacauugcagaguu

SEQ ID NO: 1451176 - RNA, 19 nt, Homo sapiens
ugaaggagcugagaaaucu

SEQ ID NO: 1451177 - RNA, 19 nt, Homo sapiens
gcauuuaaguccaauaguc

SEQ ID NO: 1451178 - RNA, 19 nt, Homo sapiens
gcagauagucuuugcucua

SEQ ID NO: 1451179 - RNA, 19 nt, Homo sapiens
guaucaaggagcauaauua

SEQ ID NO: 1451180 - RNA, 19 nt, Homo sapiens
ccacaaacuaguucuuaua

SEQ ID NO: 1451181 - RNA, 19 nt, Homo sapiens
gaaggcagagauugauuaa

SEQ ID NO: 1451182 - RNA, 19 nt, Homo sapiens
uuauagagcuuauguugga

SEQ ID NO: 1451183 - RNA, 19 nt, Homo sapiens
ggacccagaugaaccacaa

SEQ ID NO: 1451184 - RNA, 19 nt, Homo sapiens
ccauagugcuguauuugaa

SEQ ID NO: 1451185 - RNA, 19 nt, Homo sapiens
ggcuauugcucuaugauuu

SEQ ID NO: 1451186 - RNA, 19 nt, Homo sapiens
uacaagcucucuuacauau

SEQ ID NO: 1451187 - RNA, 19 nt, Homo sapiens
gaugggagcugggaagugu

SEQ ID NO: 1451188 - RNA, 19 nt, Homo sapiens
cuagugugcuuaacuuauu

SEQ ID NO: 1451189 - RNA, 19 nt, Homo sapiens
accaaaggcuuaugaugua

SEQ ID NO: 1451190 - RNA, 19 nt, Homo sapiens
gaaucuccaugccaaguga

SEQ ID NO: 1451191 - RNA, 19 nt, Homo sapiens
gaaauccacagauaauuca

SEQ ID NO: 1451192 - RNA, 19 nt, Homo sapiens
acacgaaacucucaaacau

SEQ ID NO: 1451193 - RNA, 19 nt, Homo sapiens
ccagaugaugcuuauauua

SEQ ID NO: 1451194 - RNA, 19 nt, Homo sapiens
gcuaucagauguauugaag

SEQ ID NO: 1451195 - RNA, 19 nt, Homo sapiens
ggagccagaugaugcuuau

SEQ ID NO: 1451196 - RNA, 19 nt, Homo sapiens
guacaaugcaucccagaaa

SEQ ID NO: 1451197 - RNA, 19 nt, Homo sapiens
ccagcgacauugcuuugua

SEQ ID NO: 1451198 - RNA, 19 nt, Homo sapiens
ccucaaaucagcuguaauu

SEQ ID NO: 1451199 - RNA, 19 nt, Homo sapiens
guacuagauugucagaguu

SEQ ID NO: 1451200 - RNA, 19 nt, Homo sapiens
gcggauuugugcuacauuu

SEQ ID NO: 1451201 - RNA, 19 nt, Homo sapiens
caaaggccaugaacagauc

SEQ ID NO: 1451202 - RNA, 19 nt, Homo sapiens
guggacagcuccuggaaga

SEQ ID NO: 1451203 - RNA, 19 nt, Homo sapiens
ggacacagcagggcaaaug

SEQ ID NO: 1451204 - RNA, 19 nt, Homo sapiens
gaaauaaaaugcccuacau

SEQ ID NO: 1451205 - RNA, 19 nt, Homo sapiens
aaccacagcuuuaguacaa

SEQ ID NO: 1451206 - RNA, 19 nt, Homo sapiens
gcgaguggguccaucagaa

SEQ ID NO: 1451207 - RNA, 19 nt, Homo sapiens
aaacaggguucucuuugga

SEQ ID NO: 1451208 - RNA, 19 nt, Homo sapiens
ggaaagcugcauucacuau

SEQ ID NO: 1451209 - RNA, 19 nt, Homo sapiens
gaccacaaacuaguucuua

SEQ ID NO: 1451210 - RNA, 19 nt, Homo sapiens
gguguuaguugccauagug

SEQ ID NO: 1451211 - RNA, 19 nt, Homo sapiens
caaaggcauuuaaguccaa

SEQ ID NO: 1451212 - RNA, 19 nt, Homo sapiens
gagguagaauugcagauca

SEQ ID NO: 1451213 - RNA, 19 nt, Homo sapiens
aaagagaacccacauuugu

SEQ ID NO: 1451214 - RNA, 19 nt, Homo sapiens
cauauaggauaacaaagga

SEQ ID NO: 1451215 - RNA, 19 nt, Homo sapiens
uaaaucaucuggcaucacu

SEQ ID NO: 1451216 - RNA, 19 nt, Homo sapiens
gaaccaaaggcuuaugaug

SEQ ID NO: 1451217 - RNA, 19 nt, Homo sapiens
gugaacagauuugcucuug

SEQ ID NO: 1451218 - RNA, 19 nt, Homo sapiens
gaacaagauucccauuuaa

SEQ ID NO: 1451219 - RNA, 19 nt, Homo sapiens
uaaaggaccucccagauaa

SEQ ID NO: 1451220 - RNA, 19 nt, Homo sapiens
cgaacaagauucccauuua

SEQ ID NO: 1451221 - RNA, 19 nt, Homo sapiens
gaaaauggcuguaaaguug

SEQ ID NO: 1451222 - RNA, 19 nt, Homo sapiens
gcaagaaguuccuggcaaa

SEQ ID NO: 1451223 - RNA, 19 nt, Homo sapiens
guaaaggaccucccagaua

SEQ ID NO: 1451224 - RNA, 19 nt, Homo sapiens
cuacacagcucucauccua

SEQ ID NO: 1451225 - RNA, 19 nt, Homo sapiens
ggaacuagacuaauacaaa

SEQ ID NO: 1451226 - RNA, 19 nt, Homo sapiens
gaaacuggcauggagauua

SEQ ID NO: 1451227 - RNA, 19 nt, Homo sapiens
caaaguugcugccagaaug

SEQ ID NO: 1451228 - RNA, 19 nt, Homo sapiens
gaagggaacuaaggaugaa

SEQ ID NO: 1451229 - RNA, 19 nt, Homo sapiens
caagaaaccaugacagaaa

SEQ ID NO: 1451230 - RNA, 19 nt, Homo sapiens
aaacuggcauggagauuaa

SEQ ID NO: 1451231 - RNA, 19 nt, Homo sapiens
agacauguaugaagaacua

SEQ ID NO: 1451232 - RNA, 19 nt, Homo sapiens
gaacuaaggaugaagacuu

SEQ ID NO: 1451233 - RNA, 19 nt, Homo sapiens
ggaauuaccuacuuucacu

SEQ ID NO: 1451234 - RNA, 19 nt, Homo sapiens
ccacucaacuuuguauaaa

SEQ ID NO: 1451235 - RNA, 19 nt, Homo sapiens
ugaaauaauugccaaggaa

SEQ ID NO: 1451236 - RNA, 19 nt, Homo sapiens
gaaggcaaacaaucuuaua

SEQ ID NO: 1451237 - RNA, 19 nt, Homo sapiens
ggauggagcucacucucuu

SEQ ID NO: 1451238 - RNA, 19 nt, Homo sapiens
cccaggaacuagacuaaua

SEQ ID NO: 1451239 - RNA, 19 nt, Homo sapiens
ugaugaaacugaagucuau

SEQ ID NO: 1451240 - RNA, 19 nt, Homo sapiens
gagcauaaaggacuacuug

SEQ ID NO: 1451241 - RNA, 19 nt, Homo sapiens
caucaacaccuauuucauu

SEQ ID NO: 1451242 - RNA, 19 nt, Homo sapiens
gaggaggucccuauguuaa

SEQ ID NO: 1451243 - RNA, 19 nt, Homo sapiens
gagagcggaucagcuguuu

SEQ ID NO: 1451244 - RNA, 19 nt, Homo sapiens
guuaacuacuugagacaaa

SEQ ID NO: 1451245 - RNA, 19 nt, Homo sapiens
gcaaacaaucuuauagaca

SEQ ID NO: 1451246 - RNA, 19 nt, Homo sapiens
gauuaaagaaggcaaacaa

SEQ ID NO: 1451247 - RNA, 19 nt, Homo sapiens
aauauggccuucuacaguu

SEQ ID NO: 1451248 - RNA, 19 nt, Homo sapiens
gaucuugcaccucaacuga

SEQ ID NO: 1451249 - RNA, 19 nt, Homo sapiens
cgaggaggucccuauguua

SEQ ID NO: 1451250 - RNA, 19 nt, Homo sapiens
uaaagaaggcaaacaaucu

SEQ ID NO: 1451251 - RNA, 19 nt, Homo sapiens
ccgaggaggucccuauguu

SEQ ID NO: 1451252 - RNA, 19 nt, Homo sapiens
guacuucacccaggaacua

SEQ ID NO: 1451253 - RNA, 19 nt, Homo sapiens
gagcggaucagcuguuuag

SEQ ID NO: 1451254 - RNA, 19 nt, Homo sapiens
acaccuauuucauuaccua

SEQ ID NO: 1451255 - RNA, 19 nt, Homo sapiens
gcagaugaugaaauaauug

SEQ ID NO: 1451256 - RNA, 19 nt, Homo sapiens
aagaaaccaugacagaaau

SEQ ID NO: 1451257 - RNA, 19 nt, Homo sapiens
caggccaaaucacaaauga

SEQ ID NO: 1451258 - RNA, 19 nt, Homo sapiens
cuaaaggacccaucacuuc

SEQ ID NO: 1451259 - RNA, 19 nt, Homo sapiens
gaacaugguggaucuugca

SEQ ID NO: 1451260 - RNA, 19 nt, Homo sapiens
cagcaaggcuaguucaaaa

SEQ ID NO: 1451261 - RNA, 19 nt, Homo sapiens
aacuaaggaugaagacuuu

SEQ ID NO: 1451262 - RNA, 19 nt, Homo sapiens
aaaggagcauaaaggacua

SEQ ID NO: 1451263 - RNA, 19 nt, Homo sapiens
gaaauggcaaggaggaaca

SEQ ID NO: 1451264 - RNA, 19 nt, Homo sapiens
ggcuauugcucgaacaaga

SEQ ID NO: 1451265 - RNA, 19 nt, Homo sapiens
auacagccgccaccaguua

SEQ ID NO: 1451266 - RNA, 19 nt, Homo sapiens
ggaugaagacuuuauacag

SEQ ID NO: 1451267 - RNA, 19 nt, Homo sapiens
ggauucuacuuacuuugga

SEQ ID NO: 1451268 - RNA, 19 nt, Homo sapiens
ugaagggaacuaaggauga

SEQ ID NO: 1451269 - RNA, 19 nt, Homo sapiens
ucacugaaucuaaagagaa

SEQ ID NO: 1451270 - RNA, 19 nt, Homo sapiens
gaugggcgaugccucuaca

SEQ ID NO: 1451271 - RNA, 19 nt, Homo sapiens
guuacaucaucacccauaa

SEQ ID NO: 1451272 - RNA, 19 nt, Homo sapiens
caacaaccugcuccgcuuu

SEQ ID NO: 1451273 - RNA, 19 nt, Homo sapiens
gaauugcagacauuuggaa

SEQ ID NO: 1451274 - RNA, 19 nt, Homo sapiens
ggcaaacaaucuuauagac

SEQ ID NO: 1451275 - RNA, 19 nt, Homo sapiens
acuaugagagcaagaagua

SEQ ID NO: 1451276 - RNA, 19 nt, Homo sapiens
cauuuccucuguaccauug

SEQ ID NO: 1451277 - RNA, 19 nt, Homo sapiens
caggugauguggguaguga

SEQ ID NO: 1451278 - RNA, 19 nt, Homo sapiens
gcccaagccgauugagaua

SEQ ID NO: 1451279 - RNA, 19 nt, Homo sapiens
gcauaaaggacuacuugag

SEQ ID NO: 1451280 - RNA, 19 nt, Homo sapiens
gugacagcauugaguguau

SEQ ID NO: 1451281 - RNA, 19 nt, Homo sapiens
aaauauggccuucuacagu

SEQ ID NO: 1451282 - RNA, 19 nt, Homo sapiens
ucgcuucuccaaacuauuu

SEQ ID NO: 1451283 - RNA, 19 nt, Homo sapiens
auaauucaguucuggcuau

SEQ ID NO: 1451284 - RNA, 19 nt, Homo sapiens
uacaauggauucuacuuac

SEQ ID NO: 1451285 - RNA, 19 nt, Homo sapiens
ggagauuaaagaaggcaaa

SEQ ID NO: 1451286 - RNA, 19 nt, Homo sapiens
gaaguacucggauccuagu

SEQ ID NO: 1451287 - RNA, 19 nt, Homo sapiens
gucccuauguuaacuacuu

SEQ ID NO: 1451288 - RNA, 19 nt, Homo sapiens
caacugaagggaacuaagg

SEQ ID NO: 1451289 - RNA, 19 nt, Homo sapiens
guucgcuucuccaaacuau

SEQ ID NO: 1451290 - RNA, 19 nt, Homo sapiens
ggaggucccuauguuaacu

SEQ ID NO: 1451291 - RNA, 19 nt, Homo sapiens
caaaugacggcccagaaca

SEQ ID NO: 1451292 - RNA, 19 nt, Homo sapiens
caauggauucuacuuacuu

SEQ ID NO: 1451293 - RNA, 19 nt, Homo sapiens
caacaccuauuucauuacc

SEQ ID NO: 1451294 - RNA, 19 nt, Homo sapiens
auauggccuucuacaguua

SEQ ID NO: 1451295 - RNA, 19 nt, Homo sapiens
gagaacaugguggaucuug

SEQ ID NO: 1451296 - RNA, 19 nt, Homo sapiens
ggugacagcauugagugua

SEQ ID NO: 1451297 - RNA, 19 nt, Homo sapiens
uuugcaaacugcuggaauu

SEQ ID NO: 1451298 - RNA, 19 nt, Homo sapiens
gagagacgaagggaagaaa

SEQ ID NO: 1451299 - RNA, 19 nt, Homo sapiens
aagagaacaugguggaucu

SEQ ID NO: 1451300 - RNA, 19 nt, Homo sapiens
gauaguucgcuucuccaaa

SEQ ID NO: 1451301 - RNA, 19 nt, Homo sapiens
ucaagaaaccaugacagaa

SEQ ID NO: 1451302 - RNA, 19 nt, Homo sapiens
aaagucccauuuccucugu

SEQ ID NO: 1451303 - RNA, 19 nt, Homo sapiens
uaauugcaaagucccauuu

SEQ ID NO: 1451304 - RNA, 19 nt, Homo sapiens
uaaaggacccaucacuucu

SEQ ID NO: 1451305 - RNA, 19 nt, Homo sapiens
aagaaguacucggauccua

SEQ ID NO: 1451306 - RNA, 19 nt, Homo sapiens
uaauucaguucuggcuauu

SEQ ID NO: 1451307 - RNA, 19 nt, Homo sapiens
gaacuaugagagcaagaag

SEQ ID NO: 1451308 - RNA, 19 nt, Homo sapiens
auaacaccaucaacaccua

SEQ ID NO: 1451309 - RNA, 19 nt, Homo sapiens
gccaggcaauacaguacuu

SEQ ID NO: 1451310 - RNA, 19 nt, Homo sapiens
gcucucauccuacgugaag

SEQ ID NO: 1451311 - RNA, 19 nt, Homo sapiens
acccaucacuucuucugaa

SEQ ID NO: 1451312 - RNA, 19 nt, Homo sapiens
ccuauuucauuaccuaaag

SEQ ID NO: 1451313 - RNA, 19 nt, Homo sapiens
ggaauugcagacauuugga

SEQ ID NO: 1451314 - RNA, 19 nt, Homo sapiens
gccacaagcccagcacaaa

SEQ ID NO: 1451315 - RNA, 19 nt, Homo sapiens
uuaaagaaggcaaacaauc

SEQ ID NO: 1451316 - RNA, 19 nt, Homo sapiens
ucgaacaagauucccauuu

SEQ ID NO: 1451317 - RNA, 19 nt, Homo sapiens
gaugaaacugaagucuaua

SEQ ID NO: 1451318 - RNA, 19 nt, Homo sapiens
gggaggaccuuuauuguuu

SEQ ID NO: 1451319 - RNA, 19 nt, Homo sapiens
gaacguggauuugacuuaa

SEQ ID NO: 1451320 - RNA, 19 nt, Homo sapiens
ggaaauacaugcaucaucu

SEQ ID NO: 1451321 - RNA, 19 nt, Homo sapiens
gaagauaguucuguaaagu

SEQ ID NO: 1451322 - RNA, 19 nt, Homo sapiens
guacgaaggucaugugaau

SEQ ID NO: 1451323 - RNA, 19 nt, Homo sapiens
uaagagauguucgguguuu

SEQ ID NO: 1451324 - RNA, 19 nt, Homo sapiens
gcaugagacuguuugacua

SEQ ID NO: 1451325 - RNA, 19 nt, Homo sapiens
gcguaucacucuuucagua

SEQ ID NO: 1451326 - RNA, 19 nt, Homo sapiens
gaacauccgccgaacgaaa

SEQ ID NO: 1451327 - RNA, 19 nt, Homo sapiens
gaauaacuccgccuaccua

SEQ ID NO: 1451328 - RNA, 19 nt, Homo sapiens
gaucugcgcuguggaaauc

SEQ ID NO: 1451329 - RNA, 19 nt, Homo sapiens
caaugcaccuuccaugcua

SEQ ID NO: 1451330 - RNA, 19 nt, Homo sapiens
gauguucgguguuuguaga

SEQ ID NO: 1451331 - RNA, 19 nt, Homo sapiens
gggguaaggugcuguuuua

SEQ ID NO: 1451332 - RNA, 19 nt, Homo sapiens
ggaacguggauuugacuua

SEQ ID NO: 1451333 - RNA, 19 nt, Homo sapiens
gaaguaaagagcaucguau

SEQ ID NO: 1451334 - RNA, 19 nt, Homo sapiens
ccagcuagguuuccucaga

SEQ ID NO: 1451335 - RNA, 19 nt, Homo sapiens
ccauuugccugucccauga

SEQ ID NO: 1451336 - RNA, 19 nt, Homo sapiens
ggagaucuuuggcauugau

SEQ ID NO: 1451337 - RNA, 19 nt, Homo sapiens
gcugggaucccuccucuuu

SEQ ID NO: 1451338 - RNA, 19 nt, Homo sapiens
cguauuaccguuucuauga

SEQ ID NO: 1451339 - RNA, 19 nt, Homo sapiens
caucaucuguacuugaaga

SEQ ID NO: 1451340 - RNA, 19 nt, Homo sapiens
gagcaucguauuaccguuu

SEQ ID NO: 1451341 - RNA, 19 nt, Homo sapiens
agacaugacuggaacuauc

SEQ ID NO: 1451342 - RNA, 19 nt, Homo sapiens
ucacuuggauucccaccuu

SEQ ID NO: 1451343 - RNA, 19 nt, Homo sapiens
cgaacgaaauggagagcaa

SEQ ID NO: 1451344 - RNA, 19 nt, Homo sapiens
ggaggaccuuuauuguuuc

SEQ ID NO: 1451345 - RNA, 19 nt, Homo sapiens
ccuccaagauggccaauuc

SEQ ID NO: 1451346 - RNA, 19 nt, Homo sapiens
gagaacauccgccgaacga

SEQ ID NO: 1451347 - RNA, 19 nt, Homo sapiens
ugacuccuuugcuguuuaa

SEQ ID NO: 1451348 - RNA, 19 nt, Homo sapiens
agauaguucuguaaaguug

SEQ ID NO: 1451349 - RNA, 19 nt, Homo sapiens
gagggccacuaaaugugua

SEQ ID NO: 1451350 - RNA, 19 nt, Homo sapiens
gacuagcagugaugucuug

SEQ ID NO: 1451351 - RNA, 19 nt, Homo sapiens
cgaccgauuuaaccgcaua

SEQ ID NO: 1451352 - RNA, 19 nt, Homo sapiens
ggaggucauuuaucugagu

SEQ ID NO: 1451353 - RNA, 19 nt, Homo sapiens
guaaggugcuguuuuaugu

SEQ ID NO: 1451354 - RNA, 19 nt, Homo sapiens
ggaggaacguggauuugac

SEQ ID NO: 1451355 - RNA, 19 nt, Homo sapiens
cgccaacuauugccguaua

SEQ ID NO: 1451356 - RNA, 19 nt, Homo sapiens
cugagucucuccagaaguu

SEQ ID NO: 1451357 - RNA, 19 nt, Homo sapiens
gcaugugaacgaagaagaa

SEQ ID NO: 1451358 - RNA, 19 nt, Homo sapiens
ggaagcagacaagcagaaa

SEQ ID NO: 1451359 - RNA, 19 nt, Homo sapiens
gggccucacugaaucacuu

SEQ ID NO: 1451360 - RNA, 19 nt, Homo sapiens
ucuaaggacugaagauugg

SEQ ID NO: 1451361 - RNA, 19 nt, Homo sapiens
gaacgaaauggagagcaaa

SEQ ID NO: 1451362 - RNA, 19 nt, Homo sapiens
aguaaagagcaucguauua

SEQ ID NO: 1451363 - RNA, 19 nt, Homo sapiens
ggacaccagcagucauuug

SEQ ID NO: 1451364 - RNA, 19 nt, Homo sapiens
ugaagauaguucuguaaag

SEQ ID NO: 1451365 - RNA, 19 nt, Homo sapiens
gugaagauaguucuguaaa

SEQ ID NO: 1451366 - RNA, 19 nt, Homo sapiens
acgaaggucaugugaauaa

SEQ ID NO: 1451367 - RNA, 19 nt, Homo sapiens
uagagaagcaugagacugu

SEQ ID NO: 1451368 - RNA, 19 nt, Homo sapiens
ccagaagccuuuuagagaa

SEQ ID NO: 1451369 - RNA, 19 nt, Homo sapiens
gcugagagagcuugaaagu

SEQ ID NO: 1451370 - RNA, 19 nt, Homo sapiens
ggacuugagggccacuaaa

SEQ ID NO: 1451371 - RNA, 19 nt, Homo sapiens
agaacgacauucccagugu

SEQ ID NO: 1451372 - RNA, 19 nt, Homo sapiens
gccaauuccuggugucauc

SEQ ID NO: 1451373 - RNA, 19 nt, Homo sapiens
gagaagcaugagacuguuu

SEQ ID NO: 1451374 - RNA, 19 nt, Homo sapiens
gggcugagagagcuugaaa

SEQ ID NO: 1451375 - RNA, 19 nt, Homo sapiens
gcccagcaguuugcaauca

SEQ ID NO: 1451376 - RNA, 19 nt, Homo sapiens
aaacuuggccuucucaaac

SEQ ID NO: 1451377 - RNA, 19 nt, Homo sapiens
uaaacuuggccuucucaaa

SEQ ID NO: 1451378 - RNA, 19 nt, Homo sapiens
ugcaucaucuguacuugaa

SEQ ID NO: 1451379 - RNA, 19 nt, Homo sapiens
uaccuggguuccggaaaua

SEQ ID NO: 1451380 - RNA, 19 nt, Homo sapiens
gaauaccuuagaauaguug

SEQ ID NO: 1451381 - RNA, 19 nt, Homo sapiens
cuaccuggguuccggaaau

SEQ ID NO: 1451382 - RNA, 19 nt, Homo sapiens
caccuuccaugcuacgaaa

SEQ ID NO: 1451383 - RNA, 19 nt, Homo sapiens
cugcaaauccuccaagaug

SEQ ID NO: 1451384 - RNA, 19 nt, Homo sapiens
caugacuccuuugcuguuu

SEQ ID NO: 1451385 - RNA, 19 nt, Homo sapiens
cagcuagguuuccucagau

SEQ ID NO: 1451386 - RNA, 19 nt, Homo sapiens
cuguaaaguuguuucaguu

SEQ ID NO: 1451387 - RNA, 19 nt, Homo sapiens
ccacgcguaucacucuuuc

SEQ ID NO: 1451388 - RNA, 19 nt, Homo sapiens
ggaaggugaauucuaugug

SEQ ID NO: 1451389 - RNA, 19 nt, Homo sapiens
gaaauacaugcaucaucug

SEQ ID NO: 1451390 - RNA, 19 nt, Homo sapiens
guugaauaccuuagaauag

SEQ ID NO: 1451391 - RNA, 19 nt, Homo sapiens
ggggagaucuuuggcauug

SEQ ID NO: 1451392 - RNA, 19 nt, Homo sapiens
ucagauucgccaacuauug

SEQ ID NO: 1451393 - RNA, 19 nt, Homo sapiens
guaucacucuuucaguaca

SEQ ID NO: 1451394 - RNA, 19 nt, Homo sapiens
agaaguaaagagcaucgua

SEQ ID NO: 1451395 - RNA, 19 nt, Homo sapiens
gacaugacuggaacuauca

SEQ ID NO: 1451396 - RNA, 19 nt, Homo sapiens
gcgucgcuguucauaggua

SEQ ID NO: 1451397 - RNA, 19 nt, Homo sapiens
gugcugggccucacugaau

SEQ ID NO: 1451398 - RNA, 19 nt, Homo sapiens
ucuguaaaguuguuucagu

SEQ ID NO: 1451399 - RNA, 19 nt, Homo sapiens
gagauguucgguguuugua

SEQ ID NO: 1451400 - RNA, 19 nt, Homo sapiens
caggacugcuacacgagaa

SEQ ID NO: 1451401 - RNA, 19 nt, Homo sapiens
gaagcaugagacuguuuga

SEQ ID NO: 1451402 - RNA, 19 nt, Homo sapiens
ccucagauucgccaacuau

SEQ ID NO: 1451403 - RNA, 19 nt, Homo sapiens
guauuaccguuucuaugag

SEQ ID NO: 1451404 - RNA, 19 nt, Homo sapiens
uaaagagcaucguauuacc

SEQ ID NO: 1451405 - RNA, 19 nt, Homo sapiens
gcaccuuccaugcuacgaa

SEQ ID NO: 1451406 - RNA, 19 nt, Homo sapiens
ugacuucucugcaaauccu

SEQ ID NO: 1451407 - RNA, 19 nt, Homo sapiens
ggacuagcagugaugucuu

SEQ ID NO: 1451408 - RNA, 19 nt, Homo sapiens
uggcgaauaccaacacuga

SEQ ID NO: 1451409 - RNA, 19 nt, Homo sapiens
guuuguagaucccauccau

SEQ ID NO: 1451410 - RNA, 19 nt, Homo sapiens
cuccuacgguuaauucuuc

SEQ ID NO: 1451411 - RNA, 19 nt, Homo sapiens
cgggaggaccuuuauuguu

SEQ ID NO: 1451412 - RNA, 19 nt, Homo sapiens
uugcaaucaugacuccuuu

SEQ ID NO: 1451413 - RNA, 19 nt, Homo sapiens
ccagcaguuugcaaucaug

SEQ ID NO: 1451414 - RNA, 19 nt, Homo sapiens
gaaggucaugugaauaacu

SEQ ID NO: 1451415 - RNA, 19 nt, Homo sapiens
ugucuuggcccagcaguuu

SEQ ID NO: 1451416 - RNA, 19 nt, Homo sapiens
gcuuugcaguuuccagauc

SEQ ID NO: 1451417 - RNA, 19 nt, Homo sapiens
ggacuugcagauacuccaa

SEQ ID NO: 1451418 - RNA, 19 nt, Homo sapiens
ucacaaagguuaugcauuu

SEQ ID NO: 1451419 - RNA, 19 nt, Homo sapiens
caagaaaguugacauugaa

SEQ ID NO: 1451420 - RNA, 19 nt, Homo sapiens
gagauuccauggacaagua

SEQ ID NO: 1451421 - RNA, 19 nt, Homo sapiens
gggaaacacuauauacaaa

SEQ ID NO: 1451422 - RNA, 19 nt, Homo sapiens
aaucuuagcuguugucuug

SEQ ID NO: 1451423 - RNA, 19 nt, Homo sapiens
uuaaagaacuguugguuug

SEQ ID NO: 1451424 - RNA, 19 nt, Homo sapiens
gaucugaaauaacgcauga

SEQ ID NO: 1451425 - RNA, 19 nt, Homo sapiens
ggacaguauugcucaguuu

SEQ ID NO: 1451426 - RNA, 19 nt, Homo sapiens
gagaaaccaucuucacaga

SEQ ID NO: 1451427 - RNA, 19 nt, Homo sapiens
gcagauauuucagauguga

SEQ ID NO: 1451428 - RNA, 19 nt, Homo sapiens
ccaacaaugucauguaaga

SEQ ID NO: 1451429 - RNA, 19 nt, Homo sapiens
gucaacagguucuaaauug

SEQ ID NO: 1451430 - RNA, 19 nt, Homo sapiens
cuacagagaugauuucuac

SEQ ID NO: 1451431 - RNA, 19 nt, Homo sapiens
ccagcaacgucaccaauaa

SEQ ID NO: 1451432 - RNA, 19 nt, Homo sapiens
caggagagcccaaaccaua

SEQ ID NO: 1451433 - RNA, 19 nt, Homo sapiens
guaggagaauucaacauau

SEQ ID NO: 1451434 - RNA, 19 nt, Homo sapiens
gaaaccaucuucacagacu

SEQ ID NO: 1451435 - RNA, 19 nt, Homo sapiens
ggacuagauugccaaggaa

SEQ ID NO: 1451436 - RNA, 19 nt, Homo sapiens
gaaaucagaugaguuacag

SEQ ID NO: 1451437 - RNA, 19 nt, Homo sapiens
gcgguuaugucuuugacua

SEQ ID NO: 1451438 - RNA, 19 nt, Homo sapiens
gaccaucaagaaagaauua

SEQ ID NO: 1451439 - RNA, 19 nt, Homo sapiens
ugucagagauugcagauca

SEQ ID NO: 1451440 - RNA, 19 nt, Homo sapiens
gcaaggagagccaaucaug

SEQ ID NO: 1451441 - RNA, 19 nt, Homo sapiens
gaguaaacgacgcagauua

SEQ ID NO: 1451442 - RNA, 19 nt, Homo sapiens
gaaugcagauauuucagau

SEQ ID NO: 1451443 - RNA, 19 nt, Homo sapiens
guaagggaaacacuauaua

SEQ ID NO: 1451444 - RNA, 19 nt, Homo sapiens
cagcaucuuugguucaauu

SEQ ID NO: 1451445 - RNA, 19 nt, Homo sapiens
gaaugugugucagagauug

SEQ ID NO: 1451446 - RNA, 19 nt, Homo sapiens
gcaauugucaagaaaguug

SEQ ID NO: 1451447 - RNA, 19 nt, Homo sapiens
ugacuaugauuacuacaga

SEQ ID NO: 1451448 - RNA, 19 nt, Homo sapiens
gaaccuuuccugucuguug

SEQ ID NO: 1451449 - RNA, 19 nt, Homo sapiens
aaagugaucugaaauaacg

SEQ ID NO: 1451450 - RNA, 19 nt, Homo sapiens
uggagaagauugagaaaca

SEQ ID NO: 1451451 - RNA, 19 nt, Homo sapiens
gcaauucuguauuuaaagc

SEQ ID NO: 1451452 - RNA, 19 nt, Homo sapiens
caacagguucuaaauugaa

SEQ ID NO: 1451453 - RNA, 19 nt, Homo sapiens
guuaugcauuuguacagua

SEQ ID NO: 1451454 - RNA, 19 nt, Homo sapiens
ggucaacagguucuaaauu

SEQ ID NO: 1451455 - RNA, 19 nt, Homo sapiens
gcuccgcucuacugaacua

SEQ ID NO: 1451456 - RNA, 19 nt, Homo sapiens
ggacaaguaaggacuagau

SEQ ID NO: 1451457 - RNA, 19 nt, Homo sapiens
gucaugagcuguuucuaca

SEQ ID NO: 1451458 - RNA, 19 nt, Homo sapiens
uaacccagaucaaaacuaa

SEQ ID NO: 1451459 - RNA, 19 nt, Homo sapiens
uguaggagaauucaacaua

SEQ ID NO: 1451460 - RNA, 19 nt, Homo sapiens
gcuguacaauugucagguu

SEQ ID NO: 1451461 - RNA, 19 nt, Homo sapiens
cagagaugauuucuacaau

SEQ ID NO: 1451462 - RNA, 19 nt, Homo sapiens
caacgucaccaauaagaau

SEQ ID NO: 1451463 - RNA, 19 nt, Homo sapiens
gaucugugauuaaguugag

SEQ ID NO: 1451464 - RNA, 19 nt, Homo sapiens
guuaaagaacuguugguuu

SEQ ID NO: 1451465 - RNA, 19 nt, Homo sapiens
gguaagggaaacacuauau

SEQ ID NO: 1451466 - RNA, 19 nt, Homo sapiens
gugaaaggcauuuaugaau

SEQ ID NO: 1451467 - RNA, 19 nt, Homo sapiens
agaauuaacccagaucaaa

SEQ ID NO: 1451468 - RNA, 19 nt, Homo sapiens
guuuuaagcuguacaauug

SEQ ID NO: 1451469 - RNA, 19 nt, Homo sapiens
gaugacagaugggauagag

SEQ ID NO: 1451470 - RNA, 19 nt, Homo sapiens
ggcagaagcucagaagaag

SEQ ID NO: 1451471 - RNA, 19 nt, Homo sapiens
gccagugggucaacagguu

SEQ ID NO: 1451472 - RNA, 19 nt, Homo sapiens
uagcauguuucacuguuga

SEQ ID NO: 1451473 - RNA, 19 nt, Homo sapiens
caaggagagccaaucauga

SEQ ID NO: 1451474 - RNA, 19 nt, Homo sapiens
agccggagcuggagacauu

SEQ ID NO: 1451475 - RNA, 19 nt, Homo sapiens
auacggcaauugucaagaa

SEQ ID NO: 1451476 - RNA, 19 nt, Homo sapiens
uccaucaacucccguguuu

SEQ ID NO: 1451477 - RNA, 19 nt, Homo sapiens
guuaugucuuugacuauga

SEQ ID NO: 1451478 - RNA, 19 nt, Homo sapiens
gcacuuuacagacuugaau

SEQ ID NO: 1451479 - RNA, 19 nt, Homo sapiens
aagcuuauuuccaacaaug

SEQ ID NO: 1451480 - RNA, 19 nt, Homo sapiens
aaagucaggugauauugca

SEQ ID NO: 1451481 - RNA, 19 nt, Homo sapiens
gacagcagcaucuuugguu

SEQ ID NO: 1451482 - RNA, 19 nt, Homo sapiens
ggagaagagaugacagaug

SEQ ID NO: 1451483 - RNA, 19 nt, Homo sapiens
gauguuccguucacaaagg

SEQ ID NO: 1451484 - RNA, 19 nt, Homo sapiens
aguaaacgacgcagauuaa

SEQ ID NO: 1451485 - RNA, 19 nt, Homo sapiens
agaagaagcaauuggaaga

SEQ ID NO: 1451486 - RNA, 19 nt, Homo sapiens
gcagaaggcggaggcagaa

SEQ ID NO: 1451487 - RNA, 19 nt, Homo sapiens
uacagaccaucaagaaaga

SEQ ID NO: 1451488 - RNA, 19 nt, Homo sapiens
uuccaacaaugucauguaa

SEQ ID NO: 1451489 - RNA, 19 nt, Homo sapiens
caggugauauugcaauucu

SEQ ID NO: 1451490 - RNA, 19 nt, Homo sapiens
agaggagccugcugaagga

SEQ ID NO: 1451491 - RNA, 19 nt, Homo sapiens
ggaaugugugucagagauu

SEQ ID NO: 1451492 - RNA, 19 nt, Homo sapiens
gaaagaauuaacccagauc

SEQ ID NO: 1451493 - RNA, 19 nt, Homo sapiens
agaaagaauuaacccagau

SEQ ID NO: 1451494 - RNA, 19 nt, Homo sapiens
cuaaauacggcaauuguca

SEQ ID NO: 1451495 - RNA, 19 nt, Homo sapiens
guaaacgacgcagauuaaa

SEQ ID NO: 1451496 - RNA, 19 nt, Homo sapiens
ccacaaagcagaaaagaga

SEQ ID NO: 1451497 - RNA, 19 nt, Homo sapiens
agagaugacagaugggaua

SEQ ID NO: 1451498 - RNA, 19 nt, Homo sapiens
gauugcagaucacucuaca

SEQ ID NO: 1451499 - RNA, 19 nt, Homo sapiens
gcaacgucaccaauaagaa

SEQ ID NO: 1451500 - RNA, 19 nt, Homo sapiens
uuauauuucugcccuguau

SEQ ID NO: 1451501 - RNA, 19 nt, Homo sapiens
gaauuaacccagaucaaaa

SEQ ID NO: 1451502 - RNA, 19 nt, Homo sapiens
gguuaugucuuugacuaug

SEQ ID NO: 1451503 - RNA, 19 nt, Homo sapiens
augcagauauuucagaugu

SEQ ID NO: 1451504 - RNA, 19 nt, Homo sapiens
uagaggaggacuucgauga

SEQ ID NO: 1451505 - RNA, 19 nt, Homo sapiens
gcaauuggaagagagucua

SEQ ID NO: 1451506 - RNA, 19 nt, Homo sapiens
uguuggcgguuaugucuuu

SEQ ID NO: 1451507 - RNA, 19 nt, Homo sapiens
gggagaaaccaucuucaca

SEQ ID NO: 1451508 - RNA, 19 nt, Homo sapiens
gguuugaucugugauuaag

SEQ ID NO: 1451509 - RNA, 19 nt, Homo sapiens
gaaaugugaaaggagguuu

SEQ ID NO: 1451510 - RNA, 19 nt, Homo sapiens
caaucuaaauacggcaauu

SEQ ID NO: 1451511 - RNA, 19 nt, Homo sapiens
uaugauuacuacagagaug

SEQ ID NO: 1451512 - RNA, 19 nt, Homo sapiens
guacaugagugagcgacau

SEQ ID NO: 1451513 - RNA, 19 nt, Homo sapiens
gcaucuuugguucaauuua

SEQ ID NO: 1451514 - RNA, 19 nt, Homo sapiens
gaaaagagaaacugugaca

SEQ ID NO: 1451515 - RNA, 19 nt, Homo sapiens
ggauagaggaggacuucga

SEQ ID NO: 1451516 - RNA, 19 nt, Homo sapiens
ccaagaggaauguguguca

SEQ ID NO: 1451517 - RNA, 19 nt, Homo sapiens
aggacuagauugccaagga

SEQ ID NO: 1451518 - RNA, 19 nt, Homo sapiens
gagauaagcuuuaacuuuc

SEQ ID NO: 1451519 - RNA, 19 nt, Homo sapiens
gaaaugagcgggaagauga

SEQ ID NO: 1451520 - RNA, 19 nt, Homo sapiens
ggaaauggaugucuuugga

SEQ ID NO: 1451521 - RNA, 19 nt, Homo sapiens
ggagauaagcuuuaacuuu

SEQ ID NO: 1451522 - RNA, 19 nt, Homo sapiens
gaacucugccugucuauuu

SEQ ID NO: 1451523 - RNA, 19 nt, Homo sapiens
cagagacgcuccucacuuu

SEQ ID NO: 1451524 - RNA, 19 nt, Homo sapiens
ccagaaagccaaaguaauu

SEQ ID NO: 1451525 - RNA, 19 nt, Homo sapiens
gcacccaucuucugcugua

SEQ ID NO: 1451526 - RNA, 19 nt, Homo sapiens
ucacuacgcucaguucuuu

SEQ ID NO: 1451527 - RNA, 19 nt, Homo sapiens
gagaugugcugcuggaaga

SEQ ID NO: 1451528 - RNA, 19 nt, Homo sapiens
cagaagaaauaguuccauu

SEQ ID NO: 1451529 - RNA, 19 nt, Homo sapiens
gaaugcaguuuaauguuuc

SEQ ID NO: 1451530 - RNA, 19 nt, Homo sapiens
uaaagggaagcauucauua

SEQ ID NO: 1451531 - RNA, 19 nt, Homo sapiens
gagggcagguacugucuuu

SEQ ID NO: 1451532 - RNA, 19 nt, Homo sapiens
ugaagcagccuuuguuaaa

SEQ ID NO: 1451533 - RNA, 19 nt, Homo sapiens
gaaauaguuccauuacaga

SEQ ID NO: 1451534 - RNA, 19 nt, Homo sapiens
caaacccucuuaccuaugu

SEQ ID NO: 1451535 - RNA, 19 nt, Homo sapiens
gaagaaauaguuccauuac

SEQ ID NO: 1451536 - RNA, 19 nt, Homo sapiens
cagagacgcuccucacuuc

SEQ ID NO: 1451537 - RNA, 19 nt, Homo sapiens
cagagacgcuccucacuuc

SEQ ID NO: 1451538 - RNA, 19 nt, Homo sapiens
ucaaacugguuaacuguga

SEQ ID NO: 1451539 - RNA, 19 nt, Homo sapiens
gaccaaagacauccugauu

SEQ ID NO: 1451540 - RNA, 19 nt, Homo sapiens
gggaagcauucauuaggaa

SEQ ID NO: 1451541 - RNA, 19 nt, Homo sapiens
ccaaagacauccugauucg

SEQ ID NO: 1451542 - RNA, 19 nt, Homo sapiens
gcuccucgcuucccagaug

SEQ ID NO: 1451543 - RNA, 19 nt, Homo sapiens
agaaauaguuccauuacag

SEQ ID NO: 1451544 - RNA, 19 nt, Homo sapiens
ggaauugccauggguguuu

SEQ ID NO: 1451545 - RNA, 19 nt, Homo sapiens
uuacaaggcucggaccaaa

SEQ ID NO: 1451546 - RNA, 19 nt, Homo sapiens
cgaaaugccaucacuccua

SEQ ID NO: 1451547 - RNA, 19 nt, Homo sapiens
gcuccucacuuccuagaug

SEQ ID NO: 1451548 - RNA, 19 nt, Homo sapiens
ggccuuggcuuccucacuu

SEQ ID NO: 1451549 - RNA, 19 nt, Homo sapiens
gaaauggaugucuuuggaa

SEQ ID NO: 1451550 - RNA, 19 nt, Homo sapiens
gccacgagguguuugagaa

SEQ ID NO: 1451551 - RNA, 19 nt, Homo sapiens
caucuucugcuguacuuua

SEQ ID NO: 1451552 - RNA, 19 nt, Homo sapiens
ggaagaugacucucaguuc

SEQ ID NO: 1451553 - RNA, 19 nt, Homo sapiens
gcagagacgcuccucacuu

SEQ ID NO: 1451554 - RNA, 19 nt, Homo sapiens
ccgaggagauaagcuuuaa

SEQ ID NO: 1451555 - RNA, 19 nt, Homo sapiens
gcagagacgcuccucacuu

SEQ ID NO: 1451556 - RNA, 19 nt, Homo sapiens
gcagagacgcuccucacuu

SEQ ID NO: 1451557 - RNA, 19 nt, Homo sapiens
gggagacgaucaccuuuac

SEQ ID NO: 1451558 - RNA, 19 nt, Homo sapiens
uaacagacaucaaaagcuu

SEQ ID NO: 1451559 - RNA, 19 nt, Homo sapiens
ugagguaacagacaucaaa

SEQ ID NO: 1451560 - RNA, 19 nt, Homo sapiens
gcuaugaagcuuacugguu

SEQ ID NO: 1451561 - RNA, 19 nt, Homo sapiens
gaagcuuacugguugugau

SEQ ID NO: 1451562 - RNA, 19 nt, Homo sapiens
ucuuagacauggugaggua

SEQ ID NO: 1451563 - RNA, 19 nt, Homo sapiens
ggacugaagcagccuuugu

SEQ ID NO: 1451564 - RNA, 19 nt, Homo sapiens
gauugggagugacauacuu

SEQ ID NO: 1451565 - RNA, 19 nt, Homo sapiens
cccaaacccucuuaccuau

SEQ ID NO: 1451566 - RNA, 19 nt, Homo sapiens
gggaagaugacucucaguu

SEQ ID NO: 1451567 - RNA, 19 nt, Homo sapiens
gacgauggguggccaagca

SEQ ID NO: 1451568 - RNA, 19 nt, Homo sapiens
caucuucuguggaaaugga

SEQ ID NO: 1451569 - RNA, 19 nt, Homo sapiens
acacugauguccucaaacu

SEQ ID NO: 1451570 - RNA, 19 nt, Homo sapiens
uuaaagggaagcauucauu

SEQ ID NO: 1451571 - RNA, 19 nt, Homo sapiens
cagaaagccaaaguaauuu

SEQ ID NO: 1451572 - RNA, 19 nt, Homo sapiens
ugacacggcucgccagaac

SEQ ID NO: 1451573 - RNA, 19 nt, Homo sapiens
acaaggagcaccugacuca

SEQ ID NO: 1451574 - RNA, 19 nt, Homo sapiens
aguggaagcugaaggacaa

SEQ ID NO: 1451575 - RNA, 19 nt, Homo sapiens
ggaagcauucauuaggaaa

SEQ ID NO: 1451576 - RNA, 19 nt, Homo sapiens
ccuacauccucuauagaaa

SEQ ID NO: 1451577 - RNA, 19 nt, Homo sapiens
gauugaaugcaguuuaaug

SEQ ID NO: 1451578 - RNA, 19 nt, Homo sapiens
ggaugucuuuggaacuuca

SEQ ID NO: 1451579 - RNA, 19 nt, Homo sapiens
aaagacauccugauucgau

SEQ ID NO: 1451580 - RNA, 19 nt, Homo sapiens
gauaagcuuuaacuuucca

SEQ ID NO: 1451581 - RNA, 19 nt, Homo sapiens
gauguccucaaacugguua

SEQ ID NO: 1451582 - RNA, 19 nt, Homo sapiens
gaagcauucauuaggaaau

SEQ ID NO: 1451583 - RNA, 19 nt, Homo sapiens
ucuggucccuuucguaugu

SEQ ID NO: 1451584 - RNA, 19 nt, Homo sapiens
gagcuccucuuugcuaaac

SEQ ID NO: 1451585 - RNA, 19 nt, Homo sapiens
gaggagauaagcuuuaacu

SEQ ID NO: 1451586 - RNA, 19 nt, Homo sapiens
uacauccucuauagaaaga

SEQ ID NO: 1451587 - RNA, 19 nt, Homo sapiens
gacaggaaccccauucuuu

SEQ ID NO: 1451588 - RNA, 19 nt, Homo sapiens
gagcugccuuucucuucga

SEQ ID NO: 1451589 - RNA, 19 nt, Homo sapiens
ucccaaacccucuuaccua

SEQ ID NO: 1451590 - RNA, 19 nt, Homo sapiens
gccuacauccucuauagaa

SEQ ID NO: 1451591 - RNA, 19 nt, Homo sapiens
cuaaaccugugccugaaca

SEQ ID NO: 1451592 - RNA, 19 nt, Homo sapiens
caucuuccuuccucccuau

SEQ ID NO: 1451593 - RNA, 19 nt, Homo sapiens
gacugaagcagccuuuguu

SEQ ID NO: 1451594 - RNA, 19 nt, Homo sapiens
agacgcuccucacuuccua

SEQ ID NO: 1451595 - RNA, 19 nt, Homo sapiens
aaucugaggucugguucuu

SEQ ID NO: 1451596 - RNA, 19 nt, Homo sapiens
uugacuggcugcguguuua

SEQ ID NO: 1451597 - RNA, 19 nt, Homo sapiens
gcuugguguuguauucuug

SEQ ID NO: 1451598 - RNA, 19 nt, Homo sapiens
ggagaggagcugccuuucu

SEQ ID NO: 1451599 - RNA, 19 nt, Homo sapiens
cuacugcggcugcuaugaa

SEQ ID NO: 1451600 - RNA, 19 nt, Homo sapiens
gcuccucacuuuccagacu

SEQ ID NO: 1451601 - RNA, 19 nt, Homo sapiens
gguucuugcugaccuuguu

SEQ ID NO: 1451602 - RNA, 19 nt, Homo sapiens
gcauucauuaggaaauuga

SEQ ID NO: 1451603 - RNA, 19 nt, Homo sapiens
cugcagcgauugggaguga

SEQ ID NO: 1451604 - RNA, 19 nt, Homo sapiens
cugauucgauucacugcuu

SEQ ID NO: 1451605 - RNA, 19 nt, Homo sapiens
gcugggagacgaucaccuu

SEQ ID NO: 1451606 - RNA, 19 nt, Homo sapiens
uuucuucuguggugaguga

SEQ ID NO: 1451607 - RNA, 19 nt, Homo sapiens
acaaggcucggaccaaaga

SEQ ID NO: 1451608 - RNA, 19 nt, Homo sapiens
ugggagacgaucaccuuua

SEQ ID NO: 1451609 - RNA, 19 nt, Homo sapiens
uacugguugugauguguua

SEQ ID NO: 1451610 - RNA, 19 nt, Homo sapiens
ccugucuauuugugacuua

SEQ ID NO: 1451611 - RNA, 19 nt, Homo sapiens
agggaagcauucauuagga

SEQ ID NO: 1451612 - RNA, 19 nt, Homo sapiens
gggagugacauacuuugug

SEQ ID NO: 1451613 - RNA, 19 nt, Homo sapiens
gagacgaucaccuuuacca

SEQ ID NO: 1451614 - RNA, 19 nt, Homo sapiens
uggagcuccucuuugcuaa

SEQ ID NO: 1451615 - RNA, 19 nt, Homo sapiens
aagacauccugauucgauu

SEQ ID NO: 1451616 - RNA, 19 nt, Homo sapiens
gcgcacaccaacacgaaau

SEQ ID NO: 1451617 - RNA, 19 nt, Homo sapiens
gaauugccauggguguuuu

SEQ ID NO: 1451618 - RNA, 19 nt, Homo sapiens
ccacagagcuccacagcaa

SEQ ID NO: 1451619 - RNA, 19 nt, Homo sapiens
gguauugucuuccuuugua

SEQ ID NO: 1451620 - RNA, 19 nt, Homo sapiens
guaaauguguguuuguuuc

SEQ ID NO: 1451621 - RNA, 19 nt, Homo sapiens
gaaccugacuagcccaaau

SEQ ID NO: 1451622 - RNA, 19 nt, Homo sapiens
gcacagugguauccaggaa

SEQ ID NO: 1451623 - RNA, 19 nt, Homo sapiens
gacaagaaaccaaaccuuu

SEQ ID NO: 1451624 - RNA, 19 nt, Homo sapiens
gcucauauucuccaucuuu

SEQ ID NO: 1451625 - RNA, 19 nt, Homo sapiens
ggaccaagcaguuccuuug

SEQ ID NO: 1451626 - RNA, 19 nt, Homo sapiens
guaaaaguguucuguauuc

SEQ ID NO: 1451627 - RNA, 19 nt, Homo sapiens
ucaauucuguggguaaaug

SEQ ID NO: 1451628 - RNA, 19 nt, Homo sapiens
gguaaauguguguuuguuu

SEQ ID NO: 1451629 - RNA, 19 nt, Homo sapiens
ggguaaauguguguuuguu

SEQ ID NO: 1451630 - RNA, 19 nt, Homo sapiens
uacggagccucauuuggua

SEQ ID NO: 1451631 - RNA, 19 nt, Homo sapiens
ugacuacggagccucauuu

SEQ ID NO: 1451632 - RNA, 19 nt, Homo sapiens
ccucaggcccuccagagua

SEQ ID NO: 1451633 - RNA, 19 nt, Homo sapiens
ucacucuguugcucauauu

SEQ ID NO: 1451634 - RNA, 19 nt, Homo sapiens
ucacuggagcugcuucaaa

SEQ ID NO: 1451635 - RNA, 19 nt, Homo sapiens
cuacggagccucauuuggu

SEQ ID NO: 1451636 - RNA, 19 nt, Homo sapiens
gcuguucccagacaagaaa

SEQ ID NO: 1451637 - RNA, 19 nt, Homo sapiens
guggguaaauguguguuug

SEQ ID NO: 1451638 - RNA, 19 nt, Homo sapiens
guuuguuucucuuugaaug

SEQ ID NO: 1451639 - RNA, 19 nt, Homo sapiens
ggagccucauuugguauug

SEQ ID NO: 1451640 - RNA, 19 nt, Homo sapiens
ugagugcuguucccagaca

SEQ ID NO: 1451641 - RNA, 19 nt, Homo sapiens
gccaucagcugugccucaa

SEQ ID NO: 1451642 - RNA, 19 nt, Homo sapiens
uagcccaaauagcaaguug

SEQ ID NO: 1451643 - RNA, 19 nt, Homo sapiens
caguaaaaguguucuguau

SEQ ID NO: 1451644 - RNA, 19 nt, Homo sapiens
ugacuagcccaaauagcaa

SEQ ID NO: 1451645 - RNA, 19 nt, Homo sapiens
gucacucuguugcucauau

SEQ ID NO: 1451646 - RNA, 19 nt, Homo sapiens
uguguuuguuucucuuuga

SEQ ID NO: 1451647 - RNA, 19 nt, Homo sapiens
gagccucauuugguauugu

SEQ ID NO: 1451648 - RNA, 19 nt, Homo sapiens
gcaguaaaaguguucugua

SEQ ID NO: 1451649 - RNA, 19 nt, Homo sapiens
cuucaauucuguggguaaa

SEQ ID NO: 1451650 - RNA, 19 nt, Homo sapiens
ucaaggaccagcccaagag

SEQ ID NO: 1451651 - RNA, 19 nt, Homo sapiens
gaaugucuugccacugguu

SEQ ID NO: 1451652 - RNA, 19 nt, Homo sapiens
cacuggagcugcuucaaaa

SEQ ID NO: 1451653 - RNA, 19 nt, Homo sapiens
guguuuguuucucuuugaa

SEQ ID NO: 1451654 - RNA, 19 nt, Homo sapiens
guauugucuuccuuuguag

SEQ ID NO: 1451655 - RNA, 19 nt, Homo sapiens
ucaacaacacguuccauac

SEQ ID NO: 1451656 - RNA, 19 nt, Homo sapiens
gaguugcucuuuuacuaug

SEQ ID NO: 1451657 - RNA, 19 nt, Homo sapiens
gcccaccucagccuuguga

SEQ ID NO: 1451658 - RNA, 19 nt, Homo sapiens
caacaacacguuccauacc

SEQ ID NO: 1451659 - RNA, 19 nt, Homo sapiens
ccucaguuccgcaucuuug

SEQ ID NO: 1451660 - RNA, 19 nt, Homo sapiens
gcccaagagccgcuacuuc

SEQ ID NO: 1451661 - RNA, 19 nt, Homo sapiens
aaccugacuagcccaaaua

SEQ ID NO: 1451662 - RNA, 19 nt, Homo sapiens
aaagggcugcacaguggua

SEQ ID NO: 1451663 - RNA, 19 nt, Homo sapiens
uugaaggacugggagaugu

SEQ ID NO: 1451664 - RNA, 19 nt, Homo sapiens
agacaagaaaccaaaccuu

SEQ ID NO: 1451665 - RNA, 19 nt, Homo sapiens
gagcuccacagcaaguugu

SEQ ID NO: 1451666 - RNA, 19 nt, Homo sapiens
ugucuuccuuuguaguguu

SEQ ID NO: 1451667 - RNA, 19 nt, Homo sapiens
cugacuagcccaaauagca

SEQ ID NO: 1451668 - RNA, 19 nt, Homo sapiens
ggccauguguuugcuucug

SEQ ID NO: 1451669 - RNA, 19 nt, Homo sapiens
acaagaaaccaaaccuuuu

SEQ ID NO: 1451670 - RNA, 19 nt, Homo sapiens
gccgucauccucaguguca

SEQ ID NO: 1451671 - RNA, 19 nt, Homo sapiens
gcaccgaccucauguucaa

SEQ ID NO: 1451672 - RNA, 19 nt, Homo sapiens
gaacugacgccgugaaugu

SEQ ID NO: 1451673 - RNA, 19 nt, Homo sapiens
cuacugaacugcuacuguu

SEQ ID NO: 1451674 - RNA, 19 nt, Homo sapiens
ccacuuaccuacugaacug

SEQ ID NO: 1451675 - RNA, 19 nt, Homo sapiens
ccugaacgcugugaaauug

SEQ ID NO: 1451676 - RNA, 19 nt, Homo sapiens
ugaacgcugugaaauugua

SEQ ID NO: 1451677 - RNA, 19 nt, Homo sapiens
ggaacacgcuggccaacag

SEQ ID NO: 1451678 - RNA, 19 nt, Homo sapiens
gaaauuguacugucagaac

SEQ ID NO: 1451679 - RNA, 19 nt, Homo sapiens
ucaagccacuuaccuacug

SEQ ID NO: 1451680 - RNA, 19 nt, Homo sapiens
ucaaggagagcgagaugaa

SEQ ID NO: 1451681 - RNA, 19 nt, Homo sapiens
gcuccuggccaccuucuuu

SEQ ID NO: 1451682 - RNA, 19 nt, Homo sapiens
gagcugcuugcaugcguua

SEQ ID NO: 1451683 - RNA, 19 nt, Homo sapiens
gugcaggggugaagcauaa

SEQ ID NO: 1451684 - RNA, 19 nt, Homo sapiens
cggagggcguggagaugua

SEQ ID NO: 1451685 - RNA, 19 nt, Homo sapiens
gcggccagcugaugaacug

SEQ ID NO: 1451686 - RNA, 19 nt, Homo sapiens
aaugugaucaagccacuua

SEQ ID NO: 1451687 - RNA, 19 nt, Homo sapiens
acaaacaaaugugaucaag

SEQ ID NO: 1451688 - RNA, 19 nt, Homo sapiens
ggugaagcauaaggucuug

SEQ ID NO: 1451689 - RNA, 19 nt, Homo sapiens
gaugaacugccaccugugu

SEQ ID NO: 1451690 - RNA, 19 nt, Homo sapiens
caagccacuuaccuacuga

SEQ ID NO: 1451691 - RNA, 19 nt, Homo sapiens
gugaaauuguacugucaga

SEQ ID NO: 1451692 - RNA, 19 nt, Homo sapiens
cagcagauccuguccuucu

SEQ ID NO: 1451693 - RNA, 19 nt, Homo sapiens
gagcaguacggccagaugu

SEQ ID NO: 1451694 - RNA, 19 nt, Homo sapiens
uugcaugcguuacuaauac

SEQ ID NO: 1451695 - RNA, 19 nt, Homo sapiens
gagaacugacgccgugaau

SEQ ID NO: 1451696 - RNA, 19 nt, Homo sapiens
caucguggcucugagaacu

SEQ ID NO: 1451697 - RNA, 19 nt, Homo sapiens
ugaucaagccacuuaccua

SEQ ID NO: 1451698 - RNA, 19 nt, Homo sapiens
gguccugaacgcugugaaa

SEQ ID NO: 1451699 - RNA, 19 nt, Homo sapiens
agagcgagaugaacgugau

SEQ ID NO: 1451700 - RNA, 19 nt, Homo sapiens
ugacccgaguaaagcauga

SEQ ID NO: 1451701 - RNA, 19 nt, Homo sapiens
ccaccuucuuugacaggaa

SEQ ID NO: 1451702 - RNA, 19 nt, Homo sapiens
caaggccuccggcagcuau

SEQ ID NO: 1451703 - RNA, 19 nt, Homo sapiens
cugcuacuguugccugaga

SEQ ID NO: 1451704 - RNA, 19 nt, Homo sapiens
ggagcaguacggccagaug

SEQ ID NO: 1451705 - RNA, 19 nt, Homo sapiens
guacuagagcugcuugcau

SEQ ID NO: 1451706 - RNA, 19 nt, Homo sapiens
ugucucagaugcugcacau

SEQ ID NO: 1451707 - RNA, 19 nt, Homo sapiens
cugcuugcaugcguuacua

SEQ ID NO: 1451708 - RNA, 19 nt, Homo sapiens
gggugaagcauaaggucuu

SEQ ID NO: 1451709 - RNA, 19 nt, Homo sapiens
aaauuguacugucagaacu

SEQ ID NO: 1451710 - RNA, 19 nt, Homo sapiens
gcacagccccucucaaacu

SEQ ID NO: 1451711 - RNA, 19 nt, Homo sapiens
uccagcagauccuguccuu

SEQ ID NO: 1451712 - RNA, 19 nt, Homo sapiens
cgagggaccgaguacuaga

SEQ ID NO: 1451713 - RNA, 19 nt, Homo sapiens
cuacuuccgcgaccuguuc

SEQ ID NO: 1451714 - RNA, 19 nt, Homo sapiens
gaaagaugcuaaugguuga

SEQ ID NO: 1451715 - RNA, 19 nt, Homo sapiens
ggaacaauacucucaaugu

SEQ ID NO: 1451716 - RNA, 19 nt, Homo sapiens
gcacaauggcugaggaaug

SEQ ID NO: 1451717 - RNA, 19 nt, Homo sapiens
gcuaaugguugacuuugca

SEQ ID NO: 1451718 - RNA, 19 nt, Homo sapiens
ggaccaguaaccaggcuua

SEQ ID NO: 1451719 - RNA, 19 nt, Homo sapiens
agaaggcugucuccgugua

SEQ ID NO: 1451720 - RNA, 19 nt, Homo sapiens
gccgugaaguccugccauu

SEQ ID NO: 1451721 - RNA, 19 nt, Homo sapiens
ggccauccaucugcgauug

SEQ ID NO: 1451722 - RNA, 19 nt, Homo sapiens
cuaauaaguacaugggaaa

SEQ ID NO: 1451723 - RNA, 19 nt, Homo sapiens
cacaauggcugaggaaugc

SEQ ID NO: 1451724 - RNA, 19 nt, Homo sapiens
gaugcuaaugguugacuuu

SEQ ID NO: 1451725 - RNA, 19 nt, Homo sapiens
ugggaaagaugcuaauggu

SEQ ID NO: 1451726 - RNA, 19 nt, Homo sapiens
gaaguccugccauuucaca

SEQ ID NO: 1451727 - RNA, 19 nt, Homo sapiens
ggagaggaccagcgacuac

SEQ ID NO: 1451728 - RNA, 19 nt, Homo sapiens
auaaguacaugggaaagau

SEQ ID NO: 1451729 - RNA, 19 nt, Homo sapiens
guacaugggaaagaugcua

SEQ ID NO: 1451730 - RNA, 19 nt, Homo sapiens
ugccauuucacaucuaaua

SEQ ID NO: 1451731 - RNA, 19 nt, Homo sapiens
gccauuucacaucuaauaa

SEQ ID NO: 1451732 - RNA, 19 nt, Homo sapiens
ugguugacuuugcauuaaa

SEQ ID NO: 1451733 - RNA, 19 nt, Homo sapiens
gggaaagaugcuaaugguu

SEQ ID NO: 1451734 - RNA, 19 nt, Homo sapiens
ccugccauuucacaucuaa

SEQ ID NO: 1451735 - RNA, 19 nt, Homo sapiens
acagggaccuuuucaggaa

SEQ ID NO: 1451736 - RNA, 19 nt, Homo sapiens
ccggaacaauacucucaau

SEQ ID NO: 1451737 - RNA, 19 nt, Homo sapiens
cgugaaguccugccauuuc

SEQ ID NO: 1451738 - RNA, 19 nt, Homo sapiens
augguugacuuugcauuaa

SEQ ID NO: 1451739 - RNA, 19 nt, Homo sapiens
guccugccauuucacaucu

SEQ ID NO: 1451740 - RNA, 19 nt, Homo sapiens
ggaaaugucuugaaguaua

SEQ ID NO: 1451741 - RNA, 19 nt, Homo sapiens
ggaaaugcauugaucauaa

SEQ ID NO: 1451742 - RNA, 19 nt, Homo sapiens
gaggaaaugucuugaagua

SEQ ID NO: 1451743 - RNA, 19 nt, Homo sapiens
caaaugaacuuuccauaga

SEQ ID NO: 1451744 - RNA, 19 nt, Homo sapiens
caacauauacugugaauga

SEQ ID NO: 1451745 - RNA, 19 nt, Homo sapiens
gaauugagcuaugaggaua

SEQ ID NO: 1451746 - RNA, 19 nt, Homo sapiens
agacacagcucacaaugua

SEQ ID NO: 1451747 - RNA, 19 nt, Homo sapiens
gaacaaaugcugaaaucaa

SEQ ID NO: 1451748 - RNA, 19 nt, Homo sapiens
gaucauagcucacuguaac

SEQ ID NO: 1451749 - RNA, 19 nt, Homo sapiens
gagaugggauccuucuaaa

SEQ ID NO: 1451750 - RNA, 19 nt, Homo sapiens
gaaauacuacugaccauug

SEQ ID NO: 1451751 - RNA, 19 nt, Homo sapiens
uugcaagucugccgaauua

SEQ ID NO: 1451752 - RNA, 19 nt, Homo sapiens
auaauggucucaagugaua

SEQ ID NO: 1451753 - RNA, 19 nt, Homo sapiens
ugaaugaucucucuaugau

SEQ ID NO: 1451754 - RNA, 19 nt, Homo sapiens
cuaaggauccucagucaua

SEQ ID NO: 1451755 - RNA, 19 nt, Homo sapiens
gugaaugauugcauacaua

SEQ ID NO: 1451756 - RNA, 19 nt, Homo sapiens
aaucaguggugccuucuua

SEQ ID NO: 1451757 - RNA, 19 nt, Homo sapiens
caauaauggucucaaguga

SEQ ID NO: 1451758 - RNA, 19 nt, Homo sapiens
gaaaugucuugaaguauac

SEQ ID NO: 1451759 - RNA, 19 nt, Homo sapiens
gcaaaugaacuuuccauag

SEQ ID NO: 1451760 - RNA, 19 nt, Homo sapiens
ccagaauuguguuucagua

SEQ ID NO: 1451761 - RNA, 19 nt, Homo sapiens
aaugaucucucuaugauga

SEQ ID NO: 1451762 - RNA, 19 nt, Homo sapiens
gugagagacuggagugaaa

SEQ ID NO: 1451763 - RNA, 19 nt, Homo sapiens
cuaugaaugugucuuguuu

SEQ ID NO: 1451764 - RNA, 19 nt, Homo sapiens
cagaaagggaugccuguua

SEQ ID NO: 1451765 - RNA, 19 nt, Homo sapiens
ggacuuuguucacuuucaa

SEQ ID NO: 1451766 - RNA, 19 nt, Homo sapiens
gaugggaauggaaagauua

SEQ ID NO: 1451767 - RNA, 19 nt, Homo sapiens
gaauuguguuucaguagga

SEQ ID NO: 1451768 - RNA, 19 nt, Homo sapiens
gagaagaugggaauggaaa

SEQ ID NO: 1451769 - RNA, 19 nt, Homo sapiens
gcauugcacauguaacuuu

SEQ ID NO: 1451770 - RNA, 19 nt, Homo sapiens
gacacaaccucaaaucagu

SEQ ID NO: 1451771 - RNA, 19 nt, Homo sapiens
gaugggauccuucuaaagu

SEQ ID NO: 1451772 - RNA, 19 nt, Homo sapiens
cauuugacauggauaaguu

SEQ ID NO: 1451773 - RNA, 19 nt, Homo sapiens
uggcucagaugaacuuaaa

SEQ ID NO: 1451774 - RNA, 19 nt, Homo sapiens
gaacuuuccauagaauuga

SEQ ID NO: 1451775 - RNA, 19 nt, Homo sapiens
aaagagagaugggauccuu

SEQ ID NO: 1451776 - RNA, 19 nt, Homo sapiens
gauccucagucauauucaa

SEQ ID NO: 1451777 - RNA, 19 nt, Homo sapiens
gcaagucugccgaauuaau

SEQ ID NO: 1451778 - RNA, 19 nt, Homo sapiens
aagaacaaaugcugaaauc

SEQ ID NO: 1451779 - RNA, 19 nt, Homo sapiens
gaaucuguauugucaacau

SEQ ID NO: 1451780 - RNA, 19 nt, Homo sapiens
caagugauaccaccuggaa

SEQ ID NO: 1451781 - RNA, 19 nt, Homo sapiens
ggacacaaccucaaaucag

SEQ ID NO: 1451782 - RNA, 19 nt, Homo sapiens
gcucagaugaacuuaaaga

SEQ ID NO: 1451783 - RNA, 19 nt, Homo sapiens
gcaguauggauucaaggua

SEQ ID NO: 1451784 - RNA, 19 nt, Homo sapiens
ccagguggaauuuggauaa

SEQ ID NO: 1451785 - RNA, 19 nt, Homo sapiens
aauccacgcugaaacaguu

SEQ ID NO: 1451786 - RNA, 19 nt, Homo sapiens
gaagaugggaauggaaaga

SEQ ID NO: 1451787 - RNA, 19 nt, Homo sapiens
gacaagauccggaaaugca

SEQ ID NO: 1451788 - RNA, 19 nt, Homo sapiens
caucuggaguugggacuuu

SEQ ID NO: 1451789 - RNA, 19 nt, Homo sapiens
ccacaauaauggucucaag

SEQ ID NO: 1451790 - RNA, 19 nt, Homo sapiens
cagccaaucauuaaagaaa

SEQ ID NO: 1451791 - RNA, 19 nt, Homo sapiens
caagucugccgaauuaaug

SEQ ID NO: 1451792 - RNA, 19 nt, Homo sapiens
uaaggauccucagucauau

SEQ ID NO: 1451793 - RNA, 19 nt, Homo sapiens
cauauacugugaaugaucu

SEQ ID NO: 1451794 - RNA, 19 nt, Homo sapiens
agaaagggaugccuguuac

SEQ ID NO: 1451795 - RNA, 19 nt, Homo sapiens
gugaaugaucucucuauga

SEQ ID NO: 1451796 - RNA, 19 nt, Homo sapiens
uugaaaaucuggcaaauga

SEQ ID NO: 1451797 - RNA, 19 nt, Homo sapiens
caagccagguggaauuugg

SEQ ID NO: 1451798 - RNA, 19 nt, Homo sapiens
ugggauccuucuaaaguaa

SEQ ID NO: 1451799 - RNA, 19 nt, Homo sapiens
guuaccagccaaucauuaa

SEQ ID NO: 1451800 - RNA, 19 nt, Homo sapiens
gagugaaacugggaaagca

SEQ ID NO: 1451801 - RNA, 19 nt, Homo sapiens
gcucuuuucuuccaacuuu

SEQ ID NO: 1451802 - RNA, 19 nt, Homo sapiens
agagaugggauccuucuaa

SEQ ID NO: 1451803 - RNA, 19 nt, Homo sapiens
gaacuuaaagaagcaucaa

SEQ ID NO: 1451804 - RNA, 19 nt, Homo sapiens
caaaaucaacuaucaguga

SEQ ID NO: 1451805 - RNA, 19 nt, Homo sapiens
ggagguggaagugcaguuu

SEQ ID NO: 1451806 - RNA, 19 nt, Homo sapiens
ugcaauaccugggacugua

SEQ ID NO: 1451807 - RNA, 19 nt, Homo sapiens
agacuggccugggaaauag

SEQ ID NO: 1451808 - RNA, 19 nt, Homo sapiens
gacaggacacaaccucaaa

SEQ ID NO: 1451809 - RNA, 19 nt, Homo sapiens
gguucuaacuuuucuauga

SEQ ID NO: 1451810 - RNA, 19 nt, Homo sapiens
ggaagacuggccugggaaa

SEQ ID NO: 1451811 - RNA, 19 nt, Homo sapiens
gcgccuggccugugucuau

SEQ ID NO: 1451812 - RNA, 19 nt, Homo sapiens
ucagucauauucaacaucu

SEQ ID NO: 1451813 - RNA, 19 nt, Homo sapiens
ucuggaagaucauuaaugc

SEQ ID NO: 1451814 - RNA, 19 nt, Homo sapiens
auccaucaguuuagcaaua

SEQ ID NO: 1451815 - RNA, 19 nt, Homo sapiens
cugaguagcuaggacugua

SEQ ID NO: 1451816 - RNA, 19 nt, Homo sapiens
gcacauguaacuuuuagaa

SEQ ID NO: 1451817 - RNA, 19 nt, Homo sapiens
ggcaaaugaacuuuccaua

SEQ ID NO: 1451818 - RNA, 19 nt, Homo sapiens
caucuacauuugacaugga

SEQ ID NO: 1451819 - RNA, 19 nt, Homo sapiens
agaugggaauggaaagauu

SEQ ID NO: 1451820 - RNA, 19 nt, Homo sapiens
ucaaacuccuggacucaag

SEQ ID NO: 1451821 - RNA, 19 nt, Homo sapiens
ggaguugggacuuuguuca

SEQ ID NO: 1451822 - RNA, 19 nt, Homo sapiens
cgggugaaccgaacagaaa

SEQ ID NO: 1451823 - RNA, 19 nt, Homo sapiens
cagguggaauuuggauaaa

SEQ ID NO: 1451824 - RNA, 19 nt, Homo sapiens
uccaucaguuuagcaauaa

SEQ ID NO: 1451825 - RNA, 19 nt, Homo sapiens
uaugcuagguuaugcuugu

SEQ ID NO: 1451826 - RNA, 19 nt, Homo sapiens
gaaacugggaaagcagaaa

SEQ ID NO: 1451827 - RNA, 19 nt, Homo sapiens
cuacauuugacauggauaa

SEQ ID NO: 1451828 - RNA, 19 nt, Homo sapiens
ggagaagaugggaauggaa

SEQ ID NO: 1451829 - RNA, 19 nt, Homo sapiens
uagcaucacaggccgguaa

SEQ ID NO: 1451830 - RNA, 19 nt, Homo sapiens
aaccuaaucuccagugucu

SEQ ID NO: 1451831 - RNA, 19 nt, Homo sapiens
ggugccuucuuauuccuaa

SEQ ID NO: 1451832 - RNA, 19 nt, Homo sapiens
aaauacuacugaccauugu

SEQ ID NO: 1451833 - RNA, 19 nt, Homo sapiens
gucaacauauacugugaau

SEQ ID NO: 1451834 - RNA, 19 nt, Homo sapiens
cggaaaugcauugaucaua

SEQ ID NO: 1451835 - RNA, 19 nt, Homo sapiens
agccuuagccuccugagua

SEQ ID NO: 1451836 - RNA, 19 nt, Homo sapiens
uggaggaaaugucuugaag

SEQ ID NO: 1451837 - RNA, 19 nt, Homo sapiens
acuaugccaugcagauuug

SEQ ID NO: 1451838 - RNA, 19 nt, Homo sapiens
gaaaucaacgacucaaaau

SEQ ID NO: 1451839 - RNA, 19 nt, Homo sapiens
guaagaacaaaugcugaaa

SEQ ID NO: 1451840 - RNA, 19 nt, Homo sapiens
gcaccuccaucaaggaauu

SEQ ID NO: 1451841 - RNA, 19 nt, Homo sapiens
ggaagaagaucuccaacac

SEQ ID NO: 1451842 - RNA, 19 nt, Homo sapiens
cagaagaugugaaaugcaa

SEQ ID NO: 1451843 - RNA, 19 nt, Homo sapiens
ucaagacucugcucuggaa

SEQ ID NO: 1451844 - RNA, 19 nt, Homo sapiens
gcucauggcugacuucaac

SEQ ID NO: 1451845 - RNA, 19 nt, Homo sapiens
gagcaaaggcggacaugga

SEQ ID NO: 1451846 - RNA, 19 nt, Homo sapiens
ugaagaacguaaugucaau

SEQ ID NO: 1451847 - RNA, 19 nt, Homo sapiens
gaagaacguaaugucaaua

SEQ ID NO: 1451848 - RNA, 19 nt, Homo sapiens
uuacgggacuuucuacaug

SEQ ID NO: 1451849 - RNA, 19 nt, Homo sapiens
gaacguaaugucaauaaac

SEQ ID NO: 1451850 - RNA, 19 nt, Homo sapiens
ggcgggagcugguacuguu

SEQ ID NO: 1451851 - RNA, 19 nt, Homo sapiens
ggaauccugucagaagaug

SEQ ID NO: 1451852 - RNA, 19 nt, Homo sapiens
gccagguggucauuuguga

SEQ ID NO: 1451853 - RNA, 19 nt, Homo sapiens
gcucuuacgggacuuucua

SEQ ID NO: 1451854 - RNA, 19 nt, Homo sapiens
acucugcucuggaagaaga

SEQ ID NO: 1451855 - RNA, 19 nt, Homo sapiens
ugugugagcugcauauggu

SEQ ID NO: 1451856 - RNA, 19 nt, Homo sapiens
caaggugugcgcacugcua

SEQ ID NO: 1451857 - RNA, 19 nt, Homo sapiens
agacucugcucuggaagaa

SEQ ID NO: 1451858 - RNA, 19 nt, Homo sapiens
gagcugguacuguuugaca

SEQ ID NO: 1451859 - RNA, 19 nt, Homo sapiens
gggagcugguacuguuuga

SEQ ID NO: 1451860 - RNA, 19 nt, Homo sapiens
ugucagaagaugugaaaug

SEQ ID NO: 1451861 - RNA, 19 nt, Homo sapiens
ggacuuucuacauguguga

SEQ ID NO: 1451862 - RNA, 19 nt, Homo sapiens
uggcugacuucaacaagga

SEQ ID NO: 1451863 - RNA, 19 nt, Homo sapiens
gucagaagaugugaaaugc

SEQ ID NO: 1451864 - RNA, 19 nt, Homo sapiens
ccaucggccugcuggaguu

SEQ ID NO: 1451865 - RNA, 19 nt, Homo sapiens
gaagaugugaaaugcaacu

SEQ ID NO: 1451866 - RNA, 19 nt, Homo sapiens
gugcucagccaccucaaga

SEQ ID NO: 1451867 - RNA, 19 nt, Homo sapiens
gggcaccuccaucaaggaa

SEQ ID NO: 1451868 - RNA, 19 nt, Homo sapiens
ucagccaccucaagacucu

SEQ ID NO: 1451869 - RNA, 19 nt, Homo sapiens
gguccaacccucccucaag

SEQ ID NO: 1451870 - RNA, 19 nt, Homo sapiens
caccuacgacuucaagaug

SEQ ID NO: 1451871 - RNA, 19 nt, Homo sapiens
ucaaggaauuccgggagau

SEQ ID NO: 1451872 - RNA, 19 nt, Homo sapiens
caaaggcggacauggacau

SEQ ID NO: 1451873 - RNA, 19 nt, Homo sapiens
cagcaccacagacaugaga

SEQ ID NO: 1451874 - RNA, 19 nt, Homo sapiens
ucugccagguggucauuug

SEQ ID NO: 1451875 - RNA, 19 nt, Homo sapiens
gugcaagggcgaccucauc

SEQ ID NO: 1451876 - RNA, 19 nt, Homo sapiens
ccaccuacgacuucaagau

SEQ ID NO: 1451877 - RNA, 19 nt, Homo sapiens
ggaccugugugagcugcau

SEQ ID NO: 1451878 - RNA, 19 nt, Homo sapiens
ccaacccucccucaaggaa

SEQ ID NO: 1451879 - RNA, 19 nt, Homo sapiens
cugaagaacguaaugucaa

SEQ ID NO: 1451880 - RNA, 19 nt, Homo sapiens
acacagccaccuacgacuu

SEQ ID NO: 1451881 - RNA, 19 nt, Homo sapiens
uacgggacuuucuacaugu

SEQ ID NO: 1451882 - RNA, 19 nt, Homo sapiens
ccugucagaagaugugaaa

SEQ ID NO: 1451883 - RNA, 19 nt, Homo sapiens
agaccacacuggccaacgu

SEQ ID NO: 1451884 - RNA, 19 nt, Homo sapiens
caaggaauuccgggagaug

SEQ ID NO: 1451885 - RNA, 19 nt, Homo sapiens
caagaucauucagcaauaa

SEQ ID NO: 1451886 - RNA, 19 nt, Homo sapiens
cgagagguaugacaucaaa

SEQ ID NO: 1451887 - RNA, 19 nt, Homo sapiens
ucaagaucauucagcaaua

SEQ ID NO: 1451888 - RNA, 19 nt, Homo sapiens
ugaagggacugaucaagau

SEQ ID NO: 1451889 - RNA, 19 nt, Homo sapiens
gcacagagcccggaagagu

SEQ ID NO: 1451890 - RNA, 19 nt, Homo sapiens
gcugaaggaccucaacuuu

SEQ ID NO: 1451891 - RNA, 19 nt, Homo sapiens
ccgcggaucuugagaagga

SEQ ID NO: 1451892 - RNA, 19 nt, Homo sapiens
ggauuacagccuccugaua

SEQ ID NO: 1451893 - RNA, 19 nt, Homo sapiens
gauuacagccuccugauag

SEQ ID NO: 1451894 - RNA, 19 nt, Homo sapiens
cagcauccccuaacuaaua

SEQ ID NO: 1451895 - RNA, 19 nt, Homo sapiens
gagcucaacgugcuggauu

SEQ ID NO: 1451896 - RNA, 19 nt, Homo sapiens
gugaagggacugaucaaga

SEQ ID NO: 1451897 - RNA, 19 nt, Homo sapiens
uaaccgcgcagucccguuu

SEQ ID NO: 1451898 - RNA, 19 nt, Homo sapiens
caaggacuccccuacuuua

SEQ ID NO: 1451899 - RNA, 19 nt, Homo sapiens
gggcagcagccucaucuuc

SEQ ID NO: 1451900 - RNA, 19 nt, Homo sapiens
ggcccgagcagcgcuauuu

SEQ ID NO: 1451901 - RNA, 19 nt, Homo sapiens
ucaacgugcuggauuacag

SEQ ID NO: 1451902 - RNA, 19 nt, Homo sapiens
ccugauagccuuccaacgu

SEQ ID NO: 1451903 - RNA, 19 nt, Homo sapiens
gaugggcucacgccaggaa

SEQ ID NO: 1451904 - RNA, 19 nt, Homo sapiens
gauccggaccagccaagga

SEQ ID NO: 1451905 - RNA, 19 nt, Homo sapiens
gccaaggacuccccuacuu

SEQ ID NO: 1451906 - RNA, 19 nt, Homo sapiens
gaagagucgagagcccaaa

SEQ ID NO: 1451907 - RNA, 19 nt, Homo sapiens
agcucaacgugcuggauua

SEQ ID NO: 1451908 - RNA, 19 nt, Homo sapiens
cugaaggaccucaacuuuc

SEQ ID NO: 1451909 - RNA, 19 nt, Homo sapiens
ggaaacagcuaauugagaa

SEQ ID NO: 1451910 - RNA, 19 nt, Homo sapiens
ggaaggaacuguacaacaa

SEQ ID NO: 1451911 - RNA, 19 nt, Homo sapiens
gcacagggauggauucaaa

SEQ ID NO: 1451912 - RNA, 19 nt, Homo sapiens
gaagauugaugaugaaguu

SEQ ID NO: 1451913 - RNA, 19 nt, Homo sapiens
caaauuagcucgcuuagag

SEQ ID NO: 1451914 - RNA, 19 nt, Homo sapiens
gaaagaacauugagaacau

SEQ ID NO: 1451915 - RNA, 19 nt, Homo sapiens
gaacaugucucagccagaa

SEQ ID NO: 1451916 - RNA, 19 nt, Homo sapiens
caaccaagauaaagaacua

SEQ ID NO: 1451917 - RNA, 19 nt, Homo sapiens
gaaacuucaucucuacuaa

SEQ ID NO: 1451918 - RNA, 19 nt, Homo sapiens
gaaagagcguccugaccua

SEQ ID NO: 1451919 - RNA, 19 nt, Homo sapiens
ccaaucaacuggagaugua

SEQ ID NO: 1451920 - RNA, 19 nt, Homo sapiens
ccaagcaacuucuacguaa

SEQ ID NO: 1451921 - RNA, 19 nt, Homo sapiens
ggaagaaugucccaucugu

SEQ ID NO: 1451922 - RNA, 19 nt, Homo sapiens
gcucugcgcugacuucaaa

SEQ ID NO: 1451923 - RNA, 19 nt, Homo sapiens
ggaggaagcagaauuagaa

SEQ ID NO: 1451924 - RNA, 19 nt, Homo sapiens
caagauuuaucgcacauuu

SEQ ID NO: 1451925 - RNA, 19 nt, Homo sapiens
gauagugacuuugaagaaa

SEQ ID NO: 1451926 - RNA, 19 nt, Homo sapiens
gaucagagcuaagguguca

SEQ ID NO: 1451927 - RNA, 19 nt, Homo sapiens
gcagaaggaugauaaagag

SEQ ID NO: 1451928 - RNA, 19 nt, Homo sapiens
caugauagcugcaaagcaa

SEQ ID NO: 1451929 - RNA, 19 nt, Homo sapiens
ggaagacucugauguggau

SEQ ID NO: 1451930 - RNA, 19 nt, Homo sapiens
ugagagaucuuccaaauac

SEQ ID NO: 1451931 - RNA, 19 nt, Homo sapiens
caacacagcagaaggauga

SEQ ID NO: 1451932 - RNA, 19 nt, Homo sapiens
gacuauggcuucaaacuga

SEQ ID NO: 1451933 - RNA, 19 nt, Homo sapiens
gcucacaccuguaaucuca

SEQ ID NO: 1451934 - RNA, 19 nt, Homo sapiens
gcuuauaucugaaggagaa

SEQ ID NO: 1451935 - RNA, 19 nt, Homo sapiens
gauguaaaccuuauucuug

SEQ ID NO: 1451936 - RNA, 19 nt, Homo sapiens
ucacagagaugaugucaca

SEQ ID NO: 1451937 - RNA, 19 nt, Homo sapiens
gaugaaggguggauuagga

SEQ ID NO: 1451938 - RNA, 19 nt, Homo sapiens
ucacugaacucacggcaaa

SEQ ID NO: 1451939 - RNA, 19 nt, Homo sapiens
gaaguuuguuccagauuau

SEQ ID NO: 1451940 - RNA, 19 nt, Homo sapiens
gggaagagaugcggaaaga

SEQ ID NO: 1451941 - RNA, 19 nt, Homo sapiens
caacugaggucuuaucaac

SEQ ID NO: 1451942 - RNA, 19 nt, Homo sapiens
gaaagcagcauccggaaga

SEQ ID NO: 1451943 - RNA, 19 nt, Homo sapiens
guagauaaagugacagaua

SEQ ID NO: 1451944 - RNA, 19 nt, Homo sapiens
ucaaugagguggcagaaga

SEQ ID NO: 1451945 - RNA, 19 nt, Homo sapiens
ggacucugcuacacuuaaa

SEQ ID NO: 1451946 - RNA, 19 nt, Homo sapiens
gcagugcugugcuuauuau

SEQ ID NO: 1451947 - RNA, 19 nt, Homo sapiens
caugagagaucuuccaaau

SEQ ID NO: 1451948 - RNA, 19 nt, Homo sapiens
ccauacaucuccuuucuug

SEQ ID NO: 1451949 - RNA, 19 nt, Homo sapiens
gaaaauggacccuuaauga

SEQ ID NO: 1451950 - RNA, 19 nt, Homo sapiens
gaaaagacagucauucaua

SEQ ID NO: 1451951 - RNA, 19 nt, Homo sapiens
gaaagcgucuuggaugaug

SEQ ID NO: 1451952 - RNA, 19 nt, Homo sapiens
gggaaagcgucuuggauga

SEQ ID NO: 1451953 - RNA, 19 nt, Homo sapiens
guaagaacaucuccaagca

SEQ ID NO: 1451954 - RNA, 19 nt, Homo sapiens
caacagaacaggcucauuc

SEQ ID NO: 1451955 - RNA, 19 nt, Homo sapiens
agaaguuuguuccagauua

SEQ ID NO: 1451956 - RNA, 19 nt, Homo sapiens
gacaaaccgcccauuauuu

SEQ ID NO: 1451957 - RNA, 19 nt, Homo sapiens
guaugaggauuugcuuaua

SEQ ID NO: 1451958 - RNA, 19 nt, Homo sapiens
ggacauaugaggacuaaca

SEQ ID NO: 1451959 - RNA, 19 nt, Homo sapiens
gaaacaaucacagagauga

SEQ ID NO: 1451960 - RNA, 19 nt, Homo sapiens
ggaaagcaauggcacugau

SEQ ID NO: 1451961 - RNA, 19 nt, Homo sapiens
ggaaugcucaguagaauca

SEQ ID NO: 1451962 - RNA, 19 nt, Homo sapiens
gagagucaguacacuaaga

SEQ ID NO: 1451963 - RNA, 19 nt, Homo sapiens
gagagcaucuggagcuaau

SEQ ID NO: 1451964 - RNA, 19 nt, Homo sapiens
gaaaaucucugguucucaa

SEQ ID NO: 1451965 - RNA, 19 nt, Homo sapiens
gaugaagauugaugaugaa

SEQ ID NO: 1451966 - RNA, 19 nt, Homo sapiens
agaugaagauugaugauga

SEQ ID NO: 1451967 - RNA, 19 nt, Homo sapiens
caagacaggguuacuauau

SEQ ID NO: 1451968 - RNA, 19 nt, Homo sapiens
ggaaucaucucugaagaag

SEQ ID NO: 1451969 - RNA, 19 nt, Homo sapiens
cuaggaauguaauggcuua

SEQ ID NO: 1451970 - RNA, 19 nt, Homo sapiens
gaagaaggauaaggaccaa

SEQ ID NO: 1451971 - RNA, 19 nt, Homo sapiens
agacauugauugcaaguug

SEQ ID NO: 1451972 - RNA, 19 nt, Homo sapiens
gggauaugguggaauaaga

SEQ ID NO: 1451973 - RNA, 19 nt, Homo sapiens
ggagguggcccauuuacuu

SEQ ID NO: 1451974 - RNA, 19 nt, Homo sapiens
gaagaaaugggaaagaaca

SEQ ID NO: 1451975 - RNA, 19 nt, Homo sapiens
caacuucuacguaaauuug

SEQ ID NO: 1451976 - RNA, 19 nt, Homo sapiens
aagaagagaucagagcuaa

SEQ ID NO: 1451977 - RNA, 19 nt, Homo sapiens
ggauacgaauggaagauau

SEQ ID NO: 1451978 - RNA, 19 nt, Homo sapiens
gggaggauaucaaacacaa

SEQ ID NO: 1451979 - RNA, 19 nt, Homo sapiens
gugaagacauugauugcaa

SEQ ID NO: 1451980 - RNA, 19 nt, Homo sapiens
agaagaugcuguagacuau

SEQ ID NO: 1451981 - RNA, 19 nt, Homo sapiens
ugacaaaccgcccauuauu

SEQ ID NO: 1451982 - RNA, 19 nt, Homo sapiens
gaaagaagacaaauuagcu

SEQ ID NO: 1451983 - RNA, 19 nt, Homo sapiens
gaaggaugcuggcuauggu

SEQ ID NO: 1451984 - RNA, 19 nt, Homo sapiens
caacaugaaccugugauaa

SEQ ID NO: 1451985 - RNA, 19 nt, Homo sapiens
gaagaagagaucagagcua

SEQ ID NO: 1451986 - RNA, 19 nt, Homo sapiens
ggugggugcuuaagucuga

SEQ ID NO: 1451987 - RNA, 19 nt, Homo sapiens
ggacaagacaggguuacua

SEQ ID NO: 1451988 - RNA, 19 nt, Homo sapiens
gagaaagacacaacaugaa

SEQ ID NO: 1451989 - RNA, 19 nt, Homo sapiens
ccacucggauuaugaugaa

SEQ ID NO: 1451990 - RNA, 19 nt, Homo sapiens
ggaauaagacccaaacaac

SEQ ID NO: 1451991 - RNA, 19 nt, Homo sapiens
gacaauccuuucucugcua

SEQ ID NO: 1451992 - RNA, 19 nt, Homo sapiens
aaacauucauugacucaga

SEQ ID NO: 1451993 - RNA, 19 nt, Homo sapiens
gcaccagauuguaaauaug

SEQ ID NO: 1451994 - RNA, 19 nt, Homo sapiens
gaaggaaucaucucugaag

SEQ ID NO: 1451995 - RNA, 19 nt, Homo sapiens
gcaguggguuugacuaugg

SEQ ID NO: 1451996 - RNA, 19 nt, Homo sapiens
gcccgacugugguaugaua

SEQ ID NO: 1451997 - RNA, 19 nt, Homo sapiens
ugaggcaaauuaccauaaa

SEQ ID NO: 1451998 - RNA, 19 nt, Homo sapiens
gaggauagcaacaucaguu

SEQ ID NO: 1451999 - RNA, 19 nt, Homo sapiens
ggaaagaacauugagaaca

SEQ ID NO: 1452000 - RNA, 19 nt, Homo sapiens
gucaucaacugaggucuua

SEQ ID NO: 1452001 - RNA, 19 nt, Homo sapiens
gaagauuuccagaugaaga

SEQ ID NO: 1452002 - RNA, 19 nt, Homo sapiens
ggacagcgaggaagauuca

SEQ ID NO: 1452003 - RNA, 19 nt, Homo sapiens
caacuggagauguagauaa

SEQ ID NO: 1452004 - RNA, 19 nt, Homo sapiens
ugucgaaacuucaucucua

SEQ ID NO: 1452005 - RNA, 19 nt, Homo sapiens
gagaagaugaugaggaaga

SEQ ID NO: 1452006 - RNA, 19 nt, Homo sapiens
guaaaggacuacuacaaaa

SEQ ID NO: 1452007 - RNA, 19 nt, Homo sapiens
uaugaggacuaacaaauuc

SEQ ID NO: 1452008 - RNA, 19 nt, Homo sapiens
ggaaggaacuacggcgaau

SEQ ID NO: 1452009 - RNA, 19 nt, Homo sapiens
gaacccuguugcaauauaa

SEQ ID NO: 1452010 - RNA, 19 nt, Homo sapiens
ucugaacccuguugcaaua

SEQ ID NO: 1452011 - RNA, 19 nt, Homo sapiens
ugaacccuguugcaauaua

SEQ ID NO: 1452012 - RNA, 19 nt, Homo sapiens
ggccagaugugcuucaaca

SEQ ID NO: 1452013 - RNA, 19 nt, Homo sapiens
ccaaagcgucuucgucuug

SEQ ID NO: 1452014 - RNA, 19 nt, Homo sapiens
gcaccgagcucagcaugcu

SEQ ID NO: 1452015 - RNA, 19 nt, Homo sapiens
gaagaacugccaggacauc

SEQ ID NO: 1452016 - RNA, 19 nt, Homo sapiens
guugcaauauaaagggauu

SEQ ID NO: 1452017 - RNA, 19 nt, Homo sapiens
gaacugccaggacaucaac

SEQ ID NO: 1452018 - RNA, 19 nt, Homo sapiens
gcccuucuacgcugcagua

SEQ ID NO: 1452019 - RNA, 19 nt, Homo sapiens
ggaggagagcaucgagugu

SEQ ID NO: 1452020 - RNA, 19 nt, Homo sapiens
ggaagaacugccaggacau

SEQ ID NO: 1452021 - RNA, 19 nt, Homo sapiens
ggagcggaauggacaaaau

SEQ ID NO: 1452022 - RNA, 19 nt, Homo sapiens
ccauggcccugagcagugu

SEQ ID NO: 1452023 - RNA, 19 nt, Homo sapiens
ccuggugcccuccugguuu

SEQ ID NO: 1452024 - RNA, 19 nt, Homo sapiens
gauaaugggucaccaauuu

SEQ ID NO: 1452025 - RNA, 19 nt, Homo sapiens
cuaaagaaguuacugcuua

SEQ ID NO: 1452026 - RNA, 19 nt, Homo sapiens
ggaagaaacaauugcauua

SEQ ID NO: 1452027 - RNA, 19 nt, Homo sapiens
ccaaagcccuagcaaauuu

SEQ ID NO: 1452028 - RNA, 19 nt, Homo sapiens
gcagcuggauaaagaguua

SEQ ID NO: 1452029 - RNA, 19 nt, Homo sapiens
gauaauaguucuucccaau

SEQ ID NO: 1452030 - RNA, 19 nt, Homo sapiens
ccucaaggcuuuauauuug

SEQ ID NO: 1452031 - RNA, 19 nt, Homo sapiens
gaagaaggcuauugcuaca

SEQ ID NO: 1452032 - RNA, 19 nt, Homo sapiens
gugaauaaguugaagauug

SEQ ID NO: 1452033 - RNA, 19 nt, Homo sapiens
caaauagcaucuuuacaga

SEQ ID NO: 1452034 - RNA, 19 nt, Homo sapiens
gagaaugacugcugaccaa

SEQ ID NO: 1452035 - RNA, 19 nt, Homo sapiens
ggaaauuaaucaggcuaua

SEQ ID NO: 1452036 - RNA, 19 nt, Homo sapiens
ccaccuaguuugcaaauug

SEQ ID NO: 1452037 - RNA, 19 nt, Homo sapiens
uggaaggacucaaagauaa

SEQ ID NO: 1452038 - RNA, 19 nt, Homo sapiens
gaccauacagguugcauua

SEQ ID NO: 1452039 - RNA, 19 nt, Homo sapiens
gauaugacaagggaaauua

SEQ ID NO: 1452040 - RNA, 19 nt, Homo sapiens
aagcaagacucauuuagaa

SEQ ID NO: 1452041 - RNA, 19 nt, Homo sapiens
ggaauuuacucaguuucua

SEQ ID NO: 1452042 - RNA, 19 nt, Homo sapiens
gaagcaagacucauuuaga

SEQ ID NO: 1452043 - RNA, 19 nt, Homo sapiens
auauuuggcugcuuucuua

SEQ ID NO: 1452044 - RNA, 19 nt, Homo sapiens
ugaaauuucuccaguccua

SEQ ID NO: 1452045 - RNA, 19 nt, Homo sapiens
gaaaauggaccaacaguuu

SEQ ID NO: 1452046 - RNA, 19 nt, Homo sapiens
caccuuaccucaauaucua

SEQ ID NO: 1452047 - RNA, 19 nt, Homo sapiens
gaaaguggcuucacauacc

SEQ ID NO: 1452048 - RNA, 19 nt, Homo sapiens
ccaugcagcuggauaaaga

SEQ ID NO: 1452049 - RNA, 19 nt, Homo sapiens
uaaaugcaguguucuuuca

SEQ ID NO: 1452050 - RNA, 19 nt, Homo sapiens
gcugaaccaucaauuauca

SEQ ID NO: 1452051 - RNA, 19 nt, Homo sapiens
ggacagcaccagacuauuc

SEQ ID NO: 1452052 - RNA, 19 nt, Homo sapiens
uaacugaaaugccaaaugc

SEQ ID NO: 1452053 - RNA, 19 nt, Homo sapiens
ccaagugucuuaagcuguu

SEQ ID NO: 1452054 - RNA, 19 nt, Homo sapiens
guagaaauguggcagaaag

SEQ ID NO: 1452055 - RNA, 19 nt, Homo sapiens
gaaggaucauuccaaagga

SEQ ID NO: 1452056 - RNA, 19 nt, Homo sapiens
gagcuuaauucccgagaug

SEQ ID NO: 1452057 - RNA, 19 nt, Homo sapiens
uaacuggcuucauguaaga

SEQ ID NO: 1452058 - RNA, 19 nt, Homo sapiens
ggagaaguaccacaucauu

SEQ ID NO: 1452059 - RNA, 19 nt, Homo sapiens
cgguagagcuugcaaguau

SEQ ID NO: 1452060 - RNA, 19 nt, Homo sapiens
gaacuaagaaagucaccaa

SEQ ID NO: 1452061 - RNA, 19 nt, Homo sapiens
cuacagugacucagauuua

SEQ ID NO: 1452062 - RNA, 19 nt, Homo sapiens
ggaacccucuggaacaaga

SEQ ID NO: 1452063 - RNA, 19 nt, Homo sapiens
gagaacaguuaugauguga

SEQ ID NO: 1452064 - RNA, 19 nt, Homo sapiens
uaagcugaaccaucaauua

SEQ ID NO: 1452065 - RNA, 19 nt, Homo sapiens
uaagggaauuuacucaguu

SEQ ID NO: 1452066 - RNA, 19 nt, Homo sapiens
uagcgucucuuacuacuau

SEQ ID NO: 1452067 - RNA, 19 nt, Homo sapiens
cauccugggucacugauaa

SEQ ID NO: 1452068 - RNA, 19 nt, Homo sapiens
gucauuaucagucucauua

SEQ ID NO: 1452069 - RNA, 19 nt, Homo sapiens
agaaguuacugcuuaaaga

SEQ ID NO: 1452070 - RNA, 19 nt, Homo sapiens
cuaagaaagucaccaagug

SEQ ID NO: 1452071 - RNA, 19 nt, Homo sapiens
ccaaugagcaacaguuuga

SEQ ID NO: 1452072 - RNA, 19 nt, Homo sapiens
cuaaagauccagauaguau

SEQ ID NO: 1452073 - RNA, 19 nt, Homo sapiens
ggugaugacauuugccuua

SEQ ID NO: 1452074 - RNA, 19 nt, Homo sapiens
ggcauuuacuucuacaauu

SEQ ID NO: 1452075 - RNA, 19 nt, Homo sapiens
gaaguugaccauacagguu

SEQ ID NO: 1452076 - RNA, 19 nt, Homo sapiens
ccaaaucugccacuccaua

SEQ ID NO: 1452077 - RNA, 19 nt, Homo sapiens
uaacuccucuccgcaauau

SEQ ID NO: 1452078 - RNA, 19 nt, Homo sapiens
ccaaauagcaucuuuacag

SEQ ID NO: 1452079 - RNA, 19 nt, Homo sapiens
ggccaaagcccuagcaaau

SEQ ID NO: 1452080 - RNA, 19 nt, Homo sapiens
gguguagcgucucuuacua

SEQ ID NO: 1452081 - RNA, 19 nt, Homo sapiens
cuaaacuaguuccuuguaa

SEQ ID NO: 1452082 - RNA, 19 nt, Homo sapiens
gcgagcagaugccgcagaa

SEQ ID NO: 1452083 - RNA, 19 nt, Homo sapiens
gggcaaagcgacccaauuc

SEQ ID NO: 1452084 - RNA, 19 nt, Homo sapiens
caggaaguguggaaaguug

SEQ ID NO: 1452085 - RNA, 19 nt, Homo sapiens
caacacaccaagccuuauu

SEQ ID NO: 1452086 - RNA, 19 nt, Homo sapiens
uaaauuuggugccacuuuc

SEQ ID NO: 1452087 - RNA, 19 nt, Homo sapiens
cauaagccauuguuacauc

SEQ ID NO: 1452088 - RNA, 19 nt, Homo sapiens
gaacaggccagugaugaug

SEQ ID NO: 1452089 - RNA, 19 nt, Homo sapiens
gcaagacucauuuagaaca

SEQ ID NO: 1452090 - RNA, 19 nt, Homo sapiens
gcauuacagucugaauuga

SEQ ID NO: 1452091 - RNA, 19 nt, Homo sapiens
gcugucaccuuaccucaau

SEQ ID NO: 1452092 - RNA, 19 nt, Homo sapiens
cugggucacugauaauaua

SEQ ID NO: 1452093 - RNA, 19 nt, Homo sapiens
gaauugacuucuagcacau

SEQ ID NO: 1452094 - RNA, 19 nt, Homo sapiens
caagacucauuuagaacaa

SEQ ID NO: 1452095 - RNA, 19 nt, Homo sapiens
cuuguaagcugaaccauca

SEQ ID NO: 1452096 - RNA, 19 nt, Homo sapiens
cagaggguuucaaagcaua

SEQ ID NO: 1452097 - RNA, 19 nt, Homo sapiens
caacugaaggagccuguaa

SEQ ID NO: 1452098 - RNA, 19 nt, Homo sapiens
aaaggaagguagaaaugug

SEQ ID NO: 1452099 - RNA, 19 nt, Homo sapiens
ucacccagcuuugcaaaug

SEQ ID NO: 1452100 - RNA, 19 nt, Homo sapiens
gucaucugcuucaugguua

SEQ ID NO: 1452101 - RNA, 19 nt, Homo sapiens
gggaagcaagacucauuua

SEQ ID NO: 1452102 - RNA, 19 nt, Homo sapiens
gcagcacacuuucuuucug

SEQ ID NO: 1452103 - RNA, 19 nt, Homo sapiens
gagaacaggccagugauga

SEQ ID NO: 1452104 - RNA, 19 nt, Homo sapiens
uaaacuaguuccuuguaag

SEQ ID NO: 1452105 - RNA, 19 nt, Homo sapiens
ccacagaugaacuaagaaa

SEQ ID NO: 1452106 - RNA, 19 nt, Homo sapiens
agaauggucguccguauuu

SEQ ID NO: 1452107 - RNA, 19 nt, Homo sapiens
gagaauggucguccguauu

SEQ ID NO: 1452108 - RNA, 19 nt, Homo sapiens
gcagacaauucccguggau

SEQ ID NO: 1452109 - RNA, 19 nt, Homo sapiens
agaaguaccacaucauuga

SEQ ID NO: 1452110 - RNA, 19 nt, Homo sapiens
gagaaguaccacaucauug

SEQ ID NO: 1452111 - RNA, 19 nt, Homo sapiens
gggaagaaacaauugcauu

SEQ ID NO: 1452112 - RNA, 19 nt, Homo sapiens
ccacagagaggauaauagu

SEQ ID NO: 1452113 - RNA, 19 nt, Homo sapiens
uaguaucucuguucauaug

SEQ ID NO: 1452114 - RNA, 19 nt, Homo sapiens
ccauuaaggcauucacuaa

SEQ ID NO: 1452115 - RNA, 19 nt, Homo sapiens
agauggagcuugggaaaga

SEQ ID NO: 1452116 - RNA, 19 nt, Homo sapiens
uacagugacucagauuuaa

SEQ ID NO: 1452117 - RNA, 19 nt, Homo sapiens
uuaauagccuguuacuuag

SEQ ID NO: 1452118 - RNA, 19 nt, Homo sapiens
acaagaaaguggcuucaca

SEQ ID NO: 1452119 - RNA, 19 nt, Homo sapiens
gcccaucccugaaaugucu

SEQ ID NO: 1452120 - RNA, 19 nt, Homo sapiens
gcuuaaagacggaauuuca

SEQ ID NO: 1452121 - RNA, 19 nt, Homo sapiens
caacaccaaaguacacaaa

SEQ ID NO: 1452122 - RNA, 19 nt, Homo sapiens
aaccaucaauuaucaguug

SEQ ID NO: 1452123 - RNA, 19 nt, Homo sapiens
gagccaaauagcaucuuua

SEQ ID NO: 1452124 - RNA, 19 nt, Homo sapiens
ggacugcugugaagaauga

SEQ ID NO: 1452125 - RNA, 19 nt, Homo sapiens
ggaagggacugcugugaag

SEQ ID NO: 1452126 - RNA, 19 nt, Homo sapiens
ccggaaagcuggcucugua

SEQ ID NO: 1452127 - RNA, 19 nt, Homo sapiens
guucugcauugcuaaauaa

SEQ ID NO: 1452128 - RNA, 19 nt, Homo sapiens
ugaacugccuucugaaaga

SEQ ID NO: 1452129 - RNA, 19 nt, Homo sapiens
cauuugaacugccuucuga

SEQ ID NO: 1452130 - RNA, 19 nt, Homo sapiens
gguccgagauggcagcaaa

SEQ ID NO: 1452131 - RNA, 19 nt, Homo sapiens
caagcaggauggagcacua

SEQ ID NO: 1452132 - RNA, 19 nt, Homo sapiens
gccaaguucugcauugcua

SEQ ID NO: 1452133 - RNA, 19 nt, Homo sapiens
ggaccucccuaucaugcuu

SEQ ID NO: 1452134 - RNA, 19 nt, Homo sapiens
gaacugccuucugaaagag

SEQ ID NO: 1452135 - RNA, 19 nt, Homo sapiens
ggaaagcuggcucuguaga

SEQ ID NO: 1452136 - RNA, 19 nt, Homo sapiens
cauguaguguucucagguu

SEQ ID NO: 1452137 - RNA, 19 nt, Homo sapiens
cggcagugcucggcaugua

SEQ ID NO: 1452138 - RNA, 19 nt, Homo sapiens
aaaguggaccucccuauca

SEQ ID NO: 1452139 - RNA, 19 nt, Homo sapiens
gggaagggacugcugugaa

SEQ ID NO: 1452140 - RNA, 19 nt, Homo sapiens
aagcuacguuuccuucaga

SEQ ID NO: 1452141 - RNA, 19 nt, Homo sapiens
cagcgagagucacagacaa

SEQ ID NO: 1452142 - RNA, 19 nt, Homo sapiens
gagagucacagacaagaca

SEQ ID NO: 1452143 - RNA, 19 nt, Homo sapiens
cgagacacccgaucgugaa

SEQ ID NO: 1452144 - RNA, 19 nt, Homo sapiens
uaccuacagugcauuugaa

SEQ ID NO: 1452145 - RNA, 19 nt, Homo sapiens
ugugaagaaugacagaugu

SEQ ID NO: 1452146 - RNA, 19 nt, Homo sapiens
cgaagaagggcucgagaca

SEQ ID NO: 1452147 - RNA, 19 nt, Homo sapiens
gagaugcggguccgagaug

SEQ ID NO: 1452148 - RNA, 19 nt, Homo sapiens
caaguucugcauugcuaaa

SEQ ID NO: 1452149 - RNA, 19 nt, Homo sapiens
caagcuacguuuccuucag

SEQ ID NO: 1452150 - RNA, 19 nt, Homo sapiens
gauggagcacuaccggaaa

SEQ ID NO: 1452151 - RNA, 19 nt, Homo sapiens
gcagcgagagucacagaca

SEQ ID NO: 1452152 - RNA, 19 nt, Homo sapiens
ggcccucguucccgaagaa

SEQ ID NO: 1452153 - RNA, 19 nt, Homo sapiens
aguucugcauugcuaaaua

SEQ ID NO: 1452154 - RNA, 19 nt, Homo sapiens
gaagggacugcugugaaga

SEQ ID NO: 1452155 - RNA, 19 nt, Homo sapiens
ccagggagggauuuaggaa

SEQ ID NO: 1452156 - RNA, 19 nt, Homo sapiens
cuaccuacagugcauuuga

SEQ ID NO: 1452157 - RNA, 19 nt, Homo sapiens
gggcagcgagagucacaga

SEQ ID NO: 1452158 - RNA, 19 nt, Homo sapiens
caacauccccaucaagguu

SEQ ID NO: 1452159 - RNA, 19 nt, Homo sapiens
gcagugcucggcauguagu

SEQ ID NO: 1452160 - RNA, 19 nt, Homo sapiens
cgagauggcagcaaaauuc

SEQ ID NO: 1452161 - RNA, 19 nt, Homo sapiens
guaguguucucagguucug

SEQ ID NO: 1452162 - RNA, 19 nt, Homo sapiens
gggcuuccucugccuucua

SEQ ID NO: 1452163 - RNA, 19 nt, Homo sapiens
caucuuggcuccggaucgu

SEQ ID NO: 1452164 - RNA, 19 nt, Homo sapiens
cagggagggauuuaggaaa

SEQ ID NO: 1452165 - RNA, 19 nt, Homo sapiens
ccagcuaccuccugauacc

SEQ ID NO: 1452166 - RNA, 19 nt, Homo sapiens
gcauuugaacugccuucug

SEQ ID NO: 1452167 - RNA, 19 nt, Homo sapiens
gcgagagucacagacaaga

SEQ ID NO: 1452168 - RNA, 19 nt, Homo sapiens
ucugccaaguucugcauug

SEQ ID NO: 1452169 - RNA, 19 nt, Homo sapiens
ggacugcugugaagaauga

SEQ ID NO: 1452170 - RNA, 19 nt, Homo sapiens
ggaagggacugcugugaag

SEQ ID NO: 1452171 - RNA, 19 nt, Homo sapiens
ccggaaagcuggcucugua

SEQ ID NO: 1452172 - RNA, 19 nt, Homo sapiens
ugagugaccuggguugaua

SEQ ID NO: 1452173 - RNA, 19 nt, Homo sapiens
guucugcauugcuaaauaa

SEQ ID NO: 1452174 - RNA, 19 nt, Homo sapiens
ugaacugccuucugaaaga

SEQ ID NO: 1452175 - RNA, 19 nt, Homo sapiens
cauuugaacugccuucuga

SEQ ID NO: 1452176 - RNA, 19 nt, Homo sapiens
gguccgagauggcagcaaa

SEQ ID NO: 1452177 - RNA, 19 nt, Homo sapiens
ugauauagauugaccuugu

SEQ ID NO: 1452178 - RNA, 19 nt, Homo sapiens
caagcaggauggagcacua

SEQ ID NO: 1452179 - RNA, 19 nt, Homo sapiens
gccaaguucugcauugcua

SEQ ID NO: 1452180 - RNA, 19 nt, Homo sapiens
ggaccucccuaucaugcuu

SEQ ID NO: 1452181 - RNA, 19 nt, Homo sapiens
gauauagauugaccuugug

SEQ ID NO: 1452182 - RNA, 19 nt, Homo sapiens
ugaccuggguugauauaga

SEQ ID NO: 1452183 - RNA, 19 nt, Homo sapiens
gaagagaccguggcuaugg

SEQ ID NO: 1452184 - RNA, 19 nt, Homo sapiens
gaccuggguugauauagau

SEQ ID NO: 1452185 - RNA, 19 nt, Homo sapiens
gaacugccuucugaaagag

SEQ ID NO: 1452186 - RNA, 19 nt, Homo sapiens
ggaaagcuggcucuguaga

SEQ ID NO: 1452187 - RNA, 19 nt, Homo sapiens
cauguaguguucucagguu

SEQ ID NO: 1452188 - RNA, 19 nt, Homo sapiens
cggcagugcucggcaugua

SEQ ID NO: 1452189 - RNA, 19 nt, Homo sapiens
aaaguggaccucccuauca

SEQ ID NO: 1452190 - RNA, 19 nt, Homo sapiens
gggaagggacugcugugaa

SEQ ID NO: 1452191 - RNA, 19 nt, Homo sapiens
aagcuacguuuccuucaga

SEQ ID NO: 1452192 - RNA, 19 nt, Homo sapiens
cagcgagagucacagacaa

SEQ ID NO: 1452193 - RNA, 19 nt, Homo sapiens
ggaagagaccguggcuaug

SEQ ID NO: 1452194 - RNA, 19 nt, Homo sapiens
cgagacacccgaucgugaa

SEQ ID NO: 1452195 - RNA, 19 nt, Homo sapiens
gagagucacagacaagaca

SEQ ID NO: 1452196 - RNA, 19 nt, Homo sapiens
uaccuacagugcauuugaa

SEQ ID NO: 1452197 - RNA, 19 nt, Homo sapiens
ggcaagacccuggaagaga

SEQ ID NO: 1452198 - RNA, 19 nt, Homo sapiens
ugugaagaaugacagaugu

SEQ ID NO: 1452199 - RNA, 19 nt, Homo sapiens
cgaagaagggcucgagaca

SEQ ID NO: 1452200 - RNA, 19 nt, Homo sapiens
gagaugcggguccgagaug

SEQ ID NO: 1452201 - RNA, 19 nt, Homo sapiens
uggaagagaccguggcuau

SEQ ID NO: 1452202 - RNA, 19 nt, Homo sapiens
caaguucugcauugcuaaa

SEQ ID NO: 1452203 - RNA, 19 nt, Homo sapiens
caagcuacguuuccuucag

SEQ ID NO: 1452204 - RNA, 19 nt, Homo sapiens
gauggagcacuaccggaaa

SEQ ID NO: 1452205 - RNA, 19 nt, Homo sapiens
ggcccucguucccgaagaa

SEQ ID NO: 1452206 - RNA, 19 nt, Homo sapiens
gcagcgagagucacagaca

SEQ ID NO: 1452207 - RNA, 19 nt, Homo sapiens
aguucugcauugcuaaaua

SEQ ID NO: 1452208 - RNA, 19 nt, Homo sapiens
gaagggacugcugugaaga

SEQ ID NO: 1452209 - RNA, 19 nt, Homo sapiens
ugaggcggcuucggugaga

SEQ ID NO: 1452210 - RNA, 19 nt, Homo sapiens
ccagggagggauuuaggaa

SEQ ID NO: 1452211 - RNA, 19 nt, Homo sapiens
cuaccuacagugcauuuga

SEQ ID NO: 1452212 - RNA, 19 nt, Homo sapiens
gggcagcgagagucacaga

SEQ ID NO: 1452213 - RNA, 19 nt, Homo sapiens
aagagaccguggcuaugga

SEQ ID NO: 1452214 - RNA, 19 nt, Homo sapiens
caacauccccaucaagguu

SEQ ID NO: 1452215 - RNA, 19 nt, Homo sapiens
gcagugcucggcauguagu

SEQ ID NO: 1452216 - RNA, 19 nt, Homo sapiens
cgagauggcagcaaaauuc

SEQ ID NO: 1452217 - RNA, 19 nt, Homo sapiens
guaguguucucagguucug

SEQ ID NO: 1452218 - RNA, 19 nt, Homo sapiens
gggcuuccucugccuucua

SEQ ID NO: 1452219 - RNA, 19 nt, Homo sapiens
caucuuggcuccggaucgu

SEQ ID NO: 1452220 - RNA, 19 nt, Homo sapiens
gaccguggcuauggaaacg

SEQ ID NO: 1452221 - RNA, 19 nt, Homo sapiens
cagggagggauuuaggaaa

SEQ ID NO: 1452222 - RNA, 19 nt, Homo sapiens
gcauuugaacugccuucug

SEQ ID NO: 1452223 - RNA, 19 nt, Homo sapiens
gcgagagucacagacaaga

SEQ ID NO: 1452224 - RNA, 19 nt, Homo sapiens
ucugccaaguucugcauug

SEQ ID NO: 1452225 - RNA, 19 nt, Homo sapiens
ccagcuaccuccugauacc

SEQ ID NO: 1452226 - RNA, 19 nt, Homo sapiens
ugaaagaacugaaauguga

SEQ ID NO: 1452227 - RNA, 19 nt, Homo sapiens
gaacaugccauauaacauu

SEQ ID NO: 1452228 - RNA, 19 nt, Homo sapiens
ccaaacaucuuuacacaga

SEQ ID NO: 1452229 - RNA, 19 nt, Homo sapiens
gagacucuauccugaaaua

SEQ ID NO: 1452230 - RNA, 19 nt, Homo sapiens
ucagucagauugugucuua

SEQ ID NO: 1452231 - RNA, 19 nt, Homo sapiens
caagaucucuggaaucguu

SEQ ID NO: 1452232 - RNA, 19 nt, Homo sapiens
gaacgaggagccuucaaua

SEQ ID NO: 1452233 - RNA, 19 nt, Homo sapiens
caagaugugucaaguagaa

SEQ ID NO: 1452234 - RNA, 19 nt, Homo sapiens
ggacuguacuugugacuug

SEQ ID NO: 1452235 - RNA, 19 nt, Homo sapiens
cuaaagagccugccuguuu

SEQ ID NO: 1452236 - RNA, 19 nt, Homo sapiens
gaacuguagcugugauuua

SEQ ID NO: 1452237 - RNA, 19 nt, Homo sapiens
gcacguagauuaaguuggu

SEQ ID NO: 1452238 - RNA, 19 nt, Homo sapiens
caacaaauccuuccaagau

SEQ ID NO: 1452239 - RNA, 19 nt, Homo sapiens
ucaauaagcuccacaaacu

SEQ ID NO: 1452240 - RNA, 19 nt, Homo sapiens
ggacuggauuugcuucauu

SEQ ID NO: 1452241 - RNA, 19 nt, Homo sapiens
cgaagaagcugcacgucaa

SEQ ID NO: 1452242 - RNA, 19 nt, Homo sapiens
aaacacacccuucagauuu

SEQ ID NO: 1452243 - RNA, 19 nt, Homo sapiens
gaacugaagucccucaaaa

SEQ ID NO: 1452244 - RNA, 19 nt, Homo sapiens
gagauccgcuauccagaaa

SEQ ID NO: 1452245 - RNA, 19 nt, Homo sapiens
ggacagaaaguuguuauga

SEQ ID NO: 1452246 - RNA, 19 nt, Homo sapiens
uggagaacaugccauauaa

SEQ ID NO: 1452247 - RNA, 19 nt, Homo sapiens
gaacugauaccgaaaccuu

SEQ ID NO: 1452248 - RNA, 19 nt, Homo sapiens
gcauagagaacuuggagua

SEQ ID NO: 1452249 - RNA, 19 nt, Homo sapiens
cgacaaggagaaagauuua

SEQ ID NO: 1452250 - RNA, 19 nt, Homo sapiens
gaagauaacccuuggaacu

SEQ ID NO: 1452251 - RNA, 19 nt, Homo sapiens
ggaagagacugagcacaau

SEQ ID NO: 1452252 - RNA, 19 nt, Homo sapiens
aaaggaagagugaguauuu

SEQ ID NO: 1452253 - RNA, 19 nt, Homo sapiens
acagaaaguuguuaugaga

SEQ ID NO: 1452254 - RNA, 19 nt, Homo sapiens
ugagacgccuguucaguuu

SEQ ID NO: 1452255 - RNA, 19 nt, Homo sapiens
acaauaaucuccuaaagag

SEQ ID NO: 1452256 - RNA, 19 nt, Homo sapiens
uccagaagcucccuuauau

SEQ ID NO: 1452257 - RNA, 19 nt, Homo sapiens
uaaagcaguugcacuugaa

SEQ ID NO: 1452258 - RNA, 19 nt, Homo sapiens
uugaugagcuggaugaauu

SEQ ID NO: 1452259 - RNA, 19 nt, Homo sapiens
gaacaaaggaagagugagu

SEQ ID NO: 1452260 - RNA, 19 nt, Homo sapiens
gugagaagguuucagucua

SEQ ID NO: 1452261 - RNA, 19 nt, Homo sapiens
gagcacagaagcuuucauu

SEQ ID NO: 1452262 - RNA, 19 nt, Homo sapiens
uaacgguguuuguugcuuu

SEQ ID NO: 1452263 - RNA, 19 nt, Homo sapiens
gaucaguugcaaucucuua

SEQ ID NO: 1452264 - RNA, 19 nt, Homo sapiens
gaacaacaaauucauguac

SEQ ID NO: 1452265 - RNA, 19 nt, Homo sapiens
gauugugucuuaccaaaca

SEQ ID NO: 1452266 - RNA, 19 nt, Homo sapiens
caacuccguguaaagauua

SEQ ID NO: 1452267 - RNA, 19 nt, Homo sapiens
gggaugcuuuauacacaua

SEQ ID NO: 1452268 - RNA, 19 nt, Homo sapiens
caagaucuaggucauguaa

SEQ ID NO: 1452269 - RNA, 19 nt, Homo sapiens
ggagacguauuucacaauc

SEQ ID NO: 1452270 - RNA, 19 nt, Homo sapiens
gauuaagggagacguauuu

SEQ ID NO: 1452271 - RNA, 19 nt, Homo sapiens
gaagcuaucugugaaacuc

SEQ ID NO: 1452272 - RNA, 19 nt, Homo sapiens
gauaacccuuggaacugua

SEQ ID NO: 1452273 - RNA, 19 nt, Homo sapiens
uaacaacuccguguaaaga

SEQ ID NO: 1452274 - RNA, 19 nt, Homo sapiens
guaaagcaaacucaagaaa

SEQ ID NO: 1452275 - RNA, 19 nt, Homo sapiens
gucuaugucugaacugaua

SEQ ID NO: 1452276 - RNA, 19 nt, Homo sapiens
gaggagcucuguccggaau

SEQ ID NO: 1452277 - RNA, 19 nt, Homo sapiens
aaacagcuuugaacaagau

SEQ ID NO: 1452278 - RNA, 19 nt, Homo sapiens
gaaauguggccgacaagga

SEQ ID NO: 1452279 - RNA, 19 nt, Homo sapiens
uuacacagauugacuugga

SEQ ID NO: 1452280 - RNA, 19 nt, Homo sapiens
ugacauaucgguggaaauu

SEQ ID NO: 1452281 - RNA, 19 nt, Homo sapiens
uuccaagggugucucauua

SEQ ID NO: 1452282 - RNA, 19 nt, Homo sapiens
ccaauguguuuauucagaa

SEQ ID NO: 1452283 - RNA, 19 nt, Homo sapiens
cgacgggauuguugugaaa

SEQ ID NO: 1452284 - RNA, 19 nt, Homo sapiens
gagaacaugccauauaaca

SEQ ID NO: 1452285 - RNA, 19 nt, Homo sapiens
acauaucgguggaaauuug

SEQ ID NO: 1452286 - RNA, 19 nt, Homo sapiens
ugagaaauguggccgacaa

SEQ ID NO: 1452287 - RNA, 19 nt, Homo sapiens
gacuggauuugcuucauuu

SEQ ID NO: 1452288 - RNA, 19 nt, Homo sapiens
cagauugugucuuaccaaa

SEQ ID NO: 1452289 - RNA, 19 nt, Homo sapiens
uuaaagcaguugcacuuga

SEQ ID NO: 1452290 - RNA, 19 nt, Homo sapiens
ggaauaauaaacugcagaa

SEQ ID NO: 1452291 - RNA, 19 nt, Homo sapiens
ucuaggucauguaaucuua

SEQ ID NO: 1452292 - RNA, 19 nt, Homo sapiens
gaagagacugagcacaauu

SEQ ID NO: 1452293 - RNA, 19 nt, Homo sapiens
ggaacaacaaauucaugua

SEQ ID NO: 1452294 - RNA, 19 nt, Homo sapiens
gagccugccuguuuacauc

SEQ ID NO: 1452295 - RNA, 19 nt, Homo sapiens
gagaaugugcucuauguca

SEQ ID NO: 1452296 - RNA, 19 nt, Homo sapiens
aaucuuaugucccaaacuu

SEQ ID NO: 1452297 - RNA, 19 nt, Homo sapiens
uuaggcagcaaucaaauua

SEQ ID NO: 1452298 - RNA, 19 nt, Homo sapiens
gaauugcaacuggaagaua

SEQ ID NO: 1452299 - RNA, 19 nt, Homo sapiens
ucaagaggcaaaucuguuu

SEQ ID NO: 1452300 - RNA, 19 nt, Homo sapiens
gacagaaaguuguuaugag

SEQ ID NO: 1452301 - RNA, 19 nt, Homo sapiens
gaauccagaagcucccuua

SEQ ID NO: 1452302 - RNA, 19 nt, Homo sapiens
uuucauuccuuccugauaa

SEQ ID NO: 1452303 - RNA, 19 nt, Homo sapiens
ggaaucacauagauaccau

SEQ ID NO: 1452304 - RNA, 19 nt, Homo sapiens
uagcagggauuccaaugug

SEQ ID NO: 1452305 - RNA, 19 nt, Homo sapiens
ggacugagcacagaagcuu

SEQ ID NO: 1452306 - RNA, 19 nt, Homo sapiens
gaaguugagcgacgggauu

SEQ ID NO: 1452307 - RNA, 19 nt, Homo sapiens
caacaaacaagagcuaugu

SEQ ID NO: 1452308 - RNA, 19 nt, Homo sapiens
aauugcaacuggaagauaa

SEQ ID NO: 1452309 - RNA, 19 nt, Homo sapiens
gaacaagaucuaggucaug

SEQ ID NO: 1452310 - RNA, 19 nt, Homo sapiens
agacugagcacaauugaug

SEQ ID NO: 1452311 - RNA, 19 nt, Homo sapiens
uaaggaagcaugaccacaa

SEQ ID NO: 1452312 - RNA, 19 nt, Homo sapiens
acgcugggcucuagagauu

SEQ ID NO: 1452313 - RNA, 19 nt, Homo sapiens
gcugggcucuagagauuau

SEQ ID NO: 1452314 - RNA, 19 nt, Homo sapiens
caggcugacuacaauuuaa

SEQ ID NO: 1452315 - RNA, 19 nt, Homo sapiens
gcacuugaacaacaaugaa

SEQ ID NO: 1452316 - RNA, 19 nt, Homo sapiens
gcaaaaccuucgucccuuu

SEQ ID NO: 1452317 - RNA, 19 nt, Homo sapiens
caaacucuauugccaaagg

SEQ ID NO: 1452318 - RNA, 19 nt, Homo sapiens
cacagaagcuuucauucca

SEQ ID NO: 1452319 - RNA, 19 nt, Homo sapiens
gauauacgagggaacagaa

SEQ ID NO: 1452320 - RNA, 19 nt, Homo sapiens
aguaagaagucacugauag

SEQ ID NO: 1452321 - RNA, 19 nt, Homo sapiens
gaaaucuuaugucccaaac

SEQ ID NO: 1452322 - RNA, 19 nt, Homo sapiens
caaauuacagugauuaagg

SEQ ID NO: 1452323 - RNA, 19 nt, Homo sapiens
ggauucagcgcguguaugu

SEQ ID NO: 1452324 - RNA, 19 nt, Homo sapiens
gaagguuucagucuacaga

SEQ ID NO: 1452325 - RNA, 19 nt, Homo sapiens
guggaaauuugcaaugugu

SEQ ID NO: 1452326 - RNA, 19 nt, Homo sapiens
guacauggaugcuuugaaa

SEQ ID NO: 1452327 - RNA, 19 nt, Homo sapiens
gagcagagaugcagaugaa

SEQ ID NO: 1452328 - RNA, 19 nt, Homo sapiens
ugaaggaccugaagcauuu

SEQ ID NO: 1452329 - RNA, 19 nt, Homo sapiens
cauuagaccucaccuauga

SEQ ID NO: 1452330 - RNA, 19 nt, Homo sapiens
caagaacugucuccugauu

SEQ ID NO: 1452331 - RNA, 19 nt, Homo sapiens
caacuucuguccugaguga

SEQ ID NO: 1452332 - RNA, 19 nt, Homo sapiens
gaaagcccgugaguucaua

SEQ ID NO: 1452333 - RNA, 19 nt, Homo sapiens
ggagggcaguuucaguuaa

SEQ ID NO: 1452334 - RNA, 19 nt, Homo sapiens
gcauugcccugacugauau

SEQ ID NO: 1452335 - RNA, 19 nt, Homo sapiens
caaccacuccuauuucuuu

SEQ ID NO: 1452336 - RNA, 19 nt, Homo sapiens
cgacugucaucaagaagua

SEQ ID NO: 1452337 - RNA, 19 nt, Homo sapiens
caaaagagccugucacaaa

SEQ ID NO: 1452338 - RNA, 19 nt, Homo sapiens
gagggaagccugauugaug

SEQ ID NO: 1452339 - RNA, 19 nt, Homo sapiens
gcaauagggcccauucaga

SEQ ID NO: 1452340 - RNA, 19 nt, Homo sapiens
gggaagugcugaaugcaau

SEQ ID NO: 1452341 - RNA, 19 nt, Homo sapiens
uaucaucccuagugccuuu

SEQ ID NO: 1452342 - RNA, 19 nt, Homo sapiens
uauccaagcuauccaguau

SEQ ID NO: 1452343 - RNA, 19 nt, Homo sapiens
ccagaguccuccugagauu

SEQ ID NO: 1452344 - RNA, 19 nt, Homo sapiens
ccauuucuaugucuuugua

SEQ ID NO: 1452345 - RNA, 19 nt, Homo sapiens
gaagaagggaggagaagau

SEQ ID NO: 1452346 - RNA, 19 nt, Homo sapiens
acagugaccuuccaacaug

SEQ ID NO: 1452347 - RNA, 19 nt, Homo sapiens
gcgagcccuuguucacuua

SEQ ID NO: 1452348 - RNA, 19 nt, Homo sapiens
ccacagauaaggacuauuc

SEQ ID NO: 1452349 - RNA, 19 nt, Homo sapiens
ggacuauucugccuuucau

SEQ ID NO: 1452350 - RNA, 19 nt, Homo sapiens
gcauuucccugacagaagu

SEQ ID NO: 1452351 - RNA, 19 nt, Homo sapiens
agacagagcccaggccaua

SEQ ID NO: 1452352 - RNA, 19 nt, Homo sapiens
ugagugugaucuucauaaa

SEQ ID NO: 1452353 - RNA, 19 nt, Homo sapiens
ccacuccuauuucuuugaa

SEQ ID NO: 1452354 - RNA, 19 nt, Homo sapiens
caagaaguauaaggacuau

SEQ ID NO: 1452355 - RNA, 19 nt, Homo sapiens
gcaguuucuucuccucaaa

SEQ ID NO: 1452356 - RNA, 19 nt, Homo sapiens
ccuaugaucuucaggaaag

SEQ ID NO: 1452357 - RNA, 19 nt, Homo sapiens
gcagagaugcagaugaaug

SEQ ID NO: 1452358 - RNA, 19 nt, Homo sapiens
gcaguuucuucuccucaaa

SEQ ID NO: 1452359 - RNA, 19 nt, Homo sapiens
gaugccaccuucagugaug

SEQ ID NO: 1452360 - RNA, 19 nt, Homo sapiens
caggaaagcccgugaguuc

SEQ ID NO: 1452361 - RNA, 19 nt, Homo sapiens
gacaaccacuccuauuucu

SEQ ID NO: 1452362 - RNA, 19 nt, Homo sapiens
gaggagggcaguuucaguu

SEQ ID NO: 1452363 - RNA, 19 nt, Homo sapiens
gugaauccuugcccaggua

SEQ ID NO: 1452364 - RNA, 19 nt, Homo sapiens
gaggagaagaugaggauau

SEQ ID NO: 1452365 - RNA, 19 nt, Homo sapiens
cagagaugcugacgacugu

SEQ ID NO: 1452366 - RNA, 19 nt, Homo sapiens
gaugugcuuucccgacuug

SEQ ID NO: 1452367 - RNA, 19 nt, Homo sapiens
gagcccuuguucacuuaua

SEQ ID NO: 1452368 - RNA, 19 nt, Homo sapiens
ccugguacauggaugcuuu

SEQ ID NO: 1452369 - RNA, 19 nt, Homo sapiens
gaagaggaggauacagcua

SEQ ID NO: 1452370 - RNA, 19 nt, Homo sapiens
ggacagugaccuuccaaca

SEQ ID NO: 1452371 - RNA, 19 nt, Homo sapiens
gcgaauggauagucuuguc

SEQ ID NO: 1452372 - RNA, 19 nt, Homo sapiens
gagcccaggccauaauuga

SEQ ID NO: 1452373 - RNA, 19 nt, Homo sapiens
ggaaguguugagugcaaua

SEQ ID NO: 1452374 - RNA, 19 nt, Homo sapiens
ggaagugcugaaugcaaua

SEQ ID NO: 1452375 - RNA, 19 nt, Homo sapiens
guuuacaacuuucugacuu

SEQ ID NO: 1452376 - RNA, 19 nt, Homo sapiens
uaauugacaccacagauga

SEQ ID NO: 1452377 - RNA, 19 nt, Homo sapiens
gaggucaucugggaagugu

SEQ ID NO: 1452378 - RNA, 19 nt, Homo sapiens
agggaagccugauugauga

SEQ ID NO: 1452379 - RNA, 19 nt, Homo sapiens
cgacaaccacuccuauuuc

SEQ ID NO: 1452380 - RNA, 19 nt, Homo sapiens
ucaagaaguauaaggacua

SEQ ID NO: 1452381 - RNA, 19 nt, Homo sapiens
gaacuucagaucagcgaau

SEQ ID NO: 1452382 - RNA, 19 nt, Homo sapiens
ucagaucagcgaauggaua

SEQ ID NO: 1452383 - RNA, 19 nt, Homo sapiens
ucacuuauacacuggauga

SEQ ID NO: 1452384 - RNA, 19 nt, Homo sapiens
ggcacaggcuacacccuuu

SEQ ID NO: 1452385 - RNA, 19 nt, Homo sapiens
cgggaaagcccaugaguuc

SEQ ID NO: 1452386 - RNA, 19 nt, Homo sapiens
gaagggaggagaagaugag

SEQ ID NO: 1452387 - RNA, 19 nt, Homo sapiens
ggaaagcccgugaguucau

SEQ ID NO: 1452388 - RNA, 19 nt, Homo sapiens
ccucaaauaucaagcaaaa

SEQ ID NO: 1452389 - RNA, 19 nt, Homo sapiens
ggacaaguuggugcaguuu

SEQ ID NO: 1452390 - RNA, 19 nt, Homo sapiens
gagggcaguuucaguuaag

SEQ ID NO: 1452391 - RNA, 19 nt, Homo sapiens
gguaugcccuggaugaaaa

SEQ ID NO: 1452392 - RNA, 19 nt, Homo sapiens
gcccgugaguucauagaga

SEQ ID NO: 1452393 - RNA, 19 nt, Homo sapiens
gaggggaaguuuucucuga

SEQ ID NO: 1452394 - RNA, 19 nt, Homo sapiens
ccgacaaccacuccuauuu

SEQ ID NO: 1452395 - RNA, 19 nt, Homo sapiens
gaccauuucuaugucuuug

SEQ ID NO: 1452396 - RNA, 19 nt, Homo sapiens
ggccacagauaaggacuau

SEQ ID NO: 1452397 - RNA, 19 nt, Homo sapiens
cagaaccgccuccugauuc

SEQ ID NO: 1452398 - RNA, 19 nt, Homo sapiens
gaaagauauggaagacaga

SEQ ID NO: 1452399 - RNA, 19 nt, Homo sapiens
ggucaucugggaaguguug

SEQ ID NO: 1452400 - RNA, 19 nt, Homo sapiens
uggcugaguuggugcaguu

SEQ ID NO: 1452401 - RNA, 19 nt, Homo sapiens
uccaagcuauccaguauca

SEQ ID NO: 1452402 - RNA, 19 nt, Homo sapiens
ccagaaccgccuccugauu

SEQ ID NO: 1452403 - RNA, 19 nt, Homo sapiens
gggcuacuuuccuaugauc

SEQ ID NO: 1452404 - RNA, 19 nt, Homo sapiens
cacauuagaccucaccuau

SEQ ID NO: 1452405 - RNA, 19 nt, Homo sapiens
uauucugccuuucaucuug

SEQ ID NO: 1452406 - RNA, 19 nt, Homo sapiens
gagaugcagaugaauguca

SEQ ID NO: 1452407 - RNA, 19 nt, Homo sapiens
caagcuauccaguaucauc

SEQ ID NO: 1452408 - RNA, 19 nt, Homo sapiens
gaguucauagagcuaauuu

SEQ ID NO: 1452409 - RNA, 19 nt, Homo sapiens
ggaugugcuuucccgacuu

SEQ ID NO: 1452410 - RNA, 19 nt, Homo sapiens
agugugaucuucauaaagg

SEQ ID NO: 1452411 - RNA, 19 nt, Homo sapiens
uacacgggcuacuuuccua

SEQ ID NO: 1452412 - RNA, 19 nt, Homo sapiens
cacauacacgggcuacuuu

SEQ ID NO: 1452413 - RNA, 19 nt, Homo sapiens
gcagugaagaggaggauac

SEQ ID NO: 1452414 - RNA, 19 nt, Homo sapiens
aggagaagaugaggauaug

SEQ ID NO: 1452415 - RNA, 19 nt, Homo sapiens
cagagaugcagaugaaugu

SEQ ID NO: 1452416 - RNA, 19 nt, Homo sapiens
gacagugaccuuccaacau

SEQ ID NO: 1452417 - RNA, 19 nt, Homo sapiens
ccaggguccucccaagauc

SEQ ID NO: 1452418 - RNA, 19 nt, Homo sapiens
gggaggagaagaugaggau

SEQ ID NO: 1452419 - RNA, 19 nt, Homo sapiens
uggacaaguuggugcaguu

SEQ ID NO: 1452420 - RNA, 19 nt, Homo sapiens
ccacucaacgagaagagaa

SEQ ID NO: 1452421 - RNA, 19 nt, Homo sapiens
ucagaggccagcaagagaa

SEQ ID NO: 1452422 - RNA, 19 nt, Homo sapiens
acaaguuggugcaguuucu

SEQ ID NO: 1452423 - RNA, 19 nt, Homo sapiens
ccagagagcgagcccuugu

SEQ ID NO: 1452424 - RNA, 19 nt, Homo sapiens
ggguggaacuucagaucag

SEQ ID NO: 1452425 - RNA, 19 nt, Homo sapiens
gaucagcgaauggauaguc

SEQ ID NO: 1452426 - RNA, 19 nt, Homo sapiens
ccaaauaguuucacagaua

SEQ ID NO: 1452427 - RNA, 19 nt, Homo sapiens
ggaagaccauggagaaaua

SEQ ID NO: 1452428 - RNA, 19 nt, Homo sapiens
uaacagagcuaauacagaa

SEQ ID NO: 1452429 - RNA, 19 nt, Homo sapiens
gcacugagacagcgaauua

SEQ ID NO: 1452430 - RNA, 19 nt, Homo sapiens
gaagauacguaauguuuca

SEQ ID NO: 1452431 - RNA, 19 nt, Homo sapiens
gcagauaauuccacuaaug

SEQ ID NO: 1452432 - RNA, 19 nt, Homo sapiens
gauaguggcuacuguguug

SEQ ID NO: 1452433 - RNA, 19 nt, Homo sapiens
cuagauaccuuauucagaa

SEQ ID NO: 1452434 - RNA, 19 nt, Homo sapiens
gagaauaucuggcaacaac

SEQ ID NO: 1452435 - RNA, 19 nt, Homo sapiens
guaguugccuucagcuuaa

SEQ ID NO: 1452436 - RNA, 19 nt, Homo sapiens
caagaaaacuacccaauuu

SEQ ID NO: 1452437 - RNA, 19 nt, Homo sapiens
gguaugccauggaacuuua

SEQ ID NO: 1452438 - RNA, 19 nt, Homo sapiens
guaaguuucucaaguucua

SEQ ID NO: 1452439 - RNA, 19 nt, Homo sapiens
gagggaggaucacauuuga

SEQ ID NO: 1452440 - RNA, 19 nt, Homo sapiens
gagcuaauacagaauagua

SEQ ID NO: 1452441 - RNA, 19 nt, Homo sapiens
gggcagagaugguggugaa

SEQ ID NO: 1452442 - RNA, 19 nt, Homo sapiens
guagagccuugucaucuuu

SEQ ID NO: 1452443 - RNA, 19 nt, Homo sapiens
ugaauaguuugcuguagua

SEQ ID NO: 1452444 - RNA, 19 nt, Homo sapiens
gaaucuggcccacaaauga

SEQ ID NO: 1452445 - RNA, 19 nt, Homo sapiens
agaauugucuccucaaguu

SEQ ID NO: 1452446 - RNA, 19 nt, Homo sapiens
gacagaggaaguaaauuua

SEQ ID NO: 1452447 - RNA, 19 nt, Homo sapiens
gauagucuuuggcuucauu

SEQ ID NO: 1452448 - RNA, 19 nt, Homo sapiens
uaaaggagguagaaucaca

SEQ ID NO: 1452449 - RNA, 19 nt, Homo sapiens
caacgaguguacgcaguua

SEQ ID NO: 1452450 - RNA, 19 nt, Homo sapiens
cgagaaccuuccacugaua

SEQ ID NO: 1452451 - RNA, 19 nt, Homo sapiens
ggugaaggcuguucuugga

SEQ ID NO: 1452452 - RNA, 19 nt, Homo sapiens
gcagaugauuccacuuaug

SEQ ID NO: 1452453 - RNA, 19 nt, Homo sapiens
ugaccaauuuguagaauga

SEQ ID NO: 1452454 - RNA, 19 nt, Homo sapiens
gaugacaaccucugauuga

SEQ ID NO: 1452455 - RNA, 19 nt, Homo sapiens
cgacagugaugauaacaau

SEQ ID NO: 1452456 - RNA, 19 nt, Homo sapiens
gccacucagucaaauaaua

SEQ ID NO: 1452457 - RNA, 19 nt, Homo sapiens
guauggcuauugagcauuu

SEQ ID NO: 1452458 - RNA, 19 nt, Homo sapiens
agacagaggaaguaaauuu

SEQ ID NO: 1452459 - RNA, 19 nt, Homo sapiens
ggcuuuaacuuccauuauu

SEQ ID NO: 1452460 - RNA, 19 nt, Homo sapiens
gcacuguuaccucugaaua

SEQ ID NO: 1452461 - RNA, 19 nt, Homo sapiens
gaauuacucugcucuacca

SEQ ID NO: 1452462 - RNA, 19 nt, Homo sapiens
ugugguaucugaaauauuc

SEQ ID NO: 1452463 - RNA, 19 nt, Homo sapiens
caaugaaucgcucaacuuu

SEQ ID NO: 1452464 - RNA, 19 nt, Homo sapiens
ucagugagaguuuaucaua

SEQ ID NO: 1452465 - RNA, 19 nt, Homo sapiens
gagguacagucuagcauau

SEQ ID NO: 1452466 - RNA, 19 nt, Homo sapiens
cagauaaucccacugauga

SEQ ID NO: 1452467 - RNA, 19 nt, Homo sapiens
uagcagaugauuccacuua

SEQ ID NO: 1452468 - RNA, 19 nt, Homo sapiens
cuaaugacauagcagauga

SEQ ID NO: 1452469 - RNA, 19 nt, Homo sapiens
aauauucccuggacuagaa

SEQ ID NO: 1452470 - RNA, 19 nt, Homo sapiens
gagccacucagucaaauaa

SEQ ID NO: 1452471 - RNA, 19 nt, Homo sapiens
guaaggagccacucaguca

SEQ ID NO: 1452472 - RNA, 19 nt, Homo sapiens
caacuuuauuggacaguga

SEQ ID NO: 1452473 - RNA, 19 nt, Homo sapiens
agagcagucuugucugaua

SEQ ID NO: 1452474 - RNA, 19 nt, Homo sapiens
ccaaaauacugccucuuua

SEQ ID NO: 1452475 - RNA, 19 nt, Homo sapiens
gguagagccuugucaucuu

SEQ ID NO: 1452476 - RNA, 19 nt, Homo sapiens
cagcagauaauuccacuaa

SEQ ID NO: 1452477 - RNA, 19 nt, Homo sapiens
gcaccuguagucccaguua

SEQ ID NO: 1452478 - RNA, 19 nt, Homo sapiens
gcagaguaguuugcauuga

SEQ ID NO: 1452479 - RNA, 19 nt, Homo sapiens
uguaacaucucuugaguca

SEQ ID NO: 1452480 - RNA, 19 nt, Homo sapiens
gaagaggaauaauauacac

SEQ ID NO: 1452481 - RNA, 19 nt, Homo sapiens
guauugagaugguggaagu

SEQ ID NO: 1452482 - RNA, 19 nt, Homo sapiens
gcgagaaccuuccacugau

SEQ ID NO: 1452483 - RNA, 19 nt, Homo sapiens
caaguucauuacagcagua

SEQ ID NO: 1452484 - RNA, 19 nt, Homo sapiens
gguagaaucacauuaggaa

SEQ ID NO: 1452485 - RNA, 19 nt, Homo sapiens
ggagguagaaucacauuag

SEQ ID NO: 1452486 - RNA, 19 nt, Homo sapiens
agaaaugucagaguacuua

SEQ ID NO: 1452487 - RNA, 19 nt, Homo sapiens
augaaucgcucaacuuuau

SEQ ID NO: 1452488 - RNA, 19 nt, Homo sapiens
ugaccaagaugaugcuuca

SEQ ID NO: 1452489 - RNA, 19 nt, Homo sapiens
aaaccacccaguacauuua

SEQ ID NO: 1452490 - RNA, 19 nt, Homo sapiens
gcagauaaucccacugaug

SEQ ID NO: 1452491 - RNA, 19 nt, Homo sapiens
uuaaaugccugcucauaag

SEQ ID NO: 1452492 - RNA, 19 nt, Homo sapiens
ggaauugugucuucaaaau

SEQ ID NO: 1452493 - RNA, 19 nt, Homo sapiens
caagagggaggaucacauu

SEQ ID NO: 1452494 - RNA, 19 nt, Homo sapiens
ggugaagcauggagcuauu

SEQ ID NO: 1452495 - RNA, 19 nt, Homo sapiens
gagagaauaucuggcaaca

SEQ ID NO: 1452496 - RNA, 19 nt, Homo sapiens
guuaugggacaaugaguua

SEQ ID NO: 1452497 - RNA, 19 nt, Homo sapiens
gguacagucuagcauauca

SEQ ID NO: 1452498 - RNA, 19 nt, Homo sapiens
agacuucuauugcuaacuu

SEQ ID NO: 1452499 - RNA, 19 nt, Homo sapiens
gcuuuaacuuccauuauuc

SEQ ID NO: 1452500 - RNA, 19 nt, Homo sapiens
gaaaguaaggagccacuca

SEQ ID NO: 1452501 - RNA, 19 nt, Homo sapiens
cagauaauuccacuaauga

SEQ ID NO: 1452502 - RNA, 19 nt, Homo sapiens
gaucuacuguuuauguucu

SEQ ID NO: 1452503 - RNA, 19 nt, Homo sapiens
ucaauucuaugaucuacug

SEQ ID NO: 1452504 - RNA, 19 nt, Homo sapiens
caaaugaguuaugggacaa

SEQ ID NO: 1452505 - RNA, 19 nt, Homo sapiens
aaaccaacguggaaaauaa

SEQ ID NO: 1452506 - RNA, 19 nt, Homo sapiens
gcaguucugucacgaagag

SEQ ID NO: 1452507 - RNA, 19 nt, Homo sapiens
gaaaguaccaaugcuguca

SEQ ID NO: 1452508 - RNA, 19 nt, Homo sapiens
ggagugcaguggcaugauc

SEQ ID NO: 1452509 - RNA, 19 nt, Homo sapiens
aaaguggaauugugucuuc

SEQ ID NO: 1452510 - RNA, 19 nt, Homo sapiens
auggagaucuugcuauauu

SEQ ID NO: 1452511 - RNA, 19 nt, Homo sapiens
ugauagaacuuuccaccau

SEQ ID NO: 1452512 - RNA, 19 nt, Homo sapiens
uuagagcagucuugucuga

SEQ ID NO: 1452513 - RNA, 19 nt, Homo sapiens
ugaaauauucccuggacua

SEQ ID NO: 1452514 - RNA, 19 nt, Homo sapiens
gguccaaaguaacgucuau

SEQ ID NO: 1452515 - RNA, 19 nt, Homo sapiens
gcaggaagcagaccucagu

SEQ ID NO: 1452516 - RNA, 19 nt, Homo sapiens
gaccaaauaguuucacaga

SEQ ID NO: 1452517 - RNA, 19 nt, Homo sapiens
gauaagguagagaaagaaa

SEQ ID NO: 1452518 - RNA, 19 nt, Homo sapiens
gcuuugacuuagauaauug

SEQ ID NO: 1452519 - RNA, 19 nt, Homo sapiens
gagaaccuuccacugauaa

SEQ ID NO: 1452520 - RNA, 19 nt, Homo sapiens
gccaaugaauaacuccaaa

SEQ ID NO: 1452521 - RNA, 19 nt, Homo sapiens
gcacaagguggcucauuuc

SEQ ID NO: 1452522 - RNA, 19 nt, Homo sapiens
gcuguaacaucucuugagu

SEQ ID NO: 1452523 - RNA, 19 nt, Homo sapiens
uaaaccacccaguacauuu

SEQ ID NO: 1452524 - RNA, 19 nt, Homo sapiens
acagauaaaccacccagua

SEQ ID NO: 1452525 - RNA, 19 nt, Homo sapiens
gcagugagccgagauugug

SEQ ID NO: 1452526 - RNA, 19 nt, Homo sapiens
gguagagacuuauuuguuu

SEQ ID NO: 1452527 - RNA, 19 nt, Homo sapiens
ccaaggacgucaaguguuu

SEQ ID NO: 1452528 - RNA, 19 nt, Homo sapiens
ggacuugguugcugcauga

SEQ ID NO: 1452529 - RNA, 19 nt, Homo sapiens
cuacgucacugaauaauga

SEQ ID NO: 1452530 - RNA, 19 nt, Homo sapiens
gaaaacaucucuucucuuc

SEQ ID NO: 1452531 - RNA, 19 nt, Homo sapiens
aaacaucucuucucuucuu

SEQ ID NO: 1452532 - RNA, 19 nt, Homo sapiens
guuauuagauggcuuuaug

SEQ ID NO: 1452533 - RNA, 19 nt, Homo sapiens
gagcacagauggagugauc

SEQ ID NO: 1452534 - RNA, 19 nt, Homo sapiens
gagacaaagucaauccaaa

SEQ ID NO: 1452535 - RNA, 19 nt, Homo sapiens
gcucaaaguuuucaacaua

SEQ ID NO: 1452536 - RNA, 19 nt, Homo sapiens
gcaguaugguccacaagaa

SEQ ID NO: 1452537 - RNA, 19 nt, Homo sapiens
cagcugccauugauagaua

SEQ ID NO: 1452538 - RNA, 19 nt, Homo sapiens
agaagaagaugcaggagaa

SEQ ID NO: 1452539 - RNA, 19 nt, Homo sapiens
gaacuggaacugaugaaga

SEQ ID NO: 1452540 - RNA, 19 nt, Homo sapiens
ccaagugacgcuacaguua

SEQ ID NO: 1452541 - RNA, 19 nt, Homo sapiens
ccaagagucugcucaaagu

SEQ ID NO: 1452542 - RNA, 19 nt, Homo sapiens
gaagaugagagucaaaguu

SEQ ID NO: 1452543 - RNA, 19 nt, Homo sapiens
caaauaagccgugcuaaca

SEQ ID NO: 1452544 - RNA, 19 nt, Homo sapiens
caacgugacucaaauaagc

SEQ ID NO: 1452545 - RNA, 19 nt, Homo sapiens
ggcaagaguugucugauuc

SEQ ID NO: 1452546 - RNA, 19 nt, Homo sapiens
gagagcagcugaacaacag

SEQ ID NO: 1452547 - RNA, 19 nt, Homo sapiens
gaagcagccaaacacauua

SEQ ID NO: 1452548 - RNA, 19 nt, Homo sapiens
caucaccaguugcauauga

SEQ ID NO: 1452549 - RNA, 19 nt, Homo sapiens
gccugaaucuccagccuua

SEQ ID NO: 1452550 - RNA, 19 nt, Homo sapiens
gagaagagacaaagucaau

SEQ ID NO: 1452551 - RNA, 19 nt, Homo sapiens
gagaaugggacuccaacua

SEQ ID NO: 1452552 - RNA, 19 nt, Homo sapiens
ccugauagguuauguuugu

SEQ ID NO: 1452553 - RNA, 19 nt, Homo sapiens
guacuuucaugaccaguga

SEQ ID NO: 1452554 - RNA, 19 nt, Homo sapiens
gagcaacgugacucaaaua

SEQ ID NO: 1452555 - RNA, 19 nt, Homo sapiens
gagcagccacugaagcaua

SEQ ID NO: 1452556 - RNA, 19 nt, Homo sapiens
uugcagagguugagcagua

SEQ ID NO: 1452557 - RNA, 19 nt, Homo sapiens
ugaaagccguguacguuga

SEQ ID NO: 1452558 - RNA, 19 nt, Homo sapiens
caaaggcagucagugauga

SEQ ID NO: 1452559 - RNA, 19 nt, Homo sapiens
gaggaucggcuuuaucuug

SEQ ID NO: 1452560 - RNA, 19 nt, Homo sapiens
agagaaagaugaagucuac

SEQ ID NO: 1452561 - RNA, 19 nt, Homo sapiens
gcaaguuucugagguagga

SEQ ID NO: 1452562 - RNA, 19 nt, Homo sapiens
ggucaaagaggacacacua

SEQ ID NO: 1452563 - RNA, 19 nt, Homo sapiens
ggucuuuaguggcuuguuu

SEQ ID NO: 1452564 - RNA, 19 nt, Homo sapiens
caacuaagggaaccugaaa

SEQ ID NO: 1452565 - RNA, 19 nt, Homo sapiens
ggugcaaguuucugaggua

SEQ ID NO: 1452566 - RNA, 19 nt, Homo sapiens
ccaccucugugcugacuuu

SEQ ID NO: 1452567 - RNA, 19 nt, Homo sapiens
gaaugggacuccaacuaag

SEQ ID NO: 1452568 - RNA, 19 nt, Homo sapiens
ccagagagcagcugaacaa

SEQ ID NO: 1452569 - RNA, 19 nt, Homo sapiens
cagauggagugaucauuug

SEQ ID NO: 1452570 - RNA, 19 nt, Homo sapiens
aaaggaaggugcagaagca

SEQ ID NO: 1452571 - RNA, 19 nt, Homo sapiens
guagagacuuauuuguuuc

SEQ ID NO: 1452572 - RNA, 19 nt, Homo sapiens
cagaaugcauuggaauuga

SEQ ID NO: 1452573 - RNA, 19 nt, Homo sapiens
gcagaaugcauuggaauug

SEQ ID NO: 1452574 - RNA, 19 nt, Homo sapiens
ugacuuugcugcauguguu

SEQ ID NO: 1452575 - RNA, 19 nt, Homo sapiens
ucccauaacuucagacuca

SEQ ID NO: 1452576 - RNA, 19 nt, Homo sapiens
ugaaggagcagcuagaaga

SEQ ID NO: 1452577 - RNA, 19 nt, Homo sapiens
gaggugagccugaggugaa

SEQ ID NO: 1452578 - RNA, 19 nt, Homo sapiens
cgcaagugcucagccauua

SEQ ID NO: 1452579 - RNA, 19 nt, Homo sapiens
guucacauguuuguagauu

SEQ ID NO: 1452580 - RNA, 19 nt, Homo sapiens
uaagggaaccugaaaucaa

SEQ ID NO: 1452581 - RNA, 19 nt, Homo sapiens
agaaugggacuccaacuaa

SEQ ID NO: 1452582 - RNA, 19 nt, Homo sapiens
gaaccagcugccauugaua

SEQ ID NO: 1452583 - RNA, 19 nt, Homo sapiens
ggaaugagagggugcagau

SEQ ID NO: 1452584 - RNA, 19 nt, Homo sapiens
caucaucaccaguugcaua

SEQ ID NO: 1452585 - RNA, 19 nt, Homo sapiens
guuuguagauucugauuca

SEQ ID NO: 1452586 - RNA, 19 nt, Homo sapiens
gcauauccauguucuacca

SEQ ID NO: 1452587 - RNA, 19 nt, Homo sapiens
uuuaguggguagagacuua

SEQ ID NO: 1452588 - RNA, 19 nt, Homo sapiens
ggaaggugcagaagcagaa

SEQ ID NO: 1452589 - RNA, 19 nt, Homo sapiens
gcagcaacuuuacacuuca

SEQ ID NO: 1452590 - RNA, 19 nt, Homo sapiens
ggguagagacuuauuuguu

SEQ ID NO: 1452591 - RNA, 19 nt, Homo sapiens
ccaaggcccugcugcauac

SEQ ID NO: 1452592 - RNA, 19 nt, Homo sapiens
uggcaagaguugucugauu

SEQ ID NO: 1452593 - RNA, 19 nt, Homo sapiens
ugaaccagcugccauugau

SEQ ID NO: 1452594 - RNA, 19 nt, Homo sapiens
ggcagaugcuacagaaaga

SEQ ID NO: 1452595 - RNA, 19 nt, Homo sapiens
gaaagaugaagucuaccaa

SEQ ID NO: 1452596 - RNA, 19 nt, Homo sapiens
gcuaacaguacuuucauga

SEQ ID NO: 1452597 - RNA, 19 nt, Homo sapiens
aagaugagagucaaaguuu

SEQ ID NO: 1452598 - RNA, 19 nt, Homo sapiens
cuuccuacgucacugaaua

SEQ ID NO: 1452599 - RNA, 19 nt, Homo sapiens
uaucucagacgaccaaauu

SEQ ID NO: 1452600 - RNA, 19 nt, Homo sapiens
ccacaagggagucuuccua

SEQ ID NO: 1452601 - RNA, 19 nt, Homo sapiens
ggagaagcccagagagaau

SEQ ID NO: 1452602 - RNA, 19 nt, Homo sapiens
gaagcggccucucccacau

SEQ ID NO: 1452603 - RNA, 19 nt, Homo sapiens
caagugacgcuacaguuau

SEQ ID NO: 1452604 - RNA, 19 nt, Homo sapiens
ggaggcacuucagagcuaa

SEQ ID NO: 1452605 - RNA, 19 nt, Homo sapiens
ugauaguucugcuuacgaa

SEQ ID NO: 1452606 - RNA, 19 nt, Homo sapiens
gaugaagucuaccaaaaga

SEQ ID NO: 1452607 - RNA, 19 nt, Homo sapiens
uagaagcugcuccucauuu

SEQ ID NO: 1452608 - RNA, 19 nt, Homo sapiens
ucacauguuuguagauucu

SEQ ID NO: 1452609 - RNA, 19 nt, Homo sapiens
ucagacgaccaaauugaua

SEQ ID NO: 1452610 - RNA, 19 nt, Homo sapiens
acagauggagugaucauuu

SEQ ID NO: 1452611 - RNA, 19 nt, Homo sapiens
uggaggcacuucagagcua

SEQ ID NO: 1452612 - RNA, 19 nt, Homo sapiens
gcaagaacaacaccugaag

SEQ ID NO: 1452613 - RNA, 19 nt, Homo sapiens
ccaagaaacaacagaaaca

SEQ ID NO: 1452614 - RNA, 19 nt, Homo sapiens
agaagcagccaaacacauu

SEQ ID NO: 1452615 - RNA, 19 nt, Homo sapiens
caugaaagccguguacguu

SEQ ID NO: 1452616 - RNA, 19 nt, Homo sapiens
gcacuucagagcuaaaaua

SEQ ID NO: 1452617 - RNA, 19 nt, Homo sapiens
uagaagagaggacuugguu

SEQ ID NO: 1452618 - RNA, 19 nt, Homo sapiens
ugacaucauuagccaggaa

SEQ ID NO: 1452619 - RNA, 19 nt, Homo sapiens
gaaagccguguacguugaa

SEQ ID NO: 1452620 - RNA, 19 nt, Homo sapiens
ugaguuuccuguggucuuu

SEQ ID NO: 1452621 - RNA, 19 nt, Homo sapiens
ggacgucaaguguuucugu

SEQ ID NO: 1452622 - RNA, 19 nt, Homo sapiens
caagaaacaacagaaacaa

SEQ ID NO: 1452623 - RNA, 19 nt, Homo sapiens
gcucucaaaggaaauuaaa

SEQ ID NO: 1452624 - RNA, 19 nt, Homo sapiens
agaagcugcuccucauuuc

SEQ ID NO: 1452625 - RNA, 19 nt, Homo sapiens
gagcagaggcggcaaaaga

SEQ ID NO: 1452626 - RNA, 19 nt, Homo sapiens
gcucuuugcuugaguauua

SEQ ID NO: 1452627 - RNA, 19 nt, Homo sapiens
gauauuaguuacccaguua

SEQ ID NO: 1452628 - RNA, 19 nt, Homo sapiens
gcacugguguuagauauua

SEQ ID NO: 1452629 - RNA, 19 nt, Homo sapiens
gaacaauucucucuaauac

SEQ ID NO: 1452630 - RNA, 19 nt, Homo sapiens
cagaauaguuccaaugaua

SEQ ID NO: 1452631 - RNA, 19 nt, Homo sapiens
gaaagaggauuuguuaaga

SEQ ID NO: 1452632 - RNA, 19 nt, Homo sapiens
gaaggcagcuagacuuauu

SEQ ID NO: 1452633 - RNA, 19 nt, Homo sapiens
caagaagucugcaaucaaa

SEQ ID NO: 1452634 - RNA, 19 nt, Homo sapiens
uaacgaagaugauuggaaa

SEQ ID NO: 1452635 - RNA, 19 nt, Homo sapiens
ccagauggcugaaaucauu

SEQ ID NO: 1452636 - RNA, 19 nt, Homo sapiens
ucaaauccaugcuuagaua

SEQ ID NO: 1452637 - RNA, 19 nt, Homo sapiens
ggaaauaggucacagaaaa

SEQ ID NO: 1452638 - RNA, 19 nt, Homo sapiens
caaauacucucacuagaug

SEQ ID NO: 1452639 - RNA, 19 nt, Homo sapiens
gaggauaccugccuagaga

SEQ ID NO: 1452640 - RNA, 19 nt, Homo sapiens
caagugaaguggaaacaaa

SEQ ID NO: 1452641 - RNA, 19 nt, Homo sapiens
aaaugaagcucacuaaaug

SEQ ID NO: 1452642 - RNA, 19 nt, Homo sapiens
aaacauacuuugaggauga

SEQ ID NO: 1452643 - RNA, 19 nt, Homo sapiens
ggaaugauagucugguuua

SEQ ID NO: 1452644 - RNA, 19 nt, Homo sapiens
gaaacuucaucaaacagua

SEQ ID NO: 1452645 - RNA, 19 nt, Homo sapiens
gaacuuccacgcuucauuu

SEQ ID NO: 1452646 - RNA, 19 nt, Homo sapiens
gaacuugcauuagcaguga

SEQ ID NO: 1452647 - RNA, 19 nt, Homo sapiens
uaaaugugcugaaaguuga

SEQ ID NO: 1452648 - RNA, 19 nt, Homo sapiens
caucagauaugcucauuau

SEQ ID NO: 1452649 - RNA, 19 nt, Homo sapiens
aaacucagcaugcuuguua

SEQ ID NO: 1452650 - RNA, 19 nt, Homo sapiens
gacgaaagaggauuuguua

SEQ ID NO: 1452651 - RNA, 19 nt, Homo sapiens
ucauauggcuacacguuua

SEQ ID NO: 1452652 - RNA, 19 nt, Homo sapiens
gagcauggauaauguguuc

SEQ ID NO: 1452653 - RNA, 19 nt, Homo sapiens
gcaaaugggagcauggaua

SEQ ID NO: 1452654 - RNA, 19 nt, Homo sapiens
ggaaagugcauguguuaaa

SEQ ID NO: 1452655 - RNA, 19 nt, Homo sapiens
gaggaaagugcauguguua

SEQ ID NO: 1452656 - RNA, 19 nt, Homo sapiens
gcuccuggcuaucuucaua

SEQ ID NO: 1452657 - RNA, 19 nt, Homo sapiens
uggaugaaguggugaaaua

SEQ ID NO: 1452658 - RNA, 19 nt, Homo sapiens
ucuaaaggcuuaacaugaa

SEQ ID NO: 1452659 - RNA, 19 nt, Homo sapiens
uuccaaagcugcauaauga

SEQ ID NO: 1452660 - RNA, 19 nt, Homo sapiens
ccaagucgcauuaaucuuu

SEQ ID NO: 1452661 - RNA, 19 nt, Homo sapiens
gaaagugcauguguuaaag

SEQ ID NO: 1452662 - RNA, 19 nt, Homo sapiens
ccacaauggucgauacuau

SEQ ID NO: 1452663 - RNA, 19 nt, Homo sapiens
gaaggaugaaggugacuua

SEQ ID NO: 1452664 - RNA, 19 nt, Homo sapiens
agucuaugcuguauuguua

SEQ ID NO: 1452665 - RNA, 19 nt, Homo sapiens
caaaugaagcucacuaaau

SEQ ID NO: 1452666 - RNA, 19 nt, Homo sapiens
ggacagugcuccaccuaca

SEQ ID NO: 1452667 - RNA, 19 nt, Homo sapiens
cagcuagacuuauuguauu

SEQ ID NO: 1452668 - RNA, 19 nt, Homo sapiens
gugaguagaucuucuuaau

SEQ ID NO: 1452669 - RNA, 19 nt, Homo sapiens
caacauauuucagcaguuc

SEQ ID NO: 1452670 - RNA, 19 nt, Homo sapiens
guauuaugcugcugauauu

SEQ ID NO: 1452671 - RNA, 19 nt, Homo sapiens
gugcauguguuaaagauga

SEQ ID NO: 1452672 - RNA, 19 nt, Homo sapiens
gccaaugaguuguuuauuc

SEQ ID NO: 1452673 - RNA, 19 nt, Homo sapiens
uagauucgcuuugcuauau

SEQ ID NO: 1452674 - RNA, 19 nt, Homo sapiens
uggauaauguguucacuuu

SEQ ID NO: 1452675 - RNA, 19 nt, Homo sapiens
caaaugggagcauggauaa

SEQ ID NO: 1452676 - RNA, 19 nt, Homo sapiens
cagaagcaauuauuuguuc

SEQ ID NO: 1452677 - RNA, 19 nt, Homo sapiens
ccaaugaguuguuuauucu

SEQ ID NO: 1452678 - RNA, 19 nt, Homo sapiens
gcagcuagacuuauuguau

SEQ ID NO: 1452679 - RNA, 19 nt, Homo sapiens
ugaaugcucugcuuucuca

SEQ ID NO: 1452680 - RNA, 19 nt, Homo sapiens
gcaguuaugucugugcauu

SEQ ID NO: 1452681 - RNA, 19 nt, Homo sapiens
aauccaggcugacugcuua

SEQ ID NO: 1452682 - RNA, 19 nt, Homo sapiens
acagggagcucucauagau

SEQ ID NO: 1452683 - RNA, 19 nt, Homo sapiens
ggaaacaaagucauuacaa

SEQ ID NO: 1452684 - RNA, 19 nt, Homo sapiens
gcacacaaauauaaaccau

SEQ ID NO: 1452685 - RNA, 19 nt, Homo sapiens
gaggauuuguuaagaguau

SEQ ID NO: 1452686 - RNA, 19 nt, Homo sapiens
gugcccaucucguuugaua

SEQ ID NO: 1452687 - RNA, 19 nt, Homo sapiens
cagacaagcuccuggcuau

SEQ ID NO: 1452688 - RNA, 19 nt, Homo sapiens
ucuaggaucugugguuaua

SEQ ID NO: 1452689 - RNA, 19 nt, Homo sapiens
cuacagggaaagagaauua

SEQ ID NO: 1452690 - RNA, 19 nt, Homo sapiens
gaagggcauuagaguaaau

SEQ ID NO: 1452691 - RNA, 19 nt, Homo sapiens
caaacugcuugaaggagua

SEQ ID NO: 1452692 - RNA, 19 nt, Homo sapiens
gaaaagcaccaacaaauga

SEQ ID NO: 1452693 - RNA, 19 nt, Homo sapiens
gaucaaauaaugccaacuu

SEQ ID NO: 1452694 - RNA, 19 nt, Homo sapiens
ggaaacugccuauggaaga

SEQ ID NO: 1452695 - RNA, 19 nt, Homo sapiens
uaaaggcccugcuggacaa

SEQ ID NO: 1452696 - RNA, 19 nt, Homo sapiens
ucucauagauacuaguuga

SEQ ID NO: 1452697 - RNA, 19 nt, Homo sapiens
gaagaucaguuggaugaag

SEQ ID NO: 1452698 - RNA, 19 nt, Homo sapiens
acaagaaccugguggacuu

SEQ ID NO: 1452699 - RNA, 19 nt, Homo sapiens
gcaaacaugaauucugaaa

SEQ ID NO: 1452700 - RNA, 19 nt, Homo sapiens
aggcaaacaugaauucuga

SEQ ID NO: 1452701 - RNA, 19 nt, Homo sapiens
gaaugauagucugguuuaa

SEQ ID NO: 1452702 - RNA, 19 nt, Homo sapiens
ggaugaaggugacuuacca

SEQ ID NO: 1452703 - RNA, 19 nt, Homo sapiens
uuaaaugucugaagccaau

SEQ ID NO: 1452704 - RNA, 19 nt, Homo sapiens
ggcaagcacuuuguucuga

SEQ ID NO: 1452705 - RNA, 19 nt, Homo sapiens
gaucugugguuauaauuac

SEQ ID NO: 1452706 - RNA, 19 nt, Homo sapiens
uugaagaacuugaggaaga

SEQ ID NO: 1452707 - RNA, 19 nt, Homo sapiens
ggaucugugguuauaauua

SEQ ID NO: 1452708 - RNA, 19 nt, Homo sapiens
gaaacugccuauggaagau

SEQ ID NO: 1452709 - RNA, 19 nt, Homo sapiens
agccauugcugccucauua

SEQ ID NO: 1452710 - RNA, 19 nt, Homo sapiens
gcagaauaguuccaaugau

SEQ ID NO: 1452711 - RNA, 19 nt, Homo sapiens
gcccaucucguuugauaua

SEQ ID NO: 1452712 - RNA, 19 nt, Homo sapiens
ucugaacaauucucucuaa

SEQ ID NO: 1452713 - RNA, 19 nt, Homo sapiens
caacaaaugaagcucacua

SEQ ID NO: 1452714 - RNA, 19 nt, Homo sapiens
auugauaucucagcaguua

SEQ ID NO: 1452715 - RNA, 19 nt, Homo sapiens
uaaacccuuuguagucaua

SEQ ID NO: 1452716 - RNA, 19 nt, Homo sapiens
cugaauaguuccuuaaauc

SEQ ID NO: 1452717 - RNA, 19 nt, Homo sapiens
aagaagggcauuagaguaa

SEQ ID NO: 1452718 - RNA, 19 nt, Homo sapiens
acaugaaacugucugcauu

SEQ ID NO: 1452719 - RNA, 19 nt, Homo sapiens
gcugaauaguuccuuaaau

SEQ ID NO: 1452720 - RNA, 19 nt, Homo sapiens
cgaggcagcugaagcaaag

SEQ ID NO: 1452721 - RNA, 19 nt, Homo sapiens
ggacagcacagaaacaaag

SEQ ID NO: 1452722 - RNA, 19 nt, Homo sapiens
ggaugaagaucaguuggau

SEQ ID NO: 1452723 - RNA, 19 nt, Homo sapiens
gaaagaagagagcgaggau

SEQ ID NO: 1452724 - RNA, 19 nt, Homo sapiens
cuaaaggcuuaacaugaaa

SEQ ID NO: 1452725 - RNA, 19 nt, Homo sapiens
gcaguuggagugagaauca

SEQ ID NO: 1452726 - RNA, 19 nt, Homo sapiens
ggaagaagaugaugacuua

SEQ ID NO: 1452727 - RNA, 19 nt, Homo sapiens
gaaggaaccugcuccaaga

SEQ ID NO: 1452728 - RNA, 19 nt, Homo sapiens
gagcaaagguucugggaaa

SEQ ID NO: 1452729 - RNA, 19 nt, Homo sapiens
guacucaugugucuuauuu

SEQ ID NO: 1452730 - RNA, 19 nt, Homo sapiens
gaagaaaacugccaugaaa

SEQ ID NO: 1452731 - RNA, 19 nt, Homo sapiens
ggaagaagagguggaauua

SEQ ID NO: 1452732 - RNA, 19 nt, Homo sapiens
ggagaugacugccuuuaug

SEQ ID NO: 1452733 - RNA, 19 nt, Homo sapiens
gagacaggcuccagaugua

SEQ ID NO: 1452734 - RNA, 19 nt, Homo sapiens
gaaauuaggaacugcagua

SEQ ID NO: 1452735 - RNA, 19 nt, Homo sapiens
ucagggaccucucagauuu

SEQ ID NO: 1452736 - RNA, 19 nt, Homo sapiens
ggaaggagggaagaaauua

SEQ ID NO: 1452737 - RNA, 19 nt, Homo sapiens
ggagacagaugacaaugau

SEQ ID NO: 1452738 - RNA, 19 nt, Homo sapiens
ggagaagcguuaugaagga

SEQ ID NO: 1452739 - RNA, 19 nt, Homo sapiens
gaacugcaguacaucauca

SEQ ID NO: 1452740 - RNA, 19 nt, Homo sapiens
gaagacaaacgccaaguga

SEQ ID NO: 1452741 - RNA, 19 nt, Homo sapiens
gaacaggacauggacagua

SEQ ID NO: 1452742 - RNA, 19 nt, Homo sapiens
gaaaggcagcuccaagaaa

SEQ ID NO: 1452743 - RNA, 19 nt, Homo sapiens
ccagagugaugccauguuu

SEQ ID NO: 1452744 - RNA, 19 nt, Homo sapiens
aagaagagguggaauuaga

SEQ ID NO: 1452745 - RNA, 19 nt, Homo sapiens
ggugggacuuuaauuauug

SEQ ID NO: 1452746 - RNA, 19 nt, Homo sapiens
ggaaugccacugugaguuu

SEQ ID NO: 1452747 - RNA, 19 nt, Homo sapiens
gagaugcccuauaugaguu

SEQ ID NO: 1452748 - RNA, 19 nt, Homo sapiens
ugaguuacccugccaauuu

SEQ ID NO: 1452749 - RNA, 19 nt, Homo sapiens
ggaaacugcccaaauguau

SEQ ID NO: 1452750 - RNA, 19 nt, Homo sapiens
gaaaagcuuugauucauug

SEQ ID NO: 1452751 - RNA, 19 nt, Homo sapiens
ccacugagccucuuguuug

SEQ ID NO: 1452752 - RNA, 19 nt, Homo sapiens
ggucgaagcucugagaugu

SEQ ID NO: 1452753 - RNA, 19 nt, Homo sapiens
gguaguagcaggagaggua

SEQ ID NO: 1452754 - RNA, 19 nt, Homo sapiens
ggagcucaguugauuguga

SEQ ID NO: 1452755 - RNA, 19 nt, Homo sapiens
gaauuuaccaucucguuga

SEQ ID NO: 1452756 - RNA, 19 nt, Homo sapiens
guucugaccucuccacuuc

SEQ ID NO: 1452757 - RNA, 19 nt, Homo sapiens
ccuaggagcucaguugauu

SEQ ID NO: 1452758 - RNA, 19 nt, Homo sapiens
gaaaauggccuguaaagau

SEQ ID NO: 1452759 - RNA, 19 nt, Homo sapiens
gcugagaaguuucccucua

SEQ ID NO: 1452760 - RNA, 19 nt, Homo sapiens
gcugaaugcuaauaaacuu

SEQ ID NO: 1452761 - RNA, 19 nt, Homo sapiens
gaugcuuccugacugauaa

SEQ ID NO: 1452762 - RNA, 19 nt, Homo sapiens
gaugaugacuuagaauauc

SEQ ID NO: 1452763 - RNA, 19 nt, Homo sapiens
ggaauuagaggaggaagaa

SEQ ID NO: 1452764 - RNA, 19 nt, Homo sapiens
gaaaucagagugcccaugu

SEQ ID NO: 1452765 - RNA, 19 nt, Homo sapiens
caguggagaugcccuauau

SEQ ID NO: 1452766 - RNA, 19 nt, Homo sapiens
caauagugaugaagguuau

SEQ ID NO: 1452767 - RNA, 19 nt, Homo sapiens
agaagaugaugacuuagaa

SEQ ID NO: 1452768 - RNA, 19 nt, Homo sapiens
gacagguuguggugacaua

SEQ ID NO: 1452769 - RNA, 19 nt, Homo sapiens
ggaaaggcagcuccaagaa

SEQ ID NO: 1452770 - RNA, 19 nt, Homo sapiens
gcaggagaagcccgucuua

SEQ ID NO: 1452771 - RNA, 19 nt, Homo sapiens
gagguucguuguagagaga

SEQ ID NO: 1452772 - RNA, 19 nt, Homo sapiens
gggaagaaauuaggaacug

SEQ ID NO: 1452773 - RNA, 19 nt, Homo sapiens
aagaggagguugagaagga

SEQ ID NO: 1452774 - RNA, 19 nt, Homo sapiens
ggagaugcccuauaugagu

SEQ ID NO: 1452775 - RNA, 19 nt, Homo sapiens
ggaagaagaggaagaagag

SEQ ID NO: 1452776 - RNA, 19 nt, Homo sapiens
gaguuacccugccaauuuc

SEQ ID NO: 1452777 - RNA, 19 nt, Homo sapiens
aaaggcagcuccaagaaag

SEQ ID NO: 1452778 - RNA, 19 nt, Homo sapiens
gcaagaaggguaucuguac

SEQ ID NO: 1452779 - RNA, 19 nt, Homo sapiens
agaggugggacuuuaauua

SEQ ID NO: 1452780 - RNA, 19 nt, Homo sapiens
acacguggaugguacuuug

SEQ ID NO: 1452781 - RNA, 19 nt, Homo sapiens
gaagaugcccagguacuga

SEQ ID NO: 1452782 - RNA, 19 nt, Homo sapiens
ucgaagcucugagauguuu

SEQ ID NO: 1452783 - RNA, 19 nt, Homo sapiens
gagaugacugccuuuauga

SEQ ID NO: 1452784 - RNA, 19 nt, Homo sapiens
ccaauagugaugaagguua

SEQ ID NO: 1452785 - RNA, 19 nt, Homo sapiens
gggaaacugcccaaaugua

SEQ ID NO: 1452786 - RNA, 19 nt, Homo sapiens
gagguaaacccacccaaug

SEQ ID NO: 1452787 - RNA, 19 nt, Homo sapiens
agaaagcuguggcugagaa

SEQ ID NO: 1452788 - RNA, 19 nt, Homo sapiens
gaggugggacuuuaauuau

SEQ ID NO: 1452789 - RNA, 19 nt, Homo sapiens
gaauaucugugggaaacug

SEQ ID NO: 1452790 - RNA, 19 nt, Homo sapiens
ggacauggacaguaugaca

SEQ ID NO: 1452791 - RNA, 19 nt, Homo sapiens
ggaacauucuccacccaau

SEQ ID NO: 1452792 - RNA, 19 nt, Homo sapiens
gaagggaaugccacuguga

SEQ ID NO: 1452793 - RNA, 19 nt, Homo sapiens
ucuguacucugccuaguuu

SEQ ID NO: 1452794 - RNA, 19 nt, Homo sapiens
cuucuuugcugaaugcuaa

SEQ ID NO: 1452795 - RNA, 19 nt, Homo sapiens
gagaagcguuaugaaggaa

SEQ ID NO: 1452796 - RNA, 19 nt, Homo sapiens
gaagaaaauccacauggua

SEQ ID NO: 1452797 - RNA, 19 nt, Homo sapiens
agaguacucaugugucuua

SEQ ID NO: 1452798 - RNA, 19 nt, Homo sapiens
gggccuacccuacuuauuc

SEQ ID NO: 1452799 - RNA, 19 nt, Homo sapiens
gaaccugcuccaagaaaga

SEQ ID NO: 1452800 - RNA, 19 nt, Homo sapiens
gugaugaagguuauuauga

SEQ ID NO: 1452801 - RNA, 19 nt, Homo sapiens
gggaaaggcagcuccaaga

SEQ ID NO: 1452802 - RNA, 19 nt, Homo sapiens
ggagaagcccgucuuagag

SEQ ID NO: 1452803 - RNA, 19 nt, Homo sapiens
gaggaagaacggcuaguga

SEQ ID NO: 1452804 - RNA, 19 nt, Homo sapiens
guggagaugcccuauauga

SEQ ID NO: 1452805 - RNA, 19 nt, Homo sapiens
ggaggaagaagaggaagaa

SEQ ID NO: 1452806 - RNA, 19 nt, Homo sapiens
caacauauacuucuuugcu

SEQ ID NO: 1452807 - RNA, 19 nt, Homo sapiens
uauagucacuccaaagaag

SEQ ID NO: 1452808 - RNA, 19 nt, Homo sapiens
ggaaccugcuccaagaaag

SEQ ID NO: 1452809 - RNA, 19 nt, Homo sapiens
aggaaacccuugcauagga

SEQ ID NO: 1452810 - RNA, 19 nt, Homo sapiens
gacaauaaccgggcuagga

SEQ ID NO: 1452811 - RNA, 19 nt, Homo sapiens
ccauggcccugaagauguu

SEQ ID NO: 1452812 - RNA, 19 nt, Homo sapiens
gggaguacccgugaacaaa

SEQ ID NO: 1452813 - RNA, 19 nt, Homo sapiens
ggaggaaggagggaagaaa

SEQ ID NO: 1452814 - RNA, 19 nt, Homo sapiens
uaucaggaauuuaccaucu

SEQ ID NO: 1452815 - RNA, 19 nt, Homo sapiens
agaagcccgucuuagagua

SEQ ID NO: 1452816 - RNA, 19 nt, Homo sapiens
aaacugccaugaaacucuu

SEQ ID NO: 1452817 - RNA, 19 nt, Homo sapiens
caaugaugcuugcacuauc

SEQ ID NO: 1452818 - RNA, 19 nt, Homo sapiens
gaagcucugagauguuuga

SEQ ID NO: 1452819 - RNA, 19 nt, Homo sapiens
uagaauaucugugggaaac

SEQ ID NO: 1452820 - RNA, 19 nt, Homo sapiens
cugagaaguuucccucuau

SEQ ID NO: 1452821 - RNA, 19 nt, Homo sapiens
agcagaagaugcccaggua

SEQ ID NO: 1452822 - RNA, 19 nt, Homo sapiens
ggccuacccuacuuauuca

SEQ ID NO: 1452823 - RNA, 19 nt, Homo sapiens
gcuagugaccauccagaaa

SEQ ID NO: 1452824 - RNA, 19 nt, Homo sapiens
ccugagacaucacagaauc

SEQ ID NO: 1452825 - RNA, 19 nt, Homo sapiens
gaaggagggaagaaauuag

SEQ ID NO: 1452826 - RNA, 19 nt, Homo sapiens
gaagaaagaugaguaguaa

SEQ ID NO: 1452827 - RNA, 19 nt, Homo sapiens
gaagaaauaugccaaauuc

SEQ ID NO: 1452828 - RNA, 19 nt, Homo sapiens
ggaaauccgugaaguguuu

SEQ ID NO: 1452829 - RNA, 19 nt, Homo sapiens
ccacggaccucauuacaua

SEQ ID NO: 1452830 - RNA, 19 nt, Homo sapiens
ugacagaaaugaugaagua

SEQ ID NO: 1452831 - RNA, 19 nt, Homo sapiens
gaaggaagcucucaagaag

SEQ ID NO: 1452832 - RNA, 19 nt, Homo sapiens
gaaaguggacugaacauuu

SEQ ID NO: 1452833 - RNA, 19 nt, Homo sapiens
caagauaacugcauucugu

SEQ ID NO: 1452834 - RNA, 19 nt, Homo sapiens
gaaagugacaugauaagua

SEQ ID NO: 1452835 - RNA, 19 nt, Homo sapiens
aaaguggacugaacauuua

SEQ ID NO: 1452836 - RNA, 19 nt, Homo sapiens
agauuuaccuccugaauua

SEQ ID NO: 1452837 - RNA, 19 nt, Homo sapiens
ugaagaaagugacaugaua

SEQ ID NO: 1452838 - RNA, 19 nt, Homo sapiens
ggacguggguuggcaauaa

SEQ ID NO: 1452839 - RNA, 19 nt, Homo sapiens
ggaaauuguuuguccauug

SEQ ID NO: 1452840 - RNA, 19 nt, Homo sapiens
guuagaagcuugauauuag

SEQ ID NO: 1452841 - RNA, 19 nt, Homo sapiens
ggacaucugccaauaauga

SEQ ID NO: 1452842 - RNA, 19 nt, Homo sapiens
gaagaaagugacaugauaa

SEQ ID NO: 1452843 - RNA, 19 nt, Homo sapiens
gaaaugacaguaccucaaa

SEQ ID NO: 1452844 - RNA, 19 nt, Homo sapiens
gaaagcugaugauaaggaa

SEQ ID NO: 1452845 - RNA, 19 nt, Homo sapiens
gaaacucaguauucaauca

SEQ ID NO: 1452846 - RNA, 19 nt, Homo sapiens
cuaaagacauuucagcauu

SEQ ID NO: 1452847 - RNA, 19 nt, Homo sapiens
gcacagauaccaagcuauu

SEQ ID NO: 1452848 - RNA, 19 nt, Homo sapiens
gagcacagauaccaagcua

SEQ ID NO: 1452849 - RNA, 19 nt, Homo sapiens
gcuaaaugcuggaaacuca

SEQ ID NO: 1452850 - RNA, 19 nt, Homo sapiens
gaggauggcagucagaaua

SEQ ID NO: 1452851 - RNA, 19 nt, Homo sapiens
gaacaaacaaacauacaga

SEQ ID NO: 1452852 - RNA, 19 nt, Homo sapiens
gaagaagucaaauucauug

SEQ ID NO: 1452853 - RNA, 19 nt, Homo sapiens
gaaaugugguuaauauugc

SEQ ID NO: 1452854 - RNA, 19 nt, Homo sapiens
ugaguucucugauuuaguu

SEQ ID NO: 1452855 - RNA, 19 nt, Homo sapiens
gaagaaggaaauaucguuu

SEQ ID NO: 1452856 - RNA, 19 nt, Homo sapiens
aaacagaaacuaccauuug

SEQ ID NO: 1452857 - RNA, 19 nt, Homo sapiens
ggaagaaauaugccaaauu

SEQ ID NO: 1452858 - RNA, 19 nt, Homo sapiens
guacaagcuucugaaauga

SEQ ID NO: 1452859 - RNA, 19 nt, Homo sapiens
uaaagacauuucagcauug

SEQ ID NO: 1452860 - RNA, 19 nt, Homo sapiens
uaacaggugugcauuucaa

SEQ ID NO: 1452861 - RNA, 19 nt, Homo sapiens
gcaaugaaagcugaugaua

SEQ ID NO: 1452862 - RNA, 19 nt, Homo sapiens
aaacggacguauucuguga

SEQ ID NO: 1452863 - RNA, 19 nt, Homo sapiens
acacacaggcccagcauua

SEQ ID NO: 1452864 - RNA, 19 nt, Homo sapiens
gacuuaaacuaaugacuga

SEQ ID NO: 1452865 - RNA, 19 nt, Homo sapiens
aaugaaagcugaugauaag

SEQ ID NO: 1452866 - RNA, 19 nt, Homo sapiens
gauaaugacagaaaugaug

SEQ ID NO: 1452867 - RNA, 19 nt, Homo sapiens
caaugaaagcugaugauaa

SEQ ID NO: 1452868 - RNA, 19 nt, Homo sapiens
gaggaggcccugcugauuu

SEQ ID NO: 1452869 - RNA, 19 nt, Homo sapiens
uagccacccuuaagaagua

SEQ ID NO: 1452870 - RNA, 19 nt, Homo sapiens
gcuacaaucucuggacaaa

SEQ ID NO: 1452871 - RNA, 19 nt, Homo sapiens
acacauuccuguccaaaga

SEQ ID NO: 1452872 - RNA, 19 nt, Homo sapiens
aaacaaacauacagacaca

SEQ ID NO: 1452873 - RNA, 19 nt, Homo sapiens
gaaauaugccaaauucaca

SEQ ID NO: 1452874 - RNA, 19 nt, Homo sapiens
gaaauuguuuguccauugc

SEQ ID NO: 1452875 - RNA, 19 nt, Homo sapiens
aagagaaacucccucagaa

SEQ ID NO: 1452876 - RNA, 19 nt, Homo sapiens
cauacagacacacaaauua

SEQ ID NO: 1452877 - RNA, 19 nt, Homo sapiens
uauaauggcuacagugcaa

SEQ ID NO: 1452878 - RNA, 19 nt, Homo sapiens
ccucagaacuccuaaaggu

SEQ ID NO: 1452879 - RNA, 19 nt, Homo sapiens
gaagagcuggcaucgauga

SEQ ID NO: 1452880 - RNA, 19 nt, Homo sapiens
aguacaagcuucugaaaug

SEQ ID NO: 1452881 - RNA, 19 nt, Homo sapiens
cauuacaucuucuuucuuc

SEQ ID NO: 1452882 - RNA, 19 nt, Homo sapiens
ggugugcauuucaagauaa

SEQ ID NO: 1452883 - RNA, 19 nt, Homo sapiens
gagaggauaaugacagaaa

SEQ ID NO: 1452884 - RNA, 19 nt, Homo sapiens
gacaauguacuguaucaaa

SEQ ID NO: 1452885 - RNA, 19 nt, Homo sapiens
uggaaacucuucaguacaa

SEQ ID NO: 1452886 - RNA, 19 nt, Homo sapiens
ucagaacuccuaaagguaa

SEQ ID NO: 1452887 - RNA, 19 nt, Homo sapiens
aaaaugagcucgagauuca

SEQ ID NO: 1452888 - RNA, 19 nt, Homo sapiens
uuacauacagcaucuagua

SEQ ID NO: 1452889 - RNA, 19 nt, Homo sapiens
gggcaaaagccaacuauua

SEQ ID NO: 1452890 - RNA, 19 nt, Homo sapiens
ggauucaaaggucauauaa

SEQ ID NO: 1452891 - RNA, 19 nt, Homo sapiens
ccagccaguucaucaagua

SEQ ID NO: 1452892 - RNA, 19 nt, Homo sapiens
caguguaucuucuuuguca

SEQ ID NO: 1452893 - RNA, 19 nt, Homo sapiens
caaggaacaaacaaacaua

SEQ ID NO: 1452894 - RNA, 19 nt, Homo sapiens
cauuguaacugguauauac

SEQ ID NO: 1452895 - RNA, 19 nt, Homo sapiens
gccugagucugguucuuua

SEQ ID NO: 1452896 - RNA, 19 nt, Homo sapiens
gagaugcugaggaugaaua

SEQ ID NO: 1452897 - RNA, 19 nt, Homo sapiens
gcuggaaacucaguauuca

SEQ ID NO: 1452898 - RNA, 19 nt, Homo sapiens
gcccugguauucuuuaguu

SEQ ID NO: 1452899 - RNA, 19 nt, Homo sapiens
caaugaaguuguuccgaau

SEQ ID NO: 1452900 - RNA, 19 nt, Homo sapiens
uaagagaaacucccucaga

SEQ ID NO: 1452901 - RNA, 19 nt, Homo sapiens
guucagugaccgagacuua

SEQ ID NO: 1452902 - RNA, 19 nt, Homo sapiens
ccaccgaccuuguaaaauu

SEQ ID NO: 1452903 - RNA, 19 nt, Homo sapiens
gcaguaaccacagauaaug

SEQ ID NO: 1452904 - RNA, 19 nt, Homo sapiens
acaaguagcacacuguaaa

SEQ ID NO: 1452905 - RNA, 19 nt, Homo sapiens
caacaacaggaaccucuuu

SEQ ID NO: 1452906 - RNA, 19 nt, Homo sapiens
gaaagaugaguaguaagaa

SEQ ID NO: 1452907 - RNA, 19 nt, Homo sapiens
agaagaaagaugaguagua

SEQ ID NO: 1452908 - RNA, 19 nt, Homo sapiens
uaucauccacuuacacuuu

SEQ ID NO: 1452909 - RNA, 19 nt, Homo sapiens
gcaguuuaacccugaaauu

SEQ ID NO: 1452910 - RNA, 19 nt, Homo sapiens
gugaagaauguacaagaua

SEQ ID NO: 1452911 - RNA, 19 nt, Homo sapiens
ugcaagggcucauaaggaa

SEQ ID NO: 1452912 - RNA, 19 nt, Homo sapiens
ugaaggaagcucucaagaa

SEQ ID NO: 1452913 - RNA, 19 nt, Homo sapiens
aacagaaacuaccauuuga

SEQ ID NO: 1452914 - RNA, 19 nt, Homo sapiens
gaucuggguuccgcugauu

SEQ ID NO: 1452915 - RNA, 19 nt, Homo sapiens
aggaagagcuggcaucgau

SEQ ID NO: 1452916 - RNA, 19 nt, Homo sapiens
ggguuccgcugauuccuuu

SEQ ID NO: 1452917 - RNA, 19 nt, Homo sapiens
ccaaaacaauuaccagauu

SEQ ID NO: 1452918 - RNA, 19 nt, Homo sapiens
gaguuucaguuacacauuc

SEQ ID NO: 1452919 - RNA, 19 nt, Homo sapiens
caaauuacagaagcacaua

SEQ ID NO: 1452920 - RNA, 19 nt, Homo sapiens
gcaaggaacaaacaaacau

SEQ ID NO: 1452921 - RNA, 19 nt, Homo sapiens
agaaagaugaguaguaaga

SEQ ID NO: 1452922 - RNA, 19 nt, Homo sapiens
gaaauaguucggacuugga

SEQ ID NO: 1452923 - RNA, 19 nt, Homo sapiens
gcugagaaccaaaguacaa

SEQ ID NO: 1452924 - RNA, 19 nt, Homo sapiens
uauggaaacucuucaguac

SEQ ID NO: 1452925 - RNA, 19 nt, Homo sapiens
aaacauacagacacacaaa

SEQ ID NO: 1452926 - RNA, 19 nt, Homo sapiens
guggaaagcuuuagaaaug

SEQ ID NO: 1452927 - RNA, 19 nt, Homo sapiens
gaacaaagcagcaccugaa

SEQ ID NO: 1452928 - RNA, 19 nt, Homo sapiens
gaagagaaguggcagcaau

SEQ ID NO: 1452929 - RNA, 19 nt, Homo sapiens
caaccuauaugguauguga

SEQ ID NO: 1452930 - RNA, 19 nt, Homo sapiens
ggacaauacucaauucaca

SEQ ID NO: 1452931 - RNA, 19 nt, Homo sapiens
caacagaauuuaucaagca

SEQ ID NO: 1452932 - RNA, 19 nt, Homo sapiens
gaagaagcaacagaauuua

SEQ ID NO: 1452933 - RNA, 19 nt, Homo sapiens
ugaagaagcaacagaauuu

SEQ ID NO: 1452934 - RNA, 19 nt, Homo sapiens
ggacuacgcgccuggagua

SEQ ID NO: 1452935 - RNA, 19 nt, Homo sapiens
ugacgacucuuaugaagug

SEQ ID NO: 1452936 - RNA, 19 nt, Homo sapiens
acaacuagcuggacaauac

SEQ ID NO: 1452937 - RNA, 19 nt, Homo sapiens
ggugguggcuuucuucuuc

SEQ ID NO: 1452938 - RNA, 19 nt, Homo sapiens
gcucggacuugcaucuuaa

SEQ ID NO: 1452939 - RNA, 19 nt, Homo sapiens
aaacuaguaucugcuguaa

SEQ ID NO: 1452940 - RNA, 19 nt, Homo sapiens
gcaauaaggcagucucuca

SEQ ID NO: 1452941 - RNA, 19 nt, Homo sapiens
cuuaugaaguguuggauuu

SEQ ID NO: 1452942 - RNA, 19 nt, Homo sapiens
ggaaagcuuuagaaaugau

SEQ ID NO: 1452943 - RNA, 19 nt, Homo sapiens
acaugaauauucucccaua

SEQ ID NO: 1452944 - RNA, 19 nt, Homo sapiens
caaagcagcaccugaaauc

SEQ ID NO: 1452945 - RNA, 19 nt, Homo sapiens
gaugacgacucuuaugaag

SEQ ID NO: 1452946 - RNA, 19 nt, Homo sapiens
aaagugaugacgacucuua

SEQ ID NO: 1452947 - RNA, 19 nt, Homo sapiens
gaaacgagcgaacaaagca

SEQ ID NO: 1452948 - RNA, 19 nt, Homo sapiens
ggauguagauauggagaga

SEQ ID NO: 1452949 - RNA, 19 nt, Homo sapiens
cagaauuuaucaagcagaa

SEQ ID NO: 1452950 - RNA, 19 nt, Homo sapiens
ggauuuaacugaguaugca

SEQ ID NO: 1452951 - RNA, 19 nt, Homo sapiens
aaagacagauuaagaaacg

SEQ ID NO: 1452952 - RNA, 19 nt, Homo sapiens
gaagcuuggcaaacuagua

SEQ ID NO: 1452953 - RNA, 19 nt, Homo sapiens
guaauacccuuuuguggaa

SEQ ID NO: 1452954 - RNA, 19 nt, Homo sapiens
caugaauauucucccauaa

SEQ ID NO: 1452955 - RNA, 19 nt, Homo sapiens
gaagcaacagaauuuauca

SEQ ID NO: 1452956 - RNA, 19 nt, Homo sapiens
ggauucaacuaugagaaga

SEQ ID NO: 1452957 - RNA, 19 nt, Homo sapiens
gugguggaaucgaguguuu

SEQ ID NO: 1452958 - RNA, 19 nt, Homo sapiens
caaacuaguaucugcugua

SEQ ID NO: 1452959 - RNA, 19 nt, Homo sapiens
cucaguagcuacacagauu

SEQ ID NO: 1452960 - RNA, 19 nt, Homo sapiens
ugaaagugaugacgacucu

SEQ ID NO: 1452961 - RNA, 19 nt, Homo sapiens
uaugugaaccguaguauuc

SEQ ID NO: 1452962 - RNA, 19 nt, Homo sapiens
caucuuaaggacaugaaua

SEQ ID NO: 1452963 - RNA, 19 nt, Homo sapiens
gaauuuaucaagcagaaca

SEQ ID NO: 1452964 - RNA, 19 nt, Homo sapiens
ccaagacuaugaaagugau

SEQ ID NO: 1452965 - RNA, 19 nt, Homo sapiens
gcaccugaaaucaacaauu

SEQ ID NO: 1452966 - RNA, 19 nt, Homo sapiens
gcuggacaauacucaauuc

SEQ ID NO: 1452967 - RNA, 19 nt, Homo sapiens
cgacucuuaugaaguguug

SEQ ID NO: 1452968 - RNA, 19 nt, Homo sapiens
ugcaguaggugguggcuuu

SEQ ID NO: 1452969 - RNA, 19 nt, Homo sapiens
gggcaaggagaaacaacua

SEQ ID NO: 1452970 - RNA, 19 nt, Homo sapiens
uauguuggguuuauugcuu

SEQ ID NO: 1452971 - RNA, 19 nt, Homo sapiens
ucagauugcuagucauagu

SEQ ID NO: 1452972 - RNA, 19 nt, Homo sapiens
gugaugacgacucuuauga

SEQ ID NO: 1452973 - RNA, 19 nt, Homo sapiens
guggcuaugugcagauuga

SEQ ID NO: 1452974 - RNA, 19 nt, Homo sapiens
uggcuggugugcaggauuu

SEQ ID NO: 1452975 - RNA, 19 nt, Homo sapiens
caagcagaacauugugaua

SEQ ID NO: 1452976 - RNA, 19 nt, Homo sapiens
uggaaagcuuuagaaauga

SEQ ID NO: 1452977 - RNA, 19 nt, Homo sapiens
gaaacaacuagcuggacaa

SEQ ID NO: 1452978 - RNA, 19 nt, Homo sapiens
acuaguaucugcuguaaaa

SEQ ID NO: 1452979 - RNA, 19 nt, Homo sapiens
uaagaaacgagcgaacaaa

SEQ ID NO: 1452980 - RNA, 19 nt, Homo sapiens
caauaaggcagucucucaa

SEQ ID NO: 1452981 - RNA, 19 nt, Homo sapiens
aagagaaguggcagcaaua

SEQ ID NO: 1452982 - RNA, 19 nt, Homo sapiens
auaacggauucaacuauga

SEQ ID NO: 1452983 - RNA, 19 nt, Homo sapiens
ccauaacggauucaacuau

SEQ ID NO: 1452984 - RNA, 19 nt, Homo sapiens
gcagauugacuggaagaga

SEQ ID NO: 1452985 - RNA, 19 nt, Homo sapiens
ggagagaaaagaaauaugu

SEQ ID NO: 1452986 - RNA, 19 nt, Homo sapiens
ucugaagcuuggcaaacua

SEQ ID NO: 1452987 - RNA, 19 nt, Homo sapiens
uaacugaguaugcaagaag

SEQ ID NO: 1452988 - RNA, 19 nt, Homo sapiens
ugaauauucucccauaacg

SEQ ID NO: 1452989 - RNA, 19 nt, Homo sapiens
gacaauacucaauucacaa

SEQ ID NO: 1452990 - RNA, 19 nt, Homo sapiens
cuuaaggacaugaauauuc

SEQ ID NO: 1452991 - RNA, 19 nt, Homo sapiens
uggcuuucaucgcuuugua

SEQ ID NO: 1452992 - RNA, 19 nt, Homo sapiens
gcagaacauugugauaucc

SEQ ID NO: 1452993 - RNA, 19 nt, Homo sapiens
aagcagaacauugugauau

SEQ ID NO: 1452994 - RNA, 19 nt, Homo sapiens
cuucagauugcuagucaua

SEQ ID NO: 1452995 - RNA, 19 nt, Homo sapiens
ggccacaguucgggaccua

SEQ ID NO: 1452996 - RNA, 19 nt, Homo sapiens
guuuauugcuuagcgaaau

SEQ ID NO: 1452997 - RNA, 19 nt, Homo sapiens
ggggaccacuccagaauug

SEQ ID NO: 1452998 - RNA, 19 nt, Homo sapiens
auguagauauggagagaaa

SEQ ID NO: 1452999 - RNA, 19 nt, Homo sapiens
accauuggauguagauaug

SEQ ID NO: 1453000 - RNA, 19 nt, Homo sapiens
aaauaucaccauuggaugu

SEQ ID NO: 1453001 - RNA, 19 nt, Homo sapiens
aagcagcaccugaaaucaa

SEQ ID NO: 1453002 - RNA, 19 nt, Homo sapiens
cauuggauguagauaugga

SEQ ID NO: 1453003 - RNA, 19 nt, Homo sapiens
uaucaccauuggauguaga

SEQ ID NO: 1453004 - RNA, 19 nt, Homo sapiens
guaugugaaccguaguauu

SEQ ID NO: 1453005 - RNA, 19 nt, Homo sapiens
ugcucggacuugcaucuua

SEQ ID NO: 1453006 - RNA, 19 nt, Homo sapiens
uuaagaaacgagcgaacaa

SEQ ID NO: 1453007 - RNA, 19 nt, Homo sapiens
caauucacaacuuagcauu

SEQ ID NO: 1453008 - RNA, 19 nt, Homo sapiens
aauaaggcagucucucaaa

SEQ ID NO: 1453009 - RNA, 19 nt, Homo sapiens
agaagcaacagaauuuauc

SEQ ID NO: 1453010 - RNA, 19 nt, Homo sapiens
ugaugacgacucuuaugaa

SEQ ID NO: 1453011 - RNA, 19 nt, Homo sapiens
gaccauagacuuccauccu

SEQ ID NO: 1453012 - RNA, 19 nt, Homo sapiens
gagaaguggcagcaauaag

SEQ ID NO: 1453013 - RNA, 19 nt, Homo sapiens
gcuuucaucgcuuuguaaa

SEQ ID NO: 1453014 - RNA, 19 nt, Homo sapiens
agaaguggcagcaauaagg

SEQ ID NO: 1453015 - RNA, 19 nt, Homo sapiens
agagaaguggcagcaauaa

SEQ ID NO: 1453016 - RNA, 19 nt, Homo sapiens
guucgggaccuaugguaga

SEQ ID NO: 1453017 - RNA, 19 nt, Homo sapiens
aaacaaccuauaugguaug

SEQ ID NO: 1453018 - RNA, 19 nt, Homo sapiens
aagcuuggcaaacuaguau

SEQ ID NO: 1453019 - RNA, 19 nt, Homo sapiens
uguuggauuuaacugagua

SEQ ID NO: 1453020 - RNA, 19 nt, Homo sapiens
uugaagaagcaacagaauu

SEQ ID NO: 1453021 - RNA, 19 nt, Homo sapiens
auguuggguuuauugcuua

SEQ ID NO: 1453022 - RNA, 19 nt, Homo sapiens
ggcagucucucaaaaguca

SEQ ID NO: 1453023 - RNA, 19 nt, Homo sapiens
ccacaguucgggaccuaug

SEQ ID NO: 1453024 - RNA, 19 nt, Homo sapiens
agcagaacauugugauauc

SEQ ID NO: 1453025 - RNA, 19 nt, Homo sapiens
caccauuggauguagauau

SEQ ID NO: 1453026 - RNA, 19 nt, Homo sapiens
gaacagauauuagcgcuua

SEQ ID NO: 1453027 - RNA, 19 nt, Homo sapiens
aaagaugacuuccuuguua

SEQ ID NO: 1453028 - RNA, 19 nt, Homo sapiens
gaacaagaaugacaucuag

SEQ ID NO: 1453029 - RNA, 19 nt, Homo sapiens
gcaacuagcuccacuuuca

SEQ ID NO: 1453030 - RNA, 19 nt, Homo sapiens
gcucucagcuucccauaua

SEQ ID NO: 1453031 - RNA, 19 nt, Homo sapiens
gauagugacuccauuugua

SEQ ID NO: 1453032 - RNA, 19 nt, Homo sapiens
caacauuucugacaucuga

SEQ ID NO: 1453033 - RNA, 19 nt, Homo sapiens
gcacauuccucuacacuau

SEQ ID NO: 1453034 - RNA, 19 nt, Homo sapiens
gcaaugagauucugaggau

SEQ ID NO: 1453035 - RNA, 19 nt, Homo sapiens
gcuaauuucuccauaguuu

SEQ ID NO: 1453036 - RNA, 19 nt, Homo sapiens
uaaagacacugguagauga

SEQ ID NO: 1453037 - RNA, 19 nt, Homo sapiens
gaaacagaauugacaucua

SEQ ID NO: 1453038 - RNA, 19 nt, Homo sapiens
caacagcuguauccaaauu

SEQ ID NO: 1453039 - RNA, 19 nt, Homo sapiens
ccaaugagauggaaacaga

SEQ ID NO: 1453040 - RNA, 19 nt, Homo sapiens
gaaacagccucuaaauaca

SEQ ID NO: 1453041 - RNA, 19 nt, Homo sapiens
ugacauggcucuuaucuag

SEQ ID NO: 1453042 - RNA, 19 nt, Homo sapiens
gaugacaacucaagguauu

SEQ ID NO: 1453043 - RNA, 19 nt, Homo sapiens
agaagcaacucaaccaaua

SEQ ID NO: 1453044 - RNA, 19 nt, Homo sapiens
ggaagaugauccugcauga

SEQ ID NO: 1453045 - RNA, 19 nt, Homo sapiens
gcaaacaucuacauuggau

SEQ ID NO: 1453046 - RNA, 19 nt, Homo sapiens
ucaaaucuauccucaacua

SEQ ID NO: 1453047 - RNA, 19 nt, Homo sapiens
gaagacgucuggcuuguca

SEQ ID NO: 1453048 - RNA, 19 nt, Homo sapiens
ggcaacaacugauaugaaa

SEQ ID NO: 1453049 - RNA, 19 nt, Homo sapiens
uuagaacucuuccugaaua

SEQ ID NO: 1453050 - RNA, 19 nt, Homo sapiens
ggacucccuucuaaauaua

SEQ ID NO: 1453051 - RNA, 19 nt, Homo sapiens
ucacacaucucugccaaua

SEQ ID NO: 1453052 - RNA, 19 nt, Homo sapiens
gcaauuguauuuggaggua

SEQ ID NO: 1453053 - RNA, 19 nt, Homo sapiens
gaagagacaaagauuauug

SEQ ID NO: 1453054 - RNA, 19 nt, Homo sapiens
gaacauacccacagcugaa

SEQ ID NO: 1453055 - RNA, 19 nt, Homo sapiens
uaaccaauaugccugaauu

SEQ ID NO: 1453056 - RNA, 19 nt, Homo sapiens
gauauuagcgcuuauaaca

SEQ ID NO: 1453057 - RNA, 19 nt, Homo sapiens
ccacagagccuggaaauug

SEQ ID NO: 1453058 - RNA, 19 nt, Homo sapiens
ugagaacccuucauuauca

SEQ ID NO: 1453059 - RNA, 19 nt, Homo sapiens
caacguccacuccuauuua

SEQ ID NO: 1453060 - RNA, 19 nt, Homo sapiens
ucaguugccucuuucauuu

SEQ ID NO: 1453061 - RNA, 19 nt, Homo sapiens
aggcacaccuucagaaaua

SEQ ID NO: 1453062 - RNA, 19 nt, Homo sapiens
cugccuagcucuacaauaa

SEQ ID NO: 1453063 - RNA, 19 nt, Homo sapiens
uaagagcacuggagcuauu

SEQ ID NO: 1453064 - RNA, 19 nt, Homo sapiens
gcacagacccugagaccaa

SEQ ID NO: 1453065 - RNA, 19 nt, Homo sapiens
gcaaugucaucaauuccua

SEQ ID NO: 1453066 - RNA, 19 nt, Homo sapiens
ccacauccauaaccaauau

SEQ ID NO: 1453067 - RNA, 19 nt, Homo sapiens
caccaugguuugcuaauuu

SEQ ID NO: 1453068 - RNA, 19 nt, Homo sapiens
acacuggacucccuucuaa

SEQ ID NO: 1453069 - RNA, 19 nt, Homo sapiens
gcugagaucucuacuccaa

SEQ ID NO: 1453070 - RNA, 19 nt, Homo sapiens
uccaguagauucuguauuu

SEQ ID NO: 1453071 - RNA, 19 nt, Homo sapiens
gaaaagacuuccuuaacaa

SEQ ID NO: 1453072 - RNA, 19 nt, Homo sapiens
cagcuggacuauauaauga

SEQ ID NO: 1453073 - RNA, 19 nt, Homo sapiens
caaccaauaucucaaguag

SEQ ID NO: 1453074 - RNA, 19 nt, Homo sapiens
gaacuuccuuugacaccaa

SEQ ID NO: 1453075 - RNA, 19 nt, Homo sapiens
ccaauaugccugaauuuaa

SEQ ID NO: 1453076 - RNA, 19 nt, Homo sapiens
gaaauaagcaaugagauuc

SEQ ID NO: 1453077 - RNA, 19 nt, Homo sapiens
gauggacacuugcuuacuu

SEQ ID NO: 1453078 - RNA, 19 nt, Homo sapiens
ucugacaucugacaugaua

SEQ ID NO: 1453079 - RNA, 19 nt, Homo sapiens
ggaccacacucccaucaau

SEQ ID NO: 1453080 - RNA, 19 nt, Homo sapiens
cuacaaugcuuccuagaga

SEQ ID NO: 1453081 - RNA, 19 nt, Homo sapiens
ugacuucaguugccucuuu

SEQ ID NO: 1453082 - RNA, 19 nt, Homo sapiens
cccauuaucuuaugagaaa

SEQ ID NO: 1453083 - RNA, 19 nt, Homo sapiens
ggauggaaaugccacaaga

SEQ ID NO: 1453084 - RNA, 19 nt, Homo sapiens
guaccuacauccaaugaga

SEQ ID NO: 1453085 - RNA, 19 nt, Homo sapiens
caaacuaugccacaucuuu

SEQ ID NO: 1453086 - RNA, 19 nt, Homo sapiens
gcagauagucuccauacuu

SEQ ID NO: 1453087 - RNA, 19 nt, Homo sapiens
gcaacagucucuucugaca

SEQ ID NO: 1453088 - RNA, 19 nt, Homo sapiens
cgagugcccuuccagcaua

SEQ ID NO: 1453089 - RNA, 19 nt, Homo sapiens
cacaguagguguucacauu

SEQ ID NO: 1453090 - RNA, 19 nt, Homo sapiens
gcaacaacacaaagauuaa

SEQ ID NO: 1453091 - RNA, 19 nt, Homo sapiens
gaagaugccaugucuacuu

SEQ ID NO: 1453092 - RNA, 19 nt, Homo sapiens
gucaaagucuucaacauau

SEQ ID NO: 1453093 - RNA, 19 nt, Homo sapiens
caaauugcuucaagaacuu

SEQ ID NO: 1453094 - RNA, 19 nt, Homo sapiens
ccaauuuccaccacuauua

SEQ ID NO: 1453095 - RNA, 19 nt, Homo sapiens
cuagaaagaugacuuccuu

SEQ ID NO: 1453096 - RNA, 19 nt, Homo sapiens
gaucacaccuacgaccuuu

SEQ ID NO: 1453097 - RNA, 19 nt, Homo sapiens
ccaggauacuucauuugua

SEQ ID NO: 1453098 - RNA, 19 nt, Homo sapiens
cauggagacuugauucgua

SEQ ID NO: 1453099 - RNA, 19 nt, Homo sapiens
uugcaaagcugaugaaaca

SEQ ID NO: 1453100 - RNA, 19 nt, Homo sapiens
caucaucacccucuacuuu

SEQ ID NO: 1453101 - RNA, 19 nt, Homo sapiens
cuauaaaugucacagauga

SEQ ID NO: 1453102 - RNA, 19 nt, Homo sapiens
gaaagaugacuuccuuguu

SEQ ID NO: 1453103 - RNA, 19 nt, Homo sapiens
cagaaucacuguuccugaa

SEQ ID NO: 1453104 - RNA, 19 nt, Homo sapiens
cagaugaggcuacaacuuu

SEQ ID NO: 1453105 - RNA, 19 nt, Homo sapiens
gcauccagguuguuugaaa

SEQ ID NO: 1453106 - RNA, 19 nt, Homo sapiens
gaauauuuauccgcaacua

SEQ ID NO: 1453107 - RNA, 19 nt, Homo sapiens
ggaacuguaccuugguuua

SEQ ID NO: 1453108 - RNA, 19 nt, Homo sapiens
caacuucucucccuauguc

SEQ ID NO: 1453109 - RNA, 19 nt, Homo sapiens
ggaacaagaaugacaucua

SEQ ID NO: 1453110 - RNA, 19 nt, Homo sapiens
gcaccucugucuuaucuuc

SEQ ID NO: 1453111 - RNA, 19 nt, Homo sapiens
gcucucagaugucucaaau

SEQ ID NO: 1453112 - RNA, 19 nt, Homo sapiens
gcacaaagggugacagcuu

SEQ ID NO: 1453113 - RNA, 19 nt, Homo sapiens
gcaacuucccauuaucuua

SEQ ID NO: 1453114 - RNA, 19 nt, Homo sapiens
gaaauaaauggugcaauug

SEQ ID NO: 1453115 - RNA, 19 nt, Homo sapiens
uggauggccuucucuuaua

SEQ ID NO: 1453116 - RNA, 19 nt, Homo sapiens
gaguugcaguggugacaua

SEQ ID NO: 1453117 - RNA, 19 nt, Homo sapiens
gagauaaguaugaaccuaa

SEQ ID NO: 1453118 - RNA, 19 nt, Homo sapiens
gauaugggauggugugaag

SEQ ID NO: 1453119 - RNA, 19 nt, Homo sapiens
ugaaacagccucuaaauac

SEQ ID NO: 1453120 - RNA, 19 nt, Homo sapiens
cagauagucuccauacuuc

SEQ ID NO: 1453121 - RNA, 19 nt, Homo sapiens
caauaccuaugucuacaaa

SEQ ID NO: 1453122 - RNA, 19 nt, Homo sapiens
gaucaauucuugguuguca

SEQ ID NO: 1453123 - RNA, 19 nt, Homo sapiens
uggcauggcuuucagcauu

SEQ ID NO: 1453124 - RNA, 19 nt, Homo sapiens
cuaaagaugucauggcaau

SEQ ID NO: 1453125 - RNA, 19 nt, Homo sapiens
caacuuugcccuuuguaaa

SEQ ID NO: 1453126 - RNA, 19 nt, Homo sapiens
gagaagaacucuaugaucu

SEQ ID NO: 1453127 - RNA, 19 nt, Homo sapiens
gaaauugaguguguagaaa

SEQ ID NO: 1453128 - RNA, 19 nt, Homo sapiens
gaacuggacugcauuucug

SEQ ID NO: 1453129 - RNA, 19 nt, Homo sapiens
gaccaaagagauuauguua

SEQ ID NO: 1453130 - RNA, 19 nt, Homo sapiens
gggcaaggauuucacaaga

SEQ ID NO: 1453131 - RNA, 19 nt, Homo sapiens
ucacagacauguugaggaa

SEQ ID NO: 1453132 - RNA, 19 nt, Homo sapiens
gcaaagaccgggugaaauc

SEQ ID NO: 1453133 - RNA, 19 nt, Homo sapiens
ggacugcauuucugugcua

SEQ ID NO: 1453134 - RNA, 19 nt, Homo sapiens
ccaagaccauggaaacaaa

SEQ ID NO: 1453135 - RNA, 19 nt, Homo sapiens
gcgaggaagcgaacacuua

SEQ ID NO: 1453136 - RNA, 19 nt, Homo sapiens
gagaagaccaacauguuaa

SEQ ID NO: 1453137 - RNA, 19 nt, Homo sapiens
ggaaacaaacagagaagaa

SEQ ID NO: 1453138 - RNA, 19 nt, Homo sapiens
guaguggccuccagaaugu

SEQ ID NO: 1453139 - RNA, 19 nt, Homo sapiens
acaccgaccugaucuuaaa

SEQ ID NO: 1453140 - RNA, 19 nt, Homo sapiens
gaaaugguagauaucgaua

SEQ ID NO: 1453141 - RNA, 19 nt, Homo sapiens
ggaaauugaguguguagaa

SEQ ID NO: 1453142 - RNA, 19 nt, Homo sapiens
gggaggaaauugagugugu

SEQ ID NO: 1453143 - RNA, 19 nt, Homo sapiens
gguggcagauucacugauu

SEQ ID NO: 1453144 - RNA, 19 nt, Homo sapiens
gaagaacucuaugaucucu

SEQ ID NO: 1453145 - RNA, 19 nt, Homo sapiens
uaaauuaccuucggaaacu

SEQ ID NO: 1453146 - RNA, 19 nt, Homo sapiens
guaguucucuuuuaccuua

SEQ ID NO: 1453147 - RNA, 19 nt, Homo sapiens
ccaccaaucggaccaauuu

SEQ ID NO: 1453148 - RNA, 19 nt, Homo sapiens
gcaaggauuucacaagaac

SEQ ID NO: 1453149 - RNA, 19 nt, Homo sapiens
gugcuaugcuuaauuuaug

SEQ ID NO: 1453150 - RNA, 19 nt, Homo sapiens
gcacaacuccugcaucagu

SEQ ID NO: 1453151 - RNA, 19 nt, Homo sapiens
gaaaacaauuaccagcaua

SEQ ID NO: 1453152 - RNA, 19 nt, Homo sapiens
ggaggaaauugagugugua

SEQ ID NO: 1453153 - RNA, 19 nt, Homo sapiens
ggagugauagguuucauga

SEQ ID NO: 1453154 - RNA, 19 nt, Homo sapiens
ggacaucaucuucucuaaa

SEQ ID NO: 1453155 - RNA, 19 nt, Homo sapiens
gcuaggucauggauuauau

SEQ ID NO: 1453156 - RNA, 19 nt, Homo sapiens
acagacauguugaggaauu

SEQ ID NO: 1453157 - RNA, 19 nt, Homo sapiens
agagaagaccaacauguua

SEQ ID NO: 1453158 - RNA, 19 nt, Homo sapiens
ccauccagcucaccuacua

SEQ ID NO: 1453159 - RNA, 19 nt, Homo sapiens
guguagaaaugguagauau

SEQ ID NO: 1453160 - RNA, 19 nt, Homo sapiens
aaucugaccuguacacugu

SEQ ID NO: 1453161 - RNA, 19 nt, Homo sapiens
gacaucaucuucucuaaaa

SEQ ID NO: 1453162 - RNA, 19 nt, Homo sapiens
uuacgagagucaccuauug

SEQ ID NO: 1453163 - RNA, 19 nt, Homo sapiens
ggagggcuguguacaaugg

SEQ ID NO: 1453164 - RNA, 19 nt, Homo sapiens
acaccuaugucaagccuuu

SEQ ID NO: 1453165 - RNA, 19 nt, Homo sapiens
gagagucaccuauugguau

SEQ ID NO: 1453166 - RNA, 19 nt, Homo sapiens
ggcaaggauuucacaagaa

SEQ ID NO: 1453167 - RNA, 19 nt, Homo sapiens
gccgggaucaucaaucuua

SEQ ID NO: 1453168 - RNA, 19 nt, Homo sapiens
uggaagagcuaaagaaugc

SEQ ID NO: 1453169 - RNA, 19 nt, Homo sapiens
ucugugcuaugcuuaauuu

SEQ ID NO: 1453170 - RNA, 19 nt, Homo sapiens
ccacuggcuugccuaagaa

SEQ ID NO: 1453171 - RNA, 19 nt, Homo sapiens
gcuaucacauacccaauca

SEQ ID NO: 1453172 - RNA, 19 nt, Homo sapiens
ccauauauguauccugaau

SEQ ID NO: 1453173 - RNA, 19 nt, Homo sapiens
cuucaaaucugaccuguac

SEQ ID NO: 1453174 - RNA, 19 nt, Homo sapiens
ccauguaccuggucaccuu

SEQ ID NO: 1453175 - RNA, 19 nt, Homo sapiens
gaagaccagccgcguauca

SEQ ID NO: 1453176 - RNA, 19 nt, Homo sapiens
uuacacguuugcccauaua

SEQ ID NO: 1453177 - RNA, 19 nt, Homo sapiens
guacacuacugcccagcaa

SEQ ID NO: 1453178 - RNA, 19 nt, Homo sapiens
acaauuaccagcauaguau

SEQ ID NO: 1453179 - RNA, 19 nt, Homo sapiens
ucagaaauccaacagcaaa

SEQ ID NO: 1453180 - RNA, 19 nt, Homo sapiens
uuacaacagugugauaaug

SEQ ID NO: 1453181 - RNA, 19 nt, Homo sapiens
ucacaccgaccugaucuua

SEQ ID NO: 1453182 - RNA, 19 nt, Homo sapiens
cagauucacugauuaacgu

SEQ ID NO: 1453183 - RNA, 19 nt, Homo sapiens
agaacucuaugaucucuug

SEQ ID NO: 1453184 - RNA, 19 nt, Homo sapiens
gugcggauaucccgguuug

SEQ ID NO: 1453185 - RNA, 19 nt, Homo sapiens
cagcauaguaucuucugua

SEQ ID NO: 1453186 - RNA, 19 nt, Homo sapiens
ugauagguuucaugacauu

SEQ ID NO: 1453187 - RNA, 19 nt, Homo sapiens
ccuacuaccugcagucaau

SEQ ID NO: 1453188 - RNA, 19 nt, Homo sapiens
uaucaagaccaaagagauu

SEQ ID NO: 1453189 - RNA, 19 nt, Homo sapiens
gcugugccuucaaaucuga

SEQ ID NO: 1453190 - RNA, 19 nt, Homo sapiens
ggaucacucucacaguugu

SEQ ID NO: 1453191 - RNA, 19 nt, Homo sapiens
gaaacccugaggagacuuu

SEQ ID NO: 1453192 - RNA, 19 nt, Homo sapiens
gaggacaucaucuucucua

SEQ ID NO: 1453193 - RNA, 19 nt, Homo sapiens
auagaauacuggaacacua

SEQ ID NO: 1453194 - RNA, 19 nt, Homo sapiens
cuauuacugugacuggaua

SEQ ID NO: 1453195 - RNA, 19 nt, Homo sapiens
guauugcaaucuucuucaa

SEQ ID NO: 1453196 - RNA, 19 nt, Homo sapiens
uagagaagaccaacauguu

SEQ ID NO: 1453197 - RNA, 19 nt, Homo sapiens
cagcaaagaccgggugaaa

SEQ ID NO: 1453198 - RNA, 19 nt, Homo sapiens
agugauagguuucaugaca

SEQ ID NO: 1453199 - RNA, 19 nt, Homo sapiens
guggcagauucacugauua

SEQ ID NO: 1453200 - RNA, 19 nt, Homo sapiens
gguuugagagcuauuuaaa

SEQ ID NO: 1453201 - RNA, 19 nt, Homo sapiens
ucuaugaucucuuggaaac

SEQ ID NO: 1453202 - RNA, 19 nt, Homo sapiens
aggagaagccggcauggua

SEQ ID NO: 1453203 - RNA, 19 nt, Homo sapiens
uaauagcauuugucaccuu

SEQ ID NO: 1453204 - RNA, 19 nt, Homo sapiens
gacauuauggaaaguagaa

SEQ ID NO: 1453205 - RNA, 19 nt, Homo sapiens
uuguauacauggaucgaua

SEQ ID NO: 1453206 - RNA, 19 nt, Homo sapiens
guagcaaccgcgacacaaa

SEQ ID NO: 1453207 - RNA, 19 nt, Homo sapiens
ucaacuaccucuauguacu

SEQ ID NO: 1453208 - RNA, 19 nt, Homo sapiens
uuacuggugggaaauauaa

SEQ ID NO: 1453209 - RNA, 19 nt, Homo sapiens
ccaaauuacaacaguguga

SEQ ID NO: 1453210 - RNA, 19 nt, Homo sapiens
ucacugcuuugccauuuua

SEQ ID NO: 1453211 - RNA, 19 nt, Homo sapiens
guagaacuggacugcauuu

SEQ ID NO: 1453212 - RNA, 19 nt, Homo sapiens
ggauaaccaacaccuaugu

SEQ ID NO: 1453213 - RNA, 19 nt, Homo sapiens
agaccaacauguuaaagag

SEQ ID NO: 1453214 - RNA, 19 nt, Homo sapiens
caaucuuacuggugggaaa

SEQ ID NO: 1453215 - RNA, 19 nt, Homo sapiens
ccauaagccuggccacucu

SEQ ID NO: 1453216 - RNA, 19 nt, Homo sapiens
ucaacagucucaaugacau

SEQ ID NO: 1453217 - RNA, 19 nt, Homo sapiens
caaucaacagucucaauga

SEQ ID NO: 1453218 - RNA, 19 nt, Homo sapiens
cuauauuguuggucugauu

SEQ ID NO: 1453219 - RNA, 19 nt, Homo sapiens
cguggaguuuggagugaua

SEQ ID NO: 1453220 - RNA, 19 nt, Homo sapiens
cuggaucacucucacaguu

SEQ ID NO: 1453221 - RNA, 19 nt, Homo sapiens
cagaagaccagccgcguau

SEQ ID NO: 1453222 - RNA, 19 nt, Homo sapiens
ucaaucaacagucucaaug

SEQ ID NO: 1453223 - RNA, 19 nt, Homo sapiens
caccuucuuucacugcuuu

SEQ ID NO: 1453224 - RNA, 19 nt, Homo sapiens
gaaacaaacagagaagaac

SEQ ID NO: 1453225 - RNA, 19 nt, Homo sapiens
gaagauguucuagaauaca

SEQ ID NO: 1453226 - RNA, 19 nt, Homo sapiens
ugaaucagcugccauauaa

SEQ ID NO: 1453227 - RNA, 19 nt, Homo sapiens
ggacagaaauacuuuggaa

SEQ ID NO: 1453228 - RNA, 19 nt, Homo sapiens
ggagagaaaucauauugga

SEQ ID NO: 1453229 - RNA, 19 nt, Homo sapiens
gaccuaggauguaugguua

SEQ ID NO: 1453230 - RNA, 19 nt, Homo sapiens
ccacauuccucuacuguuu

SEQ ID NO: 1453231 - RNA, 19 nt, Homo sapiens
gcaccgaauucaacaauga

SEQ ID NO: 1453232 - RNA, 19 nt, Homo sapiens
cuacuaagguuucacauau

SEQ ID NO: 1453233 - RNA, 19 nt, Homo sapiens
ggaacagacuaaguuauuu

SEQ ID NO: 1453234 - RNA, 19 nt, Homo sapiens
ggaaaucaguguugguguu

SEQ ID NO: 1453235 - RNA, 19 nt, Homo sapiens
gaaagggagagaaaucaua

SEQ ID NO: 1453236 - RNA, 19 nt, Homo sapiens
gaucagacuuguuguggaa

SEQ ID NO: 1453237 - RNA, 19 nt, Homo sapiens
gaaaaguccuucugaugua

SEQ ID NO: 1453238 - RNA, 19 nt, Homo sapiens
gaacaagguuuacgagacu

SEQ ID NO: 1453239 - RNA, 19 nt, Homo sapiens
acaaagagccaaaguauau

SEQ ID NO: 1453240 - RNA, 19 nt, Homo sapiens
gagguuauaucucauuuag

SEQ ID NO: 1453241 - RNA, 19 nt, Homo sapiens
ggaguucaacccaguguua

SEQ ID NO: 1453242 - RNA, 19 nt, Homo sapiens
ggagagccaaguacuguua

SEQ ID NO: 1453243 - RNA, 19 nt, Homo sapiens
guaaaacucucaucucauu

SEQ ID NO: 1453244 - RNA, 19 nt, Homo sapiens
aagaaugucuccuggaauu

SEQ ID NO: 1453245 - RNA, 19 nt, Homo sapiens
guaaugcagugaagaagau

SEQ ID NO: 1453246 - RNA, 19 nt, Homo sapiens
ucugaaaucugcuuguaaa

SEQ ID NO: 1453247 - RNA, 19 nt, Homo sapiens
caacaggguacaaguauga

SEQ ID NO: 1453248 - RNA, 19 nt, Homo sapiens
gagcaucuguccuuucuac

SEQ ID NO: 1453249 - RNA, 19 nt, Homo sapiens
gagaagcggugaggcaaug

SEQ ID NO: 1453250 - RNA, 19 nt, Homo sapiens
gaaguauaugcaacucuua

SEQ ID NO: 1453251 - RNA, 19 nt, Homo sapiens
ggaaguggguauauuugag

SEQ ID NO: 1453252 - RNA, 19 nt, Homo sapiens
gccuaugaaugaucagaua

SEQ ID NO: 1453253 - RNA, 19 nt, Homo sapiens
gauguaugguuaacucuca

SEQ ID NO: 1453254 - RNA, 19 nt, Homo sapiens
caguagaggugacuucaug

SEQ ID NO: 1453255 - RNA, 19 nt, Homo sapiens
guucugaaaucugcuugua

SEQ ID NO: 1453256 - RNA, 19 nt, Homo sapiens
gcuagagaccuuugauuug

SEQ ID NO: 1453257 - RNA, 19 nt, Homo sapiens
guugguaggugccuugcua

SEQ ID NO: 1453258 - RNA, 19 nt, Homo sapiens
caaaugagagucaguucuu

SEQ ID NO: 1453259 - RNA, 19 nt, Homo sapiens
ugaaguauaugcaacucuu

SEQ ID NO: 1453260 - RNA, 19 nt, Homo sapiens
guggguauauuugagguua

SEQ ID NO: 1453261 - RNA, 19 nt, Homo sapiens
aauugaagcuguaaagguu

SEQ ID NO: 1453262 - RNA, 19 nt, Homo sapiens
agacugcugucgauccaua

SEQ ID NO: 1453263 - RNA, 19 nt, Homo sapiens
uuuaugagccucuuaguuu

SEQ ID NO: 1453264 - RNA, 19 nt, Homo sapiens
ggacaagacagccaguaga

SEQ ID NO: 1453265 - RNA, 19 nt, Homo sapiens
caaguaaacucugccucaa

SEQ ID NO: 1453266 - RNA, 19 nt, Homo sapiens
ggaaauacuguaauugaag

SEQ ID NO: 1453267 - RNA, 19 nt, Homo sapiens
acacaaagagccaaaguau

SEQ ID NO: 1453268 - RNA, 19 nt, Homo sapiens
ggcaauggaacaagguuua

SEQ ID NO: 1453269 - RNA, 19 nt, Homo sapiens
ggaaggaauuggugguuuu

SEQ ID NO: 1453270 - RNA, 19 nt, Homo sapiens
gcauguuugucaacuguau

SEQ ID NO: 1453271 - RNA, 19 nt, Homo sapiens
gcuccagccucaacucaga

SEQ ID NO: 1453272 - RNA, 19 nt, Homo sapiens
agaaauacuuuggaacaga

SEQ ID NO: 1453273 - RNA, 19 nt, Homo sapiens
gagccaaaguauauuaugc

SEQ ID NO: 1453274 - RNA, 19 nt, Homo sapiens
guaugaaggagugaaauuu

SEQ ID NO: 1453275 - RNA, 19 nt, Homo sapiens
ggacagccaggguuagaug

SEQ ID NO: 1453276 - RNA, 19 nt, Homo sapiens
cuagagaccuuugauuugg

SEQ ID NO: 1453277 - RNA, 19 nt, Homo sapiens
gacaagggagagccaagua

SEQ ID NO: 1453278 - RNA, 19 nt, Homo sapiens
cuguaaagguucuuauaga

SEQ ID NO: 1453279 - RNA, 19 nt, Homo sapiens
ggugguuucuugcuggauu

SEQ ID NO: 1453280 - RNA, 19 nt, Homo sapiens
ccguuccucuuuaucuuua

SEQ ID NO: 1453281 - RNA, 19 nt, Homo sapiens
gaaaucugcuuguaaaacu

SEQ ID NO: 1453282 - RNA, 19 nt, Homo sapiens
gagagaaaucauauuggaa

SEQ ID NO: 1453283 - RNA, 19 nt, Homo sapiens
uggaacagacuaaguuauu

SEQ ID NO: 1453284 - RNA, 19 nt, Homo sapiens
gacacaaagagccaaagua

SEQ ID NO: 1453285 - RNA, 19 nt, Homo sapiens
uuggaaagauccugauuca

SEQ ID NO: 1453286 - RNA, 19 nt, Homo sapiens
gaaaucaguguugguguuc

SEQ ID NO: 1453287 - RNA, 19 nt, Homo sapiens
guaggugccuugcuaagcu

SEQ ID NO: 1453288 - RNA, 19 nt, Homo sapiens
aaaugagagucaguucuuu

SEQ ID NO: 1453289 - RNA, 19 nt, Homo sapiens
ccagagaucacaauuuuaa

SEQ ID NO: 1453290 - RNA, 19 nt, Homo sapiens
cacaaagagccaaaguaua

SEQ ID NO: 1453291 - RNA, 19 nt, Homo sapiens
gguuaacucucaggccauu

SEQ ID NO: 1453292 - RNA, 19 nt, Homo sapiens
gugagcaucuguccuuucu

SEQ ID NO: 1453293 - RNA, 19 nt, Homo sapiens
ccaauucucagcacuggaa

SEQ ID NO: 1453294 - RNA, 19 nt, Homo sapiens
gaaggagugaaauuugaga

SEQ ID NO: 1453295 - RNA, 19 nt, Homo sapiens
uuucauggccaguaaguaa

SEQ ID NO: 1453296 - RNA, 19 nt, Homo sapiens
uggcagaccuaggauguau

SEQ ID NO: 1453297 - RNA, 19 nt, Homo sapiens
gaagcuguaaagguucuua

SEQ ID NO: 1453298 - RNA, 19 nt, Homo sapiens
cacuggaaauacuguaauu

SEQ ID NO: 1453299 - RNA, 19 nt, Homo sapiens
cuucugauguauccaauuc

SEQ ID NO: 1453300 - RNA, 19 nt, Homo sapiens
uuacgagacugcugucgau

SEQ ID NO: 1453301 - RNA, 19 nt, Homo sapiens
uuaagcugcugccuaugaa

SEQ ID NO: 1453302 - RNA, 19 nt, Homo sapiens
ucagagggcaacaguggua

SEQ ID NO: 1453303 - RNA, 19 nt, Homo sapiens
ugucacaaccagcaaguaa

SEQ ID NO: 1453304 - RNA, 19 nt, Homo sapiens
aaaagaaugucuccuggaa

SEQ ID NO: 1453305 - RNA, 19 nt, Homo sapiens
uaacuuggagaggagaaua

SEQ ID NO: 1453306 - RNA, 19 nt, Homo sapiens
aaucaaucauucaggaguu

SEQ ID NO: 1453307 - RNA, 19 nt, Homo sapiens
ggugccaaaucaaucauuc

SEQ ID NO: 1453308 - RNA, 19 nt, Homo sapiens
gcacuggaaauacuguaau

SEQ ID NO: 1453309 - RNA, 19 nt, Homo sapiens
ccagacauuuaccggagaa

SEQ ID NO: 1453310 - RNA, 19 nt, Homo sapiens
augaaggagugaaauuuga

SEQ ID NO: 1453311 - RNA, 19 nt, Homo sapiens
caaguaugaaggagugaaa

SEQ ID NO: 1453312 - RNA, 19 nt, Homo sapiens
ccaacaggguacaaguaug

SEQ ID NO: 1453313 - RNA, 19 nt, Homo sapiens
cagcugccauauaaagaau

SEQ ID NO: 1453314 - RNA, 19 nt, Homo sapiens
aaagggagagaaaucauau

SEQ ID NO: 1453315 - RNA, 19 nt, Homo sapiens
uuaugagccucuuaguuug

SEQ ID NO: 1453316 - RNA, 19 nt, Homo sapiens
gcuguaaagguucuuauag

SEQ ID NO: 1453317 - RNA, 19 nt, Homo sapiens
caaagagccaaaguauauu

SEQ ID NO: 1453318 - RNA, 19 nt, Homo sapiens
uggauuucauggccaguaa

SEQ ID NO: 1453319 - RNA, 19 nt, Homo sapiens
ggaacuguaacauuaaucu

SEQ ID NO: 1453320 - RNA, 19 nt, Homo sapiens
gcuguaaugcagugaagaa

SEQ ID NO: 1453321 - RNA, 19 nt, Homo sapiens
acuaagguuucacauaugu

SEQ ID NO: 1453322 - RNA, 19 nt, Homo sapiens
cauacgaauuggaaagauc

SEQ ID NO: 1453323 - RNA, 19 nt, Homo sapiens
uaugaaggagugaaauuug

SEQ ID NO: 1453324 - RNA, 19 nt, Homo sapiens
uagaggugacuucauguuu

SEQ ID NO: 1453325 - RNA, 19 nt, Homo sapiens
caguguugguguucugaaa

SEQ ID NO: 1453326 - RNA, 19 nt, Homo sapiens
gaacuugcuucgaagauuu

SEQ ID NO: 1453327 - RNA, 19 nt, Homo sapiens
gaggauguguucccaaaua

SEQ ID NO: 1453328 - RNA, 19 nt, Homo sapiens
gaagacaggucgauugcuu

SEQ ID NO: 1453329 - RNA, 19 nt, Homo sapiens
gaacuggccagaacaauau

SEQ ID NO: 1453330 - RNA, 19 nt, Homo sapiens
gagcuacucuaauucuuga

SEQ ID NO: 1453331 - RNA, 19 nt, Homo sapiens
caagagaggccuccauuug

SEQ ID NO: 1453332 - RNA, 19 nt, Homo sapiens
ggccagcacuuguguagaa

SEQ ID NO: 1453333 - RNA, 19 nt, Homo sapiens
cggcagaggugaaauacaa

SEQ ID NO: 1453334 - RNA, 19 nt, Homo sapiens
ggaacuugcuucgaagauu

SEQ ID NO: 1453335 - RNA, 19 nt, Homo sapiens
gagacccacucaagaauau

SEQ ID NO: 1453336 - RNA, 19 nt, Homo sapiens
aaaugaaagucuuggagua

SEQ ID NO: 1453337 - RNA, 19 nt, Homo sapiens
gauggaagcccugaaguuu

SEQ ID NO: 1453338 - RNA, 19 nt, Homo sapiens
ccacagaacuggccagaac

SEQ ID NO: 1453339 - RNA, 19 nt, Homo sapiens
ccaaauauccucaauagag

SEQ ID NO: 1453340 - RNA, 19 nt, Homo sapiens
ugaggcaacuaucauguuu

SEQ ID NO: 1453341 - RNA, 19 nt, Homo sapiens
gggaauauguaucacuuca

SEQ ID NO: 1453342 - RNA, 19 nt, Homo sapiens
ggagacccacucaagaaua

SEQ ID NO: 1453343 - RNA, 19 nt, Homo sapiens
ccagaucaccgauaggaua

SEQ ID NO: 1453344 - RNA, 19 nt, Homo sapiens
cuaauccaguugaauauga

SEQ ID NO: 1453345 - RNA, 19 nt, Homo sapiens
ggagcuggccagaagaaua

SEQ ID NO: 1453346 - RNA, 19 nt, Homo sapiens
gcacuuguguagaaagauc

SEQ ID NO: 1453347 - RNA, 19 nt, Homo sapiens
gggaggcuguggaagauga

SEQ ID NO: 1453348 - RNA, 19 nt, Homo sapiens
ggaaccuccucacuacuga

SEQ ID NO: 1453349 - RNA, 19 nt, Homo sapiens
caaaaccacugaucuguga

SEQ ID NO: 1453350 - RNA, 19 nt, Homo sapiens
ugaaugauaaggcaaauga

SEQ ID NO: 1453351 - RNA, 19 nt, Homo sapiens
gcaagagaggccuccauuu

SEQ ID NO: 1453352 - RNA, 19 nt, Homo sapiens
cgauugcuuuggugaauuu

SEQ ID NO: 1453353 - RNA, 19 nt, Homo sapiens
gagcuggccagaagaauau

SEQ ID NO: 1453354 - RNA, 19 nt, Homo sapiens
gcugacaccuacaauuuag

SEQ ID NO: 1453355 - RNA, 19 nt, Homo sapiens
gcagagaucaccgcagauu

SEQ ID NO: 1453356 - RNA, 19 nt, Homo sapiens
aaacugucauuuaccugua

SEQ ID NO: 1453357 - RNA, 19 nt, Homo sapiens
ggccagaagaauauaauaa

SEQ ID NO: 1453358 - RNA, 19 nt, Homo sapiens
aguuaaagaugccuuggua

SEQ ID NO: 1453359 - RNA, 19 nt, Homo sapiens
agacagcgcuaucuggaau

SEQ ID NO: 1453360 - RNA, 19 nt, Homo sapiens
ucccaaauauccucaauag

SEQ ID NO: 1453361 - RNA, 19 nt, Homo sapiens
cgacggcagaggugaaaua

SEQ ID NO: 1453362 - RNA, 19 nt, Homo sapiens
gaggacacuaugaaugaua

SEQ ID NO: 1453363 - RNA, 19 nt, Homo sapiens
acagggaaaucacaaagau

SEQ ID NO: 1453364 - RNA, 19 nt, Homo sapiens
ucauuuaccuguauuugca

SEQ ID NO: 1453365 - RNA, 19 nt, Homo sapiens
gcauuggggcucuaaauua

SEQ ID NO: 1453366 - RNA, 19 nt, Homo sapiens
uuaaagaugccuugguaaa

SEQ ID NO: 1453367 - RNA, 19 nt, Homo sapiens
uggaagcccugaaguuugu

SEQ ID NO: 1453368 - RNA, 19 nt, Homo sapiens
uggccaggcucuacagaaa

SEQ ID NO: 1453369 - RNA, 19 nt, Homo sapiens
gggcaaccgugucaaagag

SEQ ID NO: 1453370 - RNA, 19 nt, Homo sapiens
gaggagaugcugccuauac

SEQ ID NO: 1453371 - RNA, 19 nt, Homo sapiens
ccagaagaauauaauaagg

SEQ ID NO: 1453372 - RNA, 19 nt, Homo sapiens
ggaaaucacaaagauggaa

SEQ ID NO: 1453373 - RNA, 19 nt, Homo sapiens
gcaugcgauucuuggagua

SEQ ID NO: 1453374 - RNA, 19 nt, Homo sapiens
gacgagcaguccagacguu

SEQ ID NO: 1453375 - RNA, 19 nt, Homo sapiens
agaacuggccagaacaaua

SEQ ID NO: 1453376 - RNA, 19 nt, Homo sapiens
ccacuguccuacucuaauc

SEQ ID NO: 1453377 - RNA, 19 nt, Homo sapiens
uagggaauauguaucacuu

SEQ ID NO: 1453378 - RNA, 19 nt, Homo sapiens
acucuaauccaguugaaua

SEQ ID NO: 1453379 - RNA, 19 nt, Homo sapiens
gaagauuuaguguggaugu

SEQ ID NO: 1453380 - RNA, 19 nt, Homo sapiens
gcaaccagaaucagaggaa

SEQ ID NO: 1453381 - RNA, 19 nt, Homo sapiens
gcacaucuaccuccuuguc

SEQ ID NO: 1453382 - RNA, 19 nt, Homo sapiens
cggaggacacuaugaauga

SEQ ID NO: 1453383 - RNA, 19 nt, Homo sapiens
gcacuaauccccuugaguu

SEQ ID NO: 1453384 - RNA, 19 nt, Homo sapiens
ggcugacaccuacaauuua

SEQ ID NO: 1453385 - RNA, 19 nt, Homo sapiens
ggucuuguuucagcauaaa

SEQ ID NO: 1453386 - RNA, 19 nt, Homo sapiens
aguaguauuuccuuccuuu

SEQ ID NO: 1453387 - RNA, 19 nt, Homo sapiens
ccaaaucugaggcaacuau

SEQ ID NO: 1453388 - RNA, 19 nt, Homo sapiens
cccguaagcuuaugagaca

SEQ ID NO: 1453389 - RNA, 19 nt, Homo sapiens
ggagaaagcauuccaucac

SEQ ID NO: 1453390 - RNA, 19 nt, Homo sapiens
uaaugccaauccuagguuu

SEQ ID NO: 1453391 - RNA, 19 nt, Homo sapiens
ggaggacacuaugaaugau

SEQ ID NO: 1453392 - RNA, 19 nt, Homo sapiens
ccuccucacuacugacuuu

SEQ ID NO: 1453393 - RNA, 19 nt, Homo sapiens
cagcacuuguguagaaaga

SEQ ID NO: 1453394 - RNA, 19 nt, Homo sapiens
gaaagcgaccacagaacug

SEQ ID NO: 1453395 - RNA, 19 nt, Homo sapiens
gcaggccacuguccuacuc

SEQ ID NO: 1453396 - RNA, 19 nt, Homo sapiens
gcuacucuaauucuugaua

SEQ ID NO: 1453397 - RNA, 19 nt, Homo sapiens
ggucggaggacacuaugaa

SEQ ID NO: 1453398 - RNA, 19 nt, Homo sapiens
acacaaaacugucauuuac

SEQ ID NO: 1453399 - RNA, 19 nt, Homo sapiens
ucacacuggcaaagaauuu

SEQ ID NO: 1453400 - RNA, 19 nt, Homo sapiens
cugaggagaugcugccuau

SEQ ID NO: 1453401 - RNA, 19 nt, Homo sapiens
gaaugggaaccgagcaaga

SEQ ID NO: 1453402 - RNA, 19 nt, Homo sapiens
ggccacauccucuugaaug

SEQ ID NO: 1453403 - RNA, 19 nt, Homo sapiens
ugugauugcucucccuuug

SEQ ID NO: 1453404 - RNA, 19 nt, Homo sapiens
cagagaucaccgcagauua

SEQ ID NO: 1453405 - RNA, 19 nt, Homo sapiens
gaaauacaagcuacuaacg

SEQ ID NO: 1453406 - RNA, 19 nt, Homo sapiens
gaagucuagggaauaugua

SEQ ID NO: 1453407 - RNA, 19 nt, Homo sapiens
gaugggcaaccgugucaaa

SEQ ID NO: 1453408 - RNA, 19 nt, Homo sapiens
ucacaccagauuucacuuu

SEQ ID NO: 1453409 - RNA, 19 nt, Homo sapiens
aggacacuaugaaugauaa

SEQ ID NO: 1453410 - RNA, 19 nt, Homo sapiens
ugucagaugcccaugauga

SEQ ID NO: 1453411 - RNA, 19 nt, Homo sapiens
aggcugacaccuacaauuu

SEQ ID NO: 1453412 - RNA, 19 nt, Homo sapiens
ccacugaucugugauugcu

SEQ ID NO: 1453413 - RNA, 19 nt, Homo sapiens
cgugaagucuagggaauau

SEQ ID NO: 1453414 - RNA, 19 nt, Homo sapiens
acagaaagcgaccacagaa

SEQ ID NO: 1453415 - RNA, 19 nt, Homo sapiens
gauguagggagaaagcauu

SEQ ID NO: 1453416 - RNA, 19 nt, Homo sapiens
guccuacucuaauccaguu

SEQ ID NO: 1453417 - RNA, 19 nt, Homo sapiens
gucuggaacuugcuucgaa

SEQ ID NO: 1453418 - RNA, 19 nt, Homo sapiens
cagaaugcacgccacugua

SEQ ID NO: 1453419 - RNA, 19 nt, Homo sapiens
ggugaaauacaagcuacua

SEQ ID NO: 1453420 - RNA, 19 nt, Homo sapiens
gaaccugagaguuauugau

SEQ ID NO: 1453421 - RNA, 19 nt, Homo sapiens
gagaguacucagaucaguu

SEQ ID NO: 1453422 - RNA, 19 nt, Homo sapiens
ugauugcucucccuuugug

SEQ ID NO: 1453423 - RNA, 19 nt, Homo sapiens
cagcugaguggcauaaguu

SEQ ID NO: 1453424 - RNA, 19 nt, Homo sapiens
guaaugccaauccuagguu

SEQ ID NO: 1453425 - RNA, 19 nt, Homo sapiens
ugacaaaaccaaagaaaga

SEQ ID NO: 1453426 - RNA, 19 nt, Homo sapiens
gaagaaagcuacaucgaaa

SEQ ID NO: 1453427 - RNA, 19 nt, Homo sapiens
ggaaggaauuucagaauaa

SEQ ID NO: 1453428 - RNA, 19 nt, Homo sapiens
cgaaagaccuuggaagaua

SEQ ID NO: 1453429 - RNA, 19 nt, Homo sapiens
gaaagaagaccuguuuaua

SEQ ID NO: 1453430 - RNA, 19 nt, Homo sapiens
gaaaggcaauccaaaguau

SEQ ID NO: 1453431 - RNA, 19 nt, Homo sapiens
gcaauuauguccugcuuug

SEQ ID NO: 1453432 - RNA, 19 nt, Homo sapiens
gaagaccuguuuauacauu

SEQ ID NO: 1453433 - RNA, 19 nt, Homo sapiens
gaacaggcuucauuugaug

SEQ ID NO: 1453434 - RNA, 19 nt, Homo sapiens
ggaaacaccugcagacaca

SEQ ID NO: 1453435 - RNA, 19 nt, Homo sapiens
gcauaacgauucaaggaaa

SEQ ID NO: 1453436 - RNA, 19 nt, Homo sapiens
gacaaaggcuggugcagaa

SEQ ID NO: 1453437 - RNA, 19 nt, Homo sapiens
gauugugucuucuuuauga

SEQ ID NO: 1453438 - RNA, 19 nt, Homo sapiens
guacaaacacucccacuuu

SEQ ID NO: 1453439 - RNA, 19 nt, Homo sapiens
gaacaugcaucucuuacca

SEQ ID NO: 1453440 - RNA, 19 nt, Homo sapiens
ggacuucaauucagcauca

SEQ ID NO: 1453441 - RNA, 19 nt, Homo sapiens
ggaacaggcuucauuugau

SEQ ID NO: 1453442 - RNA, 19 nt, Homo sapiens
gagauugugucuucuuuau

SEQ ID NO: 1453443 - RNA, 19 nt, Homo sapiens
ugacugagauugugucuuc

SEQ ID NO: 1453444 - RNA, 19 nt, Homo sapiens
uacaaacacucccacuuua

SEQ ID NO: 1453445 - RNA, 19 nt, Homo sapiens
gaaauucagccuagauuau

SEQ ID NO: 1453446 - RNA, 19 nt, Homo sapiens
gaaagaccuuggaagauag

SEQ ID NO: 1453447 - RNA, 19 nt, Homo sapiens
gagaugacccaaacacuaa

SEQ ID NO: 1453448 - RNA, 19 nt, Homo sapiens
ggaaagaagaccuguuuau

SEQ ID NO: 1453449 - RNA, 19 nt, Homo sapiens
gaaucucccucucugguuu

SEQ ID NO: 1453450 - RNA, 19 nt, Homo sapiens
cggaaggaauuucagaaua

SEQ ID NO: 1453451 - RNA, 19 nt, Homo sapiens
caaacacucccacuuuaua

SEQ ID NO: 1453452 - RNA, 19 nt, Homo sapiens
guuuggaugugauuacuua

SEQ ID NO: 1453453 - RNA, 19 nt, Homo sapiens
caagagagaauguguaguu

SEQ ID NO: 1453454 - RNA, 19 nt, Homo sapiens
cuggaaagcugauguagaa

SEQ ID NO: 1453455 - RNA, 19 nt, Homo sapiens
gugaggagcugccuucuuc

SEQ ID NO: 1453456 - RNA, 19 nt, Homo sapiens
ccagagaccuacaagaugu

SEQ ID NO: 1453457 - RNA, 19 nt, Homo sapiens
gaacaaagaguagacuaug

SEQ ID NO: 1453458 - RNA, 19 nt, Homo sapiens
gaagcgaccuacccacugu

SEQ ID NO: 1453459 - RNA, 19 nt, Homo sapiens
gggcaugaaguguuauuua

SEQ ID NO: 1453460 - RNA, 19 nt, Homo sapiens
caaagagucucaggcaaga

SEQ ID NO: 1453461 - RNA, 19 nt, Homo sapiens
gcuggaaacuaagcagaua

SEQ ID NO: 1453462 - RNA, 19 nt, Homo sapiens
aagaagaccuguuuauaca

SEQ ID NO: 1453463 - RNA, 19 nt, Homo sapiens
ccagaaagaaaugguauua

SEQ ID NO: 1453464 - RNA, 19 nt, Homo sapiens
gaaaguuccuuaaguucca

SEQ ID NO: 1453465 - RNA, 19 nt, Homo sapiens
gcugaaucaugaccuuuaa

SEQ ID NO: 1453466 - RNA, 19 nt, Homo sapiens
gcacugggaguuaagcuuu

SEQ ID NO: 1453467 - RNA, 19 nt, Homo sapiens
agacuuugcuacaggauuu

SEQ ID NO: 1453468 - RNA, 19 nt, Homo sapiens
ugaaagaugugcaugucaa

SEQ ID NO: 1453469 - RNA, 19 nt, Homo sapiens
gcaaaggcaccauaaguca

SEQ ID NO: 1453470 - RNA, 19 nt, Homo sapiens
gaguccagcuuagagaaua

SEQ ID NO: 1453471 - RNA, 19 nt, Homo sapiens
agagagagcuauguuucua

SEQ ID NO: 1453472 - RNA, 19 nt, Homo sapiens
gaaacaaaguacagguagu

SEQ ID NO: 1453473 - RNA, 19 nt, Homo sapiens
gaagacaguugaggagauc

SEQ ID NO: 1453474 - RNA, 19 nt, Homo sapiens
gcccuuacguggacaaaga

SEQ ID NO: 1453475 - RNA, 19 nt, Homo sapiens
aggaucagcugaaucauga

SEQ ID NO: 1453476 - RNA, 19 nt, Homo sapiens
aauaggcacucucuacauu

SEQ ID NO: 1453477 - RNA, 19 nt, Homo sapiens
guaagugaaugccaaaguc

SEQ ID NO: 1453478 - RNA, 19 nt, Homo sapiens
caugaaguguuauuuagug

SEQ ID NO: 1453479 - RNA, 19 nt, Homo sapiens
ggcaugaaguguuauuuag

SEQ ID NO: 1453480 - RNA, 19 nt, Homo sapiens
ccaaugaacucaggaagca

SEQ ID NO: 1453481 - RNA, 19 nt, Homo sapiens
cuacaggauuucaggguuu

SEQ ID NO: 1453482 - RNA, 19 nt, Homo sapiens
ggccagaaccuuuaggaaa

SEQ ID NO: 1453483 - RNA, 19 nt, Homo sapiens
ggaacaagcacuccagcaa

SEQ ID NO: 1453484 - RNA, 19 nt, Homo sapiens
ucugccagcucccuucuua

SEQ ID NO: 1453485 - RNA, 19 nt, Homo sapiens
ccaagggccuaauguuugu

SEQ ID NO: 1453486 - RNA, 19 nt, Homo sapiens
gaccauacaagaagucauu

SEQ ID NO: 1453487 - RNA, 19 nt, Homo sapiens
ugacuucucuccugugcuu

SEQ ID NO: 1453488 - RNA, 19 nt, Homo sapiens
gaucuggaguagagaaauc

SEQ ID NO: 1453489 - RNA, 19 nt, Homo sapiens
ugucucaccucguuagaaa

SEQ ID NO: 1453490 - RNA, 19 nt, Homo sapiens
gaagauaggccuggaagag

SEQ ID NO: 1453491 - RNA, 19 nt, Homo sapiens
ugaaaggcaauccaaagua

SEQ ID NO: 1453492 - RNA, 19 nt, Homo sapiens
caccauugcuggaaaguuc

SEQ ID NO: 1453493 - RNA, 19 nt, Homo sapiens
gaugugggaaucagcauaa

SEQ ID NO: 1453494 - RNA, 19 nt, Homo sapiens
uaggcacucucuacauuaa

SEQ ID NO: 1453495 - RNA, 19 nt, Homo sapiens
ucaagaaccacaccagauu

SEQ ID NO: 1453496 - RNA, 19 nt, Homo sapiens
agaaauaccuacugauggu

SEQ ID NO: 1453497 - RNA, 19 nt, Homo sapiens
aaagaacacugagaacuag

SEQ ID NO: 1453498 - RNA, 19 nt, Homo sapiens
gcagacuagucauuucaau

SEQ ID NO: 1453499 - RNA, 19 nt, Homo sapiens
caaagaaauucagccuaga

SEQ ID NO: 1453500 - RNA, 19 nt, Homo sapiens
cgaagaaagcuacaucgaa

SEQ ID NO: 1453501 - RNA, 19 nt, Homo sapiens
aaacucagaccguucauug

SEQ ID NO: 1453502 - RNA, 19 nt, Homo sapiens
ugugauagcuggucaaacu

SEQ ID NO: 1453503 - RNA, 19 nt, Homo sapiens
guguggagcacuuguguua

SEQ ID NO: 1453504 - RNA, 19 nt, Homo sapiens
gggaacacuuugcccaaga

SEQ ID NO: 1453505 - RNA, 19 nt, Homo sapiens
gccaagagaugacccaaac

SEQ ID NO: 1453506 - RNA, 19 nt, Homo sapiens
gagcuauguuucuaaccaa

SEQ ID NO: 1453507 - RNA, 19 nt, Homo sapiens
caacaggauuuuaucguuu

SEQ ID NO: 1453508 - RNA, 19 nt, Homo sapiens
uaggaaagaagaccuguuu

SEQ ID NO: 1453509 - RNA, 19 nt, Homo sapiens
gaacucaggaagcaucuca

SEQ ID NO: 1453510 - RNA, 19 nt, Homo sapiens
gcaaaagaacuagacauua

SEQ ID NO: 1453511 - RNA, 19 nt, Homo sapiens
gguccugcauucugacuga

SEQ ID NO: 1453512 - RNA, 19 nt, Homo sapiens
aaacacucccacuuuauaa

SEQ ID NO: 1453513 - RNA, 19 nt, Homo sapiens
ggaacacuuugcccaagau

SEQ ID NO: 1453514 - RNA, 19 nt, Homo sapiens
acugguggcucuaaggaua

SEQ ID NO: 1453515 - RNA, 19 nt, Homo sapiens
aaagaagaccuguuuauac

SEQ ID NO: 1453516 - RNA, 19 nt, Homo sapiens
ggucuuggccagaaccuuu

SEQ ID NO: 1453517 - RNA, 19 nt, Homo sapiens
caacacaggucaaaaccaa

SEQ ID NO: 1453518 - RNA, 19 nt, Homo sapiens
gagaagacgaagaaagcua

SEQ ID NO: 1453519 - RNA, 19 nt, Homo sapiens
gcccugaucuggaguagag

SEQ ID NO: 1453520 - RNA, 19 nt, Homo sapiens
caggagcacugggaguuaa

SEQ ID NO: 1453521 - RNA, 19 nt, Homo sapiens
ccuaauguuuguuacagaa

SEQ ID NO: 1453522 - RNA, 19 nt, Homo sapiens
caucaguaguuacaauuag

SEQ ID NO: 1453523 - RNA, 19 nt, Homo sapiens
ggaacucucccaucaguag

SEQ ID NO: 1453524 - RNA, 19 nt, Homo sapiens
ucagaauaauuucguguuc

SEQ ID NO: 1453525 - RNA, 19 nt, Homo sapiens
gagagaauguguaguuuuc

SEQ ID NO: 1453526 - RNA, 19 nt, Homo sapiens
gagauaagauucagagguu

SEQ ID NO: 1453527 - RNA, 19 nt, Homo sapiens
guacaugggugacaacuug

SEQ ID NO: 1453528 - RNA, 19 nt, Homo sapiens
acacugacauccagaauaa

SEQ ID NO: 1453529 - RNA, 19 nt, Homo sapiens
gagaaacucuggaaacauc

SEQ ID NO: 1453530 - RNA, 19 nt, Homo sapiens
uagcagaaaugauguuuga

SEQ ID NO: 1453531 - RNA, 19 nt, Homo sapiens
aagaagcccuguacaagua

SEQ ID NO: 1453532 - RNA, 19 nt, Homo sapiens
gaggagacaucuugaagug

SEQ ID NO: 1453533 - RNA, 19 nt, Homo sapiens
gggaugagcuguaccaagu

SEQ ID NO: 1453534 - RNA, 19 nt, Homo sapiens
ggacaucugugguucaaag

SEQ ID NO: 1453535 - RNA, 19 nt, Homo sapiens
uagcaagacuuaaucagaa

SEQ ID NO: 1453536 - RNA, 19 nt, Homo sapiens
ggugacaacuugaaacuuc

SEQ ID NO: 1453537 - RNA, 19 nt, Homo sapiens
acaaggccgugguaaauaa

SEQ ID NO: 1453538 - RNA, 19 nt, Homo sapiens
gagcagaggagacaucuug

SEQ ID NO: 1453539 - RNA, 19 nt, Homo sapiens
ggacaugucauccacuuug

SEQ ID NO: 1453540 - RNA, 19 nt, Homo sapiens
caacaaggccgugguaaau

SEQ ID NO: 1453541 - RNA, 19 nt, Homo sapiens
gagaaaagcuagcagaaau

SEQ ID NO: 1453542 - RNA, 19 nt, Homo sapiens
caaugugccuuuagcaaga

SEQ ID NO: 1453543 - RNA, 19 nt, Homo sapiens
gagaacauauuacagacau

SEQ ID NO: 1453544 - RNA, 19 nt, Homo sapiens
gcagaaaugauguuugaga

SEQ ID NO: 1453545 - RNA, 19 nt, Homo sapiens
cguaaguguucuuucuuua

SEQ ID NO: 1453546 - RNA, 19 nt, Homo sapiens
ucaaagagaaguugugcua

SEQ ID NO: 1453547 - RNA, 19 nt, Homo sapiens
ucagcaugauguucaauaa

SEQ ID NO: 1453548 - RNA, 19 nt, Homo sapiens
uaacuucccuugcauacuc

SEQ ID NO: 1453549 - RNA, 19 nt, Homo sapiens
cggcagacuucaaggagua

SEQ ID NO: 1453550 - RNA, 19 nt, Homo sapiens
gcaagaagcccuguacaag

SEQ ID NO: 1453551 - RNA, 19 nt, Homo sapiens
aggaaaggcucaugaagga

SEQ ID NO: 1453552 - RNA, 19 nt, Homo sapiens
caaagguacucccaucaag

SEQ ID NO: 1453553 - RNA, 19 nt, Homo sapiens
aaaggugccugucaucuca

SEQ ID NO: 1453554 - RNA, 19 nt, Homo sapiens
cuucugggcuucagcauga

SEQ ID NO: 1453555 - RNA, 19 nt, Homo sapiens
aaagagaaguugugcuaca

SEQ ID NO: 1453556 - RNA, 19 nt, Homo sapiens
ugacguaaguguucuuucu

SEQ ID NO: 1453557 - RNA, 19 nt, Homo sapiens
gagagguccugggagcaua

SEQ ID NO: 1453558 - RNA, 19 nt, Homo sapiens
gagaaagagcuacgcaaga

SEQ ID NO: 1453559 - RNA, 19 nt, Homo sapiens
gggaugacauggagaaacu

SEQ ID NO: 1453560 - RNA, 19 nt, Homo sapiens
gcagcaucaugaaguguga

SEQ ID NO: 1453561 - RNA, 19 nt, Homo sapiens
guaugaggcccuacauuug

SEQ ID NO: 1453562 - RNA, 19 nt, Homo sapiens
gauaagauucagagguuga

SEQ ID NO: 1453563 - RNA, 19 nt, Homo sapiens
gcauacagacugccagaug

SEQ ID NO: 1453564 - RNA, 19 nt, Homo sapiens
gaacagcuggcuuccaaag

SEQ ID NO: 1453565 - RNA, 19 nt, Homo sapiens
agaaagagcuacgcaagag

SEQ ID NO: 1453566 - RNA, 19 nt, Homo sapiens
ugaccgagcccucuuugaa

SEQ ID NO: 1453567 - RNA, 19 nt, Homo sapiens
ggaaguccaggagaacaua

SEQ ID NO: 1453568 - RNA, 19 nt, Homo sapiens
cgugguaaauaacaucaaa

SEQ ID NO: 1453569 - RNA, 19 nt, Homo sapiens
guuucuaccugucuaauca

SEQ ID NO: 1453570 - RNA, 19 nt, Homo sapiens
caagaagcccuguacaagu

SEQ ID NO: 1453571 - RNA, 19 nt, Homo sapiens
uuacagacauguuuaaucc

SEQ ID NO: 1453572 - RNA, 19 nt, Homo sapiens
caggagaacauauuacaga

SEQ ID NO: 1453573 - RNA, 19 nt, Homo sapiens
cagcuggcuuccaaaggua

SEQ ID NO: 1453574 - RNA, 19 nt, Homo sapiens
gagagugacguaaguguuc

SEQ ID NO: 1453575 - RNA, 19 nt, Homo sapiens
gacacugacauccagaaua

SEQ ID NO: 1453576 - RNA, 19 nt, Homo sapiens
guaaauucaaugugccuuu

SEQ ID NO: 1453577 - RNA, 19 nt, Homo sapiens
gcagaggagacaucuugaa

SEQ ID NO: 1453578 - RNA, 19 nt, Homo sapiens
agauguuccugcuguaauu

SEQ ID NO: 1453579 - RNA, 19 nt, Homo sapiens
ugaccucuaugagcaguuu

SEQ ID NO: 1453580 - RNA, 19 nt, Homo sapiens
ggguuuaacuucccuugca

SEQ ID NO: 1453581 - RNA, 19 nt, Homo sapiens
aaagcuagcagaaaugaug

SEQ ID NO: 1453582 - RNA, 19 nt, Homo sapiens
aguaugaggcccuacauuu

SEQ ID NO: 1453583 - RNA, 19 nt, Homo sapiens
cuugggacauuguaaauuc

SEQ ID NO: 1453584 - RNA, 19 nt, Homo sapiens
ccucuuugcuagcggguuu

SEQ ID NO: 1453585 - RNA, 19 nt, Homo sapiens
gcagucaccaaacucugua

SEQ ID NO: 1453586 - RNA, 19 nt, Homo sapiens
uaacaucaaagagaaguug

SEQ ID NO: 1453587 - RNA, 19 nt, Homo sapiens
ucaacaaggccgugguaaa

SEQ ID NO: 1453588 - RNA, 19 nt, Homo sapiens
uggagaaacucuggaaaca

SEQ ID NO: 1453589 - RNA, 19 nt, Homo sapiens
ggcaagaagcccuguacaa

SEQ ID NO: 1453590 - RNA, 19 nt, Homo sapiens
cagcuucuccugauagaug

SEQ ID NO: 1453591 - RNA, 19 nt, Homo sapiens
ccaaagguacucccaucaa

SEQ ID NO: 1453592 - RNA, 19 nt, Homo sapiens
ccacagcccaggacucuca

SEQ ID NO: 1453593 - RNA, 19 nt, Homo sapiens
acguaaguguucuuucuuu

SEQ ID NO: 1453594 - RNA, 19 nt, Homo sapiens
guaacaggaugggaugaca

SEQ ID NO: 1453595 - RNA, 19 nt, Homo sapiens
caucugugguucaaagaag

SEQ ID NO: 1453596 - RNA, 19 nt, Homo sapiens
gaaaagcuagcagaaauga

SEQ ID NO: 1453597 - RNA, 19 nt, Homo sapiens
gaccgagcccucuuugaau

SEQ ID NO: 1453598 - RNA, 19 nt, Homo sapiens
gagcgggagcuuggaguaa

SEQ ID NO: 1453599 - RNA, 19 nt, Homo sapiens
gaugggaugacauggagaa

SEQ ID NO: 1453600 - RNA, 19 nt, Homo sapiens
cauugagcguggacuggua

SEQ ID NO: 1453601 - RNA, 19 nt, Homo sapiens
gcucaugaaggaaguggaa

SEQ ID NO: 1453602 - RNA, 19 nt, Homo sapiens
ccagcagcaucaugaagug

SEQ ID NO: 1453603 - RNA, 19 nt, Homo sapiens
gaagcccuguacaaguaug

SEQ ID NO: 1453604 - RNA, 19 nt, Homo sapiens
cagcaugauguucaauaaa

SEQ ID NO: 1453605 - RNA, 19 nt, Homo sapiens
ggaggaaaggcucaugaag

SEQ ID NO: 1453606 - RNA, 19 nt, Homo sapiens
gacaaugguucaggacucu

SEQ ID NO: 1453607 - RNA, 19 nt, Homo sapiens
ggagaacauauuacagaca

SEQ ID NO: 1453608 - RNA, 19 nt, Homo sapiens
acagcuggcuuccaaaggu

SEQ ID NO: 1453609 - RNA, 19 nt, Homo sapiens
gcaggccugucuggagaga

SEQ ID NO: 1453610 - RNA, 19 nt, Homo sapiens
ggagaaacucuggaaacau

SEQ ID NO: 1453611 - RNA, 19 nt, Homo sapiens
caaggaguaugggacaucu

SEQ ID NO: 1453612 - RNA, 19 nt, Homo sapiens
cauccaucaugaccucuau

SEQ ID NO: 1453613 - RNA, 19 nt, Homo sapiens
gaaguccaggagaacauau

SEQ ID NO: 1453614 - RNA, 19 nt, Homo sapiens
uuagcaagacuuaaucaga

SEQ ID NO: 1453615 - RNA, 19 nt, Homo sapiens
aaagguacucccaucaaga

SEQ ID NO: 1453616 - RNA, 19 nt, Homo sapiens
gacaugucauccacuuugg

SEQ ID NO: 1453617 - RNA, 19 nt, Homo sapiens
gcuagcagaaaugauguuu

SEQ ID NO: 1453618 - RNA, 19 nt, Homo sapiens
ucuggaaacaucucuuuga

SEQ ID NO: 1453619 - RNA, 19 nt, Homo sapiens
aggccugucuggagagauu

SEQ ID NO: 1453620 - RNA, 19 nt, Homo sapiens
gauguuccugcuguaauuu

SEQ ID NO: 1453621 - RNA, 19 nt, Homo sapiens
ggaaaggcucaugaaggaa

SEQ ID NO: 1453622 - RNA, 19 nt, Homo sapiens
ugacauccagaauaaacuu

SEQ ID NO: 1453623 - RNA, 19 nt, Homo sapiens
guaccaagugcccgagguu

SEQ ID NO: 1453624 - RNA, 19 nt, Homo sapiens
aacaaggccgugguaaaua

SEQ ID NO: 1453625 - RNA, 19 nt, Homo sapiens
guucaggacucugcaaagc

SEQ ID NO: 1453626 - RNA, 19 nt, Homo sapiens
acaguuccaucaagaguua

SEQ ID NO: 1453627 - RNA, 19 nt, Homo sapiens
gagaaggccgcuaugagua

SEQ ID NO: 1453628 - RNA, 19 nt, Homo sapiens
gcaguuccagcaacaguua

SEQ ID NO: 1453629 - RNA, 19 nt, Homo sapiens
ggagaaggccgcuaugagu

SEQ ID NO: 1453630 - RNA, 19 nt, Homo sapiens
ggaggccacucacccaaug

SEQ ID NO: 1453631 - RNA, 19 nt, Homo sapiens
ccaaggacuaguauaagua

SEQ ID NO: 1453632 - RNA, 19 nt, Homo sapiens
uauguuaacuacccaagga

SEQ ID NO: 1453633 - RNA, 19 nt, Homo sapiens
agaauuuccuguuaagauc

SEQ ID NO: 1453634 - RNA, 19 nt, Homo sapiens
gagugaccauuacggaaga

SEQ ID NO: 1453635 - RNA, 19 nt, Homo sapiens
ccaccacuauggaggagaa

SEQ ID NO: 1453636 - RNA, 19 nt, Homo sapiens
acagauccagcaacaguua

SEQ ID NO: 1453637 - RNA, 19 nt, Homo sapiens
cgacagauccagcaacagu

SEQ ID NO: 1453638 - RNA, 19 nt, Homo sapiens
caacagcggaggccacuca

SEQ ID NO: 1453639 - RNA, 19 nt, Homo sapiens
caacagcggaggccacuca

SEQ ID NO: 1453640 - RNA, 19 nt, Homo sapiens
ccaccgcuauggaggagaa

SEQ ID NO: 1453641 - RNA, 19 nt, Homo sapiens
gaggaggccacuacgaaga

SEQ ID NO: 1453642 - RNA, 19 nt, Homo sapiens
gaggagaaggccgcuauga

SEQ ID NO: 1453643 - RNA, 19 nt, Homo sapiens
gaggagaaggccgcuauga

SEQ ID NO: 1453644 - RNA, 19 nt, Homo sapiens
ggccgcagcaguuccagua

SEQ ID NO: 1453645 - RNA, 19 nt, Homo sapiens
cccaaggacuaguauaagu

SEQ ID NO: 1453646 - RNA, 19 nt, Homo sapiens
uacccaaggacuaguauaa

SEQ ID NO: 1453647 - RNA, 19 nt, Homo sapiens
caacagcggaggccguuca

SEQ ID NO: 1453648 - RNA, 19 nt, Homo sapiens
caacaguuccaacaacagu

SEQ ID NO: 1453649 - RNA, 19 nt, Homo sapiens
acaguuccagcaacaguua

SEQ ID NO: 1453650 - RNA, 19 nt, Homo sapiens
gaguaggaggccacuauga

SEQ ID NO: 1453651 - RNA, 19 nt, Homo sapiens
ggaggaggaggccguuaug

SEQ ID NO: 1453652 - RNA, 19 nt, Homo sapiens
acaguuccagcaacaguua

SEQ ID NO: 1453653 - RNA, 19 nt, Homo sapiens
cacgacagauccagcaaca

SEQ ID NO: 1453654 - RNA, 19 nt, Homo sapiens
ccagagcgaccacuaugga

SEQ ID NO: 1453655 - RNA, 19 nt, Homo sapiens
caaggacuaguauaaguag

SEQ ID NO: 1453656 - RNA, 19 nt, Homo sapiens
ggaguaggaggccacuaug

SEQ ID NO: 1453657 - RNA, 19 nt, Homo sapiens
caacaguuccagcaacagu

SEQ ID NO: 1453658 - RNA, 19 nt, Homo sapiens
ccuguuaagaucuccauuu

SEQ ID NO: 1453659 - RNA, 19 nt, Homo sapiens
guauaaguaggaguuguuu

SEQ ID NO: 1453660 - RNA, 19 nt, Homo sapiens
ccucaacaguuccaacaac

SEQ ID NO: 1453661 - RNA, 19 nt, Homo sapiens
gagaagaaggcugcuacga

SEQ ID NO: 1453662 - RNA, 19 nt, Homo sapiens
gaggaggaggccguuauga

SEQ ID NO: 1453663 - RNA, 19 nt, Homo sapiens
guuaacuacccaaggacua

SEQ ID NO: 1453664 - RNA, 19 nt, Homo sapiens
cgugacaguuccagcaaca

SEQ ID NO: 1453665 - RNA, 19 nt, Homo sapiens
ccuguucuauguuaacuac

SEQ ID NO: 1453666 - RNA, 19 nt, Homo sapiens
cgcgacaguuccaucaaga

SEQ ID NO: 1453667 - RNA, 19 nt, Homo sapiens
gaagaggaggcugcuacga

SEQ ID NO: 1453668 - RNA, 19 nt, Homo sapiens
cggaguaggaggccacuau

SEQ ID NO: 1453669 - RNA, 19 nt, Homo sapiens
gacaguuccaucaagaguu

SEQ ID NO: 1453670 - RNA, 19 nt, Homo sapiens
ggagaaccgaggucacucu

SEQ ID NO: 1453671 - RNA, 19 nt, Homo sapiens
cgcaacaguuccagcaaca

SEQ ID NO: 1453672 - RNA, 19 nt, Homo sapiens
ccagagcaaccgcuaugga

SEQ ID NO: 1453673 - RNA, 19 nt, Homo sapiens
cacagcaguuccagcaaca

SEQ ID NO: 1453674 - RNA, 19 nt, Homo sapiens
ccagagccaccacuaugga

SEQ ID NO: 1453675 - RNA, 19 nt, Homo sapiens
cgacaguuccaucaagagu

SEQ ID NO: 1453676 - RNA, 19 nt, Homo sapiens
ggccuugccagucgucuug

SEQ ID NO: 1453677 - RNA, 19 nt, Homo sapiens
ggaggccacuacgaagagu

SEQ ID NO: 1453678 - RNA, 19 nt, Homo sapiens
gaggagaaccgaggucacu

SEQ ID NO: 1453679 - RNA, 19 nt, Homo sapiens
gccgcucccuugaugacaa

SEQ ID NO: 1453680 - RNA, 19 nt, Homo sapiens
ugaccgcuacggagaagaa

SEQ ID NO: 1453681 - RNA, 19 nt, Homo sapiens
cuaagcaggaacagacuug

SEQ ID NO: 1453682 - RNA, 19 nt, Homo sapiens
gaauuuccuguuaagaucu

SEQ ID NO: 1453683 - RNA, 19 nt, Homo sapiens
gauacuaagcaggaacaga

SEQ ID NO: 1453684 - RNA, 19 nt, Homo sapiens
ggccggagcagauacuaag

SEQ ID NO: 1453685 - RNA, 19 nt, Homo sapiens
gacagauccagcaacaguu

SEQ ID NO: 1453686 - RNA, 19 nt, Homo sapiens
ccgcgacaguuccaucaag

SEQ ID NO: 1453687 - RNA, 19 nt, Homo sapiens
gacaguuccagcaacaguu

SEQ ID NO: 1453688 - RNA, 19 nt, Homo sapiens
ccagagccaccgcuaugga

SEQ ID NO: 1453689 - RNA, 19 nt, Homo sapiens
ggagaaccgaggccacucu

SEQ ID NO: 1453690 - RNA, 19 nt, Homo sapiens
ggaggcugcuacgaggaau

SEQ ID NO: 1453691 - RNA, 19 nt, Homo sapiens
cccgaugccugcagugaag

SEQ ID NO: 1453692 - RNA, 19 nt, Homo sapiens
cucaacaguuccaacaaca

SEQ ID NO: 1453693 - RNA, 19 nt, Homo sapiens
gaggcugcuacgaggaaua

SEQ ID NO: 1453694 - RNA, 19 nt, Homo sapiens
ggaggagaaggccgcuaug

SEQ ID NO: 1453695 - RNA, 19 nt, Homo sapiens
aggaggaggccacuacgaa

SEQ ID NO: 1453696 - RNA, 19 nt, Homo sapiens
ggaggagaaggccgcuaug

SEQ ID NO: 1453697 - RNA, 19 nt, Homo sapiens
ccaaagagcuugauccaaa

SEQ ID NO: 1453698 - RNA, 19 nt, Homo sapiens
gaaagacccugaaaugcua

SEQ ID NO: 1453699 - RNA, 19 nt, Homo sapiens
gaaauuuccuugagacuug

SEQ ID NO: 1453700 - RNA, 19 nt, Homo sapiens
gaaaggaguacaucuauaa

SEQ ID NO: 1453701 - RNA, 19 nt, Homo sapiens
ggaaaggaguacaucuaua

SEQ ID NO: 1453702 - RNA, 19 nt, Homo sapiens
gaagacauguuuaggaaau

SEQ ID NO: 1453703 - RNA, 19 nt, Homo sapiens
caauauagaugaagaagga

SEQ ID NO: 1453704 - RNA, 19 nt, Homo sapiens
uaaaugagcggcuaauuaa

SEQ ID NO: 1453705 - RNA, 19 nt, Homo sapiens
ggcagaacguuaugaaaua

SEQ ID NO: 1453706 - RNA, 19 nt, Homo sapiens
aaacaugugugcugcauuu

SEQ ID NO: 1453707 - RNA, 19 nt, Homo sapiens
gaaagugccuggaaaauug

SEQ ID NO: 1453708 - RNA, 19 nt, Homo sapiens
caauacagcuacugaaguu

SEQ ID NO: 1453709 - RNA, 19 nt, Homo sapiens
cgaaacagaucaggaguaa

SEQ ID NO: 1453710 - RNA, 19 nt, Homo sapiens
gagcagauauuacaagaag

SEQ ID NO: 1453711 - RNA, 19 nt, Homo sapiens
uuacuuaugugaagccuua

SEQ ID NO: 1453712 - RNA, 19 nt, Homo sapiens
gaaacaacuuugaguauac

SEQ ID NO: 1453713 - RNA, 19 nt, Homo sapiens
cgacagaguucuacaagga

SEQ ID NO: 1453714 - RNA, 19 nt, Homo sapiens
gcaaguauccaccuaagaa

SEQ ID NO: 1453715 - RNA, 19 nt, Homo sapiens
ccaacagggugcuuacaua

SEQ ID NO: 1453716 - RNA, 19 nt, Homo sapiens
uaauugaucuccaguauag

SEQ ID NO: 1453717 - RNA, 19 nt, Homo sapiens
ugauauacauggaguguuu

SEQ ID NO: 1453718 - RNA, 19 nt, Homo sapiens
cuaaaugagcggcuaauua

SEQ ID NO: 1453719 - RNA, 19 nt, Homo sapiens
gcauugcacuugaacuaaa

SEQ ID NO: 1453720 - RNA, 19 nt, Homo sapiens
gugaacagcagauuaauuu

SEQ ID NO: 1453721 - RNA, 19 nt, Homo sapiens
uaaguuuccuucagcauuu

SEQ ID NO: 1453722 - RNA, 19 nt, Homo sapiens
ggccauaacccauuaauga

SEQ ID NO: 1453723 - RNA, 19 nt, Homo sapiens
gaaagugagugaguuggaa

SEQ ID NO: 1453724 - RNA, 19 nt, Homo sapiens
acagggugcuuacauauuu

SEQ ID NO: 1453725 - RNA, 19 nt, Homo sapiens
acaaagaacucacagaaag

SEQ ID NO: 1453726 - RNA, 19 nt, Homo sapiens
gggcuaaagucaaauuuca

SEQ ID NO: 1453727 - RNA, 19 nt, Homo sapiens
caauugauguugccacuga

SEQ ID NO: 1453728 - RNA, 19 nt, Homo sapiens
caagauaccagcacaagaa

SEQ ID NO: 1453729 - RNA, 19 nt, Homo sapiens
gcuaauugaucuccaguau

SEQ ID NO: 1453730 - RNA, 19 nt, Homo sapiens
ucaggagucuuuauucauu

SEQ ID NO: 1453731 - RNA, 19 nt, Homo sapiens
uaucugacauuauccauga

SEQ ID NO: 1453732 - RNA, 19 nt, Homo sapiens
gaaguaugcuuguuucacu

SEQ ID NO: 1453733 - RNA, 19 nt, Homo sapiens
gugaggaaaugcagaugua

SEQ ID NO: 1453734 - RNA, 19 nt, Homo sapiens
caacaggauuuccagauca

SEQ ID NO: 1453735 - RNA, 19 nt, Homo sapiens
aagauacgcugaaguguga

SEQ ID NO: 1453736 - RNA, 19 nt, Homo sapiens
ugauucagcuccaacuuaa

SEQ ID NO: 1453737 - RNA, 19 nt, Homo sapiens
aaacagaucaggaguaaug

SEQ ID NO: 1453738 - RNA, 19 nt, Homo sapiens
ggaguaguguaucccagua

SEQ ID NO: 1453739 - RNA, 19 nt, Homo sapiens
gcaacaggauuuccagauc

SEQ ID NO: 1453740 - RNA, 19 nt, Homo sapiens
cauaauaucagcagauuug

SEQ ID NO: 1453741 - RNA, 19 nt, Homo sapiens
gauaauaauugcuguaagc

SEQ ID NO: 1453742 - RNA, 19 nt, Homo sapiens
gagaaacaacuuugaguau

SEQ ID NO: 1453743 - RNA, 19 nt, Homo sapiens
gaaaauacccgacagaguu

SEQ ID NO: 1453744 - RNA, 19 nt, Homo sapiens
gaagaccgaguuugaaaga

SEQ ID NO: 1453745 - RNA, 19 nt, Homo sapiens
ugaaggagcaugagaaaga

SEQ ID NO: 1453746 - RNA, 19 nt, Homo sapiens
ccacugugcuugguuugua

SEQ ID NO: 1453747 - RNA, 19 nt, Homo sapiens
ugagagcuuucaucaguaa

SEQ ID NO: 1453748 - RNA, 19 nt, Homo sapiens
cagccaagcuagcaaguau

SEQ ID NO: 1453749 - RNA, 19 nt, Homo sapiens
caagguaaaugccaaagag

SEQ ID NO: 1453750 - RNA, 19 nt, Homo sapiens
gcaaauagugacagaccua

SEQ ID NO: 1453751 - RNA, 19 nt, Homo sapiens
gaaugaagcaucugcacuu

SEQ ID NO: 1453752 - RNA, 19 nt, Homo sapiens
ugagaaagacccugaaaug

SEQ ID NO: 1453753 - RNA, 19 nt, Homo sapiens
caggagucuuuauucauua

SEQ ID NO: 1453754 - RNA, 19 nt, Homo sapiens
uaagagagaagauucaaga

SEQ ID NO: 1453755 - RNA, 19 nt, Homo sapiens
gacauggaauuaagagaga

SEQ ID NO: 1453756 - RNA, 19 nt, Homo sapiens
ggauuccuauuaacuguga

SEQ ID NO: 1453757 - RNA, 19 nt, Homo sapiens
gauguguuauguccaugua

SEQ ID NO: 1453758 - RNA, 19 nt, Homo sapiens
uggaagacauguuuaggaa

SEQ ID NO: 1453759 - RNA, 19 nt, Homo sapiens
agaccgaguuugaaagaaa

SEQ ID NO: 1453760 - RNA, 19 nt, Homo sapiens
ucacuggccucucagaaau

SEQ ID NO: 1453761 - RNA, 19 nt, Homo sapiens
gagcucauaaacauucuua

SEQ ID NO: 1453762 - RNA, 19 nt, Homo sapiens
ugacaaagaacucacagaa

SEQ ID NO: 1453763 - RNA, 19 nt, Homo sapiens
gaaggcagaacguuaugaa

SEQ ID NO: 1453764 - RNA, 19 nt, Homo sapiens
gauagcugauguagcacua

SEQ ID NO: 1453765 - RNA, 19 nt, Homo sapiens
gaacuaaaugagcggcuaa

SEQ ID NO: 1453766 - RNA, 19 nt, Homo sapiens
cguacaaucuugacaacuu

SEQ ID NO: 1453767 - RNA, 19 nt, Homo sapiens
uuucugagauuuccaaguu

SEQ ID NO: 1453768 - RNA, 19 nt, Homo sapiens
gaagaaggagcaaugaaag

SEQ ID NO: 1453769 - RNA, 19 nt, Homo sapiens
ggaauuaagagagaagauu

SEQ ID NO: 1453770 - RNA, 19 nt, Homo sapiens
gcaauuagugguacaucaa

SEQ ID NO: 1453771 - RNA, 19 nt, Homo sapiens
caagaagacacaaugcauu

SEQ ID NO: 1453772 - RNA, 19 nt, Homo sapiens
guacaaucuugacaacuuc

SEQ ID NO: 1453773 - RNA, 19 nt, Homo sapiens
aaaggaagaccgaguuuga

SEQ ID NO: 1453774 - RNA, 19 nt, Homo sapiens
gacaaagaacucacagaaa

SEQ ID NO: 1453775 - RNA, 19 nt, Homo sapiens
guugaucguuccaauuuau

SEQ ID NO: 1453776 - RNA, 19 nt, Homo sapiens
ggauguccauuauagugaa

SEQ ID NO: 1453777 - RNA, 19 nt, Homo sapiens
ugaagaaggagcaaugaaa

SEQ ID NO: 1453778 - RNA, 19 nt, Homo sapiens
gugcagccaugccuaauuc

SEQ ID NO: 1453779 - RNA, 19 nt, Homo sapiens
gagggagucugagcacuga

SEQ ID NO: 1453780 - RNA, 19 nt, Homo sapiens
guacaucuauaaagaacca

SEQ ID NO: 1453781 - RNA, 19 nt, Homo sapiens
uuauagaacucuucaugga

SEQ ID NO: 1453782 - RNA, 19 nt, Homo sapiens
caaaggaagaguaaacaug

SEQ ID NO: 1453783 - RNA, 19 nt, Homo sapiens
caacagggugcuuacauau

SEQ ID NO: 1453784 - RNA, 19 nt, Homo sapiens
gaagggcuaaagucaaauu

SEQ ID NO: 1453785 - RNA, 19 nt, Homo sapiens
caaacgccguacaaucuug

SEQ ID NO: 1453786 - RNA, 19 nt, Homo sapiens
ggaguacaucuauaaagaa

SEQ ID NO: 1453787 - RNA, 19 nt, Homo sapiens
aggaguacaucuauaaaga

SEQ ID NO: 1453788 - RNA, 19 nt, Homo sapiens
ugagaaacaacuuugagua

SEQ ID NO: 1453789 - RNA, 19 nt, Homo sapiens
ucucuuaacuuacuggaau

SEQ ID NO: 1453790 - RNA, 19 nt, Homo sapiens
gauacucucuuaacuuacu

SEQ ID NO: 1453791 - RNA, 19 nt, Homo sapiens
gaagccuccugaugugcua

SEQ ID NO: 1453792 - RNA, 19 nt, Homo sapiens
agaaggagcaacaggauuu

SEQ ID NO: 1453793 - RNA, 19 nt, Homo sapiens
gaaccaacaagccaaaaua

SEQ ID NO: 1453794 - RNA, 19 nt, Homo sapiens
ggacaugauucagcuccaa

SEQ ID NO: 1453795 - RNA, 19 nt, Homo sapiens
gcacuaagcggaggaucaa

SEQ ID NO: 1453796 - RNA, 19 nt, Homo sapiens
acugauagcugauguagca

SEQ ID NO: 1453797 - RNA, 19 nt, Homo sapiens
ggaaagggcauccgacuua

SEQ ID NO: 1453798 - RNA, 19 nt, Homo sapiens
ggaauagacucaaguaugc

SEQ ID NO: 1453799 - RNA, 19 nt, Homo sapiens
gguaauaaaccuuggauuu

SEQ ID NO: 1453800 - RNA, 19 nt, Homo sapiens
gaacgauacugugcagauu

SEQ ID NO: 1453801 - RNA, 19 nt, Homo sapiens
gagaugagguaaagaagau

SEQ ID NO: 1453802 - RNA, 19 nt, Homo sapiens
ggaaagacauccugguucu

SEQ ID NO: 1453803 - RNA, 19 nt, Homo sapiens
acaaggauuuccaacauuu

SEQ ID NO: 1453804 - RNA, 19 nt, Homo sapiens
ccacaaggauuuccaacau

SEQ ID NO: 1453805 - RNA, 19 nt, Homo sapiens
gggaagauaaccagcuuua

SEQ ID NO: 1453806 - RNA, 19 nt, Homo sapiens
ucacauacccugcuggauu

SEQ ID NO: 1453807 - RNA, 19 nt, Homo sapiens
guaauaaaccuuggauuuc

SEQ ID NO: 1453808 - RNA, 19 nt, Homo sapiens
guaaagaagauauguaugc

SEQ ID NO: 1453809 - RNA, 19 nt, Homo sapiens
ggagaugagguaaagaaga

SEQ ID NO: 1453810 - RNA, 19 nt, Homo sapiens
cacaaggauuuccaacauu

SEQ ID NO: 1453811 - RNA, 19 nt, Homo sapiens
caauguauguauggugauu

SEQ ID NO: 1453812 - RNA, 19 nt, Homo sapiens
gaagauauguaugcaacac

SEQ ID NO: 1453813 - RNA, 19 nt, Homo sapiens
gaaagggcauccgacuuac

SEQ ID NO: 1453814 - RNA, 19 nt, Homo sapiens
caaaauugauggcaagguu

SEQ ID NO: 1453815 - RNA, 19 nt, Homo sapiens
cacauacccugcuggauuc

SEQ ID NO: 1453816 - RNA, 19 nt, Homo sapiens
gagguaaagaagauaugua

SEQ ID NO: 1453817 - RNA, 19 nt, Homo sapiens
ugacacaggcaauguaugu

SEQ ID NO: 1453818 - RNA, 19 nt, Homo sapiens
ucaugaugcucgaaccauu

SEQ ID NO: 1453819 - RNA, 19 nt, Homo sapiens
gcaaagugaggaagauuac

SEQ ID NO: 1453820 - RNA, 19 nt, Homo sapiens
gacuuacuauugcugaaga

SEQ ID NO: 1453821 - RNA, 19 nt, Homo sapiens
auacccugcuggauucaua

SEQ ID NO: 1453822 - RNA, 19 nt, Homo sapiens
gauaaacuaacugguguau

SEQ ID NO: 1453823 - RNA, 19 nt, Homo sapiens
uaauaaaccuuggauuucc

SEQ ID NO: 1453824 - RNA, 19 nt, Homo sapiens
uuuagggacugggaagaua

SEQ ID NO: 1453825 - RNA, 19 nt, Homo sapiens
cagauccucucaucaaggu

SEQ ID NO: 1453826 - RNA, 19 nt, Homo sapiens
ucaggaauagacucaagua

SEQ ID NO: 1453827 - RNA, 19 nt, Homo sapiens
ggcauccgacuuacuauug

SEQ ID NO: 1453828 - RNA, 19 nt, Homo sapiens
gaucacaaacagggaaaga

SEQ ID NO: 1453829 - RNA, 19 nt, Homo sapiens
uaaccucggucguguuggu

SEQ ID NO: 1453830 - RNA, 19 nt, Homo sapiens
gcuaaccucggucguguug

SEQ ID NO: 1453831 - RNA, 19 nt, Homo sapiens
ucacaaacagggaaagaca

SEQ ID NO: 1453832 - RNA, 19 nt, Homo sapiens
acgauacugugcagauuga

SEQ ID NO: 1453833 - RNA, 19 nt, Homo sapiens
agauauguaugcaacacuu

SEQ ID NO: 1453834 - RNA, 19 nt, Homo sapiens
gaugcuggauaaacuaacu

SEQ ID NO: 1453835 - RNA, 19 nt, Homo sapiens
gaugagguaaagaagauau

SEQ ID NO: 1453836 - RNA, 19 nt, Homo sapiens
uacuauugcugaagagaga

SEQ ID NO: 1453837 - RNA, 19 nt, Homo sapiens
ggugauugcuggagcuaac

SEQ ID NO: 1453838 - RNA, 19 nt, Homo sapiens
auacugugcagauugauuu

SEQ ID NO: 1453839 - RNA, 19 nt, Homo sapiens
gauacugugcagauugauu

SEQ ID NO: 1453840 - RNA, 19 nt, Homo sapiens
cuacccagauccucucauc

SEQ ID NO: 1453841 - RNA, 19 nt, Homo sapiens
gaagaggcaaaguacaagu

SEQ ID NO: 1453842 - RNA, 19 nt, Homo sapiens
ggauaaacuaacuggugua

SEQ ID NO: 1453843 - RNA, 19 nt, Homo sapiens
gacuggagaugagguaaag

SEQ ID NO: 1453844 - RNA, 19 nt, Homo sapiens
caaacagagcaguggcuaa

SEQ ID NO: 1453845 - RNA, 19 nt, Homo sapiens
ucaucaaggugaacgauac

SEQ ID NO: 1453846 - RNA, 19 nt, Homo sapiens
gggcauccgacuuacuauu

SEQ ID NO: 1453847 - RNA, 19 nt, Homo sapiens
cacaggcaauguauguaug

SEQ ID NO: 1453848 - RNA, 19 nt, Homo sapiens
acacaggcaauguauguau

SEQ ID NO: 1453849 - RNA, 19 nt, Homo sapiens
aggaauagacucaaguaug

SEQ ID NO: 1453850 - RNA, 19 nt, Homo sapiens
uggaagaggcaaaguacaa

SEQ ID NO: 1453851 - RNA, 19 nt, Homo sapiens
cgacagguccucacaagcu

SEQ ID NO: 1453852 - RNA, 19 nt, Homo sapiens
ugcaaagugaggaagauua

SEQ ID NO: 1453853 - RNA, 19 nt, Homo sapiens
caacacuuccucaaaauug

SEQ ID NO: 1453854 - RNA, 19 nt, Homo sapiens
uugcagcgccgaagcauug

SEQ ID NO: 1453855 - RNA, 19 nt, Homo sapiens
ggaagaggcaaaguacaag

SEQ ID NO: 1453856 - RNA, 19 nt, Homo sapiens
ccugcuggauucauagaug

SEQ ID NO: 1453857 - RNA, 19 nt, Homo sapiens
gggaaagggcauccgacuu

SEQ ID NO: 1453858 - RNA, 19 nt, Homo sapiens
caaauuugacacaggcaau

SEQ ID NO: 1453859 - RNA, 19 nt, Homo sapiens
gcauccgacuuacuauugc

SEQ ID NO: 1453860 - RNA, 19 nt, Homo sapiens
aagggcauccgacuuacua

SEQ ID NO: 1453861 - RNA, 19 nt, Homo sapiens
caguggaagaggcaaagua

SEQ ID NO: 1453862 - RNA, 19 nt, Homo sapiens
gcacuugaagcguguugca

SEQ ID NO: 1453863 - RNA, 19 nt, Homo sapiens
ccucaggaauagacucaag

SEQ ID NO: 1453864 - RNA, 19 nt, Homo sapiens
gguaaagaagauauguaug

SEQ ID NO: 1453865 - RNA, 19 nt, Homo sapiens
aaacuaacugguguauuug

SEQ ID NO: 1453866 - RNA, 19 nt, Homo sapiens
cagcuuugccacaaggauu

SEQ ID NO: 1453867 - RNA, 19 nt, Homo sapiens
uaugcaacacuuccucaaa

SEQ ID NO: 1453868 - RNA, 19 nt, Homo sapiens
ugacuggagaugagguaaa

SEQ ID NO: 1453869 - RNA, 19 nt, Homo sapiens
ugaacgauacugugcagau

SEQ ID NO: 1453870 - RNA, 19 nt, Homo sapiens
aaagugaggaagauuacug

SEQ ID NO: 1453871 - RNA, 19 nt, Homo sapiens
ugucaucagcauugagaaa

SEQ ID NO: 1453872 - RNA, 19 nt, Homo sapiens
gacacaggcaauguaugua

SEQ ID NO: 1453873 - RNA, 19 nt, Homo sapiens
uuagggacugggaagauaa

SEQ ID NO: 1453874 - RNA, 19 nt, Homo sapiens
gcaacacuuccucaaaauu

SEQ ID NO: 1453875 - RNA, 19 nt, Homo sapiens
gcauuuccgccuggucuau

SEQ ID NO: 1453876 - RNA, 19 nt, Homo sapiens
gccaaugaguuuaaagaua

SEQ ID NO: 1453877 - RNA, 19 nt, Homo sapiens
ccaaugaguuuaaagauag

SEQ ID NO: 1453878 - RNA, 19 nt, Homo sapiens
caaauacgcuggccacaag

SEQ ID NO: 1453879 - RNA, 19 nt, Homo sapiens
gaacauggagcuccgagaa

SEQ ID NO: 1453880 - RNA, 19 nt, Homo sapiens
ggagucauauagaugcuuu

SEQ ID NO: 1453881 - RNA, 19 nt, Homo sapiens
gggcugauguucauggaaa

SEQ ID NO: 1453882 - RNA, 19 nt, Homo sapiens
gaagagacaauacccaaau

SEQ ID NO: 1453883 - RNA, 19 nt, Homo sapiens
caacuuggauuggguuuua

SEQ ID NO: 1453884 - RNA, 19 nt, Homo sapiens
agaauuagcucguggaaaa

SEQ ID NO: 1453885 - RNA, 19 nt, Homo sapiens
caauucagcuccuccaaag

SEQ ID NO: 1453886 - RNA, 19 nt, Homo sapiens
caaagccaaugaguuuaaa

SEQ ID NO: 1453887 - RNA, 19 nt, Homo sapiens
ccaaagccaaugaguuuaa

SEQ ID NO: 1453888 - RNA, 19 nt, Homo sapiens
aagagacaauacccaaaua

SEQ ID NO: 1453889 - RNA, 19 nt, Homo sapiens
caggagacgucaagacaga

SEQ ID NO: 1453890 - RNA, 19 nt, Homo sapiens
ggacauggcccagaugauc

SEQ ID NO: 1453891 - RNA, 19 nt, Homo sapiens
ggaaagccaggaagaaauc

SEQ ID NO: 1453892 - RNA, 19 nt, Homo sapiens
gacagaagagcaacaccua

SEQ ID NO: 1453893 - RNA, 19 nt, Homo sapiens
acaugucucuaaugcuaua

SEQ ID NO: 1453894 - RNA, 19 nt, Homo sapiens
gaucgucaucuaacaauuc

SEQ ID NO: 1453895 - RNA, 19 nt, Homo sapiens
cuccaaagccaaugaguuu

SEQ ID NO: 1453896 - RNA, 19 nt, Homo sapiens
gaaaacaccaccacaggaa

SEQ ID NO: 1453897 - RNA, 19 nt, Homo sapiens
ccaacucccugugcagaga

SEQ ID NO: 1453898 - RNA, 19 nt, Homo sapiens
aagcaaacaacuuggauug

SEQ ID NO: 1453899 - RNA, 19 nt, Homo sapiens
guggaaagccaggaagaaa

SEQ ID NO: 1453900 - RNA, 19 nt, Homo sapiens
gaucaucagacuccaccaa

SEQ ID NO: 1453901 - RNA, 19 nt, Homo sapiens
ugagggagcagaacaugga

SEQ ID NO: 1453902 - RNA, 19 nt, Homo sapiens
ggagaugccaccauuacag

SEQ ID NO: 1453903 - RNA, 19 nt, Homo sapiens
ucugucagcugaugaagag

SEQ ID NO: 1453904 - RNA, 19 nt, Homo sapiens
ucaucagacuccaccaaga

SEQ ID NO: 1453905 - RNA, 19 nt, Homo sapiens
ccaaauacgcuggccacaa

SEQ ID NO: 1453906 - RNA, 19 nt, Homo sapiens
ggacaacuguggggacaug

SEQ ID NO: 1453907 - RNA, 19 nt, Homo sapiens
ugaagagacaauacccaaa

SEQ ID NO: 1453908 - RNA, 19 nt, Homo sapiens
gagcuugggagacagaagu

SEQ ID NO: 1453909 - RNA, 19 nt, Homo sapiens
acaauucagcuccuccaaa

SEQ ID NO: 1453910 - RNA, 19 nt, Homo sapiens
gguggaaagccaggaagaa

SEQ ID NO: 1453911 - RNA, 19 nt, Homo sapiens
aaagcaaacaacuuggauu

SEQ ID NO: 1453912 - RNA, 19 nt, Homo sapiens
ucugugggcugauguucau

SEQ ID NO: 1453913 - RNA, 19 nt, Homo sapiens
cgucaagacagaagagcaa

SEQ ID NO: 1453914 - RNA, 19 nt, Homo sapiens
caucagacuccaccaagag

SEQ ID NO: 1453915 - RNA, 19 nt, Homo sapiens
ucaccucugucagcugaug

SEQ ID NO: 1453916 - RNA, 19 nt, Homo sapiens
ggagacgucaagacagaag

SEQ ID NO: 1453917 - RNA, 19 nt, Homo sapiens
gauccuggcaguagugacu

SEQ ID NO: 1453918 - RNA, 19 nt, Homo sapiens
aagccaaugaguuuaaaga

SEQ ID NO: 1453919 - RNA, 19 nt, Homo sapiens
uggaaagccaggaagaaau

SEQ ID NO: 1453920 - RNA, 19 nt, Homo sapiens
cagaagagcaacaccuacu

SEQ ID NO: 1453921 - RNA, 19 nt, Homo sapiens
gggagaugccaccauuaca

SEQ ID NO: 1453922 - RNA, 19 nt, Homo sapiens
gaacaaauaugaggaugaa

SEQ ID NO: 1453923 - RNA, 19 nt, Homo sapiens
gaacaagguugaacugcaa

SEQ ID NO: 1453924 - RNA, 19 nt, Homo sapiens
gagcuucacuguuacuaaa

SEQ ID NO: 1453925 - RNA, 19 nt, Homo sapiens
cacuggagcuucacuguua

SEQ ID NO: 1453926 - RNA, 19 nt, Homo sapiens
ggaagcagcuacuccuaug

SEQ ID NO: 1453927 - RNA, 19 nt, Homo sapiens
gaacaacuuccacuuacuu

SEQ ID NO: 1453928 - RNA, 19 nt, Homo sapiens
ucaagacccucaacaacaa

SEQ ID NO: 1453929 - RNA, 19 nt, Homo sapiens
gcaguuccaccaucaagua

SEQ ID NO: 1453930 - RNA, 19 nt, Homo sapiens
gcacagcagcagagaauga

SEQ ID NO: 1453931 - RNA, 19 nt, Homo sapiens
ucagaacaacuuccacuua

SEQ ID NO: 1453932 - RNA, 19 nt, Homo sapiens
gcucuucacucuuugcaau

SEQ ID NO: 1453933 - RNA, 19 nt, Homo sapiens
ugacuaguccuaugaugua

SEQ ID NO: 1453934 - RNA, 19 nt, Homo sapiens
ggagauggcccucaaggau

SEQ ID NO: 1453935 - RNA, 19 nt, Homo sapiens
gcacaagugacuaguccua

SEQ ID NO: 1453936 - RNA, 19 nt, Homo sapiens
ucucugaggcugagcauua

SEQ ID NO: 1453937 - RNA, 19 nt, Homo sapiens
ucucaaacucucuaacuua

SEQ ID NO: 1453938 - RNA, 19 nt, Homo sapiens
cagaacaacuuccacuuac

SEQ ID NO: 1453939 - RNA, 19 nt, Homo sapiens
ucugugcucuucacucuuu

SEQ ID NO: 1453940 - RNA, 19 nt, Homo sapiens
gaugauuucugugcucuuc

SEQ ID NO: 1453941 - RNA, 19 nt, Homo sapiens
gcagagaaugaauuuguga

SEQ ID NO: 1453942 - RNA, 19 nt, Homo sapiens
ggagauugcugagaucaac

SEQ ID NO: 1453943 - RNA, 19 nt, Homo sapiens
gaagaaggauguggaugcu

SEQ ID NO: 1453944 - RNA, 19 nt, Homo sapiens
caucaucgcugaggucaag

SEQ ID NO: 1453945 - RNA, 19 nt, Homo sapiens
cagcagagaaugaauuugu

SEQ ID NO: 1453946 - RNA, 19 nt, Homo sapiens
caagugacuaguccuauga

SEQ ID NO: 1453947 - RNA, 19 nt, Homo sapiens
gcuucacuguuacuaaauu

SEQ ID NO: 1453948 - RNA, 19 nt, Homo sapiens
gcaggagauugcugagauc

SEQ ID NO: 1453949 - RNA, 19 nt, Homo sapiens
gaucaagacccucaacaac

SEQ ID NO: 1453950 - RNA, 19 nt, Homo sapiens
cgaaggcguuggacaaguc

SEQ ID NO: 1453951 - RNA, 19 nt, Homo sapiens
gcgcacagcagcagagaau

SEQ ID NO: 1453952 - RNA, 19 nt, Homo sapiens
ggucaaggcccaauaugag

SEQ ID NO: 1453953 - RNA, 19 nt, Homo sapiens
caaauaugaggaugaaauc

SEQ ID NO: 1453954 - RNA, 19 nt, Homo sapiens
cucaaacucucuaacuuau

SEQ ID NO: 1453955 - RNA, 19 nt, Homo sapiens
gcugagaucaaccgcauga

SEQ ID NO: 1453956 - RNA, 19 nt, Homo sapiens
agaaugaauuugugacucu

SEQ ID NO: 1453957 - RNA, 19 nt, Homo sapiens
gccuguaucucugugauga

SEQ ID NO: 1453958 - RNA, 19 nt, Homo sapiens
acaagugacuaguccuaug

SEQ ID NO: 1453959 - RNA, 19 nt, Homo sapiens
gaaaauugccaggggcuua

SEQ ID NO: 1453960 - RNA, 19 nt, Homo sapiens
aggcugagcauuauaagaa

SEQ ID NO: 1453961 - RNA, 19 nt, Homo sapiens
gaauuugugacucugaaga

SEQ ID NO: 1453962 - RNA, 19 nt, Homo sapiens
ccaagacugugaggcagaa

SEQ ID NO: 1453963 - RNA, 19 nt, Homo sapiens
ggagcuucacuguuacuaa

SEQ ID NO: 1453964 - RNA, 19 nt, Homo sapiens
augcagagcugucccagau

SEQ ID NO: 1453965 - RNA, 19 nt, Homo sapiens
acaacaaguuugccuccuu

SEQ ID NO: 1453966 - RNA, 19 nt, Homo sapiens
ggcugagcauuauaagaaa

SEQ ID NO: 1453967 - RNA, 19 nt, Homo sapiens
cugagagccuuguaugaug

SEQ ID NO: 1453968 - RNA, 19 nt, Homo sapiens
caaguuugccuccuucauc

SEQ ID NO: 1453969 - RNA, 19 nt, Homo sapiens
guaucucugugaugauuuc

SEQ ID NO: 1453970 - RNA, 19 nt, Homo sapiens
gaugcugccuacaugaaca

SEQ ID NO: 1453971 - RNA, 19 nt, Homo sapiens
gaggagugcaggcugaaug

SEQ ID NO: 1453972 - RNA, 19 nt, Homo sapiens
ggcccaauaugaggagauu

SEQ ID NO: 1453973 - RNA, 19 nt, Homo sapiens
ccacaucucagacacaucu

SEQ ID NO: 1453974 - RNA, 19 nt, Homo sapiens
uccaagaggucacugucaa

SEQ ID NO: 1453975 - RNA, 19 nt, Homo sapiens
cagcagcagagaaugaauu

SEQ ID NO: 1453976 - RNA, 19 nt, Homo sapiens
caagaacaaauaugaggau

SEQ ID NO: 1453977 - RNA, 19 nt, Homo sapiens
cggccuugcugguggcuuu

SEQ ID NO: 1453978 - RNA, 19 nt, Homo sapiens
aaucaccacuggagcuuca

SEQ ID NO: 1453979 - RNA, 19 nt, Homo sapiens
cuaguccuaugauguacaa

SEQ ID NO: 1453980 - RNA, 19 nt, Homo sapiens
caugaaagcacaagugacu

SEQ ID NO: 1453981 - RNA, 19 nt, Homo sapiens
ucucugugaugauuucugu

SEQ ID NO: 1453982 - RNA, 19 nt, Homo sapiens
ggguuucagugccaacuca

SEQ ID NO: 1453983 - RNA, 19 nt, Homo sapiens
gccaggggcuuauuucaga

SEQ ID NO: 1453984 - RNA, 19 nt, Homo sapiens
uuucuugccuccaguguuc

SEQ ID NO: 1453985 - RNA, 19 nt, Homo sapiens
gcgaaggcguuggacaagu

SEQ ID NO: 1453986 - RNA, 19 nt, Homo sapiens
ugaaagcacaagugacuag

SEQ ID NO: 1453987 - RNA, 19 nt, Homo sapiens
gagcgugagcagaucaaga

SEQ ID NO: 1453988 - RNA, 19 nt, Homo sapiens
gcacauccaccaccaucag

SEQ ID NO: 1453989 - RNA, 19 nt, Homo sapiens
gaauggcgaaggcguugga

SEQ ID NO: 1453990 - RNA, 19 nt, Homo sapiens
gcagagccagagcgagcua

SEQ ID NO: 1453991 - RNA, 19 nt, Homo sapiens
agagcgagcuauggcuuug

SEQ ID NO: 1453992 - RNA, 19 nt, Homo sapiens
ggaccuggacagcaucauc

SEQ ID NO: 1453993 - RNA, 19 nt, Homo sapiens
uguggaugcugccuacaug

SEQ ID NO: 1453994 - RNA, 19 nt, Homo sapiens
gacccucaacaacaaguuu

SEQ ID NO: 1453995 - RNA, 19 nt, Homo sapiens
ccaggcaguauccaugaaa

SEQ ID NO: 1453996 - RNA, 19 nt, Homo sapiens
ccacuggagcuucacuguu

SEQ ID NO: 1453997 - RNA, 19 nt, Homo sapiens
uccaagaggaucuccauug

SEQ ID NO: 1453998 - RNA, 19 nt, Homo sapiens
caacaccaagcaggagauu

SEQ ID NO: 1453999 - RNA, 19 nt, Homo sapiens
cuguaucucugugaugauu

SEQ ID NO: 1454000 - RNA, 19 nt, Homo sapiens
gggaguggauuugguuucg

SEQ ID NO: 1454001 - RNA, 19 nt, Homo sapiens
gggcuuauuucagaacaac

SEQ ID NO: 1454002 - RNA, 19 nt, Homo sapiens
ggcggcaguuccaccauca

SEQ ID NO: 1454003 - RNA, 19 nt, Homo sapiens
gcucucaaacucucuaacu

SEQ ID NO: 1454004 - RNA, 19 nt, Homo sapiens
aaaaugaccucugcuccuu

SEQ ID NO: 1454005 - RNA, 19 nt, Homo sapiens
gaggcugagcauuauaaga

SEQ ID NO: 1454006 - RNA, 19 nt, Homo sapiens
ccugagagccuuguaugau

SEQ ID NO: 1454007 - RNA, 19 nt, Homo sapiens
gugacuaguccuaugaugu

SEQ ID NO: 1454008 - RNA, 19 nt, Homo sapiens
gaaagcacaagugacuagu

SEQ ID NO: 1454009 - RNA, 19 nt, Homo sapiens
gggagauggcccucaagga

SEQ ID NO: 1454010 - RNA, 19 nt, Homo sapiens
ugaggucaaggcccaauau

SEQ ID NO: 1454011 - RNA, 19 nt, Homo sapiens
caucuguggugcuguccau

SEQ ID NO: 1454012 - RNA, 19 nt, Homo sapiens
agaacaaauaugaggauga

SEQ ID NO: 1454013 - RNA, 19 nt, Homo sapiens
ccgaggagcgugagcagau

SEQ ID NO: 1454014 - RNA, 19 nt, Homo sapiens
caacuuccacuuacuuucc

SEQ ID NO: 1454015 - RNA, 19 nt, Homo sapiens
gcuuauuucagaacaacuu

SEQ ID NO: 1454016 - RNA, 19 nt, Homo sapiens
cugaggcugagcauuauaa

SEQ ID NO: 1454017 - RNA, 19 nt, Homo sapiens
guaaucaccacuggagcuu

SEQ ID NO: 1454018 - RNA, 19 nt, Homo sapiens
gaggucaaggcccaauaug

SEQ ID NO: 1454019 - RNA, 19 nt, Homo sapiens
cagagcgagcuauggcuuu

SEQ ID NO: 1454020 - RNA, 19 nt, Homo sapiens
gaaggcguuggacaaguca

SEQ ID NO: 1454021 - RNA, 19 nt, Homo sapiens
agaacaacuuccacuuacu

SEQ ID NO: 1454022 - RNA, 19 nt, Homo sapiens
gaagagaucuaugguggaa

SEQ ID NO: 1454023 - RNA, 19 nt, Homo sapiens
gaucuaugguggaauuuca

SEQ ID NO: 1454024 - RNA, 19 nt, Homo sapiens
ucaaugugcugcuggaguu

SEQ ID NO: 1454025 - RNA, 19 nt, Homo sapiens
agagaucuaugguggaauu

SEQ ID NO: 1454026 - RNA, 19 nt, Homo sapiens
gcucggaacuccccuauau

SEQ ID NO: 1454027 - RNA, 19 nt, Homo sapiens
gguagacugugugaagaaa

SEQ ID NO: 1454028 - RNA, 19 nt, Homo sapiens
uagaaaugcucagggcaaa

SEQ ID NO: 1454029 - RNA, 19 nt, Homo sapiens
cagagccacucgaacgauu

SEQ ID NO: 1454030 - RNA, 19 nt, Homo sapiens
ucaauggagugacaguuca

SEQ ID NO: 1454031 - RNA, 19 nt, Homo sapiens
ccauuucuauaucgucaaa

SEQ ID NO: 1454032 - RNA, 19 nt, Homo sapiens
uacaauguuugcuacguuu

SEQ ID NO: 1454033 - RNA, 19 nt, Homo sapiens
uuacaauguuugcuacguu

SEQ ID NO: 1454034 - RNA, 19 nt, Homo sapiens
gagauccugcuggcaaaua

SEQ ID NO: 1454035 - RNA, 19 nt, Homo sapiens
ggucgagcaugucaucaag

SEQ ID NO: 1454036 - RNA, 19 nt, Homo sapiens
gaggguagacugugugaag

SEQ ID NO: 1454037 - RNA, 19 nt, Homo sapiens
caauuaaccgggugucuuc

SEQ ID NO: 1454038 - RNA, 19 nt, Homo sapiens
aaaagaagcggcuaggaua

SEQ ID NO: 1454039 - RNA, 19 nt, Homo sapiens
gaaaagaagcggcuaggau

SEQ ID NO: 1454040 - RNA, 19 nt, Homo sapiens
cuauggagcuaaccugaag

SEQ ID NO: 1454041 - RNA, 19 nt, Homo sapiens
ggaagaugguccuguuuuc

SEQ ID NO: 1454042 - RNA, 19 nt, Homo sapiens
uaggauagcagaagagauc

SEQ ID NO: 1454043 - RNA, 19 nt, Homo sapiens
agauccugcuggcaaauaa

SEQ ID NO: 1454044 - RNA, 19 nt, Homo sapiens
gauuccuccuauaccaaua

SEQ ID NO: 1454045 - RNA, 19 nt, Homo sapiens
gaaggcccaccugcucuuu

SEQ ID NO: 1454046 - RNA, 19 nt, Homo sapiens
cagcgaggcaguccaaugu

SEQ ID NO: 1454047 - RNA, 19 nt, Homo sapiens
gcagcgaggcaguccaaug

SEQ ID NO: 1454048 - RNA, 19 nt, Homo sapiens
ccuaacccauuucuauauc

SEQ ID NO: 1454049 - RNA, 19 nt, Homo sapiens
ggccugugccaaagccuua

SEQ ID NO: 1454050 - RNA, 19 nt, Homo sapiens
ucgaacgauuccuccuaua

SEQ ID NO: 1454051 - RNA, 19 nt, Homo sapiens
gcacacgucaauggaguga

SEQ ID NO: 1454052 - RNA, 19 nt, Homo sapiens
ucuccuaacccauuucuau

SEQ ID NO: 1454053 - RNA, 19 nt, Homo sapiens
gaaacuucuagaauuagga

SEQ ID NO: 1454054 - RNA, 19 nt, Homo sapiens
gcgcuuacuggcccuuaaa

SEQ ID NO: 1454055 - RNA, 19 nt, Homo sapiens
ucuauaucgucaaaggaaa

SEQ ID NO: 1454056 - RNA, 19 nt, Homo sapiens
uagcagaagagaucuaugg

SEQ ID NO: 1454057 - RNA, 19 nt, Homo sapiens
ggauagcagaagagaucua

SEQ ID NO: 1454058 - RNA, 19 nt, Homo sapiens
uggagauccugcuggcaaa

SEQ ID NO: 1454059 - RNA, 19 nt, Homo sapiens
uaugguggaauuucagauu

SEQ ID NO: 1454060 - RNA, 19 nt, Homo sapiens
gaacgauuccuccuauacc

SEQ ID NO: 1454061 - RNA, 19 nt, Homo sapiens
gcugaucgauccccacuuc

SEQ ID NO: 1454062 - RNA, 19 nt, Homo sapiens
gagagugcauggagauccu

SEQ ID NO: 1454063 - RNA, 19 nt, Homo sapiens
ggcgcuuacuggcccuuaa

SEQ ID NO: 1454064 - RNA, 19 nt, Homo sapiens
cuccuaacccauuucuaua

SEQ ID NO: 1454065 - RNA, 19 nt, Homo sapiens
cgaacgauuccuccuauac

SEQ ID NO: 1454066 - RNA, 19 nt, Homo sapiens
ggguagacugugugaagaa

SEQ ID NO: 1454067 - RNA, 19 nt, Homo sapiens
cucgaacgauuccuccuau

SEQ ID NO: 1454068 - RNA, 19 nt, Homo sapiens
uaacccauuucuauaucgu

SEQ ID NO: 1454069 - RNA, 19 nt, Homo sapiens
aaccugaagcguagaaaug

SEQ ID NO: 1454070 - RNA, 19 nt, Homo sapiens
uggcucuccuaacccauuu

SEQ ID NO: 1454071 - RNA, 19 nt, Homo sapiens
gcuggcaaauaauguuaac

SEQ ID NO: 1454072 - RNA, 19 nt, Homo sapiens
ugaagagaggucacagaga

SEQ ID NO: 1454073 - RNA, 19 nt, Homo sapiens
uaaccugaagcguagaaau

SEQ ID NO: 1454074 - RNA, 19 nt, Homo sapiens
uagacugugugaagaaacu

SEQ ID NO: 1454075 - RNA, 19 nt, Homo sapiens
caaugugaaccuugugaca

SEQ ID NO: 1454076 - RNA, 19 nt, Homo sapiens
uggccucgcccauccauga

SEQ ID NO: 1454077 - RNA, 19 nt, Homo sapiens
aaagaagcggcuaggauag

SEQ ID NO: 1454078 - RNA, 19 nt, Homo sapiens
gcuaaccugaagcguagaa

SEQ ID NO: 1454079 - RNA, 19 nt, Homo sapiens
uaucgucaaaggaaauaga

SEQ ID NO: 1454080 - RNA, 19 nt, Homo sapiens
acaauuaaccgggugucuu

SEQ ID NO: 1454081 - RNA, 19 nt, Homo sapiens
gcacagaaauuguaaacuu

SEQ ID NO: 1454082 - RNA, 19 nt, Homo sapiens
caacccaucuaucuuauua

SEQ ID NO: 1454083 - RNA, 19 nt, Homo sapiens
gaaauaaagcuccuaguaa

SEQ ID NO: 1454084 - RNA, 19 nt, Homo sapiens
uaucuuagcuugaguauga

SEQ ID NO: 1454085 - RNA, 19 nt, Homo sapiens
caacguuacugaagaauuu

SEQ ID NO: 1454086 - RNA, 19 nt, Homo sapiens
gaggagaagucuuagauuu

SEQ ID NO: 1454087 - RNA, 19 nt, Homo sapiens
gaaauaaagcuguagcaua

SEQ ID NO: 1454088 - RNA, 19 nt, Homo sapiens
gcaagagaguauuguauaa

SEQ ID NO: 1454089 - RNA, 19 nt, Homo sapiens
gaauauggcuuagcaaaga

SEQ ID NO: 1454090 - RNA, 19 nt, Homo sapiens
aaaccaagauugcaccuua

SEQ ID NO: 1454091 - RNA, 19 nt, Homo sapiens
ggauauugcuucaacauga

SEQ ID NO: 1454092 - RNA, 19 nt, Homo sapiens
caauauacccucuuguuua

SEQ ID NO: 1454093 - RNA, 19 nt, Homo sapiens
ggauagggaccuuuaaaua

SEQ ID NO: 1454094 - RNA, 19 nt, Homo sapiens
gaacuuaaucgcacuguuu

SEQ ID NO: 1454095 - RNA, 19 nt, Homo sapiens
gaaaggauauugcuucaac

SEQ ID NO: 1454096 - RNA, 19 nt, Homo sapiens
gcaaagagcaacuaauaug

SEQ ID NO: 1454097 - RNA, 19 nt, Homo sapiens
gccguuugcucaacaauua

SEQ ID NO: 1454098 - RNA, 19 nt, Homo sapiens
gcauagauguugaccaaga

SEQ ID NO: 1454099 - RNA, 19 nt, Homo sapiens
gggcauagauguugaccaa

SEQ ID NO: 1454100 - RNA, 19 nt, Homo sapiens
gauagggaccuuuaaauau

SEQ ID NO: 1454101 - RNA, 19 nt, Homo sapiens
ucacaucaguccaaggaua

SEQ ID NO: 1454102 - RNA, 19 nt, Homo sapiens
uagcaaagagcaacuaaua

SEQ ID NO: 1454103 - RNA, 19 nt, Homo sapiens
ggagaagucuuagauuuua

SEQ ID NO: 1454104 - RNA, 19 nt, Homo sapiens
ucacaggguuauaauguaa

SEQ ID NO: 1454105 - RNA, 19 nt, Homo sapiens
caacuaauggguuaacuuu

SEQ ID NO: 1454106 - RNA, 19 nt, Homo sapiens
gaacauuacacaccuucua

SEQ ID NO: 1454107 - RNA, 19 nt, Homo sapiens
gcacgaagccugccuugga

SEQ ID NO: 1454108 - RNA, 19 nt, Homo sapiens
gcagaucgaucaccacuac

SEQ ID NO: 1454109 - RNA, 19 nt, Homo sapiens
caaggaagcggcaaggaua

SEQ ID NO: 1454110 - RNA, 19 nt, Homo sapiens
gcucaacaauuauccaaug

SEQ ID NO: 1454111 - RNA, 19 nt, Homo sapiens
ggaaauccacuauguugaa

SEQ ID NO: 1454112 - RNA, 19 nt, Homo sapiens
uaaaugcaaucacgauaga

SEQ ID NO: 1454113 - RNA, 19 nt, Homo sapiens
gucuguaccuuguaucuua

SEQ ID NO: 1454114 - RNA, 19 nt, Homo sapiens
guacagaaaggcaaauauu

SEQ ID NO: 1454115 - RNA, 19 nt, Homo sapiens
cuauguagcuuguauguca

SEQ ID NO: 1454116 - RNA, 19 nt, Homo sapiens
ggaagcaggagcuaaugua

SEQ ID NO: 1454117 - RNA, 19 nt, Homo sapiens
gauagcagcugaauuuuau

SEQ ID NO: 1454118 - RNA, 19 nt, Homo sapiens
ucacuaagcuugcauuuug

SEQ ID NO: 1454119 - RNA, 19 nt, Homo sapiens
cauaguacauggacuuguu

SEQ ID NO: 1454120 - RNA, 19 nt, Homo sapiens
gaaauccacuauguugaau

SEQ ID NO: 1454121 - RNA, 19 nt, Homo sapiens
ucacuucucuucuccauag

SEQ ID NO: 1454122 - RNA, 19 nt, Homo sapiens
agaaauaaagcuccuagua

SEQ ID NO: 1454123 - RNA, 19 nt, Homo sapiens
gggaacuccucucuaugua

SEQ ID NO: 1454124 - RNA, 19 nt, Homo sapiens
gagcuaauguaaaugcaau

SEQ ID NO: 1454125 - RNA, 19 nt, Homo sapiens
gaagcaggagcuaauguaa

SEQ ID NO: 1454126 - RNA, 19 nt, Homo sapiens
aaggauagcagcugaauuu

SEQ ID NO: 1454127 - RNA, 19 nt, Homo sapiens
uaacuauacuugagugcaa

SEQ ID NO: 1454128 - RNA, 19 nt, Homo sapiens
caaugucgguguuagaaga

SEQ ID NO: 1454129 - RNA, 19 nt, Homo sapiens
aaacaagggcuuagaguau

SEQ ID NO: 1454130 - RNA, 19 nt, Homo sapiens
caguaaaggucaccaugaa

SEQ ID NO: 1454131 - RNA, 19 nt, Homo sapiens
gaaaggcaaccgcaaggaa

SEQ ID NO: 1454132 - RNA, 19 nt, Homo sapiens
gaauaucucacacauuugu

SEQ ID NO: 1454133 - RNA, 19 nt, Homo sapiens
ggucuauguucuucaacua

SEQ ID NO: 1454134 - RNA, 19 nt, Homo sapiens
caacuuugccgacucugua

SEQ ID NO: 1454135 - RNA, 19 nt, Homo sapiens
caacaauuauccaaugucu

SEQ ID NO: 1454136 - RNA, 19 nt, Homo sapiens
ccucagucauuucuacaua

SEQ ID NO: 1454137 - RNA, 19 nt, Homo sapiens
auacaacccaucuaucuua

SEQ ID NO: 1454138 - RNA, 19 nt, Homo sapiens
ggucaauacugcccucuca

SEQ ID NO: 1454139 - RNA, 19 nt, Homo sapiens
uaaaugcaguaaccuuaga

SEQ ID NO: 1454140 - RNA, 19 nt, Homo sapiens
gcuguagcauauucacuaa

SEQ ID NO: 1454141 - RNA, 19 nt, Homo sapiens
gcucugagaacauuauuau

SEQ ID NO: 1454142 - RNA, 19 nt, Homo sapiens
guaaaggucaccaugaaug

SEQ ID NO: 1454143 - RNA, 19 nt, Homo sapiens
auagggaccuuuaaauaug

SEQ ID NO: 1454144 - RNA, 19 nt, Homo sapiens
aacaagggcuuagaguaua

SEQ ID NO: 1454145 - RNA, 19 nt, Homo sapiens
gcacuguuucuaauucuuu

SEQ ID NO: 1454146 - RNA, 19 nt, Homo sapiens
caacaauccagcacagaaa

SEQ ID NO: 1454147 - RNA, 19 nt, Homo sapiens
aaaggcaaauauugggaua

SEQ ID NO: 1454148 - RNA, 19 nt, Homo sapiens
gaggauagggaccuuuaaa

SEQ ID NO: 1454149 - RNA, 19 nt, Homo sapiens
gggcuuagaguauacugua

SEQ ID NO: 1454150 - RNA, 19 nt, Homo sapiens
uaaagcuccuaguaaaguu

SEQ ID NO: 1454151 - RNA, 19 nt, Homo sapiens
ucaauauacccucuuguuu

SEQ ID NO: 1454152 - RNA, 19 nt, Homo sapiens
uacuuucgcuguucuguuu

SEQ ID NO: 1454153 - RNA, 19 nt, Homo sapiens
caaggcgguuauaugcaua

SEQ ID NO: 1454154 - RNA, 19 nt, Homo sapiens
gcaguaugguggaaaggau

SEQ ID NO: 1454155 - RNA, 19 nt, Homo sapiens
gaucaucacaucaguccaa

SEQ ID NO: 1454156 - RNA, 19 nt, Homo sapiens
caggaaauccacuauguug

SEQ ID NO: 1454157 - RNA, 19 nt, Homo sapiens
caaagagcaacuaauaugu

SEQ ID NO: 1454158 - RNA, 19 nt, Homo sapiens
uacauggacuuguuacaga

SEQ ID NO: 1454159 - RNA, 19 nt, Homo sapiens
gcuagaauuuggagcagau

SEQ ID NO: 1454160 - RNA, 19 nt, Homo sapiens
uuacaauacuuucgcuguu

SEQ ID NO: 1454161 - RNA, 19 nt, Homo sapiens
cauagauguugaccaagaa

SEQ ID NO: 1454162 - RNA, 19 nt, Homo sapiens
ccaucuaucuuauuagucu

SEQ ID NO: 1454163 - RNA, 19 nt, Homo sapiens
caacaacccagggcuuauu

SEQ ID NO: 1454164 - RNA, 19 nt, Homo sapiens
gucaauagcuagugauacu

SEQ ID NO: 1454165 - RNA, 19 nt, Homo sapiens
ccugagauauuuagaacau

SEQ ID NO: 1454166 - RNA, 19 nt, Homo sapiens
gaaaagugauaggaugaaa

SEQ ID NO: 1454167 - RNA, 19 nt, Homo sapiens
gcaaggaagcggcaaggau

SEQ ID NO: 1454168 - RNA, 19 nt, Homo sapiens
auauugggauacuccauua

SEQ ID NO: 1454169 - RNA, 19 nt, Homo sapiens
ucuggaagcuucuuuaugc

SEQ ID NO: 1454170 - RNA, 19 nt, Homo sapiens
uguaaaugcaguaaccuua

SEQ ID NO: 1454171 - RNA, 19 nt, Homo sapiens
auaaagcuguagcauauuc

SEQ ID NO: 1454172 - RNA, 19 nt, Homo sapiens
aaaggucuauguucuucaa

SEQ ID NO: 1454173 - RNA, 19 nt, Homo sapiens
uauacccucuuguuuauuc

SEQ ID NO: 1454174 - RNA, 19 nt, Homo sapiens
gccaauaagagaaguaaau

SEQ ID NO: 1454175 - RNA, 19 nt, Homo sapiens
cuagugauacuuggacuua

SEQ ID NO: 1454176 - RNA, 19 nt, Homo sapiens
ucaaggcgguuauaugcau

SEQ ID NO: 1454177 - RNA, 19 nt, Homo sapiens
gcaucuggaagcuucuuua

SEQ ID NO: 1454178 - RNA, 19 nt, Homo sapiens
cugcaaggguaaauacuau

SEQ ID NO: 1454179 - RNA, 19 nt, Homo sapiens
gucuuuggauuauagcaua

SEQ ID NO: 1454180 - RNA, 19 nt, Homo sapiens
gaccaagaaauuccucauu

SEQ ID NO: 1454181 - RNA, 19 nt, Homo sapiens
gggcuuggauugauguuua

SEQ ID NO: 1454182 - RNA, 19 nt, Homo sapiens
gaacagggcuuggauugau

SEQ ID NO: 1454183 - RNA, 19 nt, Homo sapiens
acacgaagcuuaaacuauu

SEQ ID NO: 1454184 - RNA, 19 nt, Homo sapiens
gggcaaagcuauagacaug

SEQ ID NO: 1454185 - RNA, 19 nt, Homo sapiens
gcagacagcuauauuuagu

SEQ ID NO: 1454186 - RNA, 19 nt, Homo sapiens
cugaguagcuggcauuaua

SEQ ID NO: 1454187 - RNA, 19 nt, Homo sapiens
caucacgccuggcuaauuu

SEQ ID NO: 1454188 - RNA, 19 nt, Homo sapiens
gaccaugacuucugcuaaa

SEQ ID NO: 1454189 - RNA, 19 nt, Homo sapiens
gaaccugggcuaagaguuu

SEQ ID NO: 1454190 - RNA, 19 nt, Homo sapiens
gaacauucgucucuuacug

SEQ ID NO: 1454191 - RNA, 19 nt, Homo sapiens
gcaagggccuccacagugu

SEQ ID NO: 1454192 - RNA, 19 nt, Homo sapiens
gggaaucgguuacugaugu

SEQ ID NO: 1454193 - RNA, 19 nt, Homo sapiens
caccaugccuggcugauuu

SEQ ID NO: 1454194 - RNA, 19 nt, Homo sapiens
gagacgggauccuucauga

SEQ ID NO: 1454195 - RNA, 19 nt, Homo sapiens
caaagaagcaccacucuag

SEQ ID NO: 1454196 - RNA, 19 nt, Homo sapiens
ggaggaucaucuucgagua

SEQ ID NO: 1454197 - RNA, 19 nt, Homo sapiens
gcaacgcccugcucaagau

SEQ ID NO: 1454198 - RNA, 19 nt, Homo sapiens
aagcugaggugacuaaaug

SEQ ID NO: 1454199 - RNA, 19 nt, Homo sapiens
ccacaauacugagaacauu

SEQ ID NO: 1454200 - RNA, 19 nt, Homo sapiens
uuacaaguccugccugaua

SEQ ID NO: 1454201 - RNA, 19 nt, Homo sapiens
aagaagagcccgcauaaug

SEQ ID NO: 1454202 - RNA, 19 nt, Homo sapiens
gauaagcugaggugacuaa

SEQ ID NO: 1454203 - RNA, 19 nt, Homo sapiens
guaaagaucacacugaagu

SEQ ID NO: 1454204 - RNA, 19 nt, Homo sapiens
gcaaagaagcaccacucua

SEQ ID NO: 1454205 - RNA, 19 nt, Homo sapiens
gugcagggcuagacacgaa

SEQ ID NO: 1454206 - RNA, 19 nt, Homo sapiens
gcaaagcuauagacauggu

SEQ ID NO: 1454207 - RNA, 19 nt, Homo sapiens
cggcagacagcuauauuua

SEQ ID NO: 1454208 - RNA, 19 nt, Homo sapiens
ugaagaagagcccgcauaa

SEQ ID NO: 1454209 - RNA, 19 nt, Homo sapiens
gagugaaccugggcuaaga

SEQ ID NO: 1454210 - RNA, 19 nt, Homo sapiens
ccaagucccugcaaagaag

SEQ ID NO: 1454211 - RNA, 19 nt, Homo sapiens
ugaggugacuaaaugauau

SEQ ID NO: 1454212 - RNA, 19 nt, Homo sapiens
gugcacacauggccucauu

SEQ ID NO: 1454213 - RNA, 19 nt, Homo sapiens
ugaagugucuccuguugug

SEQ ID NO: 1454214 - RNA, 19 nt, Homo sapiens
guuuauacccucugaauug

SEQ ID NO: 1454215 - RNA, 19 nt, Homo sapiens
ccgacaggcugaaguggua

SEQ ID NO: 1454216 - RNA, 19 nt, Homo sapiens
gggcuagacacgaagcuua

SEQ ID NO: 1454217 - RNA, 19 nt, Homo sapiens
agaagagcccgcauaauga

SEQ ID NO: 1454218 - RNA, 19 nt, Homo sapiens
ccaaagugcugggauuaca

SEQ ID NO: 1454219 - RNA, 19 nt, Homo sapiens
gcacaguggcuccguggaa

SEQ ID NO: 1454220 - RNA, 19 nt, Homo sapiens
gagaaaagccagccaggua

SEQ ID NO: 1454221 - RNA, 19 nt, Homo sapiens
gcuuucacaucaucuuuga

SEQ ID NO: 1454222 - RNA, 19 nt, Homo sapiens
gagggcagaggcaagguua

SEQ ID NO: 1454223 - RNA, 19 nt, Homo sapiens
ggagugcaguggcgcaauc

SEQ ID NO: 1454224 - RNA, 19 nt, Homo sapiens
gggauaagcugaggugacu

SEQ ID NO: 1454225 - RNA, 19 nt, Homo sapiens
guaaacaccucuggggaua

SEQ ID NO: 1454226 - RNA, 19 nt, Homo sapiens
gcacuggucauugggaauu

SEQ ID NO: 1454227 - RNA, 19 nt, Homo sapiens
ccuuggagcugaugucaau

SEQ ID NO: 1454228 - RNA, 19 nt, Homo sapiens
gggcuaagaguuuggcauu

SEQ ID NO: 1454229 - RNA, 19 nt, Homo sapiens
ucaaagugcugggauuaca

SEQ ID NO: 1454230 - RNA, 19 nt, Homo sapiens
gaagggugcagcucugguu

SEQ ID NO: 1454231 - RNA, 19 nt, Homo sapiens
ggaaucgguuacugaugug

SEQ ID NO: 1454232 - RNA, 19 nt, Homo sapiens
gaagagcccgcauaaugag

SEQ ID NO: 1454233 - RNA, 19 nt, Homo sapiens
cagugcagcuggagaggaa

SEQ ID NO: 1454234 - RNA, 19 nt, Homo sapiens
gacgggauccuucaugaga

SEQ ID NO: 1454235 - RNA, 19 nt, Homo sapiens
gauccaggcccuccacuuc

SEQ ID NO: 1454236 - RNA, 19 nt, Homo sapiens
acauuaagccagaauuuga

SEQ ID NO: 1454237 - RNA, 19 nt, Homo sapiens
gccauguugucuuugauga

SEQ ID NO: 1454238 - RNA, 19 nt, Homo sapiens
gaccaacucucagaaacuc

SEQ ID NO: 1454239 - RNA, 19 nt, Homo sapiens
gacacgaagcuuaaacuau

SEQ ID NO: 1454240 - RNA, 19 nt, Homo sapiens
gaagaagagcccgcauaau

SEQ ID NO: 1454241 - RNA, 19 nt, Homo sapiens
gaggugacuaaaugauaua

SEQ ID NO: 1454242 - RNA, 19 nt, Homo sapiens
ggaacagggcuuggauuga

SEQ ID NO: 1454243 - RNA, 19 nt, Homo sapiens
gcuaagaguuuggcauugc

SEQ ID NO: 1454244 - RNA, 19 nt, Homo sapiens
acacauuaagccagaauuu

SEQ ID NO: 1454245 - RNA, 19 nt, Homo sapiens
ccugggccauguugucuuu

SEQ ID NO: 1454246 - RNA, 19 nt, Homo sapiens
gaauccuuguucucacuga

SEQ ID NO: 1454247 - RNA, 19 nt, Homo sapiens
cugaagugguaccuccuua

SEQ ID NO: 1454248 - RNA, 19 nt, Homo sapiens
caaagaggaggcccagaug

SEQ ID NO: 1454249 - RNA, 19 nt, Homo sapiens
cuauagacaugguagaucu

SEQ ID NO: 1454250 - RNA, 19 nt, Homo sapiens
gagccucagucccuuccaa

SEQ ID NO: 1454251 - RNA, 19 nt, Homo sapiens
gcccuccacuucuccuuga

SEQ ID NO: 1454252 - RNA, 19 nt, Homo sapiens
ucugaagugucuccuguug

SEQ ID NO: 1454253 - RNA, 19 nt, Homo sapiens
ggucaucuaccuaaagaca

SEQ ID NO: 1454254 - RNA, 19 nt, Homo sapiens
gagaugagacgggauccuu

SEQ ID NO: 1454255 - RNA, 19 nt, Homo sapiens
gggugcagauccacaauac

SEQ ID NO: 1454256 - RNA, 19 nt, Homo sapiens
gcacacauggccucauugg

SEQ ID NO: 1454257 - RNA, 19 nt, Homo sapiens
guguggaggucccauuuua

SEQ ID NO: 1454258 - RNA, 19 nt, Homo sapiens
cgggauccuucaugagaaa

SEQ ID NO: 1454259 - RNA, 19 nt, Homo sapiens
gaggaggcccagaugauca

SEQ ID NO: 1454260 - RNA, 19 nt, Homo sapiens
ggacggcagacagcuauau

SEQ ID NO: 1454261 - RNA, 19 nt, Homo sapiens
ccagggaaucgguuacuga

SEQ ID NO: 1454262 - RNA, 19 nt, Homo sapiens
aagcaggacuuggcacaug

SEQ ID NO: 1454263 - RNA, 19 nt, Homo sapiens
cccacaggcuuguuucaug

SEQ ID NO: 1454264 - RNA, 19 nt, Homo sapiens
gugcagauccacaauacug

SEQ ID NO: 1454265 - RNA, 19 nt, Homo sapiens
gaccggauccacgagagua

SEQ ID NO: 1454266 - RNA, 19 nt, Homo sapiens
agguaaagaucacacugaa

SEQ ID NO: 1454267 - RNA, 19 nt, Homo sapiens
uagccaggauggucucaau

SEQ ID NO: 1454268 - RNA, 19 nt, Homo sapiens
gugcugggauuacagacau

SEQ ID NO: 1454269 - RNA, 19 nt, Homo sapiens
guuacucacagaaguguuu

SEQ ID NO: 1454270 - RNA, 19 nt, Homo sapiens
ucaaggccaccaccaaaga

SEQ ID NO: 1454271 - RNA, 19 nt, Homo sapiens
uaagccagaauuugacuug

SEQ ID NO: 1454272 - RNA, 19 nt, Homo sapiens
cgacugugccacccacuug

SEQ ID NO: 1454273 - RNA, 19 nt, Homo sapiens
gaugagacgggauccuuca

SEQ ID NO: 1454274 - RNA, 19 nt, Homo sapiens
gagacugccuucccuacac

SEQ ID NO: 1454275 - RNA, 19 nt, Homo sapiens
ccugauaccuacacaccau

SEQ ID NO: 1454276 - RNA, 19 nt, Homo sapiens
cacagcagccgguaaggaa

SEQ ID NO: 1454277 - RNA, 19 nt, Homo sapiens
cgaccaugacuucugcuaa

SEQ ID NO: 1454278 - RNA, 19 nt, Homo sapiens
acccacaucugccugaaga

SEQ ID NO: 1454279 - RNA, 19 nt, Homo sapiens
cgucaaggccaccaccaaa

SEQ ID NO: 1454280 - RNA, 19 nt, Homo sapiens
ggcuagacacgaagcuuaa

SEQ ID NO: 1454281 - RNA, 19 nt, Homo sapiens
gcacggauguuauauaauu

SEQ ID NO: 1454282 - RNA, 19 nt, Homo sapiens
ggacucagcuaggauguua

SEQ ID NO: 1454283 - RNA, 19 nt, Homo sapiens
gugcacggauguuauauaa

SEQ ID NO: 1454284 - RNA, 19 nt, Homo sapiens
gagcugauccuacaguuaa

SEQ ID NO: 1454285 - RNA, 19 nt, Homo sapiens
aaacuugggucgcuuagaa

SEQ ID NO: 1454286 - RNA, 19 nt, Homo sapiens
gcuggacucugcuucauuu

SEQ ID NO: 1454287 - RNA, 19 nt, Homo sapiens
ccuaaugaauccuuuguaa

SEQ ID NO: 1454288 - RNA, 19 nt, Homo sapiens
gguaagcgaugccucauuc

SEQ ID NO: 1454289 - RNA, 19 nt, Homo sapiens
gguuugagcuggcugaaga

SEQ ID NO: 1454290 - RNA, 19 nt, Homo sapiens
acagacuccuuuacacuua

SEQ ID NO: 1454291 - RNA, 19 nt, Homo sapiens
gaaguagucgaccauguuu

SEQ ID NO: 1454292 - RNA, 19 nt, Homo sapiens
ggaaguagucgaccauguu

SEQ ID NO: 1454293 - RNA, 19 nt, Homo sapiens
uacaagaagucacaaguau

SEQ ID NO: 1454294 - RNA, 19 nt, Homo sapiens
caagaagucacaaguaugu

SEQ ID NO: 1454295 - RNA, 19 nt, Homo sapiens
ucagaaugguuuccuguug

SEQ ID NO: 1454296 - RNA, 19 nt, Homo sapiens
acacggagcugauccuaca

SEQ ID NO: 1454297 - RNA, 19 nt, Homo sapiens
ggaaaggaaagauguguuc

SEQ ID NO: 1454298 - RNA, 19 nt, Homo sapiens
cugaggagcuuaauguguu

SEQ ID NO: 1454299 - RNA, 19 nt, Homo sapiens
gaacacacggaacuaugaa

SEQ ID NO: 1454300 - RNA, 19 nt, Homo sapiens
ggagcgacaucauuaaugc

SEQ ID NO: 1454301 - RNA, 19 nt, Homo sapiens
aagggacacucuuccauaa

SEQ ID NO: 1454302 - RNA, 19 nt, Homo sapiens
ugaccagcaucgucuguaa

SEQ ID NO: 1454303 - RNA, 19 nt, Homo sapiens
gaaaggaggaagagaagca

SEQ ID NO: 1454304 - RNA, 19 nt, Homo sapiens
caacuuaagaugacuagau

SEQ ID NO: 1454305 - RNA, 19 nt, Homo sapiens
ggaccacaaugccaacauc

SEQ ID NO: 1454306 - RNA, 19 nt, Homo sapiens
gaaagauguguucggguuu

SEQ ID NO: 1454307 - RNA, 19 nt, Homo sapiens
uacaggagcgacaucauua

SEQ ID NO: 1454308 - RNA, 19 nt, Homo sapiens
gauguuagaaucugaauac

SEQ ID NO: 1454309 - RNA, 19 nt, Homo sapiens
ggagcugauccuacaguua

SEQ ID NO: 1454310 - RNA, 19 nt, Homo sapiens
caucgucuguaaagguuaa

SEQ ID NO: 1454311 - RNA, 19 nt, Homo sapiens
gaccauguuuggauuucuu

SEQ ID NO: 1454312 - RNA, 19 nt, Homo sapiens
cuucacggcucuucacuau

SEQ ID NO: 1454313 - RNA, 19 nt, Homo sapiens
ggacucugcuucauuucuc

SEQ ID NO: 1454314 - RNA, 19 nt, Homo sapiens
acacuuaucugcccuuagg

SEQ ID NO: 1454315 - RNA, 19 nt, Homo sapiens
caaaagcaaucacucuuau

SEQ ID NO: 1454316 - RNA, 19 nt, Homo sapiens
ucacggcucuucacuaugc

SEQ ID NO: 1454317 - RNA, 19 nt, Homo sapiens
gcaaagugcaucccgaaag

SEQ ID NO: 1454318 - RNA, 19 nt, Homo sapiens
gaacacggagcugauccua

SEQ ID NO: 1454319 - RNA, 19 nt, Homo sapiens
gcagcaagaggaaaggaaa

SEQ ID NO: 1454320 - RNA, 19 nt, Homo sapiens
ucauuucucugcagcaaga

SEQ ID NO: 1454321 - RNA, 19 nt, Homo sapiens
caggaagaguugcagauuc

SEQ ID NO: 1454322 - RNA, 19 nt, Homo sapiens
uuacaagaagucacaagua

SEQ ID NO: 1454323 - RNA, 19 nt, Homo sapiens
gcugaaaggaggaagagaa

SEQ ID NO: 1454324 - RNA, 19 nt, Homo sapiens
cgaacacacggaacuauga

SEQ ID NO: 1454325 - RNA, 19 nt, Homo sapiens
gcgauacgccgugaucaaa

SEQ ID NO: 1454326 - RNA, 19 nt, Homo sapiens
aggaagaguugcagauuca

SEQ ID NO: 1454327 - RNA, 19 nt, Homo sapiens
caaagugcaucccgaaagc

SEQ ID NO: 1454328 - RNA, 19 nt, Homo sapiens
guaaccuaaugaauccuuu

SEQ ID NO: 1454329 - RNA, 19 nt, Homo sapiens
gccucauucuucugaaaua

SEQ ID NO: 1454330 - RNA, 19 nt, Homo sapiens
ggacagacuccuuuacacu

SEQ ID NO: 1454331 - RNA, 19 nt, Homo sapiens
ugaggagcuuaauguguuu

SEQ ID NO: 1454332 - RNA, 19 nt, Homo sapiens
gaagucacaaguauguaau

SEQ ID NO: 1454333 - RNA, 19 nt, Homo sapiens
gaggucaagcugugugaaa

SEQ ID NO: 1454334 - RNA, 19 nt, Homo sapiens
cagcugaggagacagguuu

SEQ ID NO: 1454335 - RNA, 19 nt, Homo sapiens
aaaguggacucagcuagga

SEQ ID NO: 1454336 - RNA, 19 nt, Homo sapiens
gggacacucuuccauaagg

SEQ ID NO: 1454337 - RNA, 19 nt, Homo sapiens
ccucauucuucugaaauaa

SEQ ID NO: 1454338 - RNA, 19 nt, Homo sapiens
agaagucacaaguauguaa

SEQ ID NO: 1454339 - RNA, 19 nt, Homo sapiens
gacagacuccuuuacacuu

SEQ ID NO: 1454340 - RNA, 19 nt, Homo sapiens
gaagacggacagacuccuu

SEQ ID NO: 1454341 - RNA, 19 nt, Homo sapiens
caagaggaaaggaaagaug

SEQ ID NO: 1454342 - RNA, 19 nt, Homo sapiens
gcgacaucauuaaugcaaa

SEQ ID NO: 1454343 - RNA, 19 nt, Homo sapiens
uggagaaguuggugagugu

SEQ ID NO: 1454344 - RNA, 19 nt, Homo sapiens
gcauugcacgcuugauguu

SEQ ID NO: 1454345 - RNA, 19 nt, Homo sapiens
caccaucauugucgaagga

SEQ ID NO: 1454346 - RNA, 19 nt, Homo sapiens
gaauacaggagcgacauca

SEQ ID NO: 1454347 - RNA, 19 nt, Homo sapiens
ugcgaaagaugcuagaaca

SEQ ID NO: 1454348 - RNA, 19 nt, Homo sapiens
uuacacuuaucugcccuua

SEQ ID NO: 1454349 - RNA, 19 nt, Homo sapiens
uccuacaguuaaagacuua

SEQ ID NO: 1454350 - RNA, 19 nt, Homo sapiens
gaugcuagaacaaggcuau

SEQ ID NO: 1454351 - RNA, 19 nt, Homo sapiens
cgaaagaugcuagaacaag

SEQ ID NO: 1454352 - RNA, 19 nt, Homo sapiens
ccacacagugcgaaagaug

SEQ ID NO: 1454353 - RNA, 19 nt, Homo sapiens
agacggacagacuccuuua

SEQ ID NO: 1454354 - RNA, 19 nt, Homo sapiens
ggaguucaaggcugagguu

SEQ ID NO: 1454355 - RNA, 19 nt, Homo sapiens
gcugugugcacggauguua

SEQ ID NO: 1454356 - RNA, 19 nt, Homo sapiens
ugccgaauguuccuucaga

SEQ ID NO: 1454357 - RNA, 19 nt, Homo sapiens
ucaaaagcaaucacucuua

SEQ ID NO: 1454358 - RNA, 19 nt, Homo sapiens
ccaggaagaguugcagauu

SEQ ID NO: 1454359 - RNA, 19 nt, Homo sapiens
gaccagcaucgucuguaaa

SEQ ID NO: 1454360 - RNA, 19 nt, Homo sapiens
cgacaucauuaaugcaaaa

SEQ ID NO: 1454361 - RNA, 19 nt, Homo sapiens
ugagcuggcugaagaagac

SEQ ID NO: 1454362 - RNA, 19 nt, Homo sapiens
ucacucuuauugccgaaug

SEQ ID NO: 1454363 - RNA, 19 nt, Homo sapiens
auacaggagcgacaucauu

SEQ ID NO: 1454364 - RNA, 19 nt, Homo sapiens
cagacuccuuuacacuuau

SEQ ID NO: 1454365 - RNA, 19 nt, Homo sapiens
cgcuucagcucgccauuau

SEQ ID NO: 1454366 - RNA, 19 nt, Homo sapiens
caucuucugaggagcuuaa

SEQ ID NO: 1454367 - RNA, 19 nt, Homo sapiens
agucgaccauguuuggauu

SEQ ID NO: 1454368 - RNA, 19 nt, Homo sapiens
cuacggcagggacucauuu

SEQ ID NO: 1454369 - RNA, 19 nt, Homo sapiens
gaggaaaggaaagaugugu

SEQ ID NO: 1454370 - RNA, 19 nt, Homo sapiens
gcgaaagaugcuagaacaa

SEQ ID NO: 1454371 - RNA, 19 nt, Homo sapiens
ugaagaagacgcgaaagca

SEQ ID NO: 1454372 - RNA, 19 nt, Homo sapiens
gcuugauguuagaaucuga

SEQ ID NO: 1454373 - RNA, 19 nt, Homo sapiens
gcaagaggaaaggaaagau

SEQ ID NO: 1454374 - RNA, 19 nt, Homo sapiens
gagaaguuggugaguguag

SEQ ID NO: 1454375 - RNA, 19 nt, Homo sapiens
ugugugcacggauguuaua

SEQ ID NO: 1454376 - RNA, 19 nt, Homo sapiens
uagccuggacguacuuuga

SEQ ID NO: 1454377 - RNA, 19 nt, Homo sapiens
cacaaacuugggucgcuua

SEQ ID NO: 1454378 - RNA, 19 nt, Homo sapiens
gccaacaucgacauucaga

SEQ ID NO: 1454379 - RNA, 19 nt, Homo sapiens
gagaggucaagcuguguga

SEQ ID NO: 1454380 - RNA, 19 nt, Homo sapiens
uaagcgaugccucauucuu

SEQ ID NO: 1454381 - RNA, 19 nt, Homo sapiens
caacaugucacaacaauaa

SEQ ID NO: 1454382 - RNA, 19 nt, Homo sapiens
gaacagcccuccacuaugc

SEQ ID NO: 1454383 - RNA, 19 nt, Homo sapiens
gaagggaaaucuugagagu

SEQ ID NO: 1454384 - RNA, 19 nt, Homo sapiens
gaugugaacugcacucaug

SEQ ID NO: 1454385 - RNA, 19 nt, Homo sapiens
gagcaaaacugucucaaaa

SEQ ID NO: 1454386 - RNA, 19 nt, Homo sapiens
uccaguaugugguauauua

SEQ ID NO: 1454387 - RNA, 19 nt, Homo sapiens
gaagauggaaaguacuuaa

SEQ ID NO: 1454388 - RNA, 19 nt, Homo sapiens
gaagcaacaugucacaaca

SEQ ID NO: 1454389 - RNA, 19 nt, Homo sapiens
gagccaagaucgcgccauu

SEQ ID NO: 1454390 - RNA, 19 nt, Homo sapiens
gagcccagccugaccaaua

SEQ ID NO: 1454391 - RNA, 19 nt, Homo sapiens
ucaaugcccuggauuacaa

SEQ ID NO: 1454392 - RNA, 19 nt, Homo sapiens
cuaaauuucucuaggaaga

SEQ ID NO: 1454393 - RNA, 19 nt, Homo sapiens
gaaggagucaacaguguaa

SEQ ID NO: 1454394 - RNA, 19 nt, Homo sapiens
uaagaacaaugcugagugu

SEQ ID NO: 1454395 - RNA, 19 nt, Homo sapiens
gguuaacgguccagaagaa

SEQ ID NO: 1454396 - RNA, 19 nt, Homo sapiens
uagaauagccggagaagau

SEQ ID NO: 1454397 - RNA, 19 nt, Homo sapiens
ggaaggagucaacagugua

SEQ ID NO: 1454398 - RNA, 19 nt, Homo sapiens
gggaaggagucaacagugu

SEQ ID NO: 1454399 - RNA, 19 nt, Homo sapiens
gaaggaauaccuguuacuu

SEQ ID NO: 1454400 - RNA, 19 nt, Homo sapiens
guuuauagauuucgaagca

SEQ ID NO: 1454401 - RNA, 19 nt, Homo sapiens
gggcagccuuuaagaacaa

SEQ ID NO: 1454402 - RNA, 19 nt, Homo sapiens
gagaagauguuugcaccau

SEQ ID NO: 1454403 - RNA, 19 nt, Homo sapiens
caugguggcucacgucugu

SEQ ID NO: 1454404 - RNA, 19 nt, Homo sapiens
cuaggaagauggaaaguac

SEQ ID NO: 1454405 - RNA, 19 nt, Homo sapiens
gcagagcauucagagcaaa

SEQ ID NO: 1454406 - RNA, 19 nt, Homo sapiens
gggcugccaugaagggaaa

SEQ ID NO: 1454407 - RNA, 19 nt, Homo sapiens
cacgagagguggccagaga

SEQ ID NO: 1454408 - RNA, 19 nt, Homo sapiens
ggaagauggaaaguacuua

SEQ ID NO: 1454409 - RNA, 19 nt, Homo sapiens
guugugugguuuauagauu

SEQ ID NO: 1454410 - RNA, 19 nt, Homo sapiens
ggucagagucaucaaccua

SEQ ID NO: 1454411 - RNA, 19 nt, Homo sapiens
agggaaaucuugagagugu

SEQ ID NO: 1454412 - RNA, 19 nt, Homo sapiens
ggagucaacaguguaacua

SEQ ID NO: 1454413 - RNA, 19 nt, Homo sapiens
guuggacacuuugaauuga

SEQ ID NO: 1454414 - RNA, 19 nt, Homo sapiens
caacagagauaccccacuu

SEQ ID NO: 1454415 - RNA, 19 nt, Homo sapiens
ccgaacagcccuccacuau

SEQ ID NO: 1454416 - RNA, 19 nt, Homo sapiens
gcgcuuaauccgaacaauu

SEQ ID NO: 1454417 - RNA, 19 nt, Homo sapiens
gaaaccccgucucuacuaa

SEQ ID NO: 1454418 - RNA, 19 nt, Homo sapiens
aauaaugugugugugguuu

SEQ ID NO: 1454419 - RNA, 19 nt, Homo sapiens
gcaacaugucacaacaaua

SEQ ID NO: 1454420 - RNA, 19 nt, Homo sapiens
ccacuaugcagcagagaaa

SEQ ID NO: 1454421 - RNA, 19 nt, Homo sapiens
agucaacaguguaacuaaa

SEQ ID NO: 1454422 - RNA, 19 nt, Homo sapiens
ccagagacccgcagcuaug

SEQ ID NO: 1454423 - RNA, 19 nt, Homo sapiens
agagaaagaugaggcuugu

SEQ ID NO: 1454424 - RNA, 19 nt, Homo sapiens
aggaauaccuguuacuuuu

SEQ ID NO: 1454425 - RNA, 19 nt, Homo sapiens
uugaugaguuccaguaugu

SEQ ID NO: 1454426 - RNA, 19 nt, Homo sapiens
ggaauaccuguuacuuuua

SEQ ID NO: 1454427 - RNA, 19 nt, Homo sapiens
gugcucagcuccaggaacu

SEQ ID NO: 1454428 - RNA, 19 nt, Homo sapiens
cagagcuguuggacacuuu

SEQ ID NO: 1454429 - RNA, 19 nt, Homo sapiens
cagagucaucaaccuaaua

SEQ ID NO: 1454430 - RNA, 19 nt, Homo sapiens
gagucaacaguguaacuaa

SEQ ID NO: 1454431 - RNA, 19 nt, Homo sapiens
ucacaacaauaaccuccau

SEQ ID NO: 1454432 - RNA, 19 nt, Homo sapiens
ccuguugugugguuuauag

SEQ ID NO: 1454433 - RNA, 19 nt, Homo sapiens
gcagaggucagagucauca

SEQ ID NO: 1454434 - RNA, 19 nt, Homo sapiens
gcgcagaggucagagucau

SEQ ID NO: 1454435 - RNA, 19 nt, Homo sapiens
aaggaauaccuguuacuuu

SEQ ID NO: 1454436 - RNA, 19 nt, Homo sapiens
gagacccgcagcuauguga

SEQ ID NO: 1454437 - RNA, 19 nt, Homo sapiens
ggaaaucuugagaguguca

SEQ ID NO: 1454438 - RNA, 19 nt, Homo sapiens
ggauggguauaaccgaaca

SEQ ID NO: 1454439 - RNA, 19 nt, Homo sapiens
gcacucauggcacacugaa

SEQ ID NO: 1454440 - RNA, 19 nt, Homo sapiens
gaauaccuguuacuuuuag

SEQ ID NO: 1454441 - RNA, 19 nt, Homo sapiens
uuugaaggaauaccuguua

SEQ ID NO: 1454442 - RNA, 19 nt, Homo sapiens
guguggagguccuauugga

SEQ ID NO: 1454443 - RNA, 19 nt, Homo sapiens
guuccaguaugugguauau

SEQ ID NO: 1454444 - RNA, 19 nt, Homo sapiens
ccacugccagcuucuuuga

SEQ ID NO: 1454445 - RNA, 19 nt, Homo sapiens
gccaugaagggaaaucuug

SEQ ID NO: 1454446 - RNA, 19 nt, Homo sapiens
agaaagaugaggcuugugu

SEQ ID NO: 1454447 - RNA, 19 nt, Homo sapiens
gagcaugugaacaccuuga

SEQ ID NO: 1454448 - RNA, 19 nt, Homo sapiens
ucagagucaucaaccuaau

SEQ ID NO: 1454449 - RNA, 19 nt, Homo sapiens
cgaggugaaugcccuggau

SEQ ID NO: 1454450 - RNA, 19 nt, Homo sapiens
gcccagcaauucggcaguu

SEQ ID NO: 1454451 - RNA, 19 nt, Homo sapiens
gacagaagaaucgcuugaa

SEQ ID NO: 1454452 - RNA, 19 nt, Homo sapiens
aacaauaaccuccauagca

SEQ ID NO: 1454453 - RNA, 19 nt, Homo sapiens
ccuugagccuugaugaguu

SEQ ID NO: 1454454 - RNA, 19 nt, Homo sapiens
uggagguccuauuggagua

SEQ ID NO: 1454455 - RNA, 19 nt, Homo sapiens
aaaccaaacaacccaacaa

SEQ ID NO: 1454456 - RNA, 19 nt, Homo sapiens
gugccuguauggugucaga

SEQ ID NO: 1454457 - RNA, 19 nt, Homo sapiens
acagaagaaucgcuugaac

SEQ ID NO: 1454458 - RNA, 19 nt, Homo sapiens
ugaccaauaugaugaaacc

SEQ ID NO: 1454459 - RNA, 19 nt, Homo sapiens
aaauuucucuaggaagaug

SEQ ID NO: 1454460 - RNA, 19 nt, Homo sapiens
gaauagccggagaagaugu

SEQ ID NO: 1454461 - RNA, 19 nt, Homo sapiens
gugcaaaccccaaugcuuu

SEQ ID NO: 1454462 - RNA, 19 nt, Homo sapiens
cgcuuaauccgaacaauug

SEQ ID NO: 1454463 - RNA, 19 nt, Homo sapiens
ggacuuggaacagagaaag

SEQ ID NO: 1454464 - RNA, 19 nt, Homo sapiens
ugaguuccaguauguggua

SEQ ID NO: 1454465 - RNA, 19 nt, Homo sapiens
agacagaagaaucgcuuga

SEQ ID NO: 1454466 - RNA, 19 nt, Homo sapiens
ucuguaaucccaggacuuu

SEQ ID NO: 1454467 - RNA, 19 nt, Homo sapiens
caguguaacuaaauuucuc

SEQ ID NO: 1454468 - RNA, 19 nt, Homo sapiens
ucacugggcagccuuuaag

SEQ ID NO: 1454469 - RNA, 19 nt, Homo sapiens
ccaccucagcccagcaauu

SEQ ID NO: 1454470 - RNA, 19 nt, Homo sapiens
aaccaaacaacccaacaaa

SEQ ID NO: 1454471 - RNA, 19 nt, Homo sapiens
caguacuccuugucacaga

SEQ ID NO: 1454472 - RNA, 19 nt, Homo sapiens
gguugucccugcaguacuc

SEQ ID NO: 1454473 - RNA, 19 nt, Homo sapiens
gacccgcagcuaugugaaa

SEQ ID NO: 1454474 - RNA, 19 nt, Homo sapiens
gucagagucaucaaccuaa

SEQ ID NO: 1454475 - RNA, 19 nt, Homo sapiens
gcaguuuggagcaugugaa

SEQ ID NO: 1454476 - RNA, 19 nt, Homo sapiens
agcaacaugucacaacaau

SEQ ID NO: 1454477 - RNA, 19 nt, Homo sapiens
cgaacagcccuccacuaug

SEQ ID NO: 1454478 - RNA, 19 nt, Homo sapiens
gucaacaguguaacuaaau

SEQ ID NO: 1454479 - RNA, 19 nt, Homo sapiens
uggagcaugugaacaccuu

SEQ ID NO: 1454480 - RNA, 19 nt, Homo sapiens
gcauucagagcaaauacuc

SEQ ID NO: 1454481 - RNA, 19 nt, Homo sapiens
gaaagacacugcauacguu

SEQ ID NO: 1454482 - RNA, 19 nt, Homo sapiens
uaacuuaugugaugacuug

SEQ ID NO: 1454483 - RNA, 19 nt, Homo sapiens
ggucaucucucuuguguga

SEQ ID NO: 1454484 - RNA, 19 nt, Homo sapiens
ucaacucucuuauagcuua

SEQ ID NO: 1454485 - RNA, 19 nt, Homo sapiens
caagaaugcugaaggcaaa

SEQ ID NO: 1454486 - RNA, 19 nt, Homo sapiens
gcaucaggcuucuuucaaa

SEQ ID NO: 1454487 - RNA, 19 nt, Homo sapiens
gggucaagauguccaauuu

SEQ ID NO: 1454488 - RNA, 19 nt, Homo sapiens
uagaaggcaugaagacuuu

SEQ ID NO: 1454489 - RNA, 19 nt, Homo sapiens
caaguuggauuuauagagu

SEQ ID NO: 1454490 - RNA, 19 nt, Homo sapiens
acagguagcacucagauua

SEQ ID NO: 1454491 - RNA, 19 nt, Homo sapiens
ggagucaaauucaaauaca

SEQ ID NO: 1454492 - RNA, 19 nt, Homo sapiens
cagcaucacuguccugguu

SEQ ID NO: 1454493 - RNA, 19 nt, Homo sapiens
gcauggagcucaggugaau

SEQ ID NO: 1454494 - RNA, 19 nt, Homo sapiens
ggauagaggagucaaauuc

SEQ ID NO: 1454495 - RNA, 19 nt, Homo sapiens
gaggucaucucucuugugu

SEQ ID NO: 1454496 - RNA, 19 nt, Homo sapiens
gaauccagcagcaucauaa

SEQ ID NO: 1454497 - RNA, 19 nt, Homo sapiens
ccagcagcaucauaagaua

SEQ ID NO: 1454498 - RNA, 19 nt, Homo sapiens
gcccuaaucuguugacauc

SEQ ID NO: 1454499 - RNA, 19 nt, Homo sapiens
gcgaugcugugucugauug

SEQ ID NO: 1454500 - RNA, 19 nt, Homo sapiens
gcacggagccagcguucaa

SEQ ID NO: 1454501 - RNA, 19 nt, Homo sapiens
ccuaagcccuaaucuguug

SEQ ID NO: 1454502 - RNA, 19 nt, Homo sapiens
gcagaccauuugaccagaa

SEQ ID NO: 1454503 - RNA, 19 nt, Homo sapiens
gcaguuaugccgccuuaga

SEQ ID NO: 1454504 - RNA, 19 nt, Homo sapiens
cagcugggauugugugaau

SEQ ID NO: 1454505 - RNA, 19 nt, Homo sapiens
ggacgugaaccaagggaaa

SEQ ID NO: 1454506 - RNA, 19 nt, Homo sapiens
ggaauccagcagcaucaua

SEQ ID NO: 1454507 - RNA, 19 nt, Homo sapiens
caacauugaccauaagauc

SEQ ID NO: 1454508 - RNA, 19 nt, Homo sapiens
gcauggaguuuggacuuug

SEQ ID NO: 1454509 - RNA, 19 nt, Homo sapiens
gauagaggagucaaauuca

SEQ ID NO: 1454510 - RNA, 19 nt, Homo sapiens
ucuccuacaucuuuaaaug

SEQ ID NO: 1454511 - RNA, 19 nt, Homo sapiens
uuaaaugcaucuagggaau

SEQ ID NO: 1454512 - RNA, 19 nt, Homo sapiens
gagcauggaguuuggacuu

SEQ ID NO: 1454513 - RNA, 19 nt, Homo sapiens
gaugggcgaugcugugucu

SEQ ID NO: 1454514 - RNA, 19 nt, Homo sapiens
gaggagucaaauucaaaua

SEQ ID NO: 1454515 - RNA, 19 nt, Homo sapiens
ugugucaacucucuuauag

SEQ ID NO: 1454516 - RNA, 19 nt, Homo sapiens
guuguagccacuagaauuu

SEQ ID NO: 1454517 - RNA, 19 nt, Homo sapiens
cagagagccugugucaaga

SEQ ID NO: 1454518 - RNA, 19 nt, Homo sapiens
gggcaacauugaccauaag

SEQ ID NO: 1454519 - RNA, 19 nt, Homo sapiens
gcugggauugugugaauuu

SEQ ID NO: 1454520 - RNA, 19 nt, Homo sapiens
ccaugaagccugucuugga

SEQ ID NO: 1454521 - RNA, 19 nt, Homo sapiens
caguuucuccuacaucuuu

SEQ ID NO: 1454522 - RNA, 19 nt, Homo sapiens
caagggaaaggucaggauu

SEQ ID NO: 1454523 - RNA, 19 nt, Homo sapiens
gaaguggagcgcagagcuu

SEQ ID NO: 1454524 - RNA, 19 nt, Homo sapiens
gagagccugugucaagaag

SEQ ID NO: 1454525 - RNA, 19 nt, Homo sapiens
ccugggcacuccacucuau

SEQ ID NO: 1454526 - RNA, 19 nt, Homo sapiens
guuuauggaguuugacuaa

SEQ ID NO: 1454527 - RNA, 19 nt, Homo sapiens
ugucaacucucuuauagcu

SEQ ID NO: 1454528 - RNA, 19 nt, Homo sapiens
acacuccacuguuuaaugc

SEQ ID NO: 1454529 - RNA, 19 nt, Homo sapiens
uagaggagucaaauucaaa

SEQ ID NO: 1454530 - RNA, 19 nt, Homo sapiens
cagcagcaucauaagauaa

SEQ ID NO: 1454531 - RNA, 19 nt, Homo sapiens
caucacggcagaucauguu

SEQ ID NO: 1454532 - RNA, 19 nt, Homo sapiens
gguuccaucucugcuauau

SEQ ID NO: 1454533 - RNA, 19 nt, Homo sapiens
auagaggagucaaauucaa

SEQ ID NO: 1454534 - RNA, 19 nt, Homo sapiens
aaccuaagcccuaaucugu

SEQ ID NO: 1454535 - RNA, 19 nt, Homo sapiens
ucaggugaauggugugaca

SEQ ID NO: 1454536 - RNA, 19 nt, Homo sapiens
uuucuuggcuugucuaaaa

SEQ ID NO: 1454537 - RNA, 19 nt, Homo sapiens
uuagaauucggaaguguuu

SEQ ID NO: 1454538 - RNA, 19 nt, Homo sapiens
guuaugccgccuuagaauu

SEQ ID NO: 1454539 - RNA, 19 nt, Homo sapiens
ggacacccaggccaagaau

SEQ ID NO: 1454540 - RNA, 19 nt, Homo sapiens
gcguucaaccugagaguga

SEQ ID NO: 1454541 - RNA, 19 nt, Homo sapiens
caucaggcuucuuucaaac

SEQ ID NO: 1454542 - RNA, 19 nt, Homo sapiens
gaggccacguggagugugu

SEQ ID NO: 1454543 - RNA, 19 nt, Homo sapiens
gugcuuugcugcagaccau

SEQ ID NO: 1454544 - RNA, 19 nt, Homo sapiens
uuucugcaccaucuaauuu

SEQ ID NO: 1454545 - RNA, 19 nt, Homo sapiens
gacacugcauacguuugua

SEQ ID NO: 1454546 - RNA, 19 nt, Homo sapiens
gggauugugugaauuugcu

SEQ ID NO: 1454547 - RNA, 19 nt, Homo sapiens
cuggcacacuccacuguuu

SEQ ID NO: 1454548 - RNA, 19 nt, Homo sapiens
uuagaaggcaugaagacuu

SEQ ID NO: 1454549 - RNA, 19 nt, Homo sapiens
cuucuuugaugcaguuaug

SEQ ID NO: 1454550 - RNA, 19 nt, Homo sapiens
cagcucagccagccacaga

SEQ ID NO: 1454551 - RNA, 19 nt, Homo sapiens
uggcccagcucuucuugga

SEQ ID NO: 1454552 - RNA, 19 nt, Homo sapiens
gagccugugucaagaagcu

SEQ ID NO: 1454553 - RNA, 19 nt, Homo sapiens
ggggcaacauugaccauaa

SEQ ID NO: 1454554 - RNA, 19 nt, Homo sapiens
aaagacacugcauacguuu

SEQ ID NO: 1454555 - RNA, 19 nt, Homo sapiens
caucauaagauaaccaaac

SEQ ID NO: 1454556 - RNA, 19 nt, Homo sapiens
augcaguuaugccgccuua

SEQ ID NO: 1454557 - RNA, 19 nt, Homo sapiens
ugauuggucuccuaugcau

SEQ ID NO: 1454558 - RNA, 19 nt, Homo sapiens
ccugccugcucauggauuu

SEQ ID NO: 1454559 - RNA, 19 nt, Homo sapiens
caacucucuuauagcuuau

SEQ ID NO: 1454560 - RNA, 19 nt, Homo sapiens
ggcacacuccacuguuuaa

SEQ ID NO: 1454561 - RNA, 19 nt, Homo sapiens
uggcacacuccacuguuua

SEQ ID NO: 1454562 - RNA, 19 nt, Homo sapiens
ucaaauacagguuuucuga

SEQ ID NO: 1454563 - RNA, 19 nt, Homo sapiens
gugugucaacucucuuaua

SEQ ID NO: 1454564 - RNA, 19 nt, Homo sapiens
gagucaaauucaaauacag

SEQ ID NO: 1454565 - RNA, 19 nt, Homo sapiens
gcacuuucugcaccaucua

SEQ ID NO: 1454566 - RNA, 19 nt, Homo sapiens
uguuguagccacuagaauu

SEQ ID NO: 1454567 - RNA, 19 nt, Homo sapiens
gccaaaaccuaagcccuaa

SEQ ID NO: 1454568 - RNA, 19 nt, Homo sapiens
ggcaucaggcuucuuucaa

SEQ ID NO: 1454569 - RNA, 19 nt, Homo sapiens
gucaagauguccaauuuuc

SEQ ID NO: 1454570 - RNA, 19 nt, Homo sapiens
gaacaucaucacggcagau

SEQ ID NO: 1454571 - RNA, 19 nt, Homo sapiens
uaggagagagcaucaugga

SEQ ID NO: 1454572 - RNA, 19 nt, Homo sapiens
gggcacuccacucuauuug

SEQ ID NO: 1454573 - RNA, 19 nt, Homo sapiens
ucaucucucuugugugaag

SEQ ID NO: 1454574 - RNA, 19 nt, Homo sapiens
ggaggucaucucucuugug

SEQ ID NO: 1454575 - RNA, 19 nt, Homo sapiens
ggugggcugugaacaucau

SEQ ID NO: 1454576 - RNA, 19 nt, Homo sapiens
uguagccacuagaauuuua

SEQ ID NO: 1454577 - RNA, 19 nt, Homo sapiens
caguuaugccgccuuagaa

SEQ ID NO: 1454578 - RNA, 19 nt, Homo sapiens
gggcgaugcugugucugau

SEQ ID NO: 1454579 - RNA, 19 nt, Homo sapiens
gcacacuccacuguuuaau

SEQ ID NO: 1454580 - RNA, 19 nt, Homo sapiens
cuuaugugaugacuugauc

SEQ ID NO: 1454581 - RNA, 19 nt, Homo sapiens
gcacauaugaggacuacuu

SEQ ID NO: 1454582 - RNA, 19 nt, Homo sapiens
ccaaaguggugaucgaguu

SEQ ID NO: 1454583 - RNA, 19 nt, Homo sapiens
cuacgaggccuucuugaaa

SEQ ID NO: 1454584 - RNA, 19 nt, Homo sapiens
caucaugccucccaagaag

SEQ ID NO: 1454585 - RNA, 19 nt, Homo sapiens
ggccaccuauuguuucaaa

SEQ ID NO: 1454586 - RNA, 19 nt, Homo sapiens
gcagagcucagacauguuc

SEQ ID NO: 1454587 - RNA, 19 nt, Homo sapiens
caacuacgaggccuucuug

SEQ ID NO: 1454588 - RNA, 19 nt, Homo sapiens
agaaggauguucccgugaa

SEQ ID NO: 1454589 - RNA, 19 nt, Homo sapiens
gaaggauguucccgugaag

SEQ ID NO: 1454590 - RNA, 19 nt, Homo sapiens
caaaguggugaucgaguuu

SEQ ID NO: 1454591 - RNA, 19 nt, Homo sapiens
gaggccaccuauuguuuca

SEQ ID NO: 1454592 - RNA, 19 nt, Homo sapiens
guguggacuuugagacuuu

SEQ ID NO: 1454593 - RNA, 19 nt, Homo sapiens
ugaucgaguuuaacaagga

SEQ ID NO: 1454594 - RNA, 19 nt, Homo sapiens
caagagugaugagcugaag

SEQ ID NO: 1454595 - RNA, 19 nt, Homo sapiens
ggaggccaccuauuguuuc

SEQ ID NO: 1454596 - RNA, 19 nt, Homo sapiens
cagucgaucucuccaaagu

SEQ ID NO: 1454597 - RNA, 19 nt, Homo sapiens
ucaccacccuuggagagaa

SEQ ID NO: 1454598 - RNA, 19 nt, Homo sapiens
ggagggguuucguguguuu

SEQ ID NO: 1454599 - RNA, 19 nt, Homo sapiens
cauaugaggacuacuugga

SEQ ID NO: 1454600 - RNA, 19 nt, Homo sapiens
gcaacggcugcaucaacua

SEQ ID NO: 1454601 - RNA, 19 nt, Homo sapiens
aaguggugaucgaguuuaa

SEQ ID NO: 1454602 - RNA, 19 nt, Homo sapiens
uccagucgaucucuccaaa

SEQ ID NO: 1454603 - RNA, 19 nt, Homo sapiens
ucuccaaaccugcugcuaa

SEQ ID NO: 1454604 - RNA, 19 nt, Homo sapiens
gacaucaugccucccaaga

SEQ ID NO: 1454605 - RNA, 19 nt, Homo sapiens
ccaggaggccaccuauugu

SEQ ID NO: 1454606 - RNA, 19 nt, Homo sapiens
aggaccagcuggaggaguu

SEQ ID NO: 1454607 - RNA, 19 nt, Homo sapiens
ggugaucgaguuuaacaag

SEQ ID NO: 1454608 - RNA, 19 nt, Homo sapiens
gaggccaaggcacauauga

SEQ ID NO: 1454609 - RNA, 19 nt, Homo sapiens
gagcucagacauguucuca

SEQ ID NO: 1454610 - RNA, 19 nt, Homo sapiens
ggauguucccgugaagaaa

SEQ ID NO: 1454611 - RNA, 19 nt, Homo sapiens
cuccaaaccugcugcuaag

SEQ ID NO: 1454612 - RNA, 19 nt, Homo sapiens
caggaggccaccuauuguu

SEQ ID NO: 1454613 - RNA, 19 nt, Homo sapiens
gaggccuucuugaaacaca

SEQ ID NO: 1454614 - RNA, 19 nt, Homo sapiens
aaaguggugaucgaguuua

SEQ ID NO: 1454615 - RNA, 19 nt, Homo sapiens
uacgaggccuucuugaaac

SEQ ID NO: 1454616 - RNA, 19 nt, Homo sapiens
accaggaggccaccuauug

SEQ ID NO: 1454617 - RNA, 19 nt, Homo sapiens
caacggcugcaucaacuac

SEQ ID NO: 1454618 - RNA, 19 nt, Homo sapiens
uuggagagaagaugacuga

SEQ ID NO: 1454619 - RNA, 19 nt, Homo sapiens
gguuucguguguuugacaa

SEQ ID NO: 1454620 - RNA, 19 nt, Homo sapiens
uccaggcaguggccaagaa

SEQ ID NO: 1454621 - RNA, 19 nt, Homo sapiens
ccaagagugaugagcugaa

SEQ ID NO: 1454622 - RNA, 19 nt, Homo sapiens
gauguucccgugaagaaac

SEQ ID NO: 1454623 - RNA, 19 nt, Homo sapiens
cguguggacuuugagacuu

SEQ ID NO: 1454624 - RNA, 19 nt, Homo sapiens
gcucugcgcugcucaaaca

SEQ ID NO: 1454625 - RNA, 19 nt, Homo sapiens
gcuccacgcugcugaaaca

SEQ ID NO: 1454626 - RNA, 19 nt, Homo sapiens
cugaagaccucaacacugu

SEQ ID NO: 1454627 - RNA, 19 nt, Homo sapiens
ggaaucuucugacccaaag

SEQ ID NO: 1454628 - RNA, 19 nt, Homo sapiens
gaagaucuggacccgguuu

SEQ ID NO: 1454629 - RNA, 19 nt, Homo sapiens
gcagagcuccaacuugcaa

SEQ ID NO: 1454630 - RNA, 19 nt, Homo sapiens
cgaccucgauccagaugug

SEQ ID NO: 1454631 - RNA, 19 nt, Homo sapiens
ucaacacugucccggaaga

SEQ ID NO: 1454632 - RNA, 19 nt, Homo sapiens
cuacuccuguggaaucuuc

SEQ ID NO: 1454633 - RNA, 19 nt, Homo sapiens
ggacccgguuucugaagac

SEQ ID NO: 1454634 - RNA, 19 nt, Homo sapiens
cccagagccugauccugaa

SEQ ID NO: 1454635 - RNA, 19 nt, Homo sapiens
gcccuacuccuguggaauc

SEQ ID NO: 1454636 - RNA, 19 nt, Homo sapiens
ccuccagccucaccaagca

SEQ ID NO: 1454637 - RNA, 19 nt, Homo sapiens
caucuccucuggccucacu

SEQ ID NO: 1454638 - RNA, 19 nt, Homo sapiens
cagcccuacuccuguggaa

SEQ ID NO: 1454639 - RNA, 19 nt, Homo sapiens
guccugaugcuguuucugu

SEQ ID NO: 1454640 - RNA, 19 nt, Homo sapiens
gaaaugauguuuacaccaa

SEQ ID NO: 1454641 - RNA, 19 nt, Homo sapiens
guacauagcugaugaaacu

SEQ ID NO: 1454642 - RNA, 19 nt, Homo sapiens
gagaacaccuuuacaauag

SEQ ID NO: 1454643 - RNA, 19 nt, Homo sapiens
ggaaagguauuauaugaug

SEQ ID NO: 1454644 - RNA, 19 nt, Homo sapiens
gcauaaacaucgccaauga

SEQ ID NO: 1454645 - RNA, 19 nt, Homo sapiens
gaagaaaccaccaacauga

SEQ ID NO: 1454646 - RNA, 19 nt, Homo sapiens
gggcaagaaucucugaaua

SEQ ID NO: 1454647 - RNA, 19 nt, Homo sapiens
aaacaaagaagcccuauaa

SEQ ID NO: 1454648 - RNA, 19 nt, Homo sapiens
ggaaugagagggaaaguuu

SEQ ID NO: 1454649 - RNA, 19 nt, Homo sapiens
ugaaacaucuguauggauu

SEQ ID NO: 1454650 - RNA, 19 nt, Homo sapiens
guaggaacauucaugguaa

SEQ ID NO: 1454651 - RNA, 19 nt, Homo sapiens
gcaagaaucucugaauauc

SEQ ID NO: 1454652 - RNA, 19 nt, Homo sapiens
cauauacucuccacaguuu

SEQ ID NO: 1454653 - RNA, 19 nt, Homo sapiens
ggaaggaccugaucuuguc

SEQ ID NO: 1454654 - RNA, 19 nt, Homo sapiens
ggcaaacuguggcuucuua

SEQ ID NO: 1454655 - RNA, 19 nt, Homo sapiens
gaucacagcuauugaacug

SEQ ID NO: 1454656 - RNA, 19 nt, Homo sapiens
caagguaacuaacaagaga

SEQ ID NO: 1454657 - RNA, 19 nt, Homo sapiens
gaacaccuuuacaauaguu

SEQ ID NO: 1454658 - RNA, 19 nt, Homo sapiens
gaacugugcuuuggcauuc

SEQ ID NO: 1454659 - RNA, 19 nt, Homo sapiens
acagacaccugggaaauua

SEQ ID NO: 1454660 - RNA, 19 nt, Homo sapiens
gagaauacauggagaaacu

SEQ ID NO: 1454661 - RNA, 19 nt, Homo sapiens
ggacugauuugcugucuuc

SEQ ID NO: 1454662 - RNA, 19 nt, Homo sapiens
cagaagaccuuaucaugug

SEQ ID NO: 1454663 - RNA, 19 nt, Homo sapiens
gagcaccuacuuuauauaa

SEQ ID NO: 1454664 - RNA, 19 nt, Homo sapiens
gaguuaagcucguugacuu

SEQ ID NO: 1454665 - RNA, 19 nt, Homo sapiens
ucacugagcuugucaaagg

SEQ ID NO: 1454666 - RNA, 19 nt, Homo sapiens
gaacauucaugguaaucga

SEQ ID NO: 1454667 - RNA, 19 nt, Homo sapiens
gaaauuauagagaccauug

SEQ ID NO: 1454668 - RNA, 19 nt, Homo sapiens
ugagaacaccuuuacaaua

SEQ ID NO: 1454669 - RNA, 19 nt, Homo sapiens
gaaacguuaugcagacuug

SEQ ID NO: 1454670 - RNA, 19 nt, Homo sapiens
gaaauccuccaccuacuuu

SEQ ID NO: 1454671 - RNA, 19 nt, Homo sapiens
ugacaugcauccugugaaa

SEQ ID NO: 1454672 - RNA, 19 nt, Homo sapiens
caaagcggaucacugugua

SEQ ID NO: 1454673 - RNA, 19 nt, Homo sapiens
gacaagagcuaggauaaca

SEQ ID NO: 1454674 - RNA, 19 nt, Homo sapiens
gacccugguugauaaauuu

SEQ ID NO: 1454675 - RNA, 19 nt, Homo sapiens
gagcaaauccaguacuauu

SEQ ID NO: 1454676 - RNA, 19 nt, Homo sapiens
gaagacaauucgaagcaau

SEQ ID NO: 1454677 - RNA, 19 nt, Homo sapiens
aaucagaccuugagagaga

SEQ ID NO: 1454678 - RNA, 19 nt, Homo sapiens
gaagaauucaaccacuuua

SEQ ID NO: 1454679 - RNA, 19 nt, Homo sapiens
gaauacauggagaaacuua

SEQ ID NO: 1454680 - RNA, 19 nt, Homo sapiens
gaggguauaucuagugaau

SEQ ID NO: 1454681 - RNA, 19 nt, Homo sapiens
gcacugccaucaaugacaa

SEQ ID NO: 1454682 - RNA, 19 nt, Homo sapiens
gaaccuuacugaaccacuu

SEQ ID NO: 1454683 - RNA, 19 nt, Homo sapiens
ggaagaaaccaccaacaug

SEQ ID NO: 1454684 - RNA, 19 nt, Homo sapiens
ggcaaagucuacaagguaa

SEQ ID NO: 1454685 - RNA, 19 nt, Homo sapiens
gcuuuggcauucagcauua

SEQ ID NO: 1454686 - RNA, 19 nt, Homo sapiens
ccaaugagcaaauccagua

SEQ ID NO: 1454687 - RNA, 19 nt, Homo sapiens
ugucaaaggucuacucaga

SEQ ID NO: 1454688 - RNA, 19 nt, Homo sapiens
caaagaagcccuauaagac

SEQ ID NO: 1454689 - RNA, 19 nt, Homo sapiens
uccauucacuggucaaaua

SEQ ID NO: 1454690 - RNA, 19 nt, Homo sapiens
ucaaaggucuacucagaug

SEQ ID NO: 1454691 - RNA, 19 nt, Homo sapiens
gaccugaucuuguccaucu

SEQ ID NO: 1454692 - RNA, 19 nt, Homo sapiens
gauaauugccuguguuuag

SEQ ID NO: 1454693 - RNA, 19 nt, Homo sapiens
cauggacccugauaauauu

SEQ ID NO: 1454694 - RNA, 19 nt, Homo sapiens
gaucuuggauaucuuugga

SEQ ID NO: 1454695 - RNA, 19 nt, Homo sapiens
acaaagaggugcacucagu

SEQ ID NO: 1454696 - RNA, 19 nt, Homo sapiens
uaugcagacuugcuaauuu

SEQ ID NO: 1454697 - RNA, 19 nt, Homo sapiens
caagaugggcggaucauga

SEQ ID NO: 1454698 - RNA, 19 nt, Homo sapiens
ucaacaugauucaguauga

SEQ ID NO: 1454699 - RNA, 19 nt, Homo sapiens
ggaauguuaccuucaauug

SEQ ID NO: 1454700 - RNA, 19 nt, Homo sapiens
ccaggucacuuuauucugu

SEQ ID NO: 1454701 - RNA, 19 nt, Homo sapiens
gcaagaggaagccaagaaa

SEQ ID NO: 1454702 - RNA, 19 nt, Homo sapiens
cuggaaagguauuauauga

SEQ ID NO: 1454703 - RNA, 19 nt, Homo sapiens
uaacuuccaaggagucuua

SEQ ID NO: 1454704 - RNA, 19 nt, Homo sapiens
guacacgucugcggagaaa

SEQ ID NO: 1454705 - RNA, 19 nt, Homo sapiens
guagauaguaugcaagaaa

SEQ ID NO: 1454706 - RNA, 19 nt, Homo sapiens
aagcauaucugacaggaau

SEQ ID NO: 1454707 - RNA, 19 nt, Homo sapiens
gcaaauaaccccucucuug

SEQ ID NO: 1454708 - RNA, 19 nt, Homo sapiens
gcacaucaaacaccucuug

SEQ ID NO: 1454709 - RNA, 19 nt, Homo sapiens
ggacauguuccuccagaaa

SEQ ID NO: 1454710 - RNA, 19 nt, Homo sapiens
gauggaauaucagaaugaa

SEQ ID NO: 1454711 - RNA, 19 nt, Homo sapiens
ucagugauauggaugaaga

SEQ ID NO: 1454712 - RNA, 19 nt, Homo sapiens
gaggacaccauguacuaua

SEQ ID NO: 1454713 - RNA, 19 nt, Homo sapiens
agaauccaaucucucauaa

SEQ ID NO: 1454714 - RNA, 19 nt, Homo sapiens
gcccaaugcugaagcuuug

SEQ ID NO: 1454715 - RNA, 19 nt, Homo sapiens
ggaaaggccaauaaucaga

SEQ ID NO: 1454716 - RNA, 19 nt, Homo sapiens
acaaagaagcccuauaaga

SEQ ID NO: 1454717 - RNA, 19 nt, Homo sapiens
guacacagacuucaagcaa

SEQ ID NO: 1454718 - RNA, 19 nt, Homo sapiens
gauaaucuacgaugcaaau

SEQ ID NO: 1454719 - RNA, 19 nt, Homo sapiens
agaaagcgcccaccugauu

SEQ ID NO: 1454720 - RNA, 19 nt, Homo sapiens
augcagacuugcuaauuua

SEQ ID NO: 1454721 - RNA, 19 nt, Homo sapiens
ggguauaucuagugaaugg

SEQ ID NO: 1454722 - RNA, 19 nt, Homo sapiens
gaaacaucuguauggauua

SEQ ID NO: 1454723 - RNA, 19 nt, Homo sapiens
gcagauggaauaucagaau

SEQ ID NO: 1454724 - RNA, 19 nt, Homo sapiens
gcaaagaccagugcauugu

SEQ ID NO: 1454725 - RNA, 19 nt, Homo sapiens
caaauugcagugugaugua

SEQ ID NO: 1454726 - RNA, 19 nt, Homo sapiens
gguauuauaugaugcuucu

SEQ ID NO: 1454727 - RNA, 19 nt, Homo sapiens
ggacaaagaggugcacuca

SEQ ID NO: 1454728 - RNA, 19 nt, Homo sapiens
aaaguucuguuucugcaaa

SEQ ID NO: 1454729 - RNA, 19 nt, Homo sapiens
gcacaacaaccgaaucauc

SEQ ID NO: 1454730 - RNA, 19 nt, Homo sapiens
uaaaggcaccuauggcaaa

SEQ ID NO: 1454731 - RNA, 19 nt, Homo sapiens
caucaaacaccucuugcua

SEQ ID NO: 1454732 - RNA, 19 nt, Homo sapiens
gaaagcgcccaccugauug

SEQ ID NO: 1454733 - RNA, 19 nt, Homo sapiens
gaggaugcauaccagaaga

SEQ ID NO: 1454734 - RNA, 19 nt, Homo sapiens
gaggcagaauacaacauuu

SEQ ID NO: 1454735 - RNA, 19 nt, Homo sapiens
caucuuauccuauccucua

SEQ ID NO: 1454736 - RNA, 19 nt, Homo sapiens
cagcaaggauugagucucu

SEQ ID NO: 1454737 - RNA, 19 nt, Homo sapiens
gcgguuggaugaagcaaug

SEQ ID NO: 1454738 - RNA, 19 nt, Homo sapiens
gguaaucgacugucuguca

SEQ ID NO: 1454739 - RNA, 19 nt, Homo sapiens
gaugcucggaggaaauuua

SEQ ID NO: 1454740 - RNA, 19 nt, Homo sapiens
gaacgacacuccuuaaagu

SEQ ID NO: 1454741 - RNA, 19 nt, Homo sapiens
gaucagugcuuggccauaa

SEQ ID NO: 1454742 - RNA, 19 nt, Homo sapiens
gauaggaugugaugauaga

SEQ ID NO: 1454743 - RNA, 19 nt, Homo sapiens
gaggauguguuguuagaaa

SEQ ID NO: 1454744 - RNA, 19 nt, Homo sapiens
gagaggauguguuguuaga

SEQ ID NO: 1454745 - RNA, 19 nt, Homo sapiens
caaggaaaguuagguaauu

SEQ ID NO: 1454746 - RNA, 19 nt, Homo sapiens
aaugagagcuugcuuacuu

SEQ ID NO: 1454747 - RNA, 19 nt, Homo sapiens
agauauagcuagugucuga

SEQ ID NO: 1454748 - RNA, 19 nt, Homo sapiens
guaaaacacuccuuaaguu

SEQ ID NO: 1454749 - RNA, 19 nt, Homo sapiens
gccaugagaucacagaaga

SEQ ID NO: 1454750 - RNA, 19 nt, Homo sapiens
aaagauaacuuggcaguca

SEQ ID NO: 1454751 - RNA, 19 nt, Homo sapiens
ucccacagaugccaaguua

SEQ ID NO: 1454752 - RNA, 19 nt, Homo sapiens
guagaaagaaccaguauca

SEQ ID NO: 1454753 - RNA, 19 nt, Homo sapiens
gaaagaaccaguaucaaac

SEQ ID NO: 1454754 - RNA, 19 nt, Homo sapiens
gugauaggaugugaugaua

SEQ ID NO: 1454755 - RNA, 19 nt, Homo sapiens
guuagaaagugguacagaa

SEQ ID NO: 1454756 - RNA, 19 nt, Homo sapiens
agaaagaaccaguaucaaa

SEQ ID NO: 1454757 - RNA, 19 nt, Homo sapiens
cuaauagucuguccuaaag

SEQ ID NO: 1454758 - RNA, 19 nt, Homo sapiens
gcuaauagucuguccuaaa

SEQ ID NO: 1454759 - RNA, 19 nt, Homo sapiens
guaguuguaggaaaucuua

SEQ ID NO: 1454760 - RNA, 19 nt, Homo sapiens
gcugacaucccaccuaauu

SEQ ID NO: 1454761 - RNA, 19 nt, Homo sapiens
gaaaguuagguaauucuga

SEQ ID NO: 1454762 - RNA, 19 nt, Homo sapiens
ggccauaaaucgaaguguu

SEQ ID NO: 1454763 - RNA, 19 nt, Homo sapiens
guuaagauauagcuagugu

SEQ ID NO: 1454764 - RNA, 19 nt, Homo sapiens
agagcuugcuuacuucuaa

SEQ ID NO: 1454765 - RNA, 19 nt, Homo sapiens
cugcaugaguucuggguua

SEQ ID NO: 1454766 - RNA, 19 nt, Homo sapiens
uggagaggauguguuguua

SEQ ID NO: 1454767 - RNA, 19 nt, Homo sapiens
caaaggcaauaauagauac

SEQ ID NO: 1454768 - RNA, 19 nt, Homo sapiens
gcaacaacuuuuccuaauu

SEQ ID NO: 1454769 - RNA, 19 nt, Homo sapiens
ggaaggugauaggauguga

SEQ ID NO: 1454770 - RNA, 19 nt, Homo sapiens
caaacuagaagacucagaa

SEQ ID NO: 1454771 - RNA, 19 nt, Homo sapiens
caaugcaguugcuuuacaa

SEQ ID NO: 1454772 - RNA, 19 nt, Homo sapiens
aagcugacaucccaccuaa

SEQ ID NO: 1454773 - RNA, 19 nt, Homo sapiens
gaauagaaggaaggugaua

SEQ ID NO: 1454774 - RNA, 19 nt, Homo sapiens
uaaagaagaauucgagcuu

SEQ ID NO: 1454775 - RNA, 19 nt, Homo sapiens
gcaguugcuuuacaagauc

SEQ ID NO: 1454776 - RNA, 19 nt, Homo sapiens
guacagaaaccugaggaaa

SEQ ID NO: 1454777 - RNA, 19 nt, Homo sapiens
gagcuugcuuacuucuaaa

SEQ ID NO: 1454778 - RNA, 19 nt, Homo sapiens
ucaagugugugaccagaau

SEQ ID NO: 1454779 - RNA, 19 nt, Homo sapiens
caacaacuuuuccuaauuc

SEQ ID NO: 1454780 - RNA, 19 nt, Homo sapiens
gaucuucaacuucgaaauc

SEQ ID NO: 1454781 - RNA, 19 nt, Homo sapiens
ucagugguauucaacauca

SEQ ID NO: 1454782 - RNA, 19 nt, Homo sapiens
gauacaaaggcaauaauag

SEQ ID NO: 1454783 - RNA, 19 nt, Homo sapiens
ucaaugcaguugcuuuaca

SEQ ID NO: 1454784 - RNA, 19 nt, Homo sapiens
aagggucacucaucuaaga

SEQ ID NO: 1454785 - RNA, 19 nt, Homo sapiens
gaagaggaaugggagaaaa

SEQ ID NO: 1454786 - RNA, 19 nt, Homo sapiens
gagcagaagaauagaagga

SEQ ID NO: 1454787 - RNA, 19 nt, Homo sapiens
gcggaggagucgagcagaa

SEQ ID NO: 1454788 - RNA, 19 nt, Homo sapiens
gaauucauagucaaggaaa

SEQ ID NO: 1454789 - RNA, 19 nt, Homo sapiens
ccacagaugccaaguuaag

SEQ ID NO: 1454790 - RNA, 19 nt, Homo sapiens
gaaaaccuguccucucugu

SEQ ID NO: 1454791 - RNA, 19 nt, Homo sapiens
aaauaagggucacucaucu

SEQ ID NO: 1454792 - RNA, 19 nt, Homo sapiens
agacaggccuccuuuccau

SEQ ID NO: 1454793 - RNA, 19 nt, Homo sapiens
uguccucucuguagaaaga

SEQ ID NO: 1454794 - RNA, 19 nt, Homo sapiens
ccacaaagcaugucuucag

SEQ ID NO: 1454795 - RNA, 19 nt, Homo sapiens
ggagucgagcagaagaaua

SEQ ID NO: 1454796 - RNA, 19 nt, Homo sapiens
cauacaacaccaacauuga

SEQ ID NO: 1454797 - RNA, 19 nt, Homo sapiens
aaacaguaccucccacaga

SEQ ID NO: 1454798 - RNA, 19 nt, Homo sapiens
gagucgagcagaagaauag

SEQ ID NO: 1454799 - RNA, 19 nt, Homo sapiens
uaagauauagcuagugucu

SEQ ID NO: 1454800 - RNA, 19 nt, Homo sapiens
guuagguaauucugaggaa

SEQ ID NO: 1454801 - RNA, 19 nt, Homo sapiens
uuagaaagugguacagaaa

SEQ ID NO: 1454802 - RNA, 19 nt, Homo sapiens
aggaugugaugauagaauu

SEQ ID NO: 1454803 - RNA, 19 nt, Homo sapiens
gagauacaaaggcaauaau

SEQ ID NO: 1454804 - RNA, 19 nt, Homo sapiens
uaacuuggcagucaaugca

SEQ ID NO: 1454805 - RNA, 19 nt, Homo sapiens
cuccuuaaguuccaaaugu

SEQ ID NO: 1454806 - RNA, 19 nt, Homo sapiens
ugagaucacagaagaggaa

SEQ ID NO: 1454807 - RNA, 19 nt, Homo sapiens
ggugauaggaugugaugau

SEQ ID NO: 1454808 - RNA, 19 nt, Homo sapiens
gaugugaugauagaauuug

SEQ ID NO: 1454809 - RNA, 19 nt, Homo sapiens
agucaaugcaguugcuuua

SEQ ID NO: 1454810 - RNA, 19 nt, Homo sapiens
ggcaggcguuccagagaga

SEQ ID NO: 1454811 - RNA, 19 nt, Homo sapiens
auaagggucacucaucuaa

SEQ ID NO: 1454812 - RNA, 19 nt, Homo sapiens
ucauacaacaccaacauug

SEQ ID NO: 1454813 - RNA, 19 nt, Homo sapiens
gcucauacaacaccaacau

SEQ ID NO: 1454814 - RNA, 19 nt, Homo sapiens
ggaugugaugauagaauuu

SEQ ID NO: 1454815 - RNA, 19 nt, Homo sapiens
caccuccacugucaucaga

SEQ ID NO: 1454816 - RNA, 19 nt, Homo sapiens
gccuuugccauuccuaaua

SEQ ID NO: 1454817 - RNA, 19 nt, Homo sapiens
aaggaaaguuagguaauuc

SEQ ID NO: 1454818 - RNA, 19 nt, Homo sapiens
aacaguaccucccacagau

SEQ ID NO: 1454819 - RNA, 19 nt, Homo sapiens
gaucacagaagaggaaugg

SEQ ID NO: 1454820 - RNA, 19 nt, Homo sapiens
gauguguuguuagaaagug

SEQ ID NO: 1454821 - RNA, 19 nt, Homo sapiens
aaacacuccuuaaguucca

SEQ ID NO: 1454822 - RNA, 19 nt, Homo sapiens
gugaugauagaauuuguga

SEQ ID NO: 1454823 - RNA, 19 nt, Homo sapiens
uaagcuauugguaguugua

SEQ ID NO: 1454824 - RNA, 19 nt, Homo sapiens
ggaaaguuagguaauucug

SEQ ID NO: 1454825 - RNA, 19 nt, Homo sapiens
ucauagucaaggaaaguua

SEQ ID NO: 1454826 - RNA, 19 nt, Homo sapiens
ggucacucaucuaagaaag

SEQ ID NO: 1454827 - RNA, 19 nt, Homo sapiens
ggaggagucgagcagaaga

SEQ ID NO: 1454828 - RNA, 19 nt, Homo sapiens
caaauguuuuccgcuaaua

SEQ ID NO: 1454829 - RNA, 19 nt, Homo sapiens
guuguaggaaaucuuagua

SEQ ID NO: 1454830 - RNA, 19 nt, Homo sapiens
auacaacaccaacauugaa

SEQ ID NO: 1454831 - RNA, 19 nt, Homo sapiens
ugcaguugcuuuacaagau

SEQ ID NO: 1454832 - RNA, 19 nt, Homo sapiens
cagaugccaaguuaagaaa

SEQ ID NO: 1454833 - RNA, 19 nt, Homo sapiens
aaagagauacaaaggcaau

SEQ ID NO: 1454834 - RNA, 19 nt, Homo sapiens
caugaguucuggguuaagu

SEQ ID NO: 1454835 - RNA, 19 nt, Homo sapiens
ucaaggaaaguuagguaau

SEQ ID NO: 1454836 - RNA, 19 nt, Homo sapiens
aaaccuguccucucuguag

SEQ ID NO: 1454837 - RNA, 19 nt, Homo sapiens
aaacuagaagacucagaaa

SEQ ID NO: 1454838 - RNA, 19 nt, Homo sapiens
agagauacaaaggcaauaa

SEQ ID NO: 1454839 - RNA, 19 nt, Homo sapiens
ugaacgacacuccuuaaag

SEQ ID NO: 1454840 - RNA, 19 nt, Homo sapiens
gaaaugugcuucuuaucuu

SEQ ID NO: 1454841 - RNA, 19 nt, Homo sapiens
gaacaugaauccacagauc

SEQ ID NO: 1454842 - RNA, 19 nt, Homo sapiens
ggagguguauuuccgguuu

SEQ ID NO: 1454843 - RNA, 19 nt, Homo sapiens
cuaagaggcugaacaugaa

SEQ ID NO: 1454844 - RNA, 19 nt, Homo sapiens
gcaaccgacugccugcuaa

SEQ ID NO: 1454845 - RNA, 19 nt, Homo sapiens
gaaggugaccaaauucuug

SEQ ID NO: 1454846 - RNA, 19 nt, Homo sapiens
cagaucaccugguuuguau

SEQ ID NO: 1454847 - RNA, 19 nt, Homo sapiens
acacuuggcugugcuauga

SEQ ID NO: 1454848 - RNA, 19 nt, Homo sapiens
ggacaagcguaucuaagag

SEQ ID NO: 1454849 - RNA, 19 nt, Homo sapiens
guacaaauucgaugacaau

SEQ ID NO: 1454850 - RNA, 19 nt, Homo sapiens
gcugugcuaugaagugaaa

SEQ ID NO: 1454851 - RNA, 19 nt, Homo sapiens
gggacaagcguaucuaaga

SEQ ID NO: 1454852 - RNA, 19 nt, Homo sapiens
gugugaagaucauggacua

SEQ ID NO: 1454853 - RNA, 19 nt, Homo sapiens
ucuaagaggcugaacauga

SEQ ID NO: 1454854 - RNA, 19 nt, Homo sapiens
gagcggauguaucgagaca

SEQ ID NO: 1454855 - RNA, 19 nt, Homo sapiens
aaacgaacccauccucuau

SEQ ID NO: 1454856 - RNA, 19 nt, Homo sapiens
aaacgucagucgaaucaca

SEQ ID NO: 1454857 - RNA, 19 nt, Homo sapiens
gguacaaauucgaugacaa

SEQ ID NO: 1454858 - RNA, 19 nt, Homo sapiens
ucaccugguuuguaucaug

SEQ ID NO: 1454859 - RNA, 19 nt, Homo sapiens
ccaaacgucagucgaauca

SEQ ID NO: 1454860 - RNA, 19 nt, Homo sapiens
gcggauguaucgagacaca

SEQ ID NO: 1454861 - RNA, 19 nt, Homo sapiens
gaacagccucagagaugga

SEQ ID NO: 1454862 - RNA, 19 nt, Homo sapiens
gaucaccugguuuguauca

SEQ ID NO: 1454863 - RNA, 19 nt, Homo sapiens
aaaugugcuucuuaucuug

SEQ ID NO: 1454864 - RNA, 19 nt, Homo sapiens
aacaggcgcuuccagauca

SEQ ID NO: 1454865 - RNA, 19 nt, Homo sapiens
gagacacauucuacgacaa

SEQ ID NO: 1454866 - RNA, 19 nt, Homo sapiens
gcacugauugcaacugaca

SEQ ID NO: 1454867 - RNA, 19 nt, Homo sapiens
cuucuuaucuugguucugu

SEQ ID NO: 1454868 - RNA, 19 nt, Homo sapiens
ucucagacuuugcauacug

SEQ ID NO: 1454869 - RNA, 19 nt, Homo sapiens
uaacaggcgcuuccagauc

SEQ ID NO: 1454870 - RNA, 19 nt, Homo sapiens
ugagaaccacgcagaaaug

SEQ ID NO: 1454871 - RNA, 19 nt, Homo sapiens
cacauucuacgacaacuuu

SEQ ID NO: 1454872 - RNA, 19 nt, Homo sapiens
ugaauccacagaucagaaa

SEQ ID NO: 1454873 - RNA, 19 nt, Homo sapiens
acaggcaggagguguauuu

SEQ ID NO: 1454874 - RNA, 19 nt, Homo sapiens
uggcacugauugcaacuga

SEQ ID NO: 1454875 - RNA, 19 nt, Homo sapiens
auucaugccuugguacaaa

SEQ ID NO: 1454876 - RNA, 19 nt, Homo sapiens
gagaaccacgcagaaaugu

SEQ ID NO: 1454877 - RNA, 19 nt, Homo sapiens
gagguguauuuccgguuug

SEQ ID NO: 1454878 - RNA, 19 nt, Homo sapiens
cgacaacuuugaaaacgaa

SEQ ID NO: 1454879 - RNA, 19 nt, Homo sapiens
aggaacagccucagagaug

SEQ ID NO: 1454880 - RNA, 19 nt, Homo sapiens
gggaaaacuuugugugcaa

SEQ ID NO: 1454881 - RNA, 19 nt, Homo sapiens
caucucagacuuugcauac

SEQ ID NO: 1454882 - RNA, 19 nt, Homo sapiens
ccucuucaucucagacuuu

SEQ ID NO: 1454883 - RNA, 19 nt, Homo sapiens
uaucuaagaggcugaacau

SEQ ID NO: 1454884 - RNA, 19 nt, Homo sapiens
gugaagaucauggacuaug

SEQ ID NO: 1454885 - RNA, 19 nt, Homo sapiens
ugaaggugaccaaauucuu

SEQ ID NO: 1454886 - RNA, 19 nt, Homo sapiens
guacuacccaaacgucagu

SEQ ID NO: 1454887 - RNA, 19 nt, Homo sapiens
uggcugugcuaugaaguga

SEQ ID NO: 1454888 - RNA, 19 nt, Homo sapiens
agccauucaugccuuggua

SEQ ID NO: 1454889 - RNA, 19 nt, Homo sapiens
ggaaaacuuugugugcaau

SEQ ID NO: 1454890 - RNA, 19 nt, Homo sapiens
gggcuggcacugauugcaa

SEQ ID NO: 1454891 - RNA, 19 nt, Homo sapiens
gauggauggaucugcaaug

SEQ ID NO: 1454892 - RNA, 19 nt, Homo sapiens
ggugaaggugaccaaauuc

SEQ ID NO: 1454893 - RNA, 19 nt, Homo sapiens
aaacuuugugugcaaugaa

SEQ ID NO: 1454894 - RNA, 19 nt, Homo sapiens
cuaccgggauagagauugg

SEQ ID NO: 1454895 - RNA, 19 nt, Homo sapiens
gugcuccucaggcugcaua

SEQ ID NO: 1454896 - RNA, 19 nt, Homo sapiens
uauaaaggcuggauuugga

SEQ ID NO: 1454897 - RNA, 19 nt, Homo sapiens
agaaagagcugaaccacau

SEQ ID NO: 1454898 - RNA, 19 nt, Homo sapiens
gcgagaugcuccagaaaga

SEQ ID NO: 1454899 - RNA, 19 nt, Homo sapiens
ccaaauuccugccugauuc

SEQ ID NO: 1454900 - RNA, 19 nt, Homo sapiens
gaugaguacuggaccuuga

SEQ ID NO: 1454901 - RNA, 19 nt, Homo sapiens
ccucugggaugcucauuaa

SEQ ID NO: 1454902 - RNA, 19 nt, Homo sapiens
gaaccuggaugccaaucau

SEQ ID NO: 1454903 - RNA, 19 nt, Homo sapiens
caucuaaccuuccaauguc

SEQ ID NO: 1454904 - RNA, 19 nt, Homo sapiens
ccuguucagucucaucuaa

SEQ ID NO: 1454905 - RNA, 19 nt, Homo sapiens
ggagaaggcagucauuguc

SEQ ID NO: 1454906 - RNA, 19 nt, Homo sapiens
gaacuggggucccuuugug

SEQ ID NO: 1454907 - RNA, 19 nt, Homo sapiens
ugauauaaaggcuggauuu

SEQ ID NO: 1454908 - RNA, 19 nt, Homo sapiens
cagcagagcagcagcuaga

SEQ ID NO: 1454909 - RNA, 19 nt, Homo sapiens
gauauaaaggcuggauuug

SEQ ID NO: 1454910 - RNA, 19 nt, Homo sapiens
ccagggcccuuuacucucu

SEQ ID NO: 1454911 - RNA, 19 nt, Homo sapiens
cuacaaauaugugucuaag

SEQ ID NO: 1454912 - RNA, 19 nt, Homo sapiens
gaagcagggagaugucaga

SEQ ID NO: 1454913 - RNA, 19 nt, Homo sapiens
ugauguuccugccaaauuc

SEQ ID NO: 1454914 - RNA, 19 nt, Homo sapiens
guggaaaacuucuacaaau

SEQ ID NO: 1454915 - RNA, 19 nt, Homo sapiens
gccaaauuccugccugauu

SEQ ID NO: 1454916 - RNA, 19 nt, Homo sapiens
gcagagcagcagcuagaga

SEQ ID NO: 1454917 - RNA, 19 nt, Homo sapiens
ccuguugcuugaaauaaug

SEQ ID NO: 1454918 - RNA, 19 nt, Homo sapiens
gaaagagcugaaccacaug

SEQ ID NO: 1454919 - RNA, 19 nt, Homo sapiens
aguacagccuggucaagaa

SEQ ID NO: 1454920 - RNA, 19 nt, Homo sapiens
ucaucuaaccuuccaaugu

SEQ ID NO: 1454921 - RNA, 19 nt, Homo sapiens
gagcagcuuccgcgagaug

SEQ ID NO: 1454922 - RNA, 19 nt, Homo sapiens
gcucuugguggcaguggua

SEQ ID NO: 1454923 - RNA, 19 nt, Homo sapiens
agaacaagaucagcaagag

SEQ ID NO: 1454924 - RNA, 19 nt, Homo sapiens
ucaagaacaagaucagcaa

SEQ ID NO: 1454925 - RNA, 19 nt, Homo sapiens
ggguagagaggcacuuuca

SEQ ID NO: 1454926 - RNA, 19 nt, Homo sapiens
ccagcugccucuucaucug

SEQ ID NO: 1454927 - RNA, 19 nt, Homo sapiens
ucucaccuguucagucuca

SEQ ID NO: 1454928 - RNA, 19 nt, Homo sapiens
ggaaggcugcggauaagcu

SEQ ID NO: 1454929 - RNA, 19 nt, Homo sapiens
aaggcuggauuuggaguuu

SEQ ID NO: 1454930 - RNA, 19 nt, Homo sapiens
ccucuccacuuucccuuag

SEQ ID NO: 1454931 - RNA, 19 nt, Homo sapiens
gugucucagucuagaggua

SEQ ID NO: 1454932 - RNA, 19 nt, Homo sapiens
ugaguacuggaccuugaua

SEQ ID NO: 1454933 - RNA, 19 nt, Homo sapiens
caaauaugugucuaaguac

SEQ ID NO: 1454934 - RNA, 19 nt, Homo sapiens
ccggaaggcugcggauaag

SEQ ID NO: 1454935 - RNA, 19 nt, Homo sapiens
gcugagccuccuccuguug

SEQ ID NO: 1454936 - RNA, 19 nt, Homo sapiens
ggcuggauuuggaguuugu

SEQ ID NO: 1454937 - RNA, 19 nt, Homo sapiens
cugauguuccugccaaauu

SEQ ID NO: 1454938 - RNA, 19 nt, Homo sapiens
uuucucaccuguucagucu

SEQ ID NO: 1454939 - RNA, 19 nt, Homo sapiens
aaaccuucccacuccuuaa

SEQ ID NO: 1454940 - RNA, 19 nt, Homo sapiens
gcuggagaaggcagucauu

SEQ ID NO: 1454941 - RNA, 19 nt, Homo sapiens
ugaggucucccugcucuug

SEQ ID NO: 1454942 - RNA, 19 nt, Homo sapiens
aagaacaagaucagcaaga

SEQ ID NO: 1454943 - RNA, 19 nt, Homo sapiens
ggaaaucucuucagaaaua

SEQ ID NO: 1454944 - RNA, 19 nt, Homo sapiens
gcagauaguugcaaaguua

SEQ ID NO: 1454945 - RNA, 19 nt, Homo sapiens
gaacagaaguuaauagaga

SEQ ID NO: 1454946 - RNA, 19 nt, Homo sapiens
caagacaugugccuuauaa

SEQ ID NO: 1454947 - RNA, 19 nt, Homo sapiens
gaugacagguguaacauga

SEQ ID NO: 1454948 - RNA, 19 nt, Homo sapiens
uaaagaauaugcugugcua

SEQ ID NO: 1454949 - RNA, 19 nt, Homo sapiens
gacaugugccuuauaauua

SEQ ID NO: 1454950 - RNA, 19 nt, Homo sapiens
guuaauaggugcauaaaca

SEQ ID NO: 1454951 - RNA, 19 nt, Homo sapiens
uaggaaaucucuucagaaa

SEQ ID NO: 1454952 - RNA, 19 nt, Homo sapiens
ugacuugguuccagaauuu

SEQ ID NO: 1454953 - RNA, 19 nt, Homo sapiens
acaaagaggucaugugguu

SEQ ID NO: 1454954 - RNA, 19 nt, Homo sapiens
gaagcuauuucauuaagug

SEQ ID NO: 1454955 - RNA, 19 nt, Homo sapiens
ggacaaugcagauaaaguu

SEQ ID NO: 1454956 - RNA, 19 nt, Homo sapiens
gcuaaaggaugcacccaaa

SEQ ID NO: 1454957 - RNA, 19 nt, Homo sapiens
caaaugaaauggacaaugc

SEQ ID NO: 1454958 - RNA, 19 nt, Homo sapiens
agaauaugcugugcuaaua

SEQ ID NO: 1454959 - RNA, 19 nt, Homo sapiens
gaucgcauauucauugaug

SEQ ID NO: 1454960 - RNA, 19 nt, Homo sapiens
gaaaggaacuacgaaaucg

SEQ ID NO: 1454961 - RNA, 19 nt, Homo sapiens
ggcaaggauugucuaauuu

SEQ ID NO: 1454962 - RNA, 19 nt, Homo sapiens
ggauagggcuuuggaggaa

SEQ ID NO: 1454963 - RNA, 19 nt, Homo sapiens
gaauggagaugggcaaaca

SEQ ID NO: 1454964 - RNA, 19 nt, Homo sapiens
ggaggcagauaguugcaaa

SEQ ID NO: 1454965 - RNA, 19 nt, Homo sapiens
gaaaguggcauggaaguau

SEQ ID NO: 1454966 - RNA, 19 nt, Homo sapiens
gaugaggguuugcuugaga

SEQ ID NO: 1454967 - RNA, 19 nt, Homo sapiens
ggaaaggaacuacgaaauc

SEQ ID NO: 1454968 - RNA, 19 nt, Homo sapiens
guauuuagccucugacuau

SEQ ID NO: 1454969 - RNA, 19 nt, Homo sapiens
gaauaugcugugcuaauaa

SEQ ID NO: 1454970 - RNA, 19 nt, Homo sapiens
gcacagcacacagacauuu

SEQ ID NO: 1454971 - RNA, 19 nt, Homo sapiens
gaaauggacaaugcagaua

SEQ ID NO: 1454972 - RNA, 19 nt, Homo sapiens
gaaugugguuguuacugaa

SEQ ID NO: 1454973 - RNA, 19 nt, Homo sapiens
aggcaaggauugucuaauu

SEQ ID NO: 1454974 - RNA, 19 nt, Homo sapiens
gagaccaggugaauaguca

SEQ ID NO: 1454975 - RNA, 19 nt, Homo sapiens
gggaguauguguguuagaa

SEQ ID NO: 1454976 - RNA, 19 nt, Homo sapiens
aaaguggcauggaaguaua

SEQ ID NO: 1454977 - RNA, 19 nt, Homo sapiens
uaaaccuccucaaacauuu

SEQ ID NO: 1454978 - RNA, 19 nt, Homo sapiens
gcuauuucauuaaguguga

SEQ ID NO: 1454979 - RNA, 19 nt, Homo sapiens
gguauaauucccaaucuaa

SEQ ID NO: 1454980 - RNA, 19 nt, Homo sapiens
guaacaugaagcacaauua

SEQ ID NO: 1454981 - RNA, 19 nt, Homo sapiens
guuguuaucuagucaaugu

SEQ ID NO: 1454982 - RNA, 19 nt, Homo sapiens
ggaauggcuugaaaucaca

SEQ ID NO: 1454983 - RNA, 19 nt, Homo sapiens
ucauaugucuucacacguu

SEQ ID NO: 1454984 - RNA, 19 nt, Homo sapiens
ggaauggcaucagaacaau

SEQ ID NO: 1454985 - RNA, 19 nt, Homo sapiens
ggaaugaugacagguguaa

SEQ ID NO: 1454986 - RNA, 19 nt, Homo sapiens
gaaugaagcagaacagaag

SEQ ID NO: 1454987 - RNA, 19 nt, Homo sapiens
gcaauucccaguaccgaaa

SEQ ID NO: 1454988 - RNA, 19 nt, Homo sapiens
gcaagacaugugccuuaua

SEQ ID NO: 1454989 - RNA, 19 nt, Homo sapiens
uauaaggaauggcaucaga

SEQ ID NO: 1454990 - RNA, 19 nt, Homo sapiens
agaaugugguuguuacuga

SEQ ID NO: 1454991 - RNA, 19 nt, Homo sapiens
guagaaaagccuuaucuua

SEQ ID NO: 1454992 - RNA, 19 nt, Homo sapiens
agacaugugccuuauaauu

SEQ ID NO: 1454993 - RNA, 19 nt, Homo sapiens
ucacacacacacaaauaua

SEQ ID NO: 1454994 - RNA, 19 nt, Homo sapiens
caaugcagauaaaguuguu

SEQ ID NO: 1454995 - RNA, 19 nt, Homo sapiens
gaagcacaauuauauuugc

SEQ ID NO: 1454996 - RNA, 19 nt, Homo sapiens
acacuaaugcagucaauuu

SEQ ID NO: 1454997 - RNA, 19 nt, Homo sapiens
gauauaaaccuccucaaac

SEQ ID NO: 1454998 - RNA, 19 nt, Homo sapiens
gaacuguccagccgaguga

SEQ ID NO: 1454999 - RNA, 19 nt, Homo sapiens
ucugcaagaugaacuguaa

SEQ ID NO: 1455000 - RNA, 19 nt, Homo sapiens
ucacaaaggaucugcaaga

SEQ ID NO: 1455001 - RNA, 19 nt, Homo sapiens
gguguaacaugaagcacaa

SEQ ID NO: 1455002 - RNA, 19 nt, Homo sapiens
gaaacugguacacagauga

SEQ ID NO: 1455003 - RNA, 19 nt, Homo sapiens
ugucuuaucuccuaguuuc

SEQ ID NO: 1455004 - RNA, 19 nt, Homo sapiens
gugcaagacaugugccuua

SEQ ID NO: 1455005 - RNA, 19 nt, Homo sapiens
caaggauugucuaauuuca

SEQ ID NO: 1455006 - RNA, 19 nt, Homo sapiens
gagugagacaugcuuauuu

SEQ ID NO: 1455007 - RNA, 19 nt, Homo sapiens
gcaaggauugucuaauuuc

SEQ ID NO: 1455008 - RNA, 19 nt, Homo sapiens
auauaaaccuccucaaaca

SEQ ID NO: 1455009 - RNA, 19 nt, Homo sapiens
cacccaaacuucaaacuuc

SEQ ID NO: 1455010 - RNA, 19 nt, Homo sapiens
ggagacacccaucagaaug

SEQ ID NO: 1455011 - RNA, 19 nt, Homo sapiens
agccuuaucuuacaaauca

SEQ ID NO: 1455012 - RNA, 19 nt, Homo sapiens
cacguugccuauauaauga

SEQ ID NO: 1455013 - RNA, 19 nt, Homo sapiens
gcauggaaguauaauaacu

SEQ ID NO: 1455014 - RNA, 19 nt, Homo sapiens
uggcauggaaguauaauaa

SEQ ID NO: 1455015 - RNA, 19 nt, Homo sapiens
gaaggaaaggaacuacgaa

SEQ ID NO: 1455016 - RNA, 19 nt, Homo sapiens
ggaaggaaaggaacuacga

SEQ ID NO: 1455017 - RNA, 19 nt, Homo sapiens
cagggaggcugcagaguca

SEQ ID NO: 1455018 - RNA, 19 nt, Homo sapiens
ucuaggaaaucucuucaga

SEQ ID NO: 1455019 - RNA, 19 nt, Homo sapiens
cuucacacguugccuauau

SEQ ID NO: 1455020 - RNA, 19 nt, Homo sapiens
ggagugagacaugcuuauu

SEQ ID NO: 1455021 - RNA, 19 nt, Homo sapiens
gaaaagccuuaucuuacaa

SEQ ID NO: 1455022 - RNA, 19 nt, Homo sapiens
guaacucucuggucuucau

SEQ ID NO: 1455023 - RNA, 19 nt, Homo sapiens
ugauauaaaccuccucaaa

SEQ ID NO: 1455024 - RNA, 19 nt, Homo sapiens
gaaauuuacagugugcaaa

SEQ ID NO: 1455025 - RNA, 19 nt, Homo sapiens
caacacgucgggaguaugu

SEQ ID NO: 1455026 - RNA, 19 nt, Homo sapiens
ucagaacaauagcuuggaa

SEQ ID NO: 1455027 - RNA, 19 nt, Homo sapiens
gaauggcaucagaacaaua

SEQ ID NO: 1455028 - RNA, 19 nt, Homo sapiens
ugaagcagaacagaaguua

SEQ ID NO: 1455029 - RNA, 19 nt, Homo sapiens
gaauucacacacacacaaa

SEQ ID NO: 1455030 - RNA, 19 nt, Homo sapiens
guuaauagagagcauguug

SEQ ID NO: 1455031 - RNA, 19 nt, Homo sapiens
gaagcagaacagaaguuaa

SEQ ID NO: 1455032 - RNA, 19 nt, Homo sapiens
ugauggugauuucuggaua

SEQ ID NO: 1455033 - RNA, 19 nt, Homo sapiens
acacguugccuauauaaug

SEQ ID NO: 1455034 - RNA, 19 nt, Homo sapiens
cagaacagaaguuaauaga

SEQ ID NO: 1455035 - RNA, 19 nt, Homo sapiens
gcacccaaacuucaaacuu

SEQ ID NO: 1455036 - RNA, 19 nt, Homo sapiens
caucagaaugugguuguua

SEQ ID NO: 1455037 - RNA, 19 nt, Homo sapiens
gauggugauuucuggauag

SEQ ID NO: 1455038 - RNA, 19 nt, Homo sapiens
cuaguuucuucaaugcuua

SEQ ID NO: 1455039 - RNA, 19 nt, Homo sapiens
gcaaaugaaauggacaaug

SEQ ID NO: 1455040 - RNA, 19 nt, Homo sapiens
aaugguggcuccuuucugu

SEQ ID NO: 1455041 - RNA, 19 nt, Homo sapiens
gcagaacagaaguuaauag

SEQ ID NO: 1455042 - RNA, 19 nt, Homo sapiens
ugaggguucugaaaucaau

SEQ ID NO: 1455043 - RNA, 19 nt, Homo sapiens
gaugagagcuuacugaauc

SEQ ID NO: 1455044 - RNA, 19 nt, Homo sapiens
gaagaugucccaacaccua

SEQ ID NO: 1455045 - RNA, 19 nt, Homo sapiens
ggaaguaggaccucaguag

SEQ ID NO: 1455046 - RNA, 19 nt, Homo sapiens
ggacagaauaugugguuau

SEQ ID NO: 1455047 - RNA, 19 nt, Homo sapiens
gacagaauaugugguuaug

SEQ ID NO: 1455048 - RNA, 19 nt, Homo sapiens
auacagaauuggaagaugu

SEQ ID NO: 1455049 - RNA, 19 nt, Homo sapiens
caagaauacagaauuggaa

SEQ ID NO: 1455050 - RNA, 19 nt, Homo sapiens
gaaaugucgcagccaagaa

SEQ ID NO: 1455051 - RNA, 19 nt, Homo sapiens
gaauuggacagaauaugug

SEQ ID NO: 1455052 - RNA, 19 nt, Homo sapiens
gaauacagaauuggaagau

SEQ ID NO: 1455053 - RNA, 19 nt, Homo sapiens
ugaauuggacagaauaugu

SEQ ID NO: 1455054 - RNA, 19 nt, Homo sapiens
aaaaugggaugagagcuua

SEQ ID NO: 1455055 - RNA, 19 nt, Homo sapiens
gggaugagagcuuacugaa

SEQ ID NO: 1455056 - RNA, 19 nt, Homo sapiens
cagccaagaauacagaauu

SEQ ID NO: 1455057 - RNA, 19 nt, Homo sapiens
gugagaagcgaauuugaau

SEQ ID NO: 1455058 - RNA, 19 nt, Homo sapiens
uaugcaugcuguuugagaa

SEQ ID NO: 1455059 - RNA, 19 nt, Homo sapiens
gagagcuuacugaaucgua

SEQ ID NO: 1455060 - RNA, 19 nt, Homo sapiens
gaaaaugggaugagagcuu

SEQ ID NO: 1455061 - RNA, 19 nt, Homo sapiens
ggaugagagcuuacugaau

SEQ ID NO: 1455062 - RNA, 19 nt, Homo sapiens
uaucaagaucuuccaguga

SEQ ID NO: 1455063 - RNA, 19 nt, Homo sapiens
agccaagaauacagaauug

SEQ ID NO: 1455064 - RNA, 19 nt, Homo sapiens
ucaagaucuuccagugaga

SEQ ID NO: 1455065 - RNA, 19 nt, Homo sapiens
ccguuucucuucuacucua

SEQ ID NO: 1455066 - RNA, 19 nt, Homo sapiens
gagacuugugcugcuauua

SEQ ID NO: 1455067 - RNA, 19 nt, Homo sapiens
ccagugagaagcgaauuug

SEQ ID NO: 1455068 - RNA, 19 nt, Homo sapiens
cuucuacucuaucaagauc

SEQ ID NO: 1455069 - RNA, 19 nt, Homo sapiens
caagaucuuccagugagaa

SEQ ID NO: 1455070 - RNA, 19 nt, Homo sapiens
aguaggaccucaguagcuu

SEQ ID NO: 1455071 - RNA, 19 nt, Homo sapiens
aaaugucgcagccaagaau

SEQ ID NO: 1455072 - RNA, 19 nt, Homo sapiens
agagacuugugcugcuauu

SEQ ID NO: 1455073 - RNA, 19 nt, Homo sapiens
agacuugugcugcuauuag

SEQ ID NO: 1455074 - RNA, 19 nt, Homo sapiens
ccuagagucgcuggaagua

SEQ ID NO: 1455075 - RNA, 19 nt, Homo sapiens
ucuacucuaucaagaucuu

SEQ ID NO: 1455076 - RNA, 19 nt, Homo sapiens
agaaaugucgcagccaaga

SEQ ID NO: 1455077 - RNA, 19 nt, Homo sapiens
gcccguugccggaagaaau

SEQ ID NO: 1455078 - RNA, 19 nt, Homo sapiens
agugagaagcgaauuugaa

SEQ ID NO: 1455079 - RNA, 19 nt, Homo sapiens
uggacagaauaugugguua

SEQ ID NO: 1455080 - RNA, 19 nt, Homo sapiens
gaggaaccguuaaaggaua

SEQ ID NO: 1455081 - RNA, 19 nt, Homo sapiens
aaggaaagauagacaauga

SEQ ID NO: 1455082 - RNA, 19 nt, Homo sapiens
gaucaaagacagagggaaa

SEQ ID NO: 1455083 - RNA, 19 nt, Homo sapiens
gguaauacuuugcuuuagu

SEQ ID NO: 1455084 - RNA, 19 nt, Homo sapiens
ggacaugauaagagaauuu

SEQ ID NO: 1455085 - RNA, 19 nt, Homo sapiens
aaagagagccagagaguga

SEQ ID NO: 1455086 - RNA, 19 nt, Homo sapiens
gcagagacgucaugauucg

SEQ ID NO: 1455087 - RNA, 19 nt, Homo sapiens
cucaguaccucaagcaaua

SEQ ID NO: 1455088 - RNA, 19 nt, Homo sapiens
gaagacaagaaguuagaaa

SEQ ID NO: 1455089 - RNA, 19 nt, Homo sapiens
ggaaaucucgacauggaaa

SEQ ID NO: 1455090 - RNA, 19 nt, Homo sapiens
gcaaugaggacaugauaag

SEQ ID NO: 1455091 - RNA, 19 nt, Homo sapiens
gaagggaaagucagagaug

SEQ ID NO: 1455092 - RNA, 19 nt, Homo sapiens
guaauacuuugcuuuaguc

SEQ ID NO: 1455093 - RNA, 19 nt, Homo sapiens
gauaagagaauuugacaac

SEQ ID NO: 1455094 - RNA, 19 nt, Homo sapiens
ggaaugccuucgaaucaag

SEQ ID NO: 1455095 - RNA, 19 nt, Homo sapiens
uggcuaggguggaggauaa

SEQ ID NO: 1455096 - RNA, 19 nt, Homo sapiens
aaacaagggcugcaggaaa

SEQ ID NO: 1455097 - RNA, 19 nt, Homo sapiens
gauagacaaugaagaacag

SEQ ID NO: 1455098 - RNA, 19 nt, Homo sapiens
auacuuugcuuuagucguu

SEQ ID NO: 1455099 - RNA, 19 nt, Homo sapiens
acacugaagacauuccuua

SEQ ID NO: 1455100 - RNA, 19 nt, Homo sapiens
gcaauauaaggaagccaua

SEQ ID NO: 1455101 - RNA, 19 nt, Homo sapiens
gagaguugaggaaccguua

SEQ ID NO: 1455102 - RNA, 19 nt, Homo sapiens
gaaagauagacaaugaaga

SEQ ID NO: 1455103 - RNA, 19 nt, Homo sapiens
ggaaagauagacaaugaag

SEQ ID NO: 1455104 - RNA, 19 nt, Homo sapiens
uagcuuguauucuggaaga

SEQ ID NO: 1455105 - RNA, 19 nt, Homo sapiens
aagggacacugaagacauu

SEQ ID NO: 1455106 - RNA, 19 nt, Homo sapiens
gaagggacacugaagacau

SEQ ID NO: 1455107 - RNA, 19 nt, Homo sapiens
uaaggaagccauacaugau

SEQ ID NO: 1455108 - RNA, 19 nt, Homo sapiens
gaugauauacccaggaaag

SEQ ID NO: 1455109 - RNA, 19 nt, Homo sapiens
gaaacaagggcugcaggaa

SEQ ID NO: 1455110 - RNA, 19 nt, Homo sapiens
cgagggaaagccagaagua

SEQ ID NO: 1455111 - RNA, 19 nt, Homo sapiens
cagcaaugaggacaugaua

SEQ ID NO: 1455112 - RNA, 19 nt, Homo sapiens
aagagaauuugacaacaug

SEQ ID NO: 1455113 - RNA, 19 nt, Homo sapiens
gcagggaggaucaaagaca

SEQ ID NO: 1455114 - RNA, 19 nt, Homo sapiens
ggagaaggaaagucagaga

SEQ ID NO: 1455115 - RNA, 19 nt, Homo sapiens
agagcaaccuguccagaau

SEQ ID NO: 1455116 - RNA, 19 nt, Homo sapiens
ggagagccagaaagugaaa

SEQ ID NO: 1455117 - RNA, 19 nt, Homo sapiens
aaggaagccauacaugaua

SEQ ID NO: 1455118 - RNA, 19 nt, Homo sapiens
ugaaagagagccagagagu

SEQ ID NO: 1455119 - RNA, 19 nt, Homo sapiens
aaggagagccagacaguga

SEQ ID NO: 1455120 - RNA, 19 nt, Homo sapiens
ggucugcgcgucuguuguu

SEQ ID NO: 1455121 - RNA, 19 nt, Homo sapiens
acaaggggcuggcucagua

SEQ ID NO: 1455122 - RNA, 19 nt, Homo sapiens
aacaagggcugcaggaaag

SEQ ID NO: 1455123 - RNA, 19 nt, Homo sapiens
ggagagccagacagugaaa

SEQ ID NO: 1455124 - RNA, 19 nt, Homo sapiens
ccagaaguagcuuguauuc

SEQ ID NO: 1455125 - RNA, 19 nt, Homo sapiens
uugcagagacgucaugauu

SEQ ID NO: 1455126 - RNA, 19 nt, Homo sapiens
ugacccaccugccaguguu

SEQ ID NO: 1455127 - RNA, 19 nt, Homo sapiens
auaaggaagccauacauga

SEQ ID NO: 1455128 - RNA, 19 nt, Homo sapiens
gcucuauguuucaguagca

SEQ ID NO: 1455129 - RNA, 19 nt, Homo sapiens
guggaugcaaagaaauuua

SEQ ID NO: 1455130 - RNA, 19 nt, Homo sapiens
gcauuugucaggccauaug

SEQ ID NO: 1455131 - RNA, 19 nt, Homo sapiens
gaggacaugauaagagaau

SEQ ID NO: 1455132 - RNA, 19 nt, Homo sapiens
ggggaaaucucgacaugga

SEQ ID NO: 1455133 - RNA, 19 nt, Homo sapiens
caaugaaaaugaaggaaug

SEQ ID NO: 1455134 - RNA, 19 nt, Homo sapiens
gacaugauaagagaauuug

SEQ ID NO: 1455135 - RNA, 19 nt, Homo sapiens
ggaagggaaagucagagau

SEQ ID NO: 1455136 - RNA, 19 nt, Homo sapiens
aggaaccguuaaaggauaa

SEQ ID NO: 1455137 - RNA, 19 nt, Homo sapiens
gaguugaggaaccguuaaa

SEQ ID NO: 1455138 - RNA, 19 nt, Homo sapiens
ggaagacaagaaguuagaa

SEQ ID NO: 1455139 - RNA, 19 nt, Homo sapiens
aggaagccauacaugauau

SEQ ID NO: 1455140 - RNA, 19 nt, Homo sapiens
augaggacaugauaagaga

SEQ ID NO: 1455141 - RNA, 19 nt, Homo sapiens
gcucaguaccucaagcaau

SEQ ID NO: 1455142 - RNA, 19 nt, Homo sapiens
agggagagccagaaaguga

SEQ ID NO: 1455143 - RNA, 19 nt, Homo sapiens
gggcaagagaguugaggaa

SEQ ID NO: 1455144 - RNA, 19 nt, Homo sapiens
ugagaggccugaaaaggaa

SEQ ID NO: 1455145 - RNA, 19 nt, Homo sapiens
ggccauauguuuuaaccuu

SEQ ID NO: 1455146 - RNA, 19 nt, Homo sapiens
caaggaaagauagacaaug

SEQ ID NO: 1455147 - RNA, 19 nt, Homo sapiens
caggaaagccaaaagaaaa

SEQ ID NO: 1455148 - RNA, 19 nt, Homo sapiens
gaggggaaaucucgacaug

SEQ ID NO: 1455149 - RNA, 19 nt, Homo sapiens
agccagaaguagcuuguau

SEQ ID NO: 1455150 - RNA, 19 nt, Homo sapiens
aggaugauauacccaggaa

SEQ ID NO: 1455151 - RNA, 19 nt, Homo sapiens
ucuggaagacaagaaguua

SEQ ID NO: 1455152 - RNA, 19 nt, Homo sapiens
gccauauguuuuaaccuua

SEQ ID NO: 1455153 - RNA, 19 nt, Homo sapiens
ugaaggagagccagacagu

SEQ ID NO: 1455154 - RNA, 19 nt, Homo sapiens
ugaggaaccguuaaaggau

SEQ ID NO: 1455155 - RNA, 19 nt, Homo sapiens
ucaaggaaagauagacaau

SEQ ID NO: 1455156 - RNA, 19 nt, Homo sapiens
gccagaaguagcuuguauu

SEQ ID NO: 1455157 - RNA, 19 nt, Homo sapiens
uggaagacaagaaguuaga

SEQ ID NO: 1455158 - RNA, 19 nt, Homo sapiens
gggagagccagaaagugaa

SEQ ID NO: 1455159 - RNA, 19 nt, Homo sapiens
cuugcucuauguuucagua

SEQ ID NO: 1455160 - RNA, 19 nt, Homo sapiens
aagagcaaccuguccagaa

SEQ ID NO: 1455161 - RNA, 19 nt, Homo sapiens
uauaaggaagccauacaug

SEQ ID NO: 1455162 - RNA, 19 nt, Homo sapiens
aggaaugccuucgaaucaa

SEQ ID NO: 1455163 - RNA, 19 nt, Homo sapiens
ugagggagagccagaaagu

SEQ ID NO: 1455164 - RNA, 19 nt, Homo sapiens
agucagagaggaagggaaa

SEQ ID NO: 1455165 - RNA, 19 nt, Homo sapiens
uugaggaaccguuaaagga

SEQ ID NO: 1455166 - RNA, 19 nt, Homo sapiens
aaacgagggaaacacagaa

SEQ ID NO: 1455167 - RNA, 19 nt, Homo sapiens
cgaaucaaggaaagauaga

SEQ ID NO: 1455168 - RNA, 19 nt, Homo sapiens
caaugaggacaugauaaga

SEQ ID NO: 1455169 - RNA, 19 nt, Homo sapiens
ccucaagcaauauaaggaa

SEQ ID NO: 1455170 - RNA, 19 nt, Homo sapiens
uagcagauuuucacacaug

SEQ ID NO: 1455171 - RNA, 19 nt, Homo sapiens
gagggaaagccagaaguag

SEQ ID NO: 1455172 - RNA, 19 nt, Homo sapiens
gggaagggcagagggugaa

SEQ ID NO: 1455173 - RNA, 19 nt, Homo sapiens
gagcaaccuguccagaauc

SEQ ID NO: 1455174 - RNA, 19 nt, Homo sapiens
gcacgagggaaagccagaa

SEQ ID NO: 1455175 - RNA, 19 nt, Homo sapiens
gcauugcagagacgucaug

SEQ ID NO: 1455176 - RNA, 19 nt, Homo sapiens
gggaaagccagaaguagcu

SEQ ID NO: 1455177 - RNA, 19 nt, Homo sapiens
ccacgaagggacacugaag

SEQ ID NO: 1455178 - RNA, 19 nt, Homo sapiens
gggaaaucucgacauggaa

SEQ ID NO: 1455179 - RNA, 19 nt, Homo sapiens
guguuugcuugcucuaugu

SEQ ID NO: 1455180 - RNA, 19 nt, Homo sapiens
ggaccacgcugaccuguag

SEQ ID NO: 1455181 - RNA, 19 nt, Homo sapiens
gaaaugacccgcgaagaga

SEQ ID NO: 1455182 - RNA, 19 nt, Homo sapiens
gcaggacauuccauucuau

SEQ ID NO: 1455183 - RNA, 19 nt, Homo sapiens
gacauuccauucuaucaca

SEQ ID NO: 1455184 - RNA, 19 nt, Homo sapiens
cgcaggacauuccauucua

SEQ ID NO: 1455185 - RNA, 19 nt, Homo sapiens
ugaaaugacccgcgaagag

SEQ ID NO: 1455186 - RNA, 19 nt, Homo sapiens
gaggcaagauucggaagag

SEQ ID NO: 1455187 - RNA, 19 nt, Homo sapiens
cagcaucccgggaauacuu

SEQ ID NO: 1455188 - RNA, 19 nt, Homo sapiens
ugcaggagcucggcuucua

SEQ ID NO: 1455189 - RNA, 19 nt, Homo sapiens
ccugaguccuggagacaga

SEQ ID NO: 1455190 - RNA, 19 nt, Homo sapiens
cagcugaaccgccuaaagg

SEQ ID NO: 1455191 - RNA, 19 nt, Homo sapiens
gcucagcaucccgggaaua

SEQ ID NO: 1455192 - RNA, 19 nt, Homo sapiens
cuagagcgcaucccacuca

SEQ ID NO: 1455193 - RNA, 19 nt, Homo sapiens
ucacgcaggacauuccauu

SEQ ID NO: 1455194 - RNA, 19 nt, Homo sapiens
agagaucaaugcgcuagug

SEQ ID NO: 1455195 - RNA, 19 nt, Homo sapiens
gccuccagcuugcgcauca

SEQ ID NO: 1455196 - RNA, 19 nt, Homo sapiens
ugacagcugaaccgccuaa

SEQ ID NO: 1455197 - RNA, 19 nt, Homo sapiens
ggacauuccauucuaucac

SEQ ID NO: 1455198 - RNA, 19 nt, Homo sapiens
acaaccuggugaugaaaca

SEQ ID NO: 1455199 - RNA, 19 nt, Homo sapiens
gagcugaguucuaaaguuc

SEQ ID NO: 1455200 - RNA, 19 nt, Homo sapiens
ugagauggcugcauuacaa

SEQ ID NO: 1455201 - RNA, 19 nt, Homo sapiens
gaagagucaugcauagaga

SEQ ID NO: 1455202 - RNA, 19 nt, Homo sapiens
gaccagacgucaccuaugu

SEQ ID NO: 1455203 - RNA, 19 nt, Homo sapiens
gauacaacuucaaaucuga

SEQ ID NO: 1455204 - RNA, 19 nt, Homo sapiens
gauaugggcuauaauacau

SEQ ID NO: 1455205 - RNA, 19 nt, Homo sapiens
gaccggauaugggcuauaa

SEQ ID NO: 1455206 - RNA, 19 nt, Homo sapiens
gcaagcagcuaaacaugca

SEQ ID NO: 1455207 - RNA, 19 nt, Homo sapiens
gaugagcaaucacaaggaa

SEQ ID NO: 1455208 - RNA, 19 nt, Homo sapiens
ccauuuaugucugguguua

SEQ ID NO: 1455209 - RNA, 19 nt, Homo sapiens
uauaugagauggcugcauu

SEQ ID NO: 1455210 - RNA, 19 nt, Homo sapiens
ggauacaacuucaaaucug

SEQ ID NO: 1455211 - RNA, 19 nt, Homo sapiens
aaagaacuguuuggaagua

SEQ ID NO: 1455212 - RNA, 19 nt, Homo sapiens
gaacacaugcauucucgaa

SEQ ID NO: 1455213 - RNA, 19 nt, Homo sapiens
gacaauggaugagcaauca

SEQ ID NO: 1455214 - RNA, 19 nt, Homo sapiens
gcacauucuuuaguuggua

SEQ ID NO: 1455215 - RNA, 19 nt, Homo sapiens
gagcuagugugcuuugaau

SEQ ID NO: 1455216 - RNA, 19 nt, Homo sapiens
ccagagagaauacaugaaa

SEQ ID NO: 1455217 - RNA, 19 nt, Homo sapiens
ggcacgagcugaguucuaa

SEQ ID NO: 1455218 - RNA, 19 nt, Homo sapiens
gcaagaucaugaagagugu

SEQ ID NO: 1455219 - RNA, 19 nt, Homo sapiens
gaacuguuuggaaguauuu

SEQ ID NO: 1455220 - RNA, 19 nt, Homo sapiens
gaauuuauacucacugugu

SEQ ID NO: 1455221 - RNA, 19 nt, Homo sapiens
ucucuuggcugucuacuau

SEQ ID NO: 1455222 - RNA, 19 nt, Homo sapiens
gaaaauggauacaacuuca

SEQ ID NO: 1455223 - RNA, 19 nt, Homo sapiens
gaguguaaccaaaguaauu

SEQ ID NO: 1455224 - RNA, 19 nt, Homo sapiens
acacaugcauucucgaaga

SEQ ID NO: 1455225 - RNA, 19 nt, Homo sapiens
caacucaaccauccaaaug

SEQ ID NO: 1455226 - RNA, 19 nt, Homo sapiens
uaaaguuccuguugcuuca

SEQ ID NO: 1455227 - RNA, 19 nt, Homo sapiens
gaggcuaauuccugaaaga

SEQ ID NO: 1455228 - RNA, 19 nt, Homo sapiens
caugaagaguguaaccaaa

SEQ ID NO: 1455229 - RNA, 19 nt, Homo sapiens
gaagaguguaaccaaagua

SEQ ID NO: 1455230 - RNA, 19 nt, Homo sapiens
gagaauacaugaaaaugga

SEQ ID NO: 1455231 - RNA, 19 nt, Homo sapiens
agucauaccuccccauuua

SEQ ID NO: 1455232 - RNA, 19 nt, Homo sapiens
caacccagauccagagaag

SEQ ID NO: 1455233 - RNA, 19 nt, Homo sapiens
gaaaguauuuugugcaagu

SEQ ID NO: 1455234 - RNA, 19 nt, Homo sapiens
ucugacaucuggucucuug

SEQ ID NO: 1455235 - RNA, 19 nt, Homo sapiens
gaaagaacuguuuggaagu

SEQ ID NO: 1455236 - RNA, 19 nt, Homo sapiens
acucaaccauccaaaugua

SEQ ID NO: 1455237 - RNA, 19 nt, Homo sapiens
ccacagcugcacauucuuu

SEQ ID NO: 1455238 - RNA, 19 nt, Homo sapiens
agucaugcauagagauaua

SEQ ID NO: 1455239 - RNA, 19 nt, Homo sapiens
gaaaauuggucgcggacaa

SEQ ID NO: 1455240 - RNA, 19 nt, Homo sapiens
ggauaugggcuauaauaca

SEQ ID NO: 1455241 - RNA, 19 nt, Homo sapiens
cgagcugaguucuaaaguu

SEQ ID NO: 1455242 - RNA, 19 nt, Homo sapiens
gcuaauuccugaaagaacu

SEQ ID NO: 1455243 - RNA, 19 nt, Homo sapiens
caaccauccaaauguaaua

SEQ ID NO: 1455244 - RNA, 19 nt, Homo sapiens
ccggauaugggcuauaaua

SEQ ID NO: 1455245 - RNA, 19 nt, Homo sapiens
ucagaucacuauucagaag

SEQ ID NO: 1455246 - RNA, 19 nt, Homo sapiens
uuucagagcuagugugcuu

SEQ ID NO: 1455247 - RNA, 19 nt, Homo sapiens
ggcgaccuauccagaauga

SEQ ID NO: 1455248 - RNA, 19 nt, Homo sapiens
uggaguaccaguagcuuua

SEQ ID NO: 1455249 - RNA, 19 nt, Homo sapiens
agacgucaccuauguuuau

SEQ ID NO: 1455250 - RNA, 19 nt, Homo sapiens
gaaauagaucuucuuaagc

SEQ ID NO: 1455251 - RNA, 19 nt, Homo sapiens
gaguaccaguagcuuuaaa

SEQ ID NO: 1455252 - RNA, 19 nt, Homo sapiens
ccagacgucaccuauguuu

SEQ ID NO: 1455253 - RNA, 19 nt, Homo sapiens
uauacucacuguguaagaa

SEQ ID NO: 1455254 - RNA, 19 nt, Homo sapiens
ugaagaguguaaccaaagu

SEQ ID NO: 1455255 - RNA, 19 nt, Homo sapiens
caccuauguuuaugacgua

SEQ ID NO: 1455256 - RNA, 19 nt, Homo sapiens
gacaguuaguuaauaugug

SEQ ID NO: 1455257 - RNA, 19 nt, Homo sapiens
gcaacucaaccauccaaau

SEQ ID NO: 1455258 - RNA, 19 nt, Homo sapiens
gcaaucacaaggaaugcaa

SEQ ID NO: 1455259 - RNA, 19 nt, Homo sapiens
uuagccaacuuucgaauag

SEQ ID NO: 1455260 - RNA, 19 nt, Homo sapiens
uaguugguacgccuuauua

SEQ ID NO: 1455261 - RNA, 19 nt, Homo sapiens
aaccacagcugcacauucu

SEQ ID NO: 1455262 - RNA, 19 nt, Homo sapiens
gaucaagcauuuuaagaag

SEQ ID NO: 1455263 - RNA, 19 nt, Homo sapiens
ggaguaccaguagcuuuaa

SEQ ID NO: 1455264 - RNA, 19 nt, Homo sapiens
ggacaauuuagugaaguuu

SEQ ID NO: 1455265 - RNA, 19 nt, Homo sapiens
cgacaguuaguuaauaugu

SEQ ID NO: 1455266 - RNA, 19 nt, Homo sapiens
gauagaacagugugacuac

SEQ ID NO: 1455267 - RNA, 19 nt, Homo sapiens
ucucgaagagucaugcaua

SEQ ID NO: 1455268 - RNA, 19 nt, Homo sapiens
gcagugcauuggaacacau

SEQ ID NO: 1455269 - RNA, 19 nt, Homo sapiens
gcugcacauucuuuaguug

SEQ ID NO: 1455270 - RNA, 19 nt, Homo sapiens
ggccaccuguuccucaguu

SEQ ID NO: 1455271 - RNA, 19 nt, Homo sapiens
cagcuaaacaugcaagauc

SEQ ID NO: 1455272 - RNA, 19 nt, Homo sapiens
cuucagaucacuauucaga

SEQ ID NO: 1455273 - RNA, 19 nt, Homo sapiens
cuacccaccucuuccuuca

SEQ ID NO: 1455274 - RNA, 19 nt, Homo sapiens
gagauggcugcauuacaaa

SEQ ID NO: 1455275 - RNA, 19 nt, Homo sapiens
caacuucaaaucugacauc

SEQ ID NO: 1455276 - RNA, 19 nt, Homo sapiens
uuuaauggaugccaaagca

SEQ ID NO: 1455277 - RNA, 19 nt, Homo sapiens
gcauagagauauaaaacca

SEQ ID NO: 1455278 - RNA, 19 nt, Homo sapiens
uaugucugguguuaagauu

SEQ ID NO: 1455279 - RNA, 19 nt, Homo sapiens
gacgucaccuauguuuaug

SEQ ID NO: 1455280 - RNA, 19 nt, Homo sapiens
cuccgacaguuaguuaaua

SEQ ID NO: 1455281 - RNA, 19 nt, Homo sapiens
agaacuguuuggaaguauu

SEQ ID NO: 1455282 - RNA, 19 nt, Homo sapiens
agaucacuauucagaagaa

SEQ ID NO: 1455283 - RNA, 19 nt, Homo sapiens
cgaccuauccagaaugauc

SEQ ID NO: 1455284 - RNA, 19 nt, Homo sapiens
cggacaauuuagugaaguu

SEQ ID NO: 1455285 - RNA, 19 nt, Homo sapiens
gguaaaacuuggagaucuu

SEQ ID NO: 1455286 - RNA, 19 nt, Homo sapiens
uccgacaguuaguuaauau

SEQ ID NO: 1455287 - RNA, 19 nt, Homo sapiens
agagucaugcauagagaua

SEQ ID NO: 1455288 - RNA, 19 nt, Homo sapiens
cgaagagucaugcauagag

SEQ ID NO: 1455289 - RNA, 19 nt, Homo sapiens
aagaguguaaccaaaguaa

SEQ ID NO: 1455290 - RNA, 19 nt, Homo sapiens
ucuuggcugucuacuauau

SEQ ID NO: 1455291 - RNA, 19 nt, Homo sapiens
agccaacuuucgaauagaa

SEQ ID NO: 1455292 - RNA, 19 nt, Homo sapiens
aaaaccagcuaauguguuc

SEQ ID NO: 1455293 - RNA, 19 nt, Homo sapiens
ugagcaaucacaaggaaug

SEQ ID NO: 1455294 - RNA, 19 nt, Homo sapiens
uauccagaaugaucaagca

SEQ ID NO: 1455295 - RNA, 19 nt, Homo sapiens
uaagaagauagaacagugu

SEQ ID NO: 1455296 - RNA, 19 nt, Homo sapiens
cacagcugcacauucuuua

SEQ ID NO: 1455297 - RNA, 19 nt, Homo sapiens
ggaugagcaaucacaagga

SEQ ID NO: 1455298 - RNA, 19 nt, Homo sapiens
cagacgucaccuauguuua

SEQ ID NO: 1455299 - RNA, 19 nt, Homo sapiens
ccaaagaccuuaugaaugu

SEQ ID NO: 1455300 - RNA, 19 nt, Homo sapiens
ggacaggaauugaaccuaa

SEQ ID NO: 1455301 - RNA, 19 nt, Homo sapiens
ccaaauaucuacugucuga

SEQ ID NO: 1455302 - RNA, 19 nt, Homo sapiens
gagaaacccuauaaaugua

SEQ ID NO: 1455303 - RNA, 19 nt, Homo sapiens
gaacagaauucuccaguag

SEQ ID NO: 1455304 - RNA, 19 nt, Homo sapiens
ugacguuacucaagaauua

SEQ ID NO: 1455305 - RNA, 19 nt, Homo sapiens
gaaagagaacguacauaua

SEQ ID NO: 1455306 - RNA, 19 nt, Homo sapiens
ggagagagaucuuauaacu

SEQ ID NO: 1455307 - RNA, 19 nt, Homo sapiens
gaaaggcauucaagacaaa

SEQ ID NO: 1455308 - RNA, 19 nt, Homo sapiens
gcaaauauuuccuauccuu

SEQ ID NO: 1455309 - RNA, 19 nt, Homo sapiens
ggugauaacucauccugua

SEQ ID NO: 1455310 - RNA, 19 nt, Homo sapiens
caauagaggugaaaggaaa

SEQ ID NO: 1455311 - RNA, 19 nt, Homo sapiens
gaaagaaaccauaugaaug

SEQ ID NO: 1455312 - RNA, 19 nt, Homo sapiens
gaagaugguucuauuugga

SEQ ID NO: 1455313 - RNA, 19 nt, Homo sapiens
ggaaagagaacguacauau

SEQ ID NO: 1455314 - RNA, 19 nt, Homo sapiens
gacagaaccucaaacacua

SEQ ID NO: 1455315 - RNA, 19 nt, Homo sapiens
gagcagagguuaucaaacu

SEQ ID NO: 1455316 - RNA, 19 nt, Homo sapiens
gagguaaacugauccagaa

SEQ ID NO: 1455317 - RNA, 19 nt, Homo sapiens
caacugacguuacucaaga

SEQ ID NO: 1455318 - RNA, 19 nt, Homo sapiens
gagagaaaccuuauaaaug

SEQ ID NO: 1455319 - RNA, 19 nt, Homo sapiens
cauaguaagugcucaguaa

SEQ ID NO: 1455320 - RNA, 19 nt, Homo sapiens
ggaaaggcauucaagacaa

SEQ ID NO: 1455321 - RNA, 19 nt, Homo sapiens
agagaaaccuuacaaaugu

SEQ ID NO: 1455322 - RNA, 19 nt, Homo sapiens
caacacaggagaauucaua

SEQ ID NO: 1455323 - RNA, 19 nt, Homo sapiens
ggaacagaauucuccagua

SEQ ID NO: 1455324 - RNA, 19 nt, Homo sapiens
ggaaagaaaccauaugaau

SEQ ID NO: 1455325 - RNA, 19 nt, Homo sapiens
gagagaaaccuuacaaaug

SEQ ID NO: 1455326 - RNA, 19 nt, Homo sapiens
ggaguuaccucucaagaag

SEQ ID NO: 1455327 - RNA, 19 nt, Homo sapiens
caggcaaacugcucacuua

SEQ ID NO: 1455328 - RNA, 19 nt, Homo sapiens
ggagagaaaccuuauaaau

SEQ ID NO: 1455329 - RNA, 19 nt, Homo sapiens
acacuaaacuugauuguuc

SEQ ID NO: 1455330 - RNA, 19 nt, Homo sapiens
gggaaggccuuuggugaua

SEQ ID NO: 1455331 - RNA, 19 nt, Homo sapiens
gagagaagcccuaugaaug

SEQ ID NO: 1455332 - RNA, 19 nt, Homo sapiens
ggauguggcuguagauuuc

SEQ ID NO: 1455333 - RNA, 19 nt, Homo sapiens
caauacaacugucacauca

SEQ ID NO: 1455334 - RNA, 19 nt, Homo sapiens
ggaauggccucgcauccaa

SEQ ID NO: 1455335 - RNA, 19 nt, Homo sapiens
gaauguaagguuuguagua

SEQ ID NO: 1455336 - RNA, 19 nt, Homo sapiens
gaagagaaaguucauaauc

SEQ ID NO: 1455337 - RNA, 19 nt, Homo sapiens
guaaagcguucacccagaa

SEQ ID NO: 1455338 - RNA, 19 nt, Homo sapiens
gagaagcccuaugaaugua

SEQ ID NO: 1455339 - RNA, 19 nt, Homo sapiens
ggauuaugaugcucuguuu

SEQ ID NO: 1455340 - RNA, 19 nt, Homo sapiens
ggaaggugauguuggagaa

SEQ ID NO: 1455341 - RNA, 19 nt, Homo sapiens
ccacagccaugcuuacuug

SEQ ID NO: 1455342 - RNA, 19 nt, Homo sapiens
gagcucaucucuuacuguu

SEQ ID NO: 1455343 - RNA, 19 nt, Homo sapiens
ccacacaccucauucaaca

SEQ ID NO: 1455344 - RNA, 19 nt, Homo sapiens
gcucaucucuuacuguuca

SEQ ID NO: 1455345 - RNA, 19 nt, Homo sapiens
caacauaagagaguucaua

SEQ ID NO: 1455346 - RNA, 19 nt, Homo sapiens
guacaucaaaggauucaua

SEQ ID NO: 1455347 - RNA, 19 nt, Homo sapiens
gccaauuacucauaacaaa

SEQ ID NO: 1455348 - RNA, 19 nt, Homo sapiens
gguccaugaucuagaauuu

SEQ ID NO: 1455349 - RNA, 19 nt, Homo sapiens
ggaacucauuuaucaauag

SEQ ID NO: 1455350 - RNA, 19 nt, Homo sapiens
guaaacugauccagaauag

SEQ ID NO: 1455351 - RNA, 19 nt, Homo sapiens
ggagagaaaccuuacaaau

SEQ ID NO: 1455352 - RNA, 19 nt, Homo sapiens
ugagaaacccuauaaaugu

SEQ ID NO: 1455353 - RNA, 19 nt, Homo sapiens
gcuauaaucuggaguacuc

SEQ ID NO: 1455354 - RNA, 19 nt, Homo sapiens
ggaaggccuuuggugauaa

SEQ ID NO: 1455355 - RNA, 19 nt, Homo sapiens
ucacaaauccuucagguau

SEQ ID NO: 1455356 - RNA, 19 nt, Homo sapiens
gggagaaacccuuugauug

SEQ ID NO: 1455357 - RNA, 19 nt, Homo sapiens
gaaaccauaugaauguaag

SEQ ID NO: 1455358 - RNA, 19 nt, Homo sapiens
ggaagaugguucuauuugg

SEQ ID NO: 1455359 - RNA, 19 nt, Homo sapiens
aaaccuggcuguugacuuc

SEQ ID NO: 1455360 - RNA, 19 nt, Homo sapiens
cagagagacucacaagcua

SEQ ID NO: 1455361 - RNA, 19 nt, Homo sapiens
cagccaugcuuacuuguuu

SEQ ID NO: 1455362 - RNA, 19 nt, Homo sapiens
gaaagucuagggaccauga

SEQ ID NO: 1455363 - RNA, 19 nt, Homo sapiens
ggaucuguuucccaaauuu

SEQ ID NO: 1455364 - RNA, 19 nt, Homo sapiens
caagagccaauuacucaua

SEQ ID NO: 1455365 - RNA, 19 nt, Homo sapiens
caucaucagcgaauucaua

SEQ ID NO: 1455366 - RNA, 19 nt, Homo sapiens
ucacuuagcucaucaucag

SEQ ID NO: 1455367 - RNA, 19 nt, Homo sapiens
gcaaacugcucacuuagcu

SEQ ID NO: 1455368 - RNA, 19 nt, Homo sapiens
ggagagaagcccuaugaau

SEQ ID NO: 1455369 - RNA, 19 nt, Homo sapiens
guucucagcuugccacuca

SEQ ID NO: 1455370 - RNA, 19 nt, Homo sapiens
ggagaagccuuuugaaugu

SEQ ID NO: 1455371 - RNA, 19 nt, Homo sapiens
gacaggaauugaaccuaaa

SEQ ID NO: 1455372 - RNA, 19 nt, Homo sapiens
cagaagagaaaguucauaa

SEQ ID NO: 1455373 - RNA, 19 nt, Homo sapiens
auacagaacacaucccuua

SEQ ID NO: 1455374 - RNA, 19 nt, Homo sapiens
gagagacucacaagcuaua

SEQ ID NO: 1455375 - RNA, 19 nt, Homo sapiens
gguaaacugauccagaaua

SEQ ID NO: 1455376 - RNA, 19 nt, Homo sapiens
gugagaaacccuauaaaug

SEQ ID NO: 1455377 - RNA, 19 nt, Homo sapiens
ggagaaacccuuugauugc

SEQ ID NO: 1455378 - RNA, 19 nt, Homo sapiens
ggagagaaaccauaugagu

SEQ ID NO: 1455379 - RNA, 19 nt, Homo sapiens
gcagagguuaucaaacuaa

SEQ ID NO: 1455380 - RNA, 19 nt, Homo sapiens
cagcagaguugagcaguug

SEQ ID NO: 1455381 - RNA, 19 nt, Homo sapiens
uagggaccaugaaugaaua

SEQ ID NO: 1455382 - RNA, 19 nt, Homo sapiens
cuuauucacuccucuugua

SEQ ID NO: 1455383 - RNA, 19 nt, Homo sapiens
ccauaugaaugugauguuu

SEQ ID NO: 1455384 - RNA, 19 nt, Homo sapiens
gagaaacccuuugauugca

SEQ ID NO: 1455385 - RNA, 19 nt, Homo sapiens
aaauugggauucugacuau

SEQ ID NO: 1455386 - RNA, 19 nt, Homo sapiens
gcccaaauaucuacugucu

SEQ ID NO: 1455387 - RNA, 19 nt, Homo sapiens
gagagagaucuuauaacua

SEQ ID NO: 1455388 - RNA, 19 nt, Homo sapiens
ggugagaaacccuauaaau

SEQ ID NO: 1455389 - RNA, 19 nt, Homo sapiens
ccacauagggcuuaaucaa

SEQ ID NO: 1455390 - RNA, 19 nt, Homo sapiens
ggacgauucagaagagaaa

SEQ ID NO: 1455391 - RNA, 19 nt, Homo sapiens
ugacuacuccagcaguuua

SEQ ID NO: 1455392 - RNA, 19 nt, Homo sapiens
ugucaucgcagaagucaua

SEQ ID NO: 1455393 - RNA, 19 nt, Homo sapiens
gaaacccuauaaauguaug

SEQ ID NO: 1455394 - RNA, 19 nt, Homo sapiens
acauagggcuuaaucaaca

SEQ ID NO: 1455395 - RNA, 19 nt, Homo sapiens
ggcaagagccaauuacuca

SEQ ID NO: 1455396 - RNA, 19 nt, Homo sapiens
uaacagacagaaccucaaa

SEQ ID NO: 1455397 - RNA, 19 nt, Homo sapiens
gaggugaaaggaaauuauu

SEQ ID NO: 1455398 - RNA, 19 nt, Homo sapiens
gcagcagaguugagcaguu

SEQ ID NO: 1455399 - RNA, 19 nt, Homo sapiens
gaagauggcagaagucaug

SEQ ID NO: 1455400 - RNA, 19 nt, Homo sapiens
gggaggauguucaauaaag

SEQ ID NO: 1455401 - RNA, 19 nt, Homo sapiens
ucacggagcuccucaugca

SEQ ID NO: 1455402 - RNA, 19 nt, Homo sapiens
ggagggcuggucuuuauuu

SEQ ID NO: 1455403 - RNA, 19 nt, Homo sapiens
ggagaaccgugagaagaug

SEQ ID NO: 1455404 - RNA, 19 nt, Homo sapiens
gugagaagauggcagaagu

SEQ ID NO: 1455405 - RNA, 19 nt, Homo sapiens
cagcagaggccaaccagaa

SEQ ID NO: 1455406 - RNA, 19 nt, Homo sapiens
gaaggcugcgggcauguuu

SEQ ID NO: 1455407 - RNA, 19 nt, Homo sapiens
uugggaggauguucaauaa

SEQ ID NO: 1455408 - RNA, 19 nt, Homo sapiens
cagaagucauguucgagaa

SEQ ID NO: 1455409 - RNA, 19 nt, Homo sapiens
cuggagggcuggucuuuau

SEQ ID NO: 1455410 - RNA, 19 nt, Homo sapiens
ggaggauguucaauaaagg

SEQ ID NO: 1455411 - RNA, 19 nt, Homo sapiens
ccgcagacuucaaggaguu

SEQ ID NO: 1455412 - RNA, 19 nt, Homo sapiens
gggaggaggcccuguacaa

SEQ ID NO: 1455413 - RNA, 19 nt, Homo sapiens
gggcuggucuuuauuuuga

SEQ ID NO: 1455414 - RNA, 19 nt, Homo sapiens
gggagaaccgugagaagau

SEQ ID NO: 1455415 - RNA, 19 nt, Homo sapiens
gcagaggccaaccagaaga

SEQ ID NO: 1455416 - RNA, 19 nt, Homo sapiens
gggaugacguggagagacu

SEQ ID NO: 1455417 - RNA, 19 nt, Homo sapiens
gagaagauggcagaaguca

SEQ ID NO: 1455418 - RNA, 19 nt, Homo sapiens
caagugugauaccgacauc

SEQ ID NO: 1455419 - RNA, 19 nt, Homo sapiens
uggcagaagucauguucga

SEQ ID NO: 1455420 - RNA, 19 nt, Homo sapiens
cccgagagcugugggaaga

SEQ ID NO: 1455421 - RNA, 19 nt, Homo sapiens
gauggcagaagucauguuc

SEQ ID NO: 1455422 - RNA, 19 nt, Homo sapiens
ccagcagcaucaccaagug

SEQ ID NO: 1455423 - RNA, 19 nt, Homo sapiens
ucuggaagcaccucuuuga

SEQ ID NO: 1455424 - RNA, 19 nt, Homo sapiens
auaccgacauccagaagau

SEQ ID NO: 1455425 - RNA, 19 nt, Homo sapiens
gcugugggauccccuauug

SEQ ID NO: 1455426 - RNA, 19 nt, Homo sapiens
ggaggaggcccuguacaag

SEQ ID NO: 1455427 - RNA, 19 nt, Homo sapiens
gaggauguucaauaaagga

SEQ ID NO: 1455428 - RNA, 19 nt, Homo sapiens
ucaccucucugaguagcuu

SEQ ID NO: 1455429 - RNA, 19 nt, Homo sapiens
ccaaccagaagaaguacuu

SEQ ID NO: 1455430 - RNA, 19 nt, Homo sapiens
ggaaggcugcgggcauguu

SEQ ID NO: 1455431 - RNA, 19 nt, Homo sapiens
uuugggaggauguucaaua

SEQ ID NO: 1455432 - RNA, 19 nt, Homo sapiens
caucgucaccucucugagu

SEQ ID NO: 1455433 - RNA, 19 nt, Homo sapiens
gagggcuggucuuuauuuu

SEQ ID NO: 1455434 - RNA, 19 nt, Homo sapiens
gauaccgacauccagaaga

SEQ ID NO: 1455435 - RNA, 19 nt, Homo sapiens
gcacuguccccaucuuuga

SEQ ID NO: 1455436 - RNA, 19 nt, Homo sapiens
ccagaagaaguacuuugug

SEQ ID NO: 1455437 - RNA, 19 nt, Homo sapiens
aggccaaccagaagaagua

SEQ ID NO: 1455438 - RNA, 19 nt, Homo sapiens
uguuuaauccgcacgcuuu

SEQ ID NO: 1455439 - RNA, 19 nt, Homo sapiens
ggugcuagcccugccuuga

SEQ ID NO: 1455440 - RNA, 19 nt, Homo sapiens
guuuaauccgcacgcuuua

SEQ ID NO: 1455441 - RNA, 19 nt, Homo sapiens
aaaagaagcugugcuacgu

SEQ ID NO: 1455442 - RNA, 19 nt, Homo sapiens
gcugcgggcauguuuaauc

SEQ ID NO: 1455443 - RNA, 19 nt, Homo sapiens
uuaauccgcacgcuuuaga

SEQ ID NO: 1455444 - RNA, 19 nt, Homo sapiens
aggaggcccuguacaagca

SEQ ID NO: 1455445 - RNA, 19 nt, Homo sapiens
caaccagaagaaguacuuu

SEQ ID NO: 1455446 - RNA, 19 nt, Homo sapiens
cagaggccaaccagaagaa

SEQ ID NO: 1455447 - RNA, 19 nt, Homo sapiens
aggcggugcuggcucucua

SEQ ID NO: 1455448 - RNA, 19 nt, Homo sapiens
uggaagcaccucuuugagu

SEQ ID NO: 1455449 - RNA, 19 nt, Homo sapiens
caucacggagcuccucaug

SEQ ID NO: 1455450 - RNA, 19 nt, Homo sapiens
ccagggagaaccgugagaa

SEQ ID NO: 1455451 - RNA, 19 nt, Homo sapiens
gcacuuguuuggacaguuu

SEQ ID NO: 1455452 - RNA, 19 nt, Homo sapiens
aaaccaagauucccaguga

SEQ ID NO: 1455453 - RNA, 19 nt, Homo sapiens
ggucacauguccuggcaua

SEQ ID NO: 1455454 - RNA, 19 nt, Homo sapiens
ccacagggaaagugaaaua

SEQ ID NO: 1455455 - RNA, 19 nt, Homo sapiens
caacaacaagcccugauuu

SEQ ID NO: 1455456 - RNA, 19 nt, Homo sapiens
ggaagccgcucacauugca

SEQ ID NO: 1455457 - RNA, 19 nt, Homo sapiens
caacuugaauuccgucauc

SEQ ID NO: 1455458 - RNA, 19 nt, Homo sapiens
ccaggagaauuguuaguga

SEQ ID NO: 1455459 - RNA, 19 nt, Homo sapiens
gugaauggccggugaugua

SEQ ID NO: 1455460 - RNA, 19 nt, Homo sapiens
gaaagaaagcauccagaca

SEQ ID NO: 1455461 - RNA, 19 nt, Homo sapiens
uggguuggaugauaccuua

SEQ ID NO: 1455462 - RNA, 19 nt, Homo sapiens
gaaauaaagccuugaaccu

SEQ ID NO: 1455463 - RNA, 19 nt, Homo sapiens
cagggaaagugaaauaaag

SEQ ID NO: 1455464 - RNA, 19 nt, Homo sapiens
caucaaugcucaccgucaa

SEQ ID NO: 1455465 - RNA, 19 nt, Homo sapiens
guucgagccugaggacuuu

SEQ ID NO: 1455466 - RNA, 19 nt, Homo sapiens
caagaugaauggcgucaac

SEQ ID NO: 1455467 - RNA, 19 nt, Homo sapiens
ggaacagaccacccacuga

SEQ ID NO: 1455468 - RNA, 19 nt, Homo sapiens
gggaacagccuggaacaga

SEQ ID NO: 1455469 - RNA, 19 nt, Homo sapiens
ugaauuccgucaucaaugc

SEQ ID NO: 1455470 - RNA, 19 nt, Homo sapiens
ccacuucuaugcgauguca

SEQ ID NO: 1455471 - RNA, 19 nt, Homo sapiens
ucacagacuuacgcacuug

SEQ ID NO: 1455472 - RNA, 19 nt, Homo sapiens
cagucaaccucccagugua

SEQ ID NO: 1455473 - RNA, 19 nt, Homo sapiens
ucaccuccgugccugcuuu

SEQ ID NO: 1455474 - RNA, 19 nt, Homo sapiens
ccaggaggaugacucucuu

SEQ ID NO: 1455475 - RNA, 19 nt, Homo sapiens
gaagccacagggaaaguga

SEQ ID NO: 1455476 - RNA, 19 nt, Homo sapiens
aaaugaagccacagggaaa

SEQ ID NO: 1455477 - RNA, 19 nt, Homo sapiens
cacacuggguuggaugaua

SEQ ID NO: 1455478 - RNA, 19 nt, Homo sapiens
gcucaccgucaauauguuu

SEQ ID NO: 1455479 - RNA, 19 nt, Homo sapiens
ucaaugcucaccgucaaua

SEQ ID NO: 1455480 - RNA, 19 nt, Homo sapiens
gcucagcagccacuucgaa

SEQ ID NO: 1455481 - RNA, 19 nt, Homo sapiens
ugacaggcagaaugaauug

SEQ ID NO: 1455482 - RNA, 19 nt, Homo sapiens
aaacaguugucuggcauca

SEQ ID NO: 1455483 - RNA, 19 nt, Homo sapiens
gagcuguggugcagagaac

SEQ ID NO: 1455484 - RNA, 19 nt, Homo sapiens
gcaccaccaccaccaacuu

SEQ ID NO: 1455485 - RNA, 19 nt, Homo sapiens
acagggaaagugaaauaaa

SEQ ID NO: 1455486 - RNA, 19 nt, Homo sapiens
guuggaugauaccuuaaug

SEQ ID NO: 1455487 - RNA, 19 nt, Homo sapiens
acacuggguuggaugauac

SEQ ID NO: 1455488 - RNA, 19 nt, Homo sapiens
gggugagggucgugagugu

SEQ ID NO: 1455489 - RNA, 19 nt, Homo sapiens
ucacauugcagucaucaca

SEQ ID NO: 1455490 - RNA, 19 nt, Homo sapiens
gagcggguccggucauucu

SEQ ID NO: 1455491 - RNA, 19 nt, Homo sapiens
ucaacaacaagcccugauu

SEQ ID NO: 1455492 - RNA, 19 nt, Homo sapiens
ggaugauaccuuaaugagu

SEQ ID NO: 1455493 - RNA, 19 nt, Homo sapiens
ugucccaggagaauuguua

SEQ ID NO: 1455494 - RNA, 19 nt, Homo sapiens
cacauguccuggcauaucu

SEQ ID NO: 1455495 - RNA, 19 nt, Homo sapiens
acauugcagucaucacaga

SEQ ID NO: 1455496 - RNA, 19 nt, Homo sapiens
ccacgcaguuuagucucuu

SEQ ID NO: 1455497 - RNA, 19 nt, Homo sapiens
cugcugcccuucaacaaca

SEQ ID NO: 1455498 - RNA, 19 nt, Homo sapiens
aauggccggugauguaugu

SEQ ID NO: 1455499 - RNA, 19 nt, Homo sapiens
ucacauguccuggcauauc

SEQ ID NO: 1455500 - RNA, 19 nt, Homo sapiens
agacuuacgcacuuguuug

SEQ ID NO: 1455501 - RNA, 19 nt, Homo sapiens
caagauucccagugaagca

SEQ ID NO: 1455502 - RNA, 19 nt, Homo sapiens
cacggaagcggaagccaaa

SEQ ID NO: 1455503 - RNA, 19 nt, Homo sapiens
ccugcggccucuacaugaa

SEQ ID NO: 1455504 - RNA, 19 nt, Homo sapiens
gaauggccggugauguaug

SEQ ID NO: 1455505 - RNA, 19 nt, Homo sapiens
gccacuaccugugcaaugc

SEQ ID NO: 1455506 - RNA, 19 nt, Homo sapiens
cagacuuacgcacuuguuu

SEQ ID NO: 1455507 - RNA, 19 nt, Homo sapiens
ccaccaccaacuugaauuc

SEQ ID NO: 1455508 - RNA, 19 nt, Homo sapiens
ccaccaccaccaacuugaa

SEQ ID NO: 1455509 - RNA, 19 nt, Homo sapiens
agacagccaccgcggauuc

SEQ ID NO: 1455510 - RNA, 19 nt, Homo sapiens
uaacauugugagccagcua

SEQ ID NO: 1455511 - RNA, 19 nt, Homo sapiens
cuucguguccgacuucuug

SEQ ID NO: 1455512 - RNA, 19 nt, Homo sapiens
ugaauggccggugauguau

SEQ ID NO: 1455513 - RNA, 19 nt, Homo sapiens
gggccuuguucuagcugaa

SEQ ID NO: 1455514 - RNA, 19 nt, Homo sapiens
ggagcuguggugcagagaa

SEQ ID NO: 1455515 - RNA, 19 nt, Homo sapiens
acagucaaccucccagugu

SEQ ID NO: 1455516 - RNA, 19 nt, Homo sapiens
ccaccuucguguccgacuu

SEQ ID NO: 1455517 - RNA, 19 nt, Homo sapiens
cacagggaaagugaaauaa

SEQ ID NO: 1455518 - RNA, 19 nt, Homo sapiens
gcaccaccccauauugaaa

SEQ ID NO: 1455519 - RNA, 19 nt, Homo sapiens
guccuucauugcccacaug

SEQ ID NO: 1455520 - RNA, 19 nt, Homo sapiens
cagaaguccugguccauua

SEQ ID NO: 1455521 - RNA, 19 nt, Homo sapiens
ccaaggcgcuguuguccua

SEQ ID NO: 1455522 - RNA, 19 nt, Homo sapiens
agagugcgguacauaauua

SEQ ID NO: 1455523 - RNA, 19 nt, Homo sapiens
aaucuaaacucucaucuug

SEQ ID NO: 1455524 - RNA, 19 nt, Homo sapiens
ggucauagccuacugucua

SEQ ID NO: 1455525 - RNA, 19 nt, Homo sapiens
gcgacgaccucgacuuuga

SEQ ID NO: 1455526 - RNA, 19 nt, Homo sapiens
gaaccaacgcggaggacua

SEQ ID NO: 1455527 - RNA, 19 nt, Homo sapiens
gaacguagcgcagaucauc

SEQ ID NO: 1455528 - RNA, 19 nt, Homo sapiens
ucaggaaucuaaacucuca

SEQ ID NO: 1455529 - RNA, 19 nt, Homo sapiens
aagcggagauagcgacuuu

SEQ ID NO: 1455530 - RNA, 19 nt, Homo sapiens
guuccuaguuucugauuau

SEQ ID NO: 1455531 - RNA, 19 nt, Homo sapiens
caagagcgcuucccauucc

SEQ ID NO: 1455532 - RNA, 19 nt, Homo sapiens
gaguuccacugcaugauga

SEQ ID NO: 1455533 - RNA, 19 nt, Homo sapiens
ucaaggccguguccaaguu

SEQ ID NO: 1455534 - RNA, 19 nt, Homo sapiens
gggaauauuucacauccau

SEQ ID NO: 1455535 - RNA, 19 nt, Homo sapiens
ucuaaacucucaucuugug

SEQ ID NO: 1455536 - RNA, 19 nt, Homo sapiens
caucucugguuccuaguuu

SEQ ID NO: 1455537 - RNA, 19 nt, Homo sapiens
acucucaucuugugcaauu

SEQ ID NO: 1455538 - RNA, 19 nt, Homo sapiens
gggaggugguggcgaauuc

SEQ ID NO: 1455539 - RNA, 19 nt, Homo sapiens
caauuuaucagguguggaa

SEQ ID NO: 1455540 - RNA, 19 nt, Homo sapiens
gcaagagcgcuucccauuc

SEQ ID NO: 1455541 - RNA, 19 nt, Homo sapiens
gcagaaguccugguccauu

SEQ ID NO: 1455542 - RNA, 19 nt, Homo sapiens
gcucauggccauuuaugug

SEQ ID NO: 1455543 - RNA, 19 nt, Homo sapiens
guggcaaccucauguacaa

SEQ ID NO: 1455544 - RNA, 19 nt, Homo sapiens
uaucagguguggaacuguu

SEQ ID NO: 1455545 - RNA, 19 nt, Homo sapiens
gaaucuaaacucucaucuu

SEQ ID NO: 1455546 - RNA, 19 nt, Homo sapiens
agggagacauccauuauca

SEQ ID NO: 1455547 - RNA, 19 nt, Homo sapiens
caagaugagcggcauguuc

SEQ ID NO: 1455548 - RNA, 19 nt, Homo sapiens
gcaaauaaagaagagacaa

SEQ ID NO: 1455549 - RNA, 19 nt, Homo sapiens
aggccaagcuuuaaacauc

SEQ ID NO: 1455550 - RNA, 19 nt, Homo sapiens
gcacuucgcgcugcucaug

SEQ ID NO: 1455551 - RNA, 19 nt, Homo sapiens
cuacacgucucagaucuuc

SEQ ID NO: 1455552 - RNA, 19 nt, Homo sapiens
gaaggucaaguucuacauc

SEQ ID NO: 1455553 - RNA, 19 nt, Homo sapiens
cgagggagacauccauuau

SEQ ID NO: 1455554 - RNA, 19 nt, Homo sapiens
ggugggcaauuuccuucaa

SEQ ID NO: 1455555 - RNA, 19 nt, Homo sapiens
ucgcaggcguggcaacuug

SEQ ID NO: 1455556 - RNA, 19 nt, Homo sapiens
cagaccugcugccaucuug

SEQ ID NO: 1455557 - RNA, 19 nt, Homo sapiens
ucucaucuugugcaauuua

SEQ ID NO: 1455558 - RNA, 19 nt, Homo sapiens
ggcaauuuccuucaacgaa

SEQ ID NO: 1455559 - RNA, 19 nt, Homo sapiens
gcaucaucguguucagcua

SEQ ID NO: 1455560 - RNA, 19 nt, Homo sapiens
gcuuuaaacaucucugguu

SEQ ID NO: 1455561 - RNA, 19 nt, Homo sapiens
acaucgacgucaagaaguu

SEQ ID NO: 1455562 - RNA, 19 nt, Homo sapiens
gaaaggcugacugggaaau

SEQ ID NO: 1455563 - RNA, 19 nt, Homo sapiens
gguuccuaguuucugauua

SEQ ID NO: 1455564 - RNA, 19 nt, Homo sapiens
ggccaagcuuuaaacaucu

SEQ ID NO: 1455565 - RNA, 19 nt, Homo sapiens
cuacaucgacgucaagaag

SEQ ID NO: 1455566 - RNA, 19 nt, Homo sapiens
ggacucguacguggccaua

SEQ ID NO: 1455567 - RNA, 19 nt, Homo sapiens
gguuguuucucaucaucuu

SEQ ID NO: 1455568 - RNA, 19 nt, Homo sapiens
gugcgguacauaauuauau

SEQ ID NO: 1455569 - RNA, 19 nt, Homo sapiens
caucuugugcaauuuauca

SEQ ID NO: 1455570 - RNA, 19 nt, Homo sapiens
ggaaaggcugacugggaaa

SEQ ID NO: 1455571 - RNA, 19 nt, Homo sapiens
guccagccauuuccagcaa

SEQ ID NO: 1455572 - RNA, 19 nt, Homo sapiens
auccagagcucggaaucua

SEQ ID NO: 1455573 - RNA, 19 nt, Homo sapiens
ccuauccucugccauucuu

SEQ ID NO: 1455574 - RNA, 19 nt, Homo sapiens
ccauuggcaucaucguguu

SEQ ID NO: 1455575 - RNA, 19 nt, Homo sapiens
uagagugcgguacauaauu

SEQ ID NO: 1455576 - RNA, 19 nt, Homo sapiens
guggugugcucguggugaa

SEQ ID NO: 1455577 - RNA, 19 nt, Homo sapiens
cuacagcguccagccauuu

SEQ ID NO: 1455578 - RNA, 19 nt, Homo sapiens
uuucuguuguccuuucuuu

SEQ ID NO: 1455579 - RNA, 19 nt, Homo sapiens
gcccacuucgucaucaaua

SEQ ID NO: 1455580 - RNA, 19 nt, Homo sapiens
ggugugcucguggugaaua

SEQ ID NO: 1455581 - RNA, 19 nt, Homo sapiens
aaacucucaucuugugcaa

SEQ ID NO: 1455582 - RNA, 19 nt, Homo sapiens
gagggagacauccauuauc

SEQ ID NO: 1455583 - RNA, 19 nt, Homo sapiens
gcguuucuguuguccuuuc

SEQ ID NO: 1455584 - RNA, 19 nt, Homo sapiens
ucgagggagacauccauua

SEQ ID NO: 1455585 - RNA, 19 nt, Homo sapiens
cagcuugccugccgguuuu

SEQ ID NO: 1455586 - RNA, 19 nt, Homo sapiens
ccagccauuuccagcaaga

SEQ ID NO: 1455587 - RNA, 19 nt, Homo sapiens
aggaggucaucacggauaa

SEQ ID NO: 1455588 - RNA, 19 nt, Homo sapiens
aaggaggucaucacggaua

SEQ ID NO: 1455589 - RNA, 19 nt, Homo sapiens
ucaauauccuggucauagc

SEQ ID NO: 1455590 - RNA, 19 nt, Homo sapiens
gcgccguggucaacaucuu

SEQ ID NO: 1455591 - RNA, 19 nt, Homo sapiens
cgaguuccacugcaugaug

SEQ ID NO: 1455592 - RNA, 19 nt, Homo sapiens
gaaguccugguccauuauc

SEQ ID NO: 1455593 - RNA, 19 nt, Homo sapiens
gcggagagcaagcggagau

SEQ ID NO: 1455594 - RNA, 19 nt, Homo sapiens
uuucaggaaucuaaacucu

SEQ ID NO: 1455595 - RNA, 19 nt, Homo sapiens
ccagcuugccugccgguuu

SEQ ID NO: 1455596 - RNA, 19 nt, Homo sapiens
ccagcgaguuccacugcau

SEQ ID NO: 1455597 - RNA, 19 nt, Homo sapiens
ccuugcgccuuccuuaaga

SEQ ID NO: 1455598 - RNA, 19 nt, Homo sapiens
ccuaguuucugauuauucg

SEQ ID NO: 1455599 - RNA, 19 nt, Homo sapiens
ggaggccaagcuuuaaaca

SEQ ID NO: 1455600 - RNA, 19 nt, Homo sapiens
ccugggagaaggucaaguu

SEQ ID NO: 1455601 - RNA, 19 nt, Homo sapiens
agcaagagcgcuucccauu

SEQ ID NO: 1455602 - RNA, 19 nt, Homo sapiens
ucugguuccuaguuucuga

SEQ ID NO: 1455603 - RNA, 19 nt, Homo sapiens
uguccuauccucugccauu

SEQ ID NO: 1455604 - RNA, 19 nt, Homo sapiens
gaaguuccccaucuccauu

SEQ ID NO: 1455605 - RNA, 19 nt, Homo sapiens
caucaauauccuggucaua

SEQ ID NO: 1455606 - RNA, 19 nt, Homo sapiens
uaauuuagagugcgguaca

SEQ ID NO: 1455607 - RNA, 19 nt, Homo sapiens
gugugcucguggugaauaa

SEQ ID NO: 1455608 - RNA, 19 nt, Homo sapiens
ccagagcucggaaucuaca

SEQ ID NO: 1455609 - RNA, 19 nt, Homo sapiens
ccacuucgucaucaauauc

SEQ ID NO: 1455610 - RNA, 19 nt, Homo sapiens
gcaaccucauguacaacag

SEQ ID NO: 1455611 - RNA, 19 nt, Homo sapiens
uuuagagugcgguacauaa

SEQ ID NO: 1455612 - RNA, 19 nt, Homo sapiens
cgucugcguuucuguuguc

SEQ ID NO: 1455613 - RNA, 19 nt, Homo sapiens
ggagagcaagcggagauag

SEQ ID NO: 1455614 - RNA, 19 nt, Homo sapiens
uuagagugcgguacauaau

SEQ ID NO: 1455615 - RNA, 19 nt, Homo sapiens
gcuguggcaccaagucuuc

SEQ ID NO: 1455616 - RNA, 19 nt, Homo sapiens
ccucaucgcgugccuguac

SEQ ID NO: 1455617 - RNA, 19 nt, Homo sapiens
cagcuacacgucucagauc

SEQ ID NO: 1455618 - RNA, 19 nt, Homo sapiens
caucuccauuggcaucauc

SEQ ID NO: 1455619 - RNA, 19 nt, Homo sapiens
uugcgacgaccucgacuuu

SEQ ID NO: 1455620 - RNA, 19 nt, Homo sapiens
gaacaugccuguauuaagg

SEQ ID NO: 1455621 - RNA, 19 nt, Homo sapiens
guccagaucuccacucuua

SEQ ID NO: 1455622 - RNA, 19 nt, Homo sapiens
gcagaaagguccuggaauc

SEQ ID NO: 1455623 - RNA, 19 nt, Homo sapiens
caagagaacuacauagaag

SEQ ID NO: 1455624 - RNA, 19 nt, Homo sapiens
gaccggaucuccauucaga

SEQ ID NO: 1455625 - RNA, 19 nt, Homo sapiens
agaagaggcugcagcaauu

SEQ ID NO: 1455626 - RNA, 19 nt, Homo sapiens
ggagaacaugccuguauua

SEQ ID NO: 1455627 - RNA, 19 nt, Homo sapiens
aagaagaaaugcaagauga

SEQ ID NO: 1455628 - RNA, 19 nt, Homo sapiens
gagaauuuauugaccaguu

SEQ ID NO: 1455629 - RNA, 19 nt, Homo sapiens
gcaaagguucagagaauuu

SEQ ID NO: 1455630 - RNA, 19 nt, Homo sapiens
ggugggaauuucugauuaa

SEQ ID NO: 1455631 - RNA, 19 nt, Homo sapiens
ugaaaugcaugcaaagguu

SEQ ID NO: 1455632 - RNA, 19 nt, Homo sapiens
gccaaaaucugguuaauga

SEQ ID NO: 1455633 - RNA, 19 nt, Homo sapiens
gcagcugaaugccaagauu

SEQ ID NO: 1455634 - RNA, 19 nt, Homo sapiens
gaggagaacaugccuguau

SEQ ID NO: 1455635 - RNA, 19 nt, Homo sapiens
ccgacaagauucagaagaa

SEQ ID NO: 1455636 - RNA, 19 nt, Homo sapiens
gaagaauccaagagaacua

SEQ ID NO: 1455637 - RNA, 19 nt, Homo sapiens
gagaacaugccuguauuaa

SEQ ID NO: 1455638 - RNA, 19 nt, Homo sapiens
cccgagaggucauauuuga

SEQ ID NO: 1455639 - RNA, 19 nt, Homo sapiens
ggucauauuugaggauguu

SEQ ID NO: 1455640 - RNA, 19 nt, Homo sapiens
caaagguucagagaauuua

SEQ ID NO: 1455641 - RNA, 19 nt, Homo sapiens
gccaacagccuucauacaa

SEQ ID NO: 1455642 - RNA, 19 nt, Homo sapiens
gaccaugaguauuccauca

SEQ ID NO: 1455643 - RNA, 19 nt, Homo sapiens
ugaacuuccugagcacuua

SEQ ID NO: 1455644 - RNA, 19 nt, Homo sapiens
gaagaugcaugccaaaauc

SEQ ID NO: 1455645 - RNA, 19 nt, Homo sapiens
gaaaagccgaguaguuaua

SEQ ID NO: 1455646 - RNA, 19 nt, Homo sapiens
ccaagagaacuacauagaa

SEQ ID NO: 1455647 - RNA, 19 nt, Homo sapiens
cccaauggcgcaugucuua

SEQ ID NO: 1455648 - RNA, 19 nt, Homo sapiens
caacuucucuuccauuuuc

SEQ ID NO: 1455649 - RNA, 19 nt, Homo sapiens
caagcaaaaugaagacuuu

SEQ ID NO: 1455650 - RNA, 19 nt, Homo sapiens
ccaacagccuucauacaag

SEQ ID NO: 1455651 - RNA, 19 nt, Homo sapiens
caagccaacagccuucaua

SEQ ID NO: 1455652 - RNA, 19 nt, Homo sapiens
aaacccagcgucccuauga

SEQ ID NO: 1455653 - RNA, 19 nt, Homo sapiens
ucaucgacaucuuggagua

SEQ ID NO: 1455654 - RNA, 19 nt, Homo sapiens
gccgaagaauccaagagaa

SEQ ID NO: 1455655 - RNA, 19 nt, Homo sapiens
augcaaagguucagagaau

SEQ ID NO: 1455656 - RNA, 19 nt, Homo sapiens
gcaauugaaaucugagcuu

SEQ ID NO: 1455657 - RNA, 19 nt, Homo sapiens
ccgaguaguuauaccagaa

SEQ ID NO: 1455658 - RNA, 19 nt, Homo sapiens
cgcaacuucucuuccauuu

SEQ ID NO: 1455659 - RNA, 19 nt, Homo sapiens
cuacagaagaugugggaaa

SEQ ID NO: 1455660 - RNA, 19 nt, Homo sapiens
gcgcagaaagguccuggaa

SEQ ID NO: 1455661 - RNA, 19 nt, Homo sapiens
gaaaagaagaaaugcaaga

SEQ ID NO: 1455662 - RNA, 19 nt, Homo sapiens
gaagaggcugcagcaauug

SEQ ID NO: 1455663 - RNA, 19 nt, Homo sapiens
aaaugaagacuuugacuag

SEQ ID NO: 1455664 - RNA, 19 nt, Homo sapiens
gacaagauucagaagaaga

SEQ ID NO: 1455665 - RNA, 19 nt, Homo sapiens
gaccaucaucgacaucuug

SEQ ID NO: 1455666 - RNA, 19 nt, Homo sapiens
aggugggaauuucugauua

SEQ ID NO: 1455667 - RNA, 19 nt, Homo sapiens
aggagaacaugccuguauu

SEQ ID NO: 1455668 - RNA, 19 nt, Homo sapiens
ccagaucuccacucuuaug

SEQ ID NO: 1455669 - RNA, 19 nt, Homo sapiens
gugggaauuucugauuaaa

SEQ ID NO: 1455670 - RNA, 19 nt, Homo sapiens
gagacaaggaaguuggaaa

SEQ ID NO: 1455671 - RNA, 19 nt, Homo sapiens
gaguaguuauaccagaaga

SEQ ID NO: 1455672 - RNA, 19 nt, Homo sapiens
gaaaccaagccaucuacuc

SEQ ID NO: 1455673 - RNA, 19 nt, Homo sapiens
gaauuuauugaccaguuug

SEQ ID NO: 1455674 - RNA, 19 nt, Homo sapiens
cgacaagauucagaagaag

SEQ ID NO: 1455675 - RNA, 19 nt, Homo sapiens
caucgggucucgggacuuc

SEQ ID NO: 1455676 - RNA, 19 nt, Homo sapiens
cuacauagaaggcggaagu

SEQ ID NO: 1455677 - RNA, 19 nt, Homo sapiens
gaggcucuccuacagaaga

SEQ ID NO: 1455678 - RNA, 19 nt, Homo sapiens
ggaaacccagcgucccuau

SEQ ID NO: 1455679 - RNA, 19 nt, Homo sapiens
agaaaugcaagaugagcua

SEQ ID NO: 1455680 - RNA, 19 nt, Homo sapiens
uggaaaagccgaguaguua

SEQ ID NO: 1455681 - RNA, 19 nt, Homo sapiens
aaaccaagccaucuacucu

SEQ ID NO: 1455682 - RNA, 19 nt, Homo sapiens
gccacuacccuucuagaug

SEQ ID NO: 1455683 - RNA, 19 nt, Homo sapiens
ucggugagaugcgcagaaa

SEQ ID NO: 1455684 - RNA, 19 nt, Homo sapiens
aaagaagaaaugcaagaug

SEQ ID NO: 1455685 - RNA, 19 nt, Homo sapiens
caggaaaccaagccaucua

SEQ ID NO: 1455686 - RNA, 19 nt, Homo sapiens
cuggagccuuggaucauuu

SEQ ID NO: 1455687 - RNA, 19 nt, Homo sapiens
ccaugaguauuccaucaag

SEQ ID NO: 1455688 - RNA, 19 nt, Homo sapiens
gaaaugcaagaugagcuau

SEQ ID NO: 1455689 - RNA, 19 nt, Homo sapiens
aagaagaggcugcagcaau

SEQ ID NO: 1455690 - RNA, 19 nt, Homo sapiens
aauccaagagaacuacaua

SEQ ID NO: 1455691 - RNA, 19 nt, Homo sapiens
ccuggagccuuggaucauu

SEQ ID NO: 1455692 - RNA, 19 nt, Homo sapiens
acaagauucagaagaagaa

SEQ ID NO: 1455693 - RNA, 19 nt, Homo sapiens
aguuccagguuccggauua

SEQ ID NO: 1455694 - RNA, 19 nt, Homo sapiens
agccuuggaucauuuacuu

SEQ ID NO: 1455695 - RNA, 19 nt, Homo sapiens
ggaguacucaaacaagaag

SEQ ID NO: 1455696 - RNA, 19 nt, Homo sapiens
caauggcgcaugucuuaca

SEQ ID NO: 1455697 - RNA, 19 nt, Homo sapiens
caggugggaauuucugauu

SEQ ID NO: 1455698 - RNA, 19 nt, Homo sapiens
cucccucccuccuuucuuu

SEQ ID NO: 1455699 - RNA, 19 nt, Homo sapiens
guaguuauaccagaagauc

SEQ ID NO: 1455700 - RNA, 19 nt, Homo sapiens
ggugagaugcgcagaaagg

SEQ ID NO: 1455701 - RNA, 19 nt, Homo sapiens
aguauuccaucaagucugu

SEQ ID NO: 1455702 - RNA, 19 nt, Homo sapiens
ugaaugccaagauugagaa

SEQ ID NO: 1455703 - RNA, 19 nt, Homo sapiens
acacugagacaaggaaguu

SEQ ID NO: 1455704 - RNA, 19 nt, Homo sapiens
aagagccacuacccuucua

SEQ ID NO: 1455705 - RNA, 19 nt, Homo sapiens
ugcaaagguucagagaauu

SEQ ID NO: 1455706 - RNA, 19 nt, Homo sapiens
gcaugcaaagguucagaga

SEQ ID NO: 1455707 - RNA, 19 nt, Homo sapiens
uuccugaaaugcaugcaaa

SEQ ID NO: 1455708 - RNA, 19 nt, Homo sapiens
uacagaagaugugggaaag

SEQ ID NO: 1455709 - RNA, 19 nt, Homo sapiens
gaaacccagcgucccuaug

SEQ ID NO: 1455710 - RNA, 19 nt, Homo sapiens
cagcugaaugccaagauug

SEQ ID NO: 1455711 - RNA, 19 nt, Homo sapiens
guucagagaauuuauugac

SEQ ID NO: 1455712 - RNA, 19 nt, Homo sapiens
ugcagcaauugaaaucuga

SEQ ID NO: 1455713 - RNA, 19 nt, Homo sapiens
uuggaguacucaaacaaga

SEQ ID NO: 1455714 - RNA, 19 nt, Homo sapiens
cgaccaucaucgacaucuu

SEQ ID NO: 1455715 - RNA, 19 nt, Homo sapiens
gcaggaaaccaagccaucu

SEQ ID NO: 1455716 - RNA, 19 nt, Homo sapiens
ggaagaugcaugccaaaau

SEQ ID NO: 1455717 - RNA, 19 nt, Homo sapiens
uccaagagaacuacauaga

SEQ ID NO: 1455718 - RNA, 19 nt, Homo sapiens
uggaugaccucggugagau

SEQ ID NO: 1455719 - RNA, 19 nt, Homo sapiens
ugagaagacccaggaggaa

SEQ ID NO: 1455720 - RNA, 19 nt, Homo sapiens
gagcagaauugcauauuua

SEQ ID NO: 1455721 - RNA, 19 nt, Homo sapiens
gcagcucuguuuagaauca

SEQ ID NO: 1455722 - RNA, 19 nt, Homo sapiens
gagcuacgauuccaucaag

SEQ ID NO: 1455723 - RNA, 19 nt, Homo sapiens
ugagcagaauugcauauuu

SEQ ID NO: 1455724 - RNA, 19 nt, Homo sapiens
ccacggaccucagcaugaa

SEQ ID NO: 1455725 - RNA, 19 nt, Homo sapiens
ugaaagaggugggauccaa

SEQ ID NO: 1455726 - RNA, 19 nt, Homo sapiens
uaccuaacauuccauauca

SEQ ID NO: 1455727 - RNA, 19 nt, Homo sapiens
gaaagaggugggauccaaa

SEQ ID NO: 1455728 - RNA, 19 nt, Homo sapiens
gauaauuaccuuucaaguc

SEQ ID NO: 1455729 - RNA, 19 nt, Homo sapiens
aaacaggaaaccacaguaa

SEQ ID NO: 1455730 - RNA, 19 nt, Homo sapiens
ccaagcaccugagacuuug

SEQ ID NO: 1455731 - RNA, 19 nt, Homo sapiens
gcacugcccuagggaagga

SEQ ID NO: 1455732 - RNA, 19 nt, Homo sapiens
ccagauaauuaccuuucaa

SEQ ID NO: 1455733 - RNA, 19 nt, Homo sapiens
gcaagcgcauccgcacgua

SEQ ID NO: 1455734 - RNA, 19 nt, Homo sapiens
gaugacuccuccucugaga

SEQ ID NO: 1455735 - RNA, 19 nt, Homo sapiens
cuuaaggccuucaacaugu

SEQ ID NO: 1455736 - RNA, 19 nt, Homo sapiens
cugcagcucuguuuagaau

SEQ ID NO: 1455737 - RNA, 19 nt, Homo sapiens
ugacgacgaugaccacgau

SEQ ID NO: 1455738 - RNA, 19 nt, Homo sapiens
ugaggacaaugacaagaug

SEQ ID NO: 1455739 - RNA, 19 nt, Homo sapiens
ccauagcccuggacaagca

SEQ ID NO: 1455740 - RNA, 19 nt, Homo sapiens
gaagaacggcauggagaug

SEQ ID NO: 1455741 - RNA, 19 nt, Homo sapiens
caagaugaacgacucugaa

SEQ ID NO: 1455742 - RNA, 19 nt, Homo sapiens
cgcagaaccuccacaguca

SEQ ID NO: 1455743 - RNA, 19 nt, Homo sapiens
ggacccugauguuagaauc

SEQ ID NO: 1455744 - RNA, 19 nt, Homo sapiens
gcggaugcgucuagagauc

SEQ ID NO: 1455745 - RNA, 19 nt, Homo sapiens
caaacaggaaaccacagua

SEQ ID NO: 1455746 - RNA, 19 nt, Homo sapiens
cguggacccugauguuaga

SEQ ID NO: 1455747 - RNA, 19 nt, Homo sapiens
gauaugagcgacuccacau

SEQ ID NO: 1455748 - RNA, 19 nt, Homo sapiens
acaggaaaccacaguaaug

SEQ ID NO: 1455749 - RNA, 19 nt, Homo sapiens
cagaugaugacgacgauga

SEQ ID NO: 1455750 - RNA, 19 nt, Homo sapiens
uaacauuccauaucacuac

SEQ ID NO: 1455751 - RNA, 19 nt, Homo sapiens
uccaagcaccugagacuuu

SEQ ID NO: 1455752 - RNA, 19 nt, Homo sapiens
uuaaggccuucaacauguu

SEQ ID NO: 1455753 - RNA, 19 nt, Homo sapiens
gaggagauccaggccauca

SEQ ID NO: 1455754 - RNA, 19 nt, Homo sapiens
ugugagagcgagacaagaa

SEQ ID NO: 1455755 - RNA, 19 nt, Homo sapiens
ggagauccaggccaucauc

SEQ ID NO: 1455756 - RNA, 19 nt, Homo sapiens
gagaguggcagcggcaaug

SEQ ID NO: 1455757 - RNA, 19 nt, Homo sapiens
agucuuaggugagcagaau

SEQ ID NO: 1455758 - RNA, 19 nt, Homo sapiens
cuuccugccucaccaguug

SEQ ID NO: 1455759 - RNA, 19 nt, Homo sapiens
gcccauagcccuggacaag

SEQ ID NO: 1455760 - RNA, 19 nt, Homo sapiens
ccaagcggaugcgucuaga

SEQ ID NO: 1455761 - RNA, 19 nt, Homo sapiens
gccgucgcaugaagaagaa

SEQ ID NO: 1455762 - RNA, 19 nt, Homo sapiens
ccaucaaccugugugacaa

SEQ ID NO: 1455763 - RNA, 19 nt, Homo sapiens
ggcugcagcucuguuuaga

SEQ ID NO: 1455764 - RNA, 19 nt, Homo sapiens
ugaccacgaugaccaugag

SEQ ID NO: 1455765 - RNA, 19 nt, Homo sapiens
ggagcuacgauuccaucaa

SEQ ID NO: 1455766 - RNA, 19 nt, Homo sapiens
gaaccuccacagucaagag

SEQ ID NO: 1455767 - RNA, 19 nt, Homo sapiens
gcagaaccuccacagucaa

SEQ ID NO: 1455768 - RNA, 19 nt, Homo sapiens
cagcgaggauuuugauaug

SEQ ID NO: 1455769 - RNA, 19 nt, Homo sapiens
ggcagaugaugacgacgau

SEQ ID NO: 1455770 - RNA, 19 nt, Homo sapiens
caggaugagacuucuguga

SEQ ID NO: 1455771 - RNA, 19 nt, Homo sapiens
gccggcaguucccugaguu

SEQ ID NO: 1455772 - RNA, 19 nt, Homo sapiens
gaggacaaugacaagauga

SEQ ID NO: 1455773 - RNA, 19 nt, Homo sapiens
uuccauaucacuacacuga

SEQ ID NO: 1455774 - RNA, 19 nt, Homo sapiens
ccauaccuaacauuccaua

SEQ ID NO: 1455775 - RNA, 19 nt, Homo sapiens
cgggugcucugaccugcuu

SEQ ID NO: 1455776 - RNA, 19 nt, Homo sapiens
ccaaacaggaaaccacagu

SEQ ID NO: 1455777 - RNA, 19 nt, Homo sapiens
ucuuaaggccuucaacaug

SEQ ID NO: 1455778 - RNA, 19 nt, Homo sapiens
acaaugacaagaugaacga

SEQ ID NO: 1455779 - RNA, 19 nt, Homo sapiens
gucugugucugucugauca

SEQ ID NO: 1455780 - RNA, 19 nt, Homo sapiens
gggcugcagcucuguuuag

SEQ ID NO: 1455781 - RNA, 19 nt, Homo sapiens
acaagaugaacgacucuga

SEQ ID NO: 1455782 - RNA, 19 nt, Homo sapiens
caggaaaccacaguaaugg

SEQ ID NO: 1455783 - RNA, 19 nt, Homo sapiens
aagcggaugcgucuagaga

SEQ ID NO: 1455784 - RNA, 19 nt, Homo sapiens
ggugagcagaauugcauau

SEQ ID NO: 1455785 - RNA, 19 nt, Homo sapiens
gugagagcgagacaagaaa

SEQ ID NO: 1455786 - RNA, 19 nt, Homo sapiens
gugagcagaauugcauauu

SEQ ID NO: 1455787 - RNA, 19 nt, Homo sapiens
cccagauaauuaccuuuca

SEQ ID NO: 1455788 - RNA, 19 nt, Homo sapiens
gcagcgaggauuuugauau

SEQ ID NO: 1455789 - RNA, 19 nt, Homo sapiens
gccaagcggaugcgucuag

SEQ ID NO: 1455790 - RNA, 19 nt, Homo sapiens
ugaagaagaacggcaugga

SEQ ID NO: 1455791 - RNA, 19 nt, Homo sapiens
uaaggccuucaacauguuu

SEQ ID NO: 1455792 - RNA, 19 nt, Homo sapiens
cgaugaccaugaggacaau

SEQ ID NO: 1455793 - RNA, 19 nt, Homo sapiens
ggagaaagguaauuugguu

SEQ ID NO: 1455794 - RNA, 19 nt, Homo sapiens
ggauauggauucuaaggau

SEQ ID NO: 1455795 - RNA, 19 nt, Homo sapiens
cagauaauaccuaugcuua

SEQ ID NO: 1455796 - RNA, 19 nt, Homo sapiens
ggguggauauggauucuaa

SEQ ID NO: 1455797 - RNA, 19 nt, Homo sapiens
gagccaaacuauccagguu

SEQ ID NO: 1455798 - RNA, 19 nt, Homo sapiens
acaagacgcgcaucauuua

SEQ ID NO: 1455799 - RNA, 19 nt, Homo sapiens
caacaagacgcgcaucauu

SEQ ID NO: 1455800 - RNA, 19 nt, Homo sapiens
gauauggauucuaaggauu

SEQ ID NO: 1455801 - RNA, 19 nt, Homo sapiens
gccaaacuauccagguuaa

SEQ ID NO: 1455802 - RNA, 19 nt, Homo sapiens
uagccugucugaaccaaua

SEQ ID NO: 1455803 - RNA, 19 nt, Homo sapiens
ggauucaauuucuccauga

SEQ ID NO: 1455804 - RNA, 19 nt, Homo sapiens
ggauugaugucuuuuauug

SEQ ID NO: 1455805 - RNA, 19 nt, Homo sapiens
gaaagguaauuugguugga

SEQ ID NO: 1455806 - RNA, 19 nt, Homo sapiens
ggaauuuacaguuucaguu

SEQ ID NO: 1455807 - RNA, 19 nt, Homo sapiens
cuaagcagauaauaccuau

SEQ ID NO: 1455808 - RNA, 19 nt, Homo sapiens
guuggaggcuggcaguauu

SEQ ID NO: 1455809 - RNA, 19 nt, Homo sapiens
cgaaugguguccugcucua

SEQ ID NO: 1455810 - RNA, 19 nt, Homo sapiens
gugugugucuguuucagua

SEQ ID NO: 1455811 - RNA, 19 nt, Homo sapiens
gauaaagaggauaagguuu

SEQ ID NO: 1455812 - RNA, 19 nt, Homo sapiens
ccaguaauaucugccuuug

SEQ ID NO: 1455813 - RNA, 19 nt, Homo sapiens
gcgcaucauuuacuucgau

SEQ ID NO: 1455814 - RNA, 19 nt, Homo sapiens
ucauuggauugaugucuuu

SEQ ID NO: 1455815 - RNA, 19 nt, Homo sapiens
gcagauaauaccuaugcuu

SEQ ID NO: 1455816 - RNA, 19 nt, Homo sapiens
ccuauaggauucaauuucu

SEQ ID NO: 1455817 - RNA, 19 nt, Homo sapiens
ucucauggguggauaugga

SEQ ID NO: 1455818 - RNA, 19 nt, Homo sapiens
caaagauguuacucgugaa

SEQ ID NO: 1455819 - RNA, 19 nt, Homo sapiens
gugugucuguuucaguaua

SEQ ID NO: 1455820 - RNA, 19 nt, Homo sapiens
cuaccuagauaaagaggau

SEQ ID NO: 1455821 - RNA, 19 nt, Homo sapiens
aacaagacgcgcaucauuu

SEQ ID NO: 1455822 - RNA, 19 nt, Homo sapiens
ggacucuaagcagauaaua

SEQ ID NO: 1455823 - RNA, 19 nt, Homo sapiens
agacgcgcaucauuuacuu

SEQ ID NO: 1455824 - RNA, 19 nt, Homo sapiens
agauaaagaggauaagguu

SEQ ID NO: 1455825 - RNA, 19 nt, Homo sapiens
cacauuggagucugucuuu

SEQ ID NO: 1455826 - RNA, 19 nt, Homo sapiens
uggugaauguggguaauuu

SEQ ID NO: 1455827 - RNA, 19 nt, Homo sapiens
auuggagucugucuuugua

SEQ ID NO: 1455828 - RNA, 19 nt, Homo sapiens
gauucaauuucuccaugau

SEQ ID NO: 1455829 - RNA, 19 nt, Homo sapiens
ucauuuacuucgaucagau

SEQ ID NO: 1455830 - RNA, 19 nt, Homo sapiens
aaacuauccagguuaacuu

SEQ ID NO: 1455831 - RNA, 19 nt, Homo sapiens
uaaggauucuagccugucu

SEQ ID NO: 1455832 - RNA, 19 nt, Homo sapiens
acagauuauuugugugugu

SEQ ID NO: 1455833 - RNA, 19 nt, Homo sapiens
gauucuagccugucugaac

SEQ ID NO: 1455834 - RNA, 19 nt, Homo sapiens
gauguuaaauggaaaacca

SEQ ID NO: 1455835 - RNA, 19 nt, Homo sapiens
ucacgugauuaaagucuac

SEQ ID NO: 1455836 - RNA, 19 nt, Homo sapiens
gcaacaagacgcgcaucau

SEQ ID NO: 1455837 - RNA, 19 nt, Homo sapiens
uauccagguuaacuugaug

SEQ ID NO: 1455838 - RNA, 19 nt, Homo sapiens
caaacuauccagguuaacu

SEQ ID NO: 1455839 - RNA, 19 nt, Homo sapiens
ucuaagcagauaauaccua

SEQ ID NO: 1455840 - RNA, 19 nt, Homo sapiens
uucaauuucuccaugaugu

SEQ ID NO: 1455841 - RNA, 19 nt, Homo sapiens
gcaccaagaaaaggaauuu

SEQ ID NO: 1455842 - RNA, 19 nt, Homo sapiens
gugaagcugccacgaaugg

SEQ ID NO: 1455843 - RNA, 19 nt, Homo sapiens
cuccugaguuauuggaaga

SEQ ID NO: 1455844 - RNA, 19 nt, Homo sapiens
cuauccagguuaacuugau

SEQ ID NO: 1455845 - RNA, 19 nt, Homo sapiens
caauuucuccaugauguuc

SEQ ID NO: 1455846 - RNA, 19 nt, Homo sapiens
aaacuggagaaagguaauu

SEQ ID NO: 1455847 - RNA, 19 nt, Homo sapiens
uagauaaagaggauaaggu

SEQ ID NO: 1455848 - RNA, 19 nt, Homo sapiens
gagaaacccuuuaaauguu

SEQ ID NO: 1455849 - RNA, 19 nt, Homo sapiens
ugaaagaagugacgaaauu

SEQ ID NO: 1455850 - RNA, 19 nt, Homo sapiens
gauaagcccuaaauucaaa

SEQ ID NO: 1455851 - RNA, 19 nt, Homo sapiens
ggaaauaccacgaugcaaa

SEQ ID NO: 1455852 - RNA, 19 nt, Homo sapiens
ggaagaagaacaagaaaga

SEQ ID NO: 1455853 - RNA, 19 nt, Homo sapiens
gaaauuguucucacaguuu

SEQ ID NO: 1455854 - RNA, 19 nt, Homo sapiens
gguaacaccucaaaccuau

SEQ ID NO: 1455855 - RNA, 19 nt, Homo sapiens
gagguagugucuagaauug

SEQ ID NO: 1455856 - RNA, 19 nt, Homo sapiens
gugcaaugguuucuuaauu

SEQ ID NO: 1455857 - RNA, 19 nt, Homo sapiens
gaaacaaugucaggagaug

SEQ ID NO: 1455858 - RNA, 19 nt, Homo sapiens
aaagaaacauugcagguau

SEQ ID NO: 1455859 - RNA, 19 nt, Homo sapiens
gcgaaaauguccccaaaua

SEQ ID NO: 1455860 - RNA, 19 nt, Homo sapiens
gcaggaagagcauuauauu

SEQ ID NO: 1455861 - RNA, 19 nt, Homo sapiens
ggauuaaccugcacagaca

SEQ ID NO: 1455862 - RNA, 19 nt, Homo sapiens
cacaggcgcuauaaacaua

SEQ ID NO: 1455863 - RNA, 19 nt, Homo sapiens
cagaaucccuauacaaugu

SEQ ID NO: 1455864 - RNA, 19 nt, Homo sapiens
gaaccaggcccuacaagug

SEQ ID NO: 1455865 - RNA, 19 nt, Homo sapiens
ggaaagggaagaagaacaa

SEQ ID NO: 1455866 - RNA, 19 nt, Homo sapiens
ugagaaacccuuuaaaugu

SEQ ID NO: 1455867 - RNA, 19 nt, Homo sapiens
gcuauaaacauacucauga

SEQ ID NO: 1455868 - RNA, 19 nt, Homo sapiens
ucaaaccuauggauucauu

SEQ ID NO: 1455869 - RNA, 19 nt, Homo sapiens
gaauuguucuccuguuugu

SEQ ID NO: 1455870 - RNA, 19 nt, Homo sapiens
gcacagacauucggagaag

SEQ ID NO: 1455871 - RNA, 19 nt, Homo sapiens
gaaauaccacgaugcaaau

SEQ ID NO: 1455872 - RNA, 19 nt, Homo sapiens
gacaauggaugacacaagu

SEQ ID NO: 1455873 - RNA, 19 nt, Homo sapiens
caaagaaacauugcaggua

SEQ ID NO: 1455874 - RNA, 19 nt, Homo sapiens
guuauuggcugaaagaaca

SEQ ID NO: 1455875 - RNA, 19 nt, Homo sapiens
guuuguagcuggauauuuc

SEQ ID NO: 1455876 - RNA, 19 nt, Homo sapiens
gguagugucuagaauuguu

SEQ ID NO: 1455877 - RNA, 19 nt, Homo sapiens
cgaaauuguucucacaguu

SEQ ID NO: 1455878 - RNA, 19 nt, Homo sapiens
gaacaagaggaucaaccua

SEQ ID NO: 1455879 - RNA, 19 nt, Homo sapiens
gaaagaagugacgaaauug

SEQ ID NO: 1455880 - RNA, 19 nt, Homo sapiens
ugacugaauuugugcaaug

SEQ ID NO: 1455881 - RNA, 19 nt, Homo sapiens
ggaagagcauuauauucuc

SEQ ID NO: 1455882 - RNA, 19 nt, Homo sapiens
aaauugcccugguuacauu

SEQ ID NO: 1455883 - RNA, 19 nt, Homo sapiens
gcaaauguguaccuguaag

SEQ ID NO: 1455884 - RNA, 19 nt, Homo sapiens
gcuguaguaugccaucauu

SEQ ID NO: 1455885 - RNA, 19 nt, Homo sapiens
ccacaaagggucagaagga

SEQ ID NO: 1455886 - RNA, 19 nt, Homo sapiens
guucaccucuucuagaaug

SEQ ID NO: 1455887 - RNA, 19 nt, Homo sapiens
gagaagaaccaguuauugg

SEQ ID NO: 1455888 - RNA, 19 nt, Homo sapiens
ggagaagaaccaguuauug

SEQ ID NO: 1455889 - RNA, 19 nt, Homo sapiens
gugagaagccuuacgaaug

SEQ ID NO: 1455890 - RNA, 19 nt, Homo sapiens
cagcagagauaccuacaag

SEQ ID NO: 1455891 - RNA, 19 nt, Homo sapiens
gcuguggaguugcaggaua

SEQ ID NO: 1455892 - RNA, 19 nt, Homo sapiens
gcaauucaccaagaucaaa

SEQ ID NO: 1455893 - RNA, 19 nt, Homo sapiens
ggaagcagaccauccugaa

SEQ ID NO: 1455894 - RNA, 19 nt, Homo sapiens
caaauuucaucccgacugu

SEQ ID NO: 1455895 - RNA, 19 nt, Homo sapiens
ccagaaaacucauaagaau

SEQ ID NO: 1455896 - RNA, 19 nt, Homo sapiens
ugaucaagcucgaggaaga

SEQ ID NO: 1455897 - RNA, 19 nt, Homo sapiens
agucaaagcuggacauuuu

SEQ ID NO: 1455898 - RNA, 19 nt, Homo sapiens
ucaacacgauggauaagug

SEQ ID NO: 1455899 - RNA, 19 nt, Homo sapiens
ucaacacgauggauaagug

SEQ ID NO: 1455900 - RNA, 19 nt, Homo sapiens
ugagaucucuguccuuucu

SEQ ID NO: 1455901 - RNA, 19 nt, Homo sapiens
aggcaaauguguaccugua

SEQ ID NO: 1455902 - RNA, 19 nt, Homo sapiens
guucugcugucuuccauga

SEQ ID NO: 1455903 - RNA, 19 nt, Homo sapiens
ugagaagccuuacgaaugc

SEQ ID NO: 1455904 - RNA, 19 nt, Homo sapiens
gcaggagaagaaccaguua

SEQ ID NO: 1455905 - RNA, 19 nt, Homo sapiens
gcagagcccacaagccaaa

SEQ ID NO: 1455906 - RNA, 19 nt, Homo sapiens
agagugagaagaaacauaa

SEQ ID NO: 1455907 - RNA, 19 nt, Homo sapiens
gaaauugcccugguuacau

SEQ ID NO: 1455908 - RNA, 19 nt, Homo sapiens
ucaaagaggaaguggauga

SEQ ID NO: 1455909 - RNA, 19 nt, Homo sapiens
gaagaacaagaaagaggaa

SEQ ID NO: 1455910 - RNA, 19 nt, Homo sapiens
cuucuagaaugucaaguuu

SEQ ID NO: 1455911 - RNA, 19 nt, Homo sapiens
uggauucauucacuugaua

SEQ ID NO: 1455912 - RNA, 19 nt, Homo sapiens
caugagaaacccuuuaaau

SEQ ID NO: 1455913 - RNA, 19 nt, Homo sapiens
ugacgaaauuguucucaca

SEQ ID NO: 1455914 - RNA, 19 nt, Homo sapiens
cagugaagacaguaaguua

SEQ ID NO: 1455915 - RNA, 19 nt, Homo sapiens
caauggaugacacaaguuu

SEQ ID NO: 1455916 - RNA, 19 nt, Homo sapiens
caucccgacuguuuacaaa

SEQ ID NO: 1455917 - RNA, 19 nt, Homo sapiens
cagauaaggcaaaugugua

SEQ ID NO: 1455918 - RNA, 19 nt, Homo sapiens
guaugaaauugcccugguu

SEQ ID NO: 1455919 - RNA, 19 nt, Homo sapiens
ggauucggguugcguguuc

SEQ ID NO: 1455920 - RNA, 19 nt, Homo sapiens
ggaggcaaguaaauugaag

SEQ ID NO: 1455921 - RNA, 19 nt, Homo sapiens
caaauucaaauguggaaga

SEQ ID NO: 1455922 - RNA, 19 nt, Homo sapiens
ucucacaguuucaaauuca

SEQ ID NO: 1455923 - RNA, 19 nt, Homo sapiens
uuugugcaaugguuucuua

SEQ ID NO: 1455924 - RNA, 19 nt, Homo sapiens
ucaccaagaucaaagaacu

SEQ ID NO: 1455925 - RNA, 19 nt, Homo sapiens
gaaucccuauacaauguga

SEQ ID NO: 1455926 - RNA, 19 nt, Homo sapiens
gcccagugauuagugagua

SEQ ID NO: 1455927 - RNA, 19 nt, Homo sapiens
ugaacgcuaugcccucauu

SEQ ID NO: 1455928 - RNA, 19 nt, Homo sapiens
gaugaaagaagugacgaaa

SEQ ID NO: 1455929 - RNA, 19 nt, Homo sapiens
gagcauacagcagcaagaa

SEQ ID NO: 1455930 - RNA, 19 nt, Homo sapiens
gaaacuacuggacugauca

SEQ ID NO: 1455931 - RNA, 19 nt, Homo sapiens
cgcaagagauggagguguu

SEQ ID NO: 1455932 - RNA, 19 nt, Homo sapiens
ccucaaaccuauggauuca

SEQ ID NO: 1455933 - RNA, 19 nt, Homo sapiens
agagucagguugcauguuc

SEQ ID NO: 1455934 - RNA, 19 nt, Homo sapiens
ucaccugccuuucuugcaa

SEQ ID NO: 1455935 - RNA, 19 nt, Homo sapiens
cuacuguucugcugucuuc

SEQ ID NO: 1455936 - RNA, 19 nt, Homo sapiens
gucaggagaugaaagaagu

SEQ ID NO: 1455937 - RNA, 19 nt, Homo sapiens
agauggagguguugcaguu

SEQ ID NO: 1455938 - RNA, 19 nt, Homo sapiens
uaaauucugugggcuguag

SEQ ID NO: 1455939 - RNA, 19 nt, Homo sapiens
cugguuacauuccauuauu

SEQ ID NO: 1455940 - RNA, 19 nt, Homo sapiens
gaaagaggaagcagaccau

SEQ ID NO: 1455941 - RNA, 19 nt, Homo sapiens
gcagagauaccuacaagcu

SEQ ID NO: 1455942 - RNA, 19 nt, Homo sapiens
aaacugaguaggaaaugaa

SEQ ID NO: 1455943 - RNA, 19 nt, Homo sapiens
acugagaucucuguccuuu

SEQ ID NO: 1455944 - RNA, 19 nt, Homo sapiens
gagcaauucaccaagauca

SEQ ID NO: 1455945 - RNA, 19 nt, Homo sapiens
ccauuaguauccagcaaga

SEQ ID NO: 1455946 - RNA, 19 nt, Homo sapiens
ggugugaaaugcuccucaa

SEQ ID NO: 1455947 - RNA, 19 nt, Homo sapiens
gagcugaaaugccgcuacu

SEQ ID NO: 1455948 - RNA, 19 nt, Homo sapiens
gaaccaaacugaucuaaag

SEQ ID NO: 1455949 - RNA, 19 nt, Homo sapiens
gagcaaggauucuggcuuu

SEQ ID NO: 1455950 - RNA, 19 nt, Homo sapiens
ucacaacucucuuacauag

SEQ ID NO: 1455951 - RNA, 19 nt, Homo sapiens
uaacugagcuccgggaaga

SEQ ID NO: 1455952 - RNA, 19 nt, Homo sapiens
gaaacuuuaucccuacuuc

SEQ ID NO: 1455953 - RNA, 19 nt, Homo sapiens
ucaaagacaucacaacucu

SEQ ID NO: 1455954 - RNA, 19 nt, Homo sapiens
caucacaacucucuuacau

SEQ ID NO: 1455955 - RNA, 19 nt, Homo sapiens
ggauuugccuucuuucagu

SEQ ID NO: 1455956 - RNA, 19 nt, Homo sapiens
uaaaacagcucacccaaau

SEQ ID NO: 1455957 - RNA, 19 nt, Homo sapiens
acaaagguccuauccagua

SEQ ID NO: 1455958 - RNA, 19 nt, Homo sapiens
aagggcagcuguccucuaa

SEQ ID NO: 1455959 - RNA, 19 nt, Homo sapiens
ggaaguagaaguagcaaag

SEQ ID NO: 1455960 - RNA, 19 nt, Homo sapiens
gcaaccagagagcuuauuu

SEQ ID NO: 1455961 - RNA, 19 nt, Homo sapiens
ucuaaaggcucuggauuug

SEQ ID NO: 1455962 - RNA, 19 nt, Homo sapiens
agacaucacaacucucuua

SEQ ID NO: 1455963 - RNA, 19 nt, Homo sapiens
gcugagcucugauucaagu

SEQ ID NO: 1455964 - RNA, 19 nt, Homo sapiens
gcaaagacggaacaacaga

SEQ ID NO: 1455965 - RNA, 19 nt, Homo sapiens
ugaggaacaugcagaagga

SEQ ID NO: 1455966 - RNA, 19 nt, Homo sapiens
aaaccaugacucacauuua

SEQ ID NO: 1455967 - RNA, 19 nt, Homo sapiens
acagaacuccuucgacuuu

SEQ ID NO: 1455968 - RNA, 19 nt, Homo sapiens
gauaaugccugaugauccu

SEQ ID NO: 1455969 - RNA, 19 nt, Homo sapiens
guaacacuuucauggagaa

SEQ ID NO: 1455970 - RNA, 19 nt, Homo sapiens
ugacucacauuuacaccuu

SEQ ID NO: 1455971 - RNA, 19 nt, Homo sapiens
ggaaccaaacugaucuaaa

SEQ ID NO: 1455972 - RNA, 19 nt, Homo sapiens
gaagauaaugccugaugau

SEQ ID NO: 1455973 - RNA, 19 nt, Homo sapiens
gaucuaaaggcucuggauu

SEQ ID NO: 1455974 - RNA, 19 nt, Homo sapiens
ccaggccugucuccacuaa

SEQ ID NO: 1455975 - RNA, 19 nt, Homo sapiens
aaagaaccauugcacaucu

SEQ ID NO: 1455976 - RNA, 19 nt, Homo sapiens
agaagauaaugccugauga

SEQ ID NO: 1455977 - RNA, 19 nt, Homo sapiens
caaaucuggugcucuccaa

SEQ ID NO: 1455978 - RNA, 19 nt, Homo sapiens
cacuaacucuggacccuaa

SEQ ID NO: 1455979 - RNA, 19 nt, Homo sapiens
caaggauucuggcuuuuaa

SEQ ID NO: 1455980 - RNA, 19 nt, Homo sapiens
caacuggagacaacucuga

SEQ ID NO: 1455981 - RNA, 19 nt, Homo sapiens
gggcauauaccuggauuau

SEQ ID NO: 1455982 - RNA, 19 nt, Homo sapiens
gaagggcagcuguccucua

SEQ ID NO: 1455983 - RNA, 19 nt, Homo sapiens
gaaguagaaguagcaaaga

SEQ ID NO: 1455984 - RNA, 19 nt, Homo sapiens
caaagguccuauccaguac

SEQ ID NO: 1455985 - RNA, 19 nt, Homo sapiens
ugaaugaggagauggaguu

SEQ ID NO: 1455986 - RNA, 19 nt, Homo sapiens
gagagaauaaagaaccauu

SEQ ID NO: 1455987 - RNA, 19 nt, Homo sapiens
ucgacaaggugggcauaua

SEQ ID NO: 1455988 - RNA, 19 nt, Homo sapiens
gggcagcuguccucuaacu

SEQ ID NO: 1455989 - RNA, 19 nt, Homo sapiens
ugucagagaauccaucauu

SEQ ID NO: 1455990 - RNA, 19 nt, Homo sapiens
ggaggagcuugccauccaa

SEQ ID NO: 1455991 - RNA, 19 nt, Homo sapiens
cgucuggcauggugacauu

SEQ ID NO: 1455992 - RNA, 19 nt, Homo sapiens
guagaaguagcaaagaaga

SEQ ID NO: 1455993 - RNA, 19 nt, Homo sapiens
gaacuuuucuuucuuccau

SEQ ID NO: 1455994 - RNA, 19 nt, Homo sapiens
ucaggagcaaugucucuua

SEQ ID NO: 1455995 - RNA, 19 nt, Homo sapiens
aaguagaaguagcaaagaa

SEQ ID NO: 1455996 - RNA, 19 nt, Homo sapiens
ugacucaaguguggcugua

SEQ ID NO: 1455997 - RNA, 19 nt, Homo sapiens
aaacagcucacccaaaucu

SEQ ID NO: 1455998 - RNA, 19 nt, Homo sapiens
caaagacggaacaacagaa

SEQ ID NO: 1455999 - RNA, 19 nt, Homo sapiens
uaaugaugguggagagaau

SEQ ID NO: 1456000 - RNA, 19 nt, Homo sapiens
auaccuggauuaugaagga

SEQ ID NO: 1456001 - RNA, 19 nt, Homo sapiens
aaccaugacucacauuuac

SEQ ID NO: 1456002 - RNA, 19 nt, Homo sapiens
gcucuggauuugccuucuu

SEQ ID NO: 1456003 - RNA, 19 nt, Homo sapiens
cugcugagcucugauucaa

SEQ ID NO: 1456004 - RNA, 19 nt, Homo sapiens
caggagcaaugucucuuag

SEQ ID NO: 1456005 - RNA, 19 nt, Homo sapiens
augaggagauggaguugaa

SEQ ID NO: 1456006 - RNA, 19 nt, Homo sapiens
uucuaaagcugcaucaguu

SEQ ID NO: 1456007 - RNA, 19 nt, Homo sapiens
caagcuacaucugcagcaa

SEQ ID NO: 1456008 - RNA, 19 nt, Homo sapiens
uaaagaaccauugcacauc

SEQ ID NO: 1456009 - RNA, 19 nt, Homo sapiens
gcaaggauucuggcuuuua

SEQ ID NO: 1456010 - RNA, 19 nt, Homo sapiens
cuaaggaaccaaacugauc

SEQ ID NO: 1456011 - RNA, 19 nt, Homo sapiens
gacuaaggaaccaaacuga

SEQ ID NO: 1456012 - RNA, 19 nt, Homo sapiens
gcccauuccuugaaaacua

SEQ ID NO: 1456013 - RNA, 19 nt, Homo sapiens
gaaguagcaaagaagacaa

SEQ ID NO: 1456014 - RNA, 19 nt, Homo sapiens
uacaugguauggagggaaa

SEQ ID NO: 1456015 - RNA, 19 nt, Homo sapiens
ucaguaacacuuucaugga

SEQ ID NO: 1456016 - RNA, 19 nt, Homo sapiens
ccauggaguuucuaaagcu

SEQ ID NO: 1456017 - RNA, 19 nt, Homo sapiens
gagaauaaagaaccauugc

SEQ ID NO: 1456018 - RNA, 19 nt, Homo sapiens
gcaaagaagacaaaaugga

SEQ ID NO: 1456019 - RNA, 19 nt, Homo sapiens
acaacucucuuacauagcu

SEQ ID NO: 1456020 - RNA, 19 nt, Homo sapiens
gagaaacuuuaucccuacu

SEQ ID NO: 1456021 - RNA, 19 nt, Homo sapiens
cgacaaggugggcauauac

SEQ ID NO: 1456022 - RNA, 19 nt, Homo sapiens
gaaaugcaggacacucucu

SEQ ID NO: 1456023 - RNA, 19 nt, Homo sapiens
caguuggaguugucagaga

SEQ ID NO: 1456024 - RNA, 19 nt, Homo sapiens
cugaugauccugagagguu

SEQ ID NO: 1456025 - RNA, 19 nt, Homo sapiens
aagaagauaaugccugaug

SEQ ID NO: 1456026 - RNA, 19 nt, Homo sapiens
ggugacauuaagaagauaa

SEQ ID NO: 1456027 - RNA, 19 nt, Homo sapiens
cauccacaguaaugaguca

SEQ ID NO: 1456028 - RNA, 19 nt, Homo sapiens
ugacuaacaaccucgacaa

SEQ ID NO: 1456029 - RNA, 19 nt, Homo sapiens
gucugacacugacuaacaa

SEQ ID NO: 1456030 - RNA, 19 nt, Homo sapiens
cauggugacauuaagaaga

SEQ ID NO: 1456031 - RNA, 19 nt, Homo sapiens
caaccagagagcuuauuuc

SEQ ID NO: 1456032 - RNA, 19 nt, Homo sapiens
aaagacaucacaacucucu

SEQ ID NO: 1456033 - RNA, 19 nt, Homo sapiens
agaaccauugcacaucuua

SEQ ID NO: 1456034 - RNA, 19 nt, Homo sapiens
gaaagugguacugggaagu

SEQ ID NO: 1456035 - RNA, 19 nt, Homo sapiens
aggaggagcuugccaucca

SEQ ID NO: 1456036 - RNA, 19 nt, Homo sapiens
gaggagauggaguugaauc

SEQ ID NO: 1456037 - RNA, 19 nt, Homo sapiens
ucagaguguuauuaaagag

SEQ ID NO: 1456038 - RNA, 19 nt, Homo sapiens
gcagaaggaagcuauugcu

SEQ ID NO: 1456039 - RNA, 19 nt, Homo sapiens
uaaggaaccaaacugaucu

SEQ ID NO: 1456040 - RNA, 19 nt, Homo sapiens
ugaugauccugagagguuu

SEQ ID NO: 1456041 - RNA, 19 nt, Homo sapiens
gggaaaugcaggacacucu

SEQ ID NO: 1456042 - RNA, 19 nt, Homo sapiens
gaaugaggagauggaguug

SEQ ID NO: 1456043 - RNA, 19 nt, Homo sapiens
ggcauggugacauuaagaa

SEQ ID NO: 1456044 - RNA, 19 nt, Homo sapiens
aggcaaagacggaacaaca

SEQ ID NO: 1456045 - RNA, 19 nt, Homo sapiens
gauauguuggugagcauuc

SEQ ID NO: 1456046 - RNA, 19 nt, Homo sapiens
auaaagaaccauugcacau

SEQ ID NO: 1456047 - RNA, 19 nt, Homo sapiens
gaugguggagagaauaaag

SEQ ID NO: 1456048 - RNA, 19 nt, Homo sapiens
gagaauuacugcuaacuuu

SEQ ID NO: 1456049 - RNA, 19 nt, Homo sapiens
cagaaugccuuaauacaaa

SEQ ID NO: 1456050 - RNA, 19 nt, Homo sapiens
caaaugagcucugccaguu

SEQ ID NO: 1456051 - RNA, 19 nt, Homo sapiens
ugaggaagcugcagaaaug

SEQ ID NO: 1456052 - RNA, 19 nt, Homo sapiens
ugaaguauaucacucauga

SEQ ID NO: 1456053 - RNA, 19 nt, Homo sapiens
gcgaucagcaggagaauua

SEQ ID NO: 1456054 - RNA, 19 nt, Homo sapiens
gcuaaagggugaacuugaa

SEQ ID NO: 1456055 - RNA, 19 nt, Homo sapiens
gcauugaacugacagacuu

SEQ ID NO: 1456056 - RNA, 19 nt, Homo sapiens
gagaaggugccagaaauua

SEQ ID NO: 1456057 - RNA, 19 nt, Homo sapiens
ccacagcucugccgcuaaa

SEQ ID NO: 1456058 - RNA, 19 nt, Homo sapiens
gugcauaccuuaaauguac

SEQ ID NO: 1456059 - RNA, 19 nt, Homo sapiens
cagccaagcuuuaccuuau

SEQ ID NO: 1456060 - RNA, 19 nt, Homo sapiens
aaugagcucugccaguuua

SEQ ID NO: 1456061 - RNA, 19 nt, Homo sapiens
gagucagaaugccuuaaua

SEQ ID NO: 1456062 - RNA, 19 nt, Homo sapiens
gaaaagagcauugacaaaa

SEQ ID NO: 1456063 - RNA, 19 nt, Homo sapiens
caucugucauccauuuaua

SEQ ID NO: 1456064 - RNA, 19 nt, Homo sapiens
uuaccaagauguccauuug

SEQ ID NO: 1456065 - RNA, 19 nt, Homo sapiens
guauaucacucaugacaag

SEQ ID NO: 1456066 - RNA, 19 nt, Homo sapiens
gugcucagcuuccuucugu

SEQ ID NO: 1456067 - RNA, 19 nt, Homo sapiens
gccaacaaaucauaaauac

SEQ ID NO: 1456068 - RNA, 19 nt, Homo sapiens
gaaggugccagaaauuaug

SEQ ID NO: 1456069 - RNA, 19 nt, Homo sapiens
gcuaaaugcuucuacaacu

SEQ ID NO: 1456070 - RNA, 19 nt, Homo sapiens
ugacagugauucagaaagu

SEQ ID NO: 1456071 - RNA, 19 nt, Homo sapiens
cugcagaaaugccauaaug

SEQ ID NO: 1456072 - RNA, 19 nt, Homo sapiens
cuacaacugucccuucaga

SEQ ID NO: 1456073 - RNA, 19 nt, Homo sapiens
cugagcaacuuagagauua

SEQ ID NO: 1456074 - RNA, 19 nt, Homo sapiens
gagcugagcaacuuagaga

SEQ ID NO: 1456075 - RNA, 19 nt, Homo sapiens
gagcucugccaguuuauaa

SEQ ID NO: 1456076 - RNA, 19 nt, Homo sapiens
caacugucccuucagaauu

SEQ ID NO: 1456077 - RNA, 19 nt, Homo sapiens
ccagacaccugacccaaca

SEQ ID NO: 1456078 - RNA, 19 nt, Homo sapiens
ucauaaauaccgugaguuu

SEQ ID NO: 1456079 - RNA, 19 nt, Homo sapiens
gccaagggauugacaugga

SEQ ID NO: 1456080 - RNA, 19 nt, Homo sapiens
cugcaucugucauccauuu

SEQ ID NO: 1456081 - RNA, 19 nt, Homo sapiens
gaaauuaugggaguuaucu

SEQ ID NO: 1456082 - RNA, 19 nt, Homo sapiens
gaauugcccaggucuuuga

SEQ ID NO: 1456083 - RNA, 19 nt, Homo sapiens
cagaaaguguggauuugga

SEQ ID NO: 1456084 - RNA, 19 nt, Homo sapiens
aggagaagauggcauaugu

SEQ ID NO: 1456085 - RNA, 19 nt, Homo sapiens
uagcagacauugugcauac

SEQ ID NO: 1456086 - RNA, 19 nt, Homo sapiens
gggccaggaugaguucuaa

SEQ ID NO: 1456087 - RNA, 19 nt, Homo sapiens
gccaagcuuuaccuuauga

SEQ ID NO: 1456088 - RNA, 19 nt, Homo sapiens
gcagaaaugccauaaugag

SEQ ID NO: 1456089 - RNA, 19 nt, Homo sapiens
cugagaugcuccagaguuu

SEQ ID NO: 1456090 - RNA, 19 nt, Homo sapiens
ucagaaugccuuaauacaa

SEQ ID NO: 1456091 - RNA, 19 nt, Homo sapiens
ucucaaagccugcaucugu

SEQ ID NO: 1456092 - RNA, 19 nt, Homo sapiens
caaguacacagauauagug

SEQ ID NO: 1456093 - RNA, 19 nt, Homo sapiens
ccagaaauuaugggaguua

SEQ ID NO: 1456094 - RNA, 19 nt, Homo sapiens
ggagaauuacugcuaacuu

SEQ ID NO: 1456095 - RNA, 19 nt, Homo sapiens
gcccaggucuuugaagguu

SEQ ID NO: 1456096 - RNA, 19 nt, Homo sapiens
ccacugcgauuccaaagac

SEQ ID NO: 1456097 - RNA, 19 nt, Homo sapiens
gaucuguagucaggaagaa

SEQ ID NO: 1456098 - RNA, 19 nt, Homo sapiens
auacagagucccaauuuga

SEQ ID NO: 1456099 - RNA, 19 nt, Homo sapiens
gaaaaucuugacaccauua

SEQ ID NO: 1456100 - RNA, 19 nt, Homo sapiens
agacccaaguacacagaua

SEQ ID NO: 1456101 - RNA, 19 nt, Homo sapiens
cuaaaugcuucuacaacug

SEQ ID NO: 1456102 - RNA, 19 nt, Homo sapiens
gugaggccauuguugagaa

SEQ ID NO: 1456103 - RNA, 19 nt, Homo sapiens
gcugagcaacuuagagauu

SEQ ID NO: 1456104 - RNA, 19 nt, Homo sapiens
ggagucagaaugccuuaau

SEQ ID NO: 1456105 - RNA, 19 nt, Homo sapiens
cagcggagaguguuccuuu

SEQ ID NO: 1456106 - RNA, 19 nt, Homo sapiens
gucauccagugccguauaa

SEQ ID NO: 1456107 - RNA, 19 nt, Homo sapiens
aguuaucugugcccaguua

SEQ ID NO: 1456108 - RNA, 19 nt, Homo sapiens
cagaauugcccaggucuuu

SEQ ID NO: 1456109 - RNA, 19 nt, Homo sapiens
ccagauacaggaaaucaug

SEQ ID NO: 1456110 - RNA, 19 nt, Homo sapiens
ucagugaggccauuguuga

SEQ ID NO: 1456111 - RNA, 19 nt, Homo sapiens
ugucauccauuuauaaguc

SEQ ID NO: 1456112 - RNA, 19 nt, Homo sapiens
cagcaaaacuugaaaagag

SEQ ID NO: 1456113 - RNA, 19 nt, Homo sapiens
uaucacucaugacaagaaa

SEQ ID NO: 1456114 - RNA, 19 nt, Homo sapiens
aaucauaaauaccgugagu

SEQ ID NO: 1456115 - RNA, 19 nt, Homo sapiens
cgccaacaaaucauaaaua

SEQ ID NO: 1456116 - RNA, 19 nt, Homo sapiens
gguaaaagacccacauuug

SEQ ID NO: 1456117 - RNA, 19 nt, Homo sapiens
ggcagacguuucaggcauu

SEQ ID NO: 1456118 - RNA, 19 nt, Homo sapiens
gacaagaaagaucagcaaa

SEQ ID NO: 1456119 - RNA, 19 nt, Homo sapiens
cccugaggcugaaguauau

SEQ ID NO: 1456120 - RNA, 19 nt, Homo sapiens
caggaaaucaugcccaaug

SEQ ID NO: 1456121 - RNA, 19 nt, Homo sapiens
ggagagugaaggagucaga

SEQ ID NO: 1456122 - RNA, 19 nt, Homo sapiens
cacaggagaagauggcaua

SEQ ID NO: 1456123 - RNA, 19 nt, Homo sapiens
uugagaaggugccagaaau

SEQ ID NO: 1456124 - RNA, 19 nt, Homo sapiens
gaauuacugcuaacuuugg

SEQ ID NO: 1456125 - RNA, 19 nt, Homo sapiens
gcaaaaucauucauucaca

SEQ ID NO: 1456126 - RNA, 19 nt, Homo sapiens
caggaucuguagucaggaa

SEQ ID NO: 1456127 - RNA, 19 nt, Homo sapiens
gcugagguguggagaaugc

SEQ ID NO: 1456128 - RNA, 19 nt, Homo sapiens
ugagaaggugccagaaauu

SEQ ID NO: 1456129 - RNA, 19 nt, Homo sapiens
cgacagcccucuccccaaa

SEQ ID NO: 1456130 - RNA, 19 nt, Homo sapiens
gcuccagaguuugguggua

SEQ ID NO: 1456131 - RNA, 19 nt, Homo sapiens
uaaucacucugcccucugu

SEQ ID NO: 1456132 - RNA, 19 nt, Homo sapiens
gaagaucgagcugaguugu

SEQ ID NO: 1456133 - RNA, 19 nt, Homo sapiens
gagcuaaagggugaacuug

SEQ ID NO: 1456134 - RNA, 19 nt, Homo sapiens
cgcauucucuguccaguuc

SEQ ID NO: 1456135 - RNA, 19 nt, Homo sapiens
agacauugugcauaccuua

SEQ ID NO: 1456136 - RNA, 19 nt, Homo sapiens
aauacagagucccaauuug

SEQ ID NO: 1456137 - RNA, 19 nt, Homo sapiens
gcucugccaguuuauaaug

SEQ ID NO: 1456138 - RNA, 19 nt, Homo sapiens
uaaaugcuucuacaacugu

SEQ ID NO: 1456139 - RNA, 19 nt, Homo sapiens
gcagacguuucaggcauuc

SEQ ID NO: 1456140 - RNA, 19 nt, Homo sapiens
gacauugugcauaccuuaa

SEQ ID NO: 1456141 - RNA, 19 nt, Homo sapiens
gagugaaggagucagaaug

SEQ ID NO: 1456142 - RNA, 19 nt, Homo sapiens
gcaucugucauccauuuau

SEQ ID NO: 1456143 - RNA, 19 nt, Homo sapiens
ccuagaguccgccaacaaa

SEQ ID NO: 1456144 - RNA, 19 nt, Homo sapiens
cuaugacagugauucagaa

SEQ ID NO: 1456145 - RNA, 19 nt, Homo sapiens
caagaaagaucagcaaaac

SEQ ID NO: 1456146 - RNA, 19 nt, Homo sapiens
ucacucaugacaagaaaga

SEQ ID NO: 1456147 - RNA, 19 nt, Homo sapiens
ggaaaaucuugacaccauu

SEQ ID NO: 1456148 - RNA, 19 nt, Homo sapiens
gcaaguggcucaagaagca

SEQ ID NO: 1456149 - RNA, 19 nt, Homo sapiens
cagggagucuguuuauuua

SEQ ID NO: 1456150 - RNA, 19 nt, Homo sapiens
ccagggagucuguuuauuu

SEQ ID NO: 1456151 - RNA, 19 nt, Homo sapiens
gcuguacucugaccacuau

SEQ ID NO: 1456152 - RNA, 19 nt, Homo sapiens
gggagucuguuuauuuaca

SEQ ID NO: 1456153 - RNA, 19 nt, Homo sapiens
ggacagacaggaccaggau

SEQ ID NO: 1456154 - RNA, 19 nt, Homo sapiens
gcacugcugcggcugaaug

SEQ ID NO: 1456155 - RNA, 19 nt, Homo sapiens
ucaccgagcugagguccaa

SEQ ID NO: 1456156 - RNA, 19 nt, Homo sapiens
ggagucuguuuauuuacau

SEQ ID NO: 1456157 - RNA, 19 nt, Homo sapiens
acaacuaccucgucuacgu

SEQ ID NO: 1456158 - RNA, 19 nt, Homo sapiens
ccacaacuaccucgucuac

SEQ ID NO: 1456159 - RNA, 19 nt, Homo sapiens
gccagcagcaggccaauca

SEQ ID NO: 1456160 - RNA, 19 nt, Homo sapiens
gagcauccccugccacuug

SEQ ID NO: 1456161 - RNA, 19 nt, Homo sapiens
ccacugcccacuucagcuu

SEQ ID NO: 1456162 - RNA, 19 nt, Homo sapiens
ugaccacuauggccuguac

SEQ ID NO: 1456163 - RNA, 19 nt, Homo sapiens
ccagaaccgguuuggaugu

SEQ ID NO: 1456164 - RNA, 19 nt, Homo sapiens
cagaaccgguuuggauguc

SEQ ID NO: 1456165 - RNA, 19 nt, Homo sapiens
acagacaggaccaggauca

SEQ ID NO: 1456166 - RNA, 19 nt, Homo sapiens
gcaacgagaucgacacuau

SEQ ID NO: 1456167 - RNA, 19 nt, Homo sapiens
ggaagcaccucaagaacgu

SEQ ID NO: 1456168 - RNA, 19 nt, Homo sapiens
gaucgacacuauguucaug

SEQ ID NO: 1456169 - RNA, 19 nt, Homo sapiens
ccaagcugguggccuguga

SEQ ID NO: 1456170 - RNA, 19 nt, Homo sapiens
cgagaucgacacuauguuc

SEQ ID NO: 1456171 - RNA, 19 nt, Homo sapiens
cagcuacaccuacccauuc

SEQ ID NO: 1456172 - RNA, 19 nt, Homo sapiens
gucuacggcuggucuguug

SEQ ID NO: 1456173 - RNA, 19 nt, Homo sapiens
ucuggagccugaggaguuu

SEQ ID NO: 1456174 - RNA, 19 nt, Homo sapiens
gcucggaagcaccucaaga

SEQ ID NO: 1456175 - RNA, 19 nt, Homo sapiens
gagaucgacacuauguuca

SEQ ID NO: 1456176 - RNA, 19 nt, Homo sapiens
caacgagaucgacacuaug

SEQ ID NO: 1456177 - RNA, 19 nt, Homo sapiens
gcgagcacuucaaccucaa

SEQ ID NO: 1456178 - RNA, 19 nt, Homo sapiens
cgagaugggcugucugucu

SEQ ID NO: 1456179 - RNA, 19 nt, Homo sapiens
ccagcuacaccuacccauu

SEQ ID NO: 1456180 - RNA, 19 nt, Homo sapiens
ggacgugguggucgaguac

SEQ ID NO: 1456181 - RNA, 19 nt, Homo sapiens
uggacgugguggucgagua

SEQ ID NO: 1456182 - RNA, 19 nt, Homo sapiens
gauaagagcucaauaaaug

SEQ ID NO: 1456183 - RNA, 19 nt, Homo sapiens
gagaaacuaugguucaaga

SEQ ID NO: 1456184 - RNA, 19 nt, Homo sapiens
ugaaggagcugccgcugaa

SEQ ID NO: 1456185 - RNA, 19 nt, Homo sapiens
ggagaaagaggucaaguuc

SEQ ID NO: 1456186 - RNA, 19 nt, Homo sapiens
gcacaggccugcugaagcu

SEQ ID NO: 1456187 - RNA, 19 nt, Homo sapiens
gugacuaccuggagaaaga

SEQ ID NO: 1456188 - RNA, 19 nt, Homo sapiens
ccagaacucgguccuauuu

SEQ ID NO: 1456189 - RNA, 19 nt, Homo sapiens
aaacuaugguucaagaaga

SEQ ID NO: 1456190 - RNA, 19 nt, Homo sapiens
ggacaccuuugaagcaugu

SEQ ID NO: 1456191 - RNA, 19 nt, Homo sapiens
ggaauaugaagucaagaaa

SEQ ID NO: 1456192 - RNA, 19 nt, Homo sapiens
gcacguccacaccuucuuu

SEQ ID NO: 1456193 - RNA, 19 nt, Homo sapiens
aaacugaccauacuaaaca

SEQ ID NO: 1456194 - RNA, 19 nt, Homo sapiens
gaagaagggcuuuguaucc

SEQ ID NO: 1456195 - RNA, 19 nt, Homo sapiens
gcaguuacaggauuacaug

SEQ ID NO: 1456196 - RNA, 19 nt, Homo sapiens
ugucaggucuuccagauca

SEQ ID NO: 1456197 - RNA, 19 nt, Homo sapiens
ggaagaagggcuuuguauc

SEQ ID NO: 1456198 - RNA, 19 nt, Homo sapiens
gaaacuaugguucaagaag

SEQ ID NO: 1456199 - RNA, 19 nt, Homo sapiens
uggagcaguuacaggauua

SEQ ID NO: 1456200 - RNA, 19 nt, Homo sapiens
ggaccagaguauugagugu

SEQ ID NO: 1456201 - RNA, 19 nt, Homo sapiens
gggaagaagggcuuuguau

SEQ ID NO: 1456202 - RNA, 19 nt, Homo sapiens
cauggaauaugaagucaag

SEQ ID NO: 1456203 - RNA, 19 nt, Homo sapiens
cagaagacaacuaccugua

SEQ ID NO: 1456204 - RNA, 19 nt, Homo sapiens
ccgauaagagcucaauaaa

SEQ ID NO: 1456205 - RNA, 19 nt, Homo sapiens
ggacggggcuugagggaau

SEQ ID NO: 1456206 - RNA, 19 nt, Homo sapiens
aauaugaagucaagaaagg

SEQ ID NO: 1456207 - RNA, 19 nt, Homo sapiens
agaacucgguccuauuuua

SEQ ID NO: 1456208 - RNA, 19 nt, Homo sapiens
gaauaugaagucaagaaag

SEQ ID NO: 1456209 - RNA, 19 nt, Homo sapiens
uggagccucuaucugguua

SEQ ID NO: 1456210 - RNA, 19 nt, Homo sapiens
guacagucaguguggagua

SEQ ID NO: 1456211 - RNA, 19 nt, Homo sapiens
cuccuuauaugaccucaaa

SEQ ID NO: 1456212 - RNA, 19 nt, Homo sapiens
ucaccuggcgcgacaauga

SEQ ID NO: 1456213 - RNA, 19 nt, Homo sapiens
agaaagaggucaaguuccu

SEQ ID NO: 1456214 - RNA, 19 nt, Homo sapiens
cgauaagagcucaauaaau

SEQ ID NO: 1456215 - RNA, 19 nt, Homo sapiens
aggauuacauggucacguu

SEQ ID NO: 1456216 - RNA, 19 nt, Homo sapiens
uuauaugaccucaaacuga

SEQ ID NO: 1456217 - RNA, 19 nt, Homo sapiens
ccugaugccugacuuguac

SEQ ID NO: 1456218 - RNA, 19 nt, Homo sapiens
ucaaacugaccauacuaaa

SEQ ID NO: 1456219 - RNA, 19 nt, Homo sapiens
ucuccugauucuccuuaua

SEQ ID NO: 1456220 - RNA, 19 nt, Homo sapiens
guccacaccuucuuuccau

SEQ ID NO: 1456221 - RNA, 19 nt, Homo sapiens
gcucugcagccgcauaaug

SEQ ID NO: 1456222 - RNA, 19 nt, Homo sapiens
cccgauaagagcucaauaa

SEQ ID NO: 1456223 - RNA, 19 nt, Homo sapiens
gccucuaucugguuagugu

SEQ ID NO: 1456224 - RNA, 19 nt, Homo sapiens
cauacuaaacaguguagaa

SEQ ID NO: 1456225 - RNA, 19 nt, Homo sapiens
uaaauguuguuccuuucca

SEQ ID NO: 1456226 - RNA, 19 nt, Homo sapiens
gaccauacuaaacagugua

SEQ ID NO: 1456227 - RNA, 19 nt, Homo sapiens
ugaccauacuaaacagugu

SEQ ID NO: 1456228 - RNA, 19 nt, Homo sapiens
caaacugaccauacuaaac

SEQ ID NO: 1456229 - RNA, 19 nt, Homo sapiens
ugacaucacgcacgacauc

SEQ ID NO: 1456230 - RNA, 19 nt, Homo sapiens
acuaaacaguguagaaggu

SEQ ID NO: 1456231 - RNA, 19 nt, Homo sapiens
ccaggacaccuuugaagca

SEQ ID NO: 1456232 - RNA, 19 nt, Homo sapiens
cuacacauccacaccugaa

SEQ ID NO: 1456233 - RNA, 19 nt, Homo sapiens
guuguuccuuuccacauca

SEQ ID NO: 1456234 - RNA, 19 nt, Homo sapiens
gguccuauuuuacagauug

SEQ ID NO: 1456235 - RNA, 19 nt, Homo sapiens
cgacgacgacgacgaggau

SEQ ID NO: 1456236 - RNA, 19 nt, Homo sapiens
uggaauaugaagucaagaa

SEQ ID NO: 1456237 - RNA, 19 nt, Homo sapiens
gagccucuaucugguuagu

SEQ ID NO: 1456238 - RNA, 19 nt, Homo sapiens
caggacaccuuugaagcau

SEQ ID NO: 1456239 - RNA, 19 nt, Homo sapiens
cagggauuacugaggguua

SEQ ID NO: 1456240 - RNA, 19 nt, Homo sapiens
gaucuggagccucuaucug

SEQ ID NO: 1456241 - RNA, 19 nt, Homo sapiens
gcucccaggacaccuuuga

SEQ ID NO: 1456242 - RNA, 19 nt, Homo sapiens
ggucuagcacccgauaaga

SEQ ID NO: 1456243 - RNA, 19 nt, Homo sapiens
gcugaggaaggcaugaaga

SEQ ID NO: 1456244 - RNA, 19 nt, Homo sapiens
cgaugcugcugcgggagua

SEQ ID NO: 1456245 - RNA, 19 nt, Homo sapiens
ccugcgcacucaucuguca

SEQ ID NO: 1456246 - RNA, 19 nt, Homo sapiens
gagcgacggcagacguuca

SEQ ID NO: 1456247 - RNA, 19 nt, Homo sapiens
ccucaaacugaccauacua

SEQ ID NO: 1456248 - RNA, 19 nt, Homo sapiens
uuggagcaguuacaggauu

SEQ ID NO: 1456249 - RNA, 19 nt, Homo sapiens
gaagucaagaaagggaaga

SEQ ID NO: 1456250 - RNA, 19 nt, Homo sapiens
gagcucaauaaauguuguu

SEQ ID NO: 1456251 - RNA, 19 nt, Homo sapiens
gaccucaaacugaccauac

SEQ ID NO: 1456252 - RNA, 19 nt, Homo sapiens
uuccagaacucgguccuau

SEQ ID NO: 1456253 - RNA, 19 nt, Homo sapiens
uggagaaagaggucaaguu

SEQ ID NO: 1456254 - RNA, 19 nt, Homo sapiens
ggauuacugaggguuaaga

SEQ ID NO: 1456255 - RNA, 19 nt, Homo sapiens
cuaucugguuagugucgua

SEQ ID NO: 1456256 - RNA, 19 nt, Homo sapiens
agggauuacugaggguuaa

SEQ ID NO: 1456257 - RNA, 19 nt, Homo sapiens
caggguggccacagggauu

SEQ ID NO: 1456258 - RNA, 19 nt, Homo sapiens
gcgcaaguuccuccuccuu

SEQ ID NO: 1456259 - RNA, 19 nt, Homo sapiens
ggaagaauaugcuaauuug

SEQ ID NO: 1456260 - RNA, 19 nt, Homo sapiens
ucaaguauauugcugcuua

SEQ ID NO: 1456261 - RNA, 19 nt, Homo sapiens
cagcuaauauucucaagua

SEQ ID NO: 1456262 - RNA, 19 nt, Homo sapiens
ggaccgagcucuuggaugu

SEQ ID NO: 1456263 - RNA, 19 nt, Homo sapiens
gcauagagcauaaaguuaa

SEQ ID NO: 1456264 - RNA, 19 nt, Homo sapiens
guauauugcugcuuagaaa

SEQ ID NO: 1456265 - RNA, 19 nt, Homo sapiens
gcaauaagcaagccuuuga

SEQ ID NO: 1456266 - RNA, 19 nt, Homo sapiens
ugacuuaguucaugaaugu

SEQ ID NO: 1456267 - RNA, 19 nt, Homo sapiens
gaacaauuagcagcaauaa

SEQ ID NO: 1456268 - RNA, 19 nt, Homo sapiens
gggaagaauaugcuaauuu

SEQ ID NO: 1456269 - RNA, 19 nt, Homo sapiens
ugaauguugucacuucuaa

SEQ ID NO: 1456270 - RNA, 19 nt, Homo sapiens
uaaaugcgagcguuuguuu

SEQ ID NO: 1456271 - RNA, 19 nt, Homo sapiens
ggaacaauuagcagcaaua

SEQ ID NO: 1456272 - RNA, 19 nt, Homo sapiens
gauguugacuuaguucaug

SEQ ID NO: 1456273 - RNA, 19 nt, Homo sapiens
cagaagagcggaaagauca

SEQ ID NO: 1456274 - RNA, 19 nt, Homo sapiens
aaacacgacugagcaagaa

SEQ ID NO: 1456275 - RNA, 19 nt, Homo sapiens
gcucuuggauguucuugga

SEQ ID NO: 1456276 - RNA, 19 nt, Homo sapiens
gugcauagagcauaaaguu

SEQ ID NO: 1456277 - RNA, 19 nt, Homo sapiens
uuugguggauguugacuua

SEQ ID NO: 1456278 - RNA, 19 nt, Homo sapiens
ggaugcaacucaaccucuu

SEQ ID NO: 1456279 - RNA, 19 nt, Homo sapiens
ucuccaaccugucccagua

SEQ ID NO: 1456280 - RNA, 19 nt, Homo sapiens
cacuagggcuauauacaaa

SEQ ID NO: 1456281 - RNA, 19 nt, Homo sapiens
caacucaaccucuuaggau

SEQ ID NO: 1456282 - RNA, 19 nt, Homo sapiens
aaagaucauugacguggaa

SEQ ID NO: 1456283 - RNA, 19 nt, Homo sapiens
ccugaaauauuuacgauac

SEQ ID NO: 1456284 - RNA, 19 nt, Homo sapiens
ucaugaauguugucacuuc

SEQ ID NO: 1456285 - RNA, 19 nt, Homo sapiens
gaucauugacguggaacua

SEQ ID NO: 1456286 - RNA, 19 nt, Homo sapiens
ucacuagggcuauauacaa

SEQ ID NO: 1456287 - RNA, 19 nt, Homo sapiens
gaaauuuaucugugcauag

SEQ ID NO: 1456288 - RNA, 19 nt, Homo sapiens
gaagagcggaaagaucauu

SEQ ID NO: 1456289 - RNA, 19 nt, Homo sapiens
uuucacagcuuagggauug

SEQ ID NO: 1456290 - RNA, 19 nt, Homo sapiens
gugcuucgauguauuuuaa

SEQ ID NO: 1456291 - RNA, 19 nt, Homo sapiens
gcaacucaaccucuuagga

SEQ ID NO: 1456292 - RNA, 19 nt, Homo sapiens
gaugcaacucaaccucuua

SEQ ID NO: 1456293 - RNA, 19 nt, Homo sapiens
gguggauguugacuuaguu

SEQ ID NO: 1456294 - RNA, 19 nt, Homo sapiens
gcgcggagaagaacagcua

SEQ ID NO: 1456295 - RNA, 19 nt, Homo sapiens
uaaacacgacugagcaaga

SEQ ID NO: 1456296 - RNA, 19 nt, Homo sapiens
gauuugaugccaggaagua

SEQ ID NO: 1456297 - RNA, 19 nt, Homo sapiens
uguacauccugcacaagua

SEQ ID NO: 1456298 - RNA, 19 nt, Homo sapiens
ggacacauucccagaagag

SEQ ID NO: 1456299 - RNA, 19 nt, Homo sapiens
caggcugacugagagauuu

SEQ ID NO: 1456300 - RNA, 19 nt, Homo sapiens
guucaugaauguugucacu

SEQ ID NO: 1456301 - RNA, 19 nt, Homo sapiens
uguugucacuucuaaaugu

SEQ ID NO: 1456302 - RNA, 19 nt, Homo sapiens
uaauaaaggcagauugagu

SEQ ID NO: 1456303 - RNA, 19 nt, Homo sapiens
gcguguacauccugcacaa

SEQ ID NO: 1456304 - RNA, 19 nt, Homo sapiens
gguaaggauuggagauugc

SEQ ID NO: 1456305 - RNA, 19 nt, Homo sapiens
ccucugugcuucgauguau

SEQ ID NO: 1456306 - RNA, 19 nt, Homo sapiens
acaauuagcagcaauaagc

SEQ ID NO: 1456307 - RNA, 19 nt, Homo sapiens
gcaaggaggggccaagaaa

SEQ ID NO: 1456308 - RNA, 19 nt, Homo sapiens
gaccuucgccauuccuaga

SEQ ID NO: 1456309 - RNA, 19 nt, Homo sapiens
caauaagcaagccuuugaa

SEQ ID NO: 1456310 - RNA, 19 nt, Homo sapiens
uccagaaucuacugcaugu

SEQ ID NO: 1456311 - RNA, 19 nt, Homo sapiens
caaguauauugcugcuuag

SEQ ID NO: 1456312 - RNA, 19 nt, Homo sapiens
cuacugcaugucccaauuu

SEQ ID NO: 1456313 - RNA, 19 nt, Homo sapiens
gcuaauuugacauuugaga

SEQ ID NO: 1456314 - RNA, 19 nt, Homo sapiens
caaccugucccaguauuuc

SEQ ID NO: 1456315 - RNA, 19 nt, Homo sapiens
aauaagcaagccuuugaaa

SEQ ID NO: 1456316 - RNA, 19 nt, Homo sapiens
ucuacugcaugucccaauu

SEQ ID NO: 1456317 - RNA, 19 nt, Homo sapiens
gagauuuucuucccucugu

SEQ ID NO: 1456318 - RNA, 19 nt, Homo sapiens
acccugggcuucacuuuca

SEQ ID NO: 1456319 - RNA, 19 nt, Homo sapiens
caggaacaauuagcagcaa

SEQ ID NO: 1456320 - RNA, 19 nt, Homo sapiens
gaauguugucacuucuaaa

SEQ ID NO: 1456321 - RNA, 19 nt, Homo sapiens
ucauugacguggaacuaca

SEQ ID NO: 1456322 - RNA, 19 nt, Homo sapiens
uaggacacauucccagaag

SEQ ID NO: 1456323 - RNA, 19 nt, Homo sapiens
cggcagcucuuaggacaca

SEQ ID NO: 1456324 - RNA, 19 nt, Homo sapiens
uggagcaccuggagaagca

SEQ ID NO: 1456325 - RNA, 19 nt, Homo sapiens
cuagagacccugacaagac

SEQ ID NO: 1456326 - RNA, 19 nt, Homo sapiens
ccagaagagcggaaagauc

SEQ ID NO: 1456327 - RNA, 19 nt, Homo sapiens
caagaaaguggcgcugugu

SEQ ID NO: 1456328 - RNA, 19 nt, Homo sapiens
gcuccagaaucuacugcau

SEQ ID NO: 1456329 - RNA, 19 nt, Homo sapiens
ugguaaggauuggagauug

SEQ ID NO: 1456330 - RNA, 19 nt, Homo sapiens
cagcaauaagcaagccuuu

SEQ ID NO: 1456331 - RNA, 19 nt, Homo sapiens
gcugggaguggauauguuc

SEQ ID NO: 1456332 - RNA, 19 nt, Homo sapiens
ugcauagagcauaaaguua

SEQ ID NO: 1456333 - RNA, 19 nt, Homo sapiens
aaacgaaaacggaggaaaa

SEQ ID NO: 1456334 - RNA, 19 nt, Homo sapiens
ggucagacugcucaacauc

SEQ ID NO: 1456335 - RNA, 19 nt, Homo sapiens
uggagacacuguggaaagu

SEQ ID NO: 1456336 - RNA, 19 nt, Homo sapiens
guugucacuucuaaaugug

SEQ ID NO: 1456337 - RNA, 19 nt, Homo sapiens
ccaaccugucccaguauuu

SEQ ID NO: 1456338 - RNA, 19 nt, Homo sapiens
gagcgucagcagccuguuc

SEQ ID NO: 1456339 - RNA, 19 nt, Homo sapiens
ucaggaccuuagagggaaa

SEQ ID NO: 1456340 - RNA, 19 nt, Homo sapiens
ugaggucugugugcguuau

SEQ ID NO: 1456341 - RNA, 19 nt, Homo sapiens
gcagcuaauauucucaagu

SEQ ID NO: 1456342 - RNA, 19 nt, Homo sapiens
gauccuagagacccugaca

SEQ ID NO: 1456343 - RNA, 19 nt, Homo sapiens
uaucugugcauagagcaua

SEQ ID NO: 1456344 - RNA, 19 nt, Homo sapiens
gcagcucuuaggacacauu

SEQ ID NO: 1456345 - RNA, 19 nt, Homo sapiens
cgugguggccgucuacuuc

SEQ ID NO: 1456346 - RNA, 19 nt, Homo sapiens
caugaauguugucacuucu

SEQ ID NO: 1456347 - RNA, 19 nt, Homo sapiens
gcuccaaggacaagugaag

SEQ ID NO: 1456348 - RNA, 19 nt, Homo sapiens
uacugcaugucccaauuug

SEQ ID NO: 1456349 - RNA, 19 nt, Homo sapiens
uggauguucuuggacuuga

SEQ ID NO: 1456350 - RNA, 19 nt, Homo sapiens
ucugugcuucgauguauuu

SEQ ID NO: 1456351 - RNA, 19 nt, Homo sapiens
guggagacacuguggaaag

SEQ ID NO: 1456352 - RNA, 19 nt, Homo sapiens
guggccgucuacuucauga

SEQ ID NO: 1456353 - RNA, 19 nt, Homo sapiens
gaaguuccaugauguuguu

SEQ ID NO: 1456354 - RNA, 19 nt, Homo sapiens
uaagggaucugaaugacuu

SEQ ID NO: 1456355 - RNA, 19 nt, Homo sapiens
gcauguggcugcagcuaug

SEQ ID NO: 1456356 - RNA, 19 nt, Homo sapiens
ggauaagggaucugaauga

SEQ ID NO: 1456357 - RNA, 19 nt, Homo sapiens
gagggauuauuucauuaug

SEQ ID NO: 1456358 - RNA, 19 nt, Homo sapiens
cuggagggauuauuucauu

SEQ ID NO: 1456359 - RNA, 19 nt, Homo sapiens
uuauguaucuggcaucaug

SEQ ID NO: 1456360 - RNA, 19 nt, Homo sapiens
ggagggauuauuucauuau

SEQ ID NO: 1456361 - RNA, 19 nt, Homo sapiens
gggcguuuguggcguugua

SEQ ID NO: 1456362 - RNA, 19 nt, Homo sapiens
uggagggauuauuucauua

SEQ ID NO: 1456363 - RNA, 19 nt, Homo sapiens
gauaagggaucugaaugac

SEQ ID NO: 1456364 - RNA, 19 nt, Homo sapiens
aagaggagcuggaccugau

SEQ ID NO: 1456365 - RNA, 19 nt, Homo sapiens
ggauggacagaacuuguuu

SEQ ID NO: 1456366 - RNA, 19 nt, Homo sapiens
ggguuuaggucugagaaga

SEQ ID NO: 1456367 - RNA, 19 nt, Homo sapiens
ggaugacacuacccugaag

SEQ ID NO: 1456368 - RNA, 19 nt, Homo sapiens
acacagaggccacuuugau

SEQ ID NO: 1456369 - RNA, 19 nt, Homo sapiens
ggucaagucuggguuuagg

SEQ ID NO: 1456370 - RNA, 19 nt, Homo sapiens
ugcaguaccuucuagaaca

SEQ ID NO: 1456371 - RNA, 19 nt, Homo sapiens
guaccucgacgaaggaguu

SEQ ID NO: 1456372 - RNA, 19 nt, Homo sapiens
ucacacagaggccacuuug

SEQ ID NO: 1456373 - RNA, 19 nt, Homo sapiens
gaaccgcaaauucagaaca

SEQ ID NO: 1456374 - RNA, 19 nt, Homo sapiens
guuccuggagggauuauuu

SEQ ID NO: 1456375 - RNA, 19 nt, Homo sapiens
gggauaagggaucugaaug

SEQ ID NO: 1456376 - RNA, 19 nt, Homo sapiens
cuaccgaaccgcaaauuca

SEQ ID NO: 1456377 - RNA, 19 nt, Homo sapiens
ggucugagaagaugacgau

SEQ ID NO: 1456378 - RNA, 19 nt, Homo sapiens
guuuaggucugagaagaug

SEQ ID NO: 1456379 - RNA, 19 nt, Homo sapiens
acacuacccugaaguucca

SEQ ID NO: 1456380 - RNA, 19 nt, Homo sapiens
gagggucaagucuggguuu

SEQ ID NO: 1456381 - RNA, 19 nt, Homo sapiens
gcaguaccuucuagaacac

SEQ ID NO: 1456382 - RNA, 19 nt, Homo sapiens
gcugugcaguaccuucuag

SEQ ID NO: 1456383 - RNA, 19 nt, Homo sapiens
ggaagcacuggacgucuca

SEQ ID NO: 1456384 - RNA, 19 nt, Homo sapiens
ggucaugaagaaugcuuug

SEQ ID NO: 1456385 - RNA, 19 nt, Homo sapiens
cauuauguaucuggcauca

SEQ ID NO: 1456386 - RNA, 19 nt, Homo sapiens
gaucccagcaagcuaucuu

SEQ ID NO: 1456387 - RNA, 19 nt, Homo sapiens
caugacggauggacagaac

SEQ ID NO: 1456388 - RNA, 19 nt, Homo sapiens
acccugaaguuccaugaug

SEQ ID NO: 1456389 - RNA, 19 nt, Homo sapiens
ucugagaagaugacgauga

SEQ ID NO: 1456390 - RNA, 19 nt, Homo sapiens
cacagaggccacuuugaug

SEQ ID NO: 1456391 - RNA, 19 nt, Homo sapiens
cgagugccuugcccgacuu

SEQ ID NO: 1456392 - RNA, 19 nt, Homo sapiens
cugagaagaugacgaugac

SEQ ID NO: 1456393 - RNA, 19 nt, Homo sapiens
cgccugaaccacacacuga

SEQ ID NO: 1456394 - RNA, 19 nt, Homo sapiens
gucucgggcuuacugaaga

SEQ ID NO: 1456395 - RNA, 19 nt, Homo sapiens
ugacggauggacagaacuu

SEQ ID NO: 1456396 - RNA, 19 nt, Homo sapiens
agggucaagucuggguuua

SEQ ID NO: 1456397 - RNA, 19 nt, Homo sapiens
cggauggacagaacuuguu

SEQ ID NO: 1456398 - RNA, 19 nt, Homo sapiens
gccagaagcucauggagaa

SEQ ID NO: 1456399 - RNA, 19 nt, Homo sapiens
acacgucagucaccuauaa

SEQ ID NO: 1456400 - RNA, 19 nt, Homo sapiens
acacggagauuacaucgaa

SEQ ID NO: 1456401 - RNA, 19 nt, Homo sapiens
ccaauuggcucagaagguu

SEQ ID NO: 1456402 - RNA, 19 nt, Homo sapiens
aaacaugaaugacaacauc

SEQ ID NO: 1456403 - RNA, 19 nt, Homo sapiens
ccaaggacuucgucaucua

SEQ ID NO: 1456404 - RNA, 19 nt, Homo sapiens
gagagcagccucaccagaa

SEQ ID NO: 1456405 - RNA, 19 nt, Homo sapiens
gugaagaucucaagcaacu

SEQ ID NO: 1456406 - RNA, 19 nt, Homo sapiens
cugcagagcuugagguugu

SEQ ID NO: 1456407 - RNA, 19 nt, Homo sapiens
gcaagcugcugugccagaa

SEQ ID NO: 1456408 - RNA, 19 nt, Homo sapiens
cccagcagguucuguuuaa

SEQ ID NO: 1456409 - RNA, 19 nt, Homo sapiens
gggccagcauugacuuuga

SEQ ID NO: 1456410 - RNA, 19 nt, Homo sapiens
gcacacgucagucaccuau

SEQ ID NO: 1456411 - RNA, 19 nt, Homo sapiens
gaugauacacggagauuac

SEQ ID NO: 1456412 - RNA, 19 nt, Homo sapiens
uggaagccauguccgauga

SEQ ID NO: 1456413 - RNA, 19 nt, Homo sapiens
ccucugugcuuucggauuc

SEQ ID NO: 1456414 - RNA, 19 nt, Homo sapiens
ccaagaccaucucauuguc

SEQ ID NO: 1456415 - RNA, 19 nt, Homo sapiens
ggauguguguccugguuca

SEQ ID NO: 1456416 - RNA, 19 nt, Homo sapiens
ucagugcggucaaggugaa

SEQ ID NO: 1456417 - RNA, 19 nt, Homo sapiens
ccaggugaccauccaauug

SEQ ID NO: 1456418 - RNA, 19 nt, Homo sapiens
gcaauugcugggccuuuga

SEQ ID NO: 1456419 - RNA, 19 nt, Homo sapiens
ggcaauugcugggccuuug

SEQ ID NO: 1456420 - RNA, 19 nt, Homo sapiens
gagaaggugcgacaucaca

SEQ ID NO: 1456421 - RNA, 19 nt, Homo sapiens
caggaugacagcauaaaug

SEQ ID NO: 1456422 - RNA, 19 nt, Homo sapiens
gcccagcagguucuguuua

SEQ ID NO: 1456423 - RNA, 19 nt, Homo sapiens
gcaggaugacagcauaaau

SEQ ID NO: 1456424 - RNA, 19 nt, Homo sapiens
gaagaugauacacggagau

SEQ ID NO: 1456425 - RNA, 19 nt, Homo sapiens
ucuauucacuuaccaucga

SEQ ID NO: 1456426 - RNA, 19 nt, Homo sapiens
caaggacuucgucaucuau

SEQ ID NO: 1456427 - RNA, 19 nt, Homo sapiens
caacgugacaccuggcaau

SEQ ID NO: 1456428 - RNA, 19 nt, Homo sapiens
uguccugguucaccuguuu

SEQ ID NO: 1456429 - RNA, 19 nt, Homo sapiens
aaaauggcccagaaaauaa

SEQ ID NO: 1456430 - RNA, 19 nt, Homo sapiens
gcuuucggauucuggaugu

SEQ ID NO: 1456431 - RNA, 19 nt, Homo sapiens
cagaaaacaucauccagau

SEQ ID NO: 1456432 - RNA, 19 nt, Homo sapiens
gaaggugcgacaucacagu

SEQ ID NO: 1456433 - RNA, 19 nt, Homo sapiens
caagaccaucucauuguca

SEQ ID NO: 1456434 - RNA, 19 nt, Homo sapiens
ucaccuauaaccaugagaa

SEQ ID NO: 1456435 - RNA, 19 nt, Homo sapiens
gauacacggagauuacauc

SEQ ID NO: 1456436 - RNA, 19 nt, Homo sapiens
ugggauguguguccugguu

SEQ ID NO: 1456437 - RNA, 19 nt, Homo sapiens
cgugacaccuggcaauugc

SEQ ID NO: 1456438 - RNA, 19 nt, Homo sapiens
aggagaaggugcgacauca

SEQ ID NO: 1456439 - RNA, 19 nt, Homo sapiens
cuggcaggaugacagcaua

SEQ ID NO: 1456440 - RNA, 19 nt, Homo sapiens
ggaacccaggcuucacuug

SEQ ID NO: 1456441 - RNA, 19 nt, Homo sapiens
cccaagaccaucucauugu

SEQ ID NO: 1456442 - RNA, 19 nt, Homo sapiens
gccaggugaccauccaauu

SEQ ID NO: 1456443 - RNA, 19 nt, Homo sapiens
gauucuggauguuuucuau

SEQ ID NO: 1456444 - RNA, 19 nt, Homo sapiens
cagaagcucauggagaaga

SEQ ID NO: 1456445 - RNA, 19 nt, Homo sapiens
aggugaagaucucaagcaa

SEQ ID NO: 1456446 - RNA, 19 nt, Homo sapiens
gcgcccuacucgaagaugu

SEQ ID NO: 1456447 - RNA, 19 nt, Homo sapiens
ggccagcauugacuuugag

SEQ ID NO: 1456448 - RNA, 19 nt, Homo sapiens
caaacaugaaugacaacau

SEQ ID NO: 1456449 - RNA, 19 nt, Homo sapiens
aauuggcucagaagguuua

SEQ ID NO: 1456450 - RNA, 19 nt, Homo sapiens
cucaccagcucccagaguu

SEQ ID NO: 1456451 - RNA, 19 nt, Homo sapiens
ccauccaauuggcucagaa

SEQ ID NO: 1456452 - RNA, 19 nt, Homo sapiens
guacuucacuuccacuuua

SEQ ID NO: 1456453 - RNA, 19 nt, Homo sapiens
gaaagaacguuuauugaag

SEQ ID NO: 1456454 - RNA, 19 nt, Homo sapiens
gaacguuuauugaagauga

SEQ ID NO: 1456455 - RNA, 19 nt, Homo sapiens
ggagaaagaacguuuauug

SEQ ID NO: 1456456 - RNA, 19 nt, Homo sapiens
gaagagagacgcaaagaau

SEQ ID NO: 1456457 - RNA, 19 nt, Homo sapiens
gaaauacuguuugagagaa

SEQ ID NO: 1456458 - RNA, 19 nt, Homo sapiens
uaagagaccuuccuagagu

SEQ ID NO: 1456459 - RNA, 19 nt, Homo sapiens
cauaaacucuucucacaau

SEQ ID NO: 1456460 - RNA, 19 nt, Homo sapiens
gggaguaaauuaaggaaug

SEQ ID NO: 1456461 - RNA, 19 nt, Homo sapiens
gagaaagaacguuuauuga

SEQ ID NO: 1456462 - RNA, 19 nt, Homo sapiens
ggaugcaucucucaugguu

SEQ ID NO: 1456463 - RNA, 19 nt, Homo sapiens
gaagaugaccuuagaagag

SEQ ID NO: 1456464 - RNA, 19 nt, Homo sapiens
ggaguaaauuaaggaauga

SEQ ID NO: 1456465 - RNA, 19 nt, Homo sapiens
aagaaagacucauugaaga

SEQ ID NO: 1456466 - RNA, 19 nt, Homo sapiens
caagaaagacucauugaag

SEQ ID NO: 1456467 - RNA, 19 nt, Homo sapiens
ggaacaaguuauggaaaga

SEQ ID NO: 1456468 - RNA, 19 nt, Homo sapiens
gcaaagaauaccuaagaga

SEQ ID NO: 1456469 - RNA, 19 nt, Homo sapiens
ugaagacuccuuugagaaa

SEQ ID NO: 1456470 - RNA, 19 nt, Homo sapiens
gaacaaguuauggaaagaa

SEQ ID NO: 1456471 - RNA, 19 nt, Homo sapiens
gagaggagaaagaacguuu

SEQ ID NO: 1456472 - RNA, 19 nt, Homo sapiens
gucauaaacucuucucaca

SEQ ID NO: 1456473 - RNA, 19 nt, Homo sapiens
gcugugggcaguugucaua

SEQ ID NO: 1456474 - RNA, 19 nt, Homo sapiens
aagaauaccuaagagacua

SEQ ID NO: 1456475 - RNA, 19 nt, Homo sapiens
ggaaagagugccugaggau

SEQ ID NO: 1456476 - RNA, 19 nt, Homo sapiens
uauugaagaugaccuuaga

SEQ ID NO: 1456477 - RNA, 19 nt, Homo sapiens
gaaucaagaaagacucauu

SEQ ID NO: 1456478 - RNA, 19 nt, Homo sapiens
aagaugaccuuagaagaga

SEQ ID NO: 1456479 - RNA, 19 nt, Homo sapiens
ugaacagcauucuaucaug

SEQ ID NO: 1456480 - RNA, 19 nt, Homo sapiens
gagagaaggcaaacagaca

SEQ ID NO: 1456481 - RNA, 19 nt, Homo sapiens
gaggauggcaugggaaaga

SEQ ID NO: 1456482 - RNA, 19 nt, Homo sapiens
cacgagagcuuuguaaggu

SEQ ID NO: 1456483 - RNA, 19 nt, Homo sapiens
ucucaugguugaagaagug

SEQ ID NO: 1456484 - RNA, 19 nt, Homo sapiens
gaggagaaagaacguuuau

SEQ ID NO: 1456485 - RNA, 19 nt, Homo sapiens
gagaaggcaaacagacaaa

SEQ ID NO: 1456486 - RNA, 19 nt, Homo sapiens
guaagguacuucacuucca

SEQ ID NO: 1456487 - RNA, 19 nt, Homo sapiens
aagagagacgcaaagaaua

SEQ ID NO: 1456488 - RNA, 19 nt, Homo sapiens
gaaugaagguagaaaacug

SEQ ID NO: 1456489 - RNA, 19 nt, Homo sapiens
uagagugaaugaagguaga

SEQ ID NO: 1456490 - RNA, 19 nt, Homo sapiens
gaagguagaaaacugaaaa

SEQ ID NO: 1456491 - RNA, 19 nt, Homo sapiens
aaagggugauagaaauaug

SEQ ID NO: 1456492 - RNA, 19 nt, Homo sapiens
ugaggauccuugccuggaa

SEQ ID NO: 1456493 - RNA, 19 nt, Homo sapiens
aaacgcuggucuucuuuua

SEQ ID NO: 1456494 - RNA, 19 nt, Homo sapiens
gaaaagggaguaaauuaag

SEQ ID NO: 1456495 - RNA, 19 nt, Homo sapiens
gaagacuccuuugagaaaa

SEQ ID NO: 1456496 - RNA, 19 nt, Homo sapiens
augcaucucucaugguuga

SEQ ID NO: 1456497 - RNA, 19 nt, Homo sapiens
acgcaaagaauaccuaaga

SEQ ID NO: 1456498 - RNA, 19 nt, Homo sapiens
gcuucaguccuaggaauua

SEQ ID NO: 1456499 - RNA, 19 nt, Homo sapiens
gaauaccuaagagacuaua

SEQ ID NO: 1456500 - RNA, 19 nt, Homo sapiens
agaaauacuguuugagaga

SEQ ID NO: 1456501 - RNA, 19 nt, Homo sapiens
gaaagacucauugaagacu

SEQ ID NO: 1456502 - RNA, 19 nt, Homo sapiens
uggaacaaguuauggaaag

SEQ ID NO: 1456503 - RNA, 19 nt, Homo sapiens
ugaagaugaccuuagaaga

SEQ ID NO: 1456504 - RNA, 19 nt, Homo sapiens
gaaagucuuacaguccauu

SEQ ID NO: 1456505 - RNA, 19 nt, Homo sapiens
caaguuauggaaagaaagu

SEQ ID NO: 1456506 - RNA, 19 nt, Homo sapiens
uagcaucugcccaaaccua

SEQ ID NO: 1456507 - RNA, 19 nt, Homo sapiens
ugugggcaguugucauaaa

SEQ ID NO: 1456508 - RNA, 19 nt, Homo sapiens
gugcuucaguccuaggaau

SEQ ID NO: 1456509 - RNA, 19 nt, Homo sapiens
auugaagacuccuuugaga

SEQ ID NO: 1456510 - RNA, 19 nt, Homo sapiens
agaggagaaagaacguuua

SEQ ID NO: 1456511 - RNA, 19 nt, Homo sapiens
acgagagcuuuguaaggua

SEQ ID NO: 1456512 - RNA, 19 nt, Homo sapiens
aaaguacaguguguuuauc

SEQ ID NO: 1456513 - RNA, 19 nt, Homo sapiens
gagacgcaaagaauaccua

SEQ ID NO: 1456514 - RNA, 19 nt, Homo sapiens
uaucacgagagcuuuguaa

SEQ ID NO: 1456515 - RNA, 19 nt, Homo sapiens
aaucaagaaagacucauug

SEQ ID NO: 1456516 - RNA, 19 nt, Homo sapiens
cauggaaggaggagaugaa

SEQ ID NO: 1456517 - RNA, 19 nt, Homo sapiens
gguacuucacuuccacuuu

SEQ ID NO: 1456518 - RNA, 19 nt, Homo sapiens
caucucucaugguugaaga

SEQ ID NO: 1456519 - RNA, 19 nt, Homo sapiens
gagacuauauuccccugaa

SEQ ID NO: 1456520 - RNA, 19 nt, Homo sapiens
cuaagagaccuuccuagag

SEQ ID NO: 1456521 - RNA, 19 nt, Homo sapiens
guggagagaggagaaagaa

SEQ ID NO: 1456522 - RNA, 19 nt, Homo sapiens
cugaaaagggaguaaauua

SEQ ID NO: 1456523 - RNA, 19 nt, Homo sapiens
ucauugaagacuccuuuga

SEQ ID NO: 1456524 - RNA, 19 nt, Homo sapiens
uaccuaagagacuauauuc

SEQ ID NO: 1456525 - RNA, 19 nt, Homo sapiens
gcucaaaaccaacuauugu

SEQ ID NO: 1456526 - RNA, 19 nt, Homo sapiens
gcaucugcccaaaccuaaa

SEQ ID NO: 1456527 - RNA, 19 nt, Homo sapiens
uagaagagagacgcaaaga

SEQ ID NO: 1456528 - RNA, 19 nt, Homo sapiens
agaagagagacgcaaagaa

SEQ ID NO: 1456529 - RNA, 19 nt, Homo sapiens
aaacagcuagugcuucagu

SEQ ID NO: 1456530 - RNA, 19 nt, Homo sapiens
aaagggaguaaauuaagga

SEQ ID NO: 1456531 - RNA, 19 nt, Homo sapiens
cuggggaacuugcagcuua

SEQ ID NO: 1456532 - RNA, 19 nt, Homo sapiens
uacuucacuuccacuuuaa

SEQ ID NO: 1456533 - RNA, 19 nt, Homo sapiens
uauagcaucugcccaaacc

SEQ ID NO: 1456534 - RNA, 19 nt, Homo sapiens
ucauaaacucuucucacaa

SEQ ID NO: 1456535 - RNA, 19 nt, Homo sapiens
agagagacgcaaagaauac

SEQ ID NO: 1456536 - RNA, 19 nt, Homo sapiens
uuuguaagguacuucacuu

SEQ ID NO: 1456537 - RNA, 19 nt, Homo sapiens
gugggcaguugucauaaac

SEQ ID NO: 1456538 - RNA, 19 nt, Homo sapiens
agagaaggcaaacagacaa

SEQ ID NO: 1456539 - RNA, 19 nt, Homo sapiens
ccacacacacccuguuugc

SEQ ID NO: 1456540 - RNA, 19 nt, Homo sapiens
aaagaauaccuaagagacu

SEQ ID NO: 1456541 - RNA, 19 nt, Homo sapiens
acagcauucuaucauggaa

SEQ ID NO: 1456542 - RNA, 19 nt, Homo sapiens
uguauagcaucugcccaaa

SEQ ID NO: 1456543 - RNA, 19 nt, Homo sapiens
uaucauggaaggaggagau

SEQ ID NO: 1456544 - RNA, 19 nt, Homo sapiens
agaccuuccuagagugaau

SEQ ID NO: 1456545 - RNA, 19 nt, Homo sapiens
ucacgagagcuuuguaagg

SEQ ID NO: 1456546 - RNA, 19 nt, Homo sapiens
agacgcaaagaauaccuaa

SEQ ID NO: 1456547 - RNA, 19 nt, Homo sapiens
uugcuuccauuucauccaa

SEQ ID NO: 1456548 - RNA, 19 nt, Homo sapiens
gaaugaagguacuuuugcu

SEQ ID NO: 1456549 - RNA, 19 nt, Homo sapiens
gcugcucuuuguccucugu

SEQ ID NO: 1456550 - RNA, 19 nt, Homo sapiens
gaaggaauuugacaagaaa

SEQ ID NO: 1456551 - RNA, 19 nt, Homo sapiens
caaagcacuucaucuauuu

SEQ ID NO: 1456552 - RNA, 19 nt, Homo sapiens
ggacauugcugccuauauc

SEQ ID NO: 1456553 - RNA, 19 nt, Homo sapiens
ggaaggcagugaucaagaa

SEQ ID NO: 1456554 - RNA, 19 nt, Homo sapiens
acaaagcacuucaucuauu

SEQ ID NO: 1456555 - RNA, 19 nt, Homo sapiens
agacaaagcacuucaucua

SEQ ID NO: 1456556 - RNA, 19 nt, Homo sapiens
agaaggaauuugacaagaa

SEQ ID NO: 1456557 - RNA, 19 nt, Homo sapiens
gaaguacaauauagagaag

SEQ ID NO: 1456558 - RNA, 19 nt, Homo sapiens
gaaggacauugcugccuau

SEQ ID NO: 1456559 - RNA, 19 nt, Homo sapiens
gaucaagaacgcagacaug

SEQ ID NO: 1456560 - RNA, 19 nt, Homo sapiens
gacaaagcacuucaucuau

SEQ ID NO: 1456561 - RNA, 19 nt, Homo sapiens
guaugucgcaguaaacaaa

SEQ ID NO: 1456562 - RNA, 19 nt, Homo sapiens
gcuacugcauggacuguau

SEQ ID NO: 1456563 - RNA, 19 nt, Homo sapiens
ucauguguaugucgcagua

SEQ ID NO: 1456564 - RNA, 19 nt, Homo sapiens
uauacucgauuucaugugu

SEQ ID NO: 1456565 - RNA, 19 nt, Homo sapiens
aacccuaccuggcauugua

SEQ ID NO: 1456566 - RNA, 19 nt, Homo sapiens
ccauggagaaguacaauau

SEQ ID NO: 1456567 - RNA, 19 nt, Homo sapiens
gcaauccuccucuucaagu

SEQ ID NO: 1456568 - RNA, 19 nt, Homo sapiens
caagaaggaauuugacaag

SEQ ID NO: 1456569 - RNA, 19 nt, Homo sapiens
gagaaguacaauauagaga

SEQ ID NO: 1456570 - RNA, 19 nt, Homo sapiens
ggacucgccuccgugaagu

SEQ ID NO: 1456571 - RNA, 19 nt, Homo sapiens
cgcaggccauggagaagua

SEQ ID NO: 1456572 - RNA, 19 nt, Homo sapiens
ggagaaguacaauauagag

SEQ ID NO: 1456573 - RNA, 19 nt, Homo sapiens
ccacgcaggccauggagaa

SEQ ID NO: 1456574 - RNA, 19 nt, Homo sapiens
aagaaggaauuugacaaga

SEQ ID NO: 1456575 - RNA, 19 nt, Homo sapiens
caauauagagaaggacauu

SEQ ID NO: 1456576 - RNA, 19 nt, Homo sapiens
cauggagaaguacaauaua

SEQ ID NO: 1456577 - RNA, 19 nt, Homo sapiens
cugccuauaucaagaagga

SEQ ID NO: 1456578 - RNA, 19 nt, Homo sapiens
uggacuguauacucgauuu

SEQ ID NO: 1456579 - RNA, 19 nt, Homo sapiens
auacucgauuucaugugua

SEQ ID NO: 1456580 - RNA, 19 nt, Homo sapiens
auggagaaguacaauauag

SEQ ID NO: 1456581 - RNA, 19 nt, Homo sapiens
gccauggagaaguacaaua

SEQ ID NO: 1456582 - RNA, 19 nt, Homo sapiens
uccaauggcugugcuacug

SEQ ID NO: 1456583 - RNA, 19 nt, Homo sapiens
aguacaauauagagaagga

SEQ ID NO: 1456584 - RNA, 19 nt, Homo sapiens
ggacuguauacucgauuuc

SEQ ID NO: 1456585 - RNA, 19 nt, Homo sapiens
uugcaauccuccucuucaa

SEQ ID NO: 1456586 - RNA, 19 nt, Homo sapiens
gagacaaagcacuucaucu

SEQ ID NO: 1456587 - RNA, 19 nt, Homo sapiens
gacauugcugccuauauca

SEQ ID NO: 1456588 - RNA, 19 nt, Homo sapiens
cuacugcauggacuguaua

SEQ ID NO: 1456589 - RNA, 19 nt, Homo sapiens
cgagacaaagcacuucauc

SEQ ID NO: 1456590 - RNA, 19 nt, Homo sapiens
uggagaaguacaauauaga

SEQ ID NO: 1456591 - RNA, 19 nt, Homo sapiens
cauggacuguauacucgau

SEQ ID NO: 1456592 - RNA, 19 nt, Homo sapiens
caggcuagguggccauggu

SEQ ID NO: 1456593 - RNA, 19 nt, Homo sapiens
ucacacacgagacaaagca

SEQ ID NO: 1456594 - RNA, 19 nt, Homo sapiens
ggaaauaugucugaguuua

SEQ ID NO: 1456595 - RNA, 19 nt, Homo sapiens
ggaauaaaguggaugacua

SEQ ID NO: 1456596 - RNA, 19 nt, Homo sapiens
caacauaaauacagcaaga

SEQ ID NO: 1456597 - RNA, 19 nt, Homo sapiens
gaagcuaauuuaccuugua

SEQ ID NO: 1456598 - RNA, 19 nt, Homo sapiens
gauggagaauucaacauaa

SEQ ID NO: 1456599 - RNA, 19 nt, Homo sapiens
gagagaacauucaauugau

SEQ ID NO: 1456600 - RNA, 19 nt, Homo sapiens
ggaacagauuuguaauuug

SEQ ID NO: 1456601 - RNA, 19 nt, Homo sapiens
ugaaaugccugaccaagau

SEQ ID NO: 1456602 - RNA, 19 nt, Homo sapiens
cugaagaguugucugcuua

SEQ ID NO: 1456603 - RNA, 19 nt, Homo sapiens
gcacaagcgaugcuaauga

SEQ ID NO: 1456604 - RNA, 19 nt, Homo sapiens
uugcagaacuugaagcuaa

SEQ ID NO: 1456605 - RNA, 19 nt, Homo sapiens
uaaagagguugcagaacuu

SEQ ID NO: 1456606 - RNA, 19 nt, Homo sapiens
aaggaggacuuccggaaua

SEQ ID NO: 1456607 - RNA, 19 nt, Homo sapiens
gaugauccacugaauauug

SEQ ID NO: 1456608 - RNA, 19 nt, Homo sapiens
gguaaaggcagcaguaaug

SEQ ID NO: 1456609 - RNA, 19 nt, Homo sapiens
cauuguagauggagaauuc

SEQ ID NO: 1456610 - RNA, 19 nt, Homo sapiens
cuaaugauguguucagugu

SEQ ID NO: 1456611 - RNA, 19 nt, Homo sapiens
ugagagaacauucaauuga

SEQ ID NO: 1456612 - RNA, 19 nt, Homo sapiens
cacuguagaucucuuauug

SEQ ID NO: 1456613 - RNA, 19 nt, Homo sapiens
caguguaacucgcagauug

SEQ ID NO: 1456614 - RNA, 19 nt, Homo sapiens
aaugauguguucaguguaa

SEQ ID NO: 1456615 - RNA, 19 nt, Homo sapiens
caaauugcuuguuaaagag

SEQ ID NO: 1456616 - RNA, 19 nt, Homo sapiens
cugcuuaccuuaacauguu

SEQ ID NO: 1456617 - RNA, 19 nt, Homo sapiens
caguuugucucuaacauga

SEQ ID NO: 1456618 - RNA, 19 nt, Homo sapiens
caaacguuaugccagauga

SEQ ID NO: 1456619 - RNA, 19 nt, Homo sapiens
guacauguaaagugcauuu

SEQ ID NO: 1456620 - RNA, 19 nt, Homo sapiens
uuaaagagguugcagaacu

SEQ ID NO: 1456621 - RNA, 19 nt, Homo sapiens
aagcaacuauugaagagaa

SEQ ID NO: 1456622 - RNA, 19 nt, Homo sapiens
gaacuugaagcuaauuuac

SEQ ID NO: 1456623 - RNA, 19 nt, Homo sapiens
gauacccgcuacaaacugu

SEQ ID NO: 1456624 - RNA, 19 nt, Homo sapiens
gcgugacgauggucucaaa

SEQ ID NO: 1456625 - RNA, 19 nt, Homo sapiens
uguauaggcuguuggugaa

SEQ ID NO: 1456626 - RNA, 19 nt, Homo sapiens
gaauaaaguggaugacuac

SEQ ID NO: 1456627 - RNA, 19 nt, Homo sapiens
cuguagaucucuuauugaa

SEQ ID NO: 1456628 - RNA, 19 nt, Homo sapiens
gcuacaaacugugauugga

SEQ ID NO: 1456629 - RNA, 19 nt, Homo sapiens
uauugaagcugcagaacau

SEQ ID NO: 1456630 - RNA, 19 nt, Homo sapiens
gauccaaacaagcuucauu

SEQ ID NO: 1456631 - RNA, 19 nt, Homo sapiens
guauagagcagacagaaag

SEQ ID NO: 1456632 - RNA, 19 nt, Homo sapiens
uaagauacccgcuacaaac

SEQ ID NO: 1456633 - RNA, 19 nt, Homo sapiens
cacaagcgaugcuaaugau

SEQ ID NO: 1456634 - RNA, 19 nt, Homo sapiens
gaauauugaagcugcagaa

SEQ ID NO: 1456635 - RNA, 19 nt, Homo sapiens
uguuacaguuugucucuaa

SEQ ID NO: 1456636 - RNA, 19 nt, Homo sapiens
caugaaacagcaagaggua

SEQ ID NO: 1456637 - RNA, 19 nt, Homo sapiens
agagaacauucaauugaug

SEQ ID NO: 1456638 - RNA, 19 nt, Homo sapiens
cauggugccucccaaagug

SEQ ID NO: 1456639 - RNA, 19 nt, Homo sapiens
caacauggugccucccaaa

SEQ ID NO: 1456640 - RNA, 19 nt, Homo sapiens
gcauagagucauucacugu

SEQ ID NO: 1456641 - RNA, 19 nt, Homo sapiens
agaguugucugcuuaccuu

SEQ ID NO: 1456642 - RNA, 19 nt, Homo sapiens
agauggagaauucaacaua

SEQ ID NO: 1456643 - RNA, 19 nt, Homo sapiens
ccacaagaacauuaaagga

SEQ ID NO: 1456644 - RNA, 19 nt, Homo sapiens
guuugucucuaacaugaaa

SEQ ID NO: 1456645 - RNA, 19 nt, Homo sapiens
gcaggcccauggacugugu

SEQ ID NO: 1456646 - RNA, 19 nt, Homo sapiens
augacuacaucaaacguua

SEQ ID NO: 1456647 - RNA, 19 nt, Homo sapiens
caaaaucucuuagcuucuu

SEQ ID NO: 1456648 - RNA, 19 nt, Homo sapiens
gugaaaugccugaccaaga

SEQ ID NO: 1456649 - RNA, 19 nt, Homo sapiens
cauagagucauucacugua

SEQ ID NO: 1456650 - RNA, 19 nt, Homo sapiens
ugugaagccucccagaaug

SEQ ID NO: 1456651 - RNA, 19 nt, Homo sapiens
uagcuucuuucacgaaugu

SEQ ID NO: 1456652 - RNA, 19 nt, Homo sapiens
gcuguuggugaaauucuua

SEQ ID NO: 1456653 - RNA, 19 nt, Homo sapiens
caagcgaugcuaaugaugu

SEQ ID NO: 1456654 - RNA, 19 nt, Homo sapiens
gcuagcaaguaaacugaag

SEQ ID NO: 1456655 - RNA, 19 nt, Homo sapiens
cacaagaacauuaaaggau

SEQ ID NO: 1456656 - RNA, 19 nt, Homo sapiens
ggggaaauaugucugaguu

SEQ ID NO: 1456657 - RNA, 19 nt, Homo sapiens
cuaccaggguggaaaauuu

SEQ ID NO: 1456658 - RNA, 19 nt, Homo sapiens
aaacugugauuggaugcaa

SEQ ID NO: 1456659 - RNA, 19 nt, Homo sapiens
ccaguccugugaccauguu

SEQ ID NO: 1456660 - RNA, 19 nt, Homo sapiens
caaggaggacuuccggaau

SEQ ID NO: 1456661 - RNA, 19 nt, Homo sapiens
gaagcugcagaacaucauu

SEQ ID NO: 1456662 - RNA, 19 nt, Homo sapiens
ggaugucguuuggggauua

SEQ ID NO: 1456663 - RNA, 19 nt, Homo sapiens
cauuaaaggaugucguuug

SEQ ID NO: 1456664 - RNA, 19 nt, Homo sapiens
aggaggacuuccggaauaa

SEQ ID NO: 1456665 - RNA, 19 nt, Homo sapiens
gggaaauaugucugaguuu

SEQ ID NO: 1456666 - RNA, 19 nt, Homo sapiens
cauguugcccugaagaaga

SEQ ID NO: 1456667 - RNA, 19 nt, Homo sapiens
augauccacugaauauuga

SEQ ID NO: 1456668 - RNA, 19 nt, Homo sapiens
gcucccacaagaacauuaa

SEQ ID NO: 1456669 - RNA, 19 nt, Homo sapiens
uagagucauucacuguaga

SEQ ID NO: 1456670 - RNA, 19 nt, Homo sapiens
guagauggagaauucaaca

SEQ ID NO: 1456671 - RNA, 19 nt, Homo sapiens
uugaugauccacugaauau

SEQ ID NO: 1456672 - RNA, 19 nt, Homo sapiens
gcccauggacuguguuaca

SEQ ID NO: 1456673 - RNA, 19 nt, Homo sapiens
gcagaacuugaagcuaauu

SEQ ID NO: 1456674 - RNA, 19 nt, Homo sapiens
caggguaaaggcagcagua

SEQ ID NO: 1456675 - RNA, 19 nt, Homo sapiens
ucggaggguuucugugaga

SEQ ID NO: 1456676 - RNA, 19 nt, Homo sapiens
gcuaauuuaccuuguacau

SEQ ID NO: 1456677 - RNA, 19 nt, Homo sapiens
aagcgaugcuaaugaugug

SEQ ID NO: 1456678 - RNA, 19 nt, Homo sapiens
uauaggcuguuggugaaau

SEQ ID NO: 1456679 - RNA, 19 nt, Homo sapiens
ucugaagaguugucugcuu

SEQ ID NO: 1456680 - RNA, 19 nt, Homo sapiens
gaggacuuccggaauaaag

SEQ ID NO: 1456681 - RNA, 19 nt, Homo sapiens
ggaggacuuccggaauaaa

SEQ ID NO: 1456682 - RNA, 19 nt, Homo sapiens
auuaaaggaugucguuugg

SEQ ID NO: 1456683 - RNA, 19 nt, Homo sapiens
cugccuagauguugugaag

SEQ ID NO: 1456684 - RNA, 19 nt, Homo sapiens
ugaagcuaauuuaccuugu

SEQ ID NO: 1456685 - RNA, 19 nt, Homo sapiens
gaaaugccugaccaagauc

SEQ ID NO: 1456686 - RNA, 19 nt, Homo sapiens
gucauucacuguagaucuc

SEQ ID NO: 1456687 - RNA, 19 nt, Homo sapiens
auaagauacccgcuacaaa

SEQ ID NO: 1456688 - RNA, 19 nt, Homo sapiens
gcucauuguagauggagaa

SEQ ID NO: 1456689 - RNA, 19 nt, Homo sapiens
aauaagauacccgcuacaa

SEQ ID NO: 1456690 - RNA, 19 nt, Homo sapiens
ucacuguagaucucuuauu

SEQ ID NO: 1456691 - RNA, 19 nt, Homo sapiens
auagagucauucacuguag

SEQ ID NO: 1456692 - RNA, 19 nt, Homo sapiens
guugugaagccucccagaa

SEQ ID NO: 1456693 - RNA, 19 nt, Homo sapiens
cagaugaggguuacuacca

SEQ ID NO: 1456694 - RNA, 19 nt, Homo sapiens
gcaaggagcaugugcagaa

SEQ ID NO: 1456695 - RNA, 19 nt, Homo sapiens
ggauccaguucaccaaaua

SEQ ID NO: 1456696 - RNA, 19 nt, Homo sapiens
gcaccgacuucuucauuga

SEQ ID NO: 1456697 - RNA, 19 nt, Homo sapiens
gaaggcggaugacaagugu

SEQ ID NO: 1456698 - RNA, 19 nt, Homo sapiens
gggaauggcugugcagaug

SEQ ID NO: 1456699 - RNA, 19 nt, Homo sapiens
gcagacauauggccaggau

SEQ ID NO: 1456700 - RNA, 19 nt, Homo sapiens
gcugugcccucaaccauga

SEQ ID NO: 1456701 - RNA, 19 nt, Homo sapiens
cagcaacugugacggauug

SEQ ID NO: 1456702 - RNA, 19 nt, Homo sapiens
gaauaucguagaugagauu

SEQ ID NO: 1456703 - RNA, 19 nt, Homo sapiens
gcagcagccuggccuacaa

SEQ ID NO: 1456704 - RNA, 19 nt, Homo sapiens
gaugagcagugccgcuuug

SEQ ID NO: 1456705 - RNA, 19 nt, Homo sapiens
gcagugccgcuuugacuuu

SEQ ID NO: 1456706 - RNA, 19 nt, Homo sapiens
ggagaagaccugagacauc

SEQ ID NO: 1456707 - RNA, 19 nt, Homo sapiens
ccaggcacauccagauuga

SEQ ID NO: 1456708 - RNA, 19 nt, Homo sapiens
uggaggagauggacaccua

SEQ ID NO: 1456709 - RNA, 19 nt, Homo sapiens
gggaucaacuacucaaugg

SEQ ID NO: 1456710 - RNA, 19 nt, Homo sapiens
gguggaggaugccaaggaa

SEQ ID NO: 1456711 - RNA, 19 nt, Homo sapiens
gcagcuaccgggacccaua

SEQ ID NO: 1456712 - RNA, 19 nt, Homo sapiens
gcacagacagcaccgacuu

SEQ ID NO: 1456713 - RNA, 19 nt, Homo sapiens
gagcugcaccucucuggaa

SEQ ID NO: 1456714 - RNA, 19 nt, Homo sapiens
gaucgcuacugcuccauuc

SEQ ID NO: 1456715 - RNA, 19 nt, Homo sapiens
cuggaaagcucagugacua

SEQ ID NO: 1456716 - RNA, 19 nt, Homo sapiens
ggacacgccacccacacua

SEQ ID NO: 1456717 - RNA, 19 nt, Homo sapiens
gaucaacuacucaauggau

SEQ ID NO: 1456718 - RNA, 19 nt, Homo sapiens
uguccuaccugcugccuuu

SEQ ID NO: 1456719 - RNA, 19 nt, Homo sapiens
caggagcucuggauacaag

SEQ ID NO: 1456720 - RNA, 19 nt, Homo sapiens
cuacuucaaugucacuguu

SEQ ID NO: 1456721 - RNA, 19 nt, Homo sapiens
cuacaucccauuaacaaga

SEQ ID NO: 1456722 - RNA, 19 nt, Homo sapiens
gcgcaacuccuacuaugug

SEQ ID NO: 1456723 - RNA, 19 nt, Homo sapiens
uaucguagaugagauuuac

SEQ ID NO: 1456724 - RNA, 19 nt, Homo sapiens
cugcagagccuccuggaaa

SEQ ID NO: 1456725 - RNA, 19 nt, Homo sapiens
gccgaugucugggaacuug

SEQ ID NO: 1456726 - RNA, 19 nt, Homo sapiens
ccaacagccucgggcauug

SEQ ID NO: 1456727 - RNA, 19 nt, Homo sapiens
ccuacgagccugacgauga

SEQ ID NO: 1456728 - RNA, 19 nt, Homo sapiens
ggaaagcucagugacuaug

SEQ ID NO: 1456729 - RNA, 19 nt, Homo sapiens
gaauggcugugcagaugag

SEQ ID NO: 1456730 - RNA, 19 nt, Homo sapiens
guccucacccucaugaaua

SEQ ID NO: 1456731 - RNA, 19 nt, Homo sapiens
gaggaaaucaccagaacuc

SEQ ID NO: 1456732 - RNA, 19 nt, Homo sapiens
ggaauggcugugcagauga

SEQ ID NO: 1456733 - RNA, 19 nt, Homo sapiens
cagcaccgacuucuucauu

SEQ ID NO: 1456734 - RNA, 19 nt, Homo sapiens
agacagcaccgacuucuuc

SEQ ID NO: 1456735 - RNA, 19 nt, Homo sapiens
gggauccaguucaccaaau

SEQ ID NO: 1456736 - RNA, 19 nt, Homo sapiens
ccuacuaugugcaccagaa

SEQ ID NO: 1456737 - RNA, 19 nt, Homo sapiens
ccucaugaauaucguagau

SEQ ID NO: 1456738 - RNA, 19 nt, Homo sapiens
gggacgugguguucaugaa

SEQ ID NO: 1456739 - RNA, 19 nt, Homo sapiens
aagcgcaacuccuacuaug

SEQ ID NO: 1456740 - RNA, 19 nt, Homo sapiens
caccggcucugcugugugu

SEQ ID NO: 1456741 - RNA, 19 nt, Homo sapiens
gggauaggccagacacugu

SEQ ID NO: 1456742 - RNA, 19 nt, Homo sapiens
gaugacaaguguggagucu

SEQ ID NO: 1456743 - RNA, 19 nt, Homo sapiens
ggcaaguggugcuucaaag

SEQ ID NO: 1456744 - RNA, 19 nt, Homo sapiens
aggagcaugugcagaacua

SEQ ID NO: 1456745 - RNA, 19 nt, Homo sapiens
caaagggcaaccuggagaa

SEQ ID NO: 1456746 - RNA, 19 nt, Homo sapiens
ggagcauccuggagcaucu

SEQ ID NO: 1456747 - RNA, 19 nt, Homo sapiens
gaaagccaacgggaucaga

SEQ ID NO: 1456748 - RNA, 19 nt, Homo sapiens
gccacucccucuacuucaa

SEQ ID NO: 1456749 - RNA, 19 nt, Homo sapiens
gagauggacaccuaugagu

SEQ ID NO: 1456750 - RNA, 19 nt, Homo sapiens
gaggagggauccaguucac

SEQ ID NO: 1456751 - RNA, 19 nt, Homo sapiens
gugccaagcgcaacuccua

SEQ ID NO: 1456752 - RNA, 19 nt, Homo sapiens
gagcagugccgcuuugacu

SEQ ID NO: 1456753 - RNA, 19 nt, Homo sapiens
gagcaugugcagaacuaug

SEQ ID NO: 1456754 - RNA, 19 nt, Homo sapiens
uggaguggcaggaggauuu

SEQ ID NO: 1456755 - RNA, 19 nt, Homo sapiens
gcagccuggccuacaagua

SEQ ID NO: 1456756 - RNA, 19 nt, Homo sapiens
ccagaagugugagcugauc

SEQ ID NO: 1456757 - RNA, 19 nt, Homo sapiens
cuccucagccuucgugaua

SEQ ID NO: 1456758 - RNA, 19 nt, Homo sapiens
ggagauggacaccuaugag

SEQ ID NO: 1456759 - RNA, 19 nt, Homo sapiens
gcaaguggugcuucaaagg

SEQ ID NO: 1456760 - RNA, 19 nt, Homo sapiens
ccaucccacuggcacguuu

SEQ ID NO: 1456761 - RNA, 19 nt, Homo sapiens
cagacgagaccaccacaug

SEQ ID NO: 1456762 - RNA, 19 nt, Homo sapiens
ggaggagggauccaguuca

SEQ ID NO: 1456763 - RNA, 19 nt, Homo sapiens
caagcgcaacuccuacuau

SEQ ID NO: 1456764 - RNA, 19 nt, Homo sapiens
gccaacagccucgggcauu

SEQ ID NO: 1456765 - RNA, 19 nt, Homo sapiens
ccaugaaggcggaugacaa

SEQ ID NO: 1456766 - RNA, 19 nt, Homo sapiens
uagggcccauguucgagua

SEQ ID NO: 1456767 - RNA, 19 nt, Homo sapiens
gugcuuagggcccauguuc

SEQ ID NO: 1456768 - RNA, 19 nt, Homo sapiens
acgacugccuccucgauga

SEQ ID NO: 1456769 - RNA, 19 nt, Homo sapiens
ugagcaccaugaccacguu

SEQ ID NO: 1456770 - RNA, 19 nt, Homo sapiens
ggacccagcaucccuuugc

SEQ ID NO: 1456771 - RNA, 19 nt, Homo sapiens
gaaagcucagugacuaugg

SEQ ID NO: 1456772 - RNA, 19 nt, Homo sapiens
gccacaagccggaccuuca

SEQ ID NO: 1456773 - RNA, 19 nt, Homo sapiens
gccaggcacauccagauug

SEQ ID NO: 1456774 - RNA, 19 nt, Homo sapiens
ugaaggcggaugacaagug

SEQ ID NO: 1456775 - RNA, 19 nt, Homo sapiens
caaguggugcuucaaaggu

SEQ ID NO: 1456776 - RNA, 19 nt, Homo sapiens
gugcagccauccugacaac

SEQ ID NO: 1456777 - RNA, 19 nt, Homo sapiens
ggaugagcagugccgcuuu

SEQ ID NO: 1456778 - RNA, 19 nt, Homo sapiens
gagcugugcccucaaccau

SEQ ID NO: 1456779 - RNA, 19 nt, Homo sapiens
ccugcacaaugaagccuuu

SEQ ID NO: 1456780 - RNA, 19 nt, Homo sapiens
caugaaggcggaugacaag

SEQ ID NO: 1456781 - RNA, 19 nt, Homo sapiens
cuacgagccugacgaugac

SEQ ID NO: 1456782 - RNA, 19 nt, Homo sapiens
gcaccaugaccacguugug

SEQ ID NO: 1456783 - RNA, 19 nt, Homo sapiens
ugaauaucguagaugagau

SEQ ID NO: 1456784 - RNA, 19 nt, Homo sapiens
gcgccacucccucuacuuc

SEQ ID NO: 1456785 - RNA, 19 nt, Homo sapiens
gcaggcaggagcucucaag

SEQ ID NO: 1456786 - RNA, 19 nt, Homo sapiens
ccaagcgcaacuccuacua

SEQ ID NO: 1456787 - RNA, 19 nt, Homo sapiens
gcuuagggcccauguucga

SEQ ID NO: 1456788 - RNA, 19 nt, Homo sapiens
ucaacuacucaauggauga

SEQ ID NO: 1456789 - RNA, 19 nt, Homo sapiens
gacagucccugagccugau

SEQ ID NO: 1456790 - RNA, 19 nt, Homo sapiens
uacaucccauuaacaagau

SEQ ID NO: 1456791 - RNA, 19 nt, Homo sapiens
gaaccccuacaucccauua

SEQ ID NO: 1456792 - RNA, 19 nt, Homo sapiens
uggaggaaaucaccagaac

SEQ ID NO: 1456793 - RNA, 19 nt, Homo sapiens
ccaauggaacccacaaggu

SEQ ID NO: 1456794 - RNA, 19 nt, Homo sapiens
gcaaggagcaugugcagaa

SEQ ID NO: 1456795 - RNA, 19 nt, Homo sapiens
ggauccaguucaccaaaua

SEQ ID NO: 1456796 - RNA, 19 nt, Homo sapiens
gcaccgacuucuucauuga

SEQ ID NO: 1456797 - RNA, 19 nt, Homo sapiens
gaaggcggaugacaagugu

SEQ ID NO: 1456798 - RNA, 19 nt, Homo sapiens
gggaauggcugugcagaug

SEQ ID NO: 1456799 - RNA, 19 nt, Homo sapiens
gcagacauauggccaggau

SEQ ID NO: 1456800 - RNA, 19 nt, Homo sapiens
gcugugcccucaaccauga

SEQ ID NO: 1456801 - RNA, 19 nt, Homo sapiens
cagcaacugugacggauug

SEQ ID NO: 1456802 - RNA, 19 nt, Homo sapiens
gaauaucguagaugagauu

SEQ ID NO: 1456803 - RNA, 19 nt, Homo sapiens
gcagcagccuggccuacaa

SEQ ID NO: 1456804 - RNA, 19 nt, Homo sapiens
gaugagcagugccgcuuug

SEQ ID NO: 1456805 - RNA, 19 nt, Homo sapiens
gcagugccgcuuugacuuu

SEQ ID NO: 1456806 - RNA, 19 nt, Homo sapiens
ggagaagaccugagacauc

SEQ ID NO: 1456807 - RNA, 19 nt, Homo sapiens
ccaggcacauccagauuga

SEQ ID NO: 1456808 - RNA, 19 nt, Homo sapiens
uggaggagauggacaccua

SEQ ID NO: 1456809 - RNA, 19 nt, Homo sapiens
gggaucaacuacucaaugg

SEQ ID NO: 1456810 - RNA, 19 nt, Homo sapiens
gguggaggaugccaaggaa

SEQ ID NO: 1456811 - RNA, 19 nt, Homo sapiens
gcagcuaccgggacccaua

SEQ ID NO: 1456812 - RNA, 19 nt, Homo sapiens
gcacagacagcaccgacuu

SEQ ID NO: 1456813 - RNA, 19 nt, Homo sapiens
gagcugcaccucucuggaa

SEQ ID NO: 1456814 - RNA, 19 nt, Homo sapiens
gaucgcuacugcuccauuc

SEQ ID NO: 1456815 - RNA, 19 nt, Homo sapiens
cuggaaagcucagugacua

SEQ ID NO: 1456816 - RNA, 19 nt, Homo sapiens
ggacacgccacccacacua

SEQ ID NO: 1456817 - RNA, 19 nt, Homo sapiens
gaucaacuacucaauggau

SEQ ID NO: 1456818 - RNA, 19 nt, Homo sapiens
uguccuaccugcugccuuu

SEQ ID NO: 1456819 - RNA, 19 nt, Homo sapiens
caggagcucuggauacaag

SEQ ID NO: 1456820 - RNA, 19 nt, Homo sapiens
cuacuucaaugucacuguu

SEQ ID NO: 1456821 - RNA, 19 nt, Homo sapiens
cuacaucccauuaacaaga

SEQ ID NO: 1456822 - RNA, 19 nt, Homo sapiens
uaucguagaugagauuuac

SEQ ID NO: 1456823 - RNA, 19 nt, Homo sapiens
cugcagagccuccuggaaa

SEQ ID NO: 1456824 - RNA, 19 nt, Homo sapiens
gccgaugucugggaacuug

SEQ ID NO: 1456825 - RNA, 19 nt, Homo sapiens
ccaacagccucgggcauug

SEQ ID NO: 1456826 - RNA, 19 nt, Homo sapiens
ccuacgagccugacgauga

SEQ ID NO: 1456827 - RNA, 19 nt, Homo sapiens
ggaaagcucagugacuaug

SEQ ID NO: 1456828 - RNA, 19 nt, Homo sapiens
gaauggcugugcagaugag

SEQ ID NO: 1456829 - RNA, 19 nt, Homo sapiens
guccucacccucaugaaua

SEQ ID NO: 1456830 - RNA, 19 nt, Homo sapiens
gaggaaaucaccagaacuc

SEQ ID NO: 1456831 - RNA, 19 nt, Homo sapiens
gugccaagcgcaacucgua

SEQ ID NO: 1456832 - RNA, 19 nt, Homo sapiens
ggaauggcugugcagauga

SEQ ID NO: 1456833 - RNA, 19 nt, Homo sapiens
cagcaccgacuucuucauu

SEQ ID NO: 1456834 - RNA, 19 nt, Homo sapiens
agacagcaccgacuucuuc

SEQ ID NO: 1456835 - RNA, 19 nt, Homo sapiens
gggauccaguucaccaaau

SEQ ID NO: 1456836 - RNA, 19 nt, Homo sapiens
cguacuaugugcaccagaa

SEQ ID NO: 1456837 - RNA, 19 nt, Homo sapiens
ccucaugaauaucguagau

SEQ ID NO: 1456838 - RNA, 19 nt, Homo sapiens
gggacgugguguucaugaa

SEQ ID NO: 1456839 - RNA, 19 nt, Homo sapiens
aagcgcaacucguacuaug

SEQ ID NO: 1456840 - RNA, 19 nt, Homo sapiens
caccggcucugcugugugu

SEQ ID NO: 1456841 - RNA, 19 nt, Homo sapiens
gggauaggccagacacugu

SEQ ID NO: 1456842 - RNA, 19 nt, Homo sapiens
gaugacaaguguggagucu

SEQ ID NO: 1456843 - RNA, 19 nt, Homo sapiens
gcgcaacucguacuaugug

SEQ ID NO: 1456844 - RNA, 19 nt, Homo sapiens
ggcaaguggugcuucaaag

SEQ ID NO: 1456845 - RNA, 19 nt, Homo sapiens
aggagcaugugcagaacua

SEQ ID NO: 1456846 - RNA, 19 nt, Homo sapiens
caaagggcaaccuggagaa

SEQ ID NO: 1456847 - RNA, 19 nt, Homo sapiens
ggagcauccuggagcaucu

SEQ ID NO: 1456848 - RNA, 19 nt, Homo sapiens
gaaagccaacgggaucaga

SEQ ID NO: 1456849 - RNA, 19 nt, Homo sapiens
gccacucccucuacuucaa

SEQ ID NO: 1456850 - RNA, 19 nt, Homo sapiens
gagauggacaccuaugagu

SEQ ID NO: 1456851 - RNA, 19 nt, Homo sapiens
gaggagggauccaguucac

SEQ ID NO: 1456852 - RNA, 19 nt, Homo sapiens
gagcagugccgcuuugacu

SEQ ID NO: 1456853 - RNA, 19 nt, Homo sapiens
gagcaugugcagaacuaug

SEQ ID NO: 1456854 - RNA, 19 nt, Homo sapiens
uggaguggcaggaggauuu

SEQ ID NO: 1456855 - RNA, 19 nt, Homo sapiens
gcagccuggccuacaagua

SEQ ID NO: 1456856 - RNA, 19 nt, Homo sapiens
ccagaagugugagcugauc

SEQ ID NO: 1456857 - RNA, 19 nt, Homo sapiens
cuccucagccuucgugaua

SEQ ID NO: 1456858 - RNA, 19 nt, Homo sapiens
ggagauggacaccuaugag

SEQ ID NO: 1456859 - RNA, 19 nt, Homo sapiens
gcaaguggugcuucaaagg

SEQ ID NO: 1456860 - RNA, 19 nt, Homo sapiens
ccaucccacuggcacguuu

SEQ ID NO: 1456861 - RNA, 19 nt, Homo sapiens
cagacgagaccaccacaug

SEQ ID NO: 1456862 - RNA, 19 nt, Homo sapiens
ggaggagggauccaguuca

SEQ ID NO: 1456863 - RNA, 19 nt, Homo sapiens
gccaacagccucgggcauu

SEQ ID NO: 1456864 - RNA, 19 nt, Homo sapiens
ccaugaaggcggaugacaa

SEQ ID NO: 1456865 - RNA, 19 nt, Homo sapiens
uagggcccauguucgagua

SEQ ID NO: 1456866 - RNA, 19 nt, Homo sapiens
gugcuuagggcccauguuc

SEQ ID NO: 1456867 - RNA, 19 nt, Homo sapiens
acgacugccuccucgauga

SEQ ID NO: 1456868 - RNA, 19 nt, Homo sapiens
gacuuugggcccucaggua

SEQ ID NO: 1456869 - RNA, 19 nt, Homo sapiens
ugagcaccaugaccacguu

SEQ ID NO: 1456870 - RNA, 19 nt, Homo sapiens
ggacccagcaucccuuugc

SEQ ID NO: 1456871 - RNA, 19 nt, Homo sapiens
gaaagcucagugacuaugg

SEQ ID NO: 1456872 - RNA, 19 nt, Homo sapiens
gccacaagccggaccuuca

SEQ ID NO: 1456873 - RNA, 19 nt, Homo sapiens
gccaggcacauccagauug

SEQ ID NO: 1456874 - RNA, 19 nt, Homo sapiens
ugaaggcggaugacaagug

SEQ ID NO: 1456875 - RNA, 19 nt, Homo sapiens
caaguggugcuucaaaggu

SEQ ID NO: 1456876 - RNA, 19 nt, Homo sapiens
gugcagccauccugacaac

SEQ ID NO: 1456877 - RNA, 19 nt, Homo sapiens
ggaugagcagugccgcuuu

SEQ ID NO: 1456878 - RNA, 19 nt, Homo sapiens
gagcugugcccucaaccau

SEQ ID NO: 1456879 - RNA, 19 nt, Homo sapiens
ccugcacaaugaagccuuu

SEQ ID NO: 1456880 - RNA, 19 nt, Homo sapiens
caugaaggcggaugacaag

SEQ ID NO: 1456881 - RNA, 19 nt, Homo sapiens
cuacgagccugacgaugac

SEQ ID NO: 1456882 - RNA, 19 nt, Homo sapiens
gcaccaugaccacguugug

SEQ ID NO: 1456883 - RNA, 19 nt, Homo sapiens
ugaauaucguagaugagau

SEQ ID NO: 1456884 - RNA, 19 nt, Homo sapiens
gcgccacucccucuacuuc

SEQ ID NO: 1456885 - RNA, 19 nt, Homo sapiens
gcaggcaggagcucucaag

SEQ ID NO: 1456886 - RNA, 19 nt, Homo sapiens
ccaagcgcaacucguacua

SEQ ID NO: 1456887 - RNA, 19 nt, Homo sapiens
gcuuagggcccauguucga

SEQ ID NO: 1456888 - RNA, 19 nt, Homo sapiens
ucaacuacucaauggauga

SEQ ID NO: 1456889 - RNA, 19 nt, Homo sapiens
gacagucccugagccugau

SEQ ID NO: 1456890 - RNA, 19 nt, Homo sapiens
uacaucccauuaacaagau

SEQ ID NO: 1456891 - RNA, 19 nt, Homo sapiens
gaaccccuacaucccauua

SEQ ID NO: 1456892 - RNA, 19 nt, Homo sapiens
uggaggaaaucaccagaac

SEQ ID NO: 1456893 - RNA, 19 nt, Homo sapiens
ccaauggaacccacaaggu

SEQ ID NO: 1456894 - RNA, 19 nt, Homo sapiens
guacagcggugaaaucaua

SEQ ID NO: 1456895 - RNA, 19 nt, Homo sapiens
auacaacgcugucauauuu

SEQ ID NO: 1456896 - RNA, 19 nt, Homo sapiens
gacauuggauacaaaguua

SEQ ID NO: 1456897 - RNA, 19 nt, Homo sapiens
gaacuccucuuucauagau

SEQ ID NO: 1456898 - RNA, 19 nt, Homo sapiens
guaaagagcuacuccaaag

SEQ ID NO: 1456899 - RNA, 19 nt, Homo sapiens
ggaucuugcuguccaauuu

SEQ ID NO: 1456900 - RNA, 19 nt, Homo sapiens
gaaagugccgaacaguuua

SEQ ID NO: 1456901 - RNA, 19 nt, Homo sapiens
gaaugagacuccuggaaau

SEQ ID NO: 1456902 - RNA, 19 nt, Homo sapiens
uuucauagaucgugacuuu

SEQ ID NO: 1456903 - RNA, 19 nt, Homo sapiens
aaggaaagaucaaggagua

SEQ ID NO: 1456904 - RNA, 19 nt, Homo sapiens
ggcaggagcuguucucuuc

SEQ ID NO: 1456905 - RNA, 19 nt, Homo sapiens
gagaugaagugcuguucuu

SEQ ID NO: 1456906 - RNA, 19 nt, Homo sapiens
gcuguucucuucugcauug

SEQ ID NO: 1456907 - RNA, 19 nt, Homo sapiens
aguaagccauccucaaaua

SEQ ID NO: 1456908 - RNA, 19 nt, Homo sapiens
ugaaagugccgaacaguuu

SEQ ID NO: 1456909 - RNA, 19 nt, Homo sapiens
gaucgugacuuuguguuau

SEQ ID NO: 1456910 - RNA, 19 nt, Homo sapiens
gcauccagcugcuuaagau

SEQ ID NO: 1456911 - RNA, 19 nt, Homo sapiens
uaacagugcucuggacaug

SEQ ID NO: 1456912 - RNA, 19 nt, Homo sapiens
ggaguaaaccagaagaaga

SEQ ID NO: 1456913 - RNA, 19 nt, Homo sapiens
gguccuaccugcaccaguu

SEQ ID NO: 1456914 - RNA, 19 nt, Homo sapiens
aaaguaagccauccucaaa

SEQ ID NO: 1456915 - RNA, 19 nt, Homo sapiens
gaguaaaccagaagaagaa

SEQ ID NO: 1456916 - RNA, 19 nt, Homo sapiens
gaaacaaagauuccaguca

SEQ ID NO: 1456917 - RNA, 19 nt, Homo sapiens
acagugcucuggacaugua

SEQ ID NO: 1456918 - RNA, 19 nt, Homo sapiens
caccaucuacccuuaaaua

SEQ ID NO: 1456919 - RNA, 19 nt, Homo sapiens
gcucaccaauggcuaaugu

SEQ ID NO: 1456920 - RNA, 19 nt, Homo sapiens
ggaaagaucaaggaguaaa

SEQ ID NO: 1456921 - RNA, 19 nt, Homo sapiens
uuccuucacuggauaaaua

SEQ ID NO: 1456922 - RNA, 19 nt, Homo sapiens
gacaugagguuccugacau

SEQ ID NO: 1456923 - RNA, 19 nt, Homo sapiens
cagcagaaguuuaaagaac

SEQ ID NO: 1456924 - RNA, 19 nt, Homo sapiens
gagcuacuccaaagaagaa

SEQ ID NO: 1456925 - RNA, 19 nt, Homo sapiens
gcagaaguuuaaagaacga

SEQ ID NO: 1456926 - RNA, 19 nt, Homo sapiens
cacaugcuguccaguuuaa

SEQ ID NO: 1456927 - RNA, 19 nt, Homo sapiens
uauaauggguggacucaca

SEQ ID NO: 1456928 - RNA, 19 nt, Homo sapiens
gggaguaugaggaugauuu

SEQ ID NO: 1456929 - RNA, 19 nt, Homo sapiens
caauaugucugggcucuca

SEQ ID NO: 1456930 - RNA, 19 nt, Homo sapiens
guaagccauccucaaauaa

SEQ ID NO: 1456931 - RNA, 19 nt, Homo sapiens
uaaccucucaguccuaauu

SEQ ID NO: 1456932 - RNA, 19 nt, Homo sapiens
caccucagccucccaagua

SEQ ID NO: 1456933 - RNA, 19 nt, Homo sapiens
acauggaauucucugauuu

SEQ ID NO: 1456934 - RNA, 19 nt, Homo sapiens
gaugggugcuuccuuguac

SEQ ID NO: 1456935 - RNA, 19 nt, Homo sapiens
ggacucaucucagguacag

SEQ ID NO: 1456936 - RNA, 19 nt, Homo sapiens
ggacuguacagccucaauu

SEQ ID NO: 1456937 - RNA, 19 nt, Homo sapiens
agaaugagacuccuggaaa

SEQ ID NO: 1456938 - RNA, 19 nt, Homo sapiens
cacacaugcuguccaguuu

SEQ ID NO: 1456939 - RNA, 19 nt, Homo sapiens
ggaguucuggaucacaaua

SEQ ID NO: 1456940 - RNA, 19 nt, Homo sapiens
ugaugucgguguuuguaaa

SEQ ID NO: 1456941 - RNA, 19 nt, Homo sapiens
guucagcugugggcaauau

SEQ ID NO: 1456942 - RNA, 19 nt, Homo sapiens
aaagagcuacuccaaagaa

SEQ ID NO: 1456943 - RNA, 19 nt, Homo sapiens
caucuacccuuaaauaucc

SEQ ID NO: 1456944 - RNA, 19 nt, Homo sapiens
uaaaccagaagaagaagaa

SEQ ID NO: 1456945 - RNA, 19 nt, Homo sapiens
ggagcucaguauucuggaa

SEQ ID NO: 1456946 - RNA, 19 nt, Homo sapiens
uagaccagcucaccaaugg

SEQ ID NO: 1456947 - RNA, 19 nt, Homo sapiens
gagcuguucucuucugcau

SEQ ID NO: 1456948 - RNA, 19 nt, Homo sapiens
acagauguuugugauguuu

SEQ ID NO: 1456949 - RNA, 19 nt, Homo sapiens
gaaacauggaauucucuga

SEQ ID NO: 1456950 - RNA, 19 nt, Homo sapiens
gauuuaugcccgugguuaa

SEQ ID NO: 1456951 - RNA, 19 nt, Homo sapiens
uaaugggaguucuggauca

SEQ ID NO: 1456952 - RNA, 19 nt, Homo sapiens
uaucagcauucacaaaucu

SEQ ID NO: 1456953 - RNA, 19 nt, Homo sapiens
ugacauuggauacaaaguu

SEQ ID NO: 1456954 - RNA, 19 nt, Homo sapiens
ggaauucucugauuuugag

SEQ ID NO: 1456955 - RNA, 19 nt, Homo sapiens
ggaguacagcggugaaauc

SEQ ID NO: 1456956 - RNA, 19 nt, Homo sapiens
gacuguaucuugacaugag

SEQ ID NO: 1456957 - RNA, 19 nt, Homo sapiens
ugagacuccuggaaauuca

SEQ ID NO: 1456958 - RNA, 19 nt, Homo sapiens
guuaucagcauucacaaau

SEQ ID NO: 1456959 - RNA, 19 nt, Homo sapiens
cucacuauguguaagauuu

SEQ ID NO: 1456960 - RNA, 19 nt, Homo sapiens
cuggaacuccucuuucaua

SEQ ID NO: 1456961 - RNA, 19 nt, Homo sapiens
gaagguuggacucaucuca

SEQ ID NO: 1456962 - RNA, 19 nt, Homo sapiens
uaacagguggagcucagua

SEQ ID NO: 1456963 - RNA, 19 nt, Homo sapiens
uuaggagcaucuauuuaug

SEQ ID NO: 1456964 - RNA, 19 nt, Homo sapiens
ucaaagcugggaaggauga

SEQ ID NO: 1456965 - RNA, 19 nt, Homo sapiens
aacauggaauucucugauu

SEQ ID NO: 1456966 - RNA, 19 nt, Homo sapiens
ggaaggaugaguucuugca

SEQ ID NO: 1456967 - RNA, 19 nt, Homo sapiens
guucuucuugucugauuua

SEQ ID NO: 1456968 - RNA, 19 nt, Homo sapiens
acacccagccgguuacaaa

SEQ ID NO: 1456969 - RNA, 19 nt, Homo sapiens
gacuguacagccucaauuu

SEQ ID NO: 1456970 - RNA, 19 nt, Homo sapiens
gaugauuuccagauccaaa

SEQ ID NO: 1456971 - RNA, 19 nt, Homo sapiens
aaaguuaucagcauucaca

SEQ ID NO: 1456972 - RNA, 19 nt, Homo sapiens
gcuauggaguccgguccua

SEQ ID NO: 1456973 - RNA, 19 nt, Homo sapiens
cuggcaaccugaaaccuuu

SEQ ID NO: 1456974 - RNA, 19 nt, Homo sapiens
cacaccaucuacccuuaaa

SEQ ID NO: 1456975 - RNA, 19 nt, Homo sapiens
ggaacuccucuuucauaga

SEQ ID NO: 1456976 - RNA, 19 nt, Homo sapiens
gaguacagcggugaaauca

SEQ ID NO: 1456977 - RNA, 19 nt, Homo sapiens
uagacuguaucuugacaug

SEQ ID NO: 1456978 - RNA, 19 nt, Homo sapiens
ucauagaucgugacuuugu

SEQ ID NO: 1456979 - RNA, 19 nt, Homo sapiens
aaagaagauuuggcguuga

SEQ ID NO: 1456980 - RNA, 19 nt, Homo sapiens
ggaguaugaggaugauuuc

SEQ ID NO: 1456981 - RNA, 19 nt, Homo sapiens
acacaugcuguccaguuua

SEQ ID NO: 1456982 - RNA, 19 nt, Homo sapiens
auccaaagaucaccuaaca

SEQ ID NO: 1456983 - RNA, 19 nt, Homo sapiens
uauacaacgcugucauauu

SEQ ID NO: 1456984 - RNA, 19 nt, Homo sapiens
ugagguuccugacauugga

SEQ ID NO: 1456985 - RNA, 19 nt, Homo sapiens
acaugagguuccugacauu

SEQ ID NO: 1456986 - RNA, 19 nt, Homo sapiens
ugaggaugauuuccagauc

SEQ ID NO: 1456987 - RNA, 19 nt, Homo sapiens
gacucacacuugcucaguu

SEQ ID NO: 1456988 - RNA, 19 nt, Homo sapiens
cuucuugucugauuuaugc

SEQ ID NO: 1456989 - RNA, 19 nt, Homo sapiens
gaaagaucaaggaguaaac

SEQ ID NO: 1456990 - RNA, 19 nt, Homo sapiens
gcaggaucuugcuguccaa

SEQ ID NO: 1456991 - RNA, 19 nt, Homo sapiens
cagccucaauuugggagua

SEQ ID NO: 1456992 - RNA, 19 nt, Homo sapiens
gaaguuuaaagaacgaauc

SEQ ID NO: 1456993 - RNA, 19 nt, Homo sapiens
uaaagagcuacuccaaaga

SEQ ID NO: 1456994 - RNA, 19 nt, Homo sapiens
ggaagcagcuguuugguuu

SEQ ID NO: 1456995 - RNA, 19 nt, Homo sapiens
ggaaagaggugcccaaucu

SEQ ID NO: 1456996 - RNA, 19 nt, Homo sapiens
ggucagcucuggauucaua

SEQ ID NO: 1456997 - RNA, 19 nt, Homo sapiens
gauccuaccucuacaagaa

SEQ ID NO: 1456998 - RNA, 19 nt, Homo sapiens
gaaaugcgaagguguuuaa

SEQ ID NO: 1456999 - RNA, 19 nt, Homo sapiens
ggaagcaccacauggauua

SEQ ID NO: 1457000 - RNA, 19 nt, Homo sapiens
gaaaugggauaaugugcuu

SEQ ID NO: 1457001 - RNA, 19 nt, Homo sapiens
gcgaagguguuuaagagua

SEQ ID NO: 1457002 - RNA, 19 nt, Homo sapiens
cuacaaacuucucaccaua

SEQ ID NO: 1457003 - RNA, 19 nt, Homo sapiens
ccucaaacauuaaagugua

SEQ ID NO: 1457004 - RNA, 19 nt, Homo sapiens
ggagagcuuucuggcaaua

SEQ ID NO: 1457005 - RNA, 19 nt, Homo sapiens
ugacagcagugcacggaua

SEQ ID NO: 1457006 - RNA, 19 nt, Homo sapiens
gcaggcagguagaguauca

SEQ ID NO: 1457007 - RNA, 19 nt, Homo sapiens
cgaagguguuuaagaguaa

SEQ ID NO: 1457008 - RNA, 19 nt, Homo sapiens
uaagagcuuugggcaguua

SEQ ID NO: 1457009 - RNA, 19 nt, Homo sapiens
agagagagaauacaaguuu

SEQ ID NO: 1457010 - RNA, 19 nt, Homo sapiens
gaaagaggugcccaaucua

SEQ ID NO: 1457011 - RNA, 19 nt, Homo sapiens
cccaggcccuugaguauuu

SEQ ID NO: 1457012 - RNA, 19 nt, Homo sapiens
gcugauuucucucucuuug

SEQ ID NO: 1457013 - RNA, 19 nt, Homo sapiens
ccagaccaaugaacuguga

SEQ ID NO: 1457014 - RNA, 19 nt, Homo sapiens
gcugaugccuugucuugug

SEQ ID NO: 1457015 - RNA, 19 nt, Homo sapiens
ggacccaaaugcaaauuac

SEQ ID NO: 1457016 - RNA, 19 nt, Homo sapiens
gcugcaagauacucuaaau

SEQ ID NO: 1457017 - RNA, 19 nt, Homo sapiens
uaucccagcuccugcauau

SEQ ID NO: 1457018 - RNA, 19 nt, Homo sapiens
ggacgaaaugggauaaugu

SEQ ID NO: 1457019 - RNA, 19 nt, Homo sapiens
gcuguguucuggaaaguug

SEQ ID NO: 1457020 - RNA, 19 nt, Homo sapiens
gaacuugcaaucacuucaa

SEQ ID NO: 1457021 - RNA, 19 nt, Homo sapiens
guugaggucugcccauaga

SEQ ID NO: 1457022 - RNA, 19 nt, Homo sapiens
agagugaacagaauacuuu

SEQ ID NO: 1457023 - RNA, 19 nt, Homo sapiens
gaaaauauuugccuuuggu

SEQ ID NO: 1457024 - RNA, 19 nt, Homo sapiens
gcacuguccuaggcauuug

SEQ ID NO: 1457025 - RNA, 19 nt, Homo sapiens
gauaaagagcaguuucaug

SEQ ID NO: 1457026 - RNA, 19 nt, Homo sapiens
gcucagagagagaauacaa

SEQ ID NO: 1457027 - RNA, 19 nt, Homo sapiens
aaagugcaguguagaaagu

SEQ ID NO: 1457028 - RNA, 19 nt, Homo sapiens
caagaucucagcccuggaa

SEQ ID NO: 1457029 - RNA, 19 nt, Homo sapiens
ucucagugcuccucaaaca

SEQ ID NO: 1457030 - RNA, 19 nt, Homo sapiens
ggguugaggucugcccaua

SEQ ID NO: 1457031 - RNA, 19 nt, Homo sapiens
gggacgaaaugggauaaug

SEQ ID NO: 1457032 - RNA, 19 nt, Homo sapiens
acaaacuucucaccauaau

SEQ ID NO: 1457033 - RNA, 19 nt, Homo sapiens
cagugcuccucaaacauua

SEQ ID NO: 1457034 - RNA, 19 nt, Homo sapiens
acaacuggcugauuucucu

SEQ ID NO: 1457035 - RNA, 19 nt, Homo sapiens
aauuacaugugcccucuaa

SEQ ID NO: 1457036 - RNA, 19 nt, Homo sapiens
ggccugagcauccauccua

SEQ ID NO: 1457037 - RNA, 19 nt, Homo sapiens
gcacggauaaagagcaguu

SEQ ID NO: 1457038 - RNA, 19 nt, Homo sapiens
uaaccucucugugcuuugu

SEQ ID NO: 1457039 - RNA, 19 nt, Homo sapiens
ccacucugauuguaaaugg

SEQ ID NO: 1457040 - RNA, 19 nt, Homo sapiens
ccuauugccugagaucuug

SEQ ID NO: 1457041 - RNA, 19 nt, Homo sapiens
uuacagaugaggaaacuga

SEQ ID NO: 1457042 - RNA, 19 nt, Homo sapiens
ucagugcuccucaaacauu

SEQ ID NO: 1457043 - RNA, 19 nt, Homo sapiens
ggagccagguccaagucuu

SEQ ID NO: 1457044 - RNA, 19 nt, Homo sapiens
agacuaacaggucccauuu

SEQ ID NO: 1457045 - RNA, 19 nt, Homo sapiens
ugauuucucucucuuugga

SEQ ID NO: 1457046 - RNA, 19 nt, Homo sapiens
gcaccacauggauuaauug

SEQ ID NO: 1457047 - RNA, 19 nt, Homo sapiens
caucugggagguucuauug

SEQ ID NO: 1457048 - RNA, 19 nt, Homo sapiens
ugccuaagcugcaagauac

SEQ ID NO: 1457049 - RNA, 19 nt, Homo sapiens
cuggaaaguuguaggagaa

SEQ ID NO: 1457050 - RNA, 19 nt, Homo sapiens
auggacaacuggcugauuu

SEQ ID NO: 1457051 - RNA, 19 nt, Homo sapiens
ugccugagaucuugcaguu

SEQ ID NO: 1457052 - RNA, 19 nt, Homo sapiens
ugaagccuauugccugaga

SEQ ID NO: 1457053 - RNA, 19 nt, Homo sapiens
gugccuaagcugcaagaua

SEQ ID NO: 1457054 - RNA, 19 nt, Homo sapiens
gauuguaaauggcuagacu

SEQ ID NO: 1457055 - RNA, 19 nt, Homo sapiens
ugccuugucuugugucuga

SEQ ID NO: 1457056 - RNA, 19 nt, Homo sapiens
gggaagcagcuguuugguu

SEQ ID NO: 1457057 - RNA, 19 nt, Homo sapiens
gacucuccauucagcauuu

SEQ ID NO: 1457058 - RNA, 19 nt, Homo sapiens
ggaaaguuguaggagaauc

SEQ ID NO: 1457059 - RNA, 19 nt, Homo sapiens
caaaugcaaauuacaugug

SEQ ID NO: 1457060 - RNA, 19 nt, Homo sapiens
gagagagaauacaaguuuu

SEQ ID NO: 1457061 - RNA, 19 nt, Homo sapiens
aauccaaucaccacuguuu

SEQ ID NO: 1457062 - RNA, 19 nt, Homo sapiens
gacagcagugcacggauaa

SEQ ID NO: 1457063 - RNA, 19 nt, Homo sapiens
gcagaccauuccagaacuc

SEQ ID NO: 1457064 - RNA, 19 nt, Homo sapiens
caggugaggugguguuugc

SEQ ID NO: 1457065 - RNA, 19 nt, Homo sapiens
ggagauccuaccucuacaa

SEQ ID NO: 1457066 - RNA, 19 nt, Homo sapiens
gaagcaccacauggauuaa

SEQ ID NO: 1457067 - RNA, 19 nt, Homo sapiens
gcagugcacggauaaagag

SEQ ID NO: 1457068 - RNA, 19 nt, Homo sapiens
gagaauggaagcaccacau

SEQ ID NO: 1457069 - RNA, 19 nt, Homo sapiens
caugaaaugcgaagguguu

SEQ ID NO: 1457070 - RNA, 19 nt, Homo sapiens
ccaaaugcaaauuacaugu

SEQ ID NO: 1457071 - RNA, 19 nt, Homo sapiens
caauauggacccaaaugca

SEQ ID NO: 1457072 - RNA, 19 nt, Homo sapiens
guaagggaagcagcuguuu

SEQ ID NO: 1457073 - RNA, 19 nt, Homo sapiens
uacaaacuucucaccauaa

SEQ ID NO: 1457074 - RNA, 19 nt, Homo sapiens
ggacucuccauucagcauu

SEQ ID NO: 1457075 - RNA, 19 nt, Homo sapiens
cuuaaccucucugugcuuu

SEQ ID NO: 1457076 - RNA, 19 nt, Homo sapiens
gagcagucuucaaguuggu

SEQ ID NO: 1457077 - RNA, 19 nt, Homo sapiens
ucuacaaacuucucaccau

SEQ ID NO: 1457078 - RNA, 19 nt, Homo sapiens
uaagcuaaucccacccuuu

SEQ ID NO: 1457079 - RNA, 19 nt, Homo sapiens
ccuccggacucuccauuca

SEQ ID NO: 1457080 - RNA, 19 nt, Homo sapiens
gcaauauggacccaaaugc

SEQ ID NO: 1457081 - RNA, 19 nt, Homo sapiens
ggcaauauggacccaaaug

SEQ ID NO: 1457082 - RNA, 19 nt, Homo sapiens
gaggugcccaaucuaguug

SEQ ID NO: 1457083 - RNA, 19 nt, Homo sapiens
uaagggaagcagcuguuug

SEQ ID NO: 1457084 - RNA, 19 nt, Homo sapiens
cggcugaugccuugucuug

SEQ ID NO: 1457085 - RNA, 19 nt, Homo sapiens
gacgaaaugggauaaugug

SEQ ID NO: 1457086 - RNA, 19 nt, Homo sapiens
gaccuugggcaguuuacuu

SEQ ID NO: 1457087 - RNA, 19 nt, Homo sapiens
uuggagcagucuucaaguu

SEQ ID NO: 1457088 - RNA, 19 nt, Homo sapiens
gagguucuauuggcugagu

SEQ ID NO: 1457089 - RNA, 19 nt, Homo sapiens
aaagaggugcccaaucuag

SEQ ID NO: 1457090 - RNA, 19 nt, Homo sapiens
cagacuaacaggucccauu

SEQ ID NO: 1457091 - RNA, 19 nt, Homo sapiens
aauaaaagguagcaacuuc

SEQ ID NO: 1457092 - RNA, 19 nt, Homo sapiens
caccacagccagaccaaug

SEQ ID NO: 1457093 - RNA, 19 nt, Homo sapiens
uguaggagaaucccucuug

SEQ ID NO: 1457094 - RNA, 19 nt, Homo sapiens
gaagaaagccaacgacaaa

SEQ ID NO: 1457095 - RNA, 19 nt, Homo sapiens
ggagagcgauggucaguug

SEQ ID NO: 1457096 - RNA, 19 nt, Homo sapiens
aaacggagauccagaagaa

SEQ ID NO: 1457097 - RNA, 19 nt, Homo sapiens
ggacagugcuacacacaga

SEQ ID NO: 1457098 - RNA, 19 nt, Homo sapiens
aagaagagccuuacaauga

SEQ ID NO: 1457099 - RNA, 19 nt, Homo sapiens
ggagaaacaagaaagcaua

SEQ ID NO: 1457100 - RNA, 19 nt, Homo sapiens
ucgagggacuucauucuua

SEQ ID NO: 1457101 - RNA, 19 nt, Homo sapiens
caagaaagcauacccucua

SEQ ID NO: 1457102 - RNA, 19 nt, Homo sapiens
gugaaggguuucccgcuua

SEQ ID NO: 1457103 - RNA, 19 nt, Homo sapiens
ggaagaguaugaagaagag

SEQ ID NO: 1457104 - RNA, 19 nt, Homo sapiens
gaagaaucauauccagaug

SEQ ID NO: 1457105 - RNA, 19 nt, Homo sapiens
caagugccauuaaugaaga

SEQ ID NO: 1457106 - RNA, 19 nt, Homo sapiens
gaagaagagccuuacaaug

SEQ ID NO: 1457107 - RNA, 19 nt, Homo sapiens
uuucagaaguggaagcuua

SEQ ID NO: 1457108 - RNA, 19 nt, Homo sapiens
ccaaagaggaagaguauga

SEQ ID NO: 1457109 - RNA, 19 nt, Homo sapiens
gauuaacaccgcauucuuu

SEQ ID NO: 1457110 - RNA, 19 nt, Homo sapiens
caaaguccaccaaguguuu

SEQ ID NO: 1457111 - RNA, 19 nt, Homo sapiens
ugaagcagauccgcucaua

SEQ ID NO: 1457112 - RNA, 19 nt, Homo sapiens
gaggaaggcagcauagaaa

SEQ ID NO: 1457113 - RNA, 19 nt, Homo sapiens
gaaaacaccccaucacaaa

SEQ ID NO: 1457114 - RNA, 19 nt, Homo sapiens
ccaccuccgugcuuucuaa

SEQ ID NO: 1457115 - RNA, 19 nt, Homo sapiens
cccaauuccuaaaguguua

SEQ ID NO: 1457116 - RNA, 19 nt, Homo sapiens
cagcaguggugaaaguauu

SEQ ID NO: 1457117 - RNA, 19 nt, Homo sapiens
gagaugaggaguacaagga

SEQ ID NO: 1457118 - RNA, 19 nt, Homo sapiens
ugacugcacuggcuaucuu

SEQ ID NO: 1457119 - RNA, 19 nt, Homo sapiens
acaagaaguugaagaccuu

SEQ ID NO: 1457120 - RNA, 19 nt, Homo sapiens
gcuaagcccgugaaacauu

SEQ ID NO: 1457121 - RNA, 19 nt, Homo sapiens
gaagaugaggccauaguca

SEQ ID NO: 1457122 - RNA, 19 nt, Homo sapiens
gaaauccaccuccgugcuu

SEQ ID NO: 1457123 - RNA, 19 nt, Homo sapiens
aagaaagcauacccucuaa

SEQ ID NO: 1457124 - RNA, 19 nt, Homo sapiens
guaguggccuucaccaaag

SEQ ID NO: 1457125 - RNA, 19 nt, Homo sapiens
aaagagggcuggccagaac

SEQ ID NO: 1457126 - RNA, 19 nt, Homo sapiens
cgagggacuucauucuuau

SEQ ID NO: 1457127 - RNA, 19 nt, Homo sapiens
uuacucaucucaggcaauu

SEQ ID NO: 1457128 - RNA, 19 nt, Homo sapiens
ggagagugcaggugauuuc

SEQ ID NO: 1457129 - RNA, 19 nt, Homo sapiens
uaucagcaguggugaaagu

SEQ ID NO: 1457130 - RNA, 19 nt, Homo sapiens
ugagaaagccaaugaacug

SEQ ID NO: 1457131 - RNA, 19 nt, Homo sapiens
gcagaccaccgcacacaga

SEQ ID NO: 1457132 - RNA, 19 nt, Homo sapiens
guauugaaguccucaguac

SEQ ID NO: 1457133 - RNA, 19 nt, Homo sapiens
ucagaggagaccuguguua

SEQ ID NO: 1457134 - RNA, 19 nt, Homo sapiens
gcucagcucagccacauug

SEQ ID NO: 1457135 - RNA, 19 nt, Homo sapiens
ggagacagaggagcuggua

SEQ ID NO: 1457136 - RNA, 19 nt, Homo sapiens
ggagcucugugacacugaa

SEQ ID NO: 1457137 - RNA, 19 nt, Homo sapiens
ccacuuccucucaauguuu

SEQ ID NO: 1457138 - RNA, 19 nt, Homo sapiens
ggugaaaguauugaaguuu

SEQ ID NO: 1457139 - RNA, 19 nt, Homo sapiens
gaaagcauacccucuaagc

SEQ ID NO: 1457140 - RNA, 19 nt, Homo sapiens
gcaaaguccaccaaguguu

SEQ ID NO: 1457141 - RNA, 19 nt, Homo sapiens
ggagcuuucagccgaauuu

SEQ ID NO: 1457142 - RNA, 19 nt, Homo sapiens
ugaagaagagccuuacaau

SEQ ID NO: 1457143 - RNA, 19 nt, Homo sapiens
guagccagccgccagauga

SEQ ID NO: 1457144 - RNA, 19 nt, Homo sapiens
cuaagcccgugaaacauug

SEQ ID NO: 1457145 - RNA, 19 nt, Homo sapiens
aagcaucaguccuccagaa

SEQ ID NO: 1457146 - RNA, 19 nt, Homo sapiens
ucugugacacugaauauuu

SEQ ID NO: 1457147 - RNA, 19 nt, Homo sapiens
gaaacggagauccagaaga

SEQ ID NO: 1457148 - RNA, 19 nt, Homo sapiens
uugcauggcuuauaucucu

SEQ ID NO: 1457149 - RNA, 19 nt, Homo sapiens
ggacuucauucuuauuucc

SEQ ID NO: 1457150 - RNA, 19 nt, Homo sapiens
caccaaagaggaagaguau

SEQ ID NO: 1457151 - RNA, 19 nt, Homo sapiens
gcuggccugucuuccgaua

SEQ ID NO: 1457152 - RNA, 19 nt, Homo sapiens
gacagaggaaggcagcaua

SEQ ID NO: 1457153 - RNA, 19 nt, Homo sapiens
ugaaagacuuggauuacac

SEQ ID NO: 1457154 - RNA, 19 nt, Homo sapiens
agaagagccuuacaaugag

SEQ ID NO: 1457155 - RNA, 19 nt, Homo sapiens
agaggaagaguaugaagaa

SEQ ID NO: 1457156 - RNA, 19 nt, Homo sapiens
gaggagaccuguguuaccu

SEQ ID NO: 1457157 - RNA, 19 nt, Homo sapiens
uaucaugucuguggauuac

SEQ ID NO: 1457158 - RNA, 19 nt, Homo sapiens
gcucagguuugacuauguc

SEQ ID NO: 1457159 - RNA, 19 nt, Homo sapiens
cagcauauaacaaacuuuc

SEQ ID NO: 1457160 - RNA, 19 nt, Homo sapiens
gaaggggcaugauuugugu

SEQ ID NO: 1457161 - RNA, 19 nt, Homo sapiens
ggaguacaaggaaguggaa

SEQ ID NO: 1457162 - RNA, 19 nt, Homo sapiens
gagucuguguugaucaaga

SEQ ID NO: 1457163 - RNA, 19 nt, Homo sapiens
gcauacgugcaccaccuua

SEQ ID NO: 1457164 - RNA, 19 nt, Homo sapiens
caaagaggaagaguaugaa

SEQ ID NO: 1457165 - RNA, 19 nt, Homo sapiens
cguaguggccuucaccaaa

SEQ ID NO: 1457166 - RNA, 19 nt, Homo sapiens
ccagaacgccuuaaaauuc

SEQ ID NO: 1457167 - RNA, 19 nt, Homo sapiens
ugaaggguuucccgcuuau

SEQ ID NO: 1457168 - RNA, 19 nt, Homo sapiens
uggacuaccuggauaugga

SEQ ID NO: 1457169 - RNA, 19 nt, Homo sapiens
aaagcaaaguccaccaagu

SEQ ID NO: 1457170 - RNA, 19 nt, Homo sapiens
cagaaacggagauccagaa

SEQ ID NO: 1457171 - RNA, 19 nt, Homo sapiens
gggacuucauucuuauuuc

SEQ ID NO: 1457172 - RNA, 19 nt, Homo sapiens
agaagaaucauauccagau

SEQ ID NO: 1457173 - RNA, 19 nt, Homo sapiens
caucagcgaggacaguauu

SEQ ID NO: 1457174 - RNA, 19 nt, Homo sapiens
ccuccgugcuuucuaaauc

SEQ ID NO: 1457175 - RNA, 19 nt, Homo sapiens
guacaaggaaguggaagug

SEQ ID NO: 1457176 - RNA, 19 nt, Homo sapiens
gaugguggagaaacaagaa

SEQ ID NO: 1457177 - RNA, 19 nt, Homo sapiens
ucagauugauagagcacuu

SEQ ID NO: 1457178 - RNA, 19 nt, Homo sapiens
guucagaggagaccugugu

SEQ ID NO: 1457179 - RNA, 19 nt, Homo sapiens
gcaccaccuuacccuauac

SEQ ID NO: 1457180 - RNA, 19 nt, Homo sapiens
cccaaugacaccaaaguuu

SEQ ID NO: 1457181 - RNA, 19 nt, Homo sapiens
ucaccaaagaggaagagua

SEQ ID NO: 1457182 - RNA, 19 nt, Homo sapiens
gcuccaaggccuuccucua

SEQ ID NO: 1457183 - RNA, 19 nt, Homo sapiens
gaccaccgcacacagauca

SEQ ID NO: 1457184 - RNA, 19 nt, Homo sapiens
aaacuuggacuaccuggau

SEQ ID NO: 1457185 - RNA, 19 nt, Homo sapiens
gaaguggaagugacugagu

SEQ ID NO: 1457186 - RNA, 19 nt, Homo sapiens
ucuagaagaaugcccaauu

SEQ ID NO: 1457187 - RNA, 19 nt, Homo sapiens
ccagaugagcuuccuaaag

SEQ ID NO: 1457188 - RNA, 19 nt, Homo sapiens
ucacccagcucugcuccaa

SEQ ID NO: 1457189 - RNA, 19 nt, Homo sapiens
ugccauuaaugaagaagaa

SEQ ID NO: 1457190 - RNA, 19 nt, Homo sapiens
cuacccaagugccauuaau

SEQ ID NO: 1457191 - RNA, 19 nt, Homo sapiens
ccucuaagcccagucaaga

SEQ ID NO: 1457192 - RNA, 19 nt, Homo sapiens
gcucugugacacugaauau

SEQ ID NO: 1457193 - RNA, 19 nt, Homo sapiens
gcguuaagccuuguucaga

SEQ ID NO: 1457194 - RNA, 19 nt, Homo sapiens
gcaccaagcuucagaacga

SEQ ID NO: 1457195 - RNA, 19 nt, Homo sapiens
guuuaaugcugacgaauuu

SEQ ID NO: 1457196 - RNA, 19 nt, Homo sapiens
gaacgaggagcaugugauu

SEQ ID NO: 1457197 - RNA, 19 nt, Homo sapiens
gaaguuuaaugcugacgaa

SEQ ID NO: 1457198 - RNA, 19 nt, Homo sapiens
cauggugucugaugaauau

SEQ ID NO: 1457199 - RNA, 19 nt, Homo sapiens
ucaaguacguucccaguca

SEQ ID NO: 1457200 - RNA, 19 nt, Homo sapiens
ugacgaauuugaagacaug

SEQ ID NO: 1457201 - RNA, 19 nt, Homo sapiens
caacaaauacauggugaaa

SEQ ID NO: 1457202 - RNA, 19 nt, Homo sapiens
ccacauuggucaagucauc

SEQ ID NO: 1457203 - RNA, 19 nt, Homo sapiens
gaacaagccguacccaaaa

SEQ ID NO: 1457204 - RNA, 19 nt, Homo sapiens
agaacaagccguacccaaa

SEQ ID NO: 1457205 - RNA, 19 nt, Homo sapiens
guucugcacucaugaaggu

SEQ ID NO: 1457206 - RNA, 19 nt, Homo sapiens
auucauaucuccaagaagu

SEQ ID NO: 1457207 - RNA, 19 nt, Homo sapiens
augagcagcugucuucuga

SEQ ID NO: 1457208 - RNA, 19 nt, Homo sapiens
ggacgccagaagauucaua

SEQ ID NO: 1457209 - RNA, 19 nt, Homo sapiens
gcagggccaaguucaaguu

SEQ ID NO: 1457210 - RNA, 19 nt, Homo sapiens
gacaggcuccagacaggua

SEQ ID NO: 1457211 - RNA, 19 nt, Homo sapiens
gaaaaguuguggcagagau

SEQ ID NO: 1457212 - RNA, 19 nt, Homo sapiens
aauaugagcagcugucuuc

SEQ ID NO: 1457213 - RNA, 19 nt, Homo sapiens
gccaugcuggucugacuua

SEQ ID NO: 1457214 - RNA, 19 nt, Homo sapiens
gcagagauggcuuucacau

SEQ ID NO: 1457215 - RNA, 19 nt, Homo sapiens
ccacauggugucugaugaa

SEQ ID NO: 1457216 - RNA, 19 nt, Homo sapiens
gaagacaugguggccaaga

SEQ ID NO: 1457217 - RNA, 19 nt, Homo sapiens
acaaauacauggugaaaag

SEQ ID NO: 1457218 - RNA, 19 nt, Homo sapiens
gcgcaggcguaguuaagag

SEQ ID NO: 1457219 - RNA, 19 nt, Homo sapiens
gccacauggugucugauga

SEQ ID NO: 1457220 - RNA, 19 nt, Homo sapiens
cgaggagcaugugauugaa

SEQ ID NO: 1457221 - RNA, 19 nt, Homo sapiens
acgaggagcaugugauuga

SEQ ID NO: 1457222 - RNA, 19 nt, Homo sapiens
ucugacuuaugcuuacuaa

SEQ ID NO: 1457223 - RNA, 19 nt, Homo sapiens
caaguacguucccagucau

SEQ ID NO: 1457224 - RNA, 19 nt, Homo sapiens
cuccaucccuuccauguca

SEQ ID NO: 1457225 - RNA, 19 nt, Homo sapiens
uaugcgaggugccuuugga

SEQ ID NO: 1457226 - RNA, 19 nt, Homo sapiens
ucuuugaccuggguagaaa

SEQ ID NO: 1457227 - RNA, 19 nt, Homo sapiens
gaauaugagcagcugucuu

SEQ ID NO: 1457228 - RNA, 19 nt, Homo sapiens
ugaccuggguagaaagaag

SEQ ID NO: 1457229 - RNA, 19 nt, Homo sapiens
aagacaugguggccaagaa

SEQ ID NO: 1457230 - RNA, 19 nt, Homo sapiens
gggcaacguauauaaaugc

SEQ ID NO: 1457231 - RNA, 19 nt, Homo sapiens
uuaaugcugacgaauuuga

SEQ ID NO: 1457232 - RNA, 19 nt, Homo sapiens
guggccacauggugucuga

SEQ ID NO: 1457233 - RNA, 19 nt, Homo sapiens
ggcggguucugcacucaug

SEQ ID NO: 1457234 - RNA, 19 nt, Homo sapiens
gcugacgaauuugaagaca

SEQ ID NO: 1457235 - RNA, 19 nt, Homo sapiens
gguccacauuggucaaguc

SEQ ID NO: 1457236 - RNA, 19 nt, Homo sapiens
cagagauggcuuucacaug

SEQ ID NO: 1457237 - RNA, 19 nt, Homo sapiens
uggcagagauggcuuucac

SEQ ID NO: 1457238 - RNA, 19 nt, Homo sapiens
gggccaugcuggucugacu

SEQ ID NO: 1457239 - RNA, 19 nt, Homo sapiens
guaguuaagagagcgcauu

SEQ ID NO: 1457240 - RNA, 19 nt, Homo sapiens
gcgcgcaggcguaguuaag

SEQ ID NO: 1457241 - RNA, 19 nt, Homo sapiens
guagaaagaaggcaaaagu

SEQ ID NO: 1457242 - RNA, 19 nt, Homo sapiens
uaguuaagagagcgcauuu

SEQ ID NO: 1457243 - RNA, 19 nt, Homo sapiens
gagagcgcauuuugacuuc

SEQ ID NO: 1457244 - RNA, 19 nt, Homo sapiens
guuaagagagcgcauuuug

SEQ ID NO: 1457245 - RNA, 19 nt, Homo sapiens
cacauggugucugaugaau

SEQ ID NO: 1457246 - RNA, 19 nt, Homo sapiens
gcaccgccgacguuacugu

SEQ ID NO: 1457247 - RNA, 19 nt, Homo sapiens
ccugaugguuguggaguca

SEQ ID NO: 1457248 - RNA, 19 nt, Homo sapiens
gacgccagaagauucauau

SEQ ID NO: 1457249 - RNA, 19 nt, Homo sapiens
gaaggaaccuggagaagua

SEQ ID NO: 1457250 - RNA, 19 nt, Homo sapiens
caaauaaccuguggaaaua

SEQ ID NO: 1457251 - RNA, 19 nt, Homo sapiens
cagaagaguugaagaauua

SEQ ID NO: 1457252 - RNA, 19 nt, Homo sapiens
gcaaacauguucuauauug

SEQ ID NO: 1457253 - RNA, 19 nt, Homo sapiens
gaauuuaguuugccaauga

SEQ ID NO: 1457254 - RNA, 19 nt, Homo sapiens
caaauacccuuccauauau

SEQ ID NO: 1457255 - RNA, 19 nt, Homo sapiens
caacauaggacuuugaaua

SEQ ID NO: 1457256 - RNA, 19 nt, Homo sapiens
gaaagaguaugauuuggaa

SEQ ID NO: 1457257 - RNA, 19 nt, Homo sapiens
gaagagcucuacaauacaa

SEQ ID NO: 1457258 - RNA, 19 nt, Homo sapiens
ggaacucugugauaacaua

SEQ ID NO: 1457259 - RNA, 19 nt, Homo sapiens
gcaccaaccucaauaggaa

SEQ ID NO: 1457260 - RNA, 19 nt, Homo sapiens
gaauggaacuugaaagcaa

SEQ ID NO: 1457261 - RNA, 19 nt, Homo sapiens
gagaacaugucauugguuu

SEQ ID NO: 1457262 - RNA, 19 nt, Homo sapiens
cagcaaacauguucuauau

SEQ ID NO: 1457263 - RNA, 19 nt, Homo sapiens
ucagaacacuuucaacuuu

SEQ ID NO: 1457264 - RNA, 19 nt, Homo sapiens
aaacaaggaccuacuaaua

SEQ ID NO: 1457265 - RNA, 19 nt, Homo sapiens
cuagugagcuugcuuuaaa

SEQ ID NO: 1457266 - RNA, 19 nt, Homo sapiens
gaauagcaaugauaggaaa

SEQ ID NO: 1457267 - RNA, 19 nt, Homo sapiens
acaaauacccuuccauaua

SEQ ID NO: 1457268 - RNA, 19 nt, Homo sapiens
caacaacaauggugaugaa

SEQ ID NO: 1457269 - RNA, 19 nt, Homo sapiens
gaggagaaauugaugaaga

SEQ ID NO: 1457270 - RNA, 19 nt, Homo sapiens
gaaacugucuugccucugu

SEQ ID NO: 1457271 - RNA, 19 nt, Homo sapiens
caacaacguuuacuuagau

SEQ ID NO: 1457272 - RNA, 19 nt, Homo sapiens
gaagaacuggaaaucauua

SEQ ID NO: 1457273 - RNA, 19 nt, Homo sapiens
gagaagaaauaacugucua

SEQ ID NO: 1457274 - RNA, 19 nt, Homo sapiens
ggagaucgcuggagagaag

SEQ ID NO: 1457275 - RNA, 19 nt, Homo sapiens
cgaauaaccuugauugaca

SEQ ID NO: 1457276 - RNA, 19 nt, Homo sapiens
caacaauggugaugaaauc

SEQ ID NO: 1457277 - RNA, 19 nt, Homo sapiens
gaaaugaagcucagaagga

SEQ ID NO: 1457278 - RNA, 19 nt, Homo sapiens
gcaauuaaaucuggcaaug

SEQ ID NO: 1457279 - RNA, 19 nt, Homo sapiens
uaaagaaagugaacaaugg

SEQ ID NO: 1457280 - RNA, 19 nt, Homo sapiens
ggaauauuguucuugugua

SEQ ID NO: 1457281 - RNA, 19 nt, Homo sapiens
caagaaacacaaaguagua

SEQ ID NO: 1457282 - RNA, 19 nt, Homo sapiens
gagucuagcucgagauauu

SEQ ID NO: 1457283 - RNA, 19 nt, Homo sapiens
gugcaggaguggcuuguua

SEQ ID NO: 1457284 - RNA, 19 nt, Homo sapiens
caaaggaugucugugauga

SEQ ID NO: 1457285 - RNA, 19 nt, Homo sapiens
cagaacacuuucaacuuua

SEQ ID NO: 1457286 - RNA, 19 nt, Homo sapiens
agagagaccuuauuggaaa

SEQ ID NO: 1457287 - RNA, 19 nt, Homo sapiens
gagcguggauaauaacuga

SEQ ID NO: 1457288 - RNA, 19 nt, Homo sapiens
aaacaaauacccuuccaua

SEQ ID NO: 1457289 - RNA, 19 nt, Homo sapiens
gaagaggaguacagcaaga

SEQ ID NO: 1457290 - RNA, 19 nt, Homo sapiens
gcacagccauacaaauuca

SEQ ID NO: 1457291 - RNA, 19 nt, Homo sapiens
acaaacaccuggcagauga

SEQ ID NO: 1457292 - RNA, 19 nt, Homo sapiens
gcacucaacuauggaaaga

SEQ ID NO: 1457293 - RNA, 19 nt, Homo sapiens
gcacaaacuaccaaguaua

SEQ ID NO: 1457294 - RNA, 19 nt, Homo sapiens
ucaaaggccucauugguau

SEQ ID NO: 1457295 - RNA, 19 nt, Homo sapiens
uggaagagcucuacaauac

SEQ ID NO: 1457296 - RNA, 19 nt, Homo sapiens
acuaugcccucuaaauuua

SEQ ID NO: 1457297 - RNA, 19 nt, Homo sapiens
cgaaagguauugugacaga

SEQ ID NO: 1457298 - RNA, 19 nt, Homo sapiens
gaacuggaaaucauuaaga

SEQ ID NO: 1457299 - RNA, 19 nt, Homo sapiens
acaacaaccucuacagaaa

SEQ ID NO: 1457300 - RNA, 19 nt, Homo sapiens
gggauuguauuaccauauu

SEQ ID NO: 1457301 - RNA, 19 nt, Homo sapiens
gcaaaucaaagaugaaaga

SEQ ID NO: 1457302 - RNA, 19 nt, Homo sapiens
cacaagggcuaauuuauuc

SEQ ID NO: 1457303 - RNA, 19 nt, Homo sapiens
ucccaggacuuccaauuua

SEQ ID NO: 1457304 - RNA, 19 nt, Homo sapiens
ccaugacgcuguugacgua

SEQ ID NO: 1457305 - RNA, 19 nt, Homo sapiens
gugaagcucuuaauagaau

SEQ ID NO: 1457306 - RNA, 19 nt, Homo sapiens
caucaugccaaguauauua

SEQ ID NO: 1457307 - RNA, 19 nt, Homo sapiens
ccacaagggcuaauuuauu

SEQ ID NO: 1457308 - RNA, 19 nt, Homo sapiens
uauugcaucuccuuucuua

SEQ ID NO: 1457309 - RNA, 19 nt, Homo sapiens
gcacauuccugcacaaacu

SEQ ID NO: 1457310 - RNA, 19 nt, Homo sapiens
caagaucucagccuccuua

SEQ ID NO: 1457311 - RNA, 19 nt, Homo sapiens
gguuaaagcugcagagaca

SEQ ID NO: 1457312 - RNA, 19 nt, Homo sapiens
ucaguucauuggucaaaua

SEQ ID NO: 1457313 - RNA, 19 nt, Homo sapiens
cuaaagacaucaguucauu

SEQ ID NO: 1457314 - RNA, 19 nt, Homo sapiens
gaacaaggguggguuugca

SEQ ID NO: 1457315 - RNA, 19 nt, Homo sapiens
gccaggaacucugugauaa

SEQ ID NO: 1457316 - RNA, 19 nt, Homo sapiens
ucaaauaaccuguggaaau

SEQ ID NO: 1457317 - RNA, 19 nt, Homo sapiens
ucagaagaguugaagaauu

SEQ ID NO: 1457318 - RNA, 19 nt, Homo sapiens
acaaugaccugcugguuug

SEQ ID NO: 1457319 - RNA, 19 nt, Homo sapiens
gggcaaguauggaaaugaa

SEQ ID NO: 1457320 - RNA, 19 nt, Homo sapiens
uggaucaucuguuacauuu

SEQ ID NO: 1457321 - RNA, 19 nt, Homo sapiens
gcauagacaucauauucug

SEQ ID NO: 1457322 - RNA, 19 nt, Homo sapiens
gcauuuacaucuucaccaa

SEQ ID NO: 1457323 - RNA, 19 nt, Homo sapiens
gaaaugagucugcagaaag

SEQ ID NO: 1457324 - RNA, 19 nt, Homo sapiens
ggaaguauaacaacaacaa

SEQ ID NO: 1457325 - RNA, 19 nt, Homo sapiens
ucaagaggaucucagcaaa

SEQ ID NO: 1457326 - RNA, 19 nt, Homo sapiens
gaagauggaagaugugaau

SEQ ID NO: 1457327 - RNA, 19 nt, Homo sapiens
agucuaugcuggagaaaua

SEQ ID NO: 1457328 - RNA, 19 nt, Homo sapiens
gagaggaggccacgguuaa

SEQ ID NO: 1457329 - RNA, 19 nt, Homo sapiens
gaacugcacagccauacaa

SEQ ID NO: 1457330 - RNA, 19 nt, Homo sapiens
gaacaagcaaugucagaug

SEQ ID NO: 1457331 - RNA, 19 nt, Homo sapiens
uaacugaagccgaaaggua

SEQ ID NO: 1457332 - RNA, 19 nt, Homo sapiens
ucucagaccauaccauuua

SEQ ID NO: 1457333 - RNA, 19 nt, Homo sapiens
ggacuucuuugcugugaau

SEQ ID NO: 1457334 - RNA, 19 nt, Homo sapiens
gaaagucuaugaguucuac

SEQ ID NO: 1457335 - RNA, 19 nt, Homo sapiens
ccaggaaagucuaugaguu

SEQ ID NO: 1457336 - RNA, 19 nt, Homo sapiens
ggcagaagauggcuauguu

SEQ ID NO: 1457337 - RNA, 19 nt, Homo sapiens
cuaauacacucuugcauca

SEQ ID NO: 1457338 - RNA, 19 nt, Homo sapiens
gaaccuccaucgcuuucuu

SEQ ID NO: 1457339 - RNA, 19 nt, Homo sapiens
caaguauacuggugaaauc

SEQ ID NO: 1457340 - RNA, 19 nt, Homo sapiens
aaagagaggcuacaaaugu

SEQ ID NO: 1457341 - RNA, 19 nt, Homo sapiens
gauggaagaugugaauugu

SEQ ID NO: 1457342 - RNA, 19 nt, Homo sapiens
gauugacauuggauuagua

SEQ ID NO: 1457343 - RNA, 19 nt, Homo sapiens
gcagcaagaccuggacuua

SEQ ID NO: 1457344 - RNA, 19 nt, Homo sapiens
guaaagaaagugaacaaug

SEQ ID NO: 1457345 - RNA, 19 nt, Homo sapiens
cacuaugccuggcuaauuu

SEQ ID NO: 1457346 - RNA, 19 nt, Homo sapiens
gagcgauucuugugucuca

SEQ ID NO: 1457347 - RNA, 19 nt, Homo sapiens
cagaugugcuggcaacuga

SEQ ID NO: 1457348 - RNA, 19 nt, Homo sapiens
gagagaagaaauaccagua

SEQ ID NO: 1457349 - RNA, 19 nt, Homo sapiens
gguaugagguggagauuaa

SEQ ID NO: 1457350 - RNA, 19 nt, Homo sapiens
ugaggaacaugcaggauuu

SEQ ID NO: 1457351 - RNA, 19 nt, Homo sapiens
caggaugucuggcgaauau

SEQ ID NO: 1457352 - RNA, 19 nt, Homo sapiens
gagcagcugugccaccaaa

SEQ ID NO: 1457353 - RNA, 19 nt, Homo sapiens
ucaaggcgcuaaacaacaa

SEQ ID NO: 1457354 - RNA, 19 nt, Homo sapiens
gcucagagauagggaaugu

SEQ ID NO: 1457355 - RNA, 19 nt, Homo sapiens
caagaaaugcuuugucugu

SEQ ID NO: 1457356 - RNA, 19 nt, Homo sapiens
ccaagggacucucuucauc

SEQ ID NO: 1457357 - RNA, 19 nt, Homo sapiens
ggacguggaugcugcuuac

SEQ ID NO: 1457358 - RNA, 19 nt, Homo sapiens
gaggauccgcucagagaua

SEQ ID NO: 1457359 - RNA, 19 nt, Homo sapiens
gaaccuggagcccauuuau

SEQ ID NO: 1457360 - RNA, 19 nt, Homo sapiens
gccaugagccgccaacuga

SEQ ID NO: 1457361 - RNA, 19 nt, Homo sapiens
caccaaggcugaaaucucu

SEQ ID NO: 1457362 - RNA, 19 nt, Homo sapiens
ggaugcugcuuacaugaau

SEQ ID NO: 1457363 - RNA, 19 nt, Homo sapiens
ggacugcgcccugaaagau

SEQ ID NO: 1457364 - RNA, 19 nt, Homo sapiens
agaaaugcuuugucuguca

SEQ ID NO: 1457365 - RNA, 19 nt, Homo sapiens
gaugcugcuuacaugaaua

SEQ ID NO: 1457366 - RNA, 19 nt, Homo sapiens
caaguucgccuccuucauc

SEQ ID NO: 1457367 - RNA, 19 nt, Homo sapiens
gaucaaggcgcuaaacaac

SEQ ID NO: 1457368 - RNA, 19 nt, Homo sapiens
gucaagaaaugcuuugucu

SEQ ID NO: 1457369 - RNA, 19 nt, Homo sapiens
acgaggagauugcccuaaa

SEQ ID NO: 1457370 - RNA, 19 nt, Homo sapiens
ggaccuggacagcaucauu

SEQ ID NO: 1457371 - RNA, 19 nt, Homo sapiens
guggaggacuacaagaaga

SEQ ID NO: 1457372 - RNA, 19 nt, Homo sapiens
gccgccaacugacccauuu

SEQ ID NO: 1457373 - RNA, 19 nt, Homo sapiens
ucagagauagggaauguga

SEQ ID NO: 1457374 - RNA, 19 nt, Homo sapiens
cagaggauccgcucagaga

SEQ ID NO: 1457375 - RNA, 19 nt, Homo sapiens
uugaacaacugcaggaaga

SEQ ID NO: 1457376 - RNA, 19 nt, Homo sapiens
gagcagaucaaggcgcuaa

SEQ ID NO: 1457377 - RNA, 19 nt, Homo sapiens
gaggagauugcccuaaaga

SEQ ID NO: 1457378 - RNA, 19 nt, Homo sapiens
gaagcuggcccuggauaug

SEQ ID NO: 1457379 - RNA, 19 nt, Homo sapiens
gaagcagugugccgaucug

SEQ ID NO: 1457380 - RNA, 19 nt, Homo sapiens
ucagcaaccugcagaagca

SEQ ID NO: 1457381 - RNA, 19 nt, Homo sapiens
gauagggaaugugaagaag

SEQ ID NO: 1457382 - RNA, 19 nt, Homo sapiens
ugaaaucucugagcucaac

SEQ ID NO: 1457383 - RNA, 19 nt, Homo sapiens
gaaaugcaaagacaacacu

SEQ ID NO: 1457384 - RNA, 19 nt, Homo sapiens
gaccuggacagcaucauug

SEQ ID NO: 1457385 - RNA, 19 nt, Homo sapiens
cagcuggacuugaacaacu

SEQ ID NO: 1457386 - RNA, 19 nt, Homo sapiens
acacuuacccaggauguuu

SEQ ID NO: 1457387 - RNA, 19 nt, Homo sapiens
auauggagaucgccaccua

SEQ ID NO: 1457388 - RNA, 19 nt, Homo sapiens
cagcagcuccgccucauuc

SEQ ID NO: 1457389 - RNA, 19 nt, Homo sapiens
cuugacagaugagauuaaa

SEQ ID NO: 1457390 - RNA, 19 nt, Homo sapiens
gacaagugguuggcucugu

SEQ ID NO: 1457391 - RNA, 19 nt, Homo sapiens
cugcagacgucaagaccaa

SEQ ID NO: 1457392 - RNA, 19 nt, Homo sapiens
uagggaaugugaagaagca

SEQ ID NO: 1457393 - RNA, 19 nt, Homo sapiens
acaacaaguucgccuccuu

SEQ ID NO: 1457394 - RNA, 19 nt, Homo sapiens
gggacucucuucaucuucu

SEQ ID NO: 1457395 - RNA, 19 nt, Homo sapiens
aagcaguuauagcuacaaa

SEQ ID NO: 1457396 - RNA, 19 nt, Homo sapiens
gugagcaucuccgucauca

SEQ ID NO: 1457397 - RNA, 19 nt, Homo sapiens
cguggaugcugcuuacaug

SEQ ID NO: 1457398 - RNA, 19 nt, Homo sapiens
ccaagucaagaaaugcuuu

SEQ ID NO: 1457399 - RNA, 19 nt, Homo sapiens
caaauucugugagcaucuc

SEQ ID NO: 1457400 - RNA, 19 nt, Homo sapiens
gcaggaugucuggcgaaua

SEQ ID NO: 1457401 - RNA, 19 nt, Homo sapiens
cgaggagauugcccuaaag

SEQ ID NO: 1457402 - RNA, 19 nt, Homo sapiens
cagauccagucccacauca

SEQ ID NO: 1457403 - RNA, 19 nt, Homo sapiens
aagggacucucuucaucuu

SEQ ID NO: 1457404 - RNA, 19 nt, Homo sapiens
gacaacacuuacccaggau

SEQ ID NO: 1457405 - RNA, 19 nt, Homo sapiens
aaugcaaagacaacacuua

SEQ ID NO: 1457406 - RNA, 19 nt, Homo sapiens
gaugcaaggaguccaguca

SEQ ID NO: 1457407 - RNA, 19 nt, Homo sapiens
ucaagcaguuauagcuaca

SEQ ID NO: 1457408 - RNA, 19 nt, Homo sapiens
guugggucauugccugaaa

SEQ ID NO: 1457409 - RNA, 19 nt, Homo sapiens
caacacuuacccaggaugu

SEQ ID NO: 1457410 - RNA, 19 nt, Homo sapiens
cagaaucaggugcuagaga

SEQ ID NO: 1457411 - RNA, 19 nt, Homo sapiens
guggacuccuugacagaug

SEQ ID NO: 1457412 - RNA, 19 nt, Homo sapiens
ccaguccucugcuucuucu

SEQ ID NO: 1457413 - RNA, 19 nt, Homo sapiens
gggcucccuuuccaaguca

SEQ ID NO: 1457414 - RNA, 19 nt, Homo sapiens
agauagggaaugugaagaa

SEQ ID NO: 1457415 - RNA, 19 nt, Homo sapiens
ggucacagcaggccagcau

SEQ ID NO: 1457416 - RNA, 19 nt, Homo sapiens
gaacaacugcaggaagaac

SEQ ID NO: 1457417 - RNA, 19 nt, Homo sapiens
ggacucucuucaucuucug

SEQ ID NO: 1457418 - RNA, 19 nt, Homo sapiens
caagggacucucuucaucu

SEQ ID NO: 1457419 - RNA, 19 nt, Homo sapiens
ugccugaaaugcaaagaca

SEQ ID NO: 1457420 - RNA, 19 nt, Homo sapiens
ccucaagcaguuauagcua

SEQ ID NO: 1457421 - RNA, 19 nt, Homo sapiens
ccaaggcugaaaucucuga

SEQ ID NO: 1457422 - RNA, 19 nt, Homo sapiens
ggacaacaaccgggaucug

SEQ ID NO: 1457423 - RNA, 19 nt, Homo sapiens
gacagaugagauuaaauuc

SEQ ID NO: 1457424 - RNA, 19 nt, Homo sapiens
aggauuugguggaggacua

SEQ ID NO: 1457425 - RNA, 19 nt, Homo sapiens
gaagaaccuggagcccauu

SEQ ID NO: 1457426 - RNA, 19 nt, Homo sapiens
caagugguuggcucuguga

SEQ ID NO: 1457427 - RNA, 19 nt, Homo sapiens
caagucaagaaaugcuuug

SEQ ID NO: 1457428 - RNA, 19 nt, Homo sapiens
ggaacaugcaggauuuggu

SEQ ID NO: 1457429 - RNA, 19 nt, Homo sapiens
gcagaagcagcuggagaug

SEQ ID NO: 1457430 - RNA, 19 nt, Homo sapiens
gaccaaguggaaccuccua

SEQ ID NO: 1457431 - RNA, 19 nt, Homo sapiens
ccagucaggagcucucuca

SEQ ID NO: 1457432 - RNA, 19 nt, Homo sapiens
accuggagcccauuuauga

SEQ ID NO: 1457433 - RNA, 19 nt, Homo sapiens
gggacugcgcccugaaaga

SEQ ID NO: 1457434 - RNA, 19 nt, Homo sapiens
gagauagggaaugugaaga

SEQ ID NO: 1457435 - RNA, 19 nt, Homo sapiens
gcagcagcuccgccucauu

SEQ ID NO: 1457436 - RNA, 19 nt, Homo sapiens
gguggaggacuacaagaag

SEQ ID NO: 1457437 - RNA, 19 nt, Homo sapiens
cuucuucugcaauaaauga

SEQ ID NO: 1457438 - RNA, 19 nt, Homo sapiens
gcagacgucaagaccaaag

SEQ ID NO: 1457439 - RNA, 19 nt, Homo sapiens
gucaucagcagcaccaaug

SEQ ID NO: 1457440 - RNA, 19 nt, Homo sapiens
ucuggcgaauauccaaauu

SEQ ID NO: 1457441 - RNA, 19 nt, Homo sapiens
gcucaagaaggacguggau

SEQ ID NO: 1457442 - RNA, 19 nt, Homo sapiens
gcucaccaaggcugaaauc

SEQ ID NO: 1457443 - RNA, 19 nt, Homo sapiens
ucaggucaccgucaacaag

SEQ ID NO: 1457444 - RNA, 19 nt, Homo sapiens
uggacuccuugacagauga

SEQ ID NO: 1457445 - RNA, 19 nt, Homo sapiens
ggacuacaagaagagguau

SEQ ID NO: 1457446 - RNA, 19 nt, Homo sapiens
caggucaccgucaacaaga

SEQ ID NO: 1457447 - RNA, 19 nt, Homo sapiens
cugaggaacaugcaggauu

SEQ ID NO: 1457448 - RNA, 19 nt, Homo sapiens
gaacagagaugggcuugaa

SEQ ID NO: 1457449 - RNA, 19 nt, Homo sapiens
caacuucucuguaaaucua

SEQ ID NO: 1457450 - RNA, 19 nt, Homo sapiens
gagcaaaucacaaggcuuu

SEQ ID NO: 1457451 - RNA, 19 nt, Homo sapiens
agagagaaaugcagaauug

SEQ ID NO: 1457452 - RNA, 19 nt, Homo sapiens
gaauugucauggcugaaua

SEQ ID NO: 1457453 - RNA, 19 nt, Homo sapiens
gauguaagauguugaccuu

SEQ ID NO: 1457454 - RNA, 19 nt, Homo sapiens
ggagauggguggcuaaugg

SEQ ID NO: 1457455 - RNA, 19 nt, Homo sapiens
gauguaccauggugaugua

SEQ ID NO: 1457456 - RNA, 19 nt, Homo sapiens
gagagugucuucagugcaa

SEQ ID NO: 1457457 - RNA, 19 nt, Homo sapiens
caugauggcuucaggauuc

SEQ ID NO: 1457458 - RNA, 19 nt, Homo sapiens
ggaaggcacuaagacauug

SEQ ID NO: 1457459 - RNA, 19 nt, Homo sapiens
gagaguagaagcugaaaga

SEQ ID NO: 1457460 - RNA, 19 nt, Homo sapiens
gcagaauuguguaccaguu

SEQ ID NO: 1457461 - RNA, 19 nt, Homo sapiens
cugcauaucuucacuuaga

SEQ ID NO: 1457462 - RNA, 19 nt, Homo sapiens
caagauggcugcuguaucc

SEQ ID NO: 1457463 - RNA, 19 nt, Homo sapiens
ccagggaggugacuacuuc

SEQ ID NO: 1457464 - RNA, 19 nt, Homo sapiens
agaaacaaacccuguauuu

SEQ ID NO: 1457465 - RNA, 19 nt, Homo sapiens
uauguaaccucuuauaugg

SEQ ID NO: 1457466 - RNA, 19 nt, Homo sapiens
guaccauggugauguaaga

SEQ ID NO: 1457467 - RNA, 19 nt, Homo sapiens
gaggugaccaguaauagaa

SEQ ID NO: 1457468 - RNA, 19 nt, Homo sapiens
gaauagaccaaucguguuc

SEQ ID NO: 1457469 - RNA, 19 nt, Homo sapiens
gcagggaacagaauuguca

SEQ ID NO: 1457470 - RNA, 19 nt, Homo sapiens
aguagaagcugaaagacuu

SEQ ID NO: 1457471 - RNA, 19 nt, Homo sapiens
ggugaaggguauacaggaa

SEQ ID NO: 1457472 - RNA, 19 nt, Homo sapiens
ggauggguauuuauuugga

SEQ ID NO: 1457473 - RNA, 19 nt, Homo sapiens
ccaaagagagugagaguag

SEQ ID NO: 1457474 - RNA, 19 nt, Homo sapiens
ggaacucuuuguacuaucu

SEQ ID NO: 1457475 - RNA, 19 nt, Homo sapiens
caggaacucuuuguacuau

SEQ ID NO: 1457476 - RNA, 19 nt, Homo sapiens
caauuucagucucuugguu

SEQ ID NO: 1457477 - RNA, 19 nt, Homo sapiens
gagaaaugcagaauugugu

SEQ ID NO: 1457478 - RNA, 19 nt, Homo sapiens
cacacugccuccugcaaua

SEQ ID NO: 1457479 - RNA, 19 nt, Homo sapiens
caacaacuccacgaaggua

SEQ ID NO: 1457480 - RNA, 19 nt, Homo sapiens
gauugggucuuggaacaaa

SEQ ID NO: 1457481 - RNA, 19 nt, Homo sapiens
ggauagccuuacucacuug

SEQ ID NO: 1457482 - RNA, 19 nt, Homo sapiens
uagcauggauucuggagau

SEQ ID NO: 1457483 - RNA, 19 nt, Homo sapiens
acauucagcugcaaggaaa

SEQ ID NO: 1457484 - RNA, 19 nt, Homo sapiens
caaggaucccucugcauuu

SEQ ID NO: 1457485 - RNA, 19 nt, Homo sapiens
gaaacaaacccuguauuuu

SEQ ID NO: 1457486 - RNA, 19 nt, Homo sapiens
caaagagagugagaguaga

SEQ ID NO: 1457487 - RNA, 19 nt, Homo sapiens
ucucagugcucguuacuuc

SEQ ID NO: 1457488 - RNA, 19 nt, Homo sapiens
gaccaguaauagaauugaa

SEQ ID NO: 1457489 - RNA, 19 nt, Homo sapiens
gggaaagggaacagaguaa

SEQ ID NO: 1457490 - RNA, 19 nt, Homo sapiens
ggugaccaguaauagaauu

SEQ ID NO: 1457491 - RNA, 19 nt, Homo sapiens
cagaauuguguaccaguua

SEQ ID NO: 1457492 - RNA, 19 nt, Homo sapiens
acaaggaucccucugcauu

SEQ ID NO: 1457493 - RNA, 19 nt, Homo sapiens
gauguccucuggaucaaag

SEQ ID NO: 1457494 - RNA, 19 nt, Homo sapiens
gggccuggauggucuagga

SEQ ID NO: 1457495 - RNA, 19 nt, Homo sapiens
ccuauggguuggcaauuug

SEQ ID NO: 1457496 - RNA, 19 nt, Homo sapiens
ggucagagcaaaucacaag

SEQ ID NO: 1457497 - RNA, 19 nt, Homo sapiens
gcuagaaacaaacccugua

SEQ ID NO: 1457498 - RNA, 19 nt, Homo sapiens
ccucuuauauggacuacau

SEQ ID NO: 1457499 - RNA, 19 nt, Homo sapiens
ggguauacaggaacucuuu

SEQ ID NO: 1457500 - RNA, 19 nt, Homo sapiens
uaaagguauuucccucuuc

SEQ ID NO: 1457501 - RNA, 19 nt, Homo sapiens
gcucaggcuuauucacaug

SEQ ID NO: 1457502 - RNA, 19 nt, Homo sapiens
gcacacugccuccugcaau

SEQ ID NO: 1457503 - RNA, 19 nt, Homo sapiens
gguauugguucaacaacuc

SEQ ID NO: 1457504 - RNA, 19 nt, Homo sapiens
ggacuacauucagcugcaa

SEQ ID NO: 1457505 - RNA, 19 nt, Homo sapiens
ggacauuagugggaaaauu

SEQ ID NO: 1457506 - RNA, 19 nt, Homo sapiens
caaagagcuuguggccauu

SEQ ID NO: 1457507 - RNA, 19 nt, Homo sapiens
uugcagugguuuaaacaaa

SEQ ID NO: 1457508 - RNA, 19 nt, Homo sapiens
gaaagggaacagaguaagg

SEQ ID NO: 1457509 - RNA, 19 nt, Homo sapiens
ucucagaccuaagggugua

SEQ ID NO: 1457510 - RNA, 19 nt, Homo sapiens
aaacaaacccuguauuuuc

SEQ ID NO: 1457511 - RNA, 19 nt, Homo sapiens
cuuggcagcuagaaacaaa

SEQ ID NO: 1457512 - RNA, 19 nt, Homo sapiens
ggaggugacuacuucuacu

SEQ ID NO: 1457513 - RNA, 19 nt, Homo sapiens
ggucacgucuuggauccuu

SEQ ID NO: 1457514 - RNA, 19 nt, Homo sapiens
ccacauagcauggauucug

SEQ ID NO: 1457515 - RNA, 19 nt, Homo sapiens
gaugagaaacagacuacau

SEQ ID NO: 1457516 - RNA, 19 nt, Homo sapiens
aaagagagugagaguagaa

SEQ ID NO: 1457517 - RNA, 19 nt, Homo sapiens
caggcuagcucaggcuuau

SEQ ID NO: 1457518 - RNA, 19 nt, Homo sapiens
gaaaugcagaauuguguac

SEQ ID NO: 1457519 - RNA, 19 nt, Homo sapiens
cuauguaaccucuuauaug

SEQ ID NO: 1457520 - RNA, 19 nt, Homo sapiens
gcuguuggcuggaauugcu

SEQ ID NO: 1457521 - RNA, 19 nt, Homo sapiens
caagagcccagaagacaca

SEQ ID NO: 1457522 - RNA, 19 nt, Homo sapiens
ccaaucguguuccaucuac

SEQ ID NO: 1457523 - RNA, 19 nt, Homo sapiens
uaagacagcagggaacaga

SEQ ID NO: 1457524 - RNA, 19 nt, Homo sapiens
gaagaggaagggccaaacu

SEQ ID NO: 1457525 - RNA, 19 nt, Homo sapiens
ccuuacccuugaagcauua

SEQ ID NO: 1457526 - RNA, 19 nt, Homo sapiens
gccuuacccuugaagcauu

SEQ ID NO: 1457527 - RNA, 19 nt, Homo sapiens
ccauggugauguaagaugu

SEQ ID NO: 1457528 - RNA, 19 nt, Homo sapiens
auaaagguauuucccucuu

SEQ ID NO: 1457529 - RNA, 19 nt, Homo sapiens
gaccaaucguguuccaucu

SEQ ID NO: 1457530 - RNA, 19 nt, Homo sapiens
caccagacuugcaguagca

SEQ ID NO: 1457531 - RNA, 19 nt, Homo sapiens
uuggauggguauuuauuug

SEQ ID NO: 1457532 - RNA, 19 nt, Homo sapiens
ccacaccagacuugcagua

SEQ ID NO: 1457533 - RNA, 19 nt, Homo sapiens
gcaggcuagcucaggcuua

SEQ ID NO: 1457534 - RNA, 19 nt, Homo sapiens
uaggauagccuuacucacu

SEQ ID NO: 1457535 - RNA, 19 nt, Homo sapiens
ugacuacuucuacuccuuu

SEQ ID NO: 1457536 - RNA, 19 nt, Homo sapiens
uguacuaucucugcaacuu

SEQ ID NO: 1457537 - RNA, 19 nt, Homo sapiens
acaggaacucuuuguacua

SEQ ID NO: 1457538 - RNA, 19 nt, Homo sapiens
ccaguucccaccucuguga

SEQ ID NO: 1457539 - RNA, 19 nt, Homo sapiens
caguuucuccaguucaaua

SEQ ID NO: 1457540 - RNA, 19 nt, Homo sapiens
ucccaccucugugacaaua

SEQ ID NO: 1457541 - RNA, 19 nt, Homo sapiens
acaaggcuuuacccagauu

SEQ ID NO: 1457542 - RNA, 19 nt, Homo sapiens
caagagagaaaugcagaau

SEQ ID NO: 1457543 - RNA, 19 nt, Homo sapiens
uggauugggucuuggaaca

SEQ ID NO: 1457544 - RNA, 19 nt, Homo sapiens
ugucugcacugcugguaug

SEQ ID NO: 1457545 - RNA, 19 nt, Homo sapiens
aggauagccuuacucacuu

SEQ ID NO: 1457546 - RNA, 19 nt, Homo sapiens
ggucuaggauagccuuacu

SEQ ID NO: 1457547 - RNA, 19 nt, Homo sapiens
caaacuuggcagcuagaaa

SEQ ID NO: 1457548 - RNA, 19 nt, Homo sapiens
gcacauucauggccauugg

SEQ ID NO: 1457549 - RNA, 19 nt, Homo sapiens
gcagaguggcggcaccuuu

SEQ ID NO: 1457550 - RNA, 19 nt, Homo sapiens
gagucgggcuacccacuga

SEQ ID NO: 1457551 - RNA, 19 nt, Homo sapiens
cccagcccauguacuaaua

SEQ ID NO: 1457552 - RNA, 19 nt, Homo sapiens
cagcccauguacuaauaaa

SEQ ID NO: 1457553 - RNA, 19 nt, Homo sapiens
aaucccagcccauguacua

SEQ ID NO: 1457554 - RNA, 19 nt, Homo sapiens
caaaaugggcuucgugaug

SEQ ID NO: 1457555 - RNA, 19 nt, Homo sapiens
cagaguggcggcaccuuug

SEQ ID NO: 1457556 - RNA, 19 nt, Homo sapiens
cggcaccuuuggcacauuc

SEQ ID NO: 1457557 - RNA, 19 nt, Homo sapiens
cugcuucgaccgugucaaa

SEQ ID NO: 1457558 - RNA, 19 nt, Homo sapiens
ccaaagaacuuaaggauuu

SEQ ID NO: 1457559 - RNA, 19 nt, Homo sapiens
uuaaggauuucugcaagua

SEQ ID NO: 1457560 - RNA, 19 nt, Homo sapiens
gaaauaaacagccgaugcu

SEQ ID NO: 1457561 - RNA, 19 nt, Homo sapiens
caaagaacuuaaggauuuc

SEQ ID NO: 1457562 - RNA, 19 nt, Homo sapiens
aaccauaucugcgcauuga

SEQ ID NO: 1457563 - RNA, 19 nt, Homo sapiens
ggaaccauaucugcgcauu

SEQ ID NO: 1457564 - RNA, 19 nt, Homo sapiens
cagccaagaccagaaauaa

SEQ ID NO: 1457565 - RNA, 19 nt, Homo sapiens
guccgaaguuggccacauu

SEQ ID NO: 1457566 - RNA, 19 nt, Homo sapiens
ccgccuggguguccucuuu

SEQ ID NO: 1457567 - RNA, 19 nt, Homo sapiens
gcucuacagccaucucuug

SEQ ID NO: 1457568 - RNA, 19 nt, Homo sapiens
gccaagaccagaaauaaac

SEQ ID NO: 1457569 - RNA, 19 nt, Homo sapiens
gacaugcacaucaucauca

SEQ ID NO: 1457570 - RNA, 19 nt, Homo sapiens
gaaccauaucugcgcauug

SEQ ID NO: 1457571 - RNA, 19 nt, Homo sapiens
gcccaaagaacuuaaggau

SEQ ID NO: 1457572 - RNA, 19 nt, Homo sapiens
caaagagcgugcgccuugu

SEQ ID NO: 1457573 - RNA, 19 nt, Homo sapiens
ccagccaagaccagaaaua

SEQ ID NO: 1457574 - RNA, 19 nt, Homo sapiens
aaggauuucugcaaguaug

SEQ ID NO: 1457575 - RNA, 19 nt, Homo sapiens
cgacaugcacaucaucauc

SEQ ID NO: 1457576 - RNA, 19 nt, Homo sapiens
cugcaaguaugagugaaga

SEQ ID NO: 1457577 - RNA, 19 nt, Homo sapiens
uaggcgggauggcugagaa

SEQ ID NO: 1457578 - RNA, 19 nt, Homo sapiens
ccaccugcccaaagaacuu

SEQ ID NO: 1457579 - RNA, 19 nt, Homo sapiens
ggcuccaccugcccaaaga

SEQ ID NO: 1457580 - RNA, 19 nt, Homo sapiens
caucaacggcgaggacaug

SEQ ID NO: 1457581 - RNA, 19 nt, Homo sapiens
acaugcacaucaucaucaa

SEQ ID NO: 1457582 - RNA, 19 nt, Homo sapiens
ccaagaccagaaauaaaca

SEQ ID NO: 1457583 - RNA, 19 nt, Homo sapiens
uguggacggcuaaguugua

SEQ ID NO: 1457584 - RNA, 19 nt, Homo sapiens
cccaaagaacuuaaggauu

SEQ ID NO: 1457585 - RNA, 19 nt, Homo sapiens
cuuaaggauuucugcaagu

SEQ ID NO: 1457586 - RNA, 19 nt, Homo sapiens
ugccaucccugcagacucu

SEQ ID NO: 1457587 - RNA, 19 nt, Homo sapiens
guggacggcuaaguuguag

SEQ ID NO: 1457588 - RNA, 19 nt, Homo sapiens
guuguggacggcuaaguug

SEQ ID NO: 1457589 - RNA, 19 nt, Homo sapiens
uaaggauuucugcaaguau

SEQ ID NO: 1457590 - RNA, 19 nt, Homo sapiens
ucuuggaccagcucuauga

SEQ ID NO: 1457591 - RNA, 19 nt, Homo sapiens
gaaaugagcccagauagaa

SEQ ID NO: 1457592 - RNA, 19 nt, Homo sapiens
gauagaaacuucaaaugca

SEQ ID NO: 1457593 - RNA, 19 nt, Homo sapiens
caagauagaauucaccuuu

SEQ ID NO: 1457594 - RNA, 19 nt, Homo sapiens
ugacguaucuggaguuugu

SEQ ID NO: 1457595 - RNA, 19 nt, Homo sapiens
ccaggcugcucucucauua

SEQ ID NO: 1457596 - RNA, 19 nt, Homo sapiens
ggaagcaaguccauaacau

SEQ ID NO: 1457597 - RNA, 19 nt, Homo sapiens
ugaguuaaaugcuaaggaa

SEQ ID NO: 1457598 - RNA, 19 nt, Homo sapiens
ggaaaugagcccagauaga

SEQ ID NO: 1457599 - RNA, 19 nt, Homo sapiens
gcugcucucucauuauaaa

SEQ ID NO: 1457600 - RNA, 19 nt, Homo sapiens
aggaagagcuggagaaugg

SEQ ID NO: 1457601 - RNA, 19 nt, Homo sapiens
gaagcaaguccauaacaug

SEQ ID NO: 1457602 - RNA, 19 nt, Homo sapiens
aggcugcucucucauuaua

SEQ ID NO: 1457603 - RNA, 19 nt, Homo sapiens
gugcuuagaaccuuaaauu

SEQ ID NO: 1457604 - RNA, 19 nt, Homo sapiens
cuuagaaccuuaaauugga

SEQ ID NO: 1457605 - RNA, 19 nt, Homo sapiens
gaagcauucuuaauuaucc

SEQ ID NO: 1457606 - RNA, 19 nt, Homo sapiens
ucaggaagcaaguccauaa

SEQ ID NO: 1457607 - RNA, 19 nt, Homo sapiens
gugauuugcuguucuguag

SEQ ID NO: 1457608 - RNA, 19 nt, Homo sapiens
gagcccagauagaaacuuc

SEQ ID NO: 1457609 - RNA, 19 nt, Homo sapiens
uaucuggaguuugugcuua

SEQ ID NO: 1457610 - RNA, 19 nt, Homo sapiens
ucgaggacuuccaauauga

SEQ ID NO: 1457611 - RNA, 19 nt, Homo sapiens
gggaagguguggcaaugug

SEQ ID NO: 1457612 - RNA, 19 nt, Homo sapiens
ucaccuuucaggacaauua

SEQ ID NO: 1457613 - RNA, 19 nt, Homo sapiens
caaagaaugaguuaaaugc

SEQ ID NO: 1457614 - RNA, 19 nt, Homo sapiens
ggaagcauucuuaauuauc

SEQ ID NO: 1457615 - RNA, 19 nt, Homo sapiens
ccagauagaaacuucaaau

SEQ ID NO: 1457616 - RNA, 19 nt, Homo sapiens
gcuuagaaccuuaaauugg

SEQ ID NO: 1457617 - RNA, 19 nt, Homo sapiens
agauagaauucaccuuuca

SEQ ID NO: 1457618 - RNA, 19 nt, Homo sapiens
guaggcguguuguggauuc

SEQ ID NO: 1457619 - RNA, 19 nt, Homo sapiens
caugacguaucuggaguuu

SEQ ID NO: 1457620 - RNA, 19 nt, Homo sapiens
cugaacagcuggaaaugag

SEQ ID NO: 1457621 - RNA, 19 nt, Homo sapiens
aaucgaggacuuccaauau

SEQ ID NO: 1457622 - RNA, 19 nt, Homo sapiens
aagcaaguccauaacauga

SEQ ID NO: 1457623 - RNA, 19 nt, Homo sapiens
aaaucgaggacuuccaaua

SEQ ID NO: 1457624 - RNA, 19 nt, Homo sapiens
ggcguguuguggauucuuu

SEQ ID NO: 1457625 - RNA, 19 nt, Homo sapiens
gaccauggcaguauuucau

SEQ ID NO: 1457626 - RNA, 19 nt, Homo sapiens
gucaacaaagaaugaguua

SEQ ID NO: 1457627 - RNA, 19 nt, Homo sapiens
ccaaggaagagcuggagaa

SEQ ID NO: 1457628 - RNA, 19 nt, Homo sapiens
aagauagaauucaccuuuc

SEQ ID NO: 1457629 - RNA, 19 nt, Homo sapiens
caacugcugauuucaucuu

SEQ ID NO: 1457630 - RNA, 19 nt, Homo sapiens
uguccaggcugcucucuca

SEQ ID NO: 1457631 - RNA, 19 nt, Homo sapiens
cagauagaaacuucaaaug

SEQ ID NO: 1457632 - RNA, 19 nt, Homo sapiens
ggacucggagacauauuuc

SEQ ID NO: 1457633 - RNA, 19 nt, Homo sapiens
uccauaacaugacguaucu

SEQ ID NO: 1457634 - RNA, 19 nt, Homo sapiens
ggaauccgaacccugaaca

SEQ ID NO: 1457635 - RNA, 19 nt, Homo sapiens
caaggaagagcuggagaau

SEQ ID NO: 1457636 - RNA, 19 nt, Homo sapiens
guuugugcuuagaaccuua

SEQ ID NO: 1457637 - RNA, 19 nt, Homo sapiens
aaaugagcccagauagaaa

SEQ ID NO: 1457638 - RNA, 19 nt, Homo sapiens
caggacaauuaaaugaaag

SEQ ID NO: 1457639 - RNA, 19 nt, Homo sapiens
guggagacacagccauuug

SEQ ID NO: 1457640 - RNA, 19 nt, Homo sapiens
gcugaccauggcaguauuu

SEQ ID NO: 1457641 - RNA, 19 nt, Homo sapiens
ggaagguguggcaaugugu

SEQ ID NO: 1457642 - RNA, 19 nt, Homo sapiens
gaaaucgaggacuuccaau

SEQ ID NO: 1457643 - RNA, 19 nt, Homo sapiens
agauagaaacuucaaaugc

SEQ ID NO: 1457644 - RNA, 19 nt, Homo sapiens
ucaguuugcguguggagaa

SEQ ID NO: 1457645 - RNA, 19 nt, Homo sapiens
guccauaacaugacguauc

SEQ ID NO: 1457646 - RNA, 19 nt, Homo sapiens
caguuugcguguggagaaa

SEQ ID NO: 1457647 - RNA, 19 nt, Homo sapiens
gcaagauagaauucaccuu

SEQ ID NO: 1457648 - RNA, 19 nt, Homo sapiens
gcccagauagaaacuucaa

SEQ ID NO: 1457649 - RNA, 19 nt, Homo sapiens
gagaagaaguugcaucgua

SEQ ID NO: 1457650 - RNA, 19 nt, Homo sapiens
gaagggaacuccacugugu

SEQ ID NO: 1457651 - RNA, 19 nt, Homo sapiens
ggacauggcuggcucuuca

SEQ ID NO: 1457652 - RNA, 19 nt, Homo sapiens
cuacagcugugaugcauua

SEQ ID NO: 1457653 - RNA, 19 nt, Homo sapiens
gcacauacauggugacucu

SEQ ID NO: 1457654 - RNA, 19 nt, Homo sapiens
gaacaggugcuccuucauu

SEQ ID NO: 1457655 - RNA, 19 nt, Homo sapiens
gcaaauccauccuuuaaaa

SEQ ID NO: 1457656 - RNA, 19 nt, Homo sapiens
ggaggacucucaccagguu

SEQ ID NO: 1457657 - RNA, 19 nt, Homo sapiens
gaacaaggaacgagaaagu

SEQ ID NO: 1457658 - RNA, 19 nt, Homo sapiens
gagaacaggugcuccuuca

SEQ ID NO: 1457659 - RNA, 19 nt, Homo sapiens
gaaguugcaucguaguuca

SEQ ID NO: 1457660 - RNA, 19 nt, Homo sapiens
ggaaugaggaugaucuuug

SEQ ID NO: 1457661 - RNA, 19 nt, Homo sapiens
cagcaaauccauccuuuaa

SEQ ID NO: 1457662 - RNA, 19 nt, Homo sapiens
gcucugaacuagccuacaa

SEQ ID NO: 1457663 - RNA, 19 nt, Homo sapiens
gaaugaggaugaucuuugg

SEQ ID NO: 1457664 - RNA, 19 nt, Homo sapiens
auacuaggguuuagcauuu

SEQ ID NO: 1457665 - RNA, 19 nt, Homo sapiens
ggaauauuguuacaguaga

SEQ ID NO: 1457666 - RNA, 19 nt, Homo sapiens
ggugaaauuugucugcauu

SEQ ID NO: 1457667 - RNA, 19 nt, Homo sapiens
cagcugugaugcauuauug

SEQ ID NO: 1457668 - RNA, 19 nt, Homo sapiens
ccugugaacugcuguggua

SEQ ID NO: 1457669 - RNA, 19 nt, Homo sapiens
cacuuuagcugaagcauug

SEQ ID NO: 1457670 - RNA, 19 nt, Homo sapiens
ccaaaggcuugaagaacuu

SEQ ID NO: 1457671 - RNA, 19 nt, Homo sapiens
ccacacaacccgacucuug

SEQ ID NO: 1457672 - RNA, 19 nt, Homo sapiens
caaaaucggucugguaaaa

SEQ ID NO: 1457673 - RNA, 19 nt, Homo sapiens
ccacaccuccucccaaauu

SEQ ID NO: 1457674 - RNA, 19 nt, Homo sapiens
gcccacaccuccucccaaa

SEQ ID NO: 1457675 - RNA, 19 nt, Homo sapiens
caacccgacucuuggagaa

SEQ ID NO: 1457676 - RNA, 19 nt, Homo sapiens
gcccacgccugccuauaaa

SEQ ID NO: 1457677 - RNA, 19 nt, Homo sapiens
ggacggaacgacaugauuc

SEQ ID NO: 1457678 - RNA, 19 nt, Homo sapiens
ggacaaagggaaugaggau

SEQ ID NO: 1457679 - RNA, 19 nt, Homo sapiens
cagaauaggccacccaguu

SEQ ID NO: 1457680 - RNA, 19 nt, Homo sapiens
guacaaguguccucaaagc

SEQ ID NO: 1457681 - RNA, 19 nt, Homo sapiens
caagaaggcuuuuggaauc

SEQ ID NO: 1457682 - RNA, 19 nt, Homo sapiens
ucagugaacuaaacacaca

SEQ ID NO: 1457683 - RNA, 19 nt, Homo sapiens
uaagaugaccgaccuguuc

SEQ ID NO: 1457684 - RNA, 19 nt, Homo sapiens
ggacugcauccucugcuuu

SEQ ID NO: 1457685 - RNA, 19 nt, Homo sapiens
cguacuugcuccuaaggua

SEQ ID NO: 1457686 - RNA, 19 nt, Homo sapiens
gaauauuguuacaguagag

SEQ ID NO: 1457687 - RNA, 19 nt, Homo sapiens
cuaggaauauuguuacagu

SEQ ID NO: 1457688 - RNA, 19 nt, Homo sapiens
cauccucuaugcuuucuug

SEQ ID NO: 1457689 - RNA, 19 nt, Homo sapiens
agacaccacuggcaaaucu

SEQ ID NO: 1457690 - RNA, 19 nt, Homo sapiens
ugacaguccuuucaaucug

SEQ ID NO: 1457691 - RNA, 19 nt, Homo sapiens
ccagccaucugagcucuuu

SEQ ID NO: 1457692 - RNA, 19 nt, Homo sapiens
ggcagaagaaguaccagua

SEQ ID NO: 1457693 - RNA, 19 nt, Homo sapiens
ggcccacgccugccuauaa

SEQ ID NO: 1457694 - RNA, 19 nt, Homo sapiens
gcaugccacugaaguccaa

SEQ ID NO: 1457695 - RNA, 19 nt, Homo sapiens
cacaccuccucccaaauua

SEQ ID NO: 1457696 - RNA, 19 nt, Homo sapiens
ggagaacaaggaacgagaa

SEQ ID NO: 1457697 - RNA, 19 nt, Homo sapiens
gcagcugcuucaagaccua

SEQ ID NO: 1457698 - RNA, 19 nt, Homo sapiens
caucguaguucagcaaauc

SEQ ID NO: 1457699 - RNA, 19 nt, Homo sapiens
acaaagggaaugaggauga

SEQ ID NO: 1457700 - RNA, 19 nt, Homo sapiens
gagccucaguuguuguuca

SEQ ID NO: 1457701 - RNA, 19 nt, Homo sapiens
gcacuuuagcugaagcauu

SEQ ID NO: 1457702 - RNA, 19 nt, Homo sapiens
uagcaaaagugaugaagaa

SEQ ID NO: 1457703 - RNA, 19 nt, Homo sapiens
caaagggaaugaggaugau

SEQ ID NO: 1457704 - RNA, 19 nt, Homo sapiens
gcucuucaguggacguuca

SEQ ID NO: 1457705 - RNA, 19 nt, Homo sapiens
caaggugucaagccucuuu

SEQ ID NO: 1457706 - RNA, 19 nt, Homo sapiens
gagaacaaggaacgagaaa

SEQ ID NO: 1457707 - RNA, 19 nt, Homo sapiens
ccagcguacuugcuccuaa

SEQ ID NO: 1457708 - RNA, 19 nt, Homo sapiens
ggaagugugagaguuuaaa

SEQ ID NO: 1457709 - RNA, 19 nt, Homo sapiens
cuucugaccuggccaagau

SEQ ID NO: 1457710 - RNA, 19 nt, Homo sapiens
caagaccuaugaggacuuc

SEQ ID NO: 1457711 - RNA, 19 nt, Homo sapiens
ggcggacccuuaaggcauu

SEQ ID NO: 1457712 - RNA, 19 nt, Homo sapiens
gcauucggacccaaucaaa

SEQ ID NO: 1457713 - RNA, 19 nt, Homo sapiens
acaaacacuucuccuugga

SEQ ID NO: 1457714 - RNA, 19 nt, Homo sapiens
uugaagcacuuuagcugaa

SEQ ID NO: 1457715 - RNA, 19 nt, Homo sapiens
gcuccaggaucgugguaug

SEQ ID NO: 1457716 - RNA, 19 nt, Homo sapiens
gcaagcaugccacugaagu

SEQ ID NO: 1457717 - RNA, 19 nt, Homo sapiens
gccacauccucuaugcuuu

SEQ ID NO: 1457718 - RNA, 19 nt, Homo sapiens
gaacuuucuuaagguagau

SEQ ID NO: 1457719 - RNA, 19 nt, Homo sapiens
cauacauggugacucuaaa

SEQ ID NO: 1457720 - RNA, 19 nt, Homo sapiens
caacgagagacuagauaga

SEQ ID NO: 1457721 - RNA, 19 nt, Homo sapiens
guacaacgagagacuagau

SEQ ID NO: 1457722 - RNA, 19 nt, Homo sapiens
gcaccuccauccgcgaaga

SEQ ID NO: 1457723 - RNA, 19 nt, Homo sapiens
gcaaggacggaacgacaug

SEQ ID NO: 1457724 - RNA, 19 nt, Homo sapiens
gccgguggcagaagaagua

SEQ ID NO: 1457725 - RNA, 19 nt, Homo sapiens
ggauuacauagacuucuuu

SEQ ID NO: 1457726 - RNA, 19 nt, Homo sapiens
agaauaggccacccaguug

SEQ ID NO: 1457727 - RNA, 19 nt, Homo sapiens
cagguuagggugagacaaa

SEQ ID NO: 1457728 - RNA, 19 nt, Homo sapiens
uuaaaagucucaugaagga

SEQ ID NO: 1457729 - RNA, 19 nt, Homo sapiens
guucaaggccaaaguuauc

SEQ ID NO: 1457730 - RNA, 19 nt, Homo sapiens
ucagcaaauccauccuuua

SEQ ID NO: 1457731 - RNA, 19 nt, Homo sapiens
cgagagacuagauagacua

SEQ ID NO: 1457732 - RNA, 19 nt, Homo sapiens
caaucaaacaggaagagaa

SEQ ID NO: 1457733 - RNA, 19 nt, Homo sapiens
ggcuguugcugcucuuuau

SEQ ID NO: 1457734 - RNA, 19 nt, Homo sapiens
gcauccuccuuuccaucua

SEQ ID NO: 1457735 - RNA, 19 nt, Homo sapiens
caaugugccugcagagacu

SEQ ID NO: 1457736 - RNA, 19 nt, Homo sapiens
gacaaaaucggucugguaa

SEQ ID NO: 1457737 - RNA, 19 nt, Homo sapiens
cauacuaggguuuagcauu

SEQ ID NO: 1457738 - RNA, 19 nt, Homo sapiens
gcagggaguuagcaaaccu

SEQ ID NO: 1457739 - RNA, 19 nt, Homo sapiens
agugggaggugguacagaa

SEQ ID NO: 1457740 - RNA, 19 nt, Homo sapiens
gaacacccagggccacauc

SEQ ID NO: 1457741 - RNA, 19 nt, Homo sapiens
cugggcagcugcuucaaga

SEQ ID NO: 1457742 - RNA, 19 nt, Homo sapiens
ucccugaguuccagaauag

SEQ ID NO: 1457743 - RNA, 19 nt, Homo sapiens
caggacauacuaggguuua

SEQ ID NO: 1457744 - RNA, 19 nt, Homo sapiens
gcaggacauacuaggguuu

SEQ ID NO: 1457745 - RNA, 19 nt, Homo sapiens
gaagugugagaguuuaaag

SEQ ID NO: 1457746 - RNA, 19 nt, Homo sapiens
ggccacauccucuaugcuu

SEQ ID NO: 1457747 - RNA, 19 nt, Homo sapiens
ggagacaccacuggcaaau

SEQ ID NO: 1457748 - RNA, 19 nt, Homo sapiens
gcugugaugcauuauugaa

SEQ ID NO: 1457749 - RNA, 19 nt, Homo sapiens
gcagcagccuaaacuauau

SEQ ID NO: 1457750 - RNA, 19 nt, Homo sapiens
gcacaaggaccucaaguca

SEQ ID NO: 1457751 - RNA, 19 nt, Homo sapiens
gagauugucaagcaaauaa

SEQ ID NO: 1457752 - RNA, 19 nt, Homo sapiens
gaggauaccgugacaagaa

SEQ ID NO: 1457753 - RNA, 19 nt, Homo sapiens
ccuugucccugucaaauaa

SEQ ID NO: 1457754 - RNA, 19 nt, Homo sapiens
auaagaacaucaacaggaa

SEQ ID NO: 1457755 - RNA, 19 nt, Homo sapiens
ucaccgagauugucaagca

SEQ ID NO: 1457756 - RNA, 19 nt, Homo sapiens
gcagggaagucugugacaa

SEQ ID NO: 1457757 - RNA, 19 nt, Homo sapiens
caagucaccagcauaagaa

SEQ ID NO: 1457758 - RNA, 19 nt, Homo sapiens
gcaaacacuuaugugaauc

SEQ ID NO: 1457759 - RNA, 19 nt, Homo sapiens
ugcaaacacuuaugugaau

SEQ ID NO: 1457760 - RNA, 19 nt, Homo sapiens
ccucaagucaccagcauaa

SEQ ID NO: 1457761 - RNA, 19 nt, Homo sapiens
ucaagucaccagcauaaga

SEQ ID NO: 1457762 - RNA, 19 nt, Homo sapiens
gcaugagcauccugugagu

SEQ ID NO: 1457763 - RNA, 19 nt, Homo sapiens
gugacaaccuggccagaca

SEQ ID NO: 1457764 - RNA, 19 nt, Homo sapiens
cagccuaaacuauaucuau

SEQ ID NO: 1457765 - RNA, 19 nt, Homo sapiens
acaagaagaggaugcagaa

SEQ ID NO: 1457766 - RNA, 19 nt, Homo sapiens
caacuccucuauccaagac

SEQ ID NO: 1457767 - RNA, 19 nt, Homo sapiens
ucaagcaaauaacauaugc

SEQ ID NO: 1457768 - RNA, 19 nt, Homo sapiens
cagcagcagccuaaacuau

SEQ ID NO: 1457769 - RNA, 19 nt, Homo sapiens
gacaaccuggccagacaua

SEQ ID NO: 1457770 - RNA, 19 nt, Homo sapiens
acauagggcucacgaucug

SEQ ID NO: 1457771 - RNA, 19 nt, Homo sapiens
gaccucaagucaccagcau

SEQ ID NO: 1457772 - RNA, 19 nt, Homo sapiens
gcccacauccgaagcacaa

SEQ ID NO: 1457773 - RNA, 19 nt, Homo sapiens
uaugcaaacacuuauguga

SEQ ID NO: 1457774 - RNA, 19 nt, Homo sapiens
cgagauugucaagcaaaua

SEQ ID NO: 1457775 - RNA, 19 nt, Homo sapiens
ccuaaacuauaucuaugca

SEQ ID NO: 1457776 - RNA, 19 nt, Homo sapiens
agcagcagccuaaacuaua

SEQ ID NO: 1457777 - RNA, 19 nt, Homo sapiens
agccuaaacuauaucuaug

SEQ ID NO: 1457778 - RNA, 19 nt, Homo sapiens
acacagcuauccccagaaa

SEQ ID NO: 1457779 - RNA, 19 nt, Homo sapiens
gggaggauaccgugacaag

SEQ ID NO: 1457780 - RNA, 19 nt, Homo sapiens
ccugucaaauaaaccagaa

SEQ ID NO: 1457781 - RNA, 19 nt, Homo sapiens
ggaggauaccgugacaaga

SEQ ID NO: 1457782 - RNA, 19 nt, Homo sapiens
gacauagggcucacgaucu

SEQ ID NO: 1457783 - RNA, 19 nt, Homo sapiens
ccgagauugucaagcaaau

SEQ ID NO: 1457784 - RNA, 19 nt, Homo sapiens
cuauaucuaugcaaacacu

SEQ ID NO: 1457785 - RNA, 19 nt, Homo sapiens
cagcauaagaacaucaaca

SEQ ID NO: 1457786 - RNA, 19 nt, Homo sapiens
gauugucaagcaaauaaca

SEQ ID NO: 1457787 - RNA, 19 nt, Homo sapiens
cagggaggauaccgugaca

SEQ ID NO: 1457788 - RNA, 19 nt, Homo sapiens
caagaagaggaugcagaaa

SEQ ID NO: 1457789 - RNA, 19 nt, Homo sapiens
caaccuggccagacauagg

SEQ ID NO: 1457790 - RNA, 19 nt, Homo sapiens
cgcccucucuacugucuga

SEQ ID NO: 1457791 - RNA, 19 nt, Homo sapiens
gaagcacaaggaccucaag

SEQ ID NO: 1457792 - RNA, 19 nt, Homo sapiens
gcauccugcuucccaacuc

SEQ ID NO: 1457793 - RNA, 19 nt, Homo sapiens
gagagugggcugggaugug

SEQ ID NO: 1457794 - RNA, 19 nt, Homo sapiens
caccgagauugucaagcaa

SEQ ID NO: 1457795 - RNA, 19 nt, Homo sapiens
aagaacaucaacaggaaug

SEQ ID NO: 1457796 - RNA, 19 nt, Homo sapiens
gucaagcaaauaacauaug

SEQ ID NO: 1457797 - RNA, 19 nt, Homo sapiens
caaacacuuaugugaaucu

SEQ ID NO: 1457798 - RNA, 19 nt, Homo sapiens
gcaacagucuggaucaaua

SEQ ID NO: 1457799 - RNA, 19 nt, Homo sapiens
gauggucggugacacauua

SEQ ID NO: 1457800 - RNA, 19 nt, Homo sapiens
gcacaaauguaagguuuau

SEQ ID NO: 1457801 - RNA, 19 nt, Homo sapiens
uaauccagcucuaagaaua

SEQ ID NO: 1457802 - RNA, 19 nt, Homo sapiens
acacauggaugcacaaaug

SEQ ID NO: 1457803 - RNA, 19 nt, Homo sapiens
gaacauuuccucaguguag

SEQ ID NO: 1457804 - RNA, 19 nt, Homo sapiens
ugacagauuccuccaguua

SEQ ID NO: 1457805 - RNA, 19 nt, Homo sapiens
gaauucaggucaguaguau

SEQ ID NO: 1457806 - RNA, 19 nt, Homo sapiens
gaaucaauuugcugaguau

SEQ ID NO: 1457807 - RNA, 19 nt, Homo sapiens
ggaagaagcaauccaggaa

SEQ ID NO: 1457808 - RNA, 19 nt, Homo sapiens
agaagaggcugaaaucauc

SEQ ID NO: 1457809 - RNA, 19 nt, Homo sapiens
gcaagugaaucugguuaau

SEQ ID NO: 1457810 - RNA, 19 nt, Homo sapiens
ugagggagcuaggcuguuu

SEQ ID NO: 1457811 - RNA, 19 nt, Homo sapiens
caggauugcuuuacacaug

SEQ ID NO: 1457812 - RNA, 19 nt, Homo sapiens
uuggaaaucuacacguuua

SEQ ID NO: 1457813 - RNA, 19 nt, Homo sapiens
ggaguaaagugguugaaaa

SEQ ID NO: 1457814 - RNA, 19 nt, Homo sapiens
caagugaaucugguuaaua

SEQ ID NO: 1457815 - RNA, 19 nt, Homo sapiens
gagugguacuuauaucuga

SEQ ID NO: 1457816 - RNA, 19 nt, Homo sapiens
ccugagggccaauuuaaua

SEQ ID NO: 1457817 - RNA, 19 nt, Homo sapiens
gagcuaggcuguuuugcua

SEQ ID NO: 1457818 - RNA, 19 nt, Homo sapiens
gauaauccagcucuaagaa

SEQ ID NO: 1457819 - RNA, 19 nt, Homo sapiens
gaaaccagcaccguccaua

SEQ ID NO: 1457820 - RNA, 19 nt, Homo sapiens
gaagaagcaauccaggaaa

SEQ ID NO: 1457821 - RNA, 19 nt, Homo sapiens
agaaucaauuugcugagua

SEQ ID NO: 1457822 - RNA, 19 nt, Homo sapiens
gucaguauguccacuuaaa

SEQ ID NO: 1457823 - RNA, 19 nt, Homo sapiens
cuacuucuauuaacgaaug

SEQ ID NO: 1457824 - RNA, 19 nt, Homo sapiens
uaaagaagaggcugaaauc

SEQ ID NO: 1457825 - RNA, 19 nt, Homo sapiens
cuaaaguccuaggauuaua

SEQ ID NO: 1457826 - RNA, 19 nt, Homo sapiens
caaggcacguggcacuaaa

SEQ ID NO: 1457827 - RNA, 19 nt, Homo sapiens
ccaacccuauugcuucuaa

SEQ ID NO: 1457828 - RNA, 19 nt, Homo sapiens
aaaauuggcugaagaaugu

SEQ ID NO: 1457829 - RNA, 19 nt, Homo sapiens
uaaaggggcuuauuaaagu

SEQ ID NO: 1457830 - RNA, 19 nt, Homo sapiens
agguuuaucuucuggcuua

SEQ ID NO: 1457831 - RNA, 19 nt, Homo sapiens
ucaauuugcugaguaugaa

SEQ ID NO: 1457832 - RNA, 19 nt, Homo sapiens
gaaaggagguccgccuacu

SEQ ID NO: 1457833 - RNA, 19 nt, Homo sapiens
uuacugaacuucgaaagga

SEQ ID NO: 1457834 - RNA, 19 nt, Homo sapiens
aaccaaaccuggaguaaag

SEQ ID NO: 1457835 - RNA, 19 nt, Homo sapiens
ccuuaaauuuccucuguuu

SEQ ID NO: 1457836 - RNA, 19 nt, Homo sapiens
guuaccaucugccuuaaau

SEQ ID NO: 1457837 - RNA, 19 nt, Homo sapiens
uaagucacaugcaaaucaa

SEQ ID NO: 1457838 - RNA, 19 nt, Homo sapiens
ccugcucucuuacaaagua

SEQ ID NO: 1457839 - RNA, 19 nt, Homo sapiens
uaaaagggcaugauuauga

SEQ ID NO: 1457840 - RNA, 19 nt, Homo sapiens
caacagucuggaucaauaa

SEQ ID NO: 1457841 - RNA, 19 nt, Homo sapiens
agaguuaccaucugccuua

SEQ ID NO: 1457842 - RNA, 19 nt, Homo sapiens
gcaaggcacguggcacuaa

SEQ ID NO: 1457843 - RNA, 19 nt, Homo sapiens
ggcaugauuaugaauguua

SEQ ID NO: 1457844 - RNA, 19 nt, Homo sapiens
gauuuaaggacuucacauu

SEQ ID NO: 1457845 - RNA, 19 nt, Homo sapiens
uacaauacaugcauuacug

SEQ ID NO: 1457846 - RNA, 19 nt, Homo sapiens
guacuaagucacaugcaaa

SEQ ID NO: 1457847 - RNA, 19 nt, Homo sapiens
gcauaugacacuagcagaa

SEQ ID NO: 1457848 - RNA, 19 nt, Homo sapiens
uaccaucugccuuaaauuu

SEQ ID NO: 1457849 - RNA, 19 nt, Homo sapiens
gugaaucugguuaauauga

SEQ ID NO: 1457850 - RNA, 19 nt, Homo sapiens
aggcugaaaucaucuguga

SEQ ID NO: 1457851 - RNA, 19 nt, Homo sapiens
acagauuccuccaguuaga

SEQ ID NO: 1457852 - RNA, 19 nt, Homo sapiens
ugaauucaggucaguagua

SEQ ID NO: 1457853 - RNA, 19 nt, Homo sapiens
caugguuucuucugugcua

SEQ ID NO: 1457854 - RNA, 19 nt, Homo sapiens
gagguccgccuacuucuau

SEQ ID NO: 1457855 - RNA, 19 nt, Homo sapiens
ggucucgaauuccuggauu

SEQ ID NO: 1457856 - RNA, 19 nt, Homo sapiens
ccaagggugugugugacua

SEQ ID NO: 1457857 - RNA, 19 nt, Homo sapiens
ccauugagugguacuuaua

SEQ ID NO: 1457858 - RNA, 19 nt, Homo sapiens
gaauguuauuuccuuugga

SEQ ID NO: 1457859 - RNA, 19 nt, Homo sapiens
gagcaggagaggcauguug

SEQ ID NO: 1457860 - RNA, 19 nt, Homo sapiens
gaagcaauccaggaaacaa

SEQ ID NO: 1457861 - RNA, 19 nt, Homo sapiens
uaaccaaaccuggaguaaa

SEQ ID NO: 1457862 - RNA, 19 nt, Homo sapiens
cgcauuacaugguuucuuc

SEQ ID NO: 1457863 - RNA, 19 nt, Homo sapiens
ggagguccgccuacuucua

SEQ ID NO: 1457864 - RNA, 19 nt, Homo sapiens
gaaaauuggcugaagaaug

SEQ ID NO: 1457865 - RNA, 19 nt, Homo sapiens
uuagggcacuccacuuaug

SEQ ID NO: 1457866 - RNA, 19 nt, Homo sapiens
gcaugauuaugaauguuag

SEQ ID NO: 1457867 - RNA, 19 nt, Homo sapiens
uaccaggagcuuaauaauu

SEQ ID NO: 1457868 - RNA, 19 nt, Homo sapiens
gaguuaccaucugccuuaa

SEQ ID NO: 1457869 - RNA, 19 nt, Homo sapiens
gccgauagcuuccuuuuag

SEQ ID NO: 1457870 - RNA, 19 nt, Homo sapiens
cuaagucacaugcaaauca

SEQ ID NO: 1457871 - RNA, 19 nt, Homo sapiens
gggcacuccacuuaugaua

SEQ ID NO: 1457872 - RNA, 19 nt, Homo sapiens
acgcccagcuaauguguuu

SEQ ID NO: 1457873 - RNA, 19 nt, Homo sapiens
augcacaaauguaagguuu

SEQ ID NO: 1457874 - RNA, 19 nt, Homo sapiens
cauggaugcacaaauguaa

SEQ ID NO: 1457875 - RNA, 19 nt, Homo sapiens
ccagcucuaagaauaauuu

SEQ ID NO: 1457876 - RNA, 19 nt, Homo sapiens
ggagaagauugaggcuugu

SEQ ID NO: 1457877 - RNA, 19 nt, Homo sapiens
ucuacacguuuacagcaua

SEQ ID NO: 1457878 - RNA, 19 nt, Homo sapiens
ucuuggaaccggagaauuu

SEQ ID NO: 1457879 - RNA, 19 nt, Homo sapiens
cuccugagcucaagugauc

SEQ ID NO: 1457880 - RNA, 19 nt, Homo sapiens
uuucuucuguggauccaua

SEQ ID NO: 1457881 - RNA, 19 nt, Homo sapiens
gacagucucaugauuauac

SEQ ID NO: 1457882 - RNA, 19 nt, Homo sapiens
caauuuaauacucguguga

SEQ ID NO: 1457883 - RNA, 19 nt, Homo sapiens
ucacaugcaaaucaaggua

SEQ ID NO: 1457884 - RNA, 19 nt, Homo sapiens
cccuauugcuucuaaguug

SEQ ID NO: 1457885 - RNA, 19 nt, Homo sapiens
ggucuucccaacccuauug

SEQ ID NO: 1457886 - RNA, 19 nt, Homo sapiens
gguccgccuacuucuauua

SEQ ID NO: 1457887 - RNA, 19 nt, Homo sapiens
uuuaaggacuucacauugg

SEQ ID NO: 1457888 - RNA, 19 nt, Homo sapiens
ggguuuaccaggagcuuaa

SEQ ID NO: 1457889 - RNA, 19 nt, Homo sapiens
gccuggcccucucaucuga

SEQ ID NO: 1457890 - RNA, 19 nt, Homo sapiens
caucugugauaaaguucaa

SEQ ID NO: 1457891 - RNA, 19 nt, Homo sapiens
cuucaccucucaaggaaau

SEQ ID NO: 1457892 - RNA, 19 nt, Homo sapiens
guauagcccagaaaauuua

SEQ ID NO: 1457893 - RNA, 19 nt, Homo sapiens
ucaguaguauagcccagaa

SEQ ID NO: 1457894 - RNA, 19 nt, Homo sapiens
ccaaggaggccucaaugca

SEQ ID NO: 1457895 - RNA, 19 nt, Homo sapiens
caccguccauauuuuauua

SEQ ID NO: 1457896 - RNA, 19 nt, Homo sapiens
ugccuuaaauuuccucugu

SEQ ID NO: 1457897 - RNA, 19 nt, Homo sapiens
uauggcaugugacagauuc

SEQ ID NO: 1457898 - RNA, 19 nt, Homo sapiens
aaacuaaggugaugagaua

SEQ ID NO: 1457899 - RNA, 19 nt, Homo sapiens
gaauaacuauguacaagga

SEQ ID NO: 1457900 - RNA, 19 nt, Homo sapiens
cuuaagaagugcuggaaua

SEQ ID NO: 1457901 - RNA, 19 nt, Homo sapiens
gagauacuguugccucaau

SEQ ID NO: 1457902 - RNA, 19 nt, Homo sapiens
acaaggacauugcaggaaa

SEQ ID NO: 1457903 - RNA, 19 nt, Homo sapiens
cuaauaaacuaaggugaug

SEQ ID NO: 1457904 - RNA, 19 nt, Homo sapiens
acaguaaccgaacaacuua

SEQ ID NO: 1457905 - RNA, 19 nt, Homo sapiens
gugcuggaauaacuaugua

SEQ ID NO: 1457906 - RNA, 19 nt, Homo sapiens
ucacuugcuucucaaccua

SEQ ID NO: 1457907 - RNA, 19 nt, Homo sapiens
gacacagucuacauaaauc

SEQ ID NO: 1457908 - RNA, 19 nt, Homo sapiens
uaaccgaacaacuuaagaa

SEQ ID NO: 1457909 - RNA, 19 nt, Homo sapiens
aaaaugaccuucgagcaua

SEQ ID NO: 1457910 - RNA, 19 nt, Homo sapiens
ggaacuggaagcauguaaa

SEQ ID NO: 1457911 - RNA, 19 nt, Homo sapiens
aggaaaaucugcagaguaa

SEQ ID NO: 1457912 - RNA, 19 nt, Homo sapiens
gaagugcuggaauaacuau

SEQ ID NO: 1457913 - RNA, 19 nt, Homo sapiens
aagaagugcuggaauaacu

SEQ ID NO: 1457914 - RNA, 19 nt, Homo sapiens
caaccuagucuaauaaacu

SEQ ID NO: 1457915 - RNA, 19 nt, Homo sapiens
ccaaagccagcaacacuug

SEQ ID NO: 1457916 - RNA, 19 nt, Homo sapiens
gaacuggaagcauguaaaa

SEQ ID NO: 1457917 - RNA, 19 nt, Homo sapiens
cacaguaaccgaacaacuu

SEQ ID NO: 1457918 - RNA, 19 nt, Homo sapiens
gaccuucgagcauauucua

SEQ ID NO: 1457919 - RNA, 19 nt, Homo sapiens
gaaaaucugcagaguaaau

SEQ ID NO: 1457920 - RNA, 19 nt, Homo sapiens
gaaaaugggagauacuguu

SEQ ID NO: 1457921 - RNA, 19 nt, Homo sapiens
uuaagaagugcuggaauaa

SEQ ID NO: 1457922 - RNA, 19 nt, Homo sapiens
gauauacaucuucuuccuu

SEQ ID NO: 1457923 - RNA, 19 nt, Homo sapiens
uggaauaacuauguacaag

SEQ ID NO: 1457924 - RNA, 19 nt, Homo sapiens
caauaucaaggaacuggaa

SEQ ID NO: 1457925 - RNA, 19 nt, Homo sapiens
agauacuguugccucaaua

SEQ ID NO: 1457926 - RNA, 19 nt, Homo sapiens
aaaugaccuucgagcauau

SEQ ID NO: 1457927 - RNA, 19 nt, Homo sapiens
ucucaaccuagucuaauaa

SEQ ID NO: 1457928 - RNA, 19 nt, Homo sapiens
cuucaagacuauguuacaa

SEQ ID NO: 1457929 - RNA, 19 nt, Homo sapiens
cuaaggugaugagauauac

SEQ ID NO: 1457930 - RNA, 19 nt, Homo sapiens
acuaaggugaugagauaua

SEQ ID NO: 1457931 - RNA, 19 nt, Homo sapiens
gauacuguugccucaauau

SEQ ID NO: 1457932 - RNA, 19 nt, Homo sapiens
ucauugcaauucugcuguu

SEQ ID NO: 1457933 - RNA, 19 nt, Homo sapiens
uaaacuaaggugaugagau

SEQ ID NO: 1457934 - RNA, 19 nt, Homo sapiens
caugaucauugcaauucug

SEQ ID NO: 1457935 - RNA, 19 nt, Homo sapiens
ucccaagccugaagacaca

SEQ ID NO: 1457936 - RNA, 19 nt, Homo sapiens
caaggaacuggaagcaugu

SEQ ID NO: 1457937 - RNA, 19 nt, Homo sapiens
acuguugccucaauaucaa

SEQ ID NO: 1457938 - RNA, 19 nt, Homo sapiens
caaggacauugcaggaaaa

SEQ ID NO: 1457939 - RNA, 19 nt, Homo sapiens
uuccagaaacccacaguaa

SEQ ID NO: 1457940 - RNA, 19 nt, Homo sapiens
ccugaggcacuaugugaaa

SEQ ID NO: 1457941 - RNA, 19 nt, Homo sapiens
ggacauugcaggaaaaucu

SEQ ID NO: 1457942 - RNA, 19 nt, Homo sapiens
uucucaaccuagucuaaua

SEQ ID NO: 1457943 - RNA, 19 nt, Homo sapiens
acacuugcacugacucuuc

SEQ ID NO: 1457944 - RNA, 19 nt, Homo sapiens
guaaccgaacaacuuaaga

SEQ ID NO: 1457945 - RNA, 19 nt, Homo sapiens
gcuucucaaccuagucuaa

SEQ ID NO: 1457946 - RNA, 19 nt, Homo sapiens
agaagugcuggaauaacua

SEQ ID NO: 1457947 - RNA, 19 nt, Homo sapiens
cacuugcacugacucuuca

SEQ ID NO: 1457948 - RNA, 19 nt, Homo sapiens
gggcucuucaugaucauug

SEQ ID NO: 1457949 - RNA, 19 nt, Homo sapiens
ugaauaaccuccaggauuu

SEQ ID NO: 1457950 - RNA, 19 nt, Homo sapiens
ggaaagaaauguuuagacu

SEQ ID NO: 1457951 - RNA, 19 nt, Homo sapiens
gaggagcaguucuuaguuu

SEQ ID NO: 1457952 - RNA, 19 nt, Homo sapiens
ggaauugcuuacacacuuu

SEQ ID NO: 1457953 - RNA, 19 nt, Homo sapiens
gaagaaauagaccagugua

SEQ ID NO: 1457954 - RNA, 19 nt, Homo sapiens
gcaaagugcagauguagga

SEQ ID NO: 1457955 - RNA, 19 nt, Homo sapiens
gaaacucuaugucuucaac

SEQ ID NO: 1457956 - RNA, 19 nt, Homo sapiens
guaugaaacucuaugucuu

SEQ ID NO: 1457957 - RNA, 19 nt, Homo sapiens
ucaguugccuuaauaaagu

SEQ ID NO: 1457958 - RNA, 19 nt, Homo sapiens
uaaggaggagcuugaauaa

SEQ ID NO: 1457959 - RNA, 19 nt, Homo sapiens
guucagccguggaaagaaa

SEQ ID NO: 1457960 - RNA, 19 nt, Homo sapiens
uagcaucucuucaaacaca

SEQ ID NO: 1457961 - RNA, 19 nt, Homo sapiens
ggcuucaguugccuuaaua

SEQ ID NO: 1457962 - RNA, 19 nt, Homo sapiens
cguagcaucucuucaaaca

SEQ ID NO: 1457963 - RNA, 19 nt, Homo sapiens
gaaauagaccaguguacca

SEQ ID NO: 1457964 - RNA, 19 nt, Homo sapiens
caggcaaagugcagaugua

SEQ ID NO: 1457965 - RNA, 19 nt, Homo sapiens
auaaggaggagcuugaaua

SEQ ID NO: 1457966 - RNA, 19 nt, Homo sapiens
guaccaaacccagagauug

SEQ ID NO: 1457967 - RNA, 19 nt, Homo sapiens
ggaaugcgaaguggaagaa

SEQ ID NO: 1457968 - RNA, 19 nt, Homo sapiens
caaaguggaaugcgaagug

SEQ ID NO: 1457969 - RNA, 19 nt, Homo sapiens
aaccuuggcuguuccagaa

SEQ ID NO: 1457970 - RNA, 19 nt, Homo sapiens
ggaagaaauagaccagugu

SEQ ID NO: 1457971 - RNA, 19 nt, Homo sapiens
cagcguagcaucucuucaa

SEQ ID NO: 1457972 - RNA, 19 nt, Homo sapiens
ugauugaugcuccaaauug

SEQ ID NO: 1457973 - RNA, 19 nt, Homo sapiens
ggucagccuuacuuuauac

SEQ ID NO: 1457974 - RNA, 19 nt, Homo sapiens
aggaauugcuuacacacuu

SEQ ID NO: 1457975 - RNA, 19 nt, Homo sapiens
gaaauguuuagacuucaga

SEQ ID NO: 1457976 - RNA, 19 nt, Homo sapiens
acccagagauugcccagaa

SEQ ID NO: 1457977 - RNA, 19 nt, Homo sapiens
ucucaggacuucugccaau

SEQ ID NO: 1457978 - RNA, 19 nt, Homo sapiens
uccaggauuuggcucauaa

SEQ ID NO: 1457979 - RNA, 19 nt, Homo sapiens
gaccacuucucaguaugaa

SEQ ID NO: 1457980 - RNA, 19 nt, Homo sapiens
gaauaaccuccaggauuug

SEQ ID NO: 1457981 - RNA, 19 nt, Homo sapiens
uugaauaaccuccaggauu

SEQ ID NO: 1457982 - RNA, 19 nt, Homo sapiens
agccuuacuuuauaccaua

SEQ ID NO: 1457983 - RNA, 19 nt, Homo sapiens
cuugaccacuucucaguau

SEQ ID NO: 1457984 - RNA, 19 nt, Homo sapiens
ccugauugaugcuccaaau

SEQ ID NO: 1457985 - RNA, 19 nt, Homo sapiens
ccaggccaguacuuccuaa

SEQ ID NO: 1457986 - RNA, 19 nt, Homo sapiens
aaacugaaccccaggaauu

SEQ ID NO: 1457987 - RNA, 19 nt, Homo sapiens
uaugaaacucuaugucuuc

SEQ ID NO: 1457988 - RNA, 19 nt, Homo sapiens
gcaggcaaagugcagaugu

SEQ ID NO: 1457989 - RNA, 19 nt, Homo sapiens
aggucagccuuacuuuaua

SEQ ID NO: 1457990 - RNA, 19 nt, Homo sapiens
aggaggagcuugaauaacc

SEQ ID NO: 1457991 - RNA, 19 nt, Homo sapiens
cugguaccauucauccuuu

SEQ ID NO: 1457992 - RNA, 19 nt, Homo sapiens
ugaccacuucucaguauga

SEQ ID NO: 1457993 - RNA, 19 nt, Homo sapiens
ggaggagcuugaauaaccu

SEQ ID NO: 1457994 - RNA, 19 nt, Homo sapiens
ugccaauccugguaccauu

SEQ ID NO: 1457995 - RNA, 19 nt, Homo sapiens
aaugcgaaguggaagaaau

SEQ ID NO: 1457996 - RNA, 19 nt, Homo sapiens
augcgaaguggaagaaaua

SEQ ID NO: 1457997 - RNA, 19 nt, Homo sapiens
ccacuucucaguaugaaac

SEQ ID NO: 1457998 - RNA, 19 nt, Homo sapiens
acaaugcucuuccccuuga

SEQ ID NO: 1457999 - RNA, 19 nt, Homo sapiens
ggccaguacuuccuaaaau

SEQ ID NO: 1458000 - RNA, 19 nt, Homo sapiens
cagccuuacuuuauaccau

SEQ ID NO: 1458001 - RNA, 19 nt, Homo sapiens
ugaggagcaguucuuaguu

SEQ ID NO: 1458002 - RNA, 19 nt, Homo sapiens
gaauugcuuacacacuuuc

SEQ ID NO: 1458003 - RNA, 19 nt, Homo sapiens
gccaguacuuccuaaaaug

SEQ ID NO: 1458004 - RNA, 19 nt, Homo sapiens
gccguggaaagaaauguuu

SEQ ID NO: 1458005 - RNA, 19 nt, Homo sapiens
cccagagauugcccagaaa

SEQ ID NO: 1458006 - RNA, 19 nt, Homo sapiens
cgaaguggaagaaauagac

SEQ ID NO: 1458007 - RNA, 19 nt, Homo sapiens
gcgaaguggaagaaauaga

SEQ ID NO: 1458008 - RNA, 19 nt, Homo sapiens
ggcaagccgugucccaaaa

SEQ ID NO: 1458009 - RNA, 19 nt, Homo sapiens
cccaggaauugcuuacaca

SEQ ID NO: 1458010 - RNA, 19 nt, Homo sapiens
uguuuagacuucagaaagg

SEQ ID NO: 1458011 - RNA, 19 nt, Homo sapiens
aaauagaccaguguaccaa

SEQ ID NO: 1458012 - RNA, 19 nt, Homo sapiens
gaaugcgaaguggaagaaa

SEQ ID NO: 1458013 - RNA, 19 nt, Homo sapiens
gcaacgacaucgaccaaua

SEQ ID NO: 1458014 - RNA, 19 nt, Homo sapiens
ggaggaagcuguuuaaagg

SEQ ID NO: 1458015 - RNA, 19 nt, Homo sapiens
gaauggaacuggcuugaug

SEQ ID NO: 1458016 - RNA, 19 nt, Homo sapiens
ggagcgagcuugggaaauu

SEQ ID NO: 1458017 - RNA, 19 nt, Homo sapiens
ggaggaaauuguaagauca

SEQ ID NO: 1458018 - RNA, 19 nt, Homo sapiens
gagcagaaaucgaagucau

SEQ ID NO: 1458019 - RNA, 19 nt, Homo sapiens
gaaauacugcccacgucua

SEQ ID NO: 1458020 - RNA, 19 nt, Homo sapiens
guaaagggcaggaggaaau

SEQ ID NO: 1458021 - RNA, 19 nt, Homo sapiens
cagaugcucuaagugauaa

SEQ ID NO: 1458022 - RNA, 19 nt, Homo sapiens
ccacacagccgacgaaugg

SEQ ID NO: 1458023 - RNA, 19 nt, Homo sapiens
uggacaagcucacuauuca

SEQ ID NO: 1458024 - RNA, 19 nt, Homo sapiens
gaucagaauagcaaggaaa

SEQ ID NO: 1458025 - RNA, 19 nt, Homo sapiens
gaaauuguaagaucagucu

SEQ ID NO: 1458026 - RNA, 19 nt, Homo sapiens
gcucuaagugauaagauuu

SEQ ID NO: 1458027 - RNA, 19 nt, Homo sapiens
gaagcuguuuaaagggauu

SEQ ID NO: 1458028 - RNA, 19 nt, Homo sapiens
gagcgagcuugggaaauug

SEQ ID NO: 1458029 - RNA, 19 nt, Homo sapiens
caagggcuccaaggaaaua

SEQ ID NO: 1458030 - RNA, 19 nt, Homo sapiens
gaugcgugcuccaggaaga

SEQ ID NO: 1458031 - RNA, 19 nt, Homo sapiens
gcaggaggaaauuguaaga

SEQ ID NO: 1458032 - RNA, 19 nt, Homo sapiens
gaccaagggcuccaaggaa

SEQ ID NO: 1458033 - RNA, 19 nt, Homo sapiens
ucagaugcucuaagugaua

SEQ ID NO: 1458034 - RNA, 19 nt, Homo sapiens
caagcucacuauucacaca

SEQ ID NO: 1458035 - RNA, 19 nt, Homo sapiens
accaagggcuccaaggaaa

SEQ ID NO: 1458036 - RNA, 19 nt, Homo sapiens
gaauagcaaggaaaguguu

SEQ ID NO: 1458037 - RNA, 19 nt, Homo sapiens
gugauaagauuuuggaaga

SEQ ID NO: 1458038 - RNA, 19 nt, Homo sapiens
ggaugcagcuggagaugcu

SEQ ID NO: 1458039 - RNA, 19 nt, Homo sapiens
caaucucccucuugcuguu

SEQ ID NO: 1458040 - RNA, 19 nt, Homo sapiens
ucacccaucucccacuuuc

SEQ ID NO: 1458041 - RNA, 19 nt, Homo sapiens
gggcaggaggaaauuguaa

SEQ ID NO: 1458042 - RNA, 19 nt, Homo sapiens
aaaucgaagucauccauca

SEQ ID NO: 1458043 - RNA, 19 nt, Homo sapiens
gaacucagggagcgagcuu

SEQ ID NO: 1458044 - RNA, 19 nt, Homo sapiens
cuagcugaguccauacaaa

SEQ ID NO: 1458045 - RNA, 19 nt, Homo sapiens
gacaagcucacuauucaca

SEQ ID NO: 1458046 - RNA, 19 nt, Homo sapiens
ggaucagaauagcaaggaa

SEQ ID NO: 1458047 - RNA, 19 nt, Homo sapiens
cuucagaugcucuaaguga

SEQ ID NO: 1458048 - RNA, 19 nt, Homo sapiens
ggucacccucuuuggauuu

SEQ ID NO: 1458049 - RNA, 19 nt, Homo sapiens
cagaauagcaaggaaagug

SEQ ID NO: 1458050 - RNA, 19 nt, Homo sapiens
gauaagauuuuggaagaug

SEQ ID NO: 1458051 - RNA, 19 nt, Homo sapiens
aggaggaaauuguaagauc

SEQ ID NO: 1458052 - RNA, 19 nt, Homo sapiens
cuaguggaguggaagauag

SEQ ID NO: 1458053 - RNA, 19 nt, Homo sapiens
uuuggaagauggucugguu

SEQ ID NO: 1458054 - RNA, 19 nt, Homo sapiens
acacugugcucuggugguu

SEQ ID NO: 1458055 - RNA, 19 nt, Homo sapiens
ucucugcccuggccucuuc

SEQ ID NO: 1458056 - RNA, 19 nt, Homo sapiens
uagcugaguccauacaaau

SEQ ID NO: 1458057 - RNA, 19 nt, Homo sapiens
cgaagucauccaucagcua

SEQ ID NO: 1458058 - RNA, 19 nt, Homo sapiens
caacgacaucgaccaauac

SEQ ID NO: 1458059 - RNA, 19 nt, Homo sapiens
uaaagggcaggaggaaauu

SEQ ID NO: 1458060 - RNA, 19 nt, Homo sapiens
guggacaagcucacuauuc

SEQ ID NO: 1458061 - RNA, 19 nt, Homo sapiens
ggauuuggaucagaauagc

SEQ ID NO: 1458062 - RNA, 19 nt, Homo sapiens
gguguggacuucagaugcu

SEQ ID NO: 1458063 - RNA, 19 nt, Homo sapiens
ggacaagagagucuaugac

SEQ ID NO: 1458064 - RNA, 19 nt, Homo sapiens
ggacuucagaugcucuaag

SEQ ID NO: 1458065 - RNA, 19 nt, Homo sapiens
gguaaagggcaggaggaaa

SEQ ID NO: 1458066 - RNA, 19 nt, Homo sapiens
ucagcuagcguguggacaa

SEQ ID NO: 1458067 - RNA, 19 nt, Homo sapiens
gcuccagccuuggcaacga

SEQ ID NO: 1458068 - RNA, 19 nt, Homo sapiens
ggugagccauuuugauuuc

SEQ ID NO: 1458069 - RNA, 19 nt, Homo sapiens
ugcaggagcagaaaucgaa

SEQ ID NO: 1458070 - RNA, 19 nt, Homo sapiens
ccuaguggaguggaagaua

SEQ ID NO: 1458071 - RNA, 19 nt, Homo sapiens
ccucacccaucucccacuu

SEQ ID NO: 1458072 - RNA, 19 nt, Homo sapiens
gaugaggacaagagagucu

SEQ ID NO: 1458073 - RNA, 19 nt, Homo sapiens
agacacggucacccucuuu

SEQ ID NO: 1458074 - RNA, 19 nt, Homo sapiens
agaaaucgaagucauccau

SEQ ID NO: 1458075 - RNA, 19 nt, Homo sapiens
ccaagggcuccaaggaaau

SEQ ID NO: 1458076 - RNA, 19 nt, Homo sapiens
ccaccacacagccgacgaa

SEQ ID NO: 1458077 - RNA, 19 nt, Homo sapiens
gaguggaagauagcaaaga

SEQ ID NO: 1458078 - RNA, 19 nt, Homo sapiens
gaccugguguggacuucag

SEQ ID NO: 1458079 - RNA, 19 nt, Homo sapiens
uggaggaagcuguuuaaag

SEQ ID NO: 1458080 - RNA, 19 nt, Homo sapiens
acacagccgacgaauggaa

SEQ ID NO: 1458081 - RNA, 19 nt, Homo sapiens
agaccaagggcuccaagga

SEQ ID NO: 1458082 - RNA, 19 nt, Homo sapiens
uguggaggaagcuguuuaa

SEQ ID NO: 1458083 - RNA, 19 nt, Homo sapiens
gcaagagccuguaaucuca

SEQ ID NO: 1458084 - RNA, 19 nt, Homo sapiens
aaagaggccucaaggagua

SEQ ID NO: 1458085 - RNA, 19 nt, Homo sapiens
uaaaugaggugaaauugca

SEQ ID NO: 1458086 - RNA, 19 nt, Homo sapiens
gaaccagcuuuuaguauua

SEQ ID NO: 1458087 - RNA, 19 nt, Homo sapiens
caaaguccaucaacaggaa

SEQ ID NO: 1458088 - RNA, 19 nt, Homo sapiens
gaaaggcacauucggaaga

SEQ ID NO: 1458089 - RNA, 19 nt, Homo sapiens
ggaacccguuugauacuga

SEQ ID NO: 1458090 - RNA, 19 nt, Homo sapiens
gaugagcugucccuguuug

SEQ ID NO: 1458091 - RNA, 19 nt, Homo sapiens
caaacgcgcuguguggaaa

SEQ ID NO: 1458092 - RNA, 19 nt, Homo sapiens
gcucagcucuugucacucu

SEQ ID NO: 1458093 - RNA, 19 nt, Homo sapiens
ggaaccagcuuuuaguauu

SEQ ID NO: 1458094 - RNA, 19 nt, Homo sapiens
ccaaguauauaguagaagu

SEQ ID NO: 1458095 - RNA, 19 nt, Homo sapiens
gacccgagcuccacguuuc

SEQ ID NO: 1458096 - RNA, 19 nt, Homo sapiens
cggaugagcugucccuguu

SEQ ID NO: 1458097 - RNA, 19 nt, Homo sapiens
gagcuucgccuuccucaau

SEQ ID NO: 1458098 - RNA, 19 nt, Homo sapiens
ugacaucgccgacuucuuc

SEQ ID NO: 1458099 - RNA, 19 nt, Homo sapiens
gaucuucgaagcauugaaa

SEQ ID NO: 1458100 - RNA, 19 nt, Homo sapiens
gcagugagcggacagacuu

SEQ ID NO: 1458101 - RNA, 19 nt, Homo sapiens
caggcuggcuuucuauuau

SEQ ID NO: 1458102 - RNA, 19 nt, Homo sapiens
caacaggaacuccgugaga

SEQ ID NO: 1458103 - RNA, 19 nt, Homo sapiens
caccaaguauauaguagaa

SEQ ID NO: 1458104 - RNA, 19 nt, Homo sapiens
ggagagauacuaccugucu

SEQ ID NO: 1458105 - RNA, 19 nt, Homo sapiens
ggaguuggguaccaucaag

SEQ ID NO: 1458106 - RNA, 19 nt, Homo sapiens
gaucgcgaaugccugcaaa

SEQ ID NO: 1458107 - RNA, 19 nt, Homo sapiens
ccuguaaucccaacacuuu

SEQ ID NO: 1458108 - RNA, 19 nt, Homo sapiens
gcaaaauccuccaagaugu

SEQ ID NO: 1458109 - RNA, 19 nt, Homo sapiens
agaagaggcuguccugucu

SEQ ID NO: 1458110 - RNA, 19 nt, Homo sapiens
caguggaacccguuugaua

SEQ ID NO: 1458111 - RNA, 19 nt, Homo sapiens
caagauggcaccacuacau

SEQ ID NO: 1458112 - RNA, 19 nt, Homo sapiens
gcaaacgcgcuguguggaa

SEQ ID NO: 1458113 - RNA, 19 nt, Homo sapiens
ccaccuccauccucagcua

SEQ ID NO: 1458114 - RNA, 19 nt, Homo sapiens
gaaaccccgucucuacuaa

SEQ ID NO: 1458115 - RNA, 19 nt, Homo sapiens
aaagacaccaggaggaauu

SEQ ID NO: 1458116 - RNA, 19 nt, Homo sapiens
gcaagguggaugagcugua

SEQ ID NO: 1458117 - RNA, 19 nt, Homo sapiens
ccucagagaccacgaagug

SEQ ID NO: 1458118 - RNA, 19 nt, Homo sapiens
cgagggacacggaguagaa

SEQ ID NO: 1458119 - RNA, 19 nt, Homo sapiens
guccuuggcucagcucuug

SEQ ID NO: 1458120 - RNA, 19 nt, Homo sapiens
ggcaagagccuguaaucuc

SEQ ID NO: 1458121 - RNA, 19 nt, Homo sapiens
gccgagagccugauagagu

SEQ ID NO: 1458122 - RNA, 19 nt, Homo sapiens
ccagaacggccacgaggaa

SEQ ID NO: 1458123 - RNA, 19 nt, Homo sapiens
caagguggaugagcuguac

SEQ ID NO: 1458124 - RNA, 19 nt, Homo sapiens
cagagccgguccucagaga

SEQ ID NO: 1458125 - RNA, 19 nt, Homo sapiens
gauggcaccacuacauuuc

SEQ ID NO: 1458126 - RNA, 19 nt, Homo sapiens
acaucaaggugacggaguu

SEQ ID NO: 1458127 - RNA, 19 nt, Homo sapiens
caugagaaccuggacauca

SEQ ID NO: 1458128 - RNA, 19 nt, Homo sapiens
ggcuggcuuucuauuauga

SEQ ID NO: 1458129 - RNA, 19 nt, Homo sapiens
ggagacgcagggcagcuuu

SEQ ID NO: 1458130 - RNA, 19 nt, Homo sapiens
augagaaccuggacaucaa

SEQ ID NO: 1458131 - RNA, 19 nt, Homo sapiens
ggucggaucgagucagaug

SEQ ID NO: 1458132 - RNA, 19 nt, Homo sapiens
ucaaggaguaucugugugu

SEQ ID NO: 1458133 - RNA, 19 nt, Homo sapiens
uguccugucugccaccaaa

SEQ ID NO: 1458134 - RNA, 19 nt, Homo sapiens
ugccugagauggacuccuu

SEQ ID NO: 1458135 - RNA, 19 nt, Homo sapiens
auuaugaccuggacaagca

SEQ ID NO: 1458136 - RNA, 19 nt, Homo sapiens
cccagcaggugaagaagau

SEQ ID NO: 1458137 - RNA, 19 nt, Homo sapiens
caaaauccuccaagaugua

SEQ ID NO: 1458138 - RNA, 19 nt, Homo sapiens
uggcucagcucuugucacu

SEQ ID NO: 1458139 - RNA, 19 nt, Homo sapiens
cagcgagggacacggagua

SEQ ID NO: 1458140 - RNA, 19 nt, Homo sapiens
acaaagacaccaggaggaa

SEQ ID NO: 1458141 - RNA, 19 nt, Homo sapiens
gcuccaaggaaccagcuuu

SEQ ID NO: 1458142 - RNA, 19 nt, Homo sapiens
aaaggcacauucggaagau

SEQ ID NO: 1458143 - RNA, 19 nt, Homo sapiens
gccggaggaucgcaaaguc

SEQ ID NO: 1458144 - RNA, 19 nt, Homo sapiens
gagccuguaaucucagcua

SEQ ID NO: 1458145 - RNA, 19 nt, Homo sapiens
ggaugagcugucccuguuu

SEQ ID NO: 1458146 - RNA, 19 nt, Homo sapiens
cgugugacaucgccgacuu

SEQ ID NO: 1458147 - RNA, 19 nt, Homo sapiens
agacuuagcgggaguagac

SEQ ID NO: 1458148 - RNA, 19 nt, Homo sapiens
ggaagauggaguuucacau

SEQ ID NO: 1458149 - RNA, 19 nt, Homo sapiens
ucacggaguuggguaccau

SEQ ID NO: 1458150 - RNA, 19 nt, Homo sapiens
ugggugcagugacguguga

SEQ ID NO: 1458151 - RNA, 19 nt, Homo sapiens
ccucaaggaguaucugugu

SEQ ID NO: 1458152 - RNA, 19 nt, Homo sapiens
ucaccaaguauauaguaga

SEQ ID NO: 1458153 - RNA, 19 nt, Homo sapiens
agauggcaccacuacauuu

SEQ ID NO: 1458154 - RNA, 19 nt, Homo sapiens
aagauggcaccacuacauu

SEQ ID NO: 1458155 - RNA, 19 nt, Homo sapiens
ccuguaaucucagcuacuc

SEQ ID NO: 1458156 - RNA, 19 nt, Homo sapiens
aaaauuagcugggcauggu

SEQ ID NO: 1458157 - RNA, 19 nt, Homo sapiens
cuaagugccaggccagaga

SEQ ID NO: 1458158 - RNA, 19 nt, Homo sapiens
uucggaagauggaguuuca

SEQ ID NO: 1458159 - RNA, 19 nt, Homo sapiens
caaagacaccaggaggaau

SEQ ID NO: 1458160 - RNA, 19 nt, Homo sapiens
cagccuggccaacaugaug

SEQ ID NO: 1458161 - RNA, 19 nt, Homo sapiens
ccagcuuccgggagagaua

SEQ ID NO: 1458162 - RNA, 19 nt, Homo sapiens
gcgaaugccugcaaaaucc

SEQ ID NO: 1458163 - RNA, 19 nt, Homo sapiens
gaugaaaccccgucucuac

SEQ ID NO: 1458164 - RNA, 19 nt, Homo sapiens
ugguggacaucacggaguu

SEQ ID NO: 1458165 - RNA, 19 nt, Homo sapiens
aacaggaacuccgugagau

SEQ ID NO: 1458166 - RNA, 19 nt, Homo sapiens
ggaaagugaugacaaguac

SEQ ID NO: 1458167 - RNA, 19 nt, Homo sapiens
gggcaauaauccuuaauau

SEQ ID NO: 1458168 - RNA, 19 nt, Homo sapiens
caaggaaagugaugacaag

SEQ ID NO: 1458169 - RNA, 19 nt, Homo sapiens
ggcaauaaauguuugucaa

SEQ ID NO: 1458170 - RNA, 19 nt, Homo sapiens
gccauucuauugacucuga

SEQ ID NO: 1458171 - RNA, 19 nt, Homo sapiens
gcaagucaacugcuucuuc

SEQ ID NO: 1458172 - RNA, 19 nt, Homo sapiens
caagucaacugcuucuucu

SEQ ID NO: 1458173 - RNA, 19 nt, Homo sapiens
gaagugauggcaguagaaa

SEQ ID NO: 1458174 - RNA, 19 nt, Homo sapiens
gcaaugggcaauaauccuu

SEQ ID NO: 1458175 - RNA, 19 nt, Homo sapiens
caaugggcaauaauccuua

SEQ ID NO: 1458176 - RNA, 19 nt, Homo sapiens
gugagagaauccugcaaug

SEQ ID NO: 1458177 - RNA, 19 nt, Homo sapiens
gaucuuccgaguccuuaaa

SEQ ID NO: 1458178 - RNA, 19 nt, Homo sapiens
cgaccaguauaacaaggaa

SEQ ID NO: 1458179 - RNA, 19 nt, Homo sapiens
gcaauaaauguuugucaac

SEQ ID NO: 1458180 - RNA, 19 nt, Homo sapiens
gcuguacccugguuugaac

SEQ ID NO: 1458181 - RNA, 19 nt, Homo sapiens
ucaccgaccaguauaacaa

SEQ ID NO: 1458182 - RNA, 19 nt, Homo sapiens
ggaucaccgaccaguauaa

SEQ ID NO: 1458183 - RNA, 19 nt, Homo sapiens
ccuguuggccauucuauug

SEQ ID NO: 1458184 - RNA, 19 nt, Homo sapiens
guggaucaccgaccaguau

SEQ ID NO: 1458185 - RNA, 19 nt, Homo sapiens
uacccugguuugaacagua

SEQ ID NO: 1458186 - RNA, 19 nt, Homo sapiens
aagcguccaugaagugaug

SEQ ID NO: 1458187 - RNA, 19 nt, Homo sapiens
aaugggcaauaauccuuaa

SEQ ID NO: 1458188 - RNA, 19 nt, Homo sapiens
aggaaagugaugacaagua

SEQ ID NO: 1458189 - RNA, 19 nt, Homo sapiens
ugggcaauaauccuuaaua

SEQ ID NO: 1458190 - RNA, 19 nt, Homo sapiens
acaaggaaagugaugacaa

SEQ ID NO: 1458191 - RNA, 19 nt, Homo sapiens
cucugcagcugaaggauga

SEQ ID NO: 1458192 - RNA, 19 nt, Homo sapiens
aguauaacaaggaaaguga

SEQ ID NO: 1458193 - RNA, 19 nt, Homo sapiens
guccagaggcagcaaguca

SEQ ID NO: 1458194 - RNA, 19 nt, Homo sapiens
cuaccaagcaaggaagaaa

SEQ ID NO: 1458195 - RNA, 19 nt, Homo sapiens
ugaagugauggcaguagaa

SEQ ID NO: 1458196 - RNA, 19 nt, Homo sapiens
ucuaagcguccaugaagug

SEQ ID NO: 1458197 - RNA, 19 nt, Homo sapiens
ggaaagugaugacaaguac

SEQ ID NO: 1458198 - RNA, 19 nt, Homo sapiens
gggcaauaauccuuaauau

SEQ ID NO: 1458199 - RNA, 19 nt, Homo sapiens
caaggaaagugaugacaag

SEQ ID NO: 1458200 - RNA, 19 nt, Homo sapiens
ggcaauaaauguuugucaa

SEQ ID NO: 1458201 - RNA, 19 nt, Homo sapiens
gccauucuauugacucuga

SEQ ID NO: 1458202 - RNA, 19 nt, Homo sapiens
gcaagucaacugcuucuuc

SEQ ID NO: 1458203 - RNA, 19 nt, Homo sapiens
caagucaacugcuucuucu

SEQ ID NO: 1458204 - RNA, 19 nt, Homo sapiens
ucacugaccaccuggagua

SEQ ID NO: 1458205 - RNA, 19 nt, Homo sapiens
gaagugauggcaguagaaa

SEQ ID NO: 1458206 - RNA, 19 nt, Homo sapiens
gcaaugggcaauaauccuu

SEQ ID NO: 1458207 - RNA, 19 nt, Homo sapiens
ggaaagggagcuucacaag

SEQ ID NO: 1458208 - RNA, 19 nt, Homo sapiens
caaugggcaauaauccuua

SEQ ID NO: 1458209 - RNA, 19 nt, Homo sapiens
gugagagaauccugcaaug

SEQ ID NO: 1458210 - RNA, 19 nt, Homo sapiens
gaucuuccgaguccuuaaa

SEQ ID NO: 1458211 - RNA, 19 nt, Homo sapiens
cgaccaguauaacaaggaa

SEQ ID NO: 1458212 - RNA, 19 nt, Homo sapiens
gcaauaaauguuugucaac

SEQ ID NO: 1458213 - RNA, 19 nt, Homo sapiens
gcuguacccugguuugaac

SEQ ID NO: 1458214 - RNA, 19 nt, Homo sapiens
ucaccgaccaguauaacaa

SEQ ID NO: 1458215 - RNA, 19 nt, Homo sapiens
ggaucaccgaccaguauaa

SEQ ID NO: 1458216 - RNA, 19 nt, Homo sapiens
ccuguuggccauucuauug

SEQ ID NO: 1458217 - RNA, 19 nt, Homo sapiens
guggaucaccgaccaguau

SEQ ID NO: 1458218 - RNA, 19 nt, Homo sapiens
uacccugguuugaacagua

SEQ ID NO: 1458219 - RNA, 19 nt, Homo sapiens
aagcguccaugaagugaug

SEQ ID NO: 1458220 - RNA, 19 nt, Homo sapiens
aaugggcaauaauccuuaa

SEQ ID NO: 1458221 - RNA, 19 nt, Homo sapiens
cugaccaccuggaguauca

SEQ ID NO: 1458222 - RNA, 19 nt, Homo sapiens
aggaaagugaugacaagua

SEQ ID NO: 1458223 - RNA, 19 nt, Homo sapiens
ugggcaauaauccuuaaua

SEQ ID NO: 1458224 - RNA, 19 nt, Homo sapiens
acaaggaaagugaugacaa

SEQ ID NO: 1458225 - RNA, 19 nt, Homo sapiens
cucugcagcugaaggauga

SEQ ID NO: 1458226 - RNA, 19 nt, Homo sapiens
aguauaacaaggaaaguga

SEQ ID NO: 1458227 - RNA, 19 nt, Homo sapiens
cuaccaagcaaggaagaaa

SEQ ID NO: 1458228 - RNA, 19 nt, Homo sapiens
ugaagugauggcaguagaa

SEQ ID NO: 1458229 - RNA, 19 nt, Homo sapiens
cagagaccacgaacugugu

SEQ ID NO: 1458230 - RNA, 19 nt, Homo sapiens
ucuaagcguccaugaagug

SEQ ID NO: 1458231 - RNA, 19 nt, Homo sapiens
gcaguaauguggaucuuuc

SEQ ID NO: 1458232 - RNA, 19 nt, Homo sapiens
caccaaauguacuuaauga

SEQ ID NO: 1458233 - RNA, 19 nt, Homo sapiens
auacagaaaugcaagauga

SEQ ID NO: 1458234 - RNA, 19 nt, Homo sapiens
ugucaucagucauucaaua

SEQ ID NO: 1458235 - RNA, 19 nt, Homo sapiens
gaacaccaaauguacuuaa

SEQ ID NO: 1458236 - RNA, 19 nt, Homo sapiens
gaagagcaguaauguggau

SEQ ID NO: 1458237 - RNA, 19 nt, Homo sapiens
gaauucuagugcugugaua

SEQ ID NO: 1458238 - RNA, 19 nt, Homo sapiens
ggaagcagaagagcaguaa

SEQ ID NO: 1458239 - RNA, 19 nt, Homo sapiens
uaaugaagacguccaagaa

SEQ ID NO: 1458240 - RNA, 19 nt, Homo sapiens
ucacauacacugcuacuuc

SEQ ID NO: 1458241 - RNA, 19 nt, Homo sapiens
gcuaaaaccugccaagaau

SEQ ID NO: 1458242 - RNA, 19 nt, Homo sapiens
ggugaacacagaauuuauu

SEQ ID NO: 1458243 - RNA, 19 nt, Homo sapiens
gcuaauaccaacuuuguca

SEQ ID NO: 1458244 - RNA, 19 nt, Homo sapiens
caauauggaacaccaaaug

SEQ ID NO: 1458245 - RNA, 19 nt, Homo sapiens
caccaucacuggagcuaga

SEQ ID NO: 1458246 - RNA, 19 nt, Homo sapiens
caggugaacacagaauuua

SEQ ID NO: 1458247 - RNA, 19 nt, Homo sapiens
ccaaauguacuuaaugaag

SEQ ID NO: 1458248 - RNA, 19 nt, Homo sapiens
ccaaguuccucucuauuuu

SEQ ID NO: 1458249 - RNA, 19 nt, Homo sapiens
ggagcuagaggaagcagaa

SEQ ID NO: 1458250 - RNA, 19 nt, Homo sapiens
cagaucacauacacugcua

SEQ ID NO: 1458251 - RNA, 19 nt, Homo sapiens
uaccaacuuugucaucauu

SEQ ID NO: 1458252 - RNA, 19 nt, Homo sapiens
gugcugugauacaaagaaa

SEQ ID NO: 1458253 - RNA, 19 nt, Homo sapiens
ccaggugaacacagaauuu

SEQ ID NO: 1458254 - RNA, 19 nt, Homo sapiens
caucagucauucaauaaac

SEQ ID NO: 1458255 - RNA, 19 nt, Homo sapiens
uugagacgcuguuuaaugg

SEQ ID NO: 1458256 - RNA, 19 nt, Homo sapiens
ugaagacguccaagaaaug

SEQ ID NO: 1458257 - RNA, 19 nt, Homo sapiens
ggaacaccaaauguacuua

SEQ ID NO: 1458258 - RNA, 19 nt, Homo sapiens
gagcaguaauguggaucuu

SEQ ID NO: 1458259 - RNA, 19 nt, Homo sapiens
ucacugcaauguggaugaa

SEQ ID NO: 1458260 - RNA, 19 nt, Homo sapiens
ggcuugagacgcuguuuaa

SEQ ID NO: 1458261 - RNA, 19 nt, Homo sapiens
gugaacacagaauuuauug

SEQ ID NO: 1458262 - RNA, 19 nt, Homo sapiens
auagaacuguuuccucugu

SEQ ID NO: 1458263 - RNA, 19 nt, Homo sapiens
gcagaagagcaguaaugug

SEQ ID NO: 1458264 - RNA, 19 nt, Homo sapiens
aaaacuaccugcaauaugg

SEQ ID NO: 1458265 - RNA, 19 nt, Homo sapiens
uccaaguuccucucuauuu

SEQ ID NO: 1458266 - RNA, 19 nt, Homo sapiens
augaagacguccaagaaau

SEQ ID NO: 1458267 - RNA, 19 nt, Homo sapiens
gucaucagucauucaauaa

SEQ ID NO: 1458268 - RNA, 19 nt, Homo sapiens
agaauuuauuggcuugaga

SEQ ID NO: 1458269 - RNA, 19 nt, Homo sapiens
aagcagaagagcaguaaug

SEQ ID NO: 1458270 - RNA, 19 nt, Homo sapiens
gcaauauggaacaccaaau

SEQ ID NO: 1458271 - RNA, 19 nt, Homo sapiens
acuccaaguuccucucuau

SEQ ID NO: 1458272 - RNA, 19 nt, Homo sapiens
cagcaccaccuccaccaaa

SEQ ID NO: 1458273 - RNA, 19 nt, Homo sapiens
cacauacacugcuacuucu

SEQ ID NO: 1458274 - RNA, 19 nt, Homo sapiens
caggacagaucacauacac

SEQ ID NO: 1458275 - RNA, 19 nt, Homo sapiens
auguggaucuuucccuuaa

SEQ ID NO: 1458276 - RNA, 19 nt, Homo sapiens
cuagugcugugauacaaag

SEQ ID NO: 1458277 - RNA, 19 nt, Homo sapiens
aaugaagacguccaagaaa

SEQ ID NO: 1458278 - RNA, 19 nt, Homo sapiens
gagauacagaaaugcaaga

SEQ ID NO: 1458279 - RNA, 19 nt, Homo sapiens
gauacagaaaugcaagaug

SEQ ID NO: 1458280 - RNA, 19 nt, Homo sapiens
gucauucaauaaacacugu

SEQ ID NO: 1458281 - RNA, 19 nt, Homo sapiens
ccaaaugccaccccuauga

SEQ ID NO: 1458282 - RNA, 19 nt, Homo sapiens
aauaccaacuuugucauca

SEQ ID NO: 1458283 - RNA, 19 nt, Homo sapiens
gccaccaucagcacuauga

SEQ ID NO: 1458284 - RNA, 19 nt, Homo sapiens
gaagacguccaagaaaugc

SEQ ID NO: 1458285 - RNA, 19 nt, Homo sapiens
uuaaugaagacguccaaga

SEQ ID NO: 1458286 - RNA, 19 nt, Homo sapiens
cuugagacgcuguuuaaug

SEQ ID NO: 1458287 - RNA, 19 nt, Homo sapiens
agaacuguuuccucuguca

SEQ ID NO: 1458288 - RNA, 19 nt, Homo sapiens
aaagagauacagaaaugca

SEQ ID NO: 1458289 - RNA, 19 nt, Homo sapiens
auauggaacaccaaaugua

SEQ ID NO: 1458290 - RNA, 19 nt, Homo sapiens
acagaaaugcaagaugaaa

SEQ ID NO: 1458291 - RNA, 19 nt, Homo sapiens
gcaccaccuccaccaaaca

SEQ ID NO: 1458292 - RNA, 19 nt, Homo sapiens
aguaccaggugaacacaga

SEQ ID NO: 1458293 - RNA, 19 nt, Homo sapiens
ccagccucaugcuacagua

SEQ ID NO: 1458294 - RNA, 19 nt, Homo sapiens
gacgcuguuuaauggguuu

SEQ ID NO: 1458295 - RNA, 19 nt, Homo sapiens
ccaaaagugguuaaauuga

SEQ ID NO: 1458296 - RNA, 19 nt, Homo sapiens
aaaccugccaagaauucua

SEQ ID NO: 1458297 - RNA, 19 nt, Homo sapiens
guggaucuuucccuuaaaa

SEQ ID NO: 1458298 - RNA, 19 nt, Homo sapiens
agacguccaagaaaugcua

SEQ ID NO: 1458299 - RNA, 19 nt, Homo sapiens
acaccaaauguacuuaaug

SEQ ID NO: 1458300 - RNA, 19 nt, Homo sapiens
aauguggaucuuucccuua

SEQ ID NO: 1458301 - RNA, 19 nt, Homo sapiens
gcuagaggaagcagaagag

SEQ ID NO: 1458302 - RNA, 19 nt, Homo sapiens
ccaaacauacugccaacac

SEQ ID NO: 1458303 - RNA, 19 nt, Homo sapiens
acacugcuacuucuaccaa

SEQ ID NO: 1458304 - RNA, 19 nt, Homo sapiens
uggcuugagacgcuguuua

SEQ ID NO: 1458305 - RNA, 19 nt, Homo sapiens
uaauaccaacuuugucauc

SEQ ID NO: 1458306 - RNA, 19 nt, Homo sapiens
gaagcaagguggcaguuua

SEQ ID NO: 1458307 - RNA, 19 nt, Homo sapiens
gaaucgagaucaacagaua

SEQ ID NO: 1458308 - RNA, 19 nt, Homo sapiens
caaaguacacccucaaaua

SEQ ID NO: 1458309 - RNA, 19 nt, Homo sapiens
gcaaguauuucaaaccaaa

SEQ ID NO: 1458310 - RNA, 19 nt, Homo sapiens
ucagauaccuuucauacaa

SEQ ID NO: 1458311 - RNA, 19 nt, Homo sapiens
gaacauacaagaaaccaaa

SEQ ID NO: 1458312 - RNA, 19 nt, Homo sapiens
gagcacaucugacucugaa

SEQ ID NO: 1458313 - RNA, 19 nt, Homo sapiens
ucaagaugcuggacgauuu

SEQ ID NO: 1458314 - RNA, 19 nt, Homo sapiens
gaaguaaacagcauaaauc

SEQ ID NO: 1458315 - RNA, 19 nt, Homo sapiens
ccuaauaacucuucagaau

SEQ ID NO: 1458316 - RNA, 19 nt, Homo sapiens
ccauacaugugucauuaua

SEQ ID NO: 1458317 - RNA, 19 nt, Homo sapiens
ggucuuugcugauguagaa

SEQ ID NO: 1458318 - RNA, 19 nt, Homo sapiens
caccauacaugugucauua

SEQ ID NO: 1458319 - RNA, 19 nt, Homo sapiens
caagguggcaguuuauaua

SEQ ID NO: 1458320 - RNA, 19 nt, Homo sapiens
caaaggacaauauccauuu

SEQ ID NO: 1458321 - RNA, 19 nt, Homo sapiens
uggaauagcucaaguucuu

SEQ ID NO: 1458322 - RNA, 19 nt, Homo sapiens
gaauuugcuuugucccuuu

SEQ ID NO: 1458323 - RNA, 19 nt, Homo sapiens
gaauuaccuucuccuuuga

SEQ ID NO: 1458324 - RNA, 19 nt, Homo sapiens
aaaguacacccucaaauaa

SEQ ID NO: 1458325 - RNA, 19 nt, Homo sapiens
acucagggauggaauuaua

SEQ ID NO: 1458326 - RNA, 19 nt, Homo sapiens
ugaaaguccucguguauca

SEQ ID NO: 1458327 - RNA, 19 nt, Homo sapiens
acaaguagaugacgaagau

SEQ ID NO: 1458328 - RNA, 19 nt, Homo sapiens
gaagcaucauuuggaauuu

SEQ ID NO: 1458329 - RNA, 19 nt, Homo sapiens
cagaagaacauacaagaaa

SEQ ID NO: 1458330 - RNA, 19 nt, Homo sapiens
aaaugaagaugcugagcua

SEQ ID NO: 1458331 - RNA, 19 nt, Homo sapiens
acaagaaaccaaacaagua

SEQ ID NO: 1458332 - RNA, 19 nt, Homo sapiens
uaagaagccuaagcaacua

SEQ ID NO: 1458333 - RNA, 19 nt, Homo sapiens
gaaagaaaaucccauugug

SEQ ID NO: 1458334 - RNA, 19 nt, Homo sapiens
gaccuuugaucccaagaaa

SEQ ID NO: 1458335 - RNA, 19 nt, Homo sapiens
ggaacaaucaugugaggaa

SEQ ID NO: 1458336 - RNA, 19 nt, Homo sapiens
gaauagcucaaguucuuaa

SEQ ID NO: 1458337 - RNA, 19 nt, Homo sapiens
agaaauaguucaccacaag

SEQ ID NO: 1458338 - RNA, 19 nt, Homo sapiens
ucauaagccuggcgaaaug

SEQ ID NO: 1458339 - RNA, 19 nt, Homo sapiens
ccagugucaucaaauguuu

SEQ ID NO: 1458340 - RNA, 19 nt, Homo sapiens
uuauugagccuuugucuaa

SEQ ID NO: 1458341 - RNA, 19 nt, Homo sapiens
gcugggaaguucaagauca

SEQ ID NO: 1458342 - RNA, 19 nt, Homo sapiens
aaaugaaaguccucgugua

SEQ ID NO: 1458343 - RNA, 19 nt, Homo sapiens
uauaacagcuggccuucug

SEQ ID NO: 1458344 - RNA, 19 nt, Homo sapiens
cuaagcaacuagaaggauu

SEQ ID NO: 1458345 - RNA, 19 nt, Homo sapiens
ugaaucacgugaagcauca

SEQ ID NO: 1458346 - RNA, 19 nt, Homo sapiens
ggauggaauuauagaagga

SEQ ID NO: 1458347 - RNA, 19 nt, Homo sapiens
gcaagguggcaguuuauau

SEQ ID NO: 1458348 - RNA, 19 nt, Homo sapiens
caagaaaccaaacaaguag

SEQ ID NO: 1458349 - RNA, 19 nt, Homo sapiens
gcaaaguacacccucaaau

SEQ ID NO: 1458350 - RNA, 19 nt, Homo sapiens
aaaguaugaucaccuuaga

SEQ ID NO: 1458351 - RNA, 19 nt, Homo sapiens
cgauuugguuccuuaguga

SEQ ID NO: 1458352 - RNA, 19 nt, Homo sapiens
ggaauagcucaaguucuua

SEQ ID NO: 1458353 - RNA, 19 nt, Homo sapiens
cgaaguaaacagcauaaau

SEQ ID NO: 1458354 - RNA, 19 nt, Homo sapiens
gacccagugucaucaaaug

SEQ ID NO: 1458355 - RNA, 19 nt, Homo sapiens
ugaagcaucauuuggaauu

SEQ ID NO: 1458356 - RNA, 19 nt, Homo sapiens
gaaauucuucagcuucguu

SEQ ID NO: 1458357 - RNA, 19 nt, Homo sapiens
agauacugcucgcaaauug

SEQ ID NO: 1458358 - RNA, 19 nt, Homo sapiens
caguaaaucuaaagcaagu

SEQ ID NO: 1458359 - RNA, 19 nt, Homo sapiens
gauuaccuccugaaacaaa

SEQ ID NO: 1458360 - RNA, 19 nt, Homo sapiens
cagaucagguccucuuaca

SEQ ID NO: 1458361 - RNA, 19 nt, Homo sapiens
uaagcaacuagaaggauua

SEQ ID NO: 1458362 - RNA, 19 nt, Homo sapiens
aaacucagggauggaauua

SEQ ID NO: 1458363 - RNA, 19 nt, Homo sapiens
ugucuaaaccugauuauag

SEQ ID NO: 1458364 - RNA, 19 nt, Homo sapiens
ugaagaugcugagcuaauc

SEQ ID NO: 1458365 - RNA, 19 nt, Homo sapiens
ccuccuccuucucaauuua

SEQ ID NO: 1458366 - RNA, 19 nt, Homo sapiens
gaucagguccucuuacaac

SEQ ID NO: 1458367 - RNA, 19 nt, Homo sapiens
gcuacagugucacaucgaa

SEQ ID NO: 1458368 - RNA, 19 nt, Homo sapiens
gagaagggcagccggaaca

SEQ ID NO: 1458369 - RNA, 19 nt, Homo sapiens
cagcuucguucccuucaga

SEQ ID NO: 1458370 - RNA, 19 nt, Homo sapiens
gaacauguaaaugaagaug

SEQ ID NO: 1458371 - RNA, 19 nt, Homo sapiens
gaaaauggaacaaucaugu

SEQ ID NO: 1458372 - RNA, 19 nt, Homo sapiens
uuuagaacgugccaugaaa

SEQ ID NO: 1458373 - RNA, 19 nt, Homo sapiens
ccaaaggacaauauccauu

SEQ ID NO: 1458374 - RNA, 19 nt, Homo sapiens
aguaggagguauaaaugaa

SEQ ID NO: 1458375 - RNA, 19 nt, Homo sapiens
gcugagcucaucuuuguug

SEQ ID NO: 1458376 - RNA, 19 nt, Homo sapiens
augcugagcucaucuuugu

SEQ ID NO: 1458377 - RNA, 19 nt, Homo sapiens
caaacaaguagaugacgaa

SEQ ID NO: 1458378 - RNA, 19 nt, Homo sapiens
uggacgauuugguuccuua

SEQ ID NO: 1458379 - RNA, 19 nt, Homo sapiens
cgugaagcaucauuuggaa

SEQ ID NO: 1458380 - RNA, 19 nt, Homo sapiens
cagauaccuuucauacaau

SEQ ID NO: 1458381 - RNA, 19 nt, Homo sapiens
uguggaacauguaaaugaa

SEQ ID NO: 1458382 - RNA, 19 nt, Homo sapiens
aaacagaucagguccucuu

SEQ ID NO: 1458383 - RNA, 19 nt, Homo sapiens
aaaggacaauauccauuuc

SEQ ID NO: 1458384 - RNA, 19 nt, Homo sapiens
aaaccaaacaaguagauga

SEQ ID NO: 1458385 - RNA, 19 nt, Homo sapiens
ucugugaauugucauuuga

SEQ ID NO: 1458386 - RNA, 19 nt, Homo sapiens
agacucacaccaccuuuaa

SEQ ID NO: 1458387 - RNA, 19 nt, Homo sapiens
guaggagguauaaaugaaa

SEQ ID NO: 1458388 - RNA, 19 nt, Homo sapiens
ggaagcaagguggcaguuu

SEQ ID NO: 1458389 - RNA, 19 nt, Homo sapiens
gaaguucaagaucaagaug

SEQ ID NO: 1458390 - RNA, 19 nt, Homo sapiens
aaagucccauuaauucuag

SEQ ID NO: 1458391 - RNA, 19 nt, Homo sapiens
caagugccggcuacaguuu

SEQ ID NO: 1458392 - RNA, 19 nt, Homo sapiens
ugccagguuugccauuaua

SEQ ID NO: 1458393 - RNA, 19 nt, Homo sapiens
caggagcccucuacugucu

SEQ ID NO: 1458394 - RNA, 19 nt, Homo sapiens
uggaacauguaaaugaaga

SEQ ID NO: 1458395 - RNA, 19 nt, Homo sapiens
cuuccuggcugguggauga

SEQ ID NO: 1458396 - RNA, 19 nt, Homo sapiens
aguacacccucaaauaaug

SEQ ID NO: 1458397 - RNA, 19 nt, Homo sapiens
uagaaauaguucaccacaa

SEQ ID NO: 1458398 - RNA, 19 nt, Homo sapiens
caucuuuguugguguggaa

SEQ ID NO: 1458399 - RNA, 19 nt, Homo sapiens
gaaauaguucaccacaagu

SEQ ID NO: 1458400 - RNA, 19 nt, Homo sapiens
gaacccaagauccuuucaa

SEQ ID NO: 1458401 - RNA, 19 nt, Homo sapiens
guguggaacauguaaauga

SEQ ID NO: 1458402 - RNA, 19 nt, Homo sapiens
cccauuaauucuaguuuca

SEQ ID NO: 1458403 - RNA, 19 nt, Homo sapiens
uuaagaagccuaagcaacu

SEQ ID NO: 1458404 - RNA, 19 nt, Homo sapiens
uguguuacuuagugacuuu

SEQ ID NO: 1458405 - RNA, 19 nt, Homo sapiens
augcugagcuaaucuuugu

SEQ ID NO: 1458406 - RNA, 19 nt, Homo sapiens
gaacggaacaucuauauug

SEQ ID NO: 1458407 - RNA, 19 nt, Homo sapiens
gaagaaugccagagaaaua

SEQ ID NO: 1458408 - RNA, 19 nt, Homo sapiens
ccaaaggacuggagacaaa

SEQ ID NO: 1458409 - RNA, 19 nt, Homo sapiens
acacacacauucaguauuu

SEQ ID NO: 1458410 - RNA, 19 nt, Homo sapiens
ggaauuagcugagccaaca

SEQ ID NO: 1458411 - RNA, 19 nt, Homo sapiens
ggacacaaaugauaucaca

SEQ ID NO: 1458412 - RNA, 19 nt, Homo sapiens
ggaucaaacuggaauaaau

SEQ ID NO: 1458413 - RNA, 19 nt, Homo sapiens
caaggaagauguauagcuu

SEQ ID NO: 1458414 - RNA, 19 nt, Homo sapiens
ggaauaaggccaaggaaga

SEQ ID NO: 1458415 - RNA, 19 nt, Homo sapiens
gagcaugguuucaggaguu

SEQ ID NO: 1458416 - RNA, 19 nt, Homo sapiens
ggacugacuuggccauguu

SEQ ID NO: 1458417 - RNA, 19 nt, Homo sapiens
uaacacaggacacaaauga

SEQ ID NO: 1458418 - RNA, 19 nt, Homo sapiens
cauaagcacuuuaggaaca

SEQ ID NO: 1458419 - RNA, 19 nt, Homo sapiens
gggaauuaaucuacaauca

SEQ ID NO: 1458420 - RNA, 19 nt, Homo sapiens
aggaagauguauagcuuua

SEQ ID NO: 1458421 - RNA, 19 nt, Homo sapiens
gacuacagcugaccugguu

SEQ ID NO: 1458422 - RNA, 19 nt, Homo sapiens
gaucuuggcugucugucau

SEQ ID NO: 1458423 - RNA, 19 nt, Homo sapiens
uguggacgccuguaaauua

SEQ ID NO: 1458424 - RNA, 19 nt, Homo sapiens
acacaggacacaaaugaua

SEQ ID NO: 1458425 - RNA, 19 nt, Homo sapiens
cgagaagaaugccagagaa

SEQ ID NO: 1458426 - RNA, 19 nt, Homo sapiens
ccagagacaucacccugaa

SEQ ID NO: 1458427 - RNA, 19 nt, Homo sapiens
gcacacacacauucaguau

SEQ ID NO: 1458428 - RNA, 19 nt, Homo sapiens
aaacugagguguuagaaaa

SEQ ID NO: 1458429 - RNA, 19 nt, Homo sapiens
gcgaggacguucacucuca

SEQ ID NO: 1458430 - RNA, 19 nt, Homo sapiens
gcacacgcaugcacacaca

SEQ ID NO: 1458431 - RNA, 19 nt, Homo sapiens
gaaacugagguguuagaaa

SEQ ID NO: 1458432 - RNA, 19 nt, Homo sapiens
ugagaacacuggaucuaau

SEQ ID NO: 1458433 - RNA, 19 nt, Homo sapiens
gcugauccuugaagaagaa

SEQ ID NO: 1458434 - RNA, 19 nt, Homo sapiens
uuucugagcugauccuuga

SEQ ID NO: 1458435 - RNA, 19 nt, Homo sapiens
gagcacagccaacccaguu

SEQ ID NO: 1458436 - RNA, 19 nt, Homo sapiens
gagaagaaugccagagaaa

SEQ ID NO: 1458437 - RNA, 19 nt, Homo sapiens
gacguucacucucaaguca

SEQ ID NO: 1458438 - RNA, 19 nt, Homo sapiens
ggagagagcguguccuaca

SEQ ID NO: 1458439 - RNA, 19 nt, Homo sapiens
cgugcaaucuugaaacuga

SEQ ID NO: 1458440 - RNA, 19 nt, Homo sapiens
gaaacgugcaaucuugaaa

SEQ ID NO: 1458441 - RNA, 19 nt, Homo sapiens
gaacacuggaucuaaugaa

SEQ ID NO: 1458442 - RNA, 19 nt, Homo sapiens
gaagauguauagcuuuagc

SEQ ID NO: 1458443 - RNA, 19 nt, Homo sapiens
ugugaaacgugcaaucuug

SEQ ID NO: 1458444 - RNA, 19 nt, Homo sapiens
agucugagguuuaacaguu

SEQ ID NO: 1458445 - RNA, 19 nt, Homo sapiens
ucuugaaacugagguguua

SEQ ID NO: 1458446 - RNA, 19 nt, Homo sapiens
cuaaugaacggaacaucua

SEQ ID NO: 1458447 - RNA, 19 nt, Homo sapiens
ggacugccaacuugucuga

SEQ ID NO: 1458448 - RNA, 19 nt, Homo sapiens
ucagucugcucauccguaa

SEQ ID NO: 1458449 - RNA, 19 nt, Homo sapiens
ugugaagucugagguuuaa

SEQ ID NO: 1458450 - RNA, 19 nt, Homo sapiens
gaucugugguguuuuguuu

SEQ ID NO: 1458451 - RNA, 19 nt, Homo sapiens
ggacccaucucucccuucu

SEQ ID NO: 1458452 - RNA, 19 nt, Homo sapiens
ccaacaaccacacggagua

SEQ ID NO: 1458453 - RNA, 19 nt, Homo sapiens
ggacagaaacggccucaac

SEQ ID NO: 1458454 - RNA, 19 nt, Homo sapiens
caacagcaacgugaucuug

SEQ ID NO: 1458455 - RNA, 19 nt, Homo sapiens
gaaauaacacaggacacaa

SEQ ID NO: 1458456 - RNA, 19 nt, Homo sapiens
gcagagaaccaggugaaug

SEQ ID NO: 1458457 - RNA, 19 nt, Homo sapiens
gaauaaggccaaggaagau

SEQ ID NO: 1458458 - RNA, 19 nt, Homo sapiens
gaguugagacgcuaauguu

SEQ ID NO: 1458459 - RNA, 19 nt, Homo sapiens
ugacccaguuacccuuuaa

SEQ ID NO: 1458460 - RNA, 19 nt, Homo sapiens
gagaaacaacauggacuuu

SEQ ID NO: 1458461 - RNA, 19 nt, Homo sapiens
ggaaacaggccccauuuug

SEQ ID NO: 1458462 - RNA, 19 nt, Homo sapiens
uaagacugcugggaaggaa

SEQ ID NO: 1458463 - RNA, 19 nt, Homo sapiens
gagaacacuggaucuaaug

SEQ ID NO: 1458464 - RNA, 19 nt, Homo sapiens
cagagaaccaggugaaugu

SEQ ID NO: 1458465 - RNA, 19 nt, Homo sapiens
gguugcagcuggagagaca

SEQ ID NO: 1458466 - RNA, 19 nt, Homo sapiens
ucgcaagcccuauuuauuc

SEQ ID NO: 1458467 - RNA, 19 nt, Homo sapiens
ucuugacagugcagucuua

SEQ ID NO: 1458468 - RNA, 19 nt, Homo sapiens
aaauaacacaggacacaaa

SEQ ID NO: 1458469 - RNA, 19 nt, Homo sapiens
gggcagagaaccaggugaa

SEQ ID NO: 1458470 - RNA, 19 nt, Homo sapiens
gugacccaguuacccuuua

SEQ ID NO: 1458471 - RNA, 19 nt, Homo sapiens
gagcugauccuugaagaag

SEQ ID NO: 1458472 - RNA, 19 nt, Homo sapiens
aagaaugccagagaaauaa

SEQ ID NO: 1458473 - RNA, 19 nt, Homo sapiens
gcacugcgaccucucugau

SEQ ID NO: 1458474 - RNA, 19 nt, Homo sapiens
cgcaagcccuauuuauuca

SEQ ID NO: 1458475 - RNA, 19 nt, Homo sapiens
guagugcagccuucuguga

SEQ ID NO: 1458476 - RNA, 19 nt, Homo sapiens
gcagccagcggucagcaaa

SEQ ID NO: 1458477 - RNA, 19 nt, Homo sapiens
gagagagcguguccuacag

SEQ ID NO: 1458478 - RNA, 19 nt, Homo sapiens
gcugguggcccuacugaug

SEQ ID NO: 1458479 - RNA, 19 nt, Homo sapiens
ucacaaagagaaacaacau

SEQ ID NO: 1458480 - RNA, 19 nt, Homo sapiens
gaaacaggccccauuuugu

SEQ ID NO: 1458481 - RNA, 19 nt, Homo sapiens
gguugggucuugugaaguc

SEQ ID NO: 1458482 - RNA, 19 nt, Homo sapiens
caaagagaaacaacaugga

SEQ ID NO: 1458483 - RNA, 19 nt, Homo sapiens
ugaaugggaccgugguuug

SEQ ID NO: 1458484 - RNA, 19 nt, Homo sapiens
ugcaugagcccgagaagaa

SEQ ID NO: 1458485 - RNA, 19 nt, Homo sapiens
gggcuccacuucuucuaca

SEQ ID NO: 1458486 - RNA, 19 nt, Homo sapiens
ggccaaggaagauguauag

SEQ ID NO: 1458487 - RNA, 19 nt, Homo sapiens
ugacaaguccguguugguu

SEQ ID NO: 1458488 - RNA, 19 nt, Homo sapiens
caagaaugggcaagaagga

SEQ ID NO: 1458489 - RNA, 19 nt, Homo sapiens
ggaccgugguuugcucuag

SEQ ID NO: 1458490 - RNA, 19 nt, Homo sapiens
ucacauaugcagaccugaa

SEQ ID NO: 1458491 - RNA, 19 nt, Homo sapiens
gcugagaacacuggaucua

SEQ ID NO: 1458492 - RNA, 19 nt, Homo sapiens
aaacaggccccauuuugua

SEQ ID NO: 1458493 - RNA, 19 nt, Homo sapiens
cuacuacugugugaaguuc

SEQ ID NO: 1458494 - RNA, 19 nt, Homo sapiens
ugcaggagcucagcauaga

SEQ ID NO: 1458495 - RNA, 19 nt, Homo sapiens
gagacgcuaauguucauga

SEQ ID NO: 1458496 - RNA, 19 nt, Homo sapiens
gaugucgcaagcccuauuu

SEQ ID NO: 1458497 - RNA, 19 nt, Homo sapiens
gagccguccuucucagagu

SEQ ID NO: 1458498 - RNA, 19 nt, Homo sapiens
ucucagacuuccagaccaa

SEQ ID NO: 1458499 - RNA, 19 nt, Homo sapiens
gagaauccacauaccuugu

SEQ ID NO: 1458500 - RNA, 19 nt, Homo sapiens
aagauuggcuuguaaaccu

SEQ ID NO: 1458501 - RNA, 19 nt, Homo sapiens
gucgcaagcccuauuuauu

SEQ ID NO: 1458502 - RNA, 19 nt, Homo sapiens
gucugagguuuaacaguuu

SEQ ID NO: 1458503 - RNA, 19 nt, Homo sapiens
ggaaccaaccugggaagug

SEQ ID NO: 1458504 - RNA, 19 nt, Homo sapiens
ugaccugguuggagaaugg

SEQ ID NO: 1458505 - RNA, 19 nt, Homo sapiens
cgaggacguucacucucaa

SEQ ID NO: 1458506 - RNA, 19 nt, Homo sapiens
gaauaagaaugcucaguuu

SEQ ID NO: 1458507 - RNA, 19 nt, Homo sapiens
gcaauuaacaucugcauaa

SEQ ID NO: 1458508 - RNA, 19 nt, Homo sapiens
caagaaagaugaauaacug

SEQ ID NO: 1458509 - RNA, 19 nt, Homo sapiens
gaguauauuucccuucuua

SEQ ID NO: 1458510 - RNA, 19 nt, Homo sapiens
gaauugccuuuaccuauaa

SEQ ID NO: 1458511 - RNA, 19 nt, Homo sapiens
ugaauugccuuuaccuaua

SEQ ID NO: 1458512 - RNA, 19 nt, Homo sapiens
acaauaagcuguuucuaug

SEQ ID NO: 1458513 - RNA, 19 nt, Homo sapiens
uaagagauuugguauguga

SEQ ID NO: 1458514 - RNA, 19 nt, Homo sapiens
caacaugguucuucugaau

SEQ ID NO: 1458515 - RNA, 19 nt, Homo sapiens
ggacaaauccauagacaau

SEQ ID NO: 1458516 - RNA, 19 nt, Homo sapiens
uagguugucucuuggauua

SEQ ID NO: 1458517 - RNA, 19 nt, Homo sapiens
gaacuuggaugagacaauc

SEQ ID NO: 1458518 - RNA, 19 nt, Homo sapiens
gaugaccgcuuaagaaagu

SEQ ID NO: 1458519 - RNA, 19 nt, Homo sapiens
ugccacagauucaacauua

SEQ ID NO: 1458520 - RNA, 19 nt, Homo sapiens
ccgaggacaugcucuauaa

SEQ ID NO: 1458521 - RNA, 19 nt, Homo sapiens
cauaagacaugcucauugu

SEQ ID NO: 1458522 - RNA, 19 nt, Homo sapiens
ucucuuggauuaagucaua

SEQ ID NO: 1458523 - RNA, 19 nt, Homo sapiens
gaauaacugcgcugaauug

SEQ ID NO: 1458524 - RNA, 19 nt, Homo sapiens
gagcaacuuucaccaaugu

SEQ ID NO: 1458525 - RNA, 19 nt, Homo sapiens
guucagaaauaccacaauu

SEQ ID NO: 1458526 - RNA, 19 nt, Homo sapiens
caauauugccguuacauuu

SEQ ID NO: 1458527 - RNA, 19 nt, Homo sapiens
ccaaagaaguaagcauauu

SEQ ID NO: 1458528 - RNA, 19 nt, Homo sapiens
gacaauaagcuguuucuau

SEQ ID NO: 1458529 - RNA, 19 nt, Homo sapiens
aggaauagguugucucuug

SEQ ID NO: 1458530 - RNA, 19 nt, Homo sapiens
uaagacaugcucauuguaa

SEQ ID NO: 1458531 - RNA, 19 nt, Homo sapiens
ccuaagagauuugguaugu

SEQ ID NO: 1458532 - RNA, 19 nt, Homo sapiens
ugagaugaauggccgcaua

SEQ ID NO: 1458533 - RNA, 19 nt, Homo sapiens
gaauaugggccaacugaga

SEQ ID NO: 1458534 - RNA, 19 nt, Homo sapiens
gcaguacuccacagaauga

SEQ ID NO: 1458535 - RNA, 19 nt, Homo sapiens
uaagaaugcucaguuuguu

SEQ ID NO: 1458536 - RNA, 19 nt, Homo sapiens
gcgcaggugcugagaauaa

SEQ ID NO: 1458537 - RNA, 19 nt, Homo sapiens
gugccuaucuauauuaaga

SEQ ID NO: 1458538 - RNA, 19 nt, Homo sapiens
caaagaaguaagcauauug

SEQ ID NO: 1458539 - RNA, 19 nt, Homo sapiens
guuggugccuccuuaguuu

SEQ ID NO: 1458540 - RNA, 19 nt, Homo sapiens
caacugagaguguuaaagu

SEQ ID NO: 1458541 - RNA, 19 nt, Homo sapiens
gcccauagcuuagagaaag

SEQ ID NO: 1458542 - RNA, 19 nt, Homo sapiens
aaguaggaauugcaucuua

SEQ ID NO: 1458543 - RNA, 19 nt, Homo sapiens
gcccaaagaaguaagcaua

SEQ ID NO: 1458544 - RNA, 19 nt, Homo sapiens
ccagaugaccgcuuaagaa

SEQ ID NO: 1458545 - RNA, 19 nt, Homo sapiens
ucagccagaugaccgcuua

SEQ ID NO: 1458546 - RNA, 19 nt, Homo sapiens
ccaaagcaguggaugagau

SEQ ID NO: 1458547 - RNA, 19 nt, Homo sapiens
ccaaagugaugauggaagu

SEQ ID NO: 1458548 - RNA, 19 nt, Homo sapiens
gugcuagacuugcauggaa

SEQ ID NO: 1458549 - RNA, 19 nt, Homo sapiens
ugaaggaacuuuucuguga

SEQ ID NO: 1458550 - RNA, 19 nt, Homo sapiens
ggaacauucuguccugcaa

SEQ ID NO: 1458551 - RNA, 19 nt, Homo sapiens
ucaguuuguuucagccuua

SEQ ID NO: 1458552 - RNA, 19 nt, Homo sapiens
acaaauccauagacaauag

SEQ ID NO: 1458553 - RNA, 19 nt, Homo sapiens
ggcaguggcuauuuaaagu

SEQ ID NO: 1458554 - RNA, 19 nt, Homo sapiens
gaggacaugcucuauaaga

SEQ ID NO: 1458555 - RNA, 19 nt, Homo sapiens
ugaagaggcuaccaaagca

SEQ ID NO: 1458556 - RNA, 19 nt, Homo sapiens
aaacauuggagacgacaua

SEQ ID NO: 1458557 - RNA, 19 nt, Homo sapiens
gcaacuuucaccaauguuu

SEQ ID NO: 1458558 - RNA, 19 nt, Homo sapiens
gcaaagucguaugcgauga

SEQ ID NO: 1458559 - RNA, 19 nt, Homo sapiens
uauguuaacuuccgcuuuc

SEQ ID NO: 1458560 - RNA, 19 nt, Homo sapiens
gaaguaaaauuuccacagu

SEQ ID NO: 1458561 - RNA, 19 nt, Homo sapiens
gcagaaggaaguaaaauuu

SEQ ID NO: 1458562 - RNA, 19 nt, Homo sapiens
ucauaugccuccagccauu

SEQ ID NO: 1458563 - RNA, 19 nt, Homo sapiens
ucacagguguuucaaaggu

SEQ ID NO: 1458564 - RNA, 19 nt, Homo sapiens
gugaacaugcuacagauuu

SEQ ID NO: 1458565 - RNA, 19 nt, Homo sapiens
cagaugaccgcuuaagaaa

SEQ ID NO: 1458566 - RNA, 19 nt, Homo sapiens
gcaguggcuauuuaaagua

SEQ ID NO: 1458567 - RNA, 19 nt, Homo sapiens
uuuaggcaguggcuauuua

SEQ ID NO: 1458568 - RNA, 19 nt, Homo sapiens
cgacagugauucugagucu

SEQ ID NO: 1458569 - RNA, 19 nt, Homo sapiens
ggaguggucguauuaacuu

SEQ ID NO: 1458570 - RNA, 19 nt, Homo sapiens
gaacaugcuacagauuuga

SEQ ID NO: 1458571 - RNA, 19 nt, Homo sapiens
ugaacaugcuacagauuug

SEQ ID NO: 1458572 - RNA, 19 nt, Homo sapiens
gcuuuggauuugugagaua

SEQ ID NO: 1458573 - RNA, 19 nt, Homo sapiens
gacaugcucuauaagaagu

SEQ ID NO: 1458574 - RNA, 19 nt, Homo sapiens
guugggaguggucguauua

SEQ ID NO: 1458575 - RNA, 19 nt, Homo sapiens
caacggcucuaaggguuau

SEQ ID NO: 1458576 - RNA, 19 nt, Homo sapiens
gauuugguaugugaggaua

SEQ ID NO: 1458577 - RNA, 19 nt, Homo sapiens
ucaauuagucacugagaaa

SEQ ID NO: 1458578 - RNA, 19 nt, Homo sapiens
gaaaacauaugugaugcaa

SEQ ID NO: 1458579 - RNA, 19 nt, Homo sapiens
gaguugaggcggagauuug

SEQ ID NO: 1458580 - RNA, 19 nt, Homo sapiens
uagagcaacuuucaccaau

SEQ ID NO: 1458581 - RNA, 19 nt, Homo sapiens
ugagaacugugaaaccaau

SEQ ID NO: 1458582 - RNA, 19 nt, Homo sapiens
gaacaccuucuauuaaacu

SEQ ID NO: 1458583 - RNA, 19 nt, Homo sapiens
gggccaaagugaugaugga

SEQ ID NO: 1458584 - RNA, 19 nt, Homo sapiens
gggugccuaucuauauuaa

SEQ ID NO: 1458585 - RNA, 19 nt, Homo sapiens
ggacaugcucuauaagaag

SEQ ID NO: 1458586 - RNA, 19 nt, Homo sapiens
ucacuuaugccacagauuc

SEQ ID NO: 1458587 - RNA, 19 nt, Homo sapiens
gaacugugaaaccaauaug

SEQ ID NO: 1458588 - RNA, 19 nt, Homo sapiens
gauaauauucacagguguu

SEQ ID NO: 1458589 - RNA, 19 nt, Homo sapiens
ccacuccuaccauucauuu

SEQ ID NO: 1458590 - RNA, 19 nt, Homo sapiens
agaauaagaaugcucaguu

SEQ ID NO: 1458591 - RNA, 19 nt, Homo sapiens
gaacauucuguccugcaaa

SEQ ID NO: 1458592 - RNA, 19 nt, Homo sapiens
gaaagucuggagugggaaa

SEQ ID NO: 1458593 - RNA, 19 nt, Homo sapiens
cacacuauauguacuguuc

SEQ ID NO: 1458594 - RNA, 19 nt, Homo sapiens
uuacagguuuauccauuug

SEQ ID NO: 1458595 - RNA, 19 nt, Homo sapiens
ccacagauucaacauuaga

SEQ ID NO: 1458596 - RNA, 19 nt, Homo sapiens
gccauuauaugagaacugu

SEQ ID NO: 1458597 - RNA, 19 nt, Homo sapiens
aguaggaauugcaucuuaa

SEQ ID NO: 1458598 - RNA, 19 nt, Homo sapiens
cuuaguuggugccuccuua

SEQ ID NO: 1458599 - RNA, 19 nt, Homo sapiens
gaacuuuucugugaauaug

SEQ ID NO: 1458600 - RNA, 19 nt, Homo sapiens
gaaggaacuuuucugugaa

SEQ ID NO: 1458601 - RNA, 19 nt, Homo sapiens
gaggucagaaccagggaua

SEQ ID NO: 1458602 - RNA, 19 nt, Homo sapiens
uaaggguuaugccuauguu

SEQ ID NO: 1458603 - RNA, 19 nt, Homo sapiens
gacaaauccauagacaaua

SEQ ID NO: 1458604 - RNA, 19 nt, Homo sapiens
cuacguauacacaaacauu

SEQ ID NO: 1458605 - RNA, 19 nt, Homo sapiens
guaggaauugcaucuuaaa

SEQ ID NO: 1458606 - RNA, 19 nt, Homo sapiens
gaacaguacuucacuuaaa

SEQ ID NO: 1458607 - RNA, 19 nt, Homo sapiens
caagaaccauugcaaauaa

SEQ ID NO: 1458608 - RNA, 19 nt, Homo sapiens
gaagaugcuuuacuaugua

SEQ ID NO: 1458609 - RNA, 19 nt, Homo sapiens
ggaagaugcuuuacuaugu

SEQ ID NO: 1458610 - RNA, 19 nt, Homo sapiens
ggaaagaguugcccuuguu

SEQ ID NO: 1458611 - RNA, 19 nt, Homo sapiens
gauaggaucuaacagcuuu

SEQ ID NO: 1458612 - RNA, 19 nt, Homo sapiens
gaacgguugucauguguaa

SEQ ID NO: 1458613 - RNA, 19 nt, Homo sapiens
caacagcugucuuauuuau

SEQ ID NO: 1458614 - RNA, 19 nt, Homo sapiens
gaaauuaggagaacgguuu

SEQ ID NO: 1458615 - RNA, 19 nt, Homo sapiens
guacuucacuuaaagagaa

SEQ ID NO: 1458616 - RNA, 19 nt, Homo sapiens
guaaacagcuuauucugau

SEQ ID NO: 1458617 - RNA, 19 nt, Homo sapiens
gcaaagaaguagaugacaa

SEQ ID NO: 1458618 - RNA, 19 nt, Homo sapiens
gaaucuagauggauauuuc

SEQ ID NO: 1458619 - RNA, 19 nt, Homo sapiens
ggaaagaaaucuaguugag

SEQ ID NO: 1458620 - RNA, 19 nt, Homo sapiens
gugcagaaauuguacuuaa

SEQ ID NO: 1458621 - RNA, 19 nt, Homo sapiens
gcagaaauaagaaggauaa

SEQ ID NO: 1458622 - RNA, 19 nt, Homo sapiens
gaacaccacccaggaguua

SEQ ID NO: 1458623 - RNA, 19 nt, Homo sapiens
cauaauagaucacguucaa

SEQ ID NO: 1458624 - RNA, 19 nt, Homo sapiens
cuucauguguucagaauua

SEQ ID NO: 1458625 - RNA, 19 nt, Homo sapiens
gagaaaagaucaaggaaaa

SEQ ID NO: 1458626 - RNA, 19 nt, Homo sapiens
aggaguagaucccauaaua

SEQ ID NO: 1458627 - RNA, 19 nt, Homo sapiens
gaaaucuaguugagcauga

SEQ ID NO: 1458628 - RNA, 19 nt, Homo sapiens
gaaaaccucucuaccaaaa

SEQ ID NO: 1458629 - RNA, 19 nt, Homo sapiens
ggaauugucagcugaauga

SEQ ID NO: 1458630 - RNA, 19 nt, Homo sapiens
gaaccagauucaaguguga

SEQ ID NO: 1458631 - RNA, 19 nt, Homo sapiens
cugaauagcauguuaguua

SEQ ID NO: 1458632 - RNA, 19 nt, Homo sapiens
ggaaucaaauccaaagcuu

SEQ ID NO: 1458633 - RNA, 19 nt, Homo sapiens
gaucuaagagcccacauaa

SEQ ID NO: 1458634 - RNA, 19 nt, Homo sapiens
ggaaagagcaaugaaagaa

SEQ ID NO: 1458635 - RNA, 19 nt, Homo sapiens
uaagugauaugucagaaga

SEQ ID NO: 1458636 - RNA, 19 nt, Homo sapiens
agaaagagcacaauaaaga

SEQ ID NO: 1458637 - RNA, 19 nt, Homo sapiens
ccacaucagugaaagaaga

SEQ ID NO: 1458638 - RNA, 19 nt, Homo sapiens
ugagaaggaucgagacaaa

SEQ ID NO: 1458639 - RNA, 19 nt, Homo sapiens
gaacauuaaguuuccagua

SEQ ID NO: 1458640 - RNA, 19 nt, Homo sapiens
aaagacagauccaaagaga

SEQ ID NO: 1458641 - RNA, 19 nt, Homo sapiens
gaaagagcaaugaaagaaa

SEQ ID NO: 1458642 - RNA, 19 nt, Homo sapiens
gaaagagcacaauaaagaa

SEQ ID NO: 1458643 - RNA, 19 nt, Homo sapiens
agacagauccaaagagaua

SEQ ID NO: 1458644 - RNA, 19 nt, Homo sapiens
ggaguuagaagaaguaaug

SEQ ID NO: 1458645 - RNA, 19 nt, Homo sapiens
ggaaagagugaaagagaaa

SEQ ID NO: 1458646 - RNA, 19 nt, Homo sapiens
gaagaaaacccuuuaguug

SEQ ID NO: 1458647 - RNA, 19 nt, Homo sapiens
ccaagaaccauugcaaaua

SEQ ID NO: 1458648 - RNA, 19 nt, Homo sapiens
uaugggagguuauugguuu

SEQ ID NO: 1458649 - RNA, 19 nt, Homo sapiens
ggaaggagaaguuggagaa

SEQ ID NO: 1458650 - RNA, 19 nt, Homo sapiens
uaaacaaguuggagaagug

SEQ ID NO: 1458651 - RNA, 19 nt, Homo sapiens
uauggaaucuagauggaua

SEQ ID NO: 1458652 - RNA, 19 nt, Homo sapiens
gauguaaacaggaaagaaa

SEQ ID NO: 1458653 - RNA, 19 nt, Homo sapiens
gaaguaauuguuugccuaa

SEQ ID NO: 1458654 - RNA, 19 nt, Homo sapiens
gaagcucagucauuuaucu

SEQ ID NO: 1458655 - RNA, 19 nt, Homo sapiens
gauuagaauucagcaauga

SEQ ID NO: 1458656 - RNA, 19 nt, Homo sapiens
aucaacagcugucuuauuu

SEQ ID NO: 1458657 - RNA, 19 nt, Homo sapiens
gagaagcucagucauuuau

SEQ ID NO: 1458658 - RNA, 19 nt, Homo sapiens
auaaaucacuccaacaaug

SEQ ID NO: 1458659 - RNA, 19 nt, Homo sapiens
acagcugucuuauuuauga

SEQ ID NO: 1458660 - RNA, 19 nt, Homo sapiens
aaugaagccugauuugauu

SEQ ID NO: 1458661 - RNA, 19 nt, Homo sapiens
ccaaagagauagaugaaaa

SEQ ID NO: 1458662 - RNA, 19 nt, Homo sapiens
gaguagaucccauaauaga

SEQ ID NO: 1458663 - RNA, 19 nt, Homo sapiens
gcaugcuacuguucucuuu

SEQ ID NO: 1458664 - RNA, 19 nt, Homo sapiens
agaaguagaugacaaggau

SEQ ID NO: 1458665 - RNA, 19 nt, Homo sapiens
gaaagaguucuaaugauag

SEQ ID NO: 1458666 - RNA, 19 nt, Homo sapiens
acgagaagcucagucauuu

SEQ ID NO: 1458667 - RNA, 19 nt, Homo sapiens
gguaaacagcuuauucuga

SEQ ID NO: 1458668 - RNA, 19 nt, Homo sapiens
aaagcugaauagcauguua

SEQ ID NO: 1458669 - RNA, 19 nt, Homo sapiens
ucgcgaagaucucguaguu

SEQ ID NO: 1458670 - RNA, 19 nt, Homo sapiens
guacuuauuucagaugaug

SEQ ID NO: 1458671 - RNA, 19 nt, Homo sapiens
aacgacagcugaucaacua

SEQ ID NO: 1458672 - RNA, 19 nt, Homo sapiens
gagaacgguuuauguugga

SEQ ID NO: 1458673 - RNA, 19 nt, Homo sapiens
gauaucguuugguucauga

SEQ ID NO: 1458674 - RNA, 19 nt, Homo sapiens
gacaaugcaugcuacuguu

SEQ ID NO: 1458675 - RNA, 19 nt, Homo sapiens
gaacaucaaagauccaagu

SEQ ID NO: 1458676 - RNA, 19 nt, Homo sapiens
cauguuaguuacuugguuu

SEQ ID NO: 1458677 - RNA, 19 nt, Homo sapiens
ggucauccaucauucuuag

SEQ ID NO: 1458678 - RNA, 19 nt, Homo sapiens
acucaaugcuggaaucaaa

SEQ ID NO: 1458679 - RNA, 19 nt, Homo sapiens
gaaaguugcaguccuuauc

SEQ ID NO: 1458680 - RNA, 19 nt, Homo sapiens
gaaaguugcaguccuuauc

SEQ ID NO: 1458681 - RNA, 19 nt, Homo sapiens
ggaguuauguuuggagaca

SEQ ID NO: 1458682 - RNA, 19 nt, Homo sapiens
cauaaaugaugugcagaaa

SEQ ID NO: 1458683 - RNA, 19 nt, Homo sapiens
gagaaguguguaagugaua

SEQ ID NO: 1458684 - RNA, 19 nt, Homo sapiens
gauccaaguuuguacuauc

SEQ ID NO: 1458685 - RNA, 19 nt, Homo sapiens
ucaguugccuuaccucaug

SEQ ID NO: 1458686 - RNA, 19 nt, Homo sapiens
cagaaaguaugcaaauagu

SEQ ID NO: 1458687 - RNA, 19 nt, Homo sapiens
gauggauauuucaugcaua

SEQ ID NO: 1458688 - RNA, 19 nt, Homo sapiens
acaaugugguauacuguuu

SEQ ID NO: 1458689 - RNA, 19 nt, Homo sapiens
guuguuagaugacuuugug

SEQ ID NO: 1458690 - RNA, 19 nt, Homo sapiens
caauaaagaaccagauuca

SEQ ID NO: 1458691 - RNA, 19 nt, Homo sapiens
uaacacaacuuucgaucac

SEQ ID NO: 1458692 - RNA, 19 nt, Homo sapiens
gacauuuccaagcuuauua

SEQ ID NO: 1458693 - RNA, 19 nt, Homo sapiens
gagcagaaauaagaaggau

SEQ ID NO: 1458694 - RNA, 19 nt, Homo sapiens
uuuggaagaugcuuuacua

SEQ ID NO: 1458695 - RNA, 19 nt, Homo sapiens
guaaugaagccugauuuga

SEQ ID NO: 1458696 - RNA, 19 nt, Homo sapiens
gaaagaguugcccuuguug

SEQ ID NO: 1458697 - RNA, 19 nt, Homo sapiens
agagaaagagcacaauaaa

SEQ ID NO: 1458698 - RNA, 19 nt, Homo sapiens
aaagagaaagagcacaaua

SEQ ID NO: 1458699 - RNA, 19 nt, Homo sapiens
aaagacagacguagaucua

SEQ ID NO: 1458700 - RNA, 19 nt, Homo sapiens
uaauagaucacguucaaga

SEQ ID NO: 1458701 - RNA, 19 nt, Homo sapiens
caaugaauaugccaaaucg

SEQ ID NO: 1458702 - RNA, 19 nt, Homo sapiens
ggaaagauugugaaagagu

SEQ ID NO: 1458703 - RNA, 19 nt, Homo sapiens
auggaaagauugugaaaga

SEQ ID NO: 1458704 - RNA, 19 nt, Homo sapiens
gcaaucuaauacaaucaga

SEQ ID NO: 1458705 - RNA, 19 nt, Homo sapiens
uacauuggauggccuuauu

SEQ ID NO: 1458706 - RNA, 19 nt, Homo sapiens
gcaccaggguccacaguga

SEQ ID NO: 1458707 - RNA, 19 nt, Homo sapiens
ggaaggccaucacagagaa

SEQ ID NO: 1458708 - RNA, 19 nt, Homo sapiens
ugaaggagauccacgagaa

SEQ ID NO: 1458709 - RNA, 19 nt, Homo sapiens
gaagagaacgagaccuuga

SEQ ID NO: 1458710 - RNA, 19 nt, Homo sapiens
gcacagaacccugggagaa

SEQ ID NO: 1458711 - RNA, 19 nt, Homo sapiens
gaccggcucugccuccuaa

SEQ ID NO: 1458712 - RNA, 19 nt, Homo sapiens
agaagacacugaaggagaa

SEQ ID NO: 1458713 - RNA, 19 nt, Homo sapiens
ugaacgggcugaaggaaga

SEQ ID NO: 1458714 - RNA, 19 nt, Homo sapiens
gaacagcagaagacacuga

SEQ ID NO: 1458715 - RNA, 19 nt, Homo sapiens
gaacaagcuucuggaacug

SEQ ID NO: 1458716 - RNA, 19 nt, Homo sapiens
gagaguaaacacuugaaga

SEQ ID NO: 1458717 - RNA, 19 nt, Homo sapiens
ugaacaggcugaaggagau

SEQ ID NO: 1458718 - RNA, 19 nt, Homo sapiens
uacagaagaugaagacaca

SEQ ID NO: 1458719 - RNA, 19 nt, Homo sapiens
agaguaaacacuugaagaa

SEQ ID NO: 1458720 - RNA, 19 nt, Homo sapiens
ggacugugcccuagacaag

SEQ ID NO: 1458721 - RNA, 19 nt, Homo sapiens
ggaagcggcagcaggaguu

SEQ ID NO: 1458722 - RNA, 19 nt, Homo sapiens
gacggagaguaaacacuug

SEQ ID NO: 1458723 - RNA, 19 nt, Homo sapiens
gcuggaaggccaucacaga

SEQ ID NO: 1458724 - RNA, 19 nt, Homo sapiens
gcagaggucgacagagguu

SEQ ID NO: 1458725 - RNA, 19 nt, Homo sapiens
acagaacccugggagaaga

SEQ ID NO: 1458726 - RNA, 19 nt, Homo sapiens
ugacggagaguaaacacuu

SEQ ID NO: 1458727 - RNA, 19 nt, Homo sapiens
gcaggacugugcccuagac

SEQ ID NO: 1458728 - RNA, 19 nt, Homo sapiens
gggaggagcccacagaacu

SEQ ID NO: 1458729 - RNA, 19 nt, Homo sapiens
gaaccugcagcgcaucuuc

SEQ ID NO: 1458730 - RNA, 19 nt, Homo sapiens
ggagauccacgagaaggaa

SEQ ID NO: 1458731 - RNA, 19 nt, Homo sapiens
gcacauccuggcccacuuc

SEQ ID NO: 1458732 - RNA, 19 nt, Homo sapiens
ggagagggcacaccaucca

SEQ ID NO: 1458733 - RNA, 19 nt, Homo sapiens
gggaacagcagaagacacu

SEQ ID NO: 1458734 - RNA, 19 nt, Homo sapiens
gaagugcugagaccagagu

SEQ ID NO: 1458735 - RNA, 19 nt, Homo sapiens
gaaggagauccacgagaag

SEQ ID NO: 1458736 - RNA, 19 nt, Homo sapiens
ccacgaggaggcugaggaa

SEQ ID NO: 1458737 - RNA, 19 nt, Homo sapiens
gcaguacagaagaugaaga

SEQ ID NO: 1458738 - RNA, 19 nt, Homo sapiens
ggaggagcccacagaacug

SEQ ID NO: 1458739 - RNA, 19 nt, Homo sapiens
ggaccugaaggccagagaa

SEQ ID NO: 1458740 - RNA, 19 nt, Homo sapiens
acaagcuucuggaacugaa

SEQ ID NO: 1458741 - RNA, 19 nt, Homo sapiens
gagaccagaguccgacgaa

SEQ ID NO: 1458742 - RNA, 19 nt, Homo sapiens
cagcugcacgggaccauug

SEQ ID NO: 1458743 - RNA, 19 nt, Homo sapiens
cgaggaggcugaggaagac

SEQ ID NO: 1458744 - RNA, 19 nt, Homo sapiens
ccugagugacggagaguaa

SEQ ID NO: 1458745 - RNA, 19 nt, Homo sapiens
cugagggcccugagaauga

SEQ ID NO: 1458746 - RNA, 19 nt, Homo sapiens
gaugaacgggcugaaggaa

SEQ ID NO: 1458747 - RNA, 19 nt, Homo sapiens
gaacuggaugagacagaca

SEQ ID NO: 1458748 - RNA, 19 nt, Homo sapiens
gaccagaguccgacgaacu

SEQ ID NO: 1458749 - RNA, 19 nt, Homo sapiens
gcaucuucauccucaccaa

SEQ ID NO: 1458750 - RNA, 19 nt, Homo sapiens
ggagaguaaacacuugaag

SEQ ID NO: 1458751 - RNA, 19 nt, Homo sapiens
gaggaucgaggagcucuuc

SEQ ID NO: 1458752 - RNA, 19 nt, Homo sapiens
cauccuggcccacuucaag

SEQ ID NO: 1458753 - RNA, 19 nt, Homo sapiens
ggucucaggcuggcgauuc

SEQ ID NO: 1458754 - RNA, 19 nt, Homo sapiens
gagagggcacaccauccaa

SEQ ID NO: 1458755 - RNA, 19 nt, Homo sapiens
acgaggaggcugaggaaga

SEQ ID NO: 1458756 - RNA, 19 nt, Homo sapiens
uggaaggccaucacagaga

SEQ ID NO: 1458757 - RNA, 19 nt, Homo sapiens
ggagacauaugguaacuua

SEQ ID NO: 1458758 - RNA, 19 nt, Homo sapiens
gaagauaugugccagaagu

SEQ ID NO: 1458759 - RNA, 19 nt, Homo sapiens
gcacagggguccuuauuua

SEQ ID NO: 1458760 - RNA, 19 nt, Homo sapiens
gcucuugccuuguuacuga

SEQ ID NO: 1458761 - RNA, 19 nt, Homo sapiens
cagaacagcuggaauaucu

SEQ ID NO: 1458762 - RNA, 19 nt, Homo sapiens
ggaaagauuuaaggaauuc

SEQ ID NO: 1458763 - RNA, 19 nt, Homo sapiens
gaacagcuggaauaucuuu

SEQ ID NO: 1458764 - RNA, 19 nt, Homo sapiens
caaagcaccucgguacaaa

SEQ ID NO: 1458765 - RNA, 19 nt, Homo sapiens
ugaauacucuccuauggaa

SEQ ID NO: 1458766 - RNA, 19 nt, Homo sapiens
gaggacuucuuugcuaaua

SEQ ID NO: 1458767 - RNA, 19 nt, Homo sapiens
caaaucauauccucugcaa

SEQ ID NO: 1458768 - RNA, 19 nt, Homo sapiens
ucagaaggaugcucaguau

SEQ ID NO: 1458769 - RNA, 19 nt, Homo sapiens
gcaaagccgagucacauuu

SEQ ID NO: 1458770 - RNA, 19 nt, Homo sapiens
aauaaaggaugguggauug

SEQ ID NO: 1458771 - RNA, 19 nt, Homo sapiens
gggaggacuucuuugcuaa

SEQ ID NO: 1458772 - RNA, 19 nt, Homo sapiens
uccgagaacucuuggcuua

SEQ ID NO: 1458773 - RNA, 19 nt, Homo sapiens
ugacaaugaugacgagaug

SEQ ID NO: 1458774 - RNA, 19 nt, Homo sapiens
ggacuucuuugcuaauaag

SEQ ID NO: 1458775 - RNA, 19 nt, Homo sapiens
ggauaaggaaggaaauauu

SEQ ID NO: 1458776 - RNA, 19 nt, Homo sapiens
gcagaagggcaacagcuuu

SEQ ID NO: 1458777 - RNA, 19 nt, Homo sapiens
cgccauggauaucaucaua

SEQ ID NO: 1458778 - RNA, 19 nt, Homo sapiens
ggacaagcuucagcaggaa

SEQ ID NO: 1458779 - RNA, 19 nt, Homo sapiens
gcacaaggguagcuguuuu

SEQ ID NO: 1458780 - RNA, 19 nt, Homo sapiens
agaaggaacugggacugua

SEQ ID NO: 1458781 - RNA, 19 nt, Homo sapiens
gaaacuuccacaucucaaa

SEQ ID NO: 1458782 - RNA, 19 nt, Homo sapiens
ggaaauggacguucugcau

SEQ ID NO: 1458783 - RNA, 19 nt, Homo sapiens
ccgggaauaucaaaucauu

SEQ ID NO: 1458784 - RNA, 19 nt, Homo sapiens
ccauggauaucaucauaau

SEQ ID NO: 1458785 - RNA, 19 nt, Homo sapiens
aaacggaguuccugguugu

SEQ ID NO: 1458786 - RNA, 19 nt, Homo sapiens
ccauucagaucaugcagaa

SEQ ID NO: 1458787 - RNA, 19 nt, Homo sapiens
ccuggcagcuccugaagaa

SEQ ID NO: 1458788 - RNA, 19 nt, Homo sapiens
aaucauauccucugcaaga

SEQ ID NO: 1458789 - RNA, 19 nt, Homo sapiens
cgggaggacuucuuugcua

SEQ ID NO: 1458790 - RNA, 19 nt, Homo sapiens
ggaaccaugaggagacaua

SEQ ID NO: 1458791 - RNA, 19 nt, Homo sapiens
gacuuuagcuccuugaaac

SEQ ID NO: 1458792 - RNA, 19 nt, Homo sapiens
guggagcucuugccuuguu

SEQ ID NO: 1458793 - RNA, 19 nt, Homo sapiens
caaaggccauucagaucau

SEQ ID NO: 1458794 - RNA, 19 nt, Homo sapiens
gaagagagagaucuacaac

SEQ ID NO: 1458795 - RNA, 19 nt, Homo sapiens
agacccaccugagugaaua

SEQ ID NO: 1458796 - RNA, 19 nt, Homo sapiens
ccugggaaaugaguugaua

SEQ ID NO: 1458797 - RNA, 19 nt, Homo sapiens
ccaaaggccauucagauca

SEQ ID NO: 1458798 - RNA, 19 nt, Homo sapiens
ggaauuccagaucaaauca

SEQ ID NO: 1458799 - RNA, 19 nt, Homo sapiens
uuaggaagauggagcuguu

SEQ ID NO: 1458800 - RNA, 19 nt, Homo sapiens
ggcaacagcuuuuauuuca

SEQ ID NO: 1458801 - RNA, 19 nt, Homo sapiens
ccaagaagagagagaucua

SEQ ID NO: 1458802 - RNA, 19 nt, Homo sapiens
gagaacagaggaugagauc

SEQ ID NO: 1458803 - RNA, 19 nt, Homo sapiens
agaaguuccuccagcagaa

SEQ ID NO: 1458804 - RNA, 19 nt, Homo sapiens
uguuaaagcucaauauugc

SEQ ID NO: 1458805 - RNA, 19 nt, Homo sapiens
aaugugccaugaucaauau

SEQ ID NO: 1458806 - RNA, 19 nt, Homo sapiens
cauauccucugcaagacuu

SEQ ID NO: 1458807 - RNA, 19 nt, Homo sapiens
gguccaccaucgucuguau

SEQ ID NO: 1458808 - RNA, 19 nt, Homo sapiens
ggaguggaguggagcucuu

SEQ ID NO: 1458809 - RNA, 19 nt, Homo sapiens
cgagaacucuuggcuuagu

SEQ ID NO: 1458810 - RNA, 19 nt, Homo sapiens
gcaucaacaagacgacuaa

SEQ ID NO: 1458811 - RNA, 19 nt, Homo sapiens
ugaugagccugggaaauga

SEQ ID NO: 1458812 - RNA, 19 nt, Homo sapiens
aaaugugccaugaucaaua

SEQ ID NO: 1458813 - RNA, 19 nt, Homo sapiens
uuaaggaauuccagaucaa

SEQ ID NO: 1458814 - RNA, 19 nt, Homo sapiens
gagucacccuucaucaugu

SEQ ID NO: 1458815 - RNA, 19 nt, Homo sapiens
ggaauaucuuucggaagga

SEQ ID NO: 1458816 - RNA, 19 nt, Homo sapiens
uggcgaagauagagagguu

SEQ ID NO: 1458817 - RNA, 19 nt, Homo sapiens
gagaacucuuggcuuagug

SEQ ID NO: 1458818 - RNA, 19 nt, Homo sapiens
aagccucguuauccuauuu

SEQ ID NO: 1458819 - RNA, 19 nt, Homo sapiens
gaguugauacggauaagga

SEQ ID NO: 1458820 - RNA, 19 nt, Homo sapiens
gaacucuuggcuuagugua

SEQ ID NO: 1458821 - RNA, 19 nt, Homo sapiens
ucaaaugugccaugaucaa

SEQ ID NO: 1458822 - RNA, 19 nt, Homo sapiens
gaggagacauaugguaacu

SEQ ID NO: 1458823 - RNA, 19 nt, Homo sapiens
ugaagacccaccugaguga

SEQ ID NO: 1458824 - RNA, 19 nt, Homo sapiens
ggccgucuguaacaucuug

SEQ ID NO: 1458825 - RNA, 19 nt, Homo sapiens
uuuaaggaauuccagauca

SEQ ID NO: 1458826 - RNA, 19 nt, Homo sapiens
ggagagucacccuucauca

SEQ ID NO: 1458827 - RNA, 19 nt, Homo sapiens
cagcagugccuuccuagau

SEQ ID NO: 1458828 - RNA, 19 nt, Homo sapiens
ucaaagcaccucgguacaa

SEQ ID NO: 1458829 - RNA, 19 nt, Homo sapiens
agucugugguccuggauuu

SEQ ID NO: 1458830 - RNA, 19 nt, Homo sapiens
gagagucacccuucaucau

SEQ ID NO: 1458831 - RNA, 19 nt, Homo sapiens
cggaguuccugguuguuga

SEQ ID NO: 1458832 - RNA, 19 nt, Homo sapiens
gcacaguugcaauaaccaa

SEQ ID NO: 1458833 - RNA, 19 nt, Homo sapiens
caacagcuuuuauuucauc

SEQ ID NO: 1458834 - RNA, 19 nt, Homo sapiens
ccaggaaguucagaaggau

SEQ ID NO: 1458835 - RNA, 19 nt, Homo sapiens
gaucuacaacccuaagucu

SEQ ID NO: 1458836 - RNA, 19 nt, Homo sapiens
caaugaugacgagaugaua

SEQ ID NO: 1458837 - RNA, 19 nt, Homo sapiens
uaaggaauuccagaucaaa

SEQ ID NO: 1458838 - RNA, 19 nt, Homo sapiens
augggcagcugaucucaaa

SEQ ID NO: 1458839 - RNA, 19 nt, Homo sapiens
gaugcucaguaucgguuug

SEQ ID NO: 1458840 - RNA, 19 nt, Homo sapiens
ggagaacagaggaugagau

SEQ ID NO: 1458841 - RNA, 19 nt, Homo sapiens
aaagccgagucacauuuga

SEQ ID NO: 1458842 - RNA, 19 nt, Homo sapiens
aaagcucaauauugcauuc

SEQ ID NO: 1458843 - RNA, 19 nt, Homo sapiens
gaaggaacugggacuguac

SEQ ID NO: 1458844 - RNA, 19 nt, Homo sapiens
ccuugaaacuuccacaucu

SEQ ID NO: 1458845 - RNA, 19 nt, Homo sapiens
caugaggagacauauggua

SEQ ID NO: 1458846 - RNA, 19 nt, Homo sapiens
gaagauggagcuguuugca

SEQ ID NO: 1458847 - RNA, 19 nt, Homo sapiens
caucgucuguauggaagaa

SEQ ID NO: 1458848 - RNA, 19 nt, Homo sapiens
gggcacaguugcaauaacc

SEQ ID NO: 1458849 - RNA, 19 nt, Homo sapiens
cgacuaagccucguuaucc

SEQ ID NO: 1458850 - RNA, 19 nt, Homo sapiens
cguggagccuugccaaagu

SEQ ID NO: 1458851 - RNA, 19 nt, Homo sapiens
caaaugugccaugaucaau

SEQ ID NO: 1458852 - RNA, 19 nt, Homo sapiens
gaaccaugaggagacauau

SEQ ID NO: 1458853 - RNA, 19 nt, Homo sapiens
ugaccgggaggacuucuuu

SEQ ID NO: 1458854 - RNA, 19 nt, Homo sapiens
gcagaggagggucacuuuc

SEQ ID NO: 1458855 - RNA, 19 nt, Homo sapiens
agucaacuguucacuccaa

SEQ ID NO: 1458856 - RNA, 19 nt, Homo sapiens
gcagaacagcuggaauauc

SEQ ID NO: 1458857 - RNA, 19 nt, Homo sapiens
gagaaaggauccuggguua

SEQ ID NO: 1458858 - RNA, 19 nt, Homo sapiens
gcaaagagggcaaucaaga

SEQ ID NO: 1458859 - RNA, 19 nt, Homo sapiens
ggaccggccugaugccuuu

SEQ ID NO: 1458860 - RNA, 19 nt, Homo sapiens
ggucacaugugcugcuuaa

SEQ ID NO: 1458861 - RNA, 19 nt, Homo sapiens
gaaaggauccuggguuaug

SEQ ID NO: 1458862 - RNA, 19 nt, Homo sapiens
caacaaaaguuucaugcua

SEQ ID NO: 1458863 - RNA, 19 nt, Homo sapiens
gaggagcccugcuaucucu

SEQ ID NO: 1458864 - RNA, 19 nt, Homo sapiens
gcuacggcgugguuuauga

SEQ ID NO: 1458865 - RNA, 19 nt, Homo sapiens
gaacuugaaaccagaaugg

SEQ ID NO: 1458866 - RNA, 19 nt, Homo sapiens
gggcaaugauagaaagaau

SEQ ID NO: 1458867 - RNA, 19 nt, Homo sapiens
gcagcuacggcgugguuua

SEQ ID NO: 1458868 - RNA, 19 nt, Homo sapiens
gcccugcuaucucugguuu

SEQ ID NO: 1458869 - RNA, 19 nt, Homo sapiens
guggagaccucgcugaaag

SEQ ID NO: 1458870 - RNA, 19 nt, Homo sapiens
ccugaugccuuugaacuug

SEQ ID NO: 1458871 - RNA, 19 nt, Homo sapiens
gcaggacuuccaugucuga

SEQ ID NO: 1458872 - RNA, 19 nt, Homo sapiens
ccagacaacauccucauca

SEQ ID NO: 1458873 - RNA, 19 nt, Homo sapiens
gugaggcgcugcuagaaaa

SEQ ID NO: 1458874 - RNA, 19 nt, Homo sapiens
acaacauccucaucacaga

SEQ ID NO: 1458875 - RNA, 19 nt, Homo sapiens
ggugaggcgcugcuagaaa

SEQ ID NO: 1458876 - RNA, 19 nt, Homo sapiens
ggguggcggucaagaagau

SEQ ID NO: 1458877 - RNA, 19 nt, Homo sapiens
ccagaacgucgugcaguuu

SEQ ID NO: 1458878 - RNA, 19 nt, Homo sapiens
ccgcagagguacacaaagc

SEQ ID NO: 1458879 - RNA, 19 nt, Homo sapiens
gggcaaucaagacaacaaa

SEQ ID NO: 1458880 - RNA, 19 nt, Homo sapiens
acgcaggacuuccaugucu

SEQ ID NO: 1458881 - RNA, 19 nt, Homo sapiens
aaacgcaggacuuccaugu

SEQ ID NO: 1458882 - RNA, 19 nt, Homo sapiens
aaagagggcaaucaagaca

SEQ ID NO: 1458883 - RNA, 19 nt, Homo sapiens
agaacgucgugcaguuuga

SEQ ID NO: 1458884 - RNA, 19 nt, Homo sapiens
agacccagccaccaacaaa

SEQ ID NO: 1458885 - RNA, 19 nt, Homo sapiens
acccaaagauggaguugca

SEQ ID NO: 1458886 - RNA, 19 nt, Homo sapiens
caaagagggcaaucaagac

SEQ ID NO: 1458887 - RNA, 19 nt, Homo sapiens
acucugagaccaagaagga

SEQ ID NO: 1458888 - RNA, 19 nt, Homo sapiens
agccaaggcggacaucuuu

SEQ ID NO: 1458889 - RNA, 19 nt, Homo sapiens
gcccgcagagguacacaaa

SEQ ID NO: 1458890 - RNA, 19 nt, Homo sapiens
ggagaccucgcugaaagga

SEQ ID NO: 1458891 - RNA, 19 nt, Homo sapiens
cagaacgucgugcaguuug

SEQ ID NO: 1458892 - RNA, 19 nt, Homo sapiens
ucacuuuuauugacucuga

SEQ ID NO: 1458893 - RNA, 19 nt, Homo sapiens
caucugggcaaugauagaa

SEQ ID NO: 1458894 - RNA, 19 nt, Homo sapiens
ugcuaucucugguuuguca

SEQ ID NO: 1458895 - RNA, 19 nt, Homo sapiens
gguggagaccucgcugaaa

SEQ ID NO: 1458896 - RNA, 19 nt, Homo sapiens
acugagaucgucccuguug

SEQ ID NO: 1458897 - RNA, 19 nt, Homo sapiens
ccugcuaucucugguuugu

SEQ ID NO: 1458898 - RNA, 19 nt, Homo sapiens
cugaugccuuugaacuuga

SEQ ID NO: 1458899 - RNA, 19 nt, Homo sapiens
cagccaaggcggacaucuu

SEQ ID NO: 1458900 - RNA, 19 nt, Homo sapiens
accagaacgucgugcaguu

SEQ ID NO: 1458901 - RNA, 19 nt, Homo sapiens
guggccgacuuuggacuaa

SEQ ID NO: 1458902 - RNA, 19 nt, Homo sapiens
gucauggaguucugugaag

SEQ ID NO: 1458903 - RNA, 19 nt, Homo sapiens
cagcuacggcgugguuuau

SEQ ID NO: 1458904 - RNA, 19 nt, Homo sapiens
gcauuaucaucugggcaau

SEQ ID NO: 1458905 - RNA, 19 nt, Homo sapiens
ugaaugugaauaaguacug

SEQ ID NO: 1458906 - RNA, 19 nt, Homo sapiens
ccauugccuuccugcacaa

SEQ ID NO: 1458907 - RNA, 19 nt, Homo sapiens
gaagaagccacauguauuu

SEQ ID NO: 1458908 - RNA, 19 nt, Homo sapiens
gaacauacagugcacauga

SEQ ID NO: 1458909 - RNA, 19 nt, Homo sapiens
gaggaagguuuauggauuu

SEQ ID NO: 1458910 - RNA, 19 nt, Homo sapiens
aagaggagaugccgaauuu

SEQ ID NO: 1458911 - RNA, 19 nt, Homo sapiens
gcaggacacugagggaaua

SEQ ID NO: 1458912 - RNA, 19 nt, Homo sapiens
guacuuaccuccuuagagu

SEQ ID NO: 1458913 - RNA, 19 nt, Homo sapiens
gcacagacauacacuaaac

SEQ ID NO: 1458914 - RNA, 19 nt, Homo sapiens
gaaaaucacugaaaucauc

SEQ ID NO: 1458915 - RNA, 19 nt, Homo sapiens
gaggagaugccgaauuuaa

SEQ ID NO: 1458916 - RNA, 19 nt, Homo sapiens
aaaccuaccauuugaguua

SEQ ID NO: 1458917 - RNA, 19 nt, Homo sapiens
aaacaacccagcccaguua

SEQ ID NO: 1458918 - RNA, 19 nt, Homo sapiens
ggagugaguuucauaggau

SEQ ID NO: 1458919 - RNA, 19 nt, Homo sapiens
ugaggaagguuuauggauu

SEQ ID NO: 1458920 - RNA, 19 nt, Homo sapiens
gagaagaagccacauguau

SEQ ID NO: 1458921 - RNA, 19 nt, Homo sapiens
ccagagaacuuugggaaug

SEQ ID NO: 1458922 - RNA, 19 nt, Homo sapiens
ggacacugagggaauauuu

SEQ ID NO: 1458923 - RNA, 19 nt, Homo sapiens
caaaggagugaguuucaua

SEQ ID NO: 1458924 - RNA, 19 nt, Homo sapiens
uuaguuacauucaggcaua

SEQ ID NO: 1458925 - RNA, 19 nt, Homo sapiens
gacauacacuaaacacgaa

SEQ ID NO: 1458926 - RNA, 19 nt, Homo sapiens
ccaccugucuuccacugua

SEQ ID NO: 1458927 - RNA, 19 nt, Homo sapiens
caccuucacuuucuccuaa

SEQ ID NO: 1458928 - RNA, 19 nt, Homo sapiens
gagcuacauuaguuacauu

SEQ ID NO: 1458929 - RNA, 19 nt, Homo sapiens
aaaaggagcuacauuaguu

SEQ ID NO: 1458930 - RNA, 19 nt, Homo sapiens
gcacccaccuucacuuucu

SEQ ID NO: 1458931 - RNA, 19 nt, Homo sapiens
caccaagucuccauagguu

SEQ ID NO: 1458932 - RNA, 19 nt, Homo sapiens
ugauuccucuuaccuuuaa

SEQ ID NO: 1458933 - RNA, 19 nt, Homo sapiens
ggagaugccgaauuuaaug

SEQ ID NO: 1458934 - RNA, 19 nt, Homo sapiens
guuguuggcucuuguguuc

SEQ ID NO: 1458935 - RNA, 19 nt, Homo sapiens
caaaggccauggguuguug

SEQ ID NO: 1458936 - RNA, 19 nt, Homo sapiens
ggagaagaagccacaugua

SEQ ID NO: 1458937 - RNA, 19 nt, Homo sapiens
gcacauggacccagucuac

SEQ ID NO: 1458938 - RNA, 19 nt, Homo sapiens
gagcuggaaugggaacuga

SEQ ID NO: 1458939 - RNA, 19 nt, Homo sapiens
gacaggaaguggaggugaa

SEQ ID NO: 1458940 - RNA, 19 nt, Homo sapiens
ucacaguacuuaccuccuu

SEQ ID NO: 1458941 - RNA, 19 nt, Homo sapiens
aaugggagaugcccuggua

SEQ ID NO: 1458942 - RNA, 19 nt, Homo sapiens
gaacucacaggcggauuaa

SEQ ID NO: 1458943 - RNA, 19 nt, Homo sapiens
ccaauaggcaggguuagua

SEQ ID NO: 1458944 - RNA, 19 nt, Homo sapiens
gagggagacuugcaaaugc

SEQ ID NO: 1458945 - RNA, 19 nt, Homo sapiens
gggcuuaccugugcucugu

SEQ ID NO: 1458946 - RNA, 19 nt, Homo sapiens
cgaauuuaaugaacccuau

SEQ ID NO: 1458947 - RNA, 19 nt, Homo sapiens
acagaaacguguagagcaa

SEQ ID NO: 1458948 - RNA, 19 nt, Homo sapiens
cagagaacuuugggaauga

SEQ ID NO: 1458949 - RNA, 19 nt, Homo sapiens
agaagaagccacauguauu

SEQ ID NO: 1458950 - RNA, 19 nt, Homo sapiens
gaaccgauucuuuccacaa

SEQ ID NO: 1458951 - RNA, 19 nt, Homo sapiens
cacaguacuuaccuccuua

SEQ ID NO: 1458952 - RNA, 19 nt, Homo sapiens
cugagaacgugaugcuuaa

SEQ ID NO: 1458953 - RNA, 19 nt, Homo sapiens
ccaacaaccuccacugcau

SEQ ID NO: 1458954 - RNA, 19 nt, Homo sapiens
ugaacucacaggcggauua

SEQ ID NO: 1458955 - RNA, 19 nt, Homo sapiens
cuccagcucugcucuguuu

SEQ ID NO: 1458956 - RNA, 19 nt, Homo sapiens
ugaggcaucacaaauuuaa

SEQ ID NO: 1458957 - RNA, 19 nt, Homo sapiens
caacccagcccaguuaaga

SEQ ID NO: 1458958 - RNA, 19 nt, Homo sapiens
cuaaauagcagagcuggaa

SEQ ID NO: 1458959 - RNA, 19 nt, Homo sapiens
acucacaccuugcccugua

SEQ ID NO: 1458960 - RNA, 19 nt, Homo sapiens
gacuguaccuggacaccaa

SEQ ID NO: 1458961 - RNA, 19 nt, Homo sapiens
ggagcuacauuaguuacau

SEQ ID NO: 1458962 - RNA, 19 nt, Homo sapiens
caacaaccuccacugcauu

SEQ ID NO: 1458963 - RNA, 19 nt, Homo sapiens
ugugauuccucuuaccuuu

SEQ ID NO: 1458964 - RNA, 19 nt, Homo sapiens
gagaugccgaauuuaauga

SEQ ID NO: 1458965 - RNA, 19 nt, Homo sapiens
gcagcaacccacauacaga

SEQ ID NO: 1458966 - RNA, 19 nt, Homo sapiens
ucaacaggguuagcuauca

SEQ ID NO: 1458967 - RNA, 19 nt, Homo sapiens
gaagguuuauggauuugac

SEQ ID NO: 1458968 - RNA, 19 nt, Homo sapiens
gguccaauaggcaggguua

SEQ ID NO: 1458969 - RNA, 19 nt, Homo sapiens
ugcaaaugcuccauaaaca

SEQ ID NO: 1458970 - RNA, 19 nt, Homo sapiens
caucugguuuguaguuuca

SEQ ID NO: 1458971 - RNA, 19 nt, Homo sapiens
gaauugcagggcugugauu

SEQ ID NO: 1458972 - RNA, 19 nt, Homo sapiens
acugagaacgugaugcuua

SEQ ID NO: 1458973 - RNA, 19 nt, Homo sapiens
ggagggagcccggaaacau

SEQ ID NO: 1458974 - RNA, 19 nt, Homo sapiens
aagcagcagugaucuguca

SEQ ID NO: 1458975 - RNA, 19 nt, Homo sapiens
uaaacaacccagcccaguu

SEQ ID NO: 1458976 - RNA, 19 nt, Homo sapiens
cacaguaccaugagguuaa

SEQ ID NO: 1458977 - RNA, 19 nt, Homo sapiens
ggaaaucuagaaaucaucu

SEQ ID NO: 1458978 - RNA, 19 nt, Homo sapiens
aaaggagcuacauuaguua

SEQ ID NO: 1458979 - RNA, 19 nt, Homo sapiens
gugccacaguuucuucuug

SEQ ID NO: 1458980 - RNA, 19 nt, Homo sapiens
ccacgugccugagugaaca

SEQ ID NO: 1458981 - RNA, 19 nt, Homo sapiens
cauagcagcagaaggaaga

SEQ ID NO: 1458982 - RNA, 19 nt, Homo sapiens
uaagaggagaugccgaauu

SEQ ID NO: 1458983 - RNA, 19 nt, Homo sapiens
ccacaguaccaugagguua

SEQ ID NO: 1458984 - RNA, 19 nt, Homo sapiens
gagcagcaacccacauaca

SEQ ID NO: 1458985 - RNA, 19 nt, Homo sapiens
gagcugaacagaggacaga

SEQ ID NO: 1458986 - RNA, 19 nt, Homo sapiens
gcuuaccugugcucuguga

SEQ ID NO: 1458987 - RNA, 19 nt, Homo sapiens
cagcaacccacauacagaa

SEQ ID NO: 1458988 - RNA, 19 nt, Homo sapiens
ggccuggucuucgcacuug

SEQ ID NO: 1458989 - RNA, 19 nt, Homo sapiens
gugauuccucuuaccuuua

SEQ ID NO: 1458990 - RNA, 19 nt, Homo sapiens
ucaaauggacggucacuac

SEQ ID NO: 1458991 - RNA, 19 nt, Homo sapiens
gcaaaugcuccauaaacag

SEQ ID NO: 1458992 - RNA, 19 nt, Homo sapiens
cgagggagacuugcaaaug

SEQ ID NO: 1458993 - RNA, 19 nt, Homo sapiens
gccacaguuucuucuugua

SEQ ID NO: 1458994 - RNA, 19 nt, Homo sapiens
ggucuucgcacuugauauc

SEQ ID NO: 1458995 - RNA, 19 nt, Homo sapiens
ccagagcacuacaauucuc

SEQ ID NO: 1458996 - RNA, 19 nt, Homo sapiens
agaaacguguagagcaaga

SEQ ID NO: 1458997 - RNA, 19 nt, Homo sapiens
aauggacggucacuacaga

SEQ ID NO: 1458998 - RNA, 19 nt, Homo sapiens
ccaaaggagugaguuucau

SEQ ID NO: 1458999 - RNA, 19 nt, Homo sapiens
gcucugaggauagcaauca

SEQ ID NO: 1459000 - RNA, 19 nt, Homo sapiens
cacaaaaggagcuacauua

SEQ ID NO: 1459001 - RNA, 19 nt, Homo sapiens
cacaguuucuucuuguaga

SEQ ID NO: 1459002 - RNA, 19 nt, Homo sapiens
ccucagggacccaggauga

SEQ ID NO: 1459003 - RNA, 19 nt, Homo sapiens
caaauggacggucacuaca

SEQ ID NO: 1459004 - RNA, 19 nt, Homo sapiens
caacagggaggggauuuua

SEQ ID NO: 1459005 - RNA, 19 nt, Homo sapiens
ggacugagaacgugaugcu

SEQ ID NO: 1459006 - RNA, 19 nt, Homo sapiens
gcaacacccgccucacugu

SEQ ID NO: 1459007 - RNA, 19 nt, Homo sapiens
ggaagguggugaaaguguu

SEQ ID NO: 1459008 - RNA, 19 nt, Homo sapiens
ucacggaggugccaaacau

SEQ ID NO: 1459009 - RNA, 19 nt, Homo sapiens
gaagguggugaaaguguuu

SEQ ID NO: 1459010 - RNA, 19 nt, Homo sapiens
gcaacacggcacugcacua

SEQ ID NO: 1459011 - RNA, 19 nt, Homo sapiens
gcuagaggccagucccaaa

SEQ ID NO: 1459012 - RNA, 19 nt, Homo sapiens
gcaucuggcugcccucaac

SEQ ID NO: 1459013 - RNA, 19 nt, Homo sapiens
ccacauccgccucguguuc

SEQ ID NO: 1459014 - RNA, 19 nt, Homo sapiens
ucgggaagguggugaaagu

SEQ ID NO: 1459015 - RNA, 19 nt, Homo sapiens
gaggccagucccaaaguuu

SEQ ID NO: 1459016 - RNA, 19 nt, Homo sapiens
cgcacgaccugcugcugua

SEQ ID NO: 1459017 - RNA, 19 nt, Homo sapiens
caggaccgcucugcaagug

SEQ ID NO: 1459018 - RNA, 19 nt, Homo sapiens
gacgggaaccugcguguag

SEQ ID NO: 1459019 - RNA, 19 nt, Homo sapiens
gacgcugggugcaguguca

SEQ ID NO: 1459020 - RNA, 19 nt, Homo sapiens
gcaccaugccucccucaag

SEQ ID NO: 1459021 - RNA, 19 nt, Homo sapiens
ugauacggcugcugcuaca

SEQ ID NO: 1459022 - RNA, 19 nt, Homo sapiens
ucaccaagcaccacuccuu

SEQ ID NO: 1459023 - RNA, 19 nt, Homo sapiens
ccaccaacagccaggguuu

SEQ ID NO: 1459024 - RNA, 19 nt, Homo sapiens
agaggccagucccaaaguu

SEQ ID NO: 1459025 - RNA, 19 nt, Homo sapiens
gggaagguggugaaagugu

SEQ ID NO: 1459026 - RNA, 19 nt, Homo sapiens
guacgacaacgcccagauc

SEQ ID NO: 1459027 - RNA, 19 nt, Homo sapiens
gccagguggucgucagcaa

SEQ ID NO: 1459028 - RNA, 19 nt, Homo sapiens
ccaggauggcggaguuuau

SEQ ID NO: 1459029 - RNA, 19 nt, Homo sapiens
caacacggcacugcacuac

SEQ ID NO: 1459030 - RNA, 19 nt, Homo sapiens
ggaggugccaaacaucgau

SEQ ID NO: 1459031 - RNA, 19 nt, Homo sapiens
cgaguggacggacgacaug

SEQ ID NO: 1459032 - RNA, 19 nt, Homo sapiens
gugugugccuggacuacga

SEQ ID NO: 1459033 - RNA, 19 nt, Homo sapiens
gagaacaaaagcucacuga

SEQ ID NO: 1459034 - RNA, 19 nt, Homo sapiens
caucggcgaccuugacaca

SEQ ID NO: 1459035 - RNA, 19 nt, Homo sapiens
uggcugcccucaacaacca

SEQ ID NO: 1459036 - RNA, 19 nt, Homo sapiens
gcgcuagcugugagaaaga

SEQ ID NO: 1459037 - RNA, 19 nt, Homo sapiens
gguggucgucagcaagaaa

SEQ ID NO: 1459038 - RNA, 19 nt, Homo sapiens
gaacaaaccucauuuacca

SEQ ID NO: 1459039 - RNA, 19 nt, Homo sapiens
gcagaacccucuuaaauau

SEQ ID NO: 1459040 - RNA, 19 nt, Homo sapiens
gaacugagcucuguacguu

SEQ ID NO: 1459041 - RNA, 19 nt, Homo sapiens
gaaguggaguauaguauuu

SEQ ID NO: 1459042 - RNA, 19 nt, Homo sapiens
gaaggauccugaacauauu

SEQ ID NO: 1459043 - RNA, 19 nt, Homo sapiens
gauggagucucaccacaua

SEQ ID NO: 1459044 - RNA, 19 nt, Homo sapiens
aaaccaacauccugucuua

SEQ ID NO: 1459045 - RNA, 19 nt, Homo sapiens
caaguaaagcuuugaguua

SEQ ID NO: 1459046 - RNA, 19 nt, Homo sapiens
caauaagugugacagaaua

SEQ ID NO: 1459047 - RNA, 19 nt, Homo sapiens
caacagaaauguggcauga

SEQ ID NO: 1459048 - RNA, 19 nt, Homo sapiens
cuaagaagcagucuaaaua

SEQ ID NO: 1459049 - RNA, 19 nt, Homo sapiens
caggugaucuauucucuua

SEQ ID NO: 1459050 - RNA, 19 nt, Homo sapiens
gaauuugucagcaugauua

SEQ ID NO: 1459051 - RNA, 19 nt, Homo sapiens
caccacaucuggcuaauuu

SEQ ID NO: 1459052 - RNA, 19 nt, Homo sapiens
gauggaaagugcauauuga

SEQ ID NO: 1459053 - RNA, 19 nt, Homo sapiens
ccacaaucauuuacaguuu

SEQ ID NO: 1459054 - RNA, 19 nt, Homo sapiens
guaauagguuuccugauga

SEQ ID NO: 1459055 - RNA, 19 nt, Homo sapiens
agaauaaggugacucauau

SEQ ID NO: 1459056 - RNA, 19 nt, Homo sapiens
guauagguguucugucaua

SEQ ID NO: 1459057 - RNA, 19 nt, Homo sapiens
ggaauaaucucaggaagca

SEQ ID NO: 1459058 - RNA, 19 nt, Homo sapiens
cauguacccuuuauuguuu

SEQ ID NO: 1459059 - RNA, 19 nt, Homo sapiens
ggcagaacccucuuaaaua

SEQ ID NO: 1459060 - RNA, 19 nt, Homo sapiens
ugacaacgcuaacuggaaa

SEQ ID NO: 1459061 - RNA, 19 nt, Homo sapiens
cuugagcucuucuuaaaua

SEQ ID NO: 1459062 - RNA, 19 nt, Homo sapiens
ccaacauccugucuuauuu

SEQ ID NO: 1459063 - RNA, 19 nt, Homo sapiens
auagaacacucaagaagua

SEQ ID NO: 1459064 - RNA, 19 nt, Homo sapiens
ccacugcacuucuaguuga

SEQ ID NO: 1459065 - RNA, 19 nt, Homo sapiens
ccaaggagauggaucacuu

SEQ ID NO: 1459066 - RNA, 19 nt, Homo sapiens
gcaaagaaagcaauaagug

SEQ ID NO: 1459067 - RNA, 19 nt, Homo sapiens
gaauucauguuguggaaga

SEQ ID NO: 1459068 - RNA, 19 nt, Homo sapiens
gguguucugucauacguua

SEQ ID NO: 1459069 - RNA, 19 nt, Homo sapiens
guccugaccuacuguauaa

SEQ ID NO: 1459070 - RNA, 19 nt, Homo sapiens
guucaugaguugcauugua

SEQ ID NO: 1459071 - RNA, 19 nt, Homo sapiens
acagaaauguggcaugauu

SEQ ID NO: 1459072 - RNA, 19 nt, Homo sapiens
ggauaagccuucuccuuuc

SEQ ID NO: 1459073 - RNA, 19 nt, Homo sapiens
gcaagaucauuguuuagug

SEQ ID NO: 1459074 - RNA, 19 nt, Homo sapiens
gcauggagagaaucauuua

SEQ ID NO: 1459075 - RNA, 19 nt, Homo sapiens
uguaauagguuuccugaug

SEQ ID NO: 1459076 - RNA, 19 nt, Homo sapiens
gaaauauggaggcuuuaaa

SEQ ID NO: 1459077 - RNA, 19 nt, Homo sapiens
uggccuggauuguguauua

SEQ ID NO: 1459078 - RNA, 19 nt, Homo sapiens
gugauguuaugaacuguua

SEQ ID NO: 1459079 - RNA, 19 nt, Homo sapiens
gagcaagcauagauggaaa

SEQ ID NO: 1459080 - RNA, 19 nt, Homo sapiens
caaaagagauaaccaguau

SEQ ID NO: 1459081 - RNA, 19 nt, Homo sapiens
gucaauaccuuuauaagca

SEQ ID NO: 1459082 - RNA, 19 nt, Homo sapiens
cauguaauguacucccuua

SEQ ID NO: 1459083 - RNA, 19 nt, Homo sapiens
uuacagaguuaaccuaaug

SEQ ID NO: 1459084 - RNA, 19 nt, Homo sapiens
gauaagccuucuccuuuca

SEQ ID NO: 1459085 - RNA, 19 nt, Homo sapiens
gaagauaucauugccaugu

SEQ ID NO: 1459086 - RNA, 19 nt, Homo sapiens
uaaggugacucauauucuu

SEQ ID NO: 1459087 - RNA, 19 nt, Homo sapiens
ugaaggauccugaacauau

SEQ ID NO: 1459088 - RNA, 19 nt, Homo sapiens
gaaggcaggcuuucauaug

SEQ ID NO: 1459089 - RNA, 19 nt, Homo sapiens
gaguuaaccuaaugaguca

SEQ ID NO: 1459090 - RNA, 19 nt, Homo sapiens
cagaggaaguggaguauag

SEQ ID NO: 1459091 - RNA, 19 nt, Homo sapiens
caugaagccuugauagaau

SEQ ID NO: 1459092 - RNA, 19 nt, Homo sapiens
gagaaggcaggcuuucaua

SEQ ID NO: 1459093 - RNA, 19 nt, Homo sapiens
ggagaaggguuaugguuuu

SEQ ID NO: 1459094 - RNA, 19 nt, Homo sapiens
accaguaucugaagguuua

SEQ ID NO: 1459095 - RNA, 19 nt, Homo sapiens
guuucuagguguugauaua

SEQ ID NO: 1459096 - RNA, 19 nt, Homo sapiens
aauguggcaugauuacuua

SEQ ID NO: 1459097 - RNA, 19 nt, Homo sapiens
ggaaguggaguauaguauu

SEQ ID NO: 1459098 - RNA, 19 nt, Homo sapiens
gaauagaacacucaagaag

SEQ ID NO: 1459099 - RNA, 19 nt, Homo sapiens
ggagacccacaaucauuua

SEQ ID NO: 1459100 - RNA, 19 nt, Homo sapiens
uggguaagauucaaacauu

SEQ ID NO: 1459101 - RNA, 19 nt, Homo sapiens
agaacccucuuaaauauga

SEQ ID NO: 1459102 - RNA, 19 nt, Homo sapiens
ggaaagugcauauugaaca

SEQ ID NO: 1459103 - RNA, 19 nt, Homo sapiens
gagcauuucuauauuggau

SEQ ID NO: 1459104 - RNA, 19 nt, Homo sapiens
ggaaagaugccagaauuca

SEQ ID NO: 1459105 - RNA, 19 nt, Homo sapiens
ccaaguagucauaaaugua

SEQ ID NO: 1459106 - RNA, 19 nt, Homo sapiens
ggguaagauucaaacauuu

SEQ ID NO: 1459107 - RNA, 19 nt, Homo sapiens
gucuugagcucuucuuaaa

SEQ ID NO: 1459108 - RNA, 19 nt, Homo sapiens
gcaauaagugugacagaau

SEQ ID NO: 1459109 - RNA, 19 nt, Homo sapiens
ugcaagaccuuccauaugu

SEQ ID NO: 1459110 - RNA, 19 nt, Homo sapiens
gaaguuguauauucuugca

SEQ ID NO: 1459111 - RNA, 19 nt, Homo sapiens
gagcucuucuuaaauauac

SEQ ID NO: 1459112 - RNA, 19 nt, Homo sapiens
cacaguggcuacaauauuc

SEQ ID NO: 1459113 - RNA, 19 nt, Homo sapiens
caucauguacccuuuauug

SEQ ID NO: 1459114 - RNA, 19 nt, Homo sapiens
uggagcagcuucguacaua

SEQ ID NO: 1459115 - RNA, 19 nt, Homo sapiens
gcuuagacucugauaauuu

SEQ ID NO: 1459116 - RNA, 19 nt, Homo sapiens
gauaaaucacucugucauu

SEQ ID NO: 1459117 - RNA, 19 nt, Homo sapiens
gauaguuuccacauaguuu

SEQ ID NO: 1459118 - RNA, 19 nt, Homo sapiens
caccacgccuggccugaua

SEQ ID NO: 1459119 - RNA, 19 nt, Homo sapiens
cucagugacuuuacauaua

SEQ ID NO: 1459120 - RNA, 19 nt, Homo sapiens
uggauaagccuucuccuuu

SEQ ID NO: 1459121 - RNA, 19 nt, Homo sapiens
gggagaaggguuaugguuu

SEQ ID NO: 1459122 - RNA, 19 nt, Homo sapiens
acugcaagaucauuguuua

SEQ ID NO: 1459123 - RNA, 19 nt, Homo sapiens
uaucggcauuucuuucuuu

SEQ ID NO: 1459124 - RNA, 19 nt, Homo sapiens
ccacugcucauguaaugua

SEQ ID NO: 1459125 - RNA, 19 nt, Homo sapiens
gaaaugcuacuuaacuuac

SEQ ID NO: 1459126 - RNA, 19 nt, Homo sapiens
aaucauugcuuucuguaga

SEQ ID NO: 1459127 - RNA, 19 nt, Homo sapiens
gagugguucuuguucauug

SEQ ID NO: 1459128 - RNA, 19 nt, Homo sapiens
uagcaccacugcacuucua

SEQ ID NO: 1459129 - RNA, 19 nt, Homo sapiens
ccaggugacucuaaauagu

SEQ ID NO: 1459130 - RNA, 19 nt, Homo sapiens
caaaggcaguggagcauac

SEQ ID NO: 1459131 - RNA, 19 nt, Homo sapiens
uaagccuucuccuuucaua

SEQ ID NO: 1459132 - RNA, 19 nt, Homo sapiens
gaaagugcauauugaacac

SEQ ID NO: 1459133 - RNA, 19 nt, Homo sapiens
gcuccagccucccauauag

SEQ ID NO: 1459134 - RNA, 19 nt, Homo sapiens
caaagaaagcaauaagugu

SEQ ID NO: 1459135 - RNA, 19 nt, Homo sapiens
auagaaacauggaaagaug

SEQ ID NO: 1459136 - RNA, 19 nt, Homo sapiens
gcuaagaagcagucuaaau

SEQ ID NO: 1459137 - RNA, 19 nt, Homo sapiens
ggugaucuauucucuuaca

SEQ ID NO: 1459138 - RNA, 19 nt, Homo sapiens
caucaugggugucaacgua

SEQ ID NO: 1459139 - RNA, 19 nt, Homo sapiens
caaauaaaccaggcuguua

SEQ ID NO: 1459140 - RNA, 19 nt, Homo sapiens
gaagggaccuccaguucug

SEQ ID NO: 1459141 - RNA, 19 nt, Homo sapiens
ccaaagaggccuacugcua

SEQ ID NO: 1459142 - RNA, 19 nt, Homo sapiens
cgaaauccaugccgaguuc

SEQ ID NO: 1459143 - RNA, 19 nt, Homo sapiens
uaacagcagucucauuaag

SEQ ID NO: 1459144 - RNA, 19 nt, Homo sapiens
cgagaacccugagaucuug

SEQ ID NO: 1459145 - RNA, 19 nt, Homo sapiens
acuaacagcagucucauua

SEQ ID NO: 1459146 - RNA, 19 nt, Homo sapiens
gcaaauaaaccaggcuguu

SEQ ID NO: 1459147 - RNA, 19 nt, Homo sapiens
caaaguggccggagacauc

SEQ ID NO: 1459148 - RNA, 19 nt, Homo sapiens
ggacgcgguugaccuagug

SEQ ID NO: 1459149 - RNA, 19 nt, Homo sapiens
cugcuaagcugcugacugu

SEQ ID NO: 1459150 - RNA, 19 nt, Homo sapiens
ugacgaagccgcucacaca

SEQ ID NO: 1459151 - RNA, 19 nt, Homo sapiens
ccggagacaucuucaagga

SEQ ID NO: 1459152 - RNA, 19 nt, Homo sapiens
cagcuggacuccgacauga

SEQ ID NO: 1459153 - RNA, 19 nt, Homo sapiens
ucaagcugcucaacucugu

SEQ ID NO: 1459154 - RNA, 19 nt, Homo sapiens
ccacaggcaacgccacuaa

SEQ ID NO: 1459155 - RNA, 19 nt, Homo sapiens
gaaaagacucugaggaaug

SEQ ID NO: 1459156 - RNA, 19 nt, Homo sapiens
ggaaaagacucugaggaau

SEQ ID NO: 1459157 - RNA, 19 nt, Homo sapiens
cgaaggccaccaccaaaga

SEQ ID NO: 1459158 - RNA, 19 nt, Homo sapiens
aaaagacucugaggaauga

SEQ ID NO: 1459159 - RNA, 19 nt, Homo sapiens
gcagcuggacuccgacaug

SEQ ID NO: 1459160 - RNA, 19 nt, Homo sapiens
gcagagcagcagcgucuuc

SEQ ID NO: 1459161 - RNA, 19 nt, Homo sapiens
gcaggagggaggaucuaga

SEQ ID NO: 1459162 - RNA, 19 nt, Homo sapiens
ugaggacagucaucaaugc

SEQ ID NO: 1459163 - RNA, 19 nt, Homo sapiens
acagcagucucauuaagca

SEQ ID NO: 1459164 - RNA, 19 nt, Homo sapiens
caguucugcuccagucuug

SEQ ID NO: 1459165 - RNA, 19 nt, Homo sapiens
gaaggccaccaccaaagag

SEQ ID NO: 1459166 - RNA, 19 nt, Homo sapiens
ccucauccacuucuucuuc

SEQ ID NO: 1459167 - RNA, 19 nt, Homo sapiens
uagucaagcugcucaacuc

SEQ ID NO: 1459168 - RNA, 19 nt, Homo sapiens
cuaacagcagucucauuaa

SEQ ID NO: 1459169 - RNA, 19 nt, Homo sapiens
gagacaucuucaaggacaa

SEQ ID NO: 1459170 - RNA, 19 nt, Homo sapiens
uaaaccaggcuguuaucug

SEQ ID NO: 1459171 - RNA, 19 nt, Homo sapiens
uggcuggacuggucauugg

SEQ ID NO: 1459172 - RNA, 19 nt, Homo sapiens
gugaggacagucaucaaug

SEQ ID NO: 1459173 - RNA, 19 nt, Homo sapiens
ggagaggcuaagugagcua

SEQ ID NO: 1459174 - RNA, 19 nt, Homo sapiens
ggucugucccugcccgaaa

SEQ ID NO: 1459175 - RNA, 19 nt, Homo sapiens
gcuggacuccgacaugauc

SEQ ID NO: 1459176 - RNA, 19 nt, Homo sapiens
gccacuaacagcagucuca

SEQ ID NO: 1459177 - RNA, 19 nt, Homo sapiens
gcuacgagaacccugagau

SEQ ID NO: 1459178 - RNA, 19 nt, Homo sapiens
ccggcauccugcuguggua

SEQ ID NO: 1459179 - RNA, 19 nt, Homo sapiens
gcgguugaccuaguggaaa

SEQ ID NO: 1459180 - RNA, 19 nt, Homo sapiens
acaacguggugcuguccaa

SEQ ID NO: 1459181 - RNA, 19 nt, Homo sapiens
gaucuucaacuggcucaca

SEQ ID NO: 1459182 - RNA, 19 nt, Homo sapiens
gaauuucagagggcuuuca

SEQ ID NO: 1459183 - RNA, 19 nt, Homo sapiens
gcaaaguggccggagacau

SEQ ID NO: 1459184 - RNA, 19 nt, Homo sapiens
ccuagaagcugcaaagaaa

SEQ ID NO: 1459185 - RNA, 19 nt, Homo sapiens
agaaauacccagugaaaua

SEQ ID NO: 1459186 - RNA, 19 nt, Homo sapiens
gcuguacucuuguucuaua

SEQ ID NO: 1459187 - RNA, 19 nt, Homo sapiens
ggaggcggcuguacucuug

SEQ ID NO: 1459188 - RNA, 19 nt, Homo sapiens
gagacuaaaucacaucaau

SEQ ID NO: 1459189 - RNA, 19 nt, Homo sapiens
gcagcagccucuucucuug

SEQ ID NO: 1459190 - RNA, 19 nt, Homo sapiens
ggauauggaacucacguua

SEQ ID NO: 1459191 - RNA, 19 nt, Homo sapiens
caagaacccuggcuacuac

SEQ ID NO: 1459192 - RNA, 19 nt, Homo sapiens
gaaauacagaucagggaaa

SEQ ID NO: 1459193 - RNA, 19 nt, Homo sapiens
ccagaaauacccagugaaa

SEQ ID NO: 1459194 - RNA, 19 nt, Homo sapiens
gagaggagacuaaaucaca

SEQ ID NO: 1459195 - RNA, 19 nt, Homo sapiens
gauauggaacucacguuaa

SEQ ID NO: 1459196 - RNA, 19 nt, Homo sapiens
ucagggaaauguuggaaug

SEQ ID NO: 1459197 - RNA, 19 nt, Homo sapiens
caagaaugguguugucuac

SEQ ID NO: 1459198 - RNA, 19 nt, Homo sapiens
ugacugggauggauaugga

SEQ ID NO: 1459199 - RNA, 19 nt, Homo sapiens
gggaauuuguugcaggauu

SEQ ID NO: 1459200 - RNA, 19 nt, Homo sapiens
gaggagaggagacuaaauc

SEQ ID NO: 1459201 - RNA, 19 nt, Homo sapiens
aaacuggaauucuaacaag

SEQ ID NO: 1459202 - RNA, 19 nt, Homo sapiens
gaaauacccagugaaauac

SEQ ID NO: 1459203 - RNA, 19 nt, Homo sapiens
aaggaacgcugccauagug

SEQ ID NO: 1459204 - RNA, 19 nt, Homo sapiens
gacugcaucuuauuacuca

SEQ ID NO: 1459205 - RNA, 19 nt, Homo sapiens
uaccagaaauacccaguga

SEQ ID NO: 1459206 - RNA, 19 nt, Homo sapiens
gcaacugggccaacuacaa

SEQ ID NO: 1459207 - RNA, 19 nt, Homo sapiens
gggaaauguuggaaugaca

SEQ ID NO: 1459208 - RNA, 19 nt, Homo sapiens
guacucuuguucuauagau

SEQ ID NO: 1459209 - RNA, 19 nt, Homo sapiens
cagcugcagucgggagaua

SEQ ID NO: 1459210 - RNA, 19 nt, Homo sapiens
ggaaauguuggaaugacaa

SEQ ID NO: 1459211 - RNA, 19 nt, Homo sapiens
aaauacagaucagggaaau

SEQ ID NO: 1459212 - RNA, 19 nt, Homo sapiens
acaagaacccuggcuacua

SEQ ID NO: 1459213 - RNA, 19 nt, Homo sapiens
cggcuguacucuuguucua

SEQ ID NO: 1459214 - RNA, 19 nt, Homo sapiens
ccaaggaccugggcaucug

SEQ ID NO: 1459215 - RNA, 19 nt, Homo sapiens
agacucugcuuccuguuau

SEQ ID NO: 1459216 - RNA, 19 nt, Homo sapiens
ccaagaaugguguugucua

SEQ ID NO: 1459217 - RNA, 19 nt, Homo sapiens
gcgagaacccaucuuccaa

SEQ ID NO: 1459218 - RNA, 19 nt, Homo sapiens
acugggacauaaucuguuu

SEQ ID NO: 1459219 - RNA, 19 nt, Homo sapiens
cuacaacaccuuuggaucu

SEQ ID NO: 1459220 - RNA, 19 nt, Homo sapiens
gcuguaacacugagcauca

SEQ ID NO: 1459221 - RNA, 19 nt, Homo sapiens
gaaauguuggaaugacaau

SEQ ID NO: 1459222 - RNA, 19 nt, Homo sapiens
caacugggccaacuacaac

SEQ ID NO: 1459223 - RNA, 19 nt, Homo sapiens
cauaaucuguuuggcaucu

SEQ ID NO: 1459224 - RNA, 19 nt, Homo sapiens
acagagcucuccgguguca

SEQ ID NO: 1459225 - RNA, 19 nt, Homo sapiens
ggacuucuccgccuuugac

SEQ ID NO: 1459226 - RNA, 19 nt, Homo sapiens
guucaguuccggguguuua

SEQ ID NO: 1459227 - RNA, 19 nt, Homo sapiens
agccauaccuguggucuau

SEQ ID NO: 1459228 - RNA, 19 nt, Homo sapiens
caaggaacgcugccauagu

SEQ ID NO: 1459229 - RNA, 19 nt, Homo sapiens
gagcagccaacgcccuuug

SEQ ID NO: 1459230 - RNA, 19 nt, Homo sapiens
ugacuuuggugaugcuaag

SEQ ID NO: 1459231 - RNA, 19 nt, Homo sapiens
cacgagcgaugacuacaag

SEQ ID NO: 1459232 - RNA, 19 nt, Homo sapiens
caacuacaacaccuuugga

SEQ ID NO: 1459233 - RNA, 19 nt, Homo sapiens
gaccuucugugacaugacu

SEQ ID NO: 1459234 - RNA, 19 nt, Homo sapiens
uaaggaugcuguccaugcu

SEQ ID NO: 1459235 - RNA, 19 nt, Homo sapiens
gccuagaagcugcaaagaa

SEQ ID NO: 1459236 - RNA, 19 nt, Homo sapiens
auauggaacucacguuaag

SEQ ID NO: 1459237 - RNA, 19 nt, Homo sapiens
gguguuuaauaacgagaga

SEQ ID NO: 1459238 - RNA, 19 nt, Homo sapiens
gaucagggaaauguuggaa

SEQ ID NO: 1459239 - RNA, 19 nt, Homo sapiens
ggccaacuacaacaccuuu

SEQ ID NO: 1459240 - RNA, 19 nt, Homo sapiens
ggaggagaggagacuaaau

SEQ ID NO: 1459241 - RNA, 19 nt, Homo sapiens
acacugagcaucacugcau

SEQ ID NO: 1459242 - RNA, 19 nt, Homo sapiens
auacagaucagggaaaugu

SEQ ID NO: 1459243 - RNA, 19 nt, Homo sapiens
ccagugaaauacagaucag

SEQ ID NO: 1459244 - RNA, 19 nt, Homo sapiens
cgagcgaugacuacaagaa

SEQ ID NO: 1459245 - RNA, 19 nt, Homo sapiens
caguuccggguguuuaaua

SEQ ID NO: 1459246 - RNA, 19 nt, Homo sapiens
acagaucagggaaauguug

SEQ ID NO: 1459247 - RNA, 19 nt, Homo sapiens
ccagcgugcacgagaauga

SEQ ID NO: 1459248 - RNA, 19 nt, Homo sapiens
agaggagacuaaaucacau

SEQ ID NO: 1459249 - RNA, 19 nt, Homo sapiens
uaacggaggcggcuguacu

SEQ ID NO: 1459250 - RNA, 19 nt, Homo sapiens
gauaacggaggcggcugua

SEQ ID NO: 1459251 - RNA, 19 nt, Homo sapiens
ccacgagcgaugacuacaa

SEQ ID NO: 1459252 - RNA, 19 nt, Homo sapiens
cagcagccucuucucuuga

SEQ ID NO: 1459253 - RNA, 19 nt, Homo sapiens
ggugauggccuguauuuuc

SEQ ID NO: 1459254 - RNA, 19 nt, Homo sapiens
uagaagcugcaaagaaauc

SEQ ID NO: 1459255 - RNA, 19 nt, Homo sapiens
cugcaaagaaaucaaggaa

SEQ ID NO: 1459256 - RNA, 19 nt, Homo sapiens
ucaaggaacgcugccauag

SEQ ID NO: 1459257 - RNA, 19 nt, Homo sapiens
agacugggacauaaucugu

SEQ ID NO: 1459258 - RNA, 19 nt, Homo sapiens
uacaacaccuuuggaucug

SEQ ID NO: 1459259 - RNA, 19 nt, Homo sapiens
ugaggacaaugaccagacu

SEQ ID NO: 1459260 - RNA, 19 nt, Homo sapiens
gacucugcuuccuguuauu

SEQ ID NO: 1459261 - RNA, 19 nt, Homo sapiens
aguuccggguguuuaauaa

SEQ ID NO: 1459262 - RNA, 19 nt, Homo sapiens
uugcaggauucguucaguu

SEQ ID NO: 1459263 - RNA, 19 nt, Homo sapiens
gucuaugacuuuggugaug

SEQ ID NO: 1459264 - RNA, 19 nt, Homo sapiens
uaccuguggucuaugacuu

SEQ ID NO: 1459265 - RNA, 19 nt, Homo sapiens
gaagcugcaaagaaaucaa

SEQ ID NO: 1459266 - RNA, 19 nt, Homo sapiens
cagaaauacccagugaaau

SEQ ID NO: 1459267 - RNA, 19 nt, Homo sapiens
gagcgaugacuacaagaac

SEQ ID NO: 1459268 - RNA, 19 nt, Homo sapiens
gggcaaaccccgucagugu

SEQ ID NO: 1459269 - RNA, 19 nt, Homo sapiens
gcagccaacgcccuuugug

SEQ ID NO: 1459270 - RNA, 19 nt, Homo sapiens
cagcuccuggcaucuguaa

SEQ ID NO: 1459271 - RNA, 19 nt, Homo sapiens
ggagacuaaaucacaucaa

SEQ ID NO: 1459272 - RNA, 19 nt, Homo sapiens
gaggagacuaaaucacauc

SEQ ID NO: 1459273 - RNA, 19 nt, Homo sapiens
gggcaacaaagcagacuac

SEQ ID NO: 1459274 - RNA, 19 nt, Homo sapiens
ccagucagcagggcaacaa

SEQ ID NO: 1459275 - RNA, 19 nt, Homo sapiens
gaagaaauaguacagaaga

SEQ ID NO: 1459276 - RNA, 19 nt, Homo sapiens
gguaagaagugucaacugu

SEQ ID NO: 1459277 - RNA, 19 nt, Homo sapiens
agaaacagcugcaaaauuu

SEQ ID NO: 1459278 - RNA, 19 nt, Homo sapiens
uaagaagugucaacuguau

SEQ ID NO: 1459279 - RNA, 19 nt, Homo sapiens
gaagauggaagucgcauug

SEQ ID NO: 1459280 - RNA, 19 nt, Homo sapiens
gaagucgcauuguagauuc

SEQ ID NO: 1459281 - RNA, 19 nt, Homo sapiens
gcaaaccgcuggucuuucg

SEQ ID NO: 1459282 - RNA, 19 nt, Homo sapiens
gugaaggaguucuuauuga

SEQ ID NO: 1459283 - RNA, 19 nt, Homo sapiens
gaagccaccucaaguccuu

SEQ ID NO: 1459284 - RNA, 19 nt, Homo sapiens
gaagacaggagucaucaga

SEQ ID NO: 1459285 - RNA, 19 nt, Homo sapiens
ucacggagcuggccaggau

SEQ ID NO: 1459286 - RNA, 19 nt, Homo sapiens
agacaggagucaucagauu

SEQ ID NO: 1459287 - RNA, 19 nt, Homo sapiens
ggaagucgcauuguagauu

SEQ ID NO: 1459288 - RNA, 19 nt, Homo sapiens
uuaagaagauugaggaaca

SEQ ID NO: 1459289 - RNA, 19 nt, Homo sapiens
gcugauaggcugaauaauc

SEQ ID NO: 1459290 - RNA, 19 nt, Homo sapiens
ugacgugggugaaggaguu

SEQ ID NO: 1459291 - RNA, 19 nt, Homo sapiens
guaagaagugucaacugua

SEQ ID NO: 1459292 - RNA, 19 nt, Homo sapiens
gguauggaucgauggauua

SEQ ID NO: 1459293 - RNA, 19 nt, Homo sapiens
ggguauggaucgauggauu

SEQ ID NO: 1459294 - RNA, 19 nt, Homo sapiens
guacagaagagcaaagaau

SEQ ID NO: 1459295 - RNA, 19 nt, Homo sapiens
ggugaaggaguucuuauug

SEQ ID NO: 1459296 - RNA, 19 nt, Homo sapiens
gggaagauuuuguaccaua

SEQ ID NO: 1459297 - RNA, 19 nt, Homo sapiens
agauggaagucgcauugua

SEQ ID NO: 1459298 - RNA, 19 nt, Homo sapiens
gacaggagucaucagauuu

SEQ ID NO: 1459299 - RNA, 19 nt, Homo sapiens
gccaugggaggaagaaaua

SEQ ID NO: 1459300 - RNA, 19 nt, Homo sapiens
ugaaggaguucuuauugag

SEQ ID NO: 1459301 - RNA, 19 nt, Homo sapiens
cugauaggcugaauaaucu

SEQ ID NO: 1459302 - RNA, 19 nt, Homo sapiens
uacagaagagcaaagaaua

SEQ ID NO: 1459303 - RNA, 19 nt, Homo sapiens
gaugccuucugucaauaaa

SEQ ID NO: 1459304 - RNA, 19 nt, Homo sapiens
acagaagagcaaagaauaa

SEQ ID NO: 1459305 - RNA, 19 nt, Homo sapiens
aggaagaaauaguacagaa

SEQ ID NO: 1459306 - RNA, 19 nt, Homo sapiens
ggucagcccucugugcaau

SEQ ID NO: 1459307 - RNA, 19 nt, Homo sapiens
ugugaugccuucugucaau

SEQ ID NO: 1459308 - RNA, 19 nt, Homo sapiens
gauggaagucgcauuguag

SEQ ID NO: 1459309 - RNA, 19 nt, Homo sapiens
gcugaauaaucuccuguag

SEQ ID NO: 1459310 - RNA, 19 nt, Homo sapiens
cgaccaggccuaugacuuc

SEQ ID NO: 1459311 - RNA, 19 nt, Homo sapiens
ugagucagcuagacagaag

SEQ ID NO: 1459312 - RNA, 19 nt, Homo sapiens
gcaauuucaacaucauaga

SEQ ID NO: 1459313 - RNA, 19 nt, Homo sapiens
ggaagaaauaguacagaag

SEQ ID NO: 1459314 - RNA, 19 nt, Homo sapiens
gugaugccuucugucaaua

SEQ ID NO: 1459315 - RNA, 19 nt, Homo sapiens
ucaacaucauagagucuuu

SEQ ID NO: 1459316 - RNA, 19 nt, Homo sapiens
ucagauuuguacccuaguu

SEQ ID NO: 1459317 - RNA, 19 nt, Homo sapiens
ggagucaucagauuuguac

SEQ ID NO: 1459318 - RNA, 19 nt, Homo sapiens
gauccuggucuacgacauu

SEQ ID NO: 1459319 - RNA, 19 nt, Homo sapiens
cgagcaagguacugagcuu

SEQ ID NO: 1459320 - RNA, 19 nt, Homo sapiens
uggcugauaggcugaauaa

SEQ ID NO: 1459321 - RNA, 19 nt, Homo sapiens
ucagcccucugugcaauuu

SEQ ID NO: 1459322 - RNA, 19 nt, Homo sapiens
gccuacaucuggcauucaa

SEQ ID NO: 1459323 - RNA, 19 nt, Homo sapiens
gaucgauggauuaagaaga

SEQ ID NO: 1459324 - RNA, 19 nt, Homo sapiens
auggaucgauggauuaaga

SEQ ID NO: 1459325 - RNA, 19 nt, Homo sapiens
cagauuuguacccuaguua

SEQ ID NO: 1459326 - RNA, 19 nt, Homo sapiens
cagaagagcaaagaauaau

SEQ ID NO: 1459327 - RNA, 19 nt, Homo sapiens
auaaucuccuguaggguaa

SEQ ID NO: 1459328 - RNA, 19 nt, Homo sapiens
gggugaaggaguucuuauu

SEQ ID NO: 1459329 - RNA, 19 nt, Homo sapiens
uaagaagccaccucaaguc

SEQ ID NO: 1459330 - RNA, 19 nt, Homo sapiens
gagugauccuggucuacga

SEQ ID NO: 1459331 - RNA, 19 nt, Homo sapiens
uuaagaagccaccucaagu

SEQ ID NO: 1459332 - RNA, 19 nt, Homo sapiens
uaagaagauugaggaacau

SEQ ID NO: 1459333 - RNA, 19 nt, Homo sapiens
ggaagauuuuguaccauau

SEQ ID NO: 1459334 - RNA, 19 nt, Homo sapiens
guauggaucgauggauuaa

SEQ ID NO: 1459335 - RNA, 19 nt, Homo sapiens
ggaagauggaagucgcauu

SEQ ID NO: 1459336 - RNA, 19 nt, Homo sapiens
caccagcuccacucacaaa

SEQ ID NO: 1459337 - RNA, 19 nt, Homo sapiens
cuacaucuggcauucaaga

SEQ ID NO: 1459338 - RNA, 19 nt, Homo sapiens
gcuggucuuucgaggguau

SEQ ID NO: 1459339 - RNA, 19 nt, Homo sapiens
ggaggaagaaauaguacag

SEQ ID NO: 1459340 - RNA, 19 nt, Homo sapiens
gcauuguagauucaagaaa

SEQ ID NO: 1459341 - RNA, 19 nt, Homo sapiens
gauggauuaagaagauuga

SEQ ID NO: 1459342 - RNA, 19 nt, Homo sapiens
uggacuggcuacaggagaa

SEQ ID NO: 1459343 - RNA, 19 nt, Homo sapiens
ucaacuguaucaagcacau

SEQ ID NO: 1459344 - RNA, 19 nt, Homo sapiens
agaagugucaacuguauca

SEQ ID NO: 1459345 - RNA, 19 nt, Homo sapiens
acaggagucaucagauuug

SEQ ID NO: 1459346 - RNA, 19 nt, Homo sapiens
caccagaaacagcugcaaa

SEQ ID NO: 1459347 - RNA, 19 nt, Homo sapiens
gugcaauuucaacaucaua

SEQ ID NO: 1459348 - RNA, 19 nt, Homo sapiens
ccuaugacuuccugcucaa

SEQ ID NO: 1459349 - RNA, 19 nt, Homo sapiens
gaggaagaaauaguacaga

SEQ ID NO: 1459350 - RNA, 19 nt, Homo sapiens
ggaaggcaccaaaaggaaa

SEQ ID NO: 1459351 - RNA, 19 nt, Homo sapiens
ggacuggcuacaggagaaa

SEQ ID NO: 1459352 - RNA, 19 nt, Homo sapiens
gauuaagaagauugaggaa

SEQ ID NO: 1459353 - RNA, 19 nt, Homo sapiens
cagaaacagcugcaaaauu

SEQ ID NO: 1459354 - RNA, 19 nt, Homo sapiens
gcuacaggagaaaguguga

SEQ ID NO: 1459355 - RNA, 19 nt, Homo sapiens
gacguaggcaagagugaga

SEQ ID NO: 1459356 - RNA, 19 nt, Homo sapiens
ccaugcugcuugggaaugu

SEQ ID NO: 1459357 - RNA, 19 nt, Homo sapiens
aaaggaaacaagcuggaau

SEQ ID NO: 1459358 - RNA, 19 nt, Homo sapiens
ucugugcaauuucaacauc

SEQ ID NO: 1459359 - RNA, 19 nt, Homo sapiens
gggcagggaagauuuugua

SEQ ID NO: 1459360 - RNA, 19 nt, Homo sapiens
caucaacugacugugguuu

SEQ ID NO: 1459361 - RNA, 19 nt, Homo sapiens
cagaagacaggagucauca

SEQ ID NO: 1459362 - RNA, 19 nt, Homo sapiens
ggagcuggccaggauagug

SEQ ID NO: 1459363 - RNA, 19 nt, Homo sapiens
uugcaaaccgcuggucuuu

SEQ ID NO: 1459364 - RNA, 19 nt, Homo sapiens
caacaucauagagucuuuc

SEQ ID NO: 1459365 - RNA, 19 nt, Homo sapiens
uaauaaugagucagcuaga

SEQ ID NO: 1459366 - RNA, 19 nt, Homo sapiens
gcagucaaauggcaaauua

SEQ ID NO: 1459367 - RNA, 19 nt, Homo sapiens
ucucagagcucuaaagaua

SEQ ID NO: 1459368 - RNA, 19 nt, Homo sapiens
gagacaaccuccucugaaa

SEQ ID NO: 1459369 - RNA, 19 nt, Homo sapiens
ucaaucaucucucacuaua

SEQ ID NO: 1459370 - RNA, 19 nt, Homo sapiens
ggaagucagcuuuguauuu

SEQ ID NO: 1459371 - RNA, 19 nt, Homo sapiens
cauauuacaugucaacgua

SEQ ID NO: 1459372 - RNA, 19 nt, Homo sapiens
ucacuucaaugucaucuuu

SEQ ID NO: 1459373 - RNA, 19 nt, Homo sapiens
caagaaagccucacuucaa

SEQ ID NO: 1459374 - RNA, 19 nt, Homo sapiens
gcaauacacucugaaagau

SEQ ID NO: 1459375 - RNA, 19 nt, Homo sapiens
gcacugcaauacacucuga

SEQ ID NO: 1459376 - RNA, 19 nt, Homo sapiens
gaagucagcuuuguauuuu

SEQ ID NO: 1459377 - RNA, 19 nt, Homo sapiens
acauaaagauccagacauu

SEQ ID NO: 1459378 - RNA, 19 nt, Homo sapiens
aaacagcccuucauuugga

SEQ ID NO: 1459379 - RNA, 19 nt, Homo sapiens
gacaaccuccucugaaaua

SEQ ID NO: 1459380 - RNA, 19 nt, Homo sapiens
caaaauggcuuucaacaau

SEQ ID NO: 1459381 - RNA, 19 nt, Homo sapiens
gaguuaacccuuuacauuu

SEQ ID NO: 1459382 - RNA, 19 nt, Homo sapiens
guugaaggcuggacaucua

SEQ ID NO: 1459383 - RNA, 19 nt, Homo sapiens
caaaguccauccuuccuau

SEQ ID NO: 1459384 - RNA, 19 nt, Homo sapiens
aaccuccucugaaauauua

SEQ ID NO: 1459385 - RNA, 19 nt, Homo sapiens
ccacuucccucuucuuugu

SEQ ID NO: 1459386 - RNA, 19 nt, Homo sapiens
uuacuugucugcagucaaa

SEQ ID NO: 1459387 - RNA, 19 nt, Homo sapiens
caugucauuucuuccauua

SEQ ID NO: 1459388 - RNA, 19 nt, Homo sapiens
guucggaucuguucaaagu

SEQ ID NO: 1459389 - RNA, 19 nt, Homo sapiens
caucuacaguuaucaaaga

SEQ ID NO: 1459390 - RNA, 19 nt, Homo sapiens
agaaacagcccuucauuug

SEQ ID NO: 1459391 - RNA, 19 nt, Homo sapiens
ugaaguggcugaacaagca

SEQ ID NO: 1459392 - RNA, 19 nt, Homo sapiens
gaaacagucauauuacaug

SEQ ID NO: 1459393 - RNA, 19 nt, Homo sapiens
gaaaugcaugggacgguua

SEQ ID NO: 1459394 - RNA, 19 nt, Homo sapiens
gcagaaacagcccuucauu

SEQ ID NO: 1459395 - RNA, 19 nt, Homo sapiens
caaauaaagcccaucauca

SEQ ID NO: 1459396 - RNA, 19 nt, Homo sapiens
gcauacuucugacaacuug

SEQ ID NO: 1459397 - RNA, 19 nt, Homo sapiens
aagcauauguccuuuacaa

SEQ ID NO: 1459398 - RNA, 19 nt, Homo sapiens
gagugaugcuugauuaugu

SEQ ID NO: 1459399 - RNA, 19 nt, Homo sapiens
gcccuacgauccuaaagaa

SEQ ID NO: 1459400 - RNA, 19 nt, Homo sapiens
caucaucaaucaucucuca

SEQ ID NO: 1459401 - RNA, 19 nt, Homo sapiens
caacaucucucuggaaagg

SEQ ID NO: 1459402 - RNA, 19 nt, Homo sapiens
ggcuggacaucuacaguua

SEQ ID NO: 1459403 - RNA, 19 nt, Homo sapiens
gaaagccucacuucaaugu

SEQ ID NO: 1459404 - RNA, 19 nt, Homo sapiens
uaaagcccaucaucaauca

SEQ ID NO: 1459405 - RNA, 19 nt, Homo sapiens
aaacauuugugccgccuaa

SEQ ID NO: 1459406 - RNA, 19 nt, Homo sapiens
auaacacgcucuuacaauu

SEQ ID NO: 1459407 - RNA, 19 nt, Homo sapiens
gauacuaaguucugugaag

SEQ ID NO: 1459408 - RNA, 19 nt, Homo sapiens
gguaaucaaaccauucuaa

SEQ ID NO: 1459409 - RNA, 19 nt, Homo sapiens
uaacacgcucuuacaauuu

SEQ ID NO: 1459410 - RNA, 19 nt, Homo sapiens
gcgcugcccugucuucaug

SEQ ID NO: 1459411 - RNA, 19 nt, Homo sapiens
cugcagaguuaacccuuua

SEQ ID NO: 1459412 - RNA, 19 nt, Homo sapiens
gggccaaugucaauuacuu

SEQ ID NO: 1459413 - RNA, 19 nt, Homo sapiens
ugacacuccuggcaauauu

SEQ ID NO: 1459414 - RNA, 19 nt, Homo sapiens
aagaaagccucacuucaau

SEQ ID NO: 1459415 - RNA, 19 nt, Homo sapiens
aaauaaagcccaucaucaa

SEQ ID NO: 1459416 - RNA, 19 nt, Homo sapiens
ucauagugcugaauuaagu

SEQ ID NO: 1459417 - RNA, 19 nt, Homo sapiens
caucaaucaucucucacua

SEQ ID NO: 1459418 - RNA, 19 nt, Homo sapiens
guugaaagcugugcuccaa

SEQ ID NO: 1459419 - RNA, 19 nt, Homo sapiens
agaguuaacccuuuacauu

SEQ ID NO: 1459420 - RNA, 19 nt, Homo sapiens
gaucagagaauuaacaaac

SEQ ID NO: 1459421 - RNA, 19 nt, Homo sapiens
gaaacagcccuucauuugg

SEQ ID NO: 1459422 - RNA, 19 nt, Homo sapiens
cagaaacagcccuucauuu

SEQ ID NO: 1459423 - RNA, 19 nt, Homo sapiens
aaacagaugugacccuuuu

SEQ ID NO: 1459424 - RNA, 19 nt, Homo sapiens
caugucaacguaacuauaa

SEQ ID NO: 1459425 - RNA, 19 nt, Homo sapiens
gauggacaaugauuugaca

SEQ ID NO: 1459426 - RNA, 19 nt, Homo sapiens
ggaaagguuguucgaguga

SEQ ID NO: 1459427 - RNA, 19 nt, Homo sapiens
aauacacucugaaagauga

SEQ ID NO: 1459428 - RNA, 19 nt, Homo sapiens
gcaugggacgguuacauuu

SEQ ID NO: 1459429 - RNA, 19 nt, Homo sapiens
ucuguuggauggacaauga

SEQ ID NO: 1459430 - RNA, 19 nt, Homo sapiens
gcuuauugaucuguucuaa

SEQ ID NO: 1459431 - RNA, 19 nt, Homo sapiens
gcagcuaucaaccgacuuu

SEQ ID NO: 1459432 - RNA, 19 nt, Homo sapiens
ggacaucuacaguuaucaa

SEQ ID NO: 1459433 - RNA, 19 nt, Homo sapiens
aagcuacacccaaacaaua

SEQ ID NO: 1459434 - RNA, 19 nt, Homo sapiens
gcuaucaaccgacuuuguu

SEQ ID NO: 1459435 - RNA, 19 nt, Homo sapiens
ugucauggcugcaacaucu

SEQ ID NO: 1459436 - RNA, 19 nt, Homo sapiens
cauuaggacuguauaccuu

SEQ ID NO: 1459437 - RNA, 19 nt, Homo sapiens
acuaugagcugaucagucu

SEQ ID NO: 1459438 - RNA, 19 nt, Homo sapiens
acagugaccucucuucagu

SEQ ID NO: 1459439 - RNA, 19 nt, Homo sapiens
cauaaagauccagacauua

SEQ ID NO: 1459440 - RNA, 19 nt, Homo sapiens
caaacaauacaacaccaaa

SEQ ID NO: 1459441 - RNA, 19 nt, Homo sapiens
caaagauacuaaguucugu

SEQ ID NO: 1459442 - RNA, 19 nt, Homo sapiens
ggaugcugcugaacuaugg

SEQ ID NO: 1459443 - RNA, 19 nt, Homo sapiens
aauuacuucugcagaguua

SEQ ID NO: 1459444 - RNA, 19 nt, Homo sapiens
ucacaaacaacacauaaag

SEQ ID NO: 1459445 - RNA, 19 nt, Homo sapiens
gaauuaagucuucacaaac

SEQ ID NO: 1459446 - RNA, 19 nt, Homo sapiens
cuacacagccucucaacug

SEQ ID NO: 1459447 - RNA, 19 nt, Homo sapiens
uuucaacaauggcaguuaa

SEQ ID NO: 1459448 - RNA, 19 nt, Homo sapiens
gccuaaagauccggaaaug

SEQ ID NO: 1459449 - RNA, 19 nt, Homo sapiens
ugcaacaucucucuggaaa

SEQ ID NO: 1459450 - RNA, 19 nt, Homo sapiens
gaacuauggguaugacaca

SEQ ID NO: 1459451 - RNA, 19 nt, Homo sapiens
ccuaaagaacagaugaaua

SEQ ID NO: 1459452 - RNA, 19 nt, Homo sapiens
acagucauauuacauguca

SEQ ID NO: 1459453 - RNA, 19 nt, Homo sapiens
ccaaauaaagcccaucauc

SEQ ID NO: 1459454 - RNA, 19 nt, Homo sapiens
aagccagcauucaaacuaa

SEQ ID NO: 1459455 - RNA, 19 nt, Homo sapiens
cuaaagauccggaaaugca

SEQ ID NO: 1459456 - RNA, 19 nt, Homo sapiens
ucaaagauacuaaguucug

SEQ ID NO: 1459457 - RNA, 19 nt, Homo sapiens
gaccaacaaccaaauaaag

SEQ ID NO: 1459458 - RNA, 19 nt, Homo sapiens
gcucuaaagauacugauuc

SEQ ID NO: 1459459 - RNA, 19 nt, Homo sapiens
cagccucgccuaucaagaa

SEQ ID NO: 1459460 - RNA, 19 nt, Homo sapiens
aaagccagcauucaaacua

SEQ ID NO: 1459461 - RNA, 19 nt, Homo sapiens
ucggaucuguucaaaguug

SEQ ID NO: 1459462 - RNA, 19 nt, Homo sapiens
gagcucugccuaaucaaga

SEQ ID NO: 1459463 - RNA, 19 nt, Homo sapiens
acuaaguucugugaaguaa

SEQ ID NO: 1459464 - RNA, 19 nt, Homo sapiens
caucagcacugcaauacac

SEQ ID NO: 1459465 - RNA, 19 nt, Homo sapiens
gguuaacugccuccagaua

SEQ ID NO: 1459466 - RNA, 19 nt, Homo sapiens
gaaaucugccuccaucaua

SEQ ID NO: 1459467 - RNA, 19 nt, Homo sapiens
gaagcaggcucucaaucaa

SEQ ID NO: 1459468 - RNA, 19 nt, Homo sapiens
gaccugaccucacaagaug

SEQ ID NO: 1459469 - RNA, 19 nt, Homo sapiens
ggauauuccucccauguug

SEQ ID NO: 1459470 - RNA, 19 nt, Homo sapiens
gcgcuuggcugcuucuuau

SEQ ID NO: 1459471 - RNA, 19 nt, Homo sapiens
gacaacgacuccuauacuu

SEQ ID NO: 1459472 - RNA, 19 nt, Homo sapiens
gcuaauaucuaccuuccau

SEQ ID NO: 1459473 - RNA, 19 nt, Homo sapiens
caucaaacauagcuucaug

SEQ ID NO: 1459474 - RNA, 19 nt, Homo sapiens
ucacguagcuggagagcau

SEQ ID NO: 1459475 - RNA, 19 nt, Homo sapiens
caacgacuccuauacuuug

SEQ ID NO: 1459476 - RNA, 19 nt, Homo sapiens
gggcagacccugacuacaa

SEQ ID NO: 1459477 - RNA, 19 nt, Homo sapiens
gaguauauccagcuguuaa

SEQ ID NO: 1459478 - RNA, 19 nt, Homo sapiens
aaaucugccuccaucauaa

SEQ ID NO: 1459479 - RNA, 19 nt, Homo sapiens
cgucaaagcuaaacuacca

SEQ ID NO: 1459480 - RNA, 19 nt, Homo sapiens
cagaguauauccagcuguu

SEQ ID NO: 1459481 - RNA, 19 nt, Homo sapiens
caacgucaaagcuaaacua

SEQ ID NO: 1459482 - RNA, 19 nt, Homo sapiens
uuacaaacguuucaucaac

SEQ ID NO: 1459483 - RNA, 19 nt, Homo sapiens
ggacaucaccaagaucuuc

SEQ ID NO: 1459484 - RNA, 19 nt, Homo sapiens
gcacugaccagggccuauu

SEQ ID NO: 1459485 - RNA, 19 nt, Homo sapiens
ugauaaaggcauugcauug

SEQ ID NO: 1459486 - RNA, 19 nt, Homo sapiens
ucauggacaucaccaagau

SEQ ID NO: 1459487 - RNA, 19 nt, Homo sapiens
ucaaucaagcaguguauga

SEQ ID NO: 1459488 - RNA, 19 nt, Homo sapiens
acaagaugauaaaggcauu

SEQ ID NO: 1459489 - RNA, 19 nt, Homo sapiens
agaagcaggcucucaauca

SEQ ID NO: 1459490 - RNA, 19 nt, Homo sapiens
uacaaacguuucaucaaca

SEQ ID NO: 1459491 - RNA, 19 nt, Homo sapiens
aacaccaacuguaaucuug

SEQ ID NO: 1459492 - RNA, 19 nt, Homo sapiens
gauauuccucccauguuga

SEQ ID NO: 1459493 - RNA, 19 nt, Homo sapiens
agucugggcaucaaacaua

SEQ ID NO: 1459494 - RNA, 19 nt, Homo sapiens
uuacagccucauccacuua

SEQ ID NO: 1459495 - RNA, 19 nt, Homo sapiens
gaccucacaagaugauaaa

SEQ ID NO: 1459496 - RNA, 19 nt, Homo sapiens
acgggcaccuggacuguuu

SEQ ID NO: 1459497 - RNA, 19 nt, Homo sapiens
gcacagacgccacuuuuca

SEQ ID NO: 1459498 - RNA, 19 nt, Homo sapiens
uaucacagguccguuuagu

SEQ ID NO: 1459499 - RNA, 19 nt, Homo sapiens
acaacgacuccuauacuuu

SEQ ID NO: 1459500 - RNA, 19 nt, Homo sapiens
ucaaccagcuggauauucc

SEQ ID NO: 1459501 - RNA, 19 nt, Homo sapiens
gccaucaaccagcuggaua

SEQ ID NO: 1459502 - RNA, 19 nt, Homo sapiens
gauaaaggcauugcauugc

SEQ ID NO: 1459503 - RNA, 19 nt, Homo sapiens
gaugauaaaggcauugcau

SEQ ID NO: 1459504 - RNA, 19 nt, Homo sapiens
gcacccuccuugaaaucug

SEQ ID NO: 1459505 - RNA, 19 nt, Homo sapiens
aggccaacgucaaagcuaa

SEQ ID NO: 1459506 - RNA, 19 nt, Homo sapiens
ugaccucacaagaugauaa

SEQ ID NO: 1459507 - RNA, 19 nt, Homo sapiens
aaacaccaacuguaaucuu

SEQ ID NO: 1459508 - RNA, 19 nt, Homo sapiens
cacggucacuucuaucaca

SEQ ID NO: 1459509 - RNA, 19 nt, Homo sapiens
ggcagacccugacuacaac

SEQ ID NO: 1459510 - RNA, 19 nt, Homo sapiens
gugcagaggccaacgucaa

SEQ ID NO: 1459511 - RNA, 19 nt, Homo sapiens
ccacuugagcuguuugcaa

SEQ ID NO: 1459512 - RNA, 19 nt, Homo sapiens
ugacaacgacuccuauacu

SEQ ID NO: 1459513 - RNA, 19 nt, Homo sapiens
uuccaucucucucccuuga

SEQ ID NO: 1459514 - RNA, 19 nt, Homo sapiens
cauguugauuagcuaccua

SEQ ID NO: 1459515 - RNA, 19 nt, Homo sapiens
gcauugcauugcugcuaca

SEQ ID NO: 1459516 - RNA, 19 nt, Homo sapiens
uaugacaacgacuccuaua

SEQ ID NO: 1459517 - RNA, 19 nt, Homo sapiens
ggaggaggacacugacaca

SEQ ID NO: 1459518 - RNA, 19 nt, Homo sapiens
gaggccaacgucaaagcua

SEQ ID NO: 1459519 - RNA, 19 nt, Homo sapiens
guuacaaacguuucaucaa

SEQ ID NO: 1459520 - RNA, 19 nt, Homo sapiens
ccuaaaacaccaacuguaa

SEQ ID NO: 1459521 - RNA, 19 nt, Homo sapiens
acuccacggucacuucuau

SEQ ID NO: 1459522 - RNA, 19 nt, Homo sapiens
ugaccugaccucacaagau

SEQ ID NO: 1459523 - RNA, 19 nt, Homo sapiens
gcgccaggagcguuacaaa

SEQ ID NO: 1459524 - RNA, 19 nt, Homo sapiens
uaauaucuaccuuccaucu

SEQ ID NO: 1459525 - RNA, 19 nt, Homo sapiens
acacugacacagaggagaa

SEQ ID NO: 1459526 - RNA, 19 nt, Homo sapiens
ugauggugcuguugcuauc

SEQ ID NO: 1459527 - RNA, 19 nt, Homo sapiens
uauggccacuugagcuguu

SEQ ID NO: 1459528 - RNA, 19 nt, Homo sapiens
ccaucaaccagcuggauau

SEQ ID NO: 1459529 - RNA, 19 nt, Homo sapiens
ucuaucacagguccguuua

SEQ ID NO: 1459530 - RNA, 19 nt, Homo sapiens
guaugacaacgacuccuau

SEQ ID NO: 1459531 - RNA, 19 nt, Homo sapiens
ugaaaucugccuccaucau

SEQ ID NO: 1459532 - RNA, 19 nt, Homo sapiens
caccaacuguaaucuugca

SEQ ID NO: 1459533 - RNA, 19 nt, Homo sapiens
auugugagccagaguauau

SEQ ID NO: 1459534 - RNA, 19 nt, Homo sapiens
ggccaacgucaaagcuaaa

SEQ ID NO: 1459535 - RNA, 19 nt, Homo sapiens
caucaaccagcuggauauu

SEQ ID NO: 1459536 - RNA, 19 nt, Homo sapiens
acaaacguuucaucaacag

SEQ ID NO: 1459537 - RNA, 19 nt, Homo sapiens
auaauugugagccagagua

SEQ ID NO: 1459538 - RNA, 19 nt, Homo sapiens
uagcaucuacaacaacugu

SEQ ID NO: 1459539 - RNA, 19 nt, Homo sapiens
ggacuguguacgugugcuu

SEQ ID NO: 1459540 - RNA, 19 nt, Homo sapiens
auaaaggcauugcauugcu

SEQ ID NO: 1459541 - RNA, 19 nt, Homo sapiens
gugauggugcuguugcuau

SEQ ID NO: 1459542 - RNA, 19 nt, Homo sapiens
uguaugacaacgacuccua

SEQ ID NO: 1459543 - RNA, 19 nt, Homo sapiens
gaugagaccucuauuaaua

SEQ ID NO: 1459544 - RNA, 19 nt, Homo sapiens
gaacaucacucaaugaaag

SEQ ID NO: 1459545 - RNA, 19 nt, Homo sapiens
ggaaugacacugaagauuu

SEQ ID NO: 1459546 - RNA, 19 nt, Homo sapiens
gaaugacacugaagauuuc

SEQ ID NO: 1459547 - RNA, 19 nt, Homo sapiens
guaauaccauguuguaaga

SEQ ID NO: 1459548 - RNA, 19 nt, Homo sapiens
auagagagcuugucagauu

SEQ ID NO: 1459549 - RNA, 19 nt, Homo sapiens
gaagaaacgugggagaugu

SEQ ID NO: 1459550 - RNA, 19 nt, Homo sapiens
gcaguaauaccauguugua

SEQ ID NO: 1459551 - RNA, 19 nt, Homo sapiens
gcaagaagccagagagaga

SEQ ID NO: 1459552 - RNA, 19 nt, Homo sapiens
gauagggaaucaucaucua

SEQ ID NO: 1459553 - RNA, 19 nt, Homo sapiens
caggagauguggguauuua

SEQ ID NO: 1459554 - RNA, 19 nt, Homo sapiens
gaggagagcugggagucua

SEQ ID NO: 1459555 - RNA, 19 nt, Homo sapiens
uaaaugcaguucuuuggaa

SEQ ID NO: 1459556 - RNA, 19 nt, Homo sapiens
gaagauucgucccuuguca

SEQ ID NO: 1459557 - RNA, 19 nt, Homo sapiens
aaacauccaucgaaccaaa

SEQ ID NO: 1459558 - RNA, 19 nt, Homo sapiens
gaacucaguauguuaaaug

SEQ ID NO: 1459559 - RNA, 19 nt, Homo sapiens
gauauugaccucagugauu

SEQ ID NO: 1459560 - RNA, 19 nt, Homo sapiens
gaaaguugauagagagcuu

SEQ ID NO: 1459561 - RNA, 19 nt, Homo sapiens
aagcagagcucaagaaacu

SEQ ID NO: 1459562 - RNA, 19 nt, Homo sapiens
ccacaugucauugaaauuu

SEQ ID NO: 1459563 - RNA, 19 nt, Homo sapiens
caagaguuaucagggaaua

SEQ ID NO: 1459564 - RNA, 19 nt, Homo sapiens
ggaaucaucaucuauggaa

SEQ ID NO: 1459565 - RNA, 19 nt, Homo sapiens
ggcagaccauuccuuagua

SEQ ID NO: 1459566 - RNA, 19 nt, Homo sapiens
gaugugaauuccaagaguu

SEQ ID NO: 1459567 - RNA, 19 nt, Homo sapiens
gaaccuagaucugauuacu

SEQ ID NO: 1459568 - RNA, 19 nt, Homo sapiens
gcagaccauuccuuaguau

SEQ ID NO: 1459569 - RNA, 19 nt, Homo sapiens
ggucacacuuccaagauau

SEQ ID NO: 1459570 - RNA, 19 nt, Homo sapiens
gcugaugagaccucuauua

SEQ ID NO: 1459571 - RNA, 19 nt, Homo sapiens
guauuuagacuccaaaguu

SEQ ID NO: 1459572 - RNA, 19 nt, Homo sapiens
ggacagggcaagucauguu

SEQ ID NO: 1459573 - RNA, 19 nt, Homo sapiens
ccaagaauuucguacugaa

SEQ ID NO: 1459574 - RNA, 19 nt, Homo sapiens
aaagauugcugguaguaau

SEQ ID NO: 1459575 - RNA, 19 nt, Homo sapiens
guuguaagagggaacauua

SEQ ID NO: 1459576 - RNA, 19 nt, Homo sapiens
gagcugggagucuauguuu

SEQ ID NO: 1459577 - RNA, 19 nt, Homo sapiens
ucaugaaguuccugauauu

SEQ ID NO: 1459578 - RNA, 19 nt, Homo sapiens
gaguauagaauuuggugua

SEQ ID NO: 1459579 - RNA, 19 nt, Homo sapiens
aaacagaagagcaagauga

SEQ ID NO: 1459580 - RNA, 19 nt, Homo sapiens
acacgaaguuucucaaagu

SEQ ID NO: 1459581 - RNA, 19 nt, Homo sapiens
cgugaugcguuggguauua

SEQ ID NO: 1459582 - RNA, 19 nt, Homo sapiens
agauugugcuuccuccuua

SEQ ID NO: 1459583 - RNA, 19 nt, Homo sapiens
caaagaggcagaacagugu

SEQ ID NO: 1459584 - RNA, 19 nt, Homo sapiens
gggucacacuuccaagaua

SEQ ID NO: 1459585 - RNA, 19 nt, Homo sapiens
caucaucuauggaaacauc

SEQ ID NO: 1459586 - RNA, 19 nt, Homo sapiens
ggacugacuggguauagaa

SEQ ID NO: 1459587 - RNA, 19 nt, Homo sapiens
ccucagugauugugaauuc

SEQ ID NO: 1459588 - RNA, 19 nt, Homo sapiens
gcugggagucuauguuuaa

SEQ ID NO: 1459589 - RNA, 19 nt, Homo sapiens
acaggaaaguugauagaga

SEQ ID NO: 1459590 - RNA, 19 nt, Homo sapiens
uuaaauggguggaugauac

SEQ ID NO: 1459591 - RNA, 19 nt, Homo sapiens
gggagucuauguuuaacga

SEQ ID NO: 1459592 - RNA, 19 nt, Homo sapiens
uuccauagccuucagauaa

SEQ ID NO: 1459593 - RNA, 19 nt, Homo sapiens
gaaucaucaucuauggaaa

SEQ ID NO: 1459594 - RNA, 19 nt, Homo sapiens
ggaagaaacgugggagaug

SEQ ID NO: 1459595 - RNA, 19 nt, Homo sapiens
gagaagcagagcucaagaa

SEQ ID NO: 1459596 - RNA, 19 nt, Homo sapiens
ggagauguggguauuuaga

SEQ ID NO: 1459597 - RNA, 19 nt, Homo sapiens
ucacaaagcagaguaauac

SEQ ID NO: 1459598 - RNA, 19 nt, Homo sapiens
gacagggcaagucauguua

SEQ ID NO: 1459599 - RNA, 19 nt, Homo sapiens
ucaaugaaagggauaauuc

SEQ ID NO: 1459600 - RNA, 19 nt, Homo sapiens
gccagaagguuagucauca

SEQ ID NO: 1459601 - RNA, 19 nt, Homo sapiens
gcauugaccuggguaguac

SEQ ID NO: 1459602 - RNA, 19 nt, Homo sapiens
cugaugagaccucuauuaa

SEQ ID NO: 1459603 - RNA, 19 nt, Homo sapiens
cuuaguaucucacaaagca

SEQ ID NO: 1459604 - RNA, 19 nt, Homo sapiens
gccaucagcuaggaagaaa

SEQ ID NO: 1459605 - RNA, 19 nt, Homo sapiens
gaaagggauaauuccauga

SEQ ID NO: 1459606 - RNA, 19 nt, Homo sapiens
ggaaacauccaucgaacca

SEQ ID NO: 1459607 - RNA, 19 nt, Homo sapiens
ccgcaaguaugggagauuu

SEQ ID NO: 1459608 - RNA, 19 nt, Homo sapiens
gagagcaguuaguacaaag

SEQ ID NO: 1459609 - RNA, 19 nt, Homo sapiens
gugaugcguuggguauuaa

SEQ ID NO: 1459610 - RNA, 19 nt, Homo sapiens
ugaauucccacaugucauu

SEQ ID NO: 1459611 - RNA, 19 nt, Homo sapiens
acuaagaacugccgaagag

SEQ ID NO: 1459612 - RNA, 19 nt, Homo sapiens
guacaaagaggcagaacag

SEQ ID NO: 1459613 - RNA, 19 nt, Homo sapiens
agaggcagaccauuccuua

SEQ ID NO: 1459614 - RNA, 19 nt, Homo sapiens
ccagagcucuauguacaug

SEQ ID NO: 1459615 - RNA, 19 nt, Homo sapiens
ggauccacgucuucuacaa

SEQ ID NO: 1459616 - RNA, 19 nt, Homo sapiens
gggaauuacugccauugag

SEQ ID NO: 1459617 - RNA, 19 nt, Homo sapiens
acuccaaaguuuauacuga

SEQ ID NO: 1459618 - RNA, 19 nt, Homo sapiens
aaacagaacagaggauuca

SEQ ID NO: 1459619 - RNA, 19 nt, Homo sapiens
gagcaaaaccgaacgagaa

SEQ ID NO: 1459620 - RNA, 19 nt, Homo sapiens
ccaggaaccuagaucugau

SEQ ID NO: 1459621 - RNA, 19 nt, Homo sapiens
ggauucaaaccgcaaguau

SEQ ID NO: 1459622 - RNA, 19 nt, Homo sapiens
ugagaccucuauuaauaca

SEQ ID NO: 1459623 - RNA, 19 nt, Homo sapiens
uagagagcuugucagauug

SEQ ID NO: 1459624 - RNA, 19 nt, Homo sapiens
ugauacacaugcccuagga

SEQ ID NO: 1459625 - RNA, 19 nt, Homo sapiens
aacagugucugguuuacuu

SEQ ID NO: 1459626 - RNA, 19 nt, Homo sapiens
gcaaguaugggagauuuag

SEQ ID NO: 1459627 - RNA, 19 nt, Homo sapiens
gggaaugacacugaagauu

SEQ ID NO: 1459628 - RNA, 19 nt, Homo sapiens
cagaugugcauguuaaaga

SEQ ID NO: 1459629 - RNA, 19 nt, Homo sapiens
cacgaaguuucucaaaguu

SEQ ID NO: 1459630 - RNA, 19 nt, Homo sapiens
ccaauuacagcucgugaug

SEQ ID NO: 1459631 - RNA, 19 nt, Homo sapiens
guauucuccaguccaauua

SEQ ID NO: 1459632 - RNA, 19 nt, Homo sapiens
gaacauuaaagcccauuuu

SEQ ID NO: 1459633 - RNA, 19 nt, Homo sapiens
ugggagaugugaauuccaa

SEQ ID NO: 1459634 - RNA, 19 nt, Homo sapiens
uuacuuggcauacacagaa

SEQ ID NO: 1459635 - RNA, 19 nt, Homo sapiens
ggagaugugaauuccaaga

SEQ ID NO: 1459636 - RNA, 19 nt, Homo sapiens
gcuuccuccuuaccuauaa

SEQ ID NO: 1459637 - RNA, 19 nt, Homo sapiens
gcauugcacgaacuaagaa

SEQ ID NO: 1459638 - RNA, 19 nt, Homo sapiens
uguaagagggaacauuaaa

SEQ ID NO: 1459639 - RNA, 19 nt, Homo sapiens
uacaggagauguggguauu

SEQ ID NO: 1459640 - RNA, 19 nt, Homo sapiens
ucagauauuuauggugaga

SEQ ID NO: 1459641 - RNA, 19 nt, Homo sapiens
uuccagagcucuauguaca

SEQ ID NO: 1459642 - RNA, 19 nt, Homo sapiens
cagcagcccuagccagaag

SEQ ID NO: 1459643 - RNA, 19 nt, Homo sapiens
gaaauuacaucgagccuuu

SEQ ID NO: 1459644 - RNA, 19 nt, Homo sapiens
ggaaguauguggcaugauu

SEQ ID NO: 1459645 - RNA, 19 nt, Homo sapiens
gaaggaauguagcuuuaaa

SEQ ID NO: 1459646 - RNA, 19 nt, Homo sapiens
gaugggaacuguauucuug

SEQ ID NO: 1459647 - RNA, 19 nt, Homo sapiens
gcacaguaccuaaugaaua

SEQ ID NO: 1459648 - RNA, 19 nt, Homo sapiens
uaacugacuugaauucuga

SEQ ID NO: 1459649 - RNA, 19 nt, Homo sapiens
aaagauauauggcagugua

SEQ ID NO: 1459650 - RNA, 19 nt, Homo sapiens
cgaaggcucuguagucuga

SEQ ID NO: 1459651 - RNA, 19 nt, Homo sapiens
ggaagacuauacugaguug

SEQ ID NO: 1459652 - RNA, 19 nt, Homo sapiens
guaacuagcugcagugaag

SEQ ID NO: 1459653 - RNA, 19 nt, Homo sapiens
ggaauuucuugcacacuuu

SEQ ID NO: 1459654 - RNA, 19 nt, Homo sapiens
gcugaaggaugaaggcuuu

SEQ ID NO: 1459655 - RNA, 19 nt, Homo sapiens
gaagauuggacccagaaua

SEQ ID NO: 1459656 - RNA, 19 nt, Homo sapiens
ccagauauauucuuagaca

SEQ ID NO: 1459657 - RNA, 19 nt, Homo sapiens
ggaaucacauugcuaacau

SEQ ID NO: 1459658 - RNA, 19 nt, Homo sapiens
cacaguaccuaaugaauau

SEQ ID NO: 1459659 - RNA, 19 nt, Homo sapiens
caucuuggcugcccaugaa

SEQ ID NO: 1459660 - RNA, 19 nt, Homo sapiens
ugagaaacgugacugagaa

SEQ ID NO: 1459661 - RNA, 19 nt, Homo sapiens
uggaaggaauguagcuuua

SEQ ID NO: 1459662 - RNA, 19 nt, Homo sapiens
ggaaauggcagguccuaau

SEQ ID NO: 1459663 - RNA, 19 nt, Homo sapiens
gauggaaucacauugcuaa

SEQ ID NO: 1459664 - RNA, 19 nt, Homo sapiens
gcaauaagcaccgacuuga

SEQ ID NO: 1459665 - RNA, 19 nt, Homo sapiens
gagcauaucagcagaguag

SEQ ID NO: 1459666 - RNA, 19 nt, Homo sapiens
gaaucacauugcuaacauu

SEQ ID NO: 1459667 - RNA, 19 nt, Homo sapiens
caucgagccuuugccauuu

SEQ ID NO: 1459668 - RNA, 19 nt, Homo sapiens
ggauuugguuucccauguu

SEQ ID NO: 1459669 - RNA, 19 nt, Homo sapiens
uagaagagaugggcuacaa

SEQ ID NO: 1459670 - RNA, 19 nt, Homo sapiens
gaagagaugggcuacaaca

SEQ ID NO: 1459671 - RNA, 19 nt, Homo sapiens
gagaagcauuggaaggaau

SEQ ID NO: 1459672 - RNA, 19 nt, Homo sapiens
aagcacaggucaauacuuc

SEQ ID NO: 1459673 - RNA, 19 nt, Homo sapiens
gcaugauucugugcuauau

SEQ ID NO: 1459674 - RNA, 19 nt, Homo sapiens
gcaccgacuugauggaauc

SEQ ID NO: 1459675 - RNA, 19 nt, Homo sapiens
caauguuaauggcacagua

SEQ ID NO: 1459676 - RNA, 19 nt, Homo sapiens
gaauuucuugcacacuuua

SEQ ID NO: 1459677 - RNA, 19 nt, Homo sapiens
ugucagauccugugaagaa

SEQ ID NO: 1459678 - RNA, 19 nt, Homo sapiens
uggaguggcuuugguauga

SEQ ID NO: 1459679 - RNA, 19 nt, Homo sapiens
gaaauggcagguccuaauc

SEQ ID NO: 1459680 - RNA, 19 nt, Homo sapiens
ggaaggaauguagcuuuaa

SEQ ID NO: 1459681 - RNA, 19 nt, Homo sapiens
caaccucuuuggaaucuuc

SEQ ID NO: 1459682 - RNA, 19 nt, Homo sapiens
ggagauuacauguuuagug

SEQ ID NO: 1459683 - RNA, 19 nt, Homo sapiens
acucccagauauauucuua

SEQ ID NO: 1459684 - RNA, 19 nt, Homo sapiens
ugacuggcguucacacaug

SEQ ID NO: 1459685 - RNA, 19 nt, Homo sapiens
acccauaacugacuugaau

SEQ ID NO: 1459686 - RNA, 19 nt, Homo sapiens
acacagucguccuaacuau

SEQ ID NO: 1459687 - RNA, 19 nt, Homo sapiens
ggagagcaaggauuugguu

SEQ ID NO: 1459688 - RNA, 19 nt, Homo sapiens
ugacugagaagcauuggaa

SEQ ID NO: 1459689 - RNA, 19 nt, Homo sapiens
agacagcguuccuagaauc

SEQ ID NO: 1459690 - RNA, 19 nt, Homo sapiens
gguuucccauguucucuuu

SEQ ID NO: 1459691 - RNA, 19 nt, Homo sapiens
ggugucagauccugugaag

SEQ ID NO: 1459692 - RNA, 19 nt, Homo sapiens
uuagacagcguuccuagaa

SEQ ID NO: 1459693 - RNA, 19 nt, Homo sapiens
ugagaagcauuggaaggaa

SEQ ID NO: 1459694 - RNA, 19 nt, Homo sapiens
gaaacgugacugagaagca

SEQ ID NO: 1459695 - RNA, 19 nt, Homo sapiens
uccuaacuaugcugaauuu

SEQ ID NO: 1459696 - RNA, 19 nt, Homo sapiens
gagcaaggauuugguuucc

SEQ ID NO: 1459697 - RNA, 19 nt, Homo sapiens
uggcugcccaugaacauua

SEQ ID NO: 1459698 - RNA, 19 nt, Homo sapiens
guucucaaccucuuuggaa

SEQ ID NO: 1459699 - RNA, 19 nt, Homo sapiens
gcacaggucaauacuucug

SEQ ID NO: 1459700 - RNA, 19 nt, Homo sapiens
ggcaugauucugugcuaua

SEQ ID NO: 1459701 - RNA, 19 nt, Homo sapiens
ucccagauauauucuuaga

SEQ ID NO: 1459702 - RNA, 19 nt, Homo sapiens
gauuugguuucccauguuc

SEQ ID NO: 1459703 - RNA, 19 nt, Homo sapiens
ucacauugcuaacauugac

SEQ ID NO: 1459704 - RNA, 19 nt, Homo sapiens
uggaauuucuugcacacuu

SEQ ID NO: 1459705 - RNA, 19 nt, Homo sapiens
cagaauacuggaagacuau

SEQ ID NO: 1459706 - RNA, 19 nt, Homo sapiens
aauaagcaccgacuugaug

SEQ ID NO: 1459707 - RNA, 19 nt, Homo sapiens
guuaauggcacaguaccua

SEQ ID NO: 1459708 - RNA, 19 nt, Homo sapiens
guacuggaaagauauaugg

SEQ ID NO: 1459709 - RNA, 19 nt, Homo sapiens
gcuccugguucuucuucuu

SEQ ID NO: 1459710 - RNA, 19 nt, Homo sapiens
gaaguauguggcaugauuc

SEQ ID NO: 1459711 - RNA, 19 nt, Homo sapiens
uugcuaacauugacugaau

SEQ ID NO: 1459712 - RNA, 19 nt, Homo sapiens
ugacugugacggacccaua

SEQ ID NO: 1459713 - RNA, 19 nt, Homo sapiens
gagagcaaggauuugguuu

SEQ ID NO: 1459714 - RNA, 19 nt, Homo sapiens
aaacgugacugagaagcau

SEQ ID NO: 1459715 - RNA, 19 nt, Homo sapiens
ucacaagcacaggucaaua

SEQ ID NO: 1459716 - RNA, 19 nt, Homo sapiens
guauguggcaugauucugu

SEQ ID NO: 1459717 - RNA, 19 nt, Homo sapiens
cuguguggcugaaggauga

SEQ ID NO: 1459718 - RNA, 19 nt, Homo sapiens
aguaggagagcaaggauuu

SEQ ID NO: 1459719 - RNA, 19 nt, Homo sapiens
gcauaucagcagaguagga

SEQ ID NO: 1459720 - RNA, 19 nt, Homo sapiens
cccaugaacauuauucuau

SEQ ID NO: 1459721 - RNA, 19 nt, Homo sapiens
gcuaacauugacugaauau

SEQ ID NO: 1459722 - RNA, 19 nt, Homo sapiens
acaccaagaagcuggaauu

SEQ ID NO: 1459723 - RNA, 19 nt, Homo sapiens
cagauccugugaagaaugg

SEQ ID NO: 1459724 - RNA, 19 nt, Homo sapiens
caguguaugggagaaauua

SEQ ID NO: 1459725 - RNA, 19 nt, Homo sapiens
ccaccacucccagauauau

SEQ ID NO: 1459726 - RNA, 19 nt, Homo sapiens
aagacuauacugaguugua

SEQ ID NO: 1459727 - RNA, 19 nt, Homo sapiens
ugccugacaugcagaccua

SEQ ID NO: 1459728 - RNA, 19 nt, Homo sapiens
gcccaugaacauuauucua

SEQ ID NO: 1459729 - RNA, 19 nt, Homo sapiens
ugacuugaauucugaucag

SEQ ID NO: 1459730 - RNA, 19 nt, Homo sapiens
ccuaaucaacucugcauuc

SEQ ID NO: 1459731 - RNA, 19 nt, Homo sapiens
uuuggaaucuucuucaucu

SEQ ID NO: 1459732 - RNA, 19 nt, Homo sapiens
gaagcuggaauuucuugca

SEQ ID NO: 1459733 - RNA, 19 nt, Homo sapiens
aauggcagguccuaaucaa

SEQ ID NO: 1459734 - RNA, 19 nt, Homo sapiens
uguggagauuacauguuua

SEQ ID NO: 1459735 - RNA, 19 nt, Homo sapiens
gcaguguaugggagaaauu

SEQ ID NO: 1459736 - RNA, 19 nt, Homo sapiens
ccauaacugacuugaauuc

SEQ ID NO: 1459737 - RNA, 19 nt, Homo sapiens
cuauugauguguuuauugc

SEQ ID NO: 1459738 - RNA, 19 nt, Homo sapiens
guggacauuuuaugcaaua

SEQ ID NO: 1459739 - RNA, 19 nt, Homo sapiens
ccacacagucguccuaacu

SEQ ID NO: 1459740 - RNA, 19 nt, Homo sapiens
gauauauggcaguguaugg

SEQ ID NO: 1459741 - RNA, 19 nt, Homo sapiens
gggcagcggaggaggaaau

SEQ ID NO: 1459742 - RNA, 19 nt, Homo sapiens
gugacggacccauaacuga

SEQ ID NO: 1459743 - RNA, 19 nt, Homo sapiens
ccaaagacgucaucaagaa

SEQ ID NO: 1459744 - RNA, 19 nt, Homo sapiens
gaaaauaacuccacaacug

SEQ ID NO: 1459745 - RNA, 19 nt, Homo sapiens
ggcauuauguuauggauuu

SEQ ID NO: 1459746 - RNA, 19 nt, Homo sapiens
guaggcaaguguaacauaa

SEQ ID NO: 1459747 - RNA, 19 nt, Homo sapiens
gauaaaugguauaccugua

SEQ ID NO: 1459748 - RNA, 19 nt, Homo sapiens
agaaggaccugguguuuau

SEQ ID NO: 1459749 - RNA, 19 nt, Homo sapiens
gaagaaggaccugguguuu

SEQ ID NO: 1459750 - RNA, 19 nt, Homo sapiens
gugcaagucuucaacacua

SEQ ID NO: 1459751 - RNA, 19 nt, Homo sapiens
gugcaaacaugauaaagug

SEQ ID NO: 1459752 - RNA, 19 nt, Homo sapiens
ggucagcacugucgucuuc

SEQ ID NO: 1459753 - RNA, 19 nt, Homo sapiens
cauaaacacugcacacuag

SEQ ID NO: 1459754 - RNA, 19 nt, Homo sapiens
acacuaggcuacaauuuau

SEQ ID NO: 1459755 - RNA, 19 nt, Homo sapiens
gugaaagccuaggacauua

SEQ ID NO: 1459756 - RNA, 19 nt, Homo sapiens
uauaaggcauuuaccauga

SEQ ID NO: 1459757 - RNA, 19 nt, Homo sapiens
gcaaacaugauaaagugua

SEQ ID NO: 1459758 - RNA, 19 nt, Homo sapiens
gcaaguagagguuccaaau

SEQ ID NO: 1459759 - RNA, 19 nt, Homo sapiens
agaagauccugguaaguaa

SEQ ID NO: 1459760 - RNA, 19 nt, Homo sapiens
ugaagaagcgcaagaaguu

SEQ ID NO: 1459761 - RNA, 19 nt, Homo sapiens
aaguagagguuccaaauau

SEQ ID NO: 1459762 - RNA, 19 nt, Homo sapiens
gcauaaacacugcacacua

SEQ ID NO: 1459763 - RNA, 19 nt, Homo sapiens
acagggauuuguucugaua

SEQ ID NO: 1459764 - RNA, 19 nt, Homo sapiens
caaguagagguuccaaaua

SEQ ID NO: 1459765 - RNA, 19 nt, Homo sapiens
guguauaaauggaauguug

SEQ ID NO: 1459766 - RNA, 19 nt, Homo sapiens
ccaagaagauccugguaag

SEQ ID NO: 1459767 - RNA, 19 nt, Homo sapiens
gcaaagucacuaauauuuc

SEQ ID NO: 1459768 - RNA, 19 nt, Homo sapiens
uaaauggaauguugugaag

SEQ ID NO: 1459769 - RNA, 19 nt, Homo sapiens
aagcaucacuuccuucaga

SEQ ID NO: 1459770 - RNA, 19 nt, Homo sapiens
cacacuaggcuacaauuua

SEQ ID NO: 1459771 - RNA, 19 nt, Homo sapiens
caagggagcaaaccugaaa

SEQ ID NO: 1459772 - RNA, 19 nt, Homo sapiens
ggacauuauuguacacuac

SEQ ID NO: 1459773 - RNA, 19 nt, Homo sapiens
gaaagccuaggacauuauu

SEQ ID NO: 1459774 - RNA, 19 nt, Homo sapiens
gcacacuaggcuacaauuu

SEQ ID NO: 1459775 - RNA, 19 nt, Homo sapiens
aagaagauccugguaagua

SEQ ID NO: 1459776 - RNA, 19 nt, Homo sapiens
acgaauccauagacaauuu

SEQ ID NO: 1459777 - RNA, 19 nt, Homo sapiens
ucaucaagguguucaguga

SEQ ID NO: 1459778 - RNA, 19 nt, Homo sapiens
guaacauaauggucaguau

SEQ ID NO: 1459779 - RNA, 19 nt, Homo sapiens
aguagagguuccaaauaua

SEQ ID NO: 1459780 - RNA, 19 nt, Homo sapiens
cuacuggcauuauguuaug

SEQ ID NO: 1459781 - RNA, 19 nt, Homo sapiens
gcacugucgucuucuugga

SEQ ID NO: 1459782 - RNA, 19 nt, Homo sapiens
aaacgaauccauagacaau

SEQ ID NO: 1459783 - RNA, 19 nt, Homo sapiens
agccagagccuccugaaua

SEQ ID NO: 1459784 - RNA, 19 nt, Homo sapiens
uaaguaauguggaccaaac

SEQ ID NO: 1459785 - RNA, 19 nt, Homo sapiens
auuagacacuccugagaua

SEQ ID NO: 1459786 - RNA, 19 nt, Homo sapiens
ccauguggcugucuuugau

SEQ ID NO: 1459787 - RNA, 19 nt, Homo sapiens
cuacacaccuaagcuaugu

SEQ ID NO: 1459788 - RNA, 19 nt, Homo sapiens
ccaaggacagcaagaagaa

SEQ ID NO: 1459789 - RNA, 19 nt, Homo sapiens
ugagugaguacaagaagua

SEQ ID NO: 1459790 - RNA, 19 nt, Homo sapiens
acuguaaacugcauaaaca

SEQ ID NO: 1459791 - RNA, 19 nt, Homo sapiens
gguauagccuguugcuucu

SEQ ID NO: 1459792 - RNA, 19 nt, Homo sapiens
gauuuguucugauaaacga

SEQ ID NO: 1459793 - RNA, 19 nt, Homo sapiens
guaccuuacuuccucuuuc

SEQ ID NO: 1459794 - RNA, 19 nt, Homo sapiens
cugcuuggaucuucugauu

SEQ ID NO: 1459795 - RNA, 19 nt, Homo sapiens
ggaccaaaccauugaugau

SEQ ID NO: 1459796 - RNA, 19 nt, Homo sapiens
gccagagccuccugaauac

SEQ ID NO: 1459797 - RNA, 19 nt, Homo sapiens
cgagcgacgugacacaaga

SEQ ID NO: 1459798 - RNA, 19 nt, Homo sapiens
ccacuacacaccuaagcua

SEQ ID NO: 1459799 - RNA, 19 nt, Homo sapiens
gugccugucuguuuaguuc

SEQ ID NO: 1459800 - RNA, 19 nt, Homo sapiens
gguugaagcagaccaaguu

SEQ ID NO: 1459801 - RNA, 19 nt, Homo sapiens
gaucuucugauuccucuug

SEQ ID NO: 1459802 - RNA, 19 nt, Homo sapiens
gagucugcauccauuaaga

SEQ ID NO: 1459803 - RNA, 19 nt, Homo sapiens
ucaagaugcugacaguaag

SEQ ID NO: 1459804 - RNA, 19 nt, Homo sapiens
gaagaagcgcaagaaguug

SEQ ID NO: 1459805 - RNA, 19 nt, Homo sapiens
caccuaagcuaugugguau

SEQ ID NO: 1459806 - RNA, 19 nt, Homo sapiens
ucugauaaacgaauccaua

SEQ ID NO: 1459807 - RNA, 19 nt, Homo sapiens
guagagguuccaaauauag

SEQ ID NO: 1459808 - RNA, 19 nt, Homo sapiens
gaucuaugccagcuccaaa

SEQ ID NO: 1459809 - RNA, 19 nt, Homo sapiens
gaugaucccuaugccacuu

SEQ ID NO: 1459810 - RNA, 19 nt, Homo sapiens
gccaagaagauccugguaa

SEQ ID NO: 1459811 - RNA, 19 nt, Homo sapiens
ggucaguauuuguguaucu

SEQ ID NO: 1459812 - RNA, 19 nt, Homo sapiens
uguacagcauguuacuaua

SEQ ID NO: 1459813 - RNA, 19 nt, Homo sapiens
cuucuaggcuacaaacaug

SEQ ID NO: 1459814 - RNA, 19 nt, Homo sapiens
caaacaugauaaaguguac

SEQ ID NO: 1459815 - RNA, 19 nt, Homo sapiens
agugagcgaccuuuaauuu

SEQ ID NO: 1459816 - RNA, 19 nt, Homo sapiens
aauggaauguugugaagau

SEQ ID NO: 1459817 - RNA, 19 nt, Homo sapiens
uggaguagagugacaauga

SEQ ID NO: 1459818 - RNA, 19 nt, Homo sapiens
ccuaggacauuauuguaca

SEQ ID NO: 1459819 - RNA, 19 nt, Homo sapiens
gauaaacgaauccauagac

SEQ ID NO: 1459820 - RNA, 19 nt, Homo sapiens
aagaaggaccugguguuua

SEQ ID NO: 1459821 - RNA, 19 nt, Homo sapiens
ggaguagagugacaaugac

SEQ ID NO: 1459822 - RNA, 19 nt, Homo sapiens
guacuguaggcaaguguaa

SEQ ID NO: 1459823 - RNA, 19 nt, Homo sapiens
gcauguuacuauacugagu

SEQ ID NO: 1459824 - RNA, 19 nt, Homo sapiens
acaccuaagcuauguggua

SEQ ID NO: 1459825 - RNA, 19 nt, Homo sapiens
ucacauaacagggauuugu

SEQ ID NO: 1459826 - RNA, 19 nt, Homo sapiens
caaauauagccauguguca

SEQ ID NO: 1459827 - RNA, 19 nt, Homo sapiens
gauacgagaagcaucacuu

SEQ ID NO: 1459828 - RNA, 19 nt, Homo sapiens
gaagauccugguaaguaau

SEQ ID NO: 1459829 - RNA, 19 nt, Homo sapiens
ugugaaagccuaggacauu

SEQ ID NO: 1459830 - RNA, 19 nt, Homo sapiens
guucuggccuucccaaacu

SEQ ID NO: 1459831 - RNA, 19 nt, Homo sapiens
gcuaauggaaaccggacua

SEQ ID NO: 1459832 - RNA, 19 nt, Homo sapiens
ggggaaggccuauauauau

SEQ ID NO: 1459833 - RNA, 19 nt, Homo sapiens
uaaggcauuuaccaugaau

SEQ ID NO: 1459834 - RNA, 19 nt, Homo sapiens
aggcaaguguaacauaaug

SEQ ID NO: 1459835 - RNA, 19 nt, Homo sapiens
gguuauggccgcuaaugga

SEQ ID NO: 1459836 - RNA, 19 nt, Homo sapiens
agaauuaucaggucagauc

SEQ ID NO: 1459837 - RNA, 19 nt, Homo sapiens
aaagaauuaucaggucaga

SEQ ID NO: 1459838 - RNA, 19 nt, Homo sapiens
gaccugguguuuaucuucu

SEQ ID NO: 1459839 - RNA, 19 nt, Homo sapiens
guacagcauguuacuauac

SEQ ID NO: 1459840 - RNA, 19 nt, Homo sapiens
uugcuuaucucaccauugg

SEQ ID NO: 1459841 - RNA, 19 nt, Homo sapiens
ggaccugguguuuaucuuc

SEQ ID NO: 1459842 - RNA, 19 nt, Homo sapiens
gaccaaaccauugaugauc

SEQ ID NO: 1459843 - RNA, 19 nt, Homo sapiens
ccacagggcuugcaaaugg

SEQ ID NO: 1459844 - RNA, 19 nt, Homo sapiens
gagagaagcaugcuccuuu

SEQ ID NO: 1459845 - RNA, 19 nt, Homo sapiens
gcagugagcugugauugug

SEQ ID NO: 1459846 - RNA, 19 nt, Homo sapiens
gaaagcacauuuaaacacu

SEQ ID NO: 1459847 - RNA, 19 nt, Homo sapiens
gcaagugggaggauuguuu

SEQ ID NO: 1459848 - RNA, 19 nt, Homo sapiens
gagcaaacguucagaaagc

SEQ ID NO: 1459849 - RNA, 19 nt, Homo sapiens
aaacaugaguuggugcuuu

SEQ ID NO: 1459850 - RNA, 19 nt, Homo sapiens
guucagaaagcacauuuaa

SEQ ID NO: 1459851 - RNA, 19 nt, Homo sapiens
gcagauucuuguuccauag

SEQ ID NO: 1459852 - RNA, 19 nt, Homo sapiens
ucagaaagcacauuuaaac

SEQ ID NO: 1459853 - RNA, 19 nt, Homo sapiens
gguaucgauuugcuucuug

SEQ ID NO: 1459854 - RNA, 19 nt, Homo sapiens
agagaagcaugcuccuuug

SEQ ID NO: 1459855 - RNA, 19 nt, Homo sapiens
gagauggcguucagaugca

SEQ ID NO: 1459856 - RNA, 19 nt, Homo sapiens
caacuucacagggccagua

SEQ ID NO: 1459857 - RNA, 19 nt, Homo sapiens
ccugcuggcucacucguuu

SEQ ID NO: 1459858 - RNA, 19 nt, Homo sapiens
guucagaugcagauucuug

SEQ ID NO: 1459859 - RNA, 19 nt, Homo sapiens
gaucagaaaaguuuggaua

SEQ ID NO: 1459860 - RNA, 19 nt, Homo sapiens
gcgcauaccugugguucca

SEQ ID NO: 1459861 - RNA, 19 nt, Homo sapiens
ucacagggccaguauucuu

SEQ ID NO: 1459862 - RNA, 19 nt, Homo sapiens
cggcugugcuucuugguau

SEQ ID NO: 1459863 - RNA, 19 nt, Homo sapiens
gagaccagccugagcaaca

SEQ ID NO: 1459864 - RNA, 19 nt, Homo sapiens
caagugggaggauuguuug

SEQ ID NO: 1459865 - RNA, 19 nt, Homo sapiens
ggugcugaaugauuaagug

SEQ ID NO: 1459866 - RNA, 19 nt, Homo sapiens
gcugaaugauuaagugacu

SEQ ID NO: 1459867 - RNA, 19 nt, Homo sapiens
ugcagauucuuguuccaua

SEQ ID NO: 1459868 - RNA, 19 nt, Homo sapiens
gcaugcggcugugcuucuu

SEQ ID NO: 1459869 - RNA, 19 nt, Homo sapiens
gaccacagggcuugcaaau

SEQ ID NO: 1459870 - RNA, 19 nt, Homo sapiens
uuuaccauguuccaaauga

SEQ ID NO: 1459871 - RNA, 19 nt, Homo sapiens
gugagcaaacguucagaaa

SEQ ID NO: 1459872 - RNA, 19 nt, Homo sapiens
cacagggccaguauucuuu

SEQ ID NO: 1459873 - RNA, 19 nt, Homo sapiens
cagaaagcacauuuaaaca

SEQ ID NO: 1459874 - RNA, 19 nt, Homo sapiens
ccauugagagucuuaguca

SEQ ID NO: 1459875 - RNA, 19 nt, Homo sapiens
aaaccggggugcugaauga

SEQ ID NO: 1459876 - RNA, 19 nt, Homo sapiens
acacuucgcuggccuuucc

SEQ ID NO: 1459877 - RNA, 19 nt, Homo sapiens
gauaucagaucagaaaagu

SEQ ID NO: 1459878 - RNA, 19 nt, Homo sapiens
uuggauaucucagcucaga

SEQ ID NO: 1459879 - RNA, 19 nt, Homo sapiens
gcguucagaugcagauucu

SEQ ID NO: 1459880 - RNA, 19 nt, Homo sapiens
ccacagaacgagacuucau

SEQ ID NO: 1459881 - RNA, 19 nt, Homo sapiens
ccggggugcugaaugauua

SEQ ID NO: 1459882 - RNA, 19 nt, Homo sapiens
uuggauaucagaucagaaa

SEQ ID NO: 1459883 - RNA, 19 nt, Homo sapiens
aagcacauuuaaacacugu

SEQ ID NO: 1459884 - RNA, 19 nt, Homo sapiens
ggacacuucgcuggccuuu

SEQ ID NO: 1459885 - RNA, 19 nt, Homo sapiens
guagaaaaguuuggauauc

SEQ ID NO: 1459886 - RNA, 19 nt, Homo sapiens
guuuggauaucagaucaga

SEQ ID NO: 1459887 - RNA, 19 nt, Homo sapiens
ggccacagaacgagacuuc

SEQ ID NO: 1459888 - RNA, 19 nt, Homo sapiens
cagaaaaguuuggauaucu

SEQ ID NO: 1459889 - RNA, 19 nt, Homo sapiens
aaguuuggauaucagauca

SEQ ID NO: 1459890 - RNA, 19 nt, Homo sapiens
ccgccguacuccauugaga

SEQ ID NO: 1459891 - RNA, 19 nt, Homo sapiens
cagaugcagauucuuguuc

SEQ ID NO: 1459892 - RNA, 19 nt, Homo sapiens
gcuucuugguaucgauuug

SEQ ID NO: 1459893 - RNA, 19 nt, Homo sapiens
gcggcugugcuucuuggua

SEQ ID NO: 1459894 - RNA, 19 nt, Homo sapiens
gugcugaaugauuaaguga

SEQ ID NO: 1459895 - RNA, 19 nt, Homo sapiens
cuucacagggccaguauuc

SEQ ID NO: 1459896 - RNA, 19 nt, Homo sapiens
gauucuuguuccauagauc

SEQ ID NO: 1459897 - RNA, 19 nt, Homo sapiens
gaagagaggugaagucgua

SEQ ID NO: 1459898 - RNA, 19 nt, Homo sapiens
gaagacagcuccuauaguu

SEQ ID NO: 1459899 - RNA, 19 nt, Homo sapiens
gagagaagaugauguaauu

SEQ ID NO: 1459900 - RNA, 19 nt, Homo sapiens
gaagacaaauggacaauug

SEQ ID NO: 1459901 - RNA, 19 nt, Homo sapiens
ccaaagaguuguaacauuu

SEQ ID NO: 1459902 - RNA, 19 nt, Homo sapiens
aaagaaagauggacaaaga

SEQ ID NO: 1459903 - RNA, 19 nt, Homo sapiens
gcaguuggcucaguuguuu

SEQ ID NO: 1459904 - RNA, 19 nt, Homo sapiens
gaacacaucagagguauuu

SEQ ID NO: 1459905 - RNA, 19 nt, Homo sapiens
gaaugugucuucaacuaaa

SEQ ID NO: 1459906 - RNA, 19 nt, Homo sapiens
ucagaucccucuuccuuua

SEQ ID NO: 1459907 - RNA, 19 nt, Homo sapiens
gaaagcuacugauacacua

SEQ ID NO: 1459908 - RNA, 19 nt, Homo sapiens
ccucuuccauugcaaauua

SEQ ID NO: 1459909 - RNA, 19 nt, Homo sapiens
acacagaguuuacuaauag

SEQ ID NO: 1459910 - RNA, 19 nt, Homo sapiens
gacacagaguuuacuaaua

SEQ ID NO: 1459911 - RNA, 19 nt, Homo sapiens
cuacagaaauuuacuggaa

SEQ ID NO: 1459912 - RNA, 19 nt, Homo sapiens
ggaagacucaugagaaauu

SEQ ID NO: 1459913 - RNA, 19 nt, Homo sapiens
gcuaaucucuucugcucua

SEQ ID NO: 1459914 - RNA, 19 nt, Homo sapiens
gaagacucaugagaaauuu

SEQ ID NO: 1459915 - RNA, 19 nt, Homo sapiens
ggaaaugaauaagcuuuga

SEQ ID NO: 1459916 - RNA, 19 nt, Homo sapiens
cagcagaguuggcacuuaa

SEQ ID NO: 1459917 - RNA, 19 nt, Homo sapiens
caagagauauacugccauu

SEQ ID NO: 1459918 - RNA, 19 nt, Homo sapiens
ggaaagcaauauauuaugc

SEQ ID NO: 1459919 - RNA, 19 nt, Homo sapiens
ggagagaaaucaaaguuuu

SEQ ID NO: 1459920 - RNA, 19 nt, Homo sapiens
aaacaguucuucucaaaca

SEQ ID NO: 1459921 - RNA, 19 nt, Homo sapiens
uaaaugagccaaagagaga

SEQ ID NO: 1459922 - RNA, 19 nt, Homo sapiens
gcagaagacagcuccuaua

SEQ ID NO: 1459923 - RNA, 19 nt, Homo sapiens
uacaguaucucccuucaaa

SEQ ID NO: 1459924 - RNA, 19 nt, Homo sapiens
guuuagaucuuggaaauga

SEQ ID NO: 1459925 - RNA, 19 nt, Homo sapiens
caagagauacuuacagaug

SEQ ID NO: 1459926 - RNA, 19 nt, Homo sapiens
aaagagagaagaugaugua

SEQ ID NO: 1459927 - RNA, 19 nt, Homo sapiens
aaggaagacucaugagaaa

SEQ ID NO: 1459928 - RNA, 19 nt, Homo sapiens
gagauuggccugggaauau

SEQ ID NO: 1459929 - RNA, 19 nt, Homo sapiens
gagauauacugccauugga

SEQ ID NO: 1459930 - RNA, 19 nt, Homo sapiens
aaauggccaucaucuagua

SEQ ID NO: 1459931 - RNA, 19 nt, Homo sapiens
aaacaggucugggcuacaa

SEQ ID NO: 1459932 - RNA, 19 nt, Homo sapiens
guacagcauuuucaacaua

SEQ ID NO: 1459933 - RNA, 19 nt, Homo sapiens
cuaccaagcugcuguccuu

SEQ ID NO: 1459934 - RNA, 19 nt, Homo sapiens
ccucuaccaucuuaaugua

SEQ ID NO: 1459935 - RNA, 19 nt, Homo sapiens
ucaaacacacaaagucaua

SEQ ID NO: 1459936 - RNA, 19 nt, Homo sapiens
acuaacagguuguaaauag

SEQ ID NO: 1459937 - RNA, 19 nt, Homo sapiens
ugagcuccauguuucuuua

SEQ ID NO: 1459938 - RNA, 19 nt, Homo sapiens
cacagucucuugagcauug

SEQ ID NO: 1459939 - RNA, 19 nt, Homo sapiens
guauguaguugugauaaug

SEQ ID NO: 1459940 - RNA, 19 nt, Homo sapiens
uaauagaggaguagagauu

SEQ ID NO: 1459941 - RNA, 19 nt, Homo sapiens
uaaggcaccuauacuuuua

SEQ ID NO: 1459942 - RNA, 19 nt, Homo sapiens
caauauguccucuuccauu

SEQ ID NO: 1459943 - RNA, 19 nt, Homo sapiens
guuaauaccaugaugcauu

SEQ ID NO: 1459944 - RNA, 19 nt, Homo sapiens
agacaaaacuguaaggaaa

SEQ ID NO: 1459945 - RNA, 19 nt, Homo sapiens
aguaugagcuccauguuuc

SEQ ID NO: 1459946 - RNA, 19 nt, Homo sapiens
aaacauaggagagaaauca

SEQ ID NO: 1459947 - RNA, 19 nt, Homo sapiens
ugacuuauguuugccuuau

SEQ ID NO: 1459948 - RNA, 19 nt, Homo sapiens
ggucugggcuacaaaagua

SEQ ID NO: 1459949 - RNA, 19 nt, Homo sapiens
aaaggaagacucaugagaa

SEQ ID NO: 1459950 - RNA, 19 nt, Homo sapiens
uggcagcuaugagauauuu

SEQ ID NO: 1459951 - RNA, 19 nt, Homo sapiens
uagagauuguugaccauuu

SEQ ID NO: 1459952 - RNA, 19 nt, Homo sapiens
ggccauuauugaucucuuu

SEQ ID NO: 1459953 - RNA, 19 nt, Homo sapiens
cccaaagaguuguaacauu

SEQ ID NO: 1459954 - RNA, 19 nt, Homo sapiens
guuacaauauguccucuuc

SEQ ID NO: 1459955 - RNA, 19 nt, Homo sapiens
gguuguaaauagaagacua

SEQ ID NO: 1459956 - RNA, 19 nt, Homo sapiens
aguaauaccuguguuuguu

SEQ ID NO: 1459957 - RNA, 19 nt, Homo sapiens
acaaauggacaauugauga

SEQ ID NO: 1459958 - RNA, 19 nt, Homo sapiens
gaaccaaacagggaccauu

SEQ ID NO: 1459959 - RNA, 19 nt, Homo sapiens
ucagaagcuuggucaguga

SEQ ID NO: 1459960 - RNA, 19 nt, Homo sapiens
ccacuaacagguuguaaau

SEQ ID NO: 1459961 - RNA, 19 nt, Homo sapiens
augacaagcugcauucaaa

SEQ ID NO: 1459962 - RNA, 19 nt, Homo sapiens
auuaagacguguugagauu

SEQ ID NO: 1459963 - RNA, 19 nt, Homo sapiens
gaaagauggacaaagacuu

SEQ ID NO: 1459964 - RNA, 19 nt, Homo sapiens
guauuucucuauugcugaa

SEQ ID NO: 1459965 - RNA, 19 nt, Homo sapiens
uagccacauuguaauagua

SEQ ID NO: 1459966 - RNA, 19 nt, Homo sapiens
ugagauggcugcccugcau

SEQ ID NO: 1459967 - RNA, 19 nt, Homo sapiens
gguguucccugugacauug

SEQ ID NO: 1459968 - RNA, 19 nt, Homo sapiens
guaauaccuguguuuguuu

SEQ ID NO: 1459969 - RNA, 19 nt, Homo sapiens
uaaaguggccauuauugau

SEQ ID NO: 1459970 - RNA, 19 nt, Homo sapiens
aauauguccucuuccauug

SEQ ID NO: 1459971 - RNA, 19 nt, Homo sapiens
cagccagucuguagaaaca

SEQ ID NO: 1459972 - RNA, 19 nt, Homo sapiens
cagaauggaccaagaggaa

SEQ ID NO: 1459973 - RNA, 19 nt, Homo sapiens
caacauggucaagcacuuu

SEQ ID NO: 1459974 - RNA, 19 nt, Homo sapiens
ucaguuguuuguuguguug

SEQ ID NO: 1459975 - RNA, 19 nt, Homo sapiens
ccagcagaguuggcacuua

SEQ ID NO: 1459976 - RNA, 19 nt, Homo sapiens
ucaacauauuggcaacaua

SEQ ID NO: 1459977 - RNA, 19 nt, Homo sapiens
cuaacagguuguaaauaga

SEQ ID NO: 1459978 - RNA, 19 nt, Homo sapiens
ccauguuucuuuaguuuca

SEQ ID NO: 1459979 - RNA, 19 nt, Homo sapiens
guuguguugugaaauguuu

SEQ ID NO: 1459980 - RNA, 19 nt, Homo sapiens
ggaaagcuacugauacacu

SEQ ID NO: 1459981 - RNA, 19 nt, Homo sapiens
gcuccauguuucuuuaguu

SEQ ID NO: 1459982 - RNA, 19 nt, Homo sapiens
ugaaucgguugaaggagaa

SEQ ID NO: 1459983 - RNA, 19 nt, Homo sapiens
uguuaccucuaccaucuua

SEQ ID NO: 1459984 - RNA, 19 nt, Homo sapiens
agguauuucugcuguauuu

SEQ ID NO: 1459985 - RNA, 19 nt, Homo sapiens
gguacagguuacaauaugu

SEQ ID NO: 1459986 - RNA, 19 nt, Homo sapiens
gccagucuguagaaacauu

SEQ ID NO: 1459987 - RNA, 19 nt, Homo sapiens
agagauacuuacagauguu

SEQ ID NO: 1459988 - RNA, 19 nt, Homo sapiens
ugaucugucuucagucuug

SEQ ID NO: 1459989 - RNA, 19 nt, Homo sapiens
gcacucuuguugcaucauc

SEQ ID NO: 1459990 - RNA, 19 nt, Homo sapiens
ccaugaugcauuaacauaa

SEQ ID NO: 1459991 - RNA, 19 nt, Homo sapiens
gggaaagcaauauauuaug

SEQ ID NO: 1459992 - RNA, 19 nt, Homo sapiens
caguuucaauagcacauaa

SEQ ID NO: 1459993 - RNA, 19 nt, Homo sapiens
uuacaguguuaccauuuga

SEQ ID NO: 1459994 - RNA, 19 nt, Homo sapiens
cuuauugcauucccaaaga

SEQ ID NO: 1459995 - RNA, 19 nt, Homo sapiens
cagaagacagcuccuauag

SEQ ID NO: 1459996 - RNA, 19 nt, Homo sapiens
aaagucaccuuccuaccau

SEQ ID NO: 1459997 - RNA, 19 nt, Homo sapiens
ggaaacggcuuacaaaaua

SEQ ID NO: 1459998 - RNA, 19 nt, Homo sapiens
ggagauauucuucagauua

SEQ ID NO: 1459999 - RNA, 19 nt, Homo sapiens
gaaagcugcugaucaguga

SEQ ID NO: 1460000 - RNA, 19 nt, Homo sapiens
gaaguggucuuauucaugu

SEQ ID NO: 1460001 - RNA, 19 nt, Homo sapiens
uauaaagccuccaucaaua

SEQ ID NO: 1460002 - RNA, 19 nt, Homo sapiens
ucacugaggucgucauuaa

SEQ ID NO: 1460003 - RNA, 19 nt, Homo sapiens
ugaaugaacugaaacgaaa

SEQ ID NO: 1460004 - RNA, 19 nt, Homo sapiens
gcaagaagagugaucagua

SEQ ID NO: 1460005 - RNA, 19 nt, Homo sapiens
gcagauagaaguggucuua

SEQ ID NO: 1460006 - RNA, 19 nt, Homo sapiens
gaagagaaagaaagguaua

SEQ ID NO: 1460007 - RNA, 19 nt, Homo sapiens
gaaaucaucugguuuuaga

SEQ ID NO: 1460008 - RNA, 19 nt, Homo sapiens
ucagagagcuguugaaacu

SEQ ID NO: 1460009 - RNA, 19 nt, Homo sapiens
ggagagugaugguguugaa

SEQ ID NO: 1460010 - RNA, 19 nt, Homo sapiens
gaagaagccaggagaguga

SEQ ID NO: 1460011 - RNA, 19 nt, Homo sapiens
gaauuuaagcccuauguga

SEQ ID NO: 1460012 - RNA, 19 nt, Homo sapiens
gaacaagccauuaaacagu

SEQ ID NO: 1460013 - RNA, 19 nt, Homo sapiens
ggauaccaguggaggauaa

SEQ ID NO: 1460014 - RNA, 19 nt, Homo sapiens
gagcuaccauuaagaagga

SEQ ID NO: 1460015 - RNA, 19 nt, Homo sapiens
gcugcaggcuguugaauug

SEQ ID NO: 1460016 - RNA, 19 nt, Homo sapiens
gcacaaguauagacucagu

SEQ ID NO: 1460017 - RNA, 19 nt, Homo sapiens
aaacuacacuacuaugaga

SEQ ID NO: 1460018 - RNA, 19 nt, Homo sapiens
caauagagcguuugagaga

SEQ ID NO: 1460019 - RNA, 19 nt, Homo sapiens
uaaaaggccugaggaaaua

SEQ ID NO: 1460020 - RNA, 19 nt, Homo sapiens
cagcugacguacccacaua

SEQ ID NO: 1460021 - RNA, 19 nt, Homo sapiens
gagacgaccagaaauauug

SEQ ID NO: 1460022 - RNA, 19 nt, Homo sapiens
aaagaaggcaagauguuua

SEQ ID NO: 1460023 - RNA, 19 nt, Homo sapiens
ccacugggagcuaccauua

SEQ ID NO: 1460024 - RNA, 19 nt, Homo sapiens
cugaagauauugacgauga

SEQ ID NO: 1460025 - RNA, 19 nt, Homo sapiens
gaauuacgacccaguguug

SEQ ID NO: 1460026 - RNA, 19 nt, Homo sapiens
caagaagagugaucaguac

SEQ ID NO: 1460027 - RNA, 19 nt, Homo sapiens
gauaaggcaauuccaugua

SEQ ID NO: 1460028 - RNA, 19 nt, Homo sapiens
ggcaagauguuuaucaaag

SEQ ID NO: 1460029 - RNA, 19 nt, Homo sapiens
agauagaaguggucuuauu

SEQ ID NO: 1460030 - RNA, 19 nt, Homo sapiens
gaucagagagcuguugaaa

SEQ ID NO: 1460031 - RNA, 19 nt, Homo sapiens
gauagaaguggucuuauuc

SEQ ID NO: 1460032 - RNA, 19 nt, Homo sapiens
auaaggcaauuccauguaa

SEQ ID NO: 1460033 - RNA, 19 nt, Homo sapiens
gaaagucaauauggucauc

SEQ ID NO: 1460034 - RNA, 19 nt, Homo sapiens
gaaggcaagauguuuauca

SEQ ID NO: 1460035 - RNA, 19 nt, Homo sapiens
gauuauacccggcagcaaa

SEQ ID NO: 1460036 - RNA, 19 nt, Homo sapiens
ccgaugaucuggccgaaga

SEQ ID NO: 1460037 - RNA, 19 nt, Homo sapiens
gcaaagauuauuucaagca

SEQ ID NO: 1460038 - RNA, 19 nt, Homo sapiens
gggcugaccuguuccuaca

SEQ ID NO: 1460039 - RNA, 19 nt, Homo sapiens
gaguagggcugaaugaacu

SEQ ID NO: 1460040 - RNA, 19 nt, Homo sapiens
ucagggagcaauuacauuu

SEQ ID NO: 1460041 - RNA, 19 nt, Homo sapiens
aggaggagcugcagauaga

SEQ ID NO: 1460042 - RNA, 19 nt, Homo sapiens
gagccaagaugaugcaacu

SEQ ID NO: 1460043 - RNA, 19 nt, Homo sapiens
aagcagagaugaccaaggu

SEQ ID NO: 1460044 - RNA, 19 nt, Homo sapiens
cugaauuccuggcugauuu

SEQ ID NO: 1460045 - RNA, 19 nt, Homo sapiens
ugaccucacuguggcauuu

SEQ ID NO: 1460046 - RNA, 19 nt, Homo sapiens
gcaagauguuuaucaaagc

SEQ ID NO: 1460047 - RNA, 19 nt, Homo sapiens
gugaagagaaagaaaggua

SEQ ID NO: 1460048 - RNA, 19 nt, Homo sapiens
agggagcaauuacauuuaa

SEQ ID NO: 1460049 - RNA, 19 nt, Homo sapiens
aaacucaacugcucucacu

SEQ ID NO: 1460050 - RNA, 19 nt, Homo sapiens
auagagcguuugagagaaa

SEQ ID NO: 1460051 - RNA, 19 nt, Homo sapiens
auacagaucuugguagaca

SEQ ID NO: 1460052 - RNA, 19 nt, Homo sapiens
gagcugguuacauucauaa

SEQ ID NO: 1460053 - RNA, 19 nt, Homo sapiens
ugagcugguuacauucaua

SEQ ID NO: 1460054 - RNA, 19 nt, Homo sapiens
uuauaaagccuccaucaau

SEQ ID NO: 1460055 - RNA, 19 nt, Homo sapiens
aaacgaaagcugcugauca

SEQ ID NO: 1460056 - RNA, 19 nt, Homo sapiens
gggagauauucuucagauu

SEQ ID NO: 1460057 - RNA, 19 nt, Homo sapiens
gcacagauaauggaaaguc

SEQ ID NO: 1460058 - RNA, 19 nt, Homo sapiens
uaagcccuaugugauauuu

SEQ ID NO: 1460059 - RNA, 19 nt, Homo sapiens
ggauaaggcaauuccaugu

SEQ ID NO: 1460060 - RNA, 19 nt, Homo sapiens
cugauuuccuuacugcaua

SEQ ID NO: 1460061 - RNA, 19 nt, Homo sapiens
uaaaugaugaccucacugu

SEQ ID NO: 1460062 - RNA, 19 nt, Homo sapiens
ccaaaagccucauugugaa

SEQ ID NO: 1460063 - RNA, 19 nt, Homo sapiens
gcuuugagacgaccagaaa

SEQ ID NO: 1460064 - RNA, 19 nt, Homo sapiens
ggagcaauuacauuuaaga

SEQ ID NO: 1460065 - RNA, 19 nt, Homo sapiens
gcaggcuguugaauuggaa

SEQ ID NO: 1460066 - RNA, 19 nt, Homo sapiens
gggcaggccgacuugauuu

SEQ ID NO: 1460067 - RNA, 19 nt, Homo sapiens
gucauuaaguccugugugu

SEQ ID NO: 1460068 - RNA, 19 nt, Homo sapiens
agagugaugguguugaaua

SEQ ID NO: 1460069 - RNA, 19 nt, Homo sapiens
gaaagguauagcagucuug

SEQ ID NO: 1460070 - RNA, 19 nt, Homo sapiens
gccaaaagccucauuguga

SEQ ID NO: 1460071 - RNA, 19 nt, Homo sapiens
aauaauccgucuggucaaa

SEQ ID NO: 1460072 - RNA, 19 nt, Homo sapiens
ugggauauguuuggugaaa

SEQ ID NO: 1460073 - RNA, 19 nt, Homo sapiens
gcauuuaaggacacuagaa

SEQ ID NO: 1460074 - RNA, 19 nt, Homo sapiens
ugagacagauguacaaaau

SEQ ID NO: 1460075 - RNA, 19 nt, Homo sapiens
gagugaugguguugaauac

SEQ ID NO: 1460076 - RNA, 19 nt, Homo sapiens
aacaggaaaucaucugguu

SEQ ID NO: 1460077 - RNA, 19 nt, Homo sapiens
uaaugaggauaaggcaauu

SEQ ID NO: 1460078 - RNA, 19 nt, Homo sapiens
cagggagcaauuacauuua

SEQ ID NO: 1460079 - RNA, 19 nt, Homo sapiens
gacccaguguugccuccua

SEQ ID NO: 1460080 - RNA, 19 nt, Homo sapiens
gagaaagaaagguauagca

SEQ ID NO: 1460081 - RNA, 19 nt, Homo sapiens
cagaacaagccauuaaaca

SEQ ID NO: 1460082 - RNA, 19 nt, Homo sapiens
ccacugcggaaacggcuua

SEQ ID NO: 1460083 - RNA, 19 nt, Homo sapiens
ccaggagagugaugguguu

SEQ ID NO: 1460084 - RNA, 19 nt, Homo sapiens
gaaacggcuuacaaaauau

SEQ ID NO: 1460085 - RNA, 19 nt, Homo sapiens
gugaugguguugaauacau

SEQ ID NO: 1460086 - RNA, 19 nt, Homo sapiens
gaagaagugacaccguauc

SEQ ID NO: 1460087 - RNA, 19 nt, Homo sapiens
ugaaggcuuugcucucugu

SEQ ID NO: 1460088 - RNA, 19 nt, Homo sapiens
cuucagaacaagccauuaa

SEQ ID NO: 1460089 - RNA, 19 nt, Homo sapiens
aagccugcauucauuggua

SEQ ID NO: 1460090 - RNA, 19 nt, Homo sapiens
cucauacagugaagcauuu

SEQ ID NO: 1460091 - RNA, 19 nt, Homo sapiens
aaggcaagauguuuaucaa

SEQ ID NO: 1460092 - RNA, 19 nt, Homo sapiens
gagaggaggagcugcagau

SEQ ID NO: 1460093 - RNA, 19 nt, Homo sapiens
agagagcuguugaaacuac

SEQ ID NO: 1460094 - RNA, 19 nt, Homo sapiens
caucaugccagcuuuguca

SEQ ID NO: 1460095 - RNA, 19 nt, Homo sapiens
ugauuuccuuacugcauaa

SEQ ID NO: 1460096 - RNA, 19 nt, Homo sapiens
ugaccaaggugcugcaaaa

SEQ ID NO: 1460097 - RNA, 19 nt, Homo sapiens
gaagagcucauauguguuu

SEQ ID NO: 1460098 - RNA, 19 nt, Homo sapiens
ggaaguagaccuccgugua

SEQ ID NO: 1460099 - RNA, 19 nt, Homo sapiens
agacagagauaucuauaga

SEQ ID NO: 1460100 - RNA, 19 nt, Homo sapiens
uggaagagcucauaugugu

SEQ ID NO: 1460101 - RNA, 19 nt, Homo sapiens
gggagucgcugcagcugua

SEQ ID NO: 1460102 - RNA, 19 nt, Homo sapiens
gaaacacguuccaaauaca

SEQ ID NO: 1460103 - RNA, 19 nt, Homo sapiens
gccuauaucugucuaucua

SEQ ID NO: 1460104 - RNA, 19 nt, Homo sapiens
gguaguagaccuccaugua

SEQ ID NO: 1460105 - RNA, 19 nt, Homo sapiens
gaaguugacuguggcugaa

SEQ ID NO: 1460106 - RNA, 19 nt, Homo sapiens
gaaccucucaggauugauu

SEQ ID NO: 1460107 - RNA, 19 nt, Homo sapiens
uagaacaucuccuggauca

SEQ ID NO: 1460108 - RNA, 19 nt, Homo sapiens
uugcauagcuccucauguu

SEQ ID NO: 1460109 - RNA, 19 nt, Homo sapiens
ugaaacacguuccaaauac

SEQ ID NO: 1460110 - RNA, 19 nt, Homo sapiens
caccguaccuggccauauu

SEQ ID NO: 1460111 - RNA, 19 nt, Homo sapiens
ucuccacucucacuucuua

SEQ ID NO: 1460112 - RNA, 19 nt, Homo sapiens
cuaccuaucuaucuaucua

SEQ ID NO: 1460113 - RNA, 19 nt, Homo sapiens
ucucagaaguccuggaauu

SEQ ID NO: 1460114 - RNA, 19 nt, Homo sapiens
gaucaggaaguagauguua

SEQ ID NO: 1460115 - RNA, 19 nt, Homo sapiens
gacaggcucugguccaaga

SEQ ID NO: 1460116 - RNA, 19 nt, Homo sapiens
gaaguagaccuccguguag

SEQ ID NO: 1460117 - RNA, 19 nt, Homo sapiens
ccaaagugcugggauuaau

SEQ ID NO: 1460118 - RNA, 19 nt, Homo sapiens
cuaccuaccuaucuaucua

SEQ ID NO: 1460119 - RNA, 19 nt, Homo sapiens
acagaggcuucuuguagua

SEQ ID NO: 1460120 - RNA, 19 nt, Homo sapiens
uggaagagcucagggaaga

SEQ ID NO: 1460121 - RNA, 19 nt, Homo sapiens
aaaagagccuagcuacuua

SEQ ID NO: 1460122 - RNA, 19 nt, Homo sapiens
agaagcggcugaagaacuu

SEQ ID NO: 1460123 - RNA, 19 nt, Homo sapiens
gaauuuggccaccaucuca

SEQ ID NO: 1460124 - RNA, 19 nt, Homo sapiens
ccagucagaucuucuugga

SEQ ID NO: 1460125 - RNA, 19 nt, Homo sapiens
gagcgccucuguucguguu

SEQ ID NO: 1460126 - RNA, 19 nt, Homo sapiens
cuaccuagauagacagaga

SEQ ID NO: 1460127 - RNA, 19 nt, Homo sapiens
gagagcagguccacuuugc

SEQ ID NO: 1460128 - RNA, 19 nt, Homo sapiens
ucucaggauugauugcaua

SEQ ID NO: 1460129 - RNA, 19 nt, Homo sapiens
gguaggagcgccucuguuc

SEQ ID NO: 1460130 - RNA, 19 nt, Homo sapiens
caccaugccuggcuaaucu

SEQ ID NO: 1460131 - RNA, 19 nt, Homo sapiens
gcauagcuccucauguuuc

SEQ ID NO: 1460132 - RNA, 19 nt, Homo sapiens
ucuaucaucuaucuaccua

SEQ ID NO: 1460133 - RNA, 19 nt, Homo sapiens
gcacucggccugucacaca

SEQ ID NO: 1460134 - RNA, 19 nt, Homo sapiens
uugaaacacguuccaaaua

SEQ ID NO: 1460135 - RNA, 19 nt, Homo sapiens
ccuccacccugauuacuga

SEQ ID NO: 1460136 - RNA, 19 nt, Homo sapiens
gacuguggcugaagagcuu

SEQ ID NO: 1460137 - RNA, 19 nt, Homo sapiens
gugcagugacuccagcuua

SEQ ID NO: 1460138 - RNA, 19 nt, Homo sapiens
ggaggaagacggcaaacuc

SEQ ID NO: 1460139 - RNA, 19 nt, Homo sapiens
cuaucuaucuaucuaccua

SEQ ID NO: 1460140 - RNA, 19 nt, Homo sapiens
caagugguccucccaaagu

SEQ ID NO: 1460141 - RNA, 19 nt, Homo sapiens
caaaagagccuagcuacuu

SEQ ID NO: 1460142 - RNA, 19 nt, Homo sapiens
gcuuaagcuuggccucaaa

SEQ ID NO: 1460143 - RNA, 19 nt, Homo sapiens
guaguagaccuccauguag

SEQ ID NO: 1460144 - RNA, 19 nt, Homo sapiens
gaggaagacggcaaacuca

SEQ ID NO: 1460145 - RNA, 19 nt, Homo sapiens
uggaggaguuguagcaguu

SEQ ID NO: 1460146 - RNA, 19 nt, Homo sapiens
ugucaugggugaagagcuu

SEQ ID NO: 1460147 - RNA, 19 nt, Homo sapiens
gagggaggguucuucuucu

SEQ ID NO: 1460148 - RNA, 19 nt, Homo sapiens
cagcaucuuuggccucugu

SEQ ID NO: 1460149 - RNA, 19 nt, Homo sapiens
gaaggaccaccaccucauc

SEQ ID NO: 1460150 - RNA, 19 nt, Homo sapiens
ugcagugacuccagcuuaa

SEQ ID NO: 1460151 - RNA, 19 nt, Homo sapiens
ggaggaggaagacggcaaa

SEQ ID NO: 1460152 - RNA, 19 nt, Homo sapiens
uggacaggcugcucuccua

SEQ ID NO: 1460153 - RNA, 19 nt, Homo sapiens
cagugcagguugcccauga

SEQ ID NO: 1460154 - RNA, 19 nt, Homo sapiens
cuaucuaucuaccuaccua

SEQ ID NO: 1460155 - RNA, 19 nt, Homo sapiens
ucccuaaccucagccuaua

SEQ ID NO: 1460156 - RNA, 19 nt, Homo sapiens
caaauucucgggcucaagu

SEQ ID NO: 1460157 - RNA, 19 nt, Homo sapiens
ggagagcagguccacuuug

SEQ ID NO: 1460158 - RNA, 19 nt, Homo sapiens
acacguuccaaauacauua

SEQ ID NO: 1460159 - RNA, 19 nt, Homo sapiens
cuaucuaccuaccuaucua

SEQ ID NO: 1460160 - RNA, 19 nt, Homo sapiens
caaagugcugggauuaaug

SEQ ID NO: 1460161 - RNA, 19 nt, Homo sapiens
uagagcaggugcacuuagu

SEQ ID NO: 1460162 - RNA, 19 nt, Homo sapiens
gguccagacgcgauuguuu

SEQ ID NO: 1460163 - RNA, 19 nt, Homo sapiens
uaguagaccuccauguagu

SEQ ID NO: 1460164 - RNA, 19 nt, Homo sapiens
gauguuagggucgcuguug

SEQ ID NO: 1460165 - RNA, 19 nt, Homo sapiens
cccuggagcuugucguuga

SEQ ID NO: 1460166 - RNA, 19 nt, Homo sapiens
uguagaacaucuccuggau

SEQ ID NO: 1460167 - RNA, 19 nt, Homo sapiens
gcccagaagcggcugaaga

SEQ ID NO: 1460168 - RNA, 19 nt, Homo sapiens
gggagagcagguccacuuu

SEQ ID NO: 1460169 - RNA, 19 nt, Homo sapiens
gcaagcacucggccuguca

SEQ ID NO: 1460170 - RNA, 19 nt, Homo sapiens
gguagagcaggugcacuua

SEQ ID NO: 1460171 - RNA, 19 nt, Homo sapiens
gcagguugcccaugaacuc

SEQ ID NO: 1460172 - RNA, 19 nt, Homo sapiens
gccuagagcagcaucuuug

SEQ ID NO: 1460173 - RNA, 19 nt, Homo sapiens
ggguucuucuucuccauga

SEQ ID NO: 1460174 - RNA, 19 nt, Homo sapiens
cccagaagcggcugaagaa

SEQ ID NO: 1460175 - RNA, 19 nt, Homo sapiens
guagaccuccguguaguug

SEQ ID NO: 1460176 - RNA, 19 nt, Homo sapiens
caauuuguccaagucgaua

SEQ ID NO: 1460177 - RNA, 19 nt, Homo sapiens
ggaccaccaccucauccaa

SEQ ID NO: 1460178 - RNA, 19 nt, Homo sapiens
ggagugcagcaguugauca

SEQ ID NO: 1460179 - RNA, 19 nt, Homo sapiens
gagaugguucugacucugu

SEQ ID NO: 1460180 - RNA, 19 nt, Homo sapiens
ugagggaggguucuucuuc

SEQ ID NO: 1460181 - RNA, 19 nt, Homo sapiens
gcagggcgagcuguucuug

SEQ ID NO: 1460182 - RNA, 19 nt, Homo sapiens
ggaagagcucauauguguu

SEQ ID NO: 1460183 - RNA, 19 nt, Homo sapiens
gacaggcccuccuccucau

SEQ ID NO: 1460184 - RNA, 19 nt, Homo sapiens
gaggaguuguagcaguugu

SEQ ID NO: 1460185 - RNA, 19 nt, Homo sapiens
ucagaaguccuggaauuca

SEQ ID NO: 1460186 - RNA, 19 nt, Homo sapiens
gccacagucccauuucuau

SEQ ID NO: 1460187 - RNA, 19 nt, Homo sapiens
guaccagucagaucuucuu

SEQ ID NO: 1460188 - RNA, 19 nt, Homo sapiens
caggauugauugcauagcu

SEQ ID NO: 1460189 - RNA, 19 nt, Homo sapiens
ccacagucccauuucuaug

SEQ ID NO: 1460190 - RNA, 19 nt, Homo sapiens
ucacuguguugcccagaca

SEQ ID NO: 1460191 - RNA, 19 nt, Homo sapiens
gagcucauauguguuuagc

SEQ ID NO: 1460192 - RNA, 19 nt, Homo sapiens
ggaucaggaaguagauguu

SEQ ID NO: 1460193 - RNA, 19 nt, Homo sapiens
gugagcguguugagcaugu

SEQ ID NO: 1460194 - RNA, 19 nt, Homo sapiens
gcuggaauuuggccaccau

SEQ ID NO: 1460195 - RNA, 19 nt, Homo sapiens
agaccuccauguaguugug

SEQ ID NO: 1460196 - RNA, 19 nt, Homo sapiens
acaggcugcucuccuagau

SEQ ID NO: 1460197 - RNA, 19 nt, Homo sapiens
ggacuauucuuucuaauca

SEQ ID NO: 1460198 - RNA, 19 nt, Homo sapiens
aaacugagguuccaaagaa

SEQ ID NO: 1460199 - RNA, 19 nt, Homo sapiens
gcagacaccugaacucuca

SEQ ID NO: 1460200 - RNA, 19 nt, Homo sapiens
uaauuuacgugucccaaua

SEQ ID NO: 1460201 - RNA, 19 nt, Homo sapiens
gcagguggauggagugauu

SEQ ID NO: 1460202 - RNA, 19 nt, Homo sapiens
ccaaagaagucaauaaacu

SEQ ID NO: 1460203 - RNA, 19 nt, Homo sapiens
ucaauaaacuuguccaaag

SEQ ID NO: 1460204 - RNA, 19 nt, Homo sapiens
cugaagcccuuucuuuaua

SEQ ID NO: 1460205 - RNA, 19 nt, Homo sapiens
gacagaugguccuaaguuu

SEQ ID NO: 1460206 - RNA, 19 nt, Homo sapiens
caacauuggcgaccucuuu

SEQ ID NO: 1460207 - RNA, 19 nt, Homo sapiens
uaaccagacuuucgacaga

SEQ ID NO: 1460208 - RNA, 19 nt, Homo sapiens
cauggacuauucuuucuaa

SEQ ID NO: 1460209 - RNA, 19 nt, Homo sapiens
aaagugaucuugugaggau

SEQ ID NO: 1460210 - RNA, 19 nt, Homo sapiens
ugaagcccuuucuuuauaa

SEQ ID NO: 1460211 - RNA, 19 nt, Homo sapiens
ucacagcaucucacauuua

SEQ ID NO: 1460212 - RNA, 19 nt, Homo sapiens
gggaguaaaugucacuuca

SEQ ID NO: 1460213 - RNA, 19 nt, Homo sapiens
agaaagggaugaaucaaca

SEQ ID NO: 1460214 - RNA, 19 nt, Homo sapiens
caugagacuuggaagauau

SEQ ID NO: 1460215 - RNA, 19 nt, Homo sapiens
gaagucacgcuccuccuuu

SEQ ID NO: 1460216 - RNA, 19 nt, Homo sapiens
acucucagcugacaaagaa

SEQ ID NO: 1460217 - RNA, 19 nt, Homo sapiens
cauugcagcuggugacauu

SEQ ID NO: 1460218 - RNA, 19 nt, Homo sapiens
gagaauacaaucuaaacga

SEQ ID NO: 1460219 - RNA, 19 nt, Homo sapiens
cagcaucucacauuuacua

SEQ ID NO: 1460220 - RNA, 19 nt, Homo sapiens
ucaugagacuuggaagaua

SEQ ID NO: 1460221 - RNA, 19 nt, Homo sapiens
gcuauucaguuugugauau

SEQ ID NO: 1460222 - RNA, 19 nt, Homo sapiens
guaaaugucacuucagcuu

SEQ ID NO: 1460223 - RNA, 19 nt, Homo sapiens
uccaggaggugcugcauuu

SEQ ID NO: 1460224 - RNA, 19 nt, Homo sapiens
uaugugaaauccauuguuc

SEQ ID NO: 1460225 - RNA, 19 nt, Homo sapiens
uaugcaaacuucaccaaga

SEQ ID NO: 1460226 - RNA, 19 nt, Homo sapiens
ugacagaugguccuaaguu

SEQ ID NO: 1460227 - RNA, 19 nt, Homo sapiens
gaugaacgcacggcuguuu

SEQ ID NO: 1460228 - RNA, 19 nt, Homo sapiens
gccaguuccuugacacauu

SEQ ID NO: 1460229 - RNA, 19 nt, Homo sapiens
cagaugguccuaaguuuga

SEQ ID NO: 1460230 - RNA, 19 nt, Homo sapiens
gcacggcuguuuccuuggu

SEQ ID NO: 1460231 - RNA, 19 nt, Homo sapiens
ccaagaaagggaugaauca

SEQ ID NO: 1460232 - RNA, 19 nt, Homo sapiens
gaagcccuuucuuuauaau

SEQ ID NO: 1460233 - RNA, 19 nt, Homo sapiens
gcggcugcaucaccagaua

SEQ ID NO: 1460234 - RNA, 19 nt, Homo sapiens
acgaacaggugaauacaga

SEQ ID NO: 1460235 - RNA, 19 nt, Homo sapiens
gagcugcagccaucucaaa

SEQ ID NO: 1460236 - RNA, 19 nt, Homo sapiens
gccauauggugguaucuau

SEQ ID NO: 1460237 - RNA, 19 nt, Homo sapiens
aaucacagcaucucacauu

SEQ ID NO: 1460238 - RNA, 19 nt, Homo sapiens
caucauauucacaguacua

SEQ ID NO: 1460239 - RNA, 19 nt, Homo sapiens
ugucugcagugcuguguaa

SEQ ID NO: 1460240 - RNA, 19 nt, Homo sapiens
ggugguaucuaugugaaau

SEQ ID NO: 1460241 - RNA, 19 nt, Homo sapiens
uaaacgaacaggugaauac

SEQ ID NO: 1460242 - RNA, 19 nt, Homo sapiens
ggaagucacgcuccuccuu

SEQ ID NO: 1460243 - RNA, 19 nt, Homo sapiens
gcagccaucucaaaaguga

SEQ ID NO: 1460244 - RNA, 19 nt, Homo sapiens
gaacaggugaauacagaag

SEQ ID NO: 1460245 - RNA, 19 nt, Homo sapiens
cagcuugccgcaucucuaa

SEQ ID NO: 1460246 - RNA, 19 nt, Homo sapiens
cuggaagucuuguucuuug

SEQ ID NO: 1460247 - RNA, 19 nt, Homo sapiens
gguccuaaguuugaaguca

SEQ ID NO: 1460248 - RNA, 19 nt, Homo sapiens
gauaucaugagacuuggaa

SEQ ID NO: 1460249 - RNA, 19 nt, Homo sapiens
ccucauuuaugcaaacuuc

SEQ ID NO: 1460250 - RNA, 19 nt, Homo sapiens
caucagagaggcacaaugg

SEQ ID NO: 1460251 - RNA, 19 nt, Homo sapiens
ggcaacauguacugacuca

SEQ ID NO: 1460252 - RNA, 19 nt, Homo sapiens
cacagcaucucacauuuac

SEQ ID NO: 1460253 - RNA, 19 nt, Homo sapiens
ccaguuccuugacacauuc

SEQ ID NO: 1460254 - RNA, 19 nt, Homo sapiens
gaacaccuaaucuuauugc

SEQ ID NO: 1460255 - RNA, 19 nt, Homo sapiens
cauauucacaguacuaauc

SEQ ID NO: 1460256 - RNA, 19 nt, Homo sapiens
guugaaauagccaucauau

SEQ ID NO: 1460257 - RNA, 19 nt, Homo sapiens
ugugauaucaugagacuug

SEQ ID NO: 1460258 - RNA, 19 nt, Homo sapiens
gccaucauauucacaguac

SEQ ID NO: 1460259 - RNA, 19 nt, Homo sapiens
augcaaacuucaccaagaa

SEQ ID NO: 1460260 - RNA, 19 nt, Homo sapiens
ggugcugcauuuacugaga

SEQ ID NO: 1460261 - RNA, 19 nt, Homo sapiens
aaagaaugccaaugguuug

SEQ ID NO: 1460262 - RNA, 19 nt, Homo sapiens
ccugaagcccuuucuuuau

SEQ ID NO: 1460263 - RNA, 19 nt, Homo sapiens
gcauggacuauucuuucua

SEQ ID NO: 1460264 - RNA, 19 nt, Homo sapiens
guaucuaugugaaauccau

SEQ ID NO: 1460265 - RNA, 19 nt, Homo sapiens
uccugaagcccuuucuuua

SEQ ID NO: 1460266 - RNA, 19 nt, Homo sapiens
cugcaucaccagauaauga

SEQ ID NO: 1460267 - RNA, 19 nt, Homo sapiens
guuccaaagaagucaauaa

SEQ ID NO: 1460268 - RNA, 19 nt, Homo sapiens
gcaaacuucaccaagaaag

SEQ ID NO: 1460269 - RNA, 19 nt, Homo sapiens
gagagaccuugggccaguu

SEQ ID NO: 1460270 - RNA, 19 nt, Homo sapiens
ugaacucucagcugacaaa

SEQ ID NO: 1460271 - RNA, 19 nt, Homo sapiens
gaggugcugcauuuacuga

SEQ ID NO: 1460272 - RNA, 19 nt, Homo sapiens
uggaagucuuguucuuuga

SEQ ID NO: 1460273 - RNA, 19 nt, Homo sapiens
caagaaagggaugaaucaa

SEQ ID NO: 1460274 - RNA, 19 nt, Homo sapiens
aggaccagcugccaaggaa

SEQ ID NO: 1460275 - RNA, 19 nt, Homo sapiens
guaaaaugcccuaccuuug

SEQ ID NO: 1460276 - RNA, 19 nt, Homo sapiens
aaaaggaugugaggcaaaa

SEQ ID NO: 1460277 - RNA, 19 nt, Homo sapiens
aaagggaugaaucaacauu

SEQ ID NO: 1460278 - RNA, 19 nt, Homo sapiens
aguggagaauacaaucuaa

SEQ ID NO: 1460279 - RNA, 19 nt, Homo sapiens
gaugguugccugcuugagu

SEQ ID NO: 1460280 - RNA, 19 nt, Homo sapiens
gcucaguggagaauacaau

SEQ ID NO: 1460281 - RNA, 19 nt, Homo sapiens
uuaagcuuaugaacaccua

SEQ ID NO: 1460282 - RNA, 19 nt, Homo sapiens
ucgugcagauggagaaaga

SEQ ID NO: 1460283 - RNA, 19 nt, Homo sapiens
cuucuugaccaucuaguuu

SEQ ID NO: 1460284 - RNA, 19 nt, Homo sapiens
cuauucaguuugugauauc

SEQ ID NO: 1460285 - RNA, 19 nt, Homo sapiens
gaaagggaugaaucaacau

SEQ ID NO: 1460286 - RNA, 19 nt, Homo sapiens
ccacccucauuuaugcaaa

SEQ ID NO: 1460287 - RNA, 19 nt, Homo sapiens
caguggagaauacaaucua

SEQ ID NO: 1460288 - RNA, 19 nt, Homo sapiens
aaaagaaugccaaugguuu

SEQ ID NO: 1460289 - RNA, 19 nt, Homo sapiens
gucaauaaacuuguccaaa

SEQ ID NO: 1460290 - RNA, 19 nt, Homo sapiens
aauccuagacgcuucuuga

SEQ ID NO: 1460291 - RNA, 19 nt, Homo sapiens
ggaccugaucuuugcacaa

SEQ ID NO: 1460292 - RNA, 19 nt, Homo sapiens
ccaggaggugcugcauuua

SEQ ID NO: 1460293 - RNA, 19 nt, Homo sapiens
acagaugguccuaaguuug

SEQ ID NO: 1460294 - RNA, 19 nt, Homo sapiens
accagacuuucgacagaua

SEQ ID NO: 1460295 - RNA, 19 nt, Homo sapiens
uaucaugagacuuggaaga

SEQ ID NO: 1460296 - RNA, 19 nt, Homo sapiens
cuugccgcaucucuaaaua

SEQ ID NO: 1460297 - RNA, 19 nt, Homo sapiens
ggaaacagaugcuaauuug

SEQ ID NO: 1460298 - RNA, 19 nt, Homo sapiens
uaaaugagcuguggauuau

SEQ ID NO: 1460299 - RNA, 19 nt, Homo sapiens
gggcacaucugcucgauaa

SEQ ID NO: 1460300 - RNA, 19 nt, Homo sapiens
cgaaagaacugcuugaaca

SEQ ID NO: 1460301 - RNA, 19 nt, Homo sapiens
gggagaaacccauuacaua

SEQ ID NO: 1460302 - RNA, 19 nt, Homo sapiens
gaaauuacucaaacacgua

SEQ ID NO: 1460303 - RNA, 19 nt, Homo sapiens
caucaaaugugcugugguu

SEQ ID NO: 1460304 - RNA, 19 nt, Homo sapiens
agaaacagaugguugcaaa

SEQ ID NO: 1460305 - RNA, 19 nt, Homo sapiens
acagugaucuggaaaauua

SEQ ID NO: 1460306 - RNA, 19 nt, Homo sapiens
gagcugcccuggacggaaa

SEQ ID NO: 1460307 - RNA, 19 nt, Homo sapiens
ggagaaacagcuugaagaa

SEQ ID NO: 1460308 - RNA, 19 nt, Homo sapiens
ggagaaacccauuacauag

SEQ ID NO: 1460309 - RNA, 19 nt, Homo sapiens
ucccagagcuuuaugauuc

SEQ ID NO: 1460310 - RNA, 19 nt, Homo sapiens
gcaaauuggucaggagaug

SEQ ID NO: 1460311 - RNA, 19 nt, Homo sapiens
gcagagaucaccagcaaga

SEQ ID NO: 1460312 - RNA, 19 nt, Homo sapiens
uuaaaugagcuguggauua

SEQ ID NO: 1460313 - RNA, 19 nt, Homo sapiens
ggacauacuucuggagauc

SEQ ID NO: 1460314 - RNA, 19 nt, Homo sapiens
gcaaagccucuauguguga

SEQ ID NO: 1460315 - RNA, 19 nt, Homo sapiens
uaaagucucuuccgcaucu

SEQ ID NO: 1460316 - RNA, 19 nt, Homo sapiens
uggcaaggaugcuaucaaa

SEQ ID NO: 1460317 - RNA, 19 nt, Homo sapiens
gggaaacagaugcuaauuu

SEQ ID NO: 1460318 - RNA, 19 nt, Homo sapiens
gcccaacccuaacaauuau

SEQ ID NO: 1460319 - RNA, 19 nt, Homo sapiens
ccaaaggcuugaaccagaa

SEQ ID NO: 1460320 - RNA, 19 nt, Homo sapiens
gaugggaauuccucagaga

SEQ ID NO: 1460321 - RNA, 19 nt, Homo sapiens
gcaacagaaugagaagcua

SEQ ID NO: 1460322 - RNA, 19 nt, Homo sapiens
gaaaaugaguagugagaug

SEQ ID NO: 1460323 - RNA, 19 nt, Homo sapiens
gagaagcuacaaacaagaa

SEQ ID NO: 1460324 - RNA, 19 nt, Homo sapiens
gaccuacagugaucuggaa

SEQ ID NO: 1460325 - RNA, 19 nt, Homo sapiens
gcaaggaugcuaucaaagg

SEQ ID NO: 1460326 - RNA, 19 nt, Homo sapiens
gagaucaccagcaagauug

SEQ ID NO: 1460327 - RNA, 19 nt, Homo sapiens
guggaaguauuuauagaug

SEQ ID NO: 1460328 - RNA, 19 nt, Homo sapiens
ggaguggaguggcacaauc

SEQ ID NO: 1460329 - RNA, 19 nt, Homo sapiens
gaaccagccaguggaaauu

SEQ ID NO: 1460330 - RNA, 19 nt, Homo sapiens
ucugugaucugaaggcaaa

SEQ ID NO: 1460331 - RNA, 19 nt, Homo sapiens
gcugguggaaguauuuaua

SEQ ID NO: 1460332 - RNA, 19 nt, Homo sapiens
agaaacccauuacauagug

SEQ ID NO: 1460333 - RNA, 19 nt, Homo sapiens
gagaaacccauuacauagu

SEQ ID NO: 1460334 - RNA, 19 nt, Homo sapiens
ugcccaacccuaacaauua

SEQ ID NO: 1460335 - RNA, 19 nt, Homo sapiens
gagcaaggagccugcauuc

SEQ ID NO: 1460336 - RNA, 19 nt, Homo sapiens
aaugagcuguggauuauuc

SEQ ID NO: 1460337 - RNA, 19 nt, Homo sapiens
guaauaaucaagggagaaa

SEQ ID NO: 1460338 - RNA, 19 nt, Homo sapiens
ugaaagacuucgggaaaca

SEQ ID NO: 1460339 - RNA, 19 nt, Homo sapiens
gaggcuggauaccaaauag

SEQ ID NO: 1460340 - RNA, 19 nt, Homo sapiens
cugcagagaucaccagcaa

SEQ ID NO: 1460341 - RNA, 19 nt, Homo sapiens
cguccgacuucgaagguua

SEQ ID NO: 1460342 - RNA, 19 nt, Homo sapiens
caaaugugcugugguucug

SEQ ID NO: 1460343 - RNA, 19 nt, Homo sapiens
gcacaucugcucgauaaca

SEQ ID NO: 1460344 - RNA, 19 nt, Homo sapiens
gcgagcacgugaaagacuu

SEQ ID NO: 1460345 - RNA, 19 nt, Homo sapiens
guacagcaacagaaugaga

SEQ ID NO: 1460346 - RNA, 19 nt, Homo sapiens
guccagcucugugaucuga

SEQ ID NO: 1460347 - RNA, 19 nt, Homo sapiens
gagcuguggauuauucauu

SEQ ID NO: 1460348 - RNA, 19 nt, Homo sapiens
gggaaacugacaucaaaug

SEQ ID NO: 1460349 - RNA, 19 nt, Homo sapiens
cgccuacagugacgaagua

SEQ ID NO: 1460350 - RNA, 19 nt, Homo sapiens
cgaaacagauuuuaaaagg

SEQ ID NO: 1460351 - RNA, 19 nt, Homo sapiens
uugcaaauguggagaaaca

SEQ ID NO: 1460352 - RNA, 19 nt, Homo sapiens
aaacagaugguugcaaaug

SEQ ID NO: 1460353 - RNA, 19 nt, Homo sapiens
ccaccacgcccagcuaauu

SEQ ID NO: 1460354 - RNA, 19 nt, Homo sapiens
acagaugguugcaaaugug

SEQ ID NO: 1460355 - RNA, 19 nt, Homo sapiens
cgugaaagacuucgggaaa

SEQ ID NO: 1460356 - RNA, 19 nt, Homo sapiens
guggaaaccgagcaaauug

SEQ ID NO: 1460357 - RNA, 19 nt, Homo sapiens
acuagaggcuggauaccaa

SEQ ID NO: 1460358 - RNA, 19 nt, Homo sapiens
gaaagaacugcuugaacag

SEQ ID NO: 1460359 - RNA, 19 nt, Homo sapiens
caaagccucuaugugugaa

SEQ ID NO: 1460360 - RNA, 19 nt, Homo sapiens
ucaagggagaaacccauua

SEQ ID NO: 1460361 - RNA, 19 nt, Homo sapiens
gaugcugguggaaguauuu

SEQ ID NO: 1460362 - RNA, 19 nt, Homo sapiens
gaagcuacaaacaagaaau

SEQ ID NO: 1460363 - RNA, 19 nt, Homo sapiens
gaaugagaagcuacaaaca

SEQ ID NO: 1460364 - RNA, 19 nt, Homo sapiens
ugaagaagcgaaagaacug

SEQ ID NO: 1460365 - RNA, 19 nt, Homo sapiens
uuagguacaucgugagcaa

SEQ ID NO: 1460366 - RNA, 19 nt, Homo sapiens
gauggucucgaucucuuaa

SEQ ID NO: 1460367 - RNA, 19 nt, Homo sapiens
ggauggucucgaucucuua

SEQ ID NO: 1460368 - RNA, 19 nt, Homo sapiens
gcgcagugcaugaguacuu

SEQ ID NO: 1460369 - RNA, 19 nt, Homo sapiens
cgagggauguacagcaaca

SEQ ID NO: 1460370 - RNA, 19 nt, Homo sapiens
uugaacagauggauuugga

SEQ ID NO: 1460371 - RNA, 19 nt, Homo sapiens
ccaacccuaacaauuauuu

SEQ ID NO: 1460372 - RNA, 19 nt, Homo sapiens
aaaccuuagucaugacaga

SEQ ID NO: 1460373 - RNA, 19 nt, Homo sapiens
ggaaaacucgaaacagauu

SEQ ID NO: 1460374 - RNA, 19 nt, Homo sapiens
gaaacagaugguugcaaau

SEQ ID NO: 1460375 - RNA, 19 nt, Homo sapiens
ggauguacagcaacagaau

SEQ ID NO: 1460376 - RNA, 19 nt, Homo sapiens
aagaacugcuugaacagau

SEQ ID NO: 1460377 - RNA, 19 nt, Homo sapiens
agagaucaccagcaagauu

SEQ ID NO: 1460378 - RNA, 19 nt, Homo sapiens
cggcagggacagcauguaa

SEQ ID NO: 1460379 - RNA, 19 nt, Homo sapiens
ccaccgugcccaacccuaa

SEQ ID NO: 1460380 - RNA, 19 nt, Homo sapiens
ggucaggagauguuggaaa

SEQ ID NO: 1460381 - RNA, 19 nt, Homo sapiens
acagauggauuuggaaguc

SEQ ID NO: 1460382 - RNA, 19 nt, Homo sapiens
ggaaaccgagcaaauuggu

SEQ ID NO: 1460383 - RNA, 19 nt, Homo sapiens
ggucacggaucgccuacag

SEQ ID NO: 1460384 - RNA, 19 nt, Homo sapiens
ggugcucacugcagagauc

SEQ ID NO: 1460385 - RNA, 19 nt, Homo sapiens
uuguagagauggaguuuca

SEQ ID NO: 1460386 - RNA, 19 nt, Homo sapiens
ugccucagccucccaagua

SEQ ID NO: 1460387 - RNA, 19 nt, Homo sapiens
ccaguggaaauuacucaaa

SEQ ID NO: 1460388 - RNA, 19 nt, Homo sapiens
aaugagaagcuacaaacaa

SEQ ID NO: 1460389 - RNA, 19 nt, Homo sapiens
caccacgcccagcuaauuu

SEQ ID NO: 1460390 - RNA, 19 nt, Homo sapiens
gguggaaguauuuauagau

SEQ ID NO: 1460391 - RNA, 19 nt, Homo sapiens
gugacgaaguacggaauga

SEQ ID NO: 1460392 - RNA, 19 nt, Homo sapiens
gucgagggauguacagcaa

SEQ ID NO: 1460393 - RNA, 19 nt, Homo sapiens
gguucugggugauuuaucu

SEQ ID NO: 1460394 - RNA, 19 nt, Homo sapiens
cgaagggguuguucuguga

SEQ ID NO: 1460395 - RNA, 19 nt, Homo sapiens
caaagucgagggauguaca

SEQ ID NO: 1460396 - RNA, 19 nt, Homo sapiens
acagcgagcacgugaaaga

SEQ ID NO: 1460397 - RNA, 19 nt, Homo sapiens
ggacgaaguuucacucuug

SEQ ID NO: 1460398 - RNA, 19 nt, Homo sapiens
gaaauggagucaauauauc

SEQ ID NO: 1460399 - RNA, 19 nt, Homo sapiens
gcaaggagaugagaaugaa

SEQ ID NO: 1460400 - RNA, 19 nt, Homo sapiens
acagagagcucaagaacaa

SEQ ID NO: 1460401 - RNA, 19 nt, Homo sapiens
gaaccaauguuuucugaua

SEQ ID NO: 1460402 - RNA, 19 nt, Homo sapiens
gaaaucagcgaucguuaug

SEQ ID NO: 1460403 - RNA, 19 nt, Homo sapiens
ccaaguagcugggauuaca

SEQ ID NO: 1460404 - RNA, 19 nt, Homo sapiens
ggaagaacuugaugaacca

SEQ ID NO: 1460405 - RNA, 19 nt, Homo sapiens
gcagagaauacaagaacua

SEQ ID NO: 1460406 - RNA, 19 nt, Homo sapiens
gagaugagaaugaauaugg

SEQ ID NO: 1460407 - RNA, 19 nt, Homo sapiens
ggaagcaacacuagacuca

SEQ ID NO: 1460408 - RNA, 19 nt, Homo sapiens
gcaaaacacuagcugaaau

SEQ ID NO: 1460409 - RNA, 19 nt, Homo sapiens
gagcagaguggaagaacuu

SEQ ID NO: 1460410 - RNA, 19 nt, Homo sapiens
caguggauccgauagaaua

SEQ ID NO: 1460411 - RNA, 19 nt, Homo sapiens
uggauccgauagaauauuu

SEQ ID NO: 1460412 - RNA, 19 nt, Homo sapiens
caaccuaagagcaauaaau

SEQ ID NO: 1460413 - RNA, 19 nt, Homo sapiens
aaucagcgaucguuaugga

SEQ ID NO: 1460414 - RNA, 19 nt, Homo sapiens
gagagcucaagaacaauua

SEQ ID NO: 1460415 - RNA, 19 nt, Homo sapiens
ccuaagagcaauaaauguu

SEQ ID NO: 1460416 - RNA, 19 nt, Homo sapiens
gaagauauucuacauucag

SEQ ID NO: 1460417 - RNA, 19 nt, Homo sapiens
ggagcgugaaagagaauua

SEQ ID NO: 1460418 - RNA, 19 nt, Homo sapiens
ggauuuacaaguauaagga

SEQ ID NO: 1460419 - RNA, 19 nt, Homo sapiens
caaccaaccuaagagcaau

SEQ ID NO: 1460420 - RNA, 19 nt, Homo sapiens
gcuggagcgugaaagagaa

SEQ ID NO: 1460421 - RNA, 19 nt, Homo sapiens
gaacuugaugaaccaaugu

SEQ ID NO: 1460422 - RNA, 19 nt, Homo sapiens
aaggagaugagaaugaaua

SEQ ID NO: 1460423 - RNA, 19 nt, Homo sapiens
gaccauggaacaacugaga

SEQ ID NO: 1460424 - RNA, 19 nt, Homo sapiens
gcagaaguggcaagaguuc

SEQ ID NO: 1460425 - RNA, 19 nt, Homo sapiens
ugaaaucagcgaucguuau

SEQ ID NO: 1460426 - RNA, 19 nt, Homo sapiens
gagaauacaagaacuacag

SEQ ID NO: 1460427 - RNA, 19 nt, Homo sapiens
gaaaaucuaguuaggaaug

SEQ ID NO: 1460428 - RNA, 19 nt, Homo sapiens
gggacgaaguuucacucuu

SEQ ID NO: 1460429 - RNA, 19 nt, Homo sapiens
ggcaaggagaugagaauga

SEQ ID NO: 1460430 - RNA, 19 nt, Homo sapiens
gcagcuagaguuggaaaug

SEQ ID NO: 1460431 - RNA, 19 nt, Homo sapiens
cgaaguuucacucuuguug

SEQ ID NO: 1460432 - RNA, 19 nt, Homo sapiens
gauuacaggaguuagaaau

SEQ ID NO: 1460433 - RNA, 19 nt, Homo sapiens
agaacuugaugaaccaaug

SEQ ID NO: 1460434 - RNA, 19 nt, Homo sapiens
ugccucagccuuccaagua

SEQ ID NO: 1460435 - RNA, 19 nt, Homo sapiens
gacgaaguuucacucuugu

SEQ ID NO: 1460436 - RNA, 19 nt, Homo sapiens
gaugagaaugaauauggaa

SEQ ID NO: 1460437 - RNA, 19 nt, Homo sapiens
gagaauuagcucugaugga

SEQ ID NO: 1460438 - RNA, 19 nt, Homo sapiens
uuacaggaguuagaaaugg

SEQ ID NO: 1460439 - RNA, 19 nt, Homo sapiens
ggagaggcagagaauacaa

SEQ ID NO: 1460440 - RNA, 19 nt, Homo sapiens
gcucuuacuucagcagcaa

SEQ ID NO: 1460441 - RNA, 19 nt, Homo sapiens
ccaaccaaccuaagagcaa

SEQ ID NO: 1460442 - RNA, 19 nt, Homo sapiens
uaacuugagcagaguggaa

SEQ ID NO: 1460443 - RNA, 19 nt, Homo sapiens
uuauggagcaccuaacuug

SEQ ID NO: 1460444 - RNA, 19 nt, Homo sapiens
gggauuacaggaguuagaa

SEQ ID NO: 1460445 - RNA, 19 nt, Homo sapiens
cauugcagcuagaguugga

SEQ ID NO: 1460446 - RNA, 19 nt, Homo sapiens
ggaguuagaaauggaguca

SEQ ID NO: 1460447 - RNA, 19 nt, Homo sapiens
caagcuggagcgugaaaga

SEQ ID NO: 1460448 - RNA, 19 nt, Homo sapiens
ggaccaaccaaccuaagag

SEQ ID NO: 1460449 - RNA, 19 nt, Homo sapiens
gcauuaaacauugaucaag

SEQ ID NO: 1460450 - RNA, 19 nt, Homo sapiens
gcagaguggaagaacuuga

SEQ ID NO: 1460451 - RNA, 19 nt, Homo sapiens
uauucuacauucagaggaa

SEQ ID NO: 1460452 - RNA, 19 nt, Homo sapiens
caacugagacaaaaggaaa

SEQ ID NO: 1460453 - RNA, 19 nt, Homo sapiens
aaccuaagagcaauaaaug

SEQ ID NO: 1460454 - RNA, 19 nt, Homo sapiens
cuaguuaggaaugaagaua

SEQ ID NO: 1460455 - RNA, 19 nt, Homo sapiens
uggaaaaucuaguuaggaa

SEQ ID NO: 1460456 - RNA, 19 nt, Homo sapiens
gaaaaggagaggcagagaa

SEQ ID NO: 1460457 - RNA, 19 nt, Homo sapiens
aguuagaaauggagucaau

SEQ ID NO: 1460458 - RNA, 19 nt, Homo sapiens
uacaggaguuagaaaugga

SEQ ID NO: 1460459 - RNA, 19 nt, Homo sapiens
ggauuacaggaguuagaaa

SEQ ID NO: 1460460 - RNA, 19 nt, Homo sapiens
gauccgauagaauauuuag

SEQ ID NO: 1460461 - RNA, 19 nt, Homo sapiens
guuagaaauggagucaaua

SEQ ID NO: 1460462 - RNA, 19 nt, Homo sapiens
gcugggauuacaggaguua

SEQ ID NO: 1460463 - RNA, 19 nt, Homo sapiens
agaugagaaugaauaugga

SEQ ID NO: 1460464 - RNA, 19 nt, Homo sapiens
agagagcucaagaacaauu

SEQ ID NO: 1460465 - RNA, 19 nt, Homo sapiens
cuacagagagcucaagaac

SEQ ID NO: 1460466 - RNA, 19 nt, Homo sapiens
gaguuggaaaugcaagaaa

SEQ ID NO: 1460467 - RNA, 19 nt, Homo sapiens
ggagucaauauaucuucaa

SEQ ID NO: 1460468 - RNA, 19 nt, Homo sapiens
ggauccgauagaauauuua

SEQ ID NO: 1460469 - RNA, 19 nt, Homo sapiens
gaacuacagagagcucaag

SEQ ID NO: 1460470 - RNA, 19 nt, Homo sapiens
cccaguggauccgauagaa

SEQ ID NO: 1460471 - RNA, 19 nt, Homo sapiens
gaguggaagaacuugauga

SEQ ID NO: 1460472 - RNA, 19 nt, Homo sapiens
gauggagcaggaaaugaug

SEQ ID NO: 1460473 - RNA, 19 nt, Homo sapiens
caauuaggcaaggagauga

SEQ ID NO: 1460474 - RNA, 19 nt, Homo sapiens
ugauggagcaggaaaugau

SEQ ID NO: 1460475 - RNA, 19 nt, Homo sapiens
ggagaugagaaugaauaug

SEQ ID NO: 1460476 - RNA, 19 nt, Homo sapiens
aauacaagaacuacagaga

SEQ ID NO: 1460477 - RNA, 19 nt, Homo sapiens
gagaggcagagaauacaag

SEQ ID NO: 1460478 - RNA, 19 nt, Homo sapiens
uggagucaauauaucuuca

SEQ ID NO: 1460479 - RNA, 19 nt, Homo sapiens
acaauuaggcaaggagaug

SEQ ID NO: 1460480 - RNA, 19 nt, Homo sapiens
cuguuuaacucaaggucuu

SEQ ID NO: 1460481 - RNA, 19 nt, Homo sapiens
aaaggagaggcagagaaua

SEQ ID NO: 1460482 - RNA, 19 nt, Homo sapiens
cagcuagaguuggaaaugc

SEQ ID NO: 1460483 - RNA, 19 nt, Homo sapiens
gaacaacugagacaaaagg

SEQ ID NO: 1460484 - RNA, 19 nt, Homo sapiens
gcgcguguguagggacgaa

SEQ ID NO: 1460485 - RNA, 19 nt, Homo sapiens
cagaggaagcaacacuaga

SEQ ID NO: 1460486 - RNA, 19 nt, Homo sapiens
guguagggacgaaguuuca

SEQ ID NO: 1460487 - RNA, 19 nt, Homo sapiens
acacuagacucaggcaaaa

SEQ ID NO: 1460488 - RNA, 19 nt, Homo sapiens
ccgauagaauauuuagcau

SEQ ID NO: 1460489 - RNA, 19 nt, Homo sapiens
ggcauugcagcuagaguug

SEQ ID NO: 1460490 - RNA, 19 nt, Homo sapiens
guaccuaggucuucuuuaa

SEQ ID NO: 1460491 - RNA, 19 nt, Homo sapiens
ggaaagcaguacaugauuu

SEQ ID NO: 1460492 - RNA, 19 nt, Homo sapiens
ccagaagucuuacugauaa

SEQ ID NO: 1460493 - RNA, 19 nt, Homo sapiens
gaaguggacuaucauaaag

SEQ ID NO: 1460494 - RNA, 19 nt, Homo sapiens
ggacuaagugggaaugaua

SEQ ID NO: 1460495 - RNA, 19 nt, Homo sapiens
guaacaaguucccaggaua

SEQ ID NO: 1460496 - RNA, 19 nt, Homo sapiens
ggaaguggacuaucauaaa

SEQ ID NO: 1460497 - RNA, 19 nt, Homo sapiens
guagaucagugguucuuaa

SEQ ID NO: 1460498 - RNA, 19 nt, Homo sapiens
cccagaagcuuaacuacua

SEQ ID NO: 1460499 - RNA, 19 nt, Homo sapiens
gaaagaagcugcugaaaac

SEQ ID NO: 1460500 - RNA, 19 nt, Homo sapiens
gaaccauacugcuauagau

SEQ ID NO: 1460501 - RNA, 19 nt, Homo sapiens
gaucagugguucuuaaaca

SEQ ID NO: 1460502 - RNA, 19 nt, Homo sapiens
caaagucuccagaaguuua

SEQ ID NO: 1460503 - RNA, 19 nt, Homo sapiens
caacuguacuuugcuauau

SEQ ID NO: 1460504 - RNA, 19 nt, Homo sapiens
cccaggauauguugauuua

SEQ ID NO: 1460505 - RNA, 19 nt, Homo sapiens
gaagaaagaagcugcugaa

SEQ ID NO: 1460506 - RNA, 19 nt, Homo sapiens
gggugaagcccaagaauuu

SEQ ID NO: 1460507 - RNA, 19 nt, Homo sapiens
ggaauuacacugaaucugu

SEQ ID NO: 1460508 - RNA, 19 nt, Homo sapiens
caggauauguugauuuaug

SEQ ID NO: 1460509 - RNA, 19 nt, Homo sapiens
cuucuaauccuguaucuua

SEQ ID NO: 1460510 - RNA, 19 nt, Homo sapiens
uaagcagacuugcacaauu

SEQ ID NO: 1460511 - RNA, 19 nt, Homo sapiens
ccaauuugccuugauguua

SEQ ID NO: 1460512 - RNA, 19 nt, Homo sapiens
guacuuugcuauauucauc

SEQ ID NO: 1460513 - RNA, 19 nt, Homo sapiens
gaagugaaagacauguuaa

SEQ ID NO: 1460514 - RNA, 19 nt, Homo sapiens
cagugguucuuaaacauua

SEQ ID NO: 1460515 - RNA, 19 nt, Homo sapiens
gagagaaccaccaccaauu

SEQ ID NO: 1460516 - RNA, 19 nt, Homo sapiens
acacauuucucauuacaug

SEQ ID NO: 1460517 - RNA, 19 nt, Homo sapiens
ggaaagggaaggagucaga

SEQ ID NO: 1460518 - RNA, 19 nt, Homo sapiens
ccagaagcuuaacuacuaa

SEQ ID NO: 1460519 - RNA, 19 nt, Homo sapiens
ggauauauguauguguuug

SEQ ID NO: 1460520 - RNA, 19 nt, Homo sapiens
ggaaaaggcaauguuauua

SEQ ID NO: 1460521 - RNA, 19 nt, Homo sapiens
gacagaauguaaacaaagu

SEQ ID NO: 1460522 - RNA, 19 nt, Homo sapiens
gaccagaagucuuacugau

SEQ ID NO: 1460523 - RNA, 19 nt, Homo sapiens
ugagaaccauacugcuaua

SEQ ID NO: 1460524 - RNA, 19 nt, Homo sapiens
ugaagugaaagacauguua

SEQ ID NO: 1460525 - RNA, 19 nt, Homo sapiens
aacaaagucuccagaaguu

SEQ ID NO: 1460526 - RNA, 19 nt, Homo sapiens
uagcuggaauucucauaaa

SEQ ID NO: 1460527 - RNA, 19 nt, Homo sapiens
uaaacaaagucuccagaag

SEQ ID NO: 1460528 - RNA, 19 nt, Homo sapiens
ggaauucucauaaaguuag

SEQ ID NO: 1460529 - RNA, 19 nt, Homo sapiens
caauuugccuugauguuag

SEQ ID NO: 1460530 - RNA, 19 nt, Homo sapiens
ggccaaauuuccacuuuca

SEQ ID NO: 1460531 - RNA, 19 nt, Homo sapiens
gaaagacauguuaagaaug

SEQ ID NO: 1460532 - RNA, 19 nt, Homo sapiens
gcuaugaagugaaagacau

SEQ ID NO: 1460533 - RNA, 19 nt, Homo sapiens
gaauuaagcagcaaauacu

SEQ ID NO: 1460534 - RNA, 19 nt, Homo sapiens
ggaccucuuucacaauugu

SEQ ID NO: 1460535 - RNA, 19 nt, Homo sapiens
aagcagacuugcacaauuc

SEQ ID NO: 1460536 - RNA, 19 nt, Homo sapiens
gaaguucaccugcacaucu

SEQ ID NO: 1460537 - RNA, 19 nt, Homo sapiens
gugaaagacauguuaagaa

SEQ ID NO: 1460538 - RNA, 19 nt, Homo sapiens
aaauacaguugacccuuga

SEQ ID NO: 1460539 - RNA, 19 nt, Homo sapiens
guuuagcuaugaagugaaa

SEQ ID NO: 1460540 - RNA, 19 nt, Homo sapiens
guaaacaaagucuccagaa

SEQ ID NO: 1460541 - RNA, 19 nt, Homo sapiens
ggaaugauaaagacagaau

SEQ ID NO: 1460542 - RNA, 19 nt, Homo sapiens
aaauguagcuggaauucuc

SEQ ID NO: 1460543 - RNA, 19 nt, Homo sapiens
acucugggauuaaugcuaa

SEQ ID NO: 1460544 - RNA, 19 nt, Homo sapiens
ugaagacucugggauuaau

SEQ ID NO: 1460545 - RNA, 19 nt, Homo sapiens
ccaccaauuugccuugaug

SEQ ID NO: 1460546 - RNA, 19 nt, Homo sapiens
gagaaccaccaccaauuug

SEQ ID NO: 1460547 - RNA, 19 nt, Homo sapiens
caucaagaaugugagagaa

SEQ ID NO: 1460548 - RNA, 19 nt, Homo sapiens
gcacaauucaagccuguau

SEQ ID NO: 1460549 - RNA, 19 nt, Homo sapiens
gaaguuuagcuaugaagug

SEQ ID NO: 1460550 - RNA, 19 nt, Homo sapiens
aaacaaagucuccagaagu

SEQ ID NO: 1460551 - RNA, 19 nt, Homo sapiens
uaagugggaaugauaaaga

SEQ ID NO: 1460552 - RNA, 19 nt, Homo sapiens
uaacaaguucccaggauau

SEQ ID NO: 1460553 - RNA, 19 nt, Homo sapiens
agagaaccaccaccaauuu

SEQ ID NO: 1460554 - RNA, 19 nt, Homo sapiens
ccuaggucuucuuuaauuu

SEQ ID NO: 1460555 - RNA, 19 nt, Homo sapiens
ggagccaaaggccaaauuu

SEQ ID NO: 1460556 - RNA, 19 nt, Homo sapiens
aagcagccauacaaauauu

SEQ ID NO: 1460557 - RNA, 19 nt, Homo sapiens
cauaaacagucaauuaacg

SEQ ID NO: 1460558 - RNA, 19 nt, Homo sapiens
aaaagcagccauacaaaua

SEQ ID NO: 1460559 - RNA, 19 nt, Homo sapiens
ccagaaguuuagcuaugaa

SEQ ID NO: 1460560 - RNA, 19 nt, Homo sapiens
gcuguuagcccgaagaaag

SEQ ID NO: 1460561 - RNA, 19 nt, Homo sapiens
guagcuggaauucucauaa

SEQ ID NO: 1460562 - RNA, 19 nt, Homo sapiens
cuuagaaacucugauacaa

SEQ ID NO: 1460563 - RNA, 19 nt, Homo sapiens
uaacuuggauuuucugugu

SEQ ID NO: 1460564 - RNA, 19 nt, Homo sapiens
aagaagggcuuguuaaaau

SEQ ID NO: 1460565 - RNA, 19 nt, Homo sapiens
gggauuaaugcuaaauuug

SEQ ID NO: 1460566 - RNA, 19 nt, Homo sapiens
gccacugccucauuuaaca

SEQ ID NO: 1460567 - RNA, 19 nt, Homo sapiens
gaaagcaguacaugauuuu

SEQ ID NO: 1460568 - RNA, 19 nt, Homo sapiens
ugggaccucuuucacaauu

SEQ ID NO: 1460569 - RNA, 19 nt, Homo sapiens
ggacuaucauaaaggucuu

SEQ ID NO: 1460570 - RNA, 19 nt, Homo sapiens
caaguucccaggauauguu

SEQ ID NO: 1460571 - RNA, 19 nt, Homo sapiens
aacauuagccuguaucaga

SEQ ID NO: 1460572 - RNA, 19 nt, Homo sapiens
cuggaauucucauaaaguu

SEQ ID NO: 1460573 - RNA, 19 nt, Homo sapiens
auugaagacucugggauua

SEQ ID NO: 1460574 - RNA, 19 nt, Homo sapiens
uaacaccauugaagacucu

SEQ ID NO: 1460575 - RNA, 19 nt, Homo sapiens
ucaacuguacuuugcuaua

SEQ ID NO: 1460576 - RNA, 19 nt, Homo sapiens
guaaauguagcuggaauuc

SEQ ID NO: 1460577 - RNA, 19 nt, Homo sapiens
agaugccacugccucauuu

SEQ ID NO: 1460578 - RNA, 19 nt, Homo sapiens
uggcagaggugaaagaaaa

SEQ ID NO: 1460579 - RNA, 19 nt, Homo sapiens
aaguuuagcuaugaaguga

SEQ ID NO: 1460580 - RNA, 19 nt, Homo sapiens
accuaggucuucuuuaauu

SEQ ID NO: 1460581 - RNA, 19 nt, Homo sapiens
uccagaaguuuagcuauga

SEQ ID NO: 1460582 - RNA, 19 nt, Homo sapiens
gugaaugcuguguaugaua

SEQ ID NO: 1460583 - RNA, 19 nt, Homo sapiens
caauaaaguaagcuaagga

SEQ ID NO: 1460584 - RNA, 19 nt, Homo sapiens
augcauauuugaaggacua

SEQ ID NO: 1460585 - RNA, 19 nt, Homo sapiens
agaagggcuuguuaaaaua

SEQ ID NO: 1460586 - RNA, 19 nt, Homo sapiens
uaccuuagaaacucugaua

SEQ ID NO: 1460587 - RNA, 19 nt, Homo sapiens
guuaagucaucaggagauu

SEQ ID NO: 1460588 - RNA, 19 nt, Homo sapiens
uaaggaaaaggcaauguua

SEQ ID NO: 1460589 - RNA, 19 nt, Homo sapiens
cugauaacauaaacaguca

SEQ ID NO: 1460590 - RNA, 19 nt, Homo sapiens
uaacaagacugcagacuuu

SEQ ID NO: 1460591 - RNA, 19 nt, Homo sapiens
gaaauaggcguacuuuaaa

SEQ ID NO: 1460592 - RNA, 19 nt, Homo sapiens
gaaguuauaucucucuguu

SEQ ID NO: 1460593 - RNA, 19 nt, Homo sapiens
uauguuaggugcucaauaa

SEQ ID NO: 1460594 - RNA, 19 nt, Homo sapiens
ccauuaaccuucugcauuu

SEQ ID NO: 1460595 - RNA, 19 nt, Homo sapiens
caucuuagccuccagaaua

SEQ ID NO: 1460596 - RNA, 19 nt, Homo sapiens
agucacagguguaauaaua

SEQ ID NO: 1460597 - RNA, 19 nt, Homo sapiens
agaaauaggcguacuuuaa

SEQ ID NO: 1460598 - RNA, 19 nt, Homo sapiens
cgacaaacguggucugaga

SEQ ID NO: 1460599 - RNA, 19 nt, Homo sapiens
gagacugccugccggcuua

SEQ ID NO: 1460600 - RNA, 19 nt, Homo sapiens
gcaacuucuuugucaauuu

SEQ ID NO: 1460601 - RNA, 19 nt, Homo sapiens
agagagaggcugagaauaa

SEQ ID NO: 1460602 - RNA, 19 nt, Homo sapiens
gagcaguggugcaauuaug

SEQ ID NO: 1460603 - RNA, 19 nt, Homo sapiens
gauguugagugcuccagua

SEQ ID NO: 1460604 - RNA, 19 nt, Homo sapiens
agaaaucgaugcagagaga

SEQ ID NO: 1460605 - RNA, 19 nt, Homo sapiens
gagauagagugacuaaagu

SEQ ID NO: 1460606 - RNA, 19 nt, Homo sapiens
caacuucuuugucaauuuc

SEQ ID NO: 1460607 - RNA, 19 nt, Homo sapiens
gcuagucacagguguaaua

SEQ ID NO: 1460608 - RNA, 19 nt, Homo sapiens
ggagugcgguggcuaguca

SEQ ID NO: 1460609 - RNA, 19 nt, Homo sapiens
ggagauagagugacuaaag

SEQ ID NO: 1460610 - RNA, 19 nt, Homo sapiens
gcaaggcaauggaaauucu

SEQ ID NO: 1460611 - RNA, 19 nt, Homo sapiens
uuaacgaaauggugacuaa

SEQ ID NO: 1460612 - RNA, 19 nt, Homo sapiens
cuaagaaguugacauaaag

SEQ ID NO: 1460613 - RNA, 19 nt, Homo sapiens
gggcaacuauauauauguu

SEQ ID NO: 1460614 - RNA, 19 nt, Homo sapiens
gaaauggugacuaauguuc

SEQ ID NO: 1460615 - RNA, 19 nt, Homo sapiens
aucaaugucuucucacuua

SEQ ID NO: 1460616 - RNA, 19 nt, Homo sapiens
gagagaggcugagaauaag

SEQ ID NO: 1460617 - RNA, 19 nt, Homo sapiens
gcagagagaggcugagaau

SEQ ID NO: 1460618 - RNA, 19 nt, Homo sapiens
ugacuaaagugaugugagu

SEQ ID NO: 1460619 - RNA, 19 nt, Homo sapiens
gaauugguauaaacuugga

SEQ ID NO: 1460620 - RNA, 19 nt, Homo sapiens
aaacacaucuugaauugcu

SEQ ID NO: 1460621 - RNA, 19 nt, Homo sapiens
guaaacagugauucucuuu

SEQ ID NO: 1460622 - RNA, 19 nt, Homo sapiens
ccaccuggccuuaucauug

SEQ ID NO: 1460623 - RNA, 19 nt, Homo sapiens
aagggauccucacaucuua

SEQ ID NO: 1460624 - RNA, 19 nt, Homo sapiens
gcacugcagucuccaacuc

SEQ ID NO: 1460625 - RNA, 19 nt, Homo sapiens
caagggauccucacaucuu

SEQ ID NO: 1460626 - RNA, 19 nt, Homo sapiens
gugauucucuuuauaucug

SEQ ID NO: 1460627 - RNA, 19 nt, Homo sapiens
gaacuuucccauuaaccuu

SEQ ID NO: 1460628 - RNA, 19 nt, Homo sapiens
ggaaaguuuugcagaauga

SEQ ID NO: 1460629 - RNA, 19 nt, Homo sapiens
gaaucaaugucuucucacu

SEQ ID NO: 1460630 - RNA, 19 nt, Homo sapiens
gauagagugacuaaaguga

SEQ ID NO: 1460631 - RNA, 19 nt, Homo sapiens
gaaaagacagaaacuaaga

SEQ ID NO: 1460632 - RNA, 19 nt, Homo sapiens
gaaggaauuauagauguug

SEQ ID NO: 1460633 - RNA, 19 nt, Homo sapiens
ucacugcggccucgacuuu

SEQ ID NO: 1460634 - RNA, 19 nt, Homo sapiens
gauuuccuuuccauucuuu

SEQ ID NO: 1460635 - RNA, 19 nt, Homo sapiens
gaacagcggagcgcggaaa

SEQ ID NO: 1460636 - RNA, 19 nt, Homo sapiens
uagagugacuaaagugaug

SEQ ID NO: 1460637 - RNA, 19 nt, Homo sapiens
ugggauagcagagaaguua

SEQ ID NO: 1460638 - RNA, 19 nt, Homo sapiens
cauuaaccuucugcauuua

SEQ ID NO: 1460639 - RNA, 19 nt, Homo sapiens
gcagaaugauuuccuuucc

SEQ ID NO: 1460640 - RNA, 19 nt, Homo sapiens
ggauagcagagaaguuaaa

SEQ ID NO: 1460641 - RNA, 19 nt, Homo sapiens
aagacuggcuccaaggaaa

SEQ ID NO: 1460642 - RNA, 19 nt, Homo sapiens
ucaaugucuucucacuuaa

SEQ ID NO: 1460643 - RNA, 19 nt, Homo sapiens
caccuggccuuaucauugu

SEQ ID NO: 1460644 - RNA, 19 nt, Homo sapiens
gguuagauuuaaagaagug

SEQ ID NO: 1460645 - RNA, 19 nt, Homo sapiens
caaggaaaguuuugcagaa

SEQ ID NO: 1460646 - RNA, 19 nt, Homo sapiens
guaaugagagacugugugu

SEQ ID NO: 1460647 - RNA, 19 nt, Homo sapiens
gggaaaagacagaaacuaa

SEQ ID NO: 1460648 - RNA, 19 nt, Homo sapiens
gagagacuguguguguaug

SEQ ID NO: 1460649 - RNA, 19 nt, Homo sapiens
cagcugcacuuggcuuaga

SEQ ID NO: 1460650 - RNA, 19 nt, Homo sapiens
gucguucccucuacccuaa

SEQ ID NO: 1460651 - RNA, 19 nt, Homo sapiens
guacugugauagagauugg

SEQ ID NO: 1460652 - RNA, 19 nt, Homo sapiens
gagacuguguguguauguu

SEQ ID NO: 1460653 - RNA, 19 nt, Homo sapiens
guugagugcuccaguaaac

SEQ ID NO: 1460654 - RNA, 19 nt, Homo sapiens
acgaaauggugacuaaugu

SEQ ID NO: 1460655 - RNA, 19 nt, Homo sapiens
aguuauaucucucuguuuc

SEQ ID NO: 1460656 - RNA, 19 nt, Homo sapiens
cugaauugguauaaacuug

SEQ ID NO: 1460657 - RNA, 19 nt, Homo sapiens
uuaaucagcuaacaagacu

SEQ ID NO: 1460658 - RNA, 19 nt, Homo sapiens
cagaaauaggcguacuuua

SEQ ID NO: 1460659 - RNA, 19 nt, Homo sapiens
aagcaagagucacaaacug

SEQ ID NO: 1460660 - RNA, 19 nt, Homo sapiens
caccuugaauuaaguucuu

SEQ ID NO: 1460661 - RNA, 19 nt, Homo sapiens
uuagugugauguaaugaga

SEQ ID NO: 1460662 - RNA, 19 nt, Homo sapiens
ucacagguguaauaauagg

SEQ ID NO: 1460663 - RNA, 19 nt, Homo sapiens
agaaugauuuccuuuccau

SEQ ID NO: 1460664 - RNA, 19 nt, Homo sapiens
ggugacuaauguucuggaa

SEQ ID NO: 1460665 - RNA, 19 nt, Homo sapiens
uaaaugcagccaugagcaa

SEQ ID NO: 1460666 - RNA, 19 nt, Homo sapiens
ugggagggcugcgcaagaa

SEQ ID NO: 1460667 - RNA, 19 nt, Homo sapiens
ggugagaugcuugggauga

SEQ ID NO: 1460668 - RNA, 19 nt, Homo sapiens
uggaaauucuaccugcauu

SEQ ID NO: 1460669 - RNA, 19 nt, Homo sapiens
gaaguggcaaggcaaugga

SEQ ID NO: 1460670 - RNA, 19 nt, Homo sapiens
agacuguguguguauguua

SEQ ID NO: 1460671 - RNA, 19 nt, Homo sapiens
ccaaagcgcaccgcccaaa

SEQ ID NO: 1460672 - RNA, 19 nt, Homo sapiens
guucuuaaacacaucuuga

SEQ ID NO: 1460673 - RNA, 19 nt, Homo sapiens
aaugagagacugugugugu

SEQ ID NO: 1460674 - RNA, 19 nt, Homo sapiens
cccauuaaccuucugcauu

SEQ ID NO: 1460675 - RNA, 19 nt, Homo sapiens
gacaaacguggucugagaa

SEQ ID NO: 1460676 - RNA, 19 nt, Homo sapiens
gcacccugguucucuuucu

SEQ ID NO: 1460677 - RNA, 19 nt, Homo sapiens
aaguacaccuugaauuaag

SEQ ID NO: 1460678 - RNA, 19 nt, Homo sapiens
cgaaauggugacuaauguu

SEQ ID NO: 1460679 - RNA, 19 nt, Homo sapiens
cguggugggugucauagau

SEQ ID NO: 1460680 - RNA, 19 nt, Homo sapiens
ggccuuaucauuguucuau

SEQ ID NO: 1460681 - RNA, 19 nt, Homo sapiens
guauguaucucagagucau

SEQ ID NO: 1460682 - RNA, 19 nt, Homo sapiens
cuaacaagacugcagacuu

SEQ ID NO: 1460683 - RNA, 19 nt, Homo sapiens
acagaaauaggcguacuuu

SEQ ID NO: 1460684 - RNA, 19 nt, Homo sapiens
gugcuccaguaaacaguga

SEQ ID NO: 1460685 - RNA, 19 nt, Homo sapiens
cuggagcaguggugcaauu

SEQ ID NO: 1460686 - RNA, 19 nt, Homo sapiens
caagacuggcuccaaggaa

SEQ ID NO: 1460687 - RNA, 19 nt, Homo sapiens
uggugggugucauagauaa

SEQ ID NO: 1460688 - RNA, 19 nt, Homo sapiens
ucacuuaaucagcuaacaa

SEQ ID NO: 1460689 - RNA, 19 nt, Homo sapiens
caaggcaauggaaauucua

SEQ ID NO: 1460690 - RNA, 19 nt, Homo sapiens
ccaaggaggugaacuuuaa

SEQ ID NO: 1460691 - RNA, 19 nt, Homo sapiens
gaaaccauaugaagaguga

SEQ ID NO: 1460692 - RNA, 19 nt, Homo sapiens
gagccaaggucacugaauu

SEQ ID NO: 1460693 - RNA, 19 nt, Homo sapiens
caagaaggcacaucugaaa

SEQ ID NO: 1460694 - RNA, 19 nt, Homo sapiens
aaacacagcgcuauaaaga

SEQ ID NO: 1460695 - RNA, 19 nt, Homo sapiens
gcaaauauguaaagaaacc

SEQ ID NO: 1460696 - RNA, 19 nt, Homo sapiens
aggcacaucugaaaccaua

SEQ ID NO: 1460697 - RNA, 19 nt, Homo sapiens
ccaagaccuucaugagaaa

SEQ ID NO: 1460698 - RNA, 19 nt, Homo sapiens
gcucagaggccaaguauac

SEQ ID NO: 1460699 - RNA, 19 nt, Homo sapiens
uccaagaccuucaugagaa

SEQ ID NO: 1460700 - RNA, 19 nt, Homo sapiens
ccagugagcaauaaagaaa

SEQ ID NO: 1460701 - RNA, 19 nt, Homo sapiens
aagaacagcugcgggaauu

SEQ ID NO: 1460702 - RNA, 19 nt, Homo sapiens
aaaaggggaugaaauguuu

SEQ ID NO: 1460703 - RNA, 19 nt, Homo sapiens
gacaugaaccacuguguga

SEQ ID NO: 1460704 - RNA, 19 nt, Homo sapiens
gccaaggaauguccaagga

SEQ ID NO: 1460705 - RNA, 19 nt, Homo sapiens
ggaaugcaaauauguaaag

SEQ ID NO: 1460706 - RNA, 19 nt, Homo sapiens
caaggaggaugacaugaac

SEQ ID NO: 1460707 - RNA, 19 nt, Homo sapiens
gauccuggaaugcaaauau

SEQ ID NO: 1460708 - RNA, 19 nt, Homo sapiens
gaacagcugcgggaauugu

SEQ ID NO: 1460709 - RNA, 19 nt, Homo sapiens
acacagcgcuauaaagaac

SEQ ID NO: 1460710 - RNA, 19 nt, Homo sapiens
ccaaggaggaugacaugaa

SEQ ID NO: 1460711 - RNA, 19 nt, Homo sapiens
gaauaaagaggcugcuucu

SEQ ID NO: 1460712 - RNA, 19 nt, Homo sapiens
gcgcagagucucccaagga

SEQ ID NO: 1460713 - RNA, 19 nt, Homo sapiens
gcacaucugaaaccauaug

SEQ ID NO: 1460714 - RNA, 19 nt, Homo sapiens
gaaggcacaucugaaacca

SEQ ID NO: 1460715 - RNA, 19 nt, Homo sapiens
ucacggagagggccaagaa

SEQ ID NO: 1460716 - RNA, 19 nt, Homo sapiens
gaaaacacagcgcuauaaa

SEQ ID NO: 1460717 - RNA, 19 nt, Homo sapiens
gaagagugaggagaaaugu

SEQ ID NO: 1460718 - RNA, 19 nt, Homo sapiens
gaauguccaaggaggauga

SEQ ID NO: 1460719 - RNA, 19 nt, Homo sapiens
ccaagaaggcacaucugaa

SEQ ID NO: 1460720 - RNA, 19 nt, Homo sapiens
gacgguugcaugucauuaa

SEQ ID NO: 1460721 - RNA, 19 nt, Homo sapiens
ugagaaaccugccaaucac

SEQ ID NO: 1460722 - RNA, 19 nt, Homo sapiens
gccaagaaggcacaucuga

SEQ ID NO: 1460723 - RNA, 19 nt, Homo sapiens
uaugaagagugaggagaaa

SEQ ID NO: 1460724 - RNA, 19 nt, Homo sapiens
ggcacgagauacacuguca

SEQ ID NO: 1460725 - RNA, 19 nt, Homo sapiens
caugaaccacugugugaaa

SEQ ID NO: 1460726 - RNA, 19 nt, Homo sapiens
caucugaaaccauaugaag

SEQ ID NO: 1460727 - RNA, 19 nt, Homo sapiens
ccaaucacaccaggcuaua

SEQ ID NO: 1460728 - RNA, 19 nt, Homo sapiens
gagaaaacacagcgcuaua

SEQ ID NO: 1460729 - RNA, 19 nt, Homo sapiens
ccacuguccuccgcaaagu

SEQ ID NO: 1460730 - RNA, 19 nt, Homo sapiens
ugaagagugaggagaaaug

SEQ ID NO: 1460731 - RNA, 19 nt, Homo sapiens
cgagagccaaggucacuga

SEQ ID NO: 1460732 - RNA, 19 nt, Homo sapiens
gaggcugcuucuccgcaaa

SEQ ID NO: 1460733 - RNA, 19 nt, Homo sapiens
acauguggcugugcucaga

SEQ ID NO: 1460734 - RNA, 19 nt, Homo sapiens
aagcugcccugcccuugga

SEQ ID NO: 1460735 - RNA, 19 nt, Homo sapiens
gcccagugagcaauaaaga

SEQ ID NO: 1460736 - RNA, 19 nt, Homo sapiens
gccaaucacaccaggcuau

SEQ ID NO: 1460737 - RNA, 19 nt, Homo sapiens
ccuggaaugcaaauaugua

SEQ ID NO: 1460738 - RNA, 19 nt, Homo sapiens
gaaacugaaaccugucaac

SEQ ID NO: 1460739 - RNA, 19 nt, Homo sapiens
cccaaggaggugaacuuua

SEQ ID NO: 1460740 - RNA, 19 nt, Homo sapiens
gccaaggucacugaauuug

SEQ ID NO: 1460741 - RNA, 19 nt, Homo sapiens
ugucaugugggaauaaaga

SEQ ID NO: 1460742 - RNA, 19 nt, Homo sapiens
aaccugccauucucauguu

SEQ ID NO: 1460743 - RNA, 19 nt, Homo sapiens
gagaaaccugccaaucaca

SEQ ID NO: 1460744 - RNA, 19 nt, Homo sapiens
augagaaaccugccaauca

SEQ ID NO: 1460745 - RNA, 19 nt, Homo sapiens
aaaccugccauucucaugu

SEQ ID NO: 1460746 - RNA, 19 nt, Homo sapiens
gugcucagaggccaaguau

SEQ ID NO: 1460747 - RNA, 19 nt, Homo sapiens
ccaagugggcaccggauag

SEQ ID NO: 1460748 - RNA, 19 nt, Homo sapiens
gccaagugggcaccggaua

SEQ ID NO: 1460749 - RNA, 19 nt, Homo sapiens
ccaaaacuccgcugacaug

SEQ ID NO: 1460750 - RNA, 19 nt, Homo sapiens
ucucuuuccuuccuacuac

SEQ ID NO: 1460751 - RNA, 19 nt, Homo sapiens
ugaaaaccuuccaggagaa

SEQ ID NO: 1460752 - RNA, 19 nt, Homo sapiens
gcccagagagcgaaaucau

SEQ ID NO: 1460753 - RNA, 19 nt, Homo sapiens
aaagaacagcugcgggaau

SEQ ID NO: 1460754 - RNA, 19 nt, Homo sapiens
ccucagcugccaaggaaug

SEQ ID NO: 1460755 - RNA, 19 nt, Homo sapiens
ucugaaaccauaugaagag

SEQ ID NO: 1460756 - RNA, 19 nt, Homo sapiens
cuggaaugcaaauauguaa

SEQ ID NO: 1460757 - RNA, 19 nt, Homo sapiens
gaagauggcuccugaaaua

SEQ ID NO: 1460758 - RNA, 19 nt, Homo sapiens
gcaaguaagucacccaaua

SEQ ID NO: 1460759 - RNA, 19 nt, Homo sapiens
gauaaagguugucagauuu

SEQ ID NO: 1460760 - RNA, 19 nt, Homo sapiens
gaacagauguauagugauc

SEQ ID NO: 1460761 - RNA, 19 nt, Homo sapiens
gaacagauauacaguugug

SEQ ID NO: 1460762 - RNA, 19 nt, Homo sapiens
ucacaaagcuguucaugga

SEQ ID NO: 1460763 - RNA, 19 nt, Homo sapiens
ggaagcagauacaguuauu

SEQ ID NO: 1460764 - RNA, 19 nt, Homo sapiens
uaauauagcucuuggacaa

SEQ ID NO: 1460765 - RNA, 19 nt, Homo sapiens
gaucagaaauuucaaagag

SEQ ID NO: 1460766 - RNA, 19 nt, Homo sapiens
aaaccaagcuuaacagaga

SEQ ID NO: 1460767 - RNA, 19 nt, Homo sapiens
gaagcuucccuuaguauua

SEQ ID NO: 1460768 - RNA, 19 nt, Homo sapiens
ggaagaggauguuggacuu

SEQ ID NO: 1460769 - RNA, 19 nt, Homo sapiens
ccagaucucuauauugaaa

SEQ ID NO: 1460770 - RNA, 19 nt, Homo sapiens
gcaaagcuauauuucuguu

SEQ ID NO: 1460771 - RNA, 19 nt, Homo sapiens
gaacuuauacagaaugguu

SEQ ID NO: 1460772 - RNA, 19 nt, Homo sapiens
agauaaagguugucagauu

SEQ ID NO: 1460773 - RNA, 19 nt, Homo sapiens
agaaguguaugguaucuaa

SEQ ID NO: 1460774 - RNA, 19 nt, Homo sapiens
uauaauagcucgucagcau

SEQ ID NO: 1460775 - RNA, 19 nt, Homo sapiens
ucagauggcuccaacucua

SEQ ID NO: 1460776 - RNA, 19 nt, Homo sapiens
cggaacagauguauaguga

SEQ ID NO: 1460777 - RNA, 19 nt, Homo sapiens
ggucacaccuucaacuaug

SEQ ID NO: 1460778 - RNA, 19 nt, Homo sapiens
gcaggaugcuaauuaagug

SEQ ID NO: 1460779 - RNA, 19 nt, Homo sapiens
ugaaguccuugauuuguaa

SEQ ID NO: 1460780 - RNA, 19 nt, Homo sapiens
caaguaagucacccaauaa

SEQ ID NO: 1460781 - RNA, 19 nt, Homo sapiens
gauggcuccugaaauagua

SEQ ID NO: 1460782 - RNA, 19 nt, Homo sapiens
gaaaugggacaaucuuuua

SEQ ID NO: 1460783 - RNA, 19 nt, Homo sapiens
gacaauauaugggagcauu

SEQ ID NO: 1460784 - RNA, 19 nt, Homo sapiens
gcgaaccucugcccuguug

SEQ ID NO: 1460785 - RNA, 19 nt, Homo sapiens
gcaacugugugaccauguu

SEQ ID NO: 1460786 - RNA, 19 nt, Homo sapiens
gcagauacaguuauuaagu

SEQ ID NO: 1460787 - RNA, 19 nt, Homo sapiens
gucaccagcugcuauagua

SEQ ID NO: 1460788 - RNA, 19 nt, Homo sapiens
ugaauaugcugcucaagau

SEQ ID NO: 1460789 - RNA, 19 nt, Homo sapiens
ccuaaugccuuuacuuuua

SEQ ID NO: 1460790 - RNA, 19 nt, Homo sapiens
cuccagaucucuauauuga

SEQ ID NO: 1460791 - RNA, 19 nt, Homo sapiens
aaauagauguggcaagaga

SEQ ID NO: 1460792 - RNA, 19 nt, Homo sapiens
gcauuagaaagucuuguua

SEQ ID NO: 1460793 - RNA, 19 nt, Homo sapiens
ccaagcagaucauuacagu

SEQ ID NO: 1460794 - RNA, 19 nt, Homo sapiens
guucacaacuuucuucuac

SEQ ID NO: 1460795 - RNA, 19 nt, Homo sapiens
uagaaagucuuguuaaagg

SEQ ID NO: 1460796 - RNA, 19 nt, Homo sapiens
gguggaaucugaacuuucu

SEQ ID NO: 1460797 - RNA, 19 nt, Homo sapiens
gauguauagugaucugauu

SEQ ID NO: 1460798 - RNA, 19 nt, Homo sapiens
aaacguugcugcuagacuu

SEQ ID NO: 1460799 - RNA, 19 nt, Homo sapiens
caaagagaacuuauacaga

SEQ ID NO: 1460800 - RNA, 19 nt, Homo sapiens
gcacuuguuuuguucauuu

SEQ ID NO: 1460801 - RNA, 19 nt, Homo sapiens
gaaagucuuguuaaaggaa

SEQ ID NO: 1460802 - RNA, 19 nt, Homo sapiens
cuucaacuauggcaaauau

SEQ ID NO: 1460803 - RNA, 19 nt, Homo sapiens
gaucauuacaguacaguau

SEQ ID NO: 1460804 - RNA, 19 nt, Homo sapiens
gaggauguuggacuucuua

SEQ ID NO: 1460805 - RNA, 19 nt, Homo sapiens
uggcaaagcuauauuucug

SEQ ID NO: 1460806 - RNA, 19 nt, Homo sapiens
uauucuagcuguuguugaa

SEQ ID NO: 1460807 - RNA, 19 nt, Homo sapiens
caggaucucuuuugcuuua

SEQ ID NO: 1460808 - RNA, 19 nt, Homo sapiens
acaguuguguguauaaaug

SEQ ID NO: 1460809 - RNA, 19 nt, Homo sapiens
ugccauagaucaacuuuua

SEQ ID NO: 1460810 - RNA, 19 nt, Homo sapiens
gcauaggcuucucuacuag

SEQ ID NO: 1460811 - RNA, 19 nt, Homo sapiens
gaagcagauacaguuauua

SEQ ID NO: 1460812 - RNA, 19 nt, Homo sapiens
gcacuuugcaacuguguga

SEQ ID NO: 1460813 - RNA, 19 nt, Homo sapiens
agcauaggcuucucuacua

SEQ ID NO: 1460814 - RNA, 19 nt, Homo sapiens
cagauacaguuauuaaguc

SEQ ID NO: 1460815 - RNA, 19 nt, Homo sapiens
gauguuggacuucuuacuu

SEQ ID NO: 1460816 - RNA, 19 nt, Homo sapiens
ggguacagauagugaaugu

SEQ ID NO: 1460817 - RNA, 19 nt, Homo sapiens
uugaaguccuugauuugua

SEQ ID NO: 1460818 - RNA, 19 nt, Homo sapiens
caacuuucuucuacucugu

SEQ ID NO: 1460819 - RNA, 19 nt, Homo sapiens
caaagcuguucauggaaga

SEQ ID NO: 1460820 - RNA, 19 nt, Homo sapiens
cagcagcacucggaacaga

SEQ ID NO: 1460821 - RNA, 19 nt, Homo sapiens
gaaucuuaauugagcauag

SEQ ID NO: 1460822 - RNA, 19 nt, Homo sapiens
uggcaaauauugugaaagg

SEQ ID NO: 1460823 - RNA, 19 nt, Homo sapiens
auauagcucuuggacaaua

SEQ ID NO: 1460824 - RNA, 19 nt, Homo sapiens
aaagauaaagguugucaga

SEQ ID NO: 1460825 - RNA, 19 nt, Homo sapiens
cagcugcccuuuccaacug

SEQ ID NO: 1460826 - RNA, 19 nt, Homo sapiens
ggagaaguguaugguaucu

SEQ ID NO: 1460827 - RNA, 19 nt, Homo sapiens
caggagcucugucacaaag

SEQ ID NO: 1460828 - RNA, 19 nt, Homo sapiens
gcgguggaaucugaacuuu

SEQ ID NO: 1460829 - RNA, 19 nt, Homo sapiens
ucaacuauggcaaauauug

SEQ ID NO: 1460830 - RNA, 19 nt, Homo sapiens
aagaugaccuuauaaagcu

SEQ ID NO: 1460831 - RNA, 19 nt, Homo sapiens
ccuccaaguucuuaaugaa

SEQ ID NO: 1460832 - RNA, 19 nt, Homo sapiens
gcucugcagguucuucaua

SEQ ID NO: 1460833 - RNA, 19 nt, Homo sapiens
gagcauaggcuucucuacu

SEQ ID NO: 1460834 - RNA, 19 nt, Homo sapiens
cuaggaagcagauacaguu

SEQ ID NO: 1460835 - RNA, 19 nt, Homo sapiens
gaagagagcuggggaugag

SEQ ID NO: 1460836 - RNA, 19 nt, Homo sapiens
ccugaucacuucauuuuaa

SEQ ID NO: 1460837 - RNA, 19 nt, Homo sapiens
aagcuucccuuaguauuau

SEQ ID NO: 1460838 - RNA, 19 nt, Homo sapiens
gaugggcgguacuuuagca

SEQ ID NO: 1460839 - RNA, 19 nt, Homo sapiens
aaagugaccauuucuaagu

SEQ ID NO: 1460840 - RNA, 19 nt, Homo sapiens
ucucagaaagugaccauuu

SEQ ID NO: 1460841 - RNA, 19 nt, Homo sapiens
ggcaacaucagacuaauag

SEQ ID NO: 1460842 - RNA, 19 nt, Homo sapiens
gcacaugggucggauuuuc

SEQ ID NO: 1460843 - RNA, 19 nt, Homo sapiens
ucacaacuuucuucuacuc

SEQ ID NO: 1460844 - RNA, 19 nt, Homo sapiens
agaaagucuuguuaaagga

SEQ ID NO: 1460845 - RNA, 19 nt, Homo sapiens
gagaacuuauacagaaugg

SEQ ID NO: 1460846 - RNA, 19 nt, Homo sapiens
ucaaagagaacuuauacag

SEQ ID NO: 1460847 - RNA, 19 nt, Homo sapiens
gaucaacuuuuaacucaga

SEQ ID NO: 1460848 - RNA, 19 nt, Homo sapiens
uguaugguaucuaaacuca

SEQ ID NO: 1460849 - RNA, 19 nt, Homo sapiens
ggauauugggagcaaguaa

SEQ ID NO: 1460850 - RNA, 19 nt, Homo sapiens
gucugucauuugaacauua

SEQ ID NO: 1460851 - RNA, 19 nt, Homo sapiens
uaaacucacccaccaagau

SEQ ID NO: 1460852 - RNA, 19 nt, Homo sapiens
gcagaucauuacaguacag

SEQ ID NO: 1460853 - RNA, 19 nt, Homo sapiens
aaaccaagcagaucauuac

SEQ ID NO: 1460854 - RNA, 19 nt, Homo sapiens
guauugguuucacauguca

SEQ ID NO: 1460855 - RNA, 19 nt, Homo sapiens
acagauagugaauguauug

SEQ ID NO: 1460856 - RNA, 19 nt, Homo sapiens
gcacauacuggccaaaauu

SEQ ID NO: 1460857 - RNA, 19 nt, Homo sapiens
ggagugaaauguugucaua

SEQ ID NO: 1460858 - RNA, 19 nt, Homo sapiens
acaagaagcucuacuuuga

SEQ ID NO: 1460859 - RNA, 19 nt, Homo sapiens
ccaggcaucucauucauua

SEQ ID NO: 1460860 - RNA, 19 nt, Homo sapiens
gcaacuggcuuauugguau

SEQ ID NO: 1460861 - RNA, 19 nt, Homo sapiens
caacgaagccauagucuuu

SEQ ID NO: 1460862 - RNA, 19 nt, Homo sapiens
ggaugcaacuggcuuauug

SEQ ID NO: 1460863 - RNA, 19 nt, Homo sapiens
gaagaauggucccagagaa

SEQ ID NO: 1460864 - RNA, 19 nt, Homo sapiens
gagcagaggcugguuauaa

SEQ ID NO: 1460865 - RNA, 19 nt, Homo sapiens
gguccucucugucccauua

SEQ ID NO: 1460866 - RNA, 19 nt, Homo sapiens
aagcagaggucauuggaua

SEQ ID NO: 1460867 - RNA, 19 nt, Homo sapiens
gcagcaaucccaauaaauu

SEQ ID NO: 1460868 - RNA, 19 nt, Homo sapiens
gaagcagugucauuacauu

SEQ ID NO: 1460869 - RNA, 19 nt, Homo sapiens
ccacguaaaugaaaccaaa

SEQ ID NO: 1460870 - RNA, 19 nt, Homo sapiens
gcaugagcauuguggaaua

SEQ ID NO: 1460871 - RNA, 19 nt, Homo sapiens
ggacauaacaggagcauca

SEQ ID NO: 1460872 - RNA, 19 nt, Homo sapiens
agaguuggauuguaguuua

SEQ ID NO: 1460873 - RNA, 19 nt, Homo sapiens
cagcagaucucaauucaca

SEQ ID NO: 1460874 - RNA, 19 nt, Homo sapiens
ggacaaccaucucacaaag

SEQ ID NO: 1460875 - RNA, 19 nt, Homo sapiens
ucgaauaugucaccaauga

SEQ ID NO: 1460876 - RNA, 19 nt, Homo sapiens
agacuaaaguucacagaaa

SEQ ID NO: 1460877 - RNA, 19 nt, Homo sapiens
aauagaagguggcuuugua

SEQ ID NO: 1460878 - RNA, 19 nt, Homo sapiens
gcucaucccuccucauuca

SEQ ID NO: 1460879 - RNA, 19 nt, Homo sapiens
guaggaagcagugucauua

SEQ ID NO: 1460880 - RNA, 19 nt, Homo sapiens
gaaccaagaucggacuaug

SEQ ID NO: 1460881 - RNA, 19 nt, Homo sapiens
ccacugggauucaaagaga

SEQ ID NO: 1460882 - RNA, 19 nt, Homo sapiens
gaucucaauucacacauga

SEQ ID NO: 1460883 - RNA, 19 nt, Homo sapiens
ggaaggacagaauauuuaa

SEQ ID NO: 1460884 - RNA, 19 nt, Homo sapiens
caaauccacuuguccauag

SEQ ID NO: 1460885 - RNA, 19 nt, Homo sapiens
ugaaauagaagguggcuuu

SEQ ID NO: 1460886 - RNA, 19 nt, Homo sapiens
gaccaagucugccaaccaa

SEQ ID NO: 1460887 - RNA, 19 nt, Homo sapiens
caagaagugcuccagauuu

SEQ ID NO: 1460888 - RNA, 19 nt, Homo sapiens
gcaccacuacuccaagaua

SEQ ID NO: 1460889 - RNA, 19 nt, Homo sapiens
ccacacauuugcaccacua

SEQ ID NO: 1460890 - RNA, 19 nt, Homo sapiens
gcagacgacugaagaagag

SEQ ID NO: 1460891 - RNA, 19 nt, Homo sapiens
aagaagugcuccagauuug

SEQ ID NO: 1460892 - RNA, 19 nt, Homo sapiens
gcacuaacuggccuucuuu

SEQ ID NO: 1460893 - RNA, 19 nt, Homo sapiens
gugaaagucucgcugaugu

SEQ ID NO: 1460894 - RNA, 19 nt, Homo sapiens
gcaacagcccagagucaua

SEQ ID NO: 1460895 - RNA, 19 nt, Homo sapiens
gcacauuuguccacuaagg

SEQ ID NO: 1460896 - RNA, 19 nt, Homo sapiens
gcaggcagguggcuuugug

SEQ ID NO: 1460897 - RNA, 19 nt, Homo sapiens
gcagaugagcccagaagaa

SEQ ID NO: 1460898 - RNA, 19 nt, Homo sapiens
aagcuucacuucucugauu

SEQ ID NO: 1460899 - RNA, 19 nt, Homo sapiens
gaaauaccuacaagaguga

SEQ ID NO: 1460900 - RNA, 19 nt, Homo sapiens
gaagcuuccugcccagaga

SEQ ID NO: 1460901 - RNA, 19 nt, Homo sapiens
cuggaaagcucauuaucuu

SEQ ID NO: 1460902 - RNA, 19 nt, Homo sapiens
cauagcaucugcccuggaa

SEQ ID NO: 1460903 - RNA, 19 nt, Homo sapiens
ggugguggaucacuuccua

SEQ ID NO: 1460904 - RNA, 19 nt, Homo sapiens
ucaaagagaauccaagguu

SEQ ID NO: 1460905 - RNA, 19 nt, Homo sapiens
gggcuucucuggccugaau

SEQ ID NO: 1460906 - RNA, 19 nt, Homo sapiens
uggaaggacagaauauuua

SEQ ID NO: 1460907 - RNA, 19 nt, Homo sapiens
gaccaaaugcucagcugua

SEQ ID NO: 1460908 - RNA, 19 nt, Homo sapiens
ggagaacagugaggacuuc

SEQ ID NO: 1460909 - RNA, 19 nt, Homo sapiens
gcuauaggccuuuguuugu

SEQ ID NO: 1460910 - RNA, 19 nt, Homo sapiens
guaccaggacucaguguuu

SEQ ID NO: 1460911 - RNA, 19 nt, Homo sapiens
caucagaucccuaugugaa

SEQ ID NO: 1460912 - RNA, 19 nt, Homo sapiens
gcuggcaggcugaccauua

SEQ ID NO: 1460913 - RNA, 19 nt, Homo sapiens
cccaauaaauucugacaug

SEQ ID NO: 1460914 - RNA, 19 nt, Homo sapiens
cagacuggcuccaauagau

SEQ ID NO: 1460915 - RNA, 19 nt, Homo sapiens
ucagacauccuccaccaua

SEQ ID NO: 1460916 - RNA, 19 nt, Homo sapiens
gagguuuccuucucacuuc

SEQ ID NO: 1460917 - RNA, 19 nt, Homo sapiens
uaaugacugucuccagaaa

SEQ ID NO: 1460918 - RNA, 19 nt, Homo sapiens
caacucaacuugucaaacc

SEQ ID NO: 1460919 - RNA, 19 nt, Homo sapiens
gcccuuuaguuuccuagua

SEQ ID NO: 1460920 - RNA, 19 nt, Homo sapiens
cguuauacgucuucagaaa

SEQ ID NO: 1460921 - RNA, 19 nt, Homo sapiens
gggagugcauccuuuggaa

SEQ ID NO: 1460922 - RNA, 19 nt, Homo sapiens
agaggcugguuauaaauuu

SEQ ID NO: 1460923 - RNA, 19 nt, Homo sapiens
uggcgugucucucuucgua

SEQ ID NO: 1460924 - RNA, 19 nt, Homo sapiens
gcagugucauuacauucaa

SEQ ID NO: 1460925 - RNA, 19 nt, Homo sapiens
ccaaaggccucagcauauc

SEQ ID NO: 1460926 - RNA, 19 nt, Homo sapiens
guagagaguaccaguauca

SEQ ID NO: 1460927 - RNA, 19 nt, Homo sapiens
ggcagcagaucucaauuca

SEQ ID NO: 1460928 - RNA, 19 nt, Homo sapiens
cacgacagcugccaggauu

SEQ ID NO: 1460929 - RNA, 19 nt, Homo sapiens
ccaauaaauucugacaugu

SEQ ID NO: 1460930 - RNA, 19 nt, Homo sapiens
acuauugucuguaaagcua

SEQ ID NO: 1460931 - RNA, 19 nt, Homo sapiens
ccagcugccuaguacuaua

SEQ ID NO: 1460932 - RNA, 19 nt, Homo sapiens
gagaguaccaguaucaaca

SEQ ID NO: 1460933 - RNA, 19 nt, Homo sapiens
ggcauucccugguggagaa

SEQ ID NO: 1460934 - RNA, 19 nt, Homo sapiens
cgagaacauugaccaaauc

SEQ ID NO: 1460935 - RNA, 19 nt, Homo sapiens
ggacuucagauccuuaugu

SEQ ID NO: 1460936 - RNA, 19 nt, Homo sapiens
cuauaggccuuuguuugua

SEQ ID NO: 1460937 - RNA, 19 nt, Homo sapiens
aagaagcucuacuuugaug

SEQ ID NO: 1460938 - RNA, 19 nt, Homo sapiens
cauagagguuuccuucuca

SEQ ID NO: 1460939 - RNA, 19 nt, Homo sapiens
ggaacagccucagaaacug

SEQ ID NO: 1460940 - RNA, 19 nt, Homo sapiens
uaucgaauaugucaccaau

SEQ ID NO: 1460941 - RNA, 19 nt, Homo sapiens
gagaauaccaagacaagca

SEQ ID NO: 1460942 - RNA, 19 nt, Homo sapiens
ccgagaacauugaccaaau

SEQ ID NO: 1460943 - RNA, 19 nt, Homo sapiens
guucucucgucaugacuua

SEQ ID NO: 1460944 - RNA, 19 nt, Homo sapiens
gacagguucucucgucaug

SEQ ID NO: 1460945 - RNA, 19 nt, Homo sapiens
gacuaaaguucacagaaag

SEQ ID NO: 1460946 - RNA, 19 nt, Homo sapiens
aaagaguacuauccacaug

SEQ ID NO: 1460947 - RNA, 19 nt, Homo sapiens
gaaagcagacuggcuccaa

SEQ ID NO: 1460948 - RNA, 19 nt, Homo sapiens
ggauggaaauaccuacaag

SEQ ID NO: 1460949 - RNA, 19 nt, Homo sapiens
gggaacagccucagaaacu

SEQ ID NO: 1460950 - RNA, 19 nt, Homo sapiens
ggaguguuauuagaaugaa

SEQ ID NO: 1460951 - RNA, 19 nt, Homo sapiens
ggacucaguguuucauaug

SEQ ID NO: 1460952 - RNA, 19 nt, Homo sapiens
gaaagucucgcugaugugu

SEQ ID NO: 1460953 - RNA, 19 nt, Homo sapiens
caaggaauuuaaaggcaau

SEQ ID NO: 1460954 - RNA, 19 nt, Homo sapiens
gcugaccauuaccauuaua

SEQ ID NO: 1460955 - RNA, 19 nt, Homo sapiens
gaggcugguuauaaauuug

SEQ ID NO: 1460956 - RNA, 19 nt, Homo sapiens
caacugggaguguuauuag

SEQ ID NO: 1460957 - RNA, 19 nt, Homo sapiens
guaaggaugucucaaguua

SEQ ID NO: 1460958 - RNA, 19 nt, Homo sapiens
gaagagaacugcacagcaa

SEQ ID NO: 1460959 - RNA, 19 nt, Homo sapiens
gaggaaagcugugaaaguu

SEQ ID NO: 1460960 - RNA, 19 nt, Homo sapiens
agaaccaacuuguguauua

SEQ ID NO: 1460961 - RNA, 19 nt, Homo sapiens
guaguuaccuuauagcauu

SEQ ID NO: 1460962 - RNA, 19 nt, Homo sapiens
ggaacaacuucaccaauga

SEQ ID NO: 1460963 - RNA, 19 nt, Homo sapiens
caucuacccuguauaaauu

SEQ ID NO: 1460964 - RNA, 19 nt, Homo sapiens
gaaaccaucuacccuguau

SEQ ID NO: 1460965 - RNA, 19 nt, Homo sapiens
ccagggcacugaagaagua

SEQ ID NO: 1460966 - RNA, 19 nt, Homo sapiens
gggaacaacuucaccaaug

SEQ ID NO: 1460967 - RNA, 19 nt, Homo sapiens
gaagaaauguucaguaacc

SEQ ID NO: 1460968 - RNA, 19 nt, Homo sapiens
ggaaugaggaccuaacuug

SEQ ID NO: 1460969 - RNA, 19 nt, Homo sapiens
caacauaccaggcaacuuc

SEQ ID NO: 1460970 - RNA, 19 nt, Homo sapiens
aaaccacacugacugauga

SEQ ID NO: 1460971 - RNA, 19 nt, Homo sapiens
uuaacaagguccaaagaaa

SEQ ID NO: 1460972 - RNA, 19 nt, Homo sapiens
ggaaagcugugaaaguucu

SEQ ID NO: 1460973 - RNA, 19 nt, Homo sapiens
gaaguauaagucccaguua

SEQ ID NO: 1460974 - RNA, 19 nt, Homo sapiens
gaaauuugcccaagaaugc

SEQ ID NO: 1460975 - RNA, 19 nt, Homo sapiens
caaaggauguuacagaaaa

SEQ ID NO: 1460976 - RNA, 19 nt, Homo sapiens
ugaggacacugguuucuau

SEQ ID NO: 1460977 - RNA, 19 nt, Homo sapiens
caaguuacaguuugggaua

SEQ ID NO: 1460978 - RNA, 19 nt, Homo sapiens
ccaaaguccauauggguua

SEQ ID NO: 1460979 - RNA, 19 nt, Homo sapiens
gcacuuugagguuauuauu

SEQ ID NO: 1460980 - RNA, 19 nt, Homo sapiens
ggucaggccucucccaaca

SEQ ID NO: 1460981 - RNA, 19 nt, Homo sapiens
gaaugaggaccuaacuuga

SEQ ID NO: 1460982 - RNA, 19 nt, Homo sapiens
uuagaaauuugcccaagaa

SEQ ID NO: 1460983 - RNA, 19 nt, Homo sapiens
agacaacagugaugaggaa

SEQ ID NO: 1460984 - RNA, 19 nt, Homo sapiens
gcucugacuuguugccauu

SEQ ID NO: 1460985 - RNA, 19 nt, Homo sapiens
aaucugcucugacuuguug

SEQ ID NO: 1460986 - RNA, 19 nt, Homo sapiens
gcaagaacggccucuguau

SEQ ID NO: 1460987 - RNA, 19 nt, Homo sapiens
cgacaagagugaugagaag

SEQ ID NO: 1460988 - RNA, 19 nt, Homo sapiens
caaaguccauauggguuaa

SEQ ID NO: 1460989 - RNA, 19 nt, Homo sapiens
caagaacggccucuguauu

SEQ ID NO: 1460990 - RNA, 19 nt, Homo sapiens
gggcagcugucacccauuc

SEQ ID NO: 1460991 - RNA, 19 nt, Homo sapiens
agacauuugugcauuguug

SEQ ID NO: 1460992 - RNA, 19 nt, Homo sapiens
cgagaucacacccucauuu

SEQ ID NO: 1460993 - RNA, 19 nt, Homo sapiens
gcagaaugcgucggaagua

SEQ ID NO: 1460994 - RNA, 19 nt, Homo sapiens
cggcauccauugcaucauu

SEQ ID NO: 1460995 - RNA, 19 nt, Homo sapiens
acacuggccuccaaaguuc

SEQ ID NO: 1460996 - RNA, 19 nt, Homo sapiens
gaaccaacuuguguauuac

SEQ ID NO: 1460997 - RNA, 19 nt, Homo sapiens
ucagugauccuguucugua

SEQ ID NO: 1460998 - RNA, 19 nt, Homo sapiens
gaaaccacacugacugaug

SEQ ID NO: 1460999 - RNA, 19 nt, Homo sapiens
aaagaaagaugcaaaagga

SEQ ID NO: 1461000 - RNA, 19 nt, Homo sapiens
caauuuggagucaagauuu

SEQ ID NO: 1461001 - RNA, 19 nt, Homo sapiens
cagagucaguggccaaaga

SEQ ID NO: 1461002 - RNA, 19 nt, Homo sapiens
caauguuucugugcuauau

SEQ ID NO: 1461003 - RNA, 19 nt, Homo sapiens
gcucaugggaagcucuuua

SEQ ID NO: 1461004 - RNA, 19 nt, Homo sapiens
ucaauaauggcauccagua

SEQ ID NO: 1461005 - RNA, 19 nt, Homo sapiens
ugagagccauguucaauac

SEQ ID NO: 1461006 - RNA, 19 nt, Homo sapiens
caguugacaugaucuguug

SEQ ID NO: 1461007 - RNA, 19 nt, Homo sapiens
guuacaguuugggauauua

SEQ ID NO: 1461008 - RNA, 19 nt, Homo sapiens
ccgccucccugcaggaaua

SEQ ID NO: 1461009 - RNA, 19 nt, Homo sapiens
gggacuauuuauaugugua

SEQ ID NO: 1461010 - RNA, 19 nt, Homo sapiens
ccaguaguuucuccucuga

SEQ ID NO: 1461011 - RNA, 19 nt, Homo sapiens
gcaauguuucugugcuaua

SEQ ID NO: 1461012 - RNA, 19 nt, Homo sapiens
ucaccuacaacgucaauaa

SEQ ID NO: 1461013 - RNA, 19 nt, Homo sapiens
gguguuguuuggcaagaaa

SEQ ID NO: 1461014 - RNA, 19 nt, Homo sapiens
uccaaaggauguuacagaa

SEQ ID NO: 1461015 - RNA, 19 nt, Homo sapiens
gagacaauuuggagucaag

SEQ ID NO: 1461016 - RNA, 19 nt, Homo sapiens
caacaucccaguaguuucu

SEQ ID NO: 1461017 - RNA, 19 nt, Homo sapiens
gugagagccauguucaaua

SEQ ID NO: 1461018 - RNA, 19 nt, Homo sapiens
ccucaacacuggccuccaa

SEQ ID NO: 1461019 - RNA, 19 nt, Homo sapiens
gcacugaagaaguauaagu

SEQ ID NO: 1461020 - RNA, 19 nt, Homo sapiens
gcagugggcagguguuugu

SEQ ID NO: 1461021 - RNA, 19 nt, Homo sapiens
aagaacggccucuguauug

SEQ ID NO: 1461022 - RNA, 19 nt, Homo sapiens
gcaagaaaccacacugacu

SEQ ID NO: 1461023 - RNA, 19 nt, Homo sapiens
gagucaagauuuuccauuu

SEQ ID NO: 1461024 - RNA, 19 nt, Homo sapiens
cagccugucuugcucauuc

SEQ ID NO: 1461025 - RNA, 19 nt, Homo sapiens
ggauuuggguuagaugauc

SEQ ID NO: 1461026 - RNA, 19 nt, Homo sapiens
uauauuggaugcucagaag

SEQ ID NO: 1461027 - RNA, 19 nt, Homo sapiens
ugaaauaggcugggagaga

SEQ ID NO: 1461028 - RNA, 19 nt, Homo sapiens
cuguauaaauucuggcuuu

SEQ ID NO: 1461029 - RNA, 19 nt, Homo sapiens
ggagagacagcauauaaaa

SEQ ID NO: 1461030 - RNA, 19 nt, Homo sapiens
gggcacugaagaaguauaa

SEQ ID NO: 1461031 - RNA, 19 nt, Homo sapiens
gaugaggaaagcugugaaa

SEQ ID NO: 1461032 - RNA, 19 nt, Homo sapiens
uaacaagguccaaagaaag

SEQ ID NO: 1461033 - RNA, 19 nt, Homo sapiens
caaguucucagcuccuaaa

SEQ ID NO: 1461034 - RNA, 19 nt, Homo sapiens
gaaaagcuagccacuggua

SEQ ID NO: 1461035 - RNA, 19 nt, Homo sapiens
ccaaaggauguuacagaaa

SEQ ID NO: 1461036 - RNA, 19 nt, Homo sapiens
gccagacauuugugcauug

SEQ ID NO: 1461037 - RNA, 19 nt, Homo sapiens
guucucagcuccuaaaaug

SEQ ID NO: 1461038 - RNA, 19 nt, Homo sapiens
aaggaugucucaaguuaca

SEQ ID NO: 1461039 - RNA, 19 nt, Homo sapiens
guuaaucugcucugacuug

SEQ ID NO: 1461040 - RNA, 19 nt, Homo sapiens
ccagaggccugcgugguau

SEQ ID NO: 1461041 - RNA, 19 nt, Homo sapiens
auaauggcauccaguaugu

SEQ ID NO: 1461042 - RNA, 19 nt, Homo sapiens
ucagagaaccaacuugugu

SEQ ID NO: 1461043 - RNA, 19 nt, Homo sapiens
aaacuuuggacgugaguaa

SEQ ID NO: 1461044 - RNA, 19 nt, Homo sapiens
aaaguggcauucagugauc

SEQ ID NO: 1461045 - RNA, 19 nt, Homo sapiens
guaaccuguuugacgcuaa

SEQ ID NO: 1461046 - RNA, 19 nt, Homo sapiens
ucucucugcuggguaguua

SEQ ID NO: 1461047 - RNA, 19 nt, Homo sapiens
ccacugguauuuuguuuug

SEQ ID NO: 1461048 - RNA, 19 nt, Homo sapiens
uaaaguggcauucagugau

SEQ ID NO: 1461049 - RNA, 19 nt, Homo sapiens
gccaaggaaugaggaccua

SEQ ID NO: 1461050 - RNA, 19 nt, Homo sapiens
gcccguagccaaggaauga

SEQ ID NO: 1461051 - RNA, 19 nt, Homo sapiens
ccaucuacccuguauaaau

SEQ ID NO: 1461052 - RNA, 19 nt, Homo sapiens
aaccaucuacccuguauaa

SEQ ID NO: 1461053 - RNA, 19 nt, Homo sapiens
ccuacaacgucaauaaugg

SEQ ID NO: 1461054 - RNA, 19 nt, Homo sapiens
caacagugaugaggaaagc

SEQ ID NO: 1461055 - RNA, 19 nt, Homo sapiens
aauguucaguaaccuguuu

SEQ ID NO: 1461056 - RNA, 19 nt, Homo sapiens
agaacggccucuguauuga

SEQ ID NO: 1461057 - RNA, 19 nt, Homo sapiens
ggacauagcuauuccaaau

SEQ ID NO: 1461058 - RNA, 19 nt, Homo sapiens
auacauaacucgcuucaua

SEQ ID NO: 1461059 - RNA, 19 nt, Homo sapiens
gaacaaauauaggcugaau

SEQ ID NO: 1461060 - RNA, 19 nt, Homo sapiens
cagugaagcuaucaaguua

SEQ ID NO: 1461061 - RNA, 19 nt, Homo sapiens
ugaaauaucugagugugua

SEQ ID NO: 1461062 - RNA, 19 nt, Homo sapiens
gccauaagcuuacgguuga

SEQ ID NO: 1461063 - RNA, 19 nt, Homo sapiens
gcaauaggccgaagugcua

SEQ ID NO: 1461064 - RNA, 19 nt, Homo sapiens
ggaauucgagguaccaaua

SEQ ID NO: 1461065 - RNA, 19 nt, Homo sapiens
ugaaagaacugugaggaaa

SEQ ID NO: 1461066 - RNA, 19 nt, Homo sapiens
ggaagaagcagagaagaaa

SEQ ID NO: 1461067 - RNA, 19 nt, Homo sapiens
ccaaagcaauggacgaaga

SEQ ID NO: 1461068 - RNA, 19 nt, Homo sapiens
ggaagaaacauugaacuug

SEQ ID NO: 1461069 - RNA, 19 nt, Homo sapiens
gagcugcauuucucaaaga

SEQ ID NO: 1461070 - RNA, 19 nt, Homo sapiens
guugagagcagucauaauu

SEQ ID NO: 1461071 - RNA, 19 nt, Homo sapiens
gccugagacucuauaauuu

SEQ ID NO: 1461072 - RNA, 19 nt, Homo sapiens
ggugauguuugaauauuga

SEQ ID NO: 1461073 - RNA, 19 nt, Homo sapiens
aagaagaaaucaaccuuug

SEQ ID NO: 1461074 - RNA, 19 nt, Homo sapiens
guacuuaucaugcuuggaa

SEQ ID NO: 1461075 - RNA, 19 nt, Homo sapiens
ucaaguauguccagugugu

SEQ ID NO: 1461076 - RNA, 19 nt, Homo sapiens
gucagagccuucuucauuu

SEQ ID NO: 1461077 - RNA, 19 nt, Homo sapiens
ugucagagccuucuucauu

SEQ ID NO: 1461078 - RNA, 19 nt, Homo sapiens
gcagucauaauuccacaua

SEQ ID NO: 1461079 - RNA, 19 nt, Homo sapiens
gaaauauacccaaagcaau

SEQ ID NO: 1461080 - RNA, 19 nt, Homo sapiens
gcagaaauauacccaaagc

SEQ ID NO: 1461081 - RNA, 19 nt, Homo sapiens
gagguuguuuagugaaauu

SEQ ID NO: 1461082 - RNA, 19 nt, Homo sapiens
uaauuuguccagugucuua

SEQ ID NO: 1461083 - RNA, 19 nt, Homo sapiens
ggauuucaguaauuguuga

SEQ ID NO: 1461084 - RNA, 19 nt, Homo sapiens
ggacgaagaccuuuuggua

SEQ ID NO: 1461085 - RNA, 19 nt, Homo sapiens
caagaggaaugugcuuaau

SEQ ID NO: 1461086 - RNA, 19 nt, Homo sapiens
uuaacaggaugcuacauga

SEQ ID NO: 1461087 - RNA, 19 nt, Homo sapiens
gcuagaaguuguccagucu

SEQ ID NO: 1461088 - RNA, 19 nt, Homo sapiens
aagcagaaauauacccaaa

SEQ ID NO: 1461089 - RNA, 19 nt, Homo sapiens
uugccaagcuucaagauga

SEQ ID NO: 1461090 - RNA, 19 nt, Homo sapiens
gaugcuagaguaguaauaa

SEQ ID NO: 1461091 - RNA, 19 nt, Homo sapiens
caagaugaaagaacuguga

SEQ ID NO: 1461092 - RNA, 19 nt, Homo sapiens
acaaauauaggcugaauuc

SEQ ID NO: 1461093 - RNA, 19 nt, Homo sapiens
ugucuuacuuaccuucaua

SEQ ID NO: 1461094 - RNA, 19 nt, Homo sapiens
gaagaugccauagcaagug

SEQ ID NO: 1461095 - RNA, 19 nt, Homo sapiens
ugccagagccauaagcuua

SEQ ID NO: 1461096 - RNA, 19 nt, Homo sapiens
cacagaagaugccauagca

SEQ ID NO: 1461097 - RNA, 19 nt, Homo sapiens
gaaaagaauuacacagaag

SEQ ID NO: 1461098 - RNA, 19 nt, Homo sapiens
gaagauguuuagugcaaaa

SEQ ID NO: 1461099 - RNA, 19 nt, Homo sapiens
gcgauggcgucucgauaug

SEQ ID NO: 1461100 - RNA, 19 nt, Homo sapiens
agaaauauacccaaagcaa
